United States Patent 9,254,311 (MODIFIED POLYNUCLEOTIDES FOR THE PRODUCTION OF PROTEINS) - sequence listing, part 26

SEQ ID NO: 55641 - DNA, 2259 bp, Artificial Sequence
  Description of Artificial Sequence: Synthetic coding sequence
atgacagccggatccgtgtgcgtgcctcaaataatcccattgagggtgccccagccaggcaaggcaaaccatgagattgataacaacaccttacttgagatgaaatctgacacccctgacgtgaacatctactacactcttgacggaagcaaaccagagtttctgaagcgaataggctacggggagaataacacattcaagtacatcaagccaattacgctgccagatggtaagattcaggtgaaggccattgccgtctcaaaggactgtaggcaaagtgggattgtaacaaaggtgttccacgtagactacgagccacccaacattgtaagcccagaagacaacgtggaaaacgtgctcaaagatagcagtcgacaggagtttaagaatgggtttgtggggtctaaactgaaaaagaagtacaaaaattcagagaaccagcggtcgtggaatgtaaacctccgcaagttccctgagagcccgctagagatacccgcatacggcggagggagcggctcaaggccacccaccagacagtcacagtctcccggatttgcccacgtgtctggtcagaagtgtcttacatctaccgaaataatgcgaattcaacgagagaccgactttcttaaatgtgcgcattgcctggcccctagaccgagtgacccattcgccagattctgccaggagtgcggcagccccgtccctcctatatttggatgtcgcttaccccctcctgagggcgctcagatgggactatgcgcagaatgtcggagtttagtgcccatgaacacccctatttgcgtagtctgcgaggcccctttggccctgcaacttcagccgcaggccagtctacatcttaaagagaaagtgatctgccgcgcttgcggcacaggaaacccagcccacttacggtattgcgttacctgtgaaggagccctgccatcatcacaagagagtatgtgcagcggggacaaggcccctccgcctccaacccagaaagggggaaccataagttgctatcggtgtgggagatggaatttgtgggaggctagtttctgcggctggtgtggcgcaatgctggggatccccgcaggatgttccgtgtgccctaagtgtggcgctagtaatcatctgagtgcacgcttttgtgggagctgcggtatctgtgtgaaaagtttagtcaagctaagtttggacagatccctggccctagccgctgaggagcctcgtcccttcagcgagagcttgaatattccactgccgaggtctgacgtgggaacgaaacgagacatagggacacagaccgtgggacttttttacccctcagggaagttgcttgcaaagaaggagcaggagctagcaagccagaaacagaggcaggaaaagatgagcgaccataaacctttattgacggcgatatcgcctgggagaggctactggagacgccagctcgaccacatcagcgcccacctgcgctgttacgcccagaacaatcctgagtttcgggcactcatagccgaaccccgaatgggcaagctgatcagcgcaaccgtacatgaagacggatgcgaggtgtctattagactcaattactcccaggtctctaataagaatctgtaccttaataaagcggtcaatttttcggatcatctgcttagctctgccgctgaaggtgacgggggactgtgcgggtcacggtccagctgggtcagcgattatagccagagcacttctgacactattgagaagatcaagaggatcaaaaactttaagacgaagacgtttcaggaaaagaaggagcaattaatccccgaaaacagactgctactgaaagaagtgggccctacgggtgagggccgtgtgtccgttattgagcaacttctggacgagggagccgaccccaattgctgtgacgaagacaataggccggtgatcaccgtggcagtcatgaataagcaccatgaagcaattccagtcctcgttcagagaggcgcagacatagatcaacaatgggggcctctgagaaacaccgctctccacgaagcgacactgctgggactcgccggacgcgagagcaccgcaacactgctgggctgtaatgcctccatccaaaagaaaaacgccggaggccagacggcatacgacctagccctaaatactggagacgatcttgttacgagccttttcgccgcaaaatttggtcagggcctggaggatcaattagctcagacacgctcgctctccctcgatgattgctag

SEQ ID NO: 55642 - DNA, 2193 bp, Artificial Sequence
  Description of Artificial Sequence: Synthetic coding sequence
atgacagcaggctcagtgtgcgtaccacagatcattcctctcagagtccctcagccgggtaaggcaaaccatgaaatcgacaataacacacttcttgagatgaaatcagataccccagacgtgaatatttactataccctggacggcagtaagcctgagtttctgaagagaatcgggtacggggaaaataacacattcaaatatattaagcctatcacactgcccgacgggaaaattcaagtcaaggccatagcagtcagcaaagattgcaggcagtccggcattgtcaccaaagtcttccacgtcgattacgagccacctaatattgtgtctccggaagacaatgtggagaatgtcttaaaggattctagcagacaagctagagaatttaagaatggattcgtgggcagcaaactcaagaaaaagtataaaaattccgagaatcagcggtcttggaatgtaaacctacggaagttccctgagtcacctctggagattcctgcctatggaggcggatccggaagtcgaccacccactagacagtcacagtcccccggattcgcacacgtaagtggccagaagtgcttaacaagcaccgaaatcatgcgcatccagcgggagactgactttctgaagtgcgcccactgtctggcacctagaccaagcgatcctttcgccaggttttgtcaggagtgcggaagccctgtgccacccatattcggctgtaggctgccaccaccagaaggagcccagatgggcctatgtgctgagtgccgctcactcgtgccaatgaatacccctatctgcgtcgtttgtgaggctccactggctctgcaattacagccccaggccagcttacatctaaaagaaaaggtcatatgtcgcgcatgtggcactgggaatcctgcacacctccggtactgtgttacttgcgagggtgccttgcctagctcccaggaaagtatgtgctccggagacaaagctccaccccctcccacccagaagggcggaaccatctcttgttataggtgtggaagatggaatttatgggaggccagtttttgtggatggtgcggagccatgctgggaatacccgcaggttgcagtgtgtgtccaaaatgcggtgcctccaatcatctgtccgctcgtttttgcggctcatgtggcatttgtgtcaaatctttggtcaagttaagtcttgatcgaagcctagcactggccgcagaggaacccagaccgttctccgagtctttgaatatcccactgcctaggtccgacgtaggaacaaagcgggatatcggaacacagaccgtggggttattttatccttcagggaagcttctcgccaaaaaggagcaggagctggcttcccagaaacagaggcaagaaaaaatgtccgaccataagcctcttctgactgccatttctccgggtagaggatactggagacgccagctagatcacattagcgcgcatctaagatgctacgcccagaataatcccgagttcagggcactgattgccgagccacgcatgggtaaactgatttcagctacagtgcacgaagatggttgtgaagtaagcatccgcctgaactactctcaggtatccaacaaggttcgtaagttgagactacgcgaggtgaagcaaccagcgtcctcgaagggcaccaagctcgctgggcgaccgctgatcaagaactttaagacaaagacctttcaggaaaagaaagagcagctcatcccagagaacagattgctcctcaaagaagtgggcccaacaggggaagggagagtgagtgttatcgagcaattactcgatgaaggcgctgacccaaactgctgtgacgaagacaaccgacctgtgattacagtggccgttatgaacaagcaccatgaggcaatacccgtgctggtgcagcgaggcgcagacatcgaccagcagtggggccctctgcgcaatacagctctgcacgaggcgacactcctgggcttggcgggaagggaaagtaccgctacactcctgggctgtaatgcatctatccagaaaaagaacgcaggagggcagaccgcatatgacctggctttgaacaccggggatgacctcgtcacgtcattgttcgctgccaaattcggacagggcctagaggatcaactggctcagaccagaagcctgtcccttgatgactgctag

SEQ ID NO: 55643 - DNA, 1917 bp, Artificial Sequence
  Description of Artificial Sequence: Synthetic coding sequence
atgcttacccttgagtcctttcagcgtgttcactggaagagccaactgatggtggaagatcaggtcctcgaccacccgcctgcctcccctaggcaggacactgtgcccttcacgttcaagtctttcctattcggacactcgatggagatccggccatggaaaagaaagggacgcacactgtttcggagactgctgttccagtctcccggatttgctcatgtttccggccaaaagtgtctaacctctaccgagataatgcgaatacagagagagactgatttcctgaagtgcgcccattgccttgctccaagaccctcagacccattcgccagattctgccaggaatgtggctcgcctgtgccccctatatttggctgccgcctcccgcctcccgagggcgcacagatggggttatgcgctgaatgccggagtctggtgcccatgaacaccccaatctgcgtggtgtgtgaggcacccttggcgctacagcttcagcctcaggcttcgctgcatctgaaggagaaagtcatctgccgggcatgtggtacgggcaatcctgcgcacctaaggtactgtgtcacttgcgaaggagctctgccctcttctcaagagagcatgtgttcgggcgacaaagccccacctccaccaacccaaaagggaggcacaatatcctgttaccgatgcgggagatggaacctctgggaagccagcttttgtggctggtgcggcgctatgctgggcattcctgcaggctgttccgtgtgtcccaagtgtggcgctagcaatcacttgtccgctcgcttttgcgggtcttgcggaatctgtgtaaagtcactagtcaagctgagccttgaccggagcctcgcactggccgctgaggagccccgtccattttctgagtcacttaacattccccttccacggagcgacgtgggtacgaaacgggacattgggacccagaccgtgggactgttctacccatcaggtaaacttctggccaagaaggagcaggagctggcaagccagaaacagcgccaggaaaaaatgtctgatcataagcccctactcactgctatttcccccggtcgaggatattggagacgtcagctggatcatatatccgctcacctgcgctgttacgctcagaacaacccagaatttcgcgctctgatcgctgagcccagaatggggaaactgatcagcgccaccgtgcatgaggatgggtgcgaagtcagcattcgccttaattattctcaggttagcaataaaaacctgtaccttaataaggctgtcaacttttctgatcaccttctcagtagtgccgctgaaggcgatggaggtctatgcggctctcggagctcatgggtgtccgactatagccagtcaacatcagatacaatcgaaaaaatcaaacggattaaaaatttcaagaccaaaacatttcaggaaaaaaaggagcagcttatccccgagaacaggctcttactgaaggaggttggcccaaccggcgaggggagggtttccgtcattgagcagctattggatgaaggggcagatcccaattgttgtgacgaagacaacagacccgtcatcacggttgccgtcatgaacaagcaccacgaagccataccggtgctcgtgcagcgaggtgcggacattgatcagcagtggggccctctgaggaacaccgcccttcacgaggcaacccttctgggcctagctggccgagagagtacggctacgctgctgggctgtaatgcttcaatacaaaaaaaaaatgctggcggacagaccgcttacgatctcgcccttaatacaggcgacgatctggtgactagcctgttcgccgctaagttcggccagggattggaggaccaactagcccaaacccgcagcttgtcactcgatgattgttag

SEQ ID NO: 55644 - DNA, 1656 bp, Artificial Sequence
  Description of Artificial Sequence: Synthetic coding sequence
tgacagagggaaacagatttcctgaagtgcgctcattgtcttgcgccaaggcccagcgaccccttcgccaggttctgtcaagagtgtggcagccccgtacctcccatcttcggctgccgtctgcccccacctgagggcgcacaaatgggcttgtgcgcggaatgtcgcagcctcgtgcctatgaacacccccatatgtgtggtctgcgaggctccgctagccctccaattgcaacctcaggctagcctgcacttgaaagagaaggtgatctgcagagcttgtggcacagggaaccctgcacacctcagatattgcgtgacgtgtgagggcgcacttccaagcagtcaggagtccatgtgcagtggggataaggcacctccccctcctacccagaaaggcggaactattagctgttatagatgcggcaggtggaatctgtgggaagcctccttctgcggctggtgcggtgccatgctgggcattcccgctgggtgcagcgtgtgccctaagtgtggggcatcaaaccatctttccgccagattttgcggcagctgcggcatatgtgttaagtcgctagtgaaactcagccttgatcgctctttggctctcgccgctgaggaaccaagaccattcagtgaatcccttaatatcccattgcccagatccgacgtaggaacaaagcgcgatatcggcacccagaccgtgggcttgttttacccctctggaaaacttctggcaaaaaaggaacaggagcttgccagccagaaacagcgacaggagaagatgagcgaccacaaaccattattgaccgcaatctcacccggtcggggatactggagacgacagctggaccatatcagcgcccaccttagatgttacgctcagaataacccggaatttcgggctctgatcgctgaacctcgtatggggaaattgattagcgccactgtgcatgaagatggttgcgaagtaagcatacgtttgaactactctcaggtgagtaataaaaatctctatctcaacaaggcagttaacttttcagatcacttgctgtcatcagctgccgagggcgacggaggcctgtgtggtagccgaagctcgtgggttagcgactactctcagtccacctcggacactattgaaaaaattaaaaggatcaaaaatttcaagactaaaacctttcaggaaaaaaaggaacagctcatacccgagaacaggttgctcctgaaggaagtgggccctaccggcgaaggtcgtgtgagtgtgatagaacagttattagacgaaggcgcagacccgaattgctgcgacgaggataacaggcctgtgatcactgtcgcggtgatgaataagcaccacgaggccatccccgtgctggtgcagcggggagctgatatcgaccaacagtgggggccactgcgcaatactgctctgcacgaggccaccctgctcggcctagccggacgcgaatctaccgcaacattacttggctgcaatgcctcaatccagaaaaagaatgcgggaggacagacagcctatgatctggccctcaacacaggcgacgatctggtgacatctctgttcgcagccaaattcggccagggtctggaggaccagctggcacagactagatctctgagcctcgatgactgttag

SEQ ID NO: 55645 - DNA, 1758 bp, Artificial Sequence
  Description of Artificial Sequence: Synthetic coding sequence
atgcttactcttgagtctttccagtcaccaggcttcgctcatgtatcaggacagaagtgccttacttccacagagatcatgagaattcagcgggagactgacttccttaaatgtgctcactgtctggcacctagaccctctgatccatttgcgagattctgtcaagaatgtggaagtcctgtccctcccatctttggatgtcggctgccaccgcctgaaggagcccagatgggtctgtgcgctgagtgccgctctctggtgcctatgaatactccaatatgcgtcgtttgcgaggctcccctagcactgcagctgcagccccaggcttcactgcacctgaaggaaaaagtcatctgccgcgcttgcggcactggtaatccagcccacttacgctactgcgtgacatgtgagggggcactgccctcctcacaggagagtatgtgttctggggacaaggcaccaccccctcccacccagaagggcggtacgatttcatgctacagatgcggccgatggaatttgtgggaagcctccttttgcgggtggtgtggcgcaatgctggggatccctgcagggtgctctgtgtgccctaagtgtggggcttcgaatcatctgagcgccaggttctgcggaagttgcggcatctgcgtgaaatcactcgtgaaactgagcctggatagatcactagctctagccgctgaggaacccagaccctttagcgagcccagatgcgcgtggcagtcgctcaacatcccactgccaaggtcagatgtaggcaccaagcgcgacattgggacccagaccgtaggactcttctacccaagcggtaagctccttgcaaaaaaggagcaggagctggcctcccagaagcagaggcaggagaaaatgagcgatcataagcctctgttgactgctataagcccagggcgaggatattggagaagacaactggatcatatttctgcccatttaagatgctacgcccagaataacccagagttcagggccttgattgctgaacccagaatgggtaagttaatcagtgcgacggtacatgaggacggctgcgaggtctccatccgactgaactattctcaggtatcaaataagaatctttacttaaacaaggctgttaatttctcagatcatttactcagctcagccgcagaaggggatggcggactgtgtggctccagatcctcttgggtgtctgactatagccagtccacatccgacactattgagaagattaagcgaattaaaaactttaagacaaagactttccaagagaagaaggaacagctgatccctgagaatcgcctgcttctcaaagaggtgggccctacgggcgaggggagggtctcggtgatcgagcagttgttagatgagggcgctgatcccaactgctgcgatgaggacaacaggcccgtaatcactgtggcagttatgaataagcatcacgaggccattcccgtactggtgcagcgtggcgctgacattgaccagcagtggggcccactcaggaacacagccctccacgaagccacactgcttggactggccggtcgggagagcaccgctactctactggggtgtaatgcttccatacagaaaaagaacgccggtgggcaaacagcatacgatctggccttaaacaccggcgacgacctggtgaccagcttatttgccgcaaagttcggacagggcctggaggaccagctggcccaaacccggtctctttctctcgatgactgctag

SEQ ID NO: 55646 - DNA, 1614 bp, Artificial Sequence
  Description of Artificial Sequence: Synthetic coding sequence
atgaccatcaatagcttcaagtcacccggtttcgcacatgtgtccggccagaagtgtctcacgagtacagagatcatgcggatccagagggaaaccgacttcctgaaatgtgcccattgcttggctccacgtccgtccgatcctttcgcgagattttgtcaggagtgtggtagccccgtgcccccaatattcggatgtagacttccaccaccagaaggggcacaaatggggctgtgtgccgagtgcaggtcactggtgcctatgaatacgccgatctgtgtggtgtgcgaggcccctctggctctgcagctccagccacaggcctcccttcaccttaaggagaaagtgatttgtagagcctgcgggacagggaatcccgcacacctccgctactgtgtcacatgcgaaggggctttgcctagtagccaggagctcggaattcccgcagggtgttccgtgtgtcctaaatgcggcgcatccaaccatctctcagcccgattttgtggaagttgcggcatctgcgtcaagtcgctggtcaagcttagccttgacaggtcccttgctttggccgctgaggagccccgaccgttttctgagtccttgaacattcctctcccacggtctgacgttggtaccaaaagggatatcggcacacagacagtgggacttttttatccaagtgggaagttgctggcgaaaaaagaacaggagctggccagtcagaagcagcgacaagagaaaatgtctgatcataaaccactcttaacagcgatcagtcccggacgaggctactggcgcaggcagctcgatcacatttcagctcatctccgatgctacgctcagaacaaccctgagttcagggccctcattgctgagcctcggatgggtaagctgatttctgccactgtccacgaagatggttgtgaagtgtctattcgcctgaactattcccaggtcagtaataagaacctgtacctgaataaagcagttaatttcagtgatcacctgctttctagcgccgcagagggagacggcggactttgcggaagccggagttcatgggtcagcgattactcccagtcgaccagcgacacaatcgaaaagataaagaggatcaaaaacttcaagactaagacctttcaagaaaaaaaagaacagttgattcccgaaaatcggctgctgctcaaggaagtcggaccgaccggggaagggagagtatccgtgatcgaacagttgttggacgaaggtgccgaccccaactgctgcgacgaggacaaccgacctgtgataacagtggccgtcatgaataagcatcatgaagccatccctgtgcttgtgcaaagaggggcagacatcgaccaacagtggggaccgctgaggaacactgcactacatgaggctacactcctgggtctggccggtcgggaatctaccgccactcttttgggatgcaatgcatctatccaaaagaagaatgcgggaggccaaacagcgtacgacttggccctaaacaccggcgacgatctggtgactagtctcttcgcagcaaaattcggccagggcctggaggaccagctcgctcagactagatcactgtctctggacgattgctag

SEQ ID NO: 55647 - DNA, 1755 bp, Artificial Sequence
  Description of Artificial Sequence: Synthetic coding sequence
atgaccatcaatagctttaagtcaccagggtttgctcacgtctctggacagaagtgcctgacgtccactgaaatcatgaggatccagcgagaaaccgatttcctcaagtgtgctcactgcctggcaccccgaccatctgacccgtttgcacggttttgtcaagagtgcgggtcccctgtccctcccatttttgggtgtagactgcctcctcccgaaggggctcagatgggcctctgtgcagagtgcagaagcctagtacctatgaacactcccatctgtgtcgtctgcgaggcccctttggcccttcagctgcaacctcaagcaagcctgcatctgaaagaaaaggtcatttgccgggcttgcggaactggcaacccagctcacctgaggtactgcgtgacatgtgaaggggctctgccatcgagtcaggagtccatgtgttccggggacaaagcccctccgccaccaacccaaaaggggggtactatctcatgctaccgctgtggccgatggaacttatgggaagcatcattctgtggctggtgcggtgcgatgctcggtataccggctggctgtagtgtttgtccaaaatgcggcgcatccaaccacctctcagctagattttgtggatcctgtggtatctgcgtgaaatccttagtgaagttatccttggacaggtctctggcactggctgctgaggaaccgcgtccgttcagcgagcctcgctgtgcttggcagagtttgaatatccccctgccgcgttcagatgtgggcaccaaacgagatattggaacccaaaccgtgggtctcttttacccatccggcaagctgctcgcgaaaaaagaacaggaactggcctcccagaaacagcggcaggagaaaatgtccgatcacaagccccttctgactgcgatttctccagggcgaggctattggcgcaggcagctcgaccacatttctgcccatctgagatgttacgctcaaaacaaccccgaattccgagccctaatagccgaacccaggatgggcaagctaatcagtgccaccgtacacgaggacggctgtgaagtaagcattcgcctcaactattcccaggtttcaaataagaatctgtaccttaacaaagcagtcaatttttccgaccatcttctgtcctccgcagctgagggtgacggcggtctttgtggctctagatcctcgtgggtctcggactatagtcaatcaacatctgacaccatcgaaaagatcaaacgcattaagaatttcaagactaaaaccttccaagagaagaaagaacagctgataccagagaaccggcttctcctgaaggaggtagggcctaccggtgagggcagggtgtccgtgatcgaacagctgctcgatgagggcgcagatcccaattgctgcgatgaagacaaccgtccagtaatcaccgttgccgtgatgaacaaacaccacgaggctataccagttttggtgcagcggggagctgacatcgaccagcagtggggacctctgagaaacacggccctgcacgaggcaactctgctgggcctcgctggtcgggaatccactgctacccttctcggctgcaacgccagtattcagaagaagaatgctggtggacaaactgcctatgatctcgctctgaacactggcgatgacttggtgaccagcctgtttgccgctaaatttggacagggtttggaagatcaactggcacagactagaagcctgtccctcgacgactgttag

SEQ ID NO: 55648 - DNA, 1050 bp, Artificial Sequence
  Description of Artificial Sequence: Synthetic coding sequence
atggctggcggatctcccgctgctaaacgggtggtcgtgtatcggaacggagatcctttttttccaggcagtcagcttgtcgtgacacaacgaagatttcctaccatggaagctttcctctgcgaggtcacttcagctgtccaggctcctttggctgttagggccctctatacaccttgccatgggcacccagtcactaacctggccgacctaaaaaataggggccagtatgtggcagccggtttcgagaggtttcataaattgcattaccttccccaccgtggcaaagacccaggcggaaaatcttgtaggctgcagggaccacctgttacaaggcacctttgcgacggagcaatcggcagacagctgccagctggagccccttcatatatacacgtcttccgtaatggcgaccttgtgtcccctcctttctccttgaagctgtcacaggcggcttcccaagactgggagactgtcctcaagctgctcacagagaaagtaaaattgcagtcaggggcagtctgtaaactctgcacactggaggggcttcctctgagcgccggaaaagaattggtcacggggcattattacgtggccgtgggggaagacgaatttaaggacctcccatacctggaattgctcgtgcctagcccatccctgccacgcggatgttggcagccccctgggagtaaaagcagacctcatcggcagggcgcacagggacatcgcgcacaggtcacacagccctctccaaaagaaccggacaggatcaagccctctgccttttatgcacgcccacagcaaacgatccagccacggagcaaactgcccactttgtcttttcccagcggcgtgataggggtgtacggagcacctcacagaaggaaggaaactgccggagcccttgaagttgctgatgacgaggatacgcagactgaggagcccctggatcagcgggctgcccagatcgtggaagaagcattatccttagagaatcagcccggagcgggagcggcaatttcagcgtcagcccctgctctgccttcttag

SEQ ID NO: 55649 - DNA, 453 bp, Artificial Sequence
  Description of Artificial Sequence: Synthetic coding sequence
ctgatcctagaagagcagttccctagcggccttatcggaccactctttacaatgaatggccatctgctcggagacagcaaggatctgcaggacaaccacttctacgtcgccgtgggcctggagacattcaagtacttcccatactggaaaagcccgagagtgccgagcgaagtccaacagcgctatgcaaacgttgagaagaattcacagcgaaagaagaaggttgactcaaaggggaaggagccctgcaaatatgatggcatacctcccaaaacccaagactccgtgtactatgctaaagaagaaaaaaagaagacactggccgaacccctagtgcaaagaggtgccgaaggggacgtgtacaaggccccaacgccgagcaaggaaacccaaggtgccctggacgtgaaagaggaacacaatgtccaactggaagtcccggtggaccagtag

SEQ ID NO: 55650 - DNA, 579 bp, Artificial Sequence
  Description of Artificial Sequence: Synthetic coding sequence
atggccgctccaccaaaagcgccaattagggtccggaatctcaccatcagggccggagccctcactgggaaagaaaacaacatgctgcaacccgagacgcacatattcacagcccctgaagagggcagcagccagggtgctctactcttaggccaggctccggagcctttgagccttccatgtactccagttaccttggaacagcagctggtctctccgtctggggatccacacagagcccctgccctgccttcaatatgttctacgcttatcctccagccctgtgcaacgctagaccctttattgctccagccacaggtgccaaaagtctcagatcaagcactcgtgtccgctcactctgaatggcagcggaagctcgaagctgctgaggcacttttaaccctcagaaactctgcccaggctcctcctgacagcatctctttgcatcagccctgcaaccctcccgctccagccggtgataaaggctttcagcctccatccccatcactgcgcccacgtcccgcatcttctatctccctgccaattgggcatctggggtgcatcagtttgttgtcctag

SEQ ID NO: 55651 - DNA, 534 bp, Artificial Sequence
  Description of Artificial Sequence: Synthetic coding sequence
atggagtccatctatctgcagaagcaccttggcgcatgtctgacccagggactcgctgaggtcgccagggtgcggccagtcgatcccatagaatatctcgccctctggatctacaagtataaggagaacgtcaccatggagcagctacggcagaaggagatggcaaaactggagcgtgagcgggagctggccctgatggagcaggaaatgatggaaagactgaaggctgaagaactgctgctccagcagcagcagcttgctctgcagctggaactcgagatgcaggagaaggaaagacagaggattcaggagcttcagcgcgctcaagagcagcttggaaaggagatgagaatgaacatggaaaatctagtgcggaatgaggacattttgcattccgaggaggctactctcgactccggcaagactttggcagagatcagcgaccggtatggagctccaaatttatccagggtagaagagctcgacgagcccatgttttcagacattgcgcttaatatcgatcaggatctctag

SEQ ID NO: 55652 - DNA, 534 bp, Artificial Sequence
  Description of Artificial Sequence: Synthetic coding sequence
atggagtcgatttatttgcagaagcacctgggtgcctgcctcacccaggggttggcagaagttgcccgtgttcgacctgttgacccaattgagtacctcgccctctggatctacaagtacaaggagaatgttacaatggagcagcttagacaaaaggagatggccaaactagaacgtgaacgagagttagcactgatggaacaagaaatgatggagagactgaaggctgaagaattattgctccagcaacagcagctggcccttcagcttgaactggaaatgcaggagaaggagaggcaacgcattcaggaacttcaacgggcacaagaacagctgggaaaagaaatgcggatgaacatggagaatttggtgcgcaacgaagacatcttgcactccgaggaggctactcttgactctggaaaaacacttgccgagatctctgacagatatggcgctcctaacctgagtcgggttgaggaactcgacgagcccatgttttccgacattgctctcaatatcgaccaggatctgtag

SEQ ID NO: 55653 - DNA, 555 bp, Artificial Sequence
  Description of Artificial Sequence: Synthetic coding sequence
atggaatctatttacttacagaaacaccttggcgcttgtttgacacagggcctggcggaagtggcgcgagtccgacctgtggatcctattgagtaccttgcactgtggatctacaagtataaagagaatgtgactatggaacagctcaggcaaaaagagatggcaaaacttgagcgggaaagagaactggccctcatggagcaggagatgatggaacggttgaaagcagaggagctgctgctgcaacagcagcagctagccttgcagcttgagcttgaaatgcaggaaaaagagcggcaaaggatccaggaactgcagcgcgcacaggaacaactagggaaggaaatgaggatgaatatggagaatctcgtcaggaatgaagatattttgcatagtgaagaagcaaccttggattccggaaagacactggccgagatctctgataggtatggtgccccaaatctctcacgagtcgaggaactggacgaaccgatgtttagcgatgtcagtatttcagtattttgcgagaaaactaggttctgcttttgtttttag

SEQ ID NO: 55654 - DNA, 243 bp, Artificial Sequence
  Description of Artificial Sequence: Synthetic coding sequence
atggaaagtatttacctgcaaaagcacttgggagcctgcctcacccaagggctggccgaagtggctcgcgtgagacccgtggatcccatagaataccttgctttgtggatctataagtataaagaaaacgtgaccatggagcagctcaggcagaaggagatggccaaactggagagagaacgcgagctggccctgatggagcaagagatgatggaacgcctcaaagctgaagagctgctgtag

SEQ ID NO: 55655 - DNA, 462 bp, Artificial Sequence
  Description of Artificial Sequence: Synthetic coding sequence
atggaaagcatctacttacaaaaacatctgggggcatgcctgactcagggacttgccgaagtggcaagagtgagacccgtagatcccattgagtatctagctttatggatttataagtataaagaaaatgtcaccatggagcagttgcggcagaaagagatggctaagctggagcgggagagggagttggcgctcatggaacaggagatgatggaaaggttaaaggcggaggaactcttattacagcagcagcagctagcactgcagctggagcttgagatgcaagaaaaggaacgccagcgcattcaggagcttcagcgagcgcaggagcagttagggaaggagatgcgtatgaatatggagaacctcgtccggaacgaagacatcctccacagcgaggaggcaaccctggacagcgggaaaactctcgcggaaatttctgacagatatggcgcaccgtag

SEQ ID NO: 55656 - DNA, 534 bp, Artificial Sequence
  Description of Artificial Sequence: Synthetic coding sequence
atggaaactaattaccttaagcgctgtttcggcaattgcctcgcccaagccctcgcagaagtcgctaaagtgcggccttcagatcctatcgaatacctcgcccactggttgtaccattatcgcaaaactgcgaaagccaaggaagaaaatcgagagaagaagatccaccttcaggaagaatacgatagctctctcaaagaaatggaaatgaccgaaatgctcaaacaagaagaataccagatacagcagaactgcgaaaagtgccataaggagctgacttccgaaaccgtgagcaccaaaaaaaccatattcatgcaggaggatacaaacccactcgaaaaggaagcgcttaaacaggaatttctgcctggtacctcttccctgatccccggaatgcctcaacaggtgcctcccagcgaatccgctggacagatcgaccagaattttaagatgccacaggagataaactacaaagaggctttccagcatgaggtggctcatgaaatgcctccgggatcaaagtcacctttttag

SEQ ID NO: 55657 - DNA, 534 bp, Artificial Sequence
  Description of Artificial Sequence: Synthetic coding sequence
atggagactaactatctgaagcgttgctttggcaattgtttggcacaagcattggccgaggtggccaaagttcgtccaagtgatccgatagagtatcttgcccattggctctaccactacagaaaaactgctaaggctaaagaggagaaccgcgagaagaaaattcatcttcaagaagagtacgacagctcgctgaaggagatggagatgactgagatgttaaagcaggaggagtatcagattcagcagaattgtgaaaaatgtcataaggagctcacatccgagaccgtcagcaccaagaagacgattttcatgcaggaagatacaaacccactggagaaagaggcactgaagcaagaatttctgcccggaacaagctcactgatccctggaatgcctcagcaagtgcccccttcggaaagtgcgggtcagatcgatcagaatttcaaaatgccccaggagattaattacaaagaggcatttcagcacgaggtcgcccacgaaatgcctcctggttccaaaagccccttttag

SEQ ID NO: 55658 - DNA, 576 bp, Artificial Sequence
  Description of Artificial Sequence: Synthetic coding sequence
atgatcctccggccaccacagcagtgtggaaccgccgctagaatggagacaaattatctgaaacggtgctttggaaattgccttgcccaggctcttgccgaggtggccaaggtgaggcctagtgaccccatagagtatctggcccactggctgtaccattaccgcaagacggctaaagctaaggaagaaaaccgggagaagaagattcaccttcaggaggaatatgattcttctcttaaagaaatggaaatgaccgaaatgctgaagcaggaagagtaccagatccagcagaattgcgaaaaatgtcacaaggagctgactagtgagacagtctcaactaaaaagactatttttatgcaggaagataccaaccccctggaaaaggaagccttgaagcaggaattcctaccagggacttcatcgctgatacccggaatgcctcagcaagtgccaccaagcgaatcagccggtcagattgaccagaactttaagatgccccaggaaatcaactataaagaagctttccaacacgaagtggcccacgagatgcctcccggatcaaaatcaccattttag

SEQ ID NO: 55659 - DNA, 534 bp, Artificial Sequence
  Description of Artificial Sequence: Synthetic coding sequence
atggagaccaattacttaaaaagatgctttgggaattgcctcgcacaggctctagctgaggtcgcaaaggttcgtccgagcgatccaatagaatacctggcccattggctctatcactatagaaaaacagccaaagcaaaagaagaaaatcgcgagaaaaagatccatcttcaggaggaatatgacagttccctgaaagagatggagatgaccgaaatgctgaagcaggaggagtaccagatccagcagaattgtgaaaaatgccataaggaactcacaagcgaaactgtgagcaccaaaaagactatttttatgcaggaggacaccaaccccctcgagaaagaggccctaaagcaggaatttctcccagggacatctagcctgatcccagggatgccccagcaagtaccaccatccgagagtgcaggacaaatcgaccagaattttaagatgccccaagagattaattacaaagaagcatttcagcatgaggttgcccatgagatgccacctgggtccaagtcccctttctag

SEQ ID NO: 55660 - DNA, 381 bp, Artificial Sequence
  Description of Artificial Sequence: Synthetic coding sequence
atggagaccaactacctcaagaggtgctttggtaactgtctggcgcaggctctggccgaagtagccaaagtacgtccatccgaccctatcgagtacttggcccactggctatatcactaccggaaaacagccaaggcaaaggaggagaatagagagaagaaaattcatttacaggaggagtacgattcgtcactgaaagagatggagatgaccgaaatgctcaaacaggaggagtatcagatacaacaaaattgtgagaagtgtcacaaggagcttacctcagagacagtttccaccaaaaagactatctttatgcaggaagataccaacccgctggagaaggaagctttgaaacaagagtttttgcctggcacctcttag

SEQ ID NO: 55661 - DNA, 534 bp, Artificial Sequence
  Description of Artificial Sequence: Synthetic coding sequence
atggagacaaactatctgaaacgctgctttggaaattgcctcgcccaagcgctggctgaggtggccaaagtgagaccgagcgatccgattgaatacctggcccactggttataccactacaggaagacggcaaaagctaaggaggaaaatcgggagaagaagattcatctgcaggaagagtatgatagctctctcaaggaaatggaaatgaccgaaatgcttaagcaggaggagtaccagatccagcagaattgcgaaaagtgtcataaagaattgacgagtgagacagtgtccactaaaaaaaccatcttcatgcaggaagacacaaacccactagaaaaggaagctctaaagcaggagttcctccccggaacatctagtctgatccccggtatgccccagcaggtgccgccatccgagagtgccggtcagattgatcagaattttaaaatgccccaagaaattaactacaaggaggcttttcaacacgaggtggcacatgagatgccaccaggatcaaaaagccctttctag

SEQ ID NO: 55662 - DNA, 915 bp, Artificial Sequence
  Description of Artificial Sequence: Synthetic coding sequence
atgtcactgaatccccctatctttttgaaacggagcgaggagaactctagcaagtttgttgaaaccaaacagagtcaaaccacaagcatcgcctcagaggacccgcttcagaatctgtgcctagcatcgcaggaagttttgcagaaggcccagcagtccgggcgttccaaatgcctgaagtgtggaggcagtcgtatgttttattgctatacgtgctatgttcctgtcgagaacgtgcctatcgagcagatccctctcgttaagttacctctcaaaatagacatcattaagcatccaaatgagactgatggcaaaagtacagccattcatgctaaattattggctcccgaattcgttaatatatacacctatccttgcatccctgaatatgaagagaaggaccatgaagtcgcactaattttcccgggaccgcagtccatatccattaaggacatcagcttccacctgcaaaaaagaatccaaaataacgtccgtggcaagaacgatgacccagataaacctagcttcaaacgtaagcggactgaagagcaggagttttgtgacctaaatgactctaaatgtaagggcacaacgctgaagaagatcattttcattgattctacttggaatcagacaaacaaaatcttcaccgacgagcggttgcaagggttactgcaagtggagctgaaaacaaggaagacctgtttctggcgacaccagaaaggcaaacctgacacttttttaagcactattgaggcaatatattattttctcgtagattaccacacggatatactgaaagagaagtacaggggtcagtatgacaatctactctttttttattcctttatgtaccagctgattaagaacgccaaatgcagcggggataaagagaccggaaagttaacacactag

SEQ ID NO: 55663 - DNA, 330 bp, Artificial Sequence
  Description of Artificial Sequence: Synthetic coding sequence
atgtcattgaatccaccaatttttctaaaaaggagtgaggagaacagctcaaaattcgtggagacaaaacaatcccaaactacctccatcgccagtgaggaccctctgcagaatttgtgtctcgcctcccaggaggttttgcagaaggcacagcaaagcgggaggagcaaatgcctaaagtgtggtggatcccgcatgttttactgctacacttgttacgtaccagtggagaatgtcccaatcgagcagatacctctcgtaaagttcagtttgtatcacctgggacaatccatggtttcttccgcatccaaaatcacttgcattggatag

SEQ ID NO: 55664 - DNA, 915 bp, Artificial Sequence
  Description of Artificial Sequence: Synthetic coding sequence
atgtctctcaaccctccaatttttcttaagcgatcagaggagaactccagcaagttcgtggaaactaagcagagtcagacaactagcattgccagcgaggacccactccagaacctctgtttggcatcacaggaagttttgcagaaggcgcagcagagtggccgtagcaaatgcctgaaatgtggtggatcaaggatgttttattgttatacctgttacgtgcccgtagagaatgtgcccattgaacaaattcccttggtaaagttgccactcaaaattgatattataaagcatcccaatgagactgatggaaagtctactgcgattcatgcaaaactgctcgccccagagtttgtgaacatttacacatacccttgtatcccagagtacgaagagaaggatcatgaggtggccctaattttccctggcccacagagcatatcaattaaggacatctctttccatctgcagaagaggattcagaataatgtcagaggaaaaaatgacgatccagacaagcctagtttcaagcgcaagcggaccgaggaacaggaattttgtgacttgaacgattccaaatgcaaggggacgaccctcaagaaaattattttcatcgattccacctggaaccagacaaacaagatattcacggacgaacgcctgcaaggcttgctccaagtagagctcaagacacgcaagacgtgtttctggagacaccagaagggcaaaccagatacctttttgagcaccatcgaagcaatctattactttttggtcgattatcataccgatattcttaaggagaaatatcgtggccagtatgataacctcctgttcttctacagctttatgtatcagctgataaagaacgctaaatgcagcggagacaaagagacaggcaaacttacccattag

SEQ ID NO: 55665 - DNA, 654 bp, Artificial Sequence
  Description of Artificial Sequence: Synthetic coding sequence
atgctaccccttaagatcgatatcatcaaacaccctaatgaaacagatgggaagagcaccgccatccatgcgaaactgttggccccagaattcgtgaacatatatacgtatccttgtatccctgaatacgaggagaaggaccacgaggttgccctaatatttccaggccctcagtccatcagcattaaggacatatctttccacctccaaaaacggatccaaaacaacgtgcggggtaaaaatgacgacccagataaacccagttttaagaggaaacgaacagaagagcaagagttctgtgacctgaacgactccaaatgtaagggcacgaccctgaagaaaattatctttatagactccacctggaatcaaaccaataaaattttcaccgacgagaggctgcagggtttactccaggttgagttgaagactaggaagacctgcttttggaggcaccagaagggtaaacctgatacatttctcagtaccattgaggctatatattacttcctcgtagattatcacacagatatccttaaagagaagtaccggggtcagtatgataatctgttatttttttacagctttatgtaccagttgattaaaaatgccaagtgcagtggggacaaggaaacaggcaaactgactcactag

SEQ ID NO: 55666 - DNA, 915 bp, Artificial Sequence
  Description of Artificial Sequence: Synthetic coding sequence
atgtcacttaacccacccatatttcttaagcgaagcgaggagaattcatcaaagtttgtcgagactaagcagagccagacaacttccatcgcatccgaggatccacttcagaatctgtgcctggcctcccaagaggtcctacagaaggctcagcagtccgggagatctaagtgtctgaagtgtggcggttcacgcatgttctactgctacacatgttacgttcccgttgagaacgttccaatcgagcagataccactcgtcaaactgccccttaaaatcgatatcatcaaacaccctaacgagacagacggcaagtctacagctattcatgccaaactgttagcaccagaatttgtgaacatttatacctatccctgcattcctgaatatgaggaaaaggaccatgaggtcgcactcatctttcccggacctcaatctatttcaataaaagacatttcattccaccttcagaaaaggatacagaataatgtgaggggtaagaacgacgatcccgacaagccttctttcaagcgcaaacggaccgaggaacaggagttttgtgacctgaacgattctaagtgcaaaggaaccaccctgaagaagattatttttattgattcgacctggaaccaaactaataaaattttcaccgacgagcggctacagggcctgttgcaagtggagctcaaaacccggaagacatgtttttggaggcaccagaagggcaaaccagacaccttcctcagcacaatcgaggcgatttattacttcctggtggattatcacaccgatatccttaaggagaagtaccgcggacagtacgataacctgctgtttttctacagctttatgtatcagctaatcaagaacgcaaagtgtagcggggataaggagaccggtaagctcacacattag

SEQ ID NO: 55667 - DNA, 285 bp, Artificial Sequence
  Description of Artificial Sequence: Synthetic coding sequence
atgtcccttaatccacctatattcctgaagaggagtgaggaaaacagcagtaagttcgtcgagaccaagcagtcacagacaacctccattgcctctgaagatccattacaaaacttgtgtctcgctagtcaggaggttctacagaaagcccagcagtccgggcgttcaaaatgcctgaaatgtggaggatctcgcatgttttactgctacacctgttatgtgcccgtcgaaaatgttccaatcgagcagatccccctggtaaaactccctttgaagattgactag

SEQ ID NO: 55668 - DNA, 897 bp, Artificial Sequence
  Description of Artificial Sequence: Synthetic coding sequence
atggaaagccaaaaagaggccagaaccttacaggaacctgtggccaggccctcgggcgcatcctcctcacagacccccaacgacaaggagaggcgagaaggcggtgcggtgccagccgcagctgcacttggtgccgaagccgacgatgatagcgcggacggtttgtgggaattacccgtggagcctgctgagagaagaccagagtgcacccggtgctctaggcctcagaaggtatgcctgtgtcccttcctccctgcccacccactgcatattagcacccatttgtacattattcagcatccggcagaggagaataaagtcctccgaaccgtgccattgcttgctgcctgtctgcctcaggacaaatgtaaggtgaagattgggaggcggttttccgaagagcgggaccctgagctcagtactgtgtgccgaaagtctggcaccctcatactgtaccctggagctgaggcggctaacctggaggagtttatactggattctcctgtgtaccccagcacaattatcattatagatgggacctggtcacaggcaaaggatatcttctacaaaaatagtctctttagacatccaaagcaggtccagctgaagacatctatctctagtcaatacgtgattaggatgcaacctacaaatagatgtttaagcaccctcgagtgcgccgctgttgccctgtctatcctagaaaagaacaattacatacaagagaccctcctccgacctctgcaggcgctgtgctcattccagctccagcatggggctcagattcggctgtccaaggagcatctgctgaagaacggtctataccccaaaccaatgcccaagaacaagcgcaagctgcgtaaaatggaacttttaatgaattctgttaaaatctag

SEQ ID NO: 55669 - DNA, 3477 bp, Artificial Sequence
  Description of Artificial Sequence: Synthetic coding sequence
atggcgacaaggaaggataccgaggaggaacaagtggtgccttcggaagaggatgaggcaaacgtgagagcagtgcaggctcactacttgaggtctccctcaccctcacagtacagcatggtctccgacgccgaaactgagagcatcttcatggaacccatccacctctcttcagctatagctgcgaagcaaataatcaacgaggaactgaaacctccgggagttcgtgccgatgcagagtgcccgggtatgctcgagagcgccgagcagttgttggtcgaggatctgtataatagagtgcgtgagaagatggatgatacttctctgtataatactccttgcgttctggacttacagcgggctctggtgcaggatcgtcaagaagctccttggaacgaggttgacgaggtttggcccaacgtcttcatagcagagaagtctgtcgctgtcaacaagggacgcttgaagaggttgggaatcacccacatcctcaatgccgctcacgggacgggggtgtacaccggacctgaattctatacaggcttggagatccagtatcttggcgtggaggtggatgattttccagaagtagatatcagtcaacacttcagaaaagcttctgaatttctggacgaggcattgctaacctaccgcggtaaggtgctggttagcagcgaaatgggaatctctagatccgcagttctggtggtggcatatttgatgatcttccataacatggccatcctggaggctctgatgaccgttagaaaaaaacgagctatttacccgaacgagggctttctgaaacagctgcgcgaactcaacgagaaacttatggaagaacgggaagaggactacgggcgtgaaggcggtagcgccgaagctgaagagggggaggggacgggcagcatgctaggcgcacgagtccacgctttgaccgtggaagaggaggacgatagcgcaagccacctgtctggctcatctctgggtaaggcaacacaggcctcaaagccactaactcttatagatgaggaggaagaagaaaaactgtacgaacagtggaaaaaaggccaggggttgctgtcagacaaagtccctcaggacgggggaggatggaggtccgctagctctgggcagggcggtgaagagcttgaggacgaagacgtagagcgcatcattcaagagtggcagtcacgaaatgaaagatatcaagctgagggatacagacggtggggcagggaggaggaaaaggaggaggagtcagatgctggatctagtgtcggtcgtcgcaggcgcactctctcggagtcaagcgcatgggagtcagtaagttcccacgatatttgggttctcaaacaacagctagaacttaaccgcccagaccacggtaggagacgaagggcagattcgatgtcatcagagtcaacctgggacgcatggaatgagcgactactggaaattgagaaagaggcatcccgtcgctaccatgcaaagagtaagcgggaggaggcagccgatcgctcctctgaagccggatctcgcgtccgagaagacgacgaggacagtgtaggttctgaggcgagctccttctataacttttgcagccggaacaaggataagctgacggcactcgaacgatggaagattaagagaatccagtttggctttcataagaaggatctcggtgcaggtgactcaagtggcgaaccgggagctgaggaggctgtaggggagaaaaacccttcagacgttagcctgacagcctaccaggcttggaaacttaaacaccagaagaaagttggctcagaaaacaaagaggaggtcgtagagctgtctaaaggggaggacagcgcacttgcgaagaaacgacaaagaagactcgaactcctcgaaagatcgagacagactctggaggaatcccaaagtatggcctcgtgggaggctgattcgagcactgcgtcaggctctatccctctctctgcgttttggtcggccgaccctagcgtgagtgcagacggagatactacttccgtgctctccactcagtctcataggtcccatctttcccaggccgcaagtaatatcgctggttgttctacttcaaaccctacaacacctctgccgaaccttccggtggggcctggagataccatctccattgccagtattcaaaattggattgccaacgtagtgtcagaaactctcgcccagaagcagaacgagatgctgctcctatcaagatcgcctagcgtggcatcaatgaaggccgtgcctgctgctagctgtttaggagacgaccaggttagcatgctgagcggccacagctcatcctccctgggagggtgcctgcttcctcagtctcaggcgaggccatctagtgacatgcagtcagttctttcgtgtaacaccaccctctcctcacccgctgaatcttgccgaagtaaggtccgtggaacatcaaaaccaattttttccttgtttgccgataacgttgacctcaaagagctcggtcgtaaagagaaggagatgcagatggagcttcgggagaaaatgagcgagtacaaaatggaaaagctggcctctgataacaagagatcttctctgttcaagaagaagaaagttaaggaggatgaagacgatggggtcggagacggagacgaggatacggactctgccatcggaagtttcagatactcttctcgtagcaactcccagaagccggagacagacacttgctcctccctcgcagtgtgcgaccattatgcctcaggatcccgggtcggcaaggagatggactcctctattaacaagtggttatctgggttgcggacggaggagaagcccccttttcagagcgattggtccgggtcttcccgcggaaagtatacacggtcatccctgctgcgggagacagagagcaagagctccagttacaaatttagcaagtcccagagcgaagaacaggatacatcaagctatcatgaggctaacggaaattcagtcagatctaccagtcgttttagctcttcctctacaagggagggacgtgaaatgcataagttcagtcgctctacatataacgagacctcctcaagcagagaggagtccccagagccttatttcttccgccgtactcccgaatccagtgagagggaggagtctcctgaaccccagaggcctaactgggccaggagccgcgattgggaggacgttgaggaatctagcaaatccgatttctctgagttcggggctaagaggaaatttacacagtcttttatgcgtagcgaggaggagggcgaaaaagagcgtacggagaatagggaggaaggccgtttcgcctccggccgacggtctcagtacagaagaagtaccgacagagaagaggaggaagagatggatgatgaggctatcatcgcggcttggaggcggagacaagaagaaacccggaccaagctgcagaagcgcagagaagactag

SEQ ID NO: 55670 - DNA, 3477 bp, Artificial Sequence
  Description of Artificial Sequence: Synthetic coding sequence
atggccaccagaaaagatactgaggaggaacaggtggtacccagtgaagaagacgaggcaaacgtgcgggcagtgcaagcccattatctccggtcgcctagtccaagtcagtattctatggtgagcgacgcagaaacagagtctatttttatggagccaatacacctaagctccgccatagccgctaagcagatcataaatgaagagttaaagcctcctggcgtgcgggctgacgccgaatgccctggaatgctggaatctgccgaacagttactggttgaagatctgtataacagggtcagagagaagatggacgatacctccctttataacaccccctgcgtgctggacttacaacgtgctctggtgcaggacaggcaagaagctccttggaacgaggtcgacgaggtctggcctaatgtattcattgccgagaagtctgttgccgtcaacaaagggaggttaaaacgactgggcatcacccacattctcaacgctgcccacggtacaggcgtctacaccgggcctgaattttacaccggtcttgagatccagtacctgggcgtcgaagtggatgactttccagaggtggacatatctcaacactttaggaaggcgtcagagttcctcgacgaggctcttctcacctacaggggcaaggtattggtgtcctcagaaatgggtatcagtcgcagtgccgtgcttgtggtggcttacctgatgatttttcacaacatggccattttagaggcactgatgacagtaaggaagaaacgggcaatctaccctaacgaaggttttctcaagcagctgagggaacttaatgagaaactgatggaagagagagaagaggattacggacgcgagggaggctctgcagaagctgaggagggagaaggcacaggttcgatgctgggtgccagggtgcatgcacttaccgtcgaagaagaagacgactccgcaagtcacctgagtggctcctcactcggaaaggccacacaggcatcaaagccattaacccttatcgacgaggaagaggaggaaaaactttacgagcagtggaagaaaggccaaggtcttctgtctgacaaggttccccaagacgggggtgggtggagatctgccagttcagggcagggaggcgaggaactggaggacgaagacgtcgagcgcattatacaggaatggcaatctcggaacgagcgctaccaggcagaggggtatagacggtggggccgagaggaggaaaaggaagaggagtccgacgctggatcctcagtcggacgccgacgcagaacactcagtgaatcatctgcttgggagagcgtgtcaagccatgacatttgggttctgaaacagcagctggagttaaacaggcccgaccatgggagaaggcggagggctgacagcatgagcagtgagtctacctgggatgcttggaacgagcgcctgctcgagatcgaaaaggaggcaagccgccgatatcatgctaaatccaaaagagaggaagccgcagacagaagctcagaagcagggagtcgggtgagagaagacgacgaggactcagttggctctgaggccagtagtttctataacttttgctcaagaaataaagataaactcactgcgttggaacgctggaaaattaagagaattcagtttggcttccacaagaaagacttaggtgccggtgacagcagcggcgagcctggcgcagaagaggcggtgggcgagaaaaacccatctgacgttagcctgaccgcatatcaggcatggaaactcaagcaccagaaaaaagtgggatctgagaacaaagaggaggtggttgagctatccaagggagaggacagcgccctggcaaagaaaagacagcgcaggctggaattgttagagagatcccgacagaccctagaagaaagtcaaagcatggcatcctgggaagcagactctagtacagcctctggttccatccccttgtctgctttctggtccgccgacccaagcgtcagcgctgacggcgataccacaagcgtcctgtccacacaaagtcaccggtcacatctgtcccaggctgccagcaatatagcagggtgctctacatccaatcccacaacgccattaccaaatttgccagtcggaccgggtgataccatcagcattgcgtccattcagaactggattgcaaatgttgtgagcgagacattagctcagaagcagaacgagatgcttctcctgtcaagaagtccaagtgttgcaagcatgaaggcggtgccggcagcaagctgtctgggcgatgaccaggtttccatgctgtccggccactcctctagctccctgggcggttgcctactaccccaatcgcaggccagaccctcatccgatatgcaaagcgtgctgagctgtaataccactttgtcttccccagccgaaagctgcaggtccaaagtgcggggaacatccaagccaatcttttccctcttcgccgataatgtggaccttaaagagctcgggaggaaggagaaggagatgcagatggagctgagagagaagatgtccgagtataaaatggaaaagctagcttcagataacaagagatcgtctctgtttaaaaaaaagaaggttaaagaggacgaagatgacggagtgggcgatggagacgaagacacagatagcgccattgggtcttttcgttactcttctcgttctaactctcagaagcctgagacggacacctgttccagcctggcggtttgcgaccattacgctagcggatctagagtgggaaaagagatggattcctcaatcaataaatggctctccggccttcgcactgaagagaagccgccttttcagtctgattggtccggaagcagcaggggcaaatacacccgaagctctctccttcgagagacggagtccaagtcttcaagctacaaattttcgaaaagtcaaagcgaggagcaagacacttcgtcataccacgaggccaatggcaattcggttcgcagcacatctcggttcagctctagttcaactcgcgaggggagggaaatgcacaaattcagccggtcaacctataatgaaacttctagtagccgggaggaatctcctgagccctatttctttcgcagaacacccgagtcttccgagcgtgaggagtccccagagcctcaaagacctaactgggcaagatctagggactgggaggacgttgaggagtcaagtaaatctgactttagcgagtttggggctaaaagaaaattcacccaatccttcatgagaagtgaggaagagggtgaaaaagagagaacagagaatcgggaagaggggagatttgcgagcgggagaaggtcccaatatcgtcggagcactgatagggaagaggaggaggaaatggatgatgaggcgattatcgccgcatggaggcgtcgccaggaagagacacggacaaagctccaaaaacggcgagaagactag

SEQ ID NO: 55671 - DNA, 3477 bp, Artificial Sequence
  Description of Artificial Sequence: Synthetic coding sequence
atggccacacggaaggacacagaagaggagcaagtagtaccttctgaggaggatgaagctaacgtacgggctgtccaggctcactacctgcgttcccccagccctagtcagtacagcatggtgagcgacgcggaaactgagtccatcttcatggagcccattcatctgtcgtcagcgatcgctgcaaaacagatcattaacgaggagttaaaaccgcctggcgtgagggcggatgccgaatgtccaggcatgttagagtctgccgaacagctgcttgtcgaagatctctacaatcgtgtccgtgagaagatggatgacacatcactctataacaccccatgcgtcctagacctccagcgggcattagtccaagaccgccaggaggctccctggaacgaggtggatgaggtatggccgaatgtctttatcgccgagaagtctgtcgccgtcaacaagggtaggctgaagagattgggtataactcatattctaaatgccgctcatggcaccggagtgtacacaggacctgaattttatacgggcttggagatccaatatttgggcgtcgaggtagacgattttcctgaagtggatatatcccagcatttcagaaaggcaagtgagttcctggatgaagctctgttgacttacaggggcaaagtgctcgtgtccagcgagatggggattagcagaagtgcagtgcttgtggtcgcctatcttatgatctttcacaacatggcaattctcgaggcgttgatgactgtccgcaaaaaaagagccatttaccctaacgagggatttctgaaacagctgagagagttaaatgagaagctaatggaagagcgcgaggaggactatggcagggagggaggaagcgctgaggccgaagaaggggaaggtacaggcagtatgttgggcgcacgggtgcacgctttgacagtggaggaggaagatgactctgcgtcacacctctctggttcctcactcgggaaggcaacccaggccagtaagccccttaccctgatcgatgaagaggaggaagagaagctgtatgagcagtggaaaaagggccaagggctgctgtctgataaagtgccccaggatggtggcggttggcggtctgcctcctccggacaagggggagaagagctggaggatgaggatgtggagcggataattcaggaatggcagtcccgtaacgagagatatcaggccgaagggtatcgccgatggggtagggaagaggagaaagaggaggagagtgacgcagggagctccgtgggaaggaggcggagaacgctttcagaaagttctgcatgggagtccgtgtcttctcacgacatttgggtgttgaagcagcagctggaacttaacagaccagaccatggaagaaggaggagggccgactccatgtcctcggaatcaacgtgggacgcctggaacgagcgcctcctggaaatcgaaaaagaggctagccgtcgctaccatgccaagagtaagcgcgaggaagccgcagataggtctagcgaagccggatccagggtccgtgaagacgacgaagattctgtagggtcagaggcgagcagcttctacaacttctgttcccgtaataaagacaagctcacggctctcgagcgctggaagatcaagcggattcaatttggtttccataaaaaagatttgggggcaggggattcttccggggagcccggagctgaggaagccgtgggtgagaagaatccaagtgatgtttcactaacggcctatcaggcgtggaagctgaaacatcagaagaaggtagggagtgaaaataaagaagaggtggtggaactgagtaagggagaggactctgcactggccaaaaagagacaacggagactggagctgctggagcgatcccgccagacacttgaagaatcccagtccatggcgagttgggaggccgactcctccacagcttccgggtctataccactttcagctttctggtcagccgatccaagcgtttctgccgatggggatactacaagtgtcctctctacccaatcgcacaggtctcatctttcacaggcagcttctaacatcgctggctgtagcacttctaacccaacaacgccactaccaaacctgccagttggcccaggagatacaatctccatagcatctattcaaaactggatcgctaatgtggtgtccgaaacactggcccaaaaacaaaacgaaatgcttttgctgagccgatcaccatcagttgcctctatgaaagccgttcctgctgccagttgcctcggggacgaccaagtttcaatgttgagcggtcactccagttcatcactcggcggatgtttgttgccccagtcacaggcacgtccctcgagcgatatgcaatctgttttgtcctgtaatacgactctgagctcaccggcagaatcctgcagatccaaggtgcgcggaaccagcaagccaatattcagcctgtttgcggacaacgtcgatttaaaagagctgggtagaaaggagaaagagatgcagatggaactccgtgagaagatgtcggagtacaaaatggaaaagttagcctcagataataaacgtagcagcttatttaagaagaaaaaagttaaggaggatgaggacgacggtgtgggggatggcgacgaagacacagactcagcgatcgggagctttagatatagtagtagaagtaatagtcagaagcctgaaacagatacctgtagctccctggctgtctgcgaccactacgcaagcggaagcagagtgggtaaggagatggatagttctataaataagtggttgtccggcctcagaacagaggaaaagcctccctttcagagtgattggagcggcagctcacgcggaaagtatacacgctccagtctgctccgggagaccgagagtaagtcatctagttataagtttagcaagtcacaaagcgaggagcaggatacatcctcataccacgaggccaacggtaatagtgtccgatcaactagcaggttctctagttccagcacacgcgagggcagagagatgcataagtttagccgctcaacttataacgagacaagcagttccagggaagagtctccggagccctacttctttagaagaaccccagaatcaagcgagagagaggagtccccagagcctcagcgtcctaattgggctaggagccgcgattgggaagatgtagaagaatccagtaaatccgacttcagtgagttcggggcaaagagaaaattcacccaatccttcatgagatctgaggaggagggggagaaggagcgcaccgagaatcgcgaagagggaaggtttgcctcaggacggcgatcgcaatacagacgatccaccgatagagaggaagaagaggaaatggatgatgaggccatcattgcggcatggcggcgtcgccaggaggagacccgtactaaattgcagaaaagacgtgaagattag

SEQ ID NO: 55672 - DNA, 531 bp, Artificial Sequence
  Description of Artificial Sequence: Synthetic coding sequence
atgggcccagccgaagcagggcgtagaggcgcagcttcccccgtcccaccaccactcgtacgggttgctccatccctttttctcggatctgcgcgagccgctggcgcagaagagcagctagctcgggctggagtcactctatgcgtcaacgtttcccgccaacaacccggacctcgggcacctggggttgctgaactccgcgtccctgtatttgacgacccagctgaagatctgttggcccacctagagccgacatgcgctgccatggaagcggcagtgagggctggcggagcctgtctggtctattgcaagaatggtaggagtcggtcagccgctgtttgcactgcctatcttatgaggcatcgcggactgagtttagccaaggccttccaaatggtgaaatccgctaggccggtggccgaacccaatcctggtttctggagccagctccagaagtacgaagaggccctgcaggcccaaagctgtctccagggagaaccccctgctttgggattagggccagaggcttag

SEQ ID NO: 55673 - DNA, 531 bp, Artificial Sequence
  Description of Artificial Sequence: Synthetic coding sequence
atggggcctgccgaagctggacgcagaggtgcagctagtccagttccccctccactcgtccgtgtcgctccttccctgtttctcgggtccgctagagccgcaggagccgaagaacagcttgcccgtgccggtgttaccctgtgtgtaaacgtgtcccgtcagcaaccaggccctcgtgctcccggtgtggccgagctgagggtaccagtgtttgatgatccagcagaagacctgttagcacacttagagcccacttgtgcagccatggaggctgccgtaagagctggaggcgcatgtcttgtgtactgcaagaacgggagatccagatccgcggcagtatgtaccgcctatctgatgcggcacagaggcctaagccttgccaaggcgttccagatggttaagtcggcccgacccgtggccgaaccaaatcccggattttggagtcaactccaaaagtatgaagaagcactgcaggctcagtcatgtctacagggggagccacctgcccttgggctgggccctgaggcctag

SEQ ID NO: 55674 - DNA, 1155 bp, Artificial Sequence
  Description of Artificial Sequence: Synthetic coding sequence
atggaaggcctgggcaggagttgcctgtggctgcgtagagagctaagcccccctcgaccaaggctgcttcttctggattgcaggagccgcgagctttacgaatcagcaagaatagggggtgctctgagtgtcgcactgcctgctttgctacttagacggttgcgtcgcggatcgctgtctgttcgtgctctccttccaggccctccactacagccaccccctcccgcacccgtgctgctctatgaccaaggcggaggtagaagaaggcgtggcgaggccgaagccgaagccgaggagtgggaggccgaatctgtgctgggcacactcctacagaaattaagggaggagggttatcttgcttattacctgcaggggggtttttcgagattccaggcagagtgcccccacttgtgcgaaacttctctggccggtagggctggctctagcatggcaccggtgccaggaccagtcccagtagtggggctcggatcattatgcctcggatctgactgttcggatgccgaatcagaggccgatcgcgactctatgtcctgcggcctggactctgagggggcaacacctcctccagtggggctgagggcatcatttcccgtgcaaatcctgcccaacctttatttaggatccgcgagagattccgccaacctagagtcacttgccaagctcggtatccgttacatactgaatgtaacacctaatctgcctaacttcttcgagaaaaacggagatttccactacaaacagatcccaattagcgaccactggtcccagaatttaagtcggttctttccggaggccatcgaatttattgacgaggctttgtctcagaactgcggcgttctggtgcattgcctggctggggtgtccaggagtgtgacagtaactgtagcatatttaatgcaaaaacttcatctgtctctgaacgatgcctacgatctagttaagcggaagaaatcaaacatatcccccaacttcaactttatggggcaactgctggactttgagcgaagcctacgactcgaggagcggcacagccaggagcaggggtcaggcggacaggcttcagcagcctctaatcctccttccttctttaccacccctacttccgacggcgcattcgaactagccccaacctag

SEQ ID NO: 55675 - DNA, 1707 bp, Artificial Sequence
  Description of Artificial Sequence: Synthetic coding sequence
atgaagtggaaagaaaagctaggggatggcgtatatgacacctttatgatgatagacgaaaccaagtgtcccccttgctccaatgtgctgtgcaatccatcggaaccaccacccccacggaggctgaacatgaccaccgagcagttcacaggggatcacactcagcactttctggacggtggtgaaatgaaagtggaacagctgtttcaagaatttggaaatagaaaatctaatactatccagagcgacggcatttccgattcggagaagtgttcacccacagtgagtcagggcaaaagctcagattgccttaacactgtcaaatcaaactccagctcaaaggcccctaaggtggtccccttaacaccagaacaggctcttaagcagtataagcatcatctcactgcctatgaaaaactggaaatcattaattaccccgaaatctactttgtgggacccaacgcgaagaagcgacacggggtgattggcggtcctaacaacggcggttacgatgacgccgatggtgcatacattcacgtccccagagatcatctagcgtacagatatgaagtcctgaagattattggcaaggggagtttcggccaagtagccagggtgtacgaccacaaactcagacaatacgtggccctgaagatggtgcggaatgaaaagcgtttccatcgacaggcagctgaggagattaggattttggagcacctgaagaagcaggataagactggctccatgaatgtgatccacatgctcgagtcctttacatttaggaatcatgtgtgcatggcttttgagcttctaagcattgatttatatgagttgataaagaagaacaagtttcagggtttctccgtgcagttggtaagaaagtttgcccaatcaattctgcagtcactggatgcactacataagaataaaattattcactgtgatttaaagcccgaaaacattttacttaaacatcacggaaggagctctactaaagtcatcgatttcggatcaagttgtttcgagtatcagaaactgtatacatacatccaatctcgattttatcgcgctcctgaaattatcctcggatcacggtactctacgccgattgatatctggtctttcggatgtatcctcgccgaactgttaacaggccagccattgttcccgggagaggacgagggcgatcaattggcttgcatgatggagctcttaggtatgccacctcccaagcttctggagcaaagtaagcgcgcaaaatacttcatcaattccaaaggaattccgaggtactgctcagttacaactcaggccgacggtcgcgtcgtcttggtgggcggtaggtccaggagggggaagaaacggggtccaccaggatcaaaagattggggcaccgcactgaagggatgtgatgactatttatttatagagtttctgaagcgctgtttgcactgggaccctagcgcccgactcacacccgcacaagccctccggcatccttggataagcaagagcgttccacgtcccctgacaactatagacaaagtgtctggtaagagagtcgtgaaccctgcctcagccttccaggggctgggatcgaagctgccccctgtcgtcggaattgctaacaaactgaaggctaacctcatgagtgagaccaacggtagcatacccttatgcagcgttctcccaaaactgatatcctag

SEQ ID NO: 55676 - DNA, 1767 bp, Artificial Sequence
  Description of Artificial Sequence: Synthetic coding sequence
atgctcccactcttggactccagtaaacgagcgggaactttgggatctggctgtggcgtgccacgagtccacagtgctgccctgtcaagagaagagggcgcatcacgcgatatttggaggatcaaggtgtgggctcgggttatgaccacccccgcaggatcagggtcaggattcggtagcgtgtcctggtggggcctgtcacctgcactagacctgcaggctgagtcacctccagtcgatcctgacagccaggccgataccgttcattcgaatcctgagctggacgtgcttttacttggttcggtggatgggaggcacctgcttcgaactctgtcacgggcaaagttttggccccgacgacgcttcaatttctttgtcttagagaataacttggaggctgtggccaggcacatgttgatcttcagcctggccctggaagagcccgagaagatggggcttcaagaacgaagcgagacctttttagaagtgtggggtaatgctttgctccgacctccagtggcagcctttgtccgtgcgcaggctgatttgttagctcaccttgtccctgagcctgaccgcctggaagagcagctcccctggctctcccttcgtgccttgaaatttcgcgagcgggacgcacttgaggccgtttttcggttctgggcaggaggtgaaaagggccctcaggccttcccaatgtcacggctctgggactcccgcctgcgtcactatttaggatcccgctatgacgccagaagaggcgtctcggattgggatttacgcatgaagctccacgaccgcggtgctcaggtcatccacccccaggagtttcggcgatggcgcgatactggtgttgcttttgagctgagagactcctctgcctaccacgtgccaaacaggacacttgcatcgggcagactactctcctatcggggtgaacgggtagctgctagaggctactggggcgacatcgccaccggaccgttcgtagctttcggtatagaagcagacgatgaaagtcttttaaggacctccaatggtcagcccgtgaagacagcaggcgaaattacacaacataacgtgacggaactattaagagatgtcgctgcctggggcagggcaagagctaccggaggggacctcgaggaacagcaacatgccgaaggttcccccgagccaggtacccccgcagcacccacccctgagtcatttactgtccactttttgccgttggactccgcacaaaccctgcatcacaaatcctgttacaatggccgttttcaactgctctatgtggcttgtggcatggtgcacctccttatcccagagctaggcgcttgtgtcgccccagggggaaacctgatcgtggaactcgccaggtatctcgtggacgtccgccaggagcagctccagggatttaatacacgcgtacgcgagctggcccaggctgctggcttcgctccacaaacaggcgctagacccagcgagacctttgccagattctgcaagagccaggaaagcgctttaggaaacactgtgcccgcagtcgagcccggtactccaccactcgatatcctcgctcaacctttggaggcctcaaatcctgctctggaaggccttacccagcccctacaaggcggaactcctcattgcgaaccttgtcaactcccctcagagtcccccggatcactgtccgaggtactggcgcagccacagggcgctctcgctcctccaaattgcgaaagtgatagtaagacgggcgtgtag

SEQ ID NO: 55677 - DNA, 1827 bp, Artificial Sequence
  Description of Artificial Sequence: Synthetic coding sequence
atgctacccctgcttgatagctctaagcgcgcaggaacactggggtccggatgcggggtgcctagggtgcatagcgcagcactctcccgagaggaaggtgcttccagagacatttggagaataaaggtgtgggccagagttatgaccacacccgcaggtagtggatctggattcggtagcgtcagctggtgggggctgtcaccggcactggatctacaggcagagcgggacgctaccgtagacgcactgccaacaactatggtgcctcaaccagccgtgatcctgccagggccaccagttgaccctgattcccaggctgatacagtccacagtaatcccgagttggatgtcctcctgctgggtagcgtggacggaaggcatctgctgcgaaccctgtccagagcaaagttctggcccaggagacgtttcaactttttcgtgcttgaaaacaacctagaagcggtggccaggcatatgttaattttcagtcttgctctggaagaacccgaaaaaatgggcttgcaggagaggtcagaaacattcctcgaggtgtggggtaacgcgttgttacgccctcccgtagccgcttttgtgagggcacaagcagatctcctagcgcatctagtgcccgagcctgaccgcttggaggaacagctgccctggctgtccctccgtgcccttaaatttcgcgaacgggacgccctcgaagcagtgttccggttctgggccggaggagagaaaggcccacaggccttccccatgagtagactttgggacagccgacttagacattacctcggtagccgctatgacgccagacgcggtgtgtcggattgggacttgcgaatgaaactgcatgaccgaggtgcccaggtgattcatcctcaggagttccggcgatggagagataccggcgtcgctttcgagttgcgggattccagcgcataccatgtgccgaatcgcaccctggcttctggaagactcctttcttatcggggtgaacgcgtcgctgccagagggtactggggcgacattgccaccggcccattcgtggcgtttggtatagaagcggacgatgagtccctgctacgcacatccaatgggcagcccgtgaagacggccggtgaaattactcaacacaatgttacagagctgctgagagatgttgcagcttgggggagggcccgtgctaccggcggtgatctggaggaacagcagcacgcggagggtagtcctgagccaggtaccccggctcctacgcctgaaagctttaccgttcactttctcccattggatagtgcccaaacgctccatcacaaatcttgttataatggcagatttcagctgctctatgtggcttgcgggatggtgcacctgctaattcctgagctcggcgcttgcgtcgcacctggaggaaacctcatcgtggagttggcccgttatctggtcgatgtgcgccaagaacaactacaagggttcaacacccgggtgcgagagcttgcacaggctgcagggtttgccccacagacaggcgctaggccgtctgagactttcgccaggttctgcaagagccaggagtcagcactgggcaatactgtgcccgctgtggaacccggaactccccctcttgatattctcgctcagccactggaggcctcaaaccccgcacttgagggcctgactcagcccctgcagggcggtactcctcactgcgaaccctgccaattgccatcggaatcaccgggttcactctctgaggtgctggctcagcctcagggggctttggccccacccaactgtgaaagcgactcaaaaacaggagtgtag

SEQ ID NO: 55678 - DNA, 288 bp, Artificial Sequence
  Description of Artificial Sequence: Synthetic coding sequence
atgactaccccagcgggttccggatccgggttcgggtcagtctcttggtggggcctcagcccagcgcttgacctccaggccgagagtccaccagtggatccagactctcaggcggacactgttcactcgaaccctgaactggatgtcctcctgcttgggtcagtggacggtcgtcacctcttgcgaacgttatcgagggccaagttctggccccgtcgaagattcaacgtcagctgggatgaagacgagtccccagattctagagtgttggaagggggtcgcgactag

SEQ ID NO: 55679 - DNA, 9278 bp, Artificial Sequence
  Description of Artificial Sequence: Synthetic coding sequence
atgtcagatgccaataaagcggcaattgcggcagagaaagaggcattaaacttaaaactcccaccgatcgtccatctgccagagaacatcggtgtcgatactccaacacagtccaagctcctgaagtacagaaggagcaaggaacagcaacagaagataaatcagctggttatagatggcgcaaagcgcaatctggacagaacgctgggaaagaggacacccttattacctccaccggactacccccagaccatgacttctgagatgaaaaaaaagggctttaactacatatatatgaagcagtgcgtagagagcagtcctctggtgccaatccagcaggagtggctggaccatatgctgcggcttattcctgaatccttaaaggagggcaaagagcgtgaggagttgctggagtccttgattaatgaagtgtcttcggattttgagaatagcatgaagcggtatctagtgcagagcgtgctggtcaagccccctgtgaaaagcctggaggacgaaggaggcccactgcctgagtcacccgtgggactggactatagtaacccctggcactctagctatgtacaggcacgtaaccagatcttcagcaatttacacatcatacaccccacaatgaagatgctcttggacttggggtacactactttcgctgatacagtgctcctcgactttacgggtatccgcgcaaagggacctattgattgcgagtctctgaaaactgatctctctatccagacacgcaacgccgaggagaaaattatgaacacctggtatccaaaggtgatcaatttgttcacaaaaaaggaagcactcgagggtgttaagccggaaaagctggatgcgttctacagctgcgtttccaccctgatgagcaaccaactcaaagatctgctgaggcggacggtggaaggatttgtaaagttattcgaccctaaggaccagcagaggctcccaatctttaaaattgagctgactttcgacgatgataagatggagttttacccaacattccaggatcttgaggacaacgtgctctctctggtagaacggatcgccgaagcactccagaacgtccagactatcccatcctggttgagtggcacttcgacgcctgtcaatctcgataccgaattacctgaacacgtgctgcactgggccgtggatacgctcaaggcggctgtgcaccggaatcttgagggggcaaggaaacattatgagacctatgtcgaaaaatataactggctgttggacgggaccgccgtggaaaatatcgaaacgtttcagacagaagaccataccttcgatgagtacacagaatttattgagaaatttctctccctcgcctcagaaattatgcttctaccccaatggattcactacactatggtccgcctggactgcgaggatctgaagacaggactgaccaataaagctaaggcattcgctaatatactattaaatgacatcgcaagcaaataccgcaaagaaaacgagtgcatatgctctgagtttgaagctattaaagagcacgccctgaaggtgcctgagacaacagaggagatgatggacctgattagttatgtggaaaaagctagaaccgtggggattgaggagctgattctgcgaattcaagaatctaagcgtcagatgagctatttcctggatgttttcttgttcccccaagaggacctggcattaaacgctactgttcttatgtggccccgtaagatcaatcctatattcgatgagaatgatgaactgatcgaaaatgccaagcataaaaaggagaacgaactcatggcaaaacgggaaaaattgatccttgagattgagaaagagtctcgccgaatggaagaatttacagaatttgctgagctggagcgaatgcaacagtatgttacagacgtgaggcagctgcagaaaagaatccaggaatctgaggaagctgtacaattcattaacaaggaggaagaactcttcaaatgggaattaaccaagtaccctgagttagacaaactgaaggtgaatatagaaccttaccagaagttttttaactttgtgctgaaatggcagaggagtgagaagcggtggatggatggagggttcctggatttaaatggtgagtcaatggaggcagacgtggaggagttcagtcgggagatttttaagacgctgaaattctttcagaccaagcttaaaaaagaattacaagaaaaaagaaaggccgctcgtaaaagaagcttggaggaagaaaagatcgaggaagagccaaaagacaacgcgaccatcaccatgtgcaggatgcgcgctcgccattggaagcagattagtgaaatcgttgggtacgatcttactccggactccgggacgactttacgcaaagtgctcaagttaaatcttacaccctacctggagcagtttgaagtaattagcgcaggcgctagtaaagagttcagcctggagaaagctatgaacactatgatcgggacttgggaggacattgcgttccatatctctctgtacagggacacgggggtttgtatcctttccagcgtcgacgagatccaggccatactggatgatcagattatcaaaactcagacaatgagggggtcgccatttatcaagccatttgaacacgaaataaaggcgtgggaagacaggctcattagaattcaggaaaccatcgacgaatggcttaaggtccaggctcagtggctgtaccttgaacccatcttctgcagcgaagacattatgcagcagatgcccgaagagggcagacagtttcagacagtagaccgccattggcgcgacatcatgaagttttgtgcaaaagatcctaaggtcctggcagcgacttcacttacaggccttcttgaaaagctccagaattgtaatgagctgttggaaaagataatgaagggcctcaacgcttacctggaaaagaagcgccttttctttcccagattctttttcctttccaacgatgagatgttggagatcttgtctgagactaaggatcctttacgtgtccaacctcacctcaagaagtgctttgagggtattgctaaactggagtttctacccaacctagacatcaaggctatgtattcttcagagggtgaaagggtggaactaatcgctctgataagcacctcagccgctcggggagccgtggaaaaatggctgattcaggttgaagacctgatgttgagaagtgttcacgacgttatcgcggctgcaaggctggcatatcctgagtctgcgagacgggattgggttcgcgaatggcctggacaagtggtactctgcatttctcaaatgttctggacctcagaaactcaggaggtgatcagcggaggtaccgaaggactcaagaagtactacaaggagttgcagaatcagttaaatgagatcgtggagctggtgcggggaaagctcagcaaacagaccaggacaaccctgggggctcttgtcaccatcgacgttcatgccagggatgtagtcatggacatgatcaagatgggggtgtcccacgacaccgatttcctgtggctagcacagctcaggtattactgggaaaacgagaatgctcgcgtcaggattattaattgcaatgttaagtacgcctatgagtaccttggcaattccccgaggttagttatcaccccacttaccgacagatgctatcgcaccctgattggcgctttctatttgaatttgggaggcgcacccgaaggacccgcaggtaccgggaaaactgagaccacgaaggatttagcgaaggctctggctgttcagtgtgtcgtgttcaactgcagcgatggcctggactacctggccatggggaagttcttcaaggggctagctagtagcggcgcatgggcttgctttgacgagtttaatagaatcgagctggaggtgctaagcgtggtcgcccaacagattctgtgtatccagagagcaatacagcagaaattggtggtattcgtgtttgaggggaccgagctgaagctgaacccaaattgctttgtggctataacaatgaatccaggatacgctggacggagtgagctacccgacaacctaaaagttctgtttaggacagtcgccatgatggtgccgaattacgcgctgattgccgaaattagcctttatagttatggatttttaaacgccaggcccctttctgtgaagatagttatgacataccggctgtgcagcgaacagctgtcttcgcagttccactacgattatggcatgagggcggtcaaggcagtgctggtcgccgcaggaaatctgaaactgaagtatccaaatgagaacgaagacatcctcttgctacgcagtatcaaagacgtgaatgagcccaagtttctttcccatgatatccctttgtttaacggcatcacaagtgacctatttccaggcatcaaattgcccgaggctgactatcatgagtttcttgagtgtgcccacgaggcttgcaatgtgcacaatctgcagcctgttaaattcttcctagagaaaattatacaaacttacgaaatgatgatagtcaggcacggtttcatgctcgtcggcgagccctttgctgcaaagacaaaagttctgcatgtgttggccgatacgctgaccctgatgaatgagcacgggtacggcgaggaagaaaaggtgatttaccggaccgttaaccctaaatcaataactatgggccagctctttggccaatttgacccagtgtctcatgaatggaccgatggcatcgttgcgaatactttcagagaatttgccctgagtgagacccccgacagaaagtgggtcgtgttcgacgggcctatcgatacactgtggatcgaatcaatgaacacagtcctggacgacaataagaagctgtgccttatgagcggtgaaatcatccagatgtccccccagatgagcctgatatttgaaaccatggatctgtctcaggcctcccccgctaccgtgtcgagatgcggcatgatttatctcgagccatctcagctggggtgggagcccctcgtcagctcttggctgaatagtctgaagggtccgctatgcgagccggagtaccaagccctgttacgtggcctgttcgcatggctcatccccccttctctcaaccaaagggtcgaactattccagctgaactacctgtatacgacaattgttagcaaaattctaaaaatattaatcaccttccggatcagcaactacttcaagtacgttcctctcaagactcagtgcaccttcatcaagttctttctccaccagcaggcttgttttatctttagcctcatttggtctatcggcggttcctgtgatacagatggcagacgagtctttgatacattcatccggctcatcatcctcggtaaagacgacgaaaaccccgttcccgacagcgtaggaaaatgggaatgcccttttgacgagaagggactcgtgtacgactacatgtatgagttgaaaaataagggaaggtgggttcactggaatgagcttatcaagaatactaacctgggcgacaagcagatcaagattcaggacatcatcgtgccaaccatggacacgatccgatatacattcttgatggacttgagtatcacgtatgccaagcctttgctgttcgtggggcctactggcaccggaaagagtgtgtatgtcaaggataagctaatgaaccacctcgagaaggatcagtattttcccttttacatcaacttgtcagctcggacgagcgcaaaccaagtgcagaatatcatcatggctcgattggacaagcggcgtaagggggtgtttggccctcccatgggtaaaaaatgtatcatattcatcgacgatatgaatatgcccgcactcgaaaagtacggtgcccaacccccaattgagctccttaggcagttctttgactgcgggcactggtacgaccttaaagacaccagcaagatcaccctggtggatattgaactgatcgctgctatgggaccacctggtggtggaaggaacccggtgacccctcgctgcattcgccactttaacatttgctctatcaactctttttcagatgagacaatggtgcggatctttagcagcattgtcgctttctatttgcgcactcatgagtttccgccagagtattttgtgattggcaaccagattgtgaacgggacaatggaaatttacaagcagtctgttgaaaacctcctgcccacacccacgaaatcgcactacactttcaatcttagggactttagtagagttattcgcggttgcctgctaattgaacgagatgcggtcgctaacaagcatacaatgatcaggctcttcgtgcatgaggtactaagagtgttctacgaccgtctgattaacgacgacgacaggagatggctgttccagctcactaagactgtgatcaaggatcactttaaggaaagctttcactcaatcttcagccaccttcggaaacagaacgcgcctgtaacagaagaagacttgagaaatctgatgttcggtgactacatgaaccctgacctagaaggtgacgatcgagtgtatatcgaaatacccaatatccaccacttctctgacgtagtcgaccaatgcctggacgaatataatcaaacgcacaagacccgcatgaacctggtgattttcagatacgtgctggaacacttgtccagaatctgcagagtccttaaacagtctggcggtaatgcacttctcgtggggctggggggatcaggcagacagtctcttaccagacttgctacatccatggccaaaatgcatatatttcagcccgaaatttcaaagagctacggcatgaacgagtggagagaggacatgaaatcatttattgccgtgccggtgacaaacagaatcgtagataacaagagcaagattttagagaaacggctgaggtacctcaatgaccactttacatacaacctttattgcaatatctgtcgttccctgttcgaaaaggacaaactcctgttttcatttcttctgtgcgctaatctactgctggcgagaaaggagattgaatatcaggaattgatgttcttgctcaccggaggggtcagcctgaaatcagcagagaaaaaccccgaccctacgtggttgcaggacaagagctgggaagagatctgccgcgcttctgaatttcctgcatttcgcggactgcgtcaacatttttgtgagcacatttatgagtggcgagagatatacgactcaaaggagccacataacgcaaagtttcctgcacctatggataagaacctgaatgagcttcaaaaaatcattatccttagatgcctgcggcctgacaagattacgcctgctatcaccaattatgtaacggacaagctggggaagaaattcgtcgagccaccaccattcgatctgaccaagtcttatttggattccaattgcacaatccctttgatttttgtgctgtccccgggtgccgatccgatggctagcctgctgaaatttgcaaatgacaaaagcatgtccggaaacaaatttcaggcgatcagtcttggacagggacagggacccatcgctgcgaagatgatcaaagctgccattgaggagggaacttgggtgtgtctgcagaactgccatctggcggtgagctggatgcctatgctagagaaaatttgcgaggactttaccagcgagacatgcaactcttcatttagactctggttgactagctacccatcaagtaagtttccagtgaccatattgcagaatggagtgaagatgactaatgaacccccaaccggtctgcggctgaacctcctgcaatcctacttgaccgatcccgtgtccgatccagaattttttaaaggttgcagagggaaggagcttgcttgggaaaagctgctctttggagtctgcttttttcacgccctggtgcaagagcgtaaaaagttcgggccactcggctggaacatcccatatggcttcaatgagtccgatcttcggatatcgatccggcagctgcagttattcattaatgagtacgatactatccccttcgaggccatctcatatctgaccggggagtgcaactacggcggtcgcgtgacagacgattgggatcggaggcttctcctgacgatgctggctgatttctataacctctacatcgtggagaacccacactataagttcagtcctagcggcaactacttcgccccaccaaagggcacttacgaagactatattgaattcatcaaaaagctgccgtttacacagcacccagagatcttcggactgcatgagaatgtggacatttcaaaggacctgcagcaaaccaaaacactttttgaaagccttctacttacacagggcggatctaagcagacgggggctagcgggtctactgaccagattctgttggagatcaccaaagacattctgaacaagttgcctagcgactttgacattgagatggctcttcggaagtatccagtaaggtacgaagagtcaatgaacactgtcctcgtccaagagatggagcgttttaataaccttatcatcacaatccggaacactttacgggacctggagaaggccatcaagggcgttgttgtgatggattctgccctggaagcactgagcggtagccttctggtcgggaaagtgccagagatatgggccaaacgaagttatccctcactgaaacccctcggatcatacattacagattttctggccagattgaatttcctgcaggattggtataattctggaaagccgtgtgtgttttggttgagtggattcttctttacccaagccttcttgactggcgctatgcagaactacgccagaaaatacaccaccccaattgatctcttaggctatgagttcgaagtgataccaagtgacacatccgacacaagccctgaggacggcgtgtacattcacggcttgtatttagatggcgcaaggtgggaccgagagtccgggttgttggccgagcagtaccctaagctgctttttgatcttatgccaattatttggataaaacccactcagaaaagtcgtattatcaaatctgacgcatatgtatgtcccctgtataaaacctccgagcgcaaaggaaccctgtctacgaccggccattcaacaaatttcgtaatagctatgctgctgaaaacagaccagccaaccaggcattggattaagcgaggggtggcgctcctgtgccagttggacgacta

SEQ ID NO: 55680 - DNA, 13374 bp, Artificial Sequence
  Description of Artificial Sequence: Synthetic coding sequence
atgactatggccccagacgtgcggctggaatatctggaggaagtcgctagcattgttctgaagtttaagccagataaatggtccaagctgattggcgctgaagagaacgtggctctcttcactgagtttttcgagaaaccagacgttcaggtccttgtgttgactctcaacgccgcaggcatgatcatcccgtgcttgggatttccccagtctctgaagtccaaaggggtatactttatcaaaacaaaaagtgagaatatcaataaggacaactaccgagcgagactcctttacggcgatatctcccctactcccgtcgatcaattgattgcggtggtcgaggaggtcctatcgagcctcttaaaccagtcggaaaatatggctggatggccacaggtcgtgtccgaggacattgtgaagcaagttcatagattaaagaacgagatgtttgtcatgagcggaaagatcaaaggaaagactctgctgccaattccagagcacctaggttctctcgatgggacattagagtccatggagcgtattcccagctctttggataacctgctgctgcacgccatcgagacgaccatcatcgactggagccaccaaatacgcgacgttttgagtaaggactctgcacaggctttgctggatggactgcatcctctgcctcaagttgaatttgagttttgggatacacggcttctgaaccttaagtgcatccatgagcagctgaatagacccaaggtaaacaaaatcgtcgagattttggaaaaggcaaaaagctgttactggccagccctgcagaatgtctacacaaatgtcaccgaaggactgaaggaagctaacgacatagtgctgtacctcaagcctctaaggatcctgctcgaagaaatggagcaagcagattttactatgctcccgacgttcattgccaaagtgctggataccatctgtttcatctgggcaacgtctgagtattacaacacaccagctcgtattatcgtgattttgcaggagttttgcaaccagattatcgagatgacccggacttttctgtcccccgaggaagttctgaagggactccagggagagattgaggaggtgctatctggtatcagcttggcagtaaatgttctgaaggagctttaccagacatacgacttctgttgcgttaatatgaagctgttttttaaggataaagagcccgtgccttgggagtttccgtcttcactagcctttagtcgcatcaacagttttttccaacgaatccagaccatcgaggagctgtacaaaacggctatcgagtttctgaaacttgaaaaaatagaattagggggagtaagaggcaacttgttgggcagccttgtgacccgcatttatgatgaagtgttcgaactggtgaaagtgttcgcagactgtaagtacgacccgctagatcccggtgatagcaacttcgacagggattatgcggacttcgagattaaaatacaggatctcgacaggcgtctggccactatcttctgccagggatttgacgattgttcctgcatcaagtccagtgctaagttgctgtacatgtgtgggggacttatggagagacccctgattctggccgaagtggcccctaggtactctgtgatgctggaattatttgatgccgagcttgataacgcgaaaattctttatgacgcgcagatggccgcatccgaggaaggtaacatcccactgatccacaaaaatatgcctcccgtagccggtcaactgaaatggagcttggagttgcaagaacgactcgaggtatccatgaagcacctaaaacacgtcgaacacccagtaatgtcaggcgcagaggccaaactgacgtaccaaaaatatgatgagatgatggagctgctgcggtgccacagggagaaaatctatcaacagtgggtcgccggagtagatcaggactgccattttaacctgggacagcctttaatactcagagatgctgcttctaatttgatacacgtgaacttttctaaagcgcttgtggctgttctgcgagaggtgaaatatttaaattttcagcagcaaaaagaaatccccgactccgccgagtcactgttcagcgaaaatgaaacctttcgcaagtttgtgggcaacctcgaactgattgtcggctggtacaacgagattaaaactatagtgaaggctgtcgagttcctcctcattaaatctgagttggaagccattgatgttaagcttctgtctgccgagaccaccctattctggaacggtgaaggtgtgtttcagtatatccaggaggtgagagaaatcttgcataacttgcagaacagaatgcagaaagcgaaacaaaacatcgagggtataagtcaggcaatgaaggactggtcggcaaacccattgtttgagcgaaaggataataagaaggaggctctcttagacttggacggcagaatcgccaatctgaacaaacggtatgctgcggtgagagacgctggggtcaaaattcaagccatggtggcagagaacgcagagcttttcagagctgacacactttctcttccttggaaggattatgtcatatacatcgacgatatggtactcgacgagttcgatcagtttatccgcaaaagccttagcttcttaatggacaatatggaatctattgcccctctctttgagattagaatggagctcgacgaggacggcctaacattcaacccaaccctggaggtgggatctgaccggggtttccttgcactgattgaggggttggtgaacgatatttacaatgtggcaagacttatacccagattagcgaaggatcggatgaactataagatggatttagaggacaatacagatcttattgagatgcgggaggaggtgtcttctctcgtgatcaacgctatgaaggaagcggaggaataccaggactcgtttgagcgatactcttacctgtggaccgacaacctgcaggaattcatgaaaaattttttgatatatgggtgcgcagtgaccgcagaggatcttgatacctggactgacgacacgattccgaagaccccccctacactcgcccaattccaagagcagattgatagttacgaaaagctctatgaagaagtttccaagtgtgagaacacaaaagttttccatggctggctccagtgtgattgccggccattcaaacaggcacttctctcaactatccggcgatggggatttatgtttaagagacacctgtcgaatcacgtgacaaattctctggccgacctggaagccttcatgaaagtggcgagaatgggtcttacaaagcccctgaaagagggtgactacgacggtttggtagaggtcatggggcatcttatgaaagtcaaggaacggcaggccgctaccgacaatatgttcgagccactgaagcagacaatcgagctcctcaaaacgtacggggaagagatgccggaagagatacacctaaaattgcaggagctccctgaacactgggctaacacaaaaaagcttgctatacaggtcaagctgactgtcgcacctctgcaggctaatgaggtctcaatactacgccgtaagtgccagcagttcgagctgaaacagcacgagtttcgagaaaggttcaggcgtgaggcccctttttcattctccgatcccaacccctataaatctcttaataagcaacaaaaaagtatttctgcgatggaaggcataatggaggccctttccaagtccggaggcctgtttgaggtgcctgtgcccgactataaacagttaaaggcttgtcaccgggaggtcagactcttgaaggaactatgggatatggtggttgttgtcaacacctcaatcgaggactggaaaaccactaaatggaaggacatcaacgtcgagcagatggatatcgattgcaagaaatttgcaaaggatatgaggtctctggacaaggagatgaagacttgggacgcgtttgttggcctcgacaatacggtgaagaacgttatcacttcccttagagcagtgagtgaactccagaaccccgctataagagagcgacattggcagcagctgatgcaagccacccaggtaaaattcaaaatgtccgaggagacgaccctggccgatttgctacagctgaatctgcactcctatgaggatgaggtccgcaatattgtagacaaagctgtgaaagagagtggcatggaaaaggtgctgaaagccctggacagcacatggagcatgatggaattccagcacgaaccgcacccgcgaacaggaaccatgatgctgaagtccagcgaagtgttggttgaaaccctggaggataatcaggtgcagcttcagaatctgatgatgagcaaatatctggctcacttcctaaaggaggtaacatcctggcagcagaaactcagcaccgccgactcagttatctccatttggttcgaggttcagcggacctggtcccacctggagagcatttttatcggaagcgaagatattaggacccagctgccaggcgactctcagcgctttgatgatatcaaccaagagtttaaggcattgatggaagacgctgtgaagaccccgaatgtggtggaggctactagcaagcctgggctgtataacaagctcgaagctctcaagaagtctctggccatctgcgagaaggccctggcagagtatcttgagaccaagagactagcgtttccgaggttctatttcgtgtctagcgccgaccttctggatattttaagtaacggcaacgatcctgtcgaggtcagccggcacctttctaaacttttcgactccctctgtaagctgaaatttcgcctggacgctagcgacaaaccattaaaagtaggactcgggatgtactccaaagaggacgagtacatggtgtttgaccaggagtgcgatctgagtggccaagtggaagtttggctgaatagagtgctcgaccggatgtgcagcacactgagacacgagatacccgaggccgtggtgacctacgaggagaaacccagagagcagtggattctggattaccctgctcaggtggccctcacctgcacgcaaatctggtggaccactgaggtgggactggctttcgctaggctggaggagggctacgagaacgccattagggactacaacaagaagcagatcagtcagctgaacgttttaattaccctgctgatgggtaacctgaacgctggagaccgcatgaaaatcatgacaatctgcaccatcgatgtgcacgcccgagacgtagtggcgaagatgattgtcgtggagtcatcacaggcttttacgtggcaggctcagctccgacacagatgggatgaggaaaaacgacactgcttcgctaatatctgtgatgcacagatacaatattcctatgaataccttggaaatacccctcgtctggtaattacacccctgacggataggtgctacattaccctgacacaatctctccatctcatcatgggtggggcacccgctggtcctgccggtactggaaaaacggaaaccactaaagacctgggtagggctctggggacgatggtatacgtattcaactgctcggagcagatggactataagagctgtgggaatatctacaagggtctggcccagaccggcgcttggggatgcttcgacgagtttaaccgcatttctgttgaagtgctcagcgtcattgctgtccaagtgaagtgcgtccaggatgccattcgtgctaaaaagaaggctttcaacttcctgggtgaaataattggcctgatccccacagtgggaatcttcattaccatgaatccgggatacgccggaagagccgagctgccggagaaccttaaggcgctgtttagaccatgcgccatggtggtaccagatttcgagcttatttgcgagattatgttaatggccgaaggattcctggaagcccgtttgttggctagaaagtttatcacactgtatacgctctgcaaggaactcttaagcaagcaggatcactatgactgggggctgcgtgccatcaagagtgtgcttgtggttgccggaagcctgaagaggggcgatccttctagagcagaggaccaggtcctcatgcgggctttgagagattttaacattccaaaaatagtgaccgatgacttacctgtgttcatggggctaattggggatctgttccccgcactggacgtgccacgcaagcgggacctgaacttcgagaaaatcattaaacagtctatcgttgaactaaaactgcaggccgaggacagcttcgtgttaaaggtagtccagctagaggagctccttcaggttagacatagcgtgtttatagttggcaatgctggaagcgggaaaagccaagtgttgaagtcccttaataagacataccagaacctgaaaagaaagcctgtagccgtggatttggacccaaaagctgttacatgtgatgaactttttggcatcatcaatccagtgaccagagagtggaaggatggattgttctccaccatcatgagagacctggcaaatattacccacgacggtccaaaatggatcatcctcgatggcgacattgatcctatgtggatcgaaagcctcaacacagtgatggatgataacaaggtgttaactctcgcaagtaacgaacgcattccgttgaataggacaatgagactcgtctttgaaatcagtcatctgcgcacggctacgccggcaacagtaagccgggcaggcattttgtatataaatcctgccgatctgggttggaaccctgttgtgtcctcttggatcgagaggcggaaggtacaaagcgagaaggctaatctgatgattctctttgacaaatacttaccaacctgtctcgacaagctgagattcggttttaaaaagattacacctgtgcccgaaatcaccgtaattcagacaattctttacctgcttgaatgcctcttgacagaaaaaaccgttccacccgattctccgagggaactgtacgagctctacttcgtgtttacatgtttctgggcttttgggggtgccatgttccaggaccagctggtggactaccgtgtggagttcagcaagtggtggattaacgagttcaaaactataaaattcccgtcccagggaacaatatttgactattacatagatccagacaccaaaaagttcctgccgtggaccgataaggtgccgagctttgaactggaccctgacgtgccattgcaagcttcattggtacacactaccgaaactattaggatcagatacttcatggacctgctgatggagaagtcttggcccgtgatgcttgtcggaaatgcaggaactggtaagagcgtgctcatgggcgacaaattagagtccttgaacacggacaactacctcgtacaagccgttcccttcaacttttatacgactagtgccatgctgcaaggtgtgctggagaagccattggaaaaaaaaagtggtcggaactacgggccacccggtactaaaaagctggtatatttcatagatgatatgaacatgcccgaggtggacaaatatggtacagtcgctccccacaccctcattcgccaacatatggatcatcggcattggtacgatcgtcacaagctcacgctgaaggatattcataactgtcagtatgtggcttgtatgaatccaacctctggcagcttcaccattgacagccgcctccagcgacacttctgtgtgtttgccgtctcatttccaggacaggaggctttgaccacaatttacaatacgatactcacgcaacacctggcttttagaagcgtgtccatggctatccaacgcatctccagtcagctggttgctgcagcgctggctctacatcagaaaatcacagccactttcctccctaccgcaataaaattccactatgtgttcaatctgcgcgacttgagcaatatttttcagggcctgctgttcagcaccgcagaggtgcttaagacaccactggatctggtccgcctgtggctacacgagacagaacgcgtatatggagataaaatggtggacgagaaggatcaagaaacacttcacagggtcacgatggcgtccaccaagaaattcttcgacgacctgggtgatgaattacttttcgctaagcccaacattttctgccattttgcccagggtatcggcgatcccaagtatgtcccagtgactgacatggccccactgaataagctcctggttgatgttctggacagttacaatgaagtgaacgcagttatgaatctggtgcttttcgaggatgctgtggcacatatatgcaggattaaccggattctagagtctccacgaggtaatgccttgctggttggcgtgggaggctctggtaaacagtctctgagccggctggccgcttatatttccggtctggatgtctttcagattacgctgaagaaggggtatggcattccagaccttaaaatcgacctggccgcacagtacattaaagcggcagtgaagaatgtgccctcagtgtttctgatgacagatagccaggtggctgaagagcagtttttggttctcatcaatgacctccttgccagcggtgagatcccgggtctgtttatggaggacgaggttgaaaacatcatatcctccatgaggcctcaggtgaagtcccttggtatgaatgatacacgggagacatgttggaagtttttcatagaaaaggttagaaggcagttaaaggttatactgtgctttagtcctgtgggctcagtgctgcgcgtcagagccagaaaatttcctgctgttgtaaattgcacagccatcgattggttccacgaatggccagaggacgccttagtaagcgtttcagcaagatttctggaggaaacggagggcatcccctgggaggtaaaggcctctatttcgttctttatgtcctatgtgcacacaactgttaatgaaatgagcagggtgtacctggcaaccgagagacgctacaattacactaccccaaaaactttcctcgagcagatcaaactgtatcagaatctgctggcaaaaaagcgaacagagcttgtcgccaagattgagaggctggagaacggactgatgaagttgcagagcaccgcgagtcaggtcgacgacctgaaagctaaattagccatccaggaagccgaattgaaacaaaaaaacgagagtgcggatcagctcattcaggtggttggcatcgaggccgagaaagtctcaaaagaaaaagccatcgctgaccaggaggaggtaaaggttgaggtcatcaacaagaacgttactgagaagcaaaaggcttgcgagaccgacctggcaaaggctgagccagctctgctggctgcccaggaggccttagacacgctgaacaaaaataatttgacagaactgaaatccttcggatcacctcctgacgccgtggtaaacgtcaccgctgctgttatgatcctgacagcccctggcggaaaaattcctaaggacaagtcttggaaggccgctaagatcatgatgggtaaagttgacacattcctcgattcccttaagaagttcgacaaggagcacattccagaggcctgcctaaaggctttcaagccttatcaggggaacccaacttttgatcctgaatttatcaggtcaaaaagtaccgcagcagccggtctttgcagttggtgcatcaacatcgtacgattctatgaggtctattgtgacgtggctcccaagagacaggccctggaggaggccaatgccgaactcgcggaggcccaggagaaactgagtcgtattaaaaataagatcgcagagttgaatgccaatctgtcaaacttgacaagcgcttttgagaaggctacagcagaaaagatcaagtgccagcaggaagctgatgcgaccaacagggttatactactggctaatcggctcgttggaggattggcttccgagaatattcgatgggccgaatccgtcgagaacttcaggtcacaaggagtgacgctctgtggagatgtgcttcttatcagcgcttttgtctcttacgttggttacttcacaaagaagtatcggaacgaactcatggaaaagttttggatcccatacatccataacctcaaagtccctatcccaatcactaacggcctcgatcctttgagcctgttgaccgatgacgcggatgtggcgacttggaacaaccaagggcttcccagcgatagaatgtccacggaaaacgccacaattttgggtaacaccgaaaggtggccactcatcgtcgacgcccagttgcagggcataaagtggattaaaaataaatacagatctgaattaaaagcaattcgtttaggccagaagagctacttagacgtcatcgagcaggccatttctgagggagatacattactgattgagaatatcggggaaaccgtcgaccccgtgctggaccctctgttgggacgtaacaccattaagaagggcaaatacatcaagattggcgataaggaagtggagtatcacccgaagttccggctaatcctccatactaaatactttaacccacactacaagcccgagatgcaggcccagtgcacactgatcaattttctggtgacaagagacggccttgaggaccaacttcttgctgctgtggttgccaaggaaagaccagaccttgagcagctgaaggctaacctcaccaaaagccagaacgagtttaaaatcgtgctgaaagaactcgaggatagcctgctagccaggctgtcagccgcaagtggcaatttcctcggggatacagcacttgtagaaaacctcgaaaccaccaaacacacagcgtctgaaattgaagaaaaagttgtggaggctaagattactgaagtcaaaattaatgaggccagagaaaactatcgacccgcagctgagcgggcttctctgctgtacttcatcctgaacgatctcaacaaaatcaatcccgtataccagttctctttgaaggcatttaatgtcgttttcgagaaagctatacagcgcaccacaccagctaacgaagtgaagcagcgcgtgataaatttgaccgacgagatcacatacagtgtttatatgtatacagccagagggctcttcgagagagacaagctgatctttcttgcacaggttaccttccaggttctatccatgaaaaaagagctgaaccctgtggagcttgatttcctgttacggttcccatttaaggcgggtgtcgtgagcccggtcgacttcttgcagcaccaagggtggggcggaattaaggccctgagcgagatggacgaatttaagaatctggattcagatatcgagggaagcgccaagcgatggaagaaattggttgaatccgaagcccctgagaaagaaatttttcctaaggaatggaaaaacaaaaccgcgttacagaaattatgcatggtaaggtgcctcagaccggacagaatgacatatgccattaagaacttcgtggaggagaaaatgggtagcaaatttgtggaaggacggtcagttgaattcagtaaatcttacgaggaaagcagcccgtctacgagtatcttttttatactctccccaggggtggatcccttgaaggacgtggaggctttaggtaagaaactgggcttcacaatagataacggcaagctacataatgtgagcctaggacaaggtcaggaggtggtggccgaaaacgccttagacgtggccgcagaaaaaggtcattgggttattctgcagaatattcatttggtggccagatggttgggcactctggataaaaagctcgagcattattctaccggatcccacgaggactatcgggtgtttatttctgcagaaccagccccatccccagagacacatatcatcccacaaggaatactggagaatgccattaaaatcactaatgagccacccacaggaatgcacgccaacctgcacaaagcactggacctatttacacaggatacactggaaatgtgcaccaaggagatggagttcaagtgtatgctcttcgctctctgctactttcacgcagtggtggccgaaagacgcaagttcggggcacagggatggaatcggtcataccccttcaacaacggcgatctgacaataagcattaacgttttgtataattacctcgaagcaaaccccaaagtcccttgggatgacctccgatatctctttggggagattatgtatggtggacatatcacggacgattgggaccggagactgtgtcggacctatcttgccgagtacattagaaccgagatgctcgagggcgacgtactgctggcgccaggcttccagattccccctaatttggactacaaaggttaccatgaatacattgacgagaatcttcccccagaatccccgtatttgtacggcttgcatccaaacgctgaaataggattcctgaccgtcacctccgagaaactgtttcggacagtccttgagatgcagccaaaggagacggactctggagctggtacaggcgtatctcgcgaggagaaggtaaaagcagttctggatgacattctggagaaaattcctgaaactttcaatatggccgagattatggccaaagcagctgaaaagacaccatacgtggtggtggctttccaggaatgtgagcgtatgaacatcctgactaacgagatgagacgctctctcaaagaactcaacctgggtctcaagggagaactcaccatcacaaccgacgtggaagatctttcaacagccttattttacgatactgtgccggacacttgggtggcccgagcctaccctagcatgatggggctcgctgcatggtacgccgacttgctcctacgcattagagagctcgaggcatggaccactgacttcgcactgcccactactgtttggctggctggcttcttcaatccacagtcatttttgacggctataatgcagagcatggcacgtaaaaatgaatggcctctcgacaaaatgtgtctgtctgttgaagtcacaaagaagaatagggaggatatgacagcacctccccgagaaggtagttacgtctatggcctatttatggagggggctagatgggatactcagaccggtgtgattgcggaagcgagactgaaagagttaactccggcaatgccagtgatatttatcaaggcaattccggtggatcggatggaaactaaaaacatttacgagtgccccgtctacaaaaccagaataaggggtcccacctatgtttggaccttcaaccttaagaccaaggaaaaagccgctaaatggatcctggccgcagttgcgctcctactgcaggtgtag

SEQ ID NO: 55681 - DNA, 13458 bp, Artificial Sequence
  Description of Artificial Sequence: Synthetic coding sequence
atgactatggccccagatgtgcgcttggaatacctcgaggaggtggcaagtattgtgctcaaatttaagcccgacaagtggtctaaattaattggggctgaagagaatgtggccttgtttacagagttctttgaaaagccggacgtacaggtgctggtgcttaccctcaacgcagccggtatgatcatcccttgtttgggattcccccagagccttaagtctaagggagtgtactttattaagacaaagtccgagaatatcaataaagacaattacagggccagactcctctacggagatataagcccaacccccgttgaccaactgatcgccgtcgtggaggaggtgctaagttctttactgaaccagagcgagaacatggcaggatggccacaggttgtcagtgaggacattgtgaaacaggtccacagattaaagaacgagatgttcgtgatgagcgggaagatcaagggcaagaccctgctgcctattccagagcacttgggatctctggacgggaccctcgaaagtatggagaggataccatcttcccttgacaacttacttctgcatgccatcgagacaaccatcattgactggagccaccagatccgggatgtcctgtcaaaagactccgcacaagcccttctagacggtctccatccactcccacaggttgagtttgaattttgggacactagactccttaacctgaaatgtatccacgaacaactcaatcggccaaaagttaataagattgttgagatcctcgagaaggctaagtcctgctattggcctgccctgcaaaacgtgtacactaacgtgactgagggacttaaggaagccaacgacattgtgttatacttgaaacctttgcggatcttactggaagaaatggagcaggccgattttacgatgcttccaacattcatcgccaaggtcctggacacaatctgctttatttgggctacttcagaatactataatacacccgcaaggatcatcgtgatcctgcaggaattttgtaaccagatcatcgaaatgactagaacttttttgtcccctgaagaggtccttaagggcctccagggagaaatagaggaagtgctatccggcatttccctggcggtgaatgtgctgaaggaactttaccagacatatgacttttgctgcgtgaatatgaagcttttctttaaggacaaggaacccgtaccgtgggagttcccctcttccctcgcttttagtcgtatcaatagcttctttcagcgtatacagaccattgaggaactgtacaagaccgctatcgaatttctcaagctggagaagattgaactcgggggtgtgagaggcaacctgctcgggagcctggtgacgaggatctacgacgaggtgttcgaattagtgaaggttttcgccgattgtaagtacgatccgttggaccctggcgatagtaatttcgacagggattacgcagattttgaaatcaagattcaggatctggaccgtagactagccacgattttctgccagggctttgacgactgtagctgtattaagtcttctgctaagctgttatacatgtgtgggggacttatggagcggcctttaatactcgcggaggtggcacctcggtactcagtaatgctagaactattcgacgctgagctggacaacgccaagatcctgtacgacgcgcaaatggcagccagcgaggaagggaacattcccctgatccataaaaacatgccacccgtggccggtcagttaaaatggtcgcttgaattacaagaaaggctggaagtgagcatgaaacatctcaagcatgttgaacaccccgtgatgtctggcgctgaagcgaagctgacatatcagaaatatgatgaaatgatggaattactgcggtgccacagggagaagatataccagcagtgggtggctggagtcgatcaggactgccacttcaacctgggacaacccctgatccttagagatgcagcaagcaacctcatccacgtgaacttctctaaggctctagttgccgtgctcagggaagtgaaatacctgaacttccaacagcagaaggaaatccccgacagtgcagagtcactctttagtgaaaatgagacatttcgaaagttcgtggggaatctggagttgatcgtcggctggtacaatgagatcaagacaatcgttaaggctgtcgagtttttgctcatcaaaagcgaattggaggctatcgatgttaagctgttgtctgcagaaaccacactgttttggaatggtgaaggagtcttccagtacatacaggaggtgagagagatcctgcacaatcttcagaatcggatgcagaaggctaagcagaacattgaagggatctctcaggcaatgaaggattggtccgccaaccctcttttcgaaagaaaggacaacaaaaaagaagctctcctggacctggatggaaggatcgctaacctgaacaagaggtacgccgctgtacgagatgcaggggtgaaaatacaggcgatggtcgccgagaacgcggagctcttcagggctgacaccctgtcgctgccctggaaagactacgtgatttacattgacgacatggtcttagatgagttcgatcagttcattaggaagtccttgagcttcttgatggataacatggtgattgacgagtccattgcacccctgttcgagatccgcatggaactggacgaggatggtctgacctttaaccccactcttgaggtgggcagtgatcgcggatttcttgccctcatcgaagggctggtgaacgatatttataacgtggcacgtctcatacctcgcctcgctaaagatcgcatgaactataagatggatttggaggataacacagatctgatcgagatgcgggaggaggtgagcagtctggtgataaatgcaatgaaggaggccgaagagtatcaggacagctttgagagatatagttatctgtggacagataacctgcaggaatttatgaaaaactttctgatctacggctgtgccgtcactgcggaggacctggatacctggacagatgacactatccctaagactccacccaccctcgcccaatttcaggaacaaattgacagctatgagaaactctatgaggaggtctcgaagtgtgaaaacaccaaggtgttccacggttggttacagtgcgactgtcgcccttttaaacaggctctcctgtccaccattagacgctggggttttatgttcaagcgtcaccttagcaaccacgtgaccaatagtctggccgacctggaggccttcatgaaggtggctcgcatgggactgactaaacccctgaaggagggtgattacgacggactggtggaggttatgggtcacctcatgaaagtgaaagaacgacaggccgctactgataacatgttcgaacccctgaagcagaccatcgaattgttgaaaacatacggtgaagagatgcccgaagaaatacatttgaaactacaggagcttccagaacactgggccaataccaagaaactcgctatccaggtaaagttgaccgtagcacctctccaagcgaacgaggtgagtattctccgaaggaagtgccaacagttcgaactgaaacagcacgagtttagggaaaggtttcggagagaggcaccattctcgttttctgatccaaatccctacaagagtctgaacaaagtatttctcctaaaggggattatggaagcgctttctaagtcagggggtctgtttgaagtccccgtccctgattacaagcagcttaaggcatgtcatagggaggtccgcctgctcaaagaactgtgggatatggttgttgtcgtgaacacatcgatcgaagactggaagacaaccaaatggaaagacatcaacgttgagcaaatggatatcgactgtaagaagtttgctaaagatatgcgcagcctggacaaagagatgaaaacctgggacgcttttgtgggtctggataacacggtcaaaaacgtgatcactagcttacgggcagtatctgagctccagaatccggctatacgcgaacggcattggcaacaattgatgcaagcaacacaagtgaaatttaagatgagcgaggaaaccactttagccgatctcctacagctcaacctgcacagttacgaagacgaagtgagaaatattgtcgacaaagccgtgaaggagtctggcatggaaaaagtcctcaaagcactggacagcacatggtctatgatggagttccagcacgaacctcatcctaggacgggcacgatgatgctcaaaagcagtgaagtactcgtcgaaaccctcgaagacaatcaggtgcaactgcagaacttgatgatgtccaaatacctggctcacttcttaaaagaagtgacttcttggcagcagaagctctctacagctgactccgtgatttctatttggttcgaggtccagcggacatggtcccatttagagtccatcttcatcggttctgaggacataaggacacaactgcctggcgattcacagcgatttgacgatataaatcaggaattcaaggcactgatggaggacgccgtaaagacacctaatgtcgtggaggccaccagcaaacccggactctacaataaactggaagcactcaagaaatctcttgctatctgtgaaaaggcgcttgccgagtacctggagaccaaaaggctggctttccccaggttctacttcgtgtcttcagcagatctgttagacatcctgtcaaatggcaatgatccggtggaagtgtccagacacctctcgaagctgttcgatagcttgtgcaagttgaagttccgcctggacgcctccgacaaacccttgaaagtgggactagggatgtactccaaagaagatgaatatatggtatttgaccaagaatgcgacctgtccggccaagtggaggtctggctaaaccgcgtgttggaccgtatgtgctctacactgagacacgagattccggaagcagttgtgacctacgaagagaaaccgcgtgagcagtggatcttggattatcctgctcagatctggtggacaaccgaagtcggcctggctttcgctagactggaggaggggtacgaaaacgccatccgagattataacaaaaagcagatttctcagctgaatgtactcatcaccctcttgatgggtaatcttaacgccggtgaccgtatgaaaatcatgacaatctgtacaatcgatgtgcacgccagggacgttgtcgcaaagatgattgttgagagctcccaagcgtttacgtggcaggcacagcttcgtcatcggtgggatgaggaaaaacgccactgcttcgcaaacatttgtgatgcccagattcagtactcatacgagtatctagggaatacccctaggttagtgattaccccgctaaccgaccgctgttacatcactctcacacagtctctgcaccttatcatgggaggagccccagctggacctgctggaacgggaaagaccgagacaaccaaagatctgggtagagccttgggcactatggtttatgtgtttaattgcagcgagcaaatggactacaagtcgtgcggcaatatctataaagggctggctcagacgggcgcttggggttgtttcgatgagttcaaccggatttccgtcgaggtgctgtcggttatagctgttcaggtgaagtgcgtgcaagacgccattcgcgcaaaaaagaaagcattcaatttcctaggcgagatcatcgggctcatacctacagtggggattttcattacaatgaatcccggatatgctgggagggccgaactccctgaaaacctgaaagccttgttccgtccttgtgctatggtggtgcccgacttcgaattgatatgtgagataatgctcatggccgaaggatttctagaggcgcgacttctggctcggaagttcataaccctgtacaccttgtgcaaagagctgttaagtaagcaggatcattatgactggggtttgagggccatcaagtcagtgcttgtagttgctggatcactcaagcggggtgacccatctcgcgcagaagaccaggtcctgatgagagccttaagagatttcaacattcccaaaatcgtcaccgacgacctcccagtgttcatggggctcatcggagacctgttcccggctctggatgtgcctcggaagagagacctgaactttgagaaaattatcaagcagtcaattgtggagcttaagcttcaggctgaagattcatttgtcctgaaagttgtgcaactggaagaactgctccaggtgagacatagcgtcttcatagtgggcaacgccggtagcggaaagtcccaggtattgaaatccctgaacaaaacctatcaaaatctgaaacgcaaacccgtggcagtggacctcgaccccaaggccgtgacctgcgacgaactgtttggaattatcaaccccgtcactagggagtggaaagacggcttattctccacaatcatgagggatctggcaaacatcacacacgatggtcccaaatggatcatcctggacggggatatcgacccaatgtggattgaatctctgaacaccgtgatggacgacaacaaagtgctaaccctcgcctctaatgagagaattccactcaaccgcaccatgcggctcgtgtttgagatttcgcatctgcgaacggccaccccagccacagtttcacgcgctggcattctatacatcaatcctgctgatctcggctggaaccccgtggtctcaagttggatagaaaggaggaaagtgcagagcgagaaggccaacctcatgatcctgttcgacaagtacctccccacctgcttagacaaattgcgattcggttttaagaaaattacacccgtacccgagatcaccgtgatccaaactatactttatctgctcgagtgccttttgactgaaaagacagtccccccagactctccgagggaactgtacgaactgtacttcgtgtttacctgcttttgggcgttcggcggagccatgttccaggatcagctggttgactatcgagtggaattcagcaagtggtggattaacgagttcaagactatcaagttcccatcacagggcaccatttttgattattacattgaccccgatactaagaagtttctgccctggactgataaagtgcccagcttcgagcttgaccctgatgttcctctgcaggcatccctagttcataccactgagacaatccgaattcgctactttatggatctgctaatggaaaaatcatggcccgtcatgctggtgggaaacgcaggaacagggaagtcggtacttatgggtgataagttagagtcactcaatacagataactacttggtccaggctgttccatttaatttctacaccacaagtgcaatgctccagggagttctggagaaacctctcgagaagaagagtggcaggaactacggccctcctggtaccaagaaacttgtttacttcatcgatgatatgaacatgcccgaagtagacaagtatggcaccgttgctcctcataccctgatccggcagcacatggaccatcgccattggtacgacaggcacaagcttaccctgaaagacattcacaactgccagtatgtcgcctgtatgaaccccaccagcgggtcattcaccatcgattcacggctgcaaaggcacttttgtgtattcgctgtctcctttcccggacaggaggccttgaccaccatctacaatactatcctcacccagcacctggcttttcgctcagtgagtatggctattcagcgcatttcgtcccagctggtcgcagctgccctggccctgcaccagaagattaccgcaacattcttacctacggccatcaagttccattacgtatttaatttgcgggacctctcaaacatttttcagggactactgttcagtactgctgaagtgctgaagacacctttagatcttgtgcggctctggttacatgaaacggagcgcgtgtacggggataagatggttgatgagaaggaccaggagacccttcaccgcgtgactatggcctccaccaagaaatttttcgacgatttgggagacgaactgctgttcgcaaaaccaaacatattttgccacttcgcgcagggaataggggatccgaagtatgttcccgtgactgacatggcgccactgaataagttactggtcgacgtgctggattcatataacgaagtgaacgcagtgatgaacctggttctgtttgaagatgcagtggcccacatatgtcggatcaacaggatcctggagagtcccagagggaatgctctactggttggagtgggcggatcaggtaaacagagcttgtctagactggccgcatatatatcgggccttgacgtttttcagatcacactaaagaagggctacgggatcccagacttgaagattgacctggctgcccagtatattaaagccgctgtgaagaacgtacccagtgtcttcctgatgacggactcccaggtcgcagaagagcagtttctggtcctgataaatgacctgctggcctccggggagatccccggactcttcatggaggatgaagtggagaatatcatcagcagcatgcgtcctcaggtgaagagcctcggaatgaatgacacacgagaaacgtgctggaaatttttcatcgagaaagttagaagacagctgaaagtgatcctgtgcttttcccctgtgggctcagtgctgagagtgcgggcacggaaattccccgcagtggtcaactgtactgctatcgactggttccacgagtggccggaggacgccctggtgtctgtaagcgctaggtttttggaggagaccgaggggatcccttgggaagtcaaggcatcgataagcttcttcatgtcatatgtgcacacgacagttaatgagatgagcagagtctatcttgccaccgagcggaggtataattatacgacccccaagacattccttgagcaaatcaagctgtaccagaatcttctagccaagaaacggacagaacttgttgcgaaaatcgagagattggagaacggtttaatgaagctccagtcaacagctagtcaggtggacgatttgaaggccaagcttgccatccaggaagctgaactaaagcagaagaatgaatcggctgatcagctgatccaggttgtgggaatagaggctgaaaaggtctccaaggagaaggcgatagccgatcaggaggaggttaaagtggaagtgatcaacaaaaatgtaaccgaaaagcagaaggcatgtgaaactgacctggcgaaagcagaaccagctttgctggcagcccaggaagcgctggatacactgaataagaacaacctaaccgagctgaagagtttcggtagccccccagatgctgtggtgaatgtgacagccgcagtgatgattttgacagctccgggtggaaagatccccaaagacaaatcttggaaggctgccaaaattatgatgggcaaggtggataccttcctcgactctttaaagaagttcgataaagaacatataccagaggcctgcctgaaggctttcaaaccctaccaaggtaatcccacttttgacccagaatttatacgtagcaagtccacagctgctgccggactatgctcatggtgtatcaacattgtcaggttttatgaagtgtactgcgatgtggctcctaagcggcaggcccttgaggaggcgaatgcggagctggctgaggcacaggagaaactgagtcgtatcaagaacaagatcgccgagctgaacgcaaatctctccaatttaacatctgctttcgagaaggccaccgctgaaaagatcaagtgtcaacaggaagctgacgcgaccaaccgagttatactccttgccaatcgcctagttgggggacttgcgtcagaaaacattcgatgggctgaatcggtggaaaattttcgctctcagggggtgacattgtgcggcgatgtacttctcatcagcgctttcgtctcatacgtgggctatttcactaagaaatacagaaacgaattgatggagaagttttggatcccatacatccataacctgaaggttccaatccctatcaccaatggactggacccgctgagcctgctcacagatgatgccgacgtggcaacatggaataatcaagggctgccctcagataggatgtctactgagaacgccacgatccttggtaataccgaaaggtggccgctgattgttgacgcccagctccaagggatcaaatggataaaaaataagtatcgatccgagcttaaagccatacgactgggccagaagagttatttggatgtgatcgaacaggctatcagtgagggtgacacgctgctcattgagaatatcggagaaacggtagatcccgtgctagacccacttctcggccgtaacacaattaagaagggaaagtatattaaaattggcgacaaagaggtggaatatcatcccaagtttagactcatcttacacacgaagtactttaaccctcactataagcctgagatgcaagctcagtgcacgttgattaacttcctggtgactagggatggacttgaagaccagcttttggccgcagttgtggcaaaagagaggccagacctggaacagctgaaagcaaatctgaccaagtcccagaacgaatttaagatagtccttaaagaactggaggattctctgctcgcaaggctgagcgcagcatctggtaatttccttggagacaccgccctagtagaaaatctggaaactaccaaacataccgctagcgaaattgaggaaaaggtagtcgaagctaagattaccgaagttaagattaacgaagcccgtgagaattataggccagccgctgagagagcctccttgctgtactttattctgaacgatcttaataaaataaaccccgtatatcaatttagtcttaaggcttttaatgtggtgtttgagaaggccattcagcggaccacccctgcaaacgaagttaaacaaagggtcattaatttgacagatgagattacttatagcgtatacatgtatacggctagaggcttgttcgagcgcgacaagttaatttttctggcccaagtgacatttcaggtgctgagcatgaaaaaagagcttaatcctgtggaactggacttcctcctcagatttcctttcaaagccggtgtggtgtcccccgtggattttctccagcaccaaggctggggcggtataaaggctctgagtgagatggacgaatttaaaaacctggacagcgatatcgaaggatccgctaagagatggaagaagctggttgaaagcgaggcgccagagaaggagattttcccaaaggagtggaaaaacaaaaccgctctgcagaagctctgcatggtgcggtgtttaagacctgaccgtatgacatatgctattaagaacttcgtggaggagaagatgggcagcaagttcgtcgaaggccgaagcgtggagttcagcaagtcttacgaggaaagctccccatccactagtatcttcttcatcctttcaccaggagtggaccccctgaaggatgtcgaggcccttgggaagaaactgggctttacgattgacaacggaaaactgcacaatgtgagcctaggtcaggggcaggaggtagtggctgaaaacgcactggatgtcgccgcagagaaaggacattgggtgatcttgcaggtgcgaggcggtcaacactgcaggaacatccatctggtggcaagatggctgggcacattggataaaaaactggagcattactccacaggaagccacgaagattatagagtctttatttctgcagagccggcaccttcgccagagacccatattattccccagggcattcttgagaatgctattaagataaccaatgagcctccaacgggcatgcatgccaacttacacaaagcacttgatcttttcactcaggatactttagagatgtgcactaaggaaatggagttcaaatgcatgctttttgcattgtgttactttcacgctgttgtggcagagcgcaggaaatttggcgctcaaggttggaacagaagctaccccttcaataatggtgacttgactattagtatcaatgtcctctacaactacctcgaagccaatccaaaggtgccctgggacgatctacgctatctgttcggagagatcatgtacggcggacatattacagacgactgggaccggcgactatgccgtacttacctggccgagtatatccgcactgagatgcttgagggtgacgtgctattggcaccgggattccagatacccccaaacttggactataaagggtatcacgagtatatagatgagaatctgccaccagaaagcccttacctgtatggactgcacccaaacgctgaaatcggcttccttactgtcacatcagagaagctattccggacagtgcttgaaatgcagcctaaggaaactgactccggggctgggaccggcgtctcaagagaggaaaaggcaggatcactgaaactgcttccttccgaaagaaagggagaagacctcgagctgcggagaggcggatgccccggaaccgggttccaggtaaaggccgtcttagatgatatactggaaaaaattcccgagaccttcaacatggctgaaatcatggctaaggccgctgagaagaccccctatgtggttgtggcctttcaggaatgtgagagaatgaacatccttaccaatgagatgagaaggtctctgaaagagttaaatttgggcctgaagggggaactgactataacaacggatgtggaggatctgagcacagcccttttttacgacacagtgccggacacatgggtggccagagcatatccgagcatgatgggcctggccgcttggtacgcagacctattgctccggattagggagctggaagcttggaccacagactttgcactgcccactactgtgtggctcgccggtttttttaacccccagagcttcttaaccgctataatgcagtcaatggcccgtaagaatgagtggcctctcgacaagatgtgcctttccgtggaggtgaccaagaaaaatagggaggatatgactgctcctccgagggaaggatcttacgtgtatggactcttcatggaaggcgctcgttgggatacgcagaccggcgttattgccgaagctaggctgaaggaactgacacctgcaatgcctgtgattttcatcaaagctattcccgtcgaccgaatggagaccaagaacatttatgaatgtcccgtgtataagacgcggatccggggtcctacctacgtctggacctttaacttaaaaaccaaagagaaggctgccaaatggattctggcagctgtggccttgctccttcaagtctaa

SEQ ID NO: 55682 - DNA, 1545 bp, Artificial Sequence
  Description of Artificial Sequence: Synthetic coding sequence
atggctgatgcagaagttataattttgcctaaaaagcacaagaagaaaaaggaaaggaagtccctccctgaggaagacgtcgctgagatccagcacgccgaggaatttttgatcaagcctgagtctaaggtcgccaaactcgacacatcacagtggccgctactgctgaaaaactttgataagctcaatgtgcgaactacccattatactccattggcatgcggatcaaaccctttaaaaagagagatcggcgactacatacgtaccgggtttatcaaccttgataaaccctcaaatccatcttctcacgaagttgtggcctggattcgtcgaatcttacgcgttgaaaaaactggccattccggaaccctagaccccaaagtgaccgggtgcctcattgtttgcatagagagggcaactagactggtgaaatcccagcagagcgctggaaaagagtacgtgggaatagtgagattgcataatgcgattgaaggaggaacccaactgtcacgagctctggagacacttactggtgccctcttccagagaccgcctctaattgccgcagtgaagcgacagttacgcgtgcgcactatttatgagagcaagatgatcgaatacgacccagagcggcgactcggtatcttttgggtgtcttgtgaagccggaacttatataaggaccctgtgtgtgcatctgggactcctgcttggggtcggcggtcagatgcaggaattgagacgtgtacgctcaggtgttatgtcagaaaaggaccacatggtaacaatgcacgacgtcttggatgctcagtggctgtatgacaaccataaagatgagagctatttgcggagggtggtttacccccttgagaagcttctgacaagccacaaaagactggtcatgaaggacagcgccgttaatgcgatatgttatggggcaaagatcatgctgcctggagtgttgcggtacgaggatgggatcgaggtgaatcaggaaatcgtggtcatcaccacaaaaggtgaggccatttgtatggccattgcgcttatgaccaccgcagttatctcaacctgtgatcatggaatcgtggccaagatcaagagagtgatcatggagcgggatacctatcctaggaaatgggggttaggtcctaaggctagccaaaaaaagctgatgatcaagcaaggcctccttgataaacacggcaagcccaccgattctacgcctgccacctggaaacaggaatacgtagactactccgaatctgccaaaaaagaagtcgtggcagaagttgtgaaagcacctcaggttgtggcagaagccgcaaagaccgcaaagagaaaacgagagagtgagtctgagagcgacgagactcccccagccgcacctcagttgattaaaaaagagaagaagaaaagtaaaaaggacaaaaaggccaaagctggtttggaaagtggcgcagagcccggagacggggacagcgatactaccaaaaagaagaagaaaaagaaaaaggccaaggaagtcgagttggtgtcggaatag

SEQ ID NO: 55683 - DNA, 13125 bp, Artificial Sequence
  Description of Artificial Sequence: Synthetic coding sequence
atgaaggtcgaccgaaccaagttgaaaaaaacacctacagaggcgccagccgactgccgggctctgatcgataagctgaaggtttgcaatgacgaacagctgttgttagagctgcagcagattaagacctggaacatcggcaaatgtgagttataccactgggtggacctgttggaccgatttgacgggatcctggccgacgcaggccaaaccgtcgaaaatatgagttggatgctcgtatgcgatagaccagaaagagaacagctgaagatgctgctgctggccgttcttaattttaccgccctgttgatcgaatactctttttcacggcacctgtactcgtctatagaacacctgactacgctgctggcaagtagtgatatgcaggtcgtcctggcggtgctcaacttactctacgtgtttagcaaacgtagcaactacattacacgcctggggtccgataagcgaacccccctgcttacacggctgcaacacttggcagagagttgggggggaaaagagaatggctttggcctagccgagtgttgtcgggatcttcatatgatgaaataccccccaagtgctaccacccttcactttgagttttacgcggacccaggggcagaggtcaaaatcgaaaaaagaaccacatcaaacaccctacattatatacatatcgagcaactggacaagataagcgaatccccatcagagataatggagagcctgactaaaatgtatagcatccccaaagataaacagatgttgttatttacgcatattagactcgcccacgggttctccaatcatagaaaacggctccaggccgtgcaagctaggttgcatgcaatcagcattttagtttattccaacgccctccaggagtccgccaacagcatcctgtacaacggcctcatagaggaactggtggacgtactgcagattacggataagcagttgatggagataaaagctgcatccctccggaccttgacatccatagtgcatttggagcgtacgccaaagcttagctcaattatcgactgcactggcaccgctagttatcacggctttctcccagtgctggtccggaactgcattcaggcaatgatcgacccttctatggatccgtatccacatcagttcgccacagccctcttttcgtttctttatcaccttgcttcttatgacgcagggggtgaggctctggtttcttgtggcatgatggaggctttgctgaaagtgataaagttcctgggtgatgaacaagatcagatcactttcgtcacccgagcggttagggttgtggacttgattaccaaccttgacatggcggcttttcagtcgcattctgggctaagtatcttcatttaccggctcgaacatgaggttgacctatgtcgaaaagagtgcccatttgtgatcaagccaaaaattcagaggccgaacacaacccaggaaggagaagaaatggagacggatatggatggcgtacaatgcatccctcagcgggctgctctgctgaagagcatgctcaattttctcaagaaagcaatccaagatccggctttttcggacgggatccggcacgtgatggacggatcactgccaacctcacttaaacacatcatctccaatgctgagtactatggcccaagtctgtttctcttggccacagaagttgtgactgtgttcgtctttcaggagccaagcctcctgtcctctctccaggacaatgggctcactgatgtgatgcttcacgctctcctgatcaaagacgtccccgctacgcgcgaggtccttgggagccttcctaacgtgttcagtgctctgtgcctgaacgcacggggacttcaaagtttcgtgcaatgccagcccttcgaacgtttgtttaaagtgttgctaagcccagactatctgcccgcaatgcgcagaaggcgaagctcggaccccctcggagatactgccagtaacctcggtagcgccgtcgatgaactgatgagacatcaacctactctcaaaacggacgcgactaccgcaatcattaagctattggaagagatctgcaatcttggcagagatcccaagtatatctgccagaaaccttcgattcagaaagccgatgggaccgcgactgctccaccaccgaggagtaaccacgctgcagaagaggcaagttccgaggacgaggaagaagaggaagtccaagctatgcagagctttaactccacacagcagaatgagaccgaacccaaccaacaggtggttggcacagaagagagaatacctatcccactgatggattacatacttaatgtgatgaaattcgtggagtcaatactgtctaacaatactactgatgaccattgtcaagagttcgtgaatcaaaaaggcctgctgcctctcgtgacaattcttggtctcccgaacctgcccatcgacttcccaactagtgcggcttgccaggccgtggccggagtgtgtaaatcaatacttacactgtcacatgagcccaaagtactccaggaaggactcttacaactagatagtattctgagcagcctggagcctcttcacaggcctatcgaaagccctggcggatcggtgcttcttagagagctcgcctgcgctgggaatgtggcggacgctactcttagcgcccaagcaacgccacttctacacgctctgaccgccgcacatgcatacatcatgatgtttgtgcatacctgccgggtcggacagtccgagattcgatcaatttccgtgaatcagtggggctcccaattggggctcagtgtgctttctaagctcagtcagctgtattgtagtctcgtctgggaatccactgtgttactctcgctgtgcacccccaatagtctgccttctggatgtgaattcggccaggctgatatgcaaaaacttgttccgaaggacgagaaagctggaaccactcagggaggaaaaagatctgacggcgaacaggatggcgctgctgggtctatggatgcttccacccaggggcttctggaggggataggccttgacggtgacaccctggctccgatggaaactgatgaacctacagccagcgatagtaagggcaagagcaagatcactcctgctatggctgcacgcattaagcagatcaaaccccttttgtcggcctcctctcgccttggtagagcccttgctgaactgtttggactgcttgtaaaattatgcgtggggtctccggttcgtcagcgtagatcacaccacgcagccagcacgacaacagcccctacaccagcagcacgaagcaccgcttcagctctcaccaaactgctgacaaaaggtctcagctggcagccaccaccctacacaccaacaccgagatttcgccttactttttttatatgcagtgtgggtttcacgagccccatgctatttgacgagcggaagtacccttaccatctcatgttacaaaaatttctctgttcaggcggtcataatgcactgttcgagacatttaactgggcactcagcatgggagggaaagtgcctgtgagtgaaggattggagcactcagacctgccggatggcacaggtgagtttctggacgcctggttgatgctggtcgagaagatggtgaacccaacaaccgtcctcgagtctcctcattccctccccgctaaattacctggaggcgttcagaattttcctcagtttagtgcactgcggtttttggtcgtaactcagaaagccgcattcacttgtattaagaacctttggaatagaaagccattaaaagtgtacggaggacgcatggctgaatcaatgctcgcgattctctgtcacattctgcggggtgagcccgtgatccgtgaacgactgtccaaagaaaaggaaggctcacgcggagaagaagatacgggccaggaagaaggcggaagtaggcgtgaaccacaggttaatcagcaacagctgcaacagctcatggatatgggtttcacaagggaacatgccatggaggcattactgaatacatcaacaatggagcaggctacagagtacctgctgactcaccctcctccaattatggggggtgtggttagggacctatccatgtcggaagaagaccaaatgatgagggcaatcgctatgtcactcggtcaggatattcccatggaccagagagcagagtcccctgaggaggttgcatgtcgaaaggaggaggaagaacgaaaagcgagggagaaacaggaggaagaagaggccaagtgccttgaaaaatttcaagatgccgatcctttagagcaagacgagttacacaccttcactgacaccatgctcccaggctgtttccacctgcttgatgagcttccagatactgtgtacagagtatgcgacttgattatgactgcaataaaacgaaacggcgcagactacagagatatgattctgaagcaggtggttaatcaggtgtgggaagcggcagacgtgctaatcaaggcggcactgcctctcacaacatccgacacgaaaactgtatccgagtggatctcccaaatggctaccctgccacaggcaagcaatctggccacacggattttattactcactctgctgtttgaagaactgaagctcccctgcgcctgggtggttgagtcttctggcattctaaatgtgctaatcaagcttctcgaagttgtacagccttgtctgcaagctgccaaggagcagaaggaagtccaaacgccaaagtggatcacaccggtcctcctgcttatagatttttacgaaaagactgccataagctccaagcggagggctcagatgacaaaatatctgcagtccaactctaataattggcgttggtttgatgacagatctggacgctggtgcagctatagtgcaagcaacaatagcacgatcgacagcgcttggaagtctggggagacctccgtgcgttttacagctggccgaaggcgctacacagtacagtttacaacaatggttcaggtcaacgaggagaccggcaatagaaggccagtgatgctcacgcttcttagggtgccacgtctgaataagaactccaagaatagtaacggtcaggagctcgaaaaaactctggaagaaagtaaagaaatggacattaagaggaaggagaacaagggcaatgacacccccttagctcttgagtccacaaacacagaaaaagagacgtccctggaagaaactaaaataggggaaatcctcatccaggggttgacagaggatatggtgaccgtcttgatccgagcctgtgtcagtatgttgggggttcccgtggatccagatacgttgcacgctaccctgcggctctgtctccggctcactagggatcacaagtacgccatgatgtttgctgagctcaaatccactagaatgattttgaacctgacccagtcctccggcttcaatggcttcactcccttggtcacgctgctcttgagacacattattgaagacccgtgcactttgcgccacacaatggaaaaagttgttaggagcgctgcaactagcggggcaggatcaacgactagcggagtggttagtggttccttaggaagtagggaaataaattatattcttcgggttctggggcctgctgcatgcagaaatccagacatcttcaccgaggtggccaattgctgcatccgcatagccttgcccgctccacggggttccggcaccgcttcggacgacgaattcgaaaatcttcgcataaagggcccaaacgccgtgcagttagttaagaccactcctttaaagcccagcccactaccggtgattccagacacgataaaggaggtaatttacgatatgctaaacgctctagcggcttatcatgcacccgaagaggcagacaagtctgaccctaagccaggggttatgactcaagaagtgggtcagttactgcaggatatgggggatgatgtgtaccagcagtataggtctctgacccggcagtcctccgatttcgatactcaaagtgggttctccattaactcacaagtgtttgcagcggacggggcaagtaccgagacaagcgcaagcgggaccagccaaggggaggcttctaccccagaagaatcacgagacgggaagaaggataaagagggtgatcgtgcgagtgaagaggggaaacagaaggggaagggatcaaaaccactgatgccaacatccaccattctgagattactcgcagagctcgtgagaagctacgtcgggatagcaaccctgatcgctaattatagctatactgtgggccagagcgaattaattaaagaagactgcagcgtgctcgcttttgtcttagaccatctgctgcctcatacacaaaatgccgaagacaaggacacacctgcactcgcaaggctttttctggcgtccctggctgccgctggcagcggtacagacgcccaagttgctctcgtgaatgaggttaaggcggctttgggacgggctctggcaatggcggagtcaaccgagaagcatgccaggcttcaggctgtaatgtgtatcatttccacaattatggagagctgtcctagtacatcgtccttttactcttcagctaccgcaaaaacccagcacaacgggatgaacaatatcatacgtctctttctaaaaaaaggactggtgaatgacctggcccgagtaccgcactccctggacctgagcagccccaacatggccaacacagtgaatgccgctctaaagcctttagaaacactcagtagaatcgttaaccagccaagctctctctttgggagcaaatccgccagttctaagaacaaatcagaacaggatgcacagggagcaagccaagactcgtcatctaaccaacaggatcccggagaacccggagaagcagaagtccaggaggaggaccatgacgttacacagacagaagtagccgatggtgacatcatggacggtgaggccgagaccgatagcgtcgtaattgccggacaacctgaggtgctgtcctcacaggaaatgcaggtcgaaaacgaactggaggacctgatagacgagctgctggaacgagacggcggatctgggaactcaacaatcattgtttctaggtctggcgaggacgaatcccaggaggatgtcctcatggacgaggctccttccaatttgagtcaggcctccacgctgcaggcgaatcgggaagacagtatgaatatactggatcccgaggatgaggaggaacacacccaggaagaggactcatcaggatcaaacgaagacgaggacgacagccaggatgaggaggaggaggaagaagaggatgaggaagacgatcaggaggatgatgaaggtgaggagggggatgaggacgatgacgatgacggctcagaaatggagcttgatgaggactaccccgacatgaatgcctcgcctctagtcagatttgagcgcttcgacagggaggatgatctcatcatcgagtttgataatatgttctcaagcgcaacagacatacccccaagtccgggaaacatccccaccacccaccccctgatggtgcgacatgccgaccactcctcgctgactttgggatcagggtcctcaacaacaagattgacccaggggattggacggtctcagagaactctgcggcagctgaccgctaatacaggtcacaccattcacgttcactatccaggaaatcgacaacccaatcctccgttaatccttcagcggctgctggggccatctgcagccgctgacatactccagctgagctccagcctgcccctacagtcaaggggaagggccaggctcctcgtcggaaacgatgatgtgcatatcattgcacgttcagacgatgagctgctggacgattttttccatgatcagtccacggccacttcccaggctggcactctgtctagcattcccaccgccctcacacggtggaccgaggagtgcaaggtactggacgccgaatcaatgcacgactgtgtatctgtggtcaaggtcagtattgttaatcaccttgagttcttaagggacgaggagctagaggagcgcagggagaaaaggcgaaagcaactcgccgaggaggaaaccaagatcacagacaagggaaaagaagataaggaaaaccgggaccagtctgcccaatgtaccgcatccaagtctaatgactctaccgaacagaatctgtccgatgggactcctatgcctgattcgtaccctacgaccccaagctccaccgacgctgcaactagcgaaagtaaagagaccctaggtacgctccagtcaagccagcaacagccaaccctccctactccacccgctctcggcgaggttccacaggagctccagtctcctgccggagagggaggtagctcgacacagctcctcatgcccgttgagcccgaggaactgggcccaacccgcccttcaggggaggccgagacaacacagatggaactctctcccgcacccacaattacttcactgagccccgaacgggcagaagactcagatgccttaaccgccgtttcaagtcagctcgaaggttccccgatggacacttcttccctcgcatcttgtacgctggaagaggctgtgggagacacatccgccgctgggagcagtgagcagccacgggctggctcctcaacacccggagatgcccctcctgcggtggcagaggtgcaaggcaggtcagatggcagcggcgagagtgcccagcctcccgaggattcatccccccctgctagtagtgaaagttcatcgacccgggattccgcagttgctatctctggagccgacagtcgtgggatcctcgaggaaccactcccatccacaagtagcgaggaagaggaccctcttgccggtatctccctgcctgagggcgtggatcccagctttttggccgcattgcccgatgacatccggagggaggttctgcagaaccagcttgggatcaggcctccaacgagaacagcgccatctaccaattcctccgctccggctgttgtgggcaaccctggtgttactgaagtatcccctgaatttctggctgctcttccacctgcaattcaagaagaagttctcgcccaacagagggccgagcagcaacgccgtgaattggcccaaaatgcttcctctgataccccaatggacccagtaacttttatccaaaccctgccctctgatctcaggcggtcagtcttggaagacatggaggattctgtactagccgttatgcctcccgacattgccgcagaagcccaagctttaaggcgtgaacaggaagctcggcagcgccagctcatgcatgagcgccttttcggtcactcgagtacatccgctctctctgcgatcctcaggtctcccgcattcacatcacggctgtcaggaaaccgtggcgtccagtacacacggctggccgtgcaaagaggtggaactttccaaatgggcggaagttcgtctcacaaccggccttctggcagcaatgtggatacactgctccgactcaggggaagactactgttagaccacgaagcactgagttgtctgcttgtcttgctgttcgtggacgaaccaaagctgaacacctccagactccatcgggtactcaggaatctgtgctaccatgctcagacgcgacactgggttattaggtcgctgctgagtatcttgcaaagaagcagcgagagtgagctgtgtatcgaaaccccaaagttaaccacctctgaagagaagggcaagaaatcaagtaagagctgcggaagtagctcccacgaaaatcgacctctggatttgttacacaagatggagagtaagagttccaaccagctgagttggctgtctgtgagtatggacgcagcattggggtgtcgcacaaatatattccagattcaaagatccgggggtcgaaaacataccgagaagcacgcaagcggcggatctaccgttcacattcacccccaggctgcccctgtcgtttgtcgccacgtcctcgacacactgatacagcttgccaaggtgttcccatcccactttacccagcagcgtaccaaggagacgaactgcgaatcagaccgggaacgaggtaataaagcatgcagcccttgttcctctcagtcatcttcatctggcatttgcaccgatttctgggatctgctcgtaaaattggacaatatgaacgtgtcacggaagggaaaaaacagcgtgaagtccgttcccgtgagtgctgggggagagggcgaaacctcaccttatagtctggaggcgagcccactggggcagttgatgaacatgttgtcacatcccgtgatcaggcggtcttctttactaacagagaagctcctgcgcctcctgtccctaatttctatcgccttaccagagaataaagtgtccgaggctcaagccaatagtggttctggggcttcctcaactacaacggcaacgagcactacctccactactaccacaactgccgcatctacaacccctaccccgccaaccgcccctactcctgtcacgtcggcccctgctttggtcgccgctactgcgattagcactattgttgtcgccgcttccaccactgtcaccacgccgaccactgctacaaccaccgtgtctatctcccccaccacaaagggatccaaaagcccagccaaggtcagcgatgggggttcaagctctaccgatttcaagatggtgagttctgggctgacagagaatcagctgcagttaagtgttgaagtcctcacctctcactcctgcagcgaggagggtcttgaggatgcagccaatgtcttgctacagctgtctcgaggagactcagggacccgggacaccgtgctcaaacttctgctcaatggtgcacgccaccttggttatacactgtgtaaacaaatcggtacacttcttgcagaactccgggaatacaatctggaacaacaacgaagggcccaatgtgaaacgctgtcgccggacggactgcccgaagagcagccccagaccaccaaattaaaggggaagatgcagtcccgctttgacatggcagagaacgtggtaattgtggcctcccagaaaagaccacttggaggccgtgagctccagctcccctcaatgtccatgctgaccagcaaaacatctacccagaagttctttttacgcgtgctgcaggtaattattcagctcagagatgataccagacgagctaataaaaaggccaagcaaacagggaggcttggatcatccggcctcggatccgcctcgtccattcaggctgctgtgagacaactggaagccgaggcagacgcaatcatccagatggtgcgggaggggcagcgcgctcgtcgacagcagcaggccgcaacttcagaatcctcacagtccgaagcgtcagtgcggcgagaagaatccccaatggatgtcgatcaaccatctcctagtgctcaggatacccagagcatcgccagcgacggcacccctcagggggagaaggagaaagaagaaagacctccagaactgccccttctctccgaacagctcagtctggatgagctctgggacatgctaggcgaatgcctgaaggaactagaggagtcccatgaccagcatgccgtgctggttctccaacctgctgtcgaagcattttttctggtgcatgctactgagcgggaatccaaaccgcctgtgagagacacacgggagtcccagttggcccacatcaaggatgaacccccaccactgtctcccgcaccactcacacctgctaccccctcttcacttgacccgtttttttcccgggagccctctagtatgcatatatcatcttcactcccacccgatactcagaaatttctgcggttcgccgaaacgcaccgaactgttctgaatcagatactgcgtcagagcaccacacatctggcggacggaccatttgccgtgctggtggattacatccgggtgctggacttcgatgttaagcgcaaatacttcagacaagaactggaacgcctggacgaaggcctcagaaaagaggacatggcagtgcacgtgcgtcgcgatcacgtattcgaggacagttacagggaacttcacaggaaaagtcctgaggagatgaagaataggttatacattgttttcgagggagaggagggacaggacgctgggggactgttaagagagtggtatatgattatttccagagagatgttcaaccctatgtacgcactgttcaggacgtcgcctggggatagggtgacatacacgattaacccatcttcccactgtaaccctaatcatctttcctattttaagtttgtgggaaggattgtcgctaaagcagtgtatgataatcgcctgttagaatgttactttaccagatctttctataagcacatactgggaaaatcagtgcgatataccgacatggagtctgaagactaccacttctaccagggcttagtgtatctcctggaaaatgatgtgtccactctggggtacgacctcacctttagtaccgaggtgcaggaattcggggtttgtgaggtccgcgatctgaagcctaacggagccaacatcttggtgacggaagagaacaaaaaagagtatgtgcacctcgtgtgtcagatgcggatgactggggcaattcgcaaacagctcgctgcatttcttgagggattttatgagattatccctaaacggctcatttcgatatttacggaacaggaacttgaacttctcattagtggtttgcccacgatagatatagacgacctaaaatctaatacagagtatcataagtatcagagcaacagcattcagatccagtggttttggagagcgctgagaagctttgaccaggcagaccgtgcaaaattcttacagttcgttacaggcacctctaaggtcccactgcagggcttcgcagctctggagggcatgaatgggatccagaaatttcagattcatagggatgaccgcagcacagaccggctccctagcgcacacacctgcttcaatcaacttgatctgcctgcctatgagtctttcgagaagcttagacacatgctgctcctggccatccaggaatgctctgagggcttcgggttagcttaa

SEQ ID NO: 55684 - DNA, 1746 bp, Artificial Sequence
  Description of Artificial Sequence: Synthetic coding sequence
atgacctcggcagttgtggattccggcggaactatcctggagctgagttccaacggagtggaaaaccaagaggaaagcgaaaaggtgagcgagtaccccgcagtgattgtggagccagtcccttctgcccgacttgaacagggctacgccgctcaagtgctcgtttatgatgacgaaacatacatgatgcaggacgttgcagaggagcaggaagtggaaacggaaaacgtggaaacagtggaggcaagtgttcattctagtaacgcccattgtacagataagaccattgaggcagcagaagctttgctccacatggagtcccccacctgtctccgtgactcacgctcaccagaatttattcacgcagcaatgcgaccagatgttattactgagaccgtggttgaggtgtcgaccgaggagagcgaacctatggacacctcacccattccaacctcgccggatagccacgaacctatgaagaaaaagaaggtaggaagaaagcccaaaacccaacagtctcccatcagcaatggttccccagagctggggatcaagaaaaaacctagggaggggaagggaaatactacttacctgtgggaattcttacttgaccttcttcaggacaagaacacctgtcctcgctacatcaagtggacacagagagagaagggtatcttcaagctggtggacagtaaggcagtgtcgaagctctggggcaagcacaaaaacaaaccggacatgaactatgaaaccatgggcagggcactgcggtactattaccagagggggatcctggctaaagtcgaaggacaaaggctggtgtatcagttcaaggacatgccgaagaatatcgtagtcattgacgacgataagagcgagacatgcaacgaagacttggctggcacgaccgatgagaaatctctagagcgcgttagcctcagcgccgagagtctgcttaaggccgcaagctccgtaagatccggaaagaatagctcccccatcaactgctctcgagccgagaagggtgttgctagagtcgtgaacatcacatcccctggccacgatgcatcttcccggtcccccactacgactgcgagcgtctcagcaactgccgctcctaggacggtccgcgtcgccatgcaggtaccagtggtgatgaccagtctgggtcaaaagatcagcactgtcgccgtgcagtccgtaaacgctggcgctcccctgatcacatcgacaagcccaacaaccgccaccagccccaaagtcgtgatccagaccattcctaccgtgatgccggctagtacagaaaacggtgataagatcaccatgcaaccggctaaaatcattaccatacctgcaactcagttagcccaatgccagttgcagaccaagtccaatctcaccggatctgggagtattaacattgtggggacgccactggccgtgcgggcactaacccccgtgagtattgctcacggaacacccgttatgagactctctatgccgacacagcaggcctccggccagacacctccccgagttatttctgccgtgattaagggtcccgaggtcaagagtgaagccgtggcaaaaaaacaggagcacgatgtcaagaccctgcagctggttgaggagaagcccgcagacggtaataagaccgtcactcacgtagtggtcgtgtctgccccttcggctattgccttgcctgtaacaatgaagacagaggggctcgtgacttgtgaaaagtag

SEQ ID NO: 55685 - DNA, 1602 bp, Artificial Sequence
  Description of Artificial Sequence: Synthetic coding sequence
atggccacatcacttcacgagggaccaactaaccaactagacttgttgatcagagcagtggaggctagcgtgcacagcagtaatgctcattgcaccgacaagaccatcgaggccgctgaggctctgctgcatatggaaagccctacgtgtttaagggattctcgctcaccagttgaggtgttcgtccctccctgcgtatcaacaccagaatttatacatgctgcaatgcggcctgacgtgataactgaaaccgttgtggaggtgtcgactgaagaatccgagcctatggacacctcccctatacctacgagcccagacagtcatgagccgatgaaaaagaaaaaagtcgggagaaagcctaagacccagcagagcccaattagtaacggaagccccgagctggggataaaaaaaaaaccacgggagggtaaaggaaacactacgtacctttgggaatttctgctggaccttcttcaggacaaaaatacttgcccgcgatacataaaatggacccagagggagaagggtatttttaagttggtggattctaaggccgtgagcaaactttgggggaagcacaagaataagcccgatatgaactatgagacaatgggacgggctcttagatattattaccagcggggtattttggctaaagttgaagggcagcgtcttgtataccagttcaaagacatgcctaaaaacatcgttgttattgatgacgacaagtccgagacatgtaacgaagacttagccggtaccacggacgaaaagtccctggagcgggtgagtctgagcgccgaatccctgctaaaggcggcttcctccgtgcgtagtgggaagaacagtagtcccatcaactgttccagagctgaaaaaggcgtcgcaagagtggtaaacattacctctccaggccacgatgcctcaagccgtagcccgacaacgacagcgagcgtgtcagctacagctgccccacggaccgtaagggtggccatgcaggtgcccgtggtcatgacatctctgggccagaagattagtaccgttgccgtccagtccgtgaatgccggagcccctctgataacatccacctcccccacaactgctacatctcctaaggtagtgatccagacgatcccgaccgttatgccggcttcgaccgagaatggggacaaaattactatgcagccagcaaagattatcactatacctgcgacacagctggcccaatgtcaactgcagaccaagtcaaatctgaccggttccggaagcattaacatcgtgggaacaccccttgcagttcgcgctttgaccccagtaagtatagcccacggcacgcccgtcatgaggctgtctatgcctacgcagcaggcatccggccagactcctcctcgggtgatctccgccgtgatcaagggacccgaggtcaaatctgaagcagtcgcgaagaagcaagaacatgatgtgaagacactgcagctggttgaagagaagcctgccgacgggaacaaaacagttacccacgtggtggtggtgtccgccccatctgctattgcactacctgtgacaatgaagacagaggggctggttacatgtgaaaagtag

SEQ ID NO: 55686 - DNA, 1515 bp, Artificial Sequence
  Description of Artificial Sequence: Synthetic coding sequence
atggccactagcctccatgagggtcctactaaccaactggacctgctaatcagagccgtggaagctagcgtccatagcagcaatgcccattgcacagacaagactatcgaagccgcagaagctctcctccatatggagtcacctacctgcctgagggactctcggtctcctgtcgaggtctttgttccaccatgtgtcagcacacccgaattcatacacgcggcaatgcgtccagatgtcattaccgaaacggttgtggaggtgagcaccgaggagagcgaaccaatggatacctctcccattcctacctcccctgacagtcacgaacccatgaagaaaaagaaaggtaacacaacttacttatgggagttcttgttggatcttttgcaggataaaaatacctgtccacgatatatcaaatggacccaaagagagaagggtatctttaagttagtggactctaaggccgtcagcaaactctggggcaagcataagaacaagcccgatatgaactacgagacaatgggcagagccctcaggtactactaccagcgaggcatactcgctaaagtcgagggacagaggctcgtttatcagttcaaggacatgccaaaaaatatagtggtgatcgacgatgataagagcgagacctgtaacgaggaccttgccggaactaccgacgagaagtccctagagcgggtttccctgtcagctgaaagccttcttaaagccgcttcttcagttcgctctggcaaaaactccagtcctatcaactgttcgagggctgagaagggagtggcaagggttgtgaatataacctcccctggccacgatgcaagttctcgcagtcccaccactacagccagcgtcagcgccaccgcagcccctcggacggtgcgagtagccatgcaggttcccgttgtgatgacatccttgggccagaagattagtacagttgccgtacagagcgtgaatgctggcgctccactcattactagcacatcgcctactactgccacgagccccaaggtggtaatacaaacgatccctaccgtcatgccagcgtccacggagaacggggataagatcaccatgcagcccgcaaagatcattacaatccccgcaactcagctcgcccagtgccagttacaaacaaaatcgaacctgactggcagcggctctatcaatatagttggcacccctctcgccgtgagagcactcaccccagtgtccatagcgcacgggacacctgtgatgcgcctctcaatgcctactcagcaagcttctggacagactccgcctcgtgtaattagcgctgttattaaaggacccgaggtgaaatcagaggccgtggccaaaaaacaggaacatgacgtcaagaccttacagctcgtcgaagagaagcctgcagacgggaacaagacagtcacgcacgtggtggtggtgagcgccccaagcgccattgccctaccggtgaccatgaaaacagagggactcgtcacgtgtgagaagtag

SEQ ID NO: 55687 - DNA, 1782 bp, Artificial Sequence
  Description of Artificial Sequence: Synthetic coding sequence
atgacctcagctgtggtggatagtggaggcacaatactcgaattatcaagtaatggtgtagaaaatcaggaagagtccgagaaagtgtccgaatacccagccgtgatcgtcgagcccgtacctagtgccaggctggaacaaggctatgcagcccaggtgttggtctacgacgatgaaacctacatgatgcaggacgttgccgaagaacaagaggtagagactgagaacgtggaaacagtcgaggcctccgtgcattccagtaacgctcactgcaccgataaaactatcgaggccgctgaggctctgttgcacatggaatcacccacttgcctccgcgattccaggagcccagtggaggtctttgtcccgccttgtgtttctactcccgagttcattcacgctgccatgcgcccagatgtgattaccgagacggtggtcgaggtcagcaccgaagaatctgaaccaatggataccagccctattcctacctcaccagactcgcatgaaccaatgaaaaaaaaaaaggttggcagaaagccgaagacacagcagtctcccatttcaaatggctccccagaacttgggatcaagaagaagcccagagaagggaaaggaaataccacctacctctgggagtttctgctagaccttttgcaagacaagaacacttgtcctcgatacattaaatggactcaacgagagaaaggcatctttaagttggttgactcgaaagccgtgagtaagctctggggcaagcataagaataaacccgacatgaactatgagacaatgggcagagccttacgctattactatcaacggggtatcctcgcaaaagtcgagggacagcggttagtgtaccagttcaaggatatgcccaagaacattgtggtgattgatgacgacaagagcgagacctgcaacgaggatttggcaggtaccaccgatgagaaaagcctggagcgggtgtcgctgagcgcagagtcattattgaaagccgcaagttccgtgaggagtgggaagaacagctcccctataaactgcagccgggcagaaaagggggtagccagggtagttaacattacttctcccggtcacgatgccagcagcagatcgcctacgactaccgcatccgtgtctgcaacagccgctccgaggactgtcagggtcgccatgcaggttcccgtggtcatgacatcactggggcaaaagatcagtaccgttgcagttcagtccgtcaacgccggagctccgctgattacaagcacgagccctaccacggccaccagtcctaaggtggtcatccagacaatccccacagtgatgccagcttctacagagaacggagataaaattaccatgcagccagctaaaatcattactattcccgcaactcagctcgctcaatgccagctgcagacaaaatcaaatcttaccggcagtggctctataaatatcgtgggaaccccactcgccgtgcgagcgctgacaccagtgagcattgcgcacggcactcctgttatgcggcttagcatgcccacccagcaggcttcggggcagactccaccaagagtgatcagtgccgtgattaagggccctgaagtcaaaagtgaagctgtagctaagaaacaagaacatgatgtcaaaacactgcagttagtggaggagaaaccagcagacgggaataagaccgtcactcatgtggtcgtggtgagcgcaccctccgctatcgcgctgccggtaaccatgaaaacagaaggactggtcacttgtgaaaaatag

SEQ ID NO: 55688 - DNA, 1746 bp, Artificial Sequence
  Description of Artificial Sequence: Synthetic coding sequence
atgacatccgctgtggtggactctggaggaactattttggaattgagctcaaacggagtggaaaatcaagaggagagtgaaaaagtctccgaatacccggcagtgattgttgaacctgtgccctccgccagactggagcaaggttatgccgctcaagttttagtgtacgacgatgagacctacatgatgcaagacgttgccgaagaacaagaagtcgagactgaaaacgtggagacggtagaagcaagcgtgcactctagcaacgcacactgcactgataagaccatcgaagctgcggaagcccttttacacatggagtctcccacttgtcttcgggattcccgcagtcccgagtttattcacgctgccatgaggcccgatgttataaccgaaacagtggtagaagtctctacagaggaaagcgagcccatggacacctccccaatccctactagcccagactcccatgagcccatgaaaaagaagaaggtaggaaggaagcccaaaacccaacagtcacctatatctaatggctcccccgagctgggaataaaaaaaaagcctcgggagggaaagggtaacactacttatctgtgggagtttctgttggacttgcttcaggacaagaatacatgtccacgctacattaaatggacacagcgcgagaagggcattttcaaattggtggatagcaaggctgtgtcaaagttgtggggaaaacataagaacaagccagatatgaattatgaaaccatgggccgagctctgagatactactatcagcgcggtatcctcgcaaaagtggagggtcagcgactggtgtaccagttcaaggatatgcctaaaaacatcgtcgtgatcgacgacgataagagtgaaacttgtaacgaagacctggccggtacgacagacgagaaatccctagaaagagtgtctcttagcgcagagagtctgcttaaagctgcctccagcgtgcgttccggcaaaaattcaagccccattaattgctctagggccgagaaaggcgtggcaagagttgtgaatattacttctcctgggcacgatgcttcgagtagatctccaacaaccactgctagcgtgagcgccacagctgctcctagaacagtgagggtcgccatgcaagtcccagtggttatgaccagcttaggccagaaaatttccacggtggctgtgcagtcagtgaatgcaggcgcacctctgatcacatctacttcgcctaccaccgccacctccccgaaagtcgtaatacagacaatccctacagttatgccggcatccacggagaatggcgacaagataaccatgcagcccgctaagattattaccattccggctacacagctggcacaatgccagttgcaaactaaaagtaatttaacaggaagtggcagtattaatattgtggggacccccctcgccgtgcgcgctctaacccccgtctcaatcgcccacggaacaccagtgatgcgcttatccatgcctacacaacaggctagtggacaaacccctcctagggttatctcagctgtgatcaagggacccgaagtgaagtccgaagccgtggccaaaaagcaggagcacgatgttaaaaccttgcaactggtagaagagaagcctgcggatgggaataaaacagtgacacacgtcgtggttgtgagcgctccaagcgccatcgcgttgccggtgaccatgaagacagaaggattggttacctgtgagaagtag

SEQ ID NO: 55689 - DNA, 1191 bp, Artificial Sequence
  Description of Artificial Sequence: Synthetic coding sequence
atgagtgtcatcgtcttcaaagggaatactacatatttgtgggagtttttgctagacctgctgcaggacaaaaacacctgcccccgttatattaagtggacccaacgtgagaaagggatctttaagctggtggatagtaaggctgtttctaagctctggggtaaacataagaataaacccgatatgaattatgagaccatgggcagggccttacgttattattaccagcgcggaatcctggctaaggtggagggacaaagattggtgtatcagtttaaggatatgcccaagaacatcgtcgtgatcgacgatgataagagtgagacatgtaacgaggacttggctggcacgacggatgaaaaaagtttggagcgggtcagtttaagcgccgagtctctcctgaaagccgctagcagcgtgcgctcagggaaaaatagcagtcctattaattgctcccgggcagagaaaggcgtcgccagagttgtgaacattacgtcacccggacacgacgccagctctaggagtcccacaactaccgctagcgtaagcgcaaccgcagcccctcggacagtgcgggtagccatgcaggttccagttgtcatgaccagcctgggacagaagatcagtaccgtggccgtacaatctgtgaatgcgggagccccattgatcacttccacctccccaactactgccacaagtcctaaagtggtgatccagaccataccaacagtgatgcctgcttcaactgagaacggcgataaaattacaatgcaacctgcaaagattatcaccatcccagctacacagctggcccagtgccaacttcagaccaagagcaatttaaccggctccggctccatcaacatcgttgggacacctctcgcagtgagagctctcaccccagtgtccatcgcccacggcacaccagtcatgagactttctatgccaacgcaacaggcctcagggcaaacgccgccaagagtcattagcgctgtcatcaagggcccagaagtgaaaagtgaggccgtagccaagaagcaggaacacgacgtgaaaacactgcaacttgtcgaagagaagcccgcagatgggaataaaacagtgactcacgtcgtcgtcgtatccgccccaagcgccatcgccttgcccgtcacaatgaagaccgagggcctcgtcacgtgcgagaaatag

SEQ ID NO: 55690 - DNA, 2385 bp, Artificial Sequence
  Description of Artificial Sequence: Synthetic coding sequence
atggcttctccaaccttatcgccagatagctccagtcaagaggccctgagcgccccaacatgctctccgacctcagacagcgagaatttgtctccagatgaacttgagttattggctaaactcgaggagcagaatcgtctgctagaagccgattccaaatccatgcgttctatgaatggttcccgccgaaacagcgggagcagtctggtgtcctcgtccagcgcgtcgagtaacctgagccatctcgaggaggacacttggatcctgtgggggcgaattgcgaacgaatgggaagaatggcgcaggcgcaaggaaaaattgcttaaagaactgatccggaaaggcataccccaccactttagggccatcgtctggcagttgttatgctcagcaacggacatgcccgtgaagaatcagtactccgagttactcaaaatgtcctctccttgcgaaaagttaattcgtcgggacattgcccgtacttatccagagcatgagttttttaagggacaagacagcctggggcaggaggtgctctttaacgtaatgaaagcttacagcttggtcgatagagaggtgggatactgtcagggatccgcttttatcgttggcttgctgctcatgcaaatgcctgaagaagaggccttctgcgttttcgtgaggctcatgcaggaataccgactgcgagagctgtttaagccgtctatggccgagttggggctgtgtatataccagttcgaatatatgttgcaggaacagctccctgacctgaatacgcatttccgctcacagagtttccacacctctatgtatgcaagctcctggtttttgactctgtttcttacaacatttccgttaccagtagccactcgggttttcgatatctttatgtatgaaggtttggagatcgtgtttcgagtagggctggcactgctccaagtgaaccaggccgaacttatgcagctggacatggaggggatgtcccagtacttccagagagtcattccacaccaattcgacagttgcccagacaaactcgtgctcaaggcctaccaggtcaagtacaatccgaagaaaatgaagcgactagaaaaggagtatgctgccatgaagtctaaggaaatggaggaacaaattgagatcaaacggctccgcacggagaatcgcctgctcaaacagagaatcgagactctggagaaaggtcaggtaacccgtgctcaggaggctgaagagaactacgtgataaaacgtgaacttgccgtcgtgcgccagcagtgcagttctgccgcagaggatctgcagaaggctcagtctactatccgacaactccaggaacagcaagaaaaccccagactcacagaggactttgtgtcccaccttgaaacggagctggagcagagtcggctgcgcgagacagagacactaggggcattgcgggaaatgcaggataaggttctcgatatggagaaacgtaacagtagcctgcccgatgagaataatgtcgcccagctgcaggaagagctgaaagcgctgaaggtgagagagggtcaggcagtggcatccacaagagagctcaaacttcagctccaggaactgagcgacacatggcaggcccacctggcacgaggtgggcgatggaaggaatcccctcggaaacttgtggtgggggagctccaggacgagctaatgtcggtgcgtctccgagaggcacaggctttggctgaaggcagggagctacggcagcgcgttgtggagttggagacacaggatcacattcaccgcaacctgctgaacagagtggaagccgagagagcagccctccaggagaagctccagtatctggctgcacagaataagggactccagacacagttgtccgaatcaagacgtaagcaagccgaagccgagtgtaagtccaaagaggaggtgatggcagtaaggttgcgcgaagcagactctatggctgccgtggcggaaatgcgccagagaattgctgaactcgaaatacagcgggaggagggccgtatacaaggacagcttaaccacagtgatagctcccaatacatacgggaactaaaggaccagatcgaagagcttaaggcagaggtccgattgttaaagggaccccctccctttgaggaccctctggcatttgatggcttatcactcgctcgtcacttggatgaggattctttgccatcctctgacgaagagttactgggtgtgggagtgggcgctgcgctccaggatgccttgtatcccttgtcacccagagatgctaggttttttcggaggctagaacgcccagccaaggattctgaagggagttccgactctgacgctgatgaactggccgcaccctacagtcagggcctcgacaattag

SEQ ID NO: 55691 - DNA, 2418 bp, Artificial Sequence
  Description of Artificial Sequence: Synthetic coding sequence
atggcgtccccaacattgagccctgacagttcgtcacaggaggcgctgtccgctcctacttgtagccccacctcagattcagagaatctgtctccagatgaactggagcttctcgccaagctggaggaacagaaccgactgcttgaggccgattcaaaatcgatgcgttccatgaacgggagtcgcaggaactcgggctcctctttggttagttcgagcagcgcatcttccaatctttcgcacctggaggaggatacgtggatcctctgggggcgaattgcaaacgagtgggaggagtggaggcggcgaaaggagaaactgttgaaggaactcatccgaaagggaatacctcatcatttcagggcaatagtctggcaactgctttgtagcgccactgacatgcctgtgaagaatcagtacagcgagctgcttaagatgtcgtctccatgtgagaagctgatcaggcgggacatcgccaggacctatcctgaacacgaattcttcaaaggccaggattccttgggccaggaggtgctgtttaatgtcatgaaagcctacagcctggtggatcgcgaagtggggtattgtcagggcagtgcttttatagtggggttgctcctcatgcaaatgcccgaggaagaggcattttgcgtctttgtgaggctcatgcaggaataccggttacgggaattattcaaaccctctatggccgagctggggctgtgtatttatcagttcgaatatatgctacaggaacaactgcccgacctaaacacccacttccgctcacagtctttccacacttcaatgtacgcatcaagctggtttttgacgctgttcctaacaaccttccccctgcccgtggccaccagagtgtttgacattttcatgtacgaaggattggagattgtgttccgcgtcggtctggcgctgcttcaggttaatcaggctgaactgatgcagcttgatatggagggcatgagtcagtactttcagagagtcattccacaccagttcgatagttgccccgacaagctggtgctgaaggcttaccaggttaaatacaacccaaaaaaaatgaaaagattggagaaagagtacgccgcaatgaagagcaaggaaatggaggagcagatcgaaattaagagactgaggactgaaaaccgactgctcaaacaaaggattgaaaccttagagaaggagtctgccgctctggctgataggctcattcaggggcaagtgacacgcgcacaggaagcagaggaaaattatgtaataaaaagagagctggccgtcgttagacagcagtgctcctccgctgctgaagatctccagaaggcccagtcaacaattaggcagctccaggaacagcaggagaatcctcggctcaccgaggactttgtaagccacctggagacggaactggaacaaagtcggttgagggaaacggagactctcggcgcattacgtgagatgcaggacaaggtgctggacatggagaagagaaatagcagcctgcctgacgaaaataacgttgcccagttgcaggaagaactgaaggctcttaaagtgagggagggacaggcagtagcatcaactcgcgaacttaaactgcagctccaggagctctcggatacctggcaagcccatctggccagaggcggtaggtggaaggaatctccgagaaaactggtagttggggagctgcaagacgagctgatgagcgttcgcttacgcgaggcccaggcactggccgaagggagagaactgcgccagcgggtcgtggaactggaaacccaggaccacatccatcgcaatttgctcaacagagtggaagcagagcgcgcagctctgcaggaaaaattacagtatctcgccgcacagaataagggcttgcagactcaactaagcgaatctcgccgaaagcaggcagaggcggaatgcaagtccaaagaggaagtcatggccgtgcgtctccgcgaagccgattccatggcagcggtcgcagagatgcgccagcggatcgcagaattggagatccagcgtgaggaaggcagaatccaggggcaactcaatcactccgactcttcacagtatattcgggaattaaaggatcagattgaagagctcaaggccgaggtaagattgttgaaggggcctcctcctttcgaggacccactggcctttgatgggctgtccctagccagacacctggacgaggattctctgccatctagcgacgaggaacttttgggcgttggagtgggagccgctctgcaagacgccctgtaccccctctctccgcgagacgccaggttttttaggaggctcgaaaggcctgccaaggattcagagggatctagtgacagtgacgctgatgagctcgctgccccatattcgcagggcttagacaactag

SEQ ID NO: 55692 - DNA, 7740 bp, Artificial Sequence
  Description of Artificial Sequence: Synthetic coding sequence
atggccgaggcagttaagccacaacggagagctaaagccaaggcctcccgtaccaagacaaaggagaaaaagaagtacgagactccacagcgggaggaatcatctgaagtgagtttgccgaaaacatcaagagaacaagaaattccatccctggcctgtgagttcaaaggggaccaccttaaggtggtcacggactcccagttgcaggacgatgcctccggccagaacgagagcgaaatgtttgacgtaccactcacctccctgaccatctccaacgaggagtctctaacctgcaataccgaacccccaaaggaaggaggcgaggccagaccgtgcgtcggagattcggctgttacgccaaaggtgcacccaggcgacaatgtggggaccaaggtagagactcctaaaaacttcacagaagttgaagagaacatgtcggttcagggcggactgtccgagtcggccccacagtctaatttctcttatactcagccggctatggagaatatccaggtgcgggagacacaaaacagcaaagaggataagcaggggcttgtctgttcatccgaagtgcctcagaacgtcggtcttcagtcaagctgcccggctaagcacggattccagacgccacgtgtgaagaagctctacccacaactccccgcagaaatcgccggtgaggccccagccttggtggccgtgaaaccccttcttagatcagaaagactatacccggagctaccatcacaattagagctagttcctttcaccaaggaacagctcaagatcttagagccaggatcctggttggagaacgttgagagctatctggaagagtttgactctatggctcaccaggaccgccacgagttttatgagctcctgctaaactatagcagatgcaggaagcagctgctgctcgccgaggcggagctactgaccctgacgtccgactgtcagaacgcaaaatctagactgtggcagttcaaagaggagcagatgtctgttcaggggatttgcgctgatcaggtcaaggtttttagctaccacaggtatcaaagagttgagatgaatgagaatgctttggtcgaactaaagaagctgtttgatgcaaaatccgagcacctgcaccagacgctggctctgcatagctacacgtcagttctttctcgcttacaggtggagtcctatatttatgccttgctatcaagctccgctgtgcttcggagctcagccattcaccagcagggcagagcatccaaacagaccgagtccatcccctccgatctgtgccaattgaaggagtgtatttcagtacttttcatgttcacaagaagagtaaatgaagacacgcagtttcacgatgatatactgctgtggttgcagaaattggtttctgtgttgcagcgagtcggatgtccaggggatcatctgtttctcctgaatcatatcttgcgatgtcccgctggcgtttcaaagtgggccgtgccattcatccagattaaagtgcttcataatccgagcggcgtgtttcacttcatgcagagcctggcgcttcttatgtccccagtgaaaaatagggcagaatttatgtgtcatatgaaaccgagtgagcgtaaaccctcctcgagtggtcccggttcaggcacctggactctggtggatgaagggggtgaagaggacgaggaccctgagacttcttggatccttctgaacgaagacgacttggtgacgatcctggcccagttcccttttcacgagctgtttcagcacttgctgggattcaaagccaagggggattacttgcccgaaaccaccagacctcaggagatgatgaaaatatttgcctttgccaattctctcgtcgaattgctggctgtgggattggagacatttaaccgcgcacggtacagacaatttgtcaagcgcatcggctacatgatccgtatgaccctcggctatgtgtccgatcactgggcccaatatgtctcccacaatcaagggtctgggcttgctcaacagccctattctatggagaaacttcaggttgagttcgatgaattgttcttgcgtgctgtgctccacgtgttaaaagctaagcgtctcggaatctggttgttcatgagtgagatgccattcgggacactttcggtgcagatgttgtggaagctcttctatctcatgcatcaagtcgaatccgaaaatctccagcagctctcctccagtctgcagcctgcacagtgtaagcagcagcttcaggatccagaacactttactaattttgagaagtgcctctcatctatgaactcttcagaggagatttgcttgcttacgacatttgcacagatggcacaggccagacgaacaaatgttgatgaagatttcatcaagatcattgtgctggagatttatgaagtcagctacgtgaccttgagcacacgggaaacatttagcaaagtggggagggaactactcggtaccattacggctgtccatcctgaaatcatctccgttctactggacagggtgcaggagactattgatcaggtcggcatggtctccctttacctattcaaagagcttcccctttacctctggcaaccaagtgcctcagaaatagcagtgattcgtgattggttactgaactacaacctgactgttgtgaagaataaacttgcatgtgtgatactggagggactgaactggggtttcgcaaagcaggccacgcttcacctggatcaggcggtccacgccgaagtggctttgatggtccttgaagcctaccagaagtacttggcgcagaagccctatgccggaatcctcagtgaaagcatgaaacaggtgtcgtacttagcatcgattgtgcgttacggtgaaacccctgagacctcattcaatcagtgggcgtggaatttgatactgagattaaaactccacaagaacgattacggtatccaacccaactgccctgccgtgccattctctgtgacagttccggacatgactgagtcacctaccttccaccctctccttaaagccgtgaaggcaggaatgcccattgggtgttatttggctctttccatgacagccgtaggccactccattgaaaagttctgtgctgaagggattcctctgctagggattcttgtgcaatcgagacacttgcgtacagtcgttcacgtccttgacaagattctcccactgttctacccctgccagtactatctcctcaagaatgagcagttcctgtctcacctcctcctttttctgcatcttgactccggcgtcccccagggagtgacccagcaggtcacccacaaagtcgcgcagcacctcacaggggcaagccatggggacaacgttaagctgttaaattcaatgatccaagcccatatcagcgtctcaacacaaccgaacgaggtcggtccggtcgccgttctcgagttctgggttcaagctctgatctctcagcacctttggtatcgcgagcagcccatcctgttcctgatggaccatctgtgcaaagccgctttccagttgatgcaagaagattgcatccagaagctgctatatcaacaacataagaatgccctgggctaccactgtgaccggtctctactgagttctctggtgagttggattgtcgccggaaacattactcctagtttcgtggagggattggctaccccaacacaagtgtggtttgcctggaccgtgttgaacatggaaagtattttcgaagaggattctcaactgagacgggtgatcgagggagaactggtaatcaattctgccttcacccctgatcaggctctgaagaaagcccagactcagttaaagctgccaatcgtgccctcattgcagaggctcctcatttaccgctgggcccatcaggccctcgtcactcctagcgaccaccccctcctgcccctgatatggcaaaaattttttctactgtacctgcacagacctggtccacagtacgggctgcccatcgacggctgtatcgggaggcggttctttcagagccccgcacacatcaatcttctgaaggaaatgaagcggagactcactgaagtcgctgactttcaccacgctgccagcaaagcactcagagtcccagctgagggctccgaagggttacccgaaagtcactcaggcacacccggatacttgaccagccccgagctgcacaaggagcttgttcgacttttcaacgtgtatatcctttggttagaagacgagaactttcagaagggagatacttatataccaagcttgcccaagcattacgatattcaccgactcgcaaaggtgatgcaaaatcaacaagacctgtggatggaatatctcaatatggaacggatctatcatgagttccaggagaccgtgggactctggacacaggccaagctggagtctcactccacaccctgctccctgagtgtgcagcttgacttcactgacccactgctcgccaaggagagagtccttagcaacctgcgaaaacacgaggcaccacagcctcccttagccttacatcctacgaagccccctgtgcctgtaatatccagcgcagtactgttatcccaaaaagacgccacccaactcgtttgcactgatctaaacctgcttcagcaacaggcccgtaccgctgcactccgcgaatctcaacaggtcgcgctggacggtgaactcctggatacgatgcccaaacagtacgtgaacagagaggagcagactaccctgcacctggagtgtaggggttccagcggaaaaaagtgccagggcgctgccgtcgtgacggtgcagttcgaaggaatgcacaagaacgaagccatctcccaacagctgcacgtgttacgcaaggaggttaagcaactgcaagccgaggccgctaaaccgccttccctgaatattgttgaagccgctgttcacgcggagaacctcatcacggccctcgtgaacgcctacaagcttcagcctacgccaggcatccagaaagtgggtatttccttattctttacgatcgtggattacgtgtcagatgaaacccaaagacacccacctactaggcagttttttacttcctgtatcgagatcctgggccaggtctttatcagcggcattaagtccgagtgtaggaaggtgctggaaacaatcctgaagaatagtaggctgtgttccttactttcccctttctttaccccgaacgccgcacctgccgagttcattcaactttatgaacaggtggtcaaattccttagcgaggataactcagacatgatcttcatgctgttgacaaaattcgatctgaagcagtggttgagcgcgacaaaaccccctctttctgaccgtacccgcctgctggaatccattcatttggctctaaccgcttggggccttgagcccgacgaggatattctgatgccatttaatctcttctgcaagcattggacttatctactactgtaccaattcccagatcagtacagtgacattcttaggttactgatgcaatcttctgccgagcagcttctctctcctgagtgctggaaagccacactccgtgccctgggctgttgtgccccatcctgccagcagggagcagcatccacagagggtgcagtgctgccatcttcatccgatgcactgctttccgacaagcaggtaatggagaccatccagtggctcagcgatttcttttacaagctgaggcttagtaagatggacttcaagtcttttggtctgttctctaaatggagcccttacatggcggacgtaaagactttcctcggctacctggttaaacggttaatcgacctggagatgacctgcttagcacaggaccccactgccagtagaaaaactgttctgaagtctttgcattcggtgattattcaactgttcaaaccttggattctggtgcttgaggataatgagtccagtcaacaacggcactatccatggctggagtctgatacagttgtggcctccagcattgtccagctgttcacagactgcatagacagcttgcatgaaagcttcaaggacaaactgctgcctggcgatgcgggtgccctgtggctacacctgatgcattactgtgaagcttgcacagcgccaaaaatgcccgaatttatcctctacgcattccacagtacatatcggaagttgccatggaaggatcttcacccagaccaaatgctcatggaggccttctttaaagtcgagcggggttccccaaaatcgtgtttcctctttctgggcagtgtcctatgtgaagtgaactgggttagcgttctgtccgatgcttggaacagctcaccacaccctgagacgaggtccatgatcgtgtgtctgttatttatgatgatcctgttggccaaagaagtccagcttgtcgatcagactgactcgccgctcctctctctgctgggacagacttcctccctgtcctggcacttggtagatatagtgagctatcagagtgtcctctcttacttcagctcacactacccgcctagcatcatattagcgaaagagtcctacgccgaattaatcatgaaactgttgaaagtaagcgctggtctcagcatacccactgactcccagaagcacctcgacgctgtgcccaagtgtcaagcctttacgcaccagatggtgcagtttctgagcacactggaacagaatgggaaaattaccctagcggtgctggaacaggaaatgtccaagctgcttgatgatattatagtgtttaaccccccagatatggatagtcaaactcgccacatggccctctccagtctgtttatggaggtgcttatgatgatgaataatgcaaccatccccactgccgaatttcttagaggctcaattagaacgtggatcgggcaaaaaatgcacgggcttgttgtcttgcctctgcttaccgcggcatgtcagagcctggcatccgtccggcatatggctgagacaacggaagcttgtattactgcttattttaaggaatcaccgctgaatcagaactccggctggggacccatcctagtgtctctgcaagttccagaacttacaatggaggagttcttacaggagtgcctgacactgggatcgtatctgacactttacgtgtacctgttacagtgtttaaattctgaacagacactgaggaacgagatgaaggttctccttatcctgtcaaaatggcttgaacaggtgtatccttccagcgtcgaggaggaagccaagcttttcctctggtggcatcaagttctccagctctccctcatacagactgagcaaaatgactctgtgctgacagaatccgtcataaggatcttgcttttggtgcagagccgccagaatctggttgcggaagaacggttgagttcgggaatcctgggtgctatcgggtttggtagaaaatctccgctgagcaatagattccgggtagtggctcgatccatggccgctttcctttctgtgcaggtgcctatggaggaccagataagacttcggccaggatctgagttgcacctcacccccaaggctcagcaagccctgaacgccctcgagtctatggcatctagcaagcagtacgtagagtatcaggaccaaatactgcaggcaacccaatttattcgacaccccggtcattgtcttcaggacggaaagtcttttttagcactactggttaattgtctgtaccctgaggtccactacctggaccacattcggtac

SEQ ID NO: 55693 - DNA, 4071 bp, Artificial Sequence
  Description of Artificial Sequence: Synthetic coding sequence
atgatacaggcacacatctccgtttccacccagccaaacgaggtggggcctgtagccgtgctcgagttttgggtgcaagccctcatttcacagcatctctggtacagagagcagcccattctctttctaatggaccatctgtgcaaagctgccttccagctgatgcaggaggactgcatccagaaactgctgtatcagcagcacaagaatgccctgggctatcattgcgatcggagtctgctgtcctccctggtgagttggatcgtagccggtaatatcacgccttctttcgtggaaggactggccaccccaactcaggtctggttcgcatggaccgtacttaacatggaaagcattttcgaggaagattcgcagctccgcagagtgattgaaggtgaactggtgattaactccgcttttacccctgatcaagccctcaagaaggctcagactcagctgaagttgccgattgtccccagcctacaacggcttctgatttacagatgggcccatcaggctctggtaaccccatctgatcacccacttctgcctctaatctggcagaagtttttcctcctttaccttcacagacccggaccacaatacggtttgcccatcgacggctgtataggacgtcggttcttccaaagtccagcccacattaatctgcttaaggagatgaagcggagactcaccgaagtggccgattttcatcacgccgctagcaaagctttgcgggtgcccgcagaaggctctgaaggtctccctgagtcccacagcggaacaccagggtatttgactagccccgaactgcataaggaacttgtcaggcttttcaacgtttatatcctctggctggaggatgagaatttccagaaaggagacacttatataccctctctccctaagcactacgacattcacagactcgccaaggtgatgcagaatcagcaggacctgtggatggaatatttgaacatggagcgtatttaccacgagttccaagagactgttggcttgtggacccaggcgaaactcgaatcccattccaccccctgcagcctcagcgtccagttggacttcactgaccccctgctcgcaaaggaacgcgttctctccaatctgaggaaacacgaagctccccaacccccactcgccctgcatccaactaaaccacctgtgccagtgatctcctcagcggtcctgctgagtcaaaaggatgccactcagttggtgtgtaccgatctgaacctgctccagcaacaggcgcgaaccgcggcattgcgcgagagtcaacaggtcgccctggacggagaactgctggataccatgccaaagcaatacgtgaacagggaggagcagaccacgctgcatctggaatgtagaggcagcagcgggaagaagtgccagggcgctgccgtggttaccgtccagtttgagggcatgcataagaacgaagcaattagtcagcagttgcacgtgctacgcaaagaggtgaagcagttgcaggctgaagctgctaaacccccttccctcaacatcgtggaagctgcagttcatgccgaaaacctgataacagcccttgttaacgcatacaagttacagccaaccccgggaattcaaaaagttgggatctctctgttctttacgatcgttgactatgtttcggacgagacccaacggcatcctccaactagacagttcttcacatcgtgtatagaaattctgggccaagtgtttataagcgggatcaaatccgaatgccgaaaagttctggagaccatcctcaagaactcacgactatgctctctgctcagccccttttttaccccgaacgctgccccagcagagtttatccagctctacgagcaggtggtcaagttcctttccgaagacaattctgatatgattttcatgttgctcactaagtttgatctgaaacagtggctttccgctacgaagcctcctttgagcgatcgaacaaggctgttggagtcaatccatttggctctgactgcttggggacttgaacctgacgaggacattctcatgcctttcaacctgttctgcaaacactggacctacttgctactttaccagtttcccgatcagtattcagatattcttcgactgctcatgcaatcgtctgcagagcagttgctgtcaccagaatgctggaaggctacactgcgggcactcggctgctgcgcaccaagctgtcagcaaggggcagcatctaccgagggcgctgtgctgcccagctctagtgacgccctgcttagtgataaacaggttatggaaactatccagtggctttctgattttttttataaattacggttgtccaagatggactttaaaagctttgggctgttttccaaatggtccccttacatggctgacgtcaaaaccttcctggggtatctggttaagcgcctgatcgatctggagatgacatgcctggcccaggatcccaccgccagcaggaagaccgtgctgaagagcctgcattccgtcataattcagttattcaaaccttggatactcgttctcgaggataatgaatcaagtcagcagcgtcactatccttggctggagagcgatactgttgtggctagctccattgtccaattatttactgattgtattgacagcttgcacgagtccttcaaggataaattgctacccggagacgcgggagctctgtggctccacctcatgcattattgtgaggcttgcacagcaccgaagatgcccgagttcattctctatgcttttcactcaacttatagaaaattgccatggaaggatctgcatcctgatcagatgctgatggaggctttctttaaggttgaaagaggaagcccaaaatcatgcttcctgtttctggggagcgtcctgtgcgaagtgaactgggtctccgtcctgtctgatgcttggaatagcagtccccatccggaaacacggtctatgattgtctgtctcctgttcatgatgatactactggctaaagaagtacagttggtcgaccagacagattccccattgctgtctctcctgggtcagacaagttctctgtcatggcacctcgtagacattgtctcttaccagtctgttttgagttacttttctagtcattatcccccaagcatcatcctagccaaagaaagctatgccgaacttattatgaagctgctcaaagtgagcgcgggactctctattcccacagactcccaaaagcacctggatgcagtgccgaaatgccaagccttcacccaccagatggtacagtttttgtctactctggagcagaacggaaagattactctcgcagtgctggagcaagagatgtccaagttgctggatgatataatagtgttcaacccccctgatatggattctcagaccagacacatggcgctaagctctctcttcatggaagtcctgatgatgatgaacaatgcaactatccccacagcagagttccttcggggatctatccggacgtggattgggcagaaaatgcatgggctggttgttctgccccttctgacagcagcctgccagtccttggctagtgtgaggcatatggcagagaccacagaagcctgcatcactgcctacttcaaggagagcccccttaatcagaacagcggttggggcccaatacttgtctccctccaggttcccgaactcactatggaagagttcttacaggagtgcctcacactgggaagctacctcactctctacgtttaccttctgcagtgtctgaattccgaacaaacactacggaacgagatgaaggtgttgctgatcctgtccaagtggctggaacaggtgtacccatcttccgtggaagaggaggcaaagctcttcctgtggtggcaccaggtgttacaacttagcctgattcagacagaacagaacgacagcgtgctgacagagtcggttatcagaattctgctccttgtgcagtctcggcaaaatctggtggccgaggagagactttctagtggaattctgggtgctatcggcttcgggagaaagagcccactgagcaacagatag

SEQ ID NO: 55694 - DNA, 1524 bp, Artificial Sequence
  Description of Artificial Sequence: Synthetic coding sequence
acaacacccgtggagcgcggaagtccaaaatcgtgctttctcttcctcgggagtgtgctgtgtgaagtgaactgggttagcgtattgtctgatgcttggaattccagcccccatcccgagacgcgatccatgatcgtttgcttattattcatgatgattctccttgcgaaagaggtgcagctggtagaccagactgatagcccactcctcagtctgctcggacagacaagtagcctatcttggcacttggtggatatcgtgagttaccagagcgtcctgtcctatttctccagtcattaccccccatcgatcatcttggcaaaggagagctatgccgaactcatcatgaagctcctgaaggtgagcgcaggcctgagcattcccaccgattctcagaagcatttggatgccgtgcccaagtgtcaagctttcacgcaccagatggtgcagtttctcagcacactggaacaaaacggaaaaatcactctcgccgttctagagcaagaaatgtctaagctgctagacgatataattgttttcaatcctcccgacatggattcccaaactcgacatatggccctctcctccctttttatggaggtgctgatgatgatgaacaatgctactatcccaacagccgaatttctccgtggcagcatcaggacatggatcggccagaagatgcacggactggtggttcttccactactgaccgccgcatgccagtcgttggcctcagtgagacatatggctgagactaccgaggcctgcattacagcctactttaaagaaagcccactcaatcagaactctggctgggggccaattttggtgtccctgcaggtgcccgagctcacaatggaggaattcctgcaagagtgcctgacgctgggttcgtacctgaccttgtatgtctacctgctgcagtgcctgaacagcgaacagaccctgcgtaatgagatgaaggttctgctgatactgagcaagtggctggagcaggtctacccatcctcggttgaggaggaggccaaactatttctatggtggcatcaggtgctccaactatcgctgatacaaacagagcagaatgactcagtcttgactgagagtgtgataagaatcctcctcctcgtccaatcacgacagaatctcgtggccgaggaacggctgtcctctgggatattaggagccattggctttgggagaaagtcaccactgtctaatagattcagagttgtggctagatccatggccgcattcctatcagttcaagtgccgatggaagaccagattcgtctgcgtccgggatccgagcttcacctgaccccaaaggcacagcaggctcttaatgcactggagtcaatggcttccagcaaacaatatgtcgaatatcaggatcagattttgcaggctacacagttcatccgacatcccggacactgcctccaagatgggaaatccttcctcgctctgctggtgaactgcctgtacccggaggtgcactatctggaccatataaggtag

SEQ ID NO: 55695 - DNA, 636 bp, Artificial Sequence
  Description of Artificial Sequence: Synthetic coding sequence
atgaaccggaagaagctacagaagctgacagacacattaactaagaattgcaaacacttcaacaaattcgaagtcaactgtttgatcaagctcttttacgatctggtcggcggagtagaacgccaagggttggttgtgggcctggatagaaacgcctttcggaacatcctgcacgtcacgttcggcatgactgacgatatgataatggatcgggtgttcagagggttcgataaagataatgacggatgtgtcaatgtgctcgaatggatccatggcttgagtttgttccttagagggtcgctagaagagaagatgaagtattgctttgaagtgttcgatctgaacggggacgggtttattagtaaagaagaaatgttccacatgctcaagaacagtctgcttaagcagccttccgaggaggaccccgatgagggaataaaggacctagtggagattaccttaaaaaagatggaccatgatcacgacgggaaattatcattcgctgactacgagcttgccgttagagaagaaaccctcttgctggaggctttcggaccatgtctcccggatccgaaatctcagatggagtttgaagctcaggtgttcaaggaccccaacgagttcaatgacatgtag

SEQ ID NO: 55696 - DNA, 480 bp, Artificial Sequence
  Description of Artificial Sequence: Synthetic coding sequence
atgaaccgcaaaaaactacagaaattgaccgacactttgactaagaactgtaagcatcttttcagagggttcgataaggacaacgacggctgtgtcaacgttctggaatggatccacggactatctttatttttacggggttcccttgaggaaaagatgaagtactgttttgaagtttttgacttgaatggtgatggtttcattagcaaagaggagatgtttcacatgctgaagaattctttgctgaagcagccctctgaagaagaccccgatgaaggaattaaagacttagtggagataacattgaaaaaaatggatcacgaccacgacggaaagctgtcgtttgctgattacgagctcgccgtgcgcgaggaaacactgctgctggaggcatttggaccttgcctcccggatccaaaatcccaaatggagttcgaggcacaggtcttcaaagatccgaacgagttcaacgatatgtag

SEQ ID NO: 55697 - DNA, 636 bp, Artificial Sequence
  Description of Artificial Sequence: Synthetic coding sequence
atgaatagaaaaaagctgcagaagctgaccgacaccctaacaaagaactgtaagcactttaataagtttgaggtgaattgcctgatcaaactcttctatgacctggtaggaggagtggaacggcagggcctggtggtgggattggaccgcaatgcctttcgcaatattctccacgtgactttcggcatgactgacgacatgattatggatcgcgtatttagagggttcgataaggataatgacggctgcgtcaatgtgttggagtggattcacgggctgagcttgtttctcagaggctcacttgaagaaaagatgaaatattgtttcgaggttttcgatctcaatggggacgggtttatcagcaaagaggaaatgttccatatgttgaagaacagcttactgaagcagccgagcgaggaggaccccgacgaaggcatcaaagacctggtcgagattactctgaaaaaaatggatcacgaccacgatgggaaactgagcttcgccgattacgagttggctgtcagggaagaaacgctcttactggaggcgttcggcccatgtttgccggaccccaagtctcagatggagtttgaagcccaagtgttcaaagaccctaacgagttcaacgatatgtag

SEQ ID NO: 55698 - DNA, 390 bp, Artificial Sequence
  Description of Artificial Sequence: Synthetic coding sequence
tgagttaatgtgctagagtggatccacggtcttagcctgttcctccgagggtctctggaggaaaagatgaaatattgcttcgaagtgttcgacctgaacggagacggcttcataagcaaagaggaaatgttccacatgctaaagaattcccttctgaaacagccgtccgaggaggaccctgacgaaggaatcaaggacctcgtggaaattactcttaaaaaaatggaccatgaccatgacggcaagttgtccttcgctgactacgagcttgccgtgcgggaggaaacattgctgcttgaagcatttggaccctgccttcctgatccgaaaagtcagatggagttcgaggcacaggtgtttaaggacccaaacgagttcaacgacatgtag

SEQ ID NO: 55699 - DNA, 480 bp, Artificial Sequence
  Description of Artificial Sequence: Synthetic coding sequence
atgaatcggaagaagctgcagaagttgaccgacacattaacgaagaactgcaaacacctgtttcggggtttcgataaggacaacgacggctgcgtcaacgtcctggaatggattcatgggctgtcactgttcctgagggggtctctggaagagaaaatgaagtattgtttcgaagtgtttgacctaaacggggacggtttcatctctaaagaagaaatgttccacatgttaaaaaattctctcctcaaacagccctccgaggaagatcctgacgaaggcataaaagacttggtagagatcacattgaagaagatggatcacgaccatgacggcaaactgagtttcgccgactatgaactggcagtccgggaagagactctacttctggaggccttcggtccgtgtcttcccgacccaaagagccagatggaattcgaagctcaggtgtttaaggaccccaacgagttcaatgacatgtag

SEQ ID NO: 55700 - DNA, 384 bp, Artificial Sequence
  Description of Artificial Sequence: Synthetic coding sequence
atggaaacttcatccagggagctgcaggcggcagaatatcttgaaaaacaccagattaaagaagtggtttcatacttgacttcagcgctcctgtttttccggcctgaaaagccaaaagaatatcttatctctctgctggagcgtttgcggatcgctaaagttactggcgtcgcattccccttctttatggacaatagtaacatcgttgccatgttcgaaatgatggactcctccggacggggaaccatatcattcgttcagtacaaggaagcgttaaagactttgggactgtgtacagaggacgaggacctccaggacgatggacacaaaataaccctggataaattcaaagaggaggtcaataagaggatgaaagagatttag

SEQ ID NO: 55701 - DNA, 450 bp, Artificial Sequence
  Description of Artificial Sequence: Synthetic coding sequence
atgtcaagcatcaacccaaacacctctggaattctgctcgagggatttcttaacatcgtccgcaagaaaaaagaagctcagagataccggaatgaggtgcgtcatatctttactgcctttgacacctactaccggggttttctgacattagaggatttcaagaaggctttccgccaggtcgccccaaagctccccgaaaggacagtgctggaggttttccgtggattgaggattttctccaagtgcctactctgccatatagatcagaaatccaagaacccctcaagcggactgcttgctgccgactcgatcatccaggctcacccatcccctgtgcagattctccggcagatgtacataaacaacgagctagaggggcgtggcttcatctgggatagttctatctcatggcgctttatgtggaacatttatggaactggagagtactag

SEQ ID NO: 55702 - DNA, 492 bp, Artificial Sequence
  Description of Artificial Sequence: Synthetic coding sequence
atgtttttctctgaagctcgagccaggagtagaacctgggaggctagcccgtccgagcatcgcaaatgggtggaagtcttcaaggcctgcgacgaagaccataagggttatctgtctcgggaggacttcaagactgccgttgtgatgctgtttggatataaaccttcaaaaattgaagtcgattccgttatgagcagtatcaaccccaatacttcaggcatcttgctcgaaggcttcctgaacatcgtccgcaagaagaaggaggctcagcggtatcgcaacgaagtccgacacatcttcaccgcctttgacacctactaccgagggttcctgaccctcgaggattttaagaaagctttccgccaggtggcacccaaactgccggaacggaccgtcctggaagttttcagggaagtggatcgcgacagtgatgggcatgtcagttttcgggacttcgaatacgcattgaactacggccaaaaagaagcttag

SEQ ID NO: 55703 - DNA, 420 bp, Artificial Sequence
  Description of Artificial Sequence: Synthetic coding sequence
atggtgtttaaagcctgcgacgaggaccacaaggggtatctgtctagggaagacttcaagacagcagtagtgatgttgtttgggtataagccaagtaagatcgaggttgactctgtgatgtcctccatcaatccaaatacgagcggcatcctgctggaggggttcctgaatattgttcgcaaaaagaaagaggcccagagatatcggaacgaggtcagacatatctttactgcctttgatacttactatcgcggatttctgaccttggaggatttcaaaaaagccttcagacaagtggccccaaagttaccagagcggaccgttttagaggtgtttagggaggtcgacagagactcagatggacatgtgtccttccgggattttgagtatgccctcaactacggccaaaaggaggcttag

SEQ ID NO: 55704 - DNA, 357 bp, Artificial Sequence
  Description of Artificial Sequence: Synthetic coding sequence
atggtgttcaaagcctgcgatgaggaccacaagggctacctatcaagggaggacttcaagactgccgtggtcatgctctttgggtacaagccatctaagattgaagtggacagtgtgatgtcttccatcaatccgaatacgtcaggcattttactagaaggtttccttaatatagtcaggaagaaaaaggaagcccagcgctaccgaaacgaagtgagacacatcttcacagccttcgacacgtattatagagggtttctgacactcgaggattttaaaaaagcttttcgacaggtggcaccaaaactgcctgagcgaaccgtgcttgaagtgttcaggggtattttcagtgcttag

SEQ ID NO: 55705 - DNA, 2355 bp, Artificial Sequence
  Description of Artificial Sequence: Synthetic coding sequence
atggagaccaaggttcacctcttctgccaggccgaagaaaacattgatctgctggatgatggtagtaactcatttgctactgatctaagctccggtacaatcaatcacaagaagtacattaagttttccaagactatcgagaaagaaatatcaccagaaatacgcagcctcagtcctgaatacaagaaaatcttcgagaccagcatcatcttctgtggagaagagaaatcttccgatttctcaggagaaaagaaggttggcaggaaatccctgcaggtgcaacagcacagtaagagaacggaaatcatacccccattcctaaaactttccaaagagaaagtgaccaggaaagagaatagcttgtgcaaactccccaatcaatattccgtccataaaacatctagcccgctgtgtacatcgagtgccatcactcgcgagaaagaaatgttgtctaatctttacatgacgctctacgacgaggttacgcatggctatctccattctaaggaactctccggtaatcacatggttgacatcggcgacattatcttcacactgaacgagttgcaggagcagtacgaggacgtttcaataaccgaggggtctccgctgaatgagattacgagcgaccgtaaactctcatctgtcgctggttgctacctgaaatataagaagaagaacagtctttcaagcaagcttcctgagccttcaatttcaaagaaactcaataagaagtctaaccagtattattcaaaaataatggaaaatgatgatctcgaaagcaagcgcccaaagaacacctggcagatccgcaaatttttaggaggagtggggtctagtaacgtaggtgttcaggagccctatagtaagaacggcattaactttaaaaagcactccgaaaagggcgagattcacgactccaagtccaagccgcagagtctgaaaagctcaacaagcttatccaagagtctcgacaaatcagatatttccagtattccaaaactccagaagcctgccgtcaggaagcatagttcccttcaaaagcaggtgtcttccaccgagaagaccgcaatctctaccctggaaaatttctgcgaggccatctccaaactccaagagaactatatagccgctgaagagcttcagtctattctgccatcaaccgggatcaatcttctagacgaggaattccagaagattgtgaccgacactagccgcaatgaaaatggcatggtggagcttgacgattttgtaaatgccctcgcgaaggaaaggtcttttccagagtgcaatgcactcccgggtgtgatcaaggccatcgacaaaatcaaggataaaaacgtggactatgaagatctcaacacctgtcttcaaaatttcggcatttacctcagtaaacctgaatttaaaaaaataactgaactgactgaagccggtgaaactaagaaagtaaattttaaggagtttatcgataccatgatgagcaacaccgaatgtttctcagagaaactcgtgcttcctgacgcaatcgagaccctagatgacctgcggaaggagaccatgtcagtgagtgacctatggaatactctgtcaagtttgaactcaaatctgaagaaggacgagtttctcgctgctctcgaattagtcaccgtagatgagggtgataaagtgcagttcgaggagtttgctaaggtggtccggaacatgagagatgccgcaagactcgaggagttacaggaggtggtactcgccgcagatctgctggaaggtgatatgattgctggtaaaaatcttgaggacttcctgagaaacgtgggcattaagtccccaaaagaagaagtcgagaagatactgcagagtgacttcgtaagtgaggataatatggtgaatataaaggattgcatgcgagctctgagggatacgcagaagttttccaactacatagattttcggaaggaagcttcgaacttgaaattacccaaagttaatgagatcaaagaggcagccaacatcctgtcgcacgtagacaacggaaaaatcggcatccccgatctggaacacgcactcaaatgcctgaatgtgaatcttactgaggaggacttcaatgaggcactgaattgctgtaatgtatccgacaacatggaggtcgatctgaaggacttcctgatgaaaatgaaggaaagcccacatttccagaagagcaaggccacgcagattctcctggctaccacccagatactgcagaacgatctcgtcgatgtttctgatcttaaaaccctgttaatggataaagacctacatactgccaacgctatattaacagtgatgctaagacacgttcctgaacatgggtag

SEQ ID NO: 55706 - DNA, 810 bp, Artificial Sequence
  Description of Artificial Sequence: Synthetic coding sequence
atgctaggaccaggccaggtccgcttacgccctagggtctggagggacaaagctgggggaagagtggccgacggggctagtggactacctccagcgagaggttcgtggcgcgaaactggcacgggtagggcactgggggcttcgagccctccacgaccagcccagggaagttcatcacccggtatccaatcaggccctagctcaagacccggtagcccaaggggcgcagaacaggccggtacgccccgtccgcgactctctctgggcatctcgcaggctacgggctcagccgcacgctggcggacccgcaggaccggaaaagggctgggctataactccgacgaaattagacccaggaccctgctcatcgaacacttgatggagggagggaggcgggatcaccataccatgaccgtgctctgggggacacaggaaatcatcgtggctgagtttcataaaaagatcaaggaagccttcgaagtgttcgatcacgaaagcaataatacagtggacgtccgagaaatcggaaccatcatcagatcccttgggtgctgcccaacagagggggagcttcatgatctaatcgctgaagtagaggaggaggaaccaacaggatatatccggttcgaaaaattcttaccggtgatgacggagatactgctggagcgaaagtaccgtcccattccagaagacgttcttcttcgcgcttttgaagtgctcgactcggcgaaacggggatttctgaccaaggacgaattaattaagtatatgacagaggaagacggggtgtcactccgacggccaggttag

SEQ ID NO: 55707 - DNA, 489 bp, Artificial Sequence
  Description of Artificial Sequence: Synthetic coding sequence
atggctgacgaaaaggaccgagaggagatcatagtggccgaattccataagaagatcaaagaagcatttgaagtctttgaccacgaaagcaataatactgtggacgtaagggaaatcggaaccataatcaggagcctggggtgctgccccacagagggagagctgcacgatcttatcgctgaagtggaagaggaggagcccacaggatatatcaggttcgagaagtttttgcccgtgatgaccgagattctgttggagagaaaatataggcctattccagaggacgttctcttaagagccttcgaggttctggactcagctaagcgtgggttcctgacaaaggacgaactcatcaaatacatgacggaggaaggcgaacctttttcacaggaggaaatggaagagatgctgtctgccgctatcgatcccgagtctaattctatcaattataaggattacattaccatgatggtgattgacgagaattag

SEQ ID NO: 55708 - DNA, 402 bp, Artificial Sequence
  Description of Artificial Sequence: Synthetic coding sequence
atggcagacgaaaaagaccgcgaagagatcatagtggctgaattccataagaaaattaaagaagcgttcgaggtgtttgatcatgagagtaacaataccgtggatgtgcgggaaattggaaccatcattcgtagtcttgggtgttgtccgactgagggcgagctgcacgatctcattgctgaagtggaggaagaggagccaacaggctacataagattcgagaaatttttgcctgtcatgactgaaatccttctggaaaggaaatacaggcccatccccgaagatgtgctgctgcgggcatttgaggtactggactcagcgaagcgaggctttttgacaaaagatgagttgattaaatatatgaccgaagaggatggggtaagtttgagacgtcctggttag

SEQ ID NO: 55709 - DNA, 1317 bp, Artificial Sequence
  Description of Artificial Sequence: Synthetic coding sequence
atggctgtgtctgaaattaaacctaaactaaaacttaatcccctgaccaaggtgcctatctcacacaacaagcgcgacagggacctccctgggtcgttgcagtgccagttgcagcataaagagaagaaactctcggcctctcagatggctgcattccaagatgcatataattttttctataaggacaaaactggatgcatagactttcatgggctgatgtgcacagtggctaaactaggcatgaatttgacgaaacacgatgtttataacgagcttaagtgcgccgatatagacagagacgggaaggtcaatttttcggacttcatcaaggtattgactgataagaatctgttcttgaaagccgtcgttccagagaaagagacttgtctagatctcgcgggtaaccccggaatcctcctctttgagatcctgtctcggctactcgaaacctcagccttgccccgtaagtccatcatagagatcgtgtcttatttccagcgaaagttccagcatactgggcctggcatgctctggtccccatatactatgggctacggaaaaaggactttgaagccagatatctgtactccaccatccagtagcatggcagcatttgctaatgcggctcgaatcgccatcatgaaagagaaggacttatttaagttcctggaggagctgaagagatgtaactctgggtcagactcaccatactcaaaaatcccaattttccccctattccccaacgtagacggggtcgtaatggggaagccctttaaagacatgcagaaactcgagatgcttcgaatcaaagagcctctgcacttcttcgaagactacttcttccacaaacgtgattggaagacccaggcggcaaacatcaagtcaatggaccccgcttccggttacagtaacaatatatttactatagaccagatgctgaagaaaaagcagacttgtaccgtggcggacgcaaccgcaatcaaacagcacgtaaaacgcgcaactgacacttacaaccttggcatcgcactggagcatcgaaaagagatgcttaatttgtggcagaagatcaggggagatctcattggcatggactcaagaaacgaaagcttctacgatacattttctacctatacttggtcttggaatgtgtgtcaggaacttctgtcaccaaaagacctgcgcctatatgacgcctacgttaatagaaacagttcccacaatagccgctcctcaagttctagtgacaccagtgaatgttatactgacagcggcaggaagcggaaaaggaagggtcttaagggtttccagcagtag

SEQ ID NO: 55710 - DNA, 489 bp, Artificial Sequence
  Description of Artificial Sequence: Synthetic coding sequence
atggccgtctctgagattaaacctaagctgaagcttaaccccttaacgaaagtgccaatttcgcataacaaaagagatagagatcttcccggatccctccagtgtcagttacagcataaagagaagaagctgagtgccagtcagatggcagcctttcaggatgcttacaattttttttacaaggacaaaacaggttgcattgatttccatgggctcatgtgcaccgtggccaaactaggaatgaacctgactaaacacgatgtgtacaacgagttgaagtgcgccgatattgaccgagatgggaaggtcaacttctctgactttatcaaggtactcactgacaaaaatctgttcctaaaagcagttgtgcctgaaaaagagacatgtctggatctagcaggaaaccccggtattctcctcttcgaaattctttcgaggcttctcgaaactagtgcccttcctcgcaaaagcattattgaaatcgtgtag

SEQ ID NO: 55711 - DNA, 525 bp, Artificial Sequence
  Description of Artificial Sequence: Synthetic coding sequence
atggccgtgtcggaaatcaaacccaaacttaagttaaatccgctcaccaaggttcccattagtcataacaagcgggatcgggacctgcccggttccctgcagtgtcagctgcaacacaaggagaaaaagctcagtgcctcacagatggccgcattccaagacgcttataatttcttctacaaggataaaaccgggtgtatcgatttccacggcctaatgtgcacagtggctaaactaggaatgaacttgacgaaacacgatgtgtacaatgagttgaagtgcgctgacatcgatcgcgatgggaaggtgaacttctccgacttcatcaaggtcttgacagacaagaaccttttcctgaaagcagttgttcctgagaaggaaacgtgcctcgaccttgccggaaatcctggcatcctgctttttgaaattctctctcgactgttagagacgagtgccctgcccaggaaatctataattgaaatcgtgagctactttcagcgtaagtttcagcacactggaccatag

SEQ ID NO: 55712 - DNA, 1473 bp, Artificial Sequence
  Description of Artificial Sequence: Synthetic coding sequence
atgaaggagcttatgcctcacctgaccttcaacgggaacggcaaaataaatgtgaacagtattatggagggactgaaaaaatttaagcctaagggcatggttactctgcataagcttaagaccgcaaacgacatcaaggacagggtgacagggcacatggccgtttcggagatcaagcctaagctcaaactgaacccactgactaaagtacccatatcacataataagagagatagggatcttcctggatctcttcagtgtcagctgcagcataaagagaagaaactgagtgcttcccaaatggcagcttttcaggacgcgtacaacttcttctacaaggacaaaacagggtgcatcgacttccacggcctgatgtgcacggtcgccaagttgggaatgaatttgacaaagcacgacgtgtataacgaattgaagtgtgccgacatcgatagggatggaaaagtcaacttttcggattttattaaggttttgaccgataaaaatctgtttctgaaagcagtggttcccgagaaggagacttgcctagacctggctggaaacccaggtattctcctgttcgaaatcttatccaggctgttggagacatccgcgctgccaagaaagtctatcatcgagatagtgtcttactttcagcgcaaattccaacatactgggccaggcatgttatggagtccatacacgatgggatacggaaaacgtaccttaaagcctgatatttgcacaccaccctcatcatctatggccgcttttgctaacgcagccagaattgcgattatgaaggagaaggatctgtttaagttcctggaagaattaaaaagatgcaatagcggcagcgacagcccttattctaagatccctatcttcccactgttccccaacgttgacggagtggttatgggcaagccatttaaggacatgcagaagctggagatgttgcgaattaaggaacccctccacttttttgaggattacttttttcataaacgggattggaaaacacaggccgctaatataaaatctatggatcctgcctctggctatagcaataatatctttactattgaccagatgcttaagaagaagcaaacttgcactgtggcggacgccactgccattaaacaacacgttaagcgggcaacagacacatacaacctgggaattgcgctcgagcatcgaaaagagatgcttaacctgtggcaaaagattagaggagacttgattggcatggattccagaaacgagtcattctatgacaccttctctacatacacatggagttggaatgtatgccaggagctgctgtccccaaaggatctgcgcctgtatgacgcttatgtgaaccggaattcatcacataatagccgctcgagctcctccagcgatacctccgaatgctatacagactccggcaggaaacggaaacgcaagggccttaagggattccagcagtag

SEQ ID NO: 55713 - DNA, 4140 bp, Artificial Sequence
  Description of Artificial Sequence: Synthetic coding sequence
atgaatgaatcagccagccaggaggagttgcgtcctgctcaggaaaataggaaagaggacaaagaacgcaaatggaatctgacagaagtgaaagaacttcacgaaacactccagtctgttcccgatgtacctgtgaaggaggacaccaacagtgttgtcgagaaagccatggacgagataaagtcacaggaactcaacctggaaggacagcggaagatctccccgggtagcatcaaggacagtaagaccgaggctagcggaaacatcgccatcaggaagagcgctaaggtcatattcgcccttgacgaaacagaactcaagtctaaacctgaacatacttggaagaaaaatctctttgagcgcatggaggccagagctcaggccatgcagcagaaaattattgataaagagaacttgaagaaggaactcgaaaaaaaggcagagaagaagctccccagggacaacttagctaaagaatggtttaacactgactccatgactctgaacaacactgcttatctactggataagctgctgcccaccctcgttcctggtgtagagaacatgttgactcaggtggagaagaagaaggtgctcaccgaggccgatactcctagcaaattcgatccgatcaactaccttggggaatacctgatccgtaacaaccctaattatatcaaagatccaggaatgagcggctaccaaaggctgatgaaggaggtcacagaagatctgaagatctacgtgcccgatactatatgcaatagagtgagcaaaatgaaggaaaacgtgaagcaaaacagaaaacagcgggagtctattgacaagatcatcgttaaagtggctaacacacgtaaacaagcgctccaagagcagtttgacgagtggatactcgaccctaaaggtatgatccctaagagtgtcatccagaatgtgctccaggagttctttcaaaatcctgacttcaaactgggctcccattgcaagcagctcgacatcacggactcaacggaacccagattaaataagatggagtttacagagtacatcagctcccacataaaggacctgaaatcggaaatgttcgaagagctcctcaaacacctgtgccattccgcagatgagtttcgggaagtgatcaaggccgatatgaggcggcaaatgtttgccgagcttttcctgcactgcgaccacggaaaggtggggttcctggatagacagcggactctggccctgctcgaattgttctacgatcacagttctcagatgcttagaagcctgctacggaatccgagacagtggccctttatagagttcgaagaaatcaacctaactgagttatggggagacatggataaccaaaagcacatttatgagggttttgacaaggtgctgctggaaatgaacactctactgtctgccaatcacgctagcaaaactcaaagtaaactgctcgagagcccagatcaacccaagcttaatgagcaaagaactagcacgccttcccctaacccacccgagcagcaaagaggcgtgacagccgaacagggaccccagaggataagcattgaggagcagcagcagggaaaaaagcccaccgccgagcaggaactatacattgagagcgtgatcgaacctggaactcacactgagagcactctcgagcaagggtctagccgcagattgctgacggaacaggagacacatcgggaatcgactacagaacaggggcaacacaaagggtcaatcgagggtcagggcccacggcgagtttccgtaagcgaacagggtagctccagggaaagtgttgccgagcagggcagccgcagagaaagtatcgcagagcaggatagacacaaaggcagtgtggccgaacaggggagcagaaggatgtctgccgcagaacaaggcagcctgcgtgaaagcgtcatcgaggagccttaccagaagtcagaacaaggtccatatggcgagattattagcgaggagcaggaagacatcggcagcactagccagtcccgcaaggactccatactcaaatctactaaatatggcgagcccatcaccagtgagtatattgaggtgccccttcaggagaaaaggtcctgggaacaaacgtacgaggaagagatttttttgagttcggagttacaagaggaggtgccaacccttagtaggaaagaccacttcccagagacaactaaaaaggaagtacagaaagataagccatgtgagcctaaaagtcagaaaatcgaagggaaatcgtggagcggggaattcttcacttgcaactggaagatgaaatatgtgacatttgaggatgaagaacaggccaacttgatctatggtaactctaggttcaccgccaagctgcacattcagtttccaaaaccgcaccctgggcacgaggtgagactgtcatcaaaacagtttcagaactacatcgagctcgtggtgtctgaactgagaggtaacgaggatcaggtcttagagtctgtagttgagtttctgatgaacgcccttgagcgttcccacatagaaagcttgcgtaatagcgcgagacggaaatggctacaccagatccagtgcgcggctgagactagcggcgtgagtctggagccggtatattctgaaacattcaaggctctcatgcaagacgctgaggcacacggcaataagaaaatcagtgcccacatcagtttattagaggagaatttgctcttacctgagaagggaaatgtcttattacgaaatgttgcgtgtacgctggatgatgcgcagtttgtccttaaccgggttttgtacagggacatgaaagggatctccttcacagtggtggacgaaggaaaaccgattcacgtccctcaagtccagtatcacgggaacatttttttttggaatcagagccggaacaaacacgactataatgggagcttcctcgctctgcccctacaggacgcctatatgcgcattttcggcgtgctggcggtggatactctgcgagaccctcacgagatcaatatctttcttcctcacgagatcaggttttatcagggagtcgccaatgtgttcagtaccgcctaccattatgtgcacagccgggaacatatactccatatagtcatcactggaattggctggctctatgacgtcactagcagtatcacatccatcaccacatatttcgtagaaccctcccccgcacaggattccgattacgtccttcgaaatatgatggtgaccgggcagctcgggctgacagaaattcacaagaaccccccaaccatacaccgaaaatcatgcattttccgcgacttcctctttaaatgtaccgacagctctgaggtcgtgttggcaagcgcttgtggggaaacccacatcgtcgtgccattgcgagaacgtacgggggaagctctcggcgtcttggatttcaatattgggcaaaatagaatgcttttgtgccaggagtataaggacctgcagaagatgatgaaagtcgtgcaggtggcctgttacgagattctgggagaattttcaggagagatcaagaagaagtatatcctagagatcgaaaatgtcagggaagttcagcgggctggcatcttgttctttaggattatgttgctggagttacaggagtcaattcagcttcttaactccatggagttcgtgagtcttctcttgtacgaccacacactggtgaccgagcctaattcacctcaggattcaaagtcaatggagttggaggccaatgttaagctggttagagatatcttaaaagcagtcatcctgttctttcatccagaactcgaattcagttccgactttggcagctgggacaaatgcaagttttacgtgaacaagtatctggtgaacaacatttgcgcctttgatcccactgcaaagcatgttgaggtcaacgtgcagttaattgatgagtacattcgggaccactcaagaaccgaggtgtggaagtttggaaacgttgtcattgagcatctgtaccactggatccacatttgcagcgcccttatgaagatcacaaaacagctgaattctggaattacgcctcctctgcctagtaagaccgacaattacatgtacgccaaaatgcctggggagggactccaggaaaagtag

SEQ ID NO: 55714 - DNA, 2781 bp, Artificial Sequence
  Description of Artificial Sequence: Synthetic coding sequence
atgaacgagtcagcctcccaggaggagctgcgtcctgcccaggaaaatcgcaaggaggataaagaacgtaagtggaaccttactgaagtaaaggagcttcacgaaaccctccagagcgtgcccgacgtgcctgtgaaggaggacacgaactcagtggtggagaaagccatggacgaaattaagagccaggagcttaatctcgaggggcagaggaagatttccccaggttccatcaaagacagcaagaccgaggccagcgggaatattgcaatcaggaaaagcgcgaaagtgatttttgctttggacgaaaccgagctgaaatctaaacccgagcatacatggaaaaaaaatttgttcgagcgcatggaagccagagcacaggctatgcagcagaaaatcattgacaaagaaaacctcaaaaaggagctcgaaaaaaaggctgagaagaaactcccccgtgacaacctggccaaggagtggtttaatacagattctatgaccctcaataacaccgcttatttacttgataagctgctgccaacactggtccccggagtcgagaacatgctgacccaggtggaaaagaaaaaagtcttgacagaagcagacacgcctagcaagttcgaccccatcaattacctcggcgagtatctgatacgcaacaatcccaactacattaaagatccaggaatgtcgggttaccagaggttgatgaaggaagtaactgaggatttgaaaatttacgtgccagatactatctgtaatcgcgtgagcaaaatgaaggagaacgtcaaacagaaccgaaagcagagagagagcattgataaaatcatagtcaaggtggcgaatacacggaagcaggcactgcaggaacaattcgatgagtggattttggacccaaaaggaatgatccctaaatcagtcatccaaaacgtgctgcaggaatttttccagaacccggactttaagctggggagtcattgcaaacagctcgatataactgactccactgaaccaaggctgaacaaaatggaatttaccgagtacatctcgtctcatataaaggatttgaagagtgagatgttcgaggagctgctcaaacacctctgccactctgctgatgaattccgcgaggtgatcaaagccgacatgcggagacaaatgtttgctgaactttttcttcattgtgatcacggaaaggttggctttctggatcgacagcgaaccctggcgttgttggagctgttttatgaccattcttcccagatgctgagatccctgctgagaaacccaaggcagtggccctttattgagttcgaagagataaacctgacggaactgtggggcgacatggacaatcaaaagcacatctacgaaggcttcgataaagtgctgctagaaatgaacacgcttttatctgccaaccatgcaagtaaaacgcagagcaaactcctcgagtccccagaccaacctaagctcaacgaacagagaacaagcactcccagcccaaatcccccagagcagcaacgcggagtgacggcagagcaaggaccccaaaggatctctatcgaggaacagcagcagggtaaaaaacccactgccgaacaggaactctatattgagagtgttatcgagcccggaactcacactgagagtactttggaacaaggctcaagcagaaggcttctcactgaacaggagacccaccgggagagtacaactgagcagggccagcataagggttctatagagggacagggaccccgacgcgtgtccgtgtccgaacagggctcatcaagggaaagtgtcgcggaacagggatcaagacgtgagtcgatcgcagagcaagatcgacataagggtagcgtcgcagagcaaggcagtaggcggatgtctgctgcggagcagggctcgctgcgagagtccgtgattgaggagccatatcaaaagagcgagcaaggaccctatggcgagataattagcgaagaacaggaggacatcggctcaacttcccagtctcggaaagacagcattctgaagtccacgaagtacggcgagcctattacctcggagtatatagaagtcccactccaggagaagcgcagctgggagcagacctatgaagaagaaatcttcttaagttctgaactacaggaagaagtgcccacgctgtctcgcaaggaccattttcccgagacgacaaaaaaggaggtccagaaagataaaccatgcgagccaaagtctcagaagatcgaggggaagagctggagcggcgagtttttcacgtgcaattggaagatgaagtatgtaacttttgaggatgaagaacaagccaatctcatttacgggaactctaggtttacagacctgcactctatcatccgcaatatccagagttgtaaagaagtgaagggtcggaccgcatttaatggcgtctctttcaatttactccagttcgtgcaactgctggaaacgttcgtaggggaagatgctcccttatcagttagcgagacactgaccagcttttttaaggagggctatgttgagaccgaacaggaaaaaatgaacgctctcgagcagttcagccagaatgcctttcaagtacgtcaaaggctgctactcgaggctattttccaaaagtgggatagcgacggctccggctttctggatctcaaagaagttgacgaacttctctacacgtacaaggaggggatggaaaaagaatcaatgaagaagggcctcaccctgagccccggatggagtgctgtcgcacagctgtag

SEQ ID NO: 55715 - DNA, 2928 bp, Artificial Sequence
  Description of Artificial Sequence: Synthetic coding sequence
atgaatgaaagcgcaagccaggaagagctgcgccctgcccaggagaatagaaaagaagataaggaacggaagtggaacctgaccgaagttaaagagttgcacgaaactctgcagtcagtgccagatgtgccggtcaaagaagacactaatagtgtggtcgagaaggccatggatgagataaaaagccaagaactgaaccttgaaggtcagaggaaaatctctccaggctccatcaaggattcaaagactgaggcttccggcaacatagcgattaggaaaagtgccaaagttatttttgccctcgatgaaaccgagttgaagagtaagcctgagcatacctggaaaaaaaacctatttgaaaggatggaggcacgggcacaagctatgcagcagaagattatcgacaaagagaatctcaagaaagagttagagaagaaggctgagaagaagttgccgagggacaacctggctaaagaatggtttaacacggactcaatgactctgaataacacggcgtacctgctggataaattgctcccgaccctggtccccggagtcgagaacatgctcacacaggtggaaaaaaaaaaagttctgacggaagcggacaccccgtcaaaattcgaccctatcaattacttgggagagtacttgatccgtaacaatcctaactacatcaaagatccaggaatgagcgggtatcaacgtctcatgaaagaggtcacagaagaccttaagatctatgtcccagacacaatttgcaacagagtctcaaaaatgaaggaaaacgtaaaacaaaaccggaagcaaagagaaagtattgataaaattatcgtaaaggtcgccaacactcggaagcaggcactgcaagaacagtttgacgagtggatccttgacccaaagggaatgataccgaaaagcgtgatccagaacgtgcttcaggaattttttcagaatcccgacttcaagctgggcagtcattgtaagcaactcgacatcactgattcaacagaaccaagacttaataaaatggaattcacggaatacatatcttcccatatcaaggatctgaagagcgagatgtttgaggaattgctgaagcacctttgtcatagtgctgatgagtttcgcgaagtgataaaggctgacatgaggagacaaatgttcgccgaacttttcctgcactgcgatcacggtaaggtgggcttcttggaccgccagcggaccctggcccttcttgagttgttctatgatcacagcagccagatgctgcggagtctgctgagaaaccccagacaatggccctttattgagttcgaggagatcaacctgactgaattgtggggcgatatggataatcagaagcatatttatgagggatttgataaggtgctgcttgagatgaacacgctgctgtctgccaatcacgccagcaaaacccagtccaaacttcttgagtcacctgaccagcctaagctgaacgaacagcgcaccagtaccccctctccaaacccaccagagcagcaaagaggtgttaccgctgagcaaggcccacagagaatctccattgaggaacagcagcagggaaagaagcctactgccgaacaagaactctatattgagtccgtgatcgaacccggtacccacaccgagtctactctggaacaggggtcctcacggaggctgctgacagagcaggagactcaccgcgagtccactaccgaacagggacagcacaaggggtcaatagagggccaaggacccagacgcgttagtgtgagtgaacagggaagttcgagagaaagcgtggccgaacagggcagtagacgcgaatctatagctgagcaggatcggcataagggatctgtggccgagcaggggtctcggcgaatgtccgccgcagagcaaggttccctgcgggagtcagtaatcgaggagccatatcagaagagtgagcaggggccatatggggagataatctcagaagagcaagaggacatcgggagtacttcccagtcaaggaaggattctattctcaagtccacgaaatacggggagccaatcaccagcgaatatattgaagtgcccctccaagaaaaaaggtcatgggagcagacatacgaagaggaaatctttctctcatccgaattgcaggaagaggtgcccactctcagcagaaaagatcactttcccgaaaccactaaaaaggaagttcaaaaagataagccttgcgaacctaaatcacagaaaatcgagggcaagtcatggtctggggaattcttcacctgtaactggaaaatgaagtatgttacgttcgaagacgaggaacaagctaatctcatctacggcaactcacgcttcacagacctccactccataatcagaaacatccaatcatgtaaagaagtgaagggacgaacagctttcaatggagtgagtttcaacttgttgcagtttgttcaactcctggaaacattcgtcggtgaggacgctccactatccgtgagcgagactttaacttctttctttaaagaggggtatgtggagactgaacaagagaagatgaacgcattggagcagtttagtcagaacgcttttcaggtgcgccagaggctactcctggaggccatcttccagaagtgggactctgatgggagtggctttttagacctgaaagaagtggatgagctcctgtacacatataaggaggggatggaaaaagaaagcatgaagaaagatcacagccggacagaagtatggaaatttggcaacgttgtgattgaacatctgtaccactggatacacatttgctctgccctgatgaaaattactaagcaattgaacagtggcattacaccacctttgccttcgaagaccgacaactatatgtatgcgaagatgcccggagagggcctccaggagaaatag

SEQ ID NO: 55716 - DNA, 4512 bp, Artificial Sequence
  Description of Artificial Sequence: Synthetic coding sequence
atgaatgaatcagcgagccaggaggagctccggccagctcaagaaaatcgtaaggaggataaagagagaaaatggaacctgaccgaggttaaagaactgcacgagacactgcagagcgtgcccgatgtacccgtgaaggaggacaccaacagcgtcgtggagaaagcgatggacgagattaaaagtcaggagcttaacttggaagggcagaggaaaatatcccccggaagtattaaggattccaaaaccgaagcgtctggaaatatcgctataagaaaatcagccaaggtgatctttgcactcgatgagaccgaactaaaatcaaagccagaacacacctggaagaagaatttgtttgagcgcatggaggctcgggcacaggcaatgcagcagaaaataatcgataaagaaaacctcaagaaagagcttgaaaaaaaggcggagaaaaaactgccaagggacaatcttgctaaggagtggttcaatacagattccatgacactcaataataccgcttatctgctcgataagctgctgcctaccctcgtaccgggtgtggaaaacatgctgacacaagtagaaaaaaaaaaggtcctgactgaggccgacactccaagtaaattcgaccccatcaactatctgggagagtacctcatccgaaataaccctaattatattaaagaccctggcatgtcaggctatcagcgccttatgaaggaggtgactgaggatctcaaaatctacgtgcccgatacaatatgtaaccgtgtgtcaaaaatgaaagagaatgtgaaacagaataggaagcaaagagaatctatcgataaaatcattgtgaaggtggcaaacactaggaaacaagctctgcaagagcaatttgatgagtggattctggatcctaaggggatgatacctaagagcgtgattcagaatgtcctgcaagaatttttccagaaccctgatttcaagttaggctcacattgtaagcagctagacattacagattccactgagccaagattaaacaaaatggaattcactgagtacataagctctcacatcaaggacctgaaaagtgagatgtttgaggaactgttgaagcacctgtgtcattcggcggatgaattcagggaggtaatcaaagccgatatgcgcagacagatgtttgcagaactgtttcttcactgtgatcacgggaaagtgggattccttgacagacagcggacccttgcactgctggaactcttctacgaccattcaagtcagatgctgaggagcttgctacgaaacccccgacagtggccattcatcgagtttgaggaaatcaacctgaccgagctgtggggggacatggataatcagaaacacatctatgagggcttcgacaaagtgctgctcgagatgaacactcttctgagcgccaaccacgctagtaagacgcagagcaaactcctggagagccctgaccagcctaagcttaatgagcagcggacatcgaccccctccccgaaccctccagaacaacagcggggtgtaaccgccgaacagggtccccagaggatctcaatcgaggaacagcagcagggcaagaagcccaccgccgagcaagagctctatattgagtcagtgattgagcctggaacacatactgagtccacattggaacaggggagctccagacgactcttgacagagcaggagacccaccgggagtctaccacagagcaaggccaacataaaggctcgatcgagggacagggtcccaggcgagtcagtgtgtcagaacagggttcctcacgggagtctgtcgcagagcaaggctctcgccgagagtctatagctgaacaggatcggcataaaggctcagtcgctgaacaaggatctcgaagaatgagcgcagccgagcaaggaagcctacgggagagcgtgattgaagaaccgtatcagaaatccgagcagggtccctacggcgagattataagcgaagagcaagaggacatcgggagcacaagccagagtcgcaaggattccatcctgaaatctacgaagtatggggagcctatcactagtgagtacatagaagttccactccaggaaaagcggtcatgggagcaaacatacgaagaagagatctttctttcttccgaactgcaggaggaggtgccaaccttgtcacggaaagatcattttcctgaaaccacaaagaaagaggtgcagaaggacaaaccatgtgagcctaagtcccagaaaatagagggcaagagttggtctggagaatttttcacttgcaactggaaaatgaagtatgtgacgttcgaagatgaagaacaggcgaacctgatttacggtaattcaagattcacagatctgcattccatcattcgaaatatccagtcctgtaaggaggtgaaggggaggacggccttcaacggagttagctttaacttgctgcagttcgtccagttacttgagactttcgtcggcgaggacgcaccactgtctgtctccgagacgctaacttctttctttaaggaaggttacgtggagaccgaacaagagaagatgaacgccctggagcagtttagccaaaacgctttccaggtgagacaacggctgctgttggaggctattttccaaaagtgggattccgatgggtctgggttcctggacctcaaagaagtagatgagctgctgtatacgtataaagagggaatggaaaaggaaagcatgaaaaaggctaaactgcacatccagtttccaaagccccaccccggacacgaagtccgcctgagcagcaagcagttccaaaattatatcgaattggtggtttccgaactgcgaggtaacgaggatcaggtgctggagagtgtggtcgaatttctgatgaacgcgctcgaacgctcccacattgagtcgcttcgcaatagtgcccgtcggaagtggctgcatcagattcagtgcgccgcagagacaagcggggtgagccttgagccagtctacagcgagacttttaaggctttgatgcaggacgcagaggcgcatgggaataagaaaatttcagcccacatctcactgttggaagaaaacctcttgctgcctgaaaaggggaatgtgctgctgcgcaatgtggcctgcaccctggacgatgcacagtttgtgttgaaccgggtcctctaccgtgatatgaaaggaatatctttcaccgtggtagacgagggtaaaccgatccatgttccccaggtgcagtatcacggcaatatttttttctggaatcaaagccggaataaacacgactataatggttcgtttctagccctcccgttgcaggatgcttatatgaggatcttcggcgtactcgctgtggatacattaagagaccctcacgaaatcaatatcttccttccacacgaaatccgcttttatcaaggagtcgccaacgtattttccaccgcatatcactatgtacacagtagggagcatatcctgcacattgtgattacggggataggatggctgtacgacgtgacctcatcgataacctctataactacatattttgtggaaccctctcccgcacaggattcagattatgtgctgcgcaacatgatggtgacagggcaactgggcctcacggaaattcacaagaatcctcccactattcaccgcaagtcatgcatatttcgcgatttcctctttaaatgcactgatagctcagaagtggtgctggcgagtgcctgcggcgagacccacatcgtcgtaccccttagagaaagaaccggggaagccttgggtgtcttggattttaatattggccagaacaggatgctgctttgccaggagtacaaggatctgcaaaagatgatgaaagtggtgcaggtggcatgctatgagattctgggcgaattttctggcgagataaagaagaagtatattttggaaatcgagaacgtgcgcgaggtgcagagggccggtattcttttcttcaggattatgctgctggaattgcaagaaagtatccagctgttgaatagcatggagtttgtttctctgttgctgtatgaccataccctcgtcaccgaaccgaacagcccccaggacagcaagagtatggagctcgaggcgaacgtgaagctcgttagggatattctgaaggcagtgattctattcttccacccggaactggaattcagttctgattttggtagctgggacaaatgtaagttttatgtcaacaagtatctcgtcaataacatctgcgcattcgaccctaccgcaaagcacgtcgaagtgaacgttcagttgatcgacgaatatatccgcgaccattcccggactgaggtttggaagttcgggaatgtggtgatagaacatttgtaccactggatacatatttgctcagcgctcatgaagatcactaagcagttgaactccgggatcacgcccccacttcccagcaagactgacaattatatgtacgctaaaatgccaggcgaaggtttacaggaaaagtag

SEQ ID NO: 55717 - DNA, 2571 bp, Artificial Sequence
  Description of Artificial Sequence: Synthetic coding sequence
ttagggcaaatgaaatgtaaggaattgaacttagagggacagcggaagatatctcccggatcaataaaggactccaaaaccgaggcctctggtaatatcgccatacgcaaatcagcgaaggtgatatttgccctggacgagactgagctaaaatccaagcccgagcatacatggaagaagaacctcttcgaaaggatggaggcccgtgcacaggccatgcagcagaagatcattgataaggaaaatctgaagaaagagctggagaagaaggctgagaagaaattgcccagggacaatcttgcgaaggagtggttcaataccgattccatgacactgaataacacagcttacctgctggataagctgttgccaacattagtccccggagtggaaaacatgctgacacaggtggagaagaagaaggtactaacagaggccgataccccctcgaagttcgatcccattaattacctcggtgagtatctcatcaggaataatcccaactatatcaaagatccaggaatgtccgggtaccagcggctgatgaaagaggtaacagaggaccttaagatttacgttcctgatacaatttgcaacagggtgtcaaagatgaaggagaatgtgaagcaaaaccggaagcagcgagagtctatcgataaaatcattgtgaaggtggccaacacacgcaaacaggccttacaggagcagtttgatgaatggatcttggacccaaagggtatgatcccaaagtcagtgattcaaaacgtgctacaggagttcttccagaaccctgacttcaaattgggcagtcactgtaagcagctcgatattacagatagcacagagcctcgactaaacaagatggagtttaccgagtatatatccagccacatcaaggacctcaagagtgagatgtttgaagagctcctgaaacatttgtgccattccgccgacgagtttcgcgaggtgatcaaagccgacatgcgcaggcagatgttcgccgagttgtttctgcactgtgatcatggaaaggtgggattcctggatcgacagagaaccctggctctgcttgagctattctatgaccactctagccagatgctgcggtctttgctgcggaaccctcgtcagtggccattcatcgagtttgaggagataaacttaacagaactgtggggggacatggacaaccagaagcatatatatgaaggttttgataaagtcctgctggagatgaacaccctcctgtcagcaaatcacgctagtaaaacccaaagcaagctgctggaaagcccggatcagcccaagttgaatgagcagcgcacctcaaccccaagccctaatccgcctgagcagcagagaggtgttaccgccgaacagggcccacagcgcatctccatcgaagaacagcagcagggaaaaaagcccacggcggagcaagagctttatattgaatctgttattgaaccagggacacataccgaaagcactctcgaacaaggctcatcacgacgcctccttaccgagcaagagactcaccgtgaatcaacgacagagcagggacaacacaaagggtccatcgaaggccaggggcctcgccgagtctccgtttccgagcaaggcagttcccgggagtctgtggctgagcagggcagccgtcgtgagtctatcgcagagcaagataggcataaaggctctgtggcagaacagggctctaggaggatgtcagcagccgaacagggttccctaagggagtccgtgattgaggagccctaccagaagagtgagcaaggcccttacggggaaatcatctcggaggagcaggaggatatcggatccacttctcaatcccgaaaggacagcatcttaaagagtacaaagtacggagaacccattactagcgagtacatagaggtgccgctccaggagaaacgttcctgggagcagacctacgaggaggagatatttttatcttctgaactccaggaagaagtgcccaccctctcacgcaaggaccactttcctgaaacaactaagaaagaggttcagaaggataaaccttgtgaacctaaaagtcagaagatcgagggcaagtcatggagtggggagttttttacatgtaactggaaaatgaaatatgttacctttgaggacgaggagcaggccaacttgatctacggaaactcacggttcactgatctccattccatcatacgaaacatccaatcttgcaaagaggtgaagggccgaactgcgtttaacggtgtaagctttaacctcttgcagtttgtgcagctacttgagacattcgtcggagaagatgctccactcagcgtctccgagacccttacatcgttctttaaggaaggctacgtggagacagagcaggaaaaaatgaacgcgctggagcaggtttcactgtgcaggcaggcaggcgtgcagtggcgcaattgctcaagtctgcagcctcctacgccaggtctgaagcgcagtagtcatcatcgtctcctgtccaactgggattatcgagaacggaggaaattcttccccctggagacaaaatttccttag

SEQ ID NO: 55718 - DNA, 1527 bp, Artificial Sequence
  Description of Artificial Sequence: Synthetic coding sequence
atgaaagagaacgtaaagcaaaataggaaacagcgggagtcaatagataaaataattgttaaggtcgccaatacgaggaaacaggccctccaagaacagttcgacgaatggatcctggaccctaagggtatgatacctaagtccgtgttgcagatacagaatgtcttacaggagttcttccaaaatccagacttcaagctaggtagtcactgtaagcagctggacatcaccgattcgaccgagcccaggcttaacaaaatggaatttactgagtatatctcttcccacatcaaagatttaaagtctgaaatgtttgaagagctattaaagcacctgtgccacagcgccgatgaatttagggaagtcatcaaggcagatatgcgtagacagatgttcgccgaactgttcctgcactgcgatcacggaaaggtggggtttcttgatagacaacgtaccctcgctctgctggagttattttatgatcacagttcacagatgcttaggagtctgctgcgcaatcctcgacagtggccatttatcgagttcgaggagataaatctgaccgagctctggggagacatggataaccagaagcacatttatgagggattcgacaaagtcttgttagagatgaatactctactgagcgctaaccacgcgagcaagacgcaatctaaactccttgagtctcctgaccagcccaaattaaacgagcagagaacaagtacgccgtcacccaatccacccgagcagcagcgtggtgtgaccgcggagcagggccctcagcggatctccatcgaagagcagcagcaaggaaagaagcctacagccgaacaggaactctatatcgagagcgtcatcgagccaggtacacacactgaatccacccttgagcaaggaagctcgagacgactgctcaccgagcaggaaacgcaccgtgagagtaccacagaacagggccaacacaaggggagcatcgaagggcaaggccctcgacgggtgtccgtctctgagcagggaagcagccgtgaaagcgtagccgaacaggggtcccgcagagagagtattgctgaacaagacagacataagggatccgtggcagagcagggtagcaggagaatgtccgctgctgaacaggggagtctccgggaatccgtgattgaagaaccctaccaaaagagcgaacaaggtccctatggggagattattagcgaggaacaggaagacattggaagtacctcgcagtctcgaaaggattctattttgaagtcgactaaatacggcgagccaatcacaagcgaatacattgaagttccactccaagaaaagagatcatgggagcagacttatgaagaggagatttttttgagttctgagttgcaagaggaggtgcccactctctcccgaaaggatcactttcctgagactaccaagaaagaagttcagaaagataagccttgcgaacctaaatcacagaagattgaagggaagtcctggtctggtgagttcttcacgtgcaactggtag

SEQ ID NO: 55719 - DNA, 2571 bp, Artificial Sequence
  Description of Artificial Sequence: Synthetic coding sequence
atggatgaaataaagtctcaagaactgaacttggagggacagcggaagattagcccaggcagcatcaaggattcgaagacagaagccagcggaaacatcgccatcaggaagagcgctaaagtaatcttcgctctcgatgaaaccgagcttaaatctaaaccagaacacacatggaaaaagaacctgtttgaaagaatggaggctagggcacaggccatgcagcagaaaatcattgacaaggaaaatctgaagaaagagcttgagaaaaaggcggagaaaaaactgccacgggacaatctggcgaaggaatggtttaacacggactccatgaccctgaacaacaccgcatatttgctggataaactcctacccacacttgtccctggggttgagaatatgttaactcaagttgagaagaagaaggtgctcaccgaggccgacacaccttctaagttcgatccgataaattatctgggcgaatacctcattcgaaataatccaaattacattaaagatcctgggatgtcgggctatcagcgccttatgaaggaggtcaccgaggacctgaagatatacgtgccagatactatttgtaatcgggtctccaaaatgaaagagaacgtgaagcaaaaccggaagcagcgcgaaagcatagataagattattgtcaaggtggcgaatacgcgcaaacaggctcttcaagagcagtttgacgaatggatcctagacccaaaaggcatgattccaaaatccgtcatccagaacgtgctgcaagaattctttcagaaccccgatttcaagctgggatctcattgcaagcagctggatatcaccgattcaaccgaacctcggctgaataaaatggagtttacagagtacatctcttcacatattaaagacctcaagtctgaaatgtttgaggagctgctcaagcatttgtgccacagcgccgatgagttccgcgaagtgataaaggccgacatgcgccgtcaaatgtttgcggagcttttcctccactgcgatcacggcaaggtggggttcctggataggcagagaaccttggcactcctggaattgttttacgatcatagctctcaaatgctcagaagcctgctgcgcaatcccagacagtggccatttatcgagttcgaagaaattaacctgactgagctgtggggagatatggacaatcagaaacatatctacgagggattcgataaggttcttttggagatgaatactttgctcagcgccaatcacgcctcaaaaacccagtctaaattgcttgaaagccccgaccagcctaaactgaacgaacaacgtacctcaaccccctcccccaacccacccgaacaacagcgaggcgtgaccgccgaacagggtccacaacggatttctatagaggaacaacagcagggaaaaaaacccacggcagaacaggagctgtacattgaatccgtcattgaaccgggaactcatacagaatccacacttgaacagggaagctcccgtcggctcctgactgagcaggaaacccaccgcgagtcaactaccgaacaggggcagcataaagggtccattgagggccaaggccctcgcagggtgtccgtgtccgaacagggcagcagccgagaatcagttgccgagcaggggagtcgcagggaaagcattgccgagcaagatcgacataaggggtctgtggccgagcaaggtagtcggcgaatgagcgctgccgagcagggatccctgcgggagtccgtgattgaggagccttaccagaagtctgagcagggcccttacggcgagataatctctgaagagcaggaggacatagggtccacaagtcagtcccggaaagactcaattctgaagtccactaagtacggagagccaattacgagcgagtacatcgaggtacccctgcaggaaaaacggtcttgggaacagacgtatgaggaagaaatctttctgtctagcgaactgcaggaggaggtacctaccttaagtcggaaggaccacttcccagagacgacgaagaaggaagtccagaaggacaagccctgcgagccgaagtctcagaaaattgagggcaagtcctggagcggtgaatttttcacatgtaattggaagatgaagtacgtcacattcgaggacgaggagcaagccaacctaatttacggaaacagtaggttcacagaccttcactccatcatacggaacattcagagttgtaaggaagtaaaagggaggactgccttcaatggggtctcatttaatcttttacagttcgtacagttgctggaaacattcgtgggcgaggatgccccactgtcggtttccgaaaccctcacctccttctttaaggaaggatatgtcgagaccgagcaggagaaaatgaacgccctggagcaggtgagcctgtgtcggcaagccggtgtgcagtggagaaattgttcatcccttcagccccctaccccagggctgaagcggagctctcaccatcggttgctgtccaactgggattatagggagagacggaagtttttccccctcgaaacaaagtttccgtag

SEQ ID NO: 55720 - DNA, 1710 bp, Artificial Sequence
  Description of Artificial Sequence: Synthetic coding sequence
atggagtttactgaatacattagctcacacatcaaagatctgaaatccgaaatgtttgaagagcttctaaagcacttatgtcattccgctgacgaattcagagaggtcatcaaggccgacatgaggaggcagatgttcgccgaactgtttttgcactgcgatcatggcaaggtgggcttcttggatagacagcgcaccttagcactgctggagttgttttatgaccattcatctcagatgctgcgttcattgctgcggaatccgcgacagtggccattcatcgagtttgaagaaatcaacttgaccgagctctggggggacatggacaaccagaaacacatctatgaagggtttgacaaagtcttacttgagatgaatacgttgctgtccgccaaccacgccagcaaaactcaaagcaagctgctggaatccccagaccagccaaaactaaatgagcagcggacgtcaacgccatctccaaaccctcccgagcaacagaggggcgttaccgctgagcagggaccacagagaatctctatagaggagcaacagcagggcaaaaagcccacagccgagcaggagctctacattgagtctgtcattgagccaggaactcacacggagtctacattagaacagggctcctcccgtaggttgctaacggaacaggagactcaccgggaatctacaacagagcagggacaacataaaggcagcattgagggccagggaccgagacgcgtatctgttagtgaacagggatcgtcaagggaatcggtcgctgagcaagggtccagacgggaatcaatcgctgagcaggatagacacaaagggtccgtggctgaacagggttcaaggcgaatgtctgctgctgagcaggggtctttacgggaatccgtgattgaggaaccttaccagaaatctgaacaggggccttatggcgaaatcatctcagaggaacaagaagatatcggatctacgagccaatctcgcaaagattctatcctgaaatctactaagtacggggaaccaattacatccgaatacatagaagtcccgctgcaggaaaaacgcagctgggagcaaacatacgaggaggaaatcttcctgagctcggaactgcaggaagaagtgccgacactgtcccgaaaagaccatttcccagagactaccaaaaaggaggtacaaaaggacaaaccctgcgagccgaagtcccagaagatcgaaggaaagtcatggagcggcgaattttttacttgtaactggaagatgaaatatgtgacgttcgaggacgaggaacaggccaatctgatctatgggaactcgagattcaccgatcttcactcaattattcggaacatccagagttgtaaggaggtcaaaggtaggactgcttttaacggggtgagcttcaacctgttgcaatttgtccagctcctggagacattcgtgggagaggacgcgccactgagtgtctctgaaactcttacttctttttttaaagagggctatgtcgagactgagcaggagaagatgaatgcattggagcaggtgtccttgtgtcgacaggctggcgtgcagtggcgcaattgctcctctttgcaaccacccacccctgggctgaaacgatcctcccatcatcgcctattgtcaaattgggattatcgcgagcgaagaaagttctttccactggagacaaagtttccctag

SEQ ID NO: 55721 - DNA, 1890 bp, Artificial Sequence
  Description of Artificial Sequence: Synthetic coding sequence
atggccataagtcctcgttcagatgcaactttctcgagccaaaagtctactcccagtgagtcacctagaacaaaaaaatttccacttaccgaagaggaaatcttttatatgaattgccgggctgcttacctgaccgtttttaaaagcagtcttgaaaatatcatcagcaaggatcaattgtacctcgccctgcagcatgcgggacgcaaccccagtcagaaaaccattaacaagtattggacacctcagactgctaagctcaacttcgatgatttctgcattattctgaggaaagaaaagcctacaagtaaggccgagctgctaaaatcgttcaagcaactcgatgtgaacgacgacggttgcatcctgcatacagatctgtacaagttccttactaagaggggtgagaagatgacgcgcgaagaagtcaatgcaatcattaacctggccgatgtcaatgccgatggtaagttcgactatatcaaattttgcaagctctatatgaccaccaatgagcaatgcttaaagacgacccttgaaaagctggaagtcgatagcaagctgatgagacaccagttcggcaatcatattgaggggtccccagaacgggatccaagtccagtgcctaaaccatcaccgaaaattaccaggaagacggacccagaaacttttctgaataagggcgatacccggtcttcgttattatccgctacacggaagtttaaaacatctgtatcatttacagtcactatgggcgcaaatggaaataggaattccaagctcatggaaccaaacctgatcaaagattggcaacatatgcagagtaaaggatgcttcttcctagaggaggatggagaaattatatcccatcagtataggatgcaaatcgctcagcgcagcatggtctacctgacaattaaacccctgaatctcagtcaagtggagggaaagccttccccatggctatcagttgacacagcattatacatcctaaaagaaaatgagtctcaggccaatctgcagctggtgtgcttcactgaactgcgaaaccgagaggtgtttgggtggaccggagagttgggaccagggatctattggttgatcccatcaaccactggatgtcgacttaggaagaagattaaacccgtcactgacgaggcacagctggtctatagagacgagactggcgagttatttctgactaaggagtttaagtcgactctgagcgacatttttgaggtcatcgacctggacgggaacggactgctgtctctggaagagtataatttttttgagctgaggacatcgggcgaaaagtgcgacgaggatgcctgggccgtctgtagagaaaactttgacacgaagcgcaacgagctgactagacaggggttcatggacctgaacttaatggaggccaacgatagggaaggcgatccctgcgatctgtgggtgaccttacactccatggggtataacaaggcactagagcttactgaggcgtgtcccttcgttatcgacatctatgccgaaaaatgcaaaccaaagataaaagccgtccacatggaagcatgctcgggccagttagagaaagctatctgcaaaagcgttctgtctaatggagatgccaaggtaatggacggttatgagaacatcattgtacatacatacagttgcgacacatggataacatctgtgattgaaaacaaatccgatgagaaagtcattatccacatcagcaatgagctgagcaaaaactgcattaataacaggggactgaacatctttgcagtggaggtcggacctaagtccactatggtgtgccagcatgtcatgcccctgaatgaaaggcaggagtggatctattattgtatatacagcttgatctcttag

SEQ ID NO: 55722 - DNA, 594 bp, Artificial Sequence
  Description of Artificial Sequence: Synthetic coding sequence
atgaggctcaaacaggggagctttctctggtacctgtacctcgataaaatctactgcctgctatcagtgcggaatgtgaaggccttagctgaatactttcacatccttgacgttcacggcaagaacacccttaacgacgtgctattctaccactttttacatcatgtgaccgaccttaaaaaggcacagattaatatagtgtttgacatgctggactggaacgcagtaggagaaatcgacttcgaaaagttctacatgttggtatgcatgctgttggcccaccagaaccatttggagggccagttcatgtatcggcattctcggcctgtgtttgatctcctcgaccttaaaggcgacctgcgcatcggagcaaaaaattttgagatgtacaggttcctgtttaacattcagaagcaggagctcaaggacctcttcagagatttcgatattacaggcgacaacaggttaaactatcaggaattcaaactgtacacaatcatctacacagacaaactccagaaacgccagaaaactgaagaaaaggaaaagggcgaacggaaacggagtctatactctaaatgtcatatcaagtag

SEQ ID NO: 55723 - DNA, 2454 bp, Artificial Sequence
  Description of Artificial Sequence: Synthetic coding sequence
atgtatggagtgtgcgggtgctgcggagctctgagaccgaggtataagcggctggtggacaacatatttcctgaagaccccgaagacggcctggtgaaaactaatatggaaaaactgactttttacgcactctcagcgcctgagaagttggataggatcggggcatacttgagcgagagactgatccgcgatgtgggacggcatcgttacggctacgtttgtattgcgatggaagcattagatcaactgctgatggcatgccactgccagtctatcaacctctttgtggaaagcttcctcaaaatggttgcgaaactgttagagtcggagaagccaaaccttcagattttaggaaccaatagttttgtgaaattcgccaacatcgaggaggacacacctagctaccaccggtcatatgactttttcgtaagccggttctctgagatgtgccattcatcgcacgatgatctcgaaattaaaaccaaaatccgtatgagcggcattaagggcctccagggcgtcgtgagaaagaccgtgaatgacgaacttcaggccaatatctgggacccccagcacatggacaagatcgtgcccagcttattgtttaatctccagcatgtggaggaggctgagtcccgttccccatcaccactgcaggcgcctgaaaaggaaaaagagagtcccgctgagctcgcagagcgctgtttgagggaattactgggaagagcagcatttggaaacattaagaacgctatcaaaccagtcttaatccacctggacaatcactccctgtgggaacctaaagtattcgctattaggtgtttcaagattatcatgtattcaattcagcctcagcacagccaccttgtgatacaacaactactgggtcatctcgacgcaaatagcaggagcgcggctacagtccgagcgggaattgtcgaggtcctaagcgaagccgctgttattgcagccaccgggagcgtcggtcctactgtcttggagatgtttaatacacttctacggcagttgcgcttgtccattgattacgcgctgacaggttcatatgatggagctgtgtcccttggaacgaaaatcattaaggagcatgaagaaagaatgttccaagaagctgtgatcaagacggtggggtcttttgcttccaccctccccacgtaccagaggagtgaagtaattctgtttatcatgtccaaggttcccaggccctcactgcatcaagctgtggacaccggcagaaccggagagaatcggaatcgtctgacccagattatgttgctgaaatccctgctacaggtgtcaaccggattccagtgtaataatatgatgtctgctctcccttccaacttccttgatagacttctttccacagccctgatggaagatgccgaaattcgattatttgtactggaaatactgatcagttttatcgaccgccatggaaatcgccataagtttagcactatctccacgctgtccgatatctccgtgctcaaactgaaggtggataagtgctctaggcaagacacagtctttatgaagaagcacagccagcaactgtatcgacacatttaccttagctgtaaagaggagactaatgttcagaagcactacgaggctttgtatggccttcttgcattaatttccatcgagctcgctaacgaggaggtggtcgtagacttgatccgcctggtgctggccgttcaggacgtcgcccaggtgaatgaggaaaacctgcctgtatacaacaggtgcgctctatatgcactgggggcagcttatctcaatctgatttctcagctcacaaccgtgcctgctttctgtcagcacatccatgaagtcatagaaactagaaaaaaggaggccccttacatgcttcccgaggacgttttcgttgagaggccacggctatcccaaaatctcgacggggtcgtgatagaactgctcttcaggcagagtaaaatttctgaggtcctgggcggttctggatataattcagacagactttgtctgccttacatcccccagttgacagacgaggaccgcctgtccaagcggcgttctatcggcgagaccatatccttacaggtggaggttgaaagtcgcaactcaccagagaaggaagagcgcgtccccgctgaagagatcacctatgagacactaaagaaagccatcgttgattccgtcgccgtggaggagcaggaacgggagaggagaagacaagtggttgaaaaatttcagaaggcccctttcgaggagatagccgctcactgcggggctcgggcatcgctgttacaatccaagctgaaccagatcttcgaaatcaccatcagaccacctccatctcccagcggtacgatcacagccgcatacgggcagcctcagaatcattctatacccgtctatgaaatgaagtttcctgatctgtgcgtttactag

SEQ ID NO: 55724 - DNA, 2349 bp, Artificial Sequence
  Description of Artificial Sequence: Synthetic coding sequence
atggagaaactcactttctacgccttgtccgcccctgaaaaacttgacaggatcggtgcatacctctcggagaggctcattagggatgtgggacgccacaggtatgggtatgtgtgcatcgcgatggaggccctggaccagctgctgatggcgtgtcactgtcaaagcattaacctgttcgtcgaatctttcctcaaaatggtcgcgaagctgctcgagtccgagaaacccaacctccagattctaggcacaaatagctttgtcaagttcgccaacatcgaggaggatacccctagctaccacagatcatatgatttttttgtctcccgcttttcagaaatgtgccacagcagccatgacgatctcgagattaagaccaagattcgtatgtccggtataaaggggctgcagggggtcgtaaggaaaaccgttaacgacgagctgcaggccaacatctgggatcctcagcatatggacaaaatcgtgccatcactgctgttcaaccttcagcacgtggaagaggccgagtcacgtagcccctctccgttgcaggctccggagaaagagaaagagagcccagccgagctggccgaaaggtgcctgagagaactgctgggcagagctgcttttggtaatattaaaaacgccattaagcccgtcttaattcatttggataatcactccctctgggaacctaaagtgttcgcaatcagatgctttaagatcatcatgtacagcatacagccacaacactctcatctggtgatccagcaactgttgggtcatttggacgcgaacagtagatcagccgctacggttagggctggaatcgttgaagtgttgtctgaagctgccgtcatagcggctacagggtcagtcggacccaccgtactcgaaatgttcaatacccttctacgtcagctcaggttgtcaatcgattacgctttaacggggtcttatgacggcgcagtctcgctggggaccaaaatcatcaaagagcatgaagagaggatgttccaggaggctgtaattaaaactgtgggctcgttcgcatctaccctgccgacctatcagaggtcagaagttattttatttatcatgtccaaggtccccaggccgtcgctccatcaggcagtcgacactggacgcaccggtgaaaaccggaatcggctgactcagatcatgttgttaaagtccctgctacaagtgagcaccggctttcagtgcaataatatgatgtctgcactcccgtcaaattttctcgaccgtctgttgagcaccgccctgatggaagacgccgagatacgcctgtttgttttagaaatcctgatctcctttattgaccggcatggaaatcggcacaagttcagcacgatttccactctgtcagacatctccgtgctcaagctgaaggttgacaagtgtagcagacaggacacagtgttcatgaagaagcatagccagcagctgtataggcacatttatctgtcctgcaaagaggaaaccaatgtgcagaaacattatgaagctttatacggcctgctggctctgatctccatcgagcttgctaatgaggaagtagttgtggatctgataaggctggttctcgcggttcaagatgtcgcccaggtcaatgaggagaatctgccagtatataacaggtgcgctctgtacgccctgggggcagcgtatctgaacctgatttctcagctgacaacagtgcctgcattctgccagcatattcatgaagtgatcgagacaaggaaaaaggaagctccgtatatgctgcccgaggacgttttcgtagagcgacctcggctgagccagaacctggatggagttgtcattgagctcttatttagacagtcaaagatttctgaggtgcttggaggatcgggatacaattccgacagactgtgcctgccgtacatcccccagctgaccgatgaagatcgactgagtaagcgccgttctatcggggagaccatttccttgcaggtggaggtagaatcaaggaatagccccgagaaagaagaacgcgttccggcagaggagatcacatacgaaacgctgaagaaggcgattgttgatagcgtggctgtcgaagaacaggagagggagcgccgacgtcaagttgtcgagaagttccagaaggcacctttcgaggaaattgccgcacactgcggggcaagagcttcgctgctccagagtaagctgaatcagatattcgaaatcaccatacgccctcctccaagcccttcaggaacgatcacggccgcttatggtcaacctcaaaatcacagcattcctgtgtatgaaatgaagttcccagacctatgcgtatactag

SEQ ID NO: 55725 - DNA, 4572 bp, Artificial Sequence
  Description of Artificial Sequence: Synthetic coding sequence
atgacaagcgtgtggaagaggctgcagcgggtgggaaagagggccgcaaaatttcagttcgtagcttgttatcacgagctggtccttgagtgcaccaagaagtggcagcctgacaagctggtcgttgtatggactagacgcaacagaagaatttgctcaaaggcacactcatggcagccaggcattcaaaatccgtatagaggaactgtcgtgtggatggtgcccgaaaacgtcgacattagcgtgactctctacagagatccccatgtagatcagtatgaagctaaggaatggaccttcatcattgagaacgagtccaaaggacaacggaaagtccttgccaccgctgaagttgaccttgctaggcacgcagggccagtaccagtgcaggttcctgtccgtcttcggttaaaacccaagtctgtcaaggtggtccaggcagagctttctttgaccctcagcggagttctgctgcgggaagggagagccaccgatgacgacatgcaatctttggcctcacttatgagcgtgaaaccaagcgacgtgggcaacttggatgattttgcagagagtgatgaggatgaagcccacggccctggggctcccgaggcgcgagcccgagtgcctcagccagacccttcccgggagttaaagacactctgtgaggaggaagaggagggacagggcaggcctcagcaagctgtggccagccctagtaatgcagaagataccagtcccgctccggtttccgctcccgcaccacctgctaggacctccaggggacaaggttccgaacgtgctaacgaggccggaggccaagtgggccctgaggctccacgcccacctgagaccagtcctgagatgaggtcaagtagacagccggctcaggacactgcccctacccctgcccctaggctcagaaagggctccgacgcacttaggccccctgttccacagggcgaggacgaagttccaaaggcgagcggggcaccacccgctggcctcggatcggcacgagaaacacaggcccaggcatgcccccaggaaggtacggaggcccacggggctcgactgggtcccagtatcgaagacaagggatctggagatccttttggcagacagcgtctgaaagccgaagagatggacacagaggaccggccagaagcctcaggggtggatacagagcctaggtctggaggccgtgaagcgaataccaaaaggagtggcgtccgggctggcgaggccgaagaatccagcgcagtgtgtcaagttgatgctgagcagaggtctaaggtcagacacgtcgacaccaagggtccggaagcaacaggggttatgccagaggccaggtgccgcggaactccagaagctcctcctagaggctcacagggacgtctcggcgttaggacacgcgacgaagccccatctggcctgtcactgccaccagcagaacctgctgggcactcgggccagctgggggacctggagggggctagagcagccgcaggccaggagcgtgaaggagccgaagttagaggaggagctccagggatagagggcaccggcctagagcagggcccatctgtgggtgctatcagcactaggcctcaggtcagttcctggcaaggagctcttctgtccactgctcaaggcgctatttcacgcggtctggggggatgggaggcagaagcaggtgggtccggcgacctggagacagagaccgaggtggtcggtctggaggtgctcggaacgcaggaaaaggaagtggagggttccggatttccggaaacccggacacttgaaatagagatcttaggagctttggaaaaagaggccgctcgctcacgggtgcttgagtcagaggtcgcaggtaccgctcagtgcgagggactggaaacacaggaaaccgaggtcggagttatagagaccccagggactgaaaccgaagtcctcggcacccagaagaccgaagcaggaggttccggagtcctccaaacccgcaccaccattgctgaaaccgaggtgcttgttacccaggagataagcggcgatctggggcctctgaaaatcgaggacactatccaaagcgagatgctgggtacacaggagaccgaggtggaggcaagccgggttcccgaaagcgaagcagagggaactgaggcaaaaatactggggactcaggaaataactgctcgcgactctggggtgcgcgagatcgaggccgagatcgccgagtccgatatattggtagctcaggagattgaggttgggctgttgggggtgctagggattgaaaccggcgcagcagaaggagcaattctcggcacccaagagatcgccagccgcgactccggggtgccaggcctggaggcggacactaccggaattcaggtcaaggaggtaggaggaagcgaagttcctgaaatcgctacaggtactgctgaaacggaaattctgggaacccaagagatcgccagtcggtcttctggagttcccggactggaaagcgaggtggcgggtgcacaggaaaccgaggtgggaggttcaggcattagcgggcctgaagccggaatggccgaggccagagtgctgatgacgaggaagactgagataatcgtaccagaggctgaaaaagaagaggcgcagacatccggagtccaggaagctgaaaccagggttggaagcgcgctaaaatatgaagctcttcgcgctccggtaacacagccacgagtactgggttcgcaggaggctaaggcggagatctccggggttcaaggctccgagactcaggtcctcagagtgcaggaggccgaggccggtgtttggggcatgtcagagggtaagtctggggcatggggcgctcaggaagcagagatgaaagtgcttgaaagcccagaaaataaatccggcacctttaaagcccaggaagctgaagctggggtcctgggcaacgagaaaggaaaggaagcagagggtagcttaacggaagcgtccctgcccgaggcccaggtcgcttctggggctggggctggcgcacccagggcctcctctccagaaaaagcggaagaagatcgacggctcccaggatctcaggcccctccagctctggtgagcagttcccagagcttgcttgaatggtgccaagaggtgaccacaggatataggggcgtaaggatcaccaacttcaccaccagctggcgtaatggactcgccttttgcgctatccttcacaggttttacccggacaagattgattacgctagcctggatcctctgaacataaaacagaacaataagcaggcgtttgatgggttcgctgcgctgggggtgtcacggttgctggagcctgccgatatggtgctgctgagcgtgcctgataaattgatcgttatgacatacctgtgtcagataagagctttctgcaccggccaggaactgcagctcgtgcaactcgaggggggtgggggagcgggtacttaccgtgtcggctctgcacagccatctccccctgatgatctagacgctgggggactcgcccagagattacgaggccacggcgcagaagggccacaagagccgaaggaggccgctgacagggcggacggtgccgctccaggcgtcgcaagccgcaatgctgtggctggacgggcttccaaggatgggggagctgaggctccaagagagagcagacccgcagaggtccctgcagaggggctggtaaacggagccggagcacctggaggcggaggagtaaggctgagaagaccctcggtaaacggcgaaccaggctcagtgcctccccctcgcgctcacggcagcttcagccacgtccgagacgctgaccttttgaaaaagaggagaagccgcctccgtaattcctcttctttctcaatggacgaccccgatgctggtgccatgggggctgcagctgcagagggacaggccccagacccttcccccgctccaggcccaccaaccgccgcagactcacaacagcccccaggtggcagctccccctccgaggagccccctccgtcgccaggggaggaggcagggctgcagagatttcaagatacctctcaatacgtttgtgcagagctgcaggcactggagcaggagcagaggcagatagatggcagagccgcagaggtggaaatgcagctcaggagccttatggaaagtggcgctaataagcttcaggaagaagtgctcatacaagagtggttcaccttggtgaacaaaaaaaatgctctgattcgccgtcaggatcagctccagctgctgatggaggagcaagatttggagcgtcgctttgagctactaagtcgcgagctgcgggctatgctggccattgaggactggcagaagacctcggctcagcaacatagagaacagctcctactcgaagagttagtatctctcgttaaccagcgggacgaacttgtacgcgacttggatcacaaggaacggatcgccttagaagaggatgagcgactcgagcggggtctagagcagcggagacggaaactttccagacagctctcgcgcagagaacgatgtgtcctgagctag

SEQ ID NO: 55726 - DNA, 1005 bp, Artificial Sequence
  Description of Artificial Sequence: Synthetic coding sequence
atgaagcacttcctccggatgttgatccaggtctgcctgtatttttattgcaaattcctgtggaggtgcctgaaattcgtgatgcggaagctaaccggaaggtgtgaactccaacgaatctgttataataccaagccgggtgccagcaggaccatgaagattgagactagtctgagagactccaaatcaaaattgctgcaaacatctgtttctgtgcaccccgacgccatcgaaaaaaccattgaggacatcatggagctgaagaaaatcaatcctgatgtcaacccccagttgggcatatcactgcaggcctgtctcttacagatagtgggctaccgcaatttgatagctgatgttgaaaaactgagaagagaggcatatgacagcgataacccacagcacgaggagatgctcttaaagctgtggaaatttctgaagccgaacacgccactcgaatccaggatttccaagcagtggtgtgagatcggctttcagggagacgacccaaaaactgatttcagaggcatgggtctgctgggcctgtacaatctacaatacttcgcggagcgagatgctaccgctgcacagcaggttctcagtgacagtcttcaccctaagtgtcgcgatatcacgaaagaggaaatatctaagttctcaaaagccgaatgggagaagaaaagaatggacaaagccatagggtactccttcgcaatcgtgggaattaacattactgaccttgcctataatctgctggtgtctggggctctgaagacccacttttataacattgcgccagaagcaccaacgctgagtcactttcagcaaacattttgttatttgatgcacgagtttcacaaattttggatcgaagaagaccccatggatatcatggaatttaaccgtgtacgagagaagttccgaaagcggatcatcaaacaactgcagaacccagacatggcactctgcccccatttcgctgcaagtgagggccttatcaatatgtag

SEQ ID NO: 55727 - DNA, 981 bp, Artificial Sequence
  Description of Artificial Sequence: Synthetic coding sequence
atgaagcatttccttcgcatgctcatccaggtatgtttatacttttactgcaagtttctgtggcgatgccttaaatttgtgatgcgaaaactcacaggccgatgtgagctacagagaatttgttacaatactaagcccggtgctagccgcacgatgaaaatagaaacatcattgagagatagtaagtccaagctgcttcagacctctgtatctgtgcaccctgacgccattgagaagaccatagaagatattatggaattaaaaaagattaatcctgacgtgaacccccaactggggattagcctacaggcgtgcctactgcagatagtaggctatcgtaaccttatagcggacgttgagaaactgagaagggaggcctatgacagcgataatccccagcatgaggaaatgttgctcaaattgtggaagtttctgaagcccaacacccctttagaatctaggatctcaaagcagtggtgcgagataggattccagggcgatgatccaaaaacagatttcaggggcatggggctgttagggctgtacaatctgcagtacttcgcagagcgggatgctaccgctgcgcaacaggtccttagcgattccctgcacccgaagtgcagtaaattcagtaaggctgagtgggaaaagaagagaatggacaaagcaataggatatagctttgctatagtcggtatcaatatcaccgacttggcctataatctgcttgtgtccggagccctgaagacccacttttacaacattgcaccggaagccccaaccctgagccactttcagcagactttctgttatctgatgcacgagtttcacaagttttggatcgaggaggacccaatggatattatggaatttaacagagtgagggagaagttcaggaaaaggatcattaagcagctacaaaacccagacatggcgctctgcccacattttgccgcttcagagggacttatcaatatgtag

SEQ ID NO: 55728 - DNA, 1176 bp, Artificial Sequence
  Description of Artificial Sequence: Synthetic coding sequence
atgaatgagaagtcttgtagctttcacagcaaggaggagcttagggatggtcaaggtgaacgactttcggcgggttattccccatcctacgataaagacaagagcgtgctagccttccgtggaatacccataagtgagctgaagaatcacggcattctgcaagcactgacaaccgaggcatatgagtgggagccaagggttgtgtctaccgaggtggtgagagcccaggaggagtgggaagccgtggacacaattcagcccgagacagggagccaagcaagcagcgagcagcccggacaactaatttcttttagcgaggcactccagcactttcaaacggttgacctcagccccttcaagaaaagaatacagcccaccatcagaaggacgggcctcgctgcactgaggcactacctttttggaccccctaagctgcatcagcgcctacgtgaggagcgcgatctcgtgctaacgatcgctcagtgtggcctggactcacaggaccccgttcatgggcgtgttcttcaaaccatttataaaaaacttaccggcagcaagttcgattgcgcattgcatggaaatcactgggaggatctaggctttcagggggctaaccccgctactgatttgagaggggctggctttcttgccctattacacttattgtacctggtcatggattccaagacattgccgatggcgcaggagatcttccgccttagcaggcatcacatccagcaatttccgttttgccttatgtctgtaaacatcacgcacatagccatccaggcacttcgggaagaatgtctctcccgggaatgcaaccgacaacagaaagtgatccctgttgtcaattctttctacgccgctacatttctgcatctcgcccatgtctggcggacccagcgcaaaacaatctccgattccgggtttgtgcttaagggtgtcctttttctgctgggccgacccagactaaacgcacagtgtccgcgttcccgggagcctaaagtggtcgccagactggtgcttgccgcagttctgccccatccccactttctgaaattccagctgaccaaaatcagtattacccatccactagagtcggctagcagcccgtttagcgctttaaccgttgccctgttctggtcatacacctacgataagcacatcttttag

SEQ ID NO: 55729 - DNA, 1146 bp, Artificial Sequence
  Description of Artificial Sequence: Synthetic coding sequence
atgaatgagaaaagttgcagctttcactccaaggaggagctcagggatgggcagggagaaagactctcagccggttacagcccttcatacgataaggataagtcagttttggctttccggggaatcccaataagcgaactcaagaaccatgggatcttgcaggccctgacgacagaggcctacgagtgggaaccgagggtggtgagcactgaggtcgtgcgcgctcaggaagagtgggaagcggttgacaccatccagcccgagaccggtagccaagctagctccgaacagcccggtcagctcattagcttttctgaagcgctgcagcatttccaaactgttgatctgagtccctttaagaagcgtattcaacccaccatccgacgtacagggttggctgcgttaaggcactatctgttcggcccacctaaattacatcagcgcctgcgcgaggaaagggacctggtgctgaccattgctcagtgcgggctggactcccaggatccagtccacggccgagtgctgcaaaccatttacaagaagctgacgggtagtaagttcgactgcgctctgcacggaaatcactgggaagatctgggatttcaaggcgcaaaccccgcaactgatcttcgcggagccggatttcttgctctgctacacctcctatacctcgtgatggacagtaagaccctgcctatggcgcaagaaattttcagactaagtagacatcatatacagcagttcccattttgtctgatgtctgttaatattacccatatagctattcaagccttgagggaggagtgcctttccagagagtgtaatcgacagcagaaagttattcctgtggtgaatagcttttatgcagccacgtttctgcacttagctcacgtctggaggacacagcgcaaaacgattagcgattcgggttttgtgctcaaagagctggaggtcctcgctaagaagagtccaagaaggctgttgaagactctggaactgtatttagcaagagtctcgaagggacaagcctccctgctaggagctcagaaatgctatggccctgaggcaccacctttcaaggacttgactttcactggggagagcgatttacagtctcatagctcagaaggagtgtggctaatctag

SEQ ID NO: 55730 - DNA, 1146 bp, Artificial Sequence
  Description of Artificial Sequence: Synthetic coding sequence
atgaacgagaagagctgtagctttcattccaaggaggaactgcgggatggtcagggagaacgcctgtccgccggatacagtccatcttacgataaagataaaagtgtcctggcatttcgagggattccaatttccgagttaaagaaccacgggatccttcaggctttgaccaccgaggcatatgagtgggagccccgagtggtgagcacggaagtcgtacgtgcccaggaagaatgggaagccgttgataccatccagcctgaaaccggctcccaagcttcatccgagcagccaggtcagctgatcagcttttctgaggccttgcagcacttccagacagtggatttgagcccattcaagaaacggatccagccgaccatccgccgtaccgggcttgctgctctccggcactacctgttcgggcctccaaaactgcaccaacggctgagagaggaacgcgacctcgtgctgaccatagcacagtgtgggctggactcacaggacccggttcacggcagggtgctccagaccatctacaaaaagctcaccggcagcaagtttgactgtgcacttcatggaaaccactgggaggatctcggattccagggggctaacccagctactgacctgaggggtgctgggttcctcgctttgttgcacctgctgtacttagttatggactccaagacccttccaatggcacaagaaatttttagacttagccggcatcacatccagcagttccctttctgtctcatgagcgtcaatattactcatatagctatccaagccctcagagaagaatgcctaagccgggaatgtaaccgccaacagaaagttatccctgtggtgaatagtttctacgcagctacatttctgcatctcgcgcacgtttggcggacgcagcggaagaccatatctgactccggatttgtgctgaaagagctggaggtgctagccaaaaaaagtcccagacgactgctcaagaccctggaactgtaccttgcccgtgtgagtaaggggcaggcaagcttactgggcgcacagaagtgctatggtccagaagcccctccattcaaggatttgactttcaccggcgagagcgacctgcaaagccattcatctgagggggtgtggctaatttag

SEQ ID NO: 55731 - DNA, 612 bp, Artificial Sequence
  Description of Artificial Sequence: Synthetic coding sequence
atgaatgagaaatcatgctcattccactctaaagaggagctgagggacggccaaggcgagagattatccgccggttatagtccttcatatgataaggacaagtccgttctagcttttcgtgggatccccatcagtgagcttaagaaccacggcattctgcaggctcttacaacagaggcctacgaatgggagccaagagtcgtgagcactgaggtcgtgagggctcaagaggagtgggaggctgttgatactattcagccggagaccggctcccaggccagctcagagcagcctggtcaactgatctcgttctcagaagccctccagcatttccagaccgttgatctgagtcctttcaagaagcgcattcagcccacaatccgcaggacagggctcgctgcactcagacactacctatttggtcctcccaagctgcatcaaagactgcgggaagagcgagacttggtgctgacaatcgctcagtgcggattggactctcaggacccagtccacggcagagtactgcagaccatctataagaagttgacgggctcaaaatttgattgcgccctccatggaaaccactgggaggacttgggcttccagggctag

SEQ ID NO: 55732 - DNA, 1146 bp, Artificial Sequence
  Description of Artificial Sequence: Synthetic coding sequence
atgaatgaaaagtcctgttctttccatagtaaagaggaacttcgtgatggccagggagaaaggctgagcgcaggatactccccatcctatgataaggataagtccgtgttggcctttagggggatccctatctctgaactcaagaaccacggtattctccaggctttgacaactgaggcctacgagtgggaacccagagtggtgagtactgaggtggtaagggcacaagaagaatgggaagcggtcgacaccatccaacccgaaaccgggagccaggccagtagtgagcaacctggccagctgatcagcttctctgaggccttgcaacacttccaaacagtggatctatccccattcaagaagcgtatccagcccacgatccgcagaactggcctcgctgctttgagacactacttgtttgggccacctaagctacaccagagactgcgggaagagcgagaccttgttcttactatagcccagtgtggcctggattcgcaagaccccgtccatggtcgagtcctgcagactatctacaaaaaactgacgggcagtaagtttgactgcgcccttcatggtaaccactgggaagacctgggattccagggggctaatcctgctacagatctccggggagcaggatttcttgctctgctgcacctgttgtatttggtcatggactccaagaccctgcctatggcccaggagatcttccggctctccaggcatcatatccagcagttcccattctgcctcatgtccgtgaacatcacccacatcgccattcaggccctcagggaggaatgtctatctagagagtgcaaccggcagcaaaaagtcatacctgtggtgaatagcttctatgcggctacgttcctgcacctggctcatgtgtggagaactcaacgtaagaccatcagcgattctgggttcgtgctcaaggagttggaggtgctagctaagaaaagccccaggagactgctcaaaacgttggagttgtacctagcaagggtctctaagggacaggcatcactgcttggtgcacaaaaatgttatggccctgaggccccaccttttaaagacctcaccttcacaggagaatccgacctgcagtcgcactcttctgagggcgtgtggctcatttag

SEQ ID NO: 55733 - DNA, 1146 bp, Artificial Sequence
  Description of Artificial Sequence: Synthetic coding sequence
atgaatgagaaaagttgtagctttcactctaaagaagaacttcgtgacggccagggggagcgtctttctgccggatattccccatcctatgataaggataagtccgtactcgctttcagggggatccccattagcgagctgaagaaccacggtatcctccaggcactgacgacggaggcatatgagtgggaaccacgggtcgtgtccacagaagtggtgagagcccaggaggaatgggaggccgtggacactatacagccggaaaccggaagccaggcaagttctgagcagcctggccagcttatcagtttttccgaagctttgcagcactttcagacagtcgatctgagcccctttaaaaagcggatccaaccgacgatccgacgtacaggcctagctgcgttgaggcattatttatttggtccacctaagctccatcagcggctgcgggaagaacgggatctcgtcctaacgatcgctcagtgcgggctggattcacaagaccccgtgcacggtagagtgctacagactatttacaaaaagctcactggaagtaagttcgattgtgccttgcatggaaatcactgggaagatcttggcttccaaggcgcaaacccagctacggacctgcgcggtgctgggtttctcgcactgctgcatcttttatacttggttatggattcaaagaccctcccaatggcccaggagatcttcagactgtctcggcaccacattcaacagtttccgttctgtttgatgtctgtgaacatcacgcatatagccattcaggcgctgagggaagaatgcctgagccgtgagtgcaacagacagcaaaaagttatccccgtggtgaactccttctacgccgcaaccttccttcacctggcgcatgtttggcgtacccagagaaagactatatcagattccggcttcgtgctcaaggagctcgaggttctcgctaagaagagccctaggcggttgctgaagactctggagctgtatctggctagggtaagcaaggggcaggcctccttgctcggagcacaaaaatgttatggccctgaggccccaccatttaaagatctcaccttcacaggagagtcagacctgcagtctcattcatcagagggagtttggctgatatag

SEQ ID NO: 55734 - DNA, 363 bp, Artificial Sequence
  Description of Artificial Sequence: Synthetic coding sequence
atgaacgaaaaatcatgtagtttccacagcaaagaggaactacgtgatgggcaaggagagaggctaagcgcgggttatagccctagttatgataaggataagagcgttctcgcatttagggggatacctatttccgaactgaagaaccatggaatcctccaagctctgactactgaagcatatgaatgggaacccagggtcgtgtctactgaggtggtgagagctcaggaggagtgggaagctgtggacactatacaaccggaaacgggatcacaggcctctagcgagcagcctgggcagctgatctctttttccgaggccctgcagcatttccagacggtggacctgtctccattcaaatag

SEQ ID NO: 55735 - DNA, 765 bp, Artificial Sequence
  Description of Artificial Sequence: Synthetic coding sequence
atgaacgaaaaatcatgctcttttcactccaaagaagaactcagagacgggcagggggagcgcctgtctgcgggttattctccgagctacgataaggataagagtgttctggctttccggggaatccctatcagcgagctgaagaatcacggaatactccaggcattgactactgaagcgtatgagtgggagcctcgcgttgtctctacagaagtggtacgtgcacaggaggagtgggaagcagtcgatacgatacagcctgaaaccgggtctcaagcctcctctgagcagccaggccagctgatatccttcagtgaggccctgcaacattttcaaactgtggatctgtcccctttcaagaagagaatccagccaaccattagacgcacagggctggccgctctccgacactatctcttcggtccgccaaagcttcaccagagactacgggaagaacgtgacctggtgctgacgatcgcccagtgtggactagattctcaggaccctgtgcatgggagggtgttgcaaacaatctataaaaaactcaccggctccaaatttgactgcgctctccacggtaaccactgggaagacctcgggttccaaggagccaatcctgctactgatttgcgtggcgctggttttctggcccttttacatctactttacttggtgatggacagtaaaactttgcctatggcacaggaaatctttagactgtctcgacaccacatccaaatcgagcgaaaccaaggtaaagggtag

SEQ ID NO: 55736 - DNA, 3363 bp, Artificial Sequence
  Description of Artificial Sequence: Synthetic coding sequence
atggtcctcaattccctcgacaaaatgattcagcttcagaagaacacagccaatattagaaacatctgcgttctagcacacgtagatcatgggaagacgacccttgcagactgcctgatctcaagcaatggaattatcagctctcgcctggccggaaaactacgatacatggactccagggaggacgagcagatccggggaataaccatgaagtcctccgctatctccctgcattacgctactggaaatgaggagtacctcattaacctgattgactcccctggccacgttgactttagcagcgaagtgagcaccgctgtgagaatttgtgacggctgcatcatagtggtcgatgcggtagaaggggtttgccctcagacccaagccgttttacgccaggcctggctggagaacatcagacctgtcctagtgatcaataagatcgataggcttatcgttgagcttaagttcacaccacaagaggcttacagccacctgaagaatattctggagcagataaatgctttaactggtacattgttcacttcaaaagttctggaggaaagggccgaaagggagaccgaaagccaggtgaatccgaactccgagcaaggcgaacaagtgtatgactggtccacgggccttgaggacacagatgacagccacctctattttagtcccgagcagggaaacgttgtttttaccagcgcgattgatggatggggcttcggaatcgagcactttgccaggatctacagccagaaaatcgggataaagaaagaagtcctcatgaaaacgctctggggggactactatattaacatgaaggctaaaaagatcatgaagggagaccaggcgaagggaaagaaaccactctttgttcagttaattctggaaaacatatggtccctatacgatgccgtcttaaagaaagacaaagataaaatcgacaaaatagtgacgtcactgggcctcaagatcggggcacgggaggcgaggcattctgatccaaaagtgcaaattaacgccatttgttctcagtggctgcctattagtcatgccgtcctggcaatggtgtgtcagaagttgcccagccctctggacatcacagccgagcgcgttgagcgcttgatgtgcacaggtagccagacttttgactcatttcctcctgagactcaggctctcaaggctgcctttatgaaatgcggttccgaggacaccgccccagtgatcatctttgtgtccaaaatgtttgccgttgacgcaaaggctcttccgcaaaacaagcctcgacctctcacacaagaggaaatagctcaaaggagggagcgggcaaggcagcgtcacgccgaaaagctggctgctgcccaagggcaggctccgttggagcctacgcaggatgggtccgcaatagaaacatgtcctaagggcgaagagcccagaggggacgagcagcaggtggagtctatgacccccaagccagtactgcaagaggagaacaaccaggagtcatttatcgcattcgcccgtgtcttcagtggcgtggcacggagagggaaaaaaatttttgtcctggggccaaaatactcccccctcgaattcctgagaagggtcccactgggcttttccgcccctcctgacggtcttccacaggtgccacatatggcctactgcgccctggaaaatttgtatctcctcatgggcagagaactggagtacctggaggaggtgccaccaggcaacgtactggggatcggcggactacaagacttcgtcctcaaatccgcaactctctgcagcctgcctagctgcccacctttcatcccactgaatttcgaggcaaccccaatagtcagagtcgccgtggaaccaaagcatccttctgagatgccccaattggtgaaaggaatgaaactcctcaatcaggccgacccatgtgtgcagatcctgatccaagagacaggagagcatgtcctagtcactgccggtgaagtccacttacagaggtgtctggacgacttgaaggaaaggttcgccaagatccatatctccgtgagcgaaccgattattcccttcagggagacgatcacaaaaccaccaaaagtcgacatggtgaacgaagagattggcaagcagcagaaagttgcagtcattcaccagatgaaggaggatcagagcaagatccctgaaggtattcaggtagacagcgacggtctcatcaccattaccactccgaacaaactggctacactgagcgtgagggccatgccactcccagaagaagtcactcaaattctggaggaaaatagtgatctgattcgcagcatggaacaattaacaagctcactgaacgagggggagaatacccatatgatccatcagaagactcaagagaaaatttgggaattcaaaggtaagctcgaacagcaccttactggcagaagatggcgaaatatagtcgatcagatctggtcttttgggcctcggaagtgcggacctaacatcctggttaacaagtccgaagacttccagaactcagtgtggacaggacctgctgacaaagcaagcaaggaagcatcaagataccgagacttggggaactcaattgtgtccgggttccaacttgcgactctgtctggacctatgtgtgaggaaccactgatgggcgtgtgttttgtactggaaaagtgggatttaagtaagtttgaggagcaaggagcttccgacctcgcaaaggaaggacaggaagaaaatgagacatgcagcgggggaaatgaaaatcaggagttgcaggatggttgctcagaggccttcgagaagcgcacatcccagaagggagaaagcccactgactgactgctacggaccgttttccggccagctcatcgccacaatgaaggaggcctgccggtacgctctgcaggtcaaaccccagcggctgatggccgctatgtatacctgtgatattatggctactggggatgtcctcggcagagtgtacgctgtattatccaagcgggagggcagggtgctgcaagaagagatgaaggagggcaccgatatgtttatcatcaaggcggttctgcccgttgcagaaagctttggcttcgccgacgaaattaggaagcgcaccagtggacttgcctccccacagctggtgttttcccactgggagatcattccatctgatcctttctgggttcccacaaccgaggaggagtatctgcacttcggggagaaggcggactccgagaatcaggctagaaaatatatgaacgccgtccggaagaggaagggtctgtatgtagaagaaaaaatcgtagaacatgcagaaaagcagaggacactcagcaagaacaagtag

SEQ ID NO: 55737 - DNA, 3210 bp, Artificial Sequence
  Description of Artificial Sequence: Synthetic coding sequence
atggttttaaattcattagataaaatgatccaattacagaagaacaccgccaatatcaggaacatctgtgttctggcacatgtcgatcacgggaacgaagagtacctgattaacttgattgacagtccaggccacgtggacttctcctccgaggtaagtaccgcagtcagaatctgtgatggctgtatcattgttgtcgacgctgtggaaggtgtgtgccctcagacacaagccgtattgcgacaggcctggcttgaaaatattcggcctgttttagtaataaataagattgatcggctgatcgtggaactcaaattcacaccgcaagaggcttacagccacttgaaaaatatactggaacaaattaatgctctgacgggcacactgttcacctctaaggttttagaagaacgggctgagagggaaacagagtcacaggtgaatccgaacagtgagcagggagagcaagtgtacgattggagcacaggcctggaagacacagacgactctcacctttacttcagccccgagcaggggaatgtggtgtttacaagtgccatagatggatgggggttcggtatcgaacacttcgccagaatttactctcagaaaatcggcattaagaaggaggtcctcatgaagactctttggggagattattacataaatatgaaggccaagaaaatcatgaagggagatcaagccaaagggaagaaacccctgttcgttcaactgatcttagaaaacatctggtccttatatgacgccgtgctcaaaaaagataaggacaagatcgataaaatcgtgacgtcgcttggtctcaaaattggggctagggaagcccgacattcagacccaaaagtgcagatcaacgctatatgctctcagtggctgcccatctcccacgccgttctcgccatggtctgtcaaaagctcccatcaccactggacataacggcggaaagggtcgaacgcctgatgtgtacgggctcccagacgtttgatagcttcccccctgaaacgcaagccctgaaggccgctttcatgaagtgtggaagcgaggacacggctcctgtcattatttttgtgagcaaaatgtttgctgtggacgcaaaggcgctgccacagaacaaaccaaggcctctcacccaagaagagatcgcacagcgcagagaacgcgcacggcaacgacacgcagagaagctggccgcagcgcaggggcaggctcctctggagccaacccaggacggctccgccatcgaaacctgccccaaaggagaagaaccccgaggcgatgagcagcaggtcgagtctatgacgcctaaaccagtcctacaggaggagaacaaccaggaatccttcattgccttcgcccgagttttcagcggcgttgctcgaaggggcaaaaaaatcttcgtcctggggcctaagtactcgcctctcgagttcctgcgacgtgttccgctgggttttagtgccccacctgatggtctgcctcaggtgccacacatggcctactgtgctcttgagaatctgtacctcctaatgggcagagagctggagtatttggaggaggtcccccctggcaacgttctaggaattggtggtctacaggactttgtcctgaaaagcgcaaccctatgtagcctcccctcttgtcctccatttatccccctgaatttcgaagccacaccaatagtcagagttgctgtggaacccaagcacccgagcgaaatgccgcagctagtgaaggggatgaaactgctcaatcaagctgacccttgtgtgcagatcctgattcaggagaccggagaacacgtgctcgtcactgccggagaggtgcacctgcagcggtgcttggacgatctcaaggagaggttcgcaaaaattcatatcagcgtaagcgagcctatcatcccatttagggagacaatcacaaaacctccgaaggtcgatatggtcaacgaggagatcggtaaacagcagaaggtcgccgtgatccaccagatgaaggaagaccagtccaagatcccagagggtattcaggtggatagtgatgggttgattactataacgacacctaacaagctggccaccctgagcgttcgcgcaatgccgctacccgaagaggtaacgcagatactcgaagaaaactcagacctgatccggtctatggaacagcttacttctagcctcaatgagggcgagaatactcatatgattcaccagaaaacccaggaaaagatctgggagttcaagggaaaattggagcagcacctgacaggtcgaaggtggcgcaacattgtggatcagatctggtcatttggtccccgaaaatgtgggccaaatatcctagtgaataagagcgaagactttcagaactctgtgtggacggggccagccgataaggcttccaaggaagcctcaagatatagagacttgggcaactctattgtgtccgggttccaacttgcgacattatctgggccaatgtgcgaggaacctctgatgggcgtgtgcttcgtgctggaaaagtgggacttgtctaagtttgaggagcagggtgccagtgacttggcaaaggaggggcaagaagaaaacgaaacctgctctggcggaaatgaaaaccaagaattgcaggacggctgttctgaggcctttgagaagaggactagccagaaaggcgagagtcccctaaccgactgttatgggcctttcagcgggcaactcattgccactatgaaggaggcctgccgctatgccctgcaagtgaagccacagcgtctcatggcggcaatgtatacctgcgatattatggcaaccggcgacgtgctggggcgagtatatgccgtgctaagtaagcgcgagggcagggtgttgcaggaggagatgaaagagggtaccgacatgttcatcatcaaagcagtgctcccagtggccgaaagtttcggcttcgcagatgaaattagaaaaaggacaagcggacttgccagcccccagttagtgttttcccactgggaaattattccttccgaccccttttgggtgcctaccaccgaagaggagtacctacacttcggtgaaaaggccgactccgagaatcaggccaggaagtacatgaacgccgtacgcaaaagaaaaggcctgtatgtagaggagaagatcgtggagcatgcggaaaaacagcgaaccctaagcaaaaataagtag

SEQ ID NO: 55738 - DNA, 93 bp, Artificial Sequence
  Description of Artificial Sequence: Synthetic coding sequence
atggtgttgaatagcctcgacaagatgattcagctacaaaagaacaccgcgaatattcgcaatatctgcgtcttagctcatgtcgaccactag

SEQ ID NO: 55739 - DNA, 54 bp, Artificial Sequence
  Description of Artificial Sequence: Synthetic coding sequence
atggtgctgaattccctagataagatgattcaactccagaagaatactgcctag

SEQ ID NO: 55740 - DNA, 420 bp, Artificial Sequence
  Description of Artificial Sequence: Synthetic coding sequence
atgtggcacacagtgccaagagccggactcggccgagttggctgccgcggtctgcccggatgcagagcccatccgcctggtgcttgggcctgttgcaccgagcaggcctgggccctggctccattaaccgttccttctcgcccatctctttgtagcggccctcgtactggcagtggccagcaggcacctggactgcaggacgtgttgtccctgtggtcagtctgcgacgacgagcatagttggagctttttgtatgccggaccttgggcaagtgaacgcgcaacaggctggcgactgagccatgaagtggaggggcagagccaaggcctccaggtgaccagctgcagacaccacgcccttcttccatgggcggtgttaggggctccttcttggccatgggcccagtggccggtcgcatag

SEQ ID NO: 55741 - DNA, 309 bp, Artificial Sequence
  Description of Artificial Sequence: Synthetic coding sequence
atgggtgccgagtgggagctgggggctgaggctggaggtagcctgctgctgtgtgcggctctgctggcagccggttgtgctcttggtcttagactgggacgcggacaaggggcagccgatcgcggagccctaatatggctatgttacgatgcactggttcacttcgctctggcctttcctgccgaccatccagtaagggtgcgggctgtatggctgttggatgacctcccaccgagggttgcccaccagaagccacagccccagcatcagcagcttgcagtgctactggccttacccgtgtttttttag

SEQ ID NO: 55742 - DNA, 387 bp, Artificial Sequence
  Description of Artificial Sequence: Synthetic coding sequence
atgggcgcagaatgggaactcggcgcagaagccggaggatccctcctcttgtgcgccgctctgctggcggcaggatgcgctctcggactaaggctcgggagaggccagggcgcagcagaccgtggggcattaatttggctctgttatgacgctctcgtgcatttcgcgcttgagggaccatttgtctacttatctcttgtgggaaacgttgctaattccgacggtcttattgccagcctctcggatgcccgatgggtatattttgatcctacaattgtctcagttgaaattcttaccgtcgctctcgatggttcccttgcgctgttcctgatttacgcaattgtcaaggagaagtattatcgtgatcgtgtagcctggggtgaatag

SEQ ID NO: 55743 - DNA, 1815 bp, Artificial Sequence
  Description of Artificial Sequence: Synthetic coding sequence
atgctgggcatgaatatgctccttatcacactctttctcctgcttcccctgagcatgctcaaaggggaaccttgggagggttgcctgcattgtactcatacaacatggagtggcaacatcatgacaaagacgttgctgtaccacacctattatgaatgcgcaggaacttgcttgggcacatgtacccacaaccagaccacatacagcgtttgtgacccaggaaggggacagccctacgtgtgttacgacccaaagtcctctcctggcacctggttcgagatccacgtcgggagtaaagagggagatctgttgaaccagaccaaagtatttccctcaggaaaggatgtggtttctctctacttcgacgtgtgccagatcgtctccatgggcagcctctttcccgtcatcttctcttccatggaatactacagttcttgtcacaaaaaccgttacgcccatcccgcttgctctaccgattcacctgtcaccacctgctgggattgcacgacctggtccaccaaccagcagtcactgggacctataatgttgactaagattccattagaaccagactgcaagacctccacatgtaatagcgtgaatctgacaatcttggagcccgatcaacccatttggacaactggcctgaaggcacccctgggtgccagggttagtggcgaagagatcgggcctggagcttacgtgtacttgtacatcattaaaaagaccaggacccgctctacacaacaattcagagtgttcgaatccttttatgaacacgtgaaccagaagttgcccgagccgccacctttggcttcaaatctctttgcacagcttgctgaaaatatcgcgagttctttgcatgtggcttcttgctatgtttgtggcggaatgaatatgggagaccagtggccctgggaggcgcgagagctgatgccccaggataacttcaccttaacagcctcctcactggagccagccccaagttcacaaagcatctggttcttaaagacctcaattattgggaagttttgtattgctcggtggggcaaagccttcacagaccctgtcggggaattgacttgcctgggccagcagtactacaacgaaaccctggggaagactttatggcgaggtaagtctaataactccgagtcaccacacccttcacccttctctcggttcccttcattgaaccattcctggtatcagctggaggcaccaaacacttggcaagccccaagcggtttatactggatatgcggtcctcaggcctatcggcagctaccagccaaatggtccggggcttgtgtgctgggcacgatccgcccttccttcttcttgatgcccttgaagcagggcgaagcacttggctatccaatctacgacgagactaaacgtaagtccaagaggggaatcacaattggggattggaaggacaatgagtggcccccagagaggattattcaatattacggcccagccacgtgggcagaggacggcatgtggggttacagaactcccgtttacatgctcaacaggattatcaggctgcaagctgtactggagatcatcacgaatgagaccgccggtgcactgaacctcctggctcagcaggccacaaaaatgcggaatgttatctaccaaaacaggctggccctcgactacctgctcgcgcaggaagaaggggtatgcggcaagttcaacttgactaactgttgtcttgagctggatgatgaggggaaggttattaaggagatcaccgcaaaaatccaaaaattggcacacattccggtgcagacatggaagggctag

SEQ ID NO: 55744 - DNA, 1692 bp, Artificial Sequence
  Description of Artificial Sequence: Synthetic coding sequence
atgggctccctgtctaactacgcactcttgcagctcacccttacagccttcttgactatcctggttcagccgcaacatctccttgcccctgtctttcgcacgctgagtatcctgactaatcagagcaactgttggctctgcgagcatttggacaatgccgaacagcctgagctggtttttgtgcccgctagtgctagcacttggtggacgtacagcggacagtggatgtatgagagggtctggtatccacaggctgaagttcagaatcacagtacctcctcctacagaaaagtcacatggcattgggaagcctcaatggaggctcagggtctgtctttcgcgcaagtgcgcctgctggagggcaacttctctctttgtgtcgagaacaagaacgggagcggcccattccttggcaacattcctaagcagtactgcaatcaaattttgtggttcgacagtactgatggtacattcatgccatccattgacgtcactaatgagagcaggaacgatgatgatgataccagtgtgtgcctgggcactagacagtgcagttggttcgccggttgtactaatcggacctggaacagtagcgctgtccctttaattggccttccgaatactcaggattacaagtgggtggacagaaatagtggactaacttggagcggtaacgacacatgtctatactcctgtcaaaaccagacaaaaggcctcttgtaccagctgtttagaaatctgttctgcagctatggcttgacagaggcgcacggtaagtggaggtgtgcggacgcctccattactaacgacaaggggcacgatggccatcgaacaccaacatggtggctaactggcagtaatctgactttgtcagtgaacaacagcggactttttttcctttgcggaaatggtgtctacaaggggttcccacccaaatggagtggccgttgcggactcggttacctggtgccatccctgacgagataccttaccctcaatgcttcacagatcactaacctccggtctttcattcacaaagtgactccccatcgctgtacacaaggagacactgataatcctccgctttactgcaatcccaaggacaactcgacaatcagagcactgtttccatcattgggcacatacgacttagagaaggctattctcaatattagtaaagccatggaacaggaattctctgctactaaacagactttagaagcccatcagtctaaagttagcagcctggcgtccgctagtaggaaagatcacgtgcttgacattcctaccacccagcgacagaccgcatgtggtactgtgggtaaacagtgttgcctctatattaattactcagaggaaattaagtccaacatccaacgcctccacgaagccagcgagaatttgaaaaacgtccccctccttgactggcaagggatcttcgccaaagtcggtgactggtttaggtcatggggatatgtgttgcttatcgttctgttctgcttgttcatctttgtgcttatctacgtaagggtttttcggaagtcccgtaggtcccttaactctcagcctctgaatctagccctgtcccctcagcaaagtgcccagcttctggtatcagagacttcctgccaagtctcaaatagggctatgaaaggactgactacgcaccagtatgacacttccctgctgtag

SEQ ID NO: 55745 - DNA, 1692 bp, Artificial Sequence
  Description of Artificial Sequence: Synthetic coding sequence
atgggctcactgtcaaattacgctctgctccagcttacccttactgccttcctgacaattctcgtccagccgcagcacctgctcgcccctgtatttaggaccctgagtattctcaccaaccagtccaactgttggttgtgcgaacacttggataacgctgaacaaccagagctcgtatttgttccggcttctgcctcaacttggtggacctacagtggtcaatggatgtatgaacgggtgtggtatccccaagctgaggtgcagaatcattctacttccagctatcgcaaagtgacttggcattgggaggcctccatggaagctcagggcctctccttcgcgcaggtccgtctgttggaggggaatttcagcttgtgcgtagaaaacaagaatggatcaggccctttcctgggtaacatcccaaagcagtactgtaaccagatcctgtggttcgatagtacagatggaacattcatgccatcaatcgatgtcaccaatgagtcccgaaacgatgatgacgatacctccgtgtgtctgggaacgagacaatgttcctggttcgctgggtgtaccaacaggacgtggaattcctcggcggttccccttatcggactccccaacactcaggattacaaatgggtcgaccgcaattccggactcacttggagcggaaatgacacgtgtctttactcctgccagaatcagaccaaagggctgctctaccagctgttccgcaacttgttttgttcgtatggtcttacagaggcccatgggaagtggcgatgcgcggacgccagcatcactaatgacaaagggcatgatgggcataggaccccgacgtggtggctgacggggtcgaatttaactttgagtgtcaataacagtgggttgttttttctgtgcggcaacggggtgtacaagggtttcccaccaaagtggtccggcagatgtggtctggggtatttagtacctagtctgacccgctacctgaccctaaacgcgagtcaaataactaatctccgctcctttattcacaaggtcaccccacatcgatgcacacagggggacacggataatcctcctctgtactgcaaccccaaagacaactccacgatcagggccctatttccgtcgctcgggacgtacgacctggagaaagcaattctaaacatatctaaggcgatggagcaggagttcagcgctactaaacagactctggaggcacatcaatctaaggtttctagccttgcatctgcttccagaaaggatcatgtgctggacattcctactacacagaggcaaactgcctgcggcaccgtgggaaagcaatgttgcttgtatataaactactcagaagaaatcaaatccaacattcagcgactgcatgaggcaagcgaaaacctgaaaaatgtgcctttgttggactggcagggcatcttcgctaaagtcggtgattggtttaggagctgggggtacgtcctgctaattgttcttttctgtctgtttatcttcgtactcatatatgtccgggttttcaggaaatcccgcagaagcctgaactcccaacccctgaatttggcactgtcccctcagcagtctgcgcaactcctggtctccgagacctcctgtcaagtttcaaacagagcaatgaaaggcctgacaactcaccaatacgatacttcgctcttgtag

SEQ ID NO: 55746 - DNA, 1608 bp, Artificial Sequence
  Description of Artificial Sequence: Synthetic coding sequence
atgacagagaagtttctcttcctatatttaagtttgctccctatgccgctactttctcaggcacaatggaatgagaattcactggtaagcttctccaagatcattgccagcggtaaccatctctctaactgctggatctgtcataactttattacaagatcctcatcatatcagtatattctcgtaagaaacttctctctcaacctgacgttcggaagtggaatccccgagggccagcataaaagcgtgccgttgcaagtcagtctcgccaactccgcacatcaggtgccatgcctggacctcaccccccctttcaatcagtctagtaagacatccttctacttttataattgtagttcactcaaccaaacgtgctgtccatgcccagagggacattgtgatagaaagaacacctccgaggaagggtttccatcgcctacaatccaccccatgtccttcagtcccgcaggctgccaccctaatctgacacattggtgccccgcaaagcagatgaatgactacagagacaagtccccgcagaaccgatgcgctgcctgggaaggtaaggaactcattacttggagggtgctttacagccttccaaaagcacataccgtcccaacttggcctaagagcaccgtgcctcttggtggcccactgtctccggcttgcaatcagactatccctgcaggctggaagtcacagctgcacaaatggtttgacagtcacattccgaggtgggcctgcacacctccagggtatgtgttcctatgtggccctcagaagaacaaactacccttcgacggcagccctaagatcacatatagcacgcctccggtcgccaacctgtatacctgcattaataacattcagcatacaggagaatgtgccgtaggcttgctgggacccaggggtatcggtgtaaccatctataacacgacccaaccacggcagaagagggccctgggactcattcttgcgggaatgggtgccgctattgggatgatagcaccatggggtggctttacatatcacgacgtgacccttagaaacttgtctcggcaaatcgacaacatcgccaagagcacacgggattctattagtaaacttaaggcctctattgattccttggccaatgttgtaatggacaatcgcctcgctctggattatctgctcgcagaacagggtggtgtgtgcgctgtgatcaacaagtcatgttgtgtgtatgtcaataactccggcgctatcgaagaagatatcaagaaaatatatgatgaggcaacctggttgcacgactttggcaaggggggtgcttcagcccgagccatttgggaggcggtcaagagcgcgctgcccagcctgaattggtttgtgccactgcttggccctgcaactgtgatattgttgctgtttctcttcggtccctgttttttcaacctgctgatcaagtgcgtgtcctcgcgcatcaagcaattccatatgaaatcaccccaaatggaaaggtaccagttaagcgtcatcggcggtccttcaacgtacaaacatatcagccctctggacgcgtctggccaacggtttcgggaaactatggaggaattttccttgtag

SEQ ID NO: 55747 - DNA, 795 bp, Artificial Sequence
  Description of Artificial Sequence: Synthetic coding sequence
atggccctcgaagctgcaggcggacccccagaagagacactgagtctatggaaacgcgagcaggcacgactgaaagcccatgtggttgatagagataccgaggcatggcagcgggaccctgccttttcagggctacagagagtgggcggagtggacgtttcctttgttaagggcgactctgtgcgcgcttgtgcttctttagtggtgctttcattccccgaactggaggtccttctggtggacggtaatggcgtgttgcatcatcggggattcggggtcgcttgtcacctcggagtgctaaccgacctcccctgcgttggggtcgccaagaaactattacaagtggacgggctcgagaataacgccttgcataaggagaagatcaggctactgcaaaccaggggcgacagtttccccctactgggggatagcggcacagtgttgggaatggcactgcggtcacatgatcgatctactcggcctttatacatatccgtgggccaccgcatgagccttgaggctgcagtccgcttaacctgttgttgttgccgcttccgaattcccgagcccgtaagacaggccgacatttgctctcgtgaacacattcggaagtctcttggcctgcccggtcctccaacccccagaagccctaaggcccagcgccctgtggcctgtcctaagggtgacagcggagagtcatctggagagggacaacctcctcaagaccacagcccaggaccccgaactgccccaaggcccggatcccaggagcaggccggtaaagattggcagtag

SEQ ID NO: 55748 - DNA, 849 bp, Artificial Sequence
  Description of Artificial Sequence: Synthetic coding sequence
atggctctggaagctgcgggagggccacccgaggagacgttgtcactgtggaaaagagaacaggctcgccttaaggctcatgtggtggacagagatactgaggcttggcagagagaccccgctttcagcggactccaacgcgtcggcggagtagatgtctcttttgttaaaggcgatagcgttagagcttgtgcttctctggtcgtgctgtccttccccgagctggaagtggtctacgaagagtctagaatggtctcattaacggcaccctatgtttcggggttcctggctttcagggaggtgcccttcctcctcgaactggtgcagcagctgagagaaaaagagccaggcttgatgccccaagtcctgcttgtggatggcaacggggtcctacaccatcggggattcggtgtggcgtgtcatttgggtgttctcacagatctcccatgcgttggagtggctaaaaaactgctgcaggtagatgggctggaaaacaacgccttgcacaaggagaagatccgactactccagacaaggggggattcctttcccctcctaggcgattccggtactgtgctcggcatggcattaaggtctcacgatcgatcaacccggccactgtacataagcgtaggacaccggatgagcctcgaggctgcagtcagactgacatgctgctgctgtaggttcaggattccagagcccgttagacaggcggacatctgtagtagagaacacatcagaaagtccctcggcttgccaggccctccgacgcccaggtcacccaaagctcagaggcctgtcgcatgcccaaaaggcgactcaggagagtcttccgctctatgctag

SEQ ID NO: 55749 - DNA, 714 bp, Artificial Sequence
  Description of Artificial Sequence: Synthetic coding sequence
atggcactcgaagctgctggcggtcctccagaggagaccctgagcctgtggaagcgcgaacaggcgcgactaaaggcccatgtcgtggaccgagataccgaagcttggcagcgggacccggcattttccggactacaacgagtaggcggagtggacgtatccttcgtcaaaggggatagtgtgcgcgcatgcgcttccctggtggtgctgtcatttcccgaactggaggttctactagtggatgggaacggcgttctccatcacaggggctttggggtcgcctgtcacctgggagtgctcacggacctgccgtgcgtgggggtggctaaaaagctccttcaggttgatggtctggagaacaatgccctccacaaggagaaaattaggctgctgcaaacccgcggagatagctttcccctgctgggagacagtggaactgtgctcggaatggccttgcgatctcacgatagatctaccaggcctctgtacatatcagtgggtcacagaatgagcttagaagcagccgtgaggctgacttgttgttgctgcagattcaggattcccgagcctgtgaggcaggccgatatctgctctcgagagcacatccgaaaatctctgggcctcccgggacctcccacccctagatcccccaaagcgcagaggccggtagcttgtccgaagggagactcaggggaaagcagtgctttgtgttag

SEQ ID NO: 55750 - DNA, 771 bp, Artificial Sequence
  Description of Artificial Sequence: Synthetic coding sequence
atggacccaacttgcagctcagaatgtatctataatcttatcccatccgatctgaaggaaccaccacagcccccacggtatatatcaatttttaaggcaaccgtgaaagacgacatgcagaaggccaaaacagcgatgaaaactatgggtcctgctaaggtagaagtccccagccctaaagattttctaaaaaagcatagcaaagagaaaaccttgcccccaaaaaaaaactttgacagaaatgtaccaaagaaaccggctgttcctttaaaaacggatcatccagtgatggggatacagtccgggaagaatttcatcaacactaacgccgcagacatcatcatgggcgtggccaaaaagcctaaacctatatatgtggataaacggaccggggacaagcacgatctggaaccttctggcctggtccccaagtatatcaataaaaaagactatggcgtgaccccggaatacatctgtaagaggaatgaggaaataaagaaggcccaggaggactacgataggtacatacaagagaacttgaaaaaggctgcaatgaaacggcttagtgatgaggagcgcgaggctgtcctccagggcctgaaaaaaaactgggaggaggtgcataaggagttccaatctttgtcggttttcattgactccatcccaaaaaaaatccggaagcagcggctggaggaggagatgaaacagctagaacatgacatcggcatcattgaaaagcacaaaattatctacatcgccaataatgcttag

SEQ ID NO: 55751 - DNA, 768 bp, Artificial Sequence
  Description of Artificial Sequence: Synthetic coding sequence
atggatcctacctgctctagcgagtgcatttacaacctaatcccctctgacctaaaagagccaccccagccccctagatatatcagcatcttcaaggctacagtgaaagatgacatgcaaaaagccaaaactgcaatgaagaccatggggcctgccaaagtcgaagtgccctcacctaaggacttcctaaagaaacattccaaggagaaaacactacctccaaaaaaaaactttgataggaatgtgcctaagaaacccgctgttcccctgaaaaccgatcatcccgtgatgggaatccaatcggggaagaactttattaacaccaacgctgccgacatcataatgggagttgccaagaagccaaaacctatctatgtggacaaaaggactggagataagcacgacctggagcccagcggactggtgcccaagtatatcaacaagaaggactacggcgtgactcccgaatacatttgtaagcggaacgaggagattaagaaggcacaggaagactatgaccgatacattcaggagaacctcaagaaagccgcaatgaaacggctgtccgatgaggaacgggaagctgttttgcaagggcttaagaaaaattgggaggaggttcataaagaatttcagagtttgtccgtcttcattgattcgatccctaaaaagattaggaaacagaggctggaggaagaaatgaaacagctcgaacatgatattggcataatcgagaaacataaaatcatctatattgctaacaagtag

SEQ ID NO: 55752 - DNA, 771 bp, Artificial Sequence
  Description of Artificial Sequence: Synthetic coding sequence
atggatccaacatgctcgagtgagtgtatatacaatttaataccaagcgacctgaaggagccccctcagcccccacgttatattagcatttttaaggcaacagtcaaagatgatatgcagaaagccaagaccgctatgaaaaccatggggcctgcgaaggtggaggtgccgagcccgaaggactttttaaagaaacactcgaaagagaagacactaccacccaagaagaattttgatcgtaatgtgcctaaaaagcccgctgtgccgctgaagacagaccatcctgtgatgggcattcaatccggcaagaactttatcaacaccaatgctgccgacatcattatgggtgtggctaaaaagcctaaaccaatttatgtggataagagaactggcgataagcacgaccttgagcctagcgggttggtaccgaaatacatcaacaaaaaggactatggtgttacgcccgagtacatctgcaagcgcaacgaggaaatcaaaaaggcgcaggaggactacgacagatacattcaggaaaatctgaaaaaggctgcgatgaagcggctgtccgacgaagagcgcgaggcggtcctgcaggggctaaagaagaattgggaagaagtccacaaagagttccagagcctttcagtattcatcgattccattcccaagaagatccgtaagcaacgcctggaagaggagatgaagcagctagagcatgacattggcatcatcgagaaacacaaaataatctacatcgccaacaatgcatag

SEQ ID NO: 55753 - DNA, 1305 bp, Artificial Sequence
  Description of Artificial Sequence: Synthetic coding sequence
atgtctatcgagaagatttgggccagggaaatcttggactcaaggggcaaccctactgtggaggttgatctttacaccgctaagggcctcttccgggctgccgttccatctggcgctagcaccggaatctatgaagctctggagttacgggacggcgataagcagcgttacctcggcaagggagtcttgaaagcagtggatcacatcaattctactattgcaccagccctcatctcatcaggtctgtcagttgtggaacaagaaaaactcgataatcttatgttggagctggacggaactgagaacaaatcaaaatttggagcaaacgccattctcggcgtgtctctggcggtgtgtaaagcaggggcagccgaaagggaacttcctctctatcgtcacattgcccagctggccggaaactcagatctgatcctcccagtgccagccttcaatgttatcaatgggggatctcacgctggaaacaagttggccatgcaagagtttatgattcttcccgtgggagcagaatcctttcgggatgccatgagactgggagcggaagtctaccacactttgaaaggggttataaaggacaagtatggcaaggatgccaccaatgtaggggacgagggtgggttcgcgcctaacatattggagaatagtgaagccctcgagctagtcaaggaggccattgataaggctggctacaccgaaaaaatagtgattgggatggacgtcgcggcaagtgaattctatagggacggcaagtatgacttggatttcaagagtcccactgatccgagtcgctacatcacaggggaccagcttggtgccctttatcaggatttcgttagggactatcctgtcgtgtcaattgaggacccctttgatcaggatgactgggccgcatggtccaagtttactgctaacgtgggtatccagatagtcggagatgacctgacagtgacgaacccaaagcgcatcgaacgcgcagtagaagaaaaagcctgcaactgccttcttctgaaggtaaatcaaataggctccgttaccgaggccatccaagcttgcaaattggcccaggaaaatggttggggagttatggttagccacagaagcggagaaacggaggataccttcattgcagacctcgtagtgggcttgtgtaccggccaaattaagacgggagccccttgcaggtctgagcgtctggctaaatacaatcaactgatgcgtattgaggaagagttaggagatgaagcaagattcgcgggtcacaactttcgcaatcctagcgtgctatag

SEQ ID NO: 55754 - DNA, 1887 bp, Artificial Sequence
  Description of Artificial Sequence: Synthetic coding sequence
atggaagaagaaggtgggggacggtcatgcgggaccacacgggaactgcagaaacttaagcaacaagctatggaatactatagggaaaacgacgtaccacgcaggctggaagagttactgaattcgaccttctacctgcagcctgcagacgtgtacggtcatttgaaagccaattgtttctcaaagcttgccaagccacctaccatttgcaaaattgttggtaaggatgtgctagatgggttgggtctgcccaccctgcaagtggatatcttttgtacaatacagaacttccctaagaatgtttgctcagtggtcatctccactcattttgaggtgcatgagaatgctctaccggagctggctaaggcggaggaagcggagcgggctagtgcggtgtcaacagctgtccaatgggtgaacagtacgataacccatgagctccagggcatggcacctagcgaccaggccgaagtcgaccatttattaagaatttttttcgcatctaaagtgcaggaagacaagggccgtaaggaactcgaaaagtccctggagtattcaaccgtgcctacaccactgcccccagtgcctcctcctccgccacccccacctcctacaaagaaaaagggtcagaagcccggtcggaaagacacgattaccgagaagccgattgctccggctgaaccagtggaacccgttctgtccggctctatggcaattggcgctgttagcttggcagttgcgaaggcatgtgctatgctcttaaacaaacctctttacctgaacatagctctcttgaaacacaaccaagagcaacccacgacactctcgatgccactcctgatggtctcactggtgtcttgtggaaagtcttcatccggcaagctcaatctgatgaaagaggtcatctgcatcccacacccagagcttactaccaaacagggcgttgagatgttgatggaaatgcagaaacacataaataagattattgagatggtcagtccttccccacctaaagctgagacgaagaagggacacgatggctcaaagcggggacagcagcaaatcactgggaaaatgtcccacctgggctgcctgaccattaactgcgattctatcgagcagcccctgctcttgatccaggaaatttgtgccaacctggggttggaattaggcaccaacctgcacctggcaatcaactgcgcaggccacgagctgatggattataacaagggtaaatatgaagttatcatgggcacctataagaatgctgctgagatggttgacctgtatgtggatcttattaataagtaccccagtattattgcactcatcgatcctttcagaaaagaagactccgagcagtgggattctatatatcacgctctcggttccaggtgttatataatcgccggaactgcgtccaagtccattagtaagttactggaacagggaaatatttctatccccaaaagcaatggcctcatcattaaacacacaaatcagacaaccatgagcgacctagtggagattacgaatctgattgacagtaaaaagcacattacggtattcggcagtactgaaggagagtcctccgatgactcacttgtcgacctggcagtcgggttgggggtgcgctttatcaagcttgggggacttagtcgcggtgagagggtgaccaaatataacagactcctcaccatagaggaggagcttgtgcagaacgggaccctggggttcaaagaggagcacacgtttttctacttcaatgaggaggcagaaaaggcagcagaggctctggaggcagcagccgctagagagcctcttgtaccgaccttccctactcaaggagttgaggagagtgctgagactggcgcatctagtggatag

SEQ ID NO: 55755 - DNA, 1824 bp, Artificial Sequence
  Description of Artificial Sequence: Synthetic coding sequence
atggccttcaggcgccaagtgaaaaacttcgtgaaaaactattccgacgcagaaatcaaagtacgtgaggccacttccaacgacccgtggggtccgtcctcctcgctcatgctggacatatccgacctgacattcaataccatctccttgagtgaaattatgaacatgttgtggcatagactgaatgaccacgggaagaattggcggcatgtttacaagtcactgacgttgatggattacctgatcaaaaacgggagtaagaaagtaatccagcattgccgagaggggttctgtaacttacagaccctgaaggatttccagcatatcgatgaggccggaaaagatcagggatactacataagggagaagtccaagcaagttatcactctgctgatggatgagcccctgctctgtaaagagagggaggtggcttgcagaacccgccaaagaaccagccactcgattctgttttctaagcgacagttgggcagctctaacagcctgacagcgtgcacttcagccccaacaccagatatctcggcctctgagaagaaatacaagctgcccaagttcgggaggctccacaacaagcggaatgtgtgcaaagccggtctgaagcaggagcactgtcaggacgtacatctgccgaccgaaacgatgctgtcccaggaaaccttgccgttgaaaatacacggctggaagtctacagaggatctgatgaccttcttggacgatgatccggagctgcctctcctggccaccccccctagcatcgtgagcccaattacctgtctgagtgaggcagaagaggtctgtaacttgtcaggcgcagatgccgtgccaacactcagtgaaaactccccgtctggccagcgagatgtttcattagacaagaggtctgacggaatatttaccaacacagtaacagagaatctgctggaaacccctctcgagaagcagagcgccgctgaggggttaaagacactgacaatccttcccgcatgctggagttcaaaagaagagttcatttctcccgatctacgggtatccaaatcagattcaacctttcataaccaagcctccgtcgaaactctgtgcctctctcctagtttcaaaattttcgaccgggtaaaagagatagtaatcaacaaagcctatcagaaaccagcccagtctagcattcagatggacgataaaattcttaaaaccacaactcgggtgtccaccgcctccgaaggggcatctagcttctccccattgagcatgagctcccctgacctcgcctcccctgagaaatctgctcacttgctatcacctatcctagctgggccatcattctggaccttatcccaccagcaacttagcagcacttccttcaaggacgaggataaaaccgccaagctccaccatagttttgcatctcgaggcccagtgtcatccgatgtggaggaaaacgattcccttaacctcttaggtattctccctaataactccgactcagccaaaaagaacatctcccacatttctagttctcactggggcgagtttagcacccaaaatgttgatcagttcatccctttgagttgctctggcttccagtcaacgaaggacttccctcaggagccagaagccaaaaactccatttccgtcctattgagagaggtgaagcgcgctatagccaggttgcacgaggatctgtcaacggtgatacaagagctcaatgtgatcaataatatcctgatgtcgatgagcttaaattccagccagattagccagagctctcaggttcctcagagcagtgagggaagttcggaccaaatctag

SEQ ID NO: 55756 - DNA, 906 bp, Artificial Sequence
  Description of Artificial Sequence: Synthetic coding sequence
atgcaggctagtgcggaccaggtcgaacgtgacatcctggagacgcagaaacgcctgcagcaggacagactgaactctgaacagtctcaagctttgcagcaccagcaggaaactggctccagccttaaggaggccgaagtgctcctgaaggatctgttcctggacgtcgacaaagcacggcgactgaagcatcctcaggctgaagagactgagaaggatattgagcagctgcacgaaagagtcactcaggagtgtgcagagtactgcgcgctctatgaaaagatggtactaccacccagacggggaattcaggggaggctgggcaccagggctggcgctgagaccgaggccggactacggaggcccgtctgggctggccacggcggagccggaggaaccgacaggggagcccaacatagggccgagggggatcagcgccctcgaagagccgctgccgagcccggaggtgctggctgtcgccatcaccctgaacccatccccaggcctacagagggcggtgttgttgcacgggctgagccagggcagcctgttcatgccctgcaggggtgcacctggcagctgagcgccctggcagaacagcagcgacggattcttcagcaggattggagtgatttaatggcagaccccgcaggagtcagaagagagtacgagcacttcaagcagcatgagcttctcagccaggagcagagtgtgaaccaactcgaagaagacggcaagcgcatggtggaactccgtcacccagccgtcggcccaattcaggcccaccaggaggcgctgaaaatggagtggcagaattttctgaacctgtgcatctgccaggagactcaactgcagcacgtggaagattactcccgcattttgtgtcctagtagttcaccccattag

SEQ ID NO: 55757 - DNA, 1038 bp, Artificial Sequence
  Description of Artificial Sequence: Synthetic coding sequence
atgcagcatgtgagctcttcacagagtagtcaaagacacgtgcaatggcctggagcttgccccggtgcgggtgaagagcagcccgcatgttctcagcctagtctgcccctcactctgccaagccctagtcatcagctgcaacagctgatggacggcagcggactcacacaaatcgcccagggtgcccaggtccagctacagcatccaggaacgccaattaccgttcgggagcgtagacctagtcaaccacacactcagagtggtgggacaattcatcacttagggcctcagtcgccagccgcagcaggaggggctggattgcagccacttgcaagcccttctcacataacaacagcgaacttacctccccagcccagacccctgggattcgagaggacaccaggagtactgctgccaggagcaggcggtgcggcaggattcggtatgacctctccgcctccgcctaccagtccatcgagaaccgccgtaccccctggcctctcgtctctgcctttgacgtcagtcggaaatactggaatgaaaaaggtgccaaagaaattggaagagatcccacctgcctcccccgagatggcccagatgcgcaagcagtgccttgattaccaccaccaagaaatgcaggctcttaaagaggtgttcaaggagtacctgatagaactattcttcttacagcattttcaaggaaacatgatggattttctggccttcaaggagagactgtatggcccactgcaggcctacctccgccaaaacgatcttgacattgaggaagaagaggaagagcacttcgaggtaatcaacgatgaagtcaaggtggtggctaggaaacatggccaacctggaaccccggtagccatcgccacccaactcccacccagaacctcagcagcctttccagcccagcaacagcccctgcaacctctcgcgccaacaacagtccttagtgtctccgcagactggaatgccctcctccagagaccaaacaagtacatatgggggctgcaataccttgaaatgtag

SEQ ID NO: 55758 - DNA, 1467 bp, Artificial Sequence
  Description of Artificial Sequence: Synthetic coding sequence
atgcagcatgtgagtagctctcaatcttcgcaaagacatgtacagtggcccggtgcatgccctggtgccggagaggaacagccagcctgcagccaaccatctctgcctttaacccttcccagtccgagccaccaattacagcagctgatggttagaggcggtcctgctggtggccaaaatatgaatgtcgacctccagggcgtcggacccggtttacagggaagcccacaggtgactttagcccctctccccctaccctcccccacgagccccggatttcagttctccgctcaacccaggcggttcgagcacgggagcccttcatacatccaggtgacgtcacctctgtcacagcaggttcaaacccagtccccaacccaaccttcacccggacctggccaggccttacagaacgtgcgcgctggcgcaccagggccaggcttgggactgtgtagttcttctcccacaggcgacttcgtggacgcttccgtgcttgtccgccaaatcagtttaagcccctccagcggagggcatttcgtattccaggatggatctgggctaacccagatcgcccagggggcacaagttcaacttcaacaccctgggacgcctattacagtcagggaacgaagaccatcccaaccacacactcaatctgggggtacaattcatcacctgggaccacagtctccagccgctgccggaggcgctgggttacagcctttggcctccccatcacatattaccaccgccaacctgcccccacaaattagctccattatacagggtcagcttgtgcaacaacagcaggtcctccaaggccctcctttgcccaggcctctggggttcgaaaggactcctggggttcttctgccgggagcaggcggtgcagccggtttcggaatgacttctccccctcccccaacttcccccagtcggactgctgtcccgcctggcctctcttcactgcccttgacgagcgtgggtaacaccggcatgaagaaggtacccaaaaagctagaggaaatacctcccgcaagcccagagatggcccagatgaggaagcagtgtttagattaccatcaccaggagatgcaggctctgaaagaggtgttcaaggaatatctgatcgagctgttctttctgcaacatttccagggcaacatgatggactttctggcctttaaggagaggctgtacggacctctgcaagcatacctgcggcagaatgacctggatatagaggaggaggaggaggagcattttgaggtcatcaacgatgaagtgaaagtggtagccaggaagcatggccagcctggaaccccagtggctattgctacacagctgccaccgagaacctccgcagccttccccgctcagcaacagcctctgcagcagattcacatgggcactcctgtcccaggtgatgttaattccatcaaaatggaggcgtccaagaggcagtag

SEQ ID NO: 55759 - DNA, 1260 bp, Artificial Sequence
  Description of Artificial Sequence: Synthetic coding sequence
atgcagcacgtttcctcctctcagtcatcgcagaggcacgtgcagtggcctggagcttgcccaggcgcaggcgaggaacagccagcttgttcacaaccctccctcccattgactttgccctctccatctcatcagctgcaacagcttatggtacaaacccagtcccctactcaaccatctccgggacctggccaagcgctgcagaatgtgcgcgcaggggctcccggtcccggacttggtctgtgcagctcatcaccgacgggagattttgtggacgctagtgtgctggtgagacagatatcattatcaccttcatccggcggacactttgtcttccaggatggaagcgggctgactcagatagcccagggggcacaagttcagctgcagcaccctggaacacctatcacagtgcgggaacggcgaccctcccaaccgcacacccagagcggcggaacaatccaccacctcggacctcagagtcctgccgcagctggcggtgcagggctccagcccctggcaagcccctctcacatcaccacggccaatctgcctccccagatcagctctattattcagggacagcttgtgcagcaacagcaggtcctccagggccctccactaccaagaccactggggtttgagcgtactcctggagtgcttctccctggtgcaggcggtgccgctgggtttggtatgacgtctccccctcccccaacctctcctagtcgaaccgccgttccccctgggctgtcctcactgcccctcacatctgtcggcaacaccggtatgaagaaggtccctaagaaattagaggaaattcctccagcatctccagaaatggcacagatgaggaaacagtgtctggattaccaccatcaagagatgcaggccctcaaagaagttttcaaggagtacctcatcgaactatttttcttacagcactttcaaggcaatatgatggatttcctagctttcaaagagcgattatacggtcccctccaggcatacttgcggcagaatgatctcgacatcgaggaggaggaagaggagcacttcgaagtcatcaatgatgaggtcaaagttgttgcccgaaaacatgggcagcctgggacaccggtggctatcgcaacacagctgccgccaagaacttccgccgctttccccgctcagcagcagcctctgcaggttttatctgatggaagtaccgttcagctcccacgcttgtctagcttggggttcgaggattcaatgtgttag

SEQ ID NO: 55760 - DNA, 1071 bp, Artificial Sequence
  Description of Artificial Sequence: Synthetic coding sequence
atgcaacatgtcagcagtagtcagtcatcccagcgacatgtgcagtggccgggagcttgcccaggcgcaggggaggaacaacctgcatgctctcagccaagcctgccactcacactgccttctccgtcccatcagctgcagcagttgatggacggctcgggactcactcagatcgcccaaggtgcccaggtccaactgcagcaccccggaaccccgattaccgttagggaaagacgtccttctcagccgcatacacagtcaggaggcaccattcaccacctgggacctcagagcccagctgcagctggaggcgcagggcttcaacccttagcttctccctcccacatcaccaccgctaatctgccccctcagattagctccatcatacagggccagctggtacagcaacagcaggtgctccagggacctccccttccgagacccctcggatttgaaaggacccctggcgtcctgctccccggagcgggaggagctgcaggttttggaatgacctctcctccacctccaacatcaccaagtcgaaccgcagttccccctgggctctctagtctcccgctgacatcagtcggcaatacagggatgaagaaagttcccaagaagctggaagagatcccccctgctagtccagagatggcgcagatgcggaagcagtgccttgattaccaccaccaagagatgcaggccttgaaggaggtttttaaggaatacttgatcgagttattctttttgcaacatttccagggcaatatgatggatttcctggcttttaaggaacgtttgtatggacccttacaggcatatctgaggcaaaatgatctcgacatcgaagaggaagaggaagagcattttgaggtgatcaacgacgaagtgaaagttgtggcacggaagcacgggcagcctggaacacctgttgcaattgcaacccagctcccccctcggactagcgcagcttttcccgctcagcagcaacccctgcaggtgctgtccgatggtagtactgtgcagctgccacggctctctagccttggtttcgaggactccatgtgttag

SEQ ID NO: 55761 - DNA, 654 bp, Artificial Sequence
  Description of Artificial Sequence: Synthetic coding sequence
atgcagcacgtcagtagttcgcagagcagtcaacgacatgtgcaatggcctggggcttgtccaggagccggtgaagagcagccggcatgttcacagccctccctgccactgaccttgccgagcccctcacaccagctgcaacagctgatggatggctcaggactcactcagattgcacagggggcacaggttcagcttcagcacccgggaactcctatcacagttcgagaacggagacccagccagcctcacacacaatccggaggaacaattcatcacttggggcctcagagtccggcagctgccggtggtgccggtctccaacccctggcctccccctcacacatcacaacagcaaaccttcccccacagatcagctctatcattcagggacaactggtccagcagcagcaggttctccagggacctcccctgcccagacctttgggctttgagaggaccccaggcgtgcttctgcccggagctggaggcgcagctgggtttggtatgaccagcccacctccacctacgtctccttctaggactgccgtcccgccaggcttaagctcacttcctctgacttctgtgggcaacaccggcatgaagaaggttccaaagaagctggaggagattcccccagccagtcccgagtag

SEQ ID NO: 55762 - DNA, 1071 bp, Artificial Sequence
  Description of Artificial Sequence: Synthetic coding sequence
atgcagcatgtgagctcatcccagtcttcccagaggcatgtgcagtggccaggcgcatgtcctggagcgggtgaagagcagcctgcatgttcccagccgtctctgcctctgacactgccatcaccatcccatcaactccagcaactgatggacggttctgggttaacgcagatcgcccagggggctcaggtgcagctgcaacatcctggaacccctatcaccgttcgcgagcggagaccttctcagccccatactcaaagcggcggtactatccaccacttgggaccccagagccccgcagccgctggcggagccggtctgcagcctctggcttccccctctcacattacaacggcgaacttaccccctcaaatctcttctatcatccagggccaactagtgcagcagcagcaggttctccagggaccccctctgccccgtccattaggcttcgagcggactccgggagttttacttcccggagccggtggggcagccggttttggtatgacctctccgcctccgccaacctcacccagtcgcacagccgttccacccggactgagcagcctgcccttaacaagcgtggggaacaccggcatgaaaaaagtcccaaaaaagttagaagaaattcctccagcctcccccgagatggcgcagatgcggaagcagtgcctcgactatcaccatcaggaaatgcaggctctgaaagaggtgttcaaggagtatcttattgagctctttttcctccagcacttccagggaaatatgatggacttcctggcgttcaaggagaggttgtatgggccactgcaggcttatttacgccagaacgatcttgacatcgaggaggaggaggaggagcacttcgaagtgattaacgacgaggtgaaggtggtcgccagaaagcatgggcagcccggtactcccgtggccatcgccacccagcttcccccacgtacttcagcagcatttccagcccagcaacagccactgcaggtcctgtcggacggatccactgtacaactgcccagactgagctcactaggattcgaagacagcatgtgctag

SEQ ID NO: 55763 - DNA, 672 bp, Artificial Sequence
  Description of Artificial Sequence: Synthetic coding sequence
atgcagcacgtgtcgagctctcagtcgtcccagcgacacgtccagtggcctggcgcatgtcccggagccggagaggagcagcctgcttgctctcagccctccctccccttaacactgccatcaccctctcaccaattgcagcagcttatggtgcaaactcagtcgccaacccagccctcccccggaccgggacaggcccttcagaacgttcgggctggagcaccaggccctgggctgggcctctgttcaagcagccccaccggcgattttgtagatgcgtctgttcttgtgcgccagatatccctgagtccaagcagcggagggcattttgtgtttcaagacggcagtggtttaacacagatcgctcagggcgctcaggtccagctgcagcaccccggaaccccaataactgtcagggaacgacggcctagccaaccccacacccagagcggcggaacaattcatcatttaggaccgcaatctcccgctgcagccggtggagctggtctccagcctctggcctctccaagtcacatcacaaccgcaaatctgcccccacaaatctcaagcattatacaaggccagctggtgcagcagcagcaggtcctacagggcccacctctgcccagaccacttggcttcgaacgcacgccaggggtgttgctgccgtag

SEQ ID NO: 55764 - DNA, 471 bp, Artificial Sequence
  Description of Artificial Sequence: Synthetic coding sequence
atgcagcacgtctctagctcccaatctagtcagcggcacgtgcagtggcctggggcatgcccaggcgctggagaggagcaacctgcttgttctcagcctagcttacccctcacccttccctctccatcacaccaactgcagcaactaatggttcagacacagtcacccacacagcctagccccggtcccggacaggccctccagaacgtgagggccggtgcacccggaccaggcttaggactgtgctcatccagcccaaccggcgatttcgttgacgccagcgtgttagtcaggcagatctcactctctccgagctctggaggccacttcgttttccaggacggcagcggcctcactcagattgcccagggagcacaggtccaactgcagcaccccggaacccccataactgtcagagaacgaagaccgagtcagcctcacacgcagtctggcggaaccatccaccattag

SEQ ID NO: 55765 - DNA, 3393 bp, Artificial Sequence
  Description of Artificial Sequence: Synthetic coding sequence
atgcagtttcctagtccccctgcagccagatctagccccgcacctcaggccgcttcttctagtgaagccgctgctccagccactgggcagcctggtccctcctgccccgtcccgggaacgtcaaggaggggacgtcctgggacgcctcctgccggaagggtggaggaggaggaggaagaggaggaggaggacgttgacaaagatccacaccctacacagaacacttgcttacggtgcaggcacttctctcttcgagaaagaaagcgcgagcctcgcagaacaatgggcggttgcgaagtgagggagtttttgttgcagtttggattcttcctgccccttttgacggcctggcccggagactgtagtcatgtgtccaataatcaggttgtgttacttgatacaacaaccgtgctgggagagctggggtggaagacatatccgctcaacgggtgggatgcaattacagagatggatgagcacaacaggcccatccatacataccaagtctgtaacgttatggagcccaaccagaacaattggctgagaaccaactggatttccagagatgctgcccagaagatttatgtggagatgaagttcacactacgggattgcaacagtatcccttgggtactgggaacttgtaaggaaactttcaacttgttttacatggaaagtgatgagagtcatggcataaaattcaaacctaaccagtacacgaagattgacaccatcgctgcggacgaatcattcacgcagatggaccttggagaccgcatcctcaaactgaataccgaaatacgggaggtgggtccaatagagcgaaaggggttctaccttgcattccaggacattggcgcttgtatcgctctcgtgtcagtacgtgttttctacaagaagtgcccttttactgtacgtaacctagccatgtttcctgatactatccctcgggtggactcctccagcctcgtggaggtgcggggaagttgtgtaaagagcgctgaagagcgcgatacaccaaagttatactgtggcgcagatggcgactggttagtcccgctggggagatgcatctgcagcactggctacgaggaaattgaggggtcatgccacgcctgccggcctggtttttataaggccttcgctggtaacaccaagtgctccaagtgtccccctcattctctgacgtatatggaagcgacatctgtctgtcaatgtgaaaaaggctacttcagggcggaaaaggaccccccatcaatggcctgcacaaggcccccaagtgcaccgaggaacgtggtgtttaacatcaacgagactgcactgatcctggaatggtcccccccttccgacaccggaggccgaaaagatctgacctacagcgtaatatgcaaaaaatgcggactagatacatcacaatgtgaggactgtggaggtggcctgcggttcattccacgccatacagggctcattaataactccgtgatagtcttagatttcgtctcacacgtcaactacacgtttgaaatagaagctatgaacggggtgtcggaattgtcattcagccccaaaccattcactgccatcacggtaaccacagaccaggatgccccatcactcattggggttgttagaaaagactgggcaagccaaaacagtatcgctctgagttggcaagcccctgcatttagtaatggtgctattcttgactatgagattaaatactatgaaaaagaacacgaacagctcacctactcttctacccggtcaaaagccccttcagtcattatcactgggttaaaacctgcaacgaaatatgtgttccatataagggttcggactgccactgggtactcgggatatagccagaaattcgagtttgagacaggggacgagacctctgacatggccgcagaacagggacagatcttggtgatagctaccgccgcagttgggggtttcacactactggtcattttgacactgttcttcctgatcacaggacggtgccagtggtatattaaagccaagatgaaaagtgaggagaagcggagaaaccatctgcagaacggtcatctgcgattcccagggattaagacttacatcgatccagacacctacgaggatcctagcctggccgtccacgagtttgccaaggagatcgacccatctcgcattcggattgagagggtcataggcgcaggggagttcggcgaggtatgctctggcaggttgaagactccaggaaagagggagatccctgtcgccattaaaactctcaagggcggtcacatggaccgccagaggcgcgactttttaagagaggccagtattatgggccagttcgatcaccctaatatcattagactcgaaggagtggttactaaacgtagtttccccgctattggcgttgaggcgttttgtccttccttcttgagagccggattcctgaacagtattcaagccccacaccctgtgccaggcggtgggagcctaccccctcgtatccctgccggaaggcctgtgatgattgtggtagagtatatggagaatggaagtcttgatagttttttgcggaagcacgatggacattttactgtcatccaactggtgggtatgctccgtggtatcgccagtggaatgaaatacctgagcgatatgggttatgtgcacagagacttggcagcccgtaacattcttgtcaatagcaacctggtgtgtaaggtttccgactttggcttgagtcgtgtgctggaggatgatccagaggctgcgtatacaaccactgggggtaaaattcctattcgctggaccgcaccagaggcaatcgcctacagaaagttctcctccgcctccgacgcgtggagctatggtatagtcatgtgggaggttatgtcatacggcgagaggccttactgggaaatgtccaaccaggacgtgatcctgtctatcgaggaaggatatagactccctgcaccaatgggctgcccggcttctctgcaccaactgatgctgcactgctggcagaaggagaggaatcataggcccaagttcaccgatattgtgagtttcttagataaattaatccgcaacccaagcgccttgcatacactcgttgaagacattctcgtaatgccggagtcgcccggagaagtacccgagtacccgctattcgtcacagtaggcgactggctcgatagtatcaagatgggacagtacaaaaacaacttcgtcgccgctggcttcacaacatttgacctaatcagtcgtatgtctattgacgatattcgcaggataggggtgatcctgatcggccaccagcggagaattgtgagctccatccagacactgcgcctccacatgatgcacattcaggagaaagggttccacgtgtag

SEQ ID NO: 55766 - DNA, 726 bp, Artificial Sequence
  Description of Artificial Sequence: Synthetic coding sequence
atggccgcagagcaagggcagattctggtgattgcaaccgctgccgtggggggatttacccttctcgtgattctcacactctttttcctcattacaggcaggtgccaatggtacattaaagccaaaatgaaatcggaagaaaaacggcgaaaccatctgcagaacgggcatctaaggttccccggtattaagacgtatatcgatccagacacttatgaggatccctcactcgccgtgcacgagttcgctaaagagatcgatccgagtcgcataagaatagagcgggtgattggcgctggcgagtttggcgaagtgtgcagcggcaggctgaaaactcccggaaagagagaaataccagtcgccatcaagactctgaaaggagggcatatggaccggcaacgtcgggatttcctgcgcgaggccagcattatgggccagtttgaccatcccaatatcataagactggagggcgtggtaactaagcgctctttcccagccattggtgtcgaagccttctgcccatcctttcttagagctggcttcctgaactcaattcaagcaccacatccagtgcccggaggcggttctctccctccaagaatccccgcaggcaggcctgtcatgatcgtagtggaatatatggaaaacggctccctcgactcctttttaaggctgtatccaaaagctgagtacaacggcaaacagtgctctcgttacagcatctag

SEQ ID NO: 55767 - DNA, 1005 bp, Artificial Sequence
  Description of Artificial Sequence: Synthetic coding sequence
atgaaggattcccctttccaagtaaccaaactctattggctgaacgagaagtgggatttcattgccagcgcctctgacatggcagcagaacagggccagatcctcgttatagctacagcggcagtgggagggttcacgctcctagttattctcaccctcttctttttgatcacaggtcgttgccaatggtacatcaaagccaagatgaagtccgaggaaaaacgtcgaaatcacctgcaaaatggccacctgcgcttccccggaatcaagacctatattgaccctgatacgtacgaggacccaagtttggcggttcacgaatttgccaaagagattgaccctagccgaatcagaatcgagcgagtcataggggctggggaattcggggaggtgtgctcggggaggctgaagacgccgggaaaaagagagatccccgttgccatcaagaccctcaaggggggtcacatggatcgccaaaggcgcgattttctgcgcgaagcgtccatcatggggcagttcgaccatccaaatattatacggctcgaaggcgtcgttacgaaacggtccttccccgcaatcggagtcgaagctttttgtccttcctttctgagggccggatttcttaacagcatccaggccccacatcctgtaccaggtggagggtccctccccccaaggatccctgccggacgacccgtgatgatcgtggtggagtacatggaaaatggctcactggatagttttcttcggaagcatgatggacactttacagtgatccaactagttggaatgttgcgcggaattgcttccggcatgaagtatctgtcagatatgggctatgtccatagagacttagccgctagaaatatactggtcaatagtaatctggtatgtaaggtatctgatttcggcctgagcagggtgctggaggatgatcctgaggccgcatatacaaccacagatctttttcagaccctcaccttaaacctttgctattccgcgtag

SEQ ID NO: 55768 - DNA, 858 bp, Artificial Sequence
  Description of Artificial Sequence: Synthetic coding sequence
atgggaggttgcgaggtacgtgagttcctgctccagttcggtttcttcttgcccttattgaccgcttggccaggtgattgtagccacgtttccaacaaccaagtggtgctgttggatacgacaactgttctgggggagttaggctggaagacatatcctctcaatggctgggacgctatcacagagatggacgagcataacaggccaattcacacttaccaggtgtgcaacgtaatggagcccaatcagaacaactggctgcggacaaactggatatcccgagatgccgcacagaagatctacgtggagatgaagtttaccctgcgagactgtaattctatcccctgggtccttggaacgtgcaaggaaacattcaatttgttctacatggagagtgatgagtcccatggaattaagtttaagcccaaccagtacactaaaatagacactattgccgcagatgagtcatttacccagatggacctgggcgaccgcattctgaagctgaatacagaaattcgcgaggttggtccgattgaaagaaaaggcttctatttggccttccaggacatcggcgcttgtatcgcgctggtctcagttcgagtgttctataagaagtgtcccttcacagtgcggaacctcgcaatgtttcctgatactatacctagagtcgactcttcatcacttgtggaagtaaggggatcctgtgtgaagtcagccgaggagcgcgacacgcctaagctgtactgcggcgctgacggagattggctggtgccgttaggccgatgtatctgttccaccggctacgaggagatcgagggaagctgtcatggggcatcaaaaggaaggtgtttctag

SEQ ID NO: 55769 - DNA, 7262 bp, Artificial Sequence
  Description of Artificial Sequence: Synthetic coding sequence
atgtccggtcatacgctgccccctctgcccgtgcctggaacaaactctacggaacaggcttccgtgccgcgtgctatggccgcaaccctgggcgctggcacacctccccgaccgcaggctcgttcgattgccggagtgtacgtcgaagcttcgggccaggcgcagtccgtgtacgctgccatggagcaaggcctgctacccgcaggcctgggccaggcacttctcgaggcccaggcagccacaggaggtctcgtggacctggcgagggggcagcttttgccggtttccaaggctctgcaacagggattggtaggcttagaactgaaggagaaattgttggcagccgagcgagctacaactgggtaccccgacccctacggaggtgaaaaactggcgttgtttcaggctattggtaaggaggttgtcgacagagctttaggacagagttggcttgaggtccagctggccacaggaggtctcgtcgaccctgcccagggggtgctggtggcccctgagcctgcctgtcaccagggactgctcgatcgtgaaacatggcataaactgtctgagcttgagccagggactggcgatctgcgattcctcgacccaaacacgctggagagacttacataccatcaacttctggaaaggtgcgttcgtgcacccggtagcggattagccttactgcctttaaagattacgttccggtcaatgggcggtgcagtatcagcagcagagctgctggaggtcgggatcctggatgagcaggctgtgcaagggctcagggagggcagattggccgcagtcgatgtgtccgcacgtgctgaggttcggaggtacctggaaggcacagggtcggttgctggcgtggtcttgcttcccgaaggccataagaaaagtttctttcaggccgcaacggagcacctcctgcccatgggaaccgctcttcctctgctcgaggcccaagctgccacccatacgctagtggatccgataactggacagaggttgtgggtcgatgaggcagttcgggcaggtctggtctcccctgaactgcatgaacaattactcgtggccgagcaagccgtgacgggacaccatgaccctttttcaggttcacaaattcccctgttccaagcgatgaaaaagggcctagtcgacagaccattggcattaaggttgttagatgcccagctggccacgggtgggttggtctgccccgcaaggagactacggctcccgctggaagctgcactgaggtgcggatgcctcgatgaggatacacagcgacagctgagccaggccggaagttttagcgacggtacccatggtggcctcagatacgaacaactgctggccctctgtgtcactgacccagagacagggctggctttcctgccactgtccggaggacctcggggtggcgaaccacaggggcctcccttcattaagtactcaaccagacaggctctcagcaccgctaccgctaccgtgtccgttgggaagttcagaggcaggcccgtttccctgtgggaactcctcttctccgaagcaataagcagcgagcagcgtgccatgctcgctcagcagtaccaggaggggaccctctccgtcgaaaaactcgccgctaaactgtccgcaaccctggagcaggccgcagcgactgcacgggtcactttttctggcctgcgtgatacagtgacaccaggagagctcctcaaggcggaaatcatcgatcaggacctctatgaaagattagaacacggtcaagctacagcaaaagatgtcggttcgctcgcctccgttcaaaggtatctccagggaactgggtgcattgcgggtctgctgctcccgggatcacaggaaaggctgtctatctacgaggctcggtgtaagggacttttgcgacccggtacagccctgatcctgttagaggctcaggctgctaccgggttcataatagacccgaaggctaacaaggggcactcggtggaagaggccttaagagccgctgttatagggccagacgtgtttgctaaactgcttagcgccgaacgagctgtcactggctatactgacccctacactggacaacagatctccctctttcaggctatgcagaaaggactgatcgtgcgcgaacacggcatccggctgttggaggcccagatcgcgacaggaggggtcatcgaccccgtccacagtcatcgggtcccagtggacgtagcttatagacggggatattttgatcagatgctgaatcttattctgttagatccatccgacgatacaaaggggttcttcgaccccaacacccatgagaatttgacctatctgcaattactggagagatgcgtgcgcgaccccgagactggcctttacctcctccctctttcaagcacacagagccctctcgtcgatagtgctactcagcaggcatttcagaacctgttactcagcgttaagtatggtcgcttccagggacagcgggtctctgcttgggaattgattaactcagagtactttagtgagggacgtaggcgtcaattactgcgacggtatagacagagagaggtgactctagggcaggtggcaaaactgttagaggcagaaacgcagcgtcaggctgacatcatgctgcctgctctcaggagtcgcgtgaccgtccatcaactgctggaagcgggaataatcgatcagcagctgttagatcaggtcctcgctggcaccatttcacccgaggcactgctgctgatggacggagtgcggagatatctgtgtggacttggggctgttggcggtgtaagactgttgccctcgggccagcgcctttctctctatcaagccatgagacagaagctgctgggtcctcgggtcgcccttgcgctgctggaggcccaggctgcaacgggaactatcatggatccgcactcgccggaatctctttcagttgacgaggctgtgaggcgaggagttgtgggaccagagttgtacggaagactaaagagagccgagggggcaatcgctggctttagagaccctttttcggggaagcaagtgtccgtgtttcaggcgatgaagaaaggcctgatcccatgggaacaagccgcacgattattggaggcccaggtggctaccggcggaatcatagatcccacctcccaccatcacctacccatgccagtcgcgattcagcgagggtacgtggaccaagaaatggaaaccgcactcagcagctctagtgagacattcccaacgcccgatggacagggcagaaccagctacgcacaactcttagaagagtgtccaagggacgagaccagcggcctccatttactgcccttgcccgagagtgcacccgctcttccgactgaagaacaagtccagcggtccctccaggcggtcccaggcgcaaaagatggaacgtcgctgtgggacctgctcagtagttgtcactttaccgaggaacaacggcgaggactgctcgaggacgtccaggaaggacgcacaaccgtcccccagctgctcgcgagtgtgcaacggtgggtccaggagaccaaacttttagcccaggcgagagtgatggtccctggaccaagaggagaggtcccggcagtatggcttttggacgcgggaattatcacccaagagactctggaagcccttgcccaaggaacccagagtcccgcacaggtagctgaacagcctgccgttaaggcctgtttgtggggaaccgggtgcgtggctggcgtcctgctgcagccttccggggcaaaagcatcaattgcgcaggctgtaagggatggtctcttacctaccggtttggggcaaaggctcctggaggctcaggtggcaagtggctttctcgtggaccccctgaacaaccagagactatctgtggaggatgccgtaaaggttggcctggttggtagggagctgtctgaacagttaggccaggccgagagagccgcagccggatatccggatccatactctcgcgcttccttatccctgtggcaggcaatggaaaaaggcctagtgccccagaatgaaggccttccccttttgcaggtgcagctggcgaccggtggagtcgtggaccccgtgcacggcgtgcatcttcctcaggcggctgcttgtcgactgggccttctggacacgcagacatctcaggtgctgacagcagtggataaggacaacaaatttttttttgacccttccgcgcgtgaccaggtgacatatcagcaattacgcgaacggtgtgtatgcgactccgaaacagggctcctcctgctgcccttaccttccgacaccgtactggaggtggacgatcatacagctgtggcccttagggcaatgaaagtgccagtcagcactggacggttcaaaggatgtagcgtgagcctatgggacctgctgcttagcgaatatgttggagccgataagcgtcgcgaacttgtggcactctgtcggtcagggagggccgctgctctacgacaggtggtctccgcggtgaccaccttggtggaagcagcagaaagacagcctcttcaggccacatttcggggactgagaaaacaggtgtcagctagggatctgtttcgagcccagttgatcagcaggaagaccctggacgaactctcacagggaacaacgacggtgaaagaggtggcggagatggactccgtaaagcggtcattagaaggtggtaatttcatagccggtgtgctaatccaaggcacacaagagcggatgagtattccagaggcactccggcgacacattttaagaccagggacagcattagtcctcctggaagctcaagccgctaccggatttattattgatcctgtggagaatcggaagctcaccgtcgaggaggctttcaaagccggtatgttcggaaaggagacctatgtaaaacttctcagcgcggaacgcgctgtaactgggtatacagacccctacacagggcagcagatctcattattccaggctatgcagaaggatttgatcgtcagagagcatgggattcgattgctggaggctcagatcgcaactgggggaatcattgatcccgtacacagccacagagtgccagtagacgtggcctaccggtgcggctacttcgacgaagaaatgaataggatactagccgacccatccgatgacacgaagggattcttcgatcccaacacccacgagaatctgacttatttgcagctattagaacggtgcgtcgaagatcctgagactggcctgtacttgctccagatcatcaaaaaaggggagaattacgtgtacattaacgaggctacccgtcacgtgctgcaatctcgaacagcaaaaatgagagtcggcaggttcgccgatcaggtggtttccttctgggacttattgtccagcccctacttcaccgaggatagaaaacgagagctcatacaggaatatggagcacaatccggcggactggagaagctactcgagatcatcacaacaaccatagaggagacggagacccagaatcaaggaatcaaagtcgctgctatccgcggagaagttactgctgcagatctgtttaactctcgggtgatagaccagaagaccctgcatacccttcgtgtaggccgaactggagggcaagcactgagcacactagagtgcgtcaagccttacctggaaggatccgggtgtattgccggtgtgaccgtcccgtccacacgagaagtgatgagtctccacgaagcatcccgaaaagagctgataccggctgcttttgcaacatggttgctggaagcgcaggccgctaccgggttccttcttgatccatgtaccaggcaaaagctgagcgtggacgaggctgtggatgtaggactggtcaacgaagagcttagagagagattgctgaaggccgagagagccgcaaccggatatcgcgaccccgcaaccggcgacacaatcccactcttccaagcgatgcagaaacaactgattgaaaaggctgaagctctgcgacttctggaggtgcaagtggcgaccggtggggttattgatccacagcatcatcaccgccttcctttggaaacggcataccgcagggggtgcctgcataaggacatctatgctttaatttcggatcagaagcatatgaggaaaaggttcgtcgatccaaatacacaggagaaggtcagctaccgagaactgcaggagcgctgccggcctcaggaggacacgggttggctgctcttccctgtgaataaggcagcccgagatagcgagcacatcgatgacgagacacgacgagcccttgaagccgagcaggtggaaattaccgtcggaaggttcagagggcagaagcccacactgtgggctttactcaattccgagtatgtgacagaggagaagaagctacagctcgttaggatgtataggactcacacacggagggccttacagacagttgcccagttgatattagaactgatcgagaagcaagaaacgagtaacaagcatctgtggtttcagggcattagaaggcagatcacagcttctgaacttctgagctccgctatcattacagaagagatgctgcaagatctggaaactggcaggagtaccacccaggagctgatggaggacgacagggtgaagagatatctggaaggcactagctgcatcgctggcgtgttggtcccagctaaagaccagcccggtaggcaagagaagatgtcaatctatcaggcaatgtggaaaggcgtgctcagacctggcaccgccttggtgttgctggaggcccaggcagccactggatttgtgattgacccagtgaggaacttgcgtctctctgtggaagaggccgtggccgctggcgtggtaggtggagagatccaagagaaactcctctcagctgaacgtgctgtcaccggctatactgatccctacacaggtcaacagatctccctgtttcaggcgatgcaaaaagacctcatagtgcgggagcatggcatccgcctgctcgaggcacagattgctaccggcggagtgatcgaccccgtccactcccacagggtgccggtcgacgtggcctacagaaggggttatttcgatgaagagatgaatcgcgtgcttgccgaccccagcgacgacacgaaaggcttttttgatcctaatacacatgagaatctaacctacctgcagctgttgcagagagcaactctggatcccgaaactgggctgctattcctgtccctgagcctgcagta

SEQ ID NO: 55770 - DNA, 15267 bp, Artificial Sequence
  Description of Artificial Sequence: Synthetic coding sequence
atgtccggccacacactccctcccctgcctgtccccggaaccaactctacagagcaggccagcgttccccgagccatggctgcgaccctaggagccggaactcctccacgtccacaggctcggtccatcgccggagtatacgtcgaagctagtgggcaggcgcaatccgtgtacgcagcaatggaacagggactgttgcctgctgggctggggcaggccctactggaagctcaggcagccactggcggtttggtcgacctagcgcgtggccagcttctgcccgtgtctaaagcactgcaacaggggctggtcggcctggaactgaaggaaaaactactcgcggctgaacgtgcgactacagggtaccccgatccctatggcggagagaagctggcattatttcaggcaattggcaaggaagtggtcgaccgagccctgggccagtcatggctagaggtgcagctcgcaaccgggggactcgtggatcctgctcaaggggtcttggtggcgcctgagccagcttgtcaccaggggttgctggatcgggaaacctggcataagctctccgagttggagcctggcaccggggatctccggttccttgaccctaatacactagagcgtctgacgtaccaccaactcctggaacgctgtgtccgagccccaggcagtggattggcgctgctgcctcttaaaatcactttccggtctatgggcggagctgtgagtgcagctgaattattagaagttggcattctggatgagcaagcagttcagggacttagagagggtcgactcgcagccgtcgacgtttctgcacgagccgaagtgcggcgttatctcgagggcacgggctcggttgccggagtagttttgctccctgaagggcataagaagagtttttttcaggctgcaaccgaacacctcctccctatgggtacagcactgcctctattagaagcccaagcagcaactcacaccctggttgacccgattacaggtcagagattgtgggtggacgaggccgtgcgggcaggcctggtttccccagagttacatgagcagcttctcgtcgccgagcaggctgtaactgggcaccatgatcccttcagcgggagccagattccactcttccaagccatgaagaaaggtctggtagataggcccctggccctaagactattagacgcgcaattagctacaggcggtttggtgtgtcctgctagacgactgaggctcccattggaggcagctcttaggtgcggctgtctggatgaagatacacagagacaattgtctcaggccggtagcttttccgatggcacacacggcggactccgctatgagcagctgctcgcactgtgtgtgactgaccctgagaccggtctggccttcttgcctctgtcgggaggacctcggggaggcgagccccagggaccccctttcatcaagtacagtacacgacaggcactgtctactgcaactgctacagtgagtgtgggcaaatttcgcggaaggccagtgtctctgtgggagctgttgttctctgaggctatatccagtgagcagagggctatgctggcgcagcagtatcaggaggggaccctcagcgttgagaagctcgcggcaaaactgagcgctactctggaacaggcagctgcgactgcgcgtgtgacatttagtggtctgagagatactgtcactccaggggaactcctgaaggctgagattatcgaccaggacctgtatgaaaggctcgagcatggtcaggccacagccaaagatgtaggttcactagccagtgttcagaggtatttacagggcacaggatgcatcgccggactactcctgcctggttcacaagaaagactttctatctacgaggctagatgcaagggcctgctgaggcctggtaccgcccttatcctgttagaagcccaggccgcaacgggtttcattattgacccaaaagctaacaaagggcactccgtagaggaagctctgcgtgctgcagtgataggccctgatgtcttcgccaagctgctgtcagcagagcgagctgtgaccggctatactgacccatacacgggccagcaaatatctttgttccaagctatgcaaaagggcctgatcgttcgggagcacgggattagactgctcgaggcgcaaattgctactggtggcgtgatcgatcctgtccattcccaccgcgtcccagtggatgttgcgtacaggcgaggatacttcgatcagatgctcaacttgatcttactagatccctcagatgatactaaaggattcttcgaccccaacacccacgagaatctcacttatctccagctgctcgagaggtgtgtgcgggatcccgagactgggttgtacctgttgccgctgtcctctacacaaagcccactggtagacagcgccactcagcaggcgttccagaaccttctcctgtctgtcaagtacggtcggttccaggggcagcgcgtctccgcttgggagctcattaatagtgagtacttctcagagggccgtcggagacagctgctgagacggtacagacagcgagaagttaccctgggtcaggtggctaaattgctggaagccgaaacacagcggcaagctgatattatgttgcccgctttgagatctcgcgtgacagttcatcagctgcttgaggccggaattatcgaccagcagctcctggatcaggtcctggcgggaaccatctcacccgaggcattacttctcatggatggggttcgcagatatctatgcggtctgggcgctgtgggcggagtccggctcttgccgtccggacagagactatctctgtaccaagccatgcggcaaaagctgcttggcccacgggtggctctggctttgctggaggcccaggcggctaccggtactattatggatcctcacagcccagagtcactgagtgtcgatgaagcagtgagaagaggagtcgtgggccctgagttatacgggcgtctcaaacgtgcagaaggtgctattgcgggattcagagatcctttcagcggcaagcaggtgtccgtgttccaggccatgaagaagggccttatcccttgggagcaggccgctcggctactggaagcccaggtcgctacaggtggaatcattgacccgaccagtcatcaccacttgccaatgccggtcgctatccagcgcggttacgtggaccaggagatggagacagccttatcctctagcagcgaaacttttccgacacctgacggccagggtcgcacctcctatgcacagctactggaggaatgtcctagggatgagacgtccggactgcatctccttccactccccgagagtgctcctgccctgccgacagaagagcaggtgcagaggagtttgcaggctgtccccggtgccaaggatgggacaagtctgtgggaccttctgtcgtcatgtcacttcacagaggagcagcgcaggggtctgttagaggacgtccaagaaggccgtaccacggtgccccagctgctggcctctgttcagagatgggttcaggagaccaaactcctcgcacaggccagagtgatggtgcccggaccaagaggggaagtgccagcagtatggttgctcgacgctgggatcattacccaggagaccctggaagctctggcgcaaggtactcagtctcctgcgcaggtcgccgagcagcccgctgtcaaggcatgcctgtggggtaccgggtgtgtcgcaggcgtgctgctgcagcctagcggtgctaaggcaagcatcgctcaggctgttagggatggcctgcttcctaccgggcttgggcagcggcttttggaggcccaggttgcgagtggattcctcgtcgatcctctaaataaccagcggttgagcgttgaagatgccgtcaaggttggtctagtggggagggagcttagtgagcagctcgggcaggccgagagggccgcagccggatatccagacccttacagccgggcaagcctttccttgtggcaggccatggagaaggggctggttccccagaacgagggccttcctctgctgcaggtccagctggccaccgggggagtggttgacccagttcacggggttcaccttccccaggccgctgcctgtcgcctgggccttcttgatacccaaacctctcaggtcctgacagccgttgacaaggataacaaattctttttcgatccctcagcgagagatcaagttacatatcagcagctccgggaaaggtgtgtttgcgatagcgagacaggcctcttactgctgcctttgccttctgacacagtgctggaagtggacgatcacaccgcagtcgcgctgagagccatgaaggtccctgtgtctactggacgcttcaagggctgctccgtcagtctgtgggatctgctcttgtcagagtatgttggcgcagataaacgcagggaattggtcgccctttgtcgatcgggcagagccgcagctctgaggcaggtggtgtctgcggttacaaccttagtggaggccgcagagcgtcagccattgcaagccaccttccgtggcctcaggaaacaggtgagcgcaagagatctgtttcgggcacaacttatctctaggaaaaccttagacgagttgtcccaaggaactaccacggtgaaggaagtcgctgaaatggattccgtgaaaaggagtctggagggcggaaatttcattgcaggggtgctgatccagggcacacaggaacgcatgagcattcccgaggccttgcgacgccacatcctaaggccaggtactgcgctggtgctcctggaggctcaggcagccacaggatttataatcgaccctgtggagaacagaaaactgaccgtggaggaagccttcaaggccggaatgtttggaaaggaaacctacgtgaaacttttgtccgctgaacgggcagtcacaggatataccgatccctatacaggtcagcaaatcagcctattccaggccatgcaaaaagatcttatcgtcagggaacacgggattagacttctcgaagctcagatcgcaacaggcggaatcattgaccctgtacattcccatagagtgccagtcgacgtggcatacaggtgcggttattttgacgaggaaatgaatcggattctggccgacccgtctgacgatacaaaggggtttttcgaccctaacactcacgaaaacctcacttatctgcagttacttgagagatgtgtggaggaccccgaaaccggcctttaccttctgcagataattaagaagggggaaaactacgtttacatcaatgaagcgactcgccatgtacttcaatcgcggactgctaagatgagggtcggcagatttgccgaccaagtcgtctccttctgggacttgctgtcttcgccatacttcacagaggatagaaaacgtgaactgatccaagagtatggggcacagtctggaggtctcgaaaaattgttagaaatcataacaaccacgatcgaggaaacggagacacagaatcagggcattaaggtcgcagccatccggggagaggtcacggcagctgatctgtttaattcaagggtgattgaccagaaaactttgcatacactgagggtggggagaaccggtggtcaggcactgagtactttagaatgtgtaaagccctacctcgaggggtctggatgcattgcgggagtcacagttccctctacgagagaagtcatgtccctgcacgaagccagtcgaaaagaattgattccagctgccttcgcgacctggctccttgaagcccaagcagccacgggtttcctgcttgatccctgtactagacagaagctgagcgttgacgaggctgtggatgtcggtttggtcaatgaggaactgcgtgagcgcctcctaaaagctgaacgagccgctacagggtacagggatcccgctaccggcgatactatacctctgttccaggccatgcagaaacaactcattgagaaggccgaagccttgaggctgctggaggtccaagtcgctaccggaggagtgattgaccctcagcatcatcaccgcctccctcttgaaacagcctaccggaggggatgcctacacaaggacatctatgccctgatttctgatcagaagcacatgagaaagagattcgtggaccctaatacccaggagaaagtaagttatcgagaattgcaggaaaggtgtcggcctcaagaggatacagggtggctgttgtttcctgtaaacaaggcggctcgtgattccgaacatattgacgacgagaccagaagggctttggaagccgaacaggttgaaataacagtgggcagatttagaggccaaaagcccaccctatgggcgctcctcaactccgaatacgtgactgaggaaaagaagctgcagctggtccgcatgtaccgtacccataccagaagggcattgcagaccgtcgcccaactgatcctcgaattaatcgaaaagcaggagacctctaacaagcatttatggtttcagggaatccgcaggcagattaccgcttcagaactgttgagctccgccatcattacggaggagatgttgcaggacctggaaaccggtcggagcacaacccaagaactgatggaggatgaccgggtaaagaggtatctcgaaggcacctcttgtatcgccggagtattggttccagcaaaggatcagcccggtcggcaggagaagatgagtatctaccaagccatgtggaagggcgtgctccggccagggacagcactggtgctcctggaggctcaagccgcaacgggctttgttattgatccagttcgaaacctgcggctttctgttgaagaggctgtcgccgctggtgtggtaggaggggagatccaagagaagcttctctctgctgaacgcgctgttacaggctacacggatccgtatactggtcagcagatctctctgttccaagctatgcagaaggatcttatcgttcgagagcacgggattaggcttctcgaagcccagatcgcaactggtggggtcattgacccggtgcactctcatagagttcccgtggacgtggcctacagacgaggatatttcgatgaggagatgaatagagtgcttgcagatcccagcgacgataccaaaggcttcttcgatcccaacacacacgagaatctcacttacgttcagcttttaaggcgttgcgttccagaccctgatacagggttatacatgcttcagcttgctggcagaggaagtgccgttcaccagctgagcgaggaactccgctgtgccttgagagatgcccgtgtgactccaggctctggagctctgcagggacaatcagtgtcggtatgggaactgctcttctaccgcgaagtgtccgaagaccgaaggcaagacctgctgtcacgataccgggctgggaccctgaccgtagaagaactgggagctacactcacaagcctccttgcccaggcacaggcgcaagctcgggctgaagcagaagccggttctcccaggccagatccacgcgaagccttgagggccgcaaccatggaggtgaaggtgggccgtctgcgcggaagagcggtaccagtgtgggatgttctggcctcaggttatgtctcccgcgctgccagagaagaactactggccgagttcggttcaggtacccttgacctccccgctctgaccagaaggctgactgcaataattgaggaagccgaggaagcgcctggggctagacctcagttgcaagatgcctggcgaggcccaagagagcctggcccagccggacgtggggacggtgattctgggcgttcacagagagaagggcaaggagagggagagacacaggaggccgctgctgctgcagccgcagccgcagcaagaagacaagagcagaccctcagagatgcgaccatggaggtgcagcgtggacagttccaaggaagacccgtgtccgtttgggacgttcttttttcttcctacttgagcgaagctcggcgagacgagctattggcccaacatgcggctggagcccttggtctgcccgacctggtggcggtgctgacacgagtgatcgaggagaccgaagagcggctcagcaaggtttccttcagaggtctgcgaagacaagtgtccgcgagcgaactgcacacaagcggtatactcgggcctgaaacacttagagaccttgctcagggcactaagacccttcaagaagtgaccgaaatggattcagtgaaacgatatctggaaggtacgtcctgtatagccggtgtgctggttcctgctaaggaccagcccggacgccaggagaagatgagcatttatcaggctatgtggaagggcgtcttaagacccggaactgccctcgtgttgctggaagcacaggcagccactggatttgtgatcgatccagtgaggaatctgcgcctgtccgtcgaggaggcagtggccgcaggggttgttggtggagaaatccaagagaagcttctgtctgcggaacgagcagtcacgggttacacagacccttacaccggccagcagatttctttatttcaggccatgcagaaagacctgatcgtgcgagagcatggcatccgcctgctcgaggcccagatcgccacgggaggcgtgatagacccagtccatagtcatagggtgcccgtggatgtggcctaccagcgaggctattttgatgaggagatgaaccgagttctagccgatcccagcgatgatactaagggattcttcgatcctaacacacacgagaacttgacatacgtacaattgcttcgccgatgcgtcccagatcctgatactggcctgtatatgctgcagttggccggtcgtggttctgctgtgcaccagctcagtgaagaactcaggtgtgctctgcgcgatgccagggtcacaccaggatctggggctttgcaggggcagtcagtttccgtttgggagctactgttctaccgggaggtctcagaggaccgtaggcaagaccttctgtccagatatagagccggaactctgaccgtcgaagaattgggggctactctcacatctctactggcacaggctcaggcccaagctagggctgaagcggaagccggatctccacgaccagatcctcgtgaggccttaagggccgcaaccatggaggttaaagtgggccgtttgaggggtcgcgctgtgccagtctgggacgttctggcatcagggtacgtttctcgcgcagctcgcgaggaattgttggccgaatttggcagtggtacgctggacctaccagcgctgacgcgccgtttaacggctatcatcgaggaagccgaggaagcacccggtgctcggcctcagctacaggatgcctggcggggtcccagggaacccggtccagcaggacgtggagatggagactcaggaaggtctcaaagagaaggccagggcgagggcgagacacaagaggccgcagctgctgctcgaaggcaggagcagacattaagggatgcaacaatggaggtgcaaagaggtcagttccagggcaggccagtctcagtgtgggacgtgcttttttcttcttacctgtctgaagcgaggagagacgagcttctggctcagcacgcagcaggagcgcttggcctgcccgatctggtagccgtcctcactcgggtgattgaagaaactgaggagaggctgtctaaagtctctttcagaggactgcgttgccaagtgtccgcctctgagctgcatacctccggtattctgggtccagaaaccctgagagatctcgctcaagggactaaaaccttacaggaggtgacagagatggactctgtaaagagatacttagaaggtacaagctgcatcgccggagtactggtgcccgctaaagaccaaccaggtcgtcaggagaagatgagcatctaccaggccatgtggaaaggcgtgctgaggcccggaaccgccctcgtgttgctcgaggcgcaagccgctacaggctttgtgatcgaccccgtgcgaaacctgagactgagcgtcgaagaggccgtggcagcaggcgtggtcgggggagagatccaggagaaactgctctctgcagaaagagccgtgacgggctatacggatccatatactgggcagcaaatctccctttttcaagctatgcagaaggatttaatcgttcgcgagcacggcattcgactcttagaggcccagattgccaccgggggagtcatcgaccccgtgcacagtcaccgggtgcctgtcgatgtggcctacagaagggggtactttgacgaagagatgaatcgagtcttggcggacccttctgatgataccaagggattcttcgaccccaacacccatgagaacctgacctacgtacagttgctccgcagatgcgtccctgatcccgataccggcctgtatatgcttcagctcgccggacgcggatcagccgtccaccagctgtcagaagaattgcggtgtgccctcagagatgcacgagtgacacccggatctggggcactgcaaggacagtccgtgtctgtgtgggaactgctcttctacagggaggtcagtgaggaccggcgacaagatcttctctcgcggtatcgggcaggcaccctgacggttgaggaattaggggctaccctgacgtccctgcttgctcaggcccaggcccaggcacgcgctgaggcagaggccggttccccaaggcctgacccacgggaggccctgagagccgctactatggaagttaaggtggggagactgcgtgggagggccgtgcccgtgtgggacgtgcttgcctctgggtatgtctcacgtgctgccagggaggaacttctagctgaattcggcagcggcactctggatctgcccgcactgaccaggaggctcactgccatcatcgaggaggcagaagaagcacctggtgctcgaccgcagctgcaggacgcttggcgaggtcctagggaacctggacctgccggtcgcggagacggagacagcggcagatcccaacgggagggccagggtgagggggaaacccaggaggccgctgctgctaccgcagctgcacgacggcaagagcagacactaagagacgccactatggaggtccagcgtggtcaatttcagggacggcctgtcagcgtttgggatgtgctgttttcatcttatcttagtgaggcgagacgggacgagttgttggcccagcatgcagcgggtgccctcgggctccctgacctggtggccgttctgacccgtgtcatcgaggagaccgaagaacggctcagtaaagtgtcattccggggactgcgacggcaggtctccgcgtccgaacttcacacttccgggatccttgggcctgaaaccctccgagatctggcacagggtaccaaaacattgcaagaggtgactgaaatggattctgtcaagaggtatctggaggggacatcttgtatcgctggtgtactggtacctgcgaaggatcaacccggaaggcaggagaaaatgtccatataccaggcgatgtggaagggcgtcttacgtcccggaactgctctggttcttctcgaagcacaggctgcaaccggatttgtcattgaccctgtccgcaacctccgactaagtgtggaagaggccgttgcagcaggggtggtgggtggagagattcaggaaaaactgctgagtgccgagcgggcagtgaccggctacaccgacccttataccgggcaacagattagcctgtttcaagcaatgcagaaggacctgatagttcgagagcatggcattcgccttctagaggcacaaattgcaactgggggtgtcatcgacccagtgcattctcaccgggtccccgtagacgtggcttacagacgcggatatttcgacgaagagatgaaccgagttcttgccgatccatctgatgataccaaaggattttttgaccctaacacccacgaaaacctgacatatgtccagctgctgcgtcgatgtgtgcccgacccggataccggcctgtacatgctgcaattagccggacgagggtccgccgtgcatcagctatccgaggagctgcgctgtgcactgcgcgacgccagggtcacccctgggtctggtgcactccaaggacaaagcgttagtgtttgggaactcttattctatagggaggtatctgaggaccgcaggcaagatttgctgagccgctatcgagctggtactcttaccgtggaggaactaggtgctacattgacttctctcctggcacaagcccaggctcaggccagggctgaggcagaagctgggtcaccccgacctgaccccagagaggccctcagggcagccacaatggaagttaaggtaggccgactgagagggcgagccgtgcccgtctgggatgtgttggcttctggctatgtatcaagggccgctcgggaggagctgctcgccgaatttgggtccggcactctggatctgcctgctttgaccaggcgtttgactgcaatcattgaagaggccgaagaggcaccaggggctagaccccagctgcaggacgcatggcggggacccagggaacccggaccagcaggcagaggagacggggacagcggtcgctcccagagagaagggcaaggcgagggggagactcaggaggccgctgcggctacagcagcggctagaaggcaggagcaaacgctccgcgatgcaacaatggaggtgcaaagggggcagtttcaagggcgacctgtgagcgtatgggacgtcctgtttagctcttatctaagcgaggccagacgtgacgagctactggctcagcacgcggctggggctctgggactgcctgatctggtcgctgtgctgacaagggtcattgaggagacagaggagcgtctcagtaaagtctcatttaggggacttaggagacaggtgtctgccagcgaactgcatacgagtgggatattaggtcccgaaacacttcgcgacctcgctcaaggaacaaagacccttcaggaagtgacagagatggacagcgtgaagcgttatctcgaaggcactagctgcatcgccggtgttcttgtgcccgctaaagaccagcctgggcaccaggaaaagatgtctatctaccaagccatgtggaagggcgtcctgcggcctggtacggcgctggttctcctggaggcccaagcggcaactgggttcgtgattgatcccgttcgaaacctgcgcttatctgttgaggaggccgtggcagcaggcgttgtggggggagagattcaagagaagctgcttagtgcagaacgggctgtgacagggtacactgacccatacaccggtcagcaaatctcactgttccaagctatgcagaaagatttaatcgtccgtgagcacggtatccgactcctggaagcccagattgccaccggcggtgttattgaccctgtacatagccaccgagtgcccgtagatgtcgcctaccggagggggtatttcgacgaggagatgaatagggtgctagctcacccctccgatgataccaaaggattcttcgaccctaacacccatgaaaacctgacctacgtccaactgctgcgcagatgtgtgcctgatcctgatactggcctgtacatgctccagctggccggacgaggctccgctgttcaccagttatcagaagaacttcgttgcgcgcttagagacgcacgggtgatgcctggctcgggggcactgcagggacaatcagttagcgtttgggagctcctgttttatagagaagtatccgaggaccgcagacaggacctgctgtctcgataccgtgctggaactctgaccgtagaagaacttggggcaaccctcacctctcttttggctcaagcacaagctcaggcccgagctgaggccgaagctgaggccggaagccctaggcccgatcccagagaggctctccgcgctgctacaatggaggtcaaggtgggccgtctcaggggcagagcagtgccagtgtgggatgttttagcctccggttacgtcagcggggctgccagagaggagttgctagctgagtttggaagtggtacattagatctccccgctctgactaggaggcttaccgcaatcattgaagaggccgaagaggccccaggagcacgcccacagcttcaagatgcctggcggggtcccagggagcctggcccagcaggcagaggagacggagacagtggacgcagtcagagagaaggacagggcgagggcgagacccaggaggccgcagccgcagccagaagacaagagcagactctccgcgatgccaccatggaagtacagagaggacagtttcagggcagaccagtttcagtctgggacgtgttattctccagctacctctcagaggcacatcgggatgagctccttgcacagcatgcagctggtgctctggggcttccagacctggtcgctgtgttaacaagagtgattgaggagacagaagaacggctgagtaaggtttcctttaggggtcttcggaggcaagtcagcgccagtgaattgcacaccagtggaatattggggccagaaaccctccgcgatcttgcccagggtaccaaaaccctacaggaagttaccgaaatggacagcgtgaaaagatatttggaaggcacctcctgcattgcgggagtgctagtcccagctaaggatcagccaggccgacaagagaaaatgtcaatttaccaagccatgtggaagggagtcctgcgaccaggcactgcactcgtgctgctcgaagcccaggccgcaaccgggttcgtgatcgatccggtgagaaatctgcgactgagtgtcgaggaggccgtggccgctggagtagtggggggtgaaattcaggagaagctgctgagcgccgaacgtgctgtgaccgggtacaccgacccctatacaggtcagcaaatatccctgtttcaggccatgcagaaagacctgattgtgcgagagcacggaatccgcctgctggaagcacaaatagccaccggaggggttatcgatccagttcacagtcatcgcgtgcctgtagatgtcgcatacagacgcggttactttgatgaggagatgaaccgggtcttggccgatccatcggacgacaccaaaggcttcttcgatcccaacactcacgagaacctgacttatttacagctcctgcaacgagccacactggaccccgaaacagggcttctgtttctgtcactgagtcttcagtaa

SEQ ID NO: 55771 - DNA, 2715 bp, Artificial Sequence
  Description of Artificial Sequence: Synthetic coding sequence
atggagtcctttcacacccggttctctgcgtggacaccattttcgaataagagtctaaataggcagctctttcaagaaagggtggcactgattagtcattggtttgacttgtggactaacaagcagcgtcaggagttccttttcgcaatctttttaagatgcactaaatctcagttgcgtttcgtgcaggattggttttcagagagaatgcaggtagccaaagtggacttctccactgtgttgccaagattcatatccttgtacattttctcattcctgtctcccaaggatctgtgcgccgcagcgcaggtgagctggccgtggaaattcctgacagagcaggattgtctctggatgcccaagtgtgtcaagttcggctggtttctcccttacacccccactgacaatgagtacggtgcatggaagcggcactatatcgcatgcgtatcacacctggactggctgacaccccgagaggctgctgcgacttacgggaccctcaatgaacccaaaacagaagatgaggagcttctggaaagacagagagaaaaatgtttaaggaaaaggatctgggagaaaattgccctccggaaaaaggaactctttaaagtgagaccaccctgggtttccgggacatgttgttctagcgtgctgaagccacgctgccagcctcgattaagtcagacggtcagggaacgtgttggccttcacgaagccttggagaagcaactggtactcacatcactagagactcttcctaaaagatcaaatataagcggatcccatagctatccgctgctcagtaaaaagaactggcatggtgtgcataaaaatgacgataggtcatcttatgcgctccggccacatttcatgctaatctcatcccggatcccagcctacgagatggtgatggagagcgtaaaggcgggtgtggtgtctgtcgtgtacgagcacagcgtaactttggagtccctgctctacttaatagagaaagccctggatggccagaaagcccaaagtatcggtatcttctctgacggagatagcagagaaattaatctgcttcaggggtataagataggggttaagaatctgctccggcctgaggtccgagatttttgggagaagctcggaagttacgtcgccaccgaagaggaaggaggacacgtggacttttttgtacccctgggcgcttcagaagccggaattgaggtgctatctcagctgtcccaactgaccgggacctttttcaccgcccctacaggtattgccacgggctcctatcagcacatcttatccgactggctcggttctcagtggggtaaggcccctagcagcatctacttttgcgagagtaaattgcagacatggtcctctttcaccgattttctcgaagagactcttaaaacagttagaaaacagctctatcccttctttaaagaattgcagaagtccatctcgggtcggatgatcggtcagtttatgttcgatacaatgggcatgacaaatatccttaacaaccaggacaccgcccaggccttagccgatgggctaatggaactaagcaaggaggacagcgagcgcaacgtggtcgaagataatagctgggacacgaagtcaagactaagtaagaacgatctgaattttgaggccctgatcaaccttgagcggatcctgcagaaagattcagccgaaaaacgagccagagtagtgcgggagctcctccagagcgaacgtaaatacgtacaaattctagaaatcgtccgggatgtctacgttgccccactcaaagcggctctgagctccaatcgggctattctatctgctgctaacatccaaatcattttttgcgacatcttacagatcctgagcctgaacagacagtttttagataaccttcgcgatagactgcaggagtggggacccgctcactgtgtgggcgagattgtaacaaaatttggatcccagctcaacacctacaccaatttctttaataactatcctgtgatcctgaagacaattgagaagtgtcgagagatgattcccgctttccgtacttttctgaagagacatgataaaactatcgtcaccaaaatgttatcattgcccgagctgctcctgtacccgtcccgccgtttcgaagaatacctgaacctgctgtacgccgtccgcttgcacactcccgctgagcacgtagatagaggcgatttgaccaccgcaattgatcaaatcaaaaaatataagggatacatcgatcagatgaagcaaaacattaccatgaaggaccacctttcagatatccaaaggattatctgggggtgccctactcttagcgaagtcaatcgataccttatccgggtgcaggacgtggcacaactgcattgttgtgacgaggagatctcattctctttgaggctctatgaacacatccacgatcttagcttattccttttcaacgacgccctgttggtgagcagcagaggcacgtcgcatacgccattcgagagaacctcaaagactacataccagtttatcgcatccgtggccttgcacagattacttatcgaaaacattcccgacagcaagtacgtgaaaaatgcttttatcctccaaggcccaaaatataaatggatatgtgccacagaaattgaggacgataaattcctgtggctgtcagtcttacgcaacgcaatcaagtcgtctatggagaaatag

SEQ ID NO: 55772 - DNA, 234 bp, Artificial Sequence
  Description of Artificial Sequence: Synthetic coding sequence
atggagtctttccacacccgcttttcagcctggactccattttcaaacaaatctctgaatagacagctcttccaggagagggtcgctctgatttcccattggtttgacctgtggaccaataaacagaggcaggagttcctgtttgccattttcctacgttgcaccaaatctcagttgcggttcgtgcaggattggttcagcgagcggatgcaggttgctaaggtggatttctag

SEQ ID NO: 55773 - DNA, 2715 bp, Artificial Sequence
  Description of Artificial Sequence: Synthetic coding sequence
atggagtcatttcatacccgtttttccgcatggactccctttagcaataagagcctcaacagacagctgtttcaagagagggtcgcccttattagccactggttcgatctctggactaataagcagaggcaggagtttcttttcgctattttcctaagatgcacaaaatcccagctgagattcgtgcaagactggtttagcgagaggatgcaggtggctaaggtagacttctctaccgtgttaccacgatttattagtctgtatatcttttcctttctgagtcccaaagatctgtgcgcagccgctcaggtcagctggccatggaaattcttgaccgaacaggattgtctctggatgccgaagtgcgtcaaatttgggtggttcctgccttatacgcctacagataatgaatacggggcatggaagaggcactacatcgcctgtgtgagccatttagactggcttacacctcgtgaggccgctgctacttatggtacattgaatgagcccaagaccgaagatgaggaactcctggaaagacagcgggagaaatgtttgaggaagcggatctgggagaaaatcgcacttaggaaaaaggagctgttcaaagtgagaccaccttgggtatccggtacctgctgttcatccgtcctgaaaccacggtgtcagccaagacttagtcagacagttcgggaaagagtgggtctgcatgaggcgctagaaaaacagttggtcttgacctccttggagacattgcctaagcgcagcaatataagtggatcccactcttatccacttttatctaagaaaaattggcacggcgttcataagaatgacgataggtcatcttacgccctccggccacacttcatgctaatctcgtctaggataccagcctacgaaatggttatggaatctgttaaagctggtgtcgtatccgtggtgtacgaacactccgtgacactagaatcgctcctctatctgatcgagaaggccttggatggccagaaggcacaatctatcggtatctttagcgacggtgacagccgggagattaatttgctccagggctacaaaattggggtcaaaaatctcttgcgtccagaggtcagggacttctgggagaaactggggtcgtatgtggccacggaggaggagggaggacacgtcgatttctttgtgcctctgggggctagtgaggctggaattgaggtcctgagccagctttcacagctaacaggcaccttcttcaccgctcccacaggcatagcaaccggcagttatcagcacatcctatctgattggctggggtcacaatggggcaaagcgccatcttcgatctacttttgcgaaagcaagctgcagacctggtcatcctttacggattttctggaagaaactttaaagactgtccggaagcaattgtacccgttctttaaggagcttcagaagtctatctccggacggatgatcggccagttcatgtttgataccatgggtatgactaatatcttgaataatcaggatacagcacaggctctcgcagatggactgatggaactgagtaaagaggactctgaacgtaacgtcgttgaggacaactcatgggataccaagtcgcgtctgagtaaaaatgatttaaactttgaggctctcataaatctggaaagaatcctgcagaaagattccgcggaaaagagggctagggtcgtccgagaactgctgcagtctgaacggaaatatgtgcagattcttgagatcgtcagggatgtctacgtcgcaccattaaaggcagcgctttctagcaatagagctattctttctgcagccaacattcagattattttctgcgatattctgcaaatcttatctctgaacaggcagtttttggataacctgagggaccgcttgcaggagtggggaccagcacactgcgtaggcgagatagtgacaaaatttggctctcagctgaacacatacacaaatttttttaacaactatcccgtgattctgaagaccattgagaaatgtcgcgaaatgatacccgcattcaggactttcctcaaacgacacgataagacaattgtaaccaaaatgctaagcctgcctgagctgctgttatatcctagtagacgattcgaggaatacctgaatctgctctacgcggtgcgcctacatactcctgcagagcatgttgaccgcggagatctcaccactgcaattgaccagatcaaaaagtataaaggctacattgaccagatgaaacagaatataactatgaaggatcacctaagcgacatccagcggattatctggggatgcccaaccctcagtgaggtgaacagatatctaattagggtccaggacgtggctcagctgcactgctgtgatgaggagattagcttctccctccggctgtacgagcacatccatgacctatctcttttcttattcaacgacgctctcctcgtgagctcccgcggtacctcccacactcctttcgagagaacctctaagacaacttatcaattcatcgctagcgtcgcattgcatagattgctcatagagaatatacccgactccaaatacgttaagaacgccttcatactccaaggtcccaaatacaagtggatttgcgctacagaaatcgaagacgacaagtttttatggctctctgtgctgcgtaacgccatcaagtctagcatggagaaatag

SEQ ID NO: 55774 - DNA, 2277 bp, Artificial Sequence
  Description of Artificial Sequence: Synthetic coding sequence
atgcaggtcgctaaggtagacttctccaccgttctgccacgctttatcagcctttatatcttcagcttcctgtctcccaaagacctgtgtgcagccgctcaggtcagctggccctggaaatttctgacagagcaggattgtctgtggatgccaaagtgcgtcaaattcgggtggtttctcccttatacaccaacagataatgaatacggtgcttggaagaggcattacatcgcctgtgtgtcgcacttggactggttgactccgcgagaggctgccgctacctacggcacactgaacgagcccaagacggaggatgaagagctgctggaacgccagagggagaaatgcttgagaaagcgaatctgggaaaaaatagcactgcgaaagaaggaacttttcaaagtccgtcctccttgggtgagtggcacttgttgctccagcgtgctgaagcctcggtgccagcctcggctctcacagacagttcgtgagcgcgtcgggctccacgaagccttagagaaacagttggtcctgacatcgctggagactttgcctaaacgctccaatatctcaggctctcatagctacccactgttatccaagaagaattggcatggggtacacaagaatgatgacagaagttcctacgctctgcggccacactttatgctgatcagctccaggattcctgcctatgaaatggtcatggagtccgtgaaagccggagtggttagcgttgtgtatgagcactccgttaccttggagagtctgctgtacctgatcgaaaaagctctagatggccaaaaggctcagagcattggaattttctccgacggggactctcgagaaatcaacctactgcagggctacaagataggcgtgaagaatctgttgcggcctgaagtgcgcgatttttgggagaagctcggatcatacgtcgctacggaggaagaggggggacatgtggacttcttcgtgcctttgggagcatctgaggctggaatcgaggtcctgagtcagctctctcaacttactgggacgttcttcaccgctcccaccggcatagccacaggttcgtatcagcacatcctctcagactggctgggaagccagtggggcaaggcccctagttctatctacttttgtgagagcaaattacagacatggagcagctttacggactttttggaagagacactgaaaaccgtcaggaagcagctttaccccttctttaaggagttgcagaaatcaatctcaggccgtatgattggtcagtttatgttcgacaccatgggaatgacaaatatcctgaataaccaggacaccgctcaggccctggccgatggcttaatggagctgagcaaagaagattctgagcgcaacgtggtagaggataattcctgggacacaaagagcaggttgtcaaagaatgatctgaacttcgaggccctcataaatctggaacggattcttcagaaagatagcgccgaaaaacgtgcacgcgtggtgcgggagctgttgcaatctgagagaaagtacgttcagattctggaaattgtgagagatgtgtatgtcgcaccgctgaaggcggcactaagctccaacagagccattttgagcgccgcaaacatccagatcatattttgtgacattctccaaatcctttcactgaatcgccagtttctggacaatcttagagatagactgcaggagtggggcccagctcattgtgtgggcgaaatcgtgaccaagttcgggagccagttaaacacgtacaccaatttcttcaacaactacccagtaatcttgaagaccatcgagaaaatgaaacagaatattaccatgaaggaccacctcagcgatattcagagaattatctgggggtgcccaaccctgtctgaagtgaatcgatatctgatacgcgtgcaggatgtagcccagttgcactgctgtgatgaggagataagcttctctctcaggttatacgagcacattcacgatctgagtctctttttatttaatgacgcactgctggtgtcttctcgcggaacctctcataccccttttgagcgaacatccaagacaacctaccaatttatcgccagcgtggctctgcaccgtctcttgattgaaaacatccccgactctaaatacgttaagaatgctttcatccttcaggggccaaagtataagtggatatgcgctacagagattgaagatgacaaatttttatggctctccgtcctgaggaatgccattaagagctccatggagaagtag

SEQ ID NO: 55775 - DNA, 987 bp, Artificial Sequence
  Description of Artificial Sequence: Synthetic coding sequence
atggccaccaagcgcctggccagacaactgggcctgattagacggaagagcatcgcccctgctaacgggaacttaggacgctctaagtccaagcagttattcgactacctgattgtcatcgactttgagtcgacctgctggaacgatggcaagcaccaccattcccaggagattatcgaatttcctgctgtgctccttaacacttctaccggacagattgattcagagttccaggcatatgtacaaccccaagagcaccccatactttccgaattttgtatggaattgacgggcattaaacaggctcaggttgatgagggtgttcccttgaagatatgcctgtctcaattctgtaaatggattcataagattcagcagcagaagaatatcatattcgcaaccggtatatcagaaccctctgcgagtgaagtgaaactgtgcgcctttgtgacctggagcgactgggacttaggcgtgtgcctggaatatgagtgtaagagaaagcagctattgaagccagtgttccttaactcctggattgatcttagggcaacctataaacttttttaccgaagaaaacctaagggcctgtcaggcgctttgcaggaagtcggaattgaattctccggacgcgaacactccggactggacgattcgaggaatacagctctcctggcctggaaaatgattcgcgacggttgcgtcatgaagattacccggagcttaaacaagggaccttttctgctgccctcttggacatggaatagcgaccttgcgagcggagaccagcacgctttccttcagcaggaatttggctgcggaacctataggaccctgctgcagaaacctaatatgagtaaacaggagaaaggcaacatcctgtggttgacgatggtttggcttagtctggcgtgtctacagcgaaagaattacaacgattgcatgttgaacacagcctcccagaccgtcacaacagagaagttttag

SEQ ID NO: 55776 - DNA, 2076 bp, Artificial Sequence
  Description of Artificial Sequence: Synthetic coding sequence
atggctacaaagagactggcaagacagttggggttgattaggcggaaatcgatcgcgccagccaatggcaatctcggacgtagcaagtccaagcagctgttcgattatctcatcgttattgatttcgagtcaacttgttggaatgatggtaagcaccaccactcacaggagataatcgagtttccagcagtgcttttaaatacaagcacgggtcagatagattcagagtttcaggcctacgtgcagcctcaggaacaccccatcctgagcgagttctgtatggagctaaccggcattaagcaggctcaggtcgacgaaggcgtcccactaaagatttgcctgtctcagttctgcaagtggatccataaaattcaacagcagaaaaatatcatctttgccactggaatctccgagccctccgcatcggaggtgaaactgtgcgccttcgttacatggtcagattgggatcttggtgtctgtttggaatatgagtgcaagaggaagcagctcctgaagcccgtcttcctgaatagctggatcgatcttcgggcaacttacaagctcttctatcggagaaaaccgaaagggctttctggcgctctgcaggaggtggggatcgagttctctggcagagagcacagcggtttagacgatagtagaaacacagctttgctggcctggaagatgatccgcgacggttgtgtaatgaagattacccgctcgcttaataaggtgcccactaagaaaaacttcagtatcctggccagaaacctgaacacgatacaagtggaggaaatgtcagcttgtaacatctctatccagggcccatccatatacaacaaggaacctaaaaacatcattaatccacacgagaaagtgcagatgaagagcatttgcgccaactcgcccattaaggcgcaacaggatcagttgcaggtgaagaacaatatcaaagcaagtctccacaatgtcaaatcaagtcttccactgttcaacacgaagtcaagcacttctgtagggcagctgcagagtccgacgttaaacagccccatctatatgcagaagcagggaaagaatgaacacctagcattcaatacaaaatctaaagccagcactgtgggtagcgaactggtgctggtgtcaaccaccgtacctactgtccaccacgtcagtgatctggaaatgtcctccacactcgactgtctccccgtgctggccgactgggaggacgttgttttgttgcctgcctctcaaccggaagaaaatgtcgactgtactgtgcctatttccgattcagatctcgagatctcctttaactccggggagcggctcatggtgctcaaggagcttgaaatgtcatctcatgagaatttcggcgacatcgaggagactccccagaagagcgagacttctaagagtattgtttataaatcaccgcacacaacaatctacaatgtaaaggaggctaaggaccctggatctgacatcagcgcctttaaactcccggagcataagagttccacctttaacagggtgaatgctaatatgtctcatcccctggtgctggggaagcatccactcctcagcggaggtactaagagaaacccttgctccccgcaggcctttcctcccgctaagaaacaacccttcacaattcatgaagaaaagccgactagcagcgactgcagtccggtgcggagctcctcctggagaagacttccctccattctgactagtaccgtgaatctacaagagccttggaaaagcgggaagatgactcctcccctgtgtaaatgtggtaggaggtcaaagcgcctggttgttagcaacaatggaccgaaccacgggaaggttttctactgctgccccatagggaaataccaagaaaaccgcaaatgttgtggctactttaagtgggagcagacacttcagaaggagcgggctaattcaatggtgccgagtcactccacaggtggactcactttttcgtcacccgagacatcccacatctgcgaccgcaacctgagcatatctaccaaaaatagcctgagactgcgcccatctatgagaaactag

SEQ ID NO: 55777 - DNA, 1281 bp, Artificial Sequence
  Description of Artificial Sequence: Synthetic coding sequence
atgagtgcatgtaacataagcatacagggcccatctatctacaataaagagcccaaaaacatcataaacccacacgagaaggtgcaaatgaaaagcatctgtgctaattcccctatcaaggcccaacaggaccagttgcaggttaaaaacaatattaaggcctccctgcacaacgtgaaatcgagcttgcccctctttaacacgaaatcgagcacaagcgtggggcagctccagtctcctacactgaattccccgatctacatgcaaaaacagggcaagaacgagcacctcgcatttaacacaaaatccaaggcaagcaccgttgggtccgagctggtgcttgtgtccaccaccgtgccaaccgttcatcatgtgtccgacctggaaatgtcctcgaccctggactgcctgcctgtgctcgccgattgggaggacgttgtattactgcccgcttcacagccagaggagaatgtcgattgtactgttcccatatccgattcggacctcgagataagctttaactctggagagcgtctaatggtgcttaaggagctggagatgagttcccacgagaattttggtgacatagaagagactccacagaaatcggagactagcaaatccatcgtctataaatcgccccacactacgatctacaacgttaaggaggccaaggaccccggatcggacatatctgccttcaaactgccagaacataaaagctccacattcaaccgtgtgaatgcgaatatgagccatcccctagttcttgggaagcaccctttgttgagcggcggaactaagagaaatccgtgcagcccccaggcattccctccagcaaaaaaacagccctttaccatccatgaagagaaaccaacttcgtccgactgcagccctgtgcgcagtagctcctggaggaggctgccttctatcttgacttccaccgttaatctgcaggaaccttggaagagcggcaagatgaccccgccactgtgtaaatgcggtcgcagatctaaacgactcgttgtatctaacaacggacccaaccatgggaaggtattctactgttgccccattggtaaatatcaagaaaataggaagtgctgtgggtatttcaaatgggaacagaccctccagaaggaaagagcaaattctatggttcccagccattctaccggcggtctgacgttttcctcacctgaaacctcccacatttgcgacaggaacctcagtataagcacaaagaacagcttaagactccgaccctctatgcggaattag

SEQ ID NO: 55778 - DNA, 696 bp, Artificial Sequence
  Description of Artificial Sequence: Synthetic coding sequence
atggtgtcctttccaccgcagaggtaccactattttctggtgctggactttgaggctacatgtgacaagccgcagatacatccgcaggaaatcatcgaatttcccatcttgaagttaaatgggcgaaccatggagattgaatccacctttcatatgtacgtgcaaccagttgtccacccccagctcacccccttttgtacagaactcacagggattatccaggccatggtggatgggcaacccagcttacagcaggttctggagcgcgtggatgagtggatggccaaggagggcttattagatccaaatgtgaaaagtatctttgtaacctgcggcgactgggatcttaaagtcatgcttccagggcagtgccagtaccttggcctgcctgtggccgactatttcaaacagtggatcaacttgaagaaaggctcctccccaggaactgcaagcggcaccagttgttatcagagcgaagaagcgcagcgcaaggagaacaccccaggcgtcaaagcttacagcttcgccatgggatgttggccaaaaaatggacttctagatatgaataaagggctgagcctccagcatatcggcaggccccacagcgggattgacgactgcaagaacattgctaacatcatgaaaactttggcttaccgcggatttatctttaagcaaacaagtaaacccttctag

SEQ ID NO: 55779 - DNA, 1014 bp, Artificial Sequence
  Description of Artificial Sequence: Synthetic coding sequence
atggcaacggcatctccggcagcagacggtgggaggggacgcccttgggagggaggactagtctcatggcctcccgcaccccctttgaccctgccctggacatggatggggccaagctggggccagcacccaggccattgggggtttccagccctcaccgagccttcagcatccccagcagctggcctcgggatctttgaggttaggcgcgtgctggatgcctcaggatgttctatgctcgcgccattgcagaccggagcggctaggttttcaagctatctactctcgcgtgctcggaaagtgctcgggagccacctgttcagtccatgtggagtgcctgagttctgctctattagcacaaggaaactagctgcccatggcttcggcgcttcgatggctgctatggtgtcttttccaccacagcggtaccattattttctcgttttggactttgaagctacctgtgacaaaccccagatccatccgcaggagatcatcgaattccccatactgaaactcaacggcagaacaatggagatagagtctacattccacatgtacgtccagccagtcgtgcatccacagctgacgccattttgcactgaactcacgggcatcatccaagccatggtggatggtcagccttcccttcagcaagtgctggaacgcgtggacgagtggatggcgaaggaaggactgctggaccccaatgtcaagagcatatttgtgacctgcggtgactgggatctcaaagtcatgctgcctgggcagtgtcagtatctggggttgccagttgctgattatttcaagcagtggataaatctgaagaaggcttattcctttgccatgggttgttggccaaagaacgggcttcttgacatgaataagggactctccctccaacacatcggaagacctcacagcgggatcgatgattgcaagaacatcgctaacatcatgaagacgctcgcgtacagaggcttcatctttaaacagacatctaaaccgttctag

SEQ ID NO: 55780 - DNA, 669 bp, Artificial Sequence
  Description of Artificial Sequence: Synthetic coding sequence
atgttcgtcatgctgcaggtcccttggttgcaatcatgtgctaatctggtgcagatcggtgcccctctgcctctcctcggatgtcttggacaatacttcgaggtgctgggatctatggaagtgctggccggacagtacgggatggagatcatcgagttccccattctcaagctgaacgggagaaccatggagatcgagtcgaccttccacatgtacgtacagccagttgtgcacccgcagctgactcccttctgcacagaactcacaggtatcatccaggccatggttgatggacagcccagtctgcagcaggttctcgagagggtggacgaatggatggccaaagaaggcctgctggatccgaacgtaaagtctatttttgtaacatgcggcgactgggacctcaaagtgatgttgccaggacagtgtcagtatctcgggctaccagtggcggactatttcaagcagtggattaacctgaagaaggcctacagttttgctatgggatgttggcctaagaacggtctcctggatatgaataaggggctgagcctacaacatatcgggaggccccactccgggatcgatgactgtaaaaacattgcaaatattatgaaaaccctcgcgtaccgtggctttattttcaagcagacctccaaacccttttag

SEQ ID NO: 55781 - DNA, 660 bp, Artificial Sequence
  Description of Artificial Sequence: Synthetic coding sequence
atggcgactgctagtcctgctgctgatggaggtaggggcagaccatgggaaggtgggctggtttcatggccacccgcacctcccctaaccctgccttggacgtggatggggccatcatggggccagcaccccggtgagatcattgagtttcccattctcaagctgaatggcagaaccatggagattgaaagcacgtttcacatgtacgtgcagccggtagtccacccacagttaacgccattctgcacagaactgaccggcatcattcaagcaatggtggacggacagccaagtttgcaacaagtcctggaaagagtggatgaatggatggccaaggagggcctcctcgatcctaatgtgaaaagcatcttcgttacatgtggggactgggacctgaaagtcatgctacccggacagtgtcagtatcttggcttaccagtggccgattatttcaaacagtggatcaatctgaaaaaggcttactcctttgccatggggtgctggcctaagaatggattactggacatgaacaaaggactttcgctgcagcacattggcaggcctcactctggcattgacgactgtaagaacatcgcaaatataatgaagacactagcatacagaggttttatctttaaacagaccagtaaaccattttag

SEQ ID NO: 55782 - DNA, 531 bp, Artificial Sequence
  Description of Artificial Sequence: Synthetic coding sequence
atggccacagccagcccagctgccgatggcggtcgcggtcgcccatgggagggaggcctggtgtcctggccccctgcccctccactcaccctgccctggacgtggatggggccatcgtggggccaacatcccggagagataattgaattcccaatacttaaacttaatggacggaccatggagatagagagcactttccatatgtacgtgcaacctgtggtgcacccacagctcactcctttctgcaccgagctgacaggtataatccaagccatggtggatggacagccgagtctgcagcaggtgctggaacgagtcgatgaatggatggcaaaggaaggactgctcgaccccaatgtcaagtctatatttgtgacttgcggggattgggacctgaaggtcatgctcccagggcagtgccagtacctggggctgcccgtggccgattatttcaagcaatggatcaacctgaaaaaagcctactcttttgccatgggctgctggcctaaaaatggcctgctcgatatgtag

SEQ ID NO: 55783 - DNA, 615 bp, Artificial Sequence
  Description of Artificial Sequence: Synthetic coding sequence
ttgcaagaaattattgagttcccgatcttgaagctgaacggcaggacgatggaaatcgagagcacctttcatatgtatgtgcagccagtggtgcaccctcagctgacgccattctgtacagaactgactggcataatccaggctatggttgatggccaaccatctctgcaacaagtcctagagcgtgtggatgaatggatggcaaaagaagggctactcgatcctaatgtcaagtcaatctttgtgacctgcggtgactgggatctaaaggttatgcttcccggtcagtgccagtatctggggctccctgtggccgattactttaaacagtggattaacctgaaaaagggctctagtcctggcaccgcctcaggaactagttgttatcagtctgaagaggcacaacgaaaggagaacactccaggggttaaagcttactctttcgccatgggatgctggccaaagaatgggcttcttgacatgaataagggattgagcctgcagcacattgggcgaccccactccggtattgatgattgcaagaacatcgctaatattatgaagacactcgcatatcgcggttttattttcaagcagacctcaaagccattctag

SEQ ID NO: 55784 - DNA, 753 bp, Artificial Sequence
  Description of Artificial Sequence: Synthetic coding sequence
atggccacagcgtcccctgcagcagatggcggacggggacgcccatgggagggaggcctcgtttcgtggcctccagcaccacccctcacactgccctggacctggatggggccatcgtggggtcagcacccaggccactggggattccccgcactgacggaaccaagcgccagccctgccgcaggccttggcatctttgaggttcggagagatgcatcagggtgtagtatgctggctcccttgcagacaggggctgctcgatttagctcatacctcttgagccgggctcgtaaggtcctcggaagccacctgttctcaccgtgcggagtgcctgagttttgttctatctctacaaggaaactggcagcacatgggtttggcgcatcaatggccgctatggtctcttttcctccccaaaggtatcactacttcttagtgttggacttcgaggccacttgcgataagccgcagatccatcctcaggaaatcatcgaattcccaatcctaaaactgaacggaaggaccatggaaattgaatcaacatttcacatgtacgtgcagcccgtagtccatccccagctgacgcctttttgtactgaactgaccggcatcatccaggctatggtagacgggcaaccgagtctgcagcaggtgctggagagagtggatgagtggatggctaaggaagggttgcttgaccccaatgtaaagtccatctttgtgacctgtggggattgggatctgaaggtctag

SEQ ID NO: 55785 - DNA, 483 bp, Artificial Sequence
  Description of Artificial Sequence: Synthetic coding sequence
atggagattgagtcgacttttcacatgtatgttcaaccagtggtccacccgcagcttactccattttgtactgagctgacaggcatcatccaggccatggttgatggccagccctcgctgcagcaggttctcgagagggtggatgagtggatggccaaggagggtctgctggatccaaacgtgaagtccatcttcgtgacttgcggcgattgggatctgaaagtgatgctccccggacagtgccagtatctaggcctgcctgtggcggactattttaaacagtggatcaacctgaagaaagcctacagttttgccatgggatgttggcccaagaatggtcttctggacatgaataagggtctgagcctccagcacattggcagaccccatagcggcatagatgactgtaagaacatcgccaacattatgaagacgcttgcctaccgcggatttatctttaagcagactagcaaacccttttag

SEQ ID NO: 55786 - DNA, 3018 bp, Artificial Sequence
  Description of Artificial Sequence: Synthetic coding sequence
atggagaagcagcgcgctctcgtggcagctaaggacggagacgtggctaccctggagagactgctggaagccggagccctggggccaggtatcacggatgctctcggcgcaggactcgtacaccatgctacacgcgctggacatctggattgcgttaaatttctggtgcagcgggctcagttaccaggaaaccagagggcgcataatggcgcaaccccagcccatgatgccgctgccacgggcagcctcgctgagctgtgctggctagttcgcgagggaggctgcggactccaagaccaggatgcttccggggtatctccccttcacctggccgctcgatttggccaccccgtgcttgtcgaatggctccttcacgaaggacactctgccacgttggagacacgagagggagctaggcccttgcaccacgcggctgtgagtggagacctgacttgcttaaaattgctgacagcggcacacggtagtagcgttaataggcggacacggagcggcgcatcccccctatacctggcttgccaggaaggtcatcttcacctggctcaattcctggtgaaagactgtggagccgatgtgcacctcagagctctggacggaatgtctgctctccatgcagcagccgctagggggcattattctttagtggtttggcttgtgaccttcacagatattggtcttaccgcacgggacaatgagggcgcaaccgcactgcattttgctgcacgaggcggacatacacctatcctggaccgacttctgctcatgggcacccctatactcagggatagttgggggggtaccccgcttcatgacgctgccgaaaacggccagatggagtgctgtcaaaccctggtgtcccaccatgtggatccctcactcagggacgaagacggctatactgctgccgacttggccgaataccacggccaccgagactgcgctcagtatctaagagaggttgcacaacctgttcctttactgatgaccccaccgccaccgccattcccccctcctccgctactggccacaaggagaagtttggaggacggacggaggggcggaccgggtcctggcaacccaagtccaatgagcctgtctcctgcgtggccagggcatcctgaccagcctctgcccagggagcagatgaccagccccgctcctccacgcatcataacatcagctacggcagacccagaaggcacggaaaccgctctggcaggcgacaccagcgacggcctggccgctttgcaactggacggactgcctagcggcgacatcgacggcttagtcccgactagagacgagagaggccagccgattcctgagtggaagcgccaggtcatggttagaaagctgcaggctcggttgggcgctgaatccagcgccgaagcgcaagataacggtgggagtagcggtcccacagagcaggccgcatggcgttatagtcagacccatcaagctattcttggacccttcggcgaactgctgactgaagatgacctggtctacttggagaagcagattgctgatctccaacttcgcaggcggtgtcaggagtacgagtctgaactgggcaggttggctgccgaacttcaggctttgctgccagaaccactcgtgagtatcactgttaactcgcatttcctacctcgggcacctgggctcgaggtcgaggaagcctcaattcccgctgccgagcccgctggcagtgctgaagctagcgaagtcgctcctggcgtgcagccattacctttttggtgttctcatatcagtagattggtgaggagcctgtccctgctgctgaaaggcgtgcacggcctcgtgcagggtgatgagaaacccagtactcggccacttcaagatacatgccgcgaggccagcgcatctcccccacggtcagaggcccaaagacagatccaggagtggggggtttccgtgcgaaccctgagggggaatttcgaatcagcctcgggtcctctgtgcggatttaaccctggcccttgcgagcccggtgcgcagcacaggcagtgtctaagcggttgttggcctgccctgccgaagcctcggtccggacttgctagcggagagcccaggcctggcgacaccgaggaggcgtctgacagcggcatatcctgcgaggaggtgccctccgaggccggtgcagctgcaggtcccgatttggcaagtctgcgcaaagagcggattatcatgctttttctgagtcactggagacggagcgcctatacccctgccctcaagactgttgcctgtcgaaccttgggagcacggcatgctggcctcagggggcaagaagcagcaaggtctcctgggcctccctcacccccttctgaaggtccacgcctgggacacttatggcaacagagaagcacaatcacgcacttgctagggaattggaaggccatcatggcccacgtccccgctaggcagttaagacgcctgagtagacagccacgcggagcacttagtcccgaacaatttctcccgcatgtggacggcgctccagtgccctactcatcactgagcctggatctgtttatgctgggatacttccagctcctggagtgcgacttgcctgccgaggaacgtaagctccgccatttactgtgttttgaggtgttcgaacatctggggacccacggctgggaagcagtgagggctttccacaaggccgtgacggatgaggtggctgccggaaggcgagcctggaccgatgggttcgaagatatcaaggccagatttttcggaagcagccagcgacccgcttgggataccgaacctgggaggaagtctggcctgactctgctggggcctctaccccacgcggctgtgccctgctccggaccggagcccactgcccaacggcttggcagccggtctcaacagggctcctttaacggagaggatatctgcggatacatcaaccggtcattcgccttctggaaagaaaaagaagcggagatgtttaatttcggcgagtag

SEQ ID NO: 55787 - DNA, 2886 bp, Artificial Sequence
  Description of Artificial Sequence: Synthetic coding sequence
atggagaaacaacgagccctggtagctgctaaagatggcgacgtggccacattagagagacttctggaggcgggagccctaggacccggaatcaccgatgcgctgggcgctggcttggttcatcatgctacccgcgctggccacttggattgcgttaagtttctcgttcagcgcgcacagctgccaggaaaccagagggcccacaatggcgcaactccggcacacgacgctgcagctacgggcagccttgcggaactttgttggctggtgcgcgaggggggatgtggtctccaagaccaggatgcaagcggagtcagcccgctgcatctcgccgctcggttcggccatcctgtcctggtggagtggctgctgcacgaaggtcacagcgctactcttgaaacgagggagggagctagaccccttcaccacgcagctgtttctggagatctgacctgcctaaaactcttgacagccgctcacggctcgagcgtcaaccggaggacccggtccggggcatccccattgtacttggcttgccaggagggacatctgcatctggctcaattcttggtgaaggactgtggcgcagacgtccatttacgcgctctcgatggtatgagcgccctgcatgctgccgctgccagagggcattatagtctggtggtctggttggtgacttttaccgatatcggtttgactgccagggataacgaaggagctactgccctccatttcgctgcaagaggcggtcataccccgatcctcgaccgcttgctgctcatggggacacccatactccgggactcttggggtggcaccccactccatgatgcagcggagaacgggcagatggaggtccctctcctgatgacacctccccctcccccattcccgccaccgcctctattagcaacacggcgatcattagaggatggcagacggggtggcccaggtccgggaaatcctagcccgatgagcctctctcctgcctggccaggacatccagaccagcctctgccccgagaacaaatgacaagcccagcccctccaagaataattacctcagcaaccgccgatcccgagggcaccgaaactgcattagctggcgataccagcgacggacttgctgcactgcagctggacggacttccctccggagacatcgatgggcttgtgcctactcgtgacgagcggggacagccgattcccgagtggaagcggcaggtcatggtccgtaaactgcaggccaggctgggggcagaatctagcgccgaggcgcaggacaacggcggtagttccggacccaccgaacaagccgcttggcgatactcacaaacacaccaggccatcctcggaccctttggggaacttctcacagaggacgatctcgtttacctggaaaaacaaattgcagacttacagctgcgccgaaggtgccaggagtacgagagcgagctagggcgtctggccgctgaactgcaggcattgctgccggagcccctagttagtattacagtaaactcgcactttcttccaagggccccaggacttgaggtggaagaggccagtattcccgctgccgagcccgcaggctccgccgaggcctctgaagtggcccctggcgtgcaaccgctgccattttggtgctcccacatttcacggctggtgcggtcgctctccctgcttcttaagggggtgcacggcctagtgcaaggcgacgagaaaccctcaactcgtcctttacaggacacctgcagagaagcaagcgcctctccaccgaggagcgaagcccagcgtcagatccaggagtggggggtctcagtacgcaccttgagagggaatttcgaatccgcgagtggtcctctctgcggttttaatcctgggccttgtgaacccggagcccaacaccgacagtgcctctccggatgttggcccgcacttcctaagccacgctccggtctggcttcaggggagccgagacccggagatacagaagaggctagcgatagtggcatctcgtgcgaagaggtcccatccgaagctggcgctgcagcaggcccagatttggcatccctgcgtaaggaacgcatcattatgctgtttctctcccactggcgacgatcagcatacacgccagcactgaaaactgtggcctgcaggaccctgggggctagacacgcagggctgaggggccaggaggccgcaagatctcccggaccaccttctccaccatccgaagggccaaggctcggacacctctggcaacaacgtagtactatcacacacctgctgggaaactggaaggccatcatggctcacgttccagctcggcagctccgaaggttgagcagacagccccgtggagccctctctcctgagcagttccttccacacgtggacggcgctcctgtcccatattcttcactcagcttggacttatttatgttagggtactttcaacttctggagtgcgacctgccggcagaggaacgaaaattaagacacctgctgtgttttgaggtgtttgagcaccttggaacacatggttgggaagctgtgcgagcattccacaaggccgtcacagacgaggtggccgcaggcaggcgcgcttggaccgatggatttgaggatattaaggcacgttttttcggaagcagccagcgtcccgcttgggatactgaaccgggtaggaagagtggcttaaccctgcttggcccactgccccacgcagccgtgccctgtagcggcccagaaccgactgcacagcgcctaggcagccgttcgcagcaaggatcattcaatggagaggacatctgtggctatatcaatcggagtttcgctttctggaaggagaaggaagccgagatgtttaacttcggagagtag

SEQ ID NO: 55788 - DNA, 1914 bp, Artificial Sequence
  Description of Artificial Sequence: Synthetic coding sequence
atgtctctgagtcccgcatggcctggccatcctgaccaacccctgcctagagaacagatgacttctcccgctccacccagaataattacttcagcgactgcagatccagaagggacagagaccgctctcgctggggacactagcgacggacttgctgcactccagctggatggtcttccatcaggagatattgatgggctggtcccaaccagagatgagcgagggcagcctattcccgaatggaagcgtcaggtgatggtgaggaaactgcaagccaggctgggggctgaaagctctgctgaagcccaggacaatggcggttctagcgggccaaccgaacaggctgcgtggcgctattctcagacccatcaagctatcttgggcccattcggtgagctactgaccgaagacgatctggtgtacttggaaaaacagatcgcggacctgcagcttaggcgtcgctgtcaggagtatgaatccgagctgggtagactggccgcagaactacaggccctccttcctgagccccttgtgtccattacagtgaatagccactttttgcctagggcgcctggactggaggtggaagaggcctccattcctgctgccgagcccgctggttcagccgaagcatccgaagtggcgcctggggtccagcccctgccattctggtgtagccatatctcacgtctcgtaagaagcctgtccctgctgctcaaaggagtgcatgggctggtgcaaggcgatgagaagccaagtactcggccattacaggatacgtgtcgtgaagcaagtgcttccccaccacgcagtgaggcgcagcgtcagatccaggaatggggcgtgagcgtgaggacccttcgcggtaacttcgaatccgcaagcggaccactatgcggcttcaatccaggtccttgcgagcctggagcgcagcatcggcaatgtctgtctggctgttggccggcactaccaaagccccgatccgggctggcatccggagaacctagacccggtgataccgaggaggcttctgatagcggaataagctgcgaggaggtaccctcagaagccggagcagctgctggacctgatctggcaagcctgagaaaggaacgcatcatcatgctgtttctgagtcactggaggcggagcgcctatacacccgctctcaagacagtggcctgccgcacattgggtgcacggcatgcaggccttcgcggacaggaagctgcccgttcccccggacccccatcccccccatccgaaggtcctcgattggggcatctgtggcagcagcgatcgaccataacacatctgctcggaaactggaaagcaattatggcccatgtgccagctcgacagttgcgtcgtttgtctagacagcccagaggggcactctccccggaacagttcctgcctcacgtagatggggctccggtcccctattcctctctcagtttggacttatttatgctaggatactttcaactgttagagtgtgatttgcctgccgaagagcgtaagctcagacacctattgtgtttcgaggtctttgagcacctcggtacccacggctgggaggcggttagagcctttcacaaagcagtgacagacgaagtcgctgcaggtaggcgagcctggaccgacggcttcgaagacatcaaagcacggttctttggttccagccaacgaccagcatgggacactgagccaggcaggaagagtggattgaccctgctggggccacttccccatgcagccgtgccatgcagcggcccagagcccacagcacaaaggttaggatcaagatctcagcagggaagttttaacggagaagacatctgcggctatattaacagaagtttcgctttttggaaagagaaagaggcggaaatgtttaatttcggagagtag

SEQ ID NO: 55789 - DNA, 249 bp, Artificial Sequence
  Description of Artificial Sequence: Synthetic coding sequence
atgtctctttcacctgcctggcctgggcaccctgaccagccactgccacgggagcaaatgactagtccagcgcctcctcggatcattacttcagctactgctgacccggaggggaccgagactgccctggcaggggacacaagcgatggccttgccgcactacagctcgatggcctgccttctggggacatcgatgggctggtaccaactagagacgagcggggtcagcccataccagaatggaagtag

SEQ ID NO: 55790 - DNA, 1194 bp, Artificial Sequence
  Description of Artificial Sequence: Synthetic coding sequence
  Description of Combined DNA/RNA Molecule: Synthetic coding sequence
atggccggatacgaatacgtcagtccagaacagctggccggattcgacaagtataagtactctgccgtggataccaaccctcttagtctgtacgtgatgcacccattctggaacacaattgtgaaggtattccccacttggctagcccctaatttgattactttctccggattcctcctcgtggtctttaacttccttctcatggcctatttcgaccctgatttctacgcctctgccccaggccataaacatgtcccggactgggtctggatcgtggttggcattctgaatttcgtcgcttataccctggacggggttgacggcaagcaggctcgtaggaccaactcttcaactcccttgggggaactgtttgaccacggcttggacagctggtcctgcgtttatttcgtcgttactgtctacagcatattcggccgtggctcaactggtgtctccgtcttcgtgctgtatctactgttgtgggtggtcctgttctcattcatcttgtctcattgggagaaatataataccggaatcctgtttctaccatgggggtacgacatctcgcaggtgacaatctcattcgtgtatattgtgaccgccgtggttggcgttgaagcatggtacgaaccgtttctgtttaacttcctctacagggatctttttacagccatgattatcggctgcgccctgtgcgtgactttgcctatgtccctgctcaattttttccgatcgtacaaaaataatacattaaaattgaatagtgtgtacgaggccatggtccccctgttctccccatgtctgctattcatcctttctaccgcctggatcctctggagccctagcgacattttagagctgcacccgcgtgttttctacttcatggttggtacagcctttgccaactctacgtgtcaactgatcgtctgtcaaatgtccagcacccggtgcccaactttgaactggttgctcgtcccactttttctggtagtcctggtcgtcaaccttggcgtagcatcctatgtcgagagcatcctgctctatactctgacgaccgcttttacgctcgcccacatacactatggggtgagggtggtgaagcagctgagcagtcactttcaaatatatcctttcagtctgcggaagcctaattcggatugattagggatggaagaaaaaaatattggcctgtag

SEQ ID NO: 55791 - DNA, 357 bp, Artificial Sequence
  Description of Artificial Sequence: Synthetic coding sequence
atgcaccctttctggaacacaatcgtgaaggtcttccccacctggctagcacccaacttgataactttcagcggtttcttgctggtggtgttcaactttttgcttatggcctatttcgatccagacttctatgcctccgcccctggacacaaacacgtgcctgactgggtgtggattgtcgtcggtattcttaacttcgtcgcctacactctggacggtgttgatggcaagcaagcacggcgtaccaatagctccaccccactgggagagctgttcgaccatggattggattcttggtcatgcgtgtacttcgtggtgacagtgtattccatttttggcagaggatcaactgggtag

SEQ ID NO: 55792 - DNA, 1200 bp, Artificial Sequence
  Description of Artificial Sequence: Synthetic coding sequence
atggggaggaagtcactctacttgctgatagttgggatcctgatcgcgtattacatctatacaccactcccagataatgtggaggaaccatggcggatgatgtggataaatgcgcacctcaagacaatccagaatctggctactttcgtcgaacttctgggactacatcatttcatggacagttttaaagtggtgggttccttcgacgaggtacccccaacctccgacgagaatgtaactgtgaccgagacaaagtttaacaacatcttggtgagagtgtacgtgccaaaacggaaatctgaggctctccgacggggacttttctacatccacgggggagggtggtgcgtgggttcagcagccctgagcggctacgatctgctttctcgttggacggctgaccggctggacgccgtcgtcgtgtccacaaattatcgtctggcgccaaagtaccattttcccatccaattcgaagacgtgtacaatgcactccggtggttcctgcgaaaaaaggtgctggctaagtacggagtgaacccggagaggattggtattagcggggattccgccggtgggaatcttgccgcagccgtaacccaacagctgctcgacgatccggatgtgaaaatcaagctcaagatacaatcccttatctatccagctcttcaacctctggacgtggatttgcccagctaccaggaaaatagtaatttcctgtttctcagtaagtcactgatggttaggttttggtcagagtacttcactacagataggtccctggagaaagcaatgttatccaggcagcacgttcctgtcgagtccagccatctatttaaatttgtgaactggtcctcactccttcctgagcgctttataaagggtcatgtgtataataatccgaattacgggagcagcgaactcgccaagaaataccccggatttctggatgttcgcgcagccccactcctagcggacgataacaagttgcggggactgccactgacgtatgtaattacctgccaatacgatttgctcagggacgatggtctgatgtacgtcacgagattacgaaacacaggggtgcaagtgacacacaaccatgttgaagatggtttccatggcgcatttagttttctgggattgaagatatcacatcgactcattaaccagtatatcgagtggctgaaggagaacctgtag

SEQ ID NO: 55793 - DNA, 2745 bp, Artificial Sequence
  Description of Artificial Sequence: Synthetic coding sequence
atgtcccgcttctttaccacgggtagcgacagtgagagcgaaagcagtctgtcaggggaagaacttgttaccaaacccgtagggggaaattatggtaaacagccactcctcctttcagaggacgaagaagacaccaagagagttgtgagatctgcaaaagacaagcgttttgaggaactcactaacctgatcagaacaattaggaatgccatgaaaatacgagatgtaactaaatgcctggaggagttcgaactcctgggtaaagcctacggtaaggccaagagcattgttgataaggagggagtgcctcggttctatattaggattctcgctgacctcgaagattacctcaatgaactgtgggaggacaaggaaggcaagaagaaaatgaacaagaacaatgcaaaggcactgtccacactcagacagaagattcgcaagtataacagagacttcgagagccacatcacctcgtataagcagaatccggagcagtcagccgacgaggatgcagaaaaaaatgaagaggattctgagggatcctctgatgaggatgaggatgaagacggggtgtccgctgctaccttcctcaaaaagaaatcagaagctccatcaggcgaaagccggaaatttctgaagaagatggatgacgaggacgaagattctgaggacagtgaagatgacgaagactgggacacaggatcaactagctcggattcagacagcgaagaggaggaaggaaagcaaacagcattggcttccaggtttctgaaaaaagccccaacgacagacgaagacaagaaggctgccgagaagaagcgggaagataaggcaaaaaaaaagcacgaccgaaaaagcaaaagacttgatgaagaagaggaggaggacaatgaggggggtgaatgggagcgagtaaggggaggagtccctctggtaaaggaaaaacctaagatgttcgccaaaggaacggagatcacacatgccgtggtcatcaagaaactgaatgaaatcttacaagcccgtggaaagaaaggcaccgaccgggctgcacagattgagcttctgcagctgctcgttcagatagctgccgagaacaatctgggagagggcgtcatcgttaagattaagtttaatatcatcgcatctttatacgactacaatcctaatctggcaacatacatgaaacctgaaatgtggggcaaatgtcttgactgcattaacgaattgatggatatcctctttgccaatccaaatattttcgtgggggagaacatccttgaggaaagcgaaaatctgcacaatgcagaccagcccctccgggtgcgcggatgtatcctgactcttgtggagagaatggacgaggagtttacaaaaattatgcagaataccgatccacatagtcaagaatacgtagagcacttaaaggacgaggcgcaagtctgcgccatcattgagagggtccaaagatatctcgaggaaaaggggacaaccgaggaagtctgccggatataccttctacggatactgcacacctattacaagtttgactataaggcacaccagaggcagctgactcccccagaggggagttctaagagcgagcaagaccaggccgaaaacgaaggcgaggattctgctgtcctaatggagagactttgtaaatatatttatgcaaaagatcgtactgatagaattcggacgtgcgcaatcctttgccatatttaccatcatgccctgcattctaggtggtatcaggctcgcgatctgatgctcatgtcacatttgcaggacaacatccagcacgcagaccccccagttcagatactctacaaccgaacaatggtgcagctcgggatctgtgcttttcgccaggggttaactaaggacgcgcataacgccctcctggatattcagtcgtcaggtagagctaaggagctgctagggcagggcttgcttctgcgcagcctccaagagaggaatcaagagcaggaaaaagtcgagcgcagacgccaggtgccctttcatttgcacatcaacttagaacttctggagtgtgtgtatctcgtgtccgctatgctgttagagataccatacatggctgcccacgaatcagatgcacgtcgtcgcatgattagcaagcagtttcaccaccagcttagagttggagagaggcagcccctccttggtccccctgaaagcatgcgggaacacgtcgttgccgcaagcaaagccatgaagatgggggattggaaaacatgccatagttttatcatcaacgaaaagatgaacgggaaagtgtgggacctcttcccggaggccgacaaagtgagaactatgttagtgcgaaaaatccaggaagaatccctgaggacttatttgtttacttactcctccgtgtacgacagcatctccatggaaaccctgtccgatatgtttgaattagatctgccaactgtccactcaattatctccaaaatgattataaatgaggaacttatggctagtctggaccagcctacccaaaccgtagtgatgcaccggaccgaacctactgcacagcagaatttggctctacagttagcggagaagttgggtagtctggtcgaaaataatgagcgggtttttgatcacaaacaagggacctacgggggatacttcagagaccaaaaagatggataccggaagaatgaagggtacatgaggcgtggcggttatcgccagcaacagtcccagacggcttactag

SEQ ID NO: 55794 - DNA, 2745 bp, Artificial Sequence
  Description of Artificial Sequence: Synthetic coding sequence
atgtccaggttttttactacgggctccgacagtgaatctgagtctagcttgtccggagaagagttggtgactaagccggtgggcggtaactatggcaaacagccattgctcctgtcagaggacgaagaggacacaaagcgagtcgtgcgaagtgcaaaggacaagcggtttgaagagctgaccaacttgatcagaacaatcagaaatgccatgaagattcgggacgtcactaagtgtttagaagagttcgaactgctggggaaggcgtatgggaaggctaaatcaatagtggacaaggaaggagtgcccagattttacatacgcatccttgctgatctcgaagactaccttaatgagctgtgggaagataaagaagggaagaagaagatgaacaaaaataatgcaaaagcattgtccacacttaggcaaaaaatccggaaatacaaccgagatttcgagtctcatattactagttataaacagaacccagaacagtccgccgatgaagacgctgaaaaaaatgaggaggacagcgagggatcatcagacgaagatgaggacgaagacggggttagcgctgctaccttcttaaaaaaaaaatccgaggcaccttccggcgagtcgcggaagttcttgaaaaaaatggacgacgaagatgaggattctgaagactcagaagatgacgaggattgggacaccggctctacctcctcggactcggactccgaagaagaggaagggaaacagacagcattggcttcccggtttctgaagaaggccccaaccacagacgaggataagaaggcagctgagaaaaaacgagaggacaaggccaagaagaaacacgatcggaaaagcaaacgtcttgatgaggaagaggaagaagacaacgaaggcggagaatgggaacgagtgagagggggagtgccgcttgtcaaggagaagccaaaaatgttcgcaaagggcactgagatcacccacgcagtggtgatcaaaaaactgaacgagatcctgcaggcacggggaaagaaaggaactgatcgggctgcgcagattgaactgcttcagctcttagtgcagatagcagctgagaacaatcttggagaaggggtgattgttaaaattaaatttaacataatagcctccctgtacgattataacccgaacttggcaacttatatgaagccagagatgtggggcaaatgtcttgattgtattaatgagctgatggacatcctgttcgctaaccccaacatcttcgtcggagaaaacatcctggaggaaagtgagaacttacacaatgctgaccagccactgcgggttagaggctgcatactgacgttggtcgagaggatggatgaggagtttacaaaaatcatgcaaaacaccgatccgcattctcaggaatatgttgaacatctgaaggatgaggcccaggtgtgcgccataatagaaagggtgcaacgctacctggaggagaagggaacaaccgaggaagtgtgtcggatctacttgctgcgtatacttcatacttactacaagttcgattacaaggctcaccagcggcaacttactccccctgagggatcctcaaagtctgagcaagaccaggcggagaatgagggagaggactcagcagtcttaatggagagattatgcaagtacatatatgctaaggatagaaccgaccgaatcagaacatgcgcaattctgtgtcacatctatcatcatgcactgcacagtcgatggtatcaggcacgtgatctcatgttgatgtcccaccttcaggataacatacaacatgctgaccctcccgtacagatcttgtacaaccggactatggttcagctgggcatatgtgcatttcgacagggacttacaaaagacgcccacaatgcattgttggacatccagtcaagcggccgagctaaagaactgctgggacaaggcttactgcttcgctctctgcaagagagaaatcaggaacaggaaaaggtggagaggagacggcaggtgccatttcatctacatatcaatctggaactgctcgaatgcgtgtatctggtctccgctatgctgctagagattccttacatggccgctcatgagtcagacgcacggaggcgcatgatctctaagcagttccaccaccagttgagagtaggcgaacggcagcccttgctggggccaccggagagtatgcgagaacacgtcgtggccgctagcaaagcaatgaagatgggggactggaagacttgtcacagttttattatcaacgagaagatgaatggaaaagtttgggatctctttccagaggccgacaaggtgcggaccatgctcgtgagaaaaattcaagaagaaagcctgcgcacttatctgttcacctactctagcgtgtatgactccatcagtatggaaacgttgagtgacatgttcgagctcgaccttcccaccgtgcactcaatcatctccaagatgatcattaacgaggaactcatggcctctctggatcagcctacccagactgtggtgatgcaccgtacagaacccacagctcaacagaatttggcactgcagctggctgaaaaacttggatctctggtggagaacaatgagagagtgttcgatcacaaacagggaacctatggagggtatttcagggaccaaaaggacgggtacagaaaaaacgagggatatatgagacgaggcggatatcgccagcaacagagccagacagcctactag

SEQ ID NO: 55795 - DNA, 2745 bp, Artificial Sequence
  Description of Artificial Sequence: Synthetic coding sequence
atgtctaggtttttcaccactggcagcgattctgagagtgaatccagtttatctggggaagagctggtaactaagcctgtgggtggtaactacggtaagcaaccgctcctgctgtcagaggacgaagaagacaccaaacgcgtggtccggtcggctaaggacaagagatttgaggagctaaccaatctgatcaggactataagaaatgcaatgaaaatacgcgacgttaccaaatgcctggaggagtttgaactcttggggaaggcatatggcaaagcaaagtctatcgtagataaagagggcgttccgaggttctatatcagaattctggcggatctcgaggattatctgaatgaactgtgggaggacaaagaggggaaaaagaagatgaacaagaataacgctaaggctctttctactcttcggcaaaagattcgaaaatataatagggatttcgagtcccacatcaccagctacaaacaaaaccctgagcagagcgccgatgaggatgcggaaaaaaacgaagaggattccgagggctccagtgacgaggacgaggatgaggacggtgttagtgctgccacgttcctcaaaaagaaatctgaagctcccagcggagagagccggaaattcttaaaaaagatggatgacgaagacgaggatagcgaagactccgaggacgacgaagactgggatactggcagcactagtagtgactcagacagtgaagaggaagagggtaagcagaccgctcttgcctcaagatttttgaagaaggctcctacaactgacgaggataagaaggccgcagagaagaaaagggaggataaggcgaagaagaagcatgacagaaagtccaagcggttagatgaagaagaagaggaagataacgaaggaggcgaatgggaaagagtgcgcggaggagttcctcttgtaaaggaaaaaccaaaaatgttcgctaagggtacagaaataacacacgctgtggtgataaaaaaactcaacgaaattctccaagcccgaggcaaaaagggaacggaccgcgcagcccaaattgagctgctacagcttttagtgcaaatcgcggcagagaataatcttggggaaggggtgattgtgaagatcaagttcaatattatcgcttccctctacgattataatccgaacctggccacttacatgaaaccagagatgtggggcaagtgtctggactgcattaacgaactgatggatatcctgtttgctaaccctaacattttcgtgggggagaacattttggaagagtcagagaacctgcataacgctgaccagcccctccgagtgagaggctgcattctcactctggtggagagaatggacgaggagtttacaaaaatcatgcagaataccgatccccactctcaagagtacgtggaacacctgaaggatgaggctcaagtgtgcgcaatcattgaacgcgtgcagcggtacttagaggaaaagggaactaccgaggaggtatgccgtatttacctgttaagaattctccacacctattataaattcgactacaaagcacatcagcggcagttaacacccccagagggctctagcaagtctgagcaggaccaggccgaaaacgagggcgaggatagcgccgtgctgatggagcgtctgtgtaagtacatttacgcaaaagacagaactgaccggatcagaacttgcgctatcctctgtcacatctatcaccacgccctgcatagcagatggtaccaagctcgagacctcatgcttatgagccacctgcaggataatatccagcacgccgatcctcccgtgcagatcctgtacaatcgtacgatggtccaattgggtatttgtgcattccgccaaggcttgaccaaggatgcacataacgccctgctcgacatacaatcgtccgggagggccaaagagctgctgggacagggacttcttctccgcagcctacaggagagaaaccaagagcaggagaaagtggaaaggcggaggcaggtgccgttccatttgcatattaatttggagctgctggagtgcgtctacctggtctccgccatgctgctggaaatcccttacatggcggctcatgagtccgacgcacggagaagaatgatttccaaacaatttcaccaccaattaagagtaggcgagcgacagcccctcttgggccctcctgaatctatgcgggagcatgtggttgcagccagtaaggcgatgaaaatgggagactggaaaacttgtcactctttcattatcaatgaaaaaatgaacgggaaagtctgggacctgttccccgaagccgataaggtgcgcaccatgctggtgcgcaagatccaagaggagtcgctccgcacctatctttttacatactcttcagtgtatgacagtattagcatggagacactgtcggacatgtttgaacttgacctgcctacagtgcattcaattatctcaaagatgattataaatgaagagttgatggcttctcttgatcagcctacacagactgtcgtgatgcatcgtactgaacccactgcgcaacaaaatctcgctctccaactggccgagaaactggggagtcttgtcgagaacaacgaaagagtttttgatcacaagcaaggcacctatggcggatacttcagggatcagaaggatggctatcgcaagaatgaaggttatatgcggaggggaggatatcgacaacagcagtcacagacagcttattag

SEQ ID NO: 55796 - DNA, 2289 bp, Artificial Sequence
  Description of Artificial Sequence: Synthetic coding sequence
atgtctaggttctttaccaccgggtctgatagtgaatccgagagctcgctttccggggaggaattggtgacaaagcccgtcggagggaactacggaaaacagcctcttttgttgagcgaggacgaggaagataccaagcgagtggtgagaagcgcaaaagacaagcggtttgaggagctgacgaatttgattagaactatccggaacgccatgaaaatcagggacgtgacaaagtgtctcgaggagtttgaattgctgggtaaagcctacgggaaggccaaaagtatcgttgacaaagagggggtcccacgcttctatatcaggattctggccgatttggaggactatctgaatgagctttgggaggacaaggagggcaagaaaaagcacgatcgtaagagtaagagattggacgaggaggaggaagaggataatgaaggaggtgaatgggagcgagttcgtggaggagtgccgctggtgaaagagaagcccaaaatgttcgccaagggcaccgaaatcacacacgccgtggttattaagaaattaaacgagatcctgcaggcaagaggcaagaagggcactgatagggccgcacaaattgagctgctgcagttgctggtacagattgctgctgaaaacaatttaggtgagggggtaatcgtgaaaatcaagtttaacataattgcctccctctacgactacaatcctaacctcgctacctacatgaaacccgagatgtggggaaaatgcctcgactgcatcaatgagcttatggatatcctgttcgcgaacccgaacatcttcgtgggtgaaaacatcctcgaggaatcagaaaatttacacaacgccgaccagcctctgagggtgaggggctgcatcttgacactagtagagcgcatggatgaggaatttactaagattatgcagaatacagatccccattcacaggagtacgtggagcaccttaaggacgaggcccaagtgtgcgcaattatagagagggtccaaaggtacttggaagagaagggaacaacggaggaagtatgccggatatacttgctccggattcttcacacttactataaattcgattacaaggcccaccaaagacaactcacaccaccggaaggttcatccaagagcgagcaggatcaggccgagaatgaaggggaggactcagctgtcctgatggagcggctgtgtaagtatatttacgccaaagacaggacggatcgaattcggacatgcgcgattctctgtcatatctatcaccatgcgctccactctaggtggtaccaggcaagggatctgatgctgatgtcgcatttacaggataacatccagcacgcggatcctccagtccaaatactatataatagaacgatggtgcaattaggaatctgtgcctttagacaggggctgacaaaagatgctcataacgctctgctggacatccagtccagtgggagagcaaaggaactccttggccagggacttctgctgcgctcacttcaggaacggaaccaggaacaagagaaggtcgagaggaggcgacaggtgccctttcatctgcacataaacctcgaattgctggagtgcgtgtacttggtctccgccatgctgctggagatcccctatatggctgctcatgagagtgacgcgagacggaggatgatttctaagcaattccatcatcagttacgcgtgggagaaaggcagcccctactaggccctccggaaagcatgcgggaacacgttgtcgccgcatctaaagccatgaagatgggcgactggaagacctgtcactcgttcattatcaatgaaaagatgaatggaaaagtgtgggatttgttcccagaggccgacaaagtcaggaccatgctggtgcggaagattcaagaagagtctctcaggacttatctgttcacttactctagtgtctatgacagtatcagcatggaaactctgtccgacatgtttgagctggacctccctaccgtgcactcaatcatatccaaaatgatcattaacgaagaactcatggcgtccttagatcagcctacacaaactgtggttatgcaccggaccgagccgacagcccagcagaatctagctcttcaactcgccgaaaaactgggctccctggtcgaaaacaatgaaagagtgtttgaccataagcagggcacctacgggggatacttccgagaccagaaggacgggtacaggaaaaatgagggatatatgcgcagaggcggatacagacagcagcaaagccagaccgcttactag

SEQ ID NO: 55797 - DNA, 2700 bp, Artificial Sequence
  Description of Artificial Sequence: Synthetic coding sequence
atgagccggttttttaccactggatctgattctgagagcgaaagcagcctcagcggagaggagctggttaccaagcctgtcggaggtaattatgggaaacagcctctccttctttctgaggatgaagaggacacaaagcgggtagtgaggagcgccaaggacaagagatttgaagaattgaccaatctcatcaggactatccgcaacgctatgaagatcagagacgttaccaaatgtctcgaggaatttgaactgctcggcaaagcctacggaaaggcaaagagtatcgtcgacaaggaaggagtgccgaggttttacataagaatcctggccgatctcgaagattacttgaacgaattgtgggaggacaaagagggtaaaaagaaaattcgaaagtacaacagggatttcgaaagtcacatcacctcttataagcaaaatcccgagcagagcgccgacgaggacgccgagaagaatgaagaggattctgagggtagctcagatgaggacgaagatgaagacggcgtttctgccgcaacgttcctaaagaagaagtcagaggctccttcaggcgagtcacgaaagtttctgaagaagatggatgatgaggatgaggatagcgaagattctgaagatgatgaggattgggacaccggctcaaccagtagcgacagcgattcagaggaagaagaaggtaagcaaaccgccctggcctctcggttcctaaaaaaggctcccactactgatgaggacaagaaggcggctgagaaaaaacgggaggacaaagctaaaaaaaaacacgatcggaaatccaaaagattagatgaggaagaagaggaggataatgagggtggagagtgggaaagggtgcggggtggcgtaccattggtgaaggaaaaacccaaaatgttcgcaaaaggcactgaaatcactcacgcagtcgtaataaagaaactcaatgaaattttacaagccaggggcaagaagggcaccgaccgcgcagcccaaattgaactcttacagctgttggtgcagattgcagcggagaacaatttaggggagggtgtcatcgttaaaataaagttcaacatcattgccagcttgtacgattacaatcctaatctggccacctatatgaaacctgagatgtggggtaagtgcctcgattgcatcaacgaactcatggatattctgtttgcgaaccccaatatattcgtcggagagaatattctggaagaatccgaaaacctccacaacgctgaccagcctctgcgcgtgcggggttgcatcctgacgctggtggagcgcatggatgaagagttcaccaagattatgcagaatacggatccgcactcccaagaatacgttgagcatcttaaagacgaagctcaagtctgtgcaatcatagaacgcgtgcagaggtatctggaagagaaagggacgacagaggaagtctgcagaatctatctgctgcgcatcctgcatacttattataagtttgactacaaggcacatcagaggcaacttaccccccctgaaggcagttctaaatccgaacaggatcaggccgagaatgaaggagaagactcagccgtgctcatggaacgactttgcaagtatatctatgctaaggaccgaacggaccggatccggacatgcgctattctgtgccatatctaccaccacgctttacatagccggtggtatcaggcacgagatctcatgctgatgagccacttacaggacaacatccagcatgcagatcctcctgtgcagatactctataacagaacaatggttcaactcggcatttgcgcattccgtcagggtctcacaaaggatgcccataacgccctgctggatatccagagctccggcagagccaaggaactgttggggcaggggcttctgttgcggtccctccaggaaaggaatcaggaacaggagaaggtggagcgcagacgacaggtgccattccatctgcacatcaatttggaactgttagagtgcgtgtatctcgtttctgccatgctgttggaaatcccctacatggctgcgcacgaatcggacgcacgcagacgcatgatttcaaaacagttccatcaccaactcagagtgggcgagaggcagcctctgttgggaccacccgagtcgatgcgcgaacatgttgttgccgcatctaaagccatgaaaatgggtgactggaaaacctgtcactcgtttatcatcaatgaaaagatgaatgggaaggtttgggatctgtttcccgaggcagataaagtcagaacaatgctagtccgtaagattcaggaagagtccctgcggacgtacctgtttacttactccagcgtttacgatagtatttctatggagacgctgagcgacatgtttgaattagatctgcccacagttcactccattattagtaagatgatcatcaatgaggagcttatggctagtctcgatcaaccgacacagaccgtcgttatgcaccggactgaaccaactgctcagcagaatctggccttgcagctggccgaaaaactcggctctctcgtcgaaaataatgagcgtgtgtttgatcataagcagggaacgtacgggggatacttccgggatcaaaaggacgggtaccgtaaaaacgaggggtatatgagacgcggaggctaccggcagcagcaatcacaaacagcctactag

SEQ ID NO: 55798 - DNA, 729 bp, Artificial Sequence
  Description of Artificial Sequence: Synthetic coding sequence
atgttagctgtggaggttagcgaagccgaaggtgggattcgcgagtgggaagaggaagaaaaggaagaggaggccgctgagcggacacctactggtgaaaaatctccaaatagccctagaaccctcttgagcctgcgcggtaaagcccgtactggcggacctatggaggtaaaactggagctgcaccccctccaaaaccgatgggcactctggttctttaaaaatgacaggtcacgggcttggcaggataacctgcacttagtgaccaaagtggacaccgtggaggatttttgggccttgtattctcacatccagttggcatccaaactcagtagcggctgcgattatgctttgttcaaagatggaatccagcctatgtgggaagattctcgcaacaaacgcggaggccgttggctagtctcccttgccaagcagcaaaggcacattgagttggacagactgtggctggagacacttctgtgtttaattggggaatctttcgaggagcatagccgcgaggtgtgtggggctgttgtgaatatcaggacaaagggagataaaatcgctgtttggacacgcgaagcggaaaaccaagcaggagtgctgcacgtgggtagggtatacaaggaacgcctagggttgtccccgaagacgataataggctaccaggcgcatgctgacactgctacaaagtctaactccttggcaaaaaataagttcgttgtctag

SEQ ID NO: 55799 - DNA, 729 bp, Artificial Sequence
  Description of Artificial Sequence: Synthetic coding sequence
atgttagctgtggaggtatccgaggccgagggcggaatcagggagtgggaggaagaggagaaggaagaggaagctgctgagcggacgcccaccggagagaaatcccccaatagccctcggaccttgctctccctacgtgggaaggcccgaaccgggggaccgatggaagtgaaactcgagctgcatcctctacagaaccgctgggctctgtggttctttaaaaatgataggtcaagggcatggcaggacaatcttcatctggtcaccaaggtagacacggtagaagatttctgggctctgtattcacacattcagctggcctctaagctgtcttctggctgcgactacgccttgtttaaagatggcattcaacccatgtgggaagattctaggaacaagaggggaggtcgttggctagtgtcactggctaagcagcagcgacatatcgaactggaccgtctttggctggagacacttttgtgcttgatcggggagtccttcgaggaacactcaagagaggtctgtggtgctgttgtgaacatcaggaccaaaggcgacaaaatagccgtgtggactagagaggccgagaaccaagccggagtgctccacgtaggcagggtgtataaagagagacttggcctgtcccccaagaccattattgggtatcaggcacatgcagacacggccacaaagtctaacagcctggccaagaataagttcgtggtgtag

SEQ ID NO: 55800 - DNA, 273 bp, Artificial Sequence
  Description of Artificial Sequence: Synthetic coding sequence
atgctggccgtcgaagtgagcgaggccgaaggaggtattcgcgagtgggaggaagaagagaaagaagaggaggccgctgagcgcacccccacgggggaaaaatcccctaatagtcctcggacactgctgtccctgcgaggtaaagctagaaccggaggtccaatggaagtgaagctggagttgcatcctttgcagaacagatgggcactctggttttttaagaacgacagaagccgcgcttggcaagataacttacatctggtcactaaatag

SEQ ID NO: 55801 - DNA, 525 bp, Artificial Sequence
  Description of Artificial Sequence: Synthetic coding sequence
atggcggctgcaatggtgccagggcgtagcgagagctgggaaagaggcgagcccggaaggcccgcactgtacttctgcggttccatcagaggaggtcgggaagatcggacactgtatgaaagaatcgtatcacggcttcggcgtttcggaaccgtgttgacagaacacgtggccgctgccgaactgggcgcaaggggggaggaagccgctgggggagaccggcttattcacgagcaggaccttgaatggttgcagcaggccgacgtggtggtggccgaagtgactcagcccagcctgggtgtcggctatgagctgggcagagctgtcgctttcaataagaggatcctatgcctatttaggcctcagagtggcagagttctgagtgcaatgatccgcggagccgctgatgggtctcgttttcaagtttgggactatgaggaaggtgaagtggaggctcttttggaccggtacttcgaggccgacccacccggacaggttgccgcaagccctgatccaactacatag

SEQ ID NO: 55802 - DNA, 423 bp, Artificial Sequence
  Description of Artificial Sequence: Synthetic coding sequence
atgtcacggtcccggcagcccccactggtgaccggcatttcccccaatgagggcattccatggacgaaggtgaccattcgcggagagaacttaggcactggcccaactgatctgatcggcctcactatctgtggacataactgccttctgaccgccgagtggatgagcgcgtcaaaaatcgtgtgcagggtcggccaggccaagaacgacaagggcgacatcatcgtcaccacaaagagcggaggacgaggcacaagtactgtctctttcaaactattgaaacctgagaagataggcatcctcgaccagtccgccgtgtgggtggatgagatgaattattacgatatgcgcaccgacaggaacaaagggatcccccctctcagcctgcggcctgcgaaccccctcggaatagaaattgaatag

SEQ ID NO: 55803 - DNA, 1560 bp, Artificial Sequence
  Description of Artificial Sequence: Synthetic coding sequence
atgttggacctggataatgacacaaggccgtcggttctggggcatctgagtcaaacggcttcactgaagaggggaagtagcttccaatctgggagagatgacacatggaggtacaaaacgcctcaccgggtggcttttgtcgagaaactaaccaagctggttttatcacagctgccaaatttttggaagctgtggatctcctacgtgaatggatcactttttagtgagaccgcagaaaaaagcggccagatagagaggagtaagaacgtgcgacagcggcagaacgattttaaaaaaatgatacaggaggtgatgcacagccttgtaaagcttacacgcggtgctctgttgccactcagcatcagggatggggaggccaagcagtatggtggctgggaggttaaatgcgagctcagcgggcagtggctcgctcatgctatccagacagtcagactgactcacgagtcactgaccgctctcgagatccctaacgatcttctgcagacgatccaagacttaatattggatcttcgtgtgcgatgcgttatggccacactgcagcatacagcagaggagatcaagcgactcgccgagaaagaggactggattgtggacaatgaggggctgacaagtctcccatgccagtttgaacagtgcattgtctgtagccttcaaagcctcaagggagtcctcgagtgcaagcccggtgaggcatcagtgttccagcagcctaagacccaggaagaggtctgtcagctcagcataaatataatgcaggttttcatttactgtctcgaacagctgtccacaaagccagacgccgacatcgatacaacacatctgagcgtggatgtcagtagtcctgatctgttcgggagcatacatgaggattttagtctcacatccgagcagcggctgctgatcgtcctgagcaactgttgctaccttgagcgccacacatttctaaacatcgccgaacactttgaaaaacataactttcagggtattgaaaaaatcacccaggtctcaatggcatccctaaaagagctcgatcagaggttatttgagaactacattgagctcaaggccgatcccatcgtcggcagccttgagccaggcatctatgcagggtacttcgactggaaagactgtctgccccctaccggagtgagaaattacctgaaggaagcgctcgtgaatataatcgctgtgcacgcggaagtctttacaatatcaaaggagctggttcctcgagtactctccaaggtcattgaggcggtgagcgaagagctttcacggctcatgcagtgtgtctccagttttagcaaaaacggcgcactgcaggccagactggagatatgcgcactgcgggacaccgtcgcagtatatctgacccccgagagcaaatctagctttaagcaagccctggaggctctaccgcagctctctagcggtgcagacaaaaaattactcgaggagttattaaataagtttaaaagctcaatgcacttgcagctgacctgctttcaggccgcaagcagtactatgatgaaaacttag

SEQ ID NO: 55804 - DNA, 1230 bp, Artificial Sequence
  Description of Artificial Sequence: Synthetic coding sequence
atggctgctctcgaaaacggcgaactgggcccattgctttcccccggtactctgcgcggtctggaggatgagtgcgtcactgatgtgaaagcacagacaagagccgctcttctacgcgtgttgcaggaagacgaagagcattggggttccctcgaagaccagccctcaagcctggctcaggatgtatgtgagcttcttgaagagcacacggagcgcgctccgaggatcagtcaggagtttggagagcggatggcccattgctgtctgggcggacttgccgagttcctgcaatctttccagcagagggtggagaggtttcacgagaaccccgctgtgcgggagatgctgcccgacacttatatttccaagacgatcgcactggtcaattgtggtccaccactgcgagccctggcagagagactagctagggtgggcccacctgaatcagaacccgcaagggaggcgtccgcgagtgcccttgaccatgtgactcgcctctgccatagagtggtggccaatttgctcttccaggagctgcagcctcactttaataaactgatgcgcagaaaatggctatctagtcctgaggctctagatggaatcgtcggaacacttggggctcaggccttagccctccgcaggatgcaggacgaaccctaccaggccttggtcgcagagttgcataggcgagccctcgtcgagtatgttcggcctctcttacggggtaggcttcgatgttcatccgctagaacacggagtagggtagccggaagactgagagaagatgcagcccagctgcagaggctgtttcgacgattggaaagtcaggctagctggctcgatgcagttgttccgcacctggccgaagtgatgcagctggaggacaccccatctatacaagttgaagtgggtgtcctggtgagggattaccccgatattaggcagaaacacgtggcagcattattggatatcaggggattgcgtaataccgcagccagacaagaaatcttagcagtagctcgcgatctggagctgtctgaggaaggcgcactgtctcctccccgagacagagcgttttttgccgacattccagtcccacgcccttcattttgcctctctctgcccctcttcttaggccgtctgcccctgagtcgcctggccagacctagcctcgcctgtctgcctagaccaagacctccttccctggccaggccgcgagcccagaggtag

SEQ ID NO: 55805 - DNA, 1230 bp, Artificial Sequence
  Description of Artificial Sequence: Synthetic coding sequence
atggccgctttggagaacggagaattggggccacttctgagtcccggaacgctaagagggctggaggatgagtgcgtgacggatgtgaaggcgcaaactagagcagccctgttacgcgtactccaggaagatgaagaacactggggctcacttgaggatcagcccagttcactggcgcaagacgtatgtgagctgctcgaggagcacaccgaacgggctcccagaataagccaggagtttggcgagcgtatggctcactgctgtcttggcggattagccgagttcctccaatcgtttcagcagagagtcgaacggttccatgagaacccagccgtgcgagaaatgttgcctgatacatacataagcaaaacaattgccctggtcaattgtgggcctccacttcgcgctctcgccgaacgactcgccagagtgggaccacctgaatctgagcccgcacgtgaggccagtgcctccgctctggatcacgtcactagactgtgccatagggtcgtcgcaaatttgcttttccaagagctgcaaccccactttaacaagctgatgcgtaggaaatggctgagctccccagaggctctggacggcatcgtgggaactctcggcgcacaggctttggctctgcggcgaatgcaggacgaaccctaccaggcgctcgtggccgagttacacagacgtgcactagttgagtatgtgcgccctcttttgaggggcaggctgcggtgcagtagtgccaggactcgaagtagggtggctggtcgccttagagaagatgccgcacagctacagagactgttccggaggcttgaatcacaggcctcatggctggatgccgtggtgccccacttagcagaagttatgcaactggaagataccccgagcatccaggtcgaagtgggcgtgttggtccgtgattacccagatattcggcagaaacatgtggccgcactcttggacatcagagggcttcgaaatacggccgctagacaggaaattcttgcagtggcccgagatctggaattgtccgaggagggtgccttgagcccgccaagggaccgagccttcttcgcagacattccggtcccgagaccctctttctgtctctctctccctctgtttctgggtaggctgcctctgtctcgcttagccagacccagcctggcatgcctgccacgtcctcgtcctccaagcttggctcgcccaagagctcagaggtag

SEQ ID NO: 55806 - DNA, 2169 bp, Artificial Sequence
  Description of Artificial Sequence: Synthetic coding sequence
atgccttctccccagactgacactcctggtccggaattgcagtctccgaaggaggccgaagaaccacaaacacctgcgcaaggatcccggagaacatcgagtcgaaaggagccaaacgcacacagaaaagatggcaccaggctgggtctgggctctctgaggcaagcgttttcaagagcgtcccagagagcactcacgcaggtgtccaaagaggataccggcttgttcagacgttccagttgctctctatttcgctcttttaggcaggctttgaatgatggccctgcaacgggtcattcccaggccacgcctgaagtgccgtccggggtcatgaatggcgtttctcagcaagcctctaccggagctgcctcagaagaacttaagcccgaggctgagggcaaaagcgtggccgacctaatcactgaacgccagctgctggcagccttcgagcagttactccggcttgagaccctcctggttgccgagaaggcttcaagaacttttgagcaggatcctacagcgttcgctaggcgcgctatggacgtgtgtcttctctatgacggccttgccgcagagatcggggctattgtcagagaaacactcgatagcgatggggtcgacgcggcagccttggctgaattggcccgagttgtaagcgcagaggaggaggctcacccatctcccccagatgatggtgacttcctgagaacaccgagacggtggagacagcactgggaagaggcagttagaaggagcgcacaggagcgggtgaggagacccggtgcgggatgggcattcggggaagccgagggagcctcaggcctggcccagcttctcgcggaactcggaggcctggtgcgaagagatctgcagaaagtgagacaggaagtgcagcctgcttacgctgccgcaggctttcccgcttgggaggtctatctcagagcctttcattccgcggtggcccagcggctgcaggaactggcaagggatgcaagaggatgtgaacaactgtacatcctgctggattgggctgccaatgtgtatgggtccccagactttttaggcgcaccaggactcgccttgcctgcagaaccgctccctcccctgcttgcgcctgacgtgtgggcacggctagaaagcgattacaccagtttccttgaagctaagatcgccagttgttttgattcaatcctccaactggagcagtcccactgggcagctgcagaagtccctgaggtgctgcaggggctgtaccaggcccctctctccatggatgtgcatatgctggttgctgagcatgtgaaagccgctggcgcaatttcggctgaactcgaagctaccacgctgcgaatttgcacacgtgctctgggtctgtttgtgccgcgtttcgagaaagctttcctggccagcgaagccgtctcagagccgcacttaggggcatacattaacgcatgcgaggaactaagaaccagtctcctgagccgatttccgggaacccaggaggaactggagaaacccctcgtgaccgcaacttgcagcttccagaagcatttgctccagggtttgcagagggagctccagcctttgtttcgggtagtgtgcactcgcgactggttaacccaggattggctgcatccattgatggacaaagtggtgacgtttgctggccatttacaacgcgtagctcggcctcgcgcacaggaaacccttcaagaggtccatcgatttgtcgtgagggaatatctggcaagggccttgagacctcgagagcgattcaggggtatggagaggatgcatgggtctcagaagatgagtctagacgcgcaggctataagcgacaccttccaaggcctgggatcggaggccacctggctcgatcaggccatccaatgtgtggctgagatcctcggtgagacttacaaggatgatatccagcgccacctcgagaccttaattaggagttatcctgacatcaggcgggaccacatcttggccatcctcgctctgcggagactcggacgacaacgcaaccagcacctgctgcaacacacacaagatttgctgcgcgcagctgccggagccgctggtgcagaagcccctagagggagagttctttttgaagaaataaaggttccttccgctatggccgtgttaatcacatgcgtgtag

SEQ ID NO: 55807 - DNA, 1545 bp, Artificial Sequence
  Description of Artificial Sequence: Synthetic coding sequence
atggaggacagtgaatttctcgcatatgtagaactgctggatgaggtggagcagggctcggtgcgcgcaaaggcttcttctgtatccttgcacgccgaaaggacttggatggagaaaatgaaggttgaggatctgaacgtatgtgagccggctagtcccgcacctgaagccccagccacaagcctcctgaacgacctgaagtattctccttcagaggaggaggaagtgacgtacactgttattaatcagtttcaacagaaattcggggcagctatcttacatattaaaaagcagaacgttttaagcgttgcagcagagggcgctaacgtgtgccggcatgggaagctttgctggttacaggttgccaccaactgcagagtctacctgttcgatatctttctgctggggtctagagcgttccacaatggcctacagatgattttggaggacaaacgtattctcaaggtgatacacgactgtcgttggctcagcgattgtctttcacaccagtatgggatactcttgaataatgtgttcgatactcaggttgctgatgtgctccaatttagcatggaaacaggtggttatctgcccaactgcataacaacactgcaggagtcactgattaagcacctccaggtcgcacccaagtacctgtcttttctggaaaagcgccagaagctcattcaggagaaccccgaagtatggtttattcggcctgtatcaccaagccttctcaaaattctggctctggaagccacgtacttactcccgttgagattggccttactcgacgagatgatgagcgatctgaccaccttagtggacgggtatctgaacacctaccgtgaaggaagcgcagacaggttgggaggcaccgaaccaacatgcatggagctccctgaagagctgttgcagctcaaagattttcagaaacagcggagggaaaaggcagctagagaatacagggttaacgcgcagggcctactgattaggacagtgttgcagcccaagaagctcgtgaccgagactgctggaaaagaggagaaggtgaaaggtttcctctttggaaaaaattttagaatagacaaagccccatcatttaccagtcaggacttccatggtgatgtgaatctgttgaaagaagagtctttaaataagcaagctacgaacccccagcacctccctccaaccgaggaaggagaaacaagcgaggacagttcaaacaaactgatttgtactaaatcaaagggtagcgaggatcaacgtatcactcagaaagaacactttatgacaccaaagcacgaatttcaggccagtttgtcattaaaagaggagacagagcagctgctgatggttgagaacaaggaggacctgaagtgtactaagcaggcagtatctatgagtagctttccccaggaaactagggtttccccatcagacacgttttaccctattagaaagacagtcgtgagcaccctgcctccctgccccgcattagagaagatcgatagttggatatctcccttcttaaacctcccttag

SEQ ID NO: 55808 - DNA, 1719 bp, Artificial Sequence
  Description of Artificial Sequence: Synthetic coding sequence
atggacccgtcttctgattaccatttcctgagtcagatcttgtggaaaagggttaagctcacccttgtatgtggggtcttcgagggggtgctgcagcatgtggacccaaacaagattgtcgtcctaaagaaggtcaagaatgtggaaacaggacgaagtgtgccaggtgtaaagctgttcttcggccacgagatcgtgaacgtcgaactgctagacgaggttgaacaggggtcagttcgagctaaggcctcctctgtttctctgcacgccgaacgcacatggatggagaagatgaaggtggaggatttgaacgtgtgtgaacctgcctcccccgctccagaggcgccagctaccagcttgctcaacgacctgaagtatagccctagtgaggaagaggaggtaacttacactgtcattaatcagtttcaacaaaagttcggcgcagccatcttgcatattaagaaacagaacgtgctgagcgttgccgctgagggcgcaaacgtgtgccgccatggcaaactgtgctggctccaggttgccaccaattgcagggtgtacctgtttgacatattcctactcggctcccgagccttccacaatggcctgcagatgatactcgaagacaagcgaatcctcaaagtgatacacgactgtcgctggctgagcgactgcctgtcccatcaatacggtatcctgctgaacaatgttttcgacacccaggtggcagacgttctgcagttctccatggagaccggcggttatttaccaaattgcatcacaaccttacaggagtcactgattaaacatctccaggtagctccgaagtatctgagctttttggaaaagcggcaaaaactaatccaggaaaaccctgaagtctggttcattagaccagtctccccatctcttctgaaaattcttgcgttagaagccacatacctgcttccactgcgccttgcgctgctggatgaaatgatgtcagacttgactactttggttgacggttaccttaacacttatcgtgaagggtctgcagacaggctgggcggaactgagccgacatgcatggagttacctgaggagctgctccaactaaaagatttccagaagcagaggagggagaaggccgcacgtgaataccgcgtgaatgctcaggggcttctgattcgtacggtcctgcaacctaaaaaactggttactgagacggcaggcaaggaggagaaagtaaaagggtttctgtttggtaaaaattttcggatagataaggcgccatctttcacatctcaggatttccacggagacgtgaatctgctgaaggaagagagcctgaataagcaggcgaccaatccacagcacctacctcctaccgaggaaggagagaccagtgaagattcctctaacaagctcatttgtaccaagtctaagggctctgaagatcagcggatcacacagaaagaacacttcatgaccccaaagcacgagtttcaggcctccctgagcctcaaggaggaaacagaacagctcctgatggtcgagaacaaggaagatcttaagtgtactaagcaagccgtgagcatgagctccttcccacaggaaacaagagtctcgcctagtgacacgttctatcccattcgcaagaccgttgtttccaccttaccaccgtgccctgcactggagaaaatcgattcctggatttcgccatttctcaatctcccctag

SEQ ID NO: 55809 - DNA, 816 bp, Artificial Sequence
  Description of Artificial Sequence: Synthetic coding sequence
atgtctcgccagaatttggtggctctcaccgttacgacactgttgggtgttgctgtgggtggattcgtcctgtggaaagggatacaacgacggagaaggagcaaaacgtctcctgtgacccagcagccacagcaaaaagtgctggggagccgggaactgcctccacccgaggatgatcagctccatagttctgccccacggagcagttggaaggagcggatactaaaagctaaagtcgtgactgtgtcgcaggaggcagaatgggaccagatcgagcctctccttagatccgagctcgaggactttcctgttctgggaatcgactgcgagtgggtcaacctggagggaaaagcttctcctctctccctcctgcagatggcctccccctccggactgtgtgtgctggttagactgcccaagctaatttgcggcggaaagacgttgcctaggactctcctggatatcttggcagatggaactatcctcaaagtgggggtgggctgctctgaagatgcctcaaagctcctccaggactatggattggtcgtcaggggttgcctagatctgcgataccttgctatgagacagagaaataacttgttgtgtaacgggctgtctctgaaatcactcgccgagacagtcctgaacttccccttggataaatctctgcttctaagatgcagtaactgggatgctgagacactgacggaggatcaggtcatctatgccgcaagggacgctcagattagcgtcgcactgttcctgcatcttttaggctacccatttagcaggaactcacccggtgagaagcggtag

SEQ ID NO: 55810 - DNA, 1866 bp, Artificial Sequence
  Description of Artificial Sequence: Synthetic coding sequence
atgagtcggcaaaacctagtggccctgacagtgaccacactactaggggttgcagttggtggatttgtgctctggaaagggatacagaggcgtcgtcggagcaagaccagccctgtgactcagcagcctcagcagaaggtactcggctcacgggaattacccccacccgaagacgaccagctccactccagtgccccacggtcaagctggaaagagcgaatccttaaagcaaaagtggtgactgtcagccaagaagccgagtgggatcaaattgaacccttgctacgcagcgagctggaagattttccggtgctaggaatagactgtgaatgggttaacctcgaagggaaagcgtctcctttaagtctgctgcagatggcaagtccttctggattgtgtgtgctcgtgcgcctgccaaagctgatctgcggcggaaagaccttgcccaggacgcttctggacatcctcgccgatggcactattcttaaggtgggcgtgggatgctctgaggacgccagcaaactattacaggattacgggttggtggtccggggatgtcttgaccttcgataccttgcaatgcgccagcgtaataatttgctgtgtaatgggctgtcactgaagtccttggccgaaaccgtcctcaacttccccttagataagtccctgcttctgcggtgtagtaactgggatgccgagaccctgactgaggatcaagttatatacgctgcccgtgatgcgcagatttccgtcgcactgttcttacacctcctgggctaccccttttctcgcaattcaccaggagagaagaacgacgatcactctagttggaggaaggtactggagaagtgtcagggagtagttgacataccatttcgatccaagggcatgagccggcttggggaggaagtgaacggggaagctactgagagccagcagaagcctaggaacaagaaaagcaagatggatgggatggtccctggtaatcaccagggacgtgatccaaggaagcacaagagaaagcccctcggcgtcgggtacagcgccagaaaaagtcccctgtatgataactgttttctgcatgctcctgacggacagcccctgtgtacatgcgatcggagaaaggctcagtggtacttagataaagggatcggggaactggtgtccgaggagcccttcgtggttaaactgcgctttgagcccgctggcagaccagaatcgcccggtgattattacctgatggtgaaggagaacttgtgcgttgtgtgtggaaagagagatagctatattcgcaaaaacgtgattccccatgaatatcggaagcatttccctattgaaatgaaggatcataacagtcacgacgtgctgctactctgcacctcctgccatgctatctcgaactactacgataaccatctcaaacagcagcttgctaaagaattccaggcgccaatcggatccgaagagggcctgcgccttcttgaagacccggagcggcgtcaggtgagaagtggcgctcgcgctctgctcaatgccgaatcgctcccgacccagagaaaggaggaattattacaagccttacgcgagttttataacaccgacgttgtaacagaagaaatgttgcaggaagccgcttccctcgaaacaaggatctcgaatgaaaactatgttcctcatggcttgaaagttgtacaatgtcattctcagggaggtcttcgctccctgatgcagttggagtccagatggagacaacactttctagactcaatgcagcccaagcaccttcctcagcagtggagcgtggaccataatcatcagaagctgcttcgaaagtttggtgaagacctgccaatacaattgagctag

SEQ ID NO: 55811 - DNA, 1491 bp, Artificial Sequence
  Description of Artificial Sequence: Synthetic coding sequence
atggcctctccctctggactctgtgtcctggttaggctcccaaagttaatttgtggcggaaaaaccttgcccaggacactgctcgatattctggcagatggaacgatccttaaagtaggggtgggctgctcggaggatgccagtaagctccttcaggattacggtttggtggtgagggggtgtctggacctgcggtacctcgcgatgagacagcgaaataatttactgtgcaacgggttgtcactaaagagcctggccgagacagtgctcaatttcccccttgacaagtcactcttgctgcgctgctctaattgggatgctgagaccctcactgaggaccaggtgatttacgcagccagagacgcacagatatctgtggctctcttcctgcatctgcttggatacccgttttcaaggaactcgcctggagaaaaaaatgatgaccacagcagctggcgcaaggttctggaaaaatgtcagggggtcgttgacatcccttttagaagcaagggtatgtcccggctgggagaagaagtgaacggcgaagcgacagaatcgcagcagaaaccgcgaaataagaaaagcaaaatggacggcatggttcccggtaatcaccagggccgagacccacggaaacacaaacggaaaccactgggcgtgggatatagtgccaggaaaagccctctgtacgataattgttttcttcacgcaccggacgggcagcccctgtgcacctgcgaccggcgtaaagcacaatggtatctcgataaagggatcggagagctggtgtctgaagagccattcgttgtgaaactgcgcttcgaacccgctggcagaccggagtctccgggtgactactacctgatggtgaaagaaaacttatgcgttgtgtgcggtaaaagagatagctacattcggaaaaatgtgatcccacatgagtatcgaaaacatttcccaatcgagatgaaggatcacaactcccacgacgtgctgctgttgtgcacttcctgccacgctatttctaactattatgacaatcacctcaaacagcaactggctaaggaatttcaggcccctatcggaagtgaagagggccttcgcctgctggaggatccagagcgtagacaggtcaggtccggtgccagggcgctgctaaacgcagagagtctgcctacacagaggaaagaagaattattacaggcgctgcgcgaattctacaataccgacgtggttactgaagagatgttacaggaagccgcaagcctcgagaccagaatctccaacgagaattatgtgccccacggactgaaagtggtgcaatgtcactcacagggaggtttgcggtctttaatgcaactagaatcgagatggcgacagcactttctcgactcaatgcagccaaagcacctcccacaacagtggtcagtggatcacaaccaccagaaacttctacgcaaattcggagaagacttgcccatacaactaagctag

SEQ ID NO: 55812 - DNA, 1866 bp, Artificial Sequence
  Description of Artificial Sequence: Synthetic coding sequence
atgtctcgccagaacctggtggccctgacggtgaccacactactgggcgtggccgtggggggttttgtgctgtggaaaggtatccagcgcaggcgtagatctaaaaccagtcccgtgactcagcaaccacagcagaaggtgctgggttctagggagttaccgcctcctgaggatgatcagttgcatagtagtgcccctcggtcctcctggaaggaaaggattctcaaggcaaaggtggtgacagtctctcaggaagctgaatgggatcaaatcgaacctctcctgagaagcgagttggaggacttccctgttctgggcatagactgcgagtgggtgaatctcgagggcaaggcttcccccctgtctctgctgcagatggccagcccctcaggactgtgcgtcctggttcgtctgccaaagctgatctgcggtgggaagacactacccagaacactgctcgatatcttagctgatggtacaatcctgaaagtgggcgtcggatgctccgaagacgccagtaaactgttgcaagactatggtcttgtggttagagggtgcctcgacctaagatatctcgccatgagacagaggaacaacttattgtgtaatggcctatctctcaaatccctggcagagacagtgctcaatttccctttagataagagcttgctgcttcggtgcagcaattgggatgccgagacattaaccgaggatcaggttatctatgcagcgcgagacgcccagatttctgtggccctgtttttacacctgttgggttatccgttctcccgaaactcacctggagaaaagaacgacgatcactcttcctggcgtaaggtcctagaaaagtgccagggcgtggtagatatccccttccgttctaagggcatgtccagactcggcgaagaagtgaacggggaagccacagaatctcagcagaaaccgaggaataaaaaatccaaaatggacggcatggtaccaggtaatcaccagggccgagacccgaggaagcacaaaagaaaaccactgggggtggggtacagcgcgaggaagagtccattgtacgataattgctttcttcacgctcctgatgggcaacccctgtgcacctgcgataggagaaaagcacaatggtatctggataaaggaatcggcgagctcgtgtcagaggaaccatttgtggtcaagctgcggttcgagccagcaggtcggcctgaatcacctggagactactacctgatggtgaaagagaacttgtgtgtggtgtgtgggaaacgcgactcatacatccggaagaatgttattcctcatgaatatagaaaacacttccctatcgagatgaaagatcacaactctcacgatgttctgcttttatgtacatcctgccacgctattagcaattactatgacaatcatctcaaacagcaactcgccaaggagttccaagctcccatcgggtcagaggagggattaagactgctggaggaccctgagcgcaggcaagtccgctcaggcgctcgtgctcttctgaatgcagagtctctgcccacacaaagaaaagaagaactcttgcaggctctgagagagttttataatacggacgtggtgacagaagagatgctgcaggaagccgcttctttggagacgcgcataagcaatgagaattatgtgcctcatggccttaaagtcgttcagtgtcactcccaaggaggcctcaggtccctgatgcagctcgaatctcgctggcggcagcatttcctcgattctatgcagcccaaacacctgccccagcagtggtcagtagaccataatcaccaaaagctccttcgcaagttcggggaagacttacccattcagctctcttag

SEQ ID NO: 55813 - DNA, 1491 bp, Artificial Sequence
  Description of Artificial Sequence: Synthetic coding sequence
atggcctcaccatctggcctttgcgttctcgttcgcctccccaaactcatttgcggaggaaaaaccctgccccgaaccctcctcgatatactcgccgacggaaccatactcaaagtcggcgtgggctgcagcgaagatgcatccaaactactccaggattacggcctggtagttagggggtgcttggaccttagatacctcgccatgcgacagcgaaataaccttctgtgcaatggcctcagtctgaaaagccttgcagagaccgtgctcaattttcctttggataagtcactattgctccgctgcagcaattgggacgctgaaactctgactgaggaccaagtgatctacgccgcaagagacgcccagatctccgtggcactcttcttgcacctgctaggatacccttttagtcgcaactctcccggtgagaaaaatgacgaccacagctcctggcgcaaggttctcgagaagtgtcaaggtgtggtcgacataccttttaggtccaaggggatgtccagactcggagaggaggtcaacggtgaagccaccgagtctcagcagaaaccacggaacaaaaaaagcaaaatggatggaatggtgcccggtaaccatcaggggcgtgaccctaggaagcacaagcgcaaacctcttggcgtcggctactccgcccgtaaatcacccctgtacgataattgtttcctgcacgcgcctgacgggcagcctttgtgtacatgcgatcggagaaaggcacagtggtatcttgacaaagggatcggggaactggtgtccgaggagcctttcgttgtgaaactccgcttcgagcctgccggtcggcctgagagcccaggggactattacctgatggtgaaggagaatttatgtgtcgtgtgtgggaagagagattcatacattaggaagaatgtgatccctcatgagtatcgcaagcacttcccaatcgaaatgaaggaccacaactcacacgatgtacttctgctttgcacatcgtgccacgccatctctaattactacgataatcacttaaagcagcagcttgcgaaagaatttcaggccccaataggaagcgaggagggcttgcgactcttagaggaccctgaaagacggcaagtgaggagtggcgctcgggctctgctaaatgctgaaagcctgcccacccagagaaaagaggagcttctgcaagccctacgtgagttttataacaccgatgttgtcacagaagagatgttgcaggaggctgcatcgctcgagacccggattagcaacgaaaattacgttccccacggattaaaggtggtgcagtgccatagccagggtggactgcggtcattaatgcagctggaaagtagatggcgccaacatttcctggattcaatgcagccaaaacaccttcctcagcagtggagcgtggaccacaaccatcaaaaattgctcagaaagtttggagaggatctgcccattcaactgtcctag

SEQ ID NO: 55814 - DNA, 1491 bp, Artificial Sequence
  Description of Artificial Sequence: Synthetic coding sequence
atggctagcccatctggactttgtgttcttgtgaggctgcccaaactgatctgcggcggaaaaacgctgcctaggactctgttagatatccttgccgatggcactattttgaaagtgggcgttgggtgctctgaggatgcctcaaaactcctgcaggactacggcttagtggttcgcggatgcctggacctgagatacttagctatgaggcagagaaataacttattatgtaacggattatcgcttaagtctctggccgaaactgttctcaactttccgctcgataagagtctattgctgcggtgttccaactgggatgccgaaaccctcaccgaggatcaggtgatttatgcagcccgagatgctcagattagtgtagccttatttttacacctgctgggttaccctttttctcgtaattcacctggcgagaagaatgacgaccactcaagttggagaaaggtattagagaagtgtcagggcgtggtggatataccctttagatctaaagggatgtcacggctcggagaagaggttaacggagaagctacggagagccagcaaaaacccaggaacaagaaaagtaaaatggacggcatggtgcctggtaaccaccaagggcgtgaccctcgtaaacataagcggaagcccttgggcgtcgggtacagcgctagaaaatcacctttatacgacaattgctttttgcatgctccagacggccagcccctttgcacgtgcgacagacgaaaggcccagtggtaccttgataagggcattggtgagttggtatctgaagagccattcgtggtgaagctgaggttcgaacctgcgggacgtccagagtcacctggcgactactatctcatggttaaagaaaatctgtgtgtcgtgtgtgggaaaagggactcatacattaggaagaatgtgattcctcacgaatataggaaacacttcccgattgagatgaaggaccataatagtcatgatgtattgctcctctgtacaagctgtcacgcaatttccaactactacgataatcatctgaaacagcagctggctaaggaattccaggctcctataggatcagaggagggactgaggctgcttgaagatccagagcggagacaggttcgctctggcgcacgcgcactcttgaatgccgagtcactacccacacaaagaaaagaggaactgctgcaggcgctccgtgagttctacaacactgatgttgtgaccgaggagatgttgcaagaggccgcatctttggagacaaggatttccaacgagaactacgtgcctcacggcctgaaagtggtgcaatgtcattctcagggcggtctccggtctctgatgcaactagagagccggtggaggcagcacttcctggacagcatgcagcccaaacacctcccgcagcagtggagtgtggaccacaatcaccagaaattactgaggaagtttggtgaggatctgccaatccaactctcttag

SEQ ID NO: 55815 - DNA, 1491 bp, Artificial Sequence
  Description of Artificial Sequence: Synthetic coding sequence
atggcaagcccttctggactgtgcgtgctggtgagactgcccaaattgatttgcggtggaaaaaccctgccccgaacactgctagacatccttgctgacggaaccatcctgaaggttggcgtgggttgttccgaggatgccagcaaacttcttcaagactatggactggttgtgagggggtgtcttgatctcaggtacctagccatgcgtcagcgaaacaatctgctttgcaacgggctttcattaaagagtctggccgagaccgtacttaatttccccttggataagagtctcctgttgcggtgcagtaattgggacgccgagaccctaaccgaagatcaagttatctacgccgcacgggacgcccaaatctccgtggccctgtttttacaccttctgggctatcccttctcacgaaactcacccggtgaaaagaacgatgatcacagctcatggcgtaaagtgctcgaaaagtgtcagggtgttgtagacatccccttcaggagcaaagggatgtcccgcctcggcgaagaggtgaacggcgaggcaacagagagtcagcagaagcctcggaataagaagtcaaagatggatggcatggtgccaggcaaccatcagggtcgcgaccccaggaagcataagcgaaagccccttggggttggctactctgctcgcaagtcacctctctatgataactgctttctgcatgctcccgatgggcagcccctttgtacctgtgaccggcgaaaggctcaatggtatctcgacaagggcatcggtgagctggtatctgaggaaccttttgtagtgaagctgagattcgagccagctgggagacctgaatcaccaggcgactattatttgatggtcaaagaaaacctttgtgttgtgtgcggaaaaagagactcttacataaggaagaatgtcattccccacgaataccgtaagcattttcctattgaaatgaaagatcacaattcccacgatgtcttactgttgtgcacaagctgccatgcaatcagcaactactacgataaccatctgaagcaacagctggccaaggaattccaggcaccaattggttcagaggaaggcttgcgcttgctggaagatcccgagcgacgccaggtcaggtccggcgcacgtgccctgctgaatgccgaatctctgccaacacagcggaaagaagagctgttgcaggctttgagggagttttacaacacagatgtcgtgacagaagagatgctccaggaggccgcatcgttggagacacgcatatcgaatgagaactacgttccacatgggctgaaggttgtccagtgtcacagccagggtggtctgcggtcactaatgcagttggaatcaaggtggagacagcacttcttggattccatgcagccaaaacatcttcctcagcaatggagcgtggaccacaatcaccaaaagctgctgcgtaaatttggcgaggacctccccattcaacttagttag

SEQ ID NO: 55816 - DNA, 345 bp, Artificial Sequence
  Description of Artificial Sequence: Synthetic coding sequence
atggcctcccctagcggcctctgcgtgctggtgcgcctgcccaagctgatatgcggagggaagaccctgcctaggacgctgctggatattctggctgacgggacaatcctcaaagttggcgtggggtgcagcgaagatgcttcaaaactccttcaagactacggactggtagtgcgcggttgtcttgatctgcgttatttggctatgcggcagcgtaataacctcctctgtaacgggctctcactcaaatctctggctgagaccgtgctcaacttccctctggataaaagtctcctattaaggtgctcaaattgggatgccgagactcttaccgaagatcagtag

SEQ ID NO: 55817 - DNA, 1491 bp, Artificial Sequence
  Description of Artificial Sequence: Synthetic coding sequence
atggctagcccgtctggcttgtgtgtgctcgtccggctgcctaaactgatctgcggcggaaaaacacttccaagaaccctgctggatattctggcggatggaacaatcctcaaggtgggagttggatgtagcgaagatgcgtcaaagttgctgcaggactacggactggtcgttaggggttgtctggacctccggtacctcgccatgagacagagaaacaacctgttatgcaacggactgtctttaaaatcccttgccgagacagtgctgaattttcctctggacaagtctttgctcctgagatgcagcaattgggatgcagagaccctgaccgaagaccaggtgatctacgctgctagggatgctcagatctctgttgctctctttttacacctactgggctatcccttctcccgcaattccccgggtgaaaaaaatgacgatcactcctcttggcggaaggtcctcgagaagtgccagggcgtggttgacatacctttccgatctaagggcatgagccggctgggagaggaagttaacggggaggccacagagagtcaacagaaaccaagaaataagaagagtaaaatggacggaatggtccccggaaatcatcagggccgagatcctcgaaagcataagcggaaacctctgggagtgggctattcggccagaaaatctccactctatgacaattgctttctgcatgcacccgacggccagcccctgtgtacctgcgatcgtcggaaggcccaatggtatcttgacaaaggaatcggtgaactggtatctgaagagccattcgtggtgaaactcagatttgagccggcaggacggcctgagagcccaggggactattacctgatggtcaaggagaacctgtgcgtcgtgtgtgggaagcgcgactcgtacattaggaaaaacgtcatcccacacgaatacaggaaacacttccctattgaaatgaaagatcataactcccatgatgtgctactcctttgtacctcatgccatgccattagcaactactatgacaaccatttgaaacaacaactcgctaaagagtttcaagccccaatcggctcggaagagggccttcgactgctcgaagaccccgagcgaaggcaagttcgtagcggagccagggcccttttaaacgccgaatcgttgcctacacagaggaaagaagagcttctgcaggcgctgagagaattctataacacagatgttgtgactgaggagatgctgcaggaggcagccagcctagagacccggatttccaatgagaactatgtcccccatggcttaaaggtggtgcagtgccactcccaaggaggcctcaggtctttgatgcagctggaatctcggtggcggcagcactttttagactctatgcaaccgaagcacctgccccagcagtggtctgtagatcataaccaccaaaaactcctccggaagttcggcgaagacctcccaattcagctgagttag

SEQ ID NO: 55818 - DNA, 2631 bp, Artificial Sequence
  Description of Artificial Sequence: Synthetic coding sequence
atggaccctggcgatccagcaggagaccccgcagccggtgaaaggcaccgaatgggaagagatcctctgctgttgctgcaggccttgcagaccctgtggtccaccagagaacgtaaacagctgagagaagaggcctggcggggatttgctgctctggacgatccactggccggactacttgacatgcttgaaagctgccgaggacagcgaggagaaggtccatcgctggcagcgtggattagtcatcagctacagtgttggctgcaggctcagccgtgccccagccttgcgcagcacagcctgcggctgaagcagctgcaagccagagcggtgaaggtccttacggaatcaccaccctcactagccgcacctctcgctagcatatttcaactgcaggacgcagataggtcatgtctgctcgcccacgtccaccgtttgcaccatgagggcagatttcgagaggctgccactctgggcgctacattgaagctgcagtccgagctcggcgttgaaaagatgtcaattccactgctacttcaggacaaggtggctcttgtggaaaggtacgtggccggattccccgacctccagcggcgattgcttgtgctgatggatagttggtgtcagccaggttttgacataaaagacgtcgcacggcgatacccagaggttacctctctaagtctggagaaactgagcccaaaggctttatcacgacaggtgcttaggctgcaggagaggtacggggttgctcctgccttgtgtcccaacgctgccatccaacagcgtttggccgcacttagacatctgtgtcataagcgattcgttgagaaatcgctgtctcaggagaattggacagatcatgtacagggcctcgtgggtcagtcaccgtggcttcaggagcagctcagccagcttctggttagtcactcagaccctgtcacagcagctcagtgtgctatggaactgctgctgccagaggaaagacttcccgctgccgtagccgtggagctcagacggttcaggctgcaaggcagagcaaccgaagctgacagtagactcgaggtgaaggacatgaaggatagatattatcagctccccattccacgagagaacgttcaccttctcgcaagctgggaggatttgacacgccacgagggtgcccttttgcagtgccaccaggttgtgggtgtggacgttgaatggacccccgtgtttgtggcgggtggcagaccacgtcctagcttattgcaggtggccgttgagggtcacgtctttttgttggacgtcctcgccctctcccagcccccaactggccagggcgctcaggccttttcacggttagtagctcagcttctgtctgatccgagcattaccaaactcggctacggcatggtgggcgacctccagaagcttggtacatcctgccccgctctcgctcacgtggaaaaacagatcttgggtggaatggatctcttgctggtgcaccgacaaatgcgggtagcatctgtcccggcacctgccgtggatcgtgctagggagttaagagggctgtcactgttggtccaacaagtgctggggaccgcattggacaagacccaacagctctcaaattgggataggaggccattgtgtgaagagcaggtgatctatgcggcagccgacgcttattgtcttctcgaggtccatcaagctttgtgtagagagcctgcgagattccacctgagcgaagacctggctggatctcgccgacccaggcaccgtgaacgacctggagcacggaagccaccaggcctgcagaaagcgagcgcaccagccgcacctcgtcaggtgcctgtcgcagtcgcggtttccgaaggggcagcaccacagatccccgcacgcgcatttcgagtcgtctgtgataacatgttgcagggactagcaaggtcactccgttgtctgggcgtcgatgctaggatgctaggcaatggcgaggaccaccgcagagctgcagaagtggcccgtcaggaaggccgaatcatactgacaagcggccaacccttccacaagctacgcgcacaggtcggggcaggtcggtgcctgtcagtcgactgctccctgaaggcacagcagcaggccaaggcagtgctgaaacatttcaatgtacgtgtgacccacgccgacatatttagtagatgtcaggcttgtaattgcgatcaatatctgaaggtgagcagggacatgatgaagcagttgatgtggctgtcatcacaccaggagggcccacggagtagcggcgatgaggctacccagagccaggcggtacaggaacctggccctgcccctgacgccgcaccagaaggttgcacctatgaccggccttgccggtggctgcagatggcagacctcagggctgagacacctgatatgctcgcggacggcacccgactccagctcgccggagtgccagtgggcgtactgagaaccccaggattaagatgtttttattgctgtaccggctgcggcaaggttttctgggatgggtcccaccttggtagagtcgccacacacttcagagatatgttggagagtgccccaagcccgtgcgaaccatcccctgccccaagccccgcttcatctcccttctag

SEQ ID NO: 55819 - DNA, 1545 bp, Artificial Sequence
  Description of Artificial Sequence: Synthetic coding sequence
atggaactacttttaccagaagagagacttcctgctgctgtggccgtggagctaaggcgtttccgcctgcaggggagggccacagaggctgattcacggctggaggttaaggatatgaaggatagatattatcagcttcccatcccaagggaaaacgtgcacctgctggccagctgggaggatctaacccgacatgaaggcgctttattgcaatgccaccaggtagtaggcgtggatgtggagtggacaccagtttttgtcgccggaggtagacctcggcctagcctgctacaggtcgccgtcgaaggccacgtatttttacttgacgtcctcgcattaagccaaccccctaccggccagggtgcacaggcgttttctcggctagtggctcagttgctgagcgacccttccattacaaagcttggatatggaatggtaggggatttgcagaagctgggcaccagttgccctgccctcgctcacgtcgagaagcagatcctgggaggaatggaccttctgctggtgcacagacaaatgcgggtggccagtgtgcctgcgcctgcagtcgacagagctcgagagctcagaggtctgtccttattagtccaacaggtcctgggaacagctctggacaaaacgcagcagctgtccaattgggatcgcaggccactatgcgaagagcaagtcatatatgccgctgcggatgcttattgtttgctcgaggtccatcaggccctgtgccgcgagccggctcgctttcatctcagcgaggaccttgccggttcacggaggcccaggcatagggagcgaccgggagccaggaagccacctggtctccagaaggcatctgcaccagcagcccctaggcagggcctggcccgttcattgcgctgcctgggggtggacgctcggatgctcggaaacggggaggatcacagacgagctgccgaggtcgctcggcaggagggcaggataatcctcacgtcaggccagccttttcataagctgcgtgcacaggtgggggctgggaggtgcctgagtgtggactgtagtttaaaagctcagcagcaggctaaagcggtgctgaagcattttaatgtcagggttactcacgctgatatcttcagccgatgtcaggcctgcaactgcgatcaatacctaaaggtgagcagagatatgatgaaacagctaatgtggctgagctctcatcaggagggacctcgctccagtgggcctgcaccggacgcagctcctgaggggtgtacttacgatcgcccatgccgctggttgcagatggccgatctccgagctgagacccctgacatgctcgcggacggaacaagactccagcttgcaggcgtcccagtgggagtgctaaggaccccaggcctgaggtgtttttactgctgtaccggctgtgggaaagtcttctgggatgggtcccacctcggaagagtggcaacacattttagagatatgttggagagtgccccaagcccctgtgaaccctctcctgcaccttctccagcttccagtcctttctag

SEQ ID NO: 55820 - DNA, 2682 bp, Artificial Sequence
  Description of Artificial Sequence: Synthetic coding sequence
atgacacccccatcaagggctgaagccggagttaggagatctcgagtcccctcagagggacgctggaggggggcagagcctcccggtatcagcgccagcactcagccggctagcgccggtagggccgcacgccactgtggggctatgagcggggcacgcggagaggggcctgaggcgggtgccggtggagccggaggacgagctgcaccagagaaccccggaggggtcctgtctgtggagttaccaggactcctggcacaactggccaggtctttcgcacttctgttacccgtgtatgccctggggtatctcggactgtcatttagctgggttcttttagcacttgccctccttgcttggtgccggagatctcgcggattgaaggccctacgcctgtgtcgtgccctcgccctcttagaagatgaggaaagagtggtgcggctgggcgtcagggcatgcgacttgccagcctgggtccacttccccgatactgaacgcgcagaatggctgaataagaccgtgaaacacatgtggccctttatatgccagtttattgaaaaactgtttcgggagactattgaacctgccgtgaggggggctaatacgcacctgtcaacattctcctttactaaagttgacgtggggcaacagcctctacggatcaatggcgtcaaggtttacacggagaacgtggacaaacgccagattatactggacctgcaaatcagctttgtagggaattgtgagattgatctggagataaaaagatatttttgtcgggctggggtcaaatccattcagatccacggtacaatgcgcgtaattttggagcccctgatcggagatatgcctttggtgggcgcattgagcatattctttttgagaaaacctctgttagaaattaattggacggggctgacaaacctgctagatgtgcccggactgaacggtctgagtgacacgataatcttagatataattagcaattaccttgtgctccccaatcgcatcacagtcccattagtttcagaggtgcagatcgcccagctgcgcttccctgtccctaagggagtgctgaggatccactttattgaagcacaagacttgcaagggaaggatacatacttgaagggactggtgaaaggaaaaagcgacccatacggaataattcgggttggaaatcagatatttcagtcacgcgttatcaaagagaacctgagcccaaaatggaacgaagtgtacgaggctttagtttacgagcacccaggccaggagttggagatcgagctgtttgatgaagacccagacaaagatgactttctgggatcactgatgatcgatctgattgaagtggagaaggaacggctgctggatgaatggttcaccctggacgaggtccctaagggcaagttgcacctgcgcctcgagtggctgaccctcatgcccaatgcctccaacctggacaaagtgcttaccgacatcaaggccgacaaggaccaagctaatgacggattaagttccgcgctgctgatcctgtaccttgactccgctcggaacctcccatccggaaaaaaaatctcctctaacccgaaccctgtcgtccaaatgtctgtcggccacaaagcccaggaaagtaagatcagatacaaaacaaatgagcccgtgtgggaggagaacttcactttttttatccacaatcctaaaagacaggatcttgaagtggaagtgcgggatgaacagcatcaatgttccctagggaatttgaaagtgccgctgagccagctcctgacctctgaggacatgactgtatcccaacgcttccagttatccaactcaggccctaactcaacgatcaaaatgaaaatagccctgcgggtgctgcacctcgagaagagggagcggccacctgaccatcagcattccgcccaggtcaaacggccttccgtgtccaaagaaggacggaaaaccagcataaaaagtcacatgtctggaagcccaggaccgggtggctcaaacactgctccttccactcctgtgatagggggaagtgacaaaccagggatggaggagaaggctcagcctcccgaagccggaccccagggtctgcatgacctgggccgaagttcctcctccctgctggcctcccccggacatatttcggtgaaggagccaaccccaagcattgcaagcgacatcagcttgcccattgccacgcaggagctccgacaacggctacggcagctggaaaatggcaccacactcggccagtctcctcttggacagattcagttgacaataagacactcgagccagcgaaacaaactgattgttgtcgtccacgcatgcagaaatctgatagcttttagcgaggacggctctgatccttacgtccgcatgtatcttctgccggacaagaggcggagcggcagaagaaaaacacacgttagcaaaaagacccttaacccggttttcgaccagagctttgactttagcgtttccttgcctgaggtacaacggaggacattggacgtggccgtgaaaaacagcggtgggtttctttccaaggataagggtcttctggggaaggttcttgtggctttagcatctgaggagctggccaaaggctggacgcagtggtatgatcttacggaggatggcacccgcccacaggctatgacctag

SEQ ID NO: 55821 - DNA, 672 bp, Artificial Sequence
  Description of Artificial Sequence: Synthetic coding sequence
atgcccgtgttccccccatgtgtactgcaggtgcgagacgagcagcaccagtgtagccttggtaatttaaaagtcccactctcacagctcctcaccagcgaagacatgaccgtgagccagcgcttccagctctctaatagcggtccaaattccactatcaagatgaagatagctcttcgcgtactgcacctcgaaaaacgagagcgcccacccgatcaccagcacagcgcccaggtgaaaaggccaagcgtgagtaaggaagggcgaaaaacaagtattaaatcccatatgagcggctcacctgggcctggcggatctaacactgcacctagcacaccggtgattgggggttcagataagccgggaatggaggagaaggctcagccacccgaggctggaccacaaggactacatgatcttgggcgatcatccagttcacttttggcctctcccggacatatttcagtgaaagagcccaccccatccattgcatcagatatatccctgcccatcgcgacacaggagctgcggcagagactgaggcaactggagaacggcacgacactaggccagtcccctctggggcaaattcagctcactatacggcacagttctcagaagcaggcctatcgtgggagggcctgtctgcagaaacctcactgccttctgtag

SEQ ID NO: 55822 - DNA, 2829 bp, Artificial Sequence
  Description of Artificial Sequence: Synthetic coding sequence
atgacagctaaccgggacgccgctctgagtagccatcggcaccctgggtgcgctcaacgaccaaggaccccaactttcgcatcttcctcccaaagacggagtgccttcggattcgatgacgggaattttcccggactcggagagaggtctcacgctcctgggagtaggctcggagctaggcggagggcaaaaaccgcccgtggtctgcggggacaccggcaaaggggagcaggagctggtctgtctcgccctgggtcggccagagcccctagcccgcctcgccctggagcccctgaaaaccctggcggagttctgtctgttgagttacctggtctgctggcccagctggctcgttccttcgcgctgctgctacccgtgtatgctctgggctatttgggactaagcttctcctgggtactgcttgccctcgccctgctggcctggtgtaggcgcagcagggggctcaaggcgcttcgtctatgccgcgctttagctctgctggaggacgaggagcgcgtggttaggctgggagtgagagcatgcgatcttcctgcttgggtacactttcctgatacggagagggcggaatggcttaataagacggttaaacacatgtggcccttcatttgccagttcattgaaaaactcttccgcgagactatcgagcccgctgtgaggggcgcaaacacacacctgtcaactttttcttttaccaaagtggacgtgggacaacagccactgcggattaacggcgtgaaagtgtacactgaaaacgtggacaaacgtcagattattctcgatctccagatctcctttgtgggtaattgtgaaatcgacctcgagattaaacggtatttctgccgcgcaggggtgaaatctattcagattcacgggacaatgcgggtcattctggagccattgattggggatatgcctctcgtgggcgctttatccatcttcttcttgcgtaaaccccttctcgagatcaattggactggcctgaccaatctgctggacgtgcccggactgaatggcctgtcggatactatcatattagatatcattagtaactatctcgtcctgccgaaccgcattaccgtcccactggttagcgaggtccagattgctcagcttagatttcctgtgccgaaaggtgtgctccgcatccacttcattgaggcccaggacctccagggaaaggatacgtacctcaaaggcctggtgaaaggtaaatctgacccctatggtatcatacgcgtagggaatcaaatttttcagagtagagtgattaaagagaatctgtctccgaaatggaatgaggtatacgaagcccttgtatacgagcatcccggtcaggagctggagattgaactcttcgacgaggaccccgacaaggacgatttcctcggttctctaatgatcgaccttatcgaggtggaaaaagagcgtctgctggacgaatggtttacgcttgatgaggtccccaaagggaagctgcatcttagattggaatggttgacacttatgcctaacgctagcaatctggacaaagtactgacagatattaaggccgacaaggaccaggcaaacgatgggttgtccagcgcactgctcattctgtatctggacagcgccagaaatttacctagcaatccactggaatttaatccggatgttctaaaaaaaactgctgtgcagcgcgctctgaagtccgggaaaaagatttcctcaaatcctaaccctgtggtgcaaatgtccgtgggccacaaggcacaggagtcaaaaatccggtataagactaacgaacccgtctgggaggagaacttcaccttctttatccataaccccaagcgtcaggacttagaagtcgaagtcagagatgagcagcaccaatgttcgctgggaaatctgaaggttcctctatctcagctgcttacatcagaggacatgaccgttagtcagcgatttcagctgagtaacagcggccctaatagcacaattaagatgaaaattgccctgagagtgctgcatttggaaaagagggaaaggccacccgaccaccaacatagtgctcaggttaagcgcccttcagtcagtaaggaaggacgaaaaacaagcattaaaagccatatgtctgggagtcccggtcctggtggatctaacaccgctccttccacacccgtgataggtgggtccgacaaacctggtatggaggagaaggcgcagccgcctgaggcgggtccacaggggcttcacgacctgggcaggtcctctagcagcctgctggccagcccaggacatataagtgttaaggagcccactccttccattgcttccgatatctccctccccatcgccacccaggaacttcgacagcgtctgcgacagctagagaatgggaccacgctgggtcaatcacctctggggcagatccagctgaccatcagacactcatcccagcgaaataagctcatagtggtcgtgcatgcatgtagaaacttgatcgcctttagcgaagatggctcagacccctacgtccggatgtacttactgcctgataagaggagatctggcaggcggaaaacccatgttagcaagaaaactctgaatccagtattcgaccagtctttcgacttttccgtgagtctgccagaagtgcaacgtcggaccctggacgtcgccgttaagaatagcgggggtttcctctctaaggataaagggctgcttggaaaagtgctcgtcgccctcgcttctgaagaactggccaaggggtggacgcaatggtatgatctgactgaggacggtactaggcctcaggcaatgacctag

SEQ ID NO: 55823 - DNA, 1584 bp, Artificial Sequence
  Description of Artificial Sequence: Synthetic coding sequence
atgtggccttttatttgtcaatttattgagaaactcttccgagaaactatcgagcccgctgtgagaggtgcgaacacccatctttcaaccttcagctttacgaaggtggacgtcggccagcagcccttgcgaatcaatggagtcaaggtgtataccgagaatgtggacaaaagacagatcatcctggacctgcagatttctttcgtaggaaattgtgagatcgacttggaaatcaagaggtatttttgcagggctggcgtgaaaagcatccagatccacggcaccatgagagtcatcttggagcctctcatcggcgacatgccgttggtaggagctctgagtatattcttcttgcgcaaaccccttctcgagatcaactggaccggattgacaaatctgctggacgtgccagggcttaacggattaagcgacactattattttagatattatctccaactatctggttctgcccaacagaatcactgtccccttagtgtcagaggtccagatcgcgcaactccgttttccggttccgaagggagtcctgagaattcactttatcgaagcccaggacttgcaaggaaaggacacttacctgaagggtctcgtgaaaggcaaaagtgatccgtacgggatcataagagtggggaaccagatcttccaatctcgggttatcaaagaaaacctgagcccgaaatggaatgaagtctatgaggccctggtttacgaacacccaggtcaggagctggagatcgagctgtttgacgaggaccctgacaaggacgactttcttggcagtctaatgatcgacctgattgaagtggagaaggagcgcttactggacgagtggttcaccctggatgaggtccctaagggaaaactgcatctgagactcgagtggctgacactgatgccaaatgcctccaatctcgataaagttcttacagatatcaaggctgataaagatcaagcgaacgatggactctcatctgccctacttattttgtacctggactccgcaaggaaccttccgagtgggaagaagatatccagtaaccctaatcctgtggttcagatgagtgtaggacataaggctcaggagtcaaagattagatacaaaaccaacgagcctgtgtgggaagaaaacttcacattcttcatacacaaccccaagaggcaggatctcgaggtcgaagtgagggatgaacagcatcaatgttcgcttggtaatctgaaggtgcccctcagccagctgctgacgagcgaagacatgactgtgagtcagcgtttccagctgagtaacagcggcccaaacagtaccatcaagatgaagatagcactgcgagtcctgcatctggaaaagcgggagcgcccacctgatcatcaacactcagctcaggtgaagcgaccatccgttagtaaagaaggaaggaagacgtcaatcaagtctcatatgagcggatctccaggtcccggtggatcaaacactgctccagcaacatcacaatcaaggagtaggccacccgcatcgccccgaacaagcaggtgcccctctccaccacggagttgcgggaagggctag

SEQ ID NO: 55824 - DNA, 987 bp, Artificial Sequence
  Description of Artificial Sequence: Synthetic coding sequence
atgccggtctttccaccctgcgtgctccaggtacgagacgagcaacaccaatgctcattggggaatctgaaagtgccgctctcccagctcctgactagcgaagacatgactgtcagccagagatttcagctgtctaattccggccctaactctaccatcaaaatgaagatcgcgcttcgcgttcttcatctggagaagagagaacgtccacctgaccaccagcacagcgcccaggtaaaacgtcctagtgtcagcaaagagggaagaaagacatcaatcaaatcccacatgtcaggatcccctggcccagggggttcgaacactgccccatccaccccggttatcgggggatcagacaaaccaggaatggaagaaaaggcccagccccctgaagccggaccccaggggcttcacgatctgggaagatcctcgtcgagcttactagcctccccaggacacattagcgtgaaggaacccacaccttcaattgcttcagatatttccttgcccatcgctacacaagagttaaggcagcggttacgtcagctcgaaaacgggactactctgggacagtcaccactgggtcagattcagctgactattcggcactcttctcagaggaacaagctgattgtcgttgtgcacgcctgccgtaatctaattgctttctctgaagacggtagcgacccatacgtgaggatgtatctgttacccgataaacggaggtccgggaggcggaagacccacgtgtcaaaaaagactctcaatcctgtattcgaccaatctttcgatttttctgtgtcgttaccagaagtgcaacgcaggaccctagatgtggctgtgaagaatagtggtggctttctatccaaagataagggattactgggcaaagtgttagtcgctctcgcatcagaggagttggcaaagggttggacccaatggtacgacctcactgaagatggcacgcggccacaggcaatgacctag

SEQ ID NO: 55825 - DNA, 2487 bp, Artificial Sequence
  Description of Artificial Sequence: Synthetic coding sequence
atggcgggtagagggtggggtgcactgtgggtatgtgtggccgctgctaccttgctgcacgccggtggactcgcccgagccgattgttggctcattgaaggcgataagggattcgtgtggctcgctatttgtagtcagaatcagcccccatacgaggctattccccagcagatcaactctacgatcgtagacttacgccttaacgagaatagaatccgatccgttcagtatgcctccctctctcgattcggtaatctcacatacctgaacctaacaaaaaatgagattggctatatcgaggacggcgcttttagtggccagtttaacttgcaagtactccagcttggatataataggctacggaatctaacagagggaatgcttagggggctgggcaaattagaatatctgtacctccaggccaatttgatagaggtcgtgatggcatcgagtttttgggaatgtccaaacatcgtgaacatcgacttgtccatgaaccgcattcaacagctgaacagcgggacctttgcaggtctcgctaaattgtccgtatgtgagctgtatagcaatcctttttactgctcatgcgagctgttgggctttttacggtggctcgctgcgtttactaatgcgacgcagacttacgataggatgcagtgcgagagtcctcccgtctattccggatattacctgctcgggcaggggcgtcgcggacataggtcgatcttaagcaagctgcagtccgtgtgcactgaggatagttacgccgctgaagtggtgggcccacctaggcccgcatcaggcagaagtcagccgggtaggagccctccacctcctcccccacccgagcctagcgatatgccttgcgccgatgacgaatgtttttctggagacggcaccacacccttagtcgcattgcccacactggcaacacaggccgaggccagacctctgataaaagtcaagcagcttacgcagaattctgcaacgatcactgttcagctgccatctccgtttcaccgcatgtatacactggagcattttaataattctaaggcaagtacagtgagccggctcaccaaagcacaggaagagatcaggcttacgaacttgttcaccctgacgaattatacgtattgcgtggtgtccacttctgcaggtctgaggcacaaccatacatgtctgactatttgcctgcccagactccccagtcctcccggtcccgtgcccagcccttctacggcaacacattacataatgaccatactcgggtgcctgtttggaatggttttggtgctgggcgcagtgtattattgtttgcgaagacgcagacggcaggaagaaaaacacaagaaagctgcctccgccgcagccgctgggagcctcaaaaagacgattatcgagttgaagtatggtccagaactagaagcccctggccttgccccattatcccagggacctctgcttggcccagaagccgtcacaagaatcccttacttacccgctgcaggagaagtagaacagtataagctggtcgaatccgccgacactcccaaggcgtcaaaaggatcatatatggaggtgaggacgggcgatccacctgaaaggcgggattgcgagctggggaggccaggtcccgactctcagtcctctgtcgcggaaatttccacaatcgctaaggaggttgacaaagtgaatcagatcatcaataactgtatcgatgctctcaaaagcgaatcaacatcttttcagggggtcaagagtggtcctgtttccgtggcggagcctcccctcgtgctgttgagtgagcccctggctgccaagcacggcttcctggcccctggttacaaagatgcattcggccacagtttacagcgccatcactcagttgaggcagctgggccaccaagagcctctaccagttccagtgggagcgttcgcagccctcgcgcttttcgggcagaggcggtgggcgtccacaaggccgctgccgctgaagctaagtacatcgagaaaggctctccagccgcagacgcaattttgacagtgacccccgcagcagccgtgcttcgcgcagaggcggaaaaaggaagacagtacggtgaacacaggcacagctaccctggctcccaccccgcagaacctcctgctccccctggtccaccacctccccctcctcacgagggcctggggaggaaggcttctatcctggaacctcttacacgcccaaggcctagagacctggcctattctcagttgagcccgcagtatcattccctctcctattcttctagccccgaatacacttgcagggcgagccagtcgatttgggagcgattccggttgtctaggaggaggcacaaagaagaggaagagtttatggccgctgggcatgccctaagaaagaaggtccagtttgccaaggatgaagacttacacgacatcctcgattattggaaaggggtttccgcacaacataaatcctag

SEQ ID NO: 55826 - DNA, 2487 bp, Artificial Sequence
  Description of Artificial Sequence: Synthetic coding sequence
atggccggtcgaggttggggcgctctgtgggtatgtgtggccgcagccactctcctacacgctggaggcctcgctcgcgcagactgctggcttatagagggcgacaaaggattcgtgtggttggctatctgttctcagaaccagccgccatatgaagccattcctcagcagatcaactctacgattgtcgatctgcgactgaacgagaatcgcattcggtcagtgcagtacgcgagtctttcaaggtttgggaaccttacctatctaaatcttacaaagaatgagattggctatattgaagacggggcatttagcggccagttcaaccttcaagtcttgcagctcggatataatcgattgcgtaacctgaccgagggaatgcttagggggctgggaaagttagagtatctgtacctgcaagccaacctgatcgaggtcgtgatggcatcgagtttttgggaatgtcctaacatagtgaacatcgatttgagtatgaaccggatacagcagctcaattctggcaccttcgctgggctcgctaaactgtctgtttgcgaactgtactccaaccccttctactgtagctgtgagcttttagggtttctgcgctggctggcagccttcaccaacgctacacagacctatgacagaatgcagtgcgaatctcctcctgtttactctgggtattacttactgggacaagggaggcggggacaccgttcaattctatccaaactgcagtcagtgtgcactgaggactcttacgccgctgaagtggtgggtccacccaggccagcatcaggtcgctcccaaccaggaagaagtccacctcctccgcctcccccagagcctagtgatatgccctgtgctgatgacgaatgctttagtggcgacggaacaacccctctggtagccctgccaacactggccacgcaagcagaagcgagaccattgatcaaggtcaaacagttgactcagaacagcgccaccatcactgtgcagctgccttcgcccttccaccggatgtacacccttgaacacttcaataactctaaggcttccaccgtttcccgtcttactaaagctcaggaggagattaggttgaccaatttatttactctcaccaactacacttattgtgtcgtctccacatctgccggactgcggcacaaccacacctgccttacgatttgtttgccaagactgccctcccccccagggcctgtgcccagcccttccacagccacacactacatcatgactattctgggctgtttgttcggaatggttctggtcctgggcgcagtctactactgcctccgcaggagaagacgccaggaggagaaacacaagaaggctgcttcggcagcggctgccggatcactcaagaaaactattattgagctgaaatacggcccagagttggaggctccgggattggcccctctgtcacaaggcccactcctcgggcctgaggcagtaacaaggataccctatctgccagctgctggggaggtcgagcagtataagcttgtggagtctgctgacacccccaaggccagcaaggggtcctatatggaagtgcgtactggcgaccccccagaaagacgagactgtgaactcggtcggcctggtcctgacagtcagagtagcgttgcagaaatatctaccatcgccaaggaagtagataaagtgaatcagatcatcaataactgtattgacgcgttgaagagcgagtctactagcttccagggggttaagtccgggcctgtgtccgtggccgaacctcccctagtactgctctccgaaccactggccgctaaacatggcttcctggcccctggttacaaagacgcctttggccattccctgcagcgacaccattccgtggaagcagctgggccacccagggccagtaccagctcgtccggctctgttcggtcacctcgggcttttagggccgaggctgtcggcgtacacaaggcagcagccgcagaggccaaatatatcgagaagggcagtcccgctgcggatgctatccttaccgtgacgcccgcagcagccgtgctgcgagccgaagctgagaagggcaggcagtacggggaacaccgccatagttaccctggaagccatccggcagagcctcccgcacctccaggtccaccgccaccacctccacacgagggtctggggagaaaggcatccattttagagccactgacaagacctaggcctagagatttagcatactcccagttgagcccccagtatcatagtctgagttactcatcctctccagaatatacttgccgggcttctcagtctatatgggagagatttcgcttatcccggagacggcacaaagaggaggaggagttcatggccgctgggcacgcccttcgcaaaaaagtgcagttcgcgaaggatgaagatctgcatgacatcctcgactattggaagggggtgtcggcccaacacaagtcgtag

SEQ ID NO: 55827 - DNA, 495 bp, Artificial Sequence
  Description of Artificial Sequence: Synthetic coding sequence
atgctgcagcaggatagcaacgatgatacagaagatgtttctctattcgatgcagaggaggaaacaactaatcggcctcgaaaggcaaaaatcaggcaccctgtggcctcttttttccatctgttcttcagagtatcagccattattgtctgtctgctctgtgagcttttgtctagtagttttatcacatgcatggtaacaattatactgctcctgagctgcgacttttgggcagtgaaaaatgttacaggccgactgatggtgggactgaggtggtggaaccacattgatgaagacggaaaatcccattgggtttttgaatcccgaaaagagtcgtcccaggaaaataaaaccgtgtccgaagctgagtccagaatcttctggctggggctcattgcatgctccgtgttatgggtcattttcgcctttagtgctctgttcagctttaccgtgaagtggctggaatccgagcccgtcatgctcagaaatcaatag

SEQ ID NO: 55828 - DNA, 534 bp, Artificial Sequence
  Description of Artificial Sequence: Synthetic coding sequence
atgtcggtgaacatggacgagctgaaacaccaggtgatgataaatcagtttgtgctgacggcgggatgcgcagctgatcaggcgaaacaactcctgcaggctgcgcactggcagtttgagactgcactgagcgcctttttccaggagaccaacatcccctactcacaccaccatcaccagatgatgtgtacgccagccaacacaccagcaacacccccaaactttcccgacgccctgaccatgttctctcgcctgaaggcgtccgaatctttccatagcggcggtagcggatcccccatggcagccactgctaccagcccgccacctcactttcctcacgctgcaaccagctcttccgccgcatcatcttggccaaccgccgcaagcccgcctggtggccctcagcatcaccagcctcagccccctctgtggacccctacacccccttcccccgcatctgactggcctcccctagcacctcagcaggcgacttctgaaccaagagcccatccagccatggaggctgagagatag

SEQ ID NO: 55829 - DNA, 495 bp, Artificial Sequence
  Description of Artificial Sequence: Synthetic coding sequence
atgagtgtaaacatggacgaactacgccatcaagttatgatcaatcagtttgtcctcgccgcaggttgtgcagccgatcaggccaagcagttgttgcaggcagcgcattggcagtttgaaactgcactaagcacattcttccaagagactaatattcctaacagccatcaccaccaccagatgatgtgcacgccgtccaacacaccagctaccccgccaaattttcccgacgccttggccatgttttccaaactcagggcctccgaaggactgcagagcagcaactcaccaatgacagcagctgcctgttctccacccgctaatttttcaccattctgggcctcatctcctccctcacatcaggccccatggatccctccaagcagcccaaccacctttcaccatctgcataggccccagccaacttggcctccgggtgcgcagcaaggaggcgctcagcagaaggcaatggccgctatggatggacagaggtag

SEQ ID NO: 55830 - DNA, 435 bp, Artificial Sequence
  Description of Artificial Sequence: Synthetic coding sequence
agcccagcaagcctcccactggcccctggctgcgccctgaggctgtgccctctgtcatttggagagggagttgagtttgatccactcccaccgaaagaagtgcggtatacttcattggtgaagtatgacagtgagcggcacttcatcgatgacgtgcagctaccacttggcctcgccgtagccagctgttctcagaccgttacttgtgtgcccaatgggacctggaggaactataaagctgaagtccgctttgaaccacgacacagaccgacgcgattcctaagcaccacaatcgtgtatccaaaataccccaaagcagtgtacaccactactcttgactacaactgcaggaagacactgagaagatttctatcatcagtggagcttgaagccgcagagctgccaggcagtgacgatctttccgacgaatgttag

SEQ ID NO: 55831 - DNA, 408 bp, Artificial Sequence
  Description of Artificial Sequence: Synthetic coding sequence
atgcggccacgtatgttgccagtcttcttcggcgagtctatcaaagtaaatccagaacccactcacgaaatcaggtgcaactctgaggtaaagtacgcgtctgagaaacacttccaggacaaagtgttttatgcccctgttcccactgtcaccgcctacagcgagacgattgtggccgctcctaactgcacttggcgcaactatcgctctcagctaaccctcgagccaaggccaagggctctaaggttcagatctactacaattatcttcccaaagcacgcaaggtctacatttcggactaccctgcactgtagtctgggccgaccgtcccgttggtttactgcctccgtacagctccagctttgccaagacccggctccaagcctgttaggacccgcaactctctag

SEQ ID NO: 55832 - DNA, 408 bp, Artificial Sequence
  Description of Artificial Sequence: Synthetic coding sequence
atgaggcctcggatgctgcccgtgttttttggtgagtccataaaagtgaatccggagcccacgcatgaaattcggtgtaacagtgaggtgaagtacgcttccgagaagcattttcaagacaaggtattctacgcgccagttcctacggttacggcctatagcgaaaccatcgtggctgccccaaactgtacttggcgcaactataggtctcagttaaccctagagcccagaccccgtgccttgaggttccgctccaccaccatcatcttccctaagcacgcccgttccacattccgcacaacactgcactgctctctcggcaggccgtcccggtggtttaccgcctccgtgcagctccagctctgtcaggatccagccccaagtctgctgggccctgccacgctctag

SEQ ID NO: 55833 - DNA, 651 bp, Artificial Sequence
  Description of Artificial Sequence: Synthetic coding sequence
atggtaggccatttgcacctgcagggaatggaggactctctgaaggaacagggcagagaaggcctgctggattcccctgacagtggcttaccgccatcccctagtcccagcccccctttttacagcctcgcacctgggattctggatgcaagggccggaggagccggagcgagctcagagccacctggaccatccgaggcaagggcaccgccatcacaattacccaaccccccagcatctgagatgcgccctcggatgcttccagtgtttttcggtgaaagcataaaagtcaacccagagcctacccatgaaattcggtgtaattctgaggtgaaatacgcgtctgagaaacactttcaagataaagtgttttatgcgcctgtgccaactgtgactgcctatagtgagacaatcgtggcggctccgaactgcacatggcgtaattatcgctcccagttgaccttagagccacgacctcgtgcactacgttttcgcagcaccacaattatcttccctaagcacgcaagaagcacctttcggaccacacttcattgttccttgggtagacccagtcgatggttcaccgccagcgtacagctccagctgtgtcaagaccccgcaccctcactgctgggcccagcaaccctctag

SEQ ID NO: 55834 - DNA, 369 bp, Artificial Sequence
  Description of Artificial Sequence: Synthetic coding sequence
atgagacccagaatgctccctgtgttttttggagagagcataaaagtgaatccagagcccacgcatgaaatacggtgcaactccgaagtgaaatacgcctccgagaagcactttcaggacaaagtgttctacgccccagtccctaccgtcaccgcatattccgagactattgtggcggcacctaactgcacctggaggaattaccgatctaggtggtttaccgcttcagtacagctgcagttgtgtcaagaagcgggaagagaagccgctcgacccaggacacgagtggagggagggggtagtccgctgcctgctctgacctatcgactcggtgggggactcttggtgttagtgtcaagaacgcagtag

SEQ ID NO: 55835 - DNA, 408 bp, Artificial Sequence
  Description of Artificial Sequence: Synthetic coding sequence
atgagacccaggatgctgcctgtgttttttggcgagtcgattaaagtgaacccagaaccaactcatgagatcagatgcaacagcgaggtgaaatacgcgagtgagaaacacttccaagataaagtgttttacgctcctgtgccaaccgtaaccgcctactcagagacaatcgtggccgcaccaaattgcacttggcgtaattatagaagccagctgacacttgaaccccgtcccagagcgctcaggtttaggtcaactacaataattttccccaagcatgcaaggagcacatttcggaccaccctacattgctccctggggagacctagtagatggttcactgcttcagtccagttacagctctgccaagatccagcccctagtctgttagggccagccacactttag

SEQ ID NO: 55836 - DNA, 435 bp, Artificial Sequence
  Description of Artificial Sequence: Synthetic coding sequence
agccctgcctctttgccactagcccctggctgcgctctgagactttgtccccttagcttcggagaaggagttgagttcgatcccttaccaccaaaggaggtcaggtatacctccctggtcaaatatgattccgaacgccatttcatcgacgacgtgcaactcccgctgggtctggccgtggcctcttgctctcaaacagtgacatgtgtgccaaatggtacttggcgcaattataaagccgaagtgaggtttgagcccaggcatagacccaccaggttcctctctacaacaattgtgtaccctaaataccctaaggccgtatatacgactaccctcgattacaactgtaggaagacgctaaggagattcctgtcatctgtagaacttgaggcggctgagctgcccggaagtgatgacctttcagacgaatgctag

SEQ ID NO: 55837 - DNA, 1083 bp, Artificial Sequence
  Description of Artificial Sequence: Synthetic coding sequence
atgatgaagaagaagaagttcaagttcaaggtcgacttcgagcttgaggagctctcaagcgtgccttttgtgaacggggtgcttttttgcaaaatgcggctcctcgacggaggctcttttacagccgaaagcagcagagaggtggtccaggctaactgcgtgcgctggagaaaaaagttctctttcatgtgtaagatgagcgcatccgcagctacaggcatcctcgacccctgcatttaccgggtcagcgtacgaaaggagctcaagggcggtaaagcctacgctaagctaggctttgccgaccttaacttggcagaatttgcgggaagcggaaacaccacccgaaggtgtctgctcgaaggctacgatacgaagaacacacgccaggataattcaatccttaaagttctgatatcaatgcagctcatgtcaggcgacccgtgctttaagacccctcctagcacaagtatgtcaataccaatcgctggggaatctgagagtctccaggaagataggaagggaggggaaacactgaaagtgcatctggggattgcagatctctccgccaagtccgctagtgtgcccgacgagctgggggcttgcggacatagtcgcacatcctcctacgcatcccagcaatccaaagtctcgggctacagcacctgtcacagcaggagcagtagttttagcgagctatgccacagaaggaacacaagtgtgggatcaacctccaccggcgtcgaaagcatcctggagccctgcgatgagatcgagcaaaagatcgcagagcccaatctggatacagcagacaaggaggatacagcgtcagaaaagctgtctagatgccctgtgaaacaggacagtgttgagtctcagctgaagcgcgttgatgacacacgcgtagatgctgatgatatcgtggagaagatccttcaatctcaggattttagcctagactcgtctgcggaggaagaaggcctaagactgtttgtgggacccggagggtccacaacatttggctctcatcacctgcccaatagagttggttccggcgcttatgagcaggtggtcattaaacggtag

SEQ ID NO: 55838 - DNA, 1068 bp, Artificial Sequence
  Description of Artificial Sequence: Synthetic coding sequence
atgatgaaaaaaaaaaagttcaaatttaaggtggacttcgagctggaggagttgagttctgtgccgtttgttaatggcgtgctgttctgtaaaatgaggctactggatggagggagcttcacagcggagtcttcacgagaagtggtccaggcaaactgtgtccgatggaggaaaaagttctcattcatgtgtaaaatgagtgcgagcgccgcaaccgggatccttgacccctgcatataccgggtctctgttagaaaggagctcaagggaggcaaagcctacgcgaagctgggattcgccgatctgaatctagctgagttcgccggaagtggaaatacaactagacgctgtttgctggaggggtacgatacaaagaacacgcgtcaggacaactcaattctgaaggtgctgataagcatgcagttgatgagtggggacccgtgttttaagaccccaccgagtactagcatgagtatacccatcgccggagaatcggagtcacttcaagaggaccgtaaggggggagagactctgaaagtgcatctgggtatcgcagacttgagcgctaagtcagcgtcagtccctgatgagctgggggcatgtgggcactcgaggaccagcagctatgcaagccagcaaagcaaagtcagcggttacagcacatgccacagtcggagtagctctttctcagaactctgccataggcggaacacctccgtcggatctacctctacaggagtggaatcgatactggagccatgcgatgagattgagcagaaaatcgccgagccgaacctcgacacagccgataaggaggacacagcaagcgaaaagctgtcacgttgtccagtgaagcaggactccgtcgagagccagcttaagcgtgtggatgacacaagggttgacgccgacgacatcgttgagaagatactccagtcccaagacttctctctagacagcagcgcggaggaggaggggctgcgactgttcgtgggccctgggggttccacaacctttggaagccatcacctccctaactcctttctcaatagcgggagcctcatttag

SEQ ID NO: 55839 - DNA, 357 bp, Artificial Sequence
  Description of Artificial Sequence: Synthetic coding sequence
atgacggacaccgccgaggcagtgcctaagttcgaggagatgttcgcttcaaggttcaccgaaaatgataaagaatatcaggagtatttgaaaaggcccccagaatctccacctatcgtcgaggaatggaactcccgtgccggtgggaaccaaagaaatagagggaatagactgcaagacaaccgccagtttcgagggagggataataggtgggggtggccgtccgacaataggagcaaccagtggcacggaaggtcgtgggggaataactaccctcagcaccgccaggaaccatattatccacagcagtacggccattatggttataaccaacgcccaccgtatgggtactactag

SEQ ID NO: 55840 - DNA, 141 bp, Artificial Sequence
  Description of Artificial Sequence: Synthetic coding sequence
atggggggttgtccggtacggaagcgacgccgtaatggcagtaaagaggggaatcaccactccacacagccaaagcggaataaaagaaacccgatattccaggacagtcaggatacagaggttgccatcttcatggagtag

SEQ ID NO: 55841 - DNA, 339 bp, Artificial Sequence
  Description of Artificial Sequence: Synthetic coding sequence
atgacttgcaggaaacgacggcgaaatggtagtaaagagggcaatcatcactcaacccaacccaagcgtaataaacgcaatcctattttccaggatagtcaggacacagagttctcctggtccgacaatgaaaggagttctagcagaattaatattccagaacgagcaagcgggccagagggaaacctgaaccagattgttactgagcccgatgccaactttcctcagttcctgcacgagggctacgtgccttgccaggggctctacagccatatcaaccaaacgttaaaagaggcccatttcaactcgcttcaacagcggggacaagccccaacttag

SEQ ID NO: 55842 - DNA, 345 bp, Artificial Sequence
  Description of Artificial Sequence: Synthetic coding sequence
atgctcgtgctctggttgaaaagaagacgcaatggttctaaggaaggaaaccatcactctacacaacctaagaggaataagcgtaatcccattttccaggattcccaggatactgagttctcatggagtgacaatgaaaggagctcgagtagaataaacatccctgaaagggcatccggtcctgaaggcaatcttaaccaaattgtaacagaacctgacgcaaactttccccaatttctgcatgaaggatacgtgccctgccagggtctctattcccacattaaccagactcttaaggaggcccactttaatagtctgcagcagcggggacaggctccaacctag

SEQ ID NO: 55843 - DNA, 561 bp, Artificial Sequence
  Description of Artificial Sequence: Synthetic coding sequence
atgggtggtcggggtgcagacgcaggctcgagcggcggtactggtcctacagaggggtattcccctcccgctgcctccactagggccgcagccagagccaaagctagaggtgggggaagagggggacggcgaaatactactccatcagttccctccctgagaggcgctgccccacgaagctttcacccaccggctgctatgtcggaaagactgcgccctcggaagcgcaggaggaacggaaacgaggaagacaatcacttgccccctcagacaaaaaggtccagcagaaatccagtttttcaagactcttgggatacagagtcatccgggtccgattccggtggttcgagctcctcctcaagtagcagcattaattctccagaccgggctagcggcccagagggctccctctcacaaaccatggccggtagttctcctaacacccctcagccagtgcctgaacaatctgcactgtgtcaaggcctctacttccatattaatcaaacccttcgcgaggcccatttccattccttgcaacatagggggagaccacttacctag

SEQ ID NO: 55844 - DNA, 624 bp, Artificial Sequence
  Description of Artificial Sequence: Synthetic coding sequence
atgggtggcagaggtgcagacgccggtagtagcggcggtacgggaccaacggaaggatatagtccaccggctgcttccactcgggctgcggcacgcgctaaggctagaggcggtgggagaggaggcaggaggaacaccacccccagcgtgcccagtctgagaggagcagccccaagaagctttcaccctcctgcggctatgtctgagaggctgcgacctagaaagcggaggagaaacggcaacgaagaggataatcacctaccacctcagaccaagaggtcttccagaaaccccgtattccaggattcatgggatacagaaacagtgcctgtcatgcgcaacagcaaggagaaccgactcaggggcaacaaggcattttgtgcctcttccgggtcagacagcggtggcagtagttcatcatcatctagttcaattaactcccccgaccgggcatctggacccgaagggagtctttcgcagaccatggcgggatcatcccccaatacccctcagccggtgcctgagcagagtgctctgtgtcagggactgtacttccatatcaaccagaccctgcgtgaagcccatttccactctctacagcacagaggcaggcctctcacgtag

SEQ ID NO: 55845 - DNA, 351 bp, Artificial Sequence
  Description of Artificial Sequence: Synthetic coding sequence
atgggcggttgtccagtgagaaagcgtagaaggaatggttccaaagagggcaatcaccacagtacccaacctaaaaggaataaaagaaaccctatctttcaggattcccaggataccgaggtattcagctggagcgataacgagcggagtagtagccggattaacattcccgagcgcgcatccggccctgaagggaacttaaatcagatcgtgacggagccagacgcaaatttccctcagtttcttcatgagggattgagcaaaccagtctacgtgatcaattggtttatgtctttcggccctgaaataaaactcaacacctcacagcaaggccgtaatcaagctgtgtag

SEQ ID NO: 55846 - DNA, 348 bp, Artificial Sequence
  Description of Artificial Sequence: Synthetic coding sequence
atggggggatgcccagttcgaaagagacggagaaatggctccaaagaaggcaatcaccacagtacccagccgaaacgaaataagcgaaatcctatttttcaggacagccaagatactgagttctcttggtcggacaatgagcgctccagctcccggattaatattccagagagagctagcggacctgaggggaacctgaatcagattgtaactgagccagacgctaactttccccaatttctccacgagggcctgtcaaaacctgtctatgtgattaactggttcatgagctttggccctgagataaagctaaacacttcacagcagggcaggaatcaggccgtatag

SEQ ID NO: 55847 - DNA, 351 bp, Artificial Sequence
  Description of Artificial Sequence: Synthetic coding sequence
atggggggatgtccagtcagaaagaggagacggaacggctccaaagagggaaaccaccattcgacacagccaaagaggaacaaacggaacccaatttttcaggattctcaagatactgaggtgttctcatggtccgacaatgagagatcttcttcgcgcattaatataccagagcgcgcttccggccctgagggcaatctgaaccagatcgtcacagagcctgacgctaactttccacagttcctgcacgaaggctacgttccttgccaggggttatactcacacatcaaccagacgctcaaagaggcgcattttaatagcctgcaacagcgtggacaggcccctacgtag

SEQ ID NO: 55848 - DNA, 1071 bp, Artificial Sequence
  Description of Artificial Sequence: Synthetic coding sequence
atggcggcaacccggtctccaaccagagccagggaacgcgagcgatccggtgccccagcggctggatccgaccaagttcactcatggatgctggcaaccagtcaggctcttgatactgtatggagaatggccaaggggtttgtgatgctggccgtttcttttctcgtggcagccatctgctacttccggcgactacatctgtattccggccataaacttaagtggtggattggctacctgcaaaggaagttcaaaagaaacttgagcgttgaggctgaagtggaccttctgagctattgcgctcgagagtggaaaggtgagactcctagaaataagctgatgcggaaggcatatgaggaactgttttggcgtcatcacataaagtgcgttcgccaggtccggagagacaattacgacgccctgcgtagcgtgctgttccagatctttagccagggtatttcatttcctagctggatgaaagaaaaggacattgtgaaactgcctgaaaaactactgttctcccagggctgtaactggatacagcagtactctttcgggccagaaaagtatacaggctctaacgtatttggcaagttgcgcaaatatgtggagttgctgaagactcagtggacagaatttaacgggatccgggactatcacaagcggggaagtatgtgtaacaccttattctcggacgcaatcctggagtataagctctatgaagcactgaaatttattatgctataccaggtcaccgaggtttacgaacagatgaaaacaaagaaagtgatcccctctctgttccggctcctttttagcagagaaacgtcatcagatccactatcctttatgatgaaccaccttaatagtgtgggggacacttgtggcctggagcaaattgacatgttcatcctcggctattcattagaggtgaaaattaaggtgttccgattgtttaagtttaacagcagggacttcgaagtttgttatcccgaagagcctctgcgggattggcccgagatcagcctgctgacagagaatgatcggcattaccacattcctgttttttag

SEQ ID NO: 55849 - DNA, 1059 bp, Artificial Sequence
  Description of Artificial Sequence: Synthetic coding sequence
atgtccagagggaccatgcctcaacccgaagcatggccaggtgcatcttgcgctgagactcctgcgagagaggcagcagcgactgctagagacgggggaaaggcagcagcctctggacaaccgcgtcctgaaatgcaatgccctgccgagcatgaggaggatatgtatagagcagccgatgagatcgaaaaggaaaaggaactcttaatccacgaacggggagcatctgagcctcggttatcagtagcccctgaaatggatataatggactattgtaaaaaagagtggaggggcaacacacagaaagccacttgtatgaagatgggatacgaagaagtcagccagaaatttacctctattcggagagtgaggggcgacaactactgtgcgttacgtgccactctcttccaggccatgagtcaagccgtagggctgcctccctggcttcaagaccccgaactgatgttattacctgaaaaactgataagtaaatacaattggatcaagcagtggaaactggggctgaagttcgatgggaagaacgaggacctggtggacaaaatcaaagagagtcttacactgctgagaaaaaaatgggcaggactcgctgagatgcgcacagccgaggccagacagatcgcgtgcgatgagctcttcactaacgaagccgaggagtattcactatatgaagcggtgaagttcttgatgctcaaccgcgctatcgagctgtataatgacaaggaaaagggcaaagaagttccatttttctccgtgctgctctttgcccgagatacaagcaatgatccaggccaactgttgcggaaccaccttaaccaggtgggacatactgggggtctagagcaggtggagatgttcctcctggcctacgctgtgagacacacgattcaggtgtaccgcctcagtaagtacaataccgaggagtttatcactgtatatcccaccgaccccccaaaagactggccggtagttaccctgatcgccgaggatgatagacactacaatatacctgtcagggtgtgcgaggaaacctccttgtag

SEQ ID NO: 55850 - DNA, 510 bp, Artificial Sequence
  Description of Artificial Sequence: Synthetic coding sequence
atgcttccttctaccatgtttttggtccacctgcccttaagcacaaacagactgcactgcttgcggaacacttcgcttgagtcctacctgtgttcatttgtccacttaaaccaccccctgcacataagcgaccgagtgatcctgatttccctgcacgaggccgtccggtttagttttgctttctcttttcctcgcggaaccttgagtatcgcttactgtttgatgagttcagtgtctacctcctccgaagcaatcatgtcaaccgagctcttggccaattactgccattcctctctgcatgtgtgtatatgtatctcctcattcccaaacgaaactggaaaccatgatagtttccccggagccgtcgtatcaatcagtgatcaacccaccgatcagtgtaagctggccgctaaagaacttccgctccgaaacttgctagagtgtaggttctttgactgcatgggtgaggaggacctcatcaatctgggtgtgatcgggaccgaacggtag

SEQ ID NO: 55851 - DNA, 510 bp, Artificial Sequence
  Description of Artificial Sequence: Synthetic coding sequence
atgcttcctagtactatgttccttgttcacctgcctctgtctactaacagactgcactgcttaaggaacacaagcctggaaccgtgcctgtgctctttcgtccacctcaatcatcctctgcatatcagtgaccctgttatcctgatttcattgcatgaggctgtcagattctcattcgccttttccttcccgaggggcacactgtcaattgcttactgcctgatgtcatccgtatctacctctagtgaagcaattatgagtaccgaattgctggccaactactgccactctagcttacatgtctgtatctgtatatcttccttcccaaatgaaactgggaatcacgacagctttccaggcgctgtggtgtccatcagcgatcagcctacggaccagtgtaaactcgctgccaaagaattgccacttcgtaatctgctggagtgtcgtttctttgattgtatgggagaagaggatcttatcaatctgggggtgatcggtactgagcgttag

SEQ ID NO: 55852 - DNA, 921 bp, Artificial Sequence
  Description of Artificial Sequence: Synthetic coding sequence
atgtctacttggaaagcacgacttactaaacgtctgaagtccccctcccgtagcatgcacccgtttccctgttcagcgctgctcgcatgtttcgggaacacccgcgaatccgcgtcatttaatcagtccggggtggctgatacacatagtactgttcgcgtgcagcctgttgcaaaagcgggacgccagcccagacacccaagcgccgagggcgcacctgaaaaacgtcaggattcatccacccacgcagagagaaacggctccgctaacaggaacagttctcaccgaactgccgctcagccggctgaaactcctgaggatgtgcctggaagtttagatgacggcgcagattgcgaggctgtcgtttttcatgcaagtataccacgcccaagtatcattgatacgcctaaggaagaagagttcagggaagaacccaaatgcctagaacttgagcagaagatgacttctgattcacctccggaagatattgatcacaaggatagctacttaatcactcgctctatcatggctgagcccgactatatagaagatgacaaccctgaactcatcaggccacagaagctcatcaatcccgtgaagaccagccgcaatcaccaggacctccatagagagcttctgatgaaccaaaaacgcggacttgctccccagaacaagccggagttgcagaaggttatggagaagcgcaagagagatcaggttattaagcagaaggaggaggaggcacagaaaaaaaagtccgacctggaaatcgagctgttgaagcgacagcagaaactagaacagctcgagctggagaaacagaaactccaggaagagcaggaaaatgcaccggagttcgtcaaagtgaagggaaatctccggagaacaggtcaagaagtagcgcaagcacaggagtcctag

SEQ ID NO: 55853 - DNA, 396 bp, Artificial Sequence
  Description of Artificial Sequence: Synthetic coding sequence
atggcagaaccagactacatcgaggacgataatcctgaactaattagaccacagaaattgatcaatcccgtcaagactagtcgtaatcaccaggatttgcatagggaactgctgatgaaccagaagcggggtctggctccacagaacaaacccgaactgcaaaaggtcatggagaagcgcaagcgagaccaggtgataaagcagaaagaggaagaggcgcagaagaaaaagtctgatctcgagatagaattgctcaaaagacagcaaaagctcgaacaactggagctggagaagcaaaaactgcaagaagaacaggaaaatgcccctgagttcgttaaagtgaagggtaatctgcgcagaacaggtcaggaggtcgctcaggctcaggagagttag

SEQ ID NO: 55854 - DNA, 396 bp, Artificial Sequence
  Description of Artificial Sequence: Synthetic coding sequence
atggcagagccggactacattgaggatgacaatcctgagctgatccggccacagaagcttataaatcctgtgaagacgtctcgcaaccaccaggaccttcaccgtgaactgttgatgaatcaaaagcgtgggttggcccctcagaataaaccggagctgcagaaggtgatggagaagcggaaacgggaccaggtgattaaacagaaagaagaggaggcccagaagaaaaaatccgacctagagatagagctgttgaagcggcagcagaaactcgagcagctcgaactggaaaaacagaagcttcaggaagaacaggaaaatgcgccagaattcgtaaaggtcaaaggaaatctgcggaggaccgggcaagaggtcgctcaagcccaggagtcatag

SEQ ID NO: 55855 - DNA, 396 bp, Artificial Sequence
  Description of Artificial Sequence: Synthetic coding sequence
atggctgagcccgactacatcgaagatgacaaccccgagttgatcaggccccagaagctaatcaatcccgtcaaaacctcccggaaccatcaggatctacatcgcgaactgctcatgaatcagaagcgaggcctggcccctcagaacaaaccagaattgcagaaggtcatggaaaagaggaagagggaccaggtcatcaagcagaaagaagaagaagcgcagaaaaaaaaatctgacctggagatcgagctgctaaaacgtcagcaaaaactggaacagctggagctggaaaagcagaagttacaggaggaacaggagaatgcccctgagttcgtgaaggtcaagggcaatctacgcaggactgggcaggaagtggctcaggcacaggaatcttag

SEQ ID NO: 55856 - DNA, 396 bp, Artificial Sequence
  Description of Artificial Sequence: Synthetic coding sequence
atggccgagccggattacattgaggacgacaacccagagctgataagacctcagaagctcattaatccagtcaagaccagcagaaaccaccaggacctgcatcgcgagctgctgatgaatcagaaaagaggtttggctccccagaataaaccggaactacagaaggtgatggagaagcggaaaagggaccaggtgattaaacaaaaggaggaagaggctcaaaaaaagaagtcagacttggagatcgaactcctaaagagacagcaaaagctcgagcagctagaactagagaagcagaagctgcaagaggaacaggagaatgcaccagagtttgttaaagtgaaggggaatcttcggcgtaccggccaggaagtcgctcaagctcaggagtcctag

SEQ ID NO: 55857 - DNA, 396 bp, Artificial Sequence
  Description of Artificial Sequence: Synthetic coding sequence
atggcagagcccgattacatcgaggatgataacccggaacttattcgcccacagaagctaataaacccagtaaaaactagccggaaccaccaagacctgcatcgggaactgcttatgaatcaaaagcggggtctggctcctcagaataaaccagaactgcagaaggtaatggaaaaaaggaagagagatcaggtgataaaacaaaaggaggaagaggcgcagaaaaagaaatccgatcttgaaattgagctgctcaaaagacagcagaaactggaacagcttgagctagaaaaacagaaactgcaagaggaacaggaaaacgcacccgagtttgtgaaagtcaagggcaatctgcgcaggactgggcaagaagtggcacaggcccaggagagctag

SEQ ID NO: 55858 - DNA, 396 bp, Artificial Sequence
  Description of Artificial Sequence: Synthetic coding sequence
atggcagaacctgattacattgaggacgataacccggagcttattagaccgcaaaagctcataaacccagtgaagacaagccggaatcaccaggaccttcatcgggaacttttgatgaaccagaagcggggactggcccctcaaaacaaaccagagctgcagaaagtaatggaaaagagaaagcgtgaccaggtgatcaaacagaaagaagaagaggcgcagaagaagaaaagtgatctggaaattgaacttttgaaacgacagcaaaaactggagcagcttgagctggagaaacagaagctgcaggaagagcaagaaaacgctccagagtttgtgaaagtgaaaggtaatctacgtcggacagggcaggaggtcgctcaagcccaggaaagctag

SEQ ID NO: 55859 - DNA, 273 bp, Artificial Sequence
  Description of Artificial Sequence: Synthetic coding sequence
atggctgagccggattatatcgaagatgacaatcctgaactgataagaccacagaaactaatcaaccctgtgaagaccagtcgaaatcaccaggatctccaccgcgagttgcttatgaatcagaagcggggacttgctccccagaataagcctgaactacagaaagtgatggagaagagaaaaagagaccaagtcatcaaacagaaggaggaggaagcacagaagaagaagtccgatctggaaatcgagctgcttaagcgtcaacagaaatag

SEQ ID NO: 55860 - DNA, 387 bp, Artificial Sequence
  Description of Artificial Sequence: Synthetic coding sequence
atggcagagccagattacattgaagacgacaatcctgagctgatcagaccgcagaaactaatcaacccagtgaaaacttctagaaaccatcaggacctgcatagggagctactgatgaaccagaagaggggcctggcccctcagaacaagcctgagctacagaaagttatggaaaaaaggaagagagaccaggtgatcaaacagaaggaggaggaggcacagaagaagaaatcggacctcgaaatcgaactgctcaaaaggcagcagaagctggaacagcttgagctcgaaaagcagaagctgcaagaagaacaggaaaacgctcccgagtttgtcaaggttaagggtaacctcaggaggaccggacaagaggtcgcccaggcgtag

SEQ ID NO: 55861 - DNA, 396 bp, Artificial Sequence
  Description of Artificial Sequence: Synthetic coding sequence
atggccgaaccagactatattgaagatgacaatcccgagctgatcaggccccaaaagctgatcaatccagtgaagacctcccggaatcatcaggatctccatcgcgagttactgatgaatcagaagaggggattggcacctcagaataagccagagctacaaaaggtgatggaaaagcggaagagggatcaggtcatcaaacagaaggaagaagaggcacagaaaaaaaaatccgacttagagatagagcttctgaagagacagcagaaactggagcagctggagctggaaaagcagaagcttcaggaggagcaggaaaacgctcctgagttcgtgaaagtaaaagggaatctgaggcggactggccaagaagtcgcacaggctcaggagtcctag

SEQ ID NO: 55862 - DNA, 396 bp, Artificial Sequence
  Description of Artificial Sequence: Synthetic coding sequence
atggcagagcccgattatattgaagatgacaatcctgaactcatccgtcctcagaagctcatcaaccctgtaaaaacaagccggaatcatcaagatcttcatagagagctcctgatgaatcagaagcggggactcgccccacaaaataagccagagctgcaaaaggtcatggagaagcggaaaagagaccaggtcattaaacagaaggaggaggaggcccagaaaaagaagagcgacctggagattgaactattaaagagacagcagaaattagaacagctggaactggaaaagcaaaagctccaggaagagcaggagaatgcaccagaattcgtgaaagttaagggtaacctgaggagaactgggcaggaggtcgcccaagcgcaggaaagctag

SEQ ID NO: 55863 - DNA, 204 bp, Artificial Sequence
  Description of Artificial Sequence: Synthetic coding sequence
atggccgagcccgactacatagaagatgacaacccggagttaatccgcccacagaagctgattaacccagtgaaaacctcacgcaaccatcaggacttgcacagagaactgctcatgaatcagaagagaggtttggcccctcagaacaaaccagaattacagaaagtaatggagaagagaaagcgcgaccaggtgattaagtag

SEQ ID NO: 55864 - DNA, 306 bp, Artificial Sequence
  Description of Artificial Sequence: Synthetic coding sequence
atggcagagccggattatattgaggacgataaccccgagctgatccggccacaaaagttgattaacccagtcaagacaagccgaaatcaccaagatctgcaccgagaacttttaatgaatcagaagcgaggtctggccccacagaataaaccggaacttcaaaaagtgatggaaaaaagaaaacgtgaccaggtgattaagcagaaggaggaagaggcacagaaaaaaaaaagtgatctggagatagagctgttgaagagacagcaaaaattggaacagctggaattggagaagcagaagctctag

SEQ ID NO: 55865 - DNA, 396 bp, Artificial Sequence
  Description of Artificial Sequence: Synthetic coding sequence
atggccgagccagattatattgaggatgacaaccctgagctgattcgaccgcaaaaattgatcaacccagtgaagaccagtaggaatcaccaggaccttcatcgggagctcctgatgaatcagaaacgcggtttagcgcctcagaacaagcctgagctgcagaaagtaatggaaaagcggaaacgcgatcaggtgatcaaacaaaaagaagaagaggcacagaagaaaaagagcgaccttgagattgagttgctcaagagacagcaaaagcttgagcagttggagctcgagaagcaaaagctccaggaggaacaagaaaacgcacctgagtttgtcaaggtgaaaggaaatttgcgacgaaccggacaagaagtagcccaggctcaggagtcatag

SEQ ID NO: 55866 - DNA, 396 bp, Artificial Sequence
  Description of Artificial Sequence: Synthetic coding sequence
atggccgagcctgattacatcgaggacgacaatccggaactgattcggcctcagaaattgatcaatcctgtcaagactagtaggaaccatcaagacctgcatcgcgaattacttatgaaccagaaaaggggcctcgcaccgcagaataaaccggagctccagaaggttatggagaaaaggaaaagagaccaagttatcaagcagaaggaggaggaagcccagaagaaaaagtccgacctggaaattgagttattgaaacggcaacagaagctggagcaactggagttggagaaacaaaaactgcaggaggaacaggagaacgcgcctgaatttgtgaaagttaagggaaatctgcgtaggacaggccaggaagtggcccaggcccaagaatcctag

SEQ ID NO: 55867 - DNA, 255 bp, Artificial Sequence
  Description of Artificial Sequence: Synthetic coding sequence
atggcagagcctgactatatcgaagacgacaacccagaactgatcagacctcagaaactaatcaatccggtgaaaacctcacggaaccaccaggatttgcatcgagaactcttgatgaaccagaaaagaggcctggcgccacagaacaaacctgagctacagaaggtaatggaaaagcgaaaacgagaccaggtaattaaacagaaggaagaagaggcccagaaaaaaaagtctgacctggaaattgaattgtag

SEQ ID NO: 55868 - DNA, 282 bp, Artificial Sequence
  Description of Artificial Sequence: Synthetic coding sequence
atggccgagcccgactatattgaagacgacaaccctgaactcatcagaccccaaaaactgattaacccagtcaaaaccagtcgcaaccaccaggacttacaccgcgagcttctgatgaatcaaaagaggggtcttgcacctcagaacaaacccgagctccagaaggtgatggagaagcgcaaacgagaccaggtgatcaagcagaaggaagaggaagctcaaaagaagaaatcagatttggaaatagaactccttaaacgacagcagaagctggaacagtag

SEQ ID NO: 55869 - DNA, 381 bp, Artificial Sequence
  Description of Artificial Sequence: Synthetic coding sequence
atggcagaaccagattacatcgaggacgacaaccccgagctgattagacctcagaaattgatcaacccagtcaagacgagccggaaccaccaggatctgcacagagagctcttgatgaatcagaaacgagggctggcacctcagaacaaacctgaactgcagaaggtgatggaaaagcggaagcgtgaccaggtgattaagcagaaggaagaggaagcgcagaagaagaagagcgatcttgaaatcgaacttctgaagagacaacagaagctggaacagcttgagctggagaaacagaagttacaagaggagcaggaaaacgcacccgagttcgtcaaagtgaagggcaacctgaggagaaccggccaggaggttgcgtag

SEQ ID NO: 55870 - DNA, 378 bp, Artificial Sequence
  Description of Artificial Sequence: Synthetic coding sequence
atggccgagccagactacatagaagatgacaatccagaactgatacgccctcagaaactgataaaccctgtgaagacatcaagaaatcaccaggacctgcaccgggagttgctaatgaatcagaaacgcggtctggcaccccagaataaacctgaactccaaaaagtgatggagaaaaggaagcgtgaccaggtcatcaagcagaaggaggaggaggcccagaaaaagaagtcggacctggagatcgagctgctgaaacgacagcagaagctggagcagttggagctcgaaaaacaaaagctacaggaggaacaggagaacgcccctgaattcgtgaaagtcaaaggcaatttgcgtcggactggccaagaagtttag

SEQ ID NO: 55871 - DNA, 396 bp, Artificial Sequence
  Description of Artificial Sequence: Synthetic coding sequence
atggctgagccggattatatagaggatgataatcctgaactgattcgtccccaaaaactgatcaaccccgtaaagacatcccggaatcaccaggatctacacagggagctgttaatgaatcagaagcggggattagctccacagaacaagcccgagttacagaaagttatggagaaaagaaagcgcgaccaagtgataaagcagaaagaggaggaggctcagaagaagaaatccgacttagaaatagagttactgaaaaggcagcaaaaattggaacagttggaactcgaaaagcagaaactgcaggaagagcaggagaacgcaccggagtttgtgaaggtgaaggggaatctgcgacgcaccgggcaggaagttgctcaggctcaagaatcttag

SEQ ID NO: 55872 - DNA, 990 bp, Artificial Sequence
  Description of Artificial Sequence: Synthetic coding sequence
atgcctgagccaggcccaagaatgaacgggttctcactgggcgagctctgctggttgttttgttgtccaccctgcccatccaggattgctgccaaactggcatttctgccacccgaaccgacatacacggttttggcacctgaacagcgcggagccggtgcaagcgcccctgcgcctgctcaagctaccgctgctgcagccgctgctcaacctgcgccacagcagcccgaagaaggcgctggcgcaggccctggcgcatgctctcttcatctgagtgagcgcgctgactggcagtactcccagcgggagcttgatgccgtcgaagtttttttcagtagaaccgctcgagacaatagactgggctgtatgttcgtcaggtgtgccccatcatcccgctatacgctgctcttctcccatggcaacgcagttgacctggggcagatgtgctccttttacatagggttaggcagtagaattaactgcaatattttttcctatgactattctggttacggcgtcagctctgggaaacctagcgagaaaaacctgtacgcagacatagatgctgcttggcaggctctgcggactcgttacggggtgagtcccgagaacatcatcctctacggccaatctattggtactgtcccaaccgtcgacctggcctctcgatacgaatgtgcggctgtgattctgcactcaccactgatgtccgggctgcgcgtggcatttcccgatactcgaaaaacgtattgcttcgacgccttccccagcattgacaagattagtaaagtcacctcccctgtcctggtgatacatggaactgaagatgaggttatcgacttctcccacggactggcgatgtacgaaaggtgtccacgagctgtggagcccctgtgggtagaaggcgctggtcataacgacattgaactgtatgctcagtatctggaaagactgaagcagtttatatcacatgaattaccaaattcatag

SEQ ID NO: 55873 - DNA, 888 bp, Artificial Sequence
  Description of Artificial Sequence: Synthetic coding sequence
atgccggaaccaggccctcgcatgaatggtttctccttgggcgagctgtgttggttattttgctgcccgccttgtccgagtagaattgctgcaaaattagcctttctgccacctgagcccacatataccgttctggcgcctgagcagagaggtgccggagcaagtgcacctgcacccgctcaggcgactgccgctgcagccgctgcccagccagctccacaacagccagaggagggggctggggcagggccaggagcctgctctctacatttgtcagaaagggcagattggcaatactctcagcgggaactggacgctgtggaggtgtttttctctagaaccgctcgggacaacagactcggctgtatgtttgttcggtgcgcccctagctcccggtacaccctgttgtttagccacgggaacgccgtagacctgggccagatgtgctcattttacatcggcctcgggtctcggattaattgtaatatcttcagttatgattacagcggttacggagtctccagtggtaagccgagcgagaaaaacctgtacgcggatattgacgcggcatggcaggccctccgcactcgctacggagtgagcccagaaaacattatactgtatggccagtccattgggactgtaccaacagtggatctagccagctcgatagataaaatttccaaagtgacttctcccgtcctcgttatacacgggaccgaggatgaggttatcgatttttctcatggtctcgctatgtatgagagatgcccgagagctgtcgagcccctatgggtggagggcgcaggacacaacgacattgagctgtacgcacagtacctcgagagactcaagcagttcattagccacgagctcccaaattcgtag

SEQ ID NO: 55874 - DNA, 816 bp, Artificial Sequence
  Description of Artificial Sequence: Synthetic coding sequence
atgctgctggctccccctagcacgcccagcaggggcagaacccctagcgctgttgagaggctcgaggcagataaggccaaatacgtcaaaacacatcaggtgattgcgcgtaggcaggagccggcactgcgaggttcaccagggccactgactccacacccctgtaacgagctgggccctcccgctagcccaagaacacccaggcccgtacggagaggatctgggcgacgcttgccaagacccgactcactaatcttttaccgccagaaaagggactgtaaagcctccgtgaacaaggaaaacgcaaagggacagggcctggtcaggaggctattcctgggcgctccaagagatgctgcccctagttcccctgcttcaaccgagaggcctgctgcctccggcggatgggccgcacctcaggacgccccagaggcagccggaaaaagagcactctgtcccacctgctccctgccattgtcagagaaagaaagattcttcaactactgcggcctcgagcgagcactggtggaagtgctgggtgctgaacggttcagccctcagtcttggggcgctgatgcctctccccaggccggtacgtcacctcctcccggaagcggagatgcttccgattggacatcctccgatcgcggagttgattctcctggcggtgcaggcggtggcggagggtccgaggcagcgggaagcgcacgagacaggagacctcctgtgtccgtggtagagaggaacgcccgagtgatccaatggctttatggctgccagcgcgctaggggtccaccgagggaatcagaggtgtag

SEQ ID NO: 55875 - DNA, 1836 bp, Artificial Sequence
  Description of Artificial Sequence: Synthetic coding sequence
atgagctgcaagaaacaaagaagtaggaagcatagcgtgaacgagaagtgcaatatgaaaatcgagcactacttcagtcccgtgagtaaggaacagcagaataattgcagtacatcgcttatgcgtatggagagtagaggcgaccccagggccaccaccaatacccaggcacagcgcttccacagtccaaagaagaaccccgaggaccagaccatgccccaaaacagaactatttacgtgaccttgaaagttaaccaccgcaggaatcaggacatgaaactaaagctgactcacagcgaaaattcgtctctgtacatggcgttgaacaccctgcaggcagtccgaaaagagattgagacccaccagggccaggaaatgctggtgcggggtacagagggcataaaagagtacatcaacctggggatgcccctgagctgctttcctgaaggaggccaagtggtgatcacgttcagccagtctaagtcaaagcagaaagaagataaccacatctttggcagacaggataaagcttccacggaatgtgtgaaattttacattcacgccatcggcattggcaagtgcaagcgcaggatagtaaaatgcggaaagctacacaaaaaaggcaggaagctctgcgtgtacgcgttcaagggagagacaatcaaggacgccctgtgtaaagatgggagatttctgagttttctcgaaaatgatgattggaagctcatcgaaaataacgatacaatcctggagagtacacagcctgtggatgaactggagggcaggtatttccaggttgaggtggaaaaaaggatggtgccttctgctgcggcatcccagaatccagaatctgaaaagcggaacacctgcgtactgcgggaacagatcgttgctcagtaccccagcttgaagcgggagtctgagaagatcatagagaatttcaaaaagaagatgaaggtcaagaatggcgagacactcttcgaactgcatcggacgacattcggaaaagtcacaaagaatagctcatccatcaaggtggttaaactcctggtgagactgtctgatagtgtaggctatctgttctgggactccgccaccacgggctacgccacttgtttcgtgtttaagggtttatttatcctaacatgcaggcacgtaatcgactcaatcgtaggtgacggaatcgagcccagcaaatgggcaacaatcattggccagtgtgtcagagttacgttcgggtatgaggaactgaaagacaaggagaccaattactttttcgtagagccctggtttgagattcataatgaggagctcgattatgctgttctgaagctgaaggaaaacggacagcaggtgccaatggagttgtataatggtatcacaccagtaccactgtccggattaatccatatcatcgggcacccttatggagagaagaaacaaatcgacgcttgtgcagtcataccccaaggacagagagcaaaaaagtgtcaggagcgagttcagagtaagaaggccgaaagccccgagtacgttcacatgtacacccagagaagttttcagaaaatcgtgcacaacccagacgttattacatacgatactgaattttttttcggggctagcggctcacccgtgttcgactccaaaggctccttggttgccatgcacgcagccggtttcgcctacacataccagaatgagacacggagtattatcgaatttggctcaaccatggagtcaattttgttagacatcaagcaaaggcataaaccatggtatgaagaagtttttgtgaaccagcaggacgtcgaaatgatgagcgatgaggacctctag

SEQ ID NO: 55876 - DNA, 1836 bp, Artificial Sequence
  Description of Artificial Sequence: Synthetic coding sequence
atgagttgtaagaagcagcgatctagaaaacacagcgtgaatgagaagtgtaatatgaaaattgaacattatttttctccagtgtctaaagagcaacagaacaattgtagtacaagcctcatgaggatggaaagccgcggagaccctcgggctaccactaacacccaggcccagcgtttccactccccaaaaaaaaaccccgaggatcagaccatgccccagaatagaaccatctacgtaactttaaaggtgaatcacaggcgcaaccaggatatgaagctcaaactaacccacagtgagaactctagcttatatatggccctgaacacattgcaagcagtccgcaaggaaatcgagacacaccaggggcaggagatgcttgtgaggggtacagagggaatcaaggagtatattaacctgggaatgcctctaagttgtttcccggaggggggacaggtagtcatcactttcagtcagtctaagagtaaacagaaagaggacaatcacatctttgggagacaggacaaagcctctaccgagtgtgtgaagttctacatccacgctatcgggattgggaaatgcaagaggcggatagttaagtgcggaaagctgcacaagaaggggcgaaagttgtgcgtctatgcctttaagggagaaaccattaaagacgccctatgcaaggatggacgtttcttgagcttcctggagaacgacgattggaaactgatcgagaataacgataccattctggaaagtacccaacctgttgatgagctcgaggggcgatatttccaggtggaggtagaaaaacgtatggtgccctccgccgctgccagtcagaaccccgagagcgaaaaaagaaacacttgtgttctgcgcgagcagatcgtagcccagtatccgagtttgaagagagaatcagaaaaaatcatagagaattttaaaaagaaaatgaaggttaagaatggcgaaactctcttcgaactgcatcggaccaccttcgggaaagtcacaaaaaacagctcaagcatcaaggtggtgaaattgctcgtacgactgagtgacagcgtaggctatctgttctgggattcggcaaccaccggttacgcgacgtgttttgtgttcaaaggcttgttcatccttacatgcagacacgtcatagatagtatcgtcggcgacggcatcgagcctagcaagtgggccactatcatcggccagtgcgtcagagtaaccttcggttacgaagagctgaaagacaaagaaacaaattactttttcgttgagccctggtttgagatacacaacgaggaacttgattacgccgttttgaagcttaaggagaacggccaacaggttccgatggagctgtacaatggcatcacccctgtgccactctctggcctgattcacattattggtcatccttacggggagaagaagcagattgatgcctgcgcagtgatccctcaggggcagcgcgctaaaaaatgtcaggagcgggtgcagtccaaaaaagccgaaagcccagaatacgttcacatgtacacgcagcgctctttccagaaaatcgtccacaacccggacgtaattacttacgacaccgaattctttttcggggcaagcggctcccccgtgtttgacagtaaggggagcctggtggctatgcacgctgccggattcgcctatacatatcagaatgagactaggtctattattgaattcggcagtactatggagagtattctgttggatattaaacagagacacaagccctggtacgaggaggtctttgtcaatcagcaggacgtggaaatgatgagtgacgaggatctttag

SEQ ID NO: 55877 - DNA, 552 bp, Artificial Sequence
  Description of Artificial Sequence: Synthetic coding sequence
atgtcatgtaagaagcagcgaagtcggaagcattctgtcaacgagaagtgtaatatgaagattgagcattacttcagtcctgtgagcaaggagcagcagaacaattgctctacatcgttgatgaggatggagtcccgaggggatcctagggccaccacaaatacacaggcacagcggtttcactcaccgaaaaaaaatcccgaggatcagaccatgccccagaataggaccatctacgttaccctcaaggtgaatcatcgcagaaatcaagacatgaaattaaaattgactcatagtgagaactcctctctctacatggctctgaacacattgcaagccgtgcgtaaagagatagagacccatcaggggcaggaaatgctggtgagagggaccgagggcataaaggagtacatcaatctcggaatgcctcttagttgcttccccgagggcggtcaggtggtgatcaccttcagtcagtctaagtcgaagcagaaggaggacaaccatatattcggaaggcaagataaagcctcaacagagtgcgtcaaatag

SEQ ID NO: 55878 - DNA, 1836 bp, Artificial Sequence
  Description of Artificial Sequence: Synthetic coding sequence
atgagttgcaaaaagcagcgctcacggaaacatagcgtcaatgaaaaatgtaatatgaagatagagcactacttttcacccgttagcaaggaacagcagaataattgttccacctccttaatgcgaatggaatctagaggggaccccagagctacaaccaacacacaggcccagcgcttccactcccccaagaagaacccggaggatcaaactatgccccaaaataggacaatttatgttaccttaaaggtgaaccatcgcagaaaccaagatatgaagctgaaactgacacactctgagaactcctccctatacatggccctgaatacactgcaagccgtcaggaaggagatagaaactcatcagggccaagagatgctcgtgcgcggtacagagggcatcaaggagtatatcaacctggggatgccattgtcctgcttccccgagggcggtcaagtggtgattactttctcacagagcaagtcgaagcaaaaagaggataatcatatttttggcagacaagacaaggcgagcaccgagtgtgtaaagttctacatacatgcaatagggatcggtaagtgcaagcggagaattgtgaaatgcggtaagctgcataaaaaaggacgcaaattgtgcgtttacgcctttaagggagagaccattaaggacgccctatgcaaggacggacggttcctttcttttcttgagaacgatgactggaagctaattgaaaacaatgatacgatactcgaaagcacccagccagtagacgagttggaggggagatacttccaggtggaggtcgaaaagcgaatggtgccttccgctgccgctagccagaacccagagtccgaaaagcggaacacatgtgttttgagagaacagatcgtggcccagtacccatccctgaagagagagagtgagaagatcattgagaattttaagaagaaaatgaaggttaaaaacggagagacgcttttcgagttgcatcggacaacgttcggcaaggttaccaagaactcctctagcataaaagtggtgaaactcttggtgaggctctcagattcagtcggatatcttttttgggactccgccaccacagggtacgctacctgctttgtatttaagggcctcttcatcctgacatgccggcacgtgatcgactccatcgtgggcgacggtatcgaaccttcaaaatgggcgactatcatcggtcagtgcgtgcgggtgacatttggttatgaagaactcaaggacaaggagactaattatttctttgttgagccgtggtttgaaatacataacgaggagttggactatgcagttttgaagctgaaagagaacggtcagcaggtacccatggagctctacaacgggatcaccccggtcccgttgagtggtctcattcatattattggccacccttatggtgagaaaaaacagatagacgcctgtgcggtgatcccacagggtcagagggccaagaagtgccaggaacgggtccagtccaaaaaagctgagtctcccgaatacgtgcacatgtacactcagcgcagcttccagaaaattgtgcacaatccagacgtcattacgtatgacacagagtttttcttcggcgcatccgggtctccggtgttcgacagtaaaggcagtctcgtcgctatgcacgccgctggcttcgcttatacttaccaaaacgaaacccgctcaataattgagttcggatccactatggaaagtatattgctggacataaagcaaaggcataaaccgtggtacgaagaggtcttcgtgaatcaacaggatgtcgaaatgatgtctgacgaagacctgtag

SEQ ID NO: 55879 - DNA, 1836 bp, Artificial Sequence
  Description of Artificial Sequence: Synthetic coding sequence
atgtcttgtaagaaacagcgcagtcggaagcattccgttaatgaaaaatgtaatatgaaaatcgagcactatttctcgccagtctcaaaagaacaacagaacaattgttctacatctcttatgaggatggaatctaggggggaccctagagcgaccacaaacacacaagctcagagatttcattcacccaagaaaaaccccgaagaccaaactatgccccagaacagaactatctacgtgacactcaaggtcaaccaccgtagaaatcaggatatgaaattgaagctgacgcactccgagaatagtagcctctatatggcgttgaatactctacaggccgtgcgcaaggagattgaaacacatcaagggcaggagatgttggtgcgtggcactgagggaattaaagagtacattaatctggggatgcctttaagttgcttcccagagggcggacaggtggtcattactttcagtcagtccaagtccaagcagaaagaggataaccacatattcgggcgacaggataaggcttctacagaatgcgtaaagttttatattcacgccattggcatcggaaagtgcaagcggaggatagttaaatgcggtaagttacacaagaagggacgtaagctgtgtgtgtacgcctttaagggcgagacaatcaaagacgccttgtgcaaggacgggaggtttctgtcctttctggaaaatgacgactggaagctgattgagaacaacgatacaatactggaatcgacccagcccgtcgatgagcttgaggggcgttacttccaagtggaagtcgagaagaggatggtcccctcagctgccgcttcccaaaacccagagtccgaaaagcggaatacgtgtgtgttgagagagcaaatcgttgcccagtatccctctctgaagcgcgaatccgagaagatcatcgaaaatttcaagaaaaaaatgaaggtgaagaatggagaaactctgtttgaactccaccggacgacttttgggaaagtgactaaaaacagctcgtctatcaaggtggttaagctcctggtgagattgagtgacagcgtcggatacctcttctgggactccgccacaaccgggtatgctacatgctttgttttcaagggcttattcatccttacatgcagacatgtaatagattctattgtaggggatggaattgaacctagcaagtgggcaaccattatcggccaatgcgtgcgtgtgacattcgggtacgaagaacttaaggataaggaaaccaactatttttttgtggaaccttggttcgagatccacaatgaggaactcgactacgcagtgttaaaactgaaggaaaatggccagcaggttccaatggagctttacaacggaattacacctgtgccacttagcgggctgatccacatcatcgggcacccctatggtgaaaagaaacagatcgacgcgtgtgcagttattcctcaggggcagcgcgctaaaaagtgccaagaaagggttcagagtaaaaaggccgagtctccagagtacgttcacatgtatactcaacgttcctttcagaaaattgttcacaatccggatgtaattacctacgacaccgagttttttttcggagcaagcggcagtccagttttcgacagcaaagggtctctcgtcgcaatgcacgcagctggatttgcttacacttaccaaaacgagacacgttccatcatcgaatttggatcaaccatggaatccatcctgctcgacatcaagcagcggcacaagccatggtacgaagaggtatttgtcaatcagcaggatgtggagatgatgtcggatgaagacctgtag

SEQ ID NO: 55880 - DNA, 291 bp, Artificial Sequence
  Description of Artificial Sequence: Synthetic coding sequence
atgtcctgtaaaaagcagcggtccagaaaacatagtgtcaacgagaaatgtaatatgaaaattgaacattacttctcacccgtgtcaaaagagcagcagaacaactgctcaacttccctgatgcggatggaaagtcgcggtgatcctagggcaacgacgaatacacaggcacagcgcttccactcgccaaagaagaatcctgaggatcaaactatgcctcagaaccggacgatttacgtaacactgaaggtaaaccatagaaggaaccaggatatgaaattgaaactgtag

SEQ ID NO: 55881 - DNA, 1836 bp, Artificial Sequence
  Description of Artificial Sequence: Synthetic coding sequence
atgagttgcaagaagcagaggagcagaaagcattcggttaacgagaaatgcaatatgaagattgaacactacttcagtccagtgtcaaaggaacagcagaataactgctccacctcacttatgaggatggagagtcgaggggacccacgtgccaccactaacacccaggcccagaggttccattcccccaagaaaaatccagaggatcagaccatgccccagaaccgtactatttacgtgactcttaaggtgaaccataggcgaaaccaggacatgaaacttaaactgactcactctgaaaatagtagcttgtatatggccctgaacacgcttcaggccgtgaggaaagaaatagagacgcatcagggacaggagatgctcgtgcgcggtactgaaggtatcaaggagtacattaatttagggatgcctctgtcttgcttccctgaaggcggacaggtagtcattacattttctcagtctaaaagtaagcagaaggaggacaatcacattttcggaagacaagataaggcttctaccgagtgtgttaaattttacatccatgcaattggtattggcaaatgtaagagaaggatagtgaagtgcggtaaattacacaaaaaagggagaaagctctgcgtttatgcttttaagggagagaccataaaggacgccctgtgtaaggacggtcgctttctcagcttccttgaaaatgacgattggaagctgatcgaaaacaacgacaccatcttggagagtacccaacctgtggatgaactagaaggacgctactttcaagttgaggtggagaaacggatggtcccaagcgccgctgcatcacagaaccccgaatcggagaagcgcaatacctgtgtactgcgagagcagattgtcgcccaatatccctcactgaagagggagtccgaaaaaattatcgaaaactttaagaagaagatgaaggtcaagaacggagaaaccttgtttgagcttcatcgaacaacctttggaaaagtgacaaagaattcctcatctatcaaagtcgtcaaactcctggtgagattaagcgattcagtgggatatctgttctgggattccgcaacaacagggtacgctacatgcttcgtttttaaggggctgtttattctgacttgtcggcatgtcatcgactcaattgttggcgatggaattgaaccttcaaagtgggccaccatcattggtcagtgtgtacgcgtgacctttggctacgaagaactgaaagacaaggagacaaattacttcttcgtagaaccttggtttgagattcacaatgaggagctggactatgccgtcctgaaattgaaggagaacggacaacaagtccctatggagctgtacaacggcattaccccagtgccgctaagtggcctgattcatatcattggccacccatacggcgaaaagaagcagatcgacgcctgtgctgtgatccctcaggggcagagagccaagaagtgtcaggaacgggtccagtctaagaaggctgagtcccccgaatacgtacacatgtatactcagcgctcttttcagaaaattgttcacaatccagatgtcataacatatgacactgagtttttcttcggggcatcgggcagccctgtcttcgactcaaaaggcagcttggtcgctatgcatgcagcaggctttgcgtatacctatcaaaatgaaacacgtagcattatcgagtttggctctaccatggaatcaattctcttggatatcaagcagcgccacaaaccctggtatgaggaagtatttgttaatcagcaggacgtggaaatgatgtccgacgaggacctatag

SEQ ID NO: 55882 - DNA, 2205 bp, Artificial Sequence
  Description of Artificial Sequence: Synthetic coding sequence
atgaactcaatgaagactgaagaaaataagtctttctcagccatggaggatgaccagcggacacgtcctgaggtttcaaaagatactgtaatgaaacagacacacgcagatacgcccgtggatcattgcctctccggaatcagaaagtgctcatcaacttttaaactgaaaagcgaggtgaacaagcatgaaacggccttggaaatgcaaaatcccaatttgaataataaagagtgttgtttcaccttcaccctgaacggcaacagtaggaaactggacagatcagtctttaccgcatatggcaaaccatcagagagcatatactcagcactatcggccaatgactacttcagtgagaggattaagaaccagtttaacaaaaacatcattgtgtacgaggaaaaaacaatagatggacatataaatcttggcatgcctctcaaatgcctgccatccgactcccatttcaaaattacgttcggacagcgtaagtcctccaaagaggatggacacatcctccggcagtgcgagaaccccaatatggagtgcatacttttccacgtcgtggccattgggagaacacggaagaagattgttaaaataaacgagctgcacgagaagggttccaagctgtgcatttacgcgttgaagggtgaaacaatcgagggagccctctgcaaggatggcagattcaggagcgacataggagaattcgagtggaagcttaaggaaggccacaaaaagatctatgggaaacaaagtatggtggacgaagtgagcggcaaggtcctggagatggacatctcaaagaaaaaggcgcttcagcaaaaggacattcacaagaagattaagcagaacgaaagcgcaaccgacgagatcaaccatcagtcactgattcagtccaaaaagaaggtccataaaccgaagaaagatggtgagaccaaggacgtggagcactcacgcgagcaaatcttgccaccgcaggatctgtctcattatatcaaggataaaaccaggcagactattcccaggattagaaattattacttctgtagcttgccacgtaagtatcggcaaatcaactcccaggtgcgccgacgcccacatctcggaaggagatatgccattaacctggatgtacagaaagaagcaataaacttattgaaaaactatcagacgctcaacgaagctattatgcaccagtacccgaactttaaggaggaagctcagtgggtgcgaaagtattttcgcgaagaacagaagcgcatgaatctttcccccgctaagcagtttaatatttacaagaaggactttggcaaaatgacagccaactctgtttcagtggccacttgtgaacagctgacctattactctaaatctgtaggttttatgcagtgggataacaatgggaatacgggtaacgctacttgctttgtctttaacgggggatatatatttacgtgccggcacgttgttcaccttatggtcgggaaaaatacccacccatccttgtggcctgatattatctcaaagtgcgccaaagtaacctttacctacaccgagttttgtccaaccccagacaattggttcagtattgaaccgtggctgaaggtttcaaatgagaacctggactacgcaatcttgaaactgaaggaaaatggcaatgcgttcccaccaggtctgtggcggcagatttcccctcagccctctaccggcctcatctacttaattggtcaccccgagggacagatcaagaagatcgatgggtgcacagtgatccctctcaatgagcgcctgaaaaagtacccaaacgactgtcaggatgggttggtggacctgtacgatacaactagcaacgtgtactgcatgtttacccaacggagcttcctttctgaggtatggaatactcacaccctcagttacgacacatgtttcagtgacggctcatccgggagcccggtgttcaatgccagtggcaaactggtggcgctgcataccttcgggctcttttaccaacgtgggtttaatgtccacgctcttatcgagttcggttactcaatggattctattctctgcgacataaagaaaaccaacgaaagtctgtacaagtctctgaacgatgaaaaactggagacttacgatgaagaaaagggaaaacaggaatcctccctacaggaccatcagatcgagccaatggagtgttag

SEQ ID NO: 55883 - DNA, 2115 bp, Artificial Sequence
  Description of Artificial Sequence: Synthetic coding sequence
atgaagcagacacatgccgacacccccgtggatcactgccttagcggcatcaggaagtgtagctcaacttttaagttgaagtcagaagtgaataaacacgaaaccgccctagagatgcaaaatcccaatctaaacaacaaagagtgctgcttcacgttcactttaaatggtaacagccggaagcttgatcggagtgtgtttaccgcttacggcaaaccgagcgagagtatctatagcgccttgagcgcgaatgattatttttcagagagaataaagaatcagtttaacaagaacataatcgtctacgaggaaaaaacaatcgacggtcatatcaatcttgggatgccacttaaatgcctcccttccgattcacactttaagataacatttggccaaagaaagagttcgaaggaggacggccacattcttcggcaatgtgaaaatcctaacatggaatgcatccttttccatgtggtagccattggcagaacccgtaagaagattgtgaaaataaatgagctacatgaaaagggatctaagctctgtatatacgctcttaagggagagactatcgagggagccctctgcaaagacggccgattcagaagcgatattggtgaatttgagtggaagctcaaggaaggacacaagaaaatttatggaaagcagagtatggttgacgaagtgagtggtaaggtgctcgagatggacatatccaaaaaaaaagctttacagcagaaagatatacataaaaagataaagcagaacgaatctgccaccgacgagatcaaccaccaatcactgatacaatctaagaagaaggtccacaaacctaaaaaggatggcgagacgaaggacgtagagcactctcgggaacaaattcttccccctcaggatctgagtcactatatcaaagacaaaaccagacaaactatccctagaatccgcaactactacttttgtagtcttccacgaaaataccgtcagatcaactcccaggtcagacgcaggccccatctcggcaggagatacgctattaatctcgacgttcaaaaagaagcaattaaccttctgaaaaactaccagacactcaacgaggccatcatgcatcaatacccaaattttaaggaagaagcacagtgggtgcgcaagtactttcgcgaggaacagaagagaatgaatttgagcccggctaaacagttcaatatctacaaaaaagattttggaaagatgacagccaattcagtgtccgtagctacctgcgagcagttgacgtattacagcaaatcagttgggttcatgcaatgggataataatggtaacactgggaacgcaacttgttttgtgttcaatggcggatatatattcacatgcagacacgtcgtccatttaatggtcggaaagaacacccacccatccctctggccggatatcattagcaaatgcgcaaaggtcacatttacttatactgaattttgccccacccccgacaattggttcagcattgaaccttggctgaaagtgtctaatgagaatctcgactatgccatactgaagctgaaagaaaatgggaacgctttcccacctggcttatggaggcagatttcccctcagccctccaccggcctgatctatcttattggccaccccgaaggccagattaaaaaaattgacgggtgtaccgtcatacccttgaacgagagactgaagaagtaccctaacgattgccaggacggccttgtggacttgtacgacaccacgtctaacgtgtactgcatgttcacccagcgaagcttcctcagcgaggtatggaacacccacactttaagctacgacacatgtttctccgacggtagctcaggctctcccgtgttcaatgcctcggggaagctggtcgccctgcatacattcggactgttctaccagcgcggttttaatgtgcacgcactgattgaatttggctactcgatggattctattttgtgtgacataaaaaagacaaatgaatcgctgtataagtcactcaatgatgagaaactcgaaacctacgacgaggaaaagggtaaacaagagagctcgttgcaggaccatcagatcgaaccaatggagtgttag

SEQ ID NO: 55884 - DNA, 2115 bp, Artificial Sequence
  Description of Artificial Sequence: Synthetic coding sequence
atgaaacagactcatgccgataccccagtggaccactgccttagcggaatcagaaaatgcagctcaacgttcaagcttaaaagcgaggtaaataagcacgaaaccgccttagagatgcagaatcccaatctgaacaataaagaatgctgcttcactttcacattaaacgggaactcccgcaaacttgataggtcagtgttcactgcctatggaaaaccgtcagaatcaatctatagcgccctgtcagctaacgactacttttctgagcggataaagaaccagttcaacaagaatattatcgtctatgaggaaaagaccatcgacggacacattaatctgggcatgcccttgaaatgccttccttcagactcccactttaagatcacctttggccaacggaagtcatccaaagaagacggccacatccttcgccagtgtgaaaatcccaatatggaatgtattctattccatgtggtggctattggacgcactcgcaaaaaaattgtcaagattaatgaactgcacgagaagggttcgaaactttgcatttacgcactgaagggggagacgatcgaaggtgccctgtgtaaggatggaagatttaggtctgacatcggtgaatttgaatggaagttgaaggaggggcataagaaaatctacggcaagcagtcgatggtagacgaagtgtccggcaaagtattagagatggacattagcaagaagaaggctctccagcagaaggacattcacaagaagataaagcagaacgagagcgcaaccgatgaaattaatcaccagagtctaatccagtcaaaaaaaaaagtgcataagccaaagaaggatggggagacgaaggatgtggagcactctcgggagcaaattcttccgcctcaggaccttagtcactacattaaagataagaccagacagacaatacctcgaatccgcaactactacttttgttctctccccagaaaataccgacaaataaattcacaggtcaggcgtaggccacacttgggacggaggtatgccatcaatcttgacgtccagaaggaggcaattaatctgctgaagaactaccagacactgaacgaagcgatcatgcaccagtacccaaatttcaaagaggaggctcaatgggtccgaaaatactttcgagaggaacagaaacgaatgaacctgtctcccgctaaacaattcaatatctataagaaagatttcggaaaaatgaccgccaattctgtgtcagtagccacttgcgaacagttgacgtattatagcaaatcagtcggctttatgcaatgggacaataacggtaacaccggcaatgccacatgttttgtgttcaacggtggttatatttttacttgcagacacgtggttcaccttatggtcggcaaaaatacccaccccagtctttggcctgatattatctctaagtgcgctaaggtgactttcacatacactgagttctgtccaacacccgacaattggttttctattgagccttggctaaaggtgtctaacgagaacctggattacgcgatactgaaactgaaagaaaacggcaatgcattcccacccggactgtggaggcagatatccccccagccctcaacaggactgatatatctgatcgggcacccagaggggcagatcaaaaagattgacgggtgcaccgtgatccccctcaatgagcggttgaaaaagtatcctaatgattgtcaggatggtctggtggacctgtacgacaccacaagcaacgtctactgcatgtttacgcaacgaagcttcctgagtgaggtctggaacacacacacactcagctacgatacctgtttcagcgacggctcaagcggcagtccagtgttcaatgcatcagggaagctggttgccctgcatacattcggccttttttaccaacggggattcaatgtgcacgcactcatagaatttggatacagcatggacagcatcctatgcgacattaaaaaaacaaacgaatcactgtacaaaagcttgaacgatgagaaactcgaaacttacgacgaggaaaaggggaagcaagagtcctcacttcaggaccatcaaattgagccgatggagtgctag

SEQ ID NO: 55885 - DNA, 489 bp, Artificial Sequence
  Description of Artificial Sequence: Synthetic coding sequence
atgaagcaaacacacgccgacacacccgtggatcattgcctttccgggatccgcaaatgtagttccaccttcaagctgaaatctgaggtcaacaaacacgaaactgcgctcgaaatgcagaatcctaacctcaacaacaaggagtgctgctttacttttaccttgaacggcaactcacgcaaacttgatagatcggtgtttaccgcttacggaaagccctccgaatccatttactcggcattgtcggctaatgattacttttcagagagaatcaaaaatcagtttaacaagaatatcattgtgtacgaggagaaaactattgacggccatattaatctgggcatgccactgaaatgcctgccgtccgatagccactttaagatcacctttgggcagaggaaaagcagcaaagaagacgggcacatcctccgccagtgcgagaacccaaacatggaatgcatcctttttcatgtggtcgccatcgggtag

SEQ ID NO: 55886 - DNA, 1212 bp, Artificial Sequence
  Description of Artificial Sequence: Synthetic coding sequence
atggtcttctgcttgagctcagaggagcctaggcggcctcttcgtagcgacatggtgcactttcaggccagcgaggtgcagcaactgttgcataataagttcgtggtaatcttgggcgatagtatacagcgcgcagtgtacaaagatcttgtgttgctcctgcaaaaggattctcttctgacagctgctcagttgaaggcgaagtatttggaggatgtcctggaagaactgacatacgggccagcacccgacctcgttataattaactcttgtctgtgggacctttcacggtatggtcgctgctctatggaaagctatagagaaaacctcgagcgggtgtttgtccgcatggatcaggttctcccagacagctgccttctagtttggaacatggccatgcctctgggcgagaggattacaggcggtttcttattacccgagttacagcctttggcaggatcactccgacgggatgtggtcgaaggtaatttttatagtgcaactttggccggtgaccactgtttcgacgtattggatctgcatttccacttccggcatgccgtacagcatagacaccgggatggcgtccactgggaccaacacgcacaccgtcacctgtctcacctgctgcttacacacgtggccgacgcctggggcgtggagctgccaaagcgagggtatcctccagatccttggatcgaggactgggcggaaatgaaccacccctttcagggcagtcaccgccagacccccgactttggcgagcacctcgctctgctgccacccccaccaagcagccttcccccacccatgccgttcccatatccactgccgcaacccagccccccacccttatttccgccacttccacaggataccccgttttttcctggacagccattccccccacatgaattcttcaactataacccagtggaggatttctctatgcctccacacctgggatgcggcccaggggtcaacttcgtgcctggtccactgccacccccaattccaggcccaaatccacatgggcagcattgggggcctgtagttcacaggggaatgcctcgttatgtgcccaactccccctatcacgtccgcaggatgggtgggccttgtcggcagaggcttcggcactccgaacgccttatccacacatacaaacttgacaggaggcctccagctcattctggcacctggcccggatag

SEQ ID NO: 55887 - DNA, 1365 bp, Artificial Sequence
  Description of Artificial Sequence: Synthetic coding sequence
atggttttctgtttgtctagcgaggagcccagaaggcccctcagaagcgacatggtgcatttccaggcaagtgaagtgcagcagctgcttcacaataaattcgtcgtgatactaggcgattccatccagagagcagtgtacaaggacctggttctcctgctccaaaaagattctcttttgacagcggcacagctgaaggctaaaggagaactgtcttttgagcaggatcaattagttgcagggggacaattgggggagctccacaacggtacccagtatagggaggtacgacagttctgctccggatccgggcaccacctcgtgcgcttttatttcctgactagagtgtacagcgagtacctggaagatgtgcttgaagaacttacatatggacccgctcccgacctcgtcatcataaattcatgtctgtgggacttgtccaggtacggacgctgtagcatggagtcataccgcgagaatcttgagcgcgtgttcgtcaggatggatcaagtgcttccggatagttgcctattggtttggaatatggccatgccactcggcgaaagaatcacgggaggattcctgctgcctgagctgcagcccctggctgggagcttgcggcgtgatgtcgtcgaaggcaacttctatagtgccactctcgcgggtgaccactgcttcgacgttctggacctgcatttccatttccgtcatgccgtgcagcacagacatagggacggcgtgcactgggatcagcacgctcaccgccacttgagtcatctgctcctgactcacgtcgccgacgcatggggcgtagaacttcccaaacgagggtatccacctgacccttggattgaggattgggctgagatgaatcatccctttcaggggtcccatcgacagacaccagactttggtgaacacctggccctgctacctcctccacctagtagcttaccaccgcctatgccatttccataccccctgccgcagccttccccaccccctctgtttcctcccttgccccaggatacccctttcttcccagggcagccgtttccacctcacgagttttttaattacaatcccgtggaagatttcagcatgccccctcacttaggatgtgggcctggagtgaattttgtgcctgggccactgcctccgccaatcccagggcctaatccgcacggccagcactggggcccagtcgtgcacagagggatgcccaggtatgtgccaaactccccataccacgttcgccgtatgggcggaccttgtagacagcgacttcggcacagcgagaggctcatacatacttacaaattagacagacgccctccggcacacagcggtacttggcccggatag

SEQ ID NO: 55888 - DNA, 465 bp, Artificial Sequence
  Description of Artificial Sequence: Synthetic coding sequence
atggtgttttgtttaagttcagaggaacccagacggccactcaggagcgacatggtgcatttccaggcctctgaggtgcagcagctgttacacaacaagttcgtagtaatcctgggcgacagcatccagcgagcagtatataaggacctggtcttgttgcttcaaaaggattcacttctgactgccgcacagctcaaggcaaaaggagaacttagcttcgagcaggaccagctggtggccggaggacagctgggtgaactgcacaatggaacccaatatagggaagtgcgacaattttgtagtggcagtggacaccaccttgtccgcttctatttcctcaccagagtttactcggagtacctggaggacgtactagaggagctgacttacggcgcatctcctagccacccgatgaattcttccacaatcattcagtggcgcacttctcgttgccaccccacttag

SEQ ID NO: 55889 - DNA, 843 bp, Artificial Sequence
  Description of Artificial Sequence: Synthetic coding sequence
atggtgttttgtctgagctccgaagaaccacggcgaccattgaggagcgatatggttcactttcaggcttcagaagtccaacagcttctccacaataaatttgtcgttattctgggagatagtatccagcgcgcagtctacaaggacctcgtgctgctgctgcagaaggactccctccttaccgcggctcagttgaaggccaagggggagttgtctttcgagcaggatcagctcgtggctggaggccagttgggcgagctgcacaacggaacacagtaccgcgaggtgagacaattttgctctgggtccggacatcatctcgtgcggttctactttctcacacgggtctacagtgagtaccttgaggacgtgcttgaggagctgacctatggacccgctcccgatctagtgattattaacagctgtttatgggatttatccagatacgggaggtgctccatggaatcttacagagagaacttggagcgggtgtttgtgaggatggatcaggtcctgccagattcttgtctgctggtatggaatatggccatgcccctcggggagaggattaccggaggatttctgttacctgaattgcagccgttggctggaagcctgagaagggatgtagtggagggaaacttttattcagccaccctggccggtgaccactgttttgacgtgttggaccttcattttcattttcggcacgccgtgcagcaccggcaccgcgacggggtgcattgggatcagcatgctcaccgacatttgtcacatctcctgctgactcacgtcgccgatgcctggggtgtggagctccccaaacggggttatcccccatag

SEQ ID NO: 55890 - DNA, 690 bp, Artificial Sequence
  Description of Artificial Sequence: Synthetic coding sequence
atggtgttttgcttgagctctgaggagcctaggaggcctcttagatcagacatggttcacttccaggccagcgaggttcagcagttgttacataacaagttcgtcgtcatcttaggagacagcattcagcgggctgtctacaaggacttggttctgctcctgcaaaaagattccctgctgacagcggctcagctgaaagctaaatatttggaagacgtgctcgaggaactaacatatggccctgcaccagatctggtcatcattaattcctgcctgtgggacctctcacggtatggcagatgttccatggagtcgtacagagagaacctggagagggtcttcgtgcggatggaccaggtactgcctgactcttgcctgcttgtttggaatatggccatgccattaggagagcgcataactgggggattcctactccccgagttacagcctctagctgggagtttgcgcagagacgtggtggagggcaatttttacagtgctacactggcaggagatcactgcttcgatgtgttagacttacacttccactttagacacgctgtccagcaccgtcatagagatggagtccattgggaccagcacgcccaccgtcacctgtctcatctgctcctgactcacgtggccgatgcctggggcgtcgagttgcccaagcggggttatccgccttag

SEQ ID NO: 55891 - DNA, 840 bp, Artificial Sequence
  Description of Artificial Sequence: Synthetic coding sequence
atgaattcttgtctgtgggatataagcagatatgggccaaatagctggagatcttacttagagaatctggagaatctgttccagtgccttgggcaggtcttgcccgagtcatgcctcttggtgtggaataccgctatgccggttggggaagaagtgacaggaggatttcttccgccaaaactcagaaggcagaaagcaacctttctgaagaacgaggtggtaaaggcaaattttcacagcgccacggaggctagaaaacataactttgacgtcctggacctccatttccactttcgccatgcgagagagaaccttcattgggatggcgtccactggaatggaagagttcatcggtgcctgtcccaactgcttctggcccatgtggcagatgcatggggagtagagctaccccatcggcaccccgtgggagagtggatcaagaaaaagaagccagggccacgcgtcgagggcccaccacaggccaaccggaaccacccagctttaccactgtcacccccactacccagtcccacctaccggccattattggggttcccgccacaaacgatcctcagttctcgcatcaatagtatagctatccagatgtccccccaccagcctatgcaggtatccagttcgaaaacgattctctggctagtgctcagctgtctctgtcctagtagcccgcaccccgtgatctcgggacttccccagtggtatatcggggtgctcgcaggtattgttcctgtcgctcctatccgcccaggcgattctgggcttgacctgcaaagagagggtccgcagcccatcctcagccagggactgaacaggaggacatag

SEQ ID NO: 55892 - DNA, 1299 bp, Artificial Sequence
  Description of Artificial Sequence: Synthetic coding sequence
atgatactactgcgagcgtctgaagtaaggcagctactgcacaacaaattcgtggtaatactaggtgacagcgtgcaccgcgcagtgtataaagatcttgtgttgctgctgcagaaagacaggctgttaactcctggtcagttgagagcacgcggagaattaaactttgagcaagatgagctggtggatggcggacaaaggggtcacatgcataatggcctcaactatagggaagtgcgggaattccgcagtgatcatcacctggtccggttctacttcctaacccgagtatattccgactatttacagacaatacttaaggagctgcagtctggcgagcatgcccctgatctggtgattatgaacagctgcctgtgggacatttcacgctatggtcccaattcttggcggtcctatttagaaaacttggagaacctcttccaatgccttgggcaggtgcttcctgagtcttgcctgctggtgtggaataccgctatgcctgtgggagaggaggtgaccggtggattcctgccaccaaagctgcgacgccagaaggccaccttccttaagaatgaggttgtcaaagccaactttcatagcgcaaccgaagcacggaagcataactttgacgtccttgatctccactttcatttccgccatgctcgggaaaacctccactgggacggcgtgcattggaatggtagagtgcatagatgtctttctcagctcttgcttgcgcatgtcgccgatgcctggggggtagagctcccccatcgccatcccgtgggggaatggatcaagaaaaagaagcccggaccccgagtagagggcccaccacaggcgaacaggaatcaccccgcactacccctgtcacccccactgccctcccctacctaccgacccctgctaggttttccaccacagaggctcccactgttgcccctgctgagtccacagccaccacctcccatccttcaccatcagggcatgcccagattcccccaaggtccacctgatgcttgcttttcaagcgaccatacgtttcagtctgaccagttctactgtcactcagacgtgccctcttcggctcacgccggattcttcgtcgaggacaattttatggtaggcccacagctgcccatgccgttctttccaacgccacgataccagaggccggctcccgttgtgcatcgcggttttgggaggtaccgccctagggggccatatacgccttggggacagcggccacggccttccaagaggcgcgcaccagccaaccccgaaccccgaccacagtag

SEQ ID NO: 55893 - DNA, 1299 bp, Artificial Sequence
  Description of Artificial Sequence: Synthetic coding sequence
atgatacttctgcgggcatcagaggtgcgccagcttttgcacaataagttcgtggtgatcctgggcgacagcgtgcatcgcgctgtatataaggacctcgtcctccttcttcagaaggataggctactcaccccaggacagctcagggctcggggagagctcaatttcgaacaagacgagttagtggatggtgggcagcgaggccacatgcacaacggtttaaactaccgcgaagtgagagaatttcgctccgaccaccatctggtgcgcttctactttctgactagggtctacagtgattacctccagaccatcctcaaggaactccagtcaggagaacacgccccagacttagttataatgaatagctgcctgtgggatatcagccgctacggtccgaacagctggcggtcctatctcgagaatctggagaatctgttccagtgtctgggacaggtgttacccgaatcctgtctcctcgtgtggaatactgctatgcccgtgggggaagaagtcacgggtggattcctgccccctaagctccgaaggcagaaagcaacatttcttaagaatgaagtggttaaggcaaacttccacagcgccacagaggcaagaaaacacaatttcgatgttctggaccttcatttccacttccggcatgcacgggagaacttgcattgggacggtgtgcactggaacggcagagtgcatcgctgtctgtcacagctcttactggcccatgtggccgacgcctggggcgtagaactgccccatcgccatcccgttggagaatggatcaaaaagaaaaaaccagggcctcgggtggaggggcctccgcaggccaatcgtaaccaccctgccctgcctctcagcccccctctcccctctccaacatataggcctttactcggctttcctccacagcggctgccactgctgcccttattatccccacaacctcctccaccaattcttcatcaccagggaatgccacgtttcccccagggtccacccgacgcctgcttcagcagcgatcacaccttccagtcagatcagttttactgtcactcagacgtgccatcttccgctcatgctggattcttcgttgaggacaatttcatggtgggtccgcagcttccgatgcctttctttccgacccctaggtaccaacggccagcaccggtagtccaccgaggcttcggtcgctatcgcccaagaggcccttatacgccctggggtcaaaggccacggccaagcaaaagaagagcccctgccaatcccgagccgcgaccgcagtag

SEQ ID NO: 55894 - DNA, 504 bp, Artificial Sequence
  Description of Artificial Sequence: Synthetic coding sequence
atgatactgctgagagcctccgaagtgcgacagctgctgcataacaagtttgtcgtgatcctgggagacagcgtgcaccgcgctgtctataaggacctggttctgctgctccagaaagatagattgctgacaccaggacagctgagagcaagaggtgagctgaattttgagcaggacgaactggtagacggcggacagaggggacacatgcataacgggctgaactaccgggaggtgcgtgagtttagatctgaccatcacttggtgcgattttactttctaactcgagtctactctgactacctccaaactatactgaaagagctccagagcggagaacatgcacccgatctggtcatcatgaactcttgcctctgggacatttcccgatacggtcccaactcatggagatcctacctggagaatctggagaacctttttcagtgtcttgggcaggtccttcccgagagctgcttgttagtctggaacaccgctatgccttag

SEQ ID NO: 55895 - DNA, 507 bp, Artificial Sequence
  Description of Artificial Sequence: Synthetic coding sequence
atgatcctgctgagggcatccgaagtgagacagctgttgcataacaaattcgtagttattctgggcgattccgtccaccgcgctgtgtacaaagatttggtgctgctactgcagaaggacagactactgactcccggacagcttcgggctcggggtgaactaaactttgaacaggacgaactggttgatggaggacagcggggacacatgcacaatggccttaactacagggaagtcagggagtttcggagcgaccaccatctagttaggttctattttctgactcgcgtttattccgattatctccagaccattctgaaagaactgcaatcaggcgagcatgccccagacttggtgatcatgaactcatgcctctgggacatcagcaggtatggacctaattcttggagatcgtatctggagaacttggagaatctgtttcaatgtctgggacaagtgttaccagaatcctgcctccttgtttggaatacggctatgcctgtctag

SEQ ID NO: 55896 - DNA, 177 bp, Artificial Sequence
  Description of Artificial Sequence: Synthetic coding sequence
atgatcttgctacgggcatccgaagtccgccaactgctgcacaataaatttgtggtcattttgggggacagcgtgcacagggctgtgtacaaggatcttgtgctactgttgcagaaggaccggctgcttactcccggacagttgcgggcacgcggtgaattgaattttgaacaatag

SEQ ID NO: 55897 - DNA, 1518 bp, Artificial Sequence
  Description of Artificial Sequence: Synthetic coding sequence
atgtcggataaagatgacatcgagacacctctgttgaccgaggccgcaccaattctggaggatggcaactgcgaacctgcaaaaaacagcgaatctgtggaccagggcgcaaaaccagaatctaagagcgagccagtggtgtccactcggaaaaggcccgagactaagccatcgagcgacctcgaaacaagtaaagtgctgcccattcaggacaacgtgtcaaaagacgtcccacaaacgcgatgggggtattggggctcctggggcaagagcattctgagctctgcttccgcaacagtagctactgtcggacagggtatttctaatgtcatcgagaaagccgaaacatcacttggcatccctggaccttccgagattagcactgaagttaagtatgtggctggtgaaaccaatgccaaagaaaatgaaaactcctcaccagtggccggtgcattcggagtgttcagtacaataagtacagctgtgcagtccaccgggaaatctgtgatttcaggagggctcgacgccctcgagttcatcggcaaaaagacgatggatgtgattgcggaaggagacccgggattcaaacgcacaaaaggtcttatgaataggaacgctacactgtcccaggtgttaagggaggctaaggagaaagaggagattcgtacatctaatgaggttacagtggaaactgataagaaaactcactacggcttgctgtttgacgagtttcaaggcctcagccatctcgaagcactggaaatgctgtcccaggagagtgagattaaggttaaaagcattctcaacagcctgtctggagaggaactggaaacgttgaaggtggagcttgaacagctgaaagagacattctctctggcagagttctgcgaagaagaagaagaagagaaaaagggagacgaagattttacaaaagacatcactgagctgttcagtcaactccacgtatcaagcaaaccggagaagttagcgcgagccagaaacacagcccacgaatggattcgcaagagtcttaccaagccactcgcagagaacgaggagggggagaaacagagtgaggcagagaacacagaacaggtgaataagaactccatcgaggatatacatgccttcgccattaggtcccttgccgagctcactgcctgctcaattgaactgtttcacaaaacagcggctctggtgttacatggtcgtaagcaagaagtaacagcaattgagaggtctcagacgctgtctcagatgaccatcgtgctctgtaaagagctgtcaagtcttagtaaggagttcactacatgtctgactacggcaggggtgaaagagatggcagatgtgctgaacccgttaatcactgcggtgttccttgaagcatccaatagcgcatcctacattcaggatgcatttcagctcctccttccagtgctggaaatttccctgatagaaaacaagattgagtctcaccggcacgagctacagggccagaagccgcttctggaacactag

SEQ ID NO: 55898 - DNA, 750 bp, Artificial Sequence
  Description of Artificial Sequence: Synthetic coding sequence
atgtcagacaaggacgacatcgagactcccctcttgactgaagccgcaccaatcctcgaagacggcaactgtgaacccgcaaaaaattccgagagcgtagaccagggcgcaaagcccgaatccaaatctgaacccgtggtttccaccaggaagagaccagagactaaaccaagttccgatcttgagacctccaaagtcttgcccattcaggataacgtgtctaaggatgtgccccaaacacgttggggatactggggcagttggggcaaaagcatcctgtcctccgcttctgctaccgtggcaaccgttggacaggggatcagtaatgtcattgagaaggcagaaacgtcacttggcattcctggacccagcgagatttcgactgaggttaaatacgtcgcaggcgagacaaatgcaaaagagaacgaaaacagtagcccagtagcgggtgcttttggggtgttctctacaataagtacggcagtgcagtcaaccggcaaaagcgtcatctccgggggtctggacgcactggagtttatcggcaaaaagacaatggacgttattgctgagggggatcctggttttaaacgcaccaagggactgatgaacaggaacgccactctttctcaggtactgagagaggccaaagagaaggaagaaattcgcacctctaatgaagtcacggtcgaaaccgataaaaaaactcactacggcctcctcttcgacgagttccaggggcttcacatctag

SEQ ID NO: 55899 - DNA, 195 bp, Artificial Sequence
  Description of Artificial Sequence: Synthetic coding sequence
atgtccgacaaagatgacatagagaccccactactgacagaggccgcacctatccttgaggatggtaactgtgagcctgccaaaaatagtgaatcggtggatcaaggtgcaaaacctgaaagtaaatctgaacctgtcgtgtccacccggaagagacctgaaactaaaccatcttctgacctggagacctcctag

SEQ ID NO: 55900 - DNA, 312 bp, Artificial Sequence
  Description of Artificial Sequence: Synthetic coding sequence
atgagtgacaaggacgatatcgaaaccccattactaactgaggcggcacctatcctggaggatggcaattgtgagcccgctaaaaactccgaaagcgttgaccagggggcaaaacctgaatctaagtccgagccagtggtaagcactcgtaagagacctgagactaagccttcaagtgatctcgagacctcaaaagtgttacccattcaggacaatgtctcaaaggacgtgccacagactagatggggatattggggatcatggggaaagtccatcttgagctcggccagcgccactgtggcgaccgtgtag

SEQ ID NO: 55901 - DNA, 378 bp, Artificial Sequence
  Description of Artificial Sequence: Synthetic coding sequence
atgagcgataaagatgatattgaaactccccttctgaccgaggcagcacccatcctcgaggatggaaactgcgaaccggctaagaactccgaaagcgtggaccagggcgctaagcccgagtcaaagagcgaaccagtcgtctcaacaaggaagcgccctgagacaaaaccctcctcagaccttgagacctctaaggtgctgcccatccaggataacgtgtctaaagacgtcccccaaacgcggtggggctactggggtagctggggtaagtcgatattatctagcgcctctgctaccgtggctacggtaggacaaggcatttcgaacgttatcgaaaaggctgaaacctcactgggcatccccggaccttctgagtag

SEQ ID NO: 55902 - DNA, 1518 bp, Artificial Sequence
  Description of Artificial Sequence: Synthetic coding sequence
atgagtgacaaagatgacattgagaccccacttctgacagaggcggctccaatcctggaagatgggaattgcgaaccggctaagaactccgaaagcgtggaccagggagcaaagccagagtcgaagtctgagccggtcgtgagtacgaggaaaaggccagagaccaaaccatcaagcgacttagagacatctaaagtactcccgatacaagacaatgtatccaaagacgtgccccaaactcgctggggatattggggatcttggggcaaatccatcttgagtagcgcatcagcgaccgtcgcaacagtcggtcagggcatctccaatgtgattgagaaagcagaaacgagcctaggcatccccggaccatcggagatctcaactgaggttaagtatgtggccggtgagacgaacgccaaggaaaatgagaactccagtcccgtggccggagcctttggagtcttttcgactattagcaccgcggtgcagagcacaggcaagagcgtgatatcaggaggacttgatgcattggagttcattggcaaaaagacaatggacgtgatcgctgaaggggatcccggatttaaacggaccaagggtttgatgaaccgcaacgccacactcagtcaagtgttgagagaagctaaggaaaaagaagaaattaggacatcaaacgaagtgaccgttgaaacagataaaaagacccactacggactgctgttcgacgagttccaggggctatctcatctggaggctctagagatgctgtctcaggaaagcgaaatcaaagtaaagtctattctgaattctttatcgggagaggagcttgaaactcttaaggtggaacttgagcaattgaaggagacattcagcttggcggagttctgcgaggaggaggaggaagaaaaaaagggcgacgaggacttcaccaaggatattacagagcttttctctcagctgcatgtcagctcaaaacctgaaaagttggcccgagcaaggaacacagctcacgagtggatacgcaaatctctgacaaagccgctcgctgaaaacgaagaaggtgaaaaacagtccgaggcggagaacaccgagcaggtaaataagaacagcattgaagacattcatgccttcgctatcagatccttggcggagcttacagcttgctctatagagctctttcacaagaccgccgctctggtccttcacggacgaaagcaggaagtaacggctatcgagaggtctcagaccctgtctcagatgactatagtgctctgcaaagagctttccagtttatcaaaggaattcactacctgtcttacaacggcgggagtcaaggaaatggccgacgtcctgaatcccctgataaccgcagtgttcctggaagcgtccaattcagccagctacatacaggacgcttttcagctgcttctacccgtgctggagatttcgttgatcgagaacaaaatagaaagtcaccgccacgagctacagggccagaagcccctgctggagcactag

SEQ ID NO: 55903 - DNA, 633 bp, Artificial Sequence
  Description of Artificial Sequence: Synthetic coding sequence
atgagtgataaggatgacatcgagactccgctgctgaccgaagcagctcccatattggaggacgggaactgcgagcctgccaaaaattcagaaagcgttgatcaaggggctaagccagagagtaagtcagaacctgtggtatctaccaggaaacgccctgaaaccaagccctcttctgaccttgagacttctaaagtgctgcccattcaggataacgtgtccaaggatgtgcctcagactcgatggggctactggggaagctgggggaaatccatcctgtcaagcgcttctgctactgtagcgaccgtggggcagggcatatctaacgtaatagaaaaagcggaaaccagtctgggtattcctggcccttcggagatctctactgaggtgaaatatgttgctggtgaaacaaacgcaaaggagaatgagaactctagccctgtggctggtgctttcggggttttctcaacaatttctaccgcagttcagagtaccggaaagtcagtcatttcgggaggtctggatgccttggaattcattggcaagaagactatggacgttattgctgagggggaccccggtttcaagaggacaaagggactaatgaacaggaacgcaacgctgagccaatag

SEQ ID NO: 55904 - DNA, 240 bp, Artificial Sequence
  Description of Artificial Sequence: Synthetic coding sequence
atgagtgacaaggatgacatcgagacacctctgctcaccgaagccgctcctatactcgaagatggcaactgcgagcctgctaaaaactctgagagcgtcgaccagggcgctaagcccgaatccaagtctgagcctgtagtaagcaccaggaagcggccagagaccaaacccagttctgacctggagacctcaaaggtactgcctatccaggacaacgtgtctaaagatgtgccgcaatag

SEQ ID NO: 55905 - DNA, 1518 bp, Artificial Sequence
  Description of Artificial Sequence: Synthetic coding sequence
atgagcgacaaggatgatatcgaaactcccctgctgaccgaggccgctccaatcctggaagacggaaactgtgaaccagccaagaattctgaatccgtggaccagggggcaaagccagaaagcaaatccgagccagtagtctcaactagaaaacgcccagagactaagcctagctctgaccttgagacgtccaaggtcctgccaattcaggacaacgttagcaaagatgttccccaaactcgctggggttactggggctcctgggggaagagcattctcagttcggcctccgcaacagttgccaccgtaggccagggtataagcaacgttatcgagaaagcagagacgtcactcggaatcccaggtccctccgaaatcagtacggaggtcaaatacgtggccggagagactaatgccaaggagaacgaaaatagtagcccagtggccggtgccttcggggttttctccactatcagcactgctgtccagagcaccgggaaaagtgtcatctcaggaggcctagatgcattggaatttatcggtaaaaagactatggacgtgattgccgagggagaccccggattcaagcgaactaagggcctgatgaatcgcaacgccacattgtctcaagtactgagggaggccaaagagaaggaggagatcagaacctctaatgaagtgactgtggagacagataagaagacccattacggactcctcttcgatgaattccaggggttgagccacctggaggcactggaaatgctctcgcaggagagtgagatcaaagtgaagtccatcctcaattcactgagcggcgaggaattggaaacattaaaggtcgaactagagcaactcaaggagaccttcagcctcgccgagttctgcgaggaggaagaagaggagaagaaaggagacgaagacttcacaaaggacatcaccgagttatttagtcagctgcacgtcagcagcaagcccgagaagctggcccgagcgcgtaacaccgctcacgagtggattcggaagtctctcacaaagcctctagccgagaacgaggagggggagaagcagtccgaagcagaaaacacggagcaagtgaacaagaactcgatcgaggacattcacgcctttgccattagatccctcgccgaactcactgcctgttcaatcgaactattccataagacagcagccttagtccttcacgggcgtaagcaggaggtgacagctattgagcgctcccagaccttaagccaaatgactattgttctctgtaaagagctctcttcattgtctaaggagttcacaacttgccttacgaccgcaggggtcaaggagatggctgatgtgcttaacccgttaatcaccgccgtgtttctggaggcgtctaacagcgcaagttatatccaggacgcttttcaattactcctgcccgtcctggagatctctctcatcgagaacaagattgaatctcaccgccacgagctgcaaggtcaaaaacccttgctagaacattag

SEQ ID NO: 55906 - DNA, 501 bp, Artificial Sequence
  Description of Artificial Sequence: Synthetic coding sequence
atgtcagacaaagatgatattgaaacccctctgcttactgaagcggctccaattctcgaggacggaaactgcgaacctgccaaaaacagcgaatcagtagatcagggggcaaaaccagagtcgaaatccgagcccgtcgtgagtaccaggaagaggccagagaccaaaccatcttccgacctcgagacgagtaaggtcctacccattcaggataacgtgagtaaggacgtgccccaaacccggtggggttactggggctcctggggtaagtcaatcctcagtagtgcctccgctacagtcgcaactgtgggacagggcatctcgaatgtgatcgagaaggcagagaccagtttgggaatccccggtcctagcgagatttccaccgaggtgaaatatgtggccggagagacaaacgccaaggagaatgagaattcctccccagtggccggtgccttcggtgttttcagtacaataagtacagcagtgcagtccactggctag

SEQ ID NO: 55907 - DNA, 48 bp, Artificial Sequence
  Description of Artificial Sequence: Synthetic coding sequence
atgtccgacaaagacgacatcgagacccccctgctgacagaagcctag

SEQ ID NO: 55908 - DNA, 2760 bp, Artificial Sequence
  Description of Artificial Sequence: Synthetic coding sequence
atggccactccttctgcagcatttgaggccctcatgaacggcgtaacttcctgggatgtgcccgaagacgctgtcccctgcgaactcctcctgattggagaagcctcttttcccgtcatggtgaacgatatgggacaggtgttgatagctgcttccagttacggaagaggtaggctggtggttgtaagccatgaggattatctggtggaagcacagctcacgccttttctattgaatgccgtcggctggctatgcagctctcctggggcacccattggcgtgcaccccagtctcgctccactcgccaagatcctggagggatcaggagtggacgcaaaggtggaaccagaggtcaaggatagcttgggtgtctactgcattgatgcctacaacgagacaatgactgagaaactcgtgaaattcatgaagtgcggcggaggattgcttattggtggccaggcatgggattgggccaaccagggcgaggacgaacgcgtcctgtttacattccccggaaatctagtgacaagcgtggcaggaatctacttcaccgataacaagggagacacttctttcttcaaggtgtctaagaagatgcctaaaatcccagttctagtcagctgcgaagatgacttgtcagacgacagagaggagctgctccatgggataagcgaactagatatatccaattctgactgttttccctcccagctcctcgtgcatggcgctctcgcgttcccgctgggcctggatagctaccacggctgtgtgatcgcagctgcccgatatggtagagggagagtggtggtcaccggacacaaggtgctgttcaccgtgggtaaattgggtcctttcctcctgaatgcagtgcggtggctagatggaggacgcagagggaaagtcgtggttcagaccgaactgagaacgctgagcgggctgctagccgtaggaggaatagacacatcaatagaaccaaatctgacctctgacgcatcagtatattgttttgaacccgtgtctgaagtaggggtcaaggagctgcaggagtttgtggctgagggcggaggacttttcgtgggagcacaggcttggtggtgggcctttaagaatccaggtgtttcgccattggctagatttcccggaaacctgcttctcaaccccttcggaataagcatcacttcacagagccttaatcctggacctttccgaactcccaaggctggcatacggacctaccattttcgaagtaccttagctgagttccaggtgatcatgggtaggaaacgaggaaatgtcgagaagggatggctggccaaactgggcccagatggggctgcatttttacagatacccgcagaagagataccagcgtacatgagtgtacatcgcctcctgaggaaacttcttagtagataccggctgccagtggctacccgtgagaacccagtgattaatgattgctgtcgtggcgctatgctgtcattggctacgggactggcacattcaggttcagacctcagcctgctggtgccggagattgaggacatgtactccagtccttatctgcgcccaagtgagtcaccgatcactgtggaagtcaactgcacaaacccaggcaccagatactgctggatgagtaccgggctgtatatccccggtcggcagatcatagaggtgtctctgcctgaggctgcggctagtgcggatctcaagattcaaattggatgccacacggacgacttaacgagggcatcaaaacttttcagagggccattggtaatcaaccgttgttgcttagacaagcccaccaagagcatcacttgcctgtggggtgggctcctgtacataatagtgcctcagaacagtaagctgggtagtgtgcctgtgaccgtgaagggcgcagtgcatgctccttattataaactgggggaaacaaccctcgaagagtggaagaggcggatacaggagaatccgggaccctggggagagctggcgaccgacaatatcatactcacagtccccaccgctaatcttagaacactggagaatccagagcctttactaaggctgtgggacgaagtaatgcaggcggtcgcccgtctaggtgcggaaccatttcctctgcggttgccacagagaatagtcgcagatgtccaaatctctgtggggtggatgcatgctggctatcctataatgtgccatctggagagtgtccaggagttaattaatgagaaactgattaggactaagggcctttggggccctgtgcatgaactgggacgcaatcaacagagacaggagtgggaattccctccccataccactgaggccacatgcaacctatggtgcgtttatgtgcacgagactgtgctgggaatacctagaagcagagccaatatcgccctgtggccgcctgtaagagagaaaagagtcaggatttacctgagtaaaggccctaacgtgaaaaattggaacgcttggactgccctggagacttacctccaactgcaggaggcatttggatgggagcctttcatcagactctttacagagtaccgcaatcagacgaacctccccactgagaacgtcgacaagatgaatctgtgggtgaagatgttctctcaccaggtgcaaaaaaatcttgccccattcttcgaggcctgggcttggcccattcagaaagaagtcgccacctcgttggcttacttacctgagtggaaggagaacatcatgaaactatatcttctgactcaaatgtag

SEQ ID NO: 55909 - DNA, 504 bp, Artificial Sequence
  Description of Artificial Sequence: Synthetic coding sequence
atggccactccttctgccgcattcgaggcgctgatgaacggggtgactagttgggatgttcctgaggacgccgtgccttgcgaactgctgctcattggcgaagctagctttccagttatggtgaatgatatgggacaggtcctgatcgccgctagcagttatggccgaggcaggctagtggtggtttctcacgaagactacttggtagaagctcaacttactcctttcctgctgaatgctgtgggctggctctgtagcagccccggagccccaattggggtccaccccagtcttgcacctctggcaaagatcttggaaggctctggtgtcgatgctaaggtggagccggaggtgaaagactcactgggtgtctattgcattgacgcctacaatgaaaccatgaccgagaagctggtaaagttcatgaagtgcggcggagggctactaatcggagggcaagcttgggactgggccaaccaaggggaggacgaacgcgtcctctag

SEQ ID NO: 55910 - DNA, 441 bp, Artificial Sequence
  Description of Artificial Sequence: Synthetic coding sequence
atggctacgccaagcgctgcatttgaagccctgatgaatggagtcacatcatgggatgtgcccgaggatgccgtgccctgtgagttgcttttaattggggaggccagctttcccgtaatggtaaatgacatgggacaggtgctgatcgccgcaagtagttacggacggggacgtctggtggtggttagccacgaggactatctagtggaagcacaactcacaccttttttacttaatgccgttggttggctttgctcatctcctggcgcacctatcggagtgcacccatcactcgcccctctcgctaagattctcgagggctctggggtggacgcaaaagtggaacccgaggtgaaagattccttgggtgtgtattgtatcgatgcgtacaacgaaacaatgaccgagaaactggtgaagtttatgaagtgtgggggttag

SEQ ID NO: 55911 - DNA, 2766 bp, Artificial Sequence
  Description of Artificial Sequence: Synthetic coding sequence
atggctactccctccgcagcctttgaagcacttatgaacggcgtgaccagttgggatgttccagaggacgccgttccatgcgaactcctcctgattggggaggccagcttccctgtgatggtgaacgatatgggacaggtgctcatagccgctagttcatacggtaggggcagactggtggtagttagccatgaagactaccttgtggaagcgcagctcacaccttttctgctgaacgccgttgggtggctctgcagcagtcccggagctcccattggggttcatccctccctggcccctttagctaaaatactcgagggttcgggcgtggatgctaaagtcgaacccgaggtgaaggatagcctgggcgtgtattgcattgatgcatacaacgaaaccatgaccgaaaagctggtgaagttcatgaaatgcggtggtgggctcctcatcggcggtcaggcatgggactgggccaatcaaggagaggatgagcgggtcctgtttactttccccggtaacctggtgacatcagtcgcaggaatttacttcaccgataacaaaggagataccagcttttttaaggtgtcaaagaagatgcctaaaatccctgtcctggtgtcttgtgaagatgacctgagcgacgatagggaagaacttttacacgggattagcgagctggatatatcaaatagcgactgctttccctcacagttgcttgtccacggcgcattagcctttccactaggcttggactcatatcacggctgcgtgatcgccgctgcacgttatggtcgaggaagggtagttgttacaggtcacaaagttctgttcaccgtggggaagctcggaccctttctgttgaatgccgtccggtggcttgacggtggacggagaggtaaggtggtggttcaaaccgaactgcgcacactgtctgggctgctggcagtgggcggtatagatacaagtattgaacccaatctaaccagcgacgcctcagtgtactgtttcgagccagtgagtgaggttggggtaaaggagctgcaggagtttgttgccgagggtggcggtctttttgtgggggctcaggcttggtggtgggcattcaagaaccccggtgtctcccccttggccaggtttcctggtaatctcctgttgaatccattcggaattagcatcacatcgcaaagtctgaaccccggaccctttaggacaccaaaggccggtatccggacataccattttcgctcgaccctcgctgagtttcaggttattatgggcagaaaaaggggaaatgtggagaagggctggctggctaagttaggcccagatggagccgcttttctgcagattcctgcagaagaaatccctgcctatatgtctgtgcatcgcttgctaaggaaactgctgtctcgctataggctgcccgtggccacgcgagagaatccagtgatcaacgattgctgtcggggagccatgcttagcctggcaactggattagcacatagcgggagtgacttaagcctacttgtgcccgagatagaagacatgtactccagcccgtacttacgaccatctgagagcccaattacagttgaagtcaactgcaccaatccgggaacacgttattgttggatgtctaccggactgtatattcccggtcgtcagatcatcgaggtatccttgccagaggcggctgcctctgccgacctgaagattcaaattggatgtcataccgatgatctaacacgcgcatcgaaattattccgtggacccctggtgattaacagatgttgtttggataagcctaccaaatcaattacgtgtttatgggggggactgctctacatcattgtccctcaaaacagcaaactagggtctgtgccggtgaccgtgaagggcgctgttcacgctccgtactataaactgggcgagacaacattggaggaatggaagcggagaattcaggaaaatcccggaccatggggcgaactggcaacagataatattattcttactgttcccaccgctaacctccgcaccttggagaatccagagcctctcttacggctctgggacgaggttatgcaggccgtagccagactgggagccgaaccctttcctctgcgtctgccacagaggatcgtcgcagatgttcagatatcagtgggttggatgcacgccggataccctatcatgtgtcatttagaaagtgtccaggagttaataaatgagaaactgatccgcaccaaaggcctgtgggggcctgtgcacgagctcggtcggaaccagcaacggcaggaatgggaattcccccctcacactaccgaagccacgtgtaatctgtggtgtgtgtacgtgcacgagaccgtgctcggcattccgcgatctagggcgaatattgcattatggccacctgtgcgggagaagcgtgtccggatctacctaagtaaggggccaaatgtcaaaaactggaatgcatggactgccctggagacatatttgcaactgcaggaagcctttggatgggagcccttcatacgactattcaccgagtataggaaccaaaccaatttacctacagagaacgtagacaagatgaacttatgggttaagatgttctcccaccaggttcagaagaacctggccccatttttcgaagcgtgggcttggccgatacagaaggaagtggcaacaagcctggcctacctgcccgaatggaaggaaaacattatgaaactatacctattgacacagatgccccactag

SEQ ID NO: 55912 - DNA, 228 bp, Artificial Sequence
  Description of Artificial Sequence: Synthetic coding sequence
atggccaccccctccgctgctttcgaggcgctgatgaatggcgtcaccagctgggatgtgccagaggacgcggtgccctgcgagctcctccttattggcgaggcctcatttccagttatggtgaacgatatggggcaggtgctgatcgctgcaagcagttacgggagaggaaggctggttgtggtcagccacgaggactacttggtcgaggcgcagctcacgccatag

SEQ ID NO: 55913 - DNA, 453 bp, Artificial Sequence
  Description of Artificial Sequence: Synthetic coding sequence
atggctactccttctgctgcctttgaggccttgatgaatggcgtgacctcttgggatgtccctgaggacgccgttccctgcgagctgttgcttatcggcgaggcgtccttccccgtgatggtcaatgacatggggcaggttttgattgcagcctctagctacggaagaggtagacttgtcgtggtttctcatgaggactatctagttgaggctcagctgactccattcttgttaaacgcagtaggatggctgtgctcctccccgggagccccaatcggggtccacccctctttggctccgctggccaaaatattggagggctccggcgtggacgcgaaggtagaacccgaagtgaaggactcactgggcgtttactgtattgatgcttacaatgaaaccatgacagagaagctcgtgaagtttatgaaatgtggcggaggtctcctgatctag

SEQ ID NO: 55914 - DNA, 2538 bp, Artificial Sequence
  Description of Artificial Sequence: Synthetic coding sequence
atggcgacaatcgccgctgcggctttcgaggccctcatggacggagtgacgtgttgggatgtccccagaggccctattcccagtgaactgcttctaataggcgaagcggcattcccagtgatggtgaacgacaaggggcaggtgcttatcgctgctagctcatacggcagggggagactcgtggtcgtgagccacgagggctacttgtctcacaccggcctggccccattcctcctgaacgccgtgagttggctctgtccatgccctggcgcacccgtgggggtgcatccaagcctggccccactagtcaatatcctgcaagatgctggtctggaggcacaagttaagccagagccaggtgagccgcttggcgtctactgtattaatgcttataacgacactcttacagctacgttgattcaattcgtgaagcatgggggtggcctgctgatcggcggacaggcctggtattgggccagccaacacggccctgataaagtgctttccaggttccccggaaacaaagtcacctcagtcgcgggagtgtacttcaccgacacctacggcgatcgagaccgctttaaagttagcaaaaaggttcctaagattccattacacgttagatatggagaagatgtgcgccaggaccagcaacagctcttagagggtatttctgagctcgacatcaggacagggggagtgccctcccagctgttggtgcacggagctctggcctttcctctaggcttggatgcctctctgaattgctttctcgcagccgctcattacggacggggacgcgtggttcttgccgcacatgaatgtctgctgtgcgcacctaagatgggtccgttccttctgaacgcggttcgctggctggctcggggtcaaaccggcaaagtcggtgtcaacacaaacctgaaggacctgtgcccgctgctatctgaacatggcctgcaatgttccttggagcctcatctgaactccgatctgtgtgtctattgctgtaaggcatactcagataaggaggctaagcagctgcaggagtttgttgccgaggggggagggctgctcatcggaggtcaggcatggtggtgggcctctcaaaacccgggacactgccctctcgccggattccctgggaacatcatcctcaactgtttcggcctctccattcttccacagaccctgaaggctgggtgcttcccggtgccaactcccgaaatgagatcatatcatttccggaaggccttaagccagttccaggcaatccttaatcacgagaacggcaatctcgagaagtcttgtctggcgaaactgagagttgacggggctgcctttttgcaaattcccgctgaaggagtaccagcttacatatcactccatcgacttttgagaaaaatgctgcgaggcagcggtctgcctgcagtctctagagagaatccagtcgctagcgattcctatgaagctgctgttctgtcattggccactgggcttgctcatagcgggactgattgcagccaacttgcacaaggactgggcacctggacctgttcctcatcattgtatccatcaaagcatcccatcactgtggagatcaacggaatcaaccccggaaataacgattgttgggtaagtaccgggctctacctgcttgagggacagaacgcagaggtatccttaagtgaggcagccgcttctgccggactgcgagtgcaaatagggtgtcatacggatgacctgaccaaggcccgaaagctgtcgcgtgcacccgttgtgacccaccagtgctggatggatagaactgagcggtccgtgagttgtctttggggaggtctgctttacgtgattgtaccaaagggtagccagttgggtcccgttcctgtcacaatcagaggggcagtacccgcaccatattacaagttgggaaaaacttcactggaggagtggaagcgccagatgcaagagaacctggcaccttggggtgagcttgccacagacaacatcattttaacagtccccaccactaacctgcaagctctgaaggatcccgagccagtgttaagactttgggacgagatgatgcaggccgtagcgagactggcagccgagccctttccgtttcggagacccgagagaatcgtggccgatgttcaaatcagtgcaggctggatgcactctgggtacccaatcatgtgtcacctagagtccgtcaaagaaatcattaatgagatggacatgcgctctagaggagtctggggtccgatacatgaactgggccataatcagcagcgtcacggttgggagttcccccctcacacgactgaggcgacttgcaacctgtggtccgtctatgttcacgaaacagtcctggggattcccagagctcaggcacacgaagccctgtcacctcctgaacgagaacggcgtattaaggcgcatctcggcaaaggtgcacctctgtgtgactggaacgtgtggactgcattagagacttatctgcaggtgctgtcccgtaatagtggcagacggggatag

SEQ ID NO: 55915 - DNA, 2448 bp, Artificial Sequence
  Description of Artificial Sequence: Synthetic coding sequence
atgaaaattttccagaaggagttcaaattcatcctgaaaaagtgcaccccaatccagaaatatcgcgaggagaatggtaactcatcctctagtccacatcatcagctgcagtcacacgcttctggccctcggtacggagaggacgtccgccaggaccagcagcagctcttagagggcattagtgagctggatatacgcaccggaggcgtcccctcacagctgctcgttcacggagccctggccttccctttaggcttagacgccagcctgaattgtttcctggcagccgcacactacggacgcggtagggtcgtcctggctgctcatgaatgtcttctctgtgctcccaagatgggtccttttttactgaatgctgtgcgctggctcgccaggggtcagactggtaaggtgggcgtgaatacgaatctgaaggacctgtgccctttgctttcagagcatgggctgcagtgttcactagaaccgcatttgaatagtgatctgtgcgtgtactgttgtaaggcttacagcgataaggaagctaaacagcttcaggagtttgtggctgagggaggaggtttgttgataggtgggcaggcgtggtggtgggcttcccagaaccctggacactgcccactggcgggtttcccaggtaacattatcctgaactgctttgggctgtcgatcttacctcagacgctgaaggctgggtgctttcccgtccccacgcctgaaatgaggtcttatcacttccggaaggccttgagccagttccaggccatactgaatcatgagaatggcaacctcgaaaaatcctgtctggccaagctgcgcgtcgatggagccgcttttttacaaatacccgctgagggcgtgcctgcctacatttcgttgcaccgtttgctaagaaaaatgctgagagggtcagggttacccgcagtcagcagagaaaaccccgtggcctccgactcctacgaagctgctgtcttatctcttgctacgggattggctcacagcgggaccgattgttcacagcttgcccaaggactaggcacttggacatgcagttccagtctttatcctagcaagcatccaatcaccgtggagattaacgggatcaacccagagtcccactccgtaatccaggtgggcatgcaatggcgggatctcagctcctgcaacctgcatctgctggggctgtcaaactccagcctgtctgcatcatgcgtcgccggtaccactggcacaagacaccatgcttggctcatcttcgtgtttctggtagaacgcgaattccacaggaaaggtaataacgattgttgggtctcaacaggtctgtacctgctggagggacagaatgccgaagtcagtctttctgaagccgcagcctccgctggactcagagtgcagattggatgccacaccgatgatcttaccaaggcgagaaaattgtctcgagcccctgtggttactcatcagtgctggatggacaggacggaacgttccgtgtcgtgcttgtggggtggactgctctacgtcatcgtgcctaagggatctcagctaggtcctgtccctgtgacgatcaggggcgcagtgcctgccccttactacaagctgggtaagacttccctggaagaatggaagcggcagatgcaggaaaatctcgcaccttggggggagcttgctactgataatattattctgaccgtgccaacaactaaccttcaagcgctgaaggatcccgagcctgtgttgcggctgtgggacgaaatgatgcaggctgttgcacgactagcagccgagccctttccgtttcgcagacccgagcggatagtggcagatgtacagatctcagccggttggatgcatagtggatacccgataatgtgccatcttgagagtgtcaaggagatcataaacgaaatggatatgaggtcacgtggtgtatggggcccaatacacgaactagggcacaatcaacagaggcacggatgggaatttcctcctcacaccaccgaagccacctgcaacctgtggagcgtgtatgtccatgagactgtcctgggcatccccagagcacaagcgcacgaggcactgtccccacccgagcgtgagaggaggattaaagcgcacctcgggaagggtgctccactgtgtgactggaacgtctggactgcccttgaaacttatctccagctccaagaggccttcgggtgggagccatttacacaattgttcgcagaataccaaacactgtcacacctccccaaagataacaccggaaggatgaatttatgggtcaagaagtttagcgagaaggtaaagaaaaacttagtcccattctttgaggcctggggttggccaattcaaaaggaagtcgcggacagcctggctagcctgcctgaatggcaagagaatcccatgcaggtttacctgcgggcaagaaagtag

SEQ ID NO: 55916 - DNA, 1695 bp, Artificial Sequence
  Description of Artificial Sequence: Synthetic coding sequence
atgggcccattcctgctaaatgccgtcagatggctggcccgaggacagaccggtaaggttggcgtgaacacgaacctgaaggacctgtgtcctttactgtccgagcatggactgcagtgctccctcgaacctcacctgaatagtgacctatgtgtttactgttgcaaagcttactcagacaaagaagcgaagcagctgcaagagttcgtcgcagaaggcggagggctgctgatcgggggtcaggcatggtggtgggcaagtcagaaccctggacactgcccattggccggattcccaggaaacataatactgaactgcttcggccttagcatcctgcctcagactctcaaggcaggctgcttcccagtgccaacacctgagatgcggagctatcactttcgcaaagctctgtcgcagtttcaggctattctgaatcacgaaaatggaaaccttgagaagtcctgcctcgcgaagctgagagtggacggtgccgcttttctgcagattcctgccgaaggggtgcccgcttacatatcattacaccggctgttacggaaaatgctccgcggaagcgggctccctgctgtctctagagagaaccctgttgcgtcagactcctatgaagcagccgtgctatccttggccacgggacttgctcacagtggcacggattgctcccagctcgctcagggattggggacatggacctgcagtagcagtctgtacccatcaaagcaccccattacagttgaaattaacggaatcaacccaggaaataacgactgctgggtgtcaactggcctgtatttactagaaggacagaacgctgaagtgagcctaagtgaggctgctgcctcagctggcttgcgtgtacaaatcggttgccacactgatgatctcacgaaggctcggaaactttctcgggctcctgtggtgacgcaccaatgttggatggatagaactgagcggtctgtaagctgcctgtgggggggattgctgtacgtcatcgtgccgaagggctcacaactggggccagtgccagtgactatccgaggtgcagtccccgctccctactataaactgggtaagacgagcctagaagagtggaaacgacagatgcaggagaatctggcaccatggggcgagctggccacagataatatcattttgactgttccaacgactaacctccaggccctaaaagaccccgaacctgtgctccgcctttgggatgagatgatgcaggccgtggcgagactggcggcagagcctttcccttttcgccgtcctgagcgtattgtggcagacgtccagatttcagccggatggatgcattccggataccccatcatgtgtcatctcgagagcgtgaaggagatcattaacgaaatggacatgaggtcaagaggagtctgggggcctattcacgaactcgggcacaatcagcagcgccacggatgggaattcccccctcacaccaccgaggcaacctgtaatctctggagcgtgtatgtccacgagacagtgttgggtatccccagagctcaggcccatgaagctctgagtccccctgagcgggagcgcaggatcaaggctcacctcgggaaaggcgctccactatgtgattggaatgtgtggacagccctcgaaacttacctgcaggtgttaagcagaaactcgggcaggcggggatag

SEQ ID NO: 55917 - DNA, 1695 bp, Artificial Sequence
  Description of Artificial Sequence: Synthetic coding sequence
atgggtccatttctactgaacgccgtgcgctggctagcacgcggacagaccgggaaagttggtgttaataccaatctgaaggatctgtgtcctctgctgagtgagcatggcttgcaatgctccctggaaccacacttgaacagcgatctctgcgtgtattgctgcaaggcatactccgacaaggaggccaagcaacttcaggagttcgtcgcagagggcggagggctgctcattggcggtcaggcctggtggtgggcatcccaaaaccccggtcattgccccctcgccggttttcctggcaatataatcctcaattgcttcggcttgagcatcttaccacagactcttaaagccggttgctttcctgtgccgacaccagaaatgagatcgtatcatttccgtaaggcattaagccaatttcaggccatcctgaaccacgaaaatgggaatctagagaagtcctgcttggccaagttgagggtggacggcgctgcctttctgcagattcccgcagagggggtccctgcttacatctctctccatcggctcctgcggaagatgctacggggaagcggccttcctgccgtctcccgggagaaccctgtggctagcgattcctacgaggctgccgtgctgtcacttgctaccggattggctcatagcggaactgattgttcccagctggcccagggacttggcacatggacatgttccagtagcctataccctagcaagcaccctatcacagttgagatcaatgggattaatccgggaaataacgattgctgggtttctaccgggctgtacctgctcgagggacagaatgccgaagtgtcccttagtgaggctgcagcctcagccggattgcgtgttcagatcgggtgccatacagacgatctcacgaaagcacggaagttatcgagggctccagttgtcacacatcagtgttggatggacaggaccgaacgatccgtgtcctgcctctggggagggctgttgtatgtgattgtcccaaaaggttcccagttaggcccagtccctgtgacgatccgaggcgctgtcccggctccctactacaaactgggtaagacaagcctcgaggaatggaagaggcagatgcaggagaatctcgccccttggggagaactggcgacagacaatatcattctaacagtgccaactacaaacttgcaggccctgaaggaccctgagccagtcctgcgactttgggacgaaatgatgcaggcggtggctaggctggctgcagagccgttcccatttcgacggcctgaaaggattgtcgcggatgtccagatctccgctgggtggatgcactccgggtatccaattatgtgtcatcttgagtccgtgaaggagatcattaatgagatggatatgcgtagtcggggagtatggggacctattcacgaactgggccataaccaacagcggcacgggtgggagtttccgccacacaccacagaagcaacatgtaacttgtggtcagtgtacgtgcacgagacagtgctcggaattccacgagctcaggcccacgaagcactctctccccctgaacgggagcgacgtattaaagcccacctggggaaaggcgcacccctgtgtgactggaacgtttggacggccctcgagacctacttgcaagtattaagccgaaacagtggacgcaggggatag

SEQ ID NO: 55918 - DNA, 2760 bp, Artificial Sequence
  Description of Artificial Sequence: Synthetic coding sequence
atggctactatcgccgctgctgcttttgaggcactgatggacggtgtgacatgctgggatgtccctcgaggtcccattccttcagaacttcttcttattggagaggctgccttcccagtcatggtgaatgacaaaggacaggtgctgatcgctgcatcctcttatggccgaggaagattggtggtggtgtcccacgagggctacctgtcccatacgggtctggctccgttcttgcttaatgctgtctcttggctgtgcccttgccccggagctcctgtgggtgtgcatccctcactggctccactggttaacatcttgcaagacgccggtcttgaagcccaggtgaagccagaacctggagaaccactgggggtctattgcataaatgcttacaacgatactctcaccgccacactcatccagttcgtgaagcacggcggaggccttctgatcgggggacaggcttggtactgggccagtcagcatgggccagataaagtactctctagattccctgggaacaaggtgacctccgtggcgggagtttactttacggacacctacggcgaccgggataggttcaaagtgtccaaaaaggtaccaaagattcctctgcacgtccggtatggggaggatgtcagacaggatcaacagcagctccttgagggtatctctgagcttgatattcgaaccggcggagtgccaagtcagctactcgtccacggcgctcttgcctttccattggggttggatgcgagcttgaattgtttcctggcagctgcgcactatggccgtgggagagtggtgctcgcggcacacgagtgccttctgtgcgcaccaaagatgggaccattcttactgaacgcagtccggtggctcgcacggggtcagaccgggaaggtcggggtgaataccaatctgaaagacctgtgcccattactcagcgaacacgggcttcagtgctccttggaaccacacctaaattccgatctctgcgtctactgctgcaaagcgtattctgacaaggaagccaagcaattacaagaatttgtagcggagggcggagggttattgatcggcggtcaggcctggtggtgggcgtcccagaatccaggacattgcccgctggctgggtttccaggaaacatcatcctgaattgctttggcttaagcatcttgcctcagacccttaaagctggctgctttcctgtccccaccccagaaatgagatcttatcatttcagaaaagcactatctcagttccaagcaatcttgaatcacgaaaacgggaacctggagaaaagttgcttagcaaagttacgggtagacggcgctgcattcttgcagatccccgcagaaggagttcctgcatacataagccttcatcggctcctacgcaagatgctccgaggttcaggtctgcctgcagtgtcaagggagaaccctgtggcaagcgatagttacgaagctgcggtactgtctcttgctacaggtctggcacactccggcacggattgctctcaattggcccaagggctcggaacttggacttgttcttcttccttgtatccttctaagcatccaatcacggtcgagataaatggcatcaatccagggaataatgactgctgggttagcacagggttgtacctcttagagggccaaaatgcagaagttagccttagcgaggccgcagcatccgccggtcttcgagtgcagattgggtgccatactgacgatctgaccaaggctcggaaactgagccgcgcacctgttgttacacaccagtgctggatggacaggactgagagatcagtctcctgcctgtggggagggttgctttacgtcatcgtgcctaagggtagtcagctgggtcccgtcccggtgactatccgcggagccgtgcctgctccctactacaagctcggcaaaacatctctcgaggaatggaagagacagatgcaagaaaacctggccccttggggcgagctggctaccgataatataatcctgaccgtcccgacaactaatctccaggccctgaaagatccagagcccgtacttcgtctgtgggatgagatgatgcaggctgtcgcacggctcgccgctgaaccgtttcccttcaggagaccagagagaatcgtggctgacgtgcagatttccgctggctggatgcactcgggatatcccataatgtgccacctggagtcagtcaaggagatcatcaacgaaatggacatgcgctcgcggggtgtatgggggcctatacatgagctgggtcataaccaacagcgtcacgggtgggaatttcctccccatacaaccgaagccacttgcaacctgtggagcgtctatgtgcacgagacagtgctaggcattccacgcgctcaagcccatgaggccctctcaccaccagaaagagagagaagaattaaagcccacctcggtaagggggctccactctgcgactggaatgtgtggaccgcgcttgagacatatctgcagctgcaggaagcgtttgggtgggagccttttacgcagctcttcgccgaataccaaacactgtcccatctccctaaggataacactggccgaatgaatctctgggttaaaaagttctctgaaaaggtgaagaagaatctcgttcccttctttgaagcttggggctggccaatccagaaagaggtggctgactcgctcgcttccctcccagaatggcaagaaaaccctatgcaagtgtaccttcgggcacgcaagtag

SEQ ID NO: 55919 - DNA, 2538 bp, Artificial Sequence
  Description of Artificial Sequence: Synthetic coding sequence
atggctactattgcagccgcagccttcgaggcactcatggatggtgtcacctgctgggacgttccgagaggacccattcccagtgagcttcttctcataggggaggctgcctttcccgttatggttaacgacaagggacaggttctgatcgcagcgtcctcttatggtcgcggacggctcgttgtggtgagtcacgaagggtacttgtcccatactggactggcaccattcctactgaacgctgtgagctggttatgcccctgtccaggcgcacctgtgggcgtccacccctcactggccccactcgtgaacatcctgcaggacgcaggcctcgaagctcaggttaaaccagagcccggagaacctcttggagtatactgcattaacgcttacaatgatacgcttactgccaccctaattcagttcgttaagcacgggggaggcctgctcatcggagggcaggcttggtattgggcatcccagcatgggcctgacaaggtgctgagtcggtttcccggaaacaaagttacatcggtagccggagtgtacttcactgacacgtacggagacagggataggtttaaggtctcaaagaaggtccccaagattccactccacgtccgctatggggaagatgttcgacaggatcagcaacagcttctcgaggggatctccgaactggatatcaggaccggcggtgtaccaagtcaactgctggtgcacggcgctctcgcctttcccctaggcttggatgccagcttgaactgcttcctggcggctgcccattatggtagaggcagggtggttctggcagctcatgagtgcctgctatgcgcaccaaagatgggcccattccttctgaacgctgtcagatggctagcgagaggccagactggcaaagtgggtgtcaataccaatcttaaggacctgtgcccccttctgtctgagcatgggctgcagtgtagccttgagccacatctgaattccgatctatgcgtttattgttgcaaggcctatagcgataaggaggccaaacaattgcaggagtttgtagccgagggtggaggactgctcatcgggggacaggcctggtggtgggccagccaaaacccgggacactgcccgctggctgggtttccaggaaacataatcctcaattgttttggtctgtccatactaccccagacattgaaggcaggctgtttcccggtcccaacgccagagatgcggtcctaccacttccggaaagcactgagtcaatttcaggcaatactgaatcatgaaaatggcaacctggaaaaatcctgcctggcaaagctgcgggtggacggcgctgcttttctgcagattccggctgaaggcgtcccggcatacatttccttacatcgcctgctgaggaaaatgctgcggggatctggactcccagcagtgtctagagagaatccagtggccagtgatagctatgaggccgcagtcctctccctggctaccggattggctcacagcggcactgactgcagccagctggcacagggccttggaacctggacatgctcctctagcctatacccaagcaaacatcctatcaccgtggaaatcaacgggatcaatcccggaaacaacgactgctgggtgagcacgggactgtatcttctggaggggcagaatgctgaggtcagcctaagcgaggcggcagccagcgctgggctgcgcgttcagataggatgtcatacagacgatctgacaaaagcgcgtaagctgtcacgtgctccggtcgtgacacatcagtgttggatggaccgcacggagcgcagtgtctcctgcctgtggggtgggttgttgtatgtcatcgtgcctaaagggtcacagctcggccctgtccccgtaactattcgtggcgcagtccccgctccctattataagctggggaaaacctcactggaagagtggaagcgccagatgcaggagaaccttgccccatggggcgagcttgctaccgacaacataattctgaccgtgcctaccaccaatctgcaagccctaaaggatccggagccagtcctaaggttatgggacgagatgatgcaggcggttgctcggctcgcagccgaacccttcccatttcgacggcctgaacgaatagtagcagacgtgcagatttccgccggatggatgcattccggttaccccattatgtgtcatctcgagagcgtgaaggaaattatcaatgaaatggatatgaggtctcgcggagtgtggggccctattcacgaactgggtcacaaccaacaacgccacggatgggaattccccccacataccacggaggccacttgtaatctgtggtccgtctacgtccatgaaaccgtgcttggaatacctagggcccaggcgcatgaggctctttcaccaccagaacgcgagaggcggattaaagcccatcttgggaagggtgccccactgtgcgattggaatgtttggactgcgctagaaacttacttgcaagtactcagcaggaacagcggcaggcgtggctag

SEQ ID NO: 55920 - DNA, 1827 bp, Artificial Sequence
  Description of Artificial Sequence: Synthetic coding sequence
atggccctcagggggccagccggactgggaccaggctcccgcagacctttagacgaggccgtcgctggtgcagaggggcgagaggcccctgccctggtcgcagctggcggagctcctgaggacgatgaagaggacgacggtcgaggacgaggattgctgcgttgggactcgttctccgcctggctccattgtgtctgtgtggtgggttttgatcttgagttgggccaagcagtcgaagtgatttaccctcagcatagcaagctgaccgacagggagaagaccaacatctgttatctgtcttttccagattccaactcgggctgtctcggggacacgcagttctgtttccgttttcgtcagtcttccggcagaagagtgtctctgcactgcttgctagatcaattcgacaaggatctcccagtgtatctcaaaaaagaccccgcttatttctacgggtacgtctacttccgtcaagtgagggacaaaacccttaagcgaggatacttccagaaatcattagtgctcatcagcaagctaccttacattcatttctttcacactgttctcaaacaaattgcacctgagtactttgagaagaatgagccttacctggaggctgcatgcaatgacgtggaccggtggcccgcacccgtccccggaaaaacccttcatttgcccatcatgggtgtcgtcatgaaagtccgaatccccacatgtcatgacaagcccggtaccacacagatagtgcagctgactcagcaggtggatacaaacatttcagttatcctgccaaccgtgcatgaagtcgacatcttccgctgcttttgccccgtcttcttgcacagtcagatgctgtgggagctagtgttgctgggtgagccactggttgtgatggcacccagccctagcgagtcgagtgagaccgtcttggcccttgtcaactgtatttcaccccttaaatatttcagtgactttcgaccgtatttcaccatccacgactccgagttcaaggaatacacaacgcggactcaggcccctcccagcgtcattctgggtgtgactaatccattctttgccaaaacactgcagcactggccacatattatcagaattggagatctgaagcccaccggcgagatccctaaacaggtaaaggtgaagaagctgaagaacctaaagaccctcgattcaaagccaggcgtttacacttcctataagccatatctgaaccgtgatgaagaaattatcaaacaattgcagaagggggtacagcaaaagcggccttcggaggcccaaagtgttatcctccggaggtactttctggagctcacccagagtttcatcattccattggaaaggtacgtagctagtctgatgccactgcagaaatctattagtccttggaaatcaccccctcagctgcgtcagttcctgccggaggagttcatgaagactctggaaaagacgggccctcagctgacgtcgcgcattaagggggactggattggactctatagacatttcctgaagtctccaaatttcgacggatggttcaagacccggaggaaagagatgacccagaagctggaggctttacacttggaggctctttgcgaggaggacctgctgctgtggattcagaagcacacagaggtcgagaccgtagatctggtgctcaaactgaagaacaagctcctgcaggccgaccgcgagcacctgcctgtgaagcctgacaccatggaaaaactccgtacacatatagacgccattatcctcgcactgcctgaggatctgcaaggcatcctccttaaaaccggaatgacttag

SEQ ID NO: 55921 - DNA, 1758 bp, Artificial Sequence
  Description of Artificial Sequence: Synthetic coding sequence
atggatgcattgctgggcactggtccaagaagggccaggggctgcctgggtgcagctgggcctacatcctcgggcagggcggcaaggacacccgctgcaccatgggctcgattctcagcctggctggaatgcgtgtgtgtggtcacttttgacctcgagctcgggcaggctctagaactggtctacccaaacgattttagactgacagataaggaaaagtcatccatttgttatttatccttcccagactcccacagcggctgcctcggggatactcagtttagctttcgcatgcggcaatgcgggggtcagaggagcccctggcacgctgatgatcgacactacaactcgcgtgcccctgtggccctgcagagagagcctgcccactattttggctatgtttacttcagacaggttaaggactccagcgttaagcgcggttattttcaaaagagcctggtgctcgtcagccgtctcccttttgtgaggctgttccaagcattgctgagcctgattgccccagagtattttgacaagttagcgccatgtctggaagctgtatgttctgaaatagatcagtggcccgctccagctccaggacaaactctcaatttacccgtcatgggcgtcgttgtacaggtcaggatcccaagcagggtggataaatcagagtcttctcctcccaagcagtttgaccaggaaaatctgcttccagcacctgtcgtactagcttctgtgcatgaactggacctcttccgttgcttcaggcccgtcctgacccatatgcagaccctttgggaactcatgctactcggtgagcctcttctggttctggccccttcacccgatgtcagttctgagatggtgctagcattgactagttgcttgcagcctttgagattttgctgcgactttcgaccatacttcacaatacatgattctgagtttaaagaattcacaacccgcacacaggccccaccaaatgttgtgcttggggtgacgaaccctttctttattaagaccttacaacactggccccacatcctgcgagtgggcgaacctaagatgtctggtgatttgccaaaacaggtaaagctgaaaaagccttctaggctgaaaacactggacaccaaaccgggtttgtacacagcctataccgcccacctgcatagggataaagccctgttgaagcgcctattgaagggggttcagaagaaacgtccctctgacgttcagtccgcactgctccgcagacatctattagaactgacacagtcgttcatcatcccattagagcactatatggcatctctgatgccactgcaaaagtcaatcactccctggaaaacccctccccaaatacaacctttcagccaggatgactttctgcggagcctggagcacgcagggccacagttgacctgtatcctgaagggcgactggttaggtctgtacagaagattttttaagtctccgcactttgatggttggtacagacaaagacacaaggagatggcactaaaactggaggcattgcatctcgaggctatatgtgaggccaatatcgaaacctggatgaaggacaagtctgaagtggaagtagtggacctcgttttgaagctgcgggagaaactagtcagagcgcaggggcaccagttgccagtcaaggaagccacacttcagcgcgctcaactgtacatagaaaccgtcatcggaagcctgccgaaggatctccaagccgtactctgtcctccttag

SEQ ID NO: 55922 - DNA, 1362 bp, Artificial Sequence
  Description of Artificial Sequence: Synthetic coding sequence
atggccggagccgctgccggagggagggggggaggagcgtgggggccaggccgagggggtgccggaggtcttagaagaggttgttcaccacctgcaccggcaggctcccctagagccggtctgcaacccttgcgagccaccattccattccagttgcagcaaccccaccagaggcgggacggagggggacgcgctgcctctgttccttgtagcgtggctcccgaaaaaagcgtatgtagaccccagccccttcaagtcaggaggacattctctctagatactatcttatcttcatatttacttgggcagtggccaagggacgccgatggcgcatttacgtgttgcactaacgataaagccactcagactccgctttcttggcaggaactcgagggtgagcgtgcctcttcctgtgcccacaaacgctctgcttcatggggctctaccgaccaccgaaaggagattagcaagctcaaacagcaactgcaacgaaccaagctgagtaggagcggtaaggagaaagaaaggggttcacccctactgggtgatcacgctgttaggggagccctaagagcatccccccctagtttcccatctgggtcgccagtgctccgactctccccatgtttgcataggagcttggagggccttaaccaggagctggaggaggtatttgtcaaagagcagggcgaggaggaactgcttagaattctcgacatcccagacgggcaccgggcacctgccccacctcaaagcggtagctgcgatcacccactgttgcttttagagcccggaaacctcgcatctagtcctagcatgtccctcgcaagcccacaaccctgcggactggctagtcacgaggagcaccggggagctgctgaggagttggcctccaccccaaatgataaggcatcctcgccaggacacccagcttttttagaagacggatccccttcccccgtgctagcttttgcagcctccccacgcccaaaccactcctacatctttaagcgggagcctcccgagggatgcgagaaagtgcgggtgtttgaggaagccacgtcgccaggacccgatctcgcctttctgaccagttgcccagacaagaataaggtacacttcaaccctacagggtcggcattttgccccgtgaatcttatgaagcctctctttcccggtatgggattcatatttcgcaactgtccttccaaccctgggtcacccctgccccctgccagtccccgaccacctcccaggaaagatcccgaggcttccaaggcgagccccctgcctttcgaaccctggcagcgcacccctcccagcgaggaacctgtcctgttccaatcctcattaatggtgtag

SEQ ID NO: 55923 - DNA, 1038 bp, Artificial Sequence
  Description of Artificial Sequence: Synthetic coding sequence
atgcgggataaagcaacccagaccgaatccgcctgggccgaggaatattctgaaaagaaaaagggaagccacaaacggagcgcatcctggggcagcacagaccagctaaaagagatcgcaaaactgaggcagcagctccagagaagcaaacactccagccggcaccaccgagacaaagagcggcagtccccgttccacggtaaccatgccgcaatcaatcagtgtcaagcgccagtgccaaagtccgcactgataccagttatcccaattaccaaatccactggtagccgctttcgcaattcggtggagggactcaatcaggagatcgagatcatcataaaagagacaggggaaaaagaagagcaactgattcctcaggatattccagatggccaccgcgcaccccctcccctggtgcagcgtagcagttccaccaggtccatagacacccaaactcccggaggtgctgataggggttccaataactcaagcagatcccagtcggtttcccctacctccttccttacaatctcaaatgagggatctgaggagagtccctgtagtgccgatgacctgctcgtagatcccagggacaaagaaaatgggaacaactcacccctgccaaaatacgctacatcaccgaagcctaataactcttatatgttcaaaagagagcctcctgagggctgtgagcgggtgaaagtgtttgaggaatgtagccccaagcagctccacgaaatccccgcattctactgccctgacaaaaataaggtcaactttattccaaagtctggttccgccttttgtctcgtttccatcttgaagcctctgctgcctacaccggatctaaccctgaaaggatccgggcattcactaactgtcactacaggaatgacaacgaccctgctccagcccatcgccgtcgctagtttgtccacaaacacagagcaggatagagttagcagaggcacatctaccgtcatgccatctgcgtctctcctgccacccccagaaccaatcgaagaggccgagggctag

SEQ ID NO: 55924 - DNA, 1770 bp, Artificial Sequence
  Description of Artificial Sequence: Synthetic coding sequence
atgagtcagcgcgtcaggcgtaatggaagtccgaccccagcaggctcgctcggcggtggagccgtggcaacagctgggggtcctgggtcacgactacagccaatgagagccaccgtcccttttcagctgaaacaacagcagcagcaacagcacggatcccctactcgatccgggggtggaggcggaggaaacaataatgggggttgctgtggtggcgcatccggcccagcaggaggagggggaggcggtgggcctcgaacagctagcaggtctactagtcccacgcgaggtggtggtaatgccgcagctcgcacctctcccacagttgcaacccaaacaggcgctagtgcaacgtcaactcgtggcacatccccgacacgcagtgccgcacctggcgcacggggatcacccccacgccctccaccgcctccccctctgttaggaaccgtgagctctccaagtagtagtcccacccacctttggaccggggaggtttcagcagctccccctccggctcgcgtacgacacagacgacggtcacctgagcagtctcgatcctcaccagaaaaacgcagtcccagcgcccctgtctgcaaggctggcgacaagaccaggcagcctagcagctcaccttcatctattatacggaggacgtcatccctggataccctcgcggcaccttatctcgcgggacactggcctagagattcgcatgggcaggccgctccgtgcatgagagacaaggctactcagaccgaatccgcctgggcggaagaatacagtgagaagaagaaagggtcacataaacgctccgcctcctggggttcaactgatcagctcaaggagatcgctaaactccggcagcagctgcagcgttcaaagcacagttctagacaccaccgggacaaagaacgccaatcacctttccatggaaaccacgccgcaatcaatcagtgtcaagctcctgtacctaagagcgcacttattcctgtaattcctataaccaagagtactggcagtcggttccgcaatagtgttgagggactgaaccaggaaatcgagatcatcatcaaggagacaggcgaaaaagaagagcagctcatcccacaagacataccggatggtcacagggcacctccaccactagtgcaaagaagtagtagcaccagaagtatcgatacgcagactcccggtggagcagacaggggcagtaacaactcaagccggtcacaatccgtgtccccaacctcttttctgaccatctccaacgaaggaagcgaggaaagcccctgcagtgcagatgatctgctagtcgaccccagagacaaggaaaacggcaataatagccctctgcctaaatacgccaccagcccaaagccaaacaacagctatatgttcaagagggaaccacccgaaggctgcgagagggttaaagtgtttgaggagtgctctcctaagcagctccacgagatccctgcattctattgcccagataagaataaggttaatttcatacctaagtctgggagcgcattttgccttgtgagcattttgaagccactgctccccacccctgatttgactttaaagggtagtgggcatagcctgacagtgacaacaggaatgaccaccacactactacagcctattgccgtggcctctctaagcactaacaccgagcaggaccgagtctctcgcggaactagcaccgtcatgccctcagcctctttgctccccccaccagagcccatcgaagaggccgaaggttag

SEQ ID NO: 55925 - DNA, 1056 bp, Artificial Sequence
  Description of Artificial Sequence: Synthetic coding sequence
atggccagtacaggctcccaagcttcagatattgacgaaatctttggcttcttcaacgatggagaacccccaacaaaaaagcctcgaaagctgcttccatccttgaaaaccaagaaacctagagagttggtcctcgtcatcggtacgggtataagtgcggcagtggccccacaggttcccgctttgaagagctggaagggcttgattcaggccctgctggatgccgctatcgactttgatctcctggaagatgaggagtctaagaagtttcaaaagtgcttacatgaagataagaaccttgtccatgtggcccacgacttgatccagaagctctcgccgagaacaagtaacgtccgtagcaccttttttaaagactgcctgtacgaggtgtttgatgaccttgagagcaagatggaggattcaggaaagcaactgctgcagtctgtccttcacctcatggagaacggggcattggttctgaccactaactttgataacctcctagaactttacgctgctgaccaaggaaagcaactggagtctctggatctcactgacgaaaaaaaggtgctcgagtgggcccaggagaagcggaagctctctgtgttacacatccatggtgtctatactaatccctccggcattgtgttgcaccctgccggataccagaacgttctacggaacaccgaggtgatgcgagagattcagaagctgtatgaaaataagtctttccttttccttggttgcggatggaccgtggatgacacgacttttcaggccttgttcctggaggctgtgaaacacaaaagcgacctagagcattttatgctcgttagacggggagatgttgacgagtttaagaaacttagagagaatatgctcgataagggcattaaagtcatttcatacggagacgactacgccgatctgcccgagtatttcaaacgtctcacgtgcgagatttctacccgcggaacctccgctgggatggtgagagaaggtcagctgaacgggagtagcgccgctcactctgagatcagaggatgcagcacttag

SEQ ID NO: 55926 - DNA, 222 bp, Artificial Sequence
  Description of Artificial Sequence: Synthetic coding sequence
atgaggctgattctcaacctctgtaggggcgcaggctgtaatcgacaggcggtggcagggcagctgctgccaagcacctggtctcttcacgcgcacggactggcaaaggaggcgccaattctgcccgtcaagaaaatctccagaagctgctcggtgaataataaggtctcaaaaaagactaccaaaccccctaccctgcggtctttcctctctccgatctag

SEQ ID NO: 55927 - DNA, 771 bp, Artificial Sequence
  Description of Artificial Sequence: Synthetic coding sequence
atggggaaaaccaaggatatcggggatgacgataccgtcgcaagtgaattctggtccggagcactcagccagccttcctccgtgccaacccgcccacgcacacccaatagggatagttggaggcgagcgtgggctgccagaggcttgcacccccgacctagcattctccagcccggacctgccagattgtcccgggctcgggctggcggtactcgctgtccacagcgcagacatggaagagccaccttctgtgcattaggcagaggcattggcgtcaggcggggacctgggccaaggcctgcaagaatccctggcttgacacttacatggaagaggatgtcagctcggcgaatgcaatgggccatgcaaaccggcggacggaatcagaccttcggaggtggcgtgcccctgttttggacctggttgactatctgttgcgccgtttggaggtcactgccctgccgtcttactcactcatgctcccgtgctttttcatccgctccgttgaaaaaaactaaatcatctatgttgccccctaagcaggcgctggccagtgcagcgaggaatctgtgtaggggagccggttgcaatcggcaggccgtcgctggccaactgctcccatcaacttggtccttacacgctcatggactcgctaaagaggcgccaatcctgcccgtcaaaaaaattagccggtcctgctcagttaacaataaagtctcaaaaaagaccacgaaaccccctaccctgaggtcctttctgtcccctatttag

SEQ ID NO: 55928 - DNA, 816 bp, Artificial Sequence
  Description of Artificial Sequence: Synthetic coding sequence
atggcccaggagaaaatggagcttgatctggagctgcctccgggtacaggcggaagtcctgccgagggcggtggctccggaggtggtggaggactgagacgctccaattctgcccctttaattcacggcttgtctgacaccagtcccgtcttccaagccgaggcgccatccgcgcgaagaaactcaactaccttccctagcaggctacaccagatcaagcaggaggagggtatggatctgattaacagagaaactgtacacgagcgtgaagttcagaccgcaatgcagatttctcacagctgggaggaaagtttctcactttcagataatgacgtcgagaaatcagcatcacctaaaaggattgacttcattcccgtgtcacctgccccttctccgacccgtggcattgggaagcagtgcttctccccttctcttcaatccttcgtcagctcaaatggcttacctccatcccctattcccagtcctactacacggttcacgacccgacgctctcagtcccctatcaactgcatccgcccaagcgtcctaggtccgctgaaacgtaaatgcgaaatggaaaccgagtatcaacccaaacggttcttccaggggataaccaacatgctgtcaagtgacgtggcccagctttccgatccgggagtgtgcgtgtcttctgatacactggatggaaactcctccagcgcgggttcgagctgcaatagtcctgccaaggtgtcaacgaccaccgatagtccagtgtctccagcgcaggctgcatcccccttcattccattggacgaattgtctagcaagtag

SEQ ID NO: 55929 - DNA, 864 bp, Artificial Sequence
  Description of Artificial Sequence: Synthetic coding sequence
atggcccaggagaaaatggagctagatctggagctgccgccagggaccggaggatcgcccgcagagggcggagggtctggtggcggtggcggattaagacgaagcaacagcgctccattgatccacggattgagtgacactagtcccgtatttcaggccgaggcaccttctgctaggcgtaattcaaccacgttcccgtcgcggcacggtctactcctgcctgcttctcctgtgagaatgcactcctcccgcttgcaccagattaaacaggaggagggcatggatctgattaatagagaaacagtgcacgagagagaagtacagactgcgatgcagatatctcattcctgggaggaatcatttagcctctcagacaatgatgtggagaagagcgcctctccaaaacggatcgattttatacctgtgtctcccgctcccagtcccactagaggcatcgggaagcagtgcttttccccctctcttcaaagtttcgtctcaagcaatggactcccaccttcccctatcccatcacccacaacccgcttcactactcgaagatcccagagtccaattaattgcatcagaccatctgtattgggtcctctgaaacgaaaatgcgaaatggagaccgaataccagcccaagaggttcttccagggcattacaaatatgctctctagtgacgtggcccagctttcagaccctggcgtttgcgtcagctctgacacactagacggaaattcttcaagcgccggttccagctgcaattcaccagccaaggtgtccacaacaactgattcccccgtgagcccagcacaggcagccagccccttcattcccctggatgagctgtccagtaagtag

SEQ ID NO: 55930 - DNA, 726 bp, Artificial Sequence
  Description of Artificial Sequence: Synthetic coding sequence
atggcacaggaaaagatggaactcgacctggagcctgacacaagctatgggggaaccttgcggagatcaagctccgcccctctcatccatgggttgtccgatctgtctcaagtgttccagccctacacactccgaactcgacgaaattccactaccatcatgtcccggcactccctgctcctgtcatcctctccgaatagaatcccttcgtccagattacaccagataaagagggaggaagggttagacatggtgaatcgagagaccgctcatgagcgcgagatgcaaactgctatgcagatctcacagagctgggacgagtcgctgagtctttccgactcagacttcgacaagcctgaaaagctgtattcaccaaaacggatcgacttcacccccgtatcccccgcaccttcccctacccggggttttggtaaaatgttcgtgtcttcaagcggtctgccaccctcccctgtgccttcgcctagaagattttcacggagatcacagtcccccgttaagtgcatccgtcccagtgtgcttggcccactgaagaggaagggtgaaatggagacagaatcccagcccaaaagactcttccagggaacaactaacatgttgagtcccgatgcggctcaactgtccgacttgtcatcctggtggtgttaccaaggggaagagatcccagcactgacaagatgcgtggagcatttacagatgaatgagtag

SEQ ID NO: 55931 - DNA, 801 bp, Artificial Sequence
  Description of Artificial Sequence: Synthetic coding sequence
atggcacaggaaaaaatggaactcgatcttgaacccgacaccagctacgggggtactctgaggagaagctcctccgcgccactgatacacgggctctccgatttgtcccaggtttttcaaccctacaccttgcgcacccgcagaaattccaccaccattatgagcagacacagtttgcttctgtcctccagccccaaccgaataccttctagcagacttcatcagatcaaacgcgaagagggcctcgacatggtgaaccgggaaaccgcacacgagagagagatgcagaccgccatgcagatttcccagtcctgggatgaaagcctcagcctgagcgactccgatttcgacaagcccgagaagctctattcgcccaaacgaatagacttcacgccagtctctcccgcacccagccctacccggggtttcggcaagatgtttgttagcagctcgggcctacccccttcccccgtaccgagccctcgaaggttttccagacgttcgcagagcccagtgaagtgcatccgcccttcggtccttggtcccttgaagagaaaaggcgagatggagacagagagccaaccaaagagactgttccagggaaccactaatatgctttcgccggacgcggcacagctgagtgaccttagttcttgttcagatatattagatggaagctcttccagcagcggtttatcaagcgacccattagccaagggaagcgcaacagccgaatccccggtggcgtgttcaaactcctgctcaagcttcattttgatggacgacttaagccccaaatag

SEQ ID NO: 55932 - DNA, 198 bp, Artificial Sequence
  Description of Artificial Sequence: Synthetic coding sequence
atggcccaagaaaaaatggaacttgatctcgagcccgacacctcctatggcggaacccttaggaggtccagctcagcacccctcatccatggactgagcgatctgagtcaggtgttccaaccttataccctaagaacgaggagaaattcgaccacaattatgagtaggcacagcttattgcatatttggcacttctag

SEQ ID NO: 55933 - DNA, 744 bp, Artificial Sequence
  Description of Artificial Sequence: Synthetic coding sequence
atggcacaagagaagatggaattggacctcgagcctgacacctcttacggcggtacactgagaaggagcagctcagctcccctgattcatggcctgagcgacctcagccaagtgtttcagccctatacactgaggacacgccgaaattccactacaatcatgtctcgccacagcttagaggaggggcttgacatggtaaacagggaaacagcgcatgagagggaaatgcagacagccatgcagatctctcagagttgggatgaatctcttagcctcagcgactccgacttcgacaaaccagagaagctgtactcccctaagcggatcgattttacacctgtatctccggcaccatcaccgacgcggggattcggcaagatgttcgtctcatcatctggccttccaccctctcctgtcccgtcacctcggcgattctcacggagatctcagtcccccgtgaaatgcattagaccatccgttctgggtccacttaaacggaagggagaaatggaaacagagtcccagcctaagcgcctgttccagggaactaccaatatgctgtctccagacgccgctcagctgagtgatttgagcagctgttcagacatcctggacggctctagttcgtctagcggactgagttcggaccccctggctaagggttctgcaacagccgaatccccagtggcttgctccaactcctgttcctctttcatcctgatggacgacttgagtcccaaatag

SEQ ID NO: 55934 - DNA, 336 bp, Artificial Sequence
  Description of Artificial Sequence: Synthetic coding sequence
atggcccaagaaaagatggaattagatctggagcctgacactagctatgggggaacactgcgtcggagctccagcgctccactgatccacgggctgtccgacctaagtcaggtctttcagccctataccctgaggactcgcagaaacagcacaactatcatgagccggcacagcctgctgttagtgccgaagggttacatggagagggttgacaaaatttataaacggcatcaggaagaaggactggatatggttaatagagaaaccgcgcacgaacgtgagatgcagactgcaatgcagatttcccagtcgtgggacgagtctttgagtctgtag

SEQ ID NO: 55935 - DNA, 747 bp, Artificial Sequence
  Description of Artificial Sequence: Synthetic coding sequence
atggcacaggaaaagatggagcttgatctggagccagacaccagttacggcggaacgttgcggcgatcgtccagcgctcccctcattcacgggttgagtgacctatcccaggtattccaaccttacactctcaggaccaggagaaactccacaaccatcatgagccgacactcgctggaagaggggttggacatggtgaaccgcgaaactgctcatgaaagagaaatgcagacagcaatgcaaatcagtcaatcctgggacgaaagtctgtctctgtccgattcagatttcgacaaacccgaaaaactgtattcccccaagcgcatcgacttcacgcctgtaagtccagctccatcgcctaccaggggatttgggaaaatgtttgtgtccagctcaggcttgccgccaagccctgttccaagcccaagacgttttagcagcaggcggtcccagtctcctgtgaagtgcatcaggccgtcagtcctgggcccactcaagcggaaaggcgaaatggaaacagagtcacagccgaagcgcctgtttcagggaaccaccaacatgttaagccccgacgcagctcagctgtccgatcttagctcatgctccgatatcctggatgggagtagctcatccagcgggctttctagtgatcctctggcaaagggctccgcaactgcagaatcccctgtcgcgtgttcaaatagctgcagctccttcattctgatggacgatctgtccccaaagtag

SEQ ID NO: 55936 - DNA, 588 bp, Artificial Sequence
  Description of Artificial Sequence: Synthetic coding sequence
atggcacaggaaaaaatgaaactcgggtttaagagcttgccctctagcacaactgcggatgggaacatcttgcggagagtcaattccgccccactgatcaacggactggggtttaacagccaggtcctgcaggcagacatgctgaggatccgaacgaataggacaaccttccgaaaccgccgatccctgctcctccctccccctcccttccatggcagtatctctcgcctgcatcaaatcaagcaagaagaagcaatggatctgatcaaccgcgagaccatgagcgaatggaaactccagagcgagatccaaattagccattcatgggaggagggcttgaaactcgttaaatggcactttaacattaaccagaagcgtttctccaaagctcagcccacctgttttctgttgatcctaccaaactgccaaaagatcatgtgcatttactttcagctgcttcttatggagactactgcgatgctcgacctgctcgtgattcgacagctcaagtccgcactgagccagaccctgctctgccatctgctgatcttggtgttaatatgcagctcgcgccagactttcaattag

SEQ ID NO: 55937 - DNA, 459 bp, Artificial Sequence
  Description of Artificial Sequence: Synthetic coding sequence
atggcccaggaaaaaatgaagttggggttcaagtctctgccctccagtacgactgcagacgggaacatcctgagaagagtcaatagcgcccctctgattaatggactagggttcaattcccaggtgctccaagccgacatgctccgcatccgcactaaccgcacgaccttccgcaaccgtcgctcactgttgttgcctcctcccccttttcatgggtccatttccaggctccatcagatcaaacaggaggaggcaatggacctgataaatcgagagaccatgtctgagtggaaacttcagtctgagattcagatcagccacagctgggaagagggattgaaattaaacgacaatggactgcagaagagcagttcgctgaaatgcatagatctcacaccagtttcctcaatggcttcatccatcaagaagacagggaagtccacttcatcatacttctag

SEQ ID NO: 55938 - DNA, 348 bp, Artificial Sequence
  Description of Artificial Sequence: Synthetic coding sequence
atggcttacttcccgggaacaggacggacagaccaggaaacacagctggacctgtctctgtgtggccgagagcctgagtcgctagaaaatctctttctggaccctgatatggcccaagagaagatgaagctcgggttcaaatctctgccctcaagcacaacagccgacggaaatattctacggagggttaatagtgctcctctgatcaacggactcggcttcaattcacaggtgcttcaagcagatatgctgcgaatcaggaccaaccgaaccacttttaggaaccgacggtcccttgagatcacctccccaacatctgtggaacaaaagcctaaggacctcttttag

SEQ ID NO: 55939 - DNA, 558 bp, Artificial Sequence
  Description of Artificial Sequence: Synthetic coding sequence
atggacctaatcaacagggaaacaatgtctgagtggaagctgcaatcggaaatccagattagccattcttgggaagagggcctcaagctgaacgacaatggtctgcagaagagtagcagcttaaaatgtatcgaccttacgcctgtcagttcaatggcctctagcatcaagaaaactggcaagcagtgcttcagcccttctctgcagacttgtgtgagctgcactggctctccttccagtccaatcccttcccctatgcagcagtacatcattcggtctcaaaatcctacgaacatcattcggccatccatactcggacctctaaagaggaaaggagaaatggcctttcaataccagccaaagaaaatttttcaggggactacgaacatgctgtcaagcgacacgtctcagctgagtgaaaacaatgtttacttgctcccagctacttttgacggaaacgactccaatgccggaagttcaggcaatagttccgccgagatcggtaccgtgaccaattctccagtgagcccaagcgatactggatctcacttattctag

SEQ ID NO: 55940 - DNA, 1659 bp, Artificial Sequence
  Description of Artificial Sequence: Synthetic coding sequence
atggagacttcaaggtcacggggtggagggggagcagtgtccgagagaggaggcgcaggggcttccgtcggcgtgtgccgccgaaaagcagaggccggagctggaacaggcacattggcagcggacatggatctgcattgcgattgcgccgctgagacgccagccgctgagccaccatccggtaaaattaataaggcagccttcaagctgtttaaaaaacggaaatctgggggtactatgcctagtatttttggagtgaagaacaagggagatggcaagtcctcggggcctacgggcttggtgaggtcccgaacccatgatgggctggccgaagtcctcgtgcttgaatctggcaggaaggaggagccacgtgggggtggcgattcgggtgggggaggaggcggtcgcccaaaccctgggcctcctcgtgctgcaggacccggaggcggtagcctggcaagctcctctgttgccaaatctcactcatttttctcactcctgaaaaaaaatggccgatcagaaaatgggaagggagaacctgttgacgcctctaaagcaggcggaaagcagaagcgcggactgaggggtctctttagcggcatgaggtggcatcgcaaagataagagagccaaggcggaggcagctgagggaagagcacccggagggggtttgattctccccggatcactcacagccagtctcgagtgcgtgaaggaggagactccgcgagccgcaagagagccagaggagcccagtcaggatgctcctagagacccagccggatgcggtgatatcatagcagatcaggaggaggaagctggaccgagttgtgataagcatgtccctggccctggaaagcccgcattgtccaagaaaaaccctggcgtggtcgcttaccaaggtggaggggaagagatggcgtcaccagacgaggtggacgatacttacttacaagaattttgggatatgctgagtcagacggaggaacaaggaccagagccccaagagggggcagcaaaggtggctgccgctttagagacaaaggttgtcccagagaccccgaaggatacaagatgtgtcgaagctgcaaaggatgcctctagcgtgaaacggagacgactgaacagaattccaattgagcctcatcctaaagaggagcccaagcatccagaaaaagaacagcaagagggcgtccccaactctgacgaaggatactgggatagtaccacacctgggcctgaggaagattcaagtagctcaggaaaaaaggccggaatcccgagagacagctactcaggcgatgccctatatgacctctacgccgatccagatggaagtcccgctaccttacctggtgggaaagataatgaggaaacctcgagcctgtcgcggttgaagccagtctcccccggaacaatcacttgccctctgcgcactcctggctcacttctcaaggatagcaaaatcccaatttctattaagcatctcactaatcttccttcctcacatcctgttgtccaccagcagccatctagaagtgaaatgcccagaaccaagatccccgtttccaaggtgctggtacggcgtgtgagcaaccgaggtctggcaggcaccaccatcagggctacggcctgccacgactcagcaaagaaactctag

SEQ ID NO: 55941 - DNA, 1659 bp, Artificial Sequence
  Description of Artificial Sequence: Synthetic coding sequence
atggagaccagccgctcccgcggagggggaggcgctgtatccgaacggggaggggcaggcgctagcgtgggcgtgtgtcgtaggaaggccgaagctggggctggcaccggcaccctcgccgctgacatggatctgcactgtgactgcgccgctgagaccccggcagccgagcccccttctggcaagatcaataaggccgctttcaagctatttaaaaagagaaaatcaggaggtaccatgccttcaatttttggagtgaaaaataagggcgacgggaagagtagcggacccacgggattagttcgatctaggacccatgatggcctggcggaggtgctagttctggaatccggacggaaggaggagcctcggggagggggtgacagcggaggaggtggaggcggtagacccaaccccggaccccctagagctgccggtcccggtggcggttccctggccagctccagtgtcgccaagtcccacagcttctttagcttgctaaagaaaaatggaagatccgaaaatggcaagggcgagccagtcgacgcatccaaagccggagggaagcagaaacgtggcctgcggggtttgttttccggcatgaggtggcaccgcaaggacaagcgtgcaaaagcggaagccgctgaggggagagcccctggcggaggcctcatcctccccggatctctgaccgctagcctggagtgtgttaaggaagaaacccccagggccgcaagagaaccggaggaaccgtctcaggacgctccaagggaccccgctggttgcggagacatcatagctgatcaagaagaggaagcaggtcccagctgcgacaaacacgtgcccggtccgggtaaaccggctctaagcaaaaaaaacccgggagttgtggcatatcaaggtggaggtgaagaaatggccagccccgatgaggtagatgacacatatctgcaggagttttgggatatgttatctcagactgaggagcaaggccctgagccgcaggaaggtgcagctaaagtggctgctgccctggaaaccaaggttgttccagagactccgaaggacacccgctgcgtcgaggcggcaaaggatgccagcagcgtcaagcgccgtcggctgaacagaatcccgatcgagccacacccaaaagaagaacctaagcaccctgagaaggagcagcaggagggcgtacccaacagcgatgagggatattgggactccaccacccccggacccgaagaagattctagctccagcggaaaaaaggcaggcattccgagagattcttatagcggagatgccttgtacgacctgtacgctgaccctgacggctcgcctgcaactctccctgggggtaaagacaatgaggagacctcatccctgtcacgacttaagccagtctctcctggtaccatcacctgccccttgaggacccctggttccctcctgaaagacagcaagatcccaattagcatcaagcacttgactaacctcccgtctagccatcccgtcgtacaccaacagccttcaagatctgagatgcccagaacgaagattcccgtcagcaaggtgcttgtgcgcagagtctccaatcgcggactggccggaacaacaattagggccacggcctgtcacgactccgctaagaagctgtag

SEQ ID NO: 55942 - DNA, 2016 bp, Artificial Sequence
  Description of Artificial Sequence: Synthetic coding sequence
atggagacttcaaggagccgaggagggggaggtgctgtctcagaaagaggtggagctggcgcttcagtaggcgtctgtcggaggaaagctgaggctggggcaggtaccggaactctggctgcagacatggacttacactgtgattgtgcggcagaaacaccagcagccgagcccccatccggcaaaatcaacaaggcagcctttaagctgtttaagaaacgtaagagcggaggtactatgccgagtattttcggggtaaaaaacaaaggagacggtaagtcgtcgggccctacaggtttggttaggtccaggacgcacgacggtctggcggaggtgctggtgctagagtccggacggaaggaagaacctcgcggtggcggagattcaggaggcggtggtggcggacggcctaaccctggccctcccagggctgccggaccagggggagggtctttggccagttcctcagtcgctaagtcacattcttttttctcgctcctgaagaagaatggccgtagtgagaatgggaaaggggagcccgtggatgccagtaaggccggaggcaagcagaagaggggtcttcgcggtctttttagcggaatgcgttggcatcggaaggataagcgggcaaaggcagaggccgctgaaggcagggcaccaggcggaggcttgattcttcctggttctctgacggccagcctggagtgtgttaaggaggaaactcccagggctgccagagagccggaggaaccgtcacaggacgctccacgggacccggcaggcgagcccgcaggcggagaagaagtgcctgctcccgctgatcgcgcacctgccaggtcttgcagggaagcagaggggttggcgcatcccggagacaccggcgcacgtggggaagacgctgctgggcaccggagagcagaacctggaccaggtgaggtgcggacggcagaagatgcgtcacgaactggggcagtcccggtgaaaacagtgcctcttgtggactcggagggaggatccgggagggcccctgccgctccggacccagccagtgtcgaccctcctagcgaccccagtgctgaccggatttgcctaatgttttctgacgtgacctccctgaaaagcttcgactccctcacaggatgcggagacatcatcgcagaccaggaggaagaggctggcccatcctgcgataagcacgtcccgggacctggaaaaccggctctgtcaaaaaagaacccgggagtggtcgcttatcagggcggaggcgaggaaatggcctctcccgatgaggtggacgacacgtacctgcaagagttttgggatatgctctcccagaccgaagaacaaggacctgaaccccaggagggcgcagccaaggtcgcagcagcactggagacgaaggtagtgcccgagacgccgaaagacactcggtgcgtggaagccgcaaaggacgcttcaagtgtgaaacgccgtaggctgaataggatccccattgaaccacatccaaaggaggaacctaaacatcccgagaaagagcaacaagagggcgtacccaacagcgatgaaggatattgggacagtacaacgccagggcctgaggaagactcgtcctcttcggggaaaaaagctggaattcctagagactcctactcaggggacgccttgtacgacctatacgctgatcccgatggatcccccgcaaccctgccagggggtaaggataacgaggaaaccagttcattatcccggctcaaaccagtttcccctggtacaataacttgcccccttcggaccccaggcagcctgctcaaggattccaagatcccaatttctataaagcacctgaccaacctgccctcgtcccatcctgttgtacatcagcagccatcccgttccgagatgccaagaactaaaattcctgtctctaaagtgttggttcgcagggtcagcaaccgaggtttagccggaacaacaatcagagccacagcctgccacgattccgccaaaaagttgtag

SEQ ID NO: 55943 - DNA, 2586 bp, Artificial Sequence
  Description of Artificial Sequence: Synthetic coding sequence
atggaactcaaaagagggaagactttcataaagtcttctctccaggtgtctcacgaaaagccccctgaccctgcagccgtggctgcagccagagaaggaactggtccgtggtccgtcctccccggaggacaacagcggcctcactccgaaaagggccctcaggcctccccaagtgcacaagagtacgatcgctgcccaaacaagggggctcaactggaccctaagggcggaccagccgctttatgtggagccactttcaagccagtgcgcaaatgcaagacacacgacagcatgagcggcgctggacgtgccacggccgctacaggccaactggtcggtagtgcatcctttccagggtcaccagggagcagacggatgatcgactaccggcacttcgttcctcagatgcccttcgtgcctgctgtcgcaaagtctatacccagaaagagaattagcctgaaacgacccaagaaatgcttccgcaacctcttccatattaggcgcaataagaccgaggatctggcttccttagcagctgagggaaagtccctgccttccccaggcgatccctctgatcccggtggcagacggtccaaggcctttctcccgcctggagaaggtccaggcttagacggactttgccaagatcttctggactcggaattactggctgacgctagcttcgggctgtgtcgagctctctgcgaagatgtcgcaagtcttcagagttttgatagtttaacagggtgtggggaagtctttgccgacgagagcagcgtgccatctttggaacttaatgaggggccagagtctccaacgcaggccgcacaaggcctggagtctaaggtgccaagagggcctctgcagggatcagtggaacagctagccagcccagctcaaaatgaggcctcagacttcactaggttctgggactccgttaatagaagcgtcagacagcaacagagagccctcctgggcccttggctgtccggaccccagggtaccgaccgggatcagtcccgactcgacactgctggtcttgccgaattgccgctgtgcccttgtcgcgaccctcgcagtgggagcaaagctagctccatcgatactgggacacctaaatcagagcagcccgagagcgtcagcacaagcgacgagggttactatgacagtttctctcctggcctagaagaggataaaaaggaggccgagagtcctggaactccagccgctactttcccacgcgactcctacagtggagacgccctttatgagctctttcatgacccatctgagggcccattaggaccatctccagacgatgacctgtgtgtgtctgagtcactcagcgggccagccctgggcacacccctttcaatctgtagctttagggtcggtgccgaggaaaacctcgcgcctgcacccggtcccgatcttctgagtcagggattcctccaatcgtcatggaaaggtaaggaatgtctcctaaagttgtgtgacaccgaactcgcgataactatgggtatcgtgtcttggcttaggcgcggaccaaccccacgtgcgccacccacccctggccaacctgcggcaccccctggtagccagggagccccacgagcgcctaccgaaaagctggggggaagggaggggctagcaagcgacgcagggggtgcaacagtatgttccgcgccttccagacaagagctatgggcccatcctgggactaccggcctgctcgctggcgagtccaaggctctggggggagccacgcagggaaccggcaccctgtctcgcgacgcttctcgggaggaagaaactcgaggtcattctgagggattgttctcatcaatggaatccgccgctactagcaccactgacacctcaggaaaaaacaaggctcctgtccccagtacctggccttgtagtcaaaaggaacccggtccaccaggggtgctgggatgttttcgaggcccatggcggccaggccacggaggcgacacactggacgccgagcctatgctggccggttgtgtggccagagtggcggctttgaagataagttccaacgaacagcctccagcagcttggcccccaaggcaagatatggggagtggccttttcgggcagcgatgggcacggggaccagatatgttggagcaaaagcagtccagctcatccccaagcatgaccaccatccacggcctgccctactctgcgtcaactcaggaccaaaggtgcagagaccgagttcaagacctgtcttggctgcgcgtggaaccaacggggctgggggtgcaggcttgggcaagtgtggaggaccagcctctgcaactgtctacagaggctgtggaacaggtggcccacggttcacagcttgatagtgaacctcgatcggcaccagccgctcgctggtcatcccagggacatcaccctgagtccctagggcttacactgaacagccagcaagaagggggagtaagtgcctcggcacctgaatgccgttgctctttgcttgcacgcgagggtcttctgtgtgggcaacctgaagtgggcgcttccgggcctgctatggcagagccacacctgtag

SEQ ID NO: 55944 - DNA, 2586 bp, Artificial Sequence
  Description of Artificial Sequence: Synthetic coding sequence
atggagctgaaacggggaaagaccttcattaaatcatctctacaggtgagccacgaaaagccacctgatcccgctgccgttgctgcagccagagaagggacggggccttggagcgtcctccctgggggacagcaaaggccccattccgaaaaagggcctcaggcatctccgtctgcccaggaatatgacaggtgcccaaacaaaggcgctcaacttgacccaaagggaggacccgctgctctgtgtggtgcaacttttaagccagttaggaagtgtaagacacatgacagtatgtctggggctggacgcgcaaccgctgccactggccagcttgtaggctctgcttcatttcccggttcgccaggcagtcggagaatgatcgactatcgtcacttcgtccctcagatgcctttcgttccagctgtcgccaaaagcattccacgtaagaggatctctctgaaaaggccaaagaagtgtttcagaaatttgtttcatattcgcagaaacaagacggaagacttggcaagtctggcggctgaagggaagtccctccctagcccaggcgacccgtctgatcctggtggcaggagaagcaaggcttttctacctccaggggaaggaccaggactggacgggctgtgccaggacctgctcgactctgaactcctggccgatgcaagctttggactttgccgagccctctgtgaggacgtagcatccctgcagtcctttgattctctgacaggctgcggcgaggtgttcgccgatgaatcatctgtgcctagtttagagctcaacgaaggccctgagagccctacccaggccgctcaaggacttgagagtaaagtacctcggggaccactgcaggggtccgtggagcaactggccagcccagcccagaacgaagctagtgacttcactcgcttttgggactctgtcaaccgcagcgtgcggcagcagcagcgagcgctcctgggcccatggcttagtggccctcaggggaccgatcgggaccagagtcggcttgatactgctgggctagcagagttacctctctgtccatgtagagatccgcgttcagggagcaaggctagtagcattgataccggaacgcccaagtccgagcagcccgagtctgtatcaacatctgacgaaggctactacgactccttctcaccaggcctcgaggaggataagaaggaagctgagagtcctggaacacccgctgccactttcccacgtgattcgtactctggggacgccctttacgagctgtttcacgatcccagtgaaggacctctggggcctagcccggacgatgatttgtgcgttagcgagtctctgagcggcccagccctggggacccccctgtccatctgcagcttcagagtgggagctgaagaaaatttggcgcctgcaccaggaccagacctgctcagccagggcttcttacagtcttcctggaagggaaaggagtgcttgttaaagctttgcgacacagaactcgccatcaccatggggattgtgtcctggttgcggagaggtcccacacctagggctccaccaacaccgggacagccagctgccccaccagggtcccagggcgcaccgcgagccccaaccgaaaagctcgggggtcgcgagggcctagcctcagatgccggaggggcaaccgtgtgctcagcaccctcccgccaggaactatgggcacatccaggaaccactggattactggcaggggagagtaaggcccttgggggagccacccagggtacaggcacactgagccgtgacgcctcccgagaagaggagacacgcggacacagtgaggggctgttcagtagtatggaatccgcagcaacttccactacagatacctctggaaagaataaagccccagtacccagtacatggccctgtagccagaaagagcctggtccaccaggcgttttggggtgctttagaggcccatggagacctggccacggcggtgatacattggacgccgagcccatgctggctggatgcgttgctcgggtggccgctctcaagatttcatcgaatgagcagccccctgcagcgtggccaccgaggcaggacatggggagtggtctgttcgggcagcgctgggcccgaggacctgatatgctggagcagaagcaaagctccagctccccatcaatgacgacgatccacggccttccatactccgctagtactcaggaccagcgctgtagggaccgggtacaggacctgagctggctaagagttgagcccaccggcttgggcgtgcaggcatgggcctccgtcgaggatcagcccctgcagttgagtaccgaagcggtggaacaggtcgcacacgggtcacagctggattcagagccacgcagtgcaccagccgctagatggagctcgcaagggcatcatcctgagtccctgggtctgaccctgaatagccagcaggaagggggagtctcagcctcagcaccagagtgccgctgttcattgcttgcaagagaagggttgttgtgtggacagccagaagtgggggcttccggacccgctatggcagaaccccacctctag

SEQ ID NO: 55945 - DNA, 429 bp, Artificial Sequence
  Description of Artificial Sequence: Synthetic coding sequence
atggagttgaaacgcggaaagacattcataaaatcttccctccaggtatcacacgaaaaaccgcctgatcctgccgctgtcgcagccgcaagggagggtactggtccctggtctgtcctgccaggtgggcaacagagacctcatagcgagaagggtccacaggccagtcccagtgcgcaggagtacgacagatgccccaataagggtgctcagttggatcctaagggcggacctgcggcattatgtggagcaacattcaagccagtgcgcaagtgcaaaactcatgattccatgtcgggcgcagggagggcgaccgccgcaacaggacagctcgttggaagcgcttcttttccgggatccccaggaagtcggagaatgattgactaccggcacttcgttccacaaatgccctttgtccccgcagtatag

SEQ ID NO: 55946 - DNA, 543 bp, Artificial Sequence
  Description of Artificial Sequence: Synthetic coding sequence
atggagttaaaacgaggcaagacattcatcaaaagcagtctgcaggtcagccacgagaaaccacccgaccccgctgccgtggcagccgcaagggagggcactgggccatggagtgtgcttccaggaggccaacagcggcctcactctgagaaagggccacaggctagcccgagtgctcaggagtacgataggtgccctaacaagggagctcagctggatccgaaaggcggtcccgcagccctatgtggagccacttttaagcccgtgcgcaagtgtaaaacgcatgattctatgagcggagcaggccgtgcgactgcagctactggacaactggtcggttcggcttcttttccaggctccccagggagcagaagaatgatcgactaccgccacttcgtgccgcagatgccgttcgtccccgctgttgctaagtccataccaaggaaaagaattagtctgaaaagaccaaaaaaatgctttcgcaatttgttccatattagaaggaataagactgaagatctggcatcccttgctgccgagtag

SEQ ID NO: 55947 - DNA, 1749 bp, Artificial Sequence
  Description of Artificial Sequence: Synthetic coding sequence
atggatccaaaggctggcggtgggggagaggaggacgactgcgtggacagtggggcagagaccggaggatccgattacagtcacctttcttcgactagcaatggcttctctacatggaggatgccttgctgtttgttcctttactgtacccacggtgacaaggaaaagggaagatggagcctccaggttgaacacacttggccaagcggagaactgagcgtggaggaagcccaggatccattcctcgtgtccatccacattattgctgaccccggtgagtcacaaccccttcaggaagcgattgataacgtgctggcatggattcacccagacctccctctctttcgcgtaagtgaaagaagagcctctcggaggaggagaaaacctcctaagggtgcccagccagccctggccgttgtgttgtttctgcaggaggagtacggtgaggagcagatactgcagctgcacaggacgcttcagcagcccccttggcgccaccaccacacagaacaggtgcacggcagattcctgccgtatctgccatgctctcaggattttttcacccttgcgcctggcaccccgctgtgggccatccgccctgtgcattatgggaaggagatcgtgaggtttacggtctactgccggtatgataattatgcagatagcctcaggttttaccaacttatcctccgtcgctccccctcacaaaaaaaggcagatttctgtatcttccctatcttctccaaccttgacgtggacattcagttctcactcaagagactgccctgcgatcagtgccccgtcccgactgacagctccgttctcgaatttagagtgcgcgatattggcgaattggtgccgctgttacccaatccgtgctcgcccatctccgaaggcagatggcagactgaggatcacgacggtaacaaaattctgctccaggcacaaagagtccacaaaaagttccccaagcccggaagggtgcaccatgcatctgaaaaaaagcgtcattcaacccctttaccctccaccgccgtgccgtcccataccccaggcagctcgcagcagagccctctgaacagcccccacccgggaccaatacggaccgggctccccccaggccatcaacaggagttcgccggacgagctaactccacccccaatcccccatggtcctttcagagaagcaagtctctgttctgtctgccaactgggggacccagtctcgctagtagtgccgaaccccagtggttcagcaacacgggcgcacccggtcaccgcgcttcagagtggaggcacgggcacctactgtctatcgatgatctggagggggcacaggagaccgacgtggacaccggcctcaggctgtcatcaagcgatctttctgtggtgagcgcctattccgccccttctcgcttttgttccactgtcgaaactcccctgccatcagagcgctgttcttcccactgggccgctcacaaggattctcgggaggggcctttgcctaccgtgtcccgcgtaacgacggaggcttcgtgggcttctcttcccttcttcactaaacggagttccagctcatctgccaccgcaagagcggctcctccagcgccttcaaccagcactctgacagatagtagtccacagctcccatgtgacactcccaaggtgaagcaaactgacggtgacatgccaccccctccagggagtgcgggtcccggagataatgacatggaggaattttacatctag

SEQ ID NO: 55948 - DNA, 1641 bp, Artificial Sequence
  Description of Artificial Sequence: Synthetic coding sequence
atggaccctaaggccggtggcggaggggaagaggatgattgtgtggatagcggtgcagagacaggtggctcggattattctcacctgagctcgacaagttccgaactgtctgtggaggaagcccaagatccgttcctagtgagtattcatatcatcgctgaccctggagaaagccagcctctgcaagaagccattgacaatgtgctggcgtggattcacccagatctccccctgttccgcgtctccgaaaggcgagcatcccgcagacggcgaaaaccccctaagggagcacagcccgcacttgccgttgtactttttcttcaagaggaatacggcgaggaacagattctgcaactgcaccgtactctccagcagccgccttggcgtcatcatcatacagaacaggtgcacggcagattcctgccgtacctaccatgtagtcaggatttttttacccttgctcctggaacccccctctgggccatccgccctgtgcactacggaaaagaaattgtcaggttcaccgtgtattgcaggtatgacaactatgcggatagcctccgattttaccaactgatcctgcgaagatcgccctctcagaagaaggccgacttttgtatcttccctattttctctaacctggacgtggatatacagttctctttgaaaaggctgccttgtgatcagtgccccgttcctaccgacagttctgtactcgagttccgggttcgggacattggagagcttgtcccgttgctcccgaacccttgctcacccatctccgaaggccgatggcagacagaggatcatgatgggaacaagatccttttgcaagctcaacgtgtgcataagaaattccctaagcccggaagggtgcatcatgcgtccgagaagaagcggcactccacccctcttccgagtaccgctgtgccgtcacacacaccaggatccagccagcaatcccctctcaacagtccacatcccggaccgatccgtacaggacttccgccaggtcaccagcaggaattcgctggccgagccaactcaactccaaatccaccatggtccttccagcggtctaaatcactcttctgtcttccaaccggcggacctagcctcgcttccagcgccgagccccagtggttttcaaataccggggctcctggtcacagggcttcagagtggagacacggtcatcttctgtccatagacgatctggagggagcccaggagaccgacgtcgacacaggtttgagactgagtagcagcgacctctcagtggtttccgcttatagtgccccttcccggttctgcagtaccgtggagacgcctttgccatctgagaggtgcagctcacactgggcagcccacaaagacagccgtgaaggaccccttcccacagtttcgagagtgacgacggaggcctcatgggccagtctgcctttctttaccaaaagatcgtcaagttcctctgccacggcacgagcagcccctccggcaccttcaacaagtactcttaccgacagctcacctcagctgccatgcgacaccccaaaagtgaagcaaaccgatggtgacatgccccctcccccaggctccgcaggcccaggtgataatgacatggaggagttctatatttag

SEQ ID NO: 55949 - DNA, 819 bp, Artificial Sequence
  Description of Artificial Sequence: Synthetic coding sequence
atggatgagactcaggggcctctggcaatgacagtgcacctcctggccaactcaggtcatggctccctgttacaaaggaccctggaccaactgttagactgtatttgtcctgaggtgcgactgttccaggtatccgaaagggcgtctcccgttaagtactgtgagaaatcgcattccaaacggtcacgcttcccgggaatgtctgtgttactgtttttgcacgagtcaccaggcgaagatagactatttcgcgtactggattccctccagcactctccatggcagtgctatccgacacaagatacacggggacgcctgtgtccatactttttcgccaaccaagagttttactcactggattcacagctccccatctggggagtcaggcaggttcactgcggctctgaaatcttgagggtcaccctctattgttcttttgataactatgaggatgctatcaggctatacgagatgatcctacagagggaggctaccctgcagaagagcaatttctgttttttcgtactctatgcgagcaagagtttcgcgctgcagctgagccttaaacaactgccaccgggtatgtcagtagatcccaaagagtcaagcgtgctgcagttcaaggttcaggaaatcggacagctcgtgcctctgctgcccaatccatgcatgccaatcagttctacccgatggcaaacccaggactacgacggcaacaagatcctcctacagcggtgggagtcttccagcgtggcccaaacgcgcgtgagatggtgccaccatagttccctgcgcagctcccctagcggatttaaatag

SEQ ID NO: 55950 - DNA, 819 bp, Artificial Sequence
  Description of Artificial Sequence: Synthetic coding sequence
atggacgaaacccaaggccctttagctatgaccgtacacctcttagcaaattctggtcatggctccctcctgcaaaggacgctggatcaattacttgattgcatctgccctgaagtgaggctgtttcaggtgtcggagcgagcctccccagtgaaatactgcgaaaaatctcattccaagaggtcacggtttcccggaatgtcagttcttctttttctccatgaatccccaggagaggaccgactgttccgagtcttggacagtctacagcatagcccctggcaatgttaccccacacaggacactaggggaagattgtgcccttacttttttgctaaccaggagttctattcgcttgattcccagctccctatctggggagtgaggcaggttcactgcgggtccgaaattctaagggtaaccctctactgttcattcgataattacgaggacgctattaggctctatgagatgattctgcaacgggaggccaccctccagaaatcaaacttctgcttctttgtactatacgcttctaagtctttcgccctgcagctcagcctcaagcagctccctcctgggatgtcagtggatcccaaggaaagcagcgtactccagttcaaagtgcaggagatcgggcagctggtgcccctgcttcctaacccttgtatgcccatcagttcaaccaggtggcagacacaggattacgacggcaacaagattctcctccaacgttgggaaagcagcagtgtggcacagactcgcgtaagatggtgccaccacagttctttaaggtcttccccgagcggctttaaatag

SEQ ID NO: 55951 - DNA, 1368 bp, Artificial Sequence
  Description of Artificial Sequence: Synthetic coding sequence
atggacgagacacagggccctctggcaatgacggtacatcttcttgccaattccggacatgggtcactcctacagcgcacactggaccagctgcttgactgcatctgtccggaggtgaggctttttcaagtatctgaaagagcctctcccgtgaagtactgcgaaaagagtcatagcaaaaggagccggtttcctggaatgtctgtcttactgttccttcacgagtcccctggcgaagatcgcttattccgggtgctcgattcactacagcacagcccctggcagtgctatccgactcaggataccaggggcagactgtgcccttactttttcgctaaccaagaattttactctctggattctcagttgcccatatggggcgtccgccaggtccattgcgggagtgagatcttgcgcgttaccctatactgctcatttgataattatgaggacgctattaggttatatgagatgatcctccagcgggaggccacgctacaaaagagcaacttctgtttcttcgtgctctacgccagtaaatcgttcgccttgcagctgtccttgaagcaactccctcctggtatgtcagtagatccaaaagaaagtagcgtcttgcagtttaaagtgcaggagatagggcagctggttcccctgctgccaaatccttgcatgccaattagctccacccgctggcaaacgcaggattacgatgggaacaagattctcttgcaggtccagctgaacccagaactcggcgtaaagaacggcattcttggagcaggcatgctaccactcggctcccgactgacgtcagtgagtgctaagcgtacaagcgagccgagatcccagcggaatcaggggaagaggtcacaaggacacagcctcgaactgccagagccaagcggcagcccaactagtgatcggtgcgccggtacatcctggaagagtcctgggcgaagctttcaggtgagctctcctgctatgggggcacacttgcacctgtcctcccatcaccttgaaagcggcgctaggatgaaagtgttgaaccgagagaatagcttccagaagctggaggcagagactaacgtggacaccgggttgacgattatcaatagcgaacccagacagacttactttggcggattccccagagatcttcagaccagtcagcctcccttttgcttgcctgcgtcgtccctgggggttgcgacaagcaaaaacaacagcgtgctcaaggagagggtatcacccctgcctctggccggtcagcgcgatctgggaacccggaagacgatatcggagtgtctcctccatctgcaggtccagggggaggagaaggaagaagatgaggaggaatttttcatatag

SEQ ID NO: 55952 - DNA, 1593 bp, Artificial Sequence
  Description of Artificial Sequence: Synthetic coding sequence
atgctggggacggataggtgtgtggttgaagagtggctctctgagttcaaggcactgccggacactcagatcactagctacgccgctactttgcatcgcaaaaagacattagtgccagccctgtataaagtgatccaggactccaacaacgaactattggagcctgtttgtcaccagctgtttgaattgtataggagttctgaggttcggctgaaacggttcacattacagttcctgcctgagctgatgtgggtgtatctgcgacttactgtctccagggatagacaaagtaacgggtgtatcgaagccttgctgcttggcatttacaacctggaaatagccgacaaggatggcaacaacaaggttttgtcttttacgattccctcactgagcaagcccagcatctaccatgagccctccaccataggcagtatggcacttactgaaggagcactgtgccagcacgacctgataagggtcgtttactccgatctgcatcctcagcgggaaacatttaccgcacagaaccggtttgaagtgctctcttttctgatgctatgttataattccgccatcgtatacatgccagcctcatcataccaatcactgtgcagaatgggttcccgagtgtgtgtgtctggttttccccgtcaacatgagaagcactggaaagaactgtgtgggaggatcgtgttggacccagagttcatggtccagctgctaaccggagtttattacgccatgtacaatggccagtgggacctaggacaggaggttctcgatgacatcatttaccgcgctcagctagaactgtttagtcagcccctgctcgtggccaatgccatgaagaacagtttaccctttgatgcacctgactcgacacaggaaggccagaaggtcctaaaggtggaagtaaccccgacggttcccaggataagccggacagcgatcacaacagccagcatacgaagacatagatggcgtagagagggggctgaaggtgtgaatgggggagaggagagcgtgaatctgaacgatgctgacgagggattctcctcaggagcctctctttcatcgcagccaattggcacgaaaccttcctcatcatcacaacggggttcacttaggaaggtggctaccggaagaagcgcaaaggataaagaaaccgccagcgccatcaagagttctgaatctcccagggacagcgtcgtaagaaaacagtacgtccagcagcccacggaccttagtgttgattctgttgagctcacacctatgaagaaacacttgagcttgccagccggtcaggtggtcccaaaaataaatagtcttagccttatcaggactgcatcggccagcagcagtaaatctttcgattacgtgaacggatcccaggcctccacttcgatcggcgtgggcacagaggggggtaccaatcttgccgctaataacgctaataggtacagcactgtgtcgctgcaagaggaccgactggggcaggcaggcgaaggaaaggagttgctgtctcccggagcaccattaacaaagcagagccgctcaccatcgttcaacatgcagttgatttcgcaagtctag

SEQ ID NO: 55953 - DNA, 627 bp, Artificial Sequence
  Description of Artificial Sequence: Synthetic coding sequence
atgttgggaaccgaccggtgtgtggtggaggagtggctgtcggagttcaaagctctgcctgatacccaaattactagctacgctgctacacttcatcggaagaagacactggttcctgccctgtacaaggtgatacaggacagcaacaacgagctcttagaacctgtttgccaccagctctttgagctatacagatccagtgaggtcagacttaaacgcttcactctacagtttttgccagagttaatgtgggtttacctgaggcttaccgtgagcagagaccggcagtcaaacggttgcattgaggctctgctgctggggatctacaacctggaaatcgcagataaggacgggaataacaaagtactgagtttcactataccttcgctaagcaagccaagcatctaccatgaaccaagcacgattggctccatggccctgacagagggagctctgtgccagcacgacctgatacgcgtcgtttactccgatttgcaccctcagagggagacatttactgcacagaacagattcgaagtgctatccttcctcatgctgtgctacaatagcgctatcgtgtacatgcccgcttcctcataccagtctctgtgtaggatgggatcttag

SEQ ID NO: 55954 - DNA, 264 bp, Artificial Sequence
  Description of Artificial Sequence: Synthetic coding sequence
atgctgggaactgatagatgtgtggtcgaggaatggctgtcggaattcaaggcactgccggacacccaaatcacaagctatgccgctacactgcaccgcaaaaagacactggtgccagccctgtacaaagtcattcaggattcaaacaacgaactgctcgagcccgtgtgtcatcagctgtttgagttatataggtcgtcagaagtgagattaaagcggtttacgcttcaatttttgccagaactcatgtgggtatacctttag

SEQ ID NO: 55955 - DNA, 342 bp, Artificial Sequence
  Description of Artificial Sequence: Synthetic coding sequence
atggacggacgagtgcagcttatgaaagccctactggccggtccattgaggccagccgctcgcagatggagaaacccaattccttttccagagactttcgatggcgatacggaccggttgcccgagtttatcgtccaaacttcctcctatatgttcgtggacgaaaatactttttcaaacgatgccctcaaggtgacatttctgataactagattgacaggtccggctctccagtgggtgatcccttacatacggaaggagtcccccttactcaatgactacagaggatttttagctgagatgaaacgcgtgtttggatgggaggaagatgaggatttctag

SEQ ID NO: 55956 - DNA, 342 bp, Artificial Sequence
  Description of Artificial Sequence: Synthetic coding sequence
atggagggcagggtccagttgatgaaggcattgcttgctcgtccactgcgcccagcagccagacgctggaggaatccaatcccctttccagagaccttcgacggagacaccgatcggctgcctgaatttatcgttcagacctcctcttatatgtttgtggatgaaaataccttttcgaatgatgccctgaaggtgacctttctgatcacaaggctgacaggcccagccctccagtgggtgatcccgtacatcaaaaaagaaagcccccttttatccgactatcgaggtttcctggccgagatgaaaagggtgttcgggtgggaagaggatgaagacttctag

SEQ ID NO: 55957 - DNA, 627 bp, Artificial Sequence
  Description of Artificial Sequence: Synthetic coding sequence
atgggtgggggaaggggtttgttgggtcgggagactcttggccctggggaccggtgctccggaaagggtccgctttgttattggcctccgccagggtcccccccagcgcctagtctgcgggctagcctgcctctggaaccaccacgctgcccgctgaggtcttgtcccctgccaagatctgcctgcctgtgctccaggaattcagcccctggcagctgctgccgtccctgggcctctctatggagcggcctgccgccaccgtcccgcgcttccagtgccccaccgatgcacatctggaccttaagctgtgcccctgtggcccaggcagaacttctccttcacaccgaccgaccgctgccacctctgccaaccccattgctcttgacacgactcccagacgactacattatgctcccaaccgatctccgctgccattgccacagacaccctagccacagcaccgacagactgctgttactggtaatttgcacacatctgggtggcatatgggcaggacacagcccgtggacgatgatccagaccgctggctgcccctccagggacctgctcccctctgctcgacccatatcgagccccatcccggagaccttctgcgcacctgcctag

SEQ ID NO: 55958 - DNA, 1782 bp, Artificial Sequence
  Description of Artificial Sequence: Synthetic coding sequence
atgggacctgacagaaaagaagtgccactgtccaggggaacccaggccgtagtcgtgggaaaggggaggggagcaccaggcgatgatagctctatggggggaagacctagttcgcctctggataagcagcagcgacagcatttgagaggccaggtggacaccctactgaggaactttctgccctgctatcggggtcagctagccgcaagcgtgctgagacagatctccagagagctcggccctcaggagcccacaggcagccaactgctgaggagtaaaaaactcccacgagtgagagagcatcggggtcccttaacccagcttcggggacatcctcctagatggcagcccatcttttgcgtccttcgcggtgatggaaggctagagtggttcagccataaagaagaatatgagaatggcggtcattgcctgggaagtactgccctgaccggttatacactactgacttcgcaacgcgagtatcttagactccttgatgccctatgcccagagtctttgggcgatcatactcaggaggaacccgacagcctgcttgaggtcccagtgagcttccccctgtttctgcagcacccttttcggaggcacctgtgttttagcgctgccacaagagaggcccagcacgcatggcgcctcgctctgcagggcggaatcagactgcaaggtattgtattgcagcggtctcaggctcccgctgcaagagccttcctcgatgcagtacggctgtacagacagcaccagggacattttggcgacgatgacgtaacactgggtagcgatgccgaagtgctaacggccgttcttatgcgtgaacagttacccgctttgagagctcaaactctcccagggctgcgtggggctgggagagctagagcctgggcttggaccgaactcctggatgcggtgcacgccgctgtgttagccggagcgagcgccggtctctgcgcgtttcagcccgagaaggacgagctcctggccagcttggaaaagaccatcagaccggacgtggatcagcttctaagacagcgcgcacgcgtggccggacggctccgcaccgacatccggggacctttagaatcgtgcctcagaagggaagtcgaccctcagctcccaagggttgtccaaaccctactccggaccgtggaagcaagtctagaggccgtgaggaccctactcgcccagggtatggaccgcctctctcacaggctgcgccagagcccttctggcaccaggctgcggcgagaggtgtactcattcggggaaatgccatgggatttggccctgatgcagacatgttatagagaggcagagaggtcaaggggcagactcgggcagctggcagcccctttcggctttttaggcatgcagtcgcttgtctttggggctcaggaccttgcgcagcagcttatggccgacgccgtcgcgaccttcctgcaattggcggatcagtgtctgacaacagccctgaactgtgaccaggctgcccagaggctggagcgagttcgagggagggtgctgaaaaaatttaaatcagactctggcctggctcagcgccgatttattagggggtggggtttgtgtattttcctccctttcgtgttgtctcaactggagcctgggtgcaagaagactgagtcacacagtgtagcccaagccgtggttcaatggtgtgatctgggatcattacagccccctccaccgaggttcaagaggtcctcacacttatccctcccatcttcatgggattataggcatcctttgtag

SEQ ID NO: 55959 - DNA, 1956 bp, Artificial Sequence
  Description of Artificial Sequence: Synthetic coding sequence
atgggccctgaccggaaggaggttccattgtcaagaggaacccaggccgtggtcgtgggcaaggggcgaggagctcctggtgatgactcttcaatggggggtagacccagttccccccttgataagcagcagaggcaacacctcagaggacaggtcgatactctgcttcgaaatttcttgccctgctaccgcggacagttagccgcatcagtcctgcgtcaaatctctcgggagttgggacctcaggagcctacaggctcacaattactacgctctaagaagctgcctagggtgcgggagcataggggtcccctgactcagctcagggggcacccccctcggtggcagccaatcttctgcgttttgcggggagacgggagactcgagtggttcagccataaggaagaatacgaaaatggtgggcactgcctggggtcaacggccctgacaggctacactctcctcacctcacagcgcgagtatctgaggttgctagacgctctgtgtcccgagtcgctgggtgaccacacccaagaagagcccgacagtctgctcgaggtccccgtctctttccctttatttctgcagcacccctttaggcgacacctgtgttttagtgctgctacacgagaagctcagcacgcatggcggttggccctgcagggagggatacggttgcagggcatcgttttacagagatcccaggccccagctgcgagagctttcctcgatgcggtacgactgtatagacagcatcaggggcacttcggcgacgatgacgtgacgcttggctctgacgctgaggtgctgactgctgtacttatgcgggagcagttgccagccctgcgggcacagaccctgcccggtctgagaggcgctggcagggccagagcatgggcatggacagagttgctggatgcagtgcacgctgcagtgctggccggagcctctgccggactgtgtgcctttcagcccgagaaagatgagttgctggcctccctggaaaaaacaatcaggccggatgtagaccagctcctgaggcagcgggctcgtgtcgcaggccgattgaggaccgacattcgcggtcctcttgaatcatgcctccgccgtgaggttgacccacaactgcctcgtgtcgtgcagacacttctgagaacagtcgaggctagcctggaagctgtccgcactctccttgcgcaggggatggacagactttcccatcgtctgaggcaatcacccagcggcactcggttaagaagggaggtgtatagcttcggggaaatgccatgggatttagcccttatgcaaacttgttatcgggaggcagagcgctcccgcggaaggctcggtcagctggcggctccctttggcttcttgggaatgcagtccctggttttcggagcccaagatttggcccaacagcttatggcagatgcggtggcaaccttcttgcagttagccgatcagtgcctgaccacggccctaaattgtgatcaggccgctcaaagattagagcgtgtgcggggacgagtcctgaagaagttcaagagcgactctgggttggcccagaggaggtttattaggggttggggactgtgcatttttctcccgttcgtcctgtcacaactggagccgggttgtaagaaagagctgcccgagtttgaaggcgacgttctggctgtcggaagtcaggcgctgacgacagaaggcatctacgaggacgtcataagggggtgtctcctgcaaagaatcgaccaagagctcaaaaagactctcggggctaacgacgttagttgtaccctcgatggatgtctggaggttccttgggagcaagaaggagctgatgaggagacagaggccgaacgggaaggcggtgcttgccctcggcaaccggattcgggcgcacagatacagccactatgtccgccaccctcccccggtacattcagaagctag

SEQ ID NO: 55960 - DNA, 2094 bp, Artificial Sequence
  Description of Artificial Sequence: Synthetic coding sequence
atggggcctgacaggaaagaggtcccactaagtagagggacgcaggcagtcgtcgtaggcaaaggcaggggcgctccgggtgacgatagtagtatgggtggtaggccctcctcacctctggacaagcagcagcgacagcacctcagaggacaagtggacacacttctgagaaacttcttgccttgttatcggggacagctagcggcttctgtgctccgacagatctccagggagctaggaccgcaagagcctacgggatcacaactactacgctcaaaaaagctgccgcgagttagggaacataggggacccctcactcagctgcggggtcatcctcctagatggcaaccaatcttctgcgtactgcgcggtgatggacgactcgagtggtttagccataaagaggaatatgagaacggaggtcactgcctcgggtcaaccgccctgaccggctatacattgttgacttcccagagagaatacctgaggctgcttgatgccctctgtcctgaatctctgggagaccacactcaggaggagcctgactcacttctggaagttccagtgtccttcccactgttcctgcagcaccccttcaggcgtcacctttgcttctctgctgccacccgtgaggcccagcatgcctggcggcttgccctgcagggtgggatacggctacagggaatagttctacagcgcagccaagccccagctgcgagagctttcctcgacgcggtgaggctgtaccgccaacaccaaggacacttcggggatgacgatgtgacacttggtagtgatgcagaggtgttgaccgctgttctgatgagggagcagctgcccgctctacgggcacaaacactgcccggtcttcgcggagcaggcagggctagggcctgggcttggaccgagctcctcgacgcagtccacgcagccgttctggccggagcctctgctggcttatgtgcattccagcctgagaaagacgaactgctggcatcactagaaaagaccatccggcctgacgttgaccagctcttgcgacagagggccagggtagctggacgattgcggactgatatccgtggacctttagagtcctgtctgagaagggaagtggatccacaactgcccagggttgtccagactctcctccgaacggttgaagcgtcgctggaagccgtgcgaacactccttgcacaggggatggataggctgagccaccgcctaagacagtcacccagcgggaccagactgcgcagggaagtttactccttcggcgaaatgccttgggacctggctcttatgcagacctgctatagagaagccgagcggagcagagggagactggggcagctggccgcaccgtttgggttcctgggcatgcagtccctggtgttcggggcacaggacctcgctcagcaacttatggcggatgctgtcgcaacatttttgcaacttgccgatcagtgtctgactacagctcttaactgcgaccaggcagcgcagcgactcgagcgtgtccggggtcgcgtcctgaaaaagttcaaatcagatagcggactcgcccaacgtcggtttatccggggttgggggctctgtatattcttgcccttcgtgctttctcaactcgagcccggttgcaaaaaggaactgcccgagtttgagggagatgtcctggccgtgggatcacaggccctgacaaccgaagggatctacgaggatgtcattcggggttgtctattacagagaatcgatcaggagctgaagaagactctgggagccaatgatgtgagttgtaccttggatggatgtctagaagttccatgggaacaggagggcgctgcaccaaacctaaacctcgtcagtagttttttggcaggtagacaagcatttaccgattttctgtgcctgcctgccaagagctccgcaaactggatcttagccgcaagcttgttaagttgctcatgttttcgctcaggcttccacagggatagccgcgtgttcctggtgcagctcgctgaaggactgtctcattctctggaaactgtcagctctcatagtgtgtggagctttaggcccacgcctcgccagtag

SEQ ID NO: 55961 - DNA, 1848 bp, Artificial Sequence
  Description of Artificial Sequence: Synthetic coding sequence
atgggacctgaccgcaaggaggttcccttgtcgaggggcactcaggcagtggtcgtcggcaaggggagaggtgccccaggtgacgacagctccatgggagggagacccagctctcctctggataagcagcaaagacaacatctaagaggacaggtagacacgttgctgcggaattttttgccctgttatcgcggacagctagcggcaagcgtgctccggcagatttcacgcgagcttggtcctcaggagcccacaggctctcagctgctccggagcaagaagctcccacgcgtaagggagcatcggggaccccttacacagctccgtggccacccgcctaggtggcaaccaattttttgcgttctgaggggcgacggccgtctggagtggttttcgcacaaggaagaatatgagaacggcggtcattgcctgggcagcactgctctgacggggtacaccctgcttacgagtcagcgtgagtatttgcgcttgctcgatgctctgtgtccagaatccctaggcgaccatacccaggaggagccagatagccttttggaggtgcccgtcagctttccattgtttttgcaacatccctttcgcaggcatctgtgtttcagcgccgcaactcgcgaagcccagcatgcttggcgcctggcccttcagggaggcataagactacagggtatagtgctccagagatctcaggcgccagccgcaagggctttcttggatgcagtgcgcttgtatcggcagcaccaaggccatttcggtgacgatgatgttactcttggaagcgatgccgaagttctcactgccgtgttgatgcgagaacagctgcccgcacttagagcacaaactcttcccggactgagaggggctggtcgcgcaagagcttgggcatggacagagctgctagatgccgtgcatgccgcagtccttgccggagccagtgccggactgtgcgccttccagccggaaaaggacgaacttttggcctccctggagaaaaccattcggccagacgtcgaccagctgttacgccagagagcgagggtggcaggtcggctccgcacagacatccgaggtccgttagagtcctgcctgcggagagaggttgatccccaactgccccgagtggttcagactcttttacgcactgtagaagccagcctggaagccgtgcgcaccctcttggcccaggggatggacagactgtctcaccggttgaggcagagtccttctggcactcgcttacggagagaagtctattcattcggcgaaatgccttgggatctcgcacttatgcagacttgctaccgggaagccgagcgctcacggggacggttaggtcagctggccgctccatttggcttcttggggatgcagagcctagttttcggagcgcaggacctagcccaacagctgatggcagatgccgttgctacctttcttcaactggccgatcagtgtctgacgaccgctcttaactgcgaccaggccgcacagcggctggaacgcgtgcgaggacgagttttaaaggaactccctgaattcgagggcgatgtgctggcagtgggttctcaggctctcaccaccgaggggatttacgaagatgtcatcaggggctgcctcctgcagaggatcgaccaggaattaaagaaaactcttggtgccaacgatgtaagctgcacactggacggatgtctcgaggtgccctgggagcaggagggggcagacgaggagaccgaagccgaaagagaagggggtgcctgtccaaggcagcctgattcaggagctcagatccagcccttgtgccccccaccctcaccagggacatttcgtagctag

SEQ ID NO: 55962 - DNA, 1710 bp, Artificial Sequence
  Description of Artificial Sequence: Synthetic coding sequence
atgggcggtaggccgagtagcccactggacaaacagcaacgtcagcatctgagaggccaagttgatacgctgcttaggaactttctgccttgttatcggggacagctggctgcttcagtactgccacgggtccgagagcaccgaggaccactgacccagctcagaggacatccgcctcgctggcagccgattttttgcgtcctccgcggagatggtaggctggagtggttttctcataaagaagagtacgaaaacggtggacactgtttgggaagtacagcccttacaggctacaccctattgacaagtcagcgggagtatctgaggctcctggatgccctctgtcctgagtctctgggagaccacacccaggaggaacctgacagcctcctcgaagtcccggtatctttcccccttttcctgcagcacccttttaggaggcacctgtgcttctctgccgctacacgcgaggcccagcatgcctggcggctggcgctgcagggcggaatacgactgcagggaatcgtactgcaacggtcacaggctcccgcagcacgtgcctttctcgacgcagtccgattgtatcgccagcatcaggggcattttggggatgacgatgttaccctcggctctgacgccgaagtactgacggccgtactgatgcgagagcagctgcctgccctgagagcccagactttacctggccttaggggggcagggagggccagagcttgggcctggaccgaacttcttgacgcagtgcacgctgcagttctggccggagcgtctgctggcctgtgtgcatttcagcccgaaaaggatgaactgttagccagcctggaaaagacaatccggccagatgtggaccagttactaagacagcgcgcaagggtggccggtaggctccggacggatatacgcggaccgctggaaagctgtctccggcgagaggtggatccgcaactgccaagagtcgtgcaaactttattacgcaccgtggaggccagcttggaggctgtacggacactgctcgcccaggggatggacaggttgtctcatagacttcgtcagtccccttcagggacccgcctgcggcgtgaggtgtactccttcggagagatgccttgggacctggctctgatgcaaacttgctaccgagaagctgagagatcacggggaagactggggcagctggcagccccattcggttttctgggtatgcagtctctggtgttcggcgcacaagacctggcgcagcagctgatggctgacgccgtggccacattccttcagctggcggatcaatgcctcactactgccttgaactgtgaccaggcagcccaacgcctggagagagtgcggggacgtgttctaaaaaagttcaagtccgatagcgggctcgctcaaaggaggttcataagaggctggggcctgtgtattttcttacccttcgtgctgagtcagctggagcccggatgcaagaaggaactgcccgagtttgagggagacgtactggctgtgggtagtcaggccctgacgaccgagggaatttatgaagatgtaatccgcggatgccttctgcagaggattgatcaggacgaagagactgaagccgaaagagaaggaggagcttgtccaaggcagccggattccggcgcacagattcagcccctgtgccctcctcccagcccgggaacgttccgcagctag

SEQ ID NO: 55963 - DNA, 1272 bp, Artificial Sequence
  Description of Artificial Sequence: Synthetic coding sequence
atgagagagcaactacccgctttaagagcgcaaaccctgcctggattgagaggcgctgggcgagctcgagcttgggcctggactgagctgcttgacgcagtacacgccgcagtactggccggtgccagtgccggactttgcgcttttcagcccgagaaggatgaacttctggcatcattagagaaaaccatcagaccagacgtggaccagctgctccgccagcgggctcgtgtggccggaaggctgcgcacagatatccgtggacctctcgagtcatgcctacggagagaagtggacccacagttacccagggtcgtgcaaaccctcctgcggaccgtggaagcgtccctggaagccgtccgcacactgctggcacaagggatggaccgcctttcgcatcgactgcgacagtctccttcaggaacacgactacggagggaagtctatagcttcggtgaaatgccatgggacctggctctaatgcaaacgtgctacagggaagccgaacgttctagaggcaggctgggacaactcgctgctccatttggcttcctagggatgcaatcactggtgtttggagcccaagatttggcacagcagctgatggcagatgccgtggctacatttctccaactagcggaccaatgtctgaccaccgcccttaactgcgatcaagctgctcagcgccttgagagggtcagggggagggtgttgaaaaagttcaagtcggacagcggcttggctcagcgtcggttcattagaggatggggactctgtatctttctccctttcgtgctcagccagctcgagcccggttgcaaaaaagagttgcctgaattcgagggggatgtactggcggtgggttctcaggctctcaccactgaaggaatttatgaggatgttatccgcggttgtctgctgcagcgaatagatcaggaactaaaaaagaccttgggcgctaacgacgtcagctgtaccctggatggctgcttggaagtcccttgggaacaagagggtgccgctccgaacctcaacctggtctcatccttcttagccggtcgccaggcttttactgacttcctgtgtttgccggcaaagagctcggccaactggatccttgccgcaagccttctcagctgtagttgttttcgatctggattccaccgggattccagagtgttcctcgtccagctcgccgaggggctctctcacagtcttgaaacagtcagctctcattcagtctggtcatttaggcccacaccaaggcaatag

SEQ ID NO: 55964 - DNA, 2748 bp, Artificial Sequence
  Description of Artificial Sequence: Synthetic coding sequence
atgaggaaatcatcctccccttccctctccaattgcaacagcgttctcgctaataaaatctttggcattcctctcgacgaactccagcagggcggacacccggacaatgaagtccctttcatagtgcgacatgttgtggactatatcgaggagcatgggggactggagcaacagggcctttttcaggtgaatgggaacgctgaaacagtagagtggctaagacagcgatacgactctggagaggaagtggacctagtgaaggaagccgacgtcccatccgctataagcttgctgaggttcttcctccaggaactccccgaaccagttatccccggttcgctgcatatccatctaatgcagctgtcccaagattataacaacgaggatgagttcgggaggaagctacgctttttgcttcagcagctgcccccagtgaactactccctactgaaattcttgtgccggttcttggcgaacgtggctagccaccatgaggaaatttggtctgcaaattccctcgctgcggtttttggtccggatgtgtttcatatatacaccgacgtggaggatatgaaggaacaggagatcgttagtcgcataatggccggtctcttggagaactactacgaattcttcgagaatgaggaggaggatttctcttccaatgatctctcatctatcaccgaacaggtcaacgagctcagcgaagaagaggaggaagatgaaaagttagagcacattgaagagttaccagaagaaggggcagagaagagcaacgacatgccagaagtggtgcagttgaggatgactgagaacatactagagagtaattctgtaaccgccacgtctacacacatatcccccatctctattctcccagcctctaccgacatcctagaaagaacaatccgagccgctgtggaacagcacctcttcgatctgcagtcttcaattgaccatgacctgaaaaatctacagcaacagtctgtcgtttgcaacaacgaggctgaatctatccattgcgatggcgagggatcaaataatcagatagatatcgcagacgacataataaatgcgagcgaatccaaccgggactgtagcaagcccgttgcttctaccaatttggacaacgaagccatgcagcaggattgcgtgttcgaaaacgaagaaaatactcagtctgttggcatcctgctggaaccctgcagcgacaggggagactccgaggacggctgtctcgagcgggaggaatatctcctgttcgatagtgacaaactctcacacctcattctcgactccagctcaaaaatctgcgacttgaacgccaacaccgagtctgaagtacccggtgggcagtcagtgggggttcaaggcgaggcggcttgcgtaagcattccccatctagatttgaagaacgttagcgatggggataagtgggaagaacctttcccagcattcaagtcctggcaagaagattcagaaagtggagaggcccaacttagtccccaggcaggaaggatgaatcaccaccccctggaggaggattgtccaccagtgctgagccacaggtctcttgatttcgggcagtcacagcgcttcctgcatgaccccgagaagctggatagcagtagtaaggccctatcattcaccagaatccgaagatctagcttctcgtcaaaggatgagaagcgggaggaccggactccgtatcagttagttaaaaaacttcagaaaaaaatccggcaatttgaagagcaattcgagagggaacgcaacagcaagccatcatatagcgacatcgcagcaaaccccaaagttttgaaatggatgaccgagctgactaaactgcggaagcagattaaagacgcaaagcataaaaactcagacggagagttcgtgccccagactaggccacgatctaacacccttcccaagagtttcggatcttccctcgaccatgaggacgaggagaatgaggacgagcccaaagtaatccaaaaggaaaaaaagcctagcaaagaggctacactcgaactcattctgaagcggctcaaagaaaagcgcatcgagaggtgcttacccgaggatatcaaaaaaatgaccaaggaccatttagtagaggagaaggcaagcctgcagaagagcttgctttactatgagagccaacatggccgacctgtcaccaaggaggagcgacacatcgtgaagccactctacgaccgatacaggctggtgaagcagatgcttaccagggcctctatcactcccgttctcgggtcaccctccactaaacgacggggacaaatgctacagccaattatcgagggtgagaccgctcacttctttgaagagatcaaggaggaggaggaggatggggtcaatttgtctagtgagcttggggacatgctgaaaacggccgtacaggttcagagtagcctcgagaacagcgaaagcgacgtcgaagagaatcaagaaaagctggctctggacctccgcctcagtagttctagagcagcatcaatgccagagctgctcgagcaactttggaaagccagggccgaaaaaaagaaactgcggaaaacattgagggaattcgaggaggctttctatcagcagaatggcaggaatgcgcagaaagaagacagggtcccagtgcttgaggagtatagggagtataagaagatcaaagccaagttgaggctcctggaggtccttatctctaaacaggattccagcaaaagcatctag

SEQ ID NO: 55965 - DNA, 2664 bp, Artificial Sequence
  Description of Artificial Sequence: Synthetic coding sequence
atgaggaaatcttcctccccctctctgagcaattgcaattccgtcctggccaacaagatatttggaatccccctggacgagctgcaacaggggggacacccagacaacgaggtgcccttcatcgtccgacacgtggtggattacattgaggagcatggtggccttgagcagcaaggactgttccaggtaaacggaaacgctgagaccgtggaatggttacgccagagatacgactctggagaagaggtggatctcgtaaaagaagcagacgtaccatctgccatctccctactgagattcttcttgcaagagctgccagagcccgttattccagggtccctgcatatccaccttatgcagctgagtcaggattataataatgaagatgagttcggcagaaagctgaggtttcttctgcagcaactgcccccagtaaattattcactcttgaagtttctgtgcagatttctggcaaacgtggcctcccatcatgaggagatttggtcagcaaatagtttagcagcggtgtttggacctgacgttttccatatatatactgatgtagaggacatgaaggagcaggagattgtttcaaggatcatggcgggtctgctggagaactattatgaattcttcgaaaatgaagaggaggatttctcttcgaatgatctatccagcataacagagcaagtgaatgagctgagtgaggaagaggaagaggatgagaagctggagcacatcgaggagctgcccgaagaaggagctgagaagagcaacgatatgccggaggtggtgcagttacggatgacggagaatattctggaatccaattccgtgaccgcaacaagcactcacattagtcctatctctatcctgcccgcatcaaccgacatccttgagaggactatcagggccgcagttgaacagcatctgtttgatctgcagtcatcgattgaccatgatctgaaaaacttacagcagcagagcgtggtgtgtaacaatgaggccgagagtatccactgtgatggggagggtagcaataatcagatcgatattgccgacgacataattaacgcctctgaaagcaaccgcgattgttccaagcccgtcgcttcaaccaatctcgataacgaagccatgcagcaggattgcgtttttgagaatgaggagaacacccagtcggtgggaattctgttagaaccttgctcagataggggcgactcagaggatggatgcctggaacgtgaggaataccttctttttgattccgataagctgtcccatctgattctggacagttcgagcaaaatatgcgatcttaacgccaacactgagtccgaagttcctggcggtcagtccgtcggggtgcaaggcgaggcggcttgtgtttcaattccacacctggacttaaagaatgtctcagacggcgataagtgggaggagcctttccccgcttttaagtcgtggcaggaggattctgagtccggcgaagcacagctgtctccccaggctggcagaatgaatcaccatcctctggaggaggattgcccaccagtgctgtcccatcggagtctggactttggacaaagtcagcgttttctgcacgacccggagaaacttgattccagcagcaaagctcttagcttcacgcggatccgcaggagctctttctcatctaaagacgagaagcgcgaggacaggacaccttaccagcttgtgaagaagctgcagaagaaaatccgtcaatttgaggaacagttcgaacgggaacgtaattccaagccctcctattctgatattgcagctaacccaaaagtccttaagtggatgacagagctgactaagctccggaagcagatcaaagatgccaagcacaaaaacagtgacggggagttcgtgcctcagaccagacctcgatccaataccctgccaaaaagttttggcagcagtctggaccatgaagacgaagagaatgaggatgaaccaaaagtgatacagaaggaaaagaagcccagcaaagaagctactctggaactgatcctgaagagactcaaagagaaaaggatcgagcgttgcctccccgaggacattaaggtgaccaaagaagagcgccatattgtcaagcccctgtatgatcggtatagactggtcaagcagatgctgactagagctagcattactcctgtgctgggaagcccttcaacgaagcggcgtgggcagatgctgcagcctatcatcgagggggaaacggcacacttcttcgaggagataaaagaggaggaggaggatggcgtgaatctcagttccgagctgggcgatatgctgaaaacagccgtgcaagtacagtcctcccttgaaaactctgaatccgatgtggaggaaaatcaggagaaactggcattggatctaagactgtcctccagccgagccgcttccatgcccgagttgctggagcagctgtggaaagctcgcgcagagaaaaaaaaactgcgcaagaccctgagagagtttgaagaggcattttatcaacaaaacggtcgcaacgcccagaaggaagaccgcgtcccggtgctagaagaataccgcgaatataaaaaaatcaaagcgaagcttcggttgctggaggtgctcatcagcaaacaggattcaagcaagtccatctag

SEQ ID NO: 55966 - DNA, 2376 bp, Artificial Sequence
  Description of Artificial Sequence: Synthetic coding sequence
atgcagctgtcccaggactacaataacgaggacgagttcggtagaaaattgcggttcttacttcagcagctgccacccgtaaactattctttattgaaattcctgtgcaggtttctggcaaacgttgcgtcacaccatgaggagatttggtcagcaaattctttagccgcagtcttcggtccagatgtctttcacatatacacggatgttgaggacatgaaagagcaggaaatagtatcacgtattatggcgggtcttctcgagaattattacgaattcttcgagaacgaagaggaagacttttctagcaatgatttatcgagcattaccgagcaggtgaatgagttgtcagaggaagaggaggaagacgagaaattggagcacattgaggagctgccggaggaaggggcagagaagtcaaatgatatgcctgaagtagtccaattgcgcatgaccgaaaacatcttagagagtaacagtgttactgccacatcaacccatatctccccgatcagcatcctgcctgcatccacggacatcctagagcggactatccgggcagcagttgagcagcaccttttcgacttacagtcctccatagatcatgatcttaagaacttgcagcagcagtctgtagtctgtaataatgaggctgagagcatccactgcgacggcgaggggtccaacaatcagatcgacatcgcggacgatattataaacgccagtgaaagtaaccgtgattgttccaaaccagtcgcctcaaccaatctcgataatgaggcgatgcagcaagactgtgtctttgagaatgaggaaaatacacagtctgtgggtatcttattggaaccgtgctctgaccggggagattccgaggatggctgtttggaacgggaggaatatctgttgttcgattccgataaactcagccatctgatcctggacagctctagtaagatttgtgacttaaacgccaacacagaaagcgaagtgccaggcggacagagcgtgggagtccagggagaagccgcttgtgtgagtatcccacatctggacctaaagaacgtcagcgatggagacaaatgggaggccagctgtccgattacattccctctcatagacttcaaaactatgcacctgcagcgagacggggaggaaccatttcccgcatttaaaagctggcaggaggacagtgagtcaggcgaagcccagttgtcccctcaggcgggtaggatgaatcatcatccgttggaagaggattgcccgccagtactctcgcacagatctttggattttgggcaatcccagaggtttctccacgatccggaaaaactggactcaagcagtaaagcactgtcttttacccgtatccgtagaagctctttctcctccaaggacgagaagcgggaggataggactccctatcagttggtgaaaaaactgcaaaagaaaatcaggcagttcgaggaacaatttgagcgagagcgtaactccaagccatcctactcagacattgctgccaatcccaaagttttgaagtggatgacggaactgacgaagctcaggaaacaaatcaaggacgccaagcacaaaaattctgacggagagttcgtgcctcaaacccgtcccagatcaaacactctccctaaaagttttggttcctctctggaccacgaagacgaagaaaacgaagacgaacccaaggtgattcagaaagagaaaaagcccagcaaggaggcaaccctggagttgatcctcaaacgtctaaaagagaagaggatcgagaggtgcctgcccgaagacataaaggtgacaaaagaggagaggcatatcgtcaaacccctttacgatcgctatcggctcgttaagcagatgctgactcgagcatcaatcacccccgtcctcgggagtccaagcactaagaggagaggtcagatgttacagccgataatagagggggagacagcccatttcttcgaggagatcaaagaggaagaagaggacggcgtgaacctttcctcagagctgggggacatgcttaagactgccgtgcaggtccaaagcagtcttgagaatagtgaatctgatgtggaggaaaatcaagagaaactggctctcgaccttagactctcctccagccgggctgcttccatgccggaactgcttgaacagctctggaaagcccgagccgagaaaaagaaactccgcaagactctcagagagtttgaagaagcattctatcagcaaaatggcaggaacgcccagaaggaggaccgagtgccagtgctggaggaatatcgggagtataagaagataaaggccaaactgagacttttggaggtactgatcagtaagcaggactcttccaagtctatctag

SEQ ID NO: 55967 - DNA, 288 bp, Artificial Sequence
  Description of Artificial Sequence: Synthetic coding sequence
atgagaaagagtagctctccgtctctctctaattgcaactccgtgctggccaataagatcttcgggatccccttggatgagctccagcagggtggtcaccctgataacgaagtgcctttcatcgtgcggcacgttgtggattacatagaggagcacggaggcctggaacagcagggtctctttcaggtgaatgggaatgccgaaaccgtggaatggctgcgccaaaggtacgatagtggagaggaagtagatcttgttaaggaggcagatgtgccgagcgctatctag

SEQ ID NO: 55968 - DNA, 159 bp, Artificial Sequence
  Description of Artificial Sequence: Synthetic coding sequence
atgaggaagagctcctcaccatctctctccaactgtaacagtgtgctggccaacaagatcttcggaatcccgttggatgaacttcagcaggggggacacccagacaatgaagtcccatttattgtacgccatgtcgtggattatatcgaagaacattag

SEQ ID NO: 55969 - DNA, 195 bp, Artificial Sequence
  Description of Artificial Sequence: Synthetic coding sequence
atgaggaagtcttcatcccccagtctatccaattgcaacagcgtcctagccaataagattttcggaatccctttagacgagctgcagcagggcggtcaccccgataatgaggtccccttcatcgtccggcacgtggtcgactacatagaggagcacgggggactggagcagcaaggactcttccaggtgaactag

SEQ ID NO: 55970 - DNA, 264 bp, Artificial Sequence
  Description of Artificial Sequence: Synthetic coding sequence
atgcggaagtcttcaagcccatccctgtctaattgcaactccgtgcttgccaataaaatttttgggattccactggacgaactacagcagggtgggcacccagataatgaggtgccgttcatcgtaaggcacgtcgtggactacattgaggagcatggagggctggagcagcagggactattccaggtgaatggcaacgccgagacagttgagtggctgcgccagcggtacgactcaggtgaggaagtcgatctcgtgaagtag

SEQ ID NO: 55971 - DNA, 429 bp, Artificial Sequence
  Description of Artificial Sequence: Synthetic coding sequence
atgaggaagtccagctctccgtccctgtccaactgtaactccgtcctggccaataagatatttggaattccactggatgaattacagcaggggggacatccagataatgaagtgccattcatcgtgaggcatgtggtggactacattgaagagcacggaggtctcgaacagcaggggctgtttcaggtgaacgggaacgctgagactgtcgagtggctccggcagcgctatgactccggagaagaggttgacctggtcaaagaagccgatgtcccctctgccatctccctgcttcgcttcttcttgcaggagctccccgagccagtcattccaggtagcctgcatatacatttaatgcagctctcacaggactataacaatgaagacgaattcggacggaagttgcgcttccttcttcagcaactttag

SEQ ID NO: 55972 - DNA, 1506 bp, Artificial Sequence
  Description of Artificial Sequence: Synthetic coding sequence
atgggcaactttaagagccgcaagccgaagtctatctttaaggccgagagcggacgatcgcatggcgagtcccaggaaacagaacacgttgtcagctcccagagcgaatgccaggtgcgcgctgggactccagcccatgagagcccccagaacaacgcttttaaatgtcaggagaccgtgagactgcagccccgaattgaccaaagaaccgccatatcacctaaggatgctttcgaaacccgtcaagaccttaacgaggaggaggccgcacaggtacacggcgtgaaggatcccgctcctgctagcacccagagcgtgcttgccgacgggactgattccgcggacccatcacccgtgcataaagatggacagaacgaagccgattctgcgccagaggacctgcattcggttggcacaagcagattgctgtaccatatcacggacggggataaccctctgctgagtcctcggtgttccatcttttcccagagtcagaggtttaatctcgacccggaaagtgccccttctcctccttccacacagcagtttatgatgccgcgttcgtccagcaggtgttcgtgtggagacggcaaggagccccaaaccataactcagctgaccaaacacattcaaagtctgaaacggaaaattagaaaattcgaggagaagttcgaacaggagaagaagtacagaccctcgcatggggacaaaacaagtaatccagaagtccttaaatggatgaatgatctggcaaaaggtaggaaacagcttaaggaactgaaactgaaattaagtgaagaacagggttctgcgcctaagggccctccaaggaacctcttgtgtgaacagcccacagtgccccgtgaaaacggtaaacctgaggccgcagggcctgagccttcttcgtctggcgaagaaacgcctgatgccgctttgacctgtttgaaggaacggagagagcagctcccccctcaggaagacagcaaggtcacgaagcaagataagaacctgattaagccattgtatgaccggtaccgcattatcaagcagattctctctacgccttccctcatcccaaccatcgaggaagaggactctgatgaggaccgaccgcaggggagtcagcagccctctcttgctgatcccgcttcacacctgccagtcggtgaccatttgacgtacagcaatgagacagaacccgtgcgggcactcctgccagatgaaaaaaaggaggtgaagcctcctgcactgagtatgtctaacctgcatgaagccaccatgcctgttctcctggaccacttaagggagacgcgcgctgacaagaagagactccgcaaggcgctgcgcgaatttgaagagcaatttttcaaacaaactgggaggtctccccagaaggaggaccggatacccatggccgacgagtactatgagtataaacacattaaagccaaattgcgtctcctggaggtgctgatctccaaacaagacgtcgccaaaactatctag

SEQ ID NO: 55973 - DNA, 1758 bp, Artificial Sequence
  Description of Artificial Sequence: Synthetic coding sequence
atgttcagttgcttttgtttcagcctgcaggacaactcgttctcgtccacaacagtgacagagtgcgatgaagaccccgtctcattacacgaggaccaaacagattgcagttcactacgggatgaaaacaataaggaaaattatccagacgccggagcactggtggaggaacatgcacccccatcttgggaaccacagcagcaaaatgtagaagctactgtgctggtggatagtgtcctgagaccctcgatggggaactttaaatcccgaaaacctaagtctatctttaaggcggaaagcggcaggtcccacggggagtcacaggaaaccgaacacgttgtgtcatctcagagcgagtgccaggtccgcgctggcactcctgcccatgaatctcctcagaacaacgccttcaagtgtcaggagaccgttagacttcaacctcgaatcgatcagcgcactgccatttctcctaaagacgcatttgaaacgcgtcaggatttaaatgaagaggaggcggcacaagtgcacggggtaaaggacccagccccagcttcaacacagagcgtcttagcggacggtacagactccgctgatcctagccccgtgcataaggacgggcaaaacgaggccgatagtgcacccgaggatcttcacagtgtaggaacaagcagactgttgtatcacatcactgacggggacaaccctttactgtcccccaggtgctcaatcttcagtcagtcacagcgttttaatctggacccggagtccgcaccatctcctccgtctacccagcagtttatgatgccccgatcttcctcccgatgctcttgcggtgatggcaaggagccccagacgatcactcagctgacaaaacacatacagtccctcaagcgaaagatccgaaagtttgaagagaaattcgagcaggagaagaagtaccggcctagccacggtgataagacaagtaatcccgaagttctcaaatggatgaacgacctggccaagggacgtaagcagctgaaggagcttaagctaaagctgtcggaagaacagggctccgcaccaaaggggccaccgaggaacctgttatgcgagcaacccaccgttcccagggagaacgggaaacctgaggcggcaggaccagaaccctcaagttcgggggaggaaactccagacgccgctttgacctgcttgaaagaacggagagagcaactgccaccacaagaagattctaaggtaacaaagcaggataagaatctcatcaagccattgtatgatcgatatcggattatcaaacaaattctgagcacgccttcactaatccctactatccaggaggaagaggattccgatgaggataggccccagggctcccagcagccctccctggccgacccagcgtctcacttgcccgtgggagaccaccttacatatagcaacgaaacagagcccgtgagggccttgcttcctgacgagaagaaagaggtcaagcctccagcactgagtatgtcaaatctgcacgaggctactatgccggtgttgctcgatcatttgcgggagactcgcgcagataagaaaaggctgagaaaagccctcagagagtttgaggaacagttctttaagcaaacaggtagatccccacaaaaggaagatcggattcctatggcagacgagtactacgagtacaagcacattaaggcaaagctgcgcctcctggaggtccttatttctaaacaagacgtggctaagaccatttag

SEQ ID NO: 55974 - DNA, 1464 bp, Artificial Sequence
  Description of Artificial Sequence: Synthetic coding sequence
atgttctcctgcttctgctttagtcttcaggataactccttcagcagcacaaccgtgactgaatgtgatgaggaccctgtttctctacacgaagaccagactgattgcagttctctccgcgacgaaaacaataaagagaactatcccgatgcaggcgctctggtggaagagcacgcgccacccagctgggagccacagcagcagaacgtggaagcaacagtgctggtggactctgtactgcggcctagcatgggcaacttcaagtcgcgaaagccaaagagtatatttaaagcagagtccggcagatcccatggggaaagccaggaaaccgagcatgtcgttagctcacagagtgaatgtcaggtgcgcgcagggactcccgctcacgaatcgccccaaaataacgcttttaagtgccaggaaaccgtgcgactgcagccacgcatcgaccaacgcactgcgatctcccctaaggacgcttttgagaccaggcaggatttgaacgaggaggaagctgctcaagtgcacggggtcaaggatcccgcaccggcatcaacccagtccgttctggccgacggaaccgattctgctgacccatcacccgtgcataaggacgggcagaacgaggcagattcagctcccgaggatctgcactccgtggggacttctcgactactatatcacatcactgacggagataatccattactctcacctaggtgtagcattttctcccaaagtcagcgattcaatctggatccggaatccgcaccaagtcccccttcaacacagcagttcatgatgccaaggagctcatccaggtgcagttgcggcgatgggaaggagccacagacaataacacagctgaccaagcatattcaaagtctgaagagaaagattcggaaattcgaggagaaattcgaacaggagaagaagtaccgcgtcacaaaacaggataaaaacctgattaagccgttatacgatcgataccggatcattaaacagatactgtctacaccatccttgattcctacaattcaggaggaggaagactcagacgaggaccgaccccaggggtcccagcagccgagtctggctgaccccgcttcgcacctccctgtcggagaccacctgacatattccaatgagacagaacccgtgcgcgcactgctacctgacgagaagaaagaggtaaagccccctgcattgtctatgagcaacctgcacgaagctacaatgccagtactacttgaccatttacgcgagaccagagcagacaagaagcggctgagaaaagccctacgtgaattcgaagaacagttctttaagcagaccggcaggagccctcagaaagaagatagaatcccaatggctgacgagtattatgaatacaaacatattaaggccaaactccggctgttagaagtgctgatctcaaagcaggatgtggctaaaaccatctag

SEQ ID NO: 55975 - DNA, 1377 bp, Artificial Sequence
  Description of Artificial Sequence: Synthetic coding sequence
atgttctcctgtttctgcttttccctgcaggacaacagctttagtagcaccacagttaccgagtgcgacgaggaccccgtgtcactgcatgaggatcagacagactgctcctcactgagagacgaaaacaacaaggagaactaccctgatgccggagccttggttgaagagcacgcacccccttcctgggagcctcagcagcagaatgtggaggccacagtgctggtggactctgtcttgcgcccttccatgggcaactttaaatctcgaaagccaaagagtatctttaaggccgagagcggaagaagccacggagagtcccaggagacagaacacgttgttagtagtcagtcagagtgtcaagtccgcgcaggtacccccgctcacgaatcccctcagaataatgcgttcaaatgccaggaaactgtgcgtcttcagcctcgcattgatcagagaacagccataagccctaaggatgcctttgagacccgtcaggaccttaacgaagaggaggccgcacaggtccatggcgtgaaagatcccgcaccagccagcacgcagagcgtcctggccgacggcaccgactccgctgatcctagccccgttcacaaggatggacagaacgaagccgattcagcacctgaggacctccactcagtgggaacgagtcgcttattatatcatataacggatggagacaaccctttattgtctcctcgctgctccatcttttcccagagccagaggttcaatcttgaccccgaaagcgcaccctcccccccatcaactcagcaattcatgatgcccagaagctcttcccgctgtagctgtggtgacgggaaagaaccacagacgatcacacagctgaccaagcacatccagtctttgaagcgtaagattcgcaaatttgaggagaagtttgaacaggagaaaaaataccgtccttcccatggtgacaaaacctccaaccctgaggtgctaaagtggatgaatgatctggcaaaaggcaggaagcaactgaaagagctaaagttaaaactttccgaggagcagggaagcgccccaaaaggaccaccgaggaacctgttgtgtgaacagcccacagttcccagggagaacggcaaacccgaggctgctggacctgagccctccagtagcggtgaagagacccccgatgcagcactgacttgcctaaaggagcgccgagaacagctccctccacaggaggacagcaaggtaactaagcaggacaagaatcttatcaagcctctctacgatcggtatagaattatcaaacagattctgagtaccccctcccttatcccgactattgtaagccaggatacctgcatgctcctcctgtgtactgatgtgtag

SEQ ID NO: 55976 - DNA, 1509 bp, Artificial Sequence
  Description of Artificial Sequence: Synthetic coding sequence
atgggaaattttaaatcccggaaaccaaaatccattttcaaagccgaatctggaagaagccatggagagtctcaggagaccgagcacgtcgttagttcgcagagcgaatgccaggtccgagctggcactccagcgcatgaaagcccccagaataatgcctttaagtgccaggagaccgtacgactgcagccacggattgatcaaaggaccgcaattagcccgaaggacgccttcgagacaaggcaagatctgaacgaagaagaagcggctcaggtgcacggggtgaaggatcccgctcctgccagtactcagtctgttttagccgacggcacagactccgcagaccctagtcccgtccataaggatgggcagaatgaggcagactcagctcctgaggatctccactccgtgggtacaagtcgtttactgtatcacatcacggatggcgacaatccactgctgagtcctagatgtagcatcttttcacagagccagaggtttaaccttgaccctgaatctgcgccttcccctcccagtacgcagcagtttatgatgccccgatcctcaagccggtgctcttgtggtgatggtaaagagccccagaccatcacccagctgaccaagcacattcagtccctaaagcgaaagattcgcaagtttgaggaaaagtttgaacaggagaaaaagtatagaccatcccacggagataagaccagtaatcctgaagttctgaagtggatgaacgatctggccaagggcagaaaacagttgaaggagctgaaacttaagctctcagaggaacaaggttccgctcccaagggaccaccgagaaaccttctttgtgaacagcctacagtccccagggaaaacgggaaaccagaagcggcaggcccagagcccagtagctcaggcgaagaaacaccagatgcagcactgacatgtcttaaagagcggagagaacagttgcccccacaggaggattcgaaagtgaccaaacaagacaaaaatctcattaagcccctgtatgacaggtataggattattaagcagatcctgagtaccccctctctgattccaactattcaggaggaggaggacagtgacgaggaccggccacaggggagtcagcagcccagtctcgctgacccagccagtcacctgcctgttggtgaccacctgacatacagcaatgagaccgagcctgtcagggccctcctgccagacgagaaaaaagaagtgaagccaccggcattaagtatgtcgaacttacacgaggccaccatgccagtactactcgatcatctgcgggagacaagagcggacaaaaagaggctgaggaaagctctaagggagtttgaggagcaattttttaaacagactgggaggtctccccagaaagaggatcgcatccctatggcagacgagtactacgagtacaagcacatcaaagccaaattgcggctgttggaggtactgatttccaaacaggacgtggctaaaactatttag

SEQ ID NO: 55977 - DNA, 18 bp, Artificial Sequence
  Description of Artificial Sequence: Synthetic coding sequence
atggggaacttcaagtag

SEQ ID NO: 55978 - DNA, 78 bp, Artificial Sequence
  Description of Artificial Sequence: Synthetic coding sequence
atgggcaatttcaagtccaggaaacccaagtctatattcaaggccgagtcaggaagatctcacggagaatcccagtag

SEQ ID NO: 55979 - DNA, 999 bp, Artificial Sequence
  Description of Artificial Sequence: Synthetic coding sequence
atggactctacgagttcattacatggcagttccctacaccggccatcaacggagcaaacccgaaccgatttctcttgggatggaatcaacttaagcatggaggatactacttccattctgcccaaactgaaacggaactctaacgcatacgggataggcgcactcgcaaagtcaagtttctctggcatcagtcgctccatgaaggaccacgtgacaaaaccaacagccatgggacagggacgggtcgctcatatgattgaatggcaggggtggggaaagacgcccgcagtacagccacaacactctcacgagagcgttaggcgggataccgacgcgtactcagacctctctgacggcgagaaggaggccaggtttctggccggtgtaatggagcagttcgccatttctgaagcaacattgatggcttggtcatccatggatggtgaggacatgtccgttaactctacccaggaaccacttggatgcaactattctgataattatcaagagctgatggactctcaggacgccctggcacaagctccaatggatggctggcctcattcctatgtgtcgcagggaatgtactgcttggggtcaagcgatgcttgggaggccagtgaccaaagccttatcgcctcccccgcaaccgggtcttatcttgggcctgcattcgacgatagccagccttccctccatgagatgggcccaagtcagcccgctagtggatacagtgcgttagagcctccccctcttctgggcggtgatactgactgggctcctggagtcggcgctgtcgaccttgcaagaggacctgccgaggaggagaagaggcctctggccccagaagaagaggaagatgcagggtgtagagacttggagagcctgtcccctagggaggacccagaaatgtcaacggccctcagtaggaaagtgagcgacgttacaagctccggtgtgcagtcatttgatgaagaagaaggagaggctaacaactag

SEQ ID NO: 55980 - DNA, 999 bp, Artificial Sequence
  Description of Artificial Sequence: Synthetic coding sequence
atggattcaacctcaagcctccacggatcctctttgcaccggccaagtacagagcagacacgtacagatttctcttgggatggcatcaacctatcaatggaagatacgaccagcatcctccccaagctgaagcgcaattcaaacgcctacggtatcggagcgctggcaaagagcagcttctctggaatatccagatctatgaaagaccacgtaaccaagcctaccgctatggggcagggcagggtggcccatatgatcgagtggcaggggtggggcaaaaccccagccgttcagccacaacactcccacgaaagcgtccgcagggacacagatgcctactcagatctgagtgatggcgagaaagaagccaggtttttggcgggagtaatggagcagttcgctatctccgaagccactctgatggcctggagtagcatggacggagaagacatgagcgtgaacagtacccaggaaccactcggctgtaactattctgataactaccaggagctcatggactcgcaggacgctttggcccaggctcctatggacggatggccgcatagctatgttagccagggcatgtactgcttgggctctagcgatgcctgggaagcatccgaccaaagtctgatagcgtctccggctactggatcttatttggggcctgcatttgatgattcccagccatcacttcatgaaatgggcccaagtcaacccgctagcggatacagcgccttggaaccgcctccacttttgggtggagacacagattgggcacccggagtcggagcggtggacctggccagagggccagccgaggaggagaaacgccctctggcccctgaggaagaagaggatgccggttgtagggatctagagtccctcagtccccgtgaggaccccgaaatgagcactgcattgagtcgcaaggtctctgacgtcacttcttccggcgtgcaatcctttgacgaggaagagggcgaggctaacaactag

SEQ ID NO: 55981 - DNA, 999 bp, Artificial Sequence
  Description of Artificial Sequence: Synthetic coding sequence
atggatagcacaagttcattgcatggcagtagtctgcatcgccctagtactgagcagacccggactgatttttcatgggatggtatcaaccttagcatggaggacaccacctcgatcttacctaaactcaagagaaattccaatgcatatgggatcggggcactcgctaagagctctttttcgggcatctccagatccatgaaagatcacgtgaccaaacccacggccatggggcaggggcgtgtcgcccacatgatagaatggcaaggctggggcaagacaccagccgtccaaccacagcactcacacgagagcgtgcgtagagacactgatgcctactctgacttgtccgatggcgagaaagaagcgaggttcctggcaggggtcatggagcagtttgcaatcagcgaggctacgctgatggcttggtcctccatggacggagaggatatgtccgtgaactcaacccaagagcccttggggtgtaattatagtgacaactatcaggaactcatggacagccaggacgcactagctcaagctccaatggatggctggccccacagttacgtctctcagggaatgtactgcttgggatccagtgatgcctgggaggcatctgatcagtccttgattgcttctcccgctactggcagttatctggggccagctttcgatgactctcaaccatcattgcatgagatggggcctagccaaccagcaagtggctattcagccctggagccccctccacttctgggaggggacaccgactgggcacctggtgtgggggcagttgaccttgccagagggcctgccgaagaggaaaagaggccattggcccctgaggaggaagaagacgctggatgtcgtgatttggagtctttgtccccgagagaagaccccgaaatgtctaccgccctgtcacggaaagtaagcgatgtcacatctagtggtgtccagagctttgacgaggaggagggcgaggctaacaattag

SEQ ID NO: 55982 - DNA, 1083 bp, Artificial Sequence
  Description of Artificial Sequence: Synthetic coding sequence
atggggtgcattggctcacgaaccgtaggcaacgaggtgattgcggtcgactggaaaggattgaaagatgtcgaccagataaacatggatagtaccagttcccttcacgggtctagccttcatcgaccctccacagaacagacacgtacagacttttcctgggatgggataaacctgagcatggaggataccaccagtatactccccaaattaaagagaaattctaacgcttatggcattggtgccctcgccaagtcttccttttcaggcatttcaagaagcatgaaggatcacgtgacgaagcccaccgctatgggacagggacgcgttgctcacatgattgaatggcagggatggggcaaaaccccggctgtgcagccacagcactctcacgagtccgtgcggagagacactgacgcttactctgacttgagtgatggcgaaaaagaggcgaggtttctcgccggtgtgatggagcagttcgctatcagtgaggctactttaatggcctggtctagtatggatggtgaggatatgtcagtgaactccacacaggagcctctgggatgcaattactccgacaattatcaagaactgatggattctcaggacgcattggcccaggcccctatggacggatggcctcacagctacgtgagtcaaggtatgtattgtttggggtcttcagacgcatgggaggccagtgatcagtccctgattgcctcccccgctaccggctcttatctgggcccagccttcgacgattcgcaaccatccctgcacgagatgggtccaagccagccggctagcggatattcagctctagaacctccccctctgctcgggggagacacagattgggctcccggtgtgggcgctgtagacctggccagaggaccagcagaggaggagaagcgcccactcgctccagaagaggaagaagatgcgggttgtagagacctagagtccctttcccctagggaggaccctgaaatgtcaacagcactgagcagaaaagtgtctgacgtcaccagttccggagtgcaaagcttcgatgaggaagagggcgaggcaaacaattag

SEQ ID NO: 55983 - DNA, 1011 bp, Artificial Sequence
  Description of Artificial Sequence: Synthetic coding sequence
tttcttctggggagacatcagcggaccgtctcgacgcacgtacttaatctttgtcccagcttccccgagcactggggctatattcccccttgggacagctggctgtccatggaagacaccacgtctattcttccgaagcttaagcggaattcaaacgcttacggcatcggcgctttggctaagtctagtttttcagggatttctaggtctatgaaagatcacgtcactaagccaactgccatgggccaggggagggttgcccacatgatagagtggcagggttggggcaagactcctgctgtgcagcctcagcattcacatgaatccgtgcgacgagacacagatgcctactccgatctgagcgatggggagaaagaggccaggttccttgctggtgtcatggaacagttcgcaatcagtgaggctactctgatggcctggtcatccatggacggagaggacatgtcagtcaacagtacccaggagcctctcgggtgtaactattccgacaattatcaggagttaatggacagccaggacgccctcgcgcaggcaccaatggacgggtggccacattcctacgtcagtcaaggcatgtattgtcttggcagctcggacgcctgggaagcaagtgatcagtctttaatcgcctcccccgcaaccggtagctacctcggacctgcattcgatgactctcaaccctccttgcacgagatgggcccttcccagcctgcgagcggatattccgcccttgagccccctccattacttggaggggacactgattgggcgcctggcgttggagctgtggatttggccagaggccctgctgaagaagaaaagcgacctcttgcacctgaagaggaagaggacgcagggtgtcgcgatctagaaagtctgagtcctagagaggacccggaaatgtccacggctctcagtcgcaaggtatccgacgtgacctctagtggagtgcagagctttgacgaggaggagggcgaggccaacaactag

SEQ ID NO: 55984 - DNA, 843 bp, Artificial Sequence
  Description of Artificial Sequence: Synthetic coding sequence
atgggctcttgcgtgtccagggatctgtttaccagtgcccacaaaaactgtcctatgccccagggcgctgaccccttgaaccccgatctaccgagtggtagaacacctacagtcgccccagattgcgtgattggcaaagataagcagatggatttctgctgggacccttggcagcgctgttttcagacaaccaatggctacctgtccgacagccgctccaggcctggcaactacaacgtggccgcactcgcaacaagttcccttgtcggcgtggtgcagagtatcaaagatcacatcaccaaacccaccgccatggctagggggcgtgttgctcaccttattgaatggaagggctggtctgcccagcctgccggatgggagttatcccccgcagaggatgagcattactgttgcttacctgatgaacttcgggaagcgcgttttgccgcaggagtcgcagaacagtttgccattacagaagccaccctgagtgcctggtctagcctcgacgaggaggagctgcatcctgaaaactccccccaggggattgtccagcttcaagatctggagtctatctatcttcaggactctttgccgtctgggccaagccaggatgacagcctgcaggctttttcctcccctagtcctagtcctgatagttgccccagccccgaggagcctcccagcacagcaggcatcccccagcccccttcacctgagctacagcatcgcagaaggctccccggtgctcagggccctgaaggcggaacgcacccacccggatccttgcctagtatggactcagggtcactctgggaggaagatgaggtattctacaactag

SEQ ID NO: 55985 - DNA, 747 bp, Artificial Sequence
  Description of Artificial Sequence: Synthetic coding sequence
atgggtaaacgggacaaccgggtggcctacatgaatcccatcgcaatggcgaggtggcgcggacccactcagtcggtcggtccgaccatccaggactacctgaataggccaaggccgacctgggaggaagtgaagaaacagctggagaataaaaagacggggtccaaggccctcgctgagtttgaggaaaagatgaacgaaaactggaagaaagagcttgaaaaatcccgcgaaaaattgctcagcggcaacgaatctagctccaagaagcgggagagaaaaaagaaaaggaagaagaagtcctgccggtcgtccagctcctcctctagcagtgactcctcatcctcttctagtgactctgaagatgaggaaaagaagcagggcaaacggcgaaaaaaaaaaaaaaatcgttcctacaaatccagccagtcgtccactcatgagagtgagagtgaaagcaaggagtcagtcaaaaagaaaaaaaagagtaaggacgagactgagaaggagaaagacgtgagaagccttagtaaaaaaagaaagaagtcttatccagacgacaagccgctgtcatctgaatcctcgtctgaatccgattatgaggaagacgtacaggcaaagaaaaagcgacggtgtgaggaaagagagcaggctaaagagaaggtgaaaaagaaaaaaaaaaagcagcacaaaaaacacagcaagaaaaagaagaagaaaagtgggagttcccacaagtcccgctag

SEQ ID NO: 55986 - DNA, 747 bp, Artificial Sequence
  Description of Artificial Sequence: Synthetic coding sequence
atgggtaagcgggacaatcgtgtggcctatatgaatcccattgcgatggctaggtggcgcggacctacgcaatctgtgggacccacgatccaggattatctgaaccgccctaggccaacctgggaagaggtgaaaaaacagctagaaaacaaaaagactggttccaaagctttagctgaatttgaggagaagatgaatgaaaactggaagaaggagcttgaaaagagccgagaaaagctgttatccggcaacgaatctagctcaaagaagcgtgaacggaagaaaaagcgaaaaaaaaagagctgcaggtcctcttccagttcaagtagtagtgactccagcagttccagcagtgacagtgaagacgaggagaagaagcagggcaagcgcaggaaaaagaagaagaataggtcctacaagtcgagccagtcttctacccatgaatctgagagcgagagtaaagaatccgttaaaaagaagaaaaagagcaaggacgaaactgaaaaagaaaaggacgtgaggtctctgtctaagaagaggaagaaatcatacccagacgataaacctctgagctccgagtcgtccagcgagagtgattatgaagaggatgttcaggctaagaagaaaagacggtgcgaggagcgcgagcaggctaaagaaaaagtgaagaagaagaaaaaaaaacaacacaaaaagcattctaaaaagaagaagaaaaagtccggaagcagccacaagtcccgatag

SEQ ID NO: 55987 - DNA, 747 bp, Artificial Sequence
  Description of Artificial Sequence: Synthetic coding sequence
atgggaaaaagggataacagagtggcctatatgaacccaatagcaatggcacggtggcgcggtccaactcaaagcgttgggccaacgatccaggattatctcaaccgccctagaccaacctgggaggaagtgaaaaagcagctcgagaacaaaaagacaggtagcaaagcgttggctgagtttgaggaaaagatgaatgagaattggaagaaggagctggagaaaagcagggagaagctgctgtccggcaacgagagcagctcgaaaaaacgagagaggaagaagaaacgaaaaaagaagtcctgtcgcagttcttcgtcatcctcttctagtgactcctcatctagctcaagcgactccgaggatgaggagaagaaacaaggcaaacggagaaagaagaagaagaaccggagctacaagagttctcaatcgagtacacacgagagtgaatccgagtccaaggaatctgtgaaaaaaaagaagaaaagcaaagatgaaaccgaaaaggagaaggacgtcaggtccttgagcaagaagaggaagaaaagctaccctgatgataagcctctgtcgtcagaaagtagcagtgagtctgattacgaagaagacgtgcaagcaaagaaaaagcggagatgcgaggagagagagcaggcgaaggagaaagtcaagaaaaagaagaaaaagcagcataaaaagcacagtaaaaagaagaaaaaaaaatccggaagcagccataaatctaggtag

SEQ ID NO: 55988 - DNA, 747 bp, Artificial Sequence
  Description of Artificial Sequence: Synthetic coding sequence
atggggaaacgcgacaaccgcgtagcatacatgaaccctatcgctatggcacgatggagaggacctacccagtccgtgggccctactatacaggactacctcaacaggcccaggcccacatgggaagaggtgaagaagcagttggagaataagaaaactggctcgaaagctttggcagaatttgaggagaaaatgaacgagaactggaagaaggagctggaaaaatcacgagagaagctcttatccgggaacgaaagctccagtaagaaacgggaaagaaaaaagaaacgtaagaaaaaatcttgcagaagctcttcaagtagcagttccagcgatagctcaagctccagctccgattctgaagatgaagagaagaaacagggaaagagacggaaaaagaagaaaaaccggtcttacaaatcttcccaatcttcaactcacgagtccgagagtgagtctaaggaatccgtgaagaaaaagaagaagtctaaggatgaaacggaaaaggagaaagacgttcggtcactgtctaaaaagaggaaaaaaagctaccccgacgacaagcccctctccagtgagagcagtagcgagagtgattacgaagaagacgtgcaggccaagaaaaagagaaggtgtgaggaaagagagcaggcaaaggaaaaggtgaagaagaaaaagaagaaacagcacaaaaaacatagcaagaaaaagaaaaaaaagtccggctctagtcataaatctagatag

SEQ ID NO: 55989 - DNA, 714 bp, Artificial Sequence
  Description of Artificial Sequence: Synthetic coding sequence
atgaaccccatcgccatggctcggagcagaggcccaatccagagctcagggcctacaatacaggactatctaaacaggcccagaccaacttgggaagaagtcaaagaacagcttgagaagaaaaaaaaagggagcaaagccctggctgagtttgaagagaagatgaatgagaactggaaaaaggagttagaaaaacatcgagagaagctgctgtcgggctccgagtcaagtagcaagaagaggcaaagaaagaagaaagagaagaaaaaatcaggtaggtactcctcctcatcatcttcatcatcggacagtagctccagctcttcagactcggaagacgaggacaagaagcaaggaaaaagacgtaagaagaagaagaacagaagccataaatcttccgagtcaagcatgagcgagacggaatcggatagtaaagattctcttaaaaaaaaaaagaaatcgaaggatggaaccgaaaaggaaaaggacatcaaaggcctctcaaaaaagcggaagatgtattctgaggacaagccactgagtagcgagagtctcagcgagtccgaatacatcgaagaggtgagggcgaagaagaaaaaatcttctgaggaacgggagaaagctacagaaaaaacgaagaaaaagaagaagcataagaaacatagcaagaagaaaaaaaaaaaggctgccagctccagtcccgattccccatag

SEQ ID NO: 55990 - DNA, 714 bp, Artificial Sequence
  Description of Artificial Sequence: Synthetic coding sequence
atgaaccccatagccatggccagatctaggggcccaattcaatccagtggccctacaatccaggactatcttaataggcctcgcccaacatgggaagaggtcaaggaacaactcgaaaaaaaaaaaaagggctccaaggcgctcgctgaatttgaggaaaaaatgaatgagaactggaagaaggagctggagaagcaccgggaaaagctgctatctggctctgaatcgagcagcaagaagcgtcaaagaaagaagaaagaaaaaaaaaaaagcggcagatattcatccagctcctcatcttcatccgattctagcagcagcagctctgatagcgaggacgaagacaaaaaacaaggcaaacggaggaagaagaagaaaaaccggtcacataagtccagcgagtcgtcgatgagcgagacagagagcgattcaaaagatagcttgaaaaaaaaaaaaaaatcgaaagacggtacagagaaagagaaagatattaaagggctttccaagaaacgaaaaatgtactcagaggacaaaccgctttcttctgagtccctgagcgaaagcgagtatattgaggaggtgcgggctaaaaaaaaaaagagctctgaagaaagagaaaaggccaccgaaaagactaagaaaaagaagaagcacaagaagcacagcaaaaagaagaaaaagaaggcggcaagcagctcaccagatagcccctag

SEQ ID NO: 55991 - DNA, 744 bp, Artificial Sequence
  Description of Artificial Sequence: Synthetic coding sequence
atggggaaacgcgacaatagggtcgcttacatgaaccccatagccatggcgcgaagccggggacctatccagagttccggtcctactatccaggactacctgaaccgccctagacccacctgggaggaagtcaaagagcaactggagaaaaagaagaagggaagtaaggcgctagctgagtttgaggaaaagatgaatgaaaactggaagaaggagttggaaaaacaccgcgaaaagttgctctctggctctgagagctcaagcaagaaacgccagaggaagaagaaagagaagaagaaaagtgggagatattctagcagtagttcgagctcatctgacagctctagttcctcctcggactctgaagacgaggataagaaacagggtaagcggcgaaaaaagaaaaagaaccgtagccataaatcatcagagagctctatgtcagagacagagagcgattccaaggatagtctgaaaaagaagaagaagtccaaggacggcacagagaaagagaaggatataaagggactctctaagaaacgcaaaatgtacagcgaggacaaacctttgagcagcgagtccttgtcagaatcggagtatatagaagaagtccgcgctaagaaaaagaaaagtagtgaggagagggaaaaggccaccgaaaagacaaagaagaagaaaaagcacaaaaaacactcaaaaaaaaagaaaaagaaggcagcaagttctagtcctgatagcccgtag

SEQ ID NO: 55992 - DNA, 93 bp, Artificial Sequence
  Description of Artificial Sequence: Synthetic coding sequence
atgaatccgatagcaatggctcgcagccgtgggcctatacaaagctctggtcccacgattcaggattatctgaatagacccaggccaacctag

SEQ ID NO: 55993 - DNA, 258 bp, Artificial Sequence
  Description of Artificial Sequence: Synthetic coding sequence
atgcttcttacaatcgagactaagtctcattacgtggctcaagctggcttagaactgcttgcctctagtgatccgcctacctccgctagccagtcagtgggcatcatagacatgagccactgcacttggcctacattgggtaaattcctcaatccctccaagccccacttctcccctatcaccaagggcaaagacggcaatatatttcctacgaaatttttgtctgatgcgctgaccgaactaaggctctgtacctag

SEQ ID NO: 55994 - DNA, 225 bp, Artificial Sequence
  Description of Artificial Sequence: Synthetic coding sequence
atgttgttaaccatagagaccaaaagccactacgtcgctcaggcaggattggagctgttagcatcatcggatcccccaaccagtgcctcccagagtgtcggtatcatcgatatgagtcactgcacctggccaacccttgggaagttcttgaacccaagcaaaccacattttagccccatcactaagggcaaagacgggaatatttttcctactaagttcctgtag

SEQ ID NO: 55995 - DNA, 258 bp, Artificial Sequence
  Description of Artificial Sequence: Synthetic coding sequence
atgcttctaactattgagacaaagagtcattatgtggcacaggcgggactcgaattactggcatcaagcgatccacctaccagcgcctctcagagcgtaggcattattgacatgtctcactgtacatggccaacattgggcaagttcctgaatccaagtaagccgcatttctccccaattacgaaaggcaaagatggcaatatctttccgaccaaattcctgagtgatgctctcacggaactgcgtttatgcacctag

SEQ ID NO: 55996 - DNA, 258 bp, Artificial Sequence
  Description of Artificial Sequence: Synthetic coding sequence
atgctcctgacgatcgagacaaagtcccactatgtggctcaggctggcctcgaactacttgcatcgtcagaccctcccacatccgcttctcagtccgtggggataattgatatgtcccactgcacttggccgacacttggcaagtttctgaatccctccaagccgcatttctcccctattacaaagggcaaggacggcaatatcttccctaccaaattcttatctgacgcactgactgaactccgtctgtgcacttag

SEQ ID NO: 55997 - DNA, 1287 bp, Artificial Sequence
  Description of Artificial Sequence: Synthetic coding sequence
atgaaccgccaggggaatcgcaaaaccaccaaagaagggtccaatgacctgaagttccaaaatttcagcctgcctaaaaatagaagctggccccgaattaactcagccacaggccagtaccaacggatgaacaaaccactgcttgactgggaacgaaactttgcggctgtcctcgatggagccaagggccatagcgacgacgattacgacgaccctgaattgaggatggaggaaacttggcagagcatcaagatcctgcccgctcgtcctattaaagagagtgagtacgccgacacccactacttcaaggtcgcgatggatactcctctccctctggatacacggactagcatctccattggacagcctacctggaatacacagaccagactggagcgagtggacaagcccatatcaaaggacgttaggagccaaaatatcaaaggcgatgcaagcgtccgaaagaataagatccctttgcctcctcccagaccactgattacactccccaagaagtaccagccactccctccggagcctgagagttccagacctccactcagccagagacacacatttcccgaggtccagagaatgcccagccagatctcccttcgcgacctgtctgaggtcctggaggccgagaaggtacctcataatcaacggaagcccgagagcacccacctactcgaaaatcagaatacccaggaaattccgcttgctatcagctcttcctctttcacaacgtccaaccatagtgtgcaaaatcgggaccaccgaggaggaatgcagccttgttccccacagcgatgccagccgccagctagttgctctcctcatgaaaacattctgccatataagtacacatcatggagaccaccgtttccaaagcgatccgatcgtaaagacgtccagcacaatgagtggtacatcggagaatacagtagacaggccgttgaggaggcatttatgaaagagaataaggatggaagcttcctggtgagggattgcagtacgaagagtaaggaggaaccatacgttctggcagtgttttacgagaacaaagtctacaacgttaaaatccggtttcttgagagaaatcagcagtttgccctgggaacaggtcttagaggagatgagaaatttgacagtgttgaagacattatcgaacactataagaattttccaatcatcctgatcgatggaaaagacaaaactggcgtccatagaaagcagtgtcatttaacgcagccgctccccctcaccaggcacctgcttcccctgtag

SEQ ID NO: 55998 - DNA, 2322 bp, Artificial Sequence
  Description of Artificial Sequence: Synthetic coding sequence
atgaaggcagccgttttggatctgggatctctgttagccaaactctttgaaacatctacagcaccacccgcaggcccttcctcccgcccatccgggggtgctgccgcagccggttccgggggaagcagggccggtaccccactggggactgctccaacactcttgcgtgcacttgccccagactcaccaagcgcctcccggaggtctcccgcaccactgctgtcctccccgtattccaggggcagtgcagcgagccgggcagctggagccgtcggaaccctcctgtcctggccatccagcccccgagcaggcaaagcacctcctcaacctccaaccccttcaggaggtgggtgctcaccagccaggctggtggttcccgctagacccccatctggtcctggcggagtgtgggccgctcttccacgcaaccccctccaacccggtccaggcgaaagggagctgggggcttgtgtggccccaggcgctggacctcggactctcttcttgactctgccagacatcggtgaagaaggagcctctgacggggattctggcgatggggaggccagggggctttccgagggcagaagaaggcatggatttaccgttcgaagcaaggactctctccctacccattttacccgcaatgtccagaaggccatcgacaaatacacttgtaaaagcctgtcctccttctcaagttccggcagccatactccaacaggcgctcataccagctggtccgggtcagccactcaatctagcaccaccggttcctctacagagaggggttccgtatactcttggagggacgacgagttcgatgaggcttcatctcagtctgtgcagaggctgttgtgggaggtggaggaaatgctgttcgaaggaaaggtgaaccctcaaacccagtccctgcttgctgaatgcggcgaatggacaagacgctccctgcacctaagggtccttggcaggcaactcattcttccaaccgataaaggagtacagcactttcaggggtcaacacctgcgagtgcagttcacagacctccgctgagtgcctgtggccacagctccaatattcgagagctgtgtatttccggatcgcagatcgtgcctgctgccctttcagcctcagcactgcccggaccggatgacactggggtcgccgacctgaccgcacgatcctctttagaggaggaagtctaccacgtcgacgggaagatcgaagaatacttcgcctttgacagaaaagaagacgatgacgagtgtctggaacagaagcccgcacagcctgggcgtaagtggcgaaaactgggactgccacctgtctccccaagagattgcgttaaggacgcagtggccgcagaggtctttgatcatgtgtggactaacatggtcgagctgctcgaggaactgataagaaaacactgggagaccactctgacagaggggaagaagcagcgcgaaaccctgaaggtcgccggtaacagattcccgcatgtgctggtcccgcacgctcacgcagatggcgcatccggcccaccatcaggccacgcagaagctcacggaatttcgcttgctagccgcttgaaccctcctcagatccaccactttagcagcagcttctactccgacatgaacggagtgatgaccattcaggccaagcctctgcaacgtagacctgcctattttgccgacaggactcagaacgagaaggaagataaggccagcggtgggggagccggagctttatcaagtgcccctcaccggttggggagggcgtctgatacccatggattgagcccgtcagctaaaaagacgcccgtcccttggcgcctgccttctcttgcatccgacagtcagcggttgaaaacacccaatatctatagcgacgaagtgctgcgcggaacaaaactgcctaccggcgttgaccacatggcaagtcctttagtgcagacctctaggagccggttccctcccttagttaccgagacaaggggtcagaatactgccgtccccggatgccgtctggtgagttatcgcggtagacatcttcagaatcgcgtgctctcagccatgccagatggcactgagcggtcaaggttgagagagcggacagccaccttggagcgcctatccagaccttctacaacacacacattccggcagagtgacacccctcggaagtcatctttgacgcaaatggaatttgctgcccatacatggacagggcagtctatccttactggatcacagtatgtgcccaaatcttttcaacgaaccacactaacttttaagcgcagattccaggtgactagctag

SEQ ID NO: 55999 - DNA, 1449 bp, Artificial Sequence
  Description of Artificial Sequence: Synthetic coding sequence
atgcttttcgaagggaaggttaacccccagactcagtcccttctggccgaatgtggggaatggactcggaggagtctacacctcagagtgctgggacgacaattaattctcccgacagataagggtgtgcagcacttccagggctcaactccggcaagtgccgtacataggcccccactttcagcctgtggtcactcctcgaatatccgagagttatgcatttctgggagtcagattgtccctgcagcattgtcggcctctgccttgcctggacccgacgatactggtgtggcagaccttacagcgaggtcctcgttggaggaggaggtgtaccacgtcgacgggaagattgaggaatatttcgccttcgaccgaaaggaagacgatgatgagtgtctagagcagaaaccggctcagcccggtaggaaatggcgcaaactagggctaccacccgttagtcctcgggactgcgtgaaggatgccgtcgcagctgaggtgttcgaccacgtttggacaaacatggtggagctactggaagagttaattcgtaaacactgggaaacaaccctgactgagggaaagaagcagagggagacactgaaagtggccggaaatagattccctcacgtgctggtgccccacgcgcacgccgatggtgcatcaggaccaccttccgggcatgccgaggcccatggcatcagcttagccagccgacttaatccccctcagattcaccatttctcatcatctttctattccgacatgaacggtgtaatgacgatccaggctaagcccctgcagagacgccctgcatattttgccgacagaacccagaacgagaaggaggataaggccagtggaggaggggctggagccttgagcagcgccccacatcgcctcgggagggcatcagacactcacggcctaagtccaagcgctaaaaagacgcccgtgccctggcgtctgccctctctggctagcgatagccaaaggctgaagactcccaacatatattctgacgaggtgctgcggggaacgaaacttcctaccggcgtagaccatatggcttcaccgttagtccagaccagccgatctcgtttcccccctctagtcactgaaactcggggacagaacactgccgtgccaggatgtcgccttgtgtcatacagaggcaggcacctgcaaaatagagtgctctccgccatgcctgacggcaccgaaaggtcccggttaagggagagaacggccactttggaacgcctctctagaccgtcaactacacatacttttcggcagagtgatactcctcgaaagtcatcccttactcaaatggagtttgcagcacacacctggactggtcagtctattttgacgggctcacagtatgttccaaaaagcttccagaggacaacgctcacatttaagcgaaggtttcaggttacttcttag

SEQ ID NO: 56000 - DNA, 1449 bp, Artificial Sequence
  Description of Artificial Sequence: Synthetic coding sequence
atgctttttgagggaaaggtcaacccgcaaacccagtccctgctggccgaatgtggtgaatggacgagaaggtcacttcatcttcgggtcctggggagacagctgattctgccaactgacaagggtgtgcagcacttccaaggctcgactcctgcgagcgctgtgcacagaccgccactgtcagcttgcgggcattctagcaacatcagagaactttgcatctcagggtcgcagatcgtgcctgcagccctctccgcatctgcactgcctggaccagatgacaccggcgtggcggatctgacagcccgatcaagccttgaagaggaagtataccatgtggatggcaagatcgaggaatatttcgcattcgatcggaaggaagatgacgatgagtgtctggagcagaagccagcccagccagggaggaagtggagaaaactaggtcttcctccagtcagtccgagagactgtgtgaaggatgccgtggccgcagaagttttcgatcacgtatggacaaatatggtggagctgctcgaagaactcatccggaagcactgggaaaccacactgaccgaggggaaaaagcaaagagaaacgttgaaggttgccggaaatagattcccgcatgttctcgtgccacatgctcacgccgacggggcatctggtccaccttcgggacacgccgaagcacacggtatttccctagcctcaaggctgaaccccccacaaatccaccacttctcaagctccttctactccgacatgaatggcgtgatgactatccaggccaaaccactgcagcggagacccgcatactttgcagaccgcacacagaatgaaaaagaagacaaggcttcaggcggaggcgcaggagcactctcctccgctcctcatagattgggtagggcttcagacacacacggcctctcaccctctgccaagaaaacaccagtgccctggcgcctcccctctctggcatctgatagccagcggctcaagaccccaaacatttacagcgatgaggttctcagggggacgaaattgcccacgggcgttgaccacatggccagccccttggtccagactagccgatctcgattcccaccgctcgtgaccgaaacccgaggccagaacacggctgtgcctgggtgccgcctcgtgagttatcgtggaaggcacctacagaaccgcgtgctctccgccatgcccgatggcacggagcgaagcagacttcgggagcggacagccaccctggaaagattaagcaggccctccaccacacacaccttcagacagtctgacacccctagaaagtcgagtttgacccagatggagtttgccgctcatacatggaccgggcagagtattttgaccggatctcagtacgtgcctaagtcgtttcagcgcaccacactgacttttaagagaaggtttcaggtcaccagttag

SEQ ID NO: 56001 - DNA, 186 bp, Artificial Sequence
  Description of Artificial Sequence: Synthetic coding sequence
atgctgttcgagggaaaggtgaatcctcagacccagtccttgctcgccgagtgtggggaatggactcggagaagtctccatctcagagtgttaggcaggcaactaattctccctacagacaaaggagtgcagcattttcaggggtccactcccgcatccgcggttcacagacctcccctcagctag

SEQ ID NO: 56002 - DNA, 1749 bp, Artificial Sequence
  Description of Artificial Sequence: Synthetic coding sequence
atgatcagtcggtacacaaggaaggcagtcccccaatcactggagcttaaagggataactaaacatgctctgaaccatcacccacccccagaaaaactcgaagaaatctctccgaccagcgacagtcatgagaaggatacctccagtcagtcaaaatctgatattaccagagagtctagttttaccagtgctgacactggtaactccctaagcgccttccctagctacaccggcgcaggcatctccaccgagggatcatctgacttcagctggggctacggcgaactggatcagaatgctacagaaaaggtgcagacaatgttcacagctattgatgagcttttgtacgagcaaaaattgtccgtgcatacaaagtccttgcaagaggaatgtcagcaatggacagctagtttcccccacttgagaattctgggcagacagatcattactccatctgagggttaccggctgtatccacgcagcccatccgctgtcagcgcgagctacgagaccacgctctcacaggagcgtgattcaacaattttcgggatacggggtaaaaagctgcacttttcttcaagctatgcacataaggcatcgagcatcgcaaagagtagctctttttgctcaatggaaagggatgaggaggacagcataatcgtctcagaagggatcattgaggaatatctggcctttgatcatatcgatatagaggagggcttccacggaaagaagagcgaagcagccacagaaaagcagaaacttgggtacccccctattgcgcctttctattgtatgaaagaggacgttctggcatatgtctttgattccgtgtggtgcaaggtggtcagctgcatggagcagctcaccagatcacactgggagggcttcgcaagcgacgatgaatctaacgtggcagtcacacgaccagacagcgagtcaagttgtgtgctatcagagctgcaccccctcgtcctgccacgcgtgccacagtcaaaagtcctgtacataactagcaaccctatgtcactgtgccaagcatctagacaccagcctaacgtgaacgatctgcttgtgcatggaatgcccctgcagcctaggaatctgagtctaatggacaaactgctcgacctggacgacaagctcctgatgaggcccggttcttccaccattctttccactcggaactggcctaaccgtgctgtcgagttttccacatcgtcactttcatacacggttcagtccacaagacgcagaaacccgcctcccaggaccctccaccccatttctacctctcacagctgtgccgagaccccacgctctgtggaagagattctgcgtggtgccagggtgcccgtcgctcccgactcgctgtcctcgccttcccccacccctcttagcagaaataatttactgcctccaatcggcactgctgaggtcgaacacgtgagcactgtaggccctcagcggcaaatgaagccgcacggagactcgtccagggctcagtccgccgtggttgacgaacccaactatcaacagcctcaggagcgccttctgctccccgacttctttccaagaccaaatacgacacagagtttcctgctggacacccagtaccgtcggtcatgtgccgttgaatatccccatcaagcaaggccgggacggggaagcgctggaccccagctccacggctctacgaaatctcaaagcggcggtagacctgtgagccggactcgtcaaggaccttag

SEQ ID NO: 56003 - DNA, 1410 bp, Artificial Sequence
  Description of Artificial Sequence: Synthetic coding sequence
tgatttacctctgccgatacaggaaatagcctgagtgcgttcccaagttatacaggtgccggtatctctactgaaggatcctccgatttttcttgggggtatggcgagttggaccagaatgcaactgagaaggtccagacaatgtttacagccatagacgaactgctttatgaacaaaagctctcagtccatacaaagagcctgcaggaggaatgccaacaatggaccgccagcttcccccacctgcgcatcctgggacgtcaaattattacccctagcgagggataccgtctgtatcccagatctccttccgcggtctctgcgtcttacgagaccaccttatcccaggagagggatagcaccatcttcggcattaggggcaaaaagctgcacttcagctcatcatatgctcacaaggcttctagcattgcaaaaagttccagtttctgctctatggaaagagatgaggaagacagcattatcgtgagtgaggggatcatagaggagtatctggctttcgaccatatcgacatcgaggagggctttcacggcaaaaaatcagaagcggctaccgagaagcaaaaattagggtacccaccgatagcccctttttactgtatgaaagaggatgtgctggcttacgtcttcgacagtgtatggtgcaaagttgtcagttgcatggaacagctgaccaggagccattgggaggggtttgcatcagacgatgagtctaacgtcgccgtcacaagaccagactccgaatcgtcctgcgttctgtctgaactccatcccctggtgttacctagagtccctcaaagtaaaatgtcactttgccaggcctccagacaccagcccaatgtgaatgacttactggtccacggcatgcccctgcagcctcggaacttaagccttatggacaagctgttagatttggacgacaagctgttgatgaggcctggctcctctacaatcctgagcacccgcaattggcccaatagagccgtggaattcagcaccagtagcctctcatataccgtgcaatcaacacggagaagaaacccccctcctcgcacgctgcaccctatctcaacatcccactcgtgcgccgagaccccaaggtcagtggaggagattttacgaggagcacgcgtccccgtggctcccgattccctcagttcaccttcacccacgccacttagtcgcaacaacctgctgccccctatagggactgctgaggtggaacacgtgtcaacagtggggcctcaaagacagatgaaaccgcacggtgacagttcacgagcacaatctgccgtggtcgatgaacccaactaccagcagccacaggagcgcctcctcctgcctgacttcttcccacggccaaacacaacccaaagctttctagtggaatag

SEQ ID NO: 56004 - DNA, 993 bp, Artificial Sequence
  Description of Artificial Sequence: Synthetic coding sequence
atggagcgcgacgaggaggattcgataattgtttctgagggtattattgaagaatatctggcctttgatcacattgacatagaagaaggctttcatggaaagaaaagtgaggctgccacagagaaacagaaactcggttatcctcctatcgcacccttctattgcatgaaagaagatgtgctcgcctacgtttttgactccgtgtggtgtaaggttgtgtcatgtatggagcagttgacaagaagccactgggagggattcgcatctgacgatgagtccaacgtggcggtcacccgccctgattccgagagtagctgcgtcctgagcgagctgcatcccttggtgcttcccagagtgccacaatccaaagtgctgtacatcacttccaaccccatgtccttgtgtcaggccagccgccatcagcctaacgtgaatgatctccttgtgcacggtatgcccctgcaaccaaggaacttgtcacttatggataagctgcttgatctagatgataagctgctgatgaggccgggaagttcgacaattctctccacccgtaattggcctaacagagccgtggagtttagtacatcatctctatcctacacggttcagagtaccagacgaaggaatccgcctccaagaacactgcacccaattagcacatcccactcttgtgccgagactcccagatctgtcgaggagatcctgcgcggagctcgtgttccagttgctccagatagtctcagctctccctcacctacccctctctcaaggaacaacctcctgcccccaatcggaaccgccgaggtggaacatgtgtcgactgtagggcctcagcgccagatgctggacacccaataccgcaggtcttgtgccgtcgagtatccccaccaggcccgtcccggaaggggctctgcagggcctcaactgcacggcagcacaaaatcccagtccgggggacggccagtgtcgagaactcgacaggggccttag

SEQ ID NO: 56005 - DNA, 1008 bp, Artificial Sequence
  Description of Artificial Sequence: Synthetic coding sequence
tcttccttctgttctatggaaagagatgaggaggattctatcatcgtaagtgaggggattattgaggagtacctagcgttcgatcacattgacattgaggaggggtttcatgggaagaagtctgaagccgcaaccgagaaacagaaactcggataccccccaatcgcacctttctactgcatgaaggaagacgtgttggcctatgttttcgatagtgtctggtgtaaggtggtctcgtgcatggaacaactgacacgctcgcactgggaaggattcgcttccgatgacgagtcgaacgtggccgtaacccggcctgactccgaatcatcttgcgttctctccgagctgcacccacttgtgctccccagagtaccacagtctaaggtgctttatatcacttctaaccctatgtccctttgccaggccagcaggcaccagcctaatgtgaacgatctgcttgtgcatggcatgcctctccagccacgcaacctctccctcatggacaagttgctggacctcgatgataaattactcatgaggcccggatcgtcaaccatactctccacccgcaactggcccaatagggcggtagaattctccacatccagtttgtcatacaccgtccaatctacccggagacggaatcctcctcccaggacacttcatcctatctccacgtctcattcttgcgccgagacaccccgaagtgtggaagaaatcctccgaggggctcgtgtcccggttgccccagatagcctttcaagtccgagccctactcccctttccaggaataacttgctgccaccaatcggcaccgctgaagttgagcatgtctcaacagtggggccacagaggcaaatgttggacacacagtatcgcaggagctgtgctgtcgagtacccacatcaggctagacctggtagaggctccgcgggtcctcagctgcacgggtcaacaaagagtcagagtgggggtcgcccagtcagtcggactcgacaagggccttag

SEQ ID NO: 56006 - DNA, 831 bp, Artificial Sequence
  Description of Artificial Sequence: Synthetic coding sequence
atggccgcatcagcgggtggaccaggctcatggtctgagaatatactcgagtactttctgcgtaacagtcagatcacagccgaggacggtgctgagataacctggtaccacgccgctaatcataaggcacagacaaatgaggcactgaaatcaactgcccatatgatagaagcagatgtactgctgccatcagacggctcagagcacagccaacccataatggctcatccgcctgagaccaactccgataacacgttgcaagaatggctcacggaggtgatgaagtccaacaaaggcattaagctggacttcaaatcgctcgcggtcgtggagcctagcatgatgctgctagaaaatgtgaagcgacatctcaaacgcccagtgtggatcaacgccgatattctgccagggcctaatggtaactcgaaggtaatcgacgcgaaacccttcctagacacagtgatcagctttttcccagacgttaccttttctttgggatggaccacaggctggcatcccgaaaaagtgaatgaagggtactcatggactatggtcaaggagatggagtatatttgtaatgaattatcccagcctgtgacgttccccgtaagggctgccctcgtccgccagtcttgttcacaactgctgtggctgctgaagaagtctaaccggtactccctgacaatatggactggaaaaaatgataactatagcgtcgaagacctgctctatattagagatcatttcgataagaagcaagtgttttatgacattttggagccacagaatcatgaatttaagcaggccattggcattaaggtcaacctatag

SEQ ID NO: 56007 - DNA, 435 bp, Artificial Sequence
  Description of Artificial Sequence: Synthetic coding sequence
atggtcgataaggacacagagcgggatatagaaatgaaaaggcagttgagaaggctcagggagctacatttgtactcaacgtggaagaagtatcaagaagccatgaagacatctctgggcgtgccccaacggggagatctggaggatctggaagagcatgttcctgggcagaccgttagtgaagaggccacaggcgtgcacatgatgcaggtcgatcccgctacactagcgaagcagctcgaggattctactatcactggcagtcaccagcaaatgtcagcatctccatccagcgcgccagccgaagaggcaaccgagaaaaccaaagtggaagaggaggttaaaacgagaaaacccaaaaagaaaactagaaagccgtccaagaaaagtaggtggaacgtgttaaagtgttgggatattttcaatatcttctag

SEQ ID NO: 56008 - DNA, 1164 bp, Artificial Sequence
  Description of Artificial Sequence: Synthetic coding sequence
atgggctgtgtgtattcttgttgtctcgaagtttgctgcggcgaggacgagatcgtctaccctagaatgcccggagaatcgaccgtctgtcatcgcgagcgggagaaaccaatcacgtaccattggtaccactggcatcctggccacatctacccaaggatcgcttcaatggaagactacgatgaggatctggtccaggaagcgagttcggaggatgtgctgggcgtccacatggttgacaaggacactgaaagagatattgaaatgaagcgccaactgagacggttgagagaactgcacctgtatagtacttggaaaaaataccaggaggccatgaagaccagcttgggggtcccgcagtgtgagagagacgagggcagcttaggaaaacccctctgccctcccgagattctcagcgaaaccctccctggctcagttaagaagcgagtgtgctttccctcagaagatcacctcgaggagttcatcgctgaacacttgcccgaagcttccaatcaaagcctgttgacagtcgcccactccgagcggggaatctcctttagctgcgaccttgaagaccttgaagagcacggtcccggacagactgtcagcgaagaggcaaccgaggtgcatactatggagggcgacccagatactttagctgagtttttgatacgcgatgtgttgcaggagctgtcctcttacaatggggaggaggaggaccctgaggaggtaaaaacctcactcggcgtccctcagagaggcgacttagaagacctcgaagagcatgtgcccggtcagaccgttagcgaggaggctactggggtgcatatgatgcaagtagaccccgctaccctggctaaatctgacctggaggacctggaggaacatgtgccagagcagacggtctctgaggaggctactggagttcacatgatgcaggtggacccagccacactcgccaaacagttggaagatagcacaattacaggctcccaccagcagatgtccgctagtccttcttcagcccctgcagaggaggctaccgagaagactaaggtagaggaggaggttaagacgcgtaaaccaaagaagaagacgagaaaaccgtccaagaagagtcgctggaacgtgctgaagtgttgggatatcttcaacattttttag

SEQ ID NO: 56009 - DNA, 1164 bp, Artificial Sequence
  Description of Artificial Sequence: Synthetic coding sequence
atgggatgtgcatattcatgttgcctggaggtttgctgcggggaggacgaaatcgtgtatcccagaatgccgggagagtcgaccgtgtgccacagagagagggagaagccaattacataccactggtaccattggcatccgggacacatctatccacgcgtcgcatcgatggaggactatgacgaagatctggtacaggaggccagcagtgaggatgtgttaggagtgcacatggtcgataaagataccgagcgggacattgaaatgaagcgccagttgcgacgactccgggagctgcacctctatagtacatggaagaagtatcaggaagcgatgaaaaccagcctgggggtccctcagtgcgagagggatgaaggatctcttggcaagcccctttgtcctcccgagatcctgtcggaaacgctgcctggctccgtgaagaagagggtgtgttttccttccgaggatcatctggaggaattcatcgctgagcatcttccagaggcctccaatcaatcactgttgaccgtcgcgcatgccgacacaggaatccagacgaacggcgatctcgaggatctggaagaacacggtccgggacagactgtgagtgaagaagctaccgaggtccacatgatggagggagatcccgataccctggccgaactgctgataagggatgtgcttcaggagttgtctagttataacggggaggaggaggatcctgaggaggtgaagacatctcttggagttccgcaacgtggggatctagaagatttggaagaacacgtccctgggcagacagtcagcgaggaagccactggagtacacatgatgcaggtggacccggctaccccagcaaagagcgaccttgaggacctggaagagcatgttccaggccagaccgtaagcgaggaagctactggtgtgcacatgatgcaggtcgatcccgctacactagccaaacaacttgaggactcgactataacaggaagtcaccagcaaatgagcgcctcaccttccagtgccccagccgaagaggcaacagaaaagaccaaagtcgaggaggaggtaaagacgcgcaagccaaagaaaaaaactcgaaagcccagtaaaaaaagcaggtggaatgtgctaaaatgttgggatattttcaacatcttctag

SEQ ID NO: 56010 - DNA, 933 bp, Artificial Sequence
  Description of Artificial Sequence: Synthetic coding sequence
atggtcgacaaagacacagagcgggatatagaaatgaagcgacagttgcgccgacttagggagctgcacttatattctacttggaaaaaataccaggaagctatgaaaaccagcttgggcgtgcctcagtgtgaaagggacgagggctcattaggaaaacccctgtgccctcccgagatcttatccgagacactgccaggatctgtcaagaaacgcgtgtgttttcccagtgaagaccacctcgaagagttcattgcagagcatctgcctgaagcttctaaccagagtctactgacagtggcacacgccgatacgggcatccagacaaatggggatctggaggatctcgaggagcatggccctggccagaccgtgagtgaggaggccaccgaggtgcacatgatggaaggggatcccgataccctggcggaattactcatccgagatgttttgcaggaactatcatcgtacaatggggaggaagaagacccagaggaggtcaagacttctctgggggtgcctcagcggggagatctggaagacttggaagaacatgtgcctggacagacagtgagcgaagaggcaactggagtccacatgatgcaggtagatccagcaacacccgcaaaaagtgatctcgaagacctggaggagcacgtcccaggccagactgtgtctgaggaggccactggtgtgcatatgatgcaggtcgaccctgccacactagctaagcagctcgaggatagcacaatcactggcagccaccaacaaatgtccgctagccccagctccgctcccgctgaggaggccactgaaaagacaaaagtggaagaggaggtcaagacccggaaacccaaaaagaaaacacgcaaacccagcaaaaaatcccggtggaatgtcttaaaatgctgggatatctttaacatcttctag

SEQ ID NO: 56011 - DNA, 933 bp, Artificial Sequence
  Description of Artificial Sequence: Synthetic coding sequence
atggtggataaagatacagaacgcgatatcgaaatgaaaagacagttgagaaggctacgcgaactacacctctactcaacttggaagaaataccaggaggccatgaaaacgtcgctgggagtcccgcaatgtgagcgtgacgaggggtccctcgggaagcctctgtgcccgccagagatcctcagcgaaacactgccaggcagtgtgaaaaaaagggtctgttttccgagcgaggatcacctggaagagttcatcgccgagcatcttcctgaagcctctaaccagtctcttctcacggtggcccacgcagacaccggaattcaaactaacggcgatctcgaggatctcgaagagcatggacctggacagactgtgagtgaagaggccacagaggtccacatgatggaaggagacccagacaccctcgcggagctcctgatcagagacgtgcttcaggaactgagctcttacaacggagaggaggaggatccagaggaggtaaagacgtcgctcggggtcccccagcgtggagatctcgaggacctggaagagcatgtacccggacagaccgtcagcgaggaggccacaggagtccacatgatgcaagtcgaccccgcaaccccggcaaagagcgatctggaggacctggaagagcacgtgccaggccagactgtcagcgaggaggccaccggtgttcacatgatgcaagtcgaccctgcgaccctcgccaaacagctcgaggactccactattaccggtagtcatcagcagatgtcagctagtccctcctcagctcccgcagaagaggcaacggagaaaacgaaagtggaggaagaagtcaaaacccgtaagccaaagaaaaaaacccgcaaaccctctaagaaaagtcgctggaacgtgctcaagtgctgggacatcttcaatatcttctag

SEQ ID NO: 56012 - DNA, 345 bp, Artificial Sequence
  Description of Artificial Sequence: Synthetic coding sequence
atggttgataaagataccgagagggacatcgaaatgaaacgacaactcagaagactccgtgaactgcacctgtattccacttggaaaaaatatcaagaagccatgaagaccagcctgggggtcccccaacgaggcgacctggaggatctggaggagcaccttccgggacagacagtgtcagaagaggcgactggcgtgcatatgatgcaggtagatcccgcaactcctgccaagaaactggaggactcaacgattacagggagtcaccagcagatgagcgccagcccttcttcggcgccagcagaggaagccactgagaagaccaaggtggaggaggaagtgtag

SEQ ID NO: 56013 - DNA, 120 bp, Artificial Sequence
  Description of Artificial Sequence: Synthetic coding sequence
atggtagataaagataccgagcgcgacatcgagatgaaacgccagctgcgcaggctgcgcgagcttcacctctactcaacctggaaaaaatatcaagaagctatgaagacctctctttag

SEQ ID NO: 56014 - DNA, 435 bp, Artificial Sequence
  Description of Artificial Sequence: Synthetic coding sequence
atggtggataaggacacagaacgcgacattgagatgaaaagacagctgaggcggctgcgggagctccatctgtattcaacttggaagaagtaccaggaagccatgaaaacttccctgggtgtgccccaaaggggtgacttggaggacctcgaggagcatctgccaggccagaccgtgagcgaagaagcgactggagtacacatgatgcaagtggatccagcaacacccgctaagaagttggaggatagcaccattacgggctcacaccagcaaatgtccgcctcaccttcctccgctcccgctgaagaagccaccgagaagaccaaagtggaggaagaggtgaagactcgaaaacccaaaaagaaaactcgaaagcccagcaaaaaatcacgatggaacgtactcaagtgctgggatatctttaatatcttctag

SEQ ID NO: 56015 - DNA, 1425 bp, Artificial Sequence
  Description of Artificial Sequence: Synthetic coding sequence
atgaaaacaaagtgtatttgtgagctgtgcagctgcgggcgacaccattgcccacaccttcccactaaaatttatgataagacagaaaagccgtgtctgctttcagaatacaccgagaactatccattttatcacagctatctgccccgagaatcatttaaacctagaagggaataccaaaaaggcccaattcccatggagggcttgaccacgtctaggagagatttcggtccacacaaggtggctcctgtgaaagtacatcaatatgatcagttcgtgccctccgaggaaaatatggacctgttaaccacatataagaaggattacaacccttatcctgtatgccgggtggatcccattaagccgcgagacagcaagtacccctgttcagacaagatggaatgtctccctacttacaaggccgactatctaccctggaaccagccacggcgagagccccttcggctcgaacataagtaccagccagcttcagtgcgcttcgataatcgcacaacccaccaggacgattatccgatcaagggacttgtaaaaactatctcttgtaagccactggccatgcccaagctctgtaatatccctcttgaggatgtcacaaactacaagatgagctatgtcgcccatcccgtggaaaagagatttgtccacgaggccgaaaagttcagaccctgtgaaatcccttttgagtctctgacaacccagaagcaatcctataggggccttatgggcgagcccgcaaagtcattaaaacctcttgccaggccgcctgggctcgatatgcccttctgtaataccactgagttccgcgataaatatcaggcttggcctatgcctcgaatgttcagtaaggctcccattacatacgtgccaccagaggataggatggatctgctgactactgtacaggcccactatacatgcccaaaaggtgctcctgctcaatcatgtcggccagctctgcagattaaaaagtgcggacgcttcgaagggtccagtacaaccaaagatgattacaagcaatggagttctatgcgtaccgagccggtgaagccggtgcctcagctggatttgcccactgagcccctagattgcctcaccacaactcgcgcacactatgtaccccacctgcccattaacactaaatcctgtaagccacactggtccggcccaagaggcaatgttccggtcgagtctcagacaacctacacaattagctttacgccaaaagagatggggcgttgcctcgcctcctaccccgagcctccgggttacaccttcgaggaggtggatgccttaggacaccgcatctacaagcctgtatcccaagcaggctcacagcagagctcacatctgtctgtagatgactccgagaatccaaaccagagagagcttgaggtcttagcctag

SEQ ID NO: 56016 - DNA, 849 bp, Artificial Sequence
  Description of Artificial Sequence: Synthetic coding sequence
atgcctaagctgtgcaatattccattggaagatgttactaattataaaatgtcatacgtggcccatcctgtggagaaacggttcgtgcacgaggcggagaagtttaggccatgtgagattccgttcgagtccctgacaactcagaaacaaagttatcggggacttatgggcgaacccgctaagtcgctgaagcccctcgcacggccacctggcctcgatatgccattctgcaatactactgaatttcgagataagtaccaagcctggcctatgcctcgcatgttctccaaggcaccaattacatacgtccccccagaggatcgcatggacttgctgaccacggttcaggctcattacacatgtcctaagggcgctccagcccagagttgtcgtcccgcattacagatcaaaaagtgcgggagatttgaggggtcaagcacaacaaaggacgattacaagcagtggtccagtatgcggaccgaacctgtgaaaccagtccctcagttggatctgccaacagaaccacttgattgcctcacaacaacccgagcccactatgtgccacatttgcccatcaacaccaaatcttgcaaacctcattggagcgggccacggggtaacgttccagtggagtcccagactacttatacaataagctttacgcccaaggaaatgggtcgatgtctcgcctcctatcccgagccccctgggtatacattcgaagaagtggatgccttagggcacaggatctacaaaccagttagccaggccggtagtcaacagagcagtcacttgagcgttgacgactcggaaaaccccaatcaacgtgagctggaagtgttggcttag

SEQ ID NO: 56017 - DNA, 1197 bp, Artificial Sequence
  Description of Artificial Sequence: Synthetic coding sequence
atgggcgctaaatcaatgagaagctggtgcctgtgccagatctgttcatgcggatcagattattgtccttacgagatcgtgaaacaaccccgtcacgtgcccgaagagtacaagccgaagcagggcaaaattgatctcggaacgacatataaaagggacctgaacagctacaaagtccaaccagttgccatcgtccggcctcttgagagacaagtcaagaaaggaaagctggatacagttccaacctacaaggacgactacagagcctgggatttacacaagtctgagctctataagccagagcagacttatcatcccccaaccgtgaagtttggcaactctacgacattccaggacgactttgtaccacaagagataaagccaagacagtcctttaaaccctcaagcgttgtgaagcggagcacagcaccctttaacggcatcaccagtcatcgtctggattatatcccccaccaactcgagctcaaatttgaaagacccaaggaagtttacaaaccgaccgatcaaagattcgaggatttaaccacacataggtgtgactttcaggggttgattggcgaaacagcaaagctgtgccggcctgtacacactcgggttacacagaacgcactgtttgaaggtagtaccgaattccgagagtcgttccagccgtgggagattccaccaccagaggtgaaaaaggtccctgaatatgtgccccctactggaagtatgctactgaacagcacatcacatctcgactacgtgccgtatcaagccaaccacgttgtgccaattaggccagttagccagaaacgctccaacaattttccgttccagggcaagtccatcatgaaagaggatttcccagcctgggagagttgccgacagggacttatcaaaaaacagcagcaaattcccaaccccagtggtaaattcgatggcctctccacattccggtcacattacgtaccacacgaactaatccctaccgaatcgtgcaagcccctcaatatagccttcaaaagttcagtacccttcgacgatgtcactatgtatagcgttgaatataccccgaagaggcaggagatctgccctgcaagctacccttcaccccctgggtacatctttgataacaccaactcacagggccacaagttctttaggaagatcattcccgcagttaaggccttttag

SEQ ID NO: 56018 - DNA, 1152 bp, Artificial Sequence
  Description of Artificial Sequence: Synthetic coding sequence
atgccttggtctgattattgcccgtacgagatcgtgaaacagcctagacatgtgccggaggagtacaagcctaagcagggcaagatcgacttgggcactacttataagagggatctgaacagttataaggtgcagccagtcgcgatagttcggcctttggaaagacaagtgaaaaaggggaaactggatacagtccctacctataaggacgactaccgagcctgggatttacacaagtctgagctgtataagcccgagcagacctaccatccgcctacagtcaagttcggcaactcaaccactttccaggacgactttgtccctcaagaaataaagcctcggcagagttttaagccctcatccgtggtgaagaggtcaaccgcaccttttaatggaattacctctcacaggcttgactatatcccccaccaactcgaacttaaatttgaaagacccaaggaagtttacaagccaactgaccagcgttttgaggacctcacaacacacaggtgcgacttccaagggctgataggggagacggccaaactgtgtagaccagtgcatacacgggtgacacagaacgccctctttgagggctctaccgagtttagagaatcatttcaaccgtgggagatacccccacctgaggtcaagaaggtacccgagtatgtgcctccaactggcagtatgctgctgaactccactagccacctggactacgttccatatcaggccaaccacgtagtgcctatccgacctgtgtcccagaaaagatccaataacttccccttccagggcaagagcatcatgaaggaggatttccccgcatgggagtcatgcagacagggactaataaaaaaacaacaacagattcctaacccttcaggcaagttcgacggtctgtccacctttcgctcacattatgtccctcatgaactcattcccaccgagtcctgcaagcccctgaatattgcttttaagagctccgtaccgtttgacgatgttaccatgtactcagttgaatataccccgaaaagacaggaaatctgccctgcctcttatccctcaccccctggctatatcttcgacaacaccaactcccaaggccacaagttttttcggaaaattatcccagccgtcaaggctttttag

SEQ ID NO: 56019 - DNA, 1152 bp, Artificial Sequence
  Description of Artificial Sequence: Synthetic coding sequence
atgggacctctttttaccactatacctggagcacacagtggtcctatgcggcctttacccaagaagcacgtagagcccatggcagtgaggcaacttttgttgggaaatagtacgatgattcgccacacttgtccaatgagcgtaccactgagccgacaagtcaaagaggtcgccgcacagaaaccttctgaagacatctacaaaaattggcaacagcaacagcaacagcaacagcagcaacagcagcagcaactcgacttgttattccatcagcggatccagatcagtctgtggcctcgaaagcagaagagaaggaagaccgagcaacactctcacccttttgtgaagaaggcgttcagattctcagccggtagcggatgtgggagaccctcatctaacaaaatgctccggtcaatgggcggaggacagagacccaccgggctaggatccgagttctttcggttgctccatgacctccacctgctggcctttgccatgaaaaggatctggattcaccggcgaggagaagctaccgctaggccgagagctccagagcatcctgctccacctgcgacagcagtccgcggtcgagacgctgcgagccagaacctgaaaaggcgaccaggatctggaaccgatgggctgagactccagggggcagagccttcccgtttgctcagaacatacgcaggcggtgccgtgattcccaccggcacgccagagagagcccagcctccccctccccaggaccctcttggccgtcgccgttggctttcacgcaacacttgggggccttggccagggaccactcagccgcctagcccccaactgctcagaaatgattggggcagttgtgggtttatggtacccgaagctgcaagggggaaggtgttccaggacagccaagaaggggctcatatacgcagagaaactgtgagcaagtcagtctgcgctgagccttggaggcatcagcgggcacgagatccagcacctacaaatttccccctgagatgtcaaaaacagcggggagctagtgcctcctctggacagcacgaaggcagagtcaatttggtctttttcattggttctccaactgtcattgcagtgccagatctgcagtgtccgactaaatactccggcatgctgtactag

SEQ ID NO: 56020 - DNA, 954 bp, Artificial Sequence
  Description of Artificial Sequence: Synthetic coding sequence
atgtttcaggccgctgagcggccacaggaatgggccatggaggggccaagagatggtttgaagaaagagagactcctggatgatcgacacgattctgggctggactccatgaaggacgaggagtacgaacagatggtgaaagagctgcaggagatcagattggagccacaagaagtccccagaggcagtgagccttggaagcagcagctgactgaggacggggattccttccttcatttagctattatccatgaggaaaaagcacttacgatggaggtaatccggcaggtgaagggggacttagcgttcctgaactttcaaaataacttgcagcagacacctctccatctggcggtcattaccaatcaacctgaaatcgcagaggctctgctcggggctggatgcgatcccgagctcagggattttcgtggaaatacccctctccacctcgcctgcgagcaggggtgcctcgcaagtgttggggtccttacgcagagttgcactactcctcacctacatagcatccttaaggctaccaactataatggccacacctgcctgcatctcgctagtattcacggttatcttggaattgtcgagctgcttgttagcttgggagctgacgtgaacgcacaggaaccatgcaacggtaggacagccctccatctggcagtggacctgcaaaacccggacctagtgtcactcctgttgaaatgcggcgctgatgtgaatcgggtaacgtatcaggggtatagtccttatcagctgacctggggacgaccgtctacacgcatccaacaacagctgggacagttgactctggaaaacctacagatgctcccagagagcgaggatgaggagagctatgatacagaatccgagttcactgagtttactgaggacgaactgccttacgacgactgcgtctttgggggacaacggttaacactgtag

SEQ ID NO: 56021 - DNA, 627 bp, Artificial Sequence
  Description of Artificial Sequence: Synthetic coding sequence
atgggcgaggtggaaatttctgccctcgcctacgtgaaaatgtgcctgcacgctgctaggtatccgcatgccgctgtgaacgggctcttcctggcgcctgccccacgcagcggagagtgcctctgtctgaccgattgcgtgcctctcttccattcccatctggcactctccgtgatgttggaagtggcccttaatcaagtcgacgtctggggcgcacaggccggtctcgtggtcgccggatattatcacgctaatgcagccgttaatgaccagtctcccggacccctggctcttaagattgcaggtcggattgctgagttttttcctgacgccgtgctaattatgctcgataatcagaaactggtgccacaacctcgcgtgcctccagtgatcgtactggagaatcaaggcctgagatgggtgcctaaggacaagaacctcgtcatgtggcgagactgggaggagtcacggcaaatggttggcgctttgttagaggacagggcgcaccaacaccttgtcgactttgattgtcacctagatgacataaggcaggattggactaatcagagactaaatacccaaattacacagtgggtggggcctactaacgggaacgggaatgcctag

SEQ ID NO: 56022 - DNA, 483 bp, Artificial Sequence
  Description of Artificial Sequence: Synthetic coding sequence
atgagtgaggcttcgcggctgtgttctgggtactattcccttaatcaatccttcgtcgagcctttccagtgtccgaggcgtggagagggggctgccctccagtattgctgcggctttgctgatctaaaatattgttgttcggagcctgggtcctatttcccttataagcactcgtacatgtggtcactgtcgattggagctcttataggtctcgggatagccgctctcgtattacttgcctttgtgatctctgtctgcgtgctatgttacctcttcctgtacacgaaaccacagagactcgacacaggactgaagctacaacatctggaggcgagttctactcaggagggcaagtcaaacggcaagactaaagcattgaattcaaatgcggctagcaacgctacaaacgagacttactacgaagctgatgacatcattcaagagaagaccatggacgcaacccagattcatattgcctattag

SEQ ID NO: 56023 - DNA, 3123 bp, Artificial Sequence
  Description of Artificial Sequence: Synthetic coding sequence
atgatgtctagcgtctcaacagagtccaagctacagcaggctgtgtcactgcagggcgtcgaccccgaaacttgcatgatcgtcttcaagaatcactgggctcaggtcgtgaaaatcctggagaaacatgatcccctgaaaaatactcaggcaaagtatggctctattcccccagatgaagcgtccgctgtccagaactatgttgagcacatgctctttctgctgattgaagagcaggctaaggatgccgcaatggggccaattctagagttcgttgtcagcgagaatattatggagaaactctttctctggtccttgagacgcgaattcaccgatgagacaaagattgagcaactgaaaatgtatgaaatgttggtcacccaatctcaccagccacttcttcaccacaagcccatcctgaagcccctgatgatgctgctgtcctcttgctcaggtaccactaccccaacagtggaggagaagttggtagtcctgttgaaccagctctgtagcattctggccaaggacccatccattctcgagctgtttttccataccagcgaggatcagggagctgccaatttcctcattttcagtctgctgatccccttcattcatagagaaggctcagtaggacagcaggccagagatgctctgctctttatcatgagtctttccgcagaaaatacaatggtggcccaccacatcgtggagaatacatatttctgccctgtactagccacagggctgtcagggctgtactcatcactgccaaccaagcttgaagagaaaggcgaagaatggcactgcttactgaaggatgattggttgctgcttccctctttggtgcaatttatgaacagcttggaattctgcaatgccgttatccaggtcgcacaccctctgatccgcaatcagcttgtgaactacatttacaatgggttcctagtacccgtgttggcccctgcactccataaagtgactgtggaagaagtaatgaccacaacagcctatctcgacttgtttcttcgctctatttccgagccagccctgctcgaaatctttctgaggtttatactcctgcatcagcacgagaacgttcacatacttgacacgcttacatctcgcatcaacacacccttccgtctgtgcgtagtctccctggcactgttccggacactcataggacttcactgtgaggatgtgatgcttcagctcgtcctccggtacttgattccctgtaatcacatgatgctgagtcaacggtgggccgtgaaagaaagagattgctactcagtcagcgctgccaagcttctagccctgactccagtgtgttgctcatctggaatcaccctcacactgggtaatcaggagagggattatatcctgtggtccaaatgcatgcacgataccagcggacccgtggagagaccgttcccagaagctttcagcgagtccgcctgtatcgtggagtatggtaaggcccttgacattagttacctgcagtatctctgggaggcccacacaaacatcctccggtgtatgcgcgattgtcgtgtatggagtgctctctacgatggagactcgccagaccctgagatgttcctgcagagtctgacagaggaaggctctgttagcagtgcatgtcccgtgttcggtcttccccagcagctgcctaggaaaaccgggccacagctggcaccaagaaaagataaaagtcaaactgagttagagtgggacgattcgtacgacacgggaatttcatcaggcgctgacgtgggttcaccaggcccttatgatgacctggaggtgtctgggccaccagcgcctatcgacccgcctaaacacattcaagagatgaaaaagaacgccctgcttctgttcaaaggctcctatatcgaggaatctgactttcaggacgacgttatggtctatcggttgtgtgcagagaaggactcggaagatatgaaggactcacaggaagaggcagcgcgtcctccggctgaagcacaggcggaggtgcagagcgtgcccatcaataatggtccgctcctctctacacagcctgagacagactcagaagaagaatggaaccgggacaactcagatccgttccattcggaaccgaaggagcccaaacaggagagagagcctgaggcggctccagaatcaaactccgagctggcgagcccggcacccgaggccgaacactcctctaacttgaccgccgcacaccccgaatccgaggaactcatcgcacagtacgaccaaataataaaggagctggacagtggcgctgaggggttgatggagcagaattaccctactccggatcctttactgctaaccaaagaggaagagggtaaggaggaatcaaagggggaaaaggagaaggaaggcaagaaggaactcgaagacgaggaagacgactttgattcctttattgccgagatgcctgcggtcgagactgttccttcgccattcgtggggagggatgaggcagcctttgccagcagacacccagtgcggacacagtcaaccccgttcactggaccttttatttccgttgttctgtccaagctggaaaacatgctggaaaatagtcttcacgtcaatttgctgctgattggaattattacccaacttgcgagctatcctcagcccctgcttcgaagttttctgctcaatacgaacatggtcttccagcctagcgtgagaagcttgtaccaggtcctggccagtgtcaagaacaaaatagaacagtttgcctctgtcgagcgtgacttcccaggattgctgatccaggcacaacagtaccttctctttagagtggacatgtccgatatgacacccgctgcactgactaaagaccccattcaggaggcctccagaaccggaagcggaaaaaatctcttggacggaccacctagggtgttacagccatttctcactcaccggaccaaggttgcagaggcaccccctaacttgcccctccctgtgcgcaacccaatgctggctgccgctctgttccctgagtttctgaaggaactagccgctctggcgcaggagcacagcattctgtgttacaaaattctgggagactttgaggattcctgctgctag

SEQ ID NO: 56024 - DNA, 123 bp, Artificial Sequence
  Description of Artificial Sequence: Synthetic coding sequence
atgatgtccagcgtaagcactgagtccaagctgcagcaagccgtcagcctacaaggggtcgatccagaaacgtgcatgattgtgtttaaaaatcattgggcccaggtggttaagatcttgtag

SEQ ID NO: 56025 - DNA, 3123 bp, Artificial Sequence
  Description of Artificial Sequence: Synthetic coding sequence
atgatgtccagtgtctcaacagagtctaaactccaacaggcggttagcctgcagggagtcgaccctgagacttgtatgattgtgttcaaaaatcattgggctcaggtggttaaaatccttgaaaagcacgaccctctaaagaatacccaggccaagtatggctcaatccccccagatgaagcctccgccgttcagaactatgtggagcacatgctgttcctgcttattgaggagcaggctaaggatgcggctatgggaccgatcctcgagtttgtggtatctgagaacattatggagaagctgttcttgtggtcccttcgcagggagttcacagacgagactaaaatagaacagttgaaaatgtacgaaatgctggtgactcagtcacaccagcctctccttcaccacaagcccatcctgaagccacttatgatgctgctttcatcgtgcagcggaactacaacacccaccgtagaggaaaaactcgtggtactgctgaaccagctgtgttctattttagccaaggatccatccatcctggaactcttcttccacacctctgaggaccagggcgctgccaatttcctgatcttttctctgctgatcccctttatccatagagaggggagtgtaggtcagcaagccagagatgctttactgttcattatgtcactgtcagccgagaacactatggttgcacaccatattgtggagaatacatacttttgtccggtcctcgccactgggctgtcaggcttatactcatccctccctacgaagctggaggaaaagggggaggagtggcactgtcttctgaaagacgactggctgctcctcccgtccctagtgcagttcatgaactccctggaattttgcaatgctgtgatccaggtcgcccacccactgatcagaaaccagctcgttaactatatctacaacggatttctggtgccggtgctggcccctgctctgcacaaggtcactgtggaggaggttatgactacaactgcctacctcgacctgttccttaggagtatttctgaacctgccctgctggaaatctttttgagattcatcctcctgcatcaacatgagaatgtgcacatccttgatactttgaccagccggattaacactccttttcggctctgcgtggtatctcttgctctgtttcgcacattgataggcttacactgcgaagatgtgatgctccaactcgtgctgcgttacctgatcccttgtaatcacatgatgctgtctcaaagatgggcggtaaaagaacgggattgttattcagtgagcgccgcaaaactgcttgccctgactccagtctgttgctcctcaggtatcacattaactctaggcaatcaggagagggattacattctttggtccaagtgcatgcacgatacttctggacctgtcgagcgcccattccctgaggcgttctccgagtccgcttgtatcgtggagtatggtaaggcattagacatttcttatctgcagtatctgtgggaggcgcatactaacattctgagatgtatgcgagattgtcgagtttggtccgccctttacgacggggattctcccgaccccgaaatgttcttgcagtctctgacagaggagggttctgtgtcgagtgcttgccccgtgttcgggctgcctcaacagttgccgagaaaaactgggccacaattggccccacgcaaagacaagtcacagactgaactggagtgggacgactcttacgacaccggaataagctctggcgcagatgtgggcagcccaggcccatacgatgatttagaggtcagcggtccacctgccccaatcgatcctccaaagcacattcaggagatgaaaaaaaatgcactgctgctgtttaaagggagctacatcgaggagagtgactttcaggacgatgtcatggtgtataggctttgtgcggagaaggacagcgaggatatgaaggactctcaggaggaggccgctcggccacccgcagaggcccaagccgaagtgcagtctgtcccgattaataacggccctctgttaagcacccagcccgagacggactctgaggaggagtggaacagggacaacagcgatcctttccatagcgaacccaaagaacctaaacaggagcgggagcccgaagcagcaccagagtccaactccgaattagcttcccctgcgcctgaagccgagcactctagcaaccttactgccgctcatcctgagtcagaggaactgatcgctcagtacgatcaaattatcaaggaactggactccggggcagaggggctgatggaacagaactatccaacgcccgatccattgttattgactaaggaggaggagggcaaagaagagtcaaaaggcgagaaggagaaagaaggaaagaaagagctcgaagacgaagaagacgacttcgatagttttatcgctgaaatgccagccgtcgagacggtgcctagcccgtttgtaggcagagacgaggccgcttttgcctctcgacatcctgtgcgaacccaatccacacctttcacaggcccttttattagcgttgtgctttccaagttggagaacatgctggaaaactccctccacgtaaatctgttgctgatcgggatcattacccagttagcctcatacccccagcctctgctacgctcatttttattaaacaccaatatggtcttccagccaagcgtccggtctctgtatcaagtcctggcatcggtcaaaaacaagattgagcagttcgcgtccgtagaacgtgactttccgggtctcctcatacaggcccagcagtacctgctgtttagggtggatatgtcagacatgaccccggctgcactaaccaaggaccccatccaggaggcatcacgaaccgggtccggcaaaaatttgttggacgggccaccccgtgtcctccaaccttttctgacccaccggacaaaggtggcggaagccccacctaatctcccccttcccgtaagaaatcccatgctggcagcagcgctgtttcctgagtttctcaaagagcttgccgctctggcgcaggagcactcaatcttatgttataaaattctcggagattttgaggatagctgctgctag

SEQ ID NO: 56026 - DNA, 183 bp, Artificial Sequence
  Description of Artificial Sequence: Synthetic coding sequence
atgatgagttccgtgtccacggagagtaaattgcagcaggcagtgtccctgcagggcgtggaccccgaaacatgtatgatcgtcttcaagaaccattgggcacaggtggtaaagatcctggaaaaacacgaccctttaaagaatacccaggcgaagtacggaagcataccaccggatgagtag

SEQ ID NO: 56027 - DNA, 42 bp, Artificial Sequence
  Description of Artificial Sequence: Synthetic coding sequence
atgatgtccagcgtctccactgagagcaaattacaacagtag

SEQ ID NO: 56028 - DNA, 129 bp, Artificial Sequence
  Description of Artificial Sequence: Synthetic coding sequence
atgatgtcatccgtttccaccgagtctaaactgcaacaggcagtgtctctgcagggagtggaccctgagacctgcatgatcgtctttaagaaccattgggctcaggtcgttaaaatcctggaaaaatag

SEQ ID NO: 56029 - DNA, 306 bp, Artificial Sequence
  Description of Artificial Sequence: Synthetic coding sequence
atgttttctaaattcacatccatcctgcaacatgccgtcgaagctctggccccatccttgccactgcaggaagactttgtttaccactggaaggcaatcactcactactacattgagacatcagacgataaggcccctgtgacagatacaaacatcccatcacatctggaacagatgctggacattctggtgcaggaagaaaacgagcgagagtcgggggagactggaccgtgcatggagtacctgctgcaccacaaaatcctggaaacgttatacaccttagggaaggcggatgtaagcagctag

SEQ ID NO: 56030 - DNA, 2298 bp, Artificial Sequence
  Description of Artificial Sequence: Synthetic coding sequence
atgttcagtaagtttacaagcattctgcagcatgctgtggaagccctggctccttccctgcctctccaggaagattttgtgtaccattggaaagccattacccactactacatcgaaacgtccgatgacaaagctcctgtgacggacactaatatccccagtcatctcgagcagatgctggatattttggtgcaggaagagaacgagcgggagagcggcgaaaccggcccttgtatggagtacttgctgcaccataagattttggagacgctgtacactctgggcaaagcagactgccccccaggaatgaagcagcaagtactggtgttctacaccaaattactgggcagaatccgacagcctctgctgcctcacattaacgttcatcgtcctgttcaaaaattgatccggctgtgcggggaagtcctggcaacacctactgaaaacgaggagatccagttcctttgcattgtgtgtgctaagctgaaacaggacccctatctagttaatttctttctggagaataagatgaagtctctggcttcaaagggagtgcccaatgtgataagcgaagatacactgaaaggccaggattccctgtccacagacacaggtcagtctagacagccagaggaacttagcggagctacaggcatggagcaaaccgaattggaggacgaacctccccatcaaatggatcacttatctaccagcctggacaatctctccgtcacgtctctgcccgaagcctccgtcgtttgcccgaaccaggattacaatctagtgaacagccttctaaacctgacccgttctcctgatggtaggattgctgtcaaggcctgtgaggggctcatgcttttggtgtctctccctgagccggctgcagccaagtgcttgacccagtccacatgtctgtgtgaactgctgaccgatagactggcatctttgtataaagctctgccgcagtcagtggacccattggatattgagacagtggaggccattaattggggcctggattcatattctcacaaggaggacgcttccgccttccctggcaagcgggctctcatatcgttcctttcctggttcgactactgcgaccaactcattaaggaagctcagaaaactgccgctgtcgcactcgccaaagcggtgcatgagagattttttataggggtgatggaaccccaattaatgcagacttccgagatgggcatattaaccagtacggcattgcttcaccgcattgtacgccaagtcacatccgatgtgcttctgcaggaaatggtgttttttatccttggcgaacagcgagagccagaaacacttgcagagatttcccgtcacccgctgcgccaccggcttatagaacattgcgatcacatttctgacgaaatctcaataatgacgctgcgcatgttcgagcatcttctgcaaaaacctaacgagcatatcctgtataacctcgtgctccgcaacttggaagagcgcaactatacagaatataaacccctatgcccagaggataaggatgtggtggagaacggtctgattgcaggcgcagtagatctagaagaggaccccctgtttaccgatatctcacctgagaacactctccctaatcaggagtggctgagttcttcccctcccgctacccctgaccaccctaagaatgatggaaagacggaggtccataagattgtaaactcgtttttgtgtctagtcccggacgatgctaaaagtagctaccacgttgaggggaccggctacgatacatacttgcgggacgcacaccggcaatttcgggattattgcgctatctgtctaaggtgggaatggcctgggtccccaaaagctctggagaagtgcaatcttgaggccgctttttttgaaggccactttctcaaggtgctcttcgacagaatggggaggattcttgatcaaccctatgatgttaacctacaggtgacaagtgtgctgagtcggcttagtctgtttccgcacccgcacattcatgaatacctgctcgatccatacgtcaacctggcaccgggttgccgatccttgttttctgtaatagtccgggtggttggggatctgatgcttcgaattcagaggatccaggattttacccctaagttgctgctggtcaggaagcgcttactggggttagaacctgaaggccctatcatcgatcatataacgctgctggagggggtaattgtgcttgaagagttttgtaaggagctggctgctatagcattcgtcaaatatcatgcctcttccacaccctag

SEQ ID NO: 56031 - DNA, 2217 bp, Artificial Sequence
  Description of Artificial Sequence: Synthetic coding sequence
atgtttagcaagtttacttccatcttacagcacgccgtcgaagcgctggctccctctttgccgttacaagaggactttgtgtaccactggaaggcaattacacactactatatcgaaacatccgatgacaaggcacctgttactgataccaacattcccagtcacttagaacaaatgctggatatcctggtgcaggaggaaaacgagagggagtccggcgagacagggccatgtatggaatatctgttgcatcacaagattctcgagaccttatacacgcttggtaaagctgactgccctcccggaatgaagcagcaggtgctagtgttttacactaagttgctcggacggattcggcagccactgctgcctcacatcaacgtacacagacctgtccaaaagctgattcgcttatgcggcgaggttctggcaacgcctactgagaacgaagagattcagtttctttgtatcgtgtgcgccaagttgaaacaagatccatatctggttaacttcttcctggagaataagatgaaaagcttagcctctaaaggcgttcccaacgtcatcagtgaggataccctcaaggggcaggactccctgagtaccgacaccggccagagccgccagccagaggaactgtccggcgctacagggatggaacagaccgagttagaggacgagcctccgcatcaaatggatcacctgtccactagcctggacaacctgagtgtgacttctctgcccgaggcgagcgtggtctgtcccaaccaggactataatcttgtcaattctctactgaatctcacccgcagtcccgatggtagaatcgccgttaaagcctgcgaagggctgatgctgttggtgtctctccccgaacctgctgccgctaagtgtctgacacaatccacatgcttatgcgaattgctgactgacagacttgctagcttatataaggccctgccacaatcagtcgatcccctggatattgagactgtggaggccatcaactggggcctcgacagctactcgcacaaagaagatgcatctgcctttcccggtaaaagagccctgatttcattcctgagttggtttgattattgtgatcagcttatcaaagaggcgcagaaaaccgcagcagttgccctcgcgaaagccgtgcacgaaagattctttataggagtgatggagccacaattgatgcaaacatccgaaatgggtatccttacaagcactgccctgctccaccggattgtgagacaggtcacatctgatgtcctgctgcaggaaatggtcttcttcattcttggcgagcagagagagccagagacactggccgagatttctcgacatccattgagacaccgcctcattgagcattgcgatcatatcagtgatgaaatctcaataatgaccttgcggatgttcgagcatttactgcaaaagcccaacgaacatatcctgtataacttagtgctacgaaacttggaagagcggaactacaccgaatacaaacctctgtgccccgaagataaggatgtggtggagaacggccttatcgcaggcgcagtcgacctagaagaggatcccctgttcacagacatcagtccagaaaatactctcccaaaccaagaatggctgtcctcttcaccacctgcgacacctgatcaccccaagaatgacgggaaaacagaagtgcacaagatcgtaaactcgttcctttgtcttgtgcccgacgacgccaagtctagctatcacgtggaaggcaccggatacgatacctacctccgggatgcacacaggcagtttagggattactgcgcaatctgcctgcggtgggaatggcccggttctcccaaggctcttgagaaatgcaacctcgaagccgcttttttcgaggggcactttctgaaggtcttgtttgaccggatggggaggattctagaccagccgtatgacgtgaatctgcaggtcaccagtgtgcttagtcgcctaagtctgttcccccacccccatattcatgagtacttactagacccatacgtaaatttagcaccaggatgcaggtctctgttctcagtgatcgtccgagtggtaggcgatctgatgctaaggattcagcgtatccaggactttacgccaaaactgctgctagtgcgaaaacgcctgctgggactcgagccagaagggccaatgcaaacccttccaagttggtggtag

SEQ ID NO: 56032 - DNA, 252 bp, Artificial Sequence
  Description of Artificial Sequence: Synthetic coding sequence
ctgagtttgtttccccatcctcatattcatgaatacttgctagatccatacgtgaacttggccccagggtgtcgatccctcttctcggtgatcgtgcgtgtcgtgggtgacctgatgttgagaatccaacgaattcaggactttacacccaagttactgttggtacgtaagcgactactaggattagagcccgaaggcccaatcagtgacctggagccagtggaagctctgaccgtctcgagcatctgttag

SEQ ID NO: 56033 - DNA, 2232 bp, Artificial Sequence
  Description of Artificial Sequence: Synthetic coding sequence
atgctctcacggctgggtgcgctgctgcaggaagcggtgggggctcgtgaaccgtctatcgatttgctgcaagcttttgtggagcattggaagggaatcacccattattatatcgagagcaccgacgagagcaccccagctaagaagactgacatcccctggcggctgaagcaaatgctcgacatactggtgtatgaagagcagcagcaagccgcagctggagaagctggaccatgcctagagtacttactccaacataagattcttgaaactttgtgcacccttggtaaggccgagtatccacccggtatgcgtcagcaggtttttcagtttttttctaaagttctcgcccaggtacagcaccctttattgcattacctcagcgtgcatcgccctgtgcagaaactgttgaggctggggggaactgccagcggaagtgtgaccgaaaaagaagaagtccaattcaccaccgttctgtgttccaagatacagcaggatccagagctcctggcgtatattctagaaggcaagaaaatagttggcaggaagaaggcttgcggggagcccacagcacttcccaaggacactaccagtcatggggataaggactgttctcacgatggtgccccagctcggccacaactggacggcgaatcgtgcggcgctcaggccttaaacagtcatatgccggctgagacggaggaactagatgggggtacaaccgagtccaatttgatcacctcactgctcggactgtgccagagtaagaagtctcgggtggccttgaaggcccaagagaacctgttactactcgtgagtatggccagtcccgcagctgcgacctatctggtacagtctagtgcctgctgcccagcaattgtgaggcacttatgccagctgtaccgctccatgccggtgttccttgatcccgcagacattgcgacactggaggggatatcctggcgactgccttctgctccatcggatgaagcgagttttcctggtaaggaggcattagcggcatttctgggatggttcgactattgtgaccacctgataaccgaggcgcataccgttgtagccgatgctctggcaaaggctgtcgctgagaacttcttcgtggagactctgcagcctcagctgctgcacgtgagcgagcagtccattctaacctcgaccgccttgcttaccgccatgttaaggcaactgaggtctcccgctctgctcagagaggccgtggcgtttctgctgggcactgataggcagccggaggcgccaggggataacccgcataccctgtacgcccacctaatcggccactgtgatcatctgtctgacgaaattagtataacgacccttagactcttcgaagagctactgcagaaaccccacgagggaatcattcactctttagtattgcggaatctcgaaggaaggccttacgtggcctggggctccccagaacccgagtcctacgaggataccctagatttggaggaagatccctactttacagatagcttcctggacagcgggtttcaaacaccagcaaaacctcggctggcccctgctacctcctatgacgggaaaaccgcagtcacggagattgttaattcgtttctctgcctggtcccagaggaagctaagacgtcggcttttctcgaggaaacaggatacgacacctatgtccacgacgcctacggcctttttcaggagtgttcttccagagtcgccagttggggctggccactgacaccgacccctttggacccacatgaaccagagcgaccgttttttgagggacacttccttagggtcctttttgataggatgagccggatcctggatcaaccttatagcctgaatcttcaggtaacatctgtgctttcccgactggcactatttccacatcctcacattcacgaatacttactggacccttatatctccctagcgccaggttgtcggtctcttttcagcgtcctggtgagagtgatcggcgatttaatgcagagaatccagcgagttccccagtttcctggaaagctgcttctagtgaggaagcagttgaccggccaggctcccggtgaacagctcgaccatcagaccttgctccagggcgttgtggttttggaagaattttgcaaggaattagccgctatcgcctttgttaagtttcctccacacgaccctagacaaaatgttagtcccgcaccagaggggcaggtgtag

SEQ ID NO: 56034 - DNA, 486 bp, Artificial Sequence
  Description of Artificial Sequence: Synthetic coding sequence
atgttgagccgcctcggggcactgctccatgagcccgagcggccattctttgaggggcactttctgcgcgtcctttttgacagaatgtctcgcatactggaccagccatattccctgaaccttcaggtgactagtgtactttcgcggctggccctctttccccatccacatatccacgaatatcttctggacccgtatatcagtctggcaccaggatgtcgtagtctgtttagtgtcctcgtgcgggtcataggtgatctgatgcagaggatacaacgagtgccacagttcccgggtaagctgcttctagtgagaaaacagctcactggccaggctcccggtgaacagttggaccaccaaacactcttgcagggcgtggtcgtgctcgaggagttttgtaaagaactggccgctatagcttttgtgaaattcccaccacacgatccacgacagaacgtgtctccagcacccgagggccaggtctag

SEQ ID NO: 56035 - DNA, 2133 bp, Artificial Sequence
  Description of Artificial Sequence: Synthetic coding sequence
atgagaggcgaaaataggcccattgggaagcgcaccttgccaccccgagctgggtggatcggcggttgtccagggtctcagcccgacgccaaagctcggaaaggttggaccctcgcccctcactccagcagatgccatagatgctgtcattatcgctgccactgtcgctgctgcttgtgccccgctgagatgactgtggggcgacctgaaggagccccaggcggtgccgaggggtctagacaaatttttccccctgaatcctttgccgacacggaagccggagaagagctgtcgggcgacggcctggtgctgccgagggcgtccaaattggacgaattcttgagtcccgaagaagaaattgactccaccagtgatagcacggggtcaatctatcaaaacctccaagagctgaaacagaaggggaggtggtgtttgctggagtcactgttccagtccgaccccgagtccgacgagaacctctcagaagatgaagaagatcttgagtctttctttcaggacaaggaccgtggcatggtacaggtccagtgcccacaggccctaagatgtggctctacacgcagatgtagtagcctcaataacttgcccagtaacatcccacgccctcagacacagccccctagtggctctcggcctccctcccagcaccggtcagtgtcatcctgggcttcatcgataaccgttcccaggccattccggatgactcttcgggaggctcgcaaaaaagctgaatggcttggaagcccagcctcatttgagcaagagcgccaacgcgctcagagacagggggaggaagaagctgagtgtcatcgccagttccgggcacagcccgtccctgctcacgtgtacctacccctgtaccaggagataatggaacggagtgaggcccgacgccaagcagggatccagaaacggaaagagcttttattgtcctccctaaagccatttagtttcctggaaaaggaagagcagttgaaagaagccgcaagacaacgcgacctagctgcaacagcagaggccaaaatctccaagcagaaagcaacacgtcgtatccccaaatcaatcctcgagcccgctctgggcgataagttacaagaagcggagcttttccgcaagattcgtatccagatgagagccttggatatgctgcagatggcctccagccctatcgcttcttcttctaaccgcgcaaaccctcagccacgcaccgccacaaggactcagcaggagaagttgggtttcctgcacaccaatttcagatttcagccacgggtgaaccctgtggtccccgactacgagggcctgtataaggcatttcagcggagggccgcaaaaagacgagaaacacaggaggccacaaggaataagccctttctgctgagaacggccaatctccggcacccccagaggccgtgcgacgcagcaaccacaggtagacggcaagattccccccaacctcctgccacaccgttacctcgatctaggtccctgagcggtcttgcttctctctccgctaacaccctgccggtgcacatcactgatgccacccgcaagcgggagagtgcagttaggagcgcccttgagaagaagaataaggcagatgagtctatccaatggcttgagattcataaaaagaaatcacaggcaatgtcaaaaagtgtgactttgagagctaaagcaatggatcctcacaagtcgctagaggaggttttcaaagcaaagctgaaagagaaccgaaataacgataggaaaagagctaaggaatataaaaaggagctcgaagagatgaagcaaagaatccaaactcggccatacttgttcgagcaagtcgccaaggatcttgccaagaaggaggccgagcagtggtatttagataccttgaagcaggctggattggaggaagatttcgtgcgcaataagggacaggggacgagagctgtgcaggaaaaagagactaaaatcaaggactttccaaggttccaagagaccacgaaactgagcattagggacccagaacagggactggagggatcactcgagcagccggcaagccctcgaaaagttttggaagaactctcccatcagagtcctgaaaacctggtgtccctggcctag

SEQ ID NO: 56036 - DNA, 1944 bp, Artificial Sequence
  Description of Artificial Sequence: Synthetic coding sequence
atgaccgtcggtaggccagagggtgcccctggcggtgccgagggatcgcgacagatttttcctcctgagtcttttgccgataccgaggctggcgaggaactcagcggagacgggctagttctgcctagggcctccaagttggatgagtttctgtctcctgaagaagagatcgacagtaccagcgattccaccggttctatttatcaaaacctccaagagctgaagcagaagggacgatggtgtctgcttgagagcctgtttcaatccgaccccgagagcgatgagaatttgtcggaggacgaagaagatttggagtccttcttccaagataaggatcgaggaatggtccaggtgcagtgccctcaggctctgcggtgtgggtcaaccaggcggtgctcaagtctgaacaatctaccttccaacattccaaggccacagactcaacctccatcaggctctcggcctccatcccaacacaggtcagtttcgtcttgggcatcatctattacagtccccaggccctttcgcatgaccttgcgtgaagcacgaaagaaggccgaatggctggggagcccggctagctttgaacaagagcgacaacgtgctcagcgccagggtgaggaggaggcagaatgccacaggcagttcagagcgcagccggtaccggcacacgtttacctcccactctaccaggaaataatggaaagatcagaggctcgcaggcaggctggtattcagaaacgcaaggaactactgctctcttctctcaagccgttctccttccttgaaaaggaagagcagttgaaagaggctgccagacagagagatcttgctgcgaccgccgaagccaaaatttcgaaacagaaagcaactagacgaatcccgaagagcattctagagcctgctttgggagacaaactgcaagaggccgaattgttccgtaaaattaggatccagatgagggcgcttgacatgttacaaatggcttcctcacccattgcctctagcagcaacagggccaaccctcagcctagaacagcaacccggactcagcaggagaaactagggttcctccacacaaattttcggttccagcctcgggttaacccagtggtgcctgactacgagggactttataaggcgttccagcgtagggccgcaaaacgtcgagaaacacaggaggccactcggaataagcctttccttctgagaacggccaatctgcgtcacccacagcgcccttgcgacgcagccacaactgggagacgtcaagactcaccacagcccccagcaacacccctccctagaagtcgaagcctctccggtctggctagcctgtctgctaacaccttgcctgtccatatcacggatgcaacccgaaaacgtgaatccgccgttcggagcgccctcgagaagaaaaacaaggcagatgaaagcattcaatggctagagatccacaagaaaaaaagccaggctatgtcaaagagcgtgacactccgggctaaggctatggatcctcacaagtccttagaagaggtgttcaaagctaaattaaaggaaaacaggaacaatgatcgcaaaagagcaaaggagtataaaaaagagcttgaggagatgaagcaaagaatccaaacccgcccttatctttttgaacaggttgcgaaggacctggccaaaaaagaggccgagcagtggtacctcgacactctgaaacaggcaggacttgaggaggatttcgtgagaaataagggtcagggcacaagagccgttcaggagaaagagaccaagattaaggacttcccgcgatttcaggaaacgactaagttatccatcagagatccagagcaggggcttgagggtagtttggaacagcctgcatccccacgaaaggtgttggaggaactcagccatcagagccccgagaacctggttagcctggcttag

SEQ ID NO: 56037 - DNA, 978 bp, Artificial Sequence
  Description of Artificial Sequence: Synthetic coding sequence
atggagggtctagaggagaacggcggtgttgttcaagttggggaacttcttccgtgcaaaatctgcggtagaacatttttccccgtcgcattgaagaaacacggtcctatttgccagaaaacggccaccaaaaaaaggaagacattcgatagctcaaggcagagggccgaggggaccgatatccccacagtaaaacctctgaagcccagaccagagcctccgaaaaaacccagtaattggaggagaaagcacgaagagtttatcgctaccattagggctgccaaagggctggaccaagctttgaaggagggtggcaaattgcctccaccgcctcccccatcatacgatcccgactatatccagtgcccatattgccagcgcagatttaacgagaatgccgcagaccgccatataaatttctgcaaggaacaggccgcacggatttcaaacaaggggaagttctcgaccgatactaaaggaaagcccacctcgcgcacacaagtgtataagcctccagctctgaagaagagcaattcaccaggtaccgcctccagcggaagcagccgcctgccacagccatctggggctggcaagactgtggtgggagtcccttccggcaaagtcagcagctcttcctcgtccctcggtaataagctccaaacactgtcaccctcacacaaaggaattgccgcaccacacgctggcgctaacgtaaaaccaagaaacagcacacccccaagtctagcgagaaatcctgcacctggagtgctaaccaacaagcgcaaaacctatacagagagttatatagctagacccgacggtgactgcgcttcctcactgaatggcggtaatattaaagggatagaagggcacagcccgggaaacttgccgaagttttgtcacgaatgcggcaccaagtatccagtcgaatgggctaagttttgctgtgagtgtggcattcggagaatgatcctctag

SEQ ID NO: 56038 - DNA, 828 bp, Artificial Sequence
  Description of Artificial Sequence: Synthetic coding sequence
atggctggtctgcagcgactggcctcgcatctccccgtgggggttatgctaccacacaatacaacggaagccccaggtcctcatagtgccaagcaagactcctacgaacaaggggatagcagccagcagtccctaaaaggccatctgcgcaacaactttcagaagcagctgctgtccaacaaggagttaatcttggacaaggtgtacactcatccgaaatggaatacgcagactaaagccaggtcttatagctaccctcattgtactggcattagccagcaggacccagaatcagactctcaagggcagggcaatggactgttctatagctcaggcccacaatcttggtaccccaaggcaaacaaccaagactttatcccgttcactaaaaaacgagtcggcgtggaccgggcttttcctctcaagcccatggtgcatcggaaatcttgtagtactggggaggctggtacagacggagatcacaatgtgtaccccaggcctcccgaaccaagggaattttcaagcaggaatttcggggtgcgcaaccaaggaaatttttccgtagtaggtacggtgctggctgcgacccaagccgaaaaagccgtggccaattttgatagaaccgaatgggtacagatcagacgcctcgaggccgctggcgagtctctagaagaggagatccggcgaaaacagatactgcttagaggaaagttaaagaaaaccgaagaggaattgcgcaggatacagacccagaaggaacaagctaaagagaacgagaacggcgagctgcagaagataatcctgccaagatctcgcgtgaaaggatag

SEQ ID NO: 56039 - DNA, 1371 bp, Artificial Sequence
  Description of Artificial Sequence: Synthetic coding sequence
atggccggactacagcgccttgcatcgcacctccctgtgggcgtcatgctcccacacaacacgactgaagccccaggaccacacagcgctaaacaggattcgtatgagcaaggagactcatcccagcagagtctgaagggacatctaaggaacaacttccagaagcagttgttgtctaataaagaattaattctggacaaggtgtacacccatccaaagtggaatactcagacgaaagcccgttcgtactcttaccctcattgcaccggtatatcacagcaggaccccgaatctgactcccagggccaggggaacgggctgttttattcttccgggccacagtcctggtatcccaaggccaacaaccaggacttcattcctttcacgaagaaacgggtgggggttgatcgcgctttccccttgaagccaatggtgcacaggaaatcttgcagcactggagaggctgggacagatggcgatcacaacgtgtaccctagaccccctgagcctagggaattttcctctcggaacttcggggtcaggaatcagggaaatttctctgttgtcggcacagtgctcgcggctacgcaggcagaaaaggccgtggccaatttcgacagaaccgagtgggtccagatccggcgtttagaagcagcaggcgagtctctggaggaagaaattagacgaaagcaaatcctgttgcgaggtaagcttaaaaagactgaagaggaactcaggagaattcagacacagaaggagcaggccaaggaaaacgaaaatggggagctccagaaaatcatcctaccacgcagcagagtgaaggggaataaaagcaatacaatgtataagcctatcttcagtcctgaatttgaattcgaagaagaatttagtcgcgatcgtcgtgaagacgagacctggggcaggagccagcagaattccgggcctttccagttttctgattataggattcagaggctgaaacgggagcgcttggttgccagcaacaacaagattcgggatcctgtttctgaaccgagcgtggaaaaattttcccccccatccgaaactccagtgggcgcactccaggggagtgcgaggaactcttccttgtccatggccccagatagcagcggctcttctggtagcattgaggagcctcagttgggggaatgctctcattgtggcaggaagttcctgtcattccgcctggagagacacagcaacatctgcagccggatgagaggttcaaagcgaaaagtgtttgacagcagtcgagcgagagccaagggcacagagctcgagcagtatctcaattggaaagggcctgccagtgctaaagcagaaccaccacaaaagagcaattggcgatag

SEQ ID NO: 56040 - DNA, 279 bp, Artificial Sequence
  Description of Artificial Sequence: Synthetic coding sequence
atggcagggctccagcgcctcgcaagtcacctacctgtgggagtcatgctgccgcacaatacgaccgaggcaccaggccctcacagcgctaaacaggattcatatgaacagggggactcctcacagcagtcactaaagggtcacttgaggaacaattttcagaagcagctactgagcaataaagaactaatactggataaggtgtacacacatcctaagtggaatacacagactaaggctcggtcttactcatatccacactgcacagggatctcttag

SEQ ID NO: 56041 - DNA, 516 bp, Artificial Sequence
  Description of Artificial Sequence: Synthetic coding sequence
atggcagggctccaaaggctggcctctcatctacccgtgggggtgatgctccctcacaacaccacagaggctccgggacctcattccgcaaagcaggattcttatgaacagggagattccagccagcagtctttgaaaggccacctgcggaataattttcagaagcagttattgtccaataaagagctgatccttgataaagtctacactcaccctaaatggaacacccagactaaagcacgttcttattcctatccgcattgcactgggatcagtcagcaggatccagaaagtgatagccaggggcagggcaacgggttattctactcaagcggccctcagtcgtggtaccctaaggccaataaccaggatttcattcctttcacgaagaaaagggtgggtgtggacagagcattcccacttaaaccaatggtccaccggaaaagttgtagcactggtgaggctggtactgatggcgatcataatgtttacccacgtcccccagaacccagatag

SEQ ID NO: 56042 - DNA, 282 bp, Artificial Sequence
  Description of Artificial Sequence: Synthetic coding sequence
atggctggcctgcagcgtctcgcctcacatctacccgttggggtcatgctgccacacaatacaaccgaagcccctggaccacactcagccaaacaggatagctacgagcaaggagattcctcccagcaatcactaaaaggccatctccgcaacaactttcagaagcagctcctgtccaataaagagttgatactcgataaggtttatacacatcctaaatggaacacacagactaaggctcgatcttatagctacccgcattgcaccggtatcagtcagtag

SEQ ID NO: 56043 - DNA, 486 bp, Artificial Sequence
  Description of Artificial Sequence: Synthetic coding sequence
atggccggactccagaggctcgcatctcacttgcctgtcggtgtgatgctgcctcataacactacagaggcaccgggacctcactctgccaagcaagattcttacgagcagggcgactctagccagcagtccttgaaggggcatctgcgaaacaatttccagaaacagctgcttagtaataaggagctcatacttgataaagtgtacactcacccaaagtggaatacccagacaaaagcacgtagctattcctatccccactgcactgggatttcacagcaagaccccgaatctgatagccaggggcagggcaacggactgttttactcatcaggaccacagagctggtatccaaaggctaacaatcaggactttatacccttcaccaaaaagcgagtgggcgttgatcgagctttccctctcaagcccatggtacacaggaaaagctgcagcaccggggaggctggaactgacggcgatcattag

SEQ ID NO: 56044 - DNA, 828 bp, Artificial Sequence
  Description of Artificial Sequence: Synthetic coding sequence
atggccgtcgcatcgacgttcatccctggactgaacccccagaaccctcattatattcccggttatacagggcattgcccccttctgcggttctctgttggccagacctacgggcaggttacaggtcaattactacggggaccacccggactggcgtggccgccagtgcacaggaccctcctgccaccaatccgaccccctcgcagtccagaagtcccaagggaatctctgccggtgcgcagaggtcaagagaggctatcctcgtcaatgatccctggatatactgggtttgtgccccgtgcccagtttattttcgcgaagaactgttcccaagtgtgggcggaggccttaagcgacttcacacacctgcacgagaagcaaggaagcgaggagctccccaaagaagccaaggggagaaaggatacagagaaggaccaggtaccagaacccgaaggtcaactggaagaacctactctggaggtggtcgagcaggctagcccttacagtatggacgacagggacccacgcaagttttttatgtctggtttcaccggttatgtaccttgcgcaagattcttgtttggttcctctttccccgtgttaaccaaccaagccctccaggagttcggccagaaacattcccctggatccgcccaggatccaaaacacctcccccctttgcccagaacctacccccagaacttgggattgctgccgaactacggcggttacgttcctggctacaagttccagtttggccacacctttgggcatctgactcatgatgctctgggactgagcacttttcagaaacagctgttggcttag

SEQ ID NO: 56045 - DNA, 651 bp, Artificial Sequence
  Description of Artificial Sequence: Synthetic coding sequence
atggctgtggccagcaccttcattcctgggctcaatccgcagaatcctcattacatccccggatacacgggacactgccccctgttgagattctccgtaggccagacctacggacaggtgacagggcagctcctgaggggcccaccaggacttgcctggcccccagtgcatcgcactctcctcccaccaatcaggcctcctagatctcccgaagttccccgtgaatccctgcccgtgagaaggggccaggaacgattgagctcctcaatgatccccggatataccggatttgttcccagggctcagttcatctttgccaagaattgtagccaggtgtgggctgaggcgctgtcggattttactcatcttcacgagaaacaggggagtgaggaactcccaaaggaagccaaaggccgaaaggataccgagaaggaccaggtcccagaacccgagggacaattggaagaacccacacttgaagtggttgaacaggccagtccttacagcatggatgatagggatcctagaaagttctttatgagtggcactgcagggatttgggccgaggcactgacacgccagtgccccggaccacagacgtcaccacccaccagtcagaatattccaagtgaaccaggcagcttcacctag

SEQ ID NO: 56046 - DNA, 954 bp, Artificial Sequence
  Description of Artificial Sequence: Synthetic coding sequence
atgacaaccacccagaagcatgatttattcactccagaaccccactatgtgcccggttacgctggttttttccctcagttgcggtaccaggtcggaaatacctacgggcgaacaactggccagctgttgacagatccaagcgtgcagaagtctccctgttccgtgttatctccaatgagcaagccgaaatttatcgaagatttctcccagagcaaacctcctcgcgtgccctgccaggacttaacagagccctatatcccccactatacttcccttaaaccgtccaagaactttgagatacttgggcagttgccaccattggaagtggacgctcaagaacccccaggggtagaaaatattccgagacaaattctcctgcccgctggatttaccccagacaccccacacccaccatgtcctcccggacgcaaaggcgactccagggacttaggacacccagtctacggagaggaagcttggaaaagcgccacaccagtatgcgaagccccacgccaacaccagttgtatcactgtcagcgggatgagtaccctcccccagccagaagacagcaagaaaccctagacgttggatcttttcagagactcccccaactggaccaccctaacctaatccagcgcaaggccattagcggatacgccggtttcattcccagatttacttgggtaatgggcctcaattatcgtgacggtgtgatgcaggccatggacgaatttgacaagagccagttccttttccgtaaccctcactgcgatttgggggaaaagttgcccggaacccactggccaagcaatcacatctattcttcccaggggctcatccccttttacatgggtttcatccccgctatgcaggacaattacgccctgacgttcggaaactcaacgcggagagcctactggaaggagtgggcaaaaagaaaccacaccctgtag

SEQ ID NO: 56047 - DNA, 816 bp, Artificial Sequence
  Description of Artificial Sequence: Synthetic coding sequence
atgacgaccacacagaaacatgacctttttacaccagagccacactatgtgcccggatacgccggattcttcccccagctgaggtaccaggttggtaatacctacgggaggactaccgggcaacttctcacagacccaagcgtgcagaaatcaccatgttcggttctgtcacccatgtcaaaacctaaatttattgaggacttctcccagtccaagccacctagagtgccttgtcaagacctcaccgagccctacatcccccattatacatccctgaagccctccaaaaacttcgagatactgggtcaactgcctccgctggaagtggacgcacaagagcctcctggagtggagaatattcctaggcaaatcctgcttcctgcaggctttaccccagacacaccacaccccccatgccctcccggaagaaagggcgactcccgagacctcgggcatcctgtttacggagaagaggcctggaaatcggccactcctgtgtgtgaggcccctcggcagcatcagctgtatcactgtcagagagatgagtatcccccacccgcaaggcgtcagcaagagactctggatgtgggtagctttcaaaggctgccacagctggatcacccgaatctcatacagaggaaggctatctcagagcaggccagtggattgggtggacctcctctacccccaagctgcttccaagaacccagttttagccaggatgaagcggtcccgtgcctgcccgttccaatctggccgcaccaaacagtagcgaatgtgcaaggcactaagggttcactggcatggcttccttag

SEQ ID NO: 56048 - DNA, 780 bp, Artificial Sequence
  Description of Artificial Sequence: Synthetic coding sequence
atggctgtcgcctctacttttattccaggcctgaacccacaaaaccctcactacattccaggctacacagggcattgccccttgcttaggttctctgtcggccaaacttacgggcaagtgacggggcagttgttaagggggcctcccggtttagcttggccgcctgtgcatcgcaccttgcttccgccaatccgacctcctagaagccccgaagtccctagagagagccttcctgtgagacggggacaagagagactcagttcttcaatgattcccggatacacaggcttcgttccgagggcccagtttatctttgcaaaaaattgttcccaagtttgggcagaggccctgtccgacttcactcaccttcacgagaaacagggctcagaggaattgccaaaagaggcgaaaggaagaaaggacaccgaaaaggatcaggtgcctgagcccgagggacaacttgaagagcccacactggaggtcgtcgagcaagcctccccctacagcatggacgacagggatccacgcaaatttttcatgtctgctttcctgtgttccccgacacgccactgcaggaacctgggtcggtcgactcatcaggctgtcccaagaacgccaaacatatcccctcattttcccgagcacactctcagaacatgggtgttttacaattatgggggatatgtaccaggatacaaattccagttcggtcatacctttgggcatcttacccatgatgccctgggtttatctacttttcagaagcagttgctagcatag

SEQ ID NO: 56049 - DNA, 492 bp, Artificial Sequence
  Description of Artificial Sequence: Synthetic coding sequence
atgtccctgggacttcttaaattccaggcagtgggcgaggaagatgaggaggatgaagaaggtgaaagtcttgatagcgttaaggccctcactgccaaattacagctacagacaaggagaccgagctacttggaatggacagctcaagtgcagtcccaggcatggcgtagggcccaggccaaacccggaccaggcggtcctggggatatctgtggcttcgacagcatggattccgctttggaatggttgagacgggaactccgtgaaatgcaagctcaggatcgccagctcgccggacaacttttacgcctgcgagcccagttgcaccgcctgaagatggaccaggcctgccacctgcaccaggaattgctcgatgaagcagaactggagctcgagctggagcctggtgccggtctggcccttgcaccgctattgcggcatttgggccttacgcgtatgaacatctcagccaggagattcacactctgctag

SEQ ID NO: 56050 - DNA, 735 bp, Artificial Sequence
  Description of Artificial Sequence: Synthetic coding sequence
atgaacccagtttattcacctgtgcagcccggagccccttacggaaatcctaaaaatatggcatacaccgggtatcccactgcgtacccggctgccgctcccgcttataaccctagtctgtatcctacaaattccccaagctatgcacctgagttccaattcctccacagcgcctacgctactttgctaatgaagcaagcttggccacagaattcctcttcctgcgggacagaaggtacattccatctccctgtggacactggaactgaaaataggacttaccaggcatcatcagcagcttttcggtacaccgctggcactccatataaagtgcctcccacgcaaagcaatacagcccctcctccttactctccttcacccaacccataccagactgccatgtatcccatccgctccgcctaccctcaacagaatctgtatgcccagggggcatattacacacagcctgtgtacgcggctcaacctcacgttattcatcacaccactgtcgttcagcctaatagcatccctagcgccatttatcccgctcccgtggcagcgccaagaaccaatggagtggccatgggtatggtcgctggtaccaccatggctatgtccgctggcacccttctcacgacccctcagcacactgcaataggcgctcaccccgtcagcatgccaacataccgggcacaaggtacaccagcatattcctacgtgccaccacactggtag

SEQ ID NO: 56051 - DNA, 708 bp, Artificial Sequence
  Description of Artificial Sequence: Synthetic coding sequence
atgaaccccgtgtatagtcctgtccagccaggtgcaccttatggcaatccaaaaaatatggcttatacaggctatccaacagcctacccagcagcagctccagcctacaacccatcattgtaccctacaaattcaccatcttatgcacccgctactctattgatgaagcaagcatggccccaaaattccagctcttgcggaacggagggtactttccatttaccagttgataccgggaccgagaatcgcacgtaccaagcctcatccgctgcctttcggtatacagccggaactccatacaaggttcctccgactcagtccaataccgctccgccaccctattctccctcacccaacccttaccagaccgcaatgtaccccattaggtcggcttatcctcagcagaacctctatgcgcagggcgcttattatacccaacccgtatatgctgcgcagccccatgtgattcatcacactacagtagtgcaaccaaattcaatccctagtgccatttatccagctcctgtagctgcaccgcgaaccaatggggttgcaatgggaatggtagctggcactacgatggcaatgtcagccggaactctgctcacaactccacaacacaccgccattggggctcaccctgtgtcgatgccgacttaccgagcacagggaacaccagcatactcatacgtacctccccactggtag

SEQ ID NO: 56052 - DNA, 390 bp, Artificial Sequence
  Description of Artificial Sequence: Synthetic coding sequence
atgaatccagtgtactccccagtccagcctggagccccatatgggaatcccaagaacatggcatataccggctaccccaccgcgtaccccgcagctgctcccgcttacaaccccagtctgtacccaacaaactccccgtcttacgccccagctactctcctgatgaagcaggcttggccacagaactcaagttcatgcggcaccgaagggacttttcacctgcctgttgatactggcactgagaaccggacttaccaggctagttcagcagctttctcgactctcctcacaacaccccagcatacggcaattggagcccatcccgtgagcatgcctacttatcgagctcaggggaccccagcatatagctatgtacctccccactggtag

SEQ ID NO: 56053 - DNA, 372 bp, Artificial Sequence
  Description of Artificial Sequence: Synthetic coding sequence
atgaatccagtctattcccccggttcttcaggggtgccctatgcgaacgcgaagggtatcggttacccggctggcttccccatgggatacgctgcagcagccccagcgtattctcctaacatgtacccaggagccaatcctacctttcagactggatacacaccgggtaccccttataaagtgtcctgcagccctactagtggggctgtacccccatacagctcctctccaaacgccgtacccatgtccccttgcgccgaccaatgggctcgtcagctgggacagatttcaggtcagcctttcgtgcttcttgctggtttgttatgttggcctcacggagaagcactggagtccctgatggattgcaattag

SEQ ID NO: 56054 - DNA, 588 bp, Artificial Sequence
  Description of Artificial Sequence: Synthetic coding sequence
atgaatccggtgtattccccagggagttctggagttccctatgctaacgctaagggaattggctatccagcgggattcccaatggggtacgccgctgccgctcccgcatactctccaaacatgtaccctggagccaatcctaccttccagaccggttacactccgggtaccccatacaaagtgtcttgctcccccaccagcggagccgtgccgccatattcttcttctcccaatccatatcagaccgccgtctaccctgttagatccgcctatccccaacaaagcccttatgcccagcaggggacatattatacacagccactgtacgccgcaccaccccacgtcatacatcatacaaccgtcgtccagccgaatggaatgcccgctaccgtgtaccctgcacctatccccccacctcggggaaatggcgtgactatgggaatggtggcaggcacaacgatggccatgtcggcagggaccctgctcactgctcactctccaactccagtagctccgcaccccgtcacagtgcccacttacagagctccagggacgccgacatatagctacgtgccaccgcaatggtag

SEQ ID NO: 56055 - DNA, 588 bp, Artificial Sequence
  Description of Artificial Sequence: Synthetic coding sequence
atgaatcccgtttactctcctggatcaagtggggtgccatatgctaacgccaaggggattggttatccagctggtttcccaatgggctacgccgctgccgctcctgcatattcaccaaacatgtaccctggcgcaaatcccaccttccagacaggctacaccccaggcacgccctataaggtgagctgctctccaacttcgggggctgttccaccctatagctcaagcccgaacccttatcaaacagccgtatatcccgtcagatccgcctatcctcagcagtccccttacgcgcagcaaggtacctactatacacagccactttacgccgctccgcctcacgtgatccaccacactaccgtagtgcagccgaacggcatgcccgctaccgtgtatccggcacccatacctccgccaagggggaacggggttacgatgggaatggtggccggaacaacaatggcaatgtcagctgggactttgctgaccgcacatagccccacccccgtggctccgcacccggtgaccgtacctacttaccgggctccgggaacaccaacttacagctacgtgccaccgcagtggtag

SEQ ID NO: 56056 - DNA, 384 bp, Artificial Sequence
  Description of Artificial Sequence: Synthetic coding sequence
atggcattcccagtggacatgcttgaaaattgttctcacgaggaactagaaaacagcgctgaggattacatgagcgatcttcggtgcggagatcctgaaaatcccgaatgcttttcgctgcttaacataacaatccccatcagtctgtccaacgttggatttgtgcccctatacgggggagaccagacacaaaagatcttggcgttgtttgctcctgaggattccttgactgccgtggccctctacctcgcggaccagtggtgggccattgacgatatagtgaagacctcagtgcctagccgggagggtctgaagcaggaagcttacgtgcctctgttcctccctaaagtaacaaattgtcagttcctgattcaatgtttctag

SEQ ID NO: 56057 - DNA, 2013 bp, Artificial Sequence
  Description of Artificial Sequence: Synthetic coding sequence
atggcttttcctgtagatatgctcgagaattgttcccacgaggaactggagaactccgccgaagattatatgagcgacctaaggtgcggagatcccgagaatccggaatgtttcagcctcttaaacatcacgatcccaatctctctgagcaacgtgggcttcgtcccgctgtatgggggagaccaaacacagaaaatcttagctttgttcgcccctgaagatagcctaactgcagtcgctctctacctggctgaccaatggtgggccattgatgacatagtgaaaacgtcggtgccgtctcgcgaaggtctgaaacaggtgtcaaccctaggggaacgggtcgttctctatgttctgaaccgtatcatttatcgtaagcaggagatggaacgcaatgaaatcccattcttgtgccatagtagtaccgattatgccaaaattctgtggaaaaagggtgaggccatcggcttttatagtgtgaagccaactggaagcatatgcgcctccttcttgactcagagctaccaactgcctgtgctcgataccatgttcctgagaaaaaaatataggggcaaggacttcggactgcacatgttggaggattttgtggactcttttactgaagacgccctaggacttcgatatccacttagttcactgatgtacaccgcctgcaagcaatattttgaaaagtaccccggtgatcatgaacttctctgggaagttgaaggagtgggtcactggtaccagagaatcccggtgacacgggcactacagagggaagctttgaaaattcttgctctttctcaaaacgagcctaaaaggcccatgagtggcgaatatggacctgcctccgtccccgaatatgaggcacggaccgaggacaatcagtcctcagagatgcaactgactatcgatagcctgaaggatgcatttgctagcaccagcgagggccatgataagacaagtgtgtctacacacactaggagcgggaatctgaagcgcccaaagatcggcaagcgcttccaggatagtgaattttcttcaagccaaggagaagatgaaaagactagccagacatcccttacagcctctatcaataagctggagtctaccgctcgcccatccgaaagttcggaggagttcctcgaagaggagccagaacagaggggtatcgaatttgaggatgaatcttcagacagagatgccagacctgccctggaaacccagccccagcaggaaaagcaggatggcgagaaggaatcggaattggaaccaatgaacggagagatcatggacgacagcctgaagaccagtctcatcacggaggaggaggattccacttctgaggtcctggacgaagaactcaaactccaaccctttaatagctctgaagacagcaccaaccttgtcccgctcgtcgtcgaatcaagcaaaccacccgaagtcgacgcgcctgacaaaacccctcgaattcccgatagcgagatgctcatggatgagggcacgtccgacgaaaaaggccatatggaagagaaattgagtctccttccacggaagaaagcgcatctgggctcatctgacaacgtcgccactatgagcaatgaagaacgctccgatggagggtttcccaactcggtcatcgccgagttctccgaagagccagtatctgagaatttgagtcccaatactacttctagtctagaggatcaaggcgaggaaggcgtgagcgaacctcaagaaaccagcaccgctctcccacaaagttccctgatcgaagtcgaactggaagacgtcccttttagtcagaatgctggtcagaaaaatcagtcagaagaacaaagcgaagcctccagcgagcaactggatcaatttacgcagtccgcagagaaggctgtggacagctcaagcgaggagatcgaggtggaggtgccggtagttgaccgaagaaatcttagacgtaaagccaagggacataaggggcctgctaagaagaaagcgaagctcacctag

SEQ ID NO: 56058 - DNA, 261 bp, Artificial Sequence
  Description of Artificial Sequence: Synthetic coding sequence
atggcttttcctgtggatatgcttgagaactgctcacatgaggaacttgagaattccgctgaagattacatgtccgatctgaggtgcggcgaccccgagaatcctgagtgcttctccctgctgaatattaccataccaattagcctgtctaacgtgggatttgttcctctgtacgggggagatcagactcagaagatactggcgctgttcgcccctgaggacagcctcaccgcagtcgcgctatacctggctgatcaatag

SEQ ID NO: 56059 - DNA, 672 bp, Artificial Sequence
  Description of Artificial Sequence: Synthetic coding sequence
atggcattcccggtggacatgctcgagaattgttcgcatgaagagctggaaaattccgcggaagactacatgtcggatctcaggtgcggagatccagaaaatccagaatgtttttctctgctgaacatcaccatcccaatttcattaagcaacgtgggcttcgtcccactctatgggggagaccagacccaaaagatcttagccctttttgcaccagaagactctctcactgcggttgccctttatttggccgatcagtggtgggcaattgatgacatcgtgaaaaccagtgtcccttcccgcgaaggcttaaagcaggtgagtaccttgggggagcgggtggtgttatatgtcctcaaccgcatcatctacaggaagcaggaaatggagagaaatgagattccttttctgtgtcactcgtctaccgattacgccaagatcctctggaagaagggggaggctatagggttctacagcgtcaagccaacgggcagcatctgtgcctcattcttaacccagtcctaccagctgcccgtacttgatacgatgtttctcaggaagaagtatcgtggtaaggactttgggttgcacatgctcgaagattttgtggattcttttacagaagatgcgcttggccttcggtacccactgagcagtctgatgtatacttag

SEQ ID NO: 56060 - DNA, 528 bp, Artificial Sequence
  Description of Artificial Sequence: Synthetic coding sequence
atggcctttcccgtggatatgctggaaaactgcagtcatgaagaactggaaaactctgccgaggattacatgagcgatctgcgatgcggcgacccagagaatccagagtgtttctctctgttgaatatcaccataccaattagcctgtccaatgtagggtttgtacccctttatggcggtgatcagacacagaagatcttggcgcttttcgcacccgaggactctttgaccgcagtcgcactctatttggcagatcaatggtgggcaatcgatgatatagttaagactagcgttccgagccgggaaggccttaagcaggtctctaccttgggcgaacgtgtcgtcctttacgtactgaacaggataatttacaggaagcaggagatggaacggaacgagattccttttctgtgtcactcatccacagattatgccaaaatcttgtggaagaagggcgaggctattggtttctactcagtcaagcccacagggtcaatttgtgcatcttttttaacccagagttactag

SEQ ID NO: 56061 - DNA, 579 bp, Artificial Sequence
  Description of Artificial Sequence: Synthetic coding sequence
atgaaggtgcagtctttcggggaaagggtggtcctcttcatccttaacgctatcatctttggacgcttagagcgcaacttggacgacgacgatatgttcttccttccacattccgtcaaggagcaggccaagatcttatggcggcgtggagcagcggtaggtttctatacgactaaaatgaagggccgtctctgcggggatggcaccggcgcatgctatctcctgcctgtcttcgacactgttttcatccggagaaaacactggcatcggggactcggcaccgctatgctgcgagacttttgtgagaccttccctgaagatgaggcgctgggggtaagctgtagcatgagccctgcgatgtatcaagctcaccctgggaatagcgaggacgtaagccggcacgccagaacatcccagaatgatagaccgcgtcagcctgcccctggcgatggatcaaaggaaaggatgtgcggcgaggagttggaagacactaaagacgaccctgaatgcggcgtcgaggaagaagacgccggactggcgggacagcctcccggaaaacttacacgctcaagcccttag

SEQ ID NO: 56062 - DNA, 579 bp, Artificial Sequence
  Description of Artificial Sequence: Synthetic coding sequence
atgaaggtgcagtccttcggagagcgggttgtgcttttcatcctgaatgccattatctttggtcgcctagagaggaacctcgacgacgacgatatgttcttccttccacatagcgtgaaagagcaggcaaagattttgtggaggagaggcgcagcggtcggtttctatacaaccaagatgaaagggagactttgtggagacgggaccggcgcatgctatctccttccagtatttgataccgtgttcatccgcagaaaacactggcaccggggtctgggaactgccatgctcagggacttttgtgaaacgttccctgaggatgaagctctgggtgtttcctgtagcatgtctcctgccatgtaccaggcccaccctgggaacagtgaggacgtgagtcgccacgccagaacatcgcagaatgatcgcccacgtcaaccagctcctggagacggcagcaaagagaggatgtgtggagaagagctggaggacactaaggacgacccggagtgcggcgtggaagaagaggacgcaggccttgctgggcagcccccaggaaagctgactcggagcagtccgtag

SEQ ID NO: 56063 - DNA, 990 bp, Artificial Sequence
  Description of Artificial Sequence: Synthetic coding sequence
atgaaacgtaggcagaagcgcaaacatctcgaaaacgaagaaagtcaggagacagcagagaagggcggaggcatgtcaaaatctcaagaagacgcgctccaaccaggcagtactcgcgtcgctaagggttggtcccagggtgttggggaggtgacgtccacgtcagagtactgcagttgtgtatccagctctcgaaaactgattcattccggcattcagaggattcaccgcgacagcccacaaccccaaagcccgcttgcacaggtacaggaacgcggtgagacccctccacggagccaacatgtttccctcagtagttacagcagctacaaaacgtgtgtgagcagtctgtgcgtgaataaggaggaaagaggcatgaagatatactatatgcaggtccagatgaataaaggcgtcgctgtgagctgggagaccgaagagaccctcgagagtctcgagaagcaaccccgaatggaagaagtcaccttatcggaagtggtcagggtagggacaccacctagcgatgtgtccaccaggaatttgctgtcagatagcgagccttccggggaagaaaaggaacatgaagaacgaaccgaatccgattccctgcctggaagccccacagtcgaggacacacccagggcaaaaacacctgattggttagtcactatggagaacggcttccggtgcatggcttgttgccgggttttcacaaccatggaggcccttcaggagcatgttcaattcggaatcagggagggcttttcctgccacgtgttccaccttaccatggcgcaacttacaggcaacatggagtcagaatcaacccaggatgagcaggaagaagagaacgggaacgagaaagaagaggaggagaagccagaggcgaaggaagaggaggggcaaccaaccgaggaagatctggggttgcggaggtcctggagccagtgtcctgggtgcgtgttccatagtccaaaggatcgaaactag

SEQ ID NO: 56064 - DNA, 849 bp, Artificial Sequence
  Description of Artificial Sequence: Synthetic coding sequence
atgaagagacgccagaagaggaaacacttggaaaacgaagagtcccaggagacagccgaaaagggcggaggcatacagagaatacatcgggatagcccgcagccacagagccccctcgcccaagtgcaggagcgtggcgagacaccaccccgttctcagcatgtctccctgtcgtcctatagttcttataaaacttgcgtctcgtccctgtgtgtgaataaggaggagcggggaatgaaaatctattatatgcaggtgcaaatgaacaagggagtggccgtgtcttgggagaccgaggaaaccctggagtccctggaaaagcagccacgaatggaggaagtcactctgtcagaagtagtgcgcgtgggaaccccaccatcagacgtaagtacgagaaatctgttaagtgatagcgaaccgagcggcgaggagaaagagcacgaggagagaactgagagtgactctcttcccggaagtcccacggtggaggacacccccagggcaaagacccccgattggctggttacaatggagaatggtttccgctgcatggcttgctgccgcgtcttcaccacaatggaggcactgcaagagcatgtgcagttcgggatcagagaggggttctcgtgccatgtttttcatctcactatggcacagctaacaggaaatatggagagcgagagcacccaagacgaacaagaggaagagaatgggaacgagaaggaggaggaagaaaaaccagaggctaaggaggaggaaggacagccaacagaagaggacttaggcctgcgcaggtcctggtcacaatgccctggatgcgtttttcatagtcctaaagaccgcaactag

SEQ ID NO: 56065 - DNA, 735 bp, Artificial Sequence
  Description of Artificial Sequence: Synthetic coding sequence
atgaaacgcaggcagaaaaggaagcacctggagaatgaggagtcacaggaaaccgctgaaaaggggggtgggatccagagaattcaccgggacagtccccaaccacagtctccactggcacaggtacaggaaagaggagagactccccctagaagccagcacgtcagcctcagctcctacagtagctacaaaacctgcgtctcaagtctgtgtgtaaataaggaagagcgagggatgaagatttactacatgcaggtgcaaatgaataaaggtgtagcagtctcgtgggaaacggaggagactctggagtccctcgagaaacagccaaggatggaggaggtgacacttagcgaggtcgtacgtgtcggcacccctccctccgatgtcagcactcgaaacctgctgtcagactctgaaccatctggggaggagaaagaacatgaggagcgcacagagtccgatagtctgccaggcagcccaacagttgaggatacccctagggctaagacgccggattggctcgttaccatggagaacggctttcgttgtatggcgtgctgtcgcgtatttacaacgatggaagccctgcaggagcacgtgcagttcggaattcgagaaggtttctcttgcccaaagatgtcaagacgcaggaagatggagatgagacgcagacgcaagcggaaccagaagcagcgccgtcggagaggttccccgcagaaaaagaccttggcctag

SEQ ID NO: 56066 - DNA, 993 bp, Artificial Sequence
  Description of Artificial Sequence: Synthetic coding sequence
atgaagaggaggcaaaagcggaaacacctcgagaatgaggaaagccaggagaccgcggaaaagggaggcggaatgagtaagtcccaggaagatgcccttcagcccggtagtaccagagtcgcgaaaggatggtcccaaggcgtgggtgaggtgacctccaccagcgaatattgtagttgcgtgagctcaagtcggaagctgatccattctggaatccagcggatccatcgagattcccctcagcctcagtcccctctagcccaggttcaggagcgaggcgagactcctcccagatcccagcacgtctccctaagctcctacagttcttacaagacatgtgtttcaagcctgtgcgttaacaaagaggaacggggaatgaaaatctactacatgcaggtgcagatgaacaagggagtggccgtcagctgggaaaccgaggagaccctggagagtctcgaaaagcagcctagaatggaagaggttaccctatctgaagtggttagagtggggacccccccttctgacgtgagcacacgaaatctcctcagcgactcagagccatccggagaggagaaagaacacgaggagcgcacagagtccgattccttacccggaagccctaccgtggaggacacacctcgagctaagactccggactggctagtaacaatggaaaatgggttcagatgcatggcttgctgccgtgtctttactactatggaggctctgcaggaacacgtgcagtttggcattcgagagggattttcttgccacgtgtttcatctcaccatggcacaactgacggggaatatggagagcgagagcactcaggatgagcaggaggaagaaaacggtaatgagaaggaggaggaggaaaaacccgaggcaaaggaagaggagggccagccaaccgaggaggacctggggctcaggcgctcttggtcccagtgtccaggatgcgtgttccactctccgaaagaccgcaactcgtag

SEQ ID NO: 56067 - DNA, 852 bp, Artificial Sequence
  Description of Artificial Sequence: Synthetic coding sequence
atgaaatgttactttaccgatcaccgaggcgaacagagccctacggatggtaccactctctctttaacttcccctgaatcgaccgaggaaagtgtggaagtgttctggccgggaactatccaacgggagggaagttcacctaggccgggtcccgctatacctcgggaagagggtctctatttcgccgctcgcgatcggggtatgcgcgattggtcttcttctccttcctctgagtcctcagagtatcagagttacagccagtatcaatcttgctgttcttgtatgtgcgacgaggataacgctgctcctcaaagcgtgtgcgccttctatacacacgtgcagacagtaagaggagtggctgtcgcctgggaaactgaagcagggttcgagccggtgacacggaagccgagaatccatgaggcacagttcatcaaacggcagcgttggaacgggagctcgttcgagatggcgagtaacacagatatgagatgggatctggaggcctgcaagagcaattgctctcccgagcccgaggacatcgatcttctggagtgctgcctgcaagagctgagagagccaccagactggctagtcaccactaattacggtgtgcgctgcgtggcatgctgccgagtcctcccatccctcgacgcactgcttgaacatgcccaacatgggatccgcgaaggcttttcgtgtcaaattttcttcgaggagatgctggaaagacgcagagcacagggtcaggctcacgaccaacagcttgaagaggagcagtctccttcagacaactctgaatgttcaaggccgcagggtgaggtcctgtccgcgcagcagcaagaaaagcagtag

SEQ ID NO: 56068 - DNA, 498 bp, Artificial Sequence
  Description of Artificial Sequence: Synthetic coding sequence
atggacgccccacgaagagacatggaactcctgagcaactctttggcagcctacgcacatattagagctaatcctgaatccttcggcctctactttgtgcttggcgtgtgtttcggtctcctcctcaccctgtgcctcctagtcatctcaatttcctgggctcccaggcctaggcctcggggacctgctcagaggagggacccccgtagttctacactggaacccgaggacgacgatgaggacgaagaggacaccgtgactaggctggggccagacgacacactgcctgggcctgagttgagtgccgagccagacggacctctcaatgtgaatgtgtttacatctgcggaggagctggagcgggctcagcgattggaggaacgcgagagaatccttagagaaatttggaggacggggcaaccagatttgttaggcacaggcacactgggcccatcccccactgccactgggacactcgggaggatgcactattactag

SEQ ID NO: 56069 - DNA, 711 bp, Artificial Sequence
  Description of Artificial Sequence: Synthetic coding sequence
atggaggtgggtctcccagcaatcactctatttttaacatccgccagctcgccagtagttgccacaaccatggatcaagagccagtgggaggagtggagcgcggtgaggctgtcgccgcttccggagcggcagccgcagccgcatttggcgagagcgccggacagatgtcaaacgagcgcggttttgagaacgtcgaattaggcgtgatcggcaagaagaagaaggtcccacgcagggtgatccactttgtatctggagagacaatggaagagtacagcacagatgaagatgaggttgacggcctcgaaaaaaaagatgtgctgcctactgtcgatccaactaagctgacctggggaccttatctttggttttatatgcttcgagctgctacctcaaccctgtcagtgtgtgattttctgggcgagaagattgcttcggtgctgggcatatcgaccccaaaatatcagtacgcaatagatgaatattaccggatgaagaaggaggaggaagaggaggaggaggaaaatcggatgtcggaagaggctgagaaacagtatcagcagaacaaactccaaaccgattccattgtccagacagaccaaccagaaacggtgattagttctagctttgttaacgtgaattttgaaatggagggcgattccgaagtgataatggaatcaaagcagaacccagtgtcagtccccccatag

SEQ ID NO: 56070 - DNA, 642 bp, Artificial Sequence
  Description of Artificial Sequence: Synthetic coding sequence
atggatcaagagcccgtcgggggtgtggaacgaggcgaagctgtggcggcaagtggagccgctgcagccgcagctttcggagaatctgctgggcagatgagtaatgaaagagggtttgagaatgtggagctgggagttatcggaaagaagaagaaggtcccaagacgggttattcattttgtgtctggggaaacaatggaagagtactctacagacgaggatgaagttgatggcctggagaagaaggatgtgcttccgaccgtggaccctaccaaactgacctggggtccttatctctggttctatatgttgagagcagctacctctactctgtcagtgtgcgactttctgggggagaagatcgcttcagtcctcggaataagcaccccaaaatatcaatacgctatcgacgaatattaccgtatgaagaaagaggaggaagaggaagaagaagagaaccgcatgtccgaggaagccgagaagcagtaccagcagaacaagcttcagacggactccatcgtacaaactgaccaacccgaaacggtcatttcatcgagcttcgtaaatgtgaatttcgagatggaaggcgattcagaggtgattatggagtctaagcaaaatcctgtgagcgtccctccatag

SEQ ID NO: 56071 - DNA, 642 bp, Artificial Sequence
  Description of Artificial Sequence: Synthetic coding sequence
atggatcaggaacctgttggcggagtcgaaaggggagaggccgtcgctgcttcaggtgcggcagccgctgccgcttttggcgagagcgccggtcagatgagtaatgaaaggggtttcgaaaatgtcgaactgggcgtgatcggcaagaagaaaaaggtgcccaggagagtgatacatttcgtgagcggcgaaacaatggaagagtactctacagatgaggatgaggtggacggtttagagaagaaggatgtgttaccgaccgtcgatccaactaagctgacatgggggccatatctctggttctacatgctaagagccgctacaagcacgctgagcgtctgcgacttcttgggcgagaagatcgcttcagtgctgggtatctccactcccaagtatcagtatgctatcgatgagtactataggatgaagaaggaagaagaggaggaggaggaggaaaatagaatgtctgaggaggccgagaagcaatatcagcagaacaagctgcagaccgatagtattgttcaaactgatcagcccgagacggtaatttcaagcagcttcgtgaatgtcaactttgaaatggaaggagattccgaagttataatggagtccaagcagaatcctgtgtcagtacccccatag

SEQ ID NO: 56072 - DNA, 231 bp, Artificial Sequence
  Description of Artificial Sequence: Synthetic coding sequence
atggaccaagaaccagtcggtggagtagaacgtggagaggctgtggcggcttcaggcgcagccgctgctgccgcattcggcgaatctgcgggacagatgtctaatgaacgagggttcgagaacgtcgagctgggcgtgattggcaagaaaaagaaagtacctcggcgtgtaatccactttgtgagcggtgagactatggaagagtattctactgacgaggacgaagtctag

SEQ ID NO: 56073 - DNA, 477 bp, Artificial Sequence
  Description of Artificial Sequence: Synthetic coding sequence
atggaaatagacgggttccagcagttggatcttgagaagtctgttccaagcaagaagacaactcctaagagaatcatccactttgttgacggcgacatcatggaagagtactctacagaggaggaagaagaggaggagaaggaagaacagtccactaacagcactctggatccaagtaaactgtcgtggggcccttatctgcgcttttgggcaggtaggattgccagtacctccttttccacttgcgagttccttgggggacgctttgcggtcttttttggccttactcaacccaaataccagtacgtgcttaatgagttttacagaatccagaacaaaaaaagtgataataagtcagagcgccgaggttccaaggctcaagcagccgaagtcccaaatgagaaatgccacttggaagctggagtgcaggagtatggcacaattcagcaggacgtgactgaagccatcccacagtag

SEQ ID NO: 56074 - DNA, 303 bp, Artificial Sequence
  Description of Artificial Sequence: Synthetic coding sequence
atggaaattgacggatttcaacagcttgacctcgagaaatcagtgccctcaaagaaaactactcctaagcggattatccactttgtcgacggtgatatcatggaagagtacagcacagaggaggaagaagaagaagagaaagaggagcaaagtacaaactcaacgctagatcctagcaagctaagctggggcccttatctgagattttgggctgggagaatagccagcacctcattcagcacctgtgagttcttgggcggtaggttcgccgtttttttcggcctgactcagcctaagtactag

SEQ ID NO: 56075 - DNA, 477 bp, Artificial Sequence
  Description of Artificial Sequence: Synthetic coding sequence
atggaaatcgacggattccaacagctggatctcgagaagagcgtgccaagcaagaagacaacaccaaaaaggataatccatttcgtggatggagatataatggaggaatactccacagaagaagaagaggaggaggagaaggaagaacaaagcacaaattccactctggacccttcaaagctttcctggggcccttatctacggttttgggctgggcgaatcgcaagcacatcattttccacctgcgagttcctcggcggtcgttttgctgtgttctttggtttaacccagcctaaataccagtacgtgcttaatgagttctacagaattcaaaataaaaagagcgataataaatcagaaagaagaggtagcaaagcacaggctgctgaagttccaaacgaaaaatgccatctggaggccggagtgcaggaatatgggacgatccagcaggatgtcaccgaggcgatcccccagtag

SEQ ID NO: 56076 - DNA, 300 bp, Artificial Sequence
  Description of Artificial Sequence: Synthetic coding sequence
atggagatcgatggttttcagcagctggacctggagaagtccgtgccaagcaaaaaaaccacacctaagcggatcatacattttgtggatggagacatcatggaggagtattcaaccgaagaggaggaagaagaagagaaggaggagcaaagcacaaactccactcttgacccctcaaaattaagctgggggccttatttgcggttctgggcaggcaggatagcctccaccagcttctcaacttgcgaatttctgggaggcagattcgcagtattttttggcctgacccagccaaaatag

SEQ ID NO: 56077 - DNA, 1944 bp, Artificial Sequence
  Description of Artificial Sequence: Synthetic coding sequence
atggccggacctcaagagactgtgctcgccctgccccttcgcgaaggggtccaggccgctgccactgttcccatcctgctgtacaatcttgaggacgggctgtccgatcacccactcgatcagggtccccgttgtcctgcgcgaaggccatgctccccagccagtgcaccagcaccaacgtccccaaagaaaccaaagatccaggccccaggtgaaacttttccgaccgactggtcaccgcctcctgtggagtttctgaaccccagagtactccaggcctctcgcgaagccccagcccagcgatgggtcggggtggtggggcctcaagggctgaggcgactggctggagaactacccgaggaactagaacaggaacacttggatctagacccaaaaagagggctggcattgcccgaaaagttattctggaacacgagtggcctgtcccagcaggctgccgctcctgaatttagctggggcggaagtgggagctacttcaacaacctggactacctcctgcaggagaaacgagaacaagctctggaacaggagcgggagcggctactgttacaggaatgtcttaatctcaattcactagacctggatgaggaggaggtgcctcttacgcccgagcacaggatgctggtagagaagtactcagtatcacttcagactatcccacccgtgcaccctggggaaactgtgttcctgccaagatgtcacccccttccttgcattctggattcgagccttctgaagcccagatcccacctggagggtctgtttctttcttccccacccgcacaacagttgagttttcttcgctcgggactgcttaatattctgtatctgcatatgccagactgcccggtttcgctgctgcaatggctctttcagctcttaacttggccacccgaaacgtcactgggagcttttggccttttatgggatttgattgtcgatgggatcttcttacagcccgatgaagacaagcatttatggtgtccctctttacaggaagtgcgggaggcattccactcactgggagctcactcacctgccctgtaccccctgggacctttctggcacggcggaagggtactgcctggtgaggctgggctgaatgaaaacgaggagcaggatgctccacaggagattgctttagacataagcctgggccacatttacaaatttctggccctatgcgctcaggctcagccaggcgcatacactgatgagaatttgatgggcctgatagagctgctctgtcggacgtcactcgacgttggactgcggctgctgccaaaagtggaccttcaacaattgctgctgctcttactggaaaatattcgagagtggcctggaaaactgcaggagctgtgttgtaccctgtcctgggtgtccgatcatcaccataaccttctcgcacttgtgcagtttttccccgatatgacaagccgtagccggcgtttgcggtcgcaattaagcctggtggtgatcgctagaatgctcggacagcaggagatgctccctctgtggcaggaaaaaacacaactttcctcattgtctcggctgctggggctcatgaggccaagcagcctgcgccaatacttagacagcgttcctttgcccccttgccaggaacagcaaccaaaagcaagcgccgaacttgatcataaagcatgttatttgtgccatagcttgctcatgcttgccggagtcgtggtctcgtgccaggacatcacccccgatcaatggggggaactccaactactttgtatgcagctagacagacatattagtacacagatccgagaaagccctcaagccatgcataggacgatgctcaaagatctggctacacaaacatatatccggtggcaggagctgctgactcattgccagccacaagcccagtatttttctccctggaaggacatctag

SEQ ID NO: 56078 - DNA, 360 bp, Artificial Sequence
  Description of Artificial Sequence: Synthetic coding sequence
atgcggcctagctcattaagacaatatctagactccgtgcctctgccaccttgccaggagcagcagcctaaggcctcagcagagctcgatcacaaggcttgctacctgtgccatagcctgctcatgctggccggagtagtggtttcttgtcaggatattacccccgatcagtggggcgaacttcagttgctttgtatgcagctggaccgacatataagcacccaaatccgcgaaagccctcaggctatgcaccgaaccatgctcaaagatttagccacacagacatatatcagatggcaggaactccttactcactgtcagccacaagctcagtacttctccccctggaaagatatctag

SEQ ID NO: 56079 - DNA, 2484 bp, Artificial Sequence
  Description of Artificial Sequence: Synthetic coding sequence
atggcccatgaacgagagatcctgaagggaatgtatgaagagttgaaagaaaaatctcacaagcctgatgtcgaacttatccaacacagagcatggcggattgatatggtttctactgagctggagtcttttcgaaaggcatcctatatcgagagtgggcctgaggagttctatcagcgattcaaaaagtgtttctcagctactcatatcttcatctcgattaagggtaaagattctcagaacaccgctcatggatacctaatactcaacagaacgcttcaccagcagctgaagattaagaacccatttctcgctcctagcagtgaagctgtcagaatccccgctacacttccacatcctggagcacttcctttccccccttatgtcgccaaggcttcatccgatgaactcctgaatctgcagaagcctctccagagtgccctgggctttgttattctgcggagctctcagaattggaacagcaagaatcggcagagatggtccaggaccaaggcgggtcagatgtcccatggcctccagatggccggtccacaggagaccgtactggctttgcctcttcgcgagggcgtccaggccgctgctacagtgcctatccttctctataaccttgaagacggcctcagcgaccatccccttgaccaggggcctcgctgtcccgcacgcaggccctgcagccctgcgtctgctcctgcgcctacatcaccaaaaaagcctaaaatacaggcaccgggtgaaacgttccccaccgattggagccctcctccagtcgaattcctcaaccctcgtgttctgcaggcatcgcgagaggctccagcccagagatgggtgggcgtggttggccctcaggggctccggaggctggctggcgaactgccggaggagttggagcaggagcacctcgatctcgacccgaaaagaggtctcgcccttcccgagaaactattttggaacacatctgggctttctcagcaggctgcagcccctgaattttcgtggggcggtagcggatcctatttcaacaacctggactacttactgcaggaaaagagagagcaggctttggaacaggagagagaaagactgctgctgcaagagtgtttgaatctgaattcactggacctcgacgaagaggaggtgccgctgactccggagcataggatgctggtggagaaatattccgtgagcttgcagacaatccctccagtccacccaggggaaacagtgttcctcccacgttgccatccactgccgtgcattctggacagcagcttgcttaagccacggtcccacctcgaaggcctgttcctgagctcaccacctgcccagcagctttcattccttaggagcggcctgctgaacatactctatctgcacatgcctgattgccccgtgtctttgctgcagtggctgttccagctgctcacgtggccacctgaaacatccttgggtgctttcgggctgctttgggacttgatcgttgatggaatattcctgcagccggacgaggacaaacatctgtggtgcccttccctgcaggaagtacgcgaagcttttcacagcctgggtgcgcattccccggcattataccctctgggaccgttctggcatggcggaagagtattgcctggggaggcaggactgaacgagaacgaggaacaggacgccccacaagagatagccctggacatttcactcggccacatctacaagtttctcgccctttgtgcgcaggcccaacctggagcctacacagacgagaacctcatgggcctgatcgaactcctgtgtcgtacatctctggacgtgggattaaggctgttgcccaaagtagacctccagcagctgctgcttctgttgctggaaaacattcgtgagtggcccggtaagctgcaggagttgtgctgtaccctatcgtgggtgtccgatcaccaccacaacctgctagccctcgtgcagttttttcctgacatgactagcaggagccggagacttaggtcacaactcagtctggtagtaattgcacggatgcttggccagcaagagatgctgcctttgtggcaggagaaaacccaattgtcctcactgagcagattgttaggtctaatgaggccctcttcacttagacaatatctcgattcggtccctctgcccccatgtcaggaacagcaaccaaaggctagcgcggaattagatcacaaggcctgctatctgtgccactctctgcttatgcttgctggagtcgttgtttcctgtcaggatataactccagaccagtggggagaacttcagctgttgtgcatgcagctggatagacatatttcaacgcaaatcagggaatccccacaggcgatgcaccggaccatgctgaaagatctcgcaacgcagacctacattcgctggcaggagttgctcacccactgtcagccacaagctcaatacttctcaccgtggaaggacatctag

SEQ ID NO: 56080 - DNA, 2040 bp, Artificial Sequence
  Description of Artificial Sequence: Synthetic coding sequence
atgtggccacggctccccggtgctggtctcgctcctcagttgagacgacaggatcagagattgcatttcacggggcaaatgagtcacggacttcagatggccggtccccaggagacagtccttgcattacccctgcgcgaaggagtccaggcagcggctaccgtgccaatcctgctctacaacctcgaggacggcctgagcgatcatccactggaccagggaccgaggtgtcctgcacgacggccatgctcacccgcatcagcccctgccccaacgtcccccaagaagcccaagattcaagcccctggggaaacatttcccactgactggtccccccctcccgtggagttcctgaatcctcgtgtgctacaggcatccagggaagcccctgcgcaaagatgggtcggcgttgttggaccacaaggcctccgcaggctggccggagaactgccagaagaactcgagcaggagcatttggacctcgatcccaaaagaggactcgctctccctgagaagctattctggaacaccagcgggttgtctcagcaagcagctgcgcctgagttttcttggggtggatctggctcctattttaataacctggattatctgctgcaggaaaagagagaacaggctctcgagcaagaaagggaacgccttctattacaggagtgcctgaacctcaattctttggatttagacgaagaggaagtgccccttacacccgaacaccgaatgctggtcgaaaagtactcagtctctttacagaccatccccccagtgcatccgggagagaccgtgttcttgcccagatgccaccctctcccatgcattctcgactcctcccttctgaaacccaggtctcacctcgagggcctgtttctgagcagtccgccagctcagcagctgagctttctgagatcaggactgttaaacattttgtacctgcacatgcccgactgtcccgtctccttgctccagtggctttttcagctcctcacttggccacctgaaacctcattgggcgcatttgggctgctttgggacctgatcgtggacggcatttttttacaacccgatgaggacaagcatctctggtgcccatctctgcaagaggtgcgtgaagccttccatagcctgggcgcacactcacctgccttataccctcttggtcccttttggcatggcggacgcgtacttcccggtgaggctgggctgaacgaaaatgaggaacaggatgccccacaagagattgctctcgatatctctctcgggcacatttacaagttcctcgcactctgtgcccaggcacaacccggtgcttataccgacgagaatctgatgggcctgatcgaactgctctgtaggacttcactggacgtcggactgaggctcctgcccaaagtggacctgcaacagctgctgttgctgctgctcgaaaatattcgggagtggccaggaaagttgcaggaactgtgttgcacactttcatgggtcagcgaccatcatcacaacttactggctttggtccagttttttccagacatgactagccgaagcagacggctgaggtcccagctatctctagttgtaattgccaggatgctcgggcaacaggaaatgctgcccctgtggcaggagaagacccaacttagttccctgagtaggctcctggggttgatgaggccaagttccctaaggcaatacctagactcagtgcctctgcccccatgccaggagcagcaaccgaaggccagcgctgaactggaccacaaggcctgttacctgtgtcacagcctgctgatgctggccggagtggtggtttcttgccaagacatcacccccgatcaatggggggagcttcagttgctatgtatgcaactggaccgccacatctccacccaaatccgggagtctccccaggccatgcatcggacaatgctgaaggacctggcaacccaaacctacatcaggtggcaggaattattaactcattgccagcctcaagcccagtatttttctccgtggaaggacatttag

SEQ ID NO: 56081 - DNA, 3060 bp, Artificial Sequence
  Description of Artificial Sequence: Synthetic coding sequence
atggggactagagacgatgtccctgaagcgaaggttctggttcctgttgccgtgtattgcggaagtatcccaaggacatccgccggaccccgagtgctcccacctggatctattaactcttcccttccccacggggagggctctctccagcccgaacctagagctctcctaaataacgaggagccctcgcagctcctgcggggactaggccaactggggggtctgaagctggacaccccttcaaagggatggcaagcacgtaacggccaccccagaaacctccgagccctgagcctgggagatcagccattagtcttattgccttcacccgaatctgaggccaattctgtggcccgtgatacaattcagattaaggataaactaaaaaagaggaggctcagcgagggcctggcagcctcttctcgggcttcactcgaccccggagggggacctcagggcgttcccctacattccaccatccctagagccacatcacagagactcttgagggtaccgagaccgatgcctctgatccaaagcatccctaccactcccgaggcatcaggcgtgaaggagaagggacttgatctgcccggttccataccagggccacacgagctccggcctggcgctcaggaagcacagatttcatggcagtacctgcactgcaatgacgaaaagatgcaaaagagcttgggcgcaattgttattcccccaattcctaaggccagaactgttgctgcaaccccttccagggtacctggcagtctgccatcccccttacctccgggtcagggtgtcctgaccggcctgagggctccgaggacaaggctggccagaggttcgggcccaagggagaaaacccccgctagtctggagccaaaaccattggcctcacccatccgggaccggccagccgctgccaagaagccagcactgcccttcagtcagtcggcccctactctcaccgcattctcgtttgattgtgccagggaagcttgcccccctctcaaggaagaagaccagaaagagatcgggacaaaaattcaagtgactatatcgaaatctgccagggaaaagatgcagctcaaacagatgaaggagatggagttactgcggagactggaagaaccaaggacaggacaagagttgacgagccagtgcctgggatcccagcgggcttttatgaaggagggtcttctgccattacgtggaagcggaactctcagcgttccaactcgcctgtctggaccttgccggaacgacgtctccattatcctaaggaagtgggccagccgtgcttctctgccgagcatacctatctcaagacaggagccacgctttgccaggcatgcttccgcaaatagcttgccagccgtactgaccctaggcagcccggaatgggaggaagaagaagagatggatcttcgggcatgcaaagagctccgtccatttagcaacccagaacttgggctccgagacgctctccagtgcctcaacagttcagattggcaaatgaaggaaaaaggtttggtgtccatacagagactggccgcatgccacagcgaagttctgacagggaagctgcatgatgtctgtctggtggtgactggagaggtgaccaacctccggtctaaagtgagccaccttgcaattagtacactgggtgatctcttccaggcactgaagaagaatatggaccaggaagcagaagagatcgccagatgcctgttgcagaaaatggcagacacaaacgagttcattcaaagggccgcaggccagagtcttcgcgcaatggtagagaacgtaaccctcgcacgcagtctggtggtgctgacgtcagcgggagtataccacagaaatccacttattcgcaagtatgccgcagagcacctatcggctgttcttgagcagattggagccgaaaagctgcttagcggtacaagggattctacagatatgcttgtccacaacctagtccgcttagctcaggatagtaaccaggatacccgcttctatggcaggaaaatggtgaatattttaatggctaacaccaaatttgatgccttcctaaagcagtcactcccaagctatgacctccagaaggtcatggctgccattaagcagcaaggaatcgaggacaacgacgaactcccctccgcgaagggccgaaaagtcttacgaagccttgtggtttgcgaaaacggcctaccaattaaggaaggtctgagctgtaatgggcctcgactggtgggacttcgctccacactgcagggcaggggggaaatggtcgaacagctcagggagctcaccagattgcttgaggccaaagatttccgatctcggatggagggagtgggacagttgctagagctctgcaaagcaaagaccgagctggtgactgcccacctcgtgcaggtattcgacgcattcactccacgccttcaagattccaacaagaaagttaatcagtgggccttagagtcattcgcaaagatgattccgctcctgcgggagagtctccatccaatgctcctcagcataattatcactgtcgcagataatctgaattccaaaaactcaggcatttacgctgcagctgtagcagtgctcgacgccatggtcgagtccctcgacaacctgtgtcttctgccggcactggccggaagggtgaggtttctcagcggccgagcagtactcgacgtaactgacaggttggctgtgttggtggcatcagtgtatccccgaaagccccaggcagtggagcggcacgttctgcccatcctgtggcactttctcaatactgccactcggaacggaaccctgcccggtccatcaggcaatattaggggcgttgtctgtaggctctccagaagcctccaggaacacatgggctcaaggctactcgactttgcggcttcccaacctaaacatgtgcttaaaaccctacaggaactcctggacagcgaatccctcgggggttctcggaaggcaaccgacaggggcgttgcccctgactcaaaaaccacaggctctagttatcctttccagttggattag

SEQ ID NO: 56082 - DNA, 2895 bp, Artificial Sequence
  Description of Artificial Sequence: Synthetic coding sequence
atgggaacccgcgacgatgtccctgaagctaaggtcctggtgccggtcgctgtgtattgcggctctatcccgcgaacttcagcgggtccgcgtgtgttgccccctggtagcattaactcctctctcccacatggagagggatctcttcagcctgagcctagagctctgctgaacaatgaagaacccagtcagctcctacgagggctgggacagcttggagggctgaaactggacactccttcaaaggggtggcaggctaggaacggtcaccctaggaacctgagggccctctccctgggggaccagccactggtcctcttgccatccccggagtccgaagctaattccgtagctagggacaccattcagattaaggataagctgaaaaaacggcgactcagcgagggacttgcggcatcctctagggcatcattagatcccggtggtgggccacagggagtccccctacactctacaatccccagggccaccagtcagagattgttacgggttcccagacccatgcccctgattcagagcatcccaactacccccgaagctagcggagtgaaagaaaaaggtctagacctccctggttctatcccaggccctcacgaactccgtcctggggctcaggaagcacagatctcctggcagtacctgcattgtaatgatgaaaaaatgcagaagtccctcggagcaattgtcatcccgcctatccccaaagcgagaaccgttgcggctacgccttctagggtacccggatcgctcccttcccccctgcctcccggacaaggagtgttaaccggattgcgagcgcctcgaacaaggctggctaggggcagcggacccagagagaaaacacccgctagcctagagcctaagccactagctagtccaattcgcgaccgcccagcggctgccaaaaagcccgcattgccattctcacagtctgccccaactctcaccgctttctcattcgattgcgctagagaggcgtgccctccattgaaggaggaagaccagaaggagataggcacaaaaattcaagttacgatatcaaagtcagcccgagaaaaaatgcagcttaaacagatgaaagagatggagttgctccgaagactggaggagccccgtaccgggcaggaactgactagccagtgcttaggaagtcaacgtgcatttatgaaagaggccaatagcctgccagctgtgctgaccctgggcagtcccgagtgggaggaagaagaggaaatggacctgcgtgcgtgcaaagagctgagacctttctccaatccagagctggggctccgtgatgcacttcagtgcttgaactcttcagattggcaaatgaaggaaaaaggtcttgtgtcaatacagcgcctcgcagcttgccatagcgaggtcctcacagggaaactgcacgatgtctgcctggtagtaacgggcgaggtgacgaacctgcgctctaaagtgagccacctggcaataagtacactgggcgacctctttcaggcgctgaagaagaatatggaccaggaggctgaggagatcgctcgctgtctgcttcaaaagatggcagatacaaatgaatttattcagcgcgctgctggccagtcccttagggcgatggtggagaatgtgaccctggctagaagtttggtggtcctgaccagtgcaggagtgtaccaccgtaacccccttatccgtaagtacgccgcagaacacctcagcgccgtgctcgaacaaattggtgctgaaaagttactttctggtactcgcgacagtacagatatgttggtgcacaaccttgtccgactcgctcaagatagtaaccaggataccagattctatggccgtaagatggtgaacatcctaatggctaatacaaaatttgatgccttcttgaagcaatctctgcccagttacgatcttcaaaaagtaatggccgcaatcaaacagcagggcatcgaagataatgatgaactgccatctgcgaaagggaggaaagtcctacggtcactcgttgtgtgcgaaaatgggctccccataaaggagggcctctcatgcaacggccctcggcttgtcggcttacggagcacactacagggtagaggcgaaatggtggagcagttacgggaactgacccggttattggaggctaaggattttaggtctaggatggagggagtcggtcagttgctggagctttgtaaagctaagaccgaactcgtgaccgcccatctggtgcaggtattcgatgctttcacacctaggctgcaagattccaacaaaaaagtcaatcagtgggctcttgagagcttcgcaaagatgattccactcttgcgcgagtctctccacccaatgttgttaagtatcattatcaccgtcgcggacaacctcaatagtaaaaattccgggatttatgctgctgcagtcgctgttctggatgctatggtggaatctttggacaatctgtgcctccttcctgctcttgctggcagggtgcgtttcctctcagggagggcagtcctggacgtgacagacagactcgctgtgcttgtcgccagcgtgtaccccaggaaaccccaggcagtggagagacacgttctgcctattctctggcactttctgaacaccgcaacacggaacggaaccttaccagggccatccggcaacatccgaggggtggtgtgccggctctcgcggtccctgcaggagcacatgggttcccgtctcctcgattttgcggcttctcagccgaaacacgtcctcaaaactttacaagaactgctggatagcgagtctctgggtggtagtcgcaaggccaccgaccggggagtagctcctgactctaagactactggcagttcatatcccttccagttggactag

SEQ ID NO: 56083 - DNA, 210 bp, Artificial Sequence
  Description of Artificial Sequence: Synthetic coding sequence
atgggaacccgggacgatgttccggaagctaaggtcctcgtgcccgtggccgtttactgcgggagcatcccacggaccagcgccggtccgagggttctcccaccaggttccattaattcgtcactgcctcacggggaaggatcgctccagccagaaccccgagccctgcttaacaacgaagagcccagccagctgttgagaggtctgtag

SEQ ID NO: 56084 - DNA, 5162 bp, Artificial Sequence
  Description of Artificial Sequence: Synthetic coding sequence
atggccgcagccccttctgctcttctcctgctgccaccttttccagttttgtctacttaccgactgcaaagcagaagtcggcctagtgctcctgagaccgatgatagcagggttgggggaattatgcggggtgaaaagaactactacttccggggagcagccggtgatcacggatcctgtcccactactacgtccccgctggcaagcgcactcctgatgccttccgaagcagtgtcatcttcttggtcagagagtggcggtggactcagcgggggagatgaagaagacacacgactcctgcagctattaaggacagcccgtgatcccagtgaagccttccaggcactacaggcagccctgcctagaaggggcggtcggcttggcttccctagaaggaaggaagccctttacagggcactgggtcgggtgttggtggaggggggttcagacgagaaaaggctttgcctgcagttgctgtccgatgtactgcgcggacagggggaagctggccagctggaggaagcattttctcttgcgctcttaccccagctcgtggtgtctctccgagaagagaatccagccctgcgtaaagatgccctacaaattctgcatatatgcctgaaacggagccctggagaggtcctgcgtaccttaatccaacagggtttggagtccaccgacgcccgtctccgcgcttcgacagccctactcctgcccatactgctcaccacagaggatctgctcttaggcctcgatctcactgaagtgatcatcagtctagcccgaaagttaggtgatcaggaaacagaggaggagagcgagaccgcgttcagtgcactccagcaaatcggagaacgcctcgggcaggaccgttttcagtcctatatctccagactgcccagcgctctccgaaggcactacaataggaggctcgaaagccagtttggttcacaggtgccctattacctggagctggaggcaagcggcttccctgaagaccccttgccgtgcgccgtcactctgtccaactctaacctcaaatttggcataatcccccaggaactgcactctagactgttggaccaggaagactacaaaaatcggacccaggccgtcgaggaactgaagcaggtgcttggaaagtttaatccatcaagtacaccacattctagcctggtcggctttattagcctgctctataaccttctggatgactccaattttaaagtcgtccacggaacactggaagttcttcacctgttggtaatccgacttggggagcaggtacagcagtttctgggccctgttatagcagcttctgttaaggttctcgccgacaacaagctggttattaaacaggagtacatgaagatctttcttaagttgatgaaagaggtgggccctcagcaggtgctctgccttttacttgaacatcttaagcataaacactctcgagtccgggaggaggtcgttaacatctgcatctgttcattgctgacctatcccagtgaagatttcgacctgcccaagctttctttcgatttagcaccggcattggtcgattctaaaaggcgcgttcggcaagctgccttagaggctttcgcagtacttgcctctagcatgggaagcgggaagacctccattctctttaaggctgtggataccgtggagctacaggacaacggggatggggtgatgaatgctgtgcaggcccgacttgctaggaagaccttgcctaggttgactgaacagggttttgtggagtacgcggtactgatgccatcttctgcagggggacgatccaaccaccttgctcatggcgctgataccgattggctgcttgcaggaaataggacccagagcgcccattgccattgcggtgaccacgtgagagattctatgcatatttatggctcttacagccctactatctgtacccggagggtcctttcagccggaaaaggaaaaaacaaattaccatgggaaaacgaacagcctggtatcatgggtgagaaccagacctcgacatccaaagatatcgagcagttttccacttatgatttcatcccaagtgctaaactgaaactgagccagggcatgccggtgaacgatgatctgtgctttagcaggaagcgggtgtctcggaacctgtttcagaactcacgcgattttaatccggactgtttgccactgtgcgcggcaggaacaactggcacccatcagactaatttgagtggcaagtgcgcacagctcgggttctcccagatttgtggcaaaacaggctccgtcggcagcgacctacagtttttgggaactacttcaagtcatcaggagaaggtgtatgcaagccttaatttcggatcgaagacacagcagactttcggctcacagaccgagtgcacctcgtcaaatggccagaacccctctcccggtgcttacattttaccatcatatcctgtgtcatccccacgaaccagcccgaagcatacaagccctctgatcatatcaccgaagaagagtcaggacaatagtgtgaattttagcaacagctggccgctgaagtccttcgaggggctctctaagccaagccctcagaagaagctcgtttcccaaaagtctagcgacccgactggtcgtaaccacggcgagaatagtcaggaaaagccgccagtccagcttacaccggctcttgtccgatcaccctctagccggcgaggtcttaacggtacaaagcccgtgcccccaatcccacgcggaattagcctcctgcccgacaaggccgatctgagtaccgtcggccacaaaaagaaagagcccgacgacatctggaaatgcgagaaagattccctccctatcgacttgagtgaactcaactttaaagacaaggacctcgaccaagaggaaatgcactcatccctgaggtctttgcggaattccgccgcaaagaagcgcgcaaagttatcaggtagtacctcggatctggaaagtcccgacagtgccatgaaactcgatttgacaatggattccccatccttatcatccagcccaaatataaatagttattctgagtcaggtgtttactcacaggagtccctcacatcgtctctgtcgacaactccacaggggaaacgaattatgtcggacatatttcctacgttcggcagcaaaccatgtcctacaagactatcctccgctaagaagaagatcagtcacatcgcagagcaatccccctccgctggtagttcaagcaacccacagcagatctccagctttgactttactactaccaaagccctgtctgaggattccgtggtggtggttggcaagggcgtatttggaagcctgtcatccgccccagccacatgctcacagagcgttatctcctcagtcgagaacggcgacaccttctctatcaagcaaagcatcgagccaccttcggggatctacggtcgatctgtgcagcagaatatctcctcttatttggatgtggaaaacgagaaagacgcaaaggtgagtatcagtaagagtacatataacaaaatgagacaaaaacggaaggaagagaaagaattgttccacaacaaggattgcgagaaaaaagagaagaattcttgggagagaatgaggcacacaggaactgaaaagatggctagcgaatccgagacacccactggcgctatctcccaatacaaagagcgtatgccctccgtcacacactcccccgagataatggacctctccgagctgagacctttttccaagcccgagattgctctgactgaggcgctaaggttgcttgctgacgaagactgggaaaagaaaatcgagggccttaactttatacggtgtctcgcagcttttcattctgaaattctgaatacgaagctgcacgagaccaatttcgcggtggtacaggaggtcaaaaacctgaggtccggagtatctcgggcagcagtggtgtgcctgtcggaccttttcacctatttgaaaaaaagcatggaccaagaactggataccacagtgaaggtactactgcacaaagctggcgagagcaacacctttatccgcgaggacgtggataaggcactaagggccatggttaataacgtcactcctgcgagagccgttgtctctctaatcaatggcggacagcgctactacggaaggaaaatgcttttctttatgatgtgccatccaaatttcgaaaagatgctcgagaaatacgtacccagcaaagatctgccttatattaaagatagtgtgcgcaatttacagcagaaaggactgggagaaatccccttggatacccctagcgccaagggaagaaggagtcataccggtagtgtgggcaatacacgcagttcctcagtctctcgagacgcttttaactccgcggagcgagccgtgacagaggtacgcgaagtgacaagaaaaagtgtccccaggaattcacttgagagcgcggaatatctgaagttgattacaggtcttttgaacgctaaagatttccgggatcgaataaacgggattaagcagctgttgagcgatacggagaataatcaggatctggtggtgggaaatatcgtcaaaatctttgacgccttcaagtcacgactgcatgattcaaattccaaggtaaacctcgttgctctggagactatgcacaaaatgataccactgctgcgagatcatctgtcccctatcattaacatgctgattccagccatcgtcgataataacttgaactccaagaaccccggaatttacgcagccgcaacaaacgttgtacaggctttgtcacagcacgtagataattacctgttacttcagcccttctgtacgaaggctcagttcttgaacggtaaggctaagcaggatatgacagagaagttagcggacattgtgacagaactataccagcgaaaaccacatgccactgagcagaaggtcctggtggtgctgtggcatctcttaggtaacatgacaaacagtggttccctgcccggagctggaggtaacatcaggacagcaacagcgaaattgtctaaggctttatttgcccagatgggacaaaaccttttgaatcaggccgcatctcagcctccgcatatcaaaaaaagtcttgaggaactgctcgatatgactattctgaacgagctcta

SEQ ID NO: 56085 - DNA, 2988 bp, Artificial Sequence
  Description of Artificial Sequence: Synthetic coding sequence
atggccgctgctccaagcgctctcttgctgttgcctccgttccctgtgctgtccacctacaggctgcaatctagaagccggccaagcgctcctgagactgatgattctcgcgtgggtggaatcatgcgaggtgaaaaaaattactactttcgcggagctgcgggtgaccatggttcttgcccgaccactaccagccctctcgcatcggccctcctcatgcccagcgaagcggttagttcatcctggtcagagtccgggggaggactctctggcggtgatgaggaggataccagactgctccagctcctccgcacagctcgagacccatcagaagccttccaggccttacaagccgctctgcctcgcaggggaggccgtctcggattccctcgtcgaaaggaggcgctgtatcgcgcattgggccgtgtgctggtcgagggcggttcggatgagaaaagattgtgtctgcaactactgtccgacgttctgagagggcaaggagaggcaggtcagctggaggaagcattttcacttgctcttctgcctcagctagtagtgtccttgcgagaggaaaaccccgctctgcgcaaggatgccctgcagatcctgcacatctgcttgaaaaggagccctggtgaagtcctcagaacattgatccaacagggacttgagtccactgatgcccgactaagagcctctactgctttattactgcctattctgttgacaacagaggatcttcttctaggactggacctgacagaggtgattatcagcttggcacgaaagttgggagatcaggagaccgaagaagagtcagaaaccgcctttagcgcactgcaacaaattggagaaagactcggccaggacagattccagagctacatatccaggctgccttccgcccttcgacgccattacaatcgcagattggagtcacagttcggctctcaggtgccatattatctggaactggaagctagcggcttccctgaggaccccctgccgtgcgcggtgacgctatctaactccaacttgaagttcggaattatacctcaggagctgcactctagactcttggatcaggaagattacaagaaccgcactcaggcagtggaagagttaaagcaggttctaggtaagtttaaccctagctcaacccctcacagttcccttgtggggttcatttcacttctctataacctgctggacgacagtaattttaaagtagtgcacgggacactcgaggttcttcacctcctggtaatccgccttggcgaacaggtgcaacagttcctcggtcccgttattgctgcttccgtgaaggttctggcagacaataagttagtgataaaacaagagtatatgaaaatcttcctgaaactgatgaaggaggtcggcccacagcaggtcctctgcttgctcttagagcatcttaagcataagcattccagggtgagggaggaggtagtgaatatttgcatctgcagtcttctcacctatcccagcgaagatttcgatctgcccaagctgtcattcgatttggctccagccctcgtggattcaaaacgcagagtgagacaagcagccctggaggccttcgctgtgttggcctcttctatggggagtggtaaaacatctatcctgtttaaggcagtggatacagtagagctgcaggacaacggtgatggtgtcatgaacgctgtccaggccagacttgccagaaaaaccctgccccgactcactgagcaggggtttgttgaatacgctgttctgatgccgtcctccgcagggggtagaagtaatcatctagcacacggggcagatacagactggcttcttgcaggtaaccggacacagtctgctcactgccattgcggcgaccacgtgcgcgattccatgcacatatatgggagctactctcctaccatttgtacccgcagggtactatctgcgggaaagggaaagaataagttaccctgggagaacgagcagccaggaatcatgggcgaaaatcagacctccaccagtaaggacatcgaacagttcagtacttatgactttatcccaagtgccaaacttaagctgtctcagggtatgccagtgaatgacgatctgtgcttcagccggaagagagtgagccggaatctgttccagaacagtcgcgattttaatcccgattgcctgccattgtgtgccgcaggaacaaccgggacccaccagaccaacctgagtggaaagtgcgctcaactgggtttttctcagatttgtggaaagactgggagtgtaggctctgacctacagttcctggggaccacctcatctcatcaggaaaaggtttatgcatccctgaactttggatccaaaacacagcagacttttggaagccagaccgagtgcacctcctcaaacgggcagaacccttcacccggtgcgtacattctgccttcttacccggtgtcatcaccacggactagccctaaacatacatccccccttattatcagccctaaaaaatcccaggacaactccgtaaacttctctaattcctggccactcaagtccttcgaaggcttgagcaaaccctcaccccaaaaaaagctggtatcacagaagagtagcgaccctaccggtagaaatcatggcgaaaattctcaagaaaaacccccagtgcagctcacacctgcactcgtgcgctctccgagctctagacgtggcctgaacggtactaagcctgtcccccctataccacgcggtatatccctgttgcccgataaggctgatctgtctactgtgggacataaaaagaaagagccggatgacatttggaaatgtgaaaaagactccctgccaatcgacttatccgagctcaatttcaaggataaagacctcgaccaggaagaagtgcgacacatctccaatatttgggtgaagacactctcaaacaaaacttttttctgtaaagagaagaatttttcttattgttag

SEQ ID NO: 56086 - DNA, 3483 bp, Artificial Sequence
  Description of Artificial Sequence: Synthetic coding sequence
atggccgcagctccttcagcattgctgctcctgcccccattccccgttcttagtacctacaggttacagagcagaagccggccttccgctcctgagacggacgacagtagagtggggggaattatgagaggtgaaaagaattactatttccgtggggcagctggggatcacggaagttgtcccactacaacaagcccgctggcctctgccctgcttatgccctcagaagcggtaagtagctcctggtccgaaagcggaggcggactgagcggaggtgacgaggaagacacccgcctgctccagctgctgagaacggccagagaccccagtgaggcttttcaagccctgcaggctgccctgccacgcagaggtggaagactgggatttcccagacgtaaggaagcattgtaccgagccttgggacgagttttggtggagggtgggagcgacgagaagcgcctctgcttgcagctcctctcggacgtcctacgtggccagggcgaggccggacagctggaagaagctttctctcttgcgttgctaccgcagctagtagtttctctgagagaggaaaaccccgctctaaggaaggacgctctgcagatcctgcacatatgcctgaaacggtctcccggagaggtgctgcgaacgctgattcagcaggggctcgaatccacagatgccagactgcgggcaagcaccgccttgctgctcccaatactgcttaccactgaggacctgttattgggcttggatcttactgaggtaatcatttccctggccaggaagcttggcgatcaagagaccgaagaggagtctgaaaccgcattctcagctctgcagcagatcggggaacgcctggggcaggaccgcttccagtcctacataagccggcttccatccgccctgcggagacattacaatagaaggctggaaagccagttcggatcccaggttccctactatttggaactggaggccagtggcttcccagaagaccccctcccctgcgccgtcactctgagcaattctaatttgaaatttggcattatcccccaggagttgcactcccgacttcttgaccaggaagattacaagaaccgcactcaggccgtggaggagctgaaacaagtgctcggaaagttcaacccttccagcactccccactccagcctggtggggtttatttcactcctgtataaccttctcgacgattctaacttcaaagtcgtacatggaacgctcgaggtgcttcaccttctcgtgatacggctcggtgaacaagtgcagcaatttttagggccagttattgccgcaagcgttaaagtgctcgccgacaacaagcttgtaatcaagcaggagtacatgaagatctttctcaagttgatgaaggaggttggccctcagcaagtgctttgtcttctgctcgagcacctgaagcacaagcactctagagtcagagaggaagtcgtcaacatatgtatttgtagtctcctcacctatccgtcagaagattttgacctgcctaagttatccttcgacctggctccagcactcgtggactccaagcgcagagtgaggcaagccgctctcgaggctttcgccgtactagctagctccatggggagtggaaagacctcaatattattcaaggctgtggacactgtagagctgcaggacaacggagacggcgtcatgaacgctgttcaggcccgactagctcgcaagaccctgccccgtctgacggaacaggggttcgtggagtacgctgtcctcatgccatcatctgcaggtggcaggagcaatcacctcgctcacggcgcagataccgactggctgctggcaggtaatcgcacccagagcgcacactgccattgcggggaccacgttcgcgactccatgcacatctatgggtcatactctccaactatctgtacccggagggtgctgtctgctggtaaggggaagaacaagctcccttgggagaatgagcagcctgggatcatgggtgaaaaccagacgagcacttccaaggacatcgaacaattcagcacatacgactttattccatccgctaagctaaagctctcccagggaatgccagtcaacgatgacctctgcttctctaggaagagggtgtccaggaatctgtttcagaattctagggatttcaaccccgattgtttacctctgtgtgctgctggcaccaccggtacccatcagacaaaccttagcggaaagtgtgcccagctgggatttagtcagatctgtggcaaaaccggaagtgtcggatccgacctccagtttctgggaacaacttccagtcaccaagagaaagtttatgcgagcctcaattttggatcaaaaacccagcagacatttggcagtcagacagaatgcacatcctcaaatgggcagaacccgtcccccggtgcttacattttgccttcttatccagttagcagccctagaactagccctaaacacacctcacctctgatcatctcacctaagaaatcacaggacaactctgtgaacttcagtaactcctggcctctgaagtcattcgagggactgagtaagccatcccctcagaagaaactggtgagccagaagtcctccgatcccaccggccgaaatcacggcgagaacagccaggaaaaaccgccagtccagctgacacccgcactggtacggtctccatcttcccggagaggattgaatgggaccaaacccgtaccgcctatccccagagggatctccctccttcctgataaggcagatcttagcacagtgggccataaaaagaaagagcctgacgacatctggaagtgcgagaaagattcgctccctattgatctgtctgaactgaactttaaggataaggacctagatcaggaggagatgcatagcagtcttcggagcctgcgcaatagcgccgctaagaaacgggctaaacttagtggctctaccagcgatttagagtcacctgatagtgcgatgaagctggatttgactatggacagccccagtctgtcatcgagtcccaatattaactcctacagtgagtcaggtgtctatagccaggaatcgcttacaagctctctcagcacaactccacaggggaaacggattatgagtgacatattcccaacattcgggtcaaagccctgtcctacacgcctaagttcagccaagaaaaagatatctcacattgcggagcaatccccctctgcagggtcttccagcaacccgcagcagatctccagcttcgactttactacaaccaaagcactgtcagaagatagcgtggtggttgtgggcaagggtgtcttcggctccctgtcatcggcgccagctacatgcagtcaatccgtgataagctccgttgaaaatggagatacgttttctattaaacagagcatcgagccgccttccggcatctatgggcgatccgtacagcagaattttatcatcagttag

SEQ ID NO: 56087 - DNA, 1032 bp, Artificial Sequence
  Description of Artificial Sequence: Synthetic coding sequence
atgaagctcctacagatgctcttgcggggaaatccttgctgcccacagcccgagatctcaccccaagggagttctgtcccttttttaggggcagccggtcatcagcagtccttgccctcttcatggaaggcttcatgtagcggacctctcgtgatggcatccgactccgatgtgaaaatgcttcttaattttgtcaacctcgcctcaagcgacataaaggccgcactcgacaaatccgctccctgtcgccgttcggttgatcacaggaagtacctgcagaagcagcttaaacgcttttctcagaagtatagtcgactgcctcgaggcctgcctggtcgggctgccgagccctacctcaagagaggatctgaggatcgccctagacgacttctgctcgacctgggtcctgactcctcgccaggaggcggaggagggtgtaaagaaaaggtcctgaggaatccgtacagagaagagtgcttggccaaggagcaacttccgcaacgccagcatcccgaggctgcacagcccggacaagtacccatgagaaagcgacagttgcccgcaagtttttgggaagaacccagacctacccattcctaccacgttggccttgagggaggacttggcccacgggaaggtcccccatacgaaggtaagaagaactgcaagggcctggaacccctgggacccgagactactctagtcagcatgtcccctagagcgctagctgagaaagaaccattaaaaatgcccggagtaagcctagtggggcgtgtgaatgcttggtcatgttgcccattccagtatcatggtcaacctatataccccggtccacttggtgcacttccacagagccccgtacccagcctcgggttatggcggaaatcacctgccttcccaggtgagttagcacacctgtgcaaggatgtggatgggctgggccagaaagtctgccgcccagtcgtgctgaagccaatacccactaaaccagctgtgccaccaccaatcttcaatgtcttcgggtacctttag

SEQ ID NO: 56088 - DNA, 1065 bp, Artificial Sequence
  Description of Artificial Sequence: Synthetic coding sequence
atgccgcttgaagagagacgatcaagtggggaacgtaacgatgcagcgccaactaatcatcgcaggcccggagaaaagcgggcttctaccgccaagcaagtttcctccgtcccgttcctgggggcagcaggccaccagcaaagtctcccatcgtcctggaaagccagctgcagtggccctctcgttatggcctccgacagtgatgtgaagatgctgctgaatttcgtcaatctggcatcctccgatatcaaagccgctctggacaaaagcgcgccttgcagaagaagcgtggaccatagaaagtacctgcagaagcagctaaagcgcttcagccagaaatactcgcggcttcctcgcggacttcctgggagagccgctgaaccttatttaaagcgcggttccgaggaccgaccgaggaggctgctgttggacctcggcccagattcttctcctggtggaggcggtggctgtaaagagaaggtcttgcgtaacccataccgggaggagtgcctcgccaaagagcagttgccccaaaggcagcacccagaggcggctcagccagggcaggtccccatgcgaaagagacagttgcctgccagtttttgggaggaaccacgaccgacccacagttaccacgttggcttggagggcggactgggccctcgtgaaggaccaccttatgagggtaagaagaactgtaaaggattagaaccccttggacctgagacaactctggtctctatgagcccccgtgccctggcagaaaaggagccactaaaaatgccaggagtctccttggtgggtcgagtgaacgcttggtcctgttgtccctttcagtaccatggccagccgatttatcctggaccacttggggctcttcctcagagtcccgtcccatcactcgggctttggagaaagtctccagcgttcccaggtgaactggcgcacctgtgtaaagatgtcgacggcctgggccagaaagtctgcaggcctgtggtacttaaaccaatacctactaaaccagccgtgccaccaccgatctttaatgtttttggctatctgtag

SEQ ID NO: 56089 - DNA, 699 bp, Artificial Sequence
  Description of Artificial Sequence: Synthetic coding sequence
atggcctctgattctgatgtgaagatgctcctgaacttcgtcaatctggcttcctctgacattaaggccgctctcgataaatccgccccatgccgtcgaagcgttgatcataggaaatatctgcagaaacagctgaagagatttagccagaaatatagccggctgccacgaggtctgcctggcagggcggctgagccgtacctgaagagggggagcgaggaccgaccaagacggttgctcttggatctagggcctgactcttccccaggtggtggcggtggctgtaaggagaaggtgttgcgcaatccataccgggaggagtgcctggccaaagagcagttgccccagcgtcaacatccggaagccgctcagcctgggcaagtccccatgcgcaagagacagctgcctgcaagtttctgggaggagccgcgacccacacactcctatcatgtgggactggaaggcggtctcggccctcgcgaagggcctccatacgagggcaaaaaaaattgcaagggcctggagcctctgggacctgagactacgctcgtgtcaatgtcacctcgggctttggctgaaaaggagcccctcaaaatgcccggagtgtctctggttggcagagtgaacgcatggtcgtgttgcccattccaataccatgggcagccgatctatcccggacccttgggggcactgccctag

SEQ ID NO: 56090 - DNA, 879 bp, Artificial Sequence
  Description of Artificial Sequence: Synthetic coding sequence
atggctagtgatagcgacgtgaaaatgctcttgaacttcgtgaacctggcttcctcagatatcaaagccgctctcgacaagagtgccccatgccggaggtcagtggaccacaggaagtatctacagaagcagctgaagcgcttctcacagaagtattctcgcctccctaggggcttgccaggcagggctgcagaaccatacctcaagagaggctcagaagaccggcctcggagattgctcctcgatttagggcctgatagctctccaggcggaggaggaggttgtaaagaaaaagtgcttagaaatccctatagggaggagtgtctggccaaagaacagctgccccaacgacaacaccctgaggccgcacaaccaggacaagtccctatgagaaagcggcagcttcctgctagtttctgggaagaacccagaccgacgcatagttaccacgtgggccttgaagggggtctcgggcctagggagggacccccatacgaagggaaaaaaaattgtaaaggactggagccgttagggccagagaccacattagtttcaatgtctccacgcgcactggccgagaaggagccactgaagatgccgggagtctcattggtcggccgtgtcaacgcatggtcttgctgtcccttccagtatcacggtcaaccgatctacccagggcctctgggggctcttcctcagagtcccgtaccttcactgggcctgtggcggaagagccccgctttccctggggaactggcccatctgtgcaaggatgtggacggattaggccaaaaagtctgccgacccgtagtcctaaagcctatccctacaaagcccgcagtaccaccgcctatctttaacgtgtttggctacctctag

SEQ ID NO: 56091 - DNA, 879 bp, Artificial Sequence
  Description of Artificial Sequence: Synthetic coding sequence
atggcgagcgatagcgatgtaaaaatgctgctaaattttgtgaatctagccagcagcgatatcaaggccgctcttgacaagtcggctccttgcaggaggagtgtggatcacaggaagtaccttcagaagcagctgaagcggttcagccagaaatattccaggctccccaggggtctgcccggacgtgcagccgagccttacttgaaaagggggtccgaggacagaccaaggagattgcttttggacttgggtcctgatagctcgcctggcggagggggtggatgtaaggagaaggttctgcggaacccatatcgagaagaatgcctggctaaagagcagctgccacaacggcagcatcctgaggctgcccagcccggacaggtgccaatgcggaagcggcagcttcccgcatctttttgggaggagcctaggccgacccactcttatcatgtggggctggaggggggtctcggccctagggagggcccaccctacgaaggcaagaagaactgtaagggtctggagcctttgggcccagagactacccttgtaagcatgtcccctcgagccctggcagagaaggaaccgctgaaaatgcccggagtgtctctggtgggaagagtcaatgcttggagctgctgcccatttcagtaccatggacagcctatctatcccggtcccctcggggcattgccccaaagtcccgtgccatcgctcggactctggaggaaatcccccgcattccctggggaactggcccacctgtgcaaagacgttgatggtctcgggcagaaagtttgccggccagtcgtgcttaagccaatccccacgaaaccggcagtccctcccccaatattcaatgtctttggatacctctag

SEQ ID NO: 56092 - DNA, 1281 bp, Artificial Sequence
  Description of Artificial Sequence: Synthetic coding sequence
atggcggtccaggccgctcttctgtccactcatcccttcgttccttttggattcggtggctccccagacggtctgggaggtgctttcggggcactcgataaaggctgctgttttgaggacgatgaaacgggggctcccgcaggagcccttttgtcgggagccgagggtggtgacgttagggaagccacaagagatctgctgagcttcatcgattcagcctctagtaacatcaaactggctctggacaagccaggcaagtccaaacggaaggtgaaccatcgcaaatacctccagaaacagattaagagatgttcagggctgatgggcgcagcccctcccggacccccaagcccttccgccgctgataccccagccaagcggccactggccgctccttctgccccaaccgtggctgccccagcgcatggaaaagctgccccacgacgcgaggccagccaagctgccgctgcagcttccttacagagcagatccctggccgcactgttcgactctttgaggcatgtgccgggaggagctgaacctgccggaggcgaggtcgcggcaccagccgctggtctgggcggagctggcacaggtggggcaggcggagacgttgccggaccggcaggcgctactgccattccgggagccagaaaggtccccttaagggcgaggaatctgccgccatcctttttcaccgagcccagccgggctggaggtgggggatgtgggccttcgggcccagacgtgtccttgggcgacctggagaagggagctgaggctgttgaatttttcgagctgctagggccagactacggcgcaggcaccgaggctgccgtgctgctagcagcagagcccctcgacgtttttccggcaggggcttccgttctgcgaggtccacccgagctcgaacctggcctgtttgagcctccacccgctgttgttggtaacctgctgtatccggagccctggtcagtgcccggatgctcacctaccaaaaagtctccattgaccgctccacgcggtggcctgaccctgaacgagccgttgtccccactttacccggcagccgctgatagtcccggtggagaggacggtcgcggacatttggcttcattcgcacctttcttccctgactgtgccctcccccctcctccccctccccaccaagtaagttatgattactcggctggctatagtcgaaccgcttattctagcctctggaggtccgacggagtgtgggagggcgctcctggggaggagggagctcatagggactag

SEQ ID NO: 56093 - DNA, 465 bp, Artificial Sequence
  Description of Artificial Sequence: Synthetic coding sequence
atgcaggggatcgatcggtggattccaagcatcccgccattgcagaatcacagcgccgtgaacaggagacacttttccgccccacagaaactgcatgcagactgtgaaaaagagatgcttgatggcggtgtgccgggaaccaccgtccgtgtcagtttcgattttagctgtctggaaatggtgcgggaactatggatgtggaatgtggaggaggaagagcacgaggtgggaattagcacctggggcggtcagcactgtggatgccctgccaaaagcttgcccggaccccaccctggaggtgtgtccgctccgcaaagtgcatctcagttgatggtcaagctgctggtgtggcagaaatccgtgcacaagctccgtaaaattgctgctcagtctgaagaatggtcctgcgttctgaacaaaatctctacccatcccttcgtgtcaaaggagcacgacggtacatag

SEQ ID NO: 56094 - DNA, 234 bp, Artificial Sequence
  Description of Artificial Sequence: Synthetic coding sequence
atggtcagggagctgtggatgtggaacgttgaggaggaggagcacgaggtcgggatctccacatgggggggacagcactgcggttgccccgctaaaagccttcccggaccacatcccggaggagtatcggcccctcagagcgcatctcagctgatggtcaagctgctggtctggcaaaaaagcgtccataaactgaggaagaaccggaatgcttattcctgtgggccactatag

SEQ ID NO: 56095 - DNA, 234 bp, Artificial Sequence
  Description of Artificial Sequence: Synthetic coding sequence
atggtcagggaattatggatgtggaacgtggaagaagaggagcatgaggtgggcatctgtacttggggcggacagcactgcggctgccccgctaaatccttgcctggccctcatccaggaggcgtgtcagccccacagtctgcatcccaactcatggtgaagctacttgtgtggcagaagtccgtgcacaagctgaggaaaaatcggaatgcctattcctgtggcccactttag

SEQ ID NO: 56096 - DNA, 405 bp, Artificial Sequence
  Description of Artificial Sequence: Synthetic coding sequence
atggcagggcacccgaaggagaaggttataccagatgaagtgcaccagaaccaaatcttgagagaactgtatctgaaggaactgagaactcagaagctgtacacccagtaccatgtcaaccctctgcgcaagatccatactgttaccaggaagccgatgagctggcatgataacttggaagagcccgctgacgcgcgattccttaacctgattcaccacgccgcacaaggcccacgaaaaaaatatccagaaacgcagactgagaaccaggaggtgggatgggacctcgagccccttattaacccggagagacacgaccggcgactgaatcattttcgagtatgttctgacataacgttatacaaggccaagacttgggggctgggtgatgatcatcataagtag

SEQ ID NO: 56097 - DNA, 3423 bp, Artificial Sequence
  Description of Artificial Sequence: Synthetic coding sequence
atggcgacaccgggtatgtcgtggcagcagcattattacggcggaagtgctgctaaatttgctccctctcctgccaccgctcagctggcaggccactccatggactactcccaggagatgcacttgaagatgtctaagaagatcgcccagctcactaaagtgatttatgctctaaacacaaagaacgacgagcacgaatctgctatccaggctttgaaagatgcccacgaggaggagatccagcagatcttagctgaaactagggagaaaattctgcagtataaatcaaaagttaccgaggagctagatttaagacgcaaaattcaggtactcgagtctagtttagaggaccatatcaagatgaagcagcaagcgctgacggaattcgaggcgtataagcacagggtcgaggacatgcagctgtgtgccgaggcccagcatgtgcagaggatcgtgacgatgtctagagaagtggaggagattcgacgcaaatttgaggagaagctgcgcagcttcggccagctacaggtccagttcgagaaggataagagactcgctctcgaggacctgcaggcagcccatcgccgagagatacaggaactgctgaagagccaacaggatcactccgctagcgtgaacaaggggcaagaaaaagcagaggaattgcacaggatggaggtggagtcactgaataaaatgctcgaagagctaagattggagcgtaagaagctcatagaagactacgaaggaaaactcaacaaggcgcaaagtttttacgagagagagttggacactctgaagcgctctcagctgtttaccgctgagtctctgcaggcttccaaagaaaaagaggcggatctccgcaaagagtttcagggccaggaagcaatcttgaggaaaactattgggaagctgaagacagaactccaaatggtacaagacgaggccggttccttgctcgataaatgccagaagcttcaaacggccttagctatcgccgaaaacaatgtgcaggtgctacagaaacaactggatgatgcaaaggaaggcgagatggccctgctctccaagcacaaggaagttgaatcagagctggcggctgccagggagaggctgcagcagcaggcgagcgatctcgtcctcaaggctagtcacataggaatgctgcaagccacacagatgacccaggaggttaccatcaaggacctcgaatcagaaaagagtagagtgaatgagcgtctgagtcagttagaggaagagcgggcatttctacgctctaagactcagtcccttgatgaggagcagaaacaacaaattctggagctcgaaaagaaggtgaacgaggctaaaaggacacagcaggaatattacgagcgggaacttaagaatttacagtccagattggaggaagaggtcacacagctcaacgaagcacattccaaaactctagaagagctggcttggaaacaccacatggcaatcgaggctgtgcacagcaacgccatcagggacaagaaaaaactccagatggatctggaggagcaacataataaagacaagctgaatctcgaagaagacaagaatcagctgcaacaggaattagagaatctcaaggaagtccttgaggataagcttaataccgctaatcaggagattggtcaccttcaggatatggtacggaagagcgagcaaggtttgggaagtgccgaaggactcattgccagcctccaggactctcaggaacggctccaaaacgagttggatctgaccaaggattcactgaaggagaccaaggatgccctactgaacgtagagggggagcttgagcaggagcgacagcaacatgaggagactatcgctgccatgaaagaagaggagaagctaaaggttgacaaaatggcccatgatttagagataaagtggacagagaacttgcgacaagaatgctccaagcttagggaggagcttcgtttgcaacacgaagaggataagaagtctgcaatgagtcaactgttacaactgaaagacagggaaaagaacgccgcaagggattcttggcaaaaaaaggtcgaagatcttctaaaccaaatcagcctgctaaaacagaatctggaaattcagctgtctcagtcccaaacttctttgcagcagctgcaagcccaattcactcaagagcgccagcgacttacgcaggaactcgaagaactggaagaacagcaccaacaacggcataaatccttaaaggaggcacatgtcctggccttccaaaccatggaggaagagaaggagaaggaacagcgcgcactggagaaccatctccaacagaagcattctgcggaactccagtctctcaaagatgctcatagagaaagcatggaaggttttaggatagagatggaacaggagcttcaaaccctgcgattcgaattggaggatgagggcaaggcaatgttggccagcctgcggtccgaattgaatcatcaacacgccgcagccatagaccttctgagacacaaccatcaccaggaactcgccgctgcaaagatggaactggagcgatcaattgacatatccagacggcagtcaaaggaacacatctgcagaataaccgatctgcaggaggagctgcggcaccgggagcatcacattagtgaactggacaaagaagtgcagcatctgcatgagaatattagtgccctaacaaaagaactggagtttaagggtaaagagattctgcgaatcagaagtgagtcaaatcaacaaattcgtctgcatgagcaggacctcaataaacggctcgagaaggaattagatgtgatgactgccgaccatctgagagagaaaaatatcatgcgagctgattttaataaaaccaacgaacttctcaaggaaattaacgccgcattgcaagtgtcccttgaagaaatggaagagaaatatctcatgagggagtctaaaccagaggacatccaaatgataacagagctgaaagcgatgttgactgaaagggatcagattatcaagaagttgatagaagataacaagttttatcaactcgagcttgtgaacagagaaacaaattttaataaggtgttcaacagttcacccacagtcggtgtcattaacccccttgccaaacagaagaaaaagaacgacaagagccctacaaatcgattcgtgagcgttccgaacctgtctgccctagaatcaggcggagtcgggaatggccaccccaatagactggaccctattcccaattcgcccgtgcacgacatagagttcaattcctccaaaccattgccacagcccgttcctcccaaaggccctaaaacattcctcagtcctgcccagagcgaggctagccctgtggcttccccagacccgcagcgccaggagtggtttgctaggtattttacattttag

SEQ ID NO: 56098 - DNA, 2916 bp, Artificial Sequence
  Description of Artificial Sequence: Synthetic coding sequence
atgaaacaacaagctctgactgagtttgaagcatacaagcaccgcgtggaggatatgcagttgtgcgccgaggcccagcacgtccagcgcatcgtgacgatgagtcgggaggtggaagaaatacgcagaaaatttgaggagaagctacgctccttcggccaacttcaggtacagttcgaaaaagataaaagactggccctcgaggacctccaggcagctcaccgcagggagatacaggagctgctgaagagccagcaagaccactctgccagcgtgaacaagggacaagagaaagcagaggaacttcacagaatggaggtggagtcattaaacaagatgctggaggagttgaggcttgagagaaagaagctgatcgaggattacgagggcaagttaaacaaggcccagagcttctacgagcgagagttagatacattgaagaggagccagctgtttacagccgagtccttgcaggcttcgaaagagaaagaggctgatctcagaaaggaattccagggacaggaggccatcctgcgaaagacaattggtaaacttaagaccgaactgcaaatggtgcaggacgaagctggcagcctgctggacaaatgccaaaagttgcaaaccgccctggcgattgccgaaaataacgtacaggtgctgcagaagcagttggacgatgccaaagaaggggagatggcactactcagcaaacacaaggaggtggaatcagagctcgccgctgccagagaacggttacaacagcaggctagtgacctagtcctcaaagcaagccacattggaatgctacaggcaacgcagatgacacaggaagtcactattaaagacctggagagcgagaagagtcgagtgaacgagcgtctctcccaactagaagaggagagggcctttcttcggtcgaagactcagtcccttgacgaggagcagaagcaacagatcctggagctggagaagaaagttaatgaagctaaaagaacacaacaggaatattatgaaagggagttgaaaaacttgcaatccagactggaggaagaagtcacacagctcaacgaagctcattcgaaaacactggaagaactggcctggaagcatcacatggcaatcgaggctgtacactctaatgccatcagagacaaaaaaaagttgcagatggaccttgaagagcagcacaataaggataagctgaatctggaggaggacaaaaaccagctgcagcaggagttagaaaacctgaaggaagttctggaggataagctcaatacagccaatcaggaaatcggccatcttcaggatatggttaggaaatctgagcagggcttgggttcggccgaagggttgatcgcgtctctccaggactcacaggagcggctgcagaatgagctggacctcaccaaagacagtctaaaagagaccaaagacgccctcttgaatgtggaaggtgagctggaacaggaacggcagcagcacgaagagactattgcagctatgaaggaagaagaaaagttgaaagtggacaaaatggcccatgacctcgaaattaagtggaccgaaaacctgcggcaggagtgcagtaaactacgggaagagctcagactgcaacatgaagaagacaagaagtctgccatgtcgcagctacttcaactcaaggatcgggagaaaaatgccgctagggattcttggcaaaaaaaggtggaggatctcctcaaccagatctcactcctgaaacagaatctggagatccaactgtcgcagtcccagactagcctgcagcagcttcaggcgcagttcacacaagagaggcaacggctgactcaggaactggaggaactggaagagcagcatcagcagcgtcacaaatcactcaaggaggcccacgtgctggcttttcaaacaatggaggaggagaaggagaaagaacagagagcgttggagaaccatctgcaacagaaacatagcgcagagctgcagtcgctcaaggatgcccacagggagagtatggagggttttcgaattgaaatggaacaagaactccaaacgctccgctttgagcttgaagacgagggtaaagctatgctcgctagcctgagatcagaactgaaccaccagcatgcagcggctattgacctgctgcggcacaatcaccaccaggagttggccgctgctaaaatggaactcgaaagatccatcgatatatcaaggaggcagtctaaagagcacatctgtagaattaccgacctgcaggaagagttaaggcatagggagcaccatatcagcgaactagataaagaagtccagcatttacacgagaatatctccgcgcttacaaaagagttggaatttaaaggcaaggaaatccttaggatccgcagcgagtctaatcagcagatccggttagaagaaatggaggagaagtaccttatgagagagtcaaaacctgaggacatccaaatgatcacagagctgaaggcgatgctgacagagagggatcagattatcaagaagctgatagaagataataagttctaccaacttgaattggttaatcgggagaccaactttaataaggtgttcaattcgtcgcccaccgttggtgttatcaaccccctagctaagcaaaaaaaaaagaatgacaagagcccgactaaccggttcgtaagtgtgccaaatctgtcagcattggagtccgggggtgttggcaatggccatccgaatagactggacccaatacccaacagtccagtccacgacatcgagtttaacagctctaagcctctgccccagccagtgccacccaaaggtcctaagactttcctatcccctgcccagagcgaagccagtcctgtcgcatcacctgaccctcagagacaggagtggttcgccaggtactttactttttag

SEQ ID NO: 56099 - DNA, 3183 bp, Artificial Sequence
  Description of Artificial Sequence: Synthetic coding sequence
atggcctcggctctcaatagcaagattaatcctcctggaacgtgccaggggagcaaggccgatggcggagcgggatggaggatggattgcgacccacagatgcacgtgaagatgtgtaaaaagatcgctcagctaactaaagtgatttacgccctgaacacccgacaggatgaggcggaggccagcatggaagctctgcgtgaagcccaccaggaagagctccaaaacgccgtggcggagactaaagccagactcctgcaggagcaggggtgtgctgaggaagaggcactgcttcaacgcattcaggccctggaatccgctctggaactgcaaaagaggctcaccgaggaggctttggccgaaagcgcctcttgccgactggaaactaaggagagagagctgcgggtggaggctgaacatgccgagcgtgtcctgaccctgtccagagagatgcttgagttaaaggccgactacgagaggagactgcagcacctgacttcacacgaagcgactccccaggggaggctaccccaagagagccccgagacaaagtcagaacccggacaagggcctgagatgcaggaagttctgctggaggtgcagcgcctgagggtggaaaatcagcagctgtcaaaagattatgcgcgtaaagctgaggagttacaggctacctatgagcgggagaatgaggccatcaggcaagccatgcagcagagcgtgtcacaggccctgtggcagtggcaggagaaagaaagcgacctgaggaaaaattttcaggtgcaggagagtgcgctgcaggctcaggtgcgtaagctggaaggggatctcgaacatagaggaagaaaaattagcgacctcaagaaatacgcccaaaagctgaaagagcggattcaggacttggacgtgcaactcaaagaagcacggcaggaaaattctgaactcaagggcacagctaaaaagctcggggagaagctagcagtcgccaaagaccggatgatgttgcaagaatgcaggggaacccaacagacagacgccatgaagaccgagcttgtgagcgaaaataaagtactcagggaggagaacgacctcgaggccggtaatctccacccccagcaggaccagagctgtcttaaggaatgcccctgcatgaaaggagggacagatatgcaaacaaagaaggaggcgtctgcagagactgaatacatgaagcaacagtatgaggaggatctccgaaagatcaagcaccagacggaggaggaaaaaaagcacctcaaggatcagctggtcaaaagactcgaagacctggtgaaaaagcacactgtggaaattaaatcagtacggtcatctgtggaggccgaaaggaagaagctgcagcgagaggtcgaggcccagctggaggaagttcgtaagaaatcggagaaggagattaaacaactggaggaggaaaaggccgctctgaacgtgaagctgcagaacagcttgttggaagtgttgcgtctggaagaattcattcaacagaataaaactcgccctactggcgctgaggagtcaccccaggagctgggtaggcaacattgcagcatcctggagacgcaggatccatgcctgaagttggacgaaacatcccctcggggtgaagaataccaagataaactggctgctgaggaaggcacgtcatccgatgaggaagaacgcactaaggttctgcttaaggaagggtcggatccgcagccccctttgggcagcctgctgaaagagaagactagcaagattcaaagacttgaggaagattggcagtcccaaaaggccaagctgcaggcccaagtctctcagatgcagcaggcacttgaacaatgcactagcaactaccgggaagacctgcaagctcttaaacagctgagtgaccttgagcgcgaaaagcttcagagagaactgcaagagacaacccagcagaaccacgccatgaaagcccagcttgaagcatctcatcagagagccttgaggatgttagaaaaggctcggcaccaggaattaaaggccaccgaggagaggctgaagaaagaatcaagtcacagcctgcagatccagcatcagactcacaggctcgagctacaggcgcttgaagagaaggcgaggcaggagctgcaggaggagcgggagagaatgcaggctcagcaggctctcctgctggagtctctacggcaggagctttccgagcaacaggctgcttgcagtggccatcagaaggatttagaagctttacaggctgagctcagagccttaggccgacagcaagcctcctctcagtgtccaggtgattccaaggaccacatcattgccactgaggaacggggaggaccaggtcaggccggttctccgccaggagccgcaggacaggggagtggcgaggggtgtggcctttgggaagagaacgcacagctgcaagacgcagtccgccgtctacgggcagaagtggaacagcatcagcaagaagcccaaaaacttcgcgaccagcggagatttctggaggagacgcagcaggctcaaagagctcgcgaggtcgaaaccctgcgtcaagaacaccgcaaagagatgcaggccatggtggccgatttcagtagtgcccaagctcagctgcaggctaggctggccgcattggaggccgagctgaaagactcgggcgagaagcccggaaagggcgcttccagacctgaggatctgcagctgatcggcagactgcagactcgcctgaaagaaagagaggatattattaagcagctcacagaggagagacgtttccactatgctgcctttccaagtgcgatgtcacataggaacagaagcttttcattcaacccacacccgggatacctcacaccttcaatgaaaaagaaaaaagttgaggacgtcccatctagagtcgttagtgtcccaaatctcgcaagctacgctaagaattttctctctggggacctttcttcacggatcaatgcccctccgattaccaccagcccttcactggacccctcaccttcctgcggtagaacatataagccaaatcagtctaccgacgctaaaaccgccacacgcacacctgatggtgagacggcacaggctaaggaggttcagcagaagcagggatcacctcatcaagagtggttcacgaagtattttagcttttag

SEQ ID NO: 56100 - DNA, 828 bp, Artificial Sequence
  Description of Artificial Sequence: Synthetic coding sequence
atgttggccccttgctcaggttgggaactggggtgctttagactatgtctacgccaggtgcggttgtgggccggtgccggtcgatgggcctgctgggcctgccaggcgagaccctattcttcaggaggatcagagcgctggccgggttccgagacagaggtgcctcccccaggcccaggacggagaaccctgaaagaatggacgctgcaggggcagaaactccacgtgcagaccaagggcggtaaagtcatatgcctgggcactgtgtacggcaacattgacatccatgcgtcagataagtcagcagtaaccatcgacaagctgcaaggctcctccgtaacggtcagcacagaggacgggctgctcaaagctaagtatttgtacactgagagcagctttctaagctcggcagccggtgacatcactctcggatccgtacatggaaacattactctgcagtctaaaatgggcaacattacggtggattcatcatccggatgtctgaaagccagcactaaccagggtgccattgacgtatacgtatctcaactgggtaaggtcgaattaaagtcccataagggtagcataattgtcaaggtcccaagctctttgcaggcccatctgcaactgtccggcaaagaggtcgatgtgaattctgaggtgcatgtgcaagagatggctgaggtgcgcaaagacgatgtcgtgactgttaccggactgatgaaccaggcttccaagcgggaaaaatggatcaaagcagacgcaccgaaaggtactgtcagctttagacgccaaagctggtttcagtccctaaagctccaggattag

SEQ ID NO: 56101 - DNA, 1179 bp, Artificial Sequence
  Description of Artificial Sequence: Synthetic coding sequence
atgctggccccttgttccggttgggaactgggctgcttccgattgtgcctcagacaggttcgcctgtgggccggagccggtcgctgggcttgttgggcctgccaggcccgaccatattccagtgggggttcagagaggtggccaggttctgagactgaggtgcctcctcccggacccggacgccgtaccctgaaagaatggacactgcaagtgagcccctttggcaggctcagggctcgtttgccctgtcatctggctgttcgacctcttgatccgttgacctatcccgatggggaccgggtattggttgcggtgtgcggagtggaggggggagtgcggggtctggatggtctccaggttaaatatgatgaagatctggaggagatggccattgtgagtgacacaatccatccccaggcctcagtagaggtgaatgctccgctgaagttcggcctggacatcaagagttccgggtccgggtgcgtgaaagtacagtcaatcgagggcgacaactgcaagatcgaaactgagcacggtaccagcatactacaatccgtgaaggggcagaagctacatgtccaaacaaagggaggcaaagtcatttgtttgggaaccgtatatggtaacatcgacatacacgctagcgataagagcgctgtaacaatagataaactccaaggttctagtgtgacagttagcacggaggacgggctgttgaaggctaagtacttgtacaccgagtcatcattcttatcatctgccgctggggatataacattgggtagcgtgcacggaaatattaccttgcagtccaagatgggtaacataactgtcgacagtagctccgggtgcttgaaggccagtaccaaccagggcgctattgacgtgtacgtatctcagctcggcaaagtggagctaaagtcccacaagggatcgatcattgtaaaggtcccaagcagcctccaggcacatctccaactatcaggcaaggaagtggatgtgaacagtgaggtgcatgtgcaagagatggcagaagtcagaaaggatgacgtggtgacggttactggacttatgaaccaggcttccaagcgggagaaatggattaaagcggatgccccaaagggcaccgtcagtttccgacgccagtcttggtttcagtctctgaagttgcaagactag

SEQ ID NO: 56102 - DNA, 900 bp, Artificial Sequence
  Description of Artificial Sequence: Synthetic coding sequence
atgtttaggaccccctcacaagccaaccgcctcgctttggtcagcgcaaaccctgacctaagactcttatttgacttgaggagacattccggacaagtggactggccgtggcaggtcactctgccagtggccgagggagtggatacagccggactggacatcaagagctcaggctccggatgcgtgaaagtccaaagcatagagggcgacaactgcaagatcgagaccgaacatggtacctctatcctccagagcgtgaaagggcagaaactccacgtgcagacaaagggcggtaaagtcatctgtctcggcactgtgtacggaaacatcgacatccacgctagtgacaaatctgcggtaaccatcgataaactccaaggttcttccgtgacagtaagcacggaggacggtcttctgaaagcaaaatacttatatacagagtcttccttcctgtcctccgccgcaggagatattacacttggttccgtgcatggcaacatcacactccaatctaagatgggcaacattacagtggattcttcctctggctgtctgaaggcaagtaccaatcagggagcaatagatgtctatgtctcccaactcggcaaagtggaactcaaaagccacaaagggtcgattatcgttaaagtcccatcctctcttcaggcccacttgcagttgtccggaaaagaggtggacgtgaattcggaagtccatgtccaggaaatggccgaagtccggaaggacgacgttgtgacagtgacagggctgatgaatcaggcctcaaagcgcgaaaaatggattaaggccgacgctcctaagggaacagagtggtccaggagtcacatcctgctgtcacaggcttcacgttgtctggctgcctccacattcagtccttag

SEQ ID NO: 56103 - DNA, 7055 bp, Artificial Sequence
  Description of Artificial Sequence: Synthetic coding sequence
atgttctttaagatgaaaaacgagatagacaatgaccctgagtccgagaagtgcattaaagatagtactatcatgaggagagagccgcagaacattctatcacctctcatgttgcctaatctggaaatccctttttctgtgaaggatatcataagcagaatagagcgcgctcaactgcaccgggctcgggaagacattgacatgcaactttccgaaataatgaacaatgtacacagaatcatgacccgctatactctggtgtttaactcctcttccgagcgcaatgtgagtctgacagaacacaagaagaaacagcggacaaacttcctggagaagatggcgacatacgcaaaaaccattgagattagagagaagaccctggctaacatacttgcctggctggaggagtggaatgacgtgctgagtgaaatgactctgatggatgtggacgagcaccatcactggattgcccagatggagttgctgcccgataccttgaaagccatcgaaaacaacgtgaagattttgtcacggttctcaacatctttcttggatgaaaaaaagaagcagaagaagaagatcttatcacgcggaactctatggaagagctggaaggaacgagtgatcaaaagaccgtcaactgccagggccctgcgacctgaccagatgatcagtgatcagctcgctacgaacacgaaagtgtctgaaattcagggaatgctccaggagctgattggtaccacaatgttttccactctagaaaataatgctatcaagtatatatccagcaccatcgtgaacctgtcgaccgctctaagtatgttgaacgatgaattgaaatgtgttaatttccagtcatcgacagtgtatgctcatgaaactagcgaagccgagaaagagctgtctctgaagattatccgagacttaagtaacgaaaacgaaatgttacagcagaaactacaggacgccgaagagaaatgtgagcaactaattaggagcaaaatcgttattgaacagttgtatgccaaactctccacaagctccactctgaaagtgctccccggtccaagtcctcaaagttctagagctatcattaaggtgggcgacactgaggataatatggacaacattctggacaaagaactggagaacatagtcgacgaagttcagcgcaaggagacaaaagatagcggtattaagtgggacagtacaatctcttatactgcacaggcggaacgaacgccggatctcacagagctgcgccagcagccagttgcatcagaggatatctccgaggattccacgaaagacaacgttagtctgaaaaagggtgacttctaccaggaagacgaaacagacgaatatcagtcttggaaacgaagccacaagaaagccacatacgtttatgagacctccggacccaatctttccgacaacaaaagtggacaaaaggtttcggaggccaaaccgtcacaatattatgaattgcaggtgctgaagaaaaagagaaaagaaatgaaaagttttagtgaggacaagtccaaatcgccaaccgaagccaagcgaaaacacctgtccctgacagaaacaaagagccagggaggaaaatctggcacaagtatgatgatgctcgaacagtttagaaaggtgaagcgggaatcgccattcgacaaaagaccaaccgccgctgagatcaaggtagagcctaccacagagtccctcgacaaagaaggaaaaggcgagatacggtccttggtggaacctctgagcatgattcagttcgatgacacagccgaaccacagaagggtaaaattaaagggaaaaagcatcatatttcttctggtacaattacttcaaaagaggagaagaccgaggagaaggaggagctgaccaaacaggttaagtcccatcaactggttaagagcctttcccgcgtggccaaggaaaccagcgaatctacacgcgtcctggagagccccgacggcaagtcagagcagtctaatctggaagagttccaggaagccataatggcatttcttaaacaaaagatagacaacatcgggaaggcattcgataaaaagaccgtacctaaggaggaggagctgctaaagcgagccgaggccgagaaactgggcataattaaggcaaaaatggaggagtattttcagaaagtggctgagacagttacaaaaattcttagaaagtacaaagacaccaagaaagaggagcaagtgggagaaaaacctatcaaacagaaaaaggtagtgtcctttatgcctggactacacttccagaaatcacccatcagcgcaaagagcgagtcatcgacgctcctatcttatgagtctacagatccagttataaataatctgattcaaatgatcctggctgaaatcgaatctgagagagacattcctacggtgagcaccgtgcagaaagaccacaaggagaaagaaaaacagaggcaagaacagtatctccaagagggtcaggagcagatgagcgggatgtctcttaagcagcagctgctcggagaaaggaacctgctcaaagagcactatgaaaagatttctgagaactgggaggagaagaaagcgtggttacagatgaaagagggcaaacaagaacagcagtcgcagaagcagtggcaagaggaggaaatgtggaaagaggaacaaaagcaagcgacgcccaaacaagcagaacaagaggagaaacagaaacagcggggtcaggaggaggaggagctgccaaaatcctcgctgcagcgtcttgaggaggggacgcagaagatgaaaacacagggtctgctgttggaaaaagagaatgggcaaatgagacagatccaaaaagaagcaaagcatctcggaccccaccgacgccgtgagaagggtaaagaaaaacagaaacctgaaaggggcctggaagatctggagaggcagatcaaaactaaggaccagatgcagatgaaggagacccagcccaaagagctcgagaagatggtgattcaaacaccgatgaccttatccccacgctggaagtctgtgttgaaggacgtgcaaagatcctacgaggggaaagagtttcagcgtaatttgaagaccttggagaacctgcctgacgaaaaggagcccatttccatcaccccccctccctccctccagtactccctgccgggagcccttcccattagtggccagccactgactaagtgtattcacctcacaccccagcaggcccaggaagtggggattaccctgacgccccagcaggcgcaggcacagggtatcacactgaccttgcagcaggcacaggaactgggcatccccctaacaccccagcaggcccaagccctcgagattctcttcaccccacagcaggcccaagccttgggaatccctctaacgccgcaacaaacacaggtgcagggcatcactttaaccccgcagcaggatcaggctcccggtattagccttacaactcagcaggctcagaaactagggatcccgttgacaccccagcaagcccaggcactcggaatcccattgacccctcagcaggcacaggagctgggtataccactcactccacagcaggctcaggccctaagagtcagcttgacacctcagcaggcccaggagctgggcattcccctgactccccagcaggcccaagcgctgggtatcactctgactctgcagcaggcgcagcagctgggcatccctctgactccacagcaagctcaggctctgggtattactcttacacctaaacaggttcaagaactgggcattcctctgacgcctcagcaggctcaagctttgggaattacgttgactccaaaacaggcccaagagctcggtatccccttaaacccccaacaggctcaaactttaggtatccctcttacgcctaagcaggcacaggctctggggatccccttcacaccccagcaagcgcaagctttaggcattcccctcaccccccagcaagcacagacccaggagattaccctgacaccccagcaggcccaagcccttgggatgcctctcacaacccagcaggcacaggaacttgggattcccctcacccctcagcatgcccaagctctgggaatgcctctgaccactcagcaggcccaggagctggggatcccgctcactccacagcaggctcaagcactgggcatgcccctcacgacgcagcaagcccaggagctcggtattcccctgaccccacagcaggcccaagagctggggattccatttacaccacagcaggcccaggcacaggagattactttaacgccacagcaggcacaagctttggggatgcctctgaccgctcagcaagcacaagagctggggataacgttgacgccacagcaggcccaggaactggggatcccattgaccccccagcaagcccaggccctgggtatcccacttatacctccccaggcccaggaattgggcatccccctgactccgcaacaggcacaggctcttggtattttgttgattcctcctcaggcccaggaactggggattcccctcactccccaacaggcccaggcactgggcattcctctgattcccccacaggctcaggagctgggaattcctctgacgccacagcaggtgcaggccctgggcattcccctcatcccccctcaggcccaagagctcgagatccccctgaccccccagcaggcccaagctctggggattcccttgacacctcagcaggcacaggaactcgggatcccccttactccccagcaggcccaggagctgggaattccattaacacctcagcaagcacaagcccaggggattcccctgaccccgcagcaggctcaagccttgggaatctccctgaccccacagcaggcccaggcgcaagggatcactttgacacctcagcaggcccaagccctgggagtgcccatcacgcccgtaaacgcctgggtgtcggctgtgacgctgactagtgagcagacacatgcactggagtctcccatgaatctggaacaggcacaggaacagctgttaaagcttggggtacccctcaccctcgacaaggctcatacactcggcagtcccctgacactcaaacaggtgcagtggtcacaccgcccatttcagaagagtaaggccagtctgcccacagggcagtctattataagcagactgtcaccatccctgcggctatctctggcatcttctgcacccaccgctgaaaagagctctatcttcggggtgtcttcaaccccactccagatcagcagagttccactcaatcaaggacctttcgcacccggaaagccactggagatgggtatcttatccgagccaggaaagcttggggcacctcagacactgcgctccagtggccagaccctggtatatggcggacagtccacaagcgcgcaattccccgcacctcaggcccctccaagccctggccagctccctattagccgggctcctccaacccccggacaaccctttatagccggtgtgccgcctacctctggacagattccaagtttgtgggcccctctgagtccgggtcagcctttagttccagaggcctctagcatccccggagacttgctggaatctggtccactaacattcagtgagcagctacaggagtttcaaccacctgcgacagcagaacagtctccctatctacaggcaccttccacacccggtcagcatctcgcaacttggacgctccccggaagggccagttccctgtggatccctcccacttctaggcacccaccaaccctgtggccttcacccgcacctggtaaacctcagaagagttggtcaccttcggtggccaagaaacgactggccatcatctcatccctgaaatcaaaatctgtgctgatccaccctagcgctcccgactttaaggtggctcaagtgccttttaccacaaaaaagttccaaatgtctgaagtctctgatacctctgaggagacccagatccttcgcgatacatttgcaatcgaatctttccggacctttcagtcacatttcactaaatatcgcacaccagtctaccaaaccccatataccgatgagcgggctctcttgacactgatgaaaccaaccacaagcccctctagcttgacaactctgttgagaacatctcagatatctccgctggaatggtaccagaagtcccgattccctcccatagacaagccgtggattcttagcagcgttagcgacacgaagaagccaaaggttatggttcctccttctagtccgcaggagctcgaagagaagcggtacttcgtggacgttgaagcccagaagaagaaccttatactgctgaatcaggctatcaagacgtgtgggctgccaagccagcttcacacaatggcgagaaccctaattatcgaaattttacacatggacacagtgcaattagggtacctgtttagaaagtatattgcctataggctgatacaacacgcgcgaaacaatattatgaagcggctgaaggccattcagaacacgggaaaaggttatgaagctagaaatctgcatatgatgttgagtcgtctggacgactacggcaagaaggtgatgcaggtctggaccgagaagcagaaaagccttgggcagaaacgtaaccaatgtcttaagaaaatgatccatgtctttaaccaactgaagaagatacacgaactaaatctgtcccaacccatcccactgatcatagaagagaagcaaattccagcttcaaccacctttgtccagaagccatttttaaagctgctaatggaagaagaccggacatctgacatctgtaaaaaattcaggcagcaagaagatcagacagaggccatatggaacgtggacctctccacaagttcctaccccatcgctgagaagaccagcatgcatagcttatgggcccaactgggaggttatccagacattcccagactgctgcagctggaagttcagtcaaccttccgcaagagcctggctagtctgcaaagtcgggtgaagaagatccctaaata

SEQ ID NO: 56104 - DNA, 1080 bp, Artificial Sequence
  Description of Artificial Sequence: Synthetic coding sequence
atgtcagaggttagtgacacaagtgaggaaacacaaattctgcgggacacatttgcaatagagtctttcagaacctttcagagccacttcacaaaatatcgcacacctgtctaccagactccttacactgacgaaagggcgctgttaactcttatgaagccaactaccagcccctcctcactgactactcttctccggacttctcagataagccccctggagtggtatcaaaagtccagattcccgcctatcgataagccctggatcttgtcctccgtatccgatacaaagaaacctaaggtaatggtcccaccgagctcaccccaggagctcgaggagaagcgatacttcgtggatgtggaggcacagaaaaaaaacctgatcctgctgaaccaggctattaaaacctgcggtctcccatcacagcttcatacaatggctaggacactgatcatagagatccttcatatggacactgtgcagttgggttacctattcagaaaatacatcgcatataggctgattcaacacgccaggaacaatattatgaagcgcctgaaggccatccaaaacacaggtaagggctacgaggcccgaaacctgcatatgatgcttagccgcctggatgactacgggaagaaagtgatgcaggtttggaccgaaaagcagaagtctctcgggcaaaaaagaaatcaatgcctcaagaagatgatccacgtatttaatcaactgaagaagatacacgagctaaacctcagtcagcccatcccactgataattgaggagaagcagattccagctagtacgacgttcgtgcaaaaacctttcttgaaactgctgatggaggaagatagaaccagcgacatatgtaagaagttcaggcagcaggaagaccagacggaagccatctggaacgttgacctgagcacgagctcctatcccatcgcggagaagacgagcatgcactcactgtgggcgcagctcggcggatacccagacatccctcggctgctccagctggaagtgcagagcacattccgtaagtcgcttgccagcctccagtctagatccagcgggtag

SEQ ID NO: 56105 - DNA, 2682 bp, Artificial Sequence
  Description of Artificial Sequence: Synthetic coding sequence
atggaaaaagatgatcccccacagctcgttacccctacaagcgttaaagcaattattctccgaatagaagcagctcagctaacacgtgcgcaagaggatatatcaacccagcttagcgacatcctggataacgttaattgcgtgataaaccggtttcaggaggagctgggctacgatctcaaagagaatgctaagtctcagcagagggatccaaaagggaagaagcggtttatcctgcttgagaagatcgccagcttcagcaaagatgctatgatgaaggaaaagcacctttacgatattctccgctggcttggtgattggggcgatacgttgacctacgaaatagggcctcgcaagtccgaagaggaggccgctgctctcgacgaatggattgaggtgaccgaaaaagtgctgccgctctctcttattgctaccaagcgtggtattgagagcttgactgctctctgctccaccctcatcgaggggcaaaagaaacggtcacaggttagtaagaggactttttggcagggatggcagggacgcagtccccagacatcgccctcacatccccagccactgagcccggaacagatgctgcaggatcagcacacgatgaataccaaggcctctgaggttacttccatgctgcaggaactgctggatagcaccatgttctccaagggtgaggtgcgtgccattagatatatggcgacagtggttgagaacctcaataaagctctaatcctgcagcataaggagaacagatcactcgagaccaagtatcggcacctccagatgcaggcaaccaaggaattaagtagtcaacggctgcatttccagcaatttatggaagtgctagaatccagaagggatgctctgctcaaacaggtagagatcctggggggtcgttaccacgacttactcctgatgaagcaggcacttgaattccagctaaaaaaggcacagaatgcaaccggtcaggccgaagacttggcagaggtgtccgtcgactcgcctggcccttcagagagggagacactgccacgaaaagagaccgtcatggaggaatcccagcaggaacccatgaaagaagaacagcttttctcccctcttccaccttccccaatggccatgatcagggactccggcgctattgccgctggacatcagcccctgtccacaatgactgtgcgcagtcgcgtggctgatgtcttcggctctaaagacaccgagagtctcgaacctgttctacttcccctggtcgatcggaggtttccaaaaaaatgggagcggcctgtcgctgagagcctcgggcacaaagataaggaccaagaggattacttccagaagggcggacttcagattaagttccactgctccaaacaattgagccttgagtccagcagacaggtgacatccgaatcccaggaggaaccttgggaggaggaattcggccgagagatgcggagacaattgtggctggaagaagaagaaatgtggcagcagcgccagaaaaagtgggcacttctggaacaggagcaccaggagaaattaagacagtggaatcttgaggatctggctagggagcaacagaggcgctgggtacaactggaaaaagagcaggaaagcccccgacgagaaccggagcagttgggtgaggatgtggagagacgtatatttacacccacatctcgctggcgtgacctagagaaagctgagctgagtcttgtaccagccccatccagaacgcaatctgctcaccaaagcaggcgccctcacttgccgatgtcaccttccacccagcagcccgctcttggtaaacaacgccctatgtcatctgtggaatttacctaccgtccacgcacaagaagggtgcctacaaagccaaagaagtctgccagttttcccgtcacaggtacttcgattcgccgactcacctggccttccctacagatcagccctgccaacattaagaaaaaggtgtatcatatggatatggaggcacagcggaaaaacctgcagctcttatctgaggagtctgaactgagactgccgcactatctgcgttcaaaagccctggagctcaccaccacgacaatggagctgggtgccctccgtctccaatatctgtgtcacaagtatattttctatcgcaggctgcaatcgctgcgacaggaggcgatcaatcatgtgcaaattatgaaggaaacagaggcctcttacaaggctcagaatctgtatatcttcctcgaaaatatagataggctgcagtccttgcgtctgcaggcatggaccgataaacagaaagggcttgaagagaagcaccgcgagtgcctgagcagtatggtgaccatgttcccgaagctacagctcgaatggaacgtgcatttgaatattcctgaagttactagtccaaaaccgaagaagtgtaaactgcctgcagcttcacccaggcacattagaccaagcggacccacctacaaacagccattcttatctcgccacagagcatgcgttccactgcaaatggcaaggcagcaaggcaagcagatggaggctgtttggaaaactgaggtcgctagcagcagctatgccattgaaaagaagacccccgctagtttgccccgtgaccagctgcgaggacaccctgacattcccagactgctgacattagacgtgtag

SEQ ID NO: 56106 - DNA, 1521 bp, Artificial Sequence
  Description of Artificial Sequence: Synthetic coding sequence
gggcaccagcccctgtccaccatgacagtgaggtcccgagtggcggatgtgtttggaagcaaggacaccgagtcactggagccggtgcttctgcccctcgttgacagacgtttccccaaaaaatgggaaagaccagtagcggaatcacttgggcataaggacaaagatcaggaagattacttccagaagggtggtctgcaaattaagtttcattgtagtaagcaactgtctttagagagctcacggcaagttacatccgagtcacaggaggagccgtgggaagaagaatttggacgggaaatgagaagacagctgtggctggaagaggaagagatgtggcaacagcgccagaaaaaatgggccctcctggagcaggaacaccaggagaagctgcgacaatggaatctcgaggatttggcccgtgagcagcagcgcaggtgggtgcagctggagaaggagcaggaatcccccaggcgggagccagagcagctgggcgaggatgtggaacgaagaatctttacgcctaccagtcgatggcgtgatcttgagaaggcggaactgtcgctggtccctgccccaagccgcacccagtccgcccaccagtcgcggaggcctcatttaccgatgagcccctccacccagcagcctgccctaggcaaacagagaccaatgtcctccgtggaatttacatatagaccaagaacgaggagggtgcccaccaaacctaaaaaaagtgccagtttcccagtgactggcacaagtatcaggaggctaacgtggcccagcctgcaaatcagtccagcaaacatcaagaagaaagtttatcacatggacatggaggcccagaggaagaacctccaactcctgtcggaggagtctgagctcagactgccacattacctgaggagcaaagctctggaactgaccacaacgactatggaactcggagctcttcggctacagtatctctgccacaaatatatattttaccgaagacttcagtccctccggcaagaagctatcaaccatgttcagatcatgaaggaaactgaggcatcatacaaggcacagaatctgtacatattcctggagaatatcgaccgcctgcagtcgcttcggctacaggcttggacagataaacagaaagggctggaggagaaacatcgcgagtgtctcagctctatggttaccatgttcccgaaacttcaactggagtggaacgttcacctgaatattccagaagtaacatctcctaagcccaagaagtgcaagctcccagctgcctctcctcgccacatccgaccatcagggcctacttacaaacaaccattcctctcgcgtcaccgcgcatgtgttcccttgcaaatggcgcgacagcagggcaaacaaatggaagcagtatggaagacagaggtggcctcctcttcttacgcgattgagaaaaagacgcccgcaagcctgcctcgggatcagctgcgtggacatcctgacatacctagattgttgaccttagacgtgtag

SEQ ID NO: 56107 - DNA, 2346 bp, Artificial Sequence
  Description of Artificial Sequence: Synthetic coding sequence
atgatgaaagagaaacatctgtatgacatcctgaggtggctcggcgattggggagacactctaacatatgagatcggccctaggaaatccgaagaggaggctgccgctctggatgagtggattgaagtcacggaaaaggtgctgccactgtctctgattgctaccaagcggggtatcgagtctttaacagccctgtgcagcactctgatagaaggccagaaaaagagaagccaagtatcaaagagaaccttctggcagggatggcagggacgaagcccacaaacatcaccaagccacccacagccgctcagtcccgaacagatgctgcaggatcagcatacaatgaataccaaagcctcggaagtgactagtatgctccaagagctgctggattctaccatgttttccaagggcgaggtgagagccattagatatatggctaccgtggtggagaacctgaataaagccctgatcttgcagcacaaagagaatcgaagcctcgaaaccaagtaccgccatttgcaaatgcaggcgaccaaggaactttcatctcagagactgcatttccaacagttcatggaggtgctagaatctcgacgggacgctctgctcaagcaggtggagatactggggggtaggtaccatgacctgctgttgatgaaacaggctctcgagtttcagctgaagaaggctcagaacgcaacgggccaggctgaagatctggccgaggtctctgtggactcccctggtccctccgaacgcgaaacattgccacgaaaagagacagtgatggaggagagccaacaggaaccaatgaaagaggaacagctattctctccgctcccccctagccctatggccatgatccgcgactctggggctatcgccgcaggacatcaacccctcagtacaatgacggtgcgaagtagggtggctgatgtattcggctccaaagacacagaaagtctggagcccgttctgttacctttagttgacagaagatttccgaaaaagtgggaacggcctgtcgccgagtctttagggcacaaagacaaagatcaggaggactacttccagaagggtgggttgcaaatcaagttccactgctcgaagcagctgagcttggaaagttctcgccaggtgacctccgagtctcaggaagagccttgggaggaggagttcggcagggagatgagacggcaactttggttggaggaagaggagatgtggcagcagcggcagaagaaatgggcacttctcgagcaggagcaccaagagaaacttaggcaatggaacttggaggatctcgcaagggaacagcaacgccgatgggtgcagctagaaaaggaacaggagagcccccgaagagagcccgagcaattgggcgaagacgtcgagcggagaatattcacccccacatcaagatggcgcgaccttgaaaaggcagaactgagcctggtgcctgcaccttctcgtacccagagtgcacatcaatcccgccgaccccacctccctatgtcaccttcaactcagcaacccgctttgggcaagcagcggcctatgagtagtgtagaattcacttataggcctaggacacgtagagtgcctacaaagccaaaaaaaagtgcatccttccccgttacagggaccagcataagaagattgacgtggccttcccttcagatttctcctgccaatatcaaaaaaaaggtgtaccacatggatatggaggcccaaagaaaaaatctgcagttgctcagcgaggagagtgaactcagacttcctcattaccttagaagcaaggccctcgagctgaccaccaccaccatggagctgggagccctcagactccagtatctttgccacaaatatattttctaccggcgacttcagagcttgagacaggaagctatcaatcacgtacagatcatgaaagagactgaagcttcctataaagctcagaatctgtatattttcctcgagaatatagatagattgcagagcctgagactgcaggcctggaccgataaacagaaaggcctggaagaaaaacaccgtgagtgcctttcatctatggttaccatgtttcccaagctccagcttgagtggaatgtgcacctgaatatccctgaggtcaccagccctaagcctaaaaaatgcaaactgccggcagcctctcccagacatattaggccttctggtccgacctataagcagccgttcctcagtagacacagggcgtgtgtcccgctgcagatggctcgactcctggcgttgtgcctgcggggactggttgcagagctggccctagttatggaggacttcgatctgctgcatgtgctctag

SEQ ID NO: 56108 - DNA, 354 bp, Artificial Sequence
  Description of Artificial Sequence: Synthetic coding sequence
tgatgtctctcaagcatggtgaccatgttcccaaagcttcaactcgagtggaatgtacacctgaacatccctgaagtcacctctccaaaacccaaaaagtgtaagctgccggcagcatcccccaggcatattagaccatccggcccaacgtacaaacagcctttcctgtcccgccatagggcatgcgtgccactgcagatggctcggcagcagggcaagcagatggaagccgtgtggaagactgaggttgcctcttcctcttacgctattgaaaaaaagacacctgcatccctacctcgggatcaactccgagggcatccagatatacccagacttctgaccttggatgtgtag

SEQ ID NO: 56109 - DNA, 1242 bp, Artificial Sequence
  Description of Artificial Sequence: Synthetic coding sequence
atgcacctggccttgactaccgttctgctatgggcatggggcctgcaagcctttgagattgtagaaaaagagaacatttttcagcggacaccttgccctgcctttctcatgtttgaaaacgccgcatacctggctgatatgtcctttgaattgccatgccattgtaaaccagaagaggttcccgctgtggtctggttttaccagaaacatctggggtctagccacaccaaggttctgacagactttgacgggcgtgtgctgacggaggccgctcaggttcgggtcggaagcgacatgctgacgcgttttagtatccgcatgttttcattactagtgttcagagctcaatccgaggactctggcctgtacttttgtggcacacgaaagggagattacttttacgcttatgatgtggacatccagaatagcgaaggaatggtcgccacttttcaggacaaagggcaggagcctttcgctgatgagtactatgggcacctgcacgtatttacaacgttctgggagtggactccctgcgacagatgtggggttcgcggagagcagtggcggattggattgtgctatctccagagccctgatttgtcccccaggtacctgaaagccgtgccagatgtagtgtcatgcgggtctcgtgcggtcccgagaaagctgcggacaaaggcgagggaccacacccccgaggttctcgtcaggagttgtctggtgccttgtgaaaaaaccaaaaccatccgtgagggagtgctggcaataatcaactacgtttctaaagtgggtagccggccatgggtgccacaggtaccaatccagttccaccagcaacggctcggacatggacttattatctcttgccccggagctcgacctgaacatgcggtggcctgggataaagatcgccagcatctctaccggacacagtacctgaagggagtcaatcgtagtatgcgcgtattcattgaccatggcaatcaactccacatcaggtttacacagctggacgaccggggtatctattactgctggcggcaaggtgtgttggtggcaggatttcggttaggcgtgacatcgcacggccattatccggctagcttcagcgatcctgaaacccggagcgccgtagagctcaccctcattgggtatcttctgatcaccgccgtcttcgttacgatccacttctgcaggtgttgctgttacttgttccattgctgtccgtctttttctccgtag

SEQ ID NO: 56110 - DNA, 1242 bp, Artificial Sequence
  Description of Artificial Sequence: Synthetic coding sequence
atgcacctcgcactgaccactgtgctgctctgggcctgggggctgcaagcttttgagatcgtagagaaggagaacatttttcaacgcacaccttgtcctgctttcctgatgtttgaaaacgctgcatacctggccgatatgtcttttgagctgccatgccattgtaagccagaagaagtgccagccgtggtctggttctaccagaaacatcttgggtcaagccatacgaaggtgctcactgactttgacggaagggtcctgactgaggccgctcaggtgcgggtcggttctgacatgctgactcgtttttccatccgtatgttctctctgctcgttttcagagcacagtccgaggacagcggactttacttttgtggcacgaggaagggggattacttctacgcatacgatgtggacatccaaaacagtgagggaatggtcgccaccttccaagataaggggcaggagcctttcgccgatgaatactatggtcatttgcatgtgtttaccacgttctgggagtggaccccttgcgacagatgcggtgtgaggggcgagcagtggcgcattggactttgttacctgcagtccccagatctaagtccaagatacctgaaggccgtgccggatgtggtcagttgtggaagtcgcgctgtaccccgaaaactgcgcacaaaggctagagatcacactcccgaagtactggttcggtcatgtctggtgccgtgtgaaaaaacaaaaaccatccgtgagggggtcctggccataatcaactatgtgagcaaggtcggatcgagaccctgggtcccccaagtgcccatccagttccatcagcagaggctgggccatggactaatcatctcatgtccgggtgcgaggccagagcatgccgttgcttgggacaaagataggcagcacctgtaccggacccagtatctgaagggagtgaacagatccatgcgggtcttcattgatcacggcaaccaactccacatccgcttcactcagctggatgacaggggcatttactattgctggcgacagggagtgctagtcgcaggattccgcctaggagtgacaagccatgggcactaccccgcatcatttagcgaccccgaaacccgtagcgcggttgagctgactctcattggctacctgcttatcaccgccgtgtttgtaactattcacttctgcaggtgctgttgctacctgtttcactgttgtccttcattcagtccttag

SEQ ID NO: 56111 - DNA, 2274 bp, Artificial Sequence
  Description of Artificial Sequence: Synthetic coding sequence
atggatagccttttcgtggaagaggttgccgctagccttgtcagggagtttctgtcacggaaaggactgaaaaaaacttgtgtgaccatggaccaggagcggcctagatcggatctatctatcaataatcgtaatgacctacgaaaagttctacacctcgaattcctctacaaggagaataaagctaaggaaaacccactgaaaactagcctagaactcataacccgctacttcttagaccacttcggcaacaccgcaaataatttcacccaggatacccccatacccgctctgtctgtccctaaaaaaaacaataaggtgcccagccggtgcagtgaaacaactctggtgaacatttacgaccttagtgatgaggatgcgggttggcgcacctcactgtccgagaccagtaaggccagacacgacaacctcgacggagacgtgttgggaaactttgtcagctcgaaacgacccccacacaaatccaaacctatgcagactgtccctggcgaaacacccgtgctgacctctgcttgggagaaaatagataaactgcatagcgagccaagcctcgatgttaaacgaatgggggagaactcccgcccaaaatccggtttgatcgttagaggtatgatgtccgggccaattgctagtagccctcaggattccttccacaggcactacctgcgtaggagctctccaagctccagtagcacccaaccccaggaagagtcaagaaaggttccagaattgttcgtatgcactcagcaggacattttggcgagttccaactcgtctccaagccggacttctctgggacagctgagtgagctcacagtggagcggcagaagacaaccgcctcttcacctcctcacctaccttcaaagagattacctccctgggatcgcgctcgccctcgcgacccaagtgaggacacaccagcagtcgatggttcgaccgatacagacagaatgcctctgaaactatacctgcccggagggaacagtcgcatgacccaggagagactggagcgtgcatttaaaaggcagggaagtcagccggctcctgttagaaagaaccagcttctcccgagtgacaaggttgatggagaactcggcgctttgagactcgaggacgtggaagacgaactgatccgggaagaagtgattcttagccccgtccctagtgtgctgaagttgcagaccgcatccaaacctatagatctttccgtggccaaggagataaaaacccttctcttcggctctagtttttgctgttttaacgaggaatggaagttgcaaagcttctccttctcaaacacggctagtctgaaatatggcatagtccaaaacaaagggggtccgtgcggcgtgcttgccgctgtccaaggctgtgtgctccaaaagcttctgttcgaaggtgacagcaaggcggattgtgcacagggtttgcagccatccgacgctcatcgcacacgctgtctggtgctcgccctcgctgacattgtatggcgagctgggggacgtgagcgtgctgtggtcgccctggcctccaggactcagcagttctcccctacaggcaaatacaaagcagatggggttctggagacgctgacattgcactctctaacctgttatgaagatctggtcaccttcctgcagcaatcgatccatcaattcgaagttggaccttacggctgtatcttgctgacacttagcgcaattctgtcccgcagtaccgagctgatccgacaagattttgacgtcccgactagccaccttatcggagctcatgggtactgtacacaagagctggtgaacctgttgctaaccgggaaggccgtgagtaacgtctttaatgacgtcgtcgagctggactccggcgacggcaacatcacactcctgaggggcatcgccgctcgctctgacattggctttcttagcctgtttgaacactacaacatgtgccaagtgggctgttttctcaaaacacctaggtttccgatttgggtggtgtgctccgaatcccacttcagtatcctgttttctctgcagcccggtttgttgcgcgattggagaaccgaaaggctattcgatctatattactacgacggactagccaaccagcaggagcagatcagattgaccatagatacaacccagaccataagcgaggacactgacaacgatctagtacccccactggaattgtgtatccgcacaaaatggaaaggggcaagtgtgaactggaacggttccgatcccatcttatag

SEQ ID NO: 56112 - DNA, 1953 bp, Artificial Sequence
  Description of Artificial Sequence: Synthetic coding sequence
atgatgccatcccccagcgactctagtcggtccttgacaagcagaccaagcaccagggggctcacccacttgagacttcacagaccatggctgcaggccttgcttaccctcggattggtccaggtgttactgggcatactggtagttactttcagtatggtggccagctctgttacaacaaccgaaagcataaagaggagctgtccctcatgggccggattcagtatatcttttttttctcttctgtctgtactgtgtgtcatgctatcaatggctggtagtgtcctttcgtgtaagaacgctcagctggccagagacttccagcagtgcagcctggagggcaaagtatgcgtttgctgtcccagcgtgcctttgttaagaccctgtcccgagagtgggcaggagctgaaggtcgcccctaacagcacttgcgacgaggcgaggggggctttgaaaaacctattgttctctgtgtgcgggctcaccatttgcgcagcgattatttgcaccctgtcggccattgtctgctgcattcagatctttagtctagatttggtccatacccagcttgctcctgagaggagcgtaagtggacccctgggccctttggggtgcaccagccctccgccagcccctcttctacacaccatgctcgatctggaggagtttgtgccccctgttcctcccccaccctattatcctcccgaatacacttgctcaagcgagactgacgcacagtcgatcacctacaatgggtctatggacagccccgtgcccctttaccccaccgattgcccaccttcatacgaggccgtcatgggcctccgaggcgacagccaggccaccctgttcgacccccagctccacgatggaagctgcatttgtgaacgggtggcttccattgtcgatgtgtccatggacagcggcagtctggtcttgtctgccattggggatctccctggcggatcctcaccctctgaggactcatgcctgcttgaacttcagggctcagtgcgcagcgtggactatgtgctctttcgcagcattcaaaggagccgggcagggtattgcctgtcactcgattgcggccttcgcggtccttttgaggagagccccctgcccaggagacctcctagagcagccaggtcctatagctgttccgcacccgaggcacctcctccgctcggtgcacctaccgctgctaggtcttgtcatagactggaaggctggcctccatgggtcggaccctgcttccctgagctaaggcgtcgggtgccacgtggcggaggacggcctgccgcagcccctcctactagagccccaacgagacggttttctgactccagcggctccctcactcctccaggccaccgtcccccacaccccgctagccctccacctctcttgctcccaagatcacattcagacccaggtatcactacatcaagcgacaccgcagatttcagggatttgtacacgaaagtgttggaggaagaggcagcaagtgtctcctccgccgacacaggtctttgctccgaggcttgcttgtttagacttgccagatgcccttcaccgaagctactccgggcacgcagtgccgagaaacgcaggcccgtgccaacctttcaaaaggtgcccttgccatccggccctgcaccggcacactcactgggagacctgaaagggtcctggcctgggaggggccttgtcacccgtttcctgcagataagtagaaaggcccctgatccttccggtactggcgctcatggacataaacaagtacctcgctccctgtggggacgcccaggaagagagtccttgcatttgcgtagttgtggcgatctttcttcttcgagctctctgcggcgtctgttgtccgggcgacgtcttgagcggggaacacgtccccacagcctgtccctcaatggcggaagcagggagactggtctgtag

SEQ ID NO: 56113 - DNA, 2703 bp, Artificial Sequence
  Description of Artificial Sequence: Synthetic coding sequence
atgggcgatagcggatctaggcgctccacactggtctcacgcctgccgatatttagaaggtccatcaataggcgtcacgactcacttccaagttctccttcatcatctaacacagttggggttcacagttcatcgcctagctccacgaactcaagctcaggaagcacaggcaagcggaggagcattttccgcacgccctccatctctttccaccacaaaaaagggtctgaaccgaaacaggaaccaacaaaccagaacctaagcatttccaatggggcacagcccggacactcaaatatgcagaaattgtccctggaagagcacatcaagacacgcggacggcattcagttgggttcagtagttcgcgaaacaagaaaataacccgcagtttgactgaagacttcgagcgcgagaaggaacacagcactaacaagaacgtgtttattaactgtctctccagtggtaagtctgaaggtgacgatagcgggtttaccgaggatcaaacacgcaggtcagtgaaacagtccacccgtaaactgctgcctaaatctttctcttcacattataaattctccaagcctgtgctgcaaagtcaatcgatttcgctcgtccagcagagtgaattctcattagaggtgacacagtaccaagagcgcgaaccggtcctagtgagggcaagcccctcgtgctctgtggacgtaactgaaagagccggatcctctctacagagccccctgttaagtgcggatctgaccacagctcaaaccccctcagagtttctagctctgactgaggacagtgtgtctgagatggacgctttctcaaaatctgggtccatggctagccattgtgataactttggccacaacgattctacaagtcaaatgtcactgaacagtgctgccgtgaccaaaacaaccaccgagcttacaggcacagtgccttgtgctattatgtctccgggtaagtaccggcttgagggacaatgctcaacagagtccaacagcctgcctgagacatctgctgctaaccagaaggaagtgctcctgcagatcgctgagttacccgcaacatccgtgtcccattcagaatcgaatctgccggctgatagcgaaagagaagaaaatattgggctccagaacggggagactatgctcggcactaatagtccccgtaagctgggattctatgaacagcataaggctatcgctgaacacgtgaagggcattcaccccatctctgatagtaagattattcccacctctggcgatcaccatatcttcaacaagacctcacacggttacgaagcaaaccctgcaaaagtgctggcatcctcactcagcccatttagggagggtcgcttcatcgagcgaaggcttcgatcatccagcgagggcaccgcaggctccagccgcatgattctgaagcccaaagatggaaacatcgaggaggtgaactctctgcgaaaacaaagagcgggaagcagttcctcaaagatgaactcattagacgtgctcaataacctggggtcttgtgaattagacgaagatgacctgatgctcgacctggagtttctcgaggagcaatcgcttcatccatctgtgtgccgcgaagactcctatcactcagtcgtgtcatgtgccgcagtggttttgacgccaatggagccaatgatagagatgaagaaacgtgaggaaccagaattccccgagccaagtaagcagaatctctccttaaaattaaccaaggatgttgatcaagaggcgcgttgctcccacatttctagaatgcccaactcccccagcgctgactggccgctgcagggagtcgaagagaatgggggaattgactccctaccgtttaggctgatgttgcaggattgcacggcggtgaagaccctactactcaagatgaaaagagtactgcaggaaagtgccgacatgtccccggcttcctcaaccacttcgctgcccgtctctcctctcaccgaggagcccgttccgttcaaggatatcatgaaagacgagtgcagcatgctgaagttgcaactcaaggagaaagatgaacttatttcccagctgcaggaggagctgggtaaagttagacatttacagaaagcattcgcgtcccgggtggacaaaagtacccagaccgagcttctgtgttacgacggactgaacctcaagcggctggaaaccgtgcaaggcggacgcgaggctacgtatcgaaatcggatagtttcgcaaaatctaagcacgcgagacagaaaggccatccacacaccgacagaggaccgatttcgttattcagccgcagaccagacctctccttacaagaacaaaacctgccagttgccttcactctgtcttagcaatttcctgaaggacaaagagctagccgaggtcatcaaacactctcgcggaacttatgagacgctgacttcagacgtcactcagaaccttcgggcaaccgtgggacagagctcacttaaaccgacggctaagaccgagggcttatcaactttcctggaaaagccgaaagatcaggtggctacagccaggcagcactctacattcaccgggagattcggccagccaccaaggggaccaatttctctgcacatgtactcccgaaagaatgtattcctgcaccacaatctccattccactgagctgcagaccctgggacagcaagatgggtag

SEQ ID NO: 56114 - DNA, 2034 bp, Artificial Sequence
  Description of Artificial Sequence: Synthetic coding sequence
atgggtgattctgggagccggagatctacactcgtatctcgccttccaatcttcagacgttccatcaatcgaagacatgattccctcccatcgagtcctagttcctccaacaccgtcggggtgcactcctcaagcccctcctccacaaactcctctagcggttccacaggcaaacggcgttccatctttagaaccccaagcatctcctttcaccataagaaaggctctgagcccaagcaggagccaacaaatcaaaatctatccattagcaatggagctcaaccagggcattctaatatgcagaaactttcactggaggaacatataaagactaggggtagacactccgtgggtttcagctcatcccgtaataaaaaaattacaaggagtctgacagaagacttcgagcgggagaaggaacactctacaaacaagaatgtctttatcaattgtctctcatctggcaagtctgagggcgatgattctggtttcacagaggatcaaacgcggagatcggttaagcagtcaactcgaaaactgttaccgaagagcttcagtagccattataaattcagtaagccggtgcttcagtctcagtctatatcccttgtacagcagagcgagttctcattggaggtgactcaataccaagaacgcgagccggtactcgtaagggcttccccaagttgttcagtggatgtgacagaaagggccggatcatcactgcagtctccactcctctctgctgatctcaccacagcccagacaccttccgagttcctcgccctgactgaggacagtgtgagtgagatggacgccttctcaaagtccggaagtatggcatcacattgtgacaatttcggccacaatgattcaacatcacagatgagcttgaactctgctgcagtgaccaaaactacaaccgagttgactggaacagtgccatgtgcaattatgtcacctgggaagtaccgcctcgagggccagtgctctacagaatccaatagcctccccgagacttccgcagcaaaccagaaagaggttctgttgcagatcgccgagctgcctgccacatccgtgtcacacagcgagtccaatctgcccgcagactccgagcgggaggagaacattggtcttcagaacggggagacgatgctcggaactaattctcctagaaagctcggtttttatgagcagcataaagcaattgcggagcacgtgaaggggatccaccccattagtgacagcaagattattcctacctctggcgaccaccacatctttaacaagacttcacacggctatgaagcaaaccccgctaaggtgttggcctcttccctgagcccttttcgagagggcagattcattgagcgccgtctgcgcagctcttctgaaggcactgcaggcagctctcgcatgattttaaagccaaaggacggcaatattgaagaggtgaacagtttacggaaacagagagccggaagctcctctagcaaaatgaatagcttggatgtgcttaacaacctgggatcctgcgagctcgacgaagacgatctgatgcttgacctcgagttcctagaggaacagagcctgcacccgtccgtttgtcgggaggactcataccattctgttgtaagttgtgctgcggtggttcttacaccaatggaaccaatgattgaaatgaaaaaacgggaggaaccagagtttcccgaaccctccaagcagaatctaagcctgaaactaacaaaggatgtagatcaggaggcccgatgctctcacattagcaggatgcccaatagcccatcagctgactggcccctgcaaggtgtggaggagaacgggggaatagattccttgcccttccgactgatgctgcaggactgcaccgctgttaaaaccctattattgaagatgaaaagagtccttcaggaaagcgccgacatgtcaccagcttcaagcacaacaagtcttcccgtgtctccgctcacggaagaacccgtgcctttcaagacaacctacccccgagagttttag

SEQ ID NO: 56115 - DNA, 2034 bp, Artificial Sequence
  Description of Artificial Sequence: Synthetic coding sequence
atgggcgactctggttcacggaggtctacgcttgtgtctcgccttccaatcttcagaagatctatcaatagacggcacgatagtctcccatcatccccgtcctcttctaatacagtgggggttcatagtagtagcccctcttccactaacagttcatctggaagtacgggcaaacgacgttccatcttcaggactccttccatttccttccaccataagaaaggcagcgagcccaagcaggaaccaaccaaccagaatctgtctatatccaacggtgctcagcccggacatagtaatatgcagaaactcagtctggaggagcatattaagaccaggggtcgacatagcgtgggattctccagtagtcggaacaagaagatcactaggagtctgacggaggacttcgaaagggagaaggagcattccaccaacaagaacgtctttatcaactgcctaagctccggaaagtcagaaggggatgatagcgggtttacagaggaccaaaccagaagatccgtgaaacagagtacaagaaaactattgcccaaatctttttcctctcactacaagtttagcaaacctgttctacagagtcaatctattagtcttgttcagcagagcgaatttagcctcgaagtgacccagtaccaggagcgtgagcccgtgctggtaagagcctctccttcttgcagcgttgacgtgacagaacgggcaggtagcagccttcagagtcccctgttgtctgcagatctaacgacggctcagacaccttccgaattcttagctctgacagaagactccgtctcagagatggacgcgttctctaaaagtggcagtatggcgtcccattgcgataactttggccacaacgactccacatcccagatgtcccttaattccgccgctgtgaccaagactactaccgagctcacaggaaccgtaccatgtgcaatcatgtctcctgggaagtatcgcctcgagggccagtgtagtactgaaagtaatagtctgcccgagacctcagcagcgaaccaaaaagaggtgctactgcagatcgctgaactgccggctactagcgtgagtcactcagaatctaatctcccggctgattcggaaagggaagaaaatataggccttcagaacggagagacaatgctggggaccaattctcctcgaaaactgggcttctacgaacagcataaggctatcgccgagcacgtaaaagggatacaccctatcagcgattccaagatcataccaacaagtggcgatcaccacatctttaacaagacttcccacggatacgaggctaatcctgcgaaggtgctcgccagttcattgtccccatttcgcgagggacgtttcattgagaggaggctaagaagttctagtgagggaactgcaggttcgagcagaatgatactgaagcccaaagacggtaatatcgaagaagtgaattcactgcgcaagcagcgggcaggcagcagcagttcaaaaatgaatagcctggacgtgttgaacaatctgggcagttgtgagttggacgaagacgacctcatgctggatttagagttcctcgaggagcagtctctgcacccgtctgtttgtcgggaggacagttaccatagcgttgtctcttgcgctgccgtcgttcttaccccaatggagcccatgatcgagatgaagaagcgagaggaaccggagtttccggagccgagcaagcagaatctgagcttgaaactgactaaagatgtcgaccaggaagcccgatgctctcatatcagcagaatgccgaactcacctagtgccgactggcccctgcagggtgtggaggaaaatggaggaatcgatagtctgccattcagactgatgctacaggactgtactgcagttaagactctcctattaaaaatgaagcgcgtattacaggaatccgctgacatgagtccagcatcgtcgaccacatcattgcctgtttcgccacttacagaggaacccgttcctttcaaggattattacaagagacctttctag

SEQ ID NO: 56116 - DNA, 2703 bp, Artificial Sequence
  Description of Artificial Sequence: Synthetic coding sequence
atgggagactcaggcagccgtcggagcacgctcgtttcacggctcccaatcttcagacggtcaatcaacagacggcacgatagtctcccttcctctccctcatctagtaacactgtgggggtccattcgagcagcccatcaagtaccaactcctccagcggctcaaccggcaagcgcaggagtatttttagaaccccatcaatcagcttccaccacaagaaagggtctgaacccaagcaggaaccaacgaatcagaatttatccatttctaacggcgcacagccagggcatagcaatatgcagaaactgagtctcgaggagcacatcaagacccgtggacgacattctgttgggttcagtagctctcgtaacaagaagataacgcggtccctgacggaagactttgagcgggagaaagaacactctacaaataagaacgtgtttataaactgtctgagttctggtaagagtgaaggagacgattcagggtttactgaggaccagactcgccgaagtgtgaagcaatcaactcgcaaattgcttcccaagtccttttcatctcactacaagttttcgaaacccgtcctgcagagtcagagtatcagcctggtgcagcagagcgagttcagcctcgaggtcacccagtatcaagaacgtgaacccgtgctggtgcgcgcttcccccagctgctctgtcgatgtcactgagagggccggaagctctctgcagagtcccctcctgtccgcagacctcaccaccgcccagaccccatccgaattcctagcgctgaccgaggacagcgtgagtgaaatggacgcgttctctaagtcaggctcaatggcaagccattgtgataacttcggacacaatgattccaccagtcaaatgtctttgaatagcgccgcagtgaccaagacaaccaccgagctcacggggacggtcccttgcgcaatcatgagtcctggcaagtatagattagaggggcaatgtagcaccgaaagcaattcactcccagaaacgtctgctgcaaaccaaaaggaagtgcttctgcagatcgccgagttgccggctacctcagtctcccattccgaatccaatctcccagctgatagtgagagggaagagaacattggtctgcagaatggagaaaccatgctgggcacaaactcgcccaggaaactggggttctatgagcagcataaggcgattgcagagcacgtgaagggcattcaccctataagcgattcaaagatcataccgacatccggggatcatcatatcttcaacaagacaagccatggttatgaggccaatcctgccaaggtgctggcatccagtctttccccattccgcgaaggacgcttcattgaacggagattgcgctcttcctcagaggggacagctggatcctcaaggatgattctgaaaccaaaggacggcaacatcgaggaggttaactccctaagaaaacaacgagcgggttcctcctcaagtaaaatgaatagccttgatgtgctgaacaaccttgggtcctgcgaactggacgaagatgatctcatgcttgacctggagtttcttgaagaacagagcctccacccttcagtgtgccgagaggactcataccacagtgtggttagctgtgccgctgtggtactgactccaatggagccgatgattgagatgaaaaaacgggaagagccagagttccccgagccgtccaaacaaaatttgtcactgaagctcacaaaagacgtcgatcaggaggccaggtgttctcacataagtcgaatgccaaacagcccctctgcggattggcccctgcaaggggtggaggaaaatgggggtattgatagcctccccttccggctgatgcttcaggattgcaccgccgttaagaccctccttctgaagatgaagagggtgttgcaggaatccgcagatatgtccccagctagctcaacaacgagcctccctgtgtccccgctcaccgaggagccagtgcctttcaaagatattatgaaggatgagtgctcgatgcttaaattgcagctgaaagagaaggacgaattgatctcgcagctccaggaggagctgggcaaagttagacatctgcagaaggctttcgccagccgggtggacaagagtacccagaccgagctcctgtgctacgacggtctgaaccttaagagactggagacagtccagggcggacgcgaagcaacctatagaaaccgcatagtgagccagaacttgtcaacccgcgaccggaaggccattcatacccctaccgaagacaggtttcggtattctgccgcagatcagacctcaccctacaagaacaagacatgtcagttacccagcctctgtttgagtaattttctgaaagataaagagctggctgaggttattaagcacagcagggggacttacgaaaccctgacatcagacgtcacacagaaccttcgggctacagtcggccagagctctttgaaaccaaccgcaaaaaccgagggcctgagcacgttcctggaaaagcccaaggatcaggttgccacagccagacagcacagcacgttcaccgggcgatttgggcagccccctcggggacctatcagcctgcacatgtactccaggaaaaatgtttttcttcaccataatctgcactccactgagctacaaacgctgggtcagcaagatggatag

SEQ ID NO: 56117 - DNA, 10074 bp, Artificial Sequence
  Description of Artificial Sequence: Synthetic coding sequence
atgggcagacatgtggcgacttcctgccatgtagcttggttgctggtgcttatttctgggtgctggggccaagtaaataggctcccatttttcacaaaccattttttcgacacctacctcttgatctcggaggatacgccagttgggtcatcagtcactcagctgttggctcaggatatggacaacgacccgctggtgttcggcgtctctggggaagaagcctctcggttctttgctgtggagccagataccggggtcgtctggctgagacagcccctcgatcgggaaacgaagagtgaattcaccgtcgaattttctgtatcagaccaccaaggtgtgataaccaggaaagtgaatatacaagttggggacgtcaatgataacgcaccaactttccataatcagccatactcagtgcggatccccgaagtaggagcgactggaaataccccggtaggtacaccgatttttatcgtaaatgctaccgacccagatcttggagcagggggatcagtgctttactccttccagccccctagccaattttttgccatcgacagcgccaggggtatcgtgacagtaatcagagaactggattatgagacaactcaggcatatcagctgaccgtcaatgccactgatcaggataagactcgaccactgtccaccctcgcaaacctcgccatcattatcactgatgtgcaagacatggaccctatcttcatcaacctgccctattccaccaacatctacgaacacagtccccctggtactacggtacgcatcattaccgcaattgaccaagacaaggggcgacctagagggatagggtacaccatcgtgtccggcaatactaattctatattcgctttagattacattagtggggtactgaccctaaacgggctgctggatagggagaacccactttacagtcatggatttatcctgactgtgaagggcaccgagctgaatgatgatcgtacacctagcgacgccactgtcaccacaacgttcaatatactcgtgattgacattaacgataatgcacccgaatttaactctagcgagtattccgtcgcgatcacagagctggcgcaagtgggatttgcactgccactgttcatccaagtggtggataaggacgaaggcttgaatagtatgttcgaagtatatctcgtggggaacaacagccatcatttcatcatatcacctacgtctgtgcaagggaaagcggacatccggatccgcgtcgcaataccccttgactatgaaacagtcgaccgatacgacttcgacctctttgcgaacgaatctgtgccagatcatgtaggatacgcaaaggtgaagatcactctcatcaatgaaaacgataataggcccatcttctcccaacccttatacaatatatctctctacgaaaatgtgactgtgggaacatctgtgctgaccgtgctcgcaacagataacgatgccggtactttcggcgaagtgtcgtactttttcagtgacgaccctgatagattcagtttggataaagataccggcctcataatgctcattgcacgtctggactatgaactgatacagcggtttaccttaactataatcgcacgcgacggtggaggggaagagacaactgggagggttcggataaacgttctggatgtgaatgacaatgtgcctacgtttcagaaagacgcctacgtgggggctttaagggagaatgagcctagcgtaacacagctggtccggctgcgggcaacggatgaggactcacctccaaacaatcagattacgtacagcatcgtttctgcttccgcatttgggtcctactttgatatatccttgtacgaaggatacggagtaatctccgtctctcgtcccctcgactatgagcaaattagcaacggcttgatctacctcacagtcatggccatggatgctggaaacccaccactcaactcgacagtccccgtcacgattgaggtcttcgatgagaacgataacccccctaccttcagcaaaccagcctactttgtcagtgtagtagagaatattatggccggagctaccgtccttttcctcaacgccacagacctagaccgctctcgagagtacggtcaggaatccattatttatagcctggaaggttccactcagttccgaatcaacgccagaagcggtgagattactacaacctcactgctggaccgcgaaacaaagtccgaatacattctgatcgtaagagctgtggatggtggggtcggccataatcagaaaacaggaattgcaaccgtgaacatcacactgttggacatcaatgataatcatccaacctggaaggacgctccctattatattaacctggtagagatgacacctcccgatagcgacgtgacaaccgtcgttgcggttgaccccgacctcggcgagaacggaacactcgtgtacagtattcagcctccaaacaagttctatagcctgaactccaccaccggcaagatcagaacaactcatgctatgctcgatcgcgagaatccagacccacatgaggcggagctcatgcgaaaaatcgtggtgtccgtgaccgattgtgggaggcctccgctgaaagccactagctctgctactgtatttgttaatctgttagacctcaatgacaacgatcccacatttcagaacctgccgtttgtggctgaggtactggagggaatcccggctggagtgagcatctatcaggtggtggctattgacctcgatgagggcctgaacgggctggtttcttacagaatgcctgtcggcatgcccagaatggatttcctgatcaatagctcatcaggcgttgtggttacaaccaccgagctggaccgagagaggatcgcagaataccagctgcgcgtggtcgcaagcgatgcagggacacctacaaagtcaagcacctccacgctcacaatccatgtgctggatgtcaatgatgagacacctacgttcttccctgccgtttacaatgtgtcggtctctgaagatgtcccccgagagtttcgcgttgtctggcttaattgtactgataacgacgtgggacttaacgccgagctgtcgtattttatcacaggtggcaatgtggatggcaagtttagtgtcggatatagagatgccgtggtgaggacagtagttgggctggatcgggagactactgctgcatatatgctcatcctggaggcaattgacaacggcccagtcggtaaacgacacaccggaactgccaccgtgttcgtcaccgtgctggacgtcaacgataaccggccaattttcctccagagcagttacgaggctagtgttcccgaagatattcccgagggtcacagcatcctacaactaaaggctacagatgctgacgagggcgaatttggtcgcgtgtggtatcgtatcttgcacggaaaccatggcaataatttccgtattcacgtcagcaatggactcctcatgcggggaccacgacccctagaccgggagcggaactctagtcacgtgctgatcgtggaggcctataatcacgacctgggtccgatgaggtcatccgtgagggtcatcgtctacgtagaagatataaacgacgaagctccagttttcacccagcagcagtactcgcggcttggcctcagggaaacagcgggaatcggaacgtccgttatagttgtgcaggcgacagatagagactctggagacggaggcctggtaaactacaggatcctgtctggcgctgagggcaagttcgaaatcgacgaatccacaggcctgattattacagttaattatctggactatgaaactaaaacttcctatatgatgaatgtgtcggctacagaccaggctccgcctttcaatcaggggttctgcagcgtctatatcactctgctgaacgaactcgacgaagcggttcagttctcgaatgccagttacgaggctgcaattcttgagaatctggctctaggcaccgagattgttcgcgtccaggcctattccatcgataacctgaatcaaataacgtataggtttaacgcctacacaagcactcaggccaaagccctcttcaagatcgacgcgattaccggagtcattaccgtccagggtctggtggatagggagaaaggcgacttctacacactgactgtggtcgctgacgatggaggcccaaaggtcgacagtacagtaaaggtgtatattaccgttctcgatgagaatgacaattctcctagattcgacttcacttctgacagtgccgttagtatccctgaggactgtcccgtgggccagcgagtggcgacagtcaaggcctgggaccccgatgctggttcgaacggtcaggttgtgttctcattggcctccgggaacattgccggagccttcgaaattgtgacgaccaacgattctatcggagaggtcttcgtagccagacccctggaccgggaggagctcgaccattatattcttcaggtggtggcctctgatagagggacgccgccacggaaaaaagaccacatcctgcaagttacaattctggatattaatgacaacccacctgtcatcgagtccccattcggctataatgtgtctgtaaacgagaatgtgggtggaggtacagccgttgtgcaggtcagggcaactgaccgggacattgggatcaacagtgtgctgagctactacatcaccgagggcaacaaggatatggcctttaggatggatagaatctctggagagatcgcaactcgcccagccccacccgaccgtgaacgccagagtttttatcacctggttgccaccgtcgaggacgagggcacgcccacccttagcgccacgacacatgtttatgtcactattgtggacgagaacgataatgctccaatgttccagcagcctcactatgaagtcctgctcgacgaaggcccagacaccctgaataccagcctgatcacgattcaggctctagatctcgacgaaggacctaacggaactgtgacctatgccattgttgccggtaacatcgttaacacatttcgtatcgaccgacatatgggagtgatcactgcagcaaaagagctcgattacgagatttcccacggccgatataccttgattgttacagccacagaccagtgcccgattctcagccaccgcctgaccagtaccactacggtcctcgtgaacgtgaacgatatcaatgacaatgtccctacttttcccagggattatgaaggcccatttgaggtgacagagggacaacctgggcctcgtgtgtggacctttttagcgcatgatcgtgactcaggacccaatggtcaggtagagtattccattatggacggtgatccactcggcgaattcgttatctcacctgtggaaggcgtattaagagtaaggaaggacgtcgaactggaccgggaaacaatagccttctacaacctcaccatctgcgcacgggatagggggatgcctcctttgtcatcaaccatgctagtcggaatccgcgtcctagatatcaatgacaacgatccagttctcctcaacctgcccatgaacattaccatatccgagaattcgcccgtcagttcctttgtcgctcacgtgcttgcaagcgatgccgactccggatgtaatgccagacttacctttaatattacagctgggaaccgtgagcgagcattttttataaatgccacgactggcatcgtgactgtgaatcgcccattggaccgggaacggatccctgagtacaagctaaccatctcagtcaaagataatcccgaaaaccccaggatcgctcggcgagactacgacctgcttctgatttttttgtccgatgagaatgataatcatccactgttcacgaagagtacttatcaagcagaagtgatggagaacagccccgctgggaccccactgaccgtgcttaacggtcctatcctggctctcgacgccgatcaggacatctatgcggtggtgacataccaattgctgggagctcagagtggtctgttcgacatcaacagctcaacaggagtggtgactgtgcggtcgggcgtgataatcgatagagaggctttttcaccacctattcttgaacttctcctgcttgctgaagacatcggcctcctcaactccaccgcccatctgctcatcaccatccttgacgataacgataaccgacccacgttctcccccgctacactcacagtacatctcctggagaattgcccaccagggttctcggttttgcaagtaacagcaacggatgaagatagtggactcaacggtgaattagtgtaccggattgaagcgggagcgcaggatcggttcttaattcatctggtgaccggagtcatccgcgtgggcaatgccacgattgatcgggaagagcaggaatcctatagacttaccgtggtagccacggaccgcggtactgtccctctgagtggaaccgctatcgtcaccattctgattgacgatatcaatgacagccgacccgagttcttgaaccccatccagactgtgtccgtgcttgaatctgcagagccgggaacggtaatcgcaaatatcacagctatcgaccacgacctgaacccgaagctggaataccatatcgtcggtattgttgccaaagacgatactgatcggctcgtccctaatcaggaggatgctttcgccgtaaacattaatacaggctctgtgatggtaaaatctcctatgaatcgggaattggttgcaacatacgaggtaacactgtccgtgatcgacaacgctagcgatctgccagagcggtcggtttcagttcccaacgcaaaactcactgtgaatgtcctagatgtaaacgataacacaccccagttcaagccgtttggaatcacgtattacatggagagaattttggaaggggcaacacctggaactacgttgatagccgtggctgccgttgacccagataagggactcaatggtcttgtcacatacactctgttggacttggttccacccggatacgtccagctcgaagattcctctgccggtaaggtgattgccaaccgcacggtcgattacgaagaggtacattggctcaacttcactgtgcgagcctccgataatggttcccctccaagagccgctgaaatcccagtgtacttggagatcgtcgacatcaacgacaacaacccgatattcgatcagccatcctaccaggaagccgtgttcgaggacgtgcctgtggggaccattatacttaccgtcacagctactgacgccgattctggaaattttgccctcatagagtactcattgggagatggcgagtcaaaattcgctattaaccctaccacgggggacatctacgtcttgtcaagtctggatcgggagaagaaagaccactacattttgaccgcactggcaaaggataatccgggagacgtggcgtccaataggcgggaaaactccgtgcaagttgtgattcaggtgctggatgtaaatgattgccgcccacagttctccaaaccacagttctcaactagcgtatacgagaacgaaccagcagggacttcggtgataactatgatggcaaccgatcaggatgaagggccaaatggcgagctgacttatagcctggagggccctggagttgaggccttccacgtggacatggactcaggtctggtcaccacgcagagacccctgcaatcttacgagaaattctctctgactgttgtcgctactgatgggggtgagccaccactgtggggcaccactatgctgcttgtcgaggttatcgacgtaaacgataaccgccctgtatttgttaggcctcccaatggtacgatcctccatatccgggaggagatccctctcagaagcaatgtgtacgaagtctacgccacagacaaagacgaaggcctgaatggagccgtgcgctattccttcctcaaaaccgcaggaaatcgcgattgggagttcttcataatcgaccctattagtggtctgatccagaccgctcagagactcgatagggagagccaggccgtttactctctgatcctggtagcatcagacctaggccagccagtgccctacgaaaccatgcagcccttgcaggtggcgctcgaagacatcgacgataacgaacccctgtttgtcaggccgcctaagggtagtccacagtatcagctgctgacagtgcctgaacactccccccgaggcacattagtgggcaacgtcaccggcgcagtggacgcagatgagggacctaacgctattgtctactactttatcgctgcaggtaatgaggaaaagaacttccacctgcagccagacggctgtctgcttgttctgcgcgatctggatagagagcgggaagcaattttctctttcattgtaaaggcttctagcaatcgaagttggactcctcctcgaggaccctctcccactttggatttagtcgcagacctgacactccaggaggtgcgagtggtcttagaagacatcaacgaccagcctcctcgattcacgaaagccgaatacacagccggtgtcgccactgacgctaaggtaggcagcgagttaatccaggtgcttgcccttgatgccgatattgggaataacagcctagtcttttatagcatcctggctattcattatttccgcgctttggctaatgactctgaagatgtcgggcaagtgtttaccatggggtccatggatggtattctgagaaccttcgatctcttcatggcctattctcctggctacttcgtggtggacatcgtcgcacgggacctggcgggtcacaatgatacagcgatcataggaatctacatcctgagggacgatcagcgggtcaaaatagtgataaacgagattccagacagggtgcggggtttcgaagaagagtttattcatttgctcagcaacattactggggctatcgtcaacacagataacgtgcagtttcacgtggataagaaggggagggttaatttcgcacagactgagctacttattcacgtcgtcaaccgagacaccaatcggattctcgacgtagacagggtcatccagatgatagacgaaaataaggaacaactgaggaacctgttccgcaactacaacgtgcttgacgtccaacctgccattagcgttcgtctgccggacgatatgtccgcactccaaatggccatcatcgtcctggcgatcctattgtttttggcggcaatgttgtttgttctcatgaactggtactaccggaccgtccataaacggaaactcaaggccatcgtagccggttcggctggcaacagaggctttatcgacattatggatatgcctaacactaataagtactctttcgatggcgcaaatcctgtctggctggatccgttttgtcgcaacctcgaactggctgcccaggccgaacacgaggatgatctgccagaaaatctgagcgaaatcgctgacctgtggaacagtcctacccgcacacacgggacgttcgggagagaaccggctgcagttaaacctgatgacgataggtacctgcgggctgccatacaagagtacgataatattgccaaactaggacagatcatccgggaggggcctatcaagggttccctgctaaaagtggtattggaggattaccttcgcctgaagaaactctttgcccaacggatggtacaaaaggcaagctcatgtcacagtagcatctctgaactgatccagaccgaactggacgaagaacctggtgaccacagcccagggcagggctccttgcggttccgacataagcctccagtggaactcaagggtcccgacggcatccatgtggttcacggatctaccggaacactcctcgctacagatctgaattcactgcccgaagaggatcagaaaggtctaggccgttcgctggaaactctcactgccgctgaggccacagcctttgaaagaaacgccagaaccgagagcgcaaagagtacccctttacacaagctgagagatgtgataatggagacaccgctggagatcactgaactgtac

SEQ ID NO: 56118 - DNA, 3144 bp, Artificial Sequence
  Description of Artificial Sequence: Synthetic coding sequence
atggaggagaaaactcagatcaaaactttcttgggatctaagctcccgaagtacggaaccaagtctgtgcgatccacacttcagcccatgcctaatggtacgcctgtcaaccttctgggcacgagcaagaactcgaacgtgaagtcctacatcaagaacaacggctctgattgcccttccagtcacagttttaattggcgcaaagccaataaatatcagctgtgtgcgcagggagtagaagaaccaaataatactcagaattctcacgacaaaataattgaccctgaaaagcgtgtgccaacccaaggaatgttcgataaaaacggtattaaaggcggtttgaagtcagtttcattgttcacatccaagctggcgaagccgtccacgatgttcgtgtcgagcaccgaagaactgaaccagaagagtttttccggccctagtaatctaggcaagtttactaagggaacgctgctcggcagaacatcctacagtagcatcaatacccccaaatcacagttgaacgggttttacggtaaccgctccgctggatccatgcagcgaccaagagctaattcctgcgctaccagaagtagttcgggggagagcctggcccagtcaccagatagcagcaagagtatcaactgtgaaaaaatggtccgctctcagtccttctcacattccatacagaactcatttctgcctccgagctcgattactagatcccactcgtttaatcgggctgtcgatctgacgaagccctaccaaaaccagcagctgtccatcagagttccactcagaagcagcatgcttaccagaaactctaggcagccagaagtgctgaacggcaacgagcacctcggctatgggttcaatcgtccttacgctgctggcggaaaaaagctggctctgccaaatggtcccggagtaacctccactctgggctacagaatggtgcatccaagtctgctaaagtcaagccggagcccttttagcggcactatgacagtggatggcaataaaaactccccggctgacacctgcgtggaggaggacgcaacggtcctggctaaggaccgggcagctaataaagaccaggaactgatagaaaacgagtcttaccggactaaaaacaatcagacaatgaaacacgacgcaaagatgagatatctgtccgacgacgtagacgatatcagcctttctagcctctcctcgtccgataagaacgacctgtccgaggactttagcgacgattttattgatatcgaagattcaaatcggactcgaataacccccgaagaaatgagcctgaaagaggaaaagcacgagaatggaccccctcaggatatgttcgactcacccaaagagaacgaaaaagcgttcagcaagaccgatgaatggattgatatctctgtttcagatcgaagcgaatgcacaaaacacacatccgggaataatttggtatcccctgacacagactatagggctgggagctctttcgagctgtctccttcagatagcagtgatggcacatacatgtgggatgaggagggtctcgaaccaatcgggaacgttcatcctgtcgggtcttacgaatcctctgagatgaattctattgatatactgaacaacttagagtcttgtgacctggaggacgacgatctgatgcttgacgttgatcttcccgaggacgccccactagagaatgtggagtgtgacaacatgaaccgatttgacaggcccgacagaaacgtccgccagccacaggaaggcttctggaagcggcctccccagaggtggtcaggccaggagcactaccatctgtcgcaccctgatcattaccaccaccacgggaaatcagatctcagccgcggaagcccctatagggagtcacctctggggcacttcgagagctatggagggatgccattcttccaggctcagaagatgttcgtagatgttccagagaatacagttatcctcgatgaaatgaccctgaggcacatggtgcaggactgcaccgccgtcaaaacccagctcctgaagcttaagcggctgttgcaccaacatgatggatcgggtagcttgcacgacatacagctgtccctcccctctagccctgagcctgaggatggagacaaggtgtataaaaatgaagatttgctaaacgagattaaacagctcaaggatgagattaaaaaaaaagacgaaaaaattcagttgctggagttacagctggcgacccagcacatttgccaccagaaatgtaaagaagagaagtgtacctacgcagacaagtatacgcagacaccatggagacgcataccacctcaagtgctacaaccaagtagttcattaccaagaccaaccgaccacacacaaggcaaactgattaagccacagaggatcgaggcaaggagcgaatgttccattcaggatatgcaccaagggggagcacacccagaggaatcatttacgcacgtgctgcatcaagagtcgaactatggcttagaggagcaaccatttagctccggaccccagctaaccatggatgtcgcaaaatctacaccatccgaagccaatctgaatatcacggtcaatgcacaagagccttatcatctcgccaacaaccagatcagcgacatgcagtttatccctacgtcactccagaccccacctgaaagcagtaccgtggaccaggccaaaagagtgggtaggaatcagtctccaccagtgggctatatgagccagcccaagtccttgcagctgcttaaaccgagcatcctgagcagcttagttccaccaccagtaagtgaaagctccccctcacggactccaacctgcaagaagtctccaatcattactacctgtaacagcgctaaattgcaaccgacctcaagtcaaactaaccttgccaataaccagaatctcaaggctagcaagctgcggcctccttctggctccttcaagcagaaacagaccaactctccccaactggaacctcaaagtttccaggccaagacatcaatccctcggccattaacgcagcggaaggaaataatgcagaaccctaacgggaatcttcactcaggcgactgtctggcctccaaccgttatagtagactgcctaagccaaaaattcattag

SEQ ID NO: 56119 - DNA, 786 bp, Artificial Sequence
  Description of Artificial Sequence: Synthetic coding sequence
atgaataggtttgaccggccagaccggaacgtcagacaacctcaggagggcttctggaaacgcccaccccagagatggtctggccaggagcattaccatctctctcatcctgaccactaccaccaccacggtaagtctgacctaagcagaggaagtccgtatagggagtctccgcttggccatttcgagagctatggcggaatgccgttctttcaggcccaaaaaatgttcgtggatgtccccgagaacacagtgatactagatgagatgactctgcgacacatggtacaggactgcacagcagtaaaaacacagctgttaaagttgaagcgactcctccatcagcacgacggcagcgggtctctgcacgatatacagctttccctgccctcttcccctgagcccgaggatggagacaaggtctataaaaatgaggatcttttgaacgagatcaagcaactgaaagacgagatcaaaaaaaaggacgaaaaaatacaactcttggagctccaactcgctacgcagcacatttgccaccaaaagtgcaaagaggagaagtgcacctatgccgacaagtacacccagaccccgtggcgacggatcccgggagggtacagcgccccaagcttcagtccctggcaaggatcattccagggcattcccagaaccgtgcctcctcatcgaaggcaaactagttcgactactgcgttccagcagcctagccaaacgcatcgctctcaccctggcaagacgaacaaagccacgacataccggggaccgcaatag

SEQ ID NO: 56120 - DNA, 3741 bp, Artificial Sequence
  Description of Artificial Sequence: Synthetic coding sequence
atgaaagtgaggcttctgcgacagctctcagcagcagcaaaggttaaggcaccttcaggcctacaaggacccccacaagcccaccagttcatctccctactgctggaagaatacggtgcgctctgccaggccgctagaagcatttctactttcttaggcaccctagagaacgaacacctcaagaaatttcaggtcacatgggaactgcataataagcacctttttgaaaacctcgtgtttagcgaaccgctccttcagtctaacctacctgccctggtaagccagatcagattggggaccacaacacacgatacgtgcagtgaggacacctactcaacactgctgcagaggtatcaacggagcgaagaggagctgaggcgggtagcagaagagtggctagaatgccagaagagaatcgatgcctacgtggacgagcaggacctccagacctcagtgaataaaagtatcgataccgggaccctcgtacagtcatggctcaggggggctgccatgaccatgaaaactaagcagcgtatgttaactgaagattgggaattgttcaaacagagaagatttattgaggagcagctgaccaacaagaaagcagttacaggagaaaataacttcaccgacaccatgcggcacatgttgtcctccagactatcaatgcctgattgcccaaattgtaattacaggaggcgttgcgcctgcgatgactgtagcctctctcacattctaacatgtgggatcatggatccacccgttacagatgatatacacatccaccagctaccccttcaggtggacccagcccctgactatctagcggagcgaagtccaccaagtgtgtcctctgcatcctctggaagtggatctagcagccccattactatacaacagcacccacggctaatcctcactgattctggatctgccccaacatttgatgacgaagacgttgccccattgtccgctaaatttgcagatatctacccacttagtaactatgacgacacagaagtcgttgcgaatatgaacggcattcactctgagctaaatggagggggagaaaacatggctctgaaggatgagagtcctcaaatttcatctacctccagcagctcctctgaagccgatgacgaagaggcagatggggaaagctccggggaaccacctggtgctcccaaagaagatggcgttctgggtagcaggtcaccgagaaccgaagagtctaaagcagattcacccccaccaagctaccctacacagcaggcagaacaggccccaaatacttgtgagtgccatgtatgtaaacaggaagcttctgggttgacacctagcgctatgaccgcaggggctctgccacccggacaccagtttttgagccccgagaagcccacacaccctgccctgcacctgtacccacatatccatgggcacgtgccacttcatacggtccctcacctgccaagacccctgatccatccaacgttgtacgccacaccaccattcactcactccaaggcactgccacctgcccctgtgcagaatcacactaacaagcatcaggtcttcaatgcttcactgcaggatcacatctatccgagttgttttggcaatacccctgaatggaactcttcaaaattcatctccctgtggggcagtgaggtgatgaacgacaagaactggaatcctggcacatttctgcctgacacaatctctggatccgagattcttgggcctacactgtccgagacacggccagaggccctccccccaccctccagcaatgagacacctgcagtgtcagacagcaaggaaaagaaaaatgccgcaaaaaagaagtgcttgtataatttccaggatgcttttatggaggccaataaagtggtaatggcaacatctagcgccacatcgtccgtgtcctgcaccgccacaactgtgcagtccagcaattcccagtttagggtgagctccaaacgccctccatctgttggcgacgtcttccatgggatcagcaaagaggaccatcgacacagcgccccagcagctcccaggaactcgccgaccggactcgccccactcccagcactgtcccccgctgccctttccccagccgctctgagtcccgcaagcacaccacacttggccaacctggccgctccctcatttcccaagaccgcgaccacaacccctggatttgttgacactagaaaaagtttctgccctgctccactgcctccagccaccgacggctcaatttccgccccaccatcagtttgcagcgatccggattgtgaagggcaccgctgcgagaatggcgtgtacgaccctcagcaggacgacggggatgaatcggccgacgaagactcttgctcagaacacagtagctccaccagcacctctactaatcagaaggaaggaaaatactgcgattgctgttactgcgaatttttcggtcacgggggacctccagctgcacctaccagccggaactacgccgaaatgagggagaaattacgactgcgcctcactaaacggaaagaggaacagcccaagaaaatggaccagatatccgaacgcgaaagcgtggtggaccacaggcgggtagaggatctgctgcagttcatcaattcaagcgaaacaaagcccgtctcatctactagagcagccaaacgagcacgccacaagcagcgcaagctggaggagaaggcccgtctggaggccgaagcccgagccagggagcacctgcacctgcaggaggagcagcgccgtagagaagaggaggaagatgaagaggaggaagaggataggtttaaagaggaatttcagcgactacaggaattacaaaaattgcgcgcagtgaagaaaaagaagaaagaacggccatccaaggattgcccaaaactggatatgctgactcgtaacttccaggccgctaccgaaagtgtgccgaatagcgggaacatccacaacggatccctcgagcagactgaggagccagagacctcctctcactctccatcccggcatatgaaccacagcgaaccacggcctggcctgggcgctgatggggacgccgctgatccagtagatacacgcgatagtaaatttctgctccccaaggaagtgaatgggaagcagcacgagccactgtctttcttttttgacataatgcaacaccacaaggagggaaacgggaagcagaagcttagacagacaagtaaggcaagctctgaaccagcgcgtagacccaccgagcctcccaaggcaaccgagggacagagcaagcccagagcgcagaccgagagcaaagccaaggttgttgacctgatgagcattaccgaacagaaacgtgaagagagaaaggtcaatagcaacaataacaataaaaagcagctcaaccacatcaaggacgaaaagtctaaccccactccgatggagcccacttctccaggagagcatcagcagaattctaagctcgtgctggccgaatcccctcagccaaaggggaaaaataagaaaaataagaagaagaaaggtgatcgcgtgaataattcaatagacgatgtgtttctgcctaaggatattgacttggactccgtggatatggacgagacagagagagaggtggagtacttcaagcggttctgtttggacagtgctagacaaacacgtcaaaggttgtccatcaactggtctaatttctctctgaagaaagctacatttgcagcccactag

SEQ ID NO: 56121 - DNA, 3636 bp, Artificial Sequence
  Description of Artificial Sequence: Synthetic coding sequence
atgaaagtccgcctgctgcggcagttgagcgctgcagcaaaggttaaggctccatctggtctgcaggggcctccgcaggcacatcagttcatctcactcctgttggaggagtatggcgctttgtgccaagcagcacgcagcatttctaccttccttggaaccctggagaacgagcacttgaagaaattccaggtcacatgggaactacataacaaacatctctttgagaatctggtcttttctgaacctttgctgcagtcaaatctgcctgctttggttagccaaatacgcctgggaaccaccacccacgacacttgctcggaagacacgtattcaacccttcttcagaggtaccagcgctctgaagaggagctcagacgcgtggctgaggaatggctagaatgccagaagcgcatcgacgcgtatgtcgacgagcagatgactatgaaaaccaaacagcgcatgctgactgaagattgggagctcttcaagcagcggaggttcattgaggagcaacttaccaataagaaagctgtgaccggcgaaaataatttcacagacacgatgcgccacatgctgtcctcccgcctctcaatgcccgactgcccaaactgcaattacagacgtcgctgtgcctgtgacgattgcagtctatcccatatacttacatgcggcatcatggatcctccggtgacagatgacattcatatccaccagcttccactccaggtcgatccagccccagactacttggccgaaagatctccaccctctgtaagttcagcctcttccggaagcgggtctagcagcccaatcaccatccagcagcaccccagattgattttgaccgactcaggttccgcacctacattctgctcagatgacgaggatgttgcccctctgagtgcaaagtttgctgatatttaccccctttccaactatgatgacactgaggtggttgctaacatgaacggtatacattccgagctcaatgggggaggtgagaatatggccctaaaggatgaatcccctcagatctcgtcaaccagcagttcatcctccgaagccgacgacgaggaagctgatggcgagtcttccggcgagccacctggtgcgcctaaagaggacggggtcctcggctcacggagtccaaggaccgaggaatccaaagccgactctccgcctccctcatatcccactcagcaagctgagcaggcgcctaacacctgtgagtgtcatgtgtgcaaacaagaagcatccggcctaacgccgtccgcaatgaccgccggagcgctgcctccaggtcaccaatttctctctccagaaaagcctacccacccagccctgcacctgtatccccatatccacggacacgtcccactccatactgtcccacatttgcctagacctctaattcaccccacgctatacgccacccctccctttacccacagcaaggctcttccccctgctccggtgcagaaccatactaataagcaccaggtgtttaacgcctcccttcaggaccacatctacccctcctgcttcggcaatacaccagagtggaatagctctaaatttatctctctctggggctctgaggtcatgaacgacaagaactggaacccagggacattcctgccagataccatttctggcagcgaaattctcggacctacactgtccgagacccgtcccgaagctcttcctccaccgtctagcaacgaaactccagccgtatctgactccaaggagaaaaaaaacgcagccaaaaagaagtgtctgtacaactttcaggatgcttttatggaggctaacaaagtcgtgatggctacaagcagtgctacttcttctgtctcatgtaccgcaaccacagtgcagtctagcaacagtcaattccgtgtgtcctcaaagcgaccaccaagcgttggcgatgtattccacggcatctctaaggaggaccatagacactcggctcctgccgcaccaagaaattcccctacaggcctcgccccactccctgccctctccccagctgctttatctccagcagccctgtctcctgcctccacacctcacttggctaatctcgccgcaccatcttttccgaaaaccgccactactacacctggatttgtcgacacacgcaaatcattctgcccagctccattgcctccggctactgacggttccatcagtgcacctccgtcggtttgcagcgaccccgattgcgaggggcacaggtgtgagaatggagtgtacgacccccaacaagatgatggtgacgagtcggcggatgaggactcgtgctctgagcattcttcgagcacctctaccagtaccaaccagaaagaggggaaatattgcgactgctgctattgtgagttttttgggcacggaggcccaccggctgccccaactagcagaaattatgcagagatgagagaaaaactgagactgagacttacaaaaagaaaagaggaacagcctaagaagatggatcagatctccgaacgcgaatcagtggtagaccacagacgagtagaagacctgttacagtttattaattcttccgaaaccaaacccgtatcttctacacgcgctgccaaacgggcacgccataaacaacgtaaacttgaagaaaaggctaggctggaagccgaggccagagcacgtgagcatctccatctgcaagaggagcaacggaggagggaggaggaggaggatgaagaagaagaggaagatcgatttaaagaggagtttcaacggttacaggaactgcagaaactgagagcagtgaaaaaaaaaaagaaggagagaccctccaaagactgcccgaaattggatatgcttacaagaaattttcaagccgcaacggaatctgtgcccaatagtggcaacatacataacggaagtcttgaacaaactgaagaaccagagacctcgtctcactccccatccaggcacatgaaccattctgagccacgcccagggctgggcgctgacggcgacgccgctgacccagttgacacaagagattccaagtttttgctgcccaaggaagtaaatggaaagcagcatgagcctctgagcttcttttttgatattatgcagcaccacaaagagggcaacggcaagcaaaaactacgtcagacctctaaggcctccagcgaaccggcaagaagaccgaccgagccgccaaaggcaactgaaggacagtcaaagccacgagcccagacggaatctaaggccaaagtggtggatctgatgtctatcactgaacagaagagggaggaaagaaaagtaaactccaacaataacaataagaagcagctgaaccacatcaaggatgagaaatctaaccccacgcccatggagccgaccagcccaggggaacatcaacagaactccaagctcgtgctggcagaatcaccccaaccaaagggcaagaacaagaaaaataagaaaaaaaagggagaccgggtgaacaattccatagacgacgtcttccttcctaaggatatcgatctcgatagtgttgatatggatgagactgagcgtgaagtcgagtatttcaagagagacggagttagcccacattgtcctggctggtcccgcacccccggtcttaagtag

SEQ ID NO: 56122 - DNA, 2469 bp, Artificial Sequence
  Description of Artificial Sequence: Synthetic coding sequence
atgactcggcgacgaagccggccaagcggcggtgccggacgcagagagagggctagggccgcaggaccgcagaagccacaagcgccagagccgcctccacctccaagcctggaggccggagctggagccggaccgcctgaagcgccagctgaaccggatcatgatggccctcgggaagacgatgagccaaatctggtgccgggacctcaggttccccctgcttccagccagccagtgcagacctgttgcctgttgtgtcaccgcgaacggaaaggctgggaggagggcccaagccagaatggcttagtgcttcagggggaaaagctgccgcctgattttatgcccaagcttgtcaagaacctgctgggcgaaatgccactgtgggtgtgtcagtcctgccgcaagagtatggaggaggacgaacgacagacgggcagagaacatgccgtagctatctcgttaagccataccagctgtaagtcacagtcctgcggggatgatagccattcttcttcttcttcaagtagttcaagcagctcatcctcatcctcgtcttgccccggtaactccggggattgggaccccagctctttcctttctgcgcacaagctgagcggattatggaacagcccccactccagcggcgctatgccaggctcctccttaggctctccccctaccattcctggggaggccttcccagttagcgaacaccaccaacatagtgacttgacagccccacctaattctcctactggccaccatcctcaaccagctagcctcatccccagccacccgagttcttttggttctcctccccaccctcacctattacccactacccccgctgcacctttcccagctcaagcttccgaatgccctgtggctgccgcaacggcaccccatacccccggaccgtgccagtcctcgcacctgccttcaacatctatgccattgcttaaaatgcctccacccttttcaggatgtagccacccctgttctgggcactgtggcggacattgttcaggcccactattgccaccaccaagttcgcagcccctaccctcaacccacagggacccgggatgcaaggggcataaatttgcccactctgggctcgcatgtcagttgccgcaaccctgcgaggctgatgagggtctaggagaggaggaggactcaagcagcgagcgaagctcatgtacgtctagttccacccaccagagagatggaaaattctgtgactgttgctattgtgagttttttggtcacaacgccgagaaagagaaggcacagctcgctgccgaggcactgaaacaggcaaatcgtgtgtcaggatctagagagccaaggcctgccagagagcggctactcgagtggccagaccgcgaactggaccgggttaactcctttctctcgtcccgactacaggagatcaaaaatacagtcaaggattcaattcgtgcttcgttcagcgtctgcgagttgtccatggattccaacggttttagtaaagaaggagccgctgaaccagagccccagagtcttcccccttccaacctctcaggaagtagcgaacagcagccagatatcaacctcgacctgagcccgctaacgttgggcagcccccagaaccacacactgcaggcgcctggcgaaccggctcctccgtgggccgagatgcgaggtccccatcctccttggacagaggtgagagggccaccaccaggaattgtccctgaaaatggtctagtaaggaggctgaacacagtgccaaacctgtctagagtgatctgggtgaaaacgcctaagcccggttacccttcctccgaagagccatcctctaaggaagtgccaagctgtaaacaggagcttccagaacctgtctcttcagggggaaagccccagaagggaaaacggcagggatcacaagccaagaagtcggaagcatcccccgcacctagacccccagcttccctggaagtaccttctgccaaaggacaggtggccggaccaaagcagcccggacgagtgctagaactccctaaggtgggatcctgcgcggaggccggagagggctctcggggaagtaggcccggacccggatgggccggtagtccgaagacagagaaggaaaagggcagctcctggcgaaactggcccggagaggcaaaggctagacctcaggaacaggaaagcgtgcagccttctggacccgcacggccacagagccttcctcagggtaagggaagatctaggagaagcagaaataaacaggagaagccagcgtcttcactggatgacgtgtttctccctaaggacatggacggcgtcgagatggacgaaaccgacagggaagttgaatacttcaagcggttctgcctggactctgcgaaacaaactagacagaaagtagctgtgaactggaccaacttctctctgaagaagacaacaccaagtactgcccagtag

SEQ ID NO: 56123 - DNA, 3798 bp, Artificial Sequence
  Description of Artificial Sequence: Synthetic coding sequence
atgaaggtccggctgttgcggcagctatctgccgcagcgaaggtgaaagccccaagcggcctgcagggaccccctcaggcacatcaatttataagtctgctcttggaggaatatggagctctgtgccaagctgccaggagcatctctacatttcttgggacactcgagaacgagcacctcaagaagttccaggtcacgtgggagctgcataataagcatctgttcgaaaatctcgtgttctctgagccccttctccaaagcaatctccctgctctggtgtcacagatccgactgggcacgactactcatgatacctgctccgaggatacctatagcactttgttgcagcgttatcagaggagtgaagaggaacttaggagagtggctgaggaatggcttgaatgccagaagcgtatcgacgcgtacgtagatgagcagatgaccatgaagaccaaacaacgcatgttgaccgaggactgggagctcttcaaacagaggcggttcatcgaggaacagctgaccaataagaaggctgtgacaggggagaataacttcacggatactatgcgccacatgctctcttctaggctctctatgccagattgccctaactgtaattatcgcagacggtgtgcttgtgacgactgcagcttaagccacatcctcacatgcgggataatggacccgcctgttacagatgacatacatatccaccagctgccacttcaggtggacccagcacccgactacttggcggagcgctcccctcctagcgtgtcctccgcaagcagcggaagcggctccagttcccctatcaccatccaacaacacccacgcctcatcctcaccgattccggctctgcccctacattctgcagcgacgacgaggatgtcgccccactgagcgccaagttcgccgatatataccctctgagcaattatgatgataccgaggtggtggccaacatgaacgggatccacagtgagctcaacggaggcggagaaaatatggccctcaaggacgagtctccccagatctcttctacgagctcaagcagcagcgaagccgatgacgaggaagcagacggggagtcttctggcgaacctccaggcgctcccaaggaagacggggtacttggatctaggagcccacgaactgaggagagcaaggccgatagtccaccaccgtcgtatcccacccagcaggccgaacaggcaccgaatacttgcgagtgccatgtgtgcaaacaagaggcgtcgggcctaaccccatcagccatgactgctggagctctacctcctggacatcagtttttgagccccgagaaaccgacccaccctgcgctgcatctatatccacacatccatggtcacgtacctttgcacacagtccctcacttgcccagaccgctcattcatcccactctgtacgccactccgccattcacacattcaaaggcccttcctcccgcacctgtccaaaatcacactaataagcatcaagtttttaacgctagtctgcaggatcacatttacccgtcttgtttcggtaacactccagaatggaactcatctaaattcatttctctgtgggggtcggaagtgatgaatgataaaaactggaaccccggaacatttcttcctgataccatatccggttcagaaatcctgggaccgactctgtctgagacccgccctgaggcactgcccccacctagcagcaatgaaacccctgcggtgagcgatagtaaagaaaagaagaatgcagctaagaaaaagtgtctctataatttccaggacgccttcatggaggctaacaaggtggtaatggctacttcaagtgcaacatcctctgtgtcgtgcacagctaccaccgttcagtcatctaattcccaattcagagtgtcttcaaagaggccaccctcagtgggggacgtctttcacggcataagcaaagaagaccacaggcacagcgcccctgcggctcctcgcaatagcccaacaggcctcgcaccactgcctgctctttccccagcagcgctcagccctgctgcattgtcacccgcttcgaccccacatctggccaatctggccgctccttcattcccaaaaacggctaccactacgccaggctttgtggatactcggaagtctttctgtccagcaccactgcctccggcaacagatggctcaatctctgcccctccgtccgtgtgcagcgacccagactgcgaggggcaccggtgcgagaacggtgtctacgacccccagcaggacgatggggatgagagcgccgatgaggacagttgctctgaacactcctcttccacttcaacctctacaaatcagaaagaagggaagtattgtgattgttgctactgtgagttcttcggtcacggcggaccccctgccgctcccacgtccaggaattacgccgagatgcgagagaaactcagacttagactaacaaagaggaaggaagagcaacccaagaagatggatcaaatttctgaaagggagtcagttgttgaccataggcgcgttgaggatttgttgcaattcataaactcttcggagacaaagcctgtgtcatctacgcgggctgcaaagagggccaggcataaacagagaaaactggaagaaaaagccaggctggaggccgaagccagggcacgcgaacacctgcacctgcaggaagaacagcgcaggcgagaggaggaggaagatgaggaggaggaggaggacagattcaaggaagagtttcagcgtctgcaagaactccaaaaattaagggccgttaagaagaaaaagaaagaacggccttctaaggattgtcctaagctcgatatgctcaccaggaatttccaagccgcaaccgaatcagtcccgaattcgggcaatatccataacgggagtctcgagcagacagaggagcccgaaacgagctcccactctccatccagacatatgaatcactctgaacctcggccaggactcggcgctgatggcgacgccgctgatccagttgacacccgtgattctaaattcctcctcccaaaggaagtcaatggcaagcaacatgagcctctgagcttttttttcgatatcatgcagcatcacaaagaaggcaacggaaagcaaaagctgcggcaaacgtcaaaagccagctctgaacccgcacgcagaccaaccgagcctcctaaagcgacggagggacaatctaagccccgtgcacagactgaaagtaaagccaaagtagtggatttgatgagtatcaccgaacagaagcgcgaagaacgcaaggtcaacagcaataacaataataaaaagcagctcaatcatatcaaagacgaaaaatcaaatccaaccccaatggaacctacctcacccggagagcatcagcagaattcaaagctagtactagccgagagtcctcagccgaaaggcaaaaataaaaagaataaaaagaagaagggcgatagggtaaacaattccattgacggcgtcagcctactgctgcctagccttggctataatggtgccatcctagctcattgtaatcttcgcctccccggatcatccgattgcgctgccagtgcatcccaggtggtcgggatcactgatgatgtcttcctgccaaaagacatcgacctggatagtgtcgatatggacgagactgaaagagaggtcgagtacttcaagaggttttgccttgacagcgccagacagacacgtcaacgcttgtcaattaactggtcgaacttctcccttaagaaagctacctttgctgcccattag

SEQ ID NO: 56124 - DNA, 3675 bp, Artificial Sequence
  Description of Artificial Sequence: Synthetic coding sequence
atgaaggtgcggctgttgcgccagctgagcgccgcagccaaggtgaaggcaccctccggactgcaagggccacctcaggcacatcagttcatttctttgctgctggaggagtacggagcactctgccaggcggcaagaagcataagtactttcctgggtacactggaaaacgaacaccttaaaaagttccaggtgacgtgggagctgcacaacaagcacctgtttgagaatctggtattttcagaacctttgctgcagagcaaccttcccgctctggtgtcacagatccgactgggaacaacgacccacgacacgtgctccgaagatacatattctaccctcctgcaacgatatcagcggagtgaagaagaactgagaagagtggccgaggagtggctggaatgtcagaaacgcatcgacgcatatgtagacgaacagatgaccatgaaaaccaaacagcgtatgctcaccgaggattgggagctattcaagcagcggcgatttattgaagaacagctgacaaacaaaaaggccgtcaccggcgaaaataactttactgatactatgaggcacatgcttagttcccgcctgagtatgcctgactgcccgaattgtaactaccggaggaggtgtgcatgcgatgattgctctctgtcccacatccttacctgcggcattatggatcctcccgtgaccgatgatatccacattcaccagctgcctctccaagtggatcctgccccagactaccttgcggaacgttcacccccttccgtatcaagtgcaagctcaggcagcggctcatcatctccaattactatccagcaacacccgaggctaattctcaccgactccggttctgcacctacgttttgttccgacgatgaggacgtcgcccctctgtcagccaaattcgctgacatctaccccctctccaattacgatgacaccgaagtcgtggcaaacatgaacggcatccactccgagttgaacggaggtggtgaaaatatggctctcaaggacgagtcaccccagattagtagcacttccagtagctcatccgaggccgatgatgaggaagcggacggggagagtagtggagagccacctggggcacctaaggaagacggtgttctggggtctagatcccctcgcacggaagaatctaaggcagactccccccctccaagctatcctacccagcaggcggagcaggctccgaatacctgtgagtgtcacgtgtgtaaacaagaggccagcggcttgacccctagcgcgatgacggcgggagccctgccccctggacatcaatttctgagccctgaaaagcctacgcatcccgcactccatctgtatccacacatccacggccacgttccactgcacacagtcccccatctgcctcggccactgattcatcctacactgtatgcaactccacctttcacgcactctaaagccctcccccctgctcccgttcaaaatcacactaacaagcatcaggtctttaatgcgagtctgcaagaccacatctacccctcttgcttcggcaacacgccggaatggaacagtagcaaatttatcagtctttgggggagtgaagtgatgaatgacaagaactggaacccagggacttttttgccagatacaatcagtggttccgaaattctgggaccaaccttatctgagacacggcctgaagcccttccacccccttctagtaatgagacacctgccgtgagtgactcaaaagaaaaaaagaatgccgcaaagaagaaatgtctctacaactttcaggatgcttttatggaggccaacaaggtggtcatggcgactagctctgccacatcttccgtctcttgtactgccaccacagtgcagtcttcgaactcacagtttagagtctcatctaagcggccaccatctgttggggatgtgtttcatggaataagcaaggaagaccacagacactctgcacctgcagcacccagaaactcccctactggactggctcctctccccgctctttcgcctgccgctctgtccccggcagccctgagtccagcctcaactccccatttggctaatctggcagcccctagctttcccaaaactgcaacaacgacccccggattcgtggacactagaaagagcttctgtccagcaccattgcctcccgctacagatggctcaatttccgccccaccctcagtttgtagtgacccagactgtgaaggccatcgatgcgaaaatggagtctatgatccgcagcaggatgatggcgacgagagcgccgacgaggacagctgctcagaacactcctctagtacctccacctccacaaatcaaaaagaaggaaaatattgtgactgttgttattgcgaattctttggtcacggtgggccaccagcggctccaacgtcacgcaattacgctgaaatgcgcgagaagctccgactgagactaaccaaacgaaaggaggagcagccaaaaaagatggaccagatatcagagagagagtccgttgtagatcacaggagggtcgaggaccttttacaatttattaattccagtgagactaagcctgtctcatctaccagggccgcaaagcgtgccaggcataagcaacgaaagttggaggaaaaagccaggctcgaggctgaagcccgagccagggaacacctacacctgcaggaagagcagaggaggagagaggaagaagaggatgaggaagaggaggaggatagatttaaagaagagttccaacgactgcaagaactccaaaaactgagggcagtcaagaagaagaaaaaagaaagacctagcaaggattgtcccaagctggacatgttgacaaggaatttccaagccgcaacagagagcgtgccaaattccggaaacattcacaacgggtctttagaacagacagaggagcctgaaacctcttcacactcaccaagcaggcacatgaaccattccgagccaagacccggtctcggcgcagacggcgatgctgctgaccctgtggacaccagggattctaagtttctcctgcctaaggaggttaatgggaaacaacacgagcccctgagcttcttctttgatataatgcaacaccacaaagagggaaatggcaagcagaagctcagacaaacatcaaaggcatcttccgaaccagcccgacgacccactgaaccccctaaagcaactgagggccagtcaaagcccagggcgcagactgagagtaaggctaaggtcgtagatctaatgtcaatcactgaacagaagcgcgaagagagaaaggtcaactcgaacaacaataacaagaaacagcttaatcacatcaaggatgagaagagcaatcccacgcccatggagcccacatcaccgggagagcaccagcagaattcaaagctcgtgctggctgaatcacctcagcctaagggcaagaacaagaaaaacaagaaaaagaagggcgaccgcgtgaacaattcaattgatgacgtgttcctaccaaaggacattgacctggatagcgtagacatggacgaaaccgagagagaggtggaatactttaagcgcttctgcttagatagcgctcgccaaacaaggcagcgccttagcatcaactggagtaacttcagtctgaagaaagccacatttgcagcccattag

SEQ ID NO: 56125 - DNA, 132 bp, Artificial Sequence
  Description of Artificial Sequence: Synthetic coding sequence
atgaaggtcaggctcctccggcagctgtcagctgctgctaaggtgaaggcaccaagcgggctacagggtccaccacaggctcatcagttcatcagtctgctgctcgaggagtacggcgctctgtgccagtag

SEQ ID NO: 56126 - DNA, 3021 bp, Artificial Sequence
  Description of Artificial Sequence: Synthetic coding sequence
atgacaatgaaaaccaagcagcgcatgcttacagaggattgggagctctttaaacaaagacgcttcatcgaagaacaactcacgaataagaaagccgtgacaggggaaaataattttacagacacgatgcgtcacatgctaagctcgagactgtccatgccggattgtccgaactgcaactaccggaggagatgtgcctgcgatgactgtagcctctctcacatcttaacttgtggcatcatggatcctcccgtcacggacgatattcacattcaccaactccctctgcaggttgatcccgctccagattacctcgccgaacgttcccctccatccgtgagcagtgcctcgagtgggtccggatcatcatcacctataacaatacagcagcatccacggctgattctgacagatagtgggagcgcccctacgttttgctccgacgacgaggatgttgcgccactgtcagcaaagtttgctgacatataccccttgagtaactatgacgataccgaagttgttgccaatatgaacggtattcatagtgagctaaatggcggtggagagaatatggctcttaaagacgagtccccccagatctcaagcacttcctccagctccagtgaggccgacgacgaggaggccgatggagaaagcagcggcgaaccccctggcgctccaaaggaagacggagtcttggggtccaggtcccccaggaccgaggaatcgaaagcagactccccccctcccagctatcctacacagcaggccgagcaggctccgaacacctgtgagtgccatgtctgtaagcaggaagctagtgggctcacaccatctgcgatgaccgccggtgcactaccccctgggcaccagtttctcagtcccgaaaagcctactcatcctgccctccacctgtaccctcacatccatggacacgttccgctccataccgtaccacatcttccgaggccattaattcatcccaccctctatgccacacctcctttcactcacagtaaggcgctgccacccgctcccgtgcagaatcacacaaataaacaccaggttttcaatgcaagcttgcaggatcacatttacccttcttgttttggaaatacaccggagtggaatagcagcaaattcatatccctgtggggctccgaggtgatgaacgacaaaaactggaatccaggcacttttttgcccgacactatttctggcagcgagattctggggcctactctctccgagacaagaccagaggcgctgccaccgccatcctcgaatgaaaccccggctgtgtcagatagcaaggagaaaaaaaatgcagctaaaaagaaatgcctgtataatttccaggatgccttcatggaagctaacaaggttgtgatggccacctcctcagccacctcatctgtcagttgcacagctactaccgtacaaagtagcaattctcaatttcgggtcagttcaaaacgcccaccaagtgtcggggacgtgtttcatggcatcagcaaagaggatcacaggcattcagcccctgccgctcccagaaacagtccgaccggcctggccccattaccagctctctctcctgccgctctgtctcccgctgccctgtctcccgctagcactcctcacctggccaatcttgctgccccaagctttccaaaaaccgccacaacgacacctgggtttgtagacaccaggaagtcattctgtcctgccccactgccgcctgcaacagacggttctatctcagcccctcccagcgtgtgcagcgacccagactgtgaggggcaccgatgtgagaatggtgtctacgaccctcagcaggatgacggagacgagagtgcggacgaagacagctgttctgagcactcgtcgtcaacttcaacatccactaatcagaaagaaggtaagtattgcgattgctgttactgcgaattcttcgggcatggcggaccccctgccgcaccaaccagtagaaactatgccgaaatgagggagaaactgcgactgaggctcaccaaacgcaaggaagagcagccaaagaaaatggatcaaatctctgaaagggaatcagttgtggatcacaggcgcgttgaggatctgctccaattcatcaatagttccgaaacaaagccagtgagctccacaagagcagctaagcgggcacgccacaagcagcgcaagctcgaggaaaaagcaagactggaggctgaggctcgggctcgcgagcatctccatctgcaggaagaacagagaaggcgcgaagaggaggaggatgaagaagaggaagaagaccggtttaaggaggaatttcagcgactgcaagagctgcagaagcttcgggctgtaaagaaaaagaaaaaggagcggccatccaaggactgtccgaagcttgacatgcttacacggaacttccaggcagctaccgagagcgtcccaaattccggtaatatccataacggcagcctggagcaaacagaggaacccgaaacctctagccactctccttctagacatatgaatcacagcgaacctcgaccagggctgggcgctgacggtgacgcagccgatcccgttgatactcgggacagcaagttccttctacccaaggaggtgaatggcaaacagcatgaacccctgtcattcttcttcgacatcatgcagcaccacaaagaaggcaatggcaagcagaagttgaggcagacatctaaagccagctcagagcctgccaggcggcctactgaacccccaaaagcaaccgaaggccaaagcaaaccacgggctcagacggaatcgaaggcaaaagttgtggatctgatgtcaattacagagcagaaaagagaagagagaaaggttaacagcaataacaacaataagaagcaactaaatcacatcaaagatgagaagtccaatccaactcctatggagcctactagtcctggcgagcaccagcaaaacagcaaactcgttctggctgaaagcccacaaccaaaagggaaaaacaaatag

SEQ ID NO: 56127 - DNA, 3636 bp, Artificial Sequence
  Description of Artificial Sequence: Synthetic coding sequence
atgaaggtacgtttgcttaggcaactatcagctgcagccaaagtaaaggctcccagcggcctacagggcccacctcaggcccatcagttcatcagcctcttgctcgaggagtacggcgctctatgtcaggctgcacgctctatttctaccttcctgggcacccttgaaaacgaacacttaaaaaagtttcaggtcacttgggagttgcacaacaagcacctcttcgagaacttggttttttctgagccactgctccagtcaaatctacctgccctggtgagtcagatacggctcggtacgactacacacgatacctgcagcgaagacacgtattccacgctcttgcagcggtatcagcgctccgaggaggaactgaggagggtagccgaggagtggctagagtgtcagaagcggatcgatgcttacgtggatgaacagatgacaatgaagaccaaacagagaatgctgacagaggactgggagctgtttaagcaacggagattcatcgaggaacagctgaccaacaagaaggcggtcactggtgagaataatttcacagatacaatgaggcacatgctgtcatcccgcctgagtatgccagactgcccaaattgtaactacagacggaggtgtgcatgtgatgattgtagtctgagccatatcctgacatgcgggatcatggaccctcctgttacagatgatatacatatccatcaactccctctgcaggttgatcccgctcccgactacttggctgaacgatccccgccatccgtttcgagcgcctcttcgggttctggctctagcagccccatcaccattcagcagcatcctaggcttattctgacggactcagggtctgctcccacgttctgtagtgacgatgaagacgtggctcctctcagtgcaaaattcgcagacatctatccccttagtaattacgacgacacagaagtggtcgctaatatgaacggaattcattctgagcttaatggcggaggcgagaacatggcactcaaagacgaatccccgcaaatctctagtactagtagtagcagcagcgaagctgacgatgaggaggcagatggcgagtcgtcgggcgaacctcctggggctccgaaagaagatggtgtgctcggaagtcgatctccacggactgaggaatcaaaagctgattccccgcctccctcttaccccacccagcaggctgaacaagcgccaaatacatgcgaatgccatgtgtgtaaacaagaggcctctggattgacaccctcggccatgacagcaggcgcactgccacctggccatcagttccttagcccggagaaacctacacaccccgcactccatttgtatccgcacattcatggtcacgtgccgttgcacaccgttcctcatctccctcggcctttgattcaccctactttgtatgccactccgcctttcactcacagtaaggctttaccaccagctcctgtgcagaaccacaccaataagcatcaggtgtttaatgcatccctgcaggatcatatctaccctagctgcttcgggaacacccctgagtggaattctagcaagtttatctccctgtggggtagtgaggttatgaatgataaaaattggaatccagggactttccttcctgataccattagcggttccgaaattctgggtcccaccttgagtgagacacgcccagaggccctccctccccctagttctaatgagaccccagcagtcagcgactcaaaggagaagaaaaacgccgctaagaaaaaatgcctatacaactttcaggacgcctttatggaggctaacaaggtagttatggcaacctcctcggctacctcttctgtgtcctgcaccgccaccacggtccagtcttccaacagtcaattcagggttagctcaaaaaggcccccaagtgtgggggacgtctttcatggcattagcaaagaagatcacaggcactctgctcctgctgcacccagaaactcccccacagggttggcccctttaccggctctatcccccgctgcactgtcacctgcagcgctgtcacctgccagcacaccccaccttgctaatttagcagcaccgagcttcccaaagaccgccaccaccacccctggcttcgtcgacacacggaagagtttttgtcctgcacccctgcccccagccaccgacgggtctatttccgctccaccatcagtgtgttccgatcccgattgcgaggggcatcgctgcgaaaatggcgtgtacgatcctcaacaggatgatggtgatgaaagcgccgacgaggacagttgcagtgaacatagcagcagtacgtctacaagcacgaaccagaaggaaggcaagtactgcgactgttgttactgcgagtttttcggccacgggggaccccctgccgctccaacttcccgcaattacgcagagatgagagaaaagcttcgtctcagacttacaaaacgaaaggaagaacagcccaagaagatggatcagattagcgaacgggaatctgtggtggaccaccgcagagtggaggacctgctccagtttatcaactcttccgaaactaagcccgtcagcagcacacgtgcggcaaaaagggccaggcataaacaacgcaaactggaggagaaagcacgtctagaggccgaggccagagctcgggagcacctccacttgcaggaagaacagcggagacgcgaagaagaagaagatgaagaagaggaagaagaccgtttcaaggaagagtttcagcggctgcaggaactccagaaactgcgggctgtgaagaagaaaaaaaaggagcggccttctaaagactgcccaaaactggacatgttgactcggaacttccaggccgctacagagtccgtgcctaacagtggaaatattcacaatgggtccttggagcagactgaggagcccgagaccagtagtcattctccatccagacatatgaaccactccgagcccagaccagggctgggggctgatggagatgccgctgacccagtggataccagagacagcaagttcttactccctaaggaggttaatgggaagcagcatgaaccactctcatttttctttgatatcatgcagcaccacaaagaggggaatggtaagcaaaaactccgccaaactagtaaagccagcagcgagcctgcacgacggcctactgagccccctaaggccacggagggacagtccaaaccgagggcacaaacggaaagcaaggccaaggtggtcgatttaatgtctatcacggagcagaaaagggaagaacgcaaggtcaatagcaataataacaataaaaagcaacttaatcatatcaaggacgagaagtccaatcctacaccaatggaacctacatcccctggcgagcatcaacagaacagcaaactcgttctggccgaatctcctcagcctaagggaaaaaacaaaaagaataaaaagaaaaaaggagatcgcgtcaacaatagcatagacgatgtgttcctgcccaaagacatcgatctcgatagtgtcgacatggatgaaacagagagagaggtcgaatactttaagagagatggtgtatccccgcactgcccgggatggtccaggactcccggactgaaatag

SEQ ID NO: 56128 - DNA, 1347 bp, Artificial Sequence
  Description of Artificial Sequence: Synthetic coding sequence
atgaaagggggaacattggggggaattcccggagagccggcagtggatcacagagacgtggacgagttgctggagtttatcaatagtacagaaccaaaggttcccaattcagcccgtgctgctaagagagccaggcacaaactcaagaaaaaagagaaagaaaaagcgcaactggccgcagaggccctaaagcaggcaaatagggtatcaggcagccgggagccccgaccagcaagagagagactgctcgaatggccagacagggaactggatcgcgtgaacagctttctgagctctcgtttgcaggaaatcaaaaacaccgtcaaggactctatccgggcatccttctcagtgtgtgagctgtctatggattctaacggttttagtaaggagggggcagctgagcccgagccgcaaagtctgccaccgagcaacctgtctggtagctctgaacaacagcccgacatcaatctagacttatcaccactcaccctggggagcccgcagaaccacaccttgcaagccccaggagagcctgcccctccatgggcagagatgagggggccacaccccccttggaccgaagtccgcggtccaccgcctggaatcgttccagaaaacggcctcgttaggagacttaacaccgtgcccaaccttagccgagtaatttgggtgaagaccccaaagcctggctaccccagctcagaagaaccttcctcaaaggaggtccccagttgcaagcaggaacttcctgaacccgtgtcgtctggtggcaagcctcagaagggcaagcgccaaggatcacaggccaaaaagtccgaagcatctccagctccacgccctccggcaagcttggaggttccctccgccaagggccaggtcgccggtccaaagcagcctggtcgcgttttggagctgcccaaggttggatcttgtgccgaggctggggaaggctctagaggttcccgccctgggcctgggtgggccggatcaccaaagacggaaaaggaaaaggggagctcatggcgcaactggccaggggaagccaaagctagaccacaagaacaggaatccgtgcagccttctggtcccgcaaggccccaaagtcttccacagggaaagggacgctctcgaaggagtcgcaacaagcaggaaaaacccgctagctctctggacgacgtgtttcttcccaaagatatggatggagtggagatggatgaaacagacagagaagttgagtatttcaaaagattttgcctcgactctgccaagcagactagacagaaagtggctgtcaattggacaaatttctccctcaagaagactaccccaagtaccgcccaatag

SEQ ID NO: 56129 - DNA, 2370 bp, Artificial Sequence
  Description of Artificial Sequence: Synthetic coding sequence
atgccaaagttagtgaagaacctgctaggagagatgcccttgtgggtttgtcagtcatgtcgcaaatccatggaagaggacgaacgccagactggtagagagcatgctgtggcaatctctttgtcacacacaagctgtaaatcccagagctgcggagatgactcacactcgtccagttctagttcctcatcttccagtagttcctcatcaagcagctgcccagggaactccggagattgggaccccagttcctttttaagcgcacacaaactgtccggactgtggaacagtccgcactcttccggagctatgcctgggagttctttgggctcccctccaaccatccctggcgaggctttccctgtgtcagagcaccaccagcactcagatctcacagcccctcccaacagtccaactggtcatcatccccagccggctagcctgatcccgtcccaccctagttcatttgggtctcctcctcatccccatctgctgcccacaacaccagctgctccatttccagctcaggctagtgaatgccctgtggccgcagccacagcacctcatactccaggaccctgccagagtagccatttaccgagtacgagcatgcctctgctcaaaatgcctccccctttctcagggtgctcacacccatgttccgggcactgtgggggacactgtagcggcccacttctgcctcccccaagctctcagcctttgccatctacccatcgtgaccccggttgtaaaggccacaaatttgcccatagtggcctggcttgtcagctcccccaaccatgcgaggccgacgaaggcctgggtgaggaagaagatagcagttctgaacgctcctcatgtaccagcagctctacacaccagcgcgacggtaagttttgcgactgttgttattgcgagttcttcggtcataatgcgccacccgcagctcccacttctagaaattacacagagatacgcgaaaagctacgcagccgccttacgcggagaaaagaagaattgcctatgaagggtggcaccttagggggaatcccgggagaacccgctgtggatcacagggacgtcgatgaattgcttgagttcatcaatagtaccgaacctaaggtgcctaatagtgctcgtgcggcaaagcgcgcacggcataaactcaaaaagaaggaaaaagaaaaggcccagcttgccgctgaagccttaaagcaagccaatagagtctcgggcagccgagaacctagacctgccagggagcgtttacttgaatggcctgacagggagctggaccgggtgaatagctttctcagtagccgcctgcaggagataaaaaacactgtcaaagattctattcgggctagcttctcagtttgcgagctgagcatggactctaacggcttttctaaagagggtgctgctgaacccgaacctcagagtctgccaccctcaaatctgagtggctcgtccgagcagcagcccgatatcaaccttgatctttccccgctcactctaggcagccctcagaaccatacgcttcaggccccaggcgagcccgcacccccttgggccgagatgcgtgggcctcacccaccttggaccgaagtacgaggacctcccccagggatcgtgcctgagaacggcctggttaggcgtctcaacaccgttcccaacctgagccgggtgatatgggttaagactcccaagcctggttatccctcgagcgaggaaccttctagcaaggaagtgccgtcctgcaagcaagaattacctgagccggtgtccagcggtggtaagcctcagaaggggaaacgtcagggaagtcaagccaaaaagagtgaagcgagccctgcccctcggccacccgcatccctggaggtgccctctgccaaaggccaggtggccggaccaaagcagcctggcagggtgttggaactccccaaggtaggctcgtgcgccgaggctggagagggatcccgagggtctagacctgggccaggctgggcaggttcccctaagacggagaaagagaagggtagcagctggcgcaactggccaggagaggctaaggctagacctcaggaacaagagagcgtgcaaccttcaggacccgctcgccctcagagtctcccacagggaaagggacgctccagacgcagccggaataagcaggaaaagcccgcttcatccctcgacgatgtatttctacctaaggacatggacggggtggagatggacgagacagatcgggaggtggagtactttaagcgcttttgtcttgactcagccaagcagacaaggcagaaggtggccgtgaattggaccaattttagcctcaaaaaaacaaccccaagcaccgcccagtag

SEQ ID NO: 56130 - DNA, 1992 bp, Artificial Sequence
  Description of Artificial Sequence: Synthetic coding sequence
atggcccatcttcggtccccgtccgggttcggcgatcctggcaagaaggatcaaaaggagtcagaagaggaacttgaagaggaggaagaggaggaggaagtggaagaggaggaagaggaagtagaagaggaggaggaggaggtcgaagaggaggaggaggaagtagtcgaagaggagctcgtcggggaggagcaggagttagaagccccagaaactttctcagaggaatatctgtggaaagtcacagacataggcgattacgacgacgatttcccagacgtgagaccccgactggcatctatcgtctccccttcccttacatctacattcgtgcctagccagagcgccacttccactgaaacaccttccgcatcgccaccttcatctacatcatcacacaagagttttcccaagatcttccagacatttagaaaagatatgagcgagatgtccattgaccgcaacatccaccgcaacttatctcctgggattcctgtgtccgtccagacagaggagagctggcttcaggacctttccgacaaggtccagtctaggaagaaggcctctaaggagaaagccgagcctgagtgcctggcatcaaagttacgggaaaaatgggtgattaacccagaggaatctaagcttaatattctgtacgagctagaattcaaagaagattttataaccctgtttgagcccagcctcaggacactgccatccatcggtcccccaagcattctggcttataaggaagagtccagtaacctgggaatcaacttcaaggacgaagaggaggaaacgagtcctaaatgcgagttttgcggcagtgatctaagggccttttttagcaacgtcgacgtctcctcagaaccaaaaggccatgcttcttgctgcatcgcttttcagaaccttattgattatatctatgaagaacaaataaagactaaaccgcctaaggccgagctcatcgctatcgatccacacgctgctcacggttccgaggttgaccgtttgaaagcaaaagagaaggcactccagaggaagcaggagcagcggatggccagacacttcgccatcatctcacgcgagcagacacattttagcgaagatgattcaaaacgccttaaaacaatttcttatcagctcagcgtggatattcctgagaagcagattatagacgacattgtgtttgattttcagctgagaaactctaatatgtccattatatgttgtgactcgaggatagcctgcggtaaggtggtgagaaatgagctcctcgaaaagcactacaagcacggctcgaagttcctcacgagtttccccgacggcactacacagatcttttatccttcggggaatcttgcaataatcagggtcccaaataaagtcaacggcttcacttgcatagtgcaggaagacatgccgactaacccagccatcctggctgtgctggatagcagtggaaggtccagctgttaccatcccaatggcaatgtgtgggtgtatattaacattctgggaggacagtatagtgaccaggctggcaataggatccgagcatggaattggtccaatagcataaccagctcaccctttgtcagctttaagccggtgttcctggccctgaaccgctacataggtgtgagaatactggagcaagacaagatcagcattacctttctggccatgggtcagcaggcaaggatttctgttggaacaaaggtgaagctccctaatcctgaagaaatccccatattgaggtatgttagtggcgacgatctcctgctgctggcttccctgataaaaatccgtcgtctgttccataagctggaaggatgcgttaactttccgtcgtcacaggtatgggaaaaacttaagcagccaagctatctatcctccctatccctcaaactcattgctctatgtcattcatccggcatcaaacaggatatcatgaagacgattagaaacattatcaacgaggagatctag

SEQ ID NO: 56131 - DNA, 1866 bp, Artificial Sequence
  Description of Artificial Sequence: Synthetic coding sequence
atggcccacctgcgatcacctagcggattcggtgatccaggaaagaaggaccaaaaagaatccgagcaggaactcgaggcccctgagactttcagtgaggaatacctttggaaagttactgatattggcgactacgacgacgactttcctgacgtccgacctcggctcgccagtatcgtgtcacctagcttgaccagcacgtttgtgccgagtcagagtgcaactagcaccgaaacaccatccgccagtcctccaagtagtacctccagtcataaatcatttcctaaaatttttcagacctttcgcaaagatatgagtgaaatgtctatcgaccggaacatacaccgcaatctctcccctggcattcccgtctctgtgcaaaccgaggaatcctggttgcaggacctgtctgataaagtccagtctcgcaaaaaagcatcgaaggagaaggccgagcctgaatgtctggccagcaagctccgagaaaagtgggttattaaccccgaagaatctaagctgaatattctctatgaattggaattcaaagaagatttcatcaccttgttcgagccctcattgcggacacttccgtccatcggacctccttctatattggcctataaggaggagtcttcaaatctggggataaatttcaaggacgaagaagaagagaccagtcctaagtgcgagttctgcggaagcgacctgagggccttcttttccaatgttgacgtctctagtgagccaaagggccatgcttcctgttgtatcgctttccagaatttaatagactatatttacgaggagcagatcaaaactaaacctccaaaggcagaactcatcgcgatagaccctcacgcagcacacggctccgaagtggaccgactgaaagccaaggagaaggcactccaaagaaaacaggaacagagaatggcacggcacttcgccattattagtagagagcagacacactttagtgaggacgatagcaagagacttaagaccatcagctaccagctctctgttgacataccagagaaacagatcatcgacgacattgtgttcgacttccagctgcggaattctaatatgtcaatcatctgctgtgactctaggatcgcctgcggaaaggtggtccggaacgaactgctagaaaagcactacaagcatggttcaaaattcttgacgtctttccctgatggaactactcaaatcttctatcccagtggtaatctggccataatcagagtgccaaacaaggttaatggattcacttgtatagttcaggaggatatgcctacaaacccagcaattcttgcagtgctggacagttccgggaggtcgtcctgttatcaccccaacgggaatgtgtgggtgtacattaacattctgggcggacagtactccgatcaggcaggaaatcggatccgcgcatggaactggtccaattctatcacgtcatcacctttcgtgtccttcaagcccgtcttcttggctctcaatagatatatcggcgtgcgtatcttggaacaggataaaatcagtataaccttcctggcaatggggcagcaggctcgaattagcgttggtactaaagtaaagctgcctaatccggaggaaatccctatcttacgatatgtgagtggcgacgacctactattgctggcctctttgattaagatccggaggttgttccataaacttgagggatgcgtcaatttcccctcttcccaggtctgggaaaaactcaagcagccgtcctatctatcatccctgtctctgaaactcatcgctctgtgtcattccagtggtattaaacaggacatcatgaaaacaatccggaatatcatcaatgaagagatttag

SEQ ID NO: 56132 - DNA, 2091 bp, Artificial Sequence
  Description of Artificial Sequence: Synthetic coding sequence
atgtcagcagagaataatcagttgagcggcgcatcgccccctcatccccctacaactccccagtactctacacagaacttgccgagcgaaaaggaggacacagaggtggagcttgatgaagagtctctgcaggacgaatcccccttttctcccgagggggagtctttagaggataaagaatacctggaggaggaggaggatcttgaggaagaagagtacctcggaaaggaagaatatcttaaagaagaagagtatctaggcaaagaagaacatctggaggaggaggaatacttggagaaggccggatacctggaagaggaggaatatattgaggaagaggagtatctaggcaaggagggctaccttgaagaggaagagtacctgggcaaagaagagcaccttgaggaagaagagtacctcgggaaagagggatatctagagaaagaagattacattgaagaggtggattacctcggcaagaaggcctatctcgaagaagaagagtacctgggcaagaaaagctacctggaagaagagaaggccctggaaaaagaggagaacttggaggaggaggaagccttggaaaaggaagaaaacctggacgggaaagaaaacctctacaaaaagtacctgaaagagccgaaggcctcttacagctcccagaccatgctgctaagagacgcacgaagcccagacgctggcccaagtcaggttacaacttttctcactgtgccgttaacatttgctaccccgagccccgtctctgagagcgcaacggaatcgagcgaactgctcctgactttgtaccggaggtcacaggccagtcagacggactggtgttacgatcgaaccgcggtcaagtcgctgaagtcaaagtccgagaccgagcaggaaaccaccacgaagctcgcaccagaggagcacgtgaacactaaagtgcagcagaagaaagaggagaatgtgctggagttcgccagcaaagagaacttctgggacggtattaccgacgagtctatcgacaagctggaagttgaagatttggacgaaaactttctgaattcttcctatcaaacagtgtttaaaacgattattaaggaaatggctgctcacaatgagctggaggaagattttgatattcctctgactaagttgctcgagagcgagaacaggtggaagctggtgattatgctgaaaaagaattacgagaagttcaaggagacaatacttcgaataaagaggagaagggaggcacagaagctgactgaaatgacaagctttactttccatctaatgtccaagcccacgccggaaaagcctgagacagaagagatacagaagccccagagggtggtccaccatcgaaaaaagctcgaaagggacaaggagtggatccagaaaaagacagtagtgcaccagggggacggtaagctgatcttgtaccctaataagaatgtttaccagattctgtttcccgatggcaccggccagattcactacccctcagggaacctcgcaatgcttatcctgtatgctaagatgaagaagtttacttacatcattctggaagacagtttggagggaagaattagagcactcatcaataattccggcaacgcaaccttctatgacgagaattcagatatatggctcaatctctcctccaatcttggctattattttccaaaggacaaacggcagaaggcctggaactggtggaatctcaacatccacgttcacgctcccccagttcagcccatctccctgaagatcaacgaatatattcaggttcagattcggtcccaggataaaataatcttctgtttcacttacgaacagaagcagatatgtctgaatctcggcaccagatataagtttgtcattccagaagtcctgagcgagatgaagaagaaaactatccttgaagctgagccaggacccacagcccagaagatcagagtgctgctcgggaagatgaatcgcctgctgaattatgctaccactcctgatcttgaaaactttattgaggctgtgtccattagtctgatggacaataaataccttaaaaaaatgttgtcaaagctctggttttag

SEQ ID NO: 56133 - DNA, 483 bp, Artificial Sequence
  Description of Artificial Sequence: Synthetic coding sequence
atgtataccataacgaagggtcccagtaagttggtcgcgcagcgccgaaccggccctactcagcagcaagtggaaggcaggctgggcgagctgttaaagtgtaggcagcccgctccacctactagccagcctccacgcgcacagccctttgctcaacctcctggcccatggcccctctcctctcccggtcccagattagtgtttaatagggtgaacggaagaagagccccttccacctcccctagtttcgagggcacacaggaaacttacactgttgctcacgaggagaatgtgaggttcgttagtgaagcatggcagcaagtacaacagcagcttgacggcggacccgctggtgagggaggcccacggcctgttcagtacgttgaaagaacccccaacccaaggctgcaaaatttcgtgccgattgacttagatgagtggtgggcacagcagttcctagcacggattacaagctgcagctag

SEQ ID NO: 56134 - DNA, 585 bp, Artificial Sequence
  Description of Artificial Sequence: Synthetic coding sequence
atgtacacaatcacaaaaggtccaagcaagctggttgcccagcgtagaactggtcccacacagcagcaggtagagggcaggcttggtgaacttctgaaatgtcggcagcctgcacccccaacttcacagccgccaagggcccaaccgtttgcacagccaccagggccatggcctctttcatcccctggcccaaggctggttttcaatagggtcaatggaagaagagccccatcaacttcccctagtttcgagggaacccaggagacttatacggtcgcccacgaagaaaacgtgaggtttgtgagcgaggcttggcagcaggtgcagcagcaattggacggcggacctgctggtgaaggcggtcccagaccagtgcagtacgtcgagagaactccaaaccccagactgcagaattttgttccaatcgatctggatgaatggtgggccgcagtacccggtgaaaaccaccaactcttcttagttgccgctggccgagggcgatgttacacagccgatctcagtccaggcgaaaaacatggggcactacctacacattgtgcgtggctgggcgctggacatacttag

SEQ ID NO: 56135 - DNA, 294 bp, Artificial Sequence
  Description of Artificial Sequence: Synthetic coding sequence
atgacttcatcccccgtgtcccgagtagtgtataatgggaaaaggacctcttcacccagaagcccaccgtctagcagcgagatattcacacctgcacacgaggaaaacgtaagattcatatacgaggcttggcaaggagtggagcgggacctgaggggacaggtgccaggtggagagcgcggtttggttgaagagtatgtagagaaagtgcctaatccatccttgaaaacttttaagccaatcgacctctctgatcttaaaagaaggtctacccaggacgctaagaaaagctag

SEQ ID NO: 56136 - DNA, 294 bp, Artificial Sequence
  Description of Artificial Sequence: Synthetic coding sequence
atgacctcctctcccgtgagcagagtcgtctataacggcaaacggacatcatcacctcgatcacctccttccagctccgaaattttcaccccggctcacgaagagaatgtgagatttatttacgaggcgtggcagggcgtggaacgggacctgaggggccaggtccctggaggcgagcgcggactggtggaggagtacgtggagaaggtgcccaaccccagtttgaagaccttcaagcccattgacctgagcgacttgaagcgtcggtcaacccaagacgcgaagaagtcgtag

SEQ ID NO: 56137 - DNA, 1440 bp, Artificial Sequence
  Description of Artificial Sequence: Synthetic coding sequence
atggtgagcaaggacacaggcaagtgcatacttaccacgagcgaatccgaggttgaaccagctgcgtgcctagccctcgagatgaagtacgcattagatcccaaccgtcagataaagaagcggaacaaggccttacaggttagattcaaggatatttgcgaagcgcaaaacgaacaaagagacactcaactaagttctggccagctaggagagaaaagggaagctaagcctgtgtcctgtagggccgcttatcgaaagtacatgacggtgccagctcgtaggtcgattcctaacgttaccaaaagcaccggcgttcaaaccagccccgacctcaagaagtgttaccagacatttcctttggatagaaagaagggaaatctcaagagcttgccggcagccgaccctttcaaaagccagaacaacggctttctgaccgatgcaaaggagaaaaacgaggctgggccaatggaagaagcccgaccatgcggtgcagggagggtccacaaaacaaccgccttggtgttccactctaaccaacatatgaacacagtggaccagccactgggtgtgaattgtacagagccctgcaaatctccagaacctctgagttacggcgaagccgctctccagaatagcacaagaccacctagtgaggaaccggactatcaattactgggacgggctaagcaggaccgcggtcgcccaaactccgaggaacctgcacctccagccctccgccgtgtgttcaagacagaggtagctaccgtgtacgctcctgctttgtccgccagggcccctgagcccggactctccgatagcgcagccgcaagtcaatggagtctatgtcccgctgacgacgaaaggcgcagggcgacccatctcaacggtttacaggccccaagcgagacggcactggcctgttccccgcctatgcagtgcctgagcccagaatgcagcgaacagcccagtcagacccacactcctcctgggctgggcaatcaacctagtcccacagcggtggcggctggagaggagtgccagcggatcgttccacacacagaagtagtagatttgaaagctcagttgcaaatgatggagaatctgatcagcagttcccaggaaacaatcaaagtgctgctgggggtgattcaggaactagaaaagggggaggcacaccgggaaggcctgtcataccgcactggccaagacacagcaaactgcgatacatgtaggaattccgcgtgcattatctattccgtagaattagacttcaaacagcaggaggacaaattgcagccagttctccggaagctgcatcctatcgaggaaactcaggttatcccaagtccctactctcaggaaacttattcaagcacccccaaacagaagtcaaaaactgagtctaaaaagcacggcagatggaagttgtggttcctttag

SEQ ID NO: 56138 - DNA, 1608 bp, Artificial Sequence
  Description of Artificial Sequence: Synthetic coding sequence
atggcgcagcagaatatgaaagtccgacctgtgctgctcaaacgcaattctctggagtctgtcgaattcgttaaacagccccaccaccgtcggtctaaaagtcaacaagtgcggtttaaggaggacggcaccacaaaaaaccctactgggctggccgaggtcgacgtgcagacccccgaggacccggctgtcatgggtaaaacccaggctactagacaccacctcccccctacctattctctgtctttccccagatcccagaaggccggtggtttcaggaatatcgccattcagacatctccttccttacgcaagcattttcccgtgttcaaacgaaagcgactcaccgcctcgaaatcactcgtcgaaatgcccacagcctctcaatctgccatccaagtcaatggcaatctgtccgaacaggacatcgtgtcttctgaccttgcctatctgcgactggcacagcacctggaagacggacccaggagagtgaaagtcagccacgcctttctgcctagagttcctaaagtacagtcaaacggaccagtgtcaatttgtctagaggcaggcacctggcgcagcttagaaaaagccacggccgctatacaggttcctgatgatatttaccatagcccttcgtgggaggctcgggagtctgcccttagtccagataggtctgctgaggtgagtaattccattcatcctctcgacgacacacgtcccggagatgggagacgggtcactcctctggactccgagaaaagtactagctgcttgaacgctacttcagtcgcaagccacactccgggaactgaagagctcaaacctgagctcctcctccccaaagataatagtgatgataaggacctaggatctttatcctcgcagagcaaagaaacctgtgtcccaagtagtccaaggactcacagtagtccgagccaaggatcacactctcagcctgctcaccctggacgtgccagcgattgtccgagttcgtctaataatcaccagaatctcgttagcttaaagacgaacagtgcaagcaagtctgcaccgggatgccaggagcaaaccgctaataatcctaccgaatcagacacactcgagttcccaaattgcccagggtcaaaccacctgcctagttctctgagccgctctgaaaccaagctacagtctaaccgagagataagcgacatcaaccagatccaccttgctcggggtgaactgtgtgacctgcagggcagactccagagcgttgaggagtctttacacagcaatcaagagaaaatcaaggtcctgcttaatgtcattcaggatcttgagaaggcacgggctttaaccgagggacgtaacttttatcggactgggcaagacctgaacaattgctccacctgtcagaacacggcctgcataatttactccgttgagtacgactttaggcagcaggaaggtagattccacgaggttctgcagagtctggaggaagccgaaccggtggaggaagcctccccgcctcctaaatctccagccgagcctcccgcacccgagaagcaggatctgcggagaaagactaagaaagtcaagaaaaaatgcttttggtggatttag

SEQ ID NO: 56139 - DNA, 1167 bp, Artificial Sequence
  Description of Artificial Sequence: Synthetic coding sequence
atgagcgacgaggcatcggccatcactagctacgagaagttcttaacaccagaagagccatttccccttctcgggccacctaggggggtgggtacatgcccttctgaagaaccgggttgtttggacattagcgactttggctgtcagcttagttcctgccatcggaccgatccactgcacagatttcacactaatcgttggaacctgacgtcatgtggcaccagcgtcgcctcgtcggaagggagtgaggaactctttagttccgtgagtgttggagaccaggacgactgttacagcctgctggacgatcaggattttacttccttcgatctattcccagaaggctcggtttgttcggatgtgtccagttccatctctacgtactgggattggtcagatagtgaattcgagtggcagctgccaggatccgatattgccagtggctctgatgtcctgagcgacgtgattccaagcattcctagcagcccttgcttgctccccaagaagaaaaataagcaccgcaaccttgacgagctgccttggtccgctatgacaaatgatgaacaggttgagtacatcgaatacttaagcagaaaggtttctaccgagatgggcctgcgggaacagcttgacattataaagatcattgatccatcagcccagatctctcccaccgatagcgagtttatcattgagctgaactgtttaaccgatgaaaaactgaaacaggttcggaactatatcaaggaacacagtcctcggcagcgcccagcccgtgaagcttggaagcgatccaatttttcctgtgctagcacctctggggtctcaggcgcatccgcttcagcgtcttcctcgagtgcctccatggtctcaagcgcctcatcctcgggaagctcagtgggaaattctgcgagcaactcatctgctaacatgtctcgggcacatagcgacagcaacctttcagcttcagcagcagaaagaatacgcgacagcaagaagcggagcaagcaacggaagttacaacagaaagccttcaggaagcggcagcttaaggaacagaggcaagctcgaaaggagcgtctgagtggtctgtttttgaatgaagaagtgctgagcttaaaggtgaccgaggaggatcacgaggctgatgtagacgtcctaatgtag

SEQ ID NO: 56140 - DNA, 1974 bp, Artificial Sequence
  Description of Artificial Sequence: Synthetic coding sequence
atggatcacttctttattaagcgaaagagaaattcagaagtcaagtataccgaagcttgctcatcttcatccgtcgaaagtggcatcgttaactcagataatatcgagaaaaacactgactccaatctgcaaactagtacaagctttgaaccccatttcaagaagaagaaggtttcagctaggcgatacaatgaagactacttaaagtacggatttatcaagtgcgagaagccttttgagaatgacaggcctcagtgtgtgatatgtaacaatatcctggccaacgaatctcttaaacctagcaagctgaaacgacatctggagacccagcatgcggagctcatcgacaaacctcttgagtattttcagcgcaagaagaaagatatcaaactatccactcagttcctgagctgttcaaccgcagttagcgaaaaggccctgctttccagttatttggtggcttacagggtggcaaaggagaaaatcgctaacacggccgctgagaagatcatccttcccgcttgcctcgatatggtgcggacaatcttcgacgacaagagtgcagataagcttaaaacaatcccgaacgataataccgtgagcttacgaatatgtacgatcgccgagcatcttgagaccatgctcatcacccgcttgcaatccggtatcgattttgccattcaactagatgaaagtacagatatcggatcatgcaccacgctacttgtttacgtgcgctacgcctggcaagacgacttcctcgaggattttctatgctttttgaacttgacaagccacctgtcaggcctcgacattttcacagaactggagagaagaattgtggggcaatacaaattaaactggaaaaactgcaaaggaattacgtccgatgggacagcgactatgacaggaaaacactcccgggtgatcaaaaaactcctggaggttaccaataacggagctgtttggaatcattgtttcatccaccgcgaaggcctggcttcacgagagattccgcagaacttgatggaagttctcaagaatgccgtcaaggtagtaaactttatcaagggatctagtcttaactccaggctgttagaaaccttctgcagtgaaattggaactaaccacactcatttgctctatcacacaaaaatccgctggctgagccagggtaaaattttgtcccgtgtatacgaactgcgaaacgaaatacacttttttctgatcgaaaagaagtcacacctcgcatcaatcttcgaagacgacacttgggtaacgaaactggcatatctgaccgacatcttcagcattcttaacgagttgagtctaaaactgcagggtaaaaattcagatgtctttcagcacgtcgaacgtatccagggttttagaaaaactctcctgttgtggcaggtgcgactgaagtcaaacaggccatcatactatatgttcccccgttttttgcagcacatcgaggagaacataatcaacgaaaacatcctcaaagaaatcaagctcgaaattctgttacacttgaccagtcttagtcagacttttaaccatttcttccctgaggaaaagttcgaaaccctccgcgagaattcttgggtaaaagaccccttcgccttcagacacccagagagtatcatcgagctgaacctggtccctgaagaggagaatgagctgcttcaactgagctcttcttacacactgaaaaacgattatgaaactctgtctctctctgcattttggatgaaagtgaaggaggattttcccctgttgagccgtaaatctgtcctgttattactgccttttacaaccaccagcctgtgcgagcttgggttctctattctgacacaattgaaaactaaggagaggaatggactcaactgcgctgctgttatgcgcgttgcgctttcttcatgtgtgccagactggaatgaattgatgaatagacaggctcacccatcttag

SEQ ID NO: 56141 - DNA, 468 bp, Artificial Sequence
  Description of Artificial Sequence: Synthetic coding sequence
atgggactgcgggctgggtcccgctgcagggctgatcaccttgcccaaccacagccacaaggccatctggccccagtcctgcggtgcggggagtgctggagagctcgaggcctgcccggtgggtgttgtttgcacaccgaaggtggctgtagtcttggggctcaggcaggctggcgaactgctggttgggaggccagaggcaggcgtgacttaggtctagaaacaacttccgcccactcccgcagcctgttgcacctctcttcctggcggagacccgacgtaggggaagctgccggagccgaactgctgcagagggcaccattgcagcagcctgatcccgctcaggcagcagtcgagggtggtctcttggccagactgccacgaccccaagatcagggctgtgggcagcaccggcctcattccccgaggctagtagacattgctttacccggtgggggttggacctag

SEQ ID NO: 56142 - DNA, 1173 bp, Artificial Sequence
  Description of Artificial Sequence: Synthetic coding sequence
atgggtgaggctggcgcaggcgcaggcgcttctggaggtccagaagcaagtcctgaagcagaggtggtgaagctgctgccatttctcgcacctggcgctcgcgctgatcttcaggctgcagccgtgagacacgtccttgccctcacaggttgcgggccaggacgggctctcctggccggacaggcggcacttttacaggcgcttatggagctggcccctgcctccgcccctgctagagacgccgcaagagccttggtaaacctggccgctgacccaggcctgcatgaaacactcctcgccgcagaccccggtctacctgcgcgactgatgggaagagcactggatccacagtggccttgggctgaggaggccgctgccgctcttgctaaccttagccgtgagcctgctccttgtgcagctctcatggctgcccttgctgctgccgagcctgcagattctggtctggaacggttagtccgagccctgtgcacccctggatacaatgcgcgagcgccactgcattatctggcacccctcctgtcaaacttgagccagaggccagcggcaagggccttcttgctggatcccgatcgatgcgttgtccagaggctgttaccactgactcaataccctgattcatctgtgaggcggggaggggtcgtaggcacccttcgaaattgttgcttcgagcaccgacatcacgaatggttgttagggccagaagtcgatatactgccttttctcctactccccctggccggacctgaggacttctccgaggaagaaatggaacgactccctgtggacctacagtacctcccgcctgacaaacagagagagcctgatgcagacattaggaaaatgctagtggaagctatcatgctgctgactgctacagcacccggtaggcagcaagttagggaccagggcgcttacttgattctgcgagagcttcattcttgggagcctgaacccgatgtgaggaccgcctgcgagaagctcatccaggtgctaataggagacgaacccgaaagaggtatggaaaacttgcttgaggtgcaggtgccagaggatgtagagcaacaactccagcagctggattgcagagagcaggagcaactcgagcgggaattggcccctgaaccctgggtggagcgagcaacaccaacatag

SEQ ID NO: 56143 - DNA, 1173 bp, Artificial Sequence
  Description of Artificial Sequence: Synthetic coding sequence
atgggtgaggctggcgctggcgctggcgcaagcggcggaccggaggcatctccagaagcggaagtcgtgaaactgctgcccttcctggccccaggcgctcgggctgatctacaagcagctgcagtgcggcacgtactggctcttaccggctgcgggcctggacgtgcgttgttggctggccaagctgctttgctgcaggccttaatggagttagcacctgcaagcgcccctgcccgagacgccgctagagcactggtgaatttagctgccgacccaggcttgcacgagactctcttggctgctgatcctggcctgccagcacggctgatggggagagccctcgacccccaatggccatgggccgaagaggctgcagctgcactcgcgaatctctcacgcgaaccagctccctgtgccgcacttatggccgctcttgccgctgcagaaccagccgattctgggttggaacggctggtgagagcgttatgcacccctgggtacaacgcacgggctccactgcattacctggcccctctactgagcaatctgtcacagcgccctgctgccagagccttcctgttggacccagataggtgcgtcgtccagaggctgctgccattgacgcagtaccctgactcttcagtcaggaggggaggagttgtggggaccctgagaaattgctgcttcgagcacagacaccacgagtggcttttgggcccagaggtcgacatcctgccatttctactactgcctttggctgggccagaggacttttccgaggaagagatgcaacgactccccgttgatttacagtaccttccgccagataaacagagggaacccgatgctgacatacggaaaatgttggttgaggccatcatgctattgactgccacggcaccaggacggcagcaggttcgcgatcagggggcatacctcattctccgggagcttcactcgtgggaacctgagccagacgtgcgcaccgcctgcgagaagctgatccaggtgctaatcggtgatgagccggaacgaggtatggagaacttactcgaagtacaggtcccagaggatgtagagcagcagttgcagcagctcgattgtcgcgaacaggagcagctggagagggagctggcacccgagccttgggtggagcgggctactcctacatag

SEQ ID NO: 56144 - DNA, 456 bp, Artificial Sequence
  Description of Artificial Sequence: Synthetic coding sequence
atgtggagtggcctgcttcctcctggcctgaacgagagcgacgccgaatccaactccgaagatgaggccacattagagaatagcggcctgaatctgcaggaggataaagaggacgagtccattcgaaaaaccgaaatcattgactttagcactgacgaacctaaaaccgaaactgagagcaacgttaacgcctacgaagaatgcccgagcgggatcccaatagacatgtggaacaagtttcaggaactgcataaaaagcacagtgagcagaaaagtacaacctcaagatttcggggtaaacgacgtaagcgtagccggaaagacaagctgaagaacgaaaaggagttgcactcagagccctcctctaacgagacacagtggaaagagctgactcaatatttcggagtgaacgaccgatttgatccccctgtgaaacggaaaaaggtggagaagtag

SEQ ID NO: 56145 - DNA, 702 bp, Artificial Sequence
  Description of Artificial Sequence: Synthetic coding sequence
atgtggagcgggttactgccacctgggctgaatgaatccgacgctgaatcaaacagcgaggacgaagcgaccctggaaaactccgggctgaacttgcaggaagacaaggaggacgaaagcataagaaagaccgagattatcgacttttctacagacgaacccaagaccgagacggagagcaacgtgaatgcttacgaagagtgcccctctggtatacccatagatatgtggaataagttccaggaactgcataaaaagcattctgagcaaaaatccacaacatcgcggttcagaggcaagaggcgaaagcgctcgagaaaggataagctgaagaacgagaaagaactgcattcagaaccatcctccaacgaaactcagtggaaagagctgactcagtattttggagtgaacgacaggtttgaccccccagtgaagcgtaaaaaggtggagaagagcggcttagagaagagaatcgaccaggccgtggaggagtggaacatcgaaaaagcggaggaactgagcaaccagctcgccacccgcgaattaggggtgaaaatcgctaaagctgtcgcatgtcacaattttgtgaaagccaagaaggaggtcgaaaactctcaagccgctcggaaaaagaagaaattagcttggggctttgaagccaaaaagaggtgggaaacaaaaagtaacatgggctatatgtag

SEQ ID NO: 56146 - DNA, 702 bp, Artificial Sequence
  Description of Artificial Sequence: Synthetic coding sequence
atgtggtccgggctgttgccacccggtttgaatgagtccgacgccgaaagtaattctgaggatgaggccacactagaaaattctggccttaatctccaagaggataaagaggatgaaagcatcagaaaaactgagataattgatttcagcaccgatgagcccaagacagaaacagaaagcaatgtcaatgcatatgaggaatgtcctagcgggattccaatcgatatgtggaataagttccaagagcttcacaaaaagcactccgagcagaaatcaactactagcaggtttcgcggtaagcggcgaaagagaagtaggaaggacaaactcaagaacgagaaggaattacactcagagcccagctccaacgaaactcagtggaaagagctgacacaatattttggtgtcaatgatcggttcgaccctcccgtaaagagaaaaaaagtcgagaagtcgggactcgaaaagcgaatagaccaggccgtggaagagtggaatatcgaaaaggccgaggaactcagcaatcaactagccacgagagagttaggcgtgaaaatcgcgaaggccgtcgcttgtcacaacttcgtcaaagccaagaaagaggtggaaaattcacaggccgcacgtaaaaagaaaaagctggcatggggtttcgaggccaaaaaaaggtgggaaacaaaatctaacatgggctacatgtag

SEQ ID NO: 56147 - DNA, 417 bp, Artificial Sequence
  Description of Artificial Sequence: Synthetic coding sequence
atgctctcaccaaccttcgtcctctgggatgtgggttaccccttgtatacatatggtagcatattcatcgtgatagtgatcatctggcaggtgaaacggtcccaccatgagttaaatctcgaagtggagagaagctgttgctggagacatcagaaagtgaggcaacgcgcacgcgacgcggcttccacagcccgtcgcctgtcccaggaggaggatcagaaaccacaagaactgttctcggtcatgaagcgggctggatttccccaaagagaggtgtgtggcgaaagctatgtgcagatccccgtggccaagtttgcaatgttgtggttgtggcggttcagtagctgctggcgcatgaggatgaccaggagccctcaactgtgccgaggggtccaccatcggtcgcctctggcctag

SEQ ID NO: 56148 - DNA, 693 bp, Artificial Sequence
  Description of Artificial Sequence: Synthetic coding sequence
atgggcaaggtgaggggcctccgggctagagtgcaccaggccgcagttcgcccaaagggagaggcggcacctggtcctgctcctcctgctccagaagcaacgcccccaccagccagcgccgcagggaaggattgggccttcatcaacacaaacattttcgcacggacaaaaattgatccttctgctttggtgcagaagctcgaacttgatgtgaggtctgtcaccagtgtccggaggggtgaagcaggcagttcagctcggagcgtaccatcaattcgcaggggagcagaagctaagacagtccttcccaaaaaagaaaagatgaaacttcggagggaacagtggctgcaaaaaatcgaagctattaaactggccgaacagaaacacagagaggagcgacgtcgccgagctaccgtggtagtaggagatttacacccactgagggacgccttacccgagctcttgggcctggaggccggatcgcggcgtcaggcacgatctcgagagtctaacaagcccaggccctctgagctgagtcggatgtctgcagcgcaacggcagcagttgctcgaggaagagcggacgcgtttccaggagctgcttgcctcgcccgcatacagggcttctccattggtggcaattggccaaactctagctcgccagatgcaactagaagatggcggacagctttag

SEQ ID NO: 56149 - DNA, 648 bp, Artificial Sequence
  Description of Artificial Sequence: Synthetic coding sequence
atgggaaaggtgagaggtcttcgtgcaagagttcaccaggccgcagtgaggccaaaaggagaagcagctccgggacccgctcccccagcaccagaagctacacctccccctgctagcgccgcaggcaaagactgggcattcattaacacaaacatcttcgctcgcactaagatcgatccttctgcgcttgtccagaagctggaactcgacgtaagaagtgtgacaagcgtacgacgcggagccgaagccaagactgttctgcccaaaaaagaaaagatgaaattgcggagggaacaatggctgcaaaagattgaggcaatcaagctagccgaacaaaagcatcgcgaggaaaggcgcagacgtgctaccgtggtagtgggggacctacaccctctgcgcgacgcactcccagagctgctcgggctcgaggcaggcagtcggagacaggctcgctctagggagtctaataagcctcggcctagcgagctttctcggatgtctgccgcacagaggcagcaattgctggaggaggagagaacccgttttcaggaacttctggctagccctgcataccgtgcaagccccctggtggccatcggacagaccctggcgaggcagatgcaacttgaagacggaggccagctttag

SEQ ID NO: 56150 - DNA, 4539 bp, Artificial Sequence
  Description of Artificial Sequence: Synthetic coding sequence
atggccacagctgtggagactgaggcctgtcaaccaaccgacgcttcttgggagtccggcggaggaggcgatgacgagatgaaacaggccctacctgaactggagtcctcacagcagaatggcggtgggggaggattaaacattgctgaaccttccggaggggcaggcagagaagagaacgctggtgccgaggccgctcagagtctctcccacgagcagccccaggactcgtcagaggcaggcgctgccgcactccctcggggtcctgaagaacctgagagacccgtgagaaggagctttcagattccaaggaaatccagggaaaagaaggccctgtttcagccgttgacaccaggcagtagagagttcgaagacgtcgtcaacatactgcattcatcttacctggaacctacttcggtcaccaatttcaactacaggagggcctgtctagtgcacaacgagcttcttgagaaggagttcaccgaaaaaagacgggaactaaaattcgatggtagactggacaaagaactgagcgaaagttacgcattcctcatggtcgacaggtaccaagtacagacaatttgcgaaaagggtctacacgtgggtcagagcaaaatcaccattttagggtcaccgtcaatgggcgtctacttgtccagatatgcagacctgctgcaggcaaaccctctggacaccggagctatgggtgacgttgtgatattcaagattatgaaagggaagatcaaaagcatttacgacccaatgggcgttaaaagtctcgagtctatgcttaacaaatcagctctcgacccgactcccaaacatgaatgccacgtctccaagaatgctaatcgcatcacaagcctgctcgcataccgtgcatatgagctcactcagtattatttttatgaatacgggttcgatgaactgcgaaggcgccctaggcatgtctgcccctacgcggttgtcagtttcacttacaaagatgacatccagacccccaagtttgtgccgtccagtagaagtaattcctttaacaccgaccgcaacatcgataagtataattacacgctgtggaaggggcagctacttaataaagggaagttgctgtgctatatctccctgcggtcggctacacgggcttttctgcccatcaagctgcctgaaaagctggatgtggagaccgtcatgagtattgaccatctaaaacaaaaaattcctccggcactgttctacaaagagacgtacttggggcctaacgaagtgctcaaaaacggcatgtattgcagtctgtacgaggtggtggagaaaactaggatcgggtctaatatggagtcccttctccagaagctagacagggagaagctggtgttggtcaaaccgctaggagaccggggttatttgtttttactctccccttaccagatggtcccaccatatgagtatcagaccgctaagagccgggtgctccatgccctctttctcttccaggagcccaggtcgattgtgaccagccagaagggtagcaccaatgctgcacctcaagagagacatgaatcgatgccggatgtgctaaaaattgcccagttcttgcagttctcactgatacagtgtaggaaagagtttaaaaacatttccgctatcaacttccactccgtcgtggagaaatatgttagcgagtttttcaaacggggattcggtagcggcaaaagggaattcattatgtttccttatgactctcgcctggacgacaagaagttcttgtacagcgctcccagaaataaatcccacatagatacctgtctgcacgcatatattttccgacctgaggtgtaccagctgccaatctgtaaactgaaggagctatttgaggaaaaccgaaagcttcagcaattttcccccctgtcagactatgaaggtcaagaagaagagatgaatggcaccaaaatgaagtttgggaagcgtaacaattcacggggagaggctattattagcgggaaacagcggtcctcacattctctggactatgacaaggatagagtgaaggaactcattaacctcatccagtgccggaagaagagcgtcggaggcgactctgataccgaggatatgagatccaagactgtactgaaacgcaagctggaagatctgccagaaaacatgaggaaattagctaagaccagtaatctcagtgagaattgccatttgtatgaggagagtcctcagcccatcggctctctgggacatgatgctgaccttaggcgtcagcagcaagatacttgtaacagcgggatcgcagatattcataggctgtttaactggttatcagagactctcgccaatgcccgtcactctgatgcctccctcaccgataccgtaaacaaggctctgggtctgagtacagacgatgcctatgaagaattgaggcagaagcatgaatacgagttgaattccaccccagacaagaaagactatgaacagccaacctgtgcgaaagtggagaacgcacaattcaaaggcacccaaagcctgctacttgaggtagatgctacatccaaatactctgtagcaatcagcactagtgaggttggcacagaccacaaactgcatctgaaagaagaccctaatcttataagtgttaataactttgaggattgcagtctctgccctagcgtgcctattgaacatggattcagacgccagcagtctaagtcaaacaacgtggaggagaccgagattcactggaagctgataccaatcacaggaggcaatgcccgatctcctgaagaccagcttggtaagcacggagaaaaacaaactcctggaatgaaaagcccggaagagcagcttgtgtgcgtcccaccccaagaggcctttcctaacgatcctcgagtgatcaatagacaacgaagcagcgactatcagtttccctcctctccattcacagatacactgaagggcaccaccgaggacgacgttctgactggccaggtcgaggagcaatgtgtgcccgctgccgaggcggagcctcctgcagtgagcgaaacaacagagagaactgtgttgggcgagtacaatctgttttcacggaaaatcgaagagattctgaagcaaaagaatgttagctacgtgagtacagtttctactcctatcttctcgacccaggagaaaatgaaacggctgtcagagtttatctatagcaagacaagtaaagcaggtgtccaggagtttgtggatgggctccacgaaaaactgaacactattatcatcaaagcctccgcaaagggtggaaaccttccacccgtgagccctaacgacagcggggctaaaattgcatccaacccacttgaaaggcatgtgatccccgtcagtagttccgatttcaataataagcatcttctggagcctctatgttcggatcccctgaaagatacgaactccgacgaacagcactcaactagcgcactgactgaggtggagatgaaccagcctcagcatgctactgagttaatggttaccagtgatcacatcgtgccaggagacatggcccgtgagcctgtcgaagaaaccaccaagtctccatcggacgttaacatttctgcacagcccgcactgtccaatttcattagccaactggagcccgaggtcttcaattctctcgtgaagatcatgaaggacgtgcagaagaatactgttaaattctatatccatgaggaagaggagagtgtgctgtgtaaggaaattaaagagtatctcatcaagttaggaaataccgagtgccatcctgaacagtttctggagagacgttcaaaacttgacaagctgctcattatcatacagaacgaagacatagcaggattcattcataaaatcccaggcttggtaaccctgaaaaagctgccctgcgtctcattcgcgggagttgactcactggacgacgttaaaaaccacacatataacgaattgttcgtctccggtggcttcatcgtgagcgacgagtcaattctgaatcccgaagtggtgaccgttgagaacctgaagaattttctgacgttcctggaggaactcagtacccctgaggggaaatggcagtggaaagtgcactgcaagttccaaaagaaactcaaagagttagggaggttgaacgcgaaggccctctctcttttaactctgctgaacgtttatcaaaaaaagcacctggtggaaattctgagttatcacaactgtgactctcagacacgcaacgcccctgaacttgattgtctgatccgtttgcaggctcagaacatccaacagcgtcacattgtctttctgacagagaagaatatcaagatgctgtctagctacacagacaacggcattgtagtagccacggccgaggactttatgcaaaatttcaaaaatctggtgggctaccacaatagtattaccgaagaaaacctacctcaactgggtgccaatgagaatcttgaaagccagagcgacgcggtgcttacactgaccccgctagaactgggggtcgggatttcccagcactag

SEQ ID NO: 56151 - DNA, 4830 bp, Artificial Sequence
  Description of Artificial Sequence: Synthetic coding sequence
atggccaccgcggtggagaccgaggcatgtcagcctactgacgcttcctgggaatccggcggtggcggtgatgatgagatgaaacaagctctaccggaactcgagtcgagtcaacaaaatggaggaggcggtggtctaaatatcgccgagccaagtggtggagccggtagagaggaaaatgccggtgcggaggccgcacagtccctctcccatgagcagccacaggacagctcggaagctggggcagcagccctgccacgagggcctgaagagcccgagagacctgttaggcgctctttccaaatccctaggaaatcgcgagagaaaaaggcactatttcaacccttaactcccggatcacgagagttcgaggatgtggtgaacatactgcacagcagttacctggagccaacaagcgtgacaaacttcaactataggagagcctgtctcgttcataatgagctccttgaaaaagaattcaccgagaagcggagagagctaaagtttgacggccgactggataaggagttgagcgagagttatgcattcctgatggttgatcgctaccaggttcagaccatctgcgaaaaaggcctgcatgttggccaatcaaagatcaccatcctgggaagccccagcatgggggtgtacttgagccgctatgccgacctgttgcaggcaaatccccttgacacaggggcaatgggggacgtcgtgattttcaaaataatgaaaggaaagattaaaagtatctacgatccaatgggcgttaaatcgctggagtcaatgctcaacaaatctgcgttggaccccacccctaagcacgaatgccacgtgagtaagaacgctaatagaataacatcattgcttgcatatagggcttacgagctgactcagtactacttctacgagtatggctttgacgaactaagaagaagaccaaggcatgtgtgtccgtatgccgtcgtgagctttacatacaaggatgacatccaaaccccgaaattcgtcccaagcagcaggagcaactccttcaatacagatcggaacatcgataagtataactacacactatggaagggccagttactgaataaggggaagcttctgtgctatatcagtctgcgctcagctaccagggctttcctccccataaaattaccagagaagctcgacgtagaaacagttatgtccatcgatcacttaaagcagaaaatcccacccgctctcttttacaaggagacctacctgggccctaacgaggtacttaagaatggcatgtattgtagcctgtacgaggtggtggagaaaacccgtatcggcagcaatatggaatctctgctgcagaagttggatcgcgagaagctggtgctcgtgaaaccactcggagatagggggtatttgttcttgctgagcccctaccaaatggtgcccccttatgagtaccagacagccaaaagccgcgtgttacatgccctgttcctgtttcaggaacccagaagtatcgttacctcacagaagggctcgactaacgcagcccctcaggagaggcacgagagtatgcctgatgtcctcaagatcgctcagtttctccagttctccctgattcagtgtagaaaagagtttaagaacatttctgctattaattttcatagcgtggtggagaagtacgtgtcagaattttttaaacggggtttcggaagtggcaaaagagaatttatcatgtttccctatgactcccgcctggatgataagaagtttctttattccgcaccccgtaataaaagtcatatcgatacttgtctgcacgcctacattttccgccctgaagtgtatcagttacctatctgcaaattgaaggagctcttcgaagagaatagaaagttgcagcaattcagtcctctgtctgattatgagggccaggaggaggagatgaatggtactaaaatgaaattcggcaaacgcaacaacagtcgcggagaggccattatatctgggaagcagcgtagttcgcatagtcttgactacgataaggaccgtgtgaaggagctgattaacttgatacagtgtcgcaagaaaagcgtcggtggggatagtgatactgaggatatgagatcaaagaccgtactgaagcgcaaactcgaagacctacctgaaaatatgcgcaagctggccaagaccagtaatctctcagagaattgccacttatatgaggaaagtcctcaaccgattggctctcttggccacgatgctgaccttaggcgtcagcagcaggacacctgtaattcaggaatcgctgacatccaccgcctgtttaactggctcagtgaaaccctggcgaacgcgcgacacagtgacgcctccctcacggataccgtcaacaaggctctcggtttgtcaacagatgacgcctacgaggaactgcggcaaaagcacgaatacgagctgaattccacaccagataagaaggactatgagcaacccacttgtgcgaaggtagaaaatgctcaattcaaaggaacacagtccctgcttctcgaagtcgatgcgacctccaagtatagtgtcgctatctccacgtctgaagtgggcaccgatcataagctgcatcttaaggaagatcctaacctgatctccgttaacaacttcgaagactgttcactgtgtccatccgtgcccatagaacacggtttcagacgccagcagtccaagagcaataatgttgaagagactgagatccactggaagctgattcccattacggacaccctaaaaggaaccaccgaagacgacgtattaactggccaggtggaggaacagtgtgttcccgctgccgaggccgagccgccagctgtcagtgagactacagagcggaccgttctgggagagtataacttgttctcccggaagatcgaagagatccttaaacagaagaacgttagttacgtctccactgtgagtacccctatattctctacacaggagaagatgaaacgcctgagcgagtttatctactctaagactagcaaggccggtgtgcaagagtttgtggatggcttgcacgagaagttaaataccattatcatcaaggcgtccgccaagggtgggaatttacctccagtcagcccaaatgacagcggcgcaaaaattgcaagcaatcctctagagaggcatgtaattcccgttagctcctctgactttaataacaaacacctactggagccactgtgtagcgacccattgaaggataccaacagcgacgagcagcactcaacttcagctttgaccgaggtggagatgaatcaaccacagcacgctaccgagctcatggttaccagtgaccatattgtgcccggagacatggcgagggaaccagtggaggagacgacaaagtccccatcagacgtgaacatctcagctcagcctgctctaagcaactttatatcccagctggaacccgaggtgttcaactcccttgtgaagattatgaaggacgttcaaaaaaatacagtaaagttttacatccatgaagaagaggaaagcgtgctctgcaaagaaatcaaggaatacctaattaagctggggaacaccgagtgccatcctgagcagtttcttgaacggagaagtaaacttgacaagctcctgatcatcattcagaacgaggacatagctgggtttatccacaagatcccgggactggtaaccctcaagaagctgccttgcgtcagtttcgccggagtggacagtcttgatgacgttaagaaccacacatataatgaactgttcgtgagtggcggtttcatagtcagtgacgagtccattctcaaccccgaagtcgtgaccgtggagaatctgaaaaattttctcaccttcctagaagaattgtctacccccgaaggcaaatggcaatggaaggtccattgtaagttccagaaaaagctgaaggagttaggcaggcttaacgcgaaagcactgtccctgcttaccctccttaacgtctatcagaagaagcatctggtggagatactgagctatcacaattgtgattcccagactcggaatgccccagaactggattgtctcattagactccaagctcagaatattcagcaacggcacatcgtgtttctgacagagaagaatattaagatgttgagctcctacactgacaatggcatagtggtggctactgccgaggacttcatgcagaattttaagaatctggtaggatatcataattctatcacggaagagaacctgccccaactcggcgctaacgagaatctggagagccagagtgctcttttagagaatgatgaaaaagacgaggaagacatgtctcttgattcaggggatgaaatctcccatatcgaggtgtgcagcaatttccactccgagatctgggaaaaggagacgaaaggttccagaggaacggaccagaaaaagaacacacagatagagctacagtcttcccctgacgtgcaaaactctctcttggaggataagacctacctagattcagaagagaggacttctatcgatatcgtctgtagtgaaggcgagaactcaaactccacggaacaagactcctattcaaacttccaggtttatcacagccaactgaacatgagccaccagttcagtcactttaatgtccttacacaccaaactttcctgggcaccccctacgctctaagttcatctcaaagccaagagaacgaaaattatttcctgtccgcatacacggaaagcctggacagggacaagtctccacctcccctgtcttggggaaaaagcgattcgagcaggccctatagtcaagagaaatag

SEQ ID NO: 56152 - DNA, 3702 bp, Artificial Sequence
  Description of Artificial Sequence: Synthetic coding sequence
atgagcatcgatcacctcaaacaaaagattcccccagctctgttttacaaggaaacttacctaggtccaaacgaggtccttaaaaacggaatgtattgttccctgtatgaagtagtggagaaaacccgcataggtagtaatatggagtcactgcttcagaagctagaccgcgagaaactggtactagtaaagcccctgggagatcgcggttatctgttcctactgagtccataccaaatggtgcctccttacgagtatcagaccgctaagagtcgcgttctgcacgcactcttcttattccaggaacctagatctattgttacatcacaaaaaggctccactaacgcggcaccccaggagagacatgaaagcatgcccgatgttctcaaaatagcgcagttcctgcaattttcgctgatacagtgtagaaaagaatttaaaaacataagcgcgatcaacttccactctgtggtggaaaagtacgtctctgaattcttcaaacgcggtttcggctcaggaaagagagaattcattatgttcccatatgattccagattagacgataagaaatttctatatagtgctcctcgcaacaagtcccacatcgacacttgtctgcatgcatatatcttcaggccagaggtgtatcagctgccaatctgtaagctgaaggagctgtttgaggagaatcggaaacttcagcagttctcccctctttctgattacgaaggacaggaggaggagatgaacgggactaaaatgaaattcggaaaacgaaataattctcgcggagaagcgataattagcggaaagcagcggagctctcacagtcttgattacgataaagatcgggtgaaagagctaattaatcttatccagtgccggaaaaaaagcgtgggcggagatagcgacaccgaggacatgcgtagcaagacagtgttaaaaagaaagcttgaggacttacctgaaaacatgaggaaactggcaaagacatcaaatcttagtgagaactgtcatctctatgaggagtccccacagcccatcggaagcttgggacacgatgctgacctccgacgacagcagcaagatacttgtaacagtgggatcgcagatatccacagactcttcaattggctgagcgagacgcttgcaaatgccaggcactcagacgccagtctcaccgatactgtcaacaaggccttaggcctgagcaccgatgacgcgtacgaagagctccggcagaagcatgaatacgagcttaatagcacccccgacaaaaaagattacgagcagccgacttgtgcaaaagtcgagaatgcacagtttaagggaacccagtcactcctcttagaggtggatgcaacatcaaaatactccgttgctatcagcacctcagaggtcggcactgaccataagctgcacctaaaggaggatcccaatttgataagtgtgaacaattttgaagattgtagcctgtgcccctcagtccccatcgaacatggctttcggaggcaacagagcaagagcaataatgtcgaggaaactgaaatacactggaagctgattcctatcaccggcggaaatgccaggagtccggaagatcagcttggcaagcatggagagaaacaaactcctgacaccctgaagggcaccacagaagacgacgtcttgacaggccaagtcgaagagcagtgcgtcccagctgccgaagctgagccacccgcagtaagcgaaactactgaacggaccgtcctgggcgagtacaacctcttttctaggaagattgaagagatactaaagcagaagaatgtttcctatgtatccaccgtctccactccaattttctccacccaggagaaaatgaagaggttgagtgaatttatttactctaaaacttctaaggcaggggtccaggaatttgtagacggtttgcacgagaaactgaacacgatcattattaaggcctcggctaaaggcggtaatctgcctcccgtgagccccaacgacagcggagcaaaaatagcttcaaatccccttgaacgtcacgtgattcctgtgagcagcagtgatttcaacaacaagcatctcctagaacccctctgcagtgaccccctgaaagacactaattccgacgagcagcattccaccagcgctttgaccgaagtcgagatgaaccagcctcaacacgctaccgagctgatggtcacatcagatcacatcgttccaggggacatggcccgagagcccgtggaagagaccaccaagtccccttcagatgtaaacatcagcgctcagcccgctttgtccaacttcatttcacagttagaaccagaggtgttcaatagcctggttaaaataatgaaggatgtgcagaaaaacactgtgaagttttatatccatgaagaagaggaaagcgtgttatgcaaagagatcaaggagtatctgataaaactgggaaacacggaatgccaccccgagcagtttttggaaagaagatcgaagctagacaagctcctcattatcatacagaacgaggatatcgccggatttatacataagatccccggactagtcactcttaagaagctgccgtgcgtttcattcgcaggagtcgattccctggacgacgtgaaaaaccatacttataacgagctgttcgtgtcaggtggttttatcgtttcggacgaatcaattctgaaccccgaagtcgttactgtggaaaatctgaagaattttctgacttttctggaagagttgagcaccccagaagggaagtggcagtggaaggtacactgtaagtttcagaaaaagctgaaagaattaggcaggcttaacgccaaggcattgagcctcttaaccttgcttaatgtctaccagaagaaacacctggtggaaatcctatcctatcataactgtgactctcagactcggaacgcacccgagctcgactgtctgattagactccaggcccagaacatccagcagagacacattgtgtttctgacagagaagaatattaaaatgctgtcttcatacactgacaacggaatcgttgtggctacagctgaggactttatgcaaaatttcaagaacctggtggggtatcacaattcaatcacagaggagaatttacctcaactgggggcaaatgaaaacctagagagccagtccgccctcctggagaacgacgagaaggacgaggaggacatgtcactggacagtggggatgagatctcgcacatcgaagtctgcagtaacttccactccgaaatttgggagaaggagactaagggttcaagaggaacggatcagaagaaaaatacccagattgaacttcagtcttcgccagatgtccagaactccctactggaagacaaaacgtacttggactccgaagagcggacaagtattgacattgtctgtagcgagggcgagaattctaacagcaccgaacaagacagttacagcaactttcaggtatatcacagccagctaaatatgtcccatcagttcagccactttaacgtcctgacacaccagacttttcttggaactccttatgcgctgtcctcctcccagtcccaggagaacgaaaattattttctgagcgcttacactgaaagtttagaccgcgacaagagtcccccacctctttcctggggcaaatctgattcttctcgaccatactcccaggagaaatag

SEQ ID NO: 56153 - DNA, 7292 bp, Artificial Sequence
  Description of Artificial Sequence: Synthetic coding sequence
atggctcccccagctcacaaatccattctcgagcgttctgagaatgtcctgatgtccccctggaaaggaaaactgatcgtgcaggatcggatgctgtgcgacattgctctgtggtccacttatggcgctatgatccccacgcaactcccacaggaacttgactttaaatatgtcatgaaggtctccagcctcaagaagagattgcctgaggcagctttccgcaagcagaattacttagaggagaaggtttgttttcaggacctatgcttcaacttgtacgaggttgagctgagcaacaggcaaggcgagaatatcgacaaacttactgaatgcattaaaaataagcagctcgccatcattaagtgtctggaggatcggggattttttatactgctgacctcttccgctctgttaagcgaacctgatttcggcggtaagcaaatggggcttcacggactgcacctttttaggagtccccttagtactggcgtgaaagacctgaaagtggaagacgatatttcgatgaaggtgattcctatcttaagtactctgaactgtgctctgcttgagacaaagaagagtctgccggaggagcgaatccaccctaataccctggtaaagaggcatttccaggaactgtataaggctgaccggagcccgagcctgtctgtggctccccaggatcggatgaaggaccctacatttctgggcaagttacctagcggattcgacctgataccgcctgcagagaaatgcccttcagaatctctgacccagttgaatagttacttctcagacccttccgcgtacatactggaagtgagcaccgctcttgaccttctggcagagcaccctcagtcgccatgcgtttctgatggtatctgtgacgcgggatttagcttggtaatgacccccgaccctgagtttctggtgtcagaggcagaggtaagaaaggagaccgaaactaagaaggacagcgaggagatgctgaaagcgaaaaaaagagtctttccactcagccctgcttctaaccttcgggtccagcctaaacgtaaggccagcatgccgcatatggtgcagtccaaaaaagtcaacctgtgccgacccttccctaagcggacggcgtcccgggctgacaatagctccgacagccccacaactcttaagttggttaaagggcaatttccacagaaacggaaacgcggtgccgaggttttaacagctcaatttgtgcaaaaaacaaagctcgatcgcaagaatcaggaggcacccattagtaaggatgtgccagtgccaacaaacgccaagagggccaggaaacaggaaaaatcaccagtgaaaaccgttccacgggctaagcctcccgttaaaaagagtcctcagaaacagcgggttaacattgtgaaaggtaacgaaaacccgaggaaccggaaacaattgcaacctgtgaaaggcgagacagcgtcaaaactgcagtccgaaatctctagggggtgtcaagaggacggaatttctatcaactctgtgcagccagaaaatacaacagccgctcacaatgatttgcccgaaaattcaatcgtcaattatgactctcaggcattaaatatgctcgcagatctggcactgtctagtgctacatcctctacgcccgtgagcgaagcaaggaacttacattgtagctcagaattgccacagaacgacgtgctgttgagcaaagagaatagtctgcggggtacctccgatcatgagtaccaccgtggcgttaagacccagaaaggcgaactgctgccgaacccgtcatccgaccggaagtccaactccgggagcgacctcaccgtgagccaggatgaagagtctctcgtgccttgctctcaggctccagccaaggcccagtcagctctgacggaggaaatgctggaaagctccgatgcatctcagtcatccagcgtctccgtcgagcattcatatgcgctcttgctcacagaacatagcaagaagcatctgcaggagagagaaatactgtcacccctgtttccaaggaacggcaccaagagcccagaggccgcaacccctgtagggaaggtgatgcccttccgccaccagccagggttgttactgcagcagaaaccgccagacgacccagtggtgaagcccaaagaccggcctccatctgcccgtgtgaagaaaagctcctgctcacgtattgtgctgtcttgcgacgattccgtaaaaataaccttcaaatgcgagaccgagtatgcttttagcctcgactctaaatataccaataacccactcgagaaaactgtggtgcgtgctttgcacgggccttggaatactgacctgcctgacaacgtcgaggaagtcaaactacttttgcatatgtgggtggccctattttactctaatcaaaataagattattcgttcgagccggaaagtagtagagcactcaaaccctgcgaagtatgtgtctattaactcaacattggagagttgtgagctccgcgaaattgaggaatctcttgggcttgagaagtgttccgccgacagccttctagagaccaatgagatttcccgcgcacacgccgctgaggtcagcttccgtgaccctaactgcctcttgccatttattaagacccctctgacccaaggactcgaattatgtgtgcaaaacgagcagaaaaagacttttgccagagagtgtgaccccgacacccaggaggaccaaaattttatttgctcctacaacaatgaagttaccggcgaagaggctaagcaggagtccttggagacgagtaaccttgtcttgtcagggatcggatcgacccaaacaaacgggccttcagttccttccgaagaagagattgttcagccattagattcaaccagggtggcctcctactctggtacagttacacaggcaacatttacccggacatatgacggtccaggctctcagccagtcatatgccagagttctgtctatggaacactggaaaacaaggtagacatcctcgacgcagctgtccagactaaaactggcactctccaagatcttatacagcacgggtcacctatcaacaacgaatgccaccctagccttgaacgtaaggacgataacatgggttgtgctgtcatcaatcccgagccgattacccttacattcgagaaaaacgcccacgtcccaattcagaccgagggggtaaataccgcagatgagcgaaccacattcaagaaagagctaatcaagcaggttagccctgcggcatccttgagacaccctgtgagcacctccgagaacgctcgcacacaggggctgagggacatcccttctctggtggtcgcaggacaaaaaggcactaaatacctatgcgcgtcttccgttgggggagagactctggacaaggctgtatgtagtcttcaaaaggaaacaccgctgccagttagtctgccctccgacaaaactatggttatggaagctttaagtctggccaaatcctcatctcacttatcaccgtctgaagaggtgaggtgcacacaggacttcttgagccagacgcaatctttattaggcttatcatctgagggattactcgagctgactcaggttgaagtggacagctccagtgcctcaaccactctgggtaggcaatgttctctgaattgcatttcgagcggctgccacacgtctggtgacagcctcgaactgcgtaagaatcacaagaacggtcccaataccgaaaatatgaatctagaagcatttgattccgtctttattaagcaaaccagcctctccgtgtctagagaggtgtctctggagttgagcgaggaggattccgatatagatcttgccctgaccattagcccacccacatcaccaagggaagagatgcccgctggagaaattgagcagtttgaagaagcgcctttttcaaatctcgaactgcaggatgttgccgaggaaatcggtgaaccagaagaggtggcccttacagaatcacgtgaagtctctagcgcagacaacgtgtccgtgtacccctcggtcagcgaagagcccgtggagaacaaggaacgtaagggcgacaatctccagcccgtcacactgatcctgagtaaggaaaattgtacacttgagatagcagaagagattaacgttacatccgatttcccttttgactccgtcattgaggaagttagccccgcttcgagcccagagcctccagtgcccgttaaggagacccggccttaccaagccgtcacgccctgtatactcaagctccacggcacccagtgtgagaaaagcaaccaaataagtcaatgtgagtcagaggatctggggattacagagaaagaaaatgtcttcgtgggcccaacacaccctgtgggacaggacaactttacgcaggttcagcaaatgcaggtgagcgcggagatgcctctgatcttgacggatcatccagggaggacggggcgtccaacgctccctggaaaagttacagaggagatcgtcagttccgagcacgacgagggactatccttcagtggtaaagtacagtgctatggtagggagcttaatcagccggcttcagcagcaaagtgtaccggcgacttttcgccgtctccagagaaactagtgaagagcggcaacccactccaacctgtctctatagagaacagaaacttggacttgaagcacctcgtactggagtcctctgagcctccattcggtcctcggaacgtgattgagaataaatcattatccgatacactggtgtcaactacagcgccaagtggaattgtgaatgtttctgtcaagcagcaaacctctcccaagagttcacagaatcatttgttccctggcgacctgaagaccgacgaagggatttatctgcaggtcaaatctcttaccgcagccagcgttgatggtgcctattcaacacagggttgtatgtgcagcgtcgtccccacactgtgctcgtcatctgacaatgctacacttacccactacgtgaggccgattaacgcggagcccgtcttccaggctcaggaaataccagccggtcgaatggcctccctcctgaagaatggcgaaccagaagcagagttgcataaagaaacaacagggccaggcaccgccggacctcaatctaacaccacctcctcccttaagggagagagaaaggctattcatacacttcaggacgtaagtacctgcgagaccaaggaacttttgaacgtaggagtcagcagcctgtgcgcaggaccatatcaaaacaccgccgatactaaggaaaacctgtccaaagagccgctcgcctcattcgtgagcgagagcttcgacacgagcgtctgcggtatcgctacagaacacgtggagatagagaactctggtgagggtctccgtgctgaagccggatccgaaacgctcgggagggacggcgaggtcggcgtgaatagcgatatgcactacgagctgtccggagacagcgatctcgatctgctgggtgactgcagaaaccctcgcctggacctggaggattcatatactctgagaggatcctacacgcgcaagaaggatgttcctaccgatgggtatgagtctagcctcaacttccacaataacaatcaggaagactgggggtgcagcagctgggtgcccggtatggagacgtctctgccgccaggtcactggacggcggcagttaagaaggaggaaaaatgtgttcctccatacgtgcagattcgcgatctacatggtattctgagaacatacgctaacttttccatcacgaaagaacttaaagacaccatgaggacgtcgcacggactgcgccgtcatccaagcttcagtgcaaactgtggattaccttcgagttggacctcgacgtggcaggtggcagacgatttgactcagaataccttggacctggagtacctgaggtttgcgcacaagctcaagcagactatcaagaatggagactctcagcattcagcgtcctctgccaacgtctttccaaaggaaagtccgacacaaatctctatcggagccttcccttctaccaaaatctccgaagccccattcctgcacccagcccctcgctcacgttcccctttactagtcaccgtggtagagtccgacccaagaccccagggccagccacggagagggtacaccgcttcctcattggactctagcagttcttggagggaacgctgttctcataaccgcgacctccgcaactctcagaggaaccatacagtgtcttttcaccttaataaattgaagtacaattcaacagtgaaggaatcacgtaacgacatcagcctgatcttgaacgagtacgccgaatttaacaaagttatgaaaaatagtaaccagttcatcttccaggataaagaactcaacgatgtttctggagaggcaaccgcccaggaaatgtatctgcctttccccggacggagtgcatcttatgaagacatcattatcgatgtctgcaccaatctgcatgtcaagctgcgttctgtggtcaaggaggcatgtaagagcacttttctgttctacctggtcgaaactgaagacaagtcattctttgtgcgcactaagaacctgctgcgcaagggtggtcacactgagattgagccccagcatttctgtcaggccttccatcgggaaaatgatacactgataataattattcgtaacgaagacataagttcacatctccatcagatcccctcactgctgaagctcaaacacttcccgagtgttatcttcgccggtgtggacagcccaggagacgtccttgaccatacttaccaggagttgtttagggcagggggattcgttatcagtgatgataaaatccttgaggcagtaactcttgtgcaactcaaggaaataatcaagatcctagagaaactgaatggaaacggaaggtggaagtggctcctgcactaccgcgaaaacaagaagctgaaggaggatgaaagggtcgacagcactgcccataaaaaaaatatcatgctgaagtccttccagtctgccaacatcatcgagctactacattaccaccagtgtgattcccggtccagcacaaaagccgagattttaaagtgcctcttaaacctgcaaatacagcacattgatgcgcgatttgccgtcctccttactgataagcccacaattccccgagaggtgtttgagaactcaggcattttggtgactgatgtcaataatttcatcgagaacatcgagaagatcgccgctcccttccgctcctcttattggta

SEQ ID NO: 56154 - DNA, 4878 bp, Artificial Sequence
  Description of Artificial Sequence: Synthetic coding sequence
atggcccctcccgctcacaagtctatattagaaagatccgagaacgtcctgatgtccccatggaagggtaagctcatcgtccaggatcgaatgctgtgtgacatagccctgtggtcaacatatggagccatgattccgacacagctgccacaggaattggattttaagtatgtgatgaaagtgagcagcctgaagaaaaggcttccagaagcagctttccgtaaacagaattacctcgaagagaaggtttgttttcaggacctgtgctttaatctgtacgaggtcgagctgtctaacaggcagggcgagaacattgacaaactgacagagtgtatcaagaataaacagctcgctatcattaagtgtctcgaagataggggatttttcatcctgctgaccagcagtgcgctgttaagcgagccggattttggaggaaagcagatgggtttacacggcctgcatctgtttaggagtccacttagcaccggggtcaaggacctcaaggttgaggatgacatctcaatgaaagtcatcccaatcctgagcacattaaactgcgccctccttgaaacaaaaaaatccctcccagaggagcggattcaccccaatacccttgtcaaaagacacttccaggaactgtataaagccgatcggtctccttccttgtcggtggcccctcaagaccggatgaaagacccaactttcttggggaaactcccctccggattcgatctcatcccccctgccgaaaagtgtccaagcgagtccctgacgcaattgaatagttatttttctgatccaagtgcatatatacttgaagtgtccacggccttggatcttctggcagaacacccgcagagcccctgcgtgtcagatggcatttgtgatgctgggttctccctcgtaatgacaccggatcccgaatttctcgtttccgaggctgaagtgcgtaaggagaccgaaaccaagaaagactccgaggagatgttaaaagctgtttgctctctccagaaggagacgcctctgcctgtgagcctgcccagcgacaaaacaatggttatggaagccttaagcctcgccaagagttcctcgcacctgtctccatcagaagaggtgcgctgcacccaggactttctgagccagacacagtcactgcttggtctgtcatcagagggcttgctcgagttgactcaggttgaggtagattcatccagcgcctcaacgaccctggggaggcaatgtagtctgaattgcatctcaagtggatgccataccagtggagattcgctggagctcagaaaaaatcacaagaacggacctaacactgagaatatgaatctcgaggctttcgactctgtgttcattaagcagaccagccttagcgtgagccgggaggtttccctcgaactctccgaagaagatagcgacatagaccttgccctgactattagccccccaacatctcctcgagaagaaatgcccgcaggtgaaatcgaacagttcgaagaggccccatttagcaatctggaactgcaggatgttgcagaggagataggagaacctgaggaagtcgcgcttacggaatcccgggaggtatcctccgccgataacgtttctgtatatccaagtgtttccgaagaacctgtggagaataaggaaagaaaaggcgataatctgcagcccgtcactctaattctttcaaaggagaattgcacactagagatcgcggaagagattaatgtcacaagtgattttcccttcgatagtgttattgaggaagtttctccagcttcttcacccgagccccctgtaccggtcaaggagaccagaccctatcaagcagttacgccctgcattctaaagctgcacggtacccagtgcgagaagtccaaccagatttcacagtgtgaatcagaagatctggggataactgagaaagagaatgtgttcgtggggcctacacacccagtggggcaggataattttacgcaggtacagcagatgcaggtctccgccgaaatgcctctgatcctcacagatcacccgggtcgaacagggcgtcctactctaccaggtaaggtgactgaggagattgtttctagtgagcatgatgagggcttgagcttctctgggaaagtgcagtgctacggtcgagagttgaaccagcccgcaagcgccgcaaaatgcaccggcgatttttctcccagtcctgaaaaactggtgaaatccggcaatcccctgcagcccgtgagtatcgagaatagaaatctggacttaaaacacctcgtcctcgaaagctctgagccaccttttggccctcgtaacgtcatagaaaataagtctctcagcgatacactcgtcagtacgactgctccctccggcatagtcaatgtgagtgtcaaacagcagacctcccccaagagctctcagaatcacctttttcccggagatcttaagacagatgaaggcatttacctccaggttaagtctctgactgctgcctccgtagacggcgcttattccacccagggttgtatgtgctctgtggtgccgacgttatgttcttcctcagacaacgccactttgactcattacgtaaggcctattaatgctgaaccagtgttccaagcccaagagatccctgccggtcgtatggcctcactcctcaagaacggcgagcctgaggccgagcttcacaaggaaacgactgggcctggtacggccggacctcagtccaacaccacttcctcattgaagggggagcgaaaagcgatccatacactgcaggatgtcagcacctgtgagactaaagaactcctgaacgtgggggtgtcgtcattatgcgccggaccctaccagaacaccgcggacaccaaagagaacctcagcaaagaacctctggcgtcttttgtgtccgagagcttcgacaccagtgtatgcgggattgccacagagcatgtggagattgagaattctggggagggccttcgcgctgaagcgggttctgaaaccctggggcgagacggggaagtcggggtgaacagcgacatgcactacgagctatcaggagacagtgatctggacctgttaggcgactgcaggaacccaaggctggatttggaggatagctatacactcaggggatcctacacaaggaaaaaggacgtgcctacagacgggtatgaatctagtctgaattttcataataacaatcaggaggactgggggtgcagcagctgggtacccggaatggagacgtctctccctcccggtcattggactgcggctgtcaagaaagaagagaaatgtgtgccaccatacgtgcagatccgcgacttgcacggcattttgcggacttatgccaacttttctattacaaaggaactcaaggatacaatgcgcacttcacatggactcagaaggcacccttccttcagtgccaattgcggacttccatcaagctggacatcaacgtggcaggtggccgacgatctcacacagaacaccctggatttggagtacctgaggtttgcacataagctgaaacaaaccattaaaaacggggattcccagcactccgccagctcggcgaatgtcttccccaaggagtctcctacccaaatttctattggcgcattcccctctactaagatctctgaagcacccttcctacatcccgctccacgaagtaggtcgccattgctggtgactgtggttgaatctgaccctaggccgcaaggccagcctagacggggttatacggccagcagcctggattcaagtagttcttggcgcgagaggtgtagtcacaatcgtgaccttagaaatagccagcgcaaccacaccgtgtccttccacttgaacaagctgaagtataattccaccgtcaaggagtccagaaacgatatttcactgatcctcaacgaatacgccgagttcaataaagtaatgaagaattcaaatcagttcatctttcaagataaggaactcaatgacgtttctggcgaggccacggcccaggaaatgtatctgccctttccgggtcggagcgccagctacgaggatatcataattgatgtctgtactaatctacatgtcaaacttcgcagtgttgtgaaggaagcttgcaaaagcacttttctattctatcttgttgaaaccgaagataagtcttttttcgtcaggactaagaatctgctgaggaagggaggccacactgagattgaacctcagcacttttgccaggcctttcacagagagaatgacacgctgatcatcatcatccgtaacgaagacatcagctcccatcttcatcagattccaagcctcctgaagctgaagcactttccctctgttatcttcgctggggtcgactctccaggcgacgtactggatcatacctatcaggaattgttcagagccggagggtttgtgatttcggatgacaagatcctggaggccgtgaccctggtccagctcaaagaaatcattaagatcctggagaagctgaacgggaatggtaggtggaagtggttattgcattatcgggaaaataagaagctcaaagaggacgagagggtagactctactgctcacaagaagaacattatgctgaagtcttttcaaagcgccaacatcatagagctgttgcactatcaccagtgtgacagccgctctagcactaaggcggagatattaaaatgcctcctgaacctgcaaatccaacacatcgacgcaagatttgctgtgctgctgacagacaaacctaccatcccgcgtgaagtcttcgaaaactcgggcatcttagtcacagacgtcaataattttatcgaaaacatcgaaaaaatagctgctcctttccgctcgtcatattggtag

SEQ ID NO: 56155 - DNA, 27 bp, Artificial Sequence
  Description of Artificial Sequence: Synthetic coding sequence
atggcgcctcccgctcataaatcctag

SEQ ID NO: 56156 - DNA, 639 bp, Artificial Sequence
  Description of Artificial Sequence: Synthetic coding sequence
atgggtaccagacagaccaagggatcactcgccgagagggcatctcctggggctgccccaggcccacggcgagagcgacctgatttttgggcctcattactcctgcgcgctggagataaggccggaagggccggagccggaatgccaccatatcataggagagtcggcatggtccaggaacttttgcgtatggttagacaggggcgacgcgaggaagctggcactctactgcagcatctgaggcaggatctaggcatggaatcaacttcactggatgatgttttgtacagatacgcatctttccgtaatttggtggatcccatcacccatgaccttataatctctctggctcggtatatccattgccctaagccccctcagggctgccctgggaggaaacctcccaggcagcactccgggcctgttggcaatccaacagatctgccgcgacccggagctggcgatcagctgcccacagcactgtggggtgccggacgacagcgcggtgccggtctgcatagaccacacggacggcatggtccagcagcagccgcaagtacccaacatccggctcctccacaccataccggcacacagtggcagcccgtcgatccaggtcgagctgcccgaccccattag

SEQ ID NO: 56157 - DNA, 1035 bp, Artificial Sequence
  Description of Artificial Sequence: Synthetic coding sequence
atgggaactagacagactaaaggatcattagctgaaagagccagccccggagcggcacctggccctaggagagaacgaccagacttttgggcaagcctactcttaagggctggcgataaggctggtagggctggtgccggaatgcctccttaccacaggcgcgtcggaatggtacaagagttattgcgaatggttaggcagggtcggagagaggaagccggaacgctgctgcagcacttgagacaagacttgggaatggagtctacttctctggacgatgtgctttacaggtatgcttctttcagaaacttggttgatcctatcacgcatgatctgatcatctctttagcgagatacatccattgtcctaagcctgagggtgatgccctcggggctatggagaagctgtgccggcaactgacataccatctgtccccacactctcaatggcgcagacacagaggactggtgaaacggaagccccaggcttgtctgaaggcagtgctcgccggaagtcctccggacaacaccgttgatttaagtgggataccacttacaagccgtgacttagaaagagtgacatcttacctgcaacgctgcggcgagcaagtcgactccgtcgaacttggctttaccggattgacagatgacatggtgctacaattactgcctgccctctctacattgcctaggttgacaaccctcgcgctcaatggaaatcgcctgacaagagccgtgctcagggacctcactgatatattaaaagacccctccaagtttcccaacgtgacctggatcgacttaggcaataacgtcgacatattctctctcccacaaccctttctgctgtcactgcgcaagcgcagtccaaaacaagggcaccttccaactattctggagctgggcgaagggccaggatccggcgaggaagtaagggagggcactgtggggcaagaggaccccggaggtggacccgtcgcccctgctgaggaccaccacgaagggaaagagacagtggcagctgcccagacctag

SEQ ID NO: 56158 - DNA, 948 bp, Artificial Sequence
  Description of Artificial Sequence: Synthetic coding sequence
atgggcgctagactcgggaggcgagccggacccgaggccggttccgaggcaggcgctgccgcaggctgcggaccggcaccttacgagcgcagggtgcggtggctgcgcgagattcagagtaccctgagggaaagacgcccagaacgggcacgccaactgttgcgactcctgagacaggatctgggtctcgagaggaccctgttacccgacatactttaccgagacgtcgcattcctcaatcctgttgatcccattagccatgacttactcgtcaatctcgctagggatctgcagtgccccaagaaggattatgagttgtggaagtcaagcgataagatttgtcggcaactgatctaccatctcacaccgcattcaaagcaacagcaggggagctccctgcggcagcgcaagacacagtcctgtctgaagtctagcctccagaaaactctgttggcgggagagactgtcgacctgtctgggatccctctgtccacgcaagatgtgcagcatataacccgttacctgtctagtcatggggctgtactggctgtgctcgacttgagctttacaggcctgtcagacgagctactccacttacttctgccctcactgtgggccctgccaagactgacgcagcttttgttaaacggaaaccggctgacccgggcaacagccagaaaattaaccgacgctatcaaggatacgaccaagttccctgcccttgcatgggttgacctgggaaacaatgtggatgtggcctcattgccacaaccgcttctcgtgggactgaggcggaggctttcccaacgcacaagcctgccgactatttacgaaggcctggacttggaaccagaaggaagcgctgccggagctacaacacctgcatctacttgggacagtacagcagccggtctcgggccagaaccccaagcatgttgtgcaagatag

SEQ ID NO: 56159 - DNA, 864 bp, Artificial Sequence
  Description of Artificial Sequence: Synthetic coding sequence
atggatatgcacagcgcaagacttgactcgtttctgagccagctgaggtgggagctgctctgcggcagggatactgggagcccttcaatgcctggcccactgcagccaacctcccaaacaggcccagacgtgcagccatcccatcaactccgcgcaagcggtgccctggaggaggattcagtttgctgcgtggaggaggaagaggaagaagaagaggaggccgtcgtcacagaggatagggacgccgcactcggcggtccgagggagcacgccctggactgggatagtggctttagcgaggtctccggatcaacctggcgggaggaggagttgcctgtgtcccaaagacccgctccttcagctcagcctcttcgaagacagtgtctttctgtgagcgggttgccaatgccgagcagggcacccgtggcctcagtcccccctgtgcaccatcctcggccaaagtctacccccgacgcatgccttgagcactggcagggattggaggctgaggattggaccgcagcactgctgaacaggggtaggtctcgccagcccctggtgctgggggataactgcttcgctgaccttgttcacaattggatggagctcccagagactggaagtgaagggggtgatggcggaggccatagagctcgggcaagaccacctcagttcctgcttggtctgtctgaacagctgcggcgaagactggccagagctaggcgaaccgctatggcaggcaaacgcctgtcgtgcccaccgcgacctgagcctgagcttccggctgacgtgtcccgattcgctgcgctgatgtcttgccggtcccggcagcccataatctgtaacgacgtgagttatctatag

SEQ ID NO: 56160 - DNA, 894 bp, Artificial Sequence
  Description of Artificial Sequence: Synthetic coding sequence
atgactatggaaagcagagaaatggattgctacctgcgcagactcaagcaagaactcatgagcatgaaggaagtaggcgatggactgcaagatcagatgaactgcatgatgggcgcacttcaggagttaaaattactccaagtgcaaaccgcattggagcaactggaaattagcggaggagggccagtgcccggatctccagagggtccaaggacacagtgcgagcacccctgttgggagggaggacgaggacctgcacggcctacagtttgttcaccctcctcgcagccttcccttggctcaagtactaagttcccgtcccatcgaagtgtgtgcggcagagatctggcccctctccctaggacccaacctcaccagtcttgcgctcagcaaggaccagaacgcgtcgaacccgatgactggacaagtactcttatgagcaggggcaggaaccggcagccgctcgtccttggtgacaacgttttcgccgacctggtgggcaattggctggacctgcccgagctggagaagggaggagaaaaaggagagacaggaggagcgagggaaccaaagggcgagaaggggcagccccaagaactgggaaggcgcttcgcacttactgctaacatctttaaaaaattcctgaggagtgtccggcctgaccgtgatcgtctcctgaaagagaaacccggttgggtgacccccatggtgcccgaatcacgtaccggtcggtcacaaaaagtgaaaaagagatcactgagcaaaggctcaggccacttccccttcccaggcaccggtgaacaccgccgtggggagaaccccccaaccagttgcccgaaggctctggaacattcgccatctggattcgacatcaacacagcagtttgggtgtag

SEQ ID NO: 56161 - DNA, 849 bp, Artificial Sequence
  Description of Artificial Sequence: Synthetic coding sequence
atgcgccagctgatgagcatgaaggaagttggggatggcctccaggatcaaatgaattgtatgatgggagccctgcaggaactgaagttgctccaggtccagacagcgttagaacagttggagataagtggcggagggccagttcccggatcacccgaggggccaagaacacagtgtgaacatccatgctgggaagggggtcgcggacctgcacgacccaccgtctgcagtccctcctcccagccttcattggggtcctccactaaatttccctcacacagatctgtttgtgggcgagacttggcgcctctcccacgtacccaaccccaccaaagctgtgcccagcagggacctgagcgggtggaaccagacgattggacctccaccctgatgtctcgtggcaggaatcgacagcccctggttctgggcgacaacgtcttcgctgatttggtcggcaattggctggatctgcccgaactggaaaaaggcggagaaaaaggggagaccgggggtgctcgcgagcccaaaggtgaaaaaggccagcctcaagagttgggacgaaggttcgcactcactgccaacatctttaaaaagttcttacggagtgtcagaccagaccgtgaccgcctgctaaaagagaagcccggatgggtgaccccaatggtccctgaaagccggaccgggcgatcccagaaggtcaaaaagaggagtctcagcaaaggatcaggacactttcctttccctggaacaggcgagcatcgtcgcggtgagaacccacccacctcatgtccaaaggcccttgaacattctccatcgggattcgacatcaacactgctgtgtgggtgtag

SEQ ID NO: 56162 - DNA, 3231 bp, Artificial Sequence
  Description of Artificial Sequence: Synthetic coding sequence
atgaaacctgatcgcgatacgctcgacgagtactttgagtacgatgcagaggaatttctcgtgtcccttgctcttctgataacggaaggcagaacccctgagtgctccgtcaagggtcggacagagtccttccactgcccgcctgcccagtcgtgctatcctgtgaccacaaagcacgaatgttcagacaagctcgctcagtgtagacaggctcggagaacacgcagcgaagtgacacttctttggaagaacaatctgcctatcatggtcgagatgatgcttctgcccgactgctgctactccgacgatgggcctaccaccgagggtattgatctcaatgaccctgccatcaaacaggacgccctattacttgaacgatggatcctcgaaccggtcccaagacagaacggagacagatttattgaggaaaaaaccctccttcttgctgttcgcagttttgtgttctttagtcagctgtctgcttggctttcagtgagtcacggcgctattcctcgcaacattctgtataggatttctgccgctgatgtcgatcttcaatggaatttctcccagacccctatcgagcatgtgtttccagtgcccaatgtatcccacaatgttgctctgaaagtttcagtccagtcccttcccagacaatcgaactatcctgtccttacgtgctccatccacactaacatcgggctgtacgagaaaagaattcagcagcataagctcaaaacccatcagcatcacaatcccaatgaagccgagcaatgtggtacaaactcctctcagcggctgtgtagcaagcagacctggaccatggcacctgagagcgtgttgcacgccaagtccggtcccagccctgagtacactgccgctgtgaaaaacataaagctgtacccaggtaccgggtctaagtctgatcatggcactagtcaggccaacatcttgggattcagcggcatcggtgatattaaaagccaggaaactagcgtgagaactttaaagtcgttttccatggttgacagttccatttccaataggcaatcgttttggcagtcagccggagagactaacccactcatcggctcgctaattcaggaaagacaggagattattgctagaatcgcccagcacctcatccactgtgacccaagtacatcccacgtatccggcaggcccttcaacactcaggaaagcagcagtctgcactcaaagctctttagagtttctcaggaaaacgaaaatgtgggaaaaggcaaggaggcctttagcatgaccttcggcagccccgagttcagctcacccgaagacaccaatgaggggaagatcaggcttaagccggagactcccagaagtgagacatgtatttcaaacgacttttactcccatatgcccgttggtgagaccaatccattaatcggctctctgctacaggaacgccaggatgtgatcgctcgtattgcccaacatcttgagcacatcgatcctacggcgagccatattcctaggcaatctttcaacatgcatgactcaagctcagtggcgagcaaggtcttccgtagttcttacgaggacaaaaatctgctcaaaaaaaataaagatgagtcaagcgtctcaatttcccatacaaaatgcagcctgctgggcgatatctcagacgggaagaatttagttccaaacaaatgttttacgtcctttaagaacaattctaaggaaaagtgttcattgaagcaccagactaggaatcagtgccagaataatcctagcgagataatccaaagtacatatcaagagacacagaacaaatcgagtagtctttcaacttcttcaatcctgtcccaacacaaagaaaataacctggatctaacgtcgcgctttaaggagcaggaaatgtccaacggtatcgataagcagtattcgaattgtaccactattgacaagcagatctgtactaacaaatacaaggagaagatcatcaatgagaactataaccccaaattctttgggaatctccagagtgatgacagtaagaagaatgactccaagatcaaggtgacagttttggagatgagcgagtatctgaataagtatgagtcgatgagtagtaataaggattcgaaacgcccaaaaacgtgcgaacagaatacccagttgaattctatcgagaattatcttaataaggacaacgaagggttcaagtgcaagaagtcagatcagctaaaaaacgagcaggacaagcaggaagatccaacaaatgagaaatctcagaactattctcagagaagatctattaaagactgcttgtcaacctgtgaacaacctaaaaatactgaagtgctgagaactaccctgaagcacagcaatgtttggcgaaaacataactttcacagcctggacggcacatcaaccagggcattccacccgcaaacaggtctccctcttcttagcagccctgtccctcagagaaagacccagtcaggatgtttcgacctggattcctccctactgcatctgaaatcttttagcagtcgaagccccagaccatgtctcaacatcgaggatgaccctgatatccatgagaagccattcttgtcgagcagtgctccccctatcacctcactgtcccttttaggcaactttgaggaatctgtgctgaattataggtttgatccactgggaattgtggatgggttcaccgccgaggtgggcgcatcaggcgcattttgccctactcacctcacactgccggttgaagttagtttctactcagtgtcagatgacaacgccccttctccctacatgggtgttataaccctggaatccctgggtaagagaggataccgggtgcctccatccggcactatccaggtgactctgttcaacccgaataaaactgtggttaagatgttcgtcgttatctatgacctgagagatatgcctgcaaatcaccagacgtttctgcgtcagcggacattctccgttccagtcaagcaggaggtaaaaagaagtgtcaataaagagaacattaggcatacggaggagaggctgctgcgctacctgatacatctacgattccagagttccaagtcagggaagatatacctgcacagagatgtgcgtctgttgttttcgcggaagtccatggaagtggactcaggcgcagcgtacgaattaaagtcttatactgagtcacccacaaacccgcagttttcaccaagatgctag

SEQ ID NO: 56163 - DNA, 3231 bp, Artificial Sequence
  Description of Artificial Sequence: Synthetic coding sequence
attcgtccgagatcagacaccctagacgagtacttcgagtatgatgcagaggagttcctcgtctccctggccctcctcatcaccgaaggtcgcacacctgaatgctctgttaagggcaggaccgaatcgttccattgcccccctgctcagtcctgctatcccgtgaccacaaagcatgaatgctcggataagcttgcacagtgccggcaggccaggcggacccgttctgaggtgaccctgctttggaaaaacaatctcccaattatggtggaaatgatgctactgcccgattgctgttactcggatgatggccctaccaccgaaggcatcgatctcaatgacccagcaatcaagcaggatgccctgctgctggagcggtggattctcgaaccagtgccccgtcagaacggagatcgattcatcgaggagaaaacactcttgctggcagtcaggagctttgtttttttctcacagctctccgcatggctttccgtctcccatggcgctattccccgaaacattctgtatagaatctccgctgcagatgttgatctacaatggaatttcagccaaactccgattgagcacgtctttcccgtccccaacgtcagccataacgtcgccctgaaggtgtcggtgcaatctctgcccaggcagtccaactacccggtactcacctgcagtattcacactaacatcgggctgtacgagaagagaatccagcagcataagctcaagactcatcagcaccacaatccaaatgaagccgagcagtgcggcaccaacagcagccagagactgtgctcgaagcagacttggacgatggctcccgagtctgtgctgcatgcgaagagcggaccatcgcccgagtacacagccgcagtgaaaaatattaagctttaccctgggacgggctcaaagagcgaccatggtaccagccaggccaacattctggggttctccggcatcggagacattaagagtcaggaaacctcagtgagaactctcaagtcgttttctatggtagatagtagtatttctaatcgacaaagcttctggcaaagtgcgggagagactaatcctcttatagggtcactaattcaggaacggcaagagatcatagctcgcatcgcccagcacttgattcattgcgatccgtcaactagccatgtgtctggcaggccctttaatacccaggagtcctcttctctgcactccaagctgttccgtgtaagtcaggaaaatgagaatgtgggcaaagggaaggaagcctttagcatgacgttcggatcccccgaattctcctcacctgaagatactaacgaggggaagatcaggctcaagcccgagacgccaaggagcgagacttgcatatccaatgacttttattcccacatgccagtgggagagaccaaccccttaatcggaagtttactgcaagagcgtcaagatgtcatcgccagaatagcacaacacttagaacatatcgacccgaccgccagtcatataccccgtcaatcttttaatatgcatgattcgtcatccgtggctagcaaagtgtttaggtcatcctatgaggataagaacctgttgaaaaaaaacaaggacgagagctctgtttctatatcacataccaaatgcagcctcctcggagacatctctgatggtaagaatctggtcccgaacaagtgcttcacttcctttaaaaacaatagcaaagagaaatgtagcctaaaacaccagaccagaaatcagtgccagaacaatccttcagaaatcatccagtctacctaccaggaaacacagaataaatcctcaagtctgagcaccagcagcatcttaagtcagcacaaggaaaacaatctggatttgaccagcagattcaaagaacaggagatgtcaaatggtatagacaagcagtactccaactgtaccacaattgataaacaaatttgcactaacaagtataaggagaagatcatcaacgaaaactataacccaaaattcttcggcaacctgcagtctgatgactccaagaaaaacgatagtaaaattaaggtcactgtcctggagatgtccgagtatttaaacaaatacgagtcaatgagttccaacaaagattctaagaggcctaaaacctgcgaacagaacacgcagctgaactctatcgaaaactatttaaataaagacaatgaaggatttaagtgcaaaaaaagtgatcagttgaagaatgaacaggataagcaggaggatcctacgaatgagaaaagtcaaaactattcccagagacgtagtatcaaagactgtttgagtacatgcgaacaacctaagaacacggaggtgttacgtactacattgaaacattctaacgtctggcgcaagcataattttcacagcctagatggaacgtccaccagagcctttcatcctcagaccggcttgcctctgctgtcaagtcctgtcccgcagcggaagacacaaagcggctgctttgatttggattcaagcctgctgcacctgaaaagtttctccagtagatcccctaggccttgtctgaacattgaggatgatccagacatacatgagaagccctttttgtcatctagcgctcctcctataacgagtctatcactgttgggaaacttcgaagaatccgtactgaactatagattcgatccattgggtattgtggatggttttacagcagaggtcggcgcttccggtgctttctgcccaacacacctgactctgccagtcgaggtatctttctatagcgtctccgacgacaatgctccaagcccatacatgggcgtgattaccctggagtccctgggcaagcggggttacagagtaccgccaagcgggaccatacaggtgacactctttaatcctaacaaaaccgtggtcaagatgttcgttgttatatatgatctgagggatatgcccgctaaccatcagaccttcttgcggcaaagaacattctccgttccagtgaagcaggaagtcaagcgaagtgtaaacaaagaaaatatcaggcacaccgaggagcgcctgctgagatacctgattcacctccgcttccagtcctcgaagtccggcaagatatatctgcatagggatgtgcgactgctattcagtaggaagtcgatggaagtggactcaggggctgcctatgagcttaaaagctatacagaaagccctaccaacccccagtttagtcctaggtgttag

SEQ ID NO: 56164 - DNA, 2877 bp, Artificial Sequence
  Description of Artificial Sequence: Synthetic coding sequence
aggccagatgccgacaccctcgacgagtacttcgagtatgatgctgaggagttcctggtcagcctggccttgctcatcacagaggggcgtactcccgagtgctcagtcaaaggcagaacagagagttttcactgtccacctgcacagagttgttacccggtaactaccaaacacgaatgttcagataagcttgcacagtgcagacaggcacggcgaacccgctcagaggtcacattactctggaagaataacctgcctataatggtcgagatgatgctgctgccagattgctgctattcggacgacggcccaaccactgaggggattgacctgaacgacccagccatcaagcaggacgccttgctgctggaacgatggatcctggagccagtccctcgtcagaatggcgatcgattcattgaggagaaaacacttttgcttgctgtaagatcgtttgtatttttctcacaactgtctgcctggctctcagtctcccacggtgccatccctagaaatatcttgtataggataagcgctgcagacgttgatctgcaatggaatttctcccaaacccctatcgaacacgtcttcccagtacctaatgtctctcacaacgtggcccttaaggtttctgtgcaaagcctcccacggcaaagtaactaccctgttctgacatgtagcattcacaccaatattgggctctacgagaaacgcatccagcagcacaagctcaagactcaccaacaccataacccaaacgaggctgaacaatgtggtaccaacagtagccagcgcttgtgcagcaaacaaacctggactatggcccctgagagcgtgttgcacgcgaagtctggccctagcccagaatatacagccgcagtgaaaaatatcaagctatatccaggaacgggaagcaaatcagaccacggaaccagccaggctaacatactcggattttccggcatcggcgatatcaagtctcaagaaacaagtgtgagaacgctgaagtccttctcaatggttgattccagcattagtaatagacagtccttctggcagtcggcgggagagacaaacccactgattggaagcctgattcaggagcggcaggagatcatcgctcggatcgcccagcacttaatccactgcgatccatccacatcacatgtgtcaggcaggcccttcaatacacaggagtcaagtagtctgcacagcaagctgttccgggtgagccaggaaaacgaaaacgtgggaaagggaaaggaggccttttcaatgaccttcggttccccagaattcagctctcccgaggatacaaacgaaggaaagattcgattaaaacccgagacaccacgctctgaaacttgtataagtaatgatttttattcacacatgcccgtcggagaaacaaacccccttattggcagcttacttcaggagagacaagatgtgattgctcgtattgcacagcacctggaacacatcgaccctactgcctctcacatccccaggcaaagctttaatatgcacgattcctcctctgtcgcctctaaagtattccggtctagctatgaggacaagaacttacttaagaagaacaaggacgaaagcagtgttagcatcagccatacaaagtgttcgttgctgggtgacatctcggacggaaaaaacttagtaccaaacaaatgcttcacctcattcaaaaataactctaaagagaaatgtagcctcaagcaccagacacggaaccagtgtcagaataatcccagtgagatcatacagtctacatatcaggaaacccagaacaagtccagctccctttcgacatctagcatcttgagtcagcacaaagaaaataatctcgacctgacctctcggtttaaagagcaggaaatgtcgaatggaatcgataaacagtacagtaattgtacaaccatcgataaacagatctgcaccaataaatataaggagaaaatcataaatgagaactataaccctaagttcttcggaaacctccagtccgacgattccaaaaaaaacgactcgaagattaaggtcacagtgctggagatgtctgaatatcttaacaagtacgaatcaatgtcttccaacaaggatagcaaacgacctaaaacgtgcgaacagaatactcagctaaactctatagaaaattatctgaataaggacaatgaggggttcaaatgcaagaagtccgaccagttaaagaacgagcaagacaagcaggaggatccaactaacgagaagagccagaactactctcagagacgctctattaaggactgtctgtccacatgcgagcagcctaagaataccgaagtgctgcgcacaactttgaagcattcaaacgtatggagaaaacacaacttccattcactggatgggacctctacccgcgcatttcatccacagaccggattacccctattgtcctcacccgtgccccaacggaaaacacagagtggatgttttgatctcgactctagtctgttgcatctgaagagtttttctagcagaagccccagaccgtgcttgaatattgaggacgatccagacattcatgagaaaccattcttatcttcctccgcccctccgatcacatcgctgtctctgctcgggaactttgaggaatcggtcctgaattaccggtttgatccacttggaattgtggacgggtttaccgctgaggtcggagcctctggggctttctgtcccacacacctcaccctgccggtcgaggtctctttttacagtgtcagcgacgataatgcgcctagcccttacatgggtgtcatcacactggaaagcctggggaaacggggataccgagtgcctccttcaggcaccatccaggtctag

SEQ ID NO: 56165 - DNA, 3252 bp, Artificial Sequence
  Description of Artificial Sequence: Synthetic coding sequence
atggtcttctcaggaaataaggggttgcatcgcgaggacactctggacgaatatttcgaatatgatgctgaagagttcttagttagtttagctttattgattaccgagggtaggacccctgaatgtagtgtgaaaggacgcacggaatcatttcactgccctcctgctcagagctgctatccagtgacgacgaaacacgagtgcagtgacaagctggcccagtgtcggcaggccagaagaacccgatccgaggtgacactgctttggaagaataacctacccattatggtggaaatgatgctcctccccgactgctgttacagcgatgacggtccaaccactgagggcatcgatctcaacgatcccgcaatcaaacaggatgccttgctgctcgagaggtggatcttagaacccgtccctagacagaacggagacaggttcatcgaagagaagaccctgctgttggcagtaaggtcttttgtatttttctctcagctgagtgcatggctgagcgtgtctcatggcgctatcccgcgtaacatactgtaccgaatcagcgccgcagatgttgacttacagtggaactttagccagacccctattgagcacgtatttcccgtgccaaacgtgtcacataatgtggccctgaaggtttccgtccagagtctgcccagacagtcaaactaccctgtcctcacttgctccattcataccaacataggcctctacgaaaaaaggattcagcaacacaagcttaagacacaccagcatcataaccctaacgaggccgagcagtgtggaacaaactcctcccaacggctgtgtagcaagcagacttggaccatggcaccggagtctgtgctgcatgctaagtcaggaccttccccagagtacaccgccgctgtgaaaaatataaagctatatcccggtacaggctccaagtcagatcacgggacttcccaggccaatatattaggattttcaggcattggagacattaagagccaagaaaccagcgtgcgcactcttaagagcttttctatggtcgatagtagtatctcaaaccggcagagcttctggcaaagcgctggtgagactaatcctctgattggaagcctgatccaggaacgccaggagattatcgctcggattgcacagcatttgatccactgtgatccatccaccagccatgtttcagggcgtccgttcaatacacaggagtccagctctcttcactctaaactgttcagggttagccaagaaaatgagaacgtggggaagggaaaggaagccttcagtatgacttttggttcacctgaattctcatcacctgaagacaccaacgaaggaaaaatccgcctgaagcccgagactccaaggtcagagacctgtatcagcaacgacttctactcacacatgccagtgggcgaaacgaatcccctcatcggatccttgctgcaagaacgacaggatgtgatcgcgcgaatagcacaacatttggagcacattgaccctacagcctcccacatcccacgccaatctttcaacatgcacgacagcagttcggtcgcctctaaggtgttcaggtcaagttatgaagacaagaatctgcttaagaagaataaagacgagtcttcagtttccatctcccatacgaagtgctctcttctgggcgatatcagtgacgggaaaaatttagtgccaaacaagtgctttacatctttcaagaacaatagcaaagagaagtgctcactgaaacaccaaacccggaatcagtgtcaaaacaatccatccgagattattcagagtacataccaagagacacaaaacaaatcctcatcactgtctacctccagtatactcagtcagcataaggaaaataatctcgacttaactagcagattcaaggaacaggagatgtcaaatggcattgacaagcagtactcgaattgcacgaccattgataaacagatctgcaccaataaatataaggagaaaattataaatgagaactacaatccaaaatttttcgggaacctgcaaagcgatgattccaagaaaaatgactccaaaataaaggtgaccgtgcttgaaatgagtgaatatcttaacaagtatgagagcatgtctagcaacaaagacagcaagcggcctaaaacatgcgaacaaaatacccaactcaactccattgaaaactatcttaataaagacaacgaaggcttcaagtgcaagaagagtgatcagttgaagaatgaacaggataaacaggaagatcccaccaatgagaagagccaaaactattcacagcggaggagcattaaagactgcttgtcaacctgtgagcagccaaagaacaccgaggtgcttcggactacattgaagcattccaacgtgtggagaaagcacaattttcactccttggatggtacgagtacacgcgcatttcatcctcagacagggctacctctcttatcctccccggtgcctcagaggaagacacagagtggctgtttcgatttggacagtagcctcctgcatcttaagtcattttcgtcaagatcccccaggccctgtctgaacattgaggacgacccggatattcatgagaaaccattcctttcgtccagcgcaccacccatcacctcactttccctgctagggaactttgaggagagcgtgttgaactatcgtttcgaccccctgggaatagttgacggattcacagcagaagttggagcatctggggctttctgccccacacacttaaccctccccgtagaagtgagtttctactctgtctccgacgataatgcgccatccccctatatgggcgttatcaccttagaaagcctagggaagcgcggatacagagttcccccttcaggaactatacaggtcaccctcttcaacccaaacaaaactgtggtcaaaatgttcgtggtgatctacgacctgcgcgatatgcccgctaatcaccagacttttcttagacaaagaactttctctgtaccggttaagcaggaggtcaagagaagcgtgaacaaagagaacatcagacacactgaagagagactgctgcggtatcttattcacctccggtttcagtctagcaaatccgggaaaatatacctgcatcgcgatgtgagattactgttcagccggaagtctatggaggtagattcaggtgcggcttatgagctgaagtcctacacggagagccccactaatccacagttttcccccaggtgttag

SEQ ID NO: 56166 - DNA, 1890 bp, Artificial Sequence
  Description of Artificial Sequence: Synthetic coding sequence
atggaggtcaaaggcccatctggcagaagcttttgctgtgagtccgaaggacagttcaagtcgtgtttaaaacgacacacaccgtcactgctacttccatcctcttggaagggaaatagtggaagctgtcttatggcaaaggccttgcaccgtatgagtcccacccccaatagctgcccgctgcctttgcccttgtgtcggatgtctggggttctgtgctctcgaaacctctttacgtttaagttctccttgtttcagctggacagtggagcctccggcgagccaggccacagcctaggccttaccttggggttttctcattgtgggaactgccaaacagcagtagttagtgctcagcccgaagggatggcatcaaatggagcttatcctgcccttggtcccggagtgacagcaaatcctggaacatccctgagcgtgttcacggccctgccatttacgactcctgcccctggccctgctcacggaccgctcttggtgaccgcgggagcacccccagggggacctttagtcctcagtacactgccctctacacctctagtcaccgagcaagatggttgcggaccaagcggtgccggagccagtaacgtgtttgtacagatgcgcaccgaggtgggtcccgtgaaggccgctcaggctcagacgctcgtgttaactcaggctccattggtgtggcaggcgcctggagctctctgtggtggagttgtgtgtcccccaccgctgctgctggcagccgcaccggtggttccggtgatggcggctcaagtcgttgggggaacgcaggcttgcgaaggtggatggtctcaaggcctgccattgcctccgccaccacccccagctgctcagctccctccaatagttagccaaggcaatgcaggaccatggccacagggcgcacacggtgaaggcagtttagcctcatcgcaggcgaaggctcccccagacgattcgtgcaaccctagaagtgtgtacgaaaatttcagactgtggcagcactacaagccgctcgcgaggcggcacttaccacagtcccctgacaccgaggcgctcagctgctttctcatacctgttctcaggtccctggcaaggcgaaaacctacaatgaccttggaggagggcctctggcgggctatgcgtgagtggcagcatacctcaaatttcgatcggatgatcttctacgagatggccgagaaatttctggagtttgaggcggaagaggaaatgcagatacagaaaagccaatggatgaaaggaccccaatgtctgccgcctccagctaccccacgactggaacctcgaggcccacccgcacctgaagttgtgaaacaaccagtctacctcccatcaaaggcaggaccgaaggcgcctactgcctgtcttcctccacctagacctcagcggcctgtgaccaaggcaagaaggcccccacctcgccctcaccggcgagcagaaacaaaggccagattgcccccaccgagaccacaaaggccagcagagactaaagttcctgaggagatcccaccagaggtggtgcaagagtacgtggacatcatggaggaactactcgggcctagcttgggggcaacaggggaaccggagaaacaacgagaggagggtgaagtgaagcagccccaggaagaggactggacccctccggacccaggcctgcttagttacaccgataagctgtgcagccagaaagattttgtcacaaaagtggaggcagtgatacacccccaattcttagaagagctcctgtctccagatccccagatggactttctcgcactgtctcaagaacttgaacaggaggaagggttgactctggctcagggagctccatcggacgccccaggaacagacaggtgttag

SEQ ID NO: 56167 - DNA, 2637 bp, Artificial Sequence
  Description of Artificial Sequence: Synthetic coding sequence
atggaagtgaagggacccagtggaaggagtttttgctgtgaaagcgaaggtcagttcaagagttgtttgaaaaggcacaccccaagcctgcttcttccttcttcatggaagggaaactccggatcctgcctgatggcaaaagccttacacagaatgtcacctactcccaacagctgtcccctccctctgccgctatgccggatgtctggggtactgtgttcccgcaacttgttcacttttaaattctcgctctttcagttggattctggggcatctggggaaccaggtcacagcctgggcctaacattggggtttagccattgcggaaattgccagaccgccgttgtgtctgcacagcccgagggaatggcctcaaacggcgcataccctgccctcggcccaggcgtcactgcgaaccctggaaccagtctgtccgtgtttaccgcactgccattcacaacccccgctcctggtcccgcacatggcccattactggtgaccgcaggggctccacccggaggacctctggtattgagcactctgcctagcaccccgctggtcacagaacaggacggctgcggccctagcggcgctggcgcatctaatgtgttcgtccaaatgagaactgaggtgggacccgtgaaggcagcacaggcccaaacactcgtgttaacccaggctcccttggtgtggcaagcaccgggagctctgtgcggaggagtggtctgtccgccacccctcctcctggccgctgcacctgtggtcccggtgatggctgcacaggtagtagggggtacccaggcgtgcgaggggggttggtctcaagggctgccactgccacctcctcctcccccagcggcacagctgccacctatcgtgtcgcaagggaatgctggtccgtggccacagggcgctcatggcgaggggtctctggccagttcacaggctaaagctcctcctgacgactcctgcaatcctaggtctgtctatgagaactttcggctgtggcagcattataaacccctggcacgcagacatttgccccaatcacccgatactgaggcactgtcctgttttcttatccccgtgcttagaagcttagcacggcgaaaaccaacgatgactctggaagaaggcttgtggagagccatgagggaatggcaacatacttctaatttcgaccgaatgatcttttacgagatggctgagaagttcctcgaatttgaggcggaggaggaaatgcaaatacagaagtcccaatggatgaagggaccccagtgcttacccccacctgcaacccccaggctggaacctaggggtcccccagcacctgaagtcgttaagcagcccgtgtacctcccatccaaggccggtcctaaggctcccaccgcctgtcttcctccacctcgcccacagaggccagttaccaaggcgaggagaccgccaccacgaccccatagacgcgcagagaccaaggcgagactgccccctccgaggccacagagaccggcagagaccaaggtacccgaagagatcccccctgaagtcgtgcaggaatacgtggatatcatggaagagctgctcggcccatcccttggcgcaacaggggagcccgagaagcagagagaggaaggggaggtaaaacagccacaggaagaggattggaccccgccagaccccggtctcctaagttataccgataaactctgctcacagaaagattttgtcactaaagtggaggcagttatccaccctcagtttctcgaggaactgctctcacctgacccacaaatggatttcctcgccctatctcaggagctggagcaagaagaagggctgacattagcccaacttgtggagaagcgcctcctacctttgaaagaaaagcagcacgcccgagccgctcctagccggggtaccgcgaggctcgattccagttcttccaaattcgccgctggacaaggcgcagagcgtgacgttcctgtgccgcagcagggcgtcggaatggagacttgcccacctcagacaacagcacgcgactcccagggccgtggcagggcccacactgggatggccagatccaaggattcagtggtgctacttggatgccaggattcacctggtctgagggccgcacggccaacatccccccctcaggaccatcgcccaacttgcccgggtgtcggcaccaaagatgcactggacctaccgggaggtagcccagtcagagaatcacacggcctcgcccagggctcttctgaggaagaggaactaccctccctggcatttctcctgggctcccagcataaactgctgccttggtggctgccgcagtcacccgtaccagccagcgggctgctctctcctgaaaagtggggcccacaagggacacatcagttcccaagcgcggagagacgcggtctaaatctcgctccaagccccgctaacaaggcgaaaaaacggcctcttttcgggtcactatctccggctgagaaaaccccccacccgggaccaggactacgcgtaagtggcgaacagtcactgacatggggcttaggcggaccaagccagagccagaagcgtaagggcgaccccttggtatcgcgcaaagaaaaaaagcagaggtgcagtcagtag

SEQ ID NO: 56168 - DNA, 2418 bp, Artificial Sequence
  Description of Artificial Sequence: Synthetic coding sequence
atgttccaggaacctgtatattttcagatatttttccaactggattctggcgcttctggagagcctgggcacagcctggggctcacactcggattttcccactgtggcaactgccagacagcagttgttagcgcccagcccgagggcatggctagtaatggggcatatcctgctctgggcccaggcgtgaccgcgaatcctggaacctcactgagtgtgtttacagcattacccttcaccacccctgccccaggcccagcccatggccctttactggtgaccgcaggcgctccacctgggggacctctcgttctgagcaccttaccatctaccccactggttacggaacaggacggatgtggaccttccggcgctggagctagtaatgtttttgtgcagatgaggaccgaggtcggaccagttaaggcagcacaggcacagacgctcgtgctgacgcaggccccactagtatggcaggcaccaggcgctctgtgtggtggagtagtgtgtccaccacctctcctccttgctgctgcaccagtcgtaccagtcatggccgcacaggttgtcggtggcacgcaggcttgcgaaggcggatggtcacagggactgcctctgcctcctccaccccctccagcagctcagctgccacctatcgttagccaagggaacgctggcccatggcctcagggcgcacatggggaaggctccctcgcctccagccaggcaaaggctcccccagatgactcctgtaatcctaggagtgtgtacgagaactttaggctgtggcagcactacaagcctctggcaagacgccacctcccccaatccccagatactgaagcactcagctgcttccttattcctgtacttcggtccctcgcacgaaggaaaccaaccatgacactggaggagggactgtggcgggcaatgcgggagtggcagcacacgtcaaatttcgatcgcatgattttttatgagatggcagagaagtttctagagttcgaggcggaggaggagatgcagatccagaaatcacagtggatgaaggggcctcagtgcctcccccctcctgcgacccccaggctggagccccgaggaccaccagcacccgaagtcgtgaaacagccggtgtatctgccatccaaggctggccctaaagcccctaccgcctgccttcccccaccaagaccccaacgccctgttacgaaggccagacggccaccacctcgcccacatagacgggctgaaactaaggccagactgccaccccctcgtcctcagcgtcccgcagagaccaaggtcccggaagaaattcctcccgaagtagtgcaggagtacgtggacatcatggaagaactcctgggccctagtctgggagctacaggagagcctgagaaacagagggaggagggcgaggttaaacagcctcaagaggaagattggacaccaccagacccaggtcttctgtcctatacagataaattgtgtagtcagaaggacttcgtcacgaaagttgaggcggtgatccacccccagttcctggaagagcttctgagcccagatccgcaaatggattttctcgctttgtcacaagaactggagcaggaagaaggactgactctcgctcagctggttgagaagaggctgttaccacttaaggagaagcagcacgcccgtgcagcgccaagcagaggtacggccaggctggattcctcatcatctaaatttgccgctggtcagggggctgaacgggatgtacccgtgccccaacagggagtgggcatggagacatgcccccctcagaccacggcacgagacagtcagggcagagggagggcccacaccgggatggcgcgtagcaaggactccgttgtcctgctgggctgccaggattcacctggccttcgggctgctaggcctacctctcccccacaggatcatcgaccaacatgtccaggcgtgggcacaaaggacgccctggacctaccaggcggaagccccgtgcgcgaatcccatggactggcgcagggaagttcagaggaggaagagctgccaagcctcgcattcttactgggctctcaacacaaattactgccttggtggctaccccaatcacctgtcccggcttctggcctgttatctcccgagaagtggggtccccagggaactcaccagttcccatccgcagagaggagaggattgaatttggctccaagccccgctaataaggccaaaaaacgtcctctgtttggctccctatctcctgcagaaaaaacaccacaccctggccctggtctcagagtatctggtgaacaatctctcacgtgggggcttggcggaccgtctcagagccagaaacgaaaaggtgatccattagtctcgcgaaaggagaagaagcagaggtgctcccaatag

SEQ ID NO: 56169 - DNA, 789 bp, Artificial Sequence
  Description of Artificial Sequence: Synthetic coding sequence
atggaggagcttctgggcccatccttgggggcaaccggcgaacctgagaagcagcgggaagagggtgaggtgaagcaaccacaggaagaggactggacgcctccggatcccggtctactctcttacaccgataagctgtgttcccagaaagatttcgtgactaaggtggaggccgtgatccacccgcagtttctcgaggagctactttctcctgatcctcaaatggatttcctcgctctttctcaagagcttgagcaggaagagggtctcactctggcacagctggtggagaaacgcctgttacccctgaaagaaaagcagcatgctcgtgccgcaccttccagagggaccgcacgcctggactcctcaagcagcaagttcgcggcaggtcaaggcgcagagagggatgtgcccgtgccacagcaaggggtgggaatggaaacttgccccccacagaccactgcaagggattctcagggtcgcggtagggcccacacggcaagcggactgctcagtccagaaaaatggggcccacagggcactcaccagttcccttctgcagagaggcgcggactgaacctggctccttctcccgcaaacaaggcaaagaaaaggccactttttggatcccttagccccgctgagaaaaccccccatcccggtcctggtctcagagttagcggggagcagagtctaacgtggggcctcggagggccaagccagagccaaaagaggaaaggagatccgctagtttccagaaaagagaagaagcagcggtgcagtcagtag

SEQ ID NO: 56170 - DNA, 1971 bp, Artificial Sequence
  Description of Artificial Sequence: Synthetic coding sequence
tgactgacacaggcccctctcgtgtggcaagccccaggagcactttgcggtggcgttgtatgcccgcctccgctgctcctggcggctgcacctgttgtgccagtgatggcggcacaggtcgtgggcggaactcaggcgtgcgaaggcggatggtcacaggggctcccactgccccctccccctcccccagctgcccagctcccgccaatcgttagccagggtaatgccggtccctggccccaaggagctcacggagagggctcattagcttcttcccaagctaaggcaccacccgacgattcctgtaacccccgatcagtgtatgaaaactttaggctatggcaacattacaaacccctggccagaagacatcttccgcagtcccctgacactgaggctctgagctgttttttgattccagtgctgcgttcattagctcgacggaagcccactatgaccctggaggagggactgtggcgggctatgcgggagtggcagcatacgtcaaatttcgacaggatgattttctacgaaatggccgagaaattcttggagttcgaggcggaggaggaaatgcagattcagaaatcacaatggatgaaggggcctcaatgtctgccacctccagccacacctcgcctggaaccacgcggtccacctgcacctgaggttgtaaagcagccagtgtatttgcccagtaaggccggtcccaaggcccctactgcgtgcctgcctcctcctcggcctcaaagacctgtgacaaaagcccgaagaccacctcccaggcctcatcgcagagcggagacaaaggcacgcctgccccctccccgaccccagagaccagctgagaccaaggtccccgaggagatccctccggaagtggtccaagaatacgtggacataatggaggaactcttggggccatcccttggcgctactggcgagcctgaaaaacagcgcgaggagggcgaggtcaaacagccacaagaagaggactggacgcctccggaccctggtctcctgtcttatactgataagctctgctctcaaaaggatttcgtcactaaagtggaggccgtgatccaccctcagttcctggaggagctgctcagcccagacccgcagatggattttctggccctctcacaggagctggaacaggaagaaggtctgacacttgctcagttagtcgagaagcggctactgcctcttaaggaaaagcaacacgccagggccgctccaagtagagggactgcacggctcgatagttcatcttcgaagtttgcagctggacaaggggctgagagagatgttcccgtgccacagcagggcgtgggtatggagacatgtccgcctcagacaaccgcgcgtgactcgcagggaagaggtagggcacacaccggaatggcacgcagcaaggacagcgttgtacttctcggatgccaggactctccaggactgcgtgcggctagacccacatccccacctcaggaccatagacccacatgtcccggtgttggaacaaaggacgcactggatctacctggcggatcacccgtgagagagagccatggcctggcacaggggagtagcgaggaagaggagctgccctcccttgcctttctgctcggctcacaacataaactgctgccatggtggctacctcaatcaccagtgcctgcaagcggactgctgagtccagaaaaatggggccctcagggcacacatcagttcccgagcgccgagcgtcgtgggttgaacttagccccaagcccagccaataaggccaagaagcggccactgttcggctccttaagtcctgccgaaaaaacaccgcaccccggacccggactgcgtgtatctggggagcagtctctcacgtggggcctgggaggtccatcccagtcacagaaacgcaaaggcgaccctctggtgtcgcggaaagagaaaaaacagagatgttcccagtag

SEQ ID NO: 56171 - DNA, 1866 bp, Artificial Sequence
  Description of Artificial Sequence: Synthetic coding sequence
atggccgctcaggtggtcggagggacacaggcctgcgaaggcggttggtcacagggcctgcccctgccccctccgccacctcccgcagcacagcttccacctattgttagtcaaggaaacgctggtccttggccacaaggagcccacggggagagctcgctggcctcgagtcaggctaaggcaccaccagatgacagctgtaaccccagatccgtgtacgagaactttcgtttgtggcaacattataaaccactggctaggagacaccttcctcagtctccagacacggaagcgctctcatgcttccttatacctgtactaaggtctctagcacgcagaaagcccacaatgacgctggaagaaggcctgtggagggccatgcgggaatggcagcatacctccaactttgaccgtatgatcttttatgagatggcagaaaagtttctagagttcgaagccgaagaggaaatgcagatccagaagtcccagtggatgaaaggtccccaatgtctgcctcctcccgcaactccccgactggagcccagggggcctccagcccctgaggtcgtcaaacaacctgtttatctcccaagtaaggccggacctaaagccccaaccgcatgcttgcctccacctcggcctcaacgacctgtcacaaaagcaagaagaccacctccacgaccacaccgaagggctgagactaaggctcggctgccccctccccgaccgcagcgccctgccgagactaaagtgccagaagagatcccacctgaggtcgtccaagagtatgtagacattatggaggagttgctggggccttcactgggagctaccggggagccagagaaacagagagaggagggcaaggtaaagcaaccccaggaggaagattggacccccccagatccgggtctgctgtcatacatcgacaagctctgcagccagaaagactttgttactaaggtggaagccgtaattcacccccagttcctcgaggaattgctgtcaccagacccccagatggattttctggcattaagtcaggacctcgaacaagaagagggcctaacccttgcccaactggtggaaaagcgattacccccactgaaagaaaagcaacacgcgagggccgcacccagtcggggaaccgcaagacttgacagcagtagtagtaagttcgcagccggacagggagctgaaagagacgttccggacccccagcagggcgttggtatggagacctgcccacctcagatgactgccagagactctcaggggagagggagggcacatactgggatggcacgctcagaagactctgtcgtgcttctgggatgccaggattcccctggcctccgggctgcctggccaaccagccctccgcaggaccacaggccgacatgcccaggggtggggacaaaggatgctctagatctgcccggagggtcgccggtgcgggagagtcacgggctcgctcaaggttcctctgaggaggaagagttgccatctctggcatttctcttaggtagccagcacaaactgctaccatggtggctcccccagtctcccgtacctgctagcggcctgctgtctcccgagaagtgggggcctcagggaacccaccaaagcccttccgcagaacgtaggggtctgaatctggcccctagccccgcaaataaggccaagaaacggcctttattcggttccttaagcccggcagagaagacaccttacccagggcctgggctgcgggtttcaggagaacagtcacttacctggggcctcggaggtccttcccagtcccaaaagcgcaagggggaccctctcgttagtaggaaggaaaagaagcagcattgcagtcagtag

SEQ ID NO: 56172 - DNA, 1689 bp, Artificial Sequence
  Description of Artificial Sequence: Synthetic coding sequence
atgtcaggagttctgtgttcacgaaatctgtttactttcaaattctctctatttcaacttgacagcggggcttccggagagcccggtcattctctcggtctgaccctgggattctcctattgtggcaattgccagactgcagtggtaagcgctcagccagaaggcatggccagcaacggtgcgtatccagtgctgggcccaggagtaacggccaaccccggtactagtcttagcgtgttcaccgcgctccccttcacaacacctgccccaggaccggctcatggccctctgcttgtgaccgcaggtgctcccccaggtggtccgctcgtgctaagcacattcccctcgacccctctggtgactgagcaggatggatgtggcccaagcggcgctggtgcttcaaatgttttcgttcaaatgcgcaccgaagttgggcctgtcaaagcagcccaggctcagaccctggtgcttacccaggccccactcgtgtggcaagctcccggagctctgtgcggaggtgtcgtgtgccccccacccctactgctagccgcagccccagtcgttcctgtgatggcagcccaagtcgtgggcggaacccaggcatgcgagggcggatggagtcagggactgcctctaccccctcctcctcccccagcagcccagctcccaccaatagtgtcacaagggaatgccggtccctggccacagggcgctcacggtgaatcttccctcgcctcatcacaggcgaaggctcctccagacgacagttgcaaccccaggtctgtctacgagaactttagactttggcaacactataagccacttgctagaaggcatctgcctcaaagcccagataccgaggctctatcatgctttctgatccctgtactacgcagcctggcacgcagaaaacctactatgactttggaggaggggctttggcgcgcaatgcgagaatggcagcatacctccaatttcgatcggatgatcttttacgagatggccgagaagttcctggagttcgaagctgaagaggagatgcagattcaaaaatcccagtggatgaaaggtccccagtgccttcctccgccagccacccccaggctcgagcccagggggccacccgcacccgaggtagtaaagcagccggtgtaccttcccagtaaggccggtccaaaggcgccaacggcatgcctgccaccacccagaccacagcgacctgtaaccaaagcgaggagaccaccccctaggccgcaccggagagctgaaacaaaggctagattgcccccaccgagaccccagaggccagccgagacaaaagtgccagaggagatccctccagaggtggtccaagagtatgtggacatcatggaggagttgctaggcccttccttgggtgctacgggcgagcccgagaagcagagggaggaaggcaaggtgaaacagcctcaggaggaagattggacacccccagatcctggtctgctctcttacattgacaagctgtgttctcagaaagattttgtgacaaaagtcgaggccgttatacatccacagttcctcgaagaactgttaagtcctgatcctcagatggacttcctcgctcttagtcaggaccttgaacaggaggagggccttaccctggcacagggtgccccttccgatgccccagggaccgaccgttgctag

SEQ ID NO: 56173 - DNA, 2637 bp, Artificial Sequence
  Description of Artificial Sequence: Synthetic coding sequence
atggaagtcaagggcccttccggcaggtccttttgctgcgagtctgaaggacagtttaaatcatgcctgaaacgacataccccttcgttacttcttccttcaagctggaaaggcaactcaggaagctgtctgatggcggaggcacttcatcgaactagtccaacccctaactcatgtcctctgcctcttcccctatgcagaatgtccggcgtgctatgcagtcggaatttgtttacattcaaattcagcttgtttcagctggactctggagccagcggggagcccggtcactcactgggccttactctggggttctcctattgtggaaactgccagaccgcagtcgtgagtgcacagccagaggggatggcctctaatggcgcatatcccgtcctgggtcctggggttaccgcaaatcccggtacttctctcagcgtcttcactgccctgcccttcacgacaccggctccgggacctgcccacggacctcttttggtaacagccggagccccacccggaggaccgctggtgctgtccacctttccgtcgactccactggtcactgagcaggacggatgcggacccagtggggcaggagcttccaatgtctttgtgcagatgcggacggaagtcgggccagtgaaggctgctcaggctcaaactttggtgctgactcaggcgccattggtgtggcaggctccaggcgcattgtgcgggggagtggtttgtcccccacccctgctgctcgctgccgcacccgtggtgcctgttatggctgcacaagtggtgggtggaacccaggcctgcgaagggggatggtctcaggggctgccgcttcctccacccccaccaccagccgcacagctgccgcctattgtgagccaggggaacgcgggtccctggccgcaaggagcgcacggcgaatcttcgctagcatccagccaagcaaaggcaccgccagacgacagctgcaatccaagatcagtgtatgaaaatttcagattatggcagcattacaaaccactggctcggcgacatctgccgcagtcacccgataccgaagccctgtcatgttttctcatccccgtcctgcggagcctggccagaaggaaacctacaatgacactggaagaggggctctggagggcaatgagggaatggcagcatactagtaattttgaccgcatgatattttacgagatggccgaaaaattcctggagtttgaagccgaggaggagatgcaaatccaaaagtcacagtggatgaaaggccctcagtgcctgccaccacctgcaactccgaggcttgagcctcgcggacccccagcccctgaagtcgtcaagcagcccgtatatctccctagcaaagctggccctaaagcccctacagcttgtctgccaccccctcgccctcagcgcccagtcaccaaggctagacgaccgccaccacgtccgcataggcgggctgagaccaaagcccgactgccgccacctcgccctcaacgccctgccgaaaccaaagtgcccgaggaaatcccccctgaagttgtgcaggaatacgtcgatattatggaagaactcctggggccttcattaggcgcaactggggagcctgaaaagcagagagaggagggtaaggtgaagcaacctcaggaggaagattggacacctccagaccctgggctgctgtcgtatatagataagctgtgcagtcaaaaggatttcgtaactaaagtggaggcagtgatccacccccaatttctggaggaactactgtccccggaccctcagatggacttcctggccttaagccaggatttggagcaggaggaagggttgacacttgcacagttggtggaaaagagattacccccactgaaggaaaagcagcacgcaagagccgctccatcacggggtactgccagactagattcaagctccagcaaattcgctgcaggccagggcgcagagcgggacgtgcctgatccgcagcagggcgtcgggatggagacgtgtccgccacaaatgaccgcgagggactctcaaggtcggggacgggctcataccgggatggctagatctgaggacagcgtggtgctgctgggatgccaggactccccaggattgcgagctgcttggcccacttctcccccacaggaccacaggcctacttgccctggcgtggggacgaaagatgccctggatttgcccggtgggtctccagtacgggagtctcacggcctagcgcagggatcatctgaggaagaggagcttcctagtctagcattccttttgggtagtcagcataagctcctgccttggtggctgccacagagcccagtgccggcttctggcctgctaagcccagaaaaatgggggcctcagggtactcaccagtcaccttcagccgaacggagaggcctgaacctcgcgccatcacctgccaacaaggcaaagaaacgtccgctatttggctctctgtcaccagctgagaaaaccccgtaccctgggccaggcctcagagtgtctggcgagcaaagtctgacctggggccttggcggacccagccaatctcagaagcgaaagggagacccgctggtttctcgcaaggagaaaaaacagcattgcagccaatag

SEQ ID NO: 56174 - DNA, 1890 bp, Artificial Sequence
  Description of Artificial Sequence: Synthetic coding sequence
atggaggttaaaggccctagcggtcgaagcttttgctgtgagtcagaaggtcagttcaaatcgtgcctgaaacgccatactccaagcctccttttaccaagctcctggaaaggaaatagtggatcttgcttgatggctgaagccctccacaggaccagcccaacacccaacagttgtcctcttcccctaccactctgccgaatgagtggtgtgctttgtagccgaaacttatttacttttaaatttagtctgtttcagctcgattcgggagcaagtggtgaacctgggcactccctcggtctgacactgggatttagctattgtggcaactgtcagacagcagttgtaagcgcgcaaccagagggaatggcttccaatggcgcataccccgtcctaggccctggcgttaccgccaatcctggtacatccctaagtgtctttacagcactacctttcactacccccgctcccggtccggctcacggtccgttgctagtaaccgctggggctccgccaggcggtccactagtgctttcaacattccccagcaccccactggtcacagagcaagatggatgtggtcctagcggcgctggggcttctaatgtgtttgtgcagatgcggaccgaagtggggccagtgaaagccgcacaggctcaaacactcgtattgacccaggctccgctcgtgtggcaggcaccgggtgctctgtgcggaggcgtggtatgtcctcctccactgttattggcggctgcgccagtggtgccagtcatggccgctcaggtggtggggggaactcaagcctgtgaggggggatggtcacagggccttcccctgccaccgcctcctcctcccgctgcccagctacctcctatcgtctcacagggaaacgccggaccctggccgcagggcgcacatggtgagagctccctggcctcatcacaagcaaaggcccctccggacgatagctgtaatccgaggtctgtgtatgagaacttcaggctgtggcagcattataagcccttggcaagaaggcatctgccacagtcaccggatactgaggctctgtcttgctttctgatcccggtcctgaggtcactcgctaggagaaagcctacaatgacgctggaggagggcctctggcgggctatgcgagagtggcagcacacaagcaatttcgaccgtatgatcttctacgagatggcggaaaaattcctggagtttgaggcagaggaggagatgcaaatacagaagtctcagtggatgaagggcccacagtgcctccctccgcctgctacaccccgactggaacccaggggtccaccagcacccgaagtggtgaagcagccagtatatctgccctcaaaagccggacccaaggctccaacggcctgcctgcctcccccacgcccacagagacccgttaccaaagcccgacgccctccccctaggccacacaggcgagctgaaacaaaggcccgtttgcctccgccacggcctcagaggcctgctgagaccaaagtcccagaagagattcctcccgaagtggtacaagagtacgtggatatcatggaggagctacttggcccaagtctgggtgccactggagagccggaaaagcaaagagaggaaggcaaagtcaaacagccccaggaagaggactggacccctcctgacccgggtctgttgtcgtacatcgacaaattgtgctcccagaaggactttgtgactaaagtggaggctgttattcacccgcagtttctcgaagaattgttgtcacccgacccccaaatggattttttagccctttctcaggatctggagcaggaagaaggtttaaccttggcacagggggcaccatcggacgctccaggcactgacaggtgttag

SEQ ID NO: 56175 - DNA, 2634 bp, Artificial Sequence
  Description of Artificial Sequence: Synthetic coding sequence
atggaggtaaagggccctagcggccgttcattttgctgcgaatccgaaggccagttcaagtcatgtttgaagcgtcacactcccagcttgctgcttccttcctcatggaagggtaattcaggatcctgtctgatggcagaagccctgcaccggatgtctcccactcccaactcgtgtccactccccttaccgctttgcaggatgtccggggtgctgtgttccaggaacctgtttacattcaaattctctttccagctggacagtggagcctcgggggagcctggtcacagtctagggcttactttgggcttttcccactgtggtaactgccagaccgctgtcgtttccgcccagccagaaggaatggcatcaaacggcgcttacccggcactgggcccaggcgtgacggctaatcctggcacctcactctccgtgttcacggcactgccattcaccactcccgcaccaggccctgcacacggcccattactggtgacagccggtgcaccacctgggggtcccctcgttttgagcaattttccgtcgacgcctcttgtcactgagcaggacgggtgtggacctagtggggcaggcgctagtaatgtgttcgtacagatgcgcacagaagttggtccggttaaagccgcacaggcccagaccctggttctcacgcagacccctctggtgtggcaggctcccggtgcgctttgtggaggggtggtgtgccctccccctctcctgctggcagcagcccctgtggtgcccgtcatggctgcgcaagtcgtaggtggaacccaagcttgtgaaggagggtggagccagggactccccttgccaccccctcccccacctgctgctcaattgcctcctatcgtgagtcaaggcaatgctggtccctggccccagggggctcacggcgaggggagcctcgccagcagccaggcaaaggccccaccagacgattcctgcaaccctagatctgtctatgagaatttcaggttatggcagcattacaaaccacttgcaagacgccacttgccacagtcccccgatactgaagcattgtcttgctttctaatccccgtgctgaggtcccttgcaaggcgtaaacccaccatgacactcgaagaaggactgtggcgggctatgcgagaatggcaacacacgtcaaatttcgacaggatgatcttttatgagatggccgagaaattcctcgagttcgaagctgaggaggagatgcaaattcagaaatcccagtggatgaagggccctcagtgcctgccacccccagctacacccagactggaaccccgtggccctccggcaccagaagttgtgaagcaaccagtgtatctgccctccaaagccggtcctaaggcacccaccgcatgcctgcctcccccaaggccccaacgcccagtgactaaagcccgtcgaccaccacctagacctcatcggagagccgaaaccaaggctaggctacccccacccaggccgcaacgtccggcagaaaccaaagtgcccgaagagatcccccctgaagtggtgcaggagtacgttgatatcatggaagaactcctgggtcctagcctgggcgcaacgggagaacctgagaagcagagggaggaaggagaggtgaagcagccacaagaagaagattggactccaccagaccctggcctcctgtcctacaccgacaaactctgctcacagaaagatttcgtgacaaaggtcgaagccgtaattcatccgcaatttcttgaggaattgctaagccccgacccccagatggactttcttgcactctctcaggagctggaacaagaggaaggactgactctggctcagctagtcgagaagcgcctcctacctctaaaggaaaaacagcacgctcgagccgctccctctagaggcaccgcccgactggattcaagttcttccaagtttgctgccggacagggagccgagcgcgatgtgcccgacccccaacagggcgtgggcatggaaacttgcccgccacagactacagccagggatagtcaggggaggggacgagctcataccggaatggcgcgtagcaaggactcagttgtgctcttgggatgccaggattcaccgggactgagggcagccagaccaacttctcccccacaagatcacagacccacgtgtcccggtgtgggaactaaggatgcgttggacttacctggtgggtctccagtgcgggagtctcacggcttggctcagggtagttctgaggaggaggaactgcctagcctggcgttcctgctggggtcccagcacaagttattaccctggtggctgccccagtcccctgtacctgcttctggtctgttaagcccggaaaaatggggacctcagggcacacaccaaagcccaagcgccgagagacggggattaaacttagctccttctccggctaataaagctaaaaagaggccactcttcggcagcctgagtcccgctgagaagactcctcaccccggacccggattgcgagtatctggggagcagagcctaacttggggtctgggcggacctagtcaaagtcagaagaggaaaggtgatcctctcgtaagtagaaaggaaaaaaagcagcggtgttcacaatag

SEQ ID NO: 56176 - DNA, 789 bp, Artificial Sequence
  Description of Artificial Sequence: Synthetic coding sequence
atggaggaactgttgggtccctccttgggggcaaccggtgaacccgaaaaacagcgggaggagggcgaggttaagcaaccccaggaagaagactggacacctccggatcctggactcctgagttatacagataagctgtgttcacagaaggactttgtgacaaaggtggaagcggttattcatcctcagttcctagaagaactgttgtctcctgaccctcaaatggatttccttgcactttcccaggaactggagcaggaggagggccttaccctggcacagctagtcgagaagaggctgttacctctgaaggagaagcagcacgccagagccgctccatcgagaggtactgctcgcctcgactcttcttcttcaaaatttgcagcaggccagggcgcagagcgggacgttcctgatccacagcagggagtgggaatggagacctgcccaccccagaccacagcccgtgactcccagggccgtggcagggcccacacggcatctggccttctctcgccagagaagtggggaccacagggcacccatcaatctccgtctgctgagcggcgaggcctcaatttagcccctagtccagcgaacaaggcgaaaaagaggccactgttcgggagtctgtcccccgctgaaaaaaccccacatccaggccctggcctgcgagtttccggcgagcaaagcctcacttggggtctcggaggaccatctcaaagccaaaaaaggaaaggcgacccactggtgagcagaaaagaaaagaagcagcgctgtagtcagtag

SEQ ID NO: 56177 - DNA, 2421 bp, Artificial Sequence
  Description of Artificial Sequence: Synthetic coding sequence
atgttccaggagcctgtgtatttccaaatcttcctgtttcagctggacagtggtgcctctggtgaacccggacactcactgggcttgacgctgggattttctcattgcggcaactgtcagaccgccgtcgtgagtgcgcagcctgaggggatggccagcaacggagcctatccggcactgggccctggcgtgacagccaaccctggcactagcctgagtgttttcaccgctttaccctttacgaccccggcacctggacccgcacatggtcccctcctagtcactgcaggcgcacctcccggaggcccactcgtgttaagcaactttccatctactcctcttgtcacagagcaggacggttgcggcccaagcggggcaggcgcttccaatgtttttgtgcaaatgcggaccgaggtgggaccagttaaagcagcacaggctcagacgctcgtgctgacacagaccccattggtatggcaagctcctggtgcgctctgcggaggtgtggtctgtcctccaccgctgctcctagcggcagccccagtggtccctgtcatggccgctcaggttgtgggcggaacccaggcttgcgagggaggttggtcacagggattacccctgccaccaccaccccctcctgccgcacagttgccaccaattgtgtcccaaggcaatgcagggccttggccacagggagcgcatggggaaggcagtttagcctcgtcccaggctaaagcgcctccagatgattcttgcaatccaaggtccgtctacgagaactttcgattatggcaacactacaagccactggcccgaagacaccttcctcagtctccagacacagaagcactctcctgctttctcattcctgtattacggtcacttgcccgacgcaaacctactatgactctggaagagggcctgtggcgcgcaatgagggagtggcagcataccagcaatttcgacaggatgattttctacgagatggctgaaaagttcctcgagttcgaggccgaagaagaaatgcagattcaaaagtctcagtggatgaagggtcctcagtgcctgcctccccctgccacacccaggctggaaccacgaggccctcccgcaccagaggtcgttaagcagcctgtgtacctcccatctaaggctgggcctaaagcccctactgcttgcctgccccctccccgaccacagcgccctgtgaccaaggctaggcgcccaccgcctagaccccacagaagagccgagaccaaagcgcgtctgcccccaccacgccctcagaggcctgctgagaccaaggtgcctgaggagatacctccggaggtagtgcaagagtacgtcgatatcatggaggaacttcttggtcccagcctgggtgcaactggcgagccagagaagcagagggaagaaggcgaagtgaaacagccacaggaagaggattggacccccccagaccccggactactcagctatactgataaactgtgcagccagaaggactttgtgacaaaggtcgaggcagtcatccacccacagtttcttgaagaacttctgtctcctgatcctcaaatggactttctcgcattgtctcaagaactggagcaggaggagggattgacacttgcccagctagtggagaaacggttgctgccattaaaagagaaacagcatgcacgtgccgcacccagccgaggtaccgcacgccttgactctagctcttccaaattcgcggctggccagggagcggaaagagacgtccctgacccccagcaaggcgtgggaatggagacttgcccccctcagaccacagcgagagacagtcagggcaggggacgagctcacacgggcatggctaggagtaaggacagcgtcgtgctccttggttgtcaagattctcctggcctccgggctgctcgccctacatctccccctcaggatcaccgcccaacgtgtcccggtgtgggaaccaaggacgctcttgacctgcccggtgggtcacctgtgcgcgagagccacgggttggctcagggttcaagcgaggaagaggagctgccctctctcgcctttctccttggcagccaacacaagctacttccgtggtggttaccccaaagcccggtgcctgcatccggtttactatctcccgagaagtggggtccacagggcacccatcagagtccctctgctgagagacgaggactcaacctcgcgccatcccccgctaataaggctaaaaagagaccgctatttgggtctttgtctcctgcagagaaaactccccatcctggtccgggtcttagagtatcaggtgagcagtccttaacatggggtttggggggaccctcccaatcgcagaagagaaagggagaccccctggtgagtcggaaggagaaaaaacagaggtgttcgcagtag

SEQ ID NO: 56178 - DNA, 1674 bp, Artificial Sequence
  Description of Artificial Sequence: Synthetic coding sequence
atgttccaggaaccagtctacttccagattttcctatttcagcttgattccggggcatccggagagccaggccactctttaggactcaccctgggcttttctcactgtgggaattgccagactgctgtggtgtctgcccagcccgagggcatggccagtaatggagcctaccctgccctgggtccaggggtaacagccaatcctggcacaagtctgtccgtgtttaccgcacttccatttaccactcccgctcctgggcctgcacatggacccctgctagtgacagcaggcgctcctccgggaggaccactggtactgagtaatttcccttcgacccctttagtgacggagcaagacggatgcggccctagcggagctggagctagcaatgtttttgtgcagatgcgcacagaggttggccctgttaaagccgcacaggcgcagactctagtgctcactcagacacccttggtttggcaggccccaggggctctgtgtggcggtgtcgtgtgcccgcctcccctcttgctagccgcagccccagtcgtgcctgtcatggctgctcaggtcgtaggagggacacaggcctgtgagggtggttggtcccaaggcttacctctacctccaccccctcctccggcagcacaactgccacccatagtcagccaagggaacgccggaccatggccacagggcgctcacggagaggggtcgcttgccagctcccaggctaaagcccctcccgacgattcatgcaaccccaggtctgtgtatgagaactttaggctctggcagcattataagcccctggccaggagacatttgccccaatcccccgataccgaggcgctctcatgtttcttaattccggtcctgcgcagcctggctcgcagaaaacccaccatgacactggaggaggggctttggcgggcaatgcgcgaatggcaacatacgtcgaatttcgacagaatgattttttatgaaatggctgagaagttcttagaattcgaggccgaagaggagatgcagatacaaaagagccaatggatgaagggccctcagtgcctgcctcctcctgccaccccgcgactggagcccaggggcccaccagcaccagaggtggtgaaacaacctgtttacctcccttctaaggccggacccaaagctcctacagcctgcctgccgccacccaggcctcagaggcccgttaccaaggctcgacggccaccacctcgaccacataggagagctgagactaaggcacgcctccccccacccagaccacagagaccagcggagaccaaggtacccgaagagatcccccctgaagtggtgcaggagtacgtggacataatggaagagcttctgggtcccagcctgggggctactggtgaacccgaaaagcaaagagaagagggcgaggtgaaacagcctcaagaggaagattggactcctcccgacccgggtctgctcagctacacggataaattgtgctcgcagaaggatttcgttaccaaggtcgaagctgtcattcacccgcaattcttggaagagctcctgtcccccgacccccaaatggacttcctggccctcagccaggagcttgagcaggaagaggggctgaccttagctcaaggggcaccttcagacgcaccaggcactgatcgttgttag

SEQ ID NO: 56179 - DNA, 759 bp, Artificial Sequence
  Description of Artificial Sequence: Synthetic coding sequence
tgaacaggagaacccgagaaacagagagaggaaggcgaggtgaaacaaccacaggaagaagattggactccacctgatcctggattactaagctataccgacaaattgtgtagccagaaagacttcgtcacgaaggtcgaagccgtcattcacccccagtttctggaggagttgctgtcgccggatccccaaatggattttctggccctgagccaggaactcgaacaggaagagggcctgaccttggcacagctagtggaaaaacggctgcttccgctgaaagagaaacagcacgctagagcagcgcctagtaggggaactgcacggctggattcctcctcctctaagttcgcggcagggcagggggctgagcgggacgtgcctgatccccaacagggggtaggaatggagacctgccccccacagaccacagctcgggactcccaaggaagggggagagcgcatactgcaagtgggctgctgtctccagaaaaatggggaccgcaaggtacacaccaaagtccatcagctgagcgcaggggcctcaacctcgcccctagccctgctaacaaggccaaaaagcggcctctgttcggaagcctgtcaccagctgagaaaaccccccaccccggtcccggactcagagtgtccggagaacagtccttgacttgggggctgggcggaccttcccagtctcagaagcgcaaaggggaccctctcgtcagtcgcaaagagaagaaacagagatgcagccaatag

SEQ ID NO: 56180 - DNA, 2637 bp, Artificial Sequence
  Description of Artificial Sequence: Synthetic coding sequence
atggaagtcaaaggaccgtccggtagatcgttttgctgcgaatccgaaggccagttcaagagctgtctgaaacgccataccccaagtctactgctacccagcagttggaaggggaatagcgggtcatgcttgatggccgaagctttgcacagaacatcgccgacgcctaacagttgtcccctgccactgccactctgtagaatgtctggagttctgtgttctaggaatctcttcactttcaaatttagccttttccagctagatagtggtgcaagcggcgagcccggacactcactcggattgacgctggggttcagttactgtggaaattgccaaacagccgttgtcagcgctcaacctgagggaatggcttctaacggagcgtatccagttttagggccaggcgtaaccgcgaaccccggtacctccctgtccgtcttcaccgcactgccatttacaacacctgcacccggacctgctcacggtcccctcctcgtgaccgcaggagcgccacccggtgggcctctcgtgctctccacttttccatccactcctctggtaaccgaacaagacgggtgcagcccctcaggtgcaggggctagcaacgtctttgtacagatgcgaacggaagtggggccagtgaaggctgcacaggcccaaaccctggtacttacgcaagcgcctttggtctggcaggcgcctggcgcactatgtggtggcgtggtttgccctccccctctgctgttagccgctgcccctgtggtcccagttatggccgctcaggtagtgggcggtactcaagcctgtgaaggtgggtggtcccagggactgccccttcctccacccccacctcctgcggcacaactccccccaattgtgagccagggcaacgctgggccttggcctcagggagcgcacggcgagagctcacttgcaagcagccaagccaaggccccacccgatgacagctgtaatccacggagcgtgtacgagaattttcgactttggcagcactacaagccattggcacgacggcacttgccccagagccccgacactgaagccctttcctgttttcttattcctgttcttcgttccctggctcgcagaaagcctacaatgacactagaagaaggcctatggagagccatgcgcgaatggcaacatacctccaactttgatcgcatgattttttatgagatggccgagaaattccttgaatttgaagcagaggaggagatgcagatccagaaatcccagtggatgaaaggcccacagtgccttcctccaccagctactccacgcctggagccacggggaccgccagcgcctgaggtcgtcaagcaaccggtgtatctcccaagtaaagctgggccaaaggctcagactgcttgcttgcctccccctaggcctcaaagaccagtaacaaaggctcgacgccctcccccacagccccaccggcgagcagagactaaggctcgactgcctccgcctaggcctcagaggcccgctgaaacgaaggtccctgaggagattccccctgaagttgtacaagaatacgttgatattatggaggaactcttgggcccatccctgggagccacgggggagccagaaaagcagagggaagaaggcaaagtgaaacagccccaggaggaagattggacccccccagaccctggcctattgtcttatatagataagctatgctcccagaaagatttcgtcacaaaggttgaggcagtgatccatcctcagtttctagaggagctgctctcccccgatccccagatggacttcctggctctctctcaggatttagaacaggaggagggcctgaccttggcccaattagtcgaaaagcggctgccccctttaaaggaaaagcagcactcacgcgcagcgccaagtcgcggtactgcacggctggactcttctagcagcaagttcgccgctggacaaggcgctgagcgcgatgtccctgacccgcaggagggggtaggcatggagacctgtccaccacaaaccactgccagggactcccaggggcgtggtcgagcacatactgggatggctaggagtgaagattctgttgtgctgctagggtgccaagattcacctgggctcagagccgctcgccctaccagcccaccgcaagatcacagacctacatgccctggagtggggacaaaagacgccttggacttacccggtgggagtcccgtgcgggagtcacacgggttagcacaggggtcgtcagaagaggaggaactgccgagcttggcctttctgctggggagccagcacaaactgctaccttggtggctgccacagtcgcctgtgcccgcaagcggattactgagtcccgagaaatggggtccccaaggaacacaccagtcccctagtgccgagaggcggggtctgaacttggcgccttctcctgccaataaggcaaaaaagcagcctttgttcggctcactttccccagcggagaagacaccccaccggggacccggtttacgagtttcaggcgaacaaagtttgacatggggcctgggagggccttctcaatcacagaaacggaaaggagatcctttggtatctcgaaaggagaaaaaacagcactgttcccagtag

SEQ ID NO: 56181 - DNA, 2271 bp, Artificial Sequence
  Description of Artificial Sequence: Synthetic coding sequence
atggctagcaacggcgcttacccagtgctgggccctggtgttactgtaaacccgggtacctctttgagcgtcttcaccgcactgcccttcgctacacctgcaccgggacctgcccataggccaccgctagtgactgccgtcgtgccacctgccggtccactcgtactgtcagcttttccctcaaccccgctggtggccggacaggatggccgtggtcctagtggggcaggggcttcaaacgtcttcgtccaaatgcgaaccgaggttggtcctgtaaaacctcctcaggcacagacactgattcttacccaggctcctttggtctggcaggccccagggaccctgtgtggcggagtcatgtgcccacctccactgctcctggctgctgcacctggtgtgccggtgaccagcgcacaagtggttgggggaactcaggcctgtgaggggggatggagccatgggctacctctcccaccacccccacccgctgcccaagtggctcccatcgtgagtccagggaacgcaaggccgtggccacagggagctcatggcgaaggcagcctcgcccctagccaggcaaaagcaaggcctgacgactcatgtaagcctaagtcagtgtatgagaactttcgcctttggcagcactacaagcccctggcacgacgacacttgcctcagagtccagacacagaggctctttcctgtttcctcatccctgtactaaggtcactggccaggcgaaaacccactatgacattagaggagggtctctggcaggcaatgagagagtggcagcatacgagcaactttgacagaatgattttttatgaaatggcagagaaatttctggagttcgaagccgaggaggagatgcagattcagaagtctcaatggatgaaaggaccccagtctctgcctccgccagccccacccaggctcgaaccccgtggtccgccagcgccagaggtggtgaaacaacccgtgtacctgccatctaaagacggaccgaaagccccaaccgcctgtctgccccctccgcgtcctcaacgccctgcagagaccaaagcacacctgccacctcctagaccgcaaaggcctgccgaaaccaacgcgcacctccccccaccgagaccacagaggcctgcggagactaaggttcccgaagagattccgcctgaggtcgttcaggaatacgtggacatcatggaagagcttttggggagtcatccaggggataccggggagcctgagggccagcgggaaaaagggaaagtggaacagcctcaggaggaagacgggattacctccgatcccggactgttgtcctacatagacaagctctgtagtcaggaggactttgtaactaaggtcgaggccgttattcatccaaggttcctcgaggaattgctctcccccgacccacagatggacttcttggcactgagtcaggagctggaacaggaggagggactcacactcgctcagctggtcgagaaaaggcttttaagcctgaaggaaaaagggtgcggcagagctgccccacgccacggaaccgcacggcttgactccagcccgtcggagttcgccgctggacaggaggccgcacgcgaggtgccggacccccagcaaagagtgtccgttgaaaccagccccccacagacagcagctcaggatccacagggccagggacgcgttcgaactggtatggccagaagtgaagacccggctgtgttactggggtgccaggatagtccgagactcaaggccgtcagaccaacatctcctccccaggatcatcggccaacgtgccctggcctggggaccaaggacgccctcgggctcccgggagagtcacccgtgaaagaatctcatggccttgctaaaggttcttccgaagaaacggagcttcccggaatggtctacgtagtgggttcacaccatcgactacggccatggcgcttatcacagtcgcctgttccctccagcggattgctctcacctggcggtcgaggccctcagggagccctacagagcccatcggcacagaagcgcggactgtcaccgagcccgtcacccgcatctaaatccaagaagagacccctgttcgggtctccatccccggctgaaaaaacaccccatcctggtcctgggctacgcgttagtggtgaacagagccttgcctggggcctgggtggaccctcccaatcccaaaagcgaaagggcgatccactggcgtccagacggaagaagaaacgtcattgcagtcagtag

SEQ ID NO: 56182 - DNA, 1479 bp, Artificial Sequence
  Description of Artificial Sequence: Synthetic coding sequence
atggcctcaaatggagcgtacccggtgctgggcccaggcgtgactgtcaacccgggtacgtctttgtccgtgtttacagccctgccatttgcaacccccgctcctgggcctgcacatcgacccccactggtgacggccgttgtcccgccagcaggccctctggtgctctctgcctttccatcgactccactggtcgccggtcaagatggcagagggccaagcggtgcgggagcatccaacgtttttgtccaaatgcgaacagaggtcggaccagtgaaaccccctcaggcccagactctgatcttaacccaggcccctctcgtctggcaggctccaggtacactgtgcggtggcgtgatgtgtccaccgccactattgctcgcggcagcccctggcgtgcctgtgacaagtgcacaggttgtgggaggtactcaggcctgtgaggggggttggagtcatggcctgcctctgccgcctcctcccccagccgcacaggtagcccctattgtgagccctggcaacgctcggccttggcctcagggggcacacggcgaaggcagcctggctccatcccaggcaaaggcccgtcctgacgactcctgcaagcccaaatcggtgtatgaaaactttcgcctctggcaacattataagcctctggctcgtcgacatctgccccagagtccagatacagaggcactgtcctgtttcttgatccccgtactgcgcagccttgcacgacgcaagcccacaatgaccctggaggagggactgtggcaggccatgcgggaatggcagcatacatccaactttgataggatgattttttacgagatggccgaaaagtttctagaatttgaagccgaggaggaaatgcaaatacagaaatctcagtggatgaagggaccccagtcactgcctccgcctgctccgcctcgtctggaacccagaggccctcctgccccagaggtggtgaaacaacccgtgtatttgccgtctaaagacggacctaaggcgcctaccgcatgcctgcctcccccaaggcctcaacgacccgcagagaccaaggcccatctgcccccacctcggccacaaaggcccgctgagacaaaggtgccagaggaaattcctcctgaggtggtgcaagagtatgttgacatcatggaagagctgcttggtagtcaccccggagacacaggagagccggaaggccaacgggaaaagggaaaagtcgaacagcctcaagaggaagacggaataacatcggaccccggtttgctgtcatacattgataaattgtgtagtcaggaggatttcgtgacaaaagtcgaagctgtcatccacccaagattccttgaggagttgttgagcccggacccccagatggactttctggctctgagtcaggagttggaacaggaagaagggctcacgctggctcagggtgccccttctgatgccttgggcacagataggtgttag

SEQ ID NO: 56183 - DNA, 2226 bp, Artificial Sequence
  Description of Artificial Sequence: Synthetic coding sequence
atggcttccaacggagcttacccagtcctcggtcctggggtgacagttaaccccggaactagcctctctgtatttactgctctgccgttcgctactcccgctcctgggcctgcccacagaccccctcttgttacggcagtcgtccccccagcaggacctttagtcttaagtgcctttccgagcacacctttggtggccggtcaggatggtcggggtccaagcggggctggggcaagcaacgtcttcgtacaaatgcggaccgaggttggccctgtgaaaccccctcaagctcagaccctcatcctgacgcaagcccctctggtgtggcaagccccaggcactctgtgtggcggtgtaatgtgcccacctccccttttactggcagccgctcccggagtaccagttacaagcgcccaagtcgttgggggtacccaggcgtgcgaagggggatggtctcatggactgccgttgccccctccacctccggcagctcaggtcgcgcctatcgtgagtccaggcaacgcccgaccctggccacagggcgctcacggagaaggctccctggcaccctcccaagccaaggccaggcccgacgacagctgtaagcctaaatcagtgtacgagaacttcagactatggcagcattacaagccgttagcacgacgccacctgccacagtctcccgataccgaagcactctcttgttttcttatccctgttttgagaagtctagccaggagaaaacccacaatgaccctggaagagggcttgtggcaggccatgagggagtggcagcatacatcaaactttgaccggatgattttctacgaaatggcagaaaaattcctggaattcgaagctgaggaagaaatgcaaattcagaagtctcagtggatgaaaggcccacaaagcctaccgcctccggctccccctcggctggagccaagggggcctcccgcacccgaggttgttaaacaacctgtatatctgccctcgaaggatgggccaaaggcaccaactgcatgcctgccacctcctaggccccagcgacctgcagaaaccaaagctcacctgcctcctcccagaccacaaagaccagctgaaacgaaagtcccggaagaaattccaccggaagtcgtgcaagagtacgtggatattatggaggagctgttgggttcacaccctggcgacaccggagaacctgaaggccagcgcgagaaaggtaaggtggagcagccacaggaagaggatgggataaccagcgatccagggctgctgtcctacatagacaaactctgttctcaggaagattttgttacaaaagtggaagcagtgatccaccctcggtttctggaagaactcctcagccccgacccccaaatggacttcctggccctctcacaagagcttgaacaggaggaggggctgaccctggcacagctggtggagaagcgactcctgagtctgaaagaaaagggatgcggtcgggcagccccacggcatggcacagctcgtttagactcgtcccctagcgagttcgcagctgggcaagaagccgcaagagaggttccagaccctcagcagcgagtctcagtggagactagtcctcctcagaccgccgcacaggatccacagggacaggggagagtccggaccggcatggcccgttccgaagatcctgcagtccttctggggtgccaagacagccctaggctcaaggccgttaggcccacaagccccccacaggaccatcgaccaacgtgccccggactcggtaccaaggacgcactgggcctcccaggagaaagcccagttaaggagtcgcatggccttgctaagggctcatctgaggagaccgaacttcctgggatggtgtatgtggttggctcacaccaccgccttagaccgtggcgcctgtctcaaagccctgtcccatcatccgggctgctgtcaccgggagggagaggtccgcagggagccctgcagtctccaagcgcccaaaaacgaggcctgagcccctccccaagtccagctagcaagagtaagaaacgtcctctttttgggagcccctccccagcggaaaagaccccccaccctggcccaggtctgcgcgtgagcggcgaacagtcccttgcctggggcttagggggtcctagtcagtcccagaagcgcaagggtgatcccctcgcgtcgaggagaaagaaaaaaaggcactgtagccagtag

SEQ ID NO: 56184 - DNA, 1773 bp, Artificial Sequence
  Description of Artificial Sequence: Synthetic coding sequence
atggccagtaatggggcttatcctgtgcttgggccaggagtgacagtcaatccgggtaccagcttatcagtgtttacagctctcccattcgcaactccagcgccaggccctgcacacaggccacctctcgttactgccgtcgtccccccagcgggaccgctggtgcttagcgcattcccatcaacacccttggtggctggccaggacggcaggggaccctctggagcaggggcaagtaatgtgtttgtccagatgcgaacagaagtgggcccagtgaagccgcctcaggcccaaacactaattctgacgcaggcccctctggtatggcaggcacccggaacactctgcggcggtgtgatgtgccctccacctttactgttagccgctgccccaggggtgcctgtgacaagcgcccaggtggtcgggggaacccaagcctgcgagggcggatggagccatggtctcccactcccccctccaccacctgcggcacaggtggccccaattgtgagtcctgggaacgctaggccttggccccagggagcccacggagaggggtcattagctccctcacaggcaaaggccaggcccgatgattcctgcaaaccaaaaagtgtgtacgagaactttaggctgtggcagcactacaagccattggccaggcggcacctgccacaaaaggtggtgcaggagtacgtagatatcatggaggaattactagggtcgcatcctggagataccggcgagcccgagggacagcgcgagaagggaaaggtggagcaaccccaggaggaggatgggatcacaagcgaccctggtctgctcagttatatcgataagctttgttcccaagaggacttcgttaccaaagtggaggctgtcattcatccaaggttcctggaggagctcctgtcaccggatccacagatggactttctcgccctaagtcaagagctcgagcaggaggaaggcctcaccctggcccaactggttgagaagagactgcttagtctcaaggagaaagggtgtggacgagctgccccaaggcatggcacagcaagacttgacagcagcccgtcagagttcgccgcaggccaggaggcagcacgggaagtccctgatccccagcagagggttagtgtggagacatcaccaccacagacagcggctcaggatccccagggacagggcagggtgagaactggcatggctagatcagaagatccagctgttctccttggctgtcaggattcgccgcgattaaaggcagtcaggcccacctctcctccgcaagaccacagacccacttgcccgggactgggcacaaaggacgcccttggcttgcctggcgagagtccagtgaaagagagccatggcctggcaaagggctccagcgaggagacagagttgcctgggatggtgtatgtggtcggttctcatcatcgtctgcgcccttggcgtctcagtcagtcacctgtcccctccagcggactgttgtctcccggaggtaggggaccccaaggggctcttcagagcccgtcggcacagaagagaggactttcacccagcccaagccccgcttcaaaatccaagaaaaggcccctttttgggagtccttccccggctgagaagactcctcaccccggtccaggcctacgggtctctggggagcagagtctggcatggggcctgggaggcccaagccagagccagaagagaaaaggcgatcccctggcatccaggaggaagaagaagcgccattgctctcaatag

SEQ ID NO: 56185 - DNA, 1479 bp, Artificial Sequence
  Description of Artificial Sequence: Synthetic coding sequence
atggctagtaacggagcctaccccgttttgggccctggcgtcactgtgaaccccggtacatctctgagcgtctttacggccctgccttttgccaccccctctccaggaccaacccaccgaccaccgctcgtaactgctgtggtgcccccagcgggaccactggtgctgtctgctttcccatccactcctttggtagcagggcaggacggccgagggcctagcggcgcaggggcaagtaacgttttcgtgcagatgcggaccgaggtaggacctgtgaaacccccacaagcacagacattgatccttacccaagcacccctggtgtggcaggcgccaggcacattatgcggcggagtgatgtgtccaccgcctttgttgctggccgctgccccaggcgttccggtcacatcagctcaggtggtgggaggcacacaggcctgcgaaggagggtggtctcacggtctcccattgcctccacctcccccagctgcccaggtagcacctatcgtttctcctggaaacgccggtccctggccgcagggggcacacggcgagggtagtcttgccccttctcaggcaaaagcaagaccagatgattcatgcaagcccaagagcgtgtacgagaatttcagactgtggcaacactacaaaccactcgccagacgacatctgcctcagtcccccgacacagaggcactttcatgttttctgattccagttctgcggagcctagcacggaggaaacctactatgacactcgaggaggggttgtggcgtgctatgcgcgaatggcagcatacctcgaactttgataggatgatcttctacgaaatggccgctaagtttcttgagttcgaagctgaagaggagatgcagattcagaagagccagtggatgaaggggccacagagcctccctccaccagctccgccacggctcgagcccagaggcccacccgcaccagaagtcgtcaaacagccagtatatcttccgtccaaagacgggccaaaggccccaacggcttgtctgccgccacccagaccccaacggcctgctgagaccaaagctcacctaccaccgccacggccacctaggccagccgaaacaaaggtgccggaggaaattccccctgaggtcgttcaggaatatgttgacattatggaggaactgctgggctcccaccccggtgataccggggaaccggaaggccagcgagaaaagggcaaggtcgaacaacctcaggaggaagatggcatgaccagcgatcccggacttctgtcatatattgacaagctgtgttcacaggaggacttcgtgactaaagtggaggcggtgattcacccaaggttcctggaagagctgttaagccctgacccccaaatggactttctcgcactgtctcaggagctggagcaggaggagggactgaccctcgcccagggagccccatcagacgcccttggcaccgatcgctgctag

SEQ ID NO: 56186 - DNA, 2226 bp, Artificial Sequence
  Description of Artificial Sequence: Synthetic coding sequence
atggcctctaacggcgcttaccctgtactcggccctggagttaccgttaaccctggaacatccctgtcagtctttaccgcgctgcctttcgcaacaccctcccctgggcctactcacaggcctccacttgtgactgcagtcgtgccaccagctggcccactggtgctgtccgcctttcctagtactccactggtagccggacaagatggaagaggaccaagcggcgcaggagctagtaatgtctttgtgcaaatgaggacagaggtggggcctgtgaagcctccccaggcccaaacattaattcttacccaggcccctttagtctggcaggcccctgggaccctgtgcggaggagttatgtgcccccctcccttattgttggcggcagctcccggtgtcccagtgacttctgcacaggttgtcggtggaactcaggcctgtgagggaggttggtcccatgggttacccctgcctcctcctccacccgctgcccaggtggctcccatcgtgtcacctgggaacgctgggccatggccccagggagcacacggtgagggaagcttggctcccagccaagctaaggcacggccagacgactcctgtaagcctaagtcggtgtacgaaaattttcgactttggcagcactataaacccctggccagaagacatctgccacagtccccagacacagaggccctgtcttgttttctaatccctgtactgcggagcctggctcggagaaagccgactatgactctggaagagggcctctggcgcgctatgcgtgaatggcagcatacatctaacttcgacagaatgatcttttatgagatggccgcaaagttcctggagtttgaagccgaggaagagatgcagatacagaagagtcaatggatgaagggccctcagtccttgcctcctcccgctccacctaggctggagcctaggggacctccagctcctgaagtggtgaaacagccagtgtatcttccctctaaggatggacctaaagcgccaactgcctgcctgccccctccaagaccccagcggcctgccgagactaaagcacacctgcctcccccacggcctccacgcccagctgagactaaagtgccggaggaaattccccctgaggtggtgcaagagtatgtggatataatggaggaactccttggaagtcacccgggagatactggagagcctgaagggcaacgagagaagggcaaggtggaacaacctcaggaagaggacggtatgacaagcgatcccggactcctctcttatattgataaactatgctcgcaggaagattttgtgacgaaggtcgaagctgtcatccatccacgttttttggaggaactgttaagtcccgatccacagatggacttcctggccctgagccaggaactggaacaggaagagggcctcacattggcccagctcgttgaaaaaaggctacttagtctgaaggagaagggctgcggaagagcagcccctcggcacggcacagctaggctggattccagtccttccgaatttgccgctggccaggaggctgccagagaggtcccagacccacagcagcgggtatctgtggagacaagtccccctcagacagcagcccaagacccccagggccaggggagggtacgcaccggcatggcgcgatcggaagatcctgcagttctcctagggtgtcaggattccccgcgattaaaagccgtgagacctacctctcccccacaagaccaccggcctacatgccccggtctaggaactaaagacgctctcggtctgcccggtgagtccccagtcaaggagagccatggcctcgccaagggtagttctgaggagaccgagctgcccggaatggtgtacgtggttggctcacaccatcgactccggccatggagactgagtcagagccctgtgccatccagtgggcttcttagtcccggaggcagaggcccacaaggcgcactccaaagccctagtgctcagaagcggggactaagcccatctcctagtccagccagcaaatctaagaaaagaccgctgtttggatccccctcgcctgccgaaaaaacacctcatccaggaccgggattgagagtctctggagaacaatccttagcttggggtttaggagggccatctcaatcgcagaagagaaaaggcgaccccctcgccagccggcgaaagaagaagcgccactgcagtcagtag

SEQ ID NO: 56187 - DNA, 1869 bp, Artificial Sequence
  Description of Artificial Sequence: Synthetic coding sequence
atgtgcccaccacctttgctcctcgccgctgcccctggcgtgcccgtgaccagcgcccaagtcgtggggggaactcaggcgtgcgagggcggatggtctcacggcctcccacttcctccgccacctcccgcagcccaagttgcgcctattgtgagccccggtaacgctgggccatggccccagggcgctcacggcgagggcagcctagcccctagtcaggccaaagctagaccagatgacagttgcaagccaaaaagcgtctacgagaactttcgtttgtggcagcactataagccccttgctcggaggcacctgccccagagccctgatacagaggccctttcgtgctttctgattcctgttttacgtagtcttgcgagaaggaagccaactatgacgctcgaggaagggctgtggcgtgccatgcgggagtggcagcacacatccaattttgataggatgattttctatgaaatggcggcaaaattcctcgagtttgaggcagaggaagagatgcaaatacagaagtcccaatggatgaaggggccacagtccttgcctccacccgcaccccctaggctggaacctcggggtcctcctgctcccgaggtggtgaagcagccagtatacctcccaagtaaggatggacctaaggcgcctactgcttgtctgcctccccctcgtccccaacgacccgctgagaccaaagcccatctgcctccccctaggcctcctagacccgcagaaaccaaggtcccggaggagattcctcccgaggtggtccaggaatatgtggatataatggaagaattgctggggagtcatcctggagatacaggcgaaccagagggtcagagagaaaaggggaaagtcgagcagccccaagaagaggatgggatgactagtgacccgggactattgtcatatatcgataagctttgctcccaggaggacttcgtaaccaaagttgaagctgtgatccatcctcgcttccttgaggagttactgtcacccgacccccagatggattttcttgcactctcgcaagaactggagcaggaggaagggctgacactggctcagctcgtagagaagcggcttctgtcactgaaggagaaaggctgcggacgggctgcaccaaggcacggaactgcgaggctggatagcagcccttcagagtttgccgctgggcaagaagccgcaagagaggtgcctgatccgcagcagcgggtatccgtggaaacatccccccctcagacagctgcacaagacccacaggggcagggaagagttcggaccggcatggcccgaagcgaggacccggctgtgcttttgggatgccaggactccccaagactgaaagctgtcaggccgaccagtcccccacaagaccacaggccaacatgtccaggcctcggaaccaaagatgcactggggctgcctggagagagtcccgtgaaagagtctcacggtctggcgaaagggtctagcgaggaaacagaattacccggaatggtgtacgtcgtcggaagccatcatcgcctccgaccttggagactaagccagtcacccgtcccctcatccggactcttgagtcccggagggagagggccacaaggagccctgcaatctccctccgcgcagaaacggggtttatcaccttctccatcacctgcatccaaatccaaaaagagacctctgttcggatccccctcccccgcagagaaaacaccacatcccggacccggactccgggtgtccggtgaacagtcgctggcctgggggctcggcggacctagccagagtcaaaaaagaaagggggaccccctggcttccagacgtaaaaagaaacggcactgctcccagtag

SEQ ID NO: 56188 - DNA, 1773 bp, Artificial Sequence
  Description of Artificial Sequence: Synthetic coding sequence
atggcgagcaacggggcttatcctgttctcggaccgggtgtgacggtgaaccccggaacgtccctttcagtcttcaccgccctacctttcgctactccttctcctggcccaactcatcgacctccccttgtgacagcagtggtgccccctgcgggacctctggtgctgagcgccttcccaagcacacctctggtggccggtcaggatggcaggggcccatcaggagccggagccagcaacgttttcgtccagatgcggacagaggtcggtccagtaaagccccctcaagcacagacactgatcctcactcaggcacccctcgtttggcaggcgcctggcaccctgtgcggtggagttatgtgtccccctccgctgctcctagccgctgcccctggagtccctgtgacatcagcacaggtggtcggcggaacccaggcctgtgaggggggttggagtcacggcctgccgctgccccctccccctcccgctgctcaggttgcccctatcgtctcccccggaaatgcaggaccttggcctcaaggcgcacatggcgagggaagtcttgctccctcccaggcaaaggctcggccagatgattcctgtaaaccaaagtccgtctacgagaattttagactgtggcaacactacaagcctctggctcggagacacctgcctcaaaaggtggtgcaggagtacgttgatatcatggaggagctgttgggctcccaccccggtgacactggggagccagagggacagagagaaaaagggaaagtggaacaaccccaagaggaggacggtatgacaagtgaccccggtctattgtcttacattgacaaactctgctctcaggaggactttgtcacgaaggtcgaggcggtgatccatccccgttttcttgaggagcttttgtcaccagatccacagatggatttcctggccctatcacaggagcttgagcaagaggagggcctgacgctggcccagcttgttgaaaaaagactgctttcacttaaagagaaggggtgtggcagggccgctcctagacatggtactgcccgactggactcctcaccatccgaattcgcagccggtcaggaagctgcccgagaggtcccagatcctcagcagcgtgtgtctgttgagacatctcctccccaaactgccgcacaggatcctcaaggacagggaagagttagaactgggatggcccgatcagaagatcctgcagtgctgctgggctgccaggacagcccccgactcaaagctgttcggccaactagtcctccacaggaccacagaccaacttgtcccggtttggggaccaaagacgccttgggactccccggagagtctccagtcaaagagagccacgggctggctaagggcagcagcgaggaaacagagcttccgggaatggtgtatgtggttggctctcatcaccgactccgtccctggcgccttagtcagagtcccgtcccatcctctgggctcctgtcccccggtggaaggggtccacagggcgctctgcaatccccttccgcacagaaacgcggattgagccccagtccatccccggcatccaagtctaagaagcgcccactgtttggctcccccagtccagcagaaaaaacacctcaccctgggcctggcctgcgggttagcggcgagcagtccctggcctgggggctcgggggaccttcacaaagtcagaaacgcaaaggggatccactcgcatcaaggagaaagaagaagcgtcattgctctcagtag

SEQ ID NO: 56189 - DNA, 1689 bp, Artificial Sequence
  Description of Artificial Sequence: Synthetic coding sequence
atgctggcctgcttgcctggacccggagacctgtctttccagctgctttcccacacgcagatgaatacgggcttgcaaaagtgggacaccacgcagaaaatgaggacagcccactatccaacccccgcagagttggacgcttacgcaaagaaggtggccaataaccccctgactattaaaatcttcccaaacagcgttaaagtgccacagaggaagcatgtgagaaggactgtgaacgggctggatacctccgcacaaagatatagcccctaccctacccaggcagccacaaaagctgggctgctggcaatcgttaaagtgcccgcaaagtctatcctgaaagacttcgatggcaccagggcgaggttactgccagaagcaatcatgaatcccccagtagctccttatgccactgtcgccccatccactctggcacatcctcaggcgcaagccttggcccgacagcaagctctacagcatgcacaaacattggctcatgcacctccacagaccctgcagcacccccaaggcataccgcctccacaggccctgtctcaccctcagagtctgcagcagcctcagggtctcggccacccgcagccgatggctcagacccaggggctcgtgcacccacaggcgcttgcccaccaaggcctgcagcaccctcataatcccctgctgcacggaggacgtaaaatgcctgacagtgatgcccctcccaatgtgacagtgagcaccagtactatacctctgagtatggccgctacccttcaacatagccaaccgcctgacctgagctcgatcgtccatcagattaaccaattttgccagactcgggctggaattagtacgacctccgtatgtgaggggcagattgcaaatcctagccctatttcccggagtctcctgattaatgctagtacacgcgtgagtactcactcagtcccaacgcccatgccatcgtgcgtcgttaaccctatggaacatacccatgccgcaactgccgctctccccgctgctgggccagtgaatttgccgaccggtatttcgagagtgcccactggatatccgtccgacctgaaaccagttacctggaatcagcatcagctcgcacacttgcagcagatgtgttctgaagcctccggaacgcctgcgcctggactgacagggaagcatgcagccggtcgagagctggcaggccctggcttcgtcggcaaggccccagcatacccccaggaactgtgcttggcacaaagtttccacctgaagcccccactggaaaagccaactccatctccaccagtgaatggaatggccgctccattagcttaccccaacggtcactactttcaacctctgtggaataatatattacccacacccaattcagacagctccggctcacaggacttagccatgccttttcatgggggacagcctaccggcgcaccacttgattgtgctgcagctcccggagctcattatagggcaggaaccggaggcggaccagtagctagccagaactccctgatgcagaccgttgactatttatcgggggacttccagcaggcctgtttcagggaacagtcactggccatgctgagcaaggctcatcgtgcacccggtaaccgggcacctgaccccaccgagtccagatccctccatattcagcatccaggttataggtag

SEQ ID NO: 56190 - DNA, 960 bp, Artificial Sequence
  Description of Artificial Sequence: Synthetic coding sequence
atgaaaaacgtcgattctgatgacctcgtgacaggaacactaccgaagcttaaatcgtccaaagagtggctggagcctaagcctctttgcttcatggaagttctggctaaggaggataccgaggctgcgatccagtccatcctgtacaaagaaaacagtgtaataaaagaactggataaatatctgcagcaccacgctttcctaaatgcacggaggaaagaaatgctctacaaaagatgggtcgattgtgtggccgaccctttacagaagaaaatcatcgaaaaggtgtgcagccacaagaagataaaaaagagaaggcagggagaactcgatggctttctgaagcacgtgaacaaaaaagggaacgcgttcatagaacactacgacccaaaagaatatgatcccttttacatgtctaaaaaagaccccaactttctgaaagtcacgattcctccttttcacgaccccctcaaaaaagcccagtacgacaaggataacgagaagcggactctcctccagtgcgagacaggaaaaatatatagtatcaaggaattcaaagaggtggaaaaagtgcagcttcactcacggttccctcagattagcaactccagacattttatcacccctaatgaatggcttaagctacccactagatacattgagtcagaattttgtcgaaggaggcgcctcaaagtgaaagtgaacttcaatgactgttcattcgacctgaaacctctggcccgagccccatatttactggagagccaggaggaggagaaaaccgtaatctacaaaaacaagggcagctcctttctagaaagagagcctctttgttaccaggaaggtaataatccttccgctaaggaggccattagcgagggatatttctcatcattgtccctctcccggaatggcaggaagactagaatgggtctcccacctcgagtgtgggggtgctag

SEQ ID NO: 56191 - DNA, 318 bp, Artificial Sequence
  Description of Artificial Sequence: Synthetic coding sequence
atggcaaaaatgttcgaccttcggaccaagattatgattggaatcggctcttcactgcttgtggcagccatggtcttgttgagcgtggtcttctgcttgtatttcaaggtggccaaggccctgaaggctgccaaggatcctgacgccgttgcggtgaaaaatcacaacccagataaagtgtgctgggcaactaattctcaagctaaggcaacaacaatggagagctgcccaagcctccaatgctgcgaaggatgccgcatgcacgcttccagcgacagccttcccccttgctgctgcgatatcaacgagggactctag

SEQ ID NO: 56192 - DNA, 291 bp, Artificial Sequence
  Description of Artificial Sequence: Synthetic coding sequence
tgaaccgtttgttgccacacaatgctcggcggtttgggtaagctggctgccgaaggcctggcacatagaacagagaaagcaaccgagggagcgatccatgccgttgaagaggtcgtgaaggaggtcgtggggcatgccaaggaaactggagaaaaagccattgccgaggccattaagaaagctcaggaatccggggacaaaaaaatgaaagagatcacggagaccgtgacaaacactgttactaacgctataacgcacgctgcagagagcctggacaagctcgggcagtag

SEQ ID NO: 56193 - DNA, 270 bp, Artificial Sequence
  Description of Artificial Sequence: Synthetic coding sequence
atgctggggggactgggtaaactggctgcagagggactcgcacatagaactgaaaaggccactgagggtgcaatccacgcagtagaagaggttgttaaagaggtggtggggcacgctaaggaaactggcgagaaagccatcgccgaagccataaagaaagcccaagagtctggcgataagaagatgaaagagatcactgaaaccgtcaccaatacagtgacgaacgctataactcacgccgctgaaagcctggataaattggggcagtag

SEQ ID NO: 56194 - DNA, 291 bp, Artificial Sequence
  Description of Artificial Sequence: Synthetic coding sequence
tgaacagtgtgttgtcataccatgcttgggggactgggcaaattggccgcagaagggctagctcaccgaacagagaaggcaacagagggcgctattcatgcagtggaggaagttgtgaaagaagtggtgggtcacgccaaagagaccggtgaaaaggccattgctgaagctattaagaaggcgcaggagagtggggacaaaaagatgaaagagatcaccgagaccgtcacaaacactgtcaccaacgcaattactcatgcggcagagagcctggacaaactgggtcagtag

SEQ ID NO: 56195 - DNA, 291 bp, Artificial Sequence
  Description of Artificial Sequence: Synthetic coding sequence
taaaccgtctgttgtcatacaatgctcggtggcttgggcaaacttgccgctgagggattagcccaccgaaccgagaaggctaccgagggcgcaatccacgctgtagaggaggttgtgaaggaggttgtggggcatgccaaagaaacgggagagaaggctatcgctgaggccatcaagaaggctcaagaatctggtgataaaaaaatgaaagaaatcacggagaccgttacaaacaccgtgaccaatgccatcacccatgcagcggaaagtctcgataaattgggacaatag

SEQ ID NO: 56196 - DNA, 270 bp, Artificial Sequence
  Description of Artificial Sequence: Synthetic coding sequence
atgttggggggacttggtaagctggcggctgaaggtttagcgcacaggacagagaaggctacggagggcgcaattcatgctgttgaagaggtggtaaaagaagtggtcggacatgctaaagagacaggcgagaaggccatagcagaggcgattaagaaggcacaggagtccggggacaaaaagatgaaagaaatcaccgagaccgtgacaaacaccgtcacaaacgctatcacacatgctgcggagtctctcgataagctgggacagtag

SEQ ID NO: 56197 - DNA, 270 bp, Artificial Sequence
  Description of Artificial Sequence: Synthetic coding sequence
atgctcggaggcctgggtaagcttgccgctgaaggcttggcacacagaacggagaaggcgaccgagggagcaatccacgcagtggaggaggtggtcaaggaggtggtcggccatgccaaggaaactggtgaaaaagctatagcagaggccattaagaaggcccaggagtccggagataaaaaaatgaaagagattactgaaaccgtaacaaacactgttactaatgccatcacacacgctgccgaaagcctggataaactaggccagtag

SEQ ID NO: 56198 - DNA, 291 bp, Artificial Sequence
  Description of Artificial Sequence: Synthetic coding sequence
taaacagtgtgctgtcacacgatgctcggaggtctcgggaaactcgctgcagaaggcttggcccatcgtaccgagaaggctaccgagggagccatccacgccgtggaggaagtcgttaaggaagttgtaggtcacgccaaggaaacgggagagaaagcgattgccgaagccatcaagaaggcccaagaatccggtgataaaaaaatgaaagagatcactgaaacagtgactaataccgtgacaaatgcgatcacacacgcagcggaaagtctcgacaaactagggcagtag

SEQ ID NO: 56199 - DNA, 204 bp, Artificial Sequence
  Description of Artificial Sequence: Synthetic coding sequence
atgagaaagccccaggccggaacgggagaagccgctagggatccaagcctgagacccgcaagaaccgtcttggtgggcgaccaggatgagtacacagctgctgagaataagagccccagaggcactctgtgtcctaccggggagcagaggatacacgctcgagaggacgcatgtatatttagcaggctctttagcgagaaatag

SEQ ID NO: 56200 - DNA, 204 bp, Artificial Sequence
  Description of Artificial Sequence: Synthetic coding sequence
atgcgtaaaccacaagccggaaccggtgaagcagctcgggacccatccctgaggcctgctcggaccgtgctagtcggagatcaggacgagtatacagccgcagagaacaaatcgccacgtggcacactgtgtcccacaggtgagcaacgcatccacgccagagaagatgcctgcatcttctcccgactgttttccgagaagtag

SEQ ID NO: 56201 - DNA, 378 bp, Artificial Sequence
  Description of Artificial Sequence: Synthetic coding sequence
atgggaattttccaactgctgcgggatcgccgtatttcatcccgaggtcccggactccatacccccaaagctgagcccaggaggagaaaaggtctgacaaccggcctcatgacgcaagctgaacggcagaagcaggcccatcagagacaggcgaccatgcgtgaaactgctctgtggtgtacaggacacatcagacccagaacccacatgcatacagggacccacacgcagacagatcgggagagagaacgcaatacacagcgcctgagagatcgagagagacgtgagaatggccgacacacacatatacatactcagacgcaccgccaatcactaattgccaaagctcttaaagatactcacccaggcaacccctag

SEQ ID NO: 56202 - DNA, 279 bp, Artificial Sequence
  Description of Artificial Sequence: Synthetic coding sequence
atgacgaagccacaggccgaatctggtgaggccgctcggcaccctatctttcgcccagcgcgaagggtttttggaatcaaaatgaccaccctgcaaccaagaattaaggctccccaggagctgaccgtactgcaggagagatcaagacctacctcaaagaaaatggccgtttgtttccacggcagtagccttaggtctgaagcgacgcctagatacagcctggaggaagaggcaagaaatgggagatggcaacaggcattaagttggtggccactctag

SEQ ID NO: 56203 - DNA, 2508 bp, Artificial Sequence
  Description of Artificial Sequence: Synthetic coding sequence
atgtccgggggatcacaggtccacatattttggggggcacccatcgccccattgaaaattactgtgtcagaggacacagccagtctgatgtcggtcgctgacccatggaaaaaaatacaattactgtactcccaacactccctgtacctaaaagatgagaagcagcataagaaccttgagaattacaaagtccctgagagtattggcagccctgacctctccggacacttcttagcgaactgcatgaaccggcacgtccatgtgaaggatgattttgtcagatcggtttcagagactcagaacatagaatcccagaagatccactcatctcgcctatctgacatcacttctagtaatatgcaaatctgtgggtttaagagcacagtcccacatttcaccgaagaggaaaagtatcagaagttacttagcgaaaacaagattagggatgaacagcctaaacatcagccagatatttgtggtaagaattttaacactaacctgttccagctggggcacaaatgtgcggcagtactggacctcgtttgtagcaccgagaagatcaatatcggtcccgaggtggtgcagcgagagtgcgtgccaactgagtaccacgagattcagaaccagtgcctcgggctcttttcatcgaatgcagtagataagtcacggtctgaggcagcagtccgtaaagtctcagacctgaaaatcagcaccgacactgagttcttatccattatcacctcttcacaagttgccttcctcgcacagaagaaggataaaagaagatctcccgtcaataagggaaacgtcaatatggagaccgagccaaaagcctcttatggcgaaattaggattccagaggaaaactcaattcagcttgacgggtttaccgaggcttatgagtcggggcagaatcaggcatatagcttggaactgtttagcccggtatgtcctaagacagagaacagcagaattcatataaattcggacaaaggcttagaggagcacactgggagccaggaacttttctcctcggaagatgagctcccacccaacgaaatcagaatcgaactatgttctagtggcatcctgtgcagccagttgaacacgttccataaaagtgctatcaaacggagctgtacttctgaggacaaggtgggtcaatccgaagccctatcccgcgtgctacaagtggccaagaagatgaagctgatttcaaacggaggagacagcgcagtggaaatggaccgcagaaacgtgtcagaatttaaatccataaagaagacttcacttattaaaaattgcgatagcaaaagccaaaaatataattgcctagtgatggtgctttctccatgccatgtgaaggagattaatattaaatttggcccaaatagtgggtctaaggttcccctggccaccgtgaccgtgatcgatcagtcagaaaccaagaaaaaggtctttctttggcgaaccgcagccttttgggctttcaccgtgtttctaggcgatattatcctcctgaccgacgtggtaatccatgaagatcagtggataggagagactgtgctccagagcaccttctcttcccaactcttgaacctggggtcgtactcgtccattcagcccgaagagtactccagcgtagttagtgaagtagtactgcaggatctgctggcctacgtgtcatctaagcattcttatttgcgcgacctccctcctcggcaacctcagcgggtaaacagcatagattttgtggagttggagcacctgcagcccgatgtgctcgtgcatgcggttctgagggtggtggactttaccattctcaccgaagccgtgtactcataccgaggacagaagcagaaaaaagtaatgctcaccgtggagcaagcacaagatcaacattatgccttggtgctgtggggcccaggagccgcttggtatccccagttgcagcgaaaaaaaggagtggtgctgataaaggcccagatcagcgagctagcatttcctataacagcatcccagaagatcgccctgaatgctcacagctccctgaaatctatcttttcttctcttccaaacatcgtctatactggatgcgctaaatgcggactagagcttgaaactgacgaaaaccggatctacaaacaatgcttctcgtgtctgcctttcaccatgaagaagatttattaccgacccgctctcatgactgccattgacggtaggcacgacgtttgcatcagggtggaaagcaagctaatcgaaaagatcctgctcaacatttctgctgattgcctgaatcgggtgatcgtgccttcctcggagatcacttatggtatggtggttgctgatttgtttcacagcttgttagccgtaagcgccgagccttgtgttcttaagatccagtcactgttcgtgcttgatgaaaattcctacccattacagcaagatttcagcttactggacttctacccagacatcgtgaaacacggtgctaatgcgagactctag

SEQ ID NO: 56204 - DNA, 2715 bp, Artificial Sequence
  Description of Artificial Sequence: Synthetic coding sequence
atgtctggcggatcacaggtgcacatcttttggggcgcacctatcgcgcctttaaagatcaccgtgagtgaggacaccgccagcctcatgtctgtggccgacccctggaagaagatccagttgctgtactcacagcattctctctaccttaaagatgaaaagcagcataagaatctggagaattacaaagtgccagaatctattgggtcccctgatctctcggggcattttcttgctaactgcatgaaccggcatgtgcacgttaaggatgatttcgtccggtctgtttctgaaacacagaatattgaatcgcagaaaatacactccagccgtctgtcagatatcacgagttctaacatgcagatttgcgggttcaagtctacagtgccacacttcactgaagaggaaaagtaccagaagttactgtccgaaaacaagattagagacgaacagcccaaacaccagcctgacatatgtggtaaaaatttcaacaccaatctgtttcaattggggcataagtgtgccgcagttctcgatctcgtctgtagcacagagaagattaatatcgggccagaagtggtccaacgagaatgtgtgccaaccgaatatcacgagatccaaaaccagtgcttaggcctattttcgagcaacgccgtggacaaatctcggtctgaagccgcagtgcgcaaggtgtcggatctgaaaatctccaccgatactgagttccttagcataatcacatctagccaggtagcctttttggcccagaagaaagataagcgacgatcacccgtaaacaaaggaaatgtaaatatggagacagagccaaaggcgtcctacggggagatcaggatacctgaggaaaattcgatccaactagatggattcaccgaggcctatgagtccggacagaaccaagcttacagcctcgagctcttttctcccgtttgtcccaagactgagaattcaaggattcacataaacagcgacaagggccttgaggagcataccggcagccaggaattattttctagcgaggacgagctcccacctaacgagatccgcatcgaattgtgttctagcggcatactgtgctctcagttaaatacttttcataagtcagctattaagcgcagctgtacctctgaagacaaggtgggccagtctgaggccctctcccgggtgctccaagtggccaaaaagatgaaattgattagcaatggaggtgattccgccgtggagatggaccgtcgtaatgtgtccgagttcaagtctattaaaaagacctctttgattaagaattgcgattcaaagtcacaaaagtacaactgcctcgtgatggtactgtctccatgccacgtgaaggagattaatataaagttcgggcctaactctggttctaaagtccctctggccacagtcacagtaatcgaccagtccgagacgaagaagaaggtctttttgtggaggactgccgcattctgggctttcacagtgttcttgggggacataatcctcctgacagacgtcgtgatccatgaggatcaatggataggtgagactgtactccagagcacattcagctcccaactgctgaatctgggctcatattcttcaatacaacccgaggagtactcctcagtcgtgtctgaggtagttctgcaggatctccttgcctatgtgagttctaaacactcgtacctacgcgatctgccccctaggcagccccagagagttaacagtattgattttgtagaactagaacatctgcagcccgacgtgttagtgcacgctgtgctgcgcgtggtagattttacaatcctgaccgaggccgtgtactcatatcggggtcagaaacagaagaaggtcatgttgaccgtggagcaggcacaggatcagcattacgccttggtgctgtggggtccaggggcagcatggtacccccagttgcagcgcaaaaaaggatacatctgggagttcaagtacctcttcgtacaatgcaactatacacttgaaaatttggagttgcatactacgccctggtctagctgtgagtgcttattcgacgatgatatacgggctatcaccttcaaggctaaatttcaaaagagcgccccatcttttgtgaaaatatctgatctggccacccatctagaagacaagtgcagtggggttgtgctgattaaggcgcagattagcgaactggcctttcccattactgcatcccagaaaattgcccttaacgctcacagtagcttaaaatcaatattctccagcttacccaacattgtgtacaccggttgtgctaagtgtggactcgaactggaaacagacgagaatcgaatctataagcagtgcttttcatgcctgccgtttacaatgaagaagatctactaccggcctgctctgatgacagctattgacggtaggcacgatgtgtgtatcagagtggaatccaagttgattgagaaaatcctcttgaatatttcagctgactgtttgaaccgggtaatcgtgccttcatcagagatcacttatggtatggttgttgcagaccttttccactcattattggcagtatctgctgaaccatgcgtgctgaagatccagtccctttttgttctcgacgagaacagctacccactccaacaagactttagcctgctggacttctaccctgatatcgtaaagcatggcgctaatgcacgtctctag

SEQ ID NO: 56205 - DNA, 1680 bp, Artificial Sequence
  Description of Artificial Sequence: Synthetic coding sequence
tgagatgagctgccgcctaacgaaatcaggatcgagctatgttcctccggcatcctgtgtagtcagctgaacaccttccacaaatctgccataaaacgcagttgcacctctgaggacaaggttggccagtcggaggctctgagccgggttctgcaagtagctaagaagatgaagctgatctccaacggcggtgacagtgccgtcgaaatggatcgacgcaacgtcagtgagtttaaatccatcaaaaagacctcgctgatcaagaattgcgattccaagtcacaaaagtataattgtctggttatggtgctttccccttgccacgtgaaagagattaacatcaagttcggcccaaacagcgggagcaaagttcccctggcgactgtgacagttattgatcagtcagagacgaagaagaaagtgtttctttggcgcacggccgcattctgggcttttacggtatttctaggagacatcatacttctcaccgacgtggtcatccatgaggatcagtggataggtgaaacagtgctgcagtccaccttcagctctcagctgttgaatctagggtcttactctagcatccagcccgaagagtactcatcggtggtgtccgaggtggtcctacaggatctgctggcctacgttagttccaaacacagttatctgcgagatctgccccctcgtcagccccaaagggtgaattcaattgatttcgtggagttggaacacctgcagcctgacgttctggtccatgctgtacttcgagttgtagacttcaccatcttaacagaagcggtctactcctaccgtgggcagaagcagaaaaaggtcatgcttactgtggagcaggcccaagatcagcattacgccctcgtcttatgggggccaggtgcggcttggtacccacagctgcagcgaaagaaggggtacatctgggagtttaaatacctcttcgtacagtgcaattacaccttggagaatctcgagctgcacacgacaccttggtcctcttgcgagtgtttgtttgatgatgacatccgagctataacctttaaagccaaattccagaaatcagccccatcgttcgtcaagatttccgacctcgccactcacctggaagacaagtgttccggtgtcgtgctgatcaaggcccaaatcagcgagctcgcctttcctattaccgcgtcccagaaaattgctctcaatgcacattcttctctcaagagcatattttcttccctccctaacatagtctatacaggctgtgcgaagtgtggcctcgaactggagactgatgaaaacagaatttataaacaatgtttttcctgtctcccattcacaatgaagaagatctactataggccagcacttatgacagccattgatggccgacacgacgtttgcatccgggtagagagtaagttgatcgagaagatcttgttaaacatttccgccgattgcctaaaccgggtgatcgtgccctcatctgagatcacttacggcatggtggttgcagatcttttccactcattgctggccgtctcggctgagccatgtgtactaaagatccagagtctattcgtgctggatgagaactcctaccccttacagcaagacttttcactacttgacttctacccagacattgtaaaacacggagccaatgctagactgtag

SEQ ID NO: 56206 - DNA, 2508 bp, Artificial Sequence
  Description of Artificial Sequence: Synthetic coding sequence
atgtcgggcggatcccaggtccatatcttctggggcgcacccatcgcccctctgaaaatcacagtctcagaggacactgcaagcctgatgtcagtcgctgacccctggaagaagatccagcttctatattcacaacatagcttgtacctcaaggacgaaaagcagcacaagaacctagaaaactataaagttccagagtcaatcgggtcaccggatctgagcggccacttcctcgcaaactgcatgaaccggcacgtgcacgtcaaggatgactttgtcagatcggtgagcgagacgcagaacatcgagtcccagaagatacattcctcaagactgagtgacatcacgagttcaaacatgcagatttgcgggtttaaatcaaccgtgccgcactttacagaggaggagaagtaccagaaactgctgagtgaaaataaaatccgggacgaacaaccaaagcatcagcccgacatctgcggaaaaaacttcaacacgaacctgttccaactcggccataaatgtgctgccgtgctcgacttggtgtgcagtaccgagaagatcaacattggacctgaggttgtccagagggagtgtgtgcccaccgagtatcacgagatccaaaaccagtgtttaggcctgttttcatcaaatgccgtggataaaagcaggagcgaggcagcggtgcgcaaggttagcgatctgaagatttcaacggacactgagttcctctcaataattacatcatctcaggtcgcttttctcgcacagaagaaggataaacgaaggagtccagtcaataagggaaacgtgaacatggagacagaaccaaaagcatcctatggagagatcaggatccccgaggagaattccattcagcttgatggcttcacagaggcctatgagtcaggacagaatcaagcatatagcctggagcttttctctcccgtctgccctaagacagaaaacagccggattcacattaatagcgacaagggactcgaggagcataccggatcacaagagctattctccagcgaagatgagctgcctccaaacgagataaggattgaattgtgctccagtggaatactttgctcccagctgaatacattccacaagagcgccatcaagagaagctgcacaagtgaggacaaggtgggtcagtctgaggctcttagtagggttttgcaggtcgctaagaaaatgaaactcatctccaatggtggcgatagcgcggtggagatggatagaagaaacgtctccgaatttaaatctattaagaagacatctcttataaaaaattgtgattctaagtctcagaaatataactgtctcgtcatggtactgtccccctgccatgtcaaggagattaacatcaagttcggccctaatagcggcagcaaagttccactcgccaccgtgactgtgatagaccagagcgaaacgaagaagaaagtgttcctttggcggacggccgctttctgggccttcactgtgtttctgggcgacatcattttgctcaccgatgtggtcatacacgaagatcaatggattggcgaaaccgtcctacaaagtactttttctagtcagctgttgaatctcggctcatactcctcaatccaacctgaagaatactcctcagtcgtgagcgaggtggtgctgcaggatctcctggcatacgtgtcatccaaacactcctatttgagggacctccctccgaggcaacctcaaagggtgaactcaatcgacttcgtggagctggaacacctgcagcccgacgtgctcgtgcatgccgtgctgagggtcgtggactttactatactgactgaggcggtgtactcataccgcggacaaaaacaaaaaaaggtgatgctcaccgtggagcaagcgcaagatcagcattatgctttggtgctgtggggtccaggcgcagcttggtatccacagttacagaggaaaaagggcgtagtactcatcaaagcacagatatccgaactcgcatttccaatcacagcttctcagaagatagcactgaacgcccacagtagcttgaagtcaatcttttcctctctgcctaacatcgtttacacggggtgcgctaaatgtggactggaattagagaccgatgagaaccgcatctacaaacagtgcttcagttgcctcccctttaccatgaaaaaaatttattaccggcctgcgctgatgactgctatcgacggcagacacgacgtctgtatacgcgtggagtccaagttgattgaaaaaatactgctgaacatatctgcggactgtctcaaccgggtgatcgtcccgagttccgaaattacatatggtatggttgtcgccgacttatttcatagcctcttggccgtgagcgcagaaccctgcgttctcaaaatccaatctctctttgtgttagacgaaaattcatatcccctgcaacaggacttcagcctcctggacttttacccggatatcgtcaagcacggagcgaatgcccgattgtag

SEQ ID NO: 56207 - DNA, 732 bp, Artificial Sequence
  Description of Artificial Sequence: Synthetic coding sequence
atgcttaccgtagagcaggcacaggaccagcactacgcgttggtactgtggggacctggggcagcttggtatcctcagcttcagcgtaagaaaggatacatttgggagtttaagtacctatttgtgcagaggaactacactttagagaatctcgaactgcacacgacaccctggagtagctgcgaatgccttttcgatgatgacattagggccataacatttaaagcgaagttccagaagtccgcacctagtttcgtgaagatttcagacctcgccactcatctggaagacaagtgctcaggggtcgtgctaatcaaagcgcagatatccgagctggcctttcctctgactgccgctcagaagattgctctgaatgcacactcttcgctgaaaagcattttcagctctctgcctaacataatttatacgggatgtgccaagtgcggactggagctggaaaccgacgagaaccgtatctacaagcagtgctttagttgccttccgttcactatgaaaaagatctattaccggcctgctctcatgactgctgttgacggtagacacaacgtttatattcgggttgagtctaagctgattgagaaaatactgttaaatatttccgcccattgcttgaacagagtgatcggaaacattagccgctcacccatggggtggctgtggcagacgtgttctaccccctgttggcagagcgcccaaaacctggtatactag

SEQ ID NO: 56208 - DNA, 639 bp, Artificial Sequence
  Description of Artificial Sequence: Synthetic coding sequence
atgctgaccgtggagcaggcccaggatcagcactatgccctcgtcctttggggacctggtgctgcttggtatccccaactccagcgcaaaaaaggtgtggtgctgattaaggcccaaataagcgagctggcattccctctgacagccgctcaaaaaattgctctgaatgcccactcttccttgaagtccatattttccagtttgcccaatatcatctacactggttgtgctaaatgcgggctggagctggagaccgacgagaatcggatctacaaacagtgtttcagctgtctgccctttaccatgaagaaaatctactaccggcctgctttgatgacagcagtggatggacgtcacaacgtgtacattcgggttgaatccaaactgatcgaaaagatcttactgaacatcagtgcacactgccttaaccgggtcatcgtcccctcctccgagatcacctatggcatggtggtagccgatctgttccacagtctgctagccgtgtccgcagaaccttgcgtgctgaagattcagagtttgtttgtcctggacgagaactcatatcctttacagcaggacttctctctgctggatttctatcctgacatggtcaaacatggggcaaatgccaggctctag

SEQ ID NO: 56209 - DNA, 2505 bp, Artificial Sequence
  Description of Artificial Sequence: Synthetic coding sequence
atggaggaccccgctgccccaggaacaggagggccacccgcaaatggaaacggaaatggtggcggaaaagggaaacaggcagctcctaagggccgagaggcttttaggtcacagcggcgagagtctgaggggtctgtcgattgtcccacgttagagtttgaatacggggatgccgatggtcacgccgctgaactttctgagttgtattcttatacagagaatctggagtttacgaataaccgcagatgttttgaggaggattttaagacgcaggtccagggcaaggagtggctggaactcgaggaggatgctcagaaggcatatattatgggtctgctagaccgtctggaggtagtttccagggagagaaggctgaaggtggccagagccgtattgtaccttgcacaagggaccttcggcgagtgcgattcagaggtggacgttctccactggagtcgatacaactgcttcctactgtatcagatgggaaccttctctacctttctggagctacttcacatggagatcgacaacagccaggcatgctctagtgcccttcggaagccggctgtgtctatcgctgatagcacggagctgagagtcctgctgtcagtaatgtatctgatggtcgaaaatattcgtctggaaagagagacagacccttgcggctggcggacagcgagagaaacgttcaggacggagttgtccttcagtatgcataacgaagaaccattcgccctgttactgttttccatggtgactaagttctgtagcggcctggcgcctcacttccccatcaagaaggtcctgcttctgctgtggaaggtagttatgtttacgttgggtggatttgagcacttgcaaaccctcaaggtacagaagagggccgagctgggtttacccccactggcagaggacagcatccaggtggtgaaaagcatgcgcgcagcaagccccccaagctatactctggatctgggggaaagccagctagcccctcctccttccaagctcagagggagacggggatctcggagacagttgctgacaaagcaggatagcctggacatctataacgagagagacttattcaaaactgaagaaccagctacagaagaagaggaagaatctgctggggacggcgagagaactcttgacggagagttggatctactagaacaggacccattagtcccccctcccccaagccaggcgcctctgtcagcggagcgggttgcgtttccaaagggacttccctgggctcccaaagttcgccaaaaagatattgaacattttctggagatgtcccggaacaagttcatcgggtttactcttggacaggacactgatacactcgtcggactgcccaggcctattcacgagagcgttaaaacactcaaacagcacaagtacatatctatcgctgacgtgcagatcaaaaacgaggaggaattggagaaatgcccaatgtcgctcggggaggaagtggtgccagagacaccatgtgagatcctctatcagggaatgctgtactctcttcctcagtacatgatcgcgttgctgaagatcctcctggccgctgctccgacatccaaggccaagacagacagcattaacattcttgcggacgtgctgcctgaagagatgcctatcacagtgctacagagcatgaagcttgggattgacgtgaatcgccacaaggaaattatcgttaaatctatatctacactgctcttactgctgctaaagcactttaagctgaaccacatttatcagtttgaatatgttagccagcacctcgtttttgcaaactgcatcccattaatcctcaaattttttaaccagaacattctgtcgtacatcaccgctaaaaacagtatctcagtgctcgactacccctgttgtacgattcaggatctgcccgaattgactaccgagagcctggaggctggggataacagccagttctgttggcggaacctgttttcctgcataaacctcctcagactcctcaacaagctgactaagtggaaacattcacgcaccatgatgcttgtcgtcttcaaatctgccccaatccttaagcgcgctctaaaagtgaagcaggctatgttgcagttgtacgtactgaaactgttgaaattacagacgaaatatctgggtcggcaatggcgcaagtccaacatgaagacgatgagtgcaatataccagaaagtgcgccacagaatgaatgacgactgggcatacggcaatgatatagatgctcggccttgggatttccaagccgaagagtgcaccctcagagcaaacatcgaggccttcaactctcggaggtacgacagacctcaggacagtgagttcagccccgtggacaattgcctgcagtcagtcttgggccagcgcctcgatttgcccgaggacttccattatagctacgaactgtggcttgagcgtgaagtgttcagccagccaatctgctgggaggagctgttgcaaaatcactag

SEQ ID NO: 56210 - DNA, 2277 bp, Artificial Sequence
  Description of Artificial Sequence: Synthetic coding sequence
atggaagacccagcggcacctggtaccggcggtccgccagccaacggcaatgggaacgggggaggaaaaggtaagcaggcagccccaaagggcagggaggcctttcgatcgcagcgaagggagtcagaaggaagcgttgattgccctaccctggaatttgagtatggggacgccgacggacacgccgcagagttgtctgaactgtacagttacacggaaaacctagagtttacgaacaaccggaggtgctttgaggaagatttcaaaacccaggtccaggggaaggaatggttggaactcgaggaagacgcacagaaggcctacattatgggtcttctcgaccgcctggaggttgtgtctcgggaacgaaggcttaaagtagctcgggctgtgttgtacttggcacaggggaccttcggcgaatgcgacagtgaggtagatgtgctgcattggtccagatataactgttttttattgtatcagatgggcacattttccacctttcttgaactgctgcacatggagattgataacagccaggcctgctcctcagcactacgcaagcccgctgtctctatcgccgattctacagaactgcgtgtgctactatctgttatgtatctgatggtagaaaacattagactcgagcgtgaaactgatccttgcgggtggagaacggctcgtgaaaccttccggacagaactgagtttcagtatgcacaatgaggagcccttcgccctgctgctgttctctatggtgaccaagttttgctctggtctggcccctcattttcccattaaaaaggtcctgctcctcttatggaaggtcgtgatgttcaccctgggcggatttgagcacttgcaaacacttaaggtacagaagcgcgctgagcttggcctcccacctttagccgaggattccatccaggtcgtgaagtcaatgagagccgcatctcccccatcttatacgctcgatttaggcgagagtcagctagcacccccaccatccaagctgagaggacggagagggtcacgacgacagctgctcactaaacaggactccctggacatctataacgagagggatctgttcaaaacagaagaacccgctacagaggaagaggaagagagtgctggggacggtgaacggacgctcgatggcgaactcgacttactggaacaggacccgcttgtccctccgcctccctcgcaggcaccattgagtgctgagcgcgtcgcattccccaaggggctcccctgggcacccaaggtcagacagaaggatatagagcactttttggaaatgagtcgtaacaagtttatagggttcacattgggccaagacactgatactctggtgggcctcccacgcccaattcacgaaagtgtgaaaactctgaagcaacataagtacatcagcattgctgacgtgcagattaagaacgaggaggaactcgaaaagtgccccatgtctctgggcgaagaagttgtgcccgagacaccttgtgagatcttatatcagggtatgctttactccctgccacagtacatgatcgctcttttgaaaattctcctcgccgctgcacccacctcaaaggccaagactgacagcataaatattctggcagacgtgttgccagaagagatgccaatcacggttttacaatccatgaagctgggaatcgatgtgaaccggcataaagaaattattgtcaaatcaatctcgactctgcttttgctgttactgaaacacttcaagctcaaccatatttatcagtttgaatacgtgagccagcacctggtgttcgccaattgcatcccgcttatccttaagttcttcaaccaaaatatcctcagttacatcactgcaaagaatagcatttcggttcttgattacccttgctgtaccattcaagacctcccggagctgaccaccgagtctctcgaagcaggtgacaattcacagttttgctggagaaacctgttcagttgcatcaacctgctccgcttgctcaacaaactgacgaagtggaaacacagtaggaccatgatgttggtagtattcaagagtgctcctattctgaaacgagctctcaaggtgaagcaggccatgttgcagctatatgtcctcaaactgctgaagctgcagacaaagtatctcggacgtcagtggagaaagtcaaatatgaagacaatgagcgctatttatcagaaggtgcgccaccggatgaacgatgattgggcgtacgggaacggcgagagttctcagagctcttag

SEQ ID NO: 56211 - DNA, 636 bp, Artificial Sequence
  Description of Artificial Sequence: Synthetic coding sequence
atgttctctcagggactttgcagcgactccatgttcccagagatgtggagacccgtggacatggggtggcctcagacccggatgcctcgagtccggtctctgcatgcatacccccctttcttcccccttcagcagttgcttacaaagcaggactctctggatatctataacgagagagacctgttcaagacagaggagccagcaaccgaggaggaggaagagagtgcgggagatggggagagaactctcgatggcgaactggatctcccctgggcgcctaaggtgcggcaaaaagacattgagcattttcttgagatgtcccggaacaagttcattggcttcaccctgggccaggatactgacacgttggttgggctcccccgacctattcacgagtccgtcaagaccctgaagcaacacaagtacatatctatagcggacgtgcagatcaaaaatgaagaagaattagaaaaatgtcctatgagtctcgtcagccagggatccccaactcaagaagaaagtaggcgcaaaccagtgttttcagtcgtgactgagcatgtgtgcatgcattcattctcgattctcgggtgcaattgcgtccccggaggtcgcggaggtactagggacgccatgtag

SEQ ID NO: 56212 - DNA, 1272 bp, Artificial Sequence
  Description of Artificial Sequence: Synthetic coding sequence
atgctgccctggaagaaacacaaatttgaactgttagccgaagccccaccaaggcaggcatccaaaccgaaagggtatgcagtgtcactgcattattcagcattaagctccctcgctagagcctgccctgaaggggctctatcaagagtagggtctatgttccgatccaaaaggaaaaaactgcatatcaccagcgaggaccccacctacacggtgttgtatctaggaaacgctaccactatccaagccagaggcgatgggtgtacagacctagccgtgggaaagatctggtctaagtctgaggcaggacgccaaggaacgaaaatgaagttgaccgtgtccgcccaaggtattcgcatggtccacgccgaggagagggcgctgcgtcgaccaggccatctgtacctgctacatcgggtgacctattgtgtagctgacgctcggctgccaaaggtcttcgcatgggtgtacagacacgagctcaaacataaggccgtcatgctgagatgccacgctgtgcttgtcagcaagccggagaaggcccaggcaatggccctccttctctaccagactagcgccaatgccttggccgagtttaagagactgaaacgcagggatgacgcccgacaccaacagcaagaattagtcggcgctcataccataccactcgttccgttgcggaagttgctcctccacggaccctgttgttataaacctcccgtggagcgtagtcggagcgccccaaagctcggaagcataacggaggacctgctcggagaacagctggagcaggagttacaggaggaggaagaagaagaacagccggagggatgccccgaagaggaggagaatcgcgctgcggaaggcgacccggcagaggaggaagccgaggcgcagagagcactagtggtcgccatgcattttgagtgtggagatcttctggacactctcgaaaatgggaggggcgaagcactgggaggcggtggaggcagtttgggcccaggagcgggtccccctccactcctgctgggatctgccagcgacatgaaggctgagctgtctcaactgattagtgatctgggagagctgtcattcggcaatgatgtccggaccctacaggccgacttgagggttactaggttgctgtctggtgactctaccgggtccgaatccagtatcgaggggggtggacccgacgccacatcggccaccgctggcgatagcagcagacaagctgacggggcttcagccgatgagccccactccggctag

SEQ ID NO: 56213 - DNA, 990 bp, Artificial Sequence
  Description of Artificial Sequence: Synthetic coding sequence
atgctgccttggcggcgtaataagttcgtgctagtggaagacgaagccaagtgcaaggctaaatccctgtccccaggactggcatatacctcactacttagttcattcctgcgaagctgccctgacctgctacccgattggcctctggagcgtctagggagggtattcaggagtcgacgtcagaaagtagaactgaacaaggaagatcccacgtacacagtatggtaccttggaaacgctgtaactctacatgcgaagggtgacgggtgcaccgacgatgccgtcggcaaaatatgggctcggtgtggtcctggcggaggaaccaagatgaagctcaccttggggcctcatggcatacgcatgcaaccgtgtgagcgctccgccgctgggggatccgggggtcggcgtccggcacatgcctatctgttgcccagaattacctattgcactgcagacggacggcacccacgcgtttttgcttgggtgtataggcaccaggccaggcataaggcagttgtactgagatgccatgctgttttgcttgctagggcgcataaggcccgtgcacttgcgagattactgaggcaaaccgcactggctgctttcagcgattttaaacgactgcaaagacagagcgatgcgagacacgtacgccagcaacacctgagagctggcggtgctgctgccagcgtacccagagcacctctgagaaggctgctcaacgctaaatgtgcctaccgaccacctccctcagaacgctctagaggggctccccgtctctcctctattcaggaggaagacgaagaggaggaggaagacgatgccgaagagcaggaggggggagtgccacagcgcgaaaggcctgaggtgctgtccctggcgcgtgaactgcgaacttgctccctgaggggagcgcctgccccacctccccctgcacaaccccgacgctggaaggctgggccaagggagagagcgggacaggccagatag

SEQ ID NO: 56214 - DNA, 1074 bp, Artificial Sequence
  Description of Artificial Sequence: Synthetic coding sequence
atggccgctgcagaggtggccgacactcagcttatgctaggggtcggactaatagagaaagacactaacggcgaagtgttgtgggtgtggtgctatccatcaacaacggccaccctacgaaacctgttgctgcggaagtgctgtttgacagacgagaataagcttctgcaccctttcgtgttcggtcaatacagacgtacctggttctacataactacgatcgaagttcctgattccagcatcctcaagaaggtgacgcatttttctatagtgctcaccgccaaagattttaacccagagaagtacgctgctttcaccaggatactctgccgtatgtacctgaagcacggttcaccggtaaaaatgatggagagctacatagctgtgctcactaagggaatctgccagagcgaggaaaatgggtcctttctgtcaaaggactttgatgctagaaaagcctatctggccggttcaataaaggacatcgtgtctcagtttggaatggaaactgtgatcttgcacacagcactaatgttgaagaagagaattgtcgtgtatcaccctaaaattgaagctgtccaggagtttactcgcactctccctgccctcgtatggcaccgtcaagactggacaattcttcactcctacgttcacctgaacgccgacgagctggaagcactgcagatgtgcacaggctacgtcgcaggtttcgtcgatcttgaggtgagcaataggccagacctgtacgacgtgttcgtaaacctcgctgaatctgaaattactattgcccctctggcaaaagaagccatggctatgggcaaattacataaggagatggggcaactgatcgtgcagtccgcagaggaccctgagaagtctgagtcccatgttatccaggacatcgccctcaaaacgcgagaaatctttactaatttggctcccttttccgaagtctcggccgacggggaaaagagggttttgaatctagaagccctgaagcagaaacggtttccgccagctaccgaaaacttcctatatcacctggccgcagcagagcagatgttgaaaatctag

SEQ ID NO: 56215 - DNA, 603 bp, Artificial Sequence
  Description of Artificial Sequence: Synthetic coding sequence
atggctgccgctgaggttgcggatacacagctgatgttgggtgtaggccttattgagaaggacaccaatggcgaggtcctttgggtgtggtgttatccatcaaccacagctaccctacgcaacctgctcctgcgtaaatgttgtctgacagatgagaacaagctcctgcacccattcgtgttcggacagtataggagaacttggttttacattacgactatagaagtcccagactcctcaatactgaaaaaggtaacacatttctccatcgtgcttaccgccaaagatttcaatcccgagaaatacgccgcatttacacggatcctttgcagaatgtacttaaaacatgggagcccagtgaagatgatggaaagctacattgccgtgctgacaaagggcatctgtcaatccgaagagaatggcagctttctgagtaaagacttcgatgcacgaaaagcctacttggctggaagcatcaaaggcctatgcttgccatggtgcggaactgaccgcacaggccctagctttactctaacatgtacctccacacctatgagctggaagccatgccgctgtgcacaggttacaagtctggacctatag

SEQ ID NO: 56216 - DNA, 621 bp, Artificial Sequence
  Description of Artificial Sequence: Synthetic coding sequence
atgctgccgtcactgggatactgcgtcgatatcgtctctcaattcggcatggagaccgttatattgcatacagccctgatgctaaaaaagaggattgtggtctaccacccgaaaattgaagctgtgcaagaattcacccggactcttcctgccctggtgtggcatagacaggactggaccatcctacactcttacgtgcacttgaacgccgatgagttggaagcactccagatgtgtacaggttatgtcgccggttttgtcgatctcgaagtctcgaacaggccagacctctacgatgtctttgtcaacctggcggagagtgagatcaccattgctcccctagcgaaggaagcaatggctatgggaaaactgcataaggaaatgggccagctgatagtccagtctgcggaggatccagagaaaagcgaatctcacgttattcaggacattgccctcaagaccagagagatattcactaatcttgctccttttagcgaagtgtccgcggacggtgaaaaacgcgtattaaatctagaggcactgaagcagaaacggttcccacccgctacagagaacttcctctaccacctcgcagcagccgagcagatgcttaagatttag

SEQ ID NO: 56217 - DNA, 666 bp, Artificial Sequence
  Description of Artificial Sequence: Synthetic coding sequence
atggcagccgctgaggtcgcggacacacagttaatgctgggggtagggttgatcgagaaagacaccaacggggaggtgttatgggtgtggtgctacccaagtaccacagccaccctcaggaatctgctgctccggaagtgctgcttaaccgacgagaacaaattactgcatcccttcgtgtttggccagtatcgacggacttggttttatattactaccattgaagttcccgattctagtatcctcaagaaagtaacacacttctccattgtcctcaccgctaaggacttcaatcctgaaaagtacgccgcatttacacggatcttatgtcgcatgtatttaaagcatggttcacccgtgaaaatgatggaatcctacattgcagtccttacaaaagggatttgtcaaagcgaggagaatggatcctttctgagtaaggactttgatgcccgtaaagcatacttagccggaagtattaaggatatagtttcacagtttggtatgaactgttacctcactcattccacggacgcgaaagagaagaactgcggagtctctccgcaagatcgctcaggtccgggagtgcatcaggactccgcttgccccggagtagctcccaccggtttagatcacccttcattactcagagcgcctcagcggcgttag

SEQ ID NO: 56218 - DNA, 1386 bp, Artificial Sequence
  Description of Artificial Sequence: Synthetic coding sequence
atgcaccagagatacttttggaccgaccagggccaagtcgcccttggcggacattacatggcagaaggtgagggttattttgccatgtccgaggacgaactggcttgctccccttacattccccttgggggagatttcgggggtggggacttcggtggtggggactttggcggaggtgacttcggcggaggcggatcatttgggggacactgtctcgactactgcgagtctccaaccgcacattgtaatgtcctgaactgggagcaggtccaacgccttgatgggatcctgtctgagactattcccattcatggacggggtaatttcccgaccctggagttgcagccatccctgattgttaaagtcgtccgacgccgtttagctgagaagagaataggggttcgagacgtcaggttgaatggctcagctgccagccacgtcctgcaccaggatagcgggctgggatacaaggacctagatctcatcttctgtgccgatttgagaggcgagggagagtttcaaaccgtaaaagatgtcgtcctggactgcttgctggactttctgcccgagggagtaaataaagagaagatcactcctctaactctcaaggaagcctacgtgcagaaaatggtcaaagtgtgtaacgattctgacagatggagtctgataagtctctctaataattccggcaaaaatgtagagctgaaatttgtggacagcctgagacgccagtttgaattcagcgttgactcttttcaaatcaaacttgattctctcctacttttctatgagtgttccgagaaccccatgaccgagacctttcatcccactataatcggagaatctgtttacggggattttcaagaagcattcgaccacctttgtaataagattatcgctaccagaaatccggaagagatcagaggtggaggattgttaaaatattgcaatctgctggtgcggggttttaggccggcatctgatgagataaagacgttacaacgttatatgtgcagtcgtttctttatcgatttcagcgacattggtgagcaacaaaggaaactggaaagctacctgcagaaccacttcgtgggactcgaggaccgtaagtatgagtacctcatgactttgcacggagtggttaacgaatcaacagtttgccttatgggtcacgagaggcgacaaacattgaatctgattaccatgttggctatcagggtgctagcggaccagaatgtaatacctaatgtggccaatgtgacatgttattatcagcccgctccctacgtggctgatgccaattttagcaattactatatcgcgcaggtccagccagtcttcacttgccagcagcagacttatagcacctggctcccgtgcaattag

SEQ ID NO: 56219 - DNA, 1572 bp, Artificial Sequence
  Description of Artificial Sequence: Synthetic coding sequence
atgcagatgcgtcgggtctggagaacatgcaggtctggtcccagaaagcgcagggaagcgagatacaaaaaaagcactgaggacatttttcctgcgcagctcctcaagctgcagagacacgagagggtatggcagcaggagcctccggtgcgtgaccaccgttcctggggagggtcgggcgctgggggtgttgccggtcgggagtggaccgaccaggggcaggttgcattagggggacattatatggcagaaggcgagggttattttgctatgagcgaggacgaactggcctgctccccctacataccattgggcggtgacttcgggggtggcgactttgggggtggcgactttggcggtggcgatttcgggggtggcggatcttttgggggacactgtctggattactgcgagtcccccactgcgcattgcaacgtgctcaactgggagcaggtacaacgcttggacggtatcttgtcagagaccattcctattcacggtagaggaaacttcccaacccttgaactgcagccatctctgatagtgaaggttgtgaggcgccgtcttgcagagaaaagaataggcgttcgggatgtcaggctgaacgggtctgcggctagtcacgttcttcaccaagactcaggactgggctataaggatctcgatctcattttttgcgctgatctgcgtggcgagggtgagtttcaaacagtgaaagacgttgtactagactgtctgctcgatttcctccccgagggtgtaaataaggagaaaattacgcccctgacactgaaggaagcctatgtgcagaagatggtgaaggtttgcaacgatagcgaccgatggtcactaatcagcctatcaaacaattccggaaaaaacgtggaactgaagtttgtcgattcgctacgcagacagttcgaattttctgtggactcctttcaaattaaactagattctctgctgttgttttacgagtgttcagaaaacccaatgaccgaaacatttcatcctacgatcattggcgaatccgtttatggagacttccaagaggccttcgaccacctgtgtaacaagattatcgcgactcgcaatcctgaggagatacgaggaggcggacttcttaaatactgcaaccttttggttagggggtttagaccagccagtgatgagatcaaaactttacagagatacatgtgttcaaggttctttattgatttctctgacattggtgagcagcagagaaaattggagtcctacttacaaaatcatttcgtcgggctggaggaccgaaagtacgaataccttatgacattacacggtgtggtgaatgagagcacagtttgcctgatggggcatgagcggaggcaaaccttaaaccttatcaccatgctggctatccgagtgttagccgatcagaatgtgattccaaatgtcgcaaatgtgacgtgctactatcaaccagcaccctatgtcgcagacgcaaacttttccaattattacatcgcacaggtgcagcccgtgttcacttgccaacaacaaacctattccacatggctcccatgcaattag

SEQ ID NO: 56220 - DNA, 267 bp, Artificial Sequence
  Description of Artificial Sequence: Synthetic coding sequence
tgaaaacgtatcggagtcagagatgttaggctgaacggctccgccgcaagccacgtgctccaccaagattctggcctaggctataaggatctcgacctaatattttgtgccgaccttcgcggagagggcgaattccagaccgttaaggatgtggttttggactgcctgctggactttctgcccgagggagtgaataaagagaagatcacacctctgactttgaaggaggaatctcacactaccacctactttcttaacatctcctag

SEQ ID NO: 56221 - DNA, 261 bp, Artificial Sequence
  Description of Artificial Sequence: Synthetic coding sequence
taacaggattccggactgggatacaaagaccttgacctgatcttctgcgcggacctgcgcggagaaggcgagtttcagactgtgaaggacgtcgtgttagattgcctcctggattttctgccagagggggtcaataaggagaagatcacccccctgacgctaaaagtgttccacaggcttctccgtcattggagagccgctgagaagaccggcgtgttattcgccgaacccctttgtggtatcggcagaccgcaggtatag

SEQ ID NO: 56222 - DNA, 1278 bp, Artificial Sequence
  Description of Artificial Sequence: Synthetic coding sequence
atgatgccttcagaaagtggcgctgagcgaagagacagagctgccgcacaggtcgggacagcggcagctactgccgttgccaccgcagcaccagccggaggcggacccgatcctgaggccctgagcgccttccccggtaggcacctttcagggttatcttggccccaggtcaagagactggatgccctgctgagcgagcccatcccaatacacggccgaggaaacttccccacactttcagtacagcctcgccagatcgtgcaggttgtgcggtctaccctggaagagcagggtctgcacgtccacagtgtgcggctacacggctcagcagcatcccacgtgctccacccagaaagcggcctaggatataaggatttagacctcgtgtttcgagtggacctgagatctgaagcctcttttcagttgacaaaggcggtcgtcctggcctgtctcctggatttcctgcctgccggtgtctcccgcgcaaagattactccgctcacactgaaggaggcatacgtgcagaagcttgtcaaagtgtgcacggatagtgaccgttggagtctgatcagtctgtctaataaatcagggaagaatgtggagttgaaattcgtggactctgtaagacgacagtttgaattttcaatcgacagcttccagatcattctggacagtctgctgctgtttggtcaatgcagcagcacccccatgtctgaagcttttcatcctaccgtgaccggagaatcactatatggagacttcacggaggcgttagaacacctgaggcatagagtgatagccaccaggagccctgaggaaatacgtggcggaggccttctgaagtattgccatctgttggtgcggggatttagaccccgaccatctactgatgttagggctctccagaggtatatgtgctcacgcttctttattgactttccagacctggtcgaacagagacgaacactcgagcggtacttagaagctcacttcgggggtgctgacgctgccagacggtatgcgtgtttggtgacccttcaccgcgtagtaaacgaatctaccgtgtgcctgatgaatcatgagagaaggcagactctggacctgattgccgctttggcattacaggctctggccgagcaggggcctgcagcaacagcggctctagcatggcgaccacctggcactgatggcgtcgtgcccgcaaccgttaattattacgtcacaccggtgcaaccgctgctcgcacacgcttacccaacctggcttccttgcaactag

SEQ ID NO: 56223 - DNA, 1170 bp, Artificial Sequence
  Description of Artificial Sequence: Synthetic coding sequence
atgagtgaaattcgttttaccaacctgacatgggatcaggtgattaccctcgaccaagtcctcgacgaagtcatccctatccatggaaagggtaatttcccaaccatggaagtgaagcctaaagacatcattcacgtggtaaaagaccagctgatcgggcaggggattatagtgaaagacgcacggctgaacggatccgtagccagttacattcttgcgagccacaacggcatctcctataaagacctggacgtgatcttcggagtagagcttccgggaaacgaagagttccaggtcgttaaagacgcagtgctggattgtttactggactttctgcctaaggatgtgaaaaaagaaaagctctcgcccgacattatgaaggacgcctatgtccaaaaactggtgaaggtttgcaacggccatgactgttggagtctcatttctctgtcgaataacaccggcaagaatctggaactgaagttcgtcagctccctccgtcggcagtttgagttcagcgtggactcattccagatcgtcctggatccaatgctcgacttctattctgataagaatgccaagctgactaaggaatcataccccgtcgtggtggctgaatctatgtatggggattttcaagaggcaatgactcacctgcaacacaaactgatctgcaccaggaaaccagaggaaatcagaggaggaggtctgcttaaatactgtagcctgctggtgcacggattcaaacccgcttgtatgtccgaaatcaaaaacctggagagatacatgtgttcccgattctttattgacttcccgcatattgaagagcagcagaagaaaatagagtcttatcttcataatcattttattggagaaggtatgacaaaatatgactatctcatgactctgcacggtgtggtaaatgagagcacagtctgcctgatgtcgtacgagcggagacagatcttgcatcttatcacaatgatggcactgaaggtgctaggggaactaaacattttacctaatacccaaaaggtgacatgtttttatcaacctgcaccttatttcgccgctgaggcccgatatcctatttacgtaatccctgaacctccacccgtgagcttccagccttaccaccccctgcacttcagaggaagtaatggtatgagctag

SEQ ID NO: 56224 - DNA, 1170 bp, Artificial Sequence
  Description of Artificial Sequence: Synthetic coding sequence
atgtccgaaattaggttcacaaacctgacttgggatcaagtcattacgcttgaccaggtcttggacgaagtgataccgattcacgggaaaggcaattttcctaccatggaggtcaaacccaaggacattatccatgtcgtaaaagatcagttgatcggacaggggatcatcgttaaagatgccaggctcaacggctccgtggcttcatatattttggcgtcccataacggtattagttacaaagacctcgatgtgatctttggggtggagctgcccggaaacgaggaatttcaggtggtgaaggatgcagtgctcgactgcctcctggactttttaccgaaggatgtgaagaaggaaaagctgagtcccgacatcatgaaagacgcctatgtgcagaaactggtcaaagtgtgcaatgggcacgattgctggagcctcatctcgctgagcaacaatacagggaagaatctggagcttaagttcgttagctctctgcgtcgacagttcgagtttagtgtagactccttccagatagtcctggaccccatgctggacttttactccgacaagaatgctaagttaactaaagagtcatacccagttgtcgttgctgagtccatgtatggcgacttccaggaagccatgacacatctccaacataaactcatctgcacccgtaagcctgaagagatacgcggtggaggcctcttgaagtattgctctctgttggtccacggattcaagccggcatgtatgtctgagatcaaaaatctcgaacgctatatgtgttcccggtttttcattgattttccacatattgaagaacagcagaagaagattgagagctatttgcataaccacttcattggtgagggcatgaccaagtacgattaccttatgactctgcacggtgtggtcaacgagtctacagtatgcctgatgagctatgagcgaagacaaatacttcacctgataaccatgatggccttaaaggttctaggggaactgaatatcttgcctaatacccagaaagtcacgtgtttctatcagccagccccatactttgcagcggaggctcggtatcccatttatgtcattccagagcccccacctgtaagtttccagccgtaccatcccttgcactttcgaggcagtaatggaatgtcttag

SEQ ID NO: 56225 - DNA, 888 bp, Artificial Sequence
  Description of Artificial Sequence: Synthetic coding sequence
atgcagatgtcggttccctgcgtgctcagttcccttcaaaatcatgagcccaataagccgctcttcaccactcaatcccaactgctctctaaggtgttggaggttctggacccggaccggaagctcgaggacacatgggcttactgtcaggacacacgaaaggggatgaaggaaccaaccaagctccttaagaagcatagcacccaggtgtacctgggaccaagcaagaaaacttccgtttcaaatgccggacagtggctgtatgaggagaagccacacaagatggatttactgcacgagaacggtcccagaccaggactccatgaaaatgtgtgtaaggctgtaagcgatttttgcaaatgggtcaccacattcggcatctcagacatcgacgaggagtttatcctgaagcagtttgacatcgactacgaaaccaagccctcccatgatgccttgcatacaatgaaactgaaccaggtgccgctggaactgaagaggtccgttgggctcagcaaactgcaggaaaccgagttcttccagaaattaggctacgagaggaagcttcaaaaaccacagaacccatataagccgaagtgggtaaaaatgcgctacggggcttggtacctgaatccgaagctctggaagaaacagagggtagatgagcctctcgttgaccccgaggtgagccacaaggctcaggaggagaacttcaaaaaggagctccaggagcaggaagaacttctggcagatctgcacgggaccgtggccttcaaagacttcatcctcagtagagggtatcggacccctagatttctggagaacatgtatatcgggaaggagtgtaagcgggcttgtaacaaaactcctatcaagcggactcaagcctag

SEQ ID NO: 56226 - DNA, 1056 bp, Artificial Sequence
  Description of Artificial Sequence: Synthetic coding sequence
atggctgatagaaggcggcgtttaagacccggaaccctcgccccagtacgggagggcgttaactgtcgtagtaggtgcttcacaaagcataagaatgggctgaagttcccaacatctctccactctaggcagcttgtttttcctagaaaggggcttgatgactttaggaaaggatgtccgccatgcaccggactggtcacccaagtgccggttgagggttttctgcctcaaatctaccaccgggctccacagctcgcccctaagaaacggcagattaaactcttaaaagaagcagacgttctcagtaaactgagcccagctcagcaggcaagaaaagcgtttctggaggacgtggaggcccatttgacgccccatccactcgcactgtacttgaacctagaggaggcaatgcccatcgagctgctctcgaaggttttggaagtgcttgaccccgatagaaagctggaggatacctgggcatattgtcaggatacacgcaagggaatgaaagaacccacgaagctgcttaagaagcatagcactcaggtctacctaggaccaagtaagaagacaagtgtctccaatgccggacagtggctgtacgaggaaaagcctcacaaaatggacctgcttcatgaaaacgggcctcggcctgggctgcacgaaaacggcatatctgacatcgacgaggaatttatcctcaagcaatttgatatagattatgagacaaagccctcccacgacgctctacatacgatgaagttgaaccaagtccccctggagctgaagcggtccgtcggcctatccaagctgcaagaaaccgagttcttccagaagctcggatatgagcggaaattgcagaagcctcaaaacccctacaagcccaaatgggtcaagatgagatatggagcgtggtatctgaatcccaagctttggaagaagcagagggtggatgaacccctggtcgacccagaggtctcacataaagcccaggaagagaatttcaagaaagagttacaggaacagtcaattttcaagaaagcaatggatatctag

SEQ ID NO: 56227 - DNA, 2376 bp, Artificial Sequence
  Description of Artificial Sequence: Synthetic coding sequence
atgggagaccaacgcctgcaggactggctgaggagccctggaatggatagtaaaccatggtactgcaataaaaggccatcaaaatgttttgccaagtgcaaacatcgcaggctgcgattcccacctatggatacacagaattgggtgttcgttaaggagggaatggacgattttagatacgggtgcccttctcccgaagacactctagtttgccgcagagatgagttcctactgcctaagatctccctgagaggccctcaggccgacccgaagtccggccagaaaaaattgctgaagaaggcggctctgttttctaaactatccccagctcaactagcccgtaaagcctttgtagagcaggtcgaggcccagcttatggcaaaacatccactggctatgtatcctaacttgggtgaagacatgcctcccgacctgttgctccaggtgctgaagcacctggatccagaaagagaactcgaggatgcctgggcctgctgtgagacgcaagagaagaccacagaagtccctacagagccagggaagcacccttgtggcgaattctgtctgaagcctccagaaacacccgtgagccacctgctgcctgaaccacccgagactggggtgtcccacctttcgccggagccaccaaagactccggtatctagcctccgtcccgaacctcctgaaacaggcgtctctcacctgcggcctgagccacctgagaccggcgtttcgcacattaggcctgggcctcccattacgagaagaagatctagtctgctacgccagctgttgaagctcgactccgagaggaagctcgaggatgcaagagccccatgcgagggtcgtgagaagactactgacgaacctaccgagcccggaaagtatccatgtggaaaattctgcccaagaccgtttgagacgcccttgagccacttaagacaagagccccctaagacccctgtgtcaagtcttaggcccgaaccccctgagactggggaatcacatctgcggctagagcattccaaaacaaggcggggaagtagcctaaggagtgagccctccgaaacaggagtaagcaggttacgccttgcccctccgaaaactagacgcggttccagcctgcacgccgagccctctaagactggtgtcagtcacctttcccccgagcccccaaagacagaagtgagccacctccatcctgtaccccctaaaactggagtgtgccacctgaggctggaacctcctgatacatcacaggtctctaatctgctgctgtacatactaaaggtcctcgactcaggccgtaccctcaaagacgtctgggataggtgtgaagccagggtgaaaaagactaaagaacctacggagccccataagtctccatgtggggagccttgcctccaacctccagagacacaggtttctcacccgcacccagagcatccaaagactcgacggagatcctccctgcacagtcaacctccaaagacacggaggacaagcagcctacgaagtgagcccccaaagacccgcagaacctctagccttagatccgagccccctaaaactcgacggactagctcactggggcctgagccacctaagacccgcagggtgtctagtctacgccctgagttgccgaaatctaggcgggttagctccttgcatccagaaccccctaaagctcccgagagccatcagtttagtgaacctcccaagattcgtgcctcttacatcaaggaattattacaggaagatactccgagtacaaaagaatgcgtgtccgattcactgcaatatagatacactagtgagaaactccgcgagttctttaaatgggctggagacctgggcgctgatgaggagtctataaggaatctgttcgatttcacacccaaatacagagccacccatgaagaccagaaattcaagaaagtgaaggagtgctcttcagaattaaaatacagcatggagctcgacgagaaagatgaggataagttcttttctcaggagaaatactggggcaggaaattccataccccctctaactcgtacaccgcccagcgggttaagatgaaatatggggcttggtatttaaagccaaagttgtggaagaagctacgcagtgacgagcctctgatcgatccgaaactcttgttgaaaaaacctgacgaaccggacgtattggatgatctgtatggcccaattgcttttaaggactttatcctatcaaaaggttacgaaatgcctggcatcatacagagactgttcgcaagaagggggtggacgtacgacagtgtcaaaacccctattcagagggctatgatcttttataaatacaaggagattgtagaggccagtgaggaagattag

SEQ ID NO: 56228 - DNA, 1938 bp, Artificial Sequence
  Description of Artificial Sequence: Synthetic coding sequence
atgggggaccggagacctcaggacaggcctcgaagccagggcatggacagtaaaccctggtattgcgataagcctccttccaaatatttcgccaagcgtaaacaccgacgcctccgttttccaccagtggacacccaaaactgggtgttcgtgacggaggggatggatgacttcagatacgcttgtcagtcccctgaggacaccctcgtgtgccgccgtgacgagttcttgctgccaaagatctccttaagggggcctcaagctgacaggaaaagcaggaagaaaaaactgctaaagaaagctgccctgttctccgagctgtctcctgtccaacctgccaggaaggcctttgtggaagaggtggaggctcaactgatgactaaacacccgctggcaatgtacccgaatctggggaaggatatgccgccagacctactgctgcaggtcctcaagcagctcgatccggagaggaagctagaagatgcctgggcgaggtgcgaggcgagagagaaaactactgaagttcccaccgaatctgggaagtatccctgtggagagagttgtcctcgccctcccgagacaccagtgagccgacttcggcctcagctccctaagacaccagtgagctcaagacgtcccgaaccccctaagactcgcgtttcaagtcttcgccctgagccccctaaaacccgcgtcagtagtttacaccctgagccacccgagaccagggctagtcatctgcgtgtggacccgcctgagaccggagtgtcgcacctatgccccgagccccctaagacactggtttcttccgtccatccggagcctccagatacaggcgctagtcatctctgtccagaaccgcctgagactcgagtttctcacctgcacccggagcctccagaaactggtgtgtctcacttaagacctgagccttcgaaaacacaggtgagttcactttgtcctgagcccccagaggcgggagtgagccacttatgtttggagccacctaacacccacagggtgtcgagttttctgttacaggtgttaaaactggattcagagaagaaactggaggacgctcgagctaggtgcgaaggccaagagatgacaacagaagagcttacgaagccaggaaaatatcatttctgggagtcctgtccccgtcccttcgagtctcgcatgcctcacttacggttggtcctgcccatcacgagaaggatggccagcttgtgcctcaagcccccaaaaaccaggcgcgttagtagtctgtgtcccgaaccaacaaagaccggggcttcacatctgaaagagctgtttcaagaggatactccttctaccatggaatgcgtgtctgactccttgcagcgcaggcacaccagtaggaagttgcgggactttaaatgggcaggagacctcggtgtcaacgaggagagtattagctcactctttgactttacgccagaatgccggacaacggatcaggatcaaaagattaaaaaagccaatgagtgcgcctcaagactgatgtacggcatggaactggacgatatggatgaggtggagttcctgagaataaagtactgggatcggagaagacgagccgctcctcattcatactcagcacagcgcggaagaatccggtatggaccatggtattttgagccaaaactcggcaagaaactgcggagtgacgaaccattgatagaccccaagcccgtcctggaaaagcccgacgagccagatatcttagacgggctgtacggacccattgctttcaaggatttcatactttccaaaggataccggatgcctggggttatcgagaagctcttcgcaaagaagggctggacatatgatagtgttaagaccccgattcagagagctgtccaagtgtacaaatataaggaagacgtcacggacgcctccaaggaggactag

SEQ ID NO: 56229 - DNA, 3108 bp, Artificial Sequence
  Description of Artificial Sequence: Synthetic coding sequence
atgggcgaccaacggccacaggacaggccttccagtcctggaatggactccactccatggtactgcgataaacccccttcaaagtacttcgcgaaaaggaaacaccggaggctgcgcttccctcctgtcgatactcagaactgggtttttgtaaccgaaggcatggatgattttaggtacggatgtcagtcaccggaggatacactggtgtgtaggagagacgagtttctgctccccaagatttctttacggggaccgcaagcagatcctaaatcaaggaaaaagaagctcctgaagaaagctgccctattctcaaagttgtcccccgctcagcctgccagaaaagcctttgtggaggaagttgaggctcagttgatgacaaagcaccccctggcaatgtatcctaacctcggtgaagacatgcccccagatcttctgctacaggtgcttaaacccctcgatcctgagcggaaactggaagatgctgggtcttgcgagggacaggagaaaaccaccgacgaacctacggagccaggaaaatatccctgcggcgaattttccccgaggccacccgagactcgcgttagctgtttgccccctgaacctcctaagaccccagtgagttctctgcgtcctgagccacccgagactggtgtatctcatttaaggccccagcccccaaaaacacaggtaagtagcctgcacctggagcccccagaaaccggcgtttcccacctgagacccgagcctccaaaaactcaggtgagctctcttcatctcgagcccccagagacaggcgtgagccatttatacttagagccaccaggaacaggcgtttcacacctgtgtccggaaccccctaagacccgggtttctcacctccatagggagccccctgaaaccggggttcctgatctgtgtctggagcccccaaagagccgcgttagccaccttcgacctgaaccttcagagacaggggtgtctcatctgcaccccgagccaccaaagacccttgtcagcagcctgcatcccgagcccccagaaaccggggtgtcacatctctgccctgagcctccagagacacgtgtaagtcctcttagacagctgcctcccgaggctggcgtttcccacctgtgtccagagcctccgaagacacgggtgcctcccctccgaccagaaacacccaagaacggtgtttcccctctgtttcccgagcctcccaagacgaggatttcgaacctaagaagtgagcctcccaagattggagtttcacatctctgtctcgagccacctaaaacccgtggcagccatctgcgtcctgagcccccagaaactggcgtaagccacctccggcctgaaccccctaagacacgagtgtcctccctgcatctcgagccgcctgaaactggtgtgtctcatttatgtcccgagcctcccgagaaggacgtcagtcatctacggccagagccacccgacaccggagtgagtcatctgtgtccagaacctccgaagacccgcgtttcacatctcaggcccgaaccgagtgaaacgggcgtgtctcatctgcgccctgagccacctaaaatcctagtgtcttctttacaccaagcaccacccgagagttccgtatcgcaccttcggcctgaaccgccagaaaccggcgtgtcgcacttgcgccctgaaccacctaagactcgcatgtatagccttagaccagagcctcctgatacaggagttagccacctgtgtccagaacctcctaagacaagagtgtccagcctcccacccgaacctccggagaccggggtgtcacacctctgccctgagcctcctgaaacgcgcgtgtcacatctgaggcctgaaccacccgaaacaggggtttctcatctgcgcccagaaccgcctaagacacggatgtacagcctccgcccagaaccaccaaacactggagtgtcccacctgtgtcccgagccccctaagacaagggtctcaagcctgccacctgagccaccggagacaggcgtatctcacctctgtcctgagccgcctgagactcgggtgagccacctgcggcctgagccacccgagacaggggtgagtcgacttcatcccgagcccccaaagacccgcgtctcgtctctgcatgctgagcccccagagtccagagtgtcccatttatgcccagagccccctgagaccggggtttctcatctgcgtcctgagccacctaaacctagagtgagttcgctgcggcctgaacctcttgagacgcgcgtttcccatttgagacctgagccccctgagacgggggtgagccatttacaccctgagcttcctaaacctagagtatcctctttgcatctagaaccccctaagacgcgcagagtttcctcgctgcgattagagcctcctaaaacaggcagagtctctagcctctgtcccgagcctaccaagacaggcgcaagccacctcaaagaactattccaggagggcacttccagcacaatggagtgtgtttcagactctctgcagagaaggcacacttccaggaaactcagagactttaagtgggccggtgacctaggtgtgaacgaagagtccatctcttccctgttcgactttactcctgaatgtcgggctacatatcaagaccaaaaaaacaagaaggcaaatgaatgttctagtggcttgaagtattcaatggagttggacgagatggatgaggtcaaattcttctcccaggagaaggacttggacggcaagattcagaatgctcctaatagccactcggcccagcacgtgaaaatgggttacggcgcttggtacctgaagcctaaactcggcaagaaattacgaagcgacgagcctctcattgaccccaagctggtgctcgaaaaaccagacgagccggacattttagacggtctctacggtcccatcgccttcaaagactttatcctttcaaagggatacgagatgccgggtatcatccaacgactatttgctcgaagaggctggacatatgacagtgtgaagacaccgattcagcgggctatgcaggtgtacaagtacaaggaagacgtgacggatgcttcggaggaagattag

SEQ ID NO: 56230 - DNA, 888 bp, Artificial Sequence
  Description of Artificial Sequence: Synthetic coding sequence
atgcagatgtcggtgccctgcgttctgtcaagcctccaaaatcatgagccaaataagccactgtttacaacccagtcccaactcctctctaaggtgctggaggtgctggatccggaccggaaactggaggacacctgggcttattgccaagacacccggaaaggaatgaaggaacccacgaaacttttgaagaagcactcgacccaggtgtacctgggccctagcaaaaagaccagtgtgtcgaacgccggtcagtggctatacgaagaaaaaccccataagatggatctcctccacgagaacggcccacggcctggcttacatgagaatgtgtgcaaggccgtgagcgatttctgtaagtgggtgacaaccttcggcataagtgacattgatgaggagttcattcttaaacaatttgacatcgattatgaaacaaaaccctctcacgacgccctccacacaatgaaacttaatcaagtgcctttggaattgaagcgttctgtggggttgagcaagctgcaggagaccgaattttttcagaagctgggctacgagcgaaagctccagaagcctcagaacccttacaagcccaagtgggtcaagatgagatatggagcctggtacttgaatccaaagctatggaaaaagcaacgagtggatgaacccctggtcgatcctgaggtttctcacaaagcacaggaggagaacttcaagaaggaactgcaggaacaggaggaactgctcgcagacctgcatggtacggtggccttcaaggattttatactgagccgtgggtaccggacccccaggtttctagagaacatgtatatcggcaaggagtgcaagcgagcctgtaacaagacccccataaagcgaacccaggcatag

SEQ ID NO: 56231 - DNA, 1182 bp, Artificial Sequence
  Description of Artificial Sequence: Synthetic coding sequence
atggcagataggcggaggcggttaaggccgggaactctagctcccgttagagaaggagtgaactgtcgtagcagatgctttacaaagcacaagaatgggctcaaattcccaacatccttacattcaagacagctggtctttcctcgtaaaggactagatgattttaggaagggatgtccaccctgtacagggcttgtgacccaggtgccagttgaagggttcctgccacaaatctaccacagggcgcctcagcttgccccaaagaagagacaaataaaacttctgaaggaggccgacgtgttaagcaaattgtcccctgcccaacaggctaggaaggctttcctggaggatgttgaagcgcatctaactccccatcctctggctttatatcttaatttagaagaggcaatgcctatagagctgctcagcaaggtgctggaagtgctcgaccctgacagaaaactagaggatacgtgggcctactgccaggataccagaaaagggatgaaggaacccacgaaacttcttaagaaacactctacccaagtttacctgggcccttctaagaaaaccagtgtctcaaacgcgggtcagtggctgtatgaggagaaaccgcataaaatggacctattacacgagaacggccctagaccgggactacatgagaatggcatctcggatattgatgaggagtttatcctgaaacagtttgacatagattatgaaactaagccttcccatgacgccctgcacactatgaaactaaaccaggtgcccctggagctgaagagaagtgtggggctctctaaactgcaggaaaccgaattttttcagaaactcggatacgagagaaaactacagaaacctcagaatccatataagcccaagtgggtcaagatgaggtatggcgcttggtacctgaatcctaagctatggaaaaagcagcgggtagacgaacccctcgtggaccctgaagtgagtcataaagctcaggaagagaatttcaaaaaggagctgcaggaacaagaggaacttctggctgatctgcatggcacagtagcatttaaggacttcatactaagccgcggatatcggacacctagatttctggagaacatgtacatcggcaaggaatgcaagagggcttgcaataagacccccattaagcggacccaagcctag

SEQ ID NO: 56232 - DNA, 972 bp, Artificial Sequence
  Description of Artificial Sequence: Synthetic coding sequence
atgggaaatctcctgaaagtcctgacacgtgagatcgagaattacccacatttctttttggatttcgaaaatgcccagcctactgaaggagaaagagaaatctggaaccagatttcagcagtgctgcaggatagcgaaagcattctcgcggatcttcaagcctacaagggcgcaggcccagaaatcagggacgcaatacagaatccgaacgatattcagttgcaggagaaggcttggaatgcagtgtgtccccttgtggtgaggcttaagcgcttttacgaattctccattcggctggagaaagcgctccagtcactgctggaatctctgacttgcccaccctatacacccacacaacaccttgaacgggaacaggcgctggcaaaagagttcgcagagattctgcatttcactctccggttcgacgagttgaagatgcgcaatccagcgattcagaacgactttagctactatcgcagaactatttcaagaaacagaattaacaacatgcacttggatattgaaaatgaggtcaacaacgaaatggctaataggatgagcctcttttacgcagaagccactcccatgctcaaaaccctgagcaatgcaactatgcattttgtctctgaaaacaaaacattacccatcgagaatacaacagactgcttgagtaccatgacttccgtgtgtaaggttatgctcgagacacccgagtacagaagtcgcttcacaagtgaagagaccttgatgttttgcatgagggtgatggtaggagtgatcatattgtatgatcacgtccacccagttggagccttctgtaaaacttctaaaattgacatgaaaggatgtataaaggtcttgaaggagcaagcacctgattctgtagagggactcttaaatgccctccggtttaccactaaacaccttaacgacgaatctaccagcaagcaaatccgtgccatgttacagtag

SEQ ID NO: 56233 - DNA, 972 bp, Artificial Sequence
  Description of Artificial Sequence: Synthetic coding sequence
atgggaaatttgctgaaagttctcaccagagagatagaaaattatccgcacttctttctggactttgaaaatgcgcagccaacagagggagaaagggagatttggaatcagattagtgcagtcctccaggactccgagtccattttagccgaccttcaggcctataaaggtgccggacccgagatacgcgacgctatacagaacccgaacgatatccaattacaggagaaagcctggaatgccgtctgccctttggttgtaagactgaaaaggttctatgaattttccattaggctcgagaaggctcttcaaagcctgttagaaagcctgacatgtcctccatacactcccactcagcacttggagcgcgagcaggccctggccaaagaattcgctgagatactgcatttcacactccgcttcgatgagctgaagatgcgcaatcccgcaattcagaatgacttctcatattacaggcgtacgatttccagaaacagaatcaataatatgcatctggatattgagaacgaggtaaataatgagatggccaaccgtatgagcctgttctacgccgaagccacgcctatgctgaaaaccttgtcaaacgcaactatgcatttcgtctctgaaaataagacgctgcccatcgaaaacactacagattgtcttagtaccatgacatcagtctgtaaggtcatgctggagacccctgagtatagatcacgctttacaagtgaagaaactctgatgttttgcatgagagtgatggtgggagtgatcattctttatgaccacgtacatcccgtgggcgcattttgcaaaacaagcaagatcgacatgaagggatgtatcaaagttttaaaggagcaagctccggacagtgtggaggggttgcttaatgctttacgatttacgaccaagcatcttaatgatgagagcacaagtaagcagatcagagccatgttacagtag

SEQ ID NO: 56234 - DNA, 972 bp, Artificial Sequence
  Description of Artificial Sequence: Synthetic coding sequence
atgggcaacttattgaaggtgctgacaagggagattgagaattacccccattttttcctggacttcgagaatgcacaaccgacagagggggagcgggaaatctggaatcaaatcagtgctgtcctccaggattcagagtccatattagccgacctgcaggcctacaaaggagcaggcccagaaattagggacgcaattcaaaacccgaatgatatacaactgcaggagaaggcctggaatgccgtctgtcccttggtggtccggctgaaaaggttttacgaattttctattcgtttggagaaagcattgcagtccctcttggagtctctgacttgtcccccatacactccaacgcagcatctagagcgagaacaggccttggcaaaagagtttgctgagatcctccactttaccttgcggtttgacgagctgaagatgagaaaccctgccattcagaatgacttctcatattatagacggacaattagccgcaatcggattaataacatgcacctggacattgaaaatgaggttaataacgagatggcgaaccgcatgtcactgttctacgccgaggctacccccatgttaaaaacgctgtctaacgcaaccatgcactttgtcagtgaaaacaagacgctcccaatcgaaaacacgaccgactgtctgtctaccatgacctccgtatgcaaggtcatgctggagacgcccgaataccgcagcaggtttacctctgaagaaactctcatgttttgcatgcgcgtgatggttggcgtgatcattctgtatgatcacgtccaccctgttggagctttttgcaagacaagcaagatcgacatgaagggttgcatcaaagtcttgaaagagcaggcgcctgattctgtggaggggctgctcaatgcactacgattcactacaaaacatttaaatgatgagagcaccagtaaacagatccgcgctatgctccaatag

SEQ ID NO: 56235 - DNA, 285 bp, Artificial Sequence
  Description of Artificial Sequence: Synthetic coding sequence
atgggtaacctcctgaaggtgcttactcgagagatcgagaactacccacacttcttcttggactttgaaaatgcacaacctactgaaggcgaacgagagatttggaatcagatcagtgccgtgttacaggattcagaatcgattttggcagacttacaagcgtataagggcgctgggcctgagataagagacgcgatacagaaccctaatgacatccagctccaggagaaggcctggaacgcagtctgcccgctagtagtgcgactgaaaagattctacgagtag

SEQ ID NO: 56236 - DNA, 264 bp, Artificial Sequence
  Description of Artificial Sequence: Synthetic coding sequence
atggggaatttgctgaaggttctaactcgggaaatagaaaattacccacacttctttcttgactttgagaacgcccagccgacagaaggggagcgggagatttggaaccaaataagcgccgtgctacaggattccgagtcaattcttgctgaccttcaggcttataaaggggcaggcccagagatacgggacgcaatacaaaatccgaacgatatccagctccaggagaaggcatggaatgccgtgtgtccactcgtggtctag

SEQ ID NO: 56237 - DNA, 654 bp, Artificial Sequence
  Description of Artificial Sequence: Synthetic coding sequence
atgcagaaagcgagttggagaacctgttcccacacagaggagcttgcaactaagtacgagcgcgctatacagcatcccgctgatgagaagttgcaggagaaagcatggggggcagtggtgcccttagtcgggaaagaaatactcagaatcttctctgaggtgcgcagcagcataaagagatcatctggctctctgaacaagtatcctattttctctcatcccgcttctagggctcgacaggccctggcaaagcagttcgccgagatcctacactttaccctcaggtttgatgaactgaaaatgaccaacccggctatccagaacgacttttcatactacaggcgcaccctatccaggatgagaattacaatgtatcgagccgaaggggagaatgaagtgaataacgagctggctaaccgaatgagcctcttttatgctgaagccacacccatgttgaagaccctttctgacgcgaccacaaagttcgtgtctgagaacaagaacctcccaattgagaataccacagattgtctgtctaccatggcatccgtgtgtagagttatgctagagacacctgagtaccggagcaggtttacaaacgaggaaactgtatccttcctggaaggcaacggagggtgccacaacaccctttag

SEQ ID NO: 56238 - DNA, 975 bp, Artificial Sequence
  Description of Artificial Sequence: Synthetic coding sequence
atgggcaatctgttaaaggttttgacgtgtacagacctggagcagggccctaactttttcctcgacttcgaaaatgcacagcccacggaatctgagaaagagatttacaatcaggtcaatgtggtgctgaaagatgccgagggaattctggaagaccttcagagctatagaggggcaggacatgaaattcgtgaggccatccagcacccggcagatgagaagttgcaggaaaaggcctggggcgcagtggtccctctagtagggaaactgaaaaaattctatgaatttagccaaagactggaggcagcattgcgtggcctgcttggagccctgaccagcaccccatatagcccgactcagcatctagagagagagcaggctctggctaagcagtttgcagaaattctacacttcacactgcgctttgacgagctaaagatgacaaatcctgccattcagaacgacttctcttactatcgcaggaccctttcccgcatgaggatcaataatgttcccgcagaaggtgaaaacgaagtcaataacgaactcgcgaatcgcatgtcattattttatgctgaagctacaccgatgctgaaaaccttatcagatgctaccacgaagttcgtctctgagaacaaaaatctcccaatcgaaaacaccaccgattgcctgtctaccatggcatcagtttgtcgggtcatgctggagaccccggaatatcgcagcaggttcactaatgaagagacagttagcttttgtctacgggtgatggtgggtgtaattatcctttacgaccatgtgcaccccgtcggagctttcgcaaagacctcaaaaatcgacatgaagggctgtatcaaagtcctgaaagatcagccacccaactctgtggaaggccttctgaatgctctgaggtacactaccaagcacctgaatgacgaaacaacgtccaaacagataaaatctatgctccagtag

SEQ ID NO: 56239 - DNA, 975 bp, Artificial Sequence
  Description of Artificial Sequence: Synthetic coding sequence
atgggcaatctgctcaaggtgctgacctgcactgatctggaacagggcccaaacttcttcctcgactttgagaatgcacagcctactgagtctgaaaaggagatctacaaccaggtcaacgtggtgctcaaagatgccgagggaattcttgaagacttacaatcttatagaggggcagggcatgaaattcgtgaagctatacagcaccccgctgatgagaagctccaggagaaagcgtggggggctgtagtccccttggtcggcaaattgaagaaattctatgaattctctcagcgcctggaggccgcactgcgcggtctgctcggcgcactcaccagcacaccatacagccccacgcaacatcttgagcgcgagcaggcactagccaaacagttcgcggaaattctacacttcacacttaggtttgatgaactgaagatgaccaacccggctatccagaacgacttctcctactacagacggacactgtcgagaatgagaattaataacgttcctgcagagggagaaaacgaggtaaataacgagttggcaaaccgaatgagtctgttttatgccgaggccacccccatgctcaagaccctctccgacgcaacaaccaaattcgtatccgagaacaaaaatctgccgatcgaaaacacaacagactgtctttccacgatggctagcgtgtgccgggtgatgttggagacccctgaataccgctccaggttcaccaacgaagaaacagtcagcttctgcctgcgcgttatggtgggagtcataatcttgtatgatcacgtgcacccagtcggtgcctttgctaaaacttctaaaatcgatatgaaagggtgcattaaggtgctgaaagaccagcccccaaactccgtggagggattgctaaacgccctccggtacaccaccaaacatttgaatgatgaaacgaccagcaaacagatcaaaagcatgcttcaatag

SEQ ID NO: 56240 - DNA, 192 bp, Artificial Sequence
  Description of Artificial Sequence: Synthetic coding sequence
atggggaatcttttgaaagtccttacttgcacagatcttgagcagggcccaaactttttccttgattttgagaacgctcaaccgaccgaaagcgagaaggaaatttacaatcaggttaatgtcgtcttgaaagacgctgaaggtatcctcgaggacctgcagtcgtatcgcggagccggtcatgaaatctag

SEQ ID NO: 56241 - DNA, 198 bp, Artificial Sequence
  Description of Artificial Sequence: Synthetic coding sequence
atgggcaacctgttgaaggttctgacgtgtacagaccttgagcagggtccaaacttctttctggatttcgaaaacgcccagcccaccgagagcgaaaaggagatttataaccaggtcaatgtcgtgttgaaggatgccgaaggcatcctcgaagacctccaaagttatagaggcgcaggtcacgaaatcagagaatag

SEQ ID NO: 56242 - DNA, 297 bp, Artificial Sequence
  Description of Artificial Sequence: Synthetic coding sequence
atgggcaatcttctgaaggtccttacatgcacagacttagaacagggccctaatttttttctggactttgaaaacgctcagccaacagagagcgagaaagagatctacaatcaggtgaacgtggtgcttaaggatgctgaagggattctcgaagatctccagagctatagaggtgccggacacgagatccgggaagccatccagcatccagcagacgagaagttgcaggaaaaagcttggggcgcagtggttccgctagtgggcaagttgaagaagttctacgaattctctcagtag

SEQ ID NO: 56243 - DNA, 207 bp, Artificial Sequence
  Description of Artificial Sequence: Synthetic coding sequence
atggggaatctgcttaaagtgctaacctgtacggatctggagcagggcccaaacttcttcctggatttcgagaacgcacagcctaccgagtctgaaaaagagatttacaaccaggtaaacgtggtgctcaaggatgctgaaggcattctggaagacttgcagagctataggggagccggacacgaaattagagaagccatccaatag

SEQ ID NO: 56244 - DNA, 147 bp, Artificial Sequence
  Description of Artificial Sequence: Synthetic coding sequence
atgggtaacctcctcaaggtcctaacttgtaccgatctcgagcagggacccaatttctttctcgattttgaaaacgctcagccaactgagagcgaaaaggagatttataaccaggtcaacgtggtcctcaaagacgcagagggctag

SEQ ID NO: 56245 - DNA, 975 bp, Artificial Sequence
  Description of Artificial Sequence: Synthetic coding sequence
atgggtaatctgttaaaagtgctgacatgcaccgatctcgagcagggcccaaacttcttcttagacttcgagaacgctcagcccactgagagcgagaaggaaatttacaatcaagtgaatgtcgtactaaaagatgcggagggtattcttgaagatcttcagtcctaccgtggagcgggtcacgagatacgggaggccattcagcaccctgccgatgaaaaacttcaagagaaagcttggggcgctgttgttcccctggtaggtaagctcaagaagttctacgaattctcacagcgcttggaggccgcactcaggggccttctaggcgctctcacatccaccccctacagtcctacacagcaccttgaaagggagcaggccctcgcaaaacaattcgccgagatcttacactttaccctgaggttcgacgaactgaaaatgaccaaccccgctattcagaatgattttagttactatcgtaggaccctgtccagaatgagaatcaataatgttccagcagagggcgagaatgaagtgaacaacgagcttgcaaataggatgtctctattctatgcagaggcaacgcccatgttgaagaccctcagcgacgctacaaccaaattcgtgagtgagaataaaaacctgccgattgagaacaccaccgactgtctgtcgactatggcatctgtgtgtcgagtcatgctggagaccccggagtacaggagtagatttacaaatgaggagacggttagtttctgtctgagggtcatggttggggtgattatcctctacgaccatgttcacccagtcggtgctttcgctaaaacatctaagattgatatgaaggggtgtatcaaggtcctgaaagatcaacccccaaattctgttgaggggctgctgaacgcgctcaggtacaccaccaaacatctgaacgatgagaccacgtcgaagcagatcaaatcaatgttacagtag

SEQ ID NO: 56246 - DNA, 468 bp, Artificial Sequence
  Description of Artificial Sequence: Synthetic coding sequence
atgggcaatttactgaaggtgctaacatgtaccgacctcgagcaaggcccaaacttcttcttggattttgaaaatgcacagcccacagaatcggaaaaggaaatttacaaccaggtcaatgtcgttctaaaagatgccgagggcatattagaggatctgcagagctatcgcggagcaggacacgaaattagagaggctatacagcacccagcagatgagaagctccaggaaaaggcctggggcgctgtcgtaccactggtgggtaagctgaaaaagttctatgaattctcacagagactggaggccgctctgaggggactcctaggcgcactgacatctaccccttacagtccaacgcaacatctggagcgagagcaggctctagcgaaacagttcgccgagatcctgcactttaccttaagatttgacgagttaaaggtggaactgtctataggcccagactgctag

SEQ ID NO: 56247 - DNA, 975 bp, Artificial Sequence
  Description of Artificial Sequence: Synthetic coding sequence
atgggtaatctgctgaaggtcctaacatgtacagatctggagcagggtcccaatttctttttggattttgagaatgcccaacccacggagagcgaaaaagagatatataaccaggtgaacgtcgtcctcaaggatgccgaggggattctcgaggatctgcagtcttataggggggctggacacgagatccgcgaagccatccagcacccagcagatgagaagctccaggagaaggcctggggagctgtcgtgccgctggtggggaaacttaagaagttctatgaattcagccagcgcctggaagccgctctgcggggtctactaggtgctctgacaagtacaccatactcgccaacccagcacttggagagagagcaagccctcgccaagcagtttgccgaaatacttcactttaccttaaggtttgacgaactgaaaatgacaaatcctgccatccagaacgacttcagttattatagaaggacactgtcccgcatgcggataaacaacgttccagctgaaggagagaacgaagttaacaacgaattggctaatagaatgtctttattctacgccgaggccaccccaatgttaaagactttgtctgatgcgaccactaagttcgtgagcgagaacaagaaccttccaatcgaaaataccaccgattgtttatctacaatggcatcagtatgcagagttatgttggaaacacctgagtatagaagtagattcaccaatgaggaaaccgtttccttctgcctcagggtgatggtaggagtcatcatcctctacgatcacgtgcatcccgtgggtgccttcgcaaaaacctccaaaattgatatgaagggctgcatcaaggtgctaaaggaccagccacccaacagtgtggagggactgctgaatgctttacggtacactaccaagcacctgaatgatgagaccaccagcaagcaaataaagtcgatgctgcagtag

SEQ ID NO: 56248 - DNA, 975 bp, Artificial Sequence
  Description of Artificial Sequence: Synthetic coding sequence
atggggaaccttctgaaggttttgacctgtaccgacctagagcaggggcctaacttttttctggatttcgagaacgcccagcccactgaatctgaaaaggagatctataatcaggtgaatgttgtacttaaagacgccgaggggattctagaggatttgcagtcctatcgcggtgctgggcacgaaattagggaggccatccagcaccccgcagacgagaaactgcaggaaaaggcatggggggcagtggtcccgctcgtgggcaagctgaagaaattttacgaatttagtcaacggctggaagcagcattgaggggcttgctcggcgctttgaccagcaccccatacagccccacgcagcacctggagcgtgaacaggccctggcaaaacagtttgccgagatacttcacttcaccttacggttcgatgagcttaagatgaccaaccctgctatccagaacgatttcagctattatagacgcactctgagtagaatgagaatcaacaatgtaccagccgagggggaaaatgaggtgaataacgaactcgcaaatcgcatgagcctgttctacgcagaggctacacccatgcttaaaacgctgtcggacgccaccacgaaattcgtgagtgagaacaaaaacctacctatcgagaataccaccgactgtctcagcaccatggccagcgtgtgcagagtaatgctggaaactccggagtaccggagtcgattcacaaacgaggagaccgtttcgttctgcctgagagtcatggttggcgtcataattctctacgatcacgtccaccctgtgggagcgttcgccaagacttctaagattgacatgaagggctgcataaaggtgctgaaagatcagcctccgaatagcgtggagggcctcctgaatgccctaagatacaccactaaacacctcaatgatgaaaccacctcaaaacagataaagagcatgttgcagtag

SEQ ID NO: 56249 - DNA, 303 bp, Artificial Sequence
  Description of Artificial Sequence: Synthetic coding sequence
atgggcaatctgttaaaggtcttgacttgcacggacctagagcagggtcctaacttttttcttgactttgaaaacgcccagccaaccgagtcagagaaagagatttataaccaagtgaacgtcgtgctcaaagatgcagagggcattttggaggaccttcagtcctacaggggggctggccacgagatcagggaggccatccaacaccccgctgatgagaaactacaggagaaagcctggggcgcagttgtcccactcgttgggaagttgaaaaagttttatgaattttctcagaggctctag

SEQ ID NO: 56250 - DNA, 240 bp, Artificial Sequence
  Description of Artificial Sequence: Synthetic coding sequence
atgggcaatcttctgaaggtcctcacatgcacggacctggaacagggcccaaattttttcctggattttgagaacgctcagcctactgagtctgagaaggagatttataatcaggtgaatgttgttttaaaagacgcggaaggtatcctggaagacctgcaatcctatcggggtgccggacacgagattcgggaagctattcagcaccccgcagatgagaagcttcaggagaaagcatag

SEQ ID NO: 56251 - DNA, 141 bp, Artificial Sequence
  Description of Artificial Sequence: Synthetic coding sequence
atggggaaccttctcaaggtgttgacgtgtaccgatctagagcagggccctaatttctttttagacttcgagaacgcgcagcccacggagtctgaaaaggagatatacaaccaggtgaacgtagttctgaaggacgcgtag

SEQ ID NO: 56252 - DNA, 975 bp, Artificial Sequence
  Description of Artificial Sequence: Synthetic coding sequence
atggggaatctgctaaaggtgctcacttgcaccgatctcgaacaggggcctaacttctttctcgactttgagaatgcccagcctaccgagtcagaaaaggagatatataaccaggtgaatgtcgtgttgaaggacgcagaaggaatcttggaggacctgcaatcttacaggggagccggacatgagattcgagaggccatccagcaccccgctgacgagaagctgcaggagaaggcttggggcgctgtggtgccactcgttggaaaattgaagaagttttatgagttttctcaaaggttggaggccgctctgagagggctgcttggcgcactgactagtactccctactcccccacacagcatctggaaagggaacaggctttggccaaacaatttgcagagattctccattttaccttgcgattcgacgagctgaagatgactaaccctgctatccaaaatgactttagttactatcgcagaactctgtccaggatgcggattaacaatgtgccagcagagggagaaaacgaggtgaataatgaactagctaatcgaatgtctcttttctatgcggaagccactcctatgttaaaaaccctgagcgacgctaccaccaaattcgtgtctgaaaacaaaaatttgccaatcgagaacactacagactgcctgagtactatggcaagcgtgtgtcgagtgatgttggagactccagaatacagatcaagattcactaatgaagaaacagtctccttttgcctgagggtgatggtgggggtgattattctgtatgaccatgtgcaccctgtgggagctttcgctaagacaagcaagatcgacatgaaggggtgtattaaggtgctgaaggaccagccacctaacagcgtggagggattgctcaacgcccttaggtatacaacgaaacatctgaatgacgaaacaacctcaaagcaaatcaaatcaatgttgcaatag

SEQ ID NO: 56253 - DNA, 975 bp, Artificial Sequence
  Description of Artificial Sequence: Synthetic coding sequence
atgggaaatctgctgaaggtcttgacctgtacggatttagaacaaggtcctaatttttttctggactttgagaacgcccaaccgactgagtccgagaaagagatttacaaccaggtgaacgtagtgctcaaagacgccgaagggatcctcgaagacctccagtcctatagaggggctggacatgaaattcgagaggccatccaacacccggctgacgagaaactgcaggagaaagcatggggtgccgtggtgcctcttgtcggaaaactcaagaaattctacgagttttctcaacgcttagaggctgcccttcggggactgctgggcgcactcaccagtacaccttattcaccaacacagcacttggaaagggaacaagccctggccaaacagttcgcagagattcttcactttaccctgagattcgatgaactgaagatgacaaaccccgctattcagaacgatttttcttattaccgcaggacactttccagaatgcggattaataatgtacccgctgagggggagaacgaggtcaacaacgagctggccaacagaatgagcctcttttatgcggaggccacacccatgctcaagaccctttctgacgcaactacaaagtttgtgtctgagaataagaaccttccgatagagaacaccacggactgtctcagcactatggcgagtgtgtgccgcgtcatgctcgaaacgcctgagtaccgatctcgcttcactaacgaggagaccgtgagcttctgtctgagagtgatggtaggggtgatcatcctgtatgaccatgtccaccctgttggtgccttcgccaagaccagcaaaatcgatatgaaggggtgcatcaaggtgttgaaagaccagcctcctaactcggttgaaggtctccttaatgcactgcggtatacgacaaaacacctaaatgacgaaactaccagcaagcagattaagagcatgttacagtag

SEQ ID NO: 56254 - DNA, 282 bp, Artificial Sequence
  Description of Artificial Sequence: Synthetic coding sequence
atggggaacttactgaaagtgctcacctgcactgaccttgaacagggccctaacttcttcctggacttcgaaaatgctcagcctaccgagagcgaaaaggagatctacaaccaggttaatgttgtcctgaaagatgcagagggaatcctcgaagatctccagtcgtaccgaggggcaggccacgaaattcgcgaggccattcagcatcctgccgatgagaaacttcaggagaaggcctggggcgctgtcgtcccactggtgggaaaactgaagaagttctag

SEQ ID NO: 56255 - DNA, 978 bp, Artificial Sequence
  Description of Artificial Sequence: Synthetic coding sequence
atggcccaatataaagggacaatgcgtgaagccggacgcgctatgcaccttttaaaaaaacgggagcggcaaagggagcagatggaggtgctgaagcaaaggatcgcagaggagactatccttaaaagccaagtagataaacggttctccgcacactacgatgccgtggaagccgaactgaagagctccacggtgggacttgtgacgttgaacgacatgaaagcacggcaggaggccctagtgcgggaacgcgaacgacagcttgccaagagacaacatctggaagagcagaggctgcagcaggagcggcagagggaacaggagcagaggcgtgaacgtaagcgtaagatcagttgtctgtcattcgcactagatgatttggacgaccaggcagatgccgctgaagctagacgcgctggaaacctggggaaaaatccagatgtggacactagtttccttcccgatagagaccgcgaagaggaagagaacaggctaagggaggaactcaggcaagagtgggaagcacagcgagagaaagtcaaagacgaagagatggaggtgaccttttcttattgggatgggtctgggcatcgtaggaccgtacgggtcaggaaggggaacaccgtgcagcagttcctgaagaaggccttgcaagggcttaggaaggatttcttagaattaagatctgcaggagtcgagcagctgatgttcatcaaagaagaccttattctgccacactatcacacattctacgattttattattgctcgtgcaagggggaagtcaggccctcttttctcattcgatgtgcatgatgacgtgcgcctgttgtcggacgcaactatggagaaagatgaatcccatgccggaaaggtggtactgcgctcttggtatgaaaaaaacaagcacatttttcctgccagccgctgggaggcatatgaccctgaaaaaaaatgggacaaatataccatcagatag

SEQ ID NO: 56256 - DNA, 978 bp, Artificial Sequence
  Description of Artificial Sequence: Synthetic coding sequence
atggctcagtataagggaacaatgcgagaggcaggtagggccatgcacctgctcaagaaaagagaaaggcagcgggagcagatggaagtgcttaagcagaggatcgccgaggagactatccttaagtctcaggttgacaagcgctttagcgctcattacgacgctgtagaagctgagctaaagtcctccactgtgggcctggtcaccctcaacgacatgaaagcacggcaggaagctctcgttcgcgaaagagaaaggcagctcgctaagaggcagcacctggaagaacagagactccaacaggagcgacagagggaacaggaacagcggagggaacgcaaacgcaagatcagttgtctgtcttttgctctggacgatctggatgatcaggcagatgcagccgaagcgcgaagagcgggtaatctcggcaagaatcccgacgttgatacctcctttctgccagacagagatagggaagaggaagagaatcgactgcgcgaggaactaaggcaggagtgggaagctcagcgggaaaaggtgaaggacgaggagatggaggtgacttttagttactgggacggttcagggcacaggagaactgttagagtgcgaaaggggaataccgtccagcagtttctgaagaaagccttgcagggcctgcggaaggattttcttgagctgcgctccgcaggcgttgagcagctgatgttcattaaagaggatctgattctgccgcactatcacacattctacgactttatcatcgctagagccagagggaagtctggcccactcttcagtttcgatgtgcacgatgacgtgcggctcctgagtgatgcgactatggagaaggacgaaagtcacgcagggaaggttgtgcttagatcctggtacgagaagaacaagcacatttttccagcctcccgctgggaggcctatgacccggaaaagaagtgggataagtatacaataagatag

SEQ ID NO: 56257 - DNA, 1269 bp, Artificial Sequence
  Description of Artificial Sequence: Synthetic coding sequence
atggtgatggtcttaagcgagtctctgtcaactaggggcgctgactccatcgcttgcggcacattcagtagggaacttcacacccctaagaagatgtctcaagggccaacccttttctcttgtggcataatggagaacgatcgatggcgggacctggatagaaagtgcccactccagatcgatcagcccagtacaagcatctgggagtgtctcccggaaaaagattctagcttgtggcatcgggaagcggtgaccgcatgcgctgttacatcccttattaaggatctgagtatctcggatcacaacggcaatccatccgcgccacccagtaagaggcaatgtcggagtctttcattttcggacgagatgtcttcctgccgcacttcatggcggcctctcggatctaaagtgtggacccctgtcgaaaaaagacgatgctactctggaggcagcgtccagcgttactcgaacggcttctctacaatgcagagatctagcagctttagtctgcctagcagagctaacgtactgtcctccccatgcgaccaagccggacttcatcaccgatttgggggtcagccatgccagggtgtcccgggttctgccccttgcgggcaggcaggggacacgtggagtcctgacctgcacccagtcggtgggggaaggctggatctgcagaggtctctgtcctgttctcacgagcagttttcattcgtggagtactgtcccccatcagccaattccactccagctagtacccctgagctcgccagacgttcaagcggcctgagcagaagtagatcacagccctgcgtccttaatgataagaaggtgggagtgaagcggaggcgccctgaggaagtccaggaacagagaccgagcctggatttggccaagatggctcagaactgccagacctttagctccctgagctgcttgtccgccggaaccgaggattgcgggccacagtcgccatttgcaagacatgtgtctaacacacgggcatggacagctctgctttccgcctctggcccagggggtcgtactccagccggaactccagtcccagagcccctgccaccctcttttgatgaccacctggcttgtcaggaagatctttcttgcgaggagtctgactcctgtgcacttgatgaagactgcggtcggagggccgagcccgctgccgcatggagagatcgaggcgctccgggaaactcgctgtgtagtctggacggcgagctggacattgaacagatcgagaaaaattag

SEQ ID NO: 56258 - DNA, 1269 bp, Artificial Sequence
  Description of Artificial Sequence: Synthetic coding sequence
atggtaatggtgctgagtgaatcactttcaactcgaggtgcagattccatcgcttgcggaactttctccagggagctgcacacccctaagaagatgtcccaaggtcctacgttgtttagctgcggtataatggaaaatgatcgatggcgcgatctcgacaggaagtgccccctccagattgatcagccatccacttctatctgggagtgcctgcccgagaaagattcatctctgtggcatagggaagcagttacagcctgtgccgtaacttcattgattaaagacctgagtatcagcgaccacaacggtaatccttccgcgccacctagtaaaagacagtgcaggagcctgtcattctcagacgagatgagttcatgtagaacttcctggaggcctctgggtagtaaggtctggacgccagtcgagaagcgacgctgctactctggtggcagcgtccagagatattcaaacgggttttcaaccatgcaacgcagctcatccttcagtctcccaagccgggcaaatgtgttatcaagcccctgtgatcaggcgggattacaccaccgcttcgggggacagccttgtcaaggtgttcctggcagcgcgccatgcggacaggcgggagatacatggtcacccgacctgcatcccgttggaggaggcagattggacctccagcgttctctgagctgctcccacgaacagttctcttttgtcgagtattgccctccatcagccaactctaccccggcatccacaccagagctcgcaagaaggagcagtggcctcagtagatccagatcccagccctgtgtccttaatgacaaaaaagtgggggtcaaaagaagaagacctgaggaagtccaggagcaaagaccctccctggacttggcaaagatggcacagaattgtcaaactttcagctctctctcttgtctttctgccggaacggaggattgcggaccacagtcgccatttgccaggcacgtcagtaataccagggcctggactgccctgctgagcgcatcaggccctggcggacgaaccccagccggaacccctgtgccagaaccactgcccccatcttttgatgaccaccttgcctgtcaggaagacctgagttgtgaagagtccgattcctgtgctttggacgaagattgcgggaggagagccgagccagctgccgcatggcgcgaccgcggtgcccctggcaattccctatgcagcctggacggagaacttgatatagagcagattgaaaaaaactag

SEQ ID NO: 56259 - DNA, 1179 bp, Artificial Sequence
  Description of Artificial Sequence: Synthetic coding sequence
atgattacattgatcaccgagcaactgcagaagcaaaccttggacgagttaaagtgcacaagattctcaatttcattaccgctccccgaccacgccgacatttcaaattgcgggaattcctttcagttagtgagcgaaggcgcatcctggcgtggactgccacactgctcatgcgcagagttccaagactccctgaattttagttaccatccatccggactctccttgcacctacgccctcctagtagagggaactctcctaaagaacagcctttctcccaagttctccggcctgagccccctgacccagaaaagctgcccgttccccctgcacctccttccaagcggcattgccgctccctaagcgtgcctgtggacctgtctcgctggcagcctgtgtggcggccagccccttcaaaattatggacgcccatcaagcaccggggaagcggaggcggtggaggtcctcaggtgccacaccaaagccctcctaaaagagtcagctcactcaggtttctgcaagccccatcagcctcgtcccagtgtgccccagctcataggccttacagtcctccctttttcagcctagcccttgctcaggattccagtcggccttgtgcggcaagtccgcagtccgggagctgggagtcggatgccgagtccctttctccttgcccaccccaaaggcgcttctcactatccccatcgctgggcccacaggctagccgattcctcccctctgccagatcctctcctgcctccagccccgagctgccttggcggcctcggggtctgcgtaacctccctcgctcacgttcccagccatgtgatctcgacgcgagaaaaaccggagtcaaacggagacacgaggaggatcctcggaggctccggccatcccttgacttcgataaaatgaatcaaaagccttattcaggtggcttatgcctgcaggaaactgcacgggaggggtcttcaatctctcccccatggttcatggcttgttcaccaccgccactgtccgctagctgttctccaacagggggatccagccaggtgctctctgagagcgaggaggaagaggagggtgccgtacgttggggcaggcaggctctgtctaagcgtacattatgtcagcgcgatttcggcgacctcgacctgaacctcattgaggagaactag

SEQ ID NO: 56260 - DNA, 1179 bp, Artificial Sequence
  Description of Artificial Sequence: Synthetic coding sequence
atgatcacattaatcaccgagcagctacagaagcaaacactggatgaactgaaatgcactcgcttttcaatttcactgccgttgcccgatcatgccgacatcagtaattgtgggaattctttccagctagtgtccgagggtgcatcatggcgcggactgccccactgcagctgcgctgagttccaggactctttaaacttttcttaccatccttcaggactgtctctgcacctgaggcctcccagccggggtaatagtccaaaagagcagcccttttcccaagtcttacgccctgaaccccctgaccccgagaagctgcccgtgccaccggcacccccttccaaacgtcactgccgttccctgtccgttccagtggatttgtcacggtggcaaccagtgtggaggcccgctccttctaaactgtggacacccattaagcatcggggaagcggtggaggcggaggtccccaagttccacatcaatcacccccaaaacgcgtctcctctctgagatttctccaagcaccaagcgcctcttctcagtgcgcacccgctcatcggccatacagtcctcctttcttctccctagctttggctcaggattccagccggccatgcgctgcgtccccccaaagcggtagttgggaatccgacgctgaatccttgtcgccttgtcccccacagcgaaggtttagtttgtcaccttccctgggtccccaagccagcagattcctgccttctgctaggtcttccccagcctcgagtccagaactgccttggcgcccacgcggactgcggaatctcccgaggagccggtctcagccttgcgacctggatgcccgtaaaaccggggtcaaacgtaggcacgaggaggatcccagacggctccggccttcactcgattttgataagatgaaccagaagccttacagcggcggtttatgccttcaagagacagcacgagaggggagcagcatcagcccaccgtggtttatggcatgtagtccaccgcctttgagtgcttcatgctcacctaccggaggcagctcccaggtgttaagtgaatcagaggaagaagaagagggggcagtcaggtggggtaggcaggctttgtcgaagcgaactctgtgccagcgtgactttggggacttggacctgaacctgatcgaagagaattag

SEQ ID NO: 56261 - DNA, 1158 bp, Artificial Sequence
  Description of Artificial Sequence: Synthetic coding sequence
atgagtctgattttgaatattcttagagaaatgttagaatactttggggtgccagttgagcaggtcttgctgatctgggaaaacaaggactatggaagcactcggagtattgtccgaattatcggaaaaatgctgccactcgagccttgtagacgtcctaactttgagctgatcccattgctgaatagcgtcgactctgacaactgcgggagtatggttccctcatttgccgacatcctgtatgtggccaatgatgaggaagcctcctatctcaggtttcgcaatagcatctggaagaatgaagaggagaaggtggagatttttcatccactgcgacttgtcagagatccattgagcccagccgtccgccagaaggagacagttaagaatgatttgccggtgaacgaggctgctataagaaagatcgcagccctggaaaacgagctaacctttttgcggagccagatcgccgctatcgtcgaaatgcaggaactaaaaaattcaaccaactcaagcagctttggcctttctgacgaacgcatatccctgggacagctgtcttccagccgtgcagctcatttatcagtcgacccagaccagctgcccggttccgttttgagcccaccacccccaccgcctctcccaccgcagttttctagcctacaacctccatgcttccccccagtgcagcctggtagtaataacatttgtgactccgacaatcctgccaccgaaatgagcaaacagaatcccgcagccaataagaccaattacagccatcacagcaaaagccaacgaaataaagatataccgaatatgttggatgtcctgaaagacatgaataaagtcaaacttagagccatcgaaagatcccccggagggagaccaatccacaaacgaaaacgccagaattcacactgggacccagtgagtctcattagtcacgctttgaaacagaaatttgcttttcaggaggacgattcgttcgagaaagagaatagaagctgggagtcctccccttttagttcacctgagacgagtaggttcgggcaccacataagccagtcagagggccagcgcaccaaggaggaaatggtcaacaccaaagcagtggaccagggcatttcaaatacctcgcttctgaattctagaatttag

SEQ ID NO: 56262 - DNA, 1158 bp, Artificial Sequence
  Description of Artificial Sequence: Synthetic coding sequence
atgtctcttattctcaatatcctacgggagatgctcgaatattttggagttcccgtggagcaagtcttacttatctgggaaaacaaggactatggttccacgcgctccattgtcaggattataggcaagatgctcccgctggagccatgccggagaccaaacttcgaattgataccactgctaaatagcgtcgactccgataactgtggctcaatggtgccctctttcgccgacattttatatgtagctaatgacgaggaagcaagttatctgagatttcgaaactctatttggaagaacgaggaggagaaggtggaaatttttcatccactgcgcctggtacgcgaccccctttcgcccgctgtaagacagaaggagacagtgaagaatgaccttcccgtgaatgaagcagcaattagaaagattgccgctctcgaaaatgaactgaccttcctgaggtcgcagatcgcagctatagttgagatgcaggagctgaaaaacagcactaactccagttctttcggactcagtgatgagcggataagtctagggcagcttagttcctcacgggcagcccacctttccgtggaccccgaccagctgcctggaagtgtgctcagccccccacctccccctcctctaccaccccaattttcaagtcttcagcctccctgtttcccccctgtgcagccagggagcaataatatctgcgacagcgataaccctgcgaccgaaatgtccaaacagaaccccgcagctaataagacaaattactcacatcattcgaaaagtcagcgcaacaaagacattcctaatatgctagacgtactcaaagatatgaataaagtgaagctccgcgctatcgaaagatcgcccggagggagacccatccataaacgcaagcggcagaatagccactgggaccccgtgtctcttatctcccacgctctgaagcagaagttcgcctttcaagaggacgattcatttgaaaaggaaaacagaagctgggaatcatcaccgttcagctcaccagagaccagtagattcggccatcacatttcacagagtgaaggccagagaactaaggaggagatggtcaacactaaggccgtcgatcagggcatttccaatacgtctctgctcaactctcgaatatag

SEQ ID NO: 56263 - DNA, 879 bp, Artificial Sequence
  Description of Artificial Sequence: Synthetic coding sequence
atgtctggaatggaagctactgtgacgatcccgatttggcaaaacaagcctcatggggcagctaggtcagtggtgaggcgaataggcaccaaccttcctctgaagccctgtgctcgggcttcttttgaaaccctgcctaacatctcagatctctgcctccgagacgtgccccctgtgcctaccctggctgatatcgcctggatagccgctgacgaagaagagacatatgctcgcgtgagatcagacaccagacctctgcgtcacacatggaagcccagccctcttatcgttatgcagcggaatgccagcgtgccaaaccttcggggttctgaggagcgcctgttggcgctgaagaaaccggctctcccagccctgagccgcacaactgaactccaggacgaactgtcacacctgcggagccagattgcaaagattgttgcagccgatgctgcatctgccagcttaacccctgacttcctgagccccggtagtagcaatgtgtcgtctcctctcccctgttttggtagttcctttcattccactacttctttcgtcatttctgacatcactgaagagactgaggtcgaggtacccgaattgccttcagtgccgctcctctgttccgcctcccctgagtgctgtaagcctgagcataaagctgcttgtagttcatccgaggaagatgactgcgttagcctgagcaaggccagctccttcgcagatatgatgggaatcctgaaggattttcatcggatgaaacaaagtcaggacctgaatcgtagcctgttgaaggaggaagatccggctgtccttatctctgaggtgcttcgcagaaagttcgcactcaaggaagaagacataagtcgcaaggggaactag

SEQ ID NO: 56264 - DNA, 879 bp, Artificial Sequence
  Description of Artificial Sequence: Synthetic coding sequence
atgtccgggatggaagcaacagttacgattccaatttggcaaaataagccccacggagcagctcggtctgtcgtgagacgcatcggaacaaacttgcccttgaaaccgtgcgcccgtgcctcttttgagactttgccaaacattagcgacttgtgtttaagggatgtgccaccagttccgaccctcgcagatattgcctggatcgcagccgatgaagaggagacatacgctagggttcgctccgatacccgccctctgcgccatacttggaaaccttcccctctgattgtcatgcagaggaacgcctccgtgccaaacctgagggggagtgaggaaagattgttggccttgaagaagccagccttgcctgcattgagccgcacaaccgagttacaggacgaactctcccatttgcggtcacaaattgcaaaaatagtagctgcagatgccgcaagtgcctccctaacacccgacttcctctcgcccggatccagcaacgtgtcatctccactcccctgcttcggatcttccttccatagcactacctcctttgttattagcgatattacagaagaaactgaggtggaagtgcctgaactgccctccgtccccctgctgtgtagcgcatccccagagtgctgcaagccagaacataaggctgcatgcagttccagcgaggaggacgattgcgtctctctgtcaaaagcaagcagtttcgctgacatgatggggatactgaaggattttcatcgcatgaagcagtctcaggatctgaaccgatccctgctgaaagaagaagatccggctgtcttaatttccgaagtccttcgtagaaaattcgccttgaaagaggaggacatttcaagaaagggcaactag

SEQ ID NO: 56265 - DNA, 879 bp, Artificial Sequence
  Description of Artificial Sequence: Synthetic coding sequence
atgtccggaatggaggctacagtgaccatacccatctggcagaataaaccccacggggctgctcggtccgttgttcgcaggatcgggacaaacctccctctgaaaccgtgtgccagagcatcattcgagaccctgcctaacataagcgatctgtgtctgagagacgtgcctcccgtccccaccctcgccgacattgcttggattgcagccgatgaggaagaaacatatgcaagagttagatctgacacacggcctctgcgtcacacttggaagccttctcccttgatcgtgatgcagagaaacgcctccgttcccaacttaagggggtctgaagagaggctattggcactgaagaagcccgcactgcccgcactgagccggaccaccgaactacaagacgaactgagccaccttagaagtcagatcgccaagatcgtggccgcagacgcagcaagcgcatcgttgactcccgacttcctgtcccccggttccagtaatgtgagtagccccttgccctgcttcggaagcagctttcattcgaccactagttttgtgatcagtgacattaccgaggagacagaagtagaagtaccggagctaccatcagtccctctgctgtgcagcgccagtcccgaatgctgcaaacccgaacacaaagccgcttgttcctcttccgaagaagatgactgtgtgtctttgtcaaaggcgtcctctttcgcagatatgatgggcatcctcaaagacttccaccggatgaagcagagccaggatttaaaccggtcactcttgaaggaggaagacccagctgtgttaatttcagaggtgctgaggcgcaaattcgcacttaaagaggaggacatctctcggaaaggtaattag

SEQ ID NO: 56266 - DNA, 843 bp, Artificial Sequence
  Description of Artificial Sequence: Synthetic coding sequence
atgtccggcatggaagccacagtgacaatcccaatctggcagaacaagcctcatggggctgctaggtcggtggttagacgtatcgggaccaatctgccactgaaaccatgtgctagggcttccttcgaaacactgccaaatatatccgatctctgtctgcgagacgttcctcctgttccaacattagctgacattgcatggatcgctgccgacgaagaagagacctacgctcgcgtccgcagcgacacgagaccattgcggcatacatggaagcccagcccactgattgtcatgcagagaaacgcaagtgtgccaaatctgaggggctcggaggagagactgctggccctgaaaaaacccgctctgcccgcactgtccaggactactgaactacaagatgagctgtctcacctccggtcacaaatcgctaaaatcgtggccgctgacgccggatcttctaatgttagttccccactaccctgtttcggaagctctttccactcaactacaagtttcgtgatctcagacatcaccgaggaaaccgaggtggaggtgcccgaactcccttctgtccccttactgtgtagcgcctctcctgagtgctgcaaacccgaacacaaagccgcttgcagttcctccgaggaagacgactgcgtgtcactgtccaaagcctcatcttttgcagacatgatgggtatcctcaaggactttcatcggatgaagcaatcccaagatctaaatcgatctctccttaaagaagaggacccagcagtgctcataagtgaggttttgaggcgcaagttcgcgctcaaggaggaggacatctctcgcaagggaaactag

SEQ ID NO: 56267 - DNA, 459 bp, Artificial Sequence
  Description of Artificial Sequence: Synthetic coding sequence
atgagcggaatggaagctacagtaaccattcctatctggcagaataaaccacacggcgctgctcgatccgtcgtgcggaggattgggaccaacttgcctctgaaaccctgtgccagagcctccttcgagacactccctaacatttccgacctctgcttgcgagacgtcccccctgtgcccacacttgcagacattgcttggatagccgcagatgaggaggagacctatgcccgtgtgaggtccgacacaaggcctttaagacacacctggaaaccctccccgctcatcgtaatgcagcgcaatgcgtcagtgccaaatttgcgtggctcagaggagcgcctgttagcccttaaaaagccggctctccctgccctgagtcggacaacagagctgcaggatgagctttcccacctccgcagtcaaatcgctaagattgtcgcggctgacgccgcaagctag

SEQ ID NO: 56268 - DNA, 618 bp, Artificial Sequence
  Description of Artificial Sequence: Synthetic coding sequence
atgagcggcatggaggctaccgtcaccatacccatttggcagaataagccccatggcgcagccaggtccgtggtgcgcagaatagggacgaacctgccactgaagccctgtgccagggcgtcttttgagaccctccctaacatcagtgatctttgcctccgggatgtgcccccagtgcctaccttagccgacattgcctggatcgcagctgacgaggaggaaacatacgccagggtgaggtccgatacccggccactgcgccatacgtggaagccttcccccctgatcgtgatgcaacgcaacgcttccgtgccgaacttgcggggatcggaggagcggctgctggccctgaaaaagcccgctctgccagccctgagtcgaaccaccgagctgcaagatgaactctcacatctgaggagccagatagcaaaaattgtggccgctgatgctgtgaccagcccgaggagacaacgctggcggagcctgagcttccaccaatctccatgcttcgtactccccgcactgaacgtggcgaaccagaatactaagttgccggcagtgcgacttaaaaggatgaccgccagtctgtgccccaggccagccgcactgcagacctag

SEQ ID NO: 56269 - DNA, 618 bp, Artificial Sequence
  Description of Artificial Sequence: Synthetic coding sequence
atgagcgggatggaggccaccgtgactatacccatctggcagaataaaccacatggggctgcgagaagtgtcgtgcggcgtattgggacaaatttgccccttaagccctgcgctcgcgcttcctttgagacacttcccaatatatccgatctttgcctgcgcgacgtgcccccagtgccaaccctggccgacattgcatggatcgccgctgacgaggaagagacatacgcaagggtgcgtagtgacactaggcctcttagacacacgtggaaaccctcgcctttgatcgttatgcagcgaaacgctagcgtgcctaatctgcgcggatctgaagaacggctcttggcgctgaagaagcccgcattgccagcgctgtcaaggactacggagcttcaggacgagctgtctcatctccgcagccaaatcgctaaaattgtagctgctgatgcggtgacgtcgccccgtcgacagcgctggaggagcctcagctttcatcagtccccctgctttgtactgcctgctctcaatgtcgccaatcaaaacactaagctgcccgctgtccgactgaaacgtatgacagctagtctgtgccccagacctgccgcactgcagacatag

SEQ ID NO: 56270 - DNA, 333 bp, Artificial Sequence
  Description of Artificial Sequence: Synthetic coding sequence
atgtcaggaatggaggctaccgtaacaatccccatttggcaaaacaaacctcacggggctgcaaggtccgtcgttcgaagaatcggcactaacctccccctgaaaccctgcgcgagggctagctttgaaacgttacccaacattagtgacctgtgccttcgggacgttccacccgtgcccactcttgctgacatcgcttggattgccgcagacgaggaggaaacatatgcgagagtgaggtctgataccaggccgttgagacatacgtggaaaccatcccctcttatcgtaatgcaaagaaatgcatccgttcccaacctccgaggcagctag

SEQ ID NO: 56271 - DNA, 513 bp, Artificial Sequence
  Description of Artificial Sequence: Synthetic coding sequence
atgagcgggatggaggctaccgtgactattcctatctggcagaataaaccccacggcgctgcaaggtcagtggtgagacgcatcggaaccaacctgccattgaagccatgcgccagggcctcatttgagactttgcccaatatcagcgacttatgtcttcgtgatgtccctcccgtgcccaccctggcagacatcgcctggatagctgccgacgaggaggaaacctacgcacgcgtgagaagcgacactagaccgctgcgacatacttggaaaccaagtccattaatcgtgatgcaacgcaacgcttctgtgccaaacctccgcggatccgaggaacggctactcgccctgaaaaaaccagccttgccagcgctgtctagaactaccgagcttcaggacgaactctcacatctacgcagccagatcgctaaaatcgtcgctgccgacgctgcttccgccagtttgactcccgactttctctcccccggtagctctaatgtttcctctccttag

SEQ ID NO: 56272 - DNA, 348 bp, Artificial Sequence
  Description of Artificial Sequence: Synthetic coding sequence
atgagcggcatggaggctacagttaccattcccatctggcagaacaagccgcatggtgctgcccgttctgtggttcgtcggatcgggacgaatctacctctgaaaccctgcgcgagagcttctttcgagacactgcccaatatcagtgatctgtgcctaagagacgtacccccagtgcctacactggcggacatcgcttggattgccgctgacgaagaagagacctacgcacgagtccgttctgatacaaggcctctcagacacacctggaagccttctcctcttatagttatgcagcgaaatgccagtgtgcccaacctgcgtgggagcgaggagcgcctgctgtag

SEQ ID NO: 56273 - DNA, 1995 bp, Artificial Sequence
  Description of Artificial Sequence: Synthetic coding sequence
atgcaccgcatgccagacccagggaagttcaagttgctggaacaggctagggacgtccgggagcctgtgagatacttttcctctgtggaagaggtggcgtccgtcttccccgatcgcatcttcgtgatggaggccatcaccttctcggtcaaggttgtaagcggtgaattttccgaggattccgaggtgtacaatttcacattgcacgcgggtgatgagcttacactgatgggacaagccgagattctgtgtgctaaaaccactaaagagcggtcccgctttactacccttctgcgaaagctcggtagggccggtgccctggctggcgttggaggtggagggcctgctagcgcaggagccgcaggcggaacaggcggtgggggagcacgccctgttaagggcaagatgccctgtctaatctgcatgaaccacagaaccaatgaaagtttgtcactgcccttccaatgccagggaagattcagtaccagaagcccgttagagctccaaatgcaagaaggggagcatactgtccgagcaatcatcgagagagtaagattaccggtgaacgtactggttccttcacgcccacctagaaatccttatgaccttcaccccgtcagagaagggcactgttacaagctggtgagtatcatctctaagaccgttgtgctcggtctcgctctcagaagggaggggccagcaccattgcacttcctccttctgacagacacccctcgatttgctctgcctcagggcctgcttgcgggagacccacgcgtagagaggctggtgagagattctgccagttactgtagggagagattcgacccagacgagtacagcactgccgtgcgcgaagcgcctgctgaactggctgaggactgcgcttctccacggcgtgccagactttgccttcccgcacctcgagctcctggccttgccagggcaccgggaccactggctccagccccagccggagaaggcgatcaggagtacgtatccccagactgggcagcagcccctgagcctgccgcacctcctgctgaaattccatacgaagagttgtgggctcaccagggcccagaaggcttggtcagacccccacctgggttggacctgatctctttcggtgcagcaggacccccacgcagggagcccgaagcccctcctccccctgtccccccaaaatcggaggctgtgaaggaagaatgcagattgctgaatgctccaccggttcccccacggggtgggaatggatccggcaggctgtcaagctctccccctgtgcccccacgatttcctaagctgcaaccagttcactccccttcatcttccctctcatactattcatctggcctgcaggatggagctggatcaaggtctggaagtggatctccctcccctgacacttacagtttgtattgttacccctgcacgtggggcgattgcaaggagcccgttctggagccattcgatccattcgagctcggccaaggttcctctcctgaacctgagctgcttcgcagtcaggagcccagggcggttggcacacctggccctggaccccgtctgagccccctaggcccatcaaaagcattcgaaccagaggggctggtcctccaccaggtccctacccccctctcacctgctgctctgcaaggtccagaggccggaggagcgctcttcctgacacaggggaggctggagggtccacccgcttctccaagagacggagccactggctttggtgtgcgggacgccagttcatggcaaccacctgcggacttgtctgcattgagcctggaggaagtaagccgctcactcagattcatcgggctttccgaggatgtcgtgtctttctttgccagagagagaatcgacggaagcatcttcgtccaactcagtgaggatatccttgccgatgacttccatctcacaaagctgcaagtcaaaaaaattatgcagtttatcaaagggtggcgcccaaagatatag

SEQ ID NO: 56274 - DNA, 2631 bp, Artificial Sequence
  Description of Artificial Sequence: Synthetic coding sequence
atggacccagcgccttctctggggtgttcgttgaaagatgtcaaatggtcctcggttgcagtgcctctggatcttctggtctctacgtaccgcctcccccaaatcgccagactcgataacggcgagtgtgtggagggactgcgcgaaaacgactatctgcttattcacagctgcaggcagtggaccacgatcacggcccactccctggaagaaggccactacgtaatcggccctaagatcgaaattcccgtacactacgcgggacaattcaagttactcgaacaggacagggacatcaaagaacctgtgcagtatttcaatagcgtggaagaagtcgccaaggcatttccagaaagagtgtacgtgatggaagacattacctttaatgtgaaggtggcatctggcgagtgtaacgaagatacagaggtttataacattactctctgtactggcgatgaactcaccctcatgggccaggctgagatattgtatgctaaaacctttaaagaaaagagccggcttaacaccatcttcaagaagatcgggaaactgaattcaattagcaagctgggaaagggaaagatgccttgcttgatttgcatgaaccatcgcacgaatgaaagcattagtctgcccttccagtgtaaggggcgattttcaacacggagtcccctggagctgcaaatgcaggaaggagagcataccattcgtaatattgtcgaaaaaacccgcctcccagtgaatgtaacagtgccctccccgccaccacgtaatccctacgacctccacttcatcagggagggacatcggtataaattcgttaatattcagacgaagaccgttgtcgtgtgctgcgtactgcggaataataagatcctccccatgcacttccccctgcacctcaccgtgccgaagttcagcctgccagagcatctggtgaagggagaatcatggcctgagaccctggttcaccattggctcggcatatgtcaggaacagttcgatatcgatgagtactcccgcgcagtgcgtgatgtgaaaacagattggaatgaggagtgcaaatctccaaagaaagggagatgctccggccacaaccacgtaccaaacagcctaagctatgctcgcgacgagctgacccagagtttccacaggctgtccgtgtgcgtatacgggaataatcttcacggcaactctgaggtcaaccttcacgggtgcagggatctgggaggagactgggcccctttcccgcacgacattctgccgtaccaggacagcggagacagtggctcagactatctttttcccgaagctagcgaagaaagcgctggaatacctggcaaatccgaattgccatacgaagagctgtggctggaggagggcaagccatctcatcaaccccttacccgctctctatctgagaagaaccgctgtgatcagttccgcggttcagtgaggagtaagtgtgctacttctccactgcctatccccggtacgttgggcgctgcagtgaaatccagcgacacagcacttcccccacccccagtccccccaaagagcgaggcagtccgcgaagagtgccgcctactcaacgctccccctgtcccccctcgtagcgcaaagcctctgtctacttcccccagcatcccccctcgcaccgttaaacctgccaggcagcagacacggtcaccctcacctactttgagttattatagcagtggacttcacaacatttctgtgactaagactgacactaacccgagcgaatctaccccagttagctgttacccatgcaatcgcgtgaaaaccgactccgtggacctcaagagccccttcggatccccctcagcagaggcagtatcctcacggctttcctggcccaatcactacagcggcgcatctgagtcacaaacacggtctgatttccttttggacccctcccggagttatagctaccccagacaaaagaccccagggaccccgaagcgcaattgtcccgctcccttcgacttcgacggatgcgaactgctggcttctccgactagcccggtcaccgccgagttcagctcatctgttagcggctgccccaagtccgcctcatactcactcgaatctaccgatgttaagtccctagctgctggggtcactaagcagtctacttcttgtccagcactcccacccagagcccctaagcttgtcgaggagaaagtagcctcggagacttcacccctgcccttaaaaattgatggggctgaggaggatcccaagtctgggtcacccgacctgagcgaagatcagtacttcgtcaaaaaaggcatgcaggatatcttctctgcgtcctaccccttcagctctcccctccacctccaactcgccccaaggagctgcggcgatgggagcccatggcaaccaccagctgatctgagcggtctgagcatagaggaagtgtctaagtccctgaggtttatcggactgtctgaagatgtgattagctttttcgtgaccgaaaaaatcgacggtaatcttctcgtccagttaacagaggagattttgagcgaagactttaaactgagcaagctgcaggtcaagaaaatcatgcaattcataaatggatggagacccaagatctag

SEQ ID NO: 56275 - DNA, 2628 bp, Artificial Sequence
  Description of Artificial Sequence: Synthetic coding sequence
atggaccctgcgccatccctcggctgttcactcaaggacgttaaatggtcgtccgtggccgtacccctggacctgctggtgtcaacctacaggttaccccagatcgcgagactcgataatggggagtgtgtggagggcttacgtgaaaacgattaccttttgattcactcatgtaggcaatggaccacaattactgcacatagccttgaggagggccactatgtgattggacccaagattgaaatacctgtgcattatgccggacagttcaaactgctggagcaggaccgagacatcaaggagccagtacaatactttaatagcgttgaggaagtggcaaaggcctttccagagcgggtgtacgttatggaggatattacttttaacgtcaaggttgcctccggagagtgcaatgaggacacggaggtctacaacatcacgctgtgtacaggagacgagttgaccctcatgggccaggcagaaatcctctatgcaaagactttcaaggagaaatccagactgaacactatctttaagaagatcggaaaactgaatagcatctcaaagctcggaaagggaaagatgccctgcttaatttgtatgaatcatcgaaccaacgaatctattagtctgcccttccagtgcaagggtcgattctctacgagatctccattagaattgcagatgcaggaaggcgaacatactataaggaacatcgtagaaaagaccagactgcctgtgaatgtgaccgttccttcacccccacccagaaatccatacgacctgcattttatcagggagggacaccgttacaaattcgtgaatattcagactaaaaccgttgtcgtgtgttgcgtcctgcggaataacaaaatcttaccaatgcactttccactgcacctgacagtccccaaattttcgttgcctgagcacttggtgaaaggtgagtcctggccggaaacactggtgcaccattggctgggcatttgtcaggaacagtttgacatcgacgaatatagtagagcagtgagggacgttaaaaccgactggaacgaggaatgtaaatcccccaaaaagggaagatgtagcggtcataaccacgtccctaacagcctgtcctatgctcgcgacgagctgactcaaagcttccaccgtctcagcgtgtgtgtatatggaaacaatctgcatggaaattccgaagtgaacctccacgggtgccgtgatctcgggggtgactgggcaccgttcccgcacgacatcctgccatatcaggactccggggatagcggttccgactatctttttcccgaagcttccgaggagtctgccggaatcccaggaaagtctgaactcccctatgaggagctgtggttggaagaggggaagccctcccaccaaccgctgacccgatcccttagtgagaagaaccgctgcgatcagttccgaggaagtgtcaggtccaaatgtgccaccagccccctaccaatcccgggtaccctgggagctgcggtaaagtcttctgataccgctctgccccctccacccgtacccccaaaatctgaagctgtgagggaagagtgcagacttcttaacgctccgccagtgccccctcgaagcgccaagcccctgagcacaagcccttcaattcctcccagaacagttaaacctgcacgccagcaaacacggtctcccagccccacattaagctactacagtagcggtctccataacattgtgacgaaaaccgacacaaatccttccgaatcaacacctgtgtcttgttacccttgtaaccgagttaagacagactccgtggatttgaagagccctttcggctcgcctagtgctgaagccgtgtccagccgattgagctggcccaatcattactcaggggcatcggagtcccaaactaggagcgattttctcctggatccctcacgatcctatagttaccctcggcagaaaacaccgggtacacctaaaaggaactgcccagcacctttcgactttgacggatgcgaactgttggccagtcccactagtcccgtgaccgcagaattctcgtctagtgtgtccggctgccccaaaagtgcatcttattccctcgagtcgactgacgtgaagagtctcgcagctggtgtgacaaagcagagtacgagctgtcccgcactcccaccccgtgctccaaaattagtggaggagaaagttgccagcgagacctcgcccctccctttgaaaatagacggagcagaagaagatccaaaaagcggatcccccgacctgagcgaggatcagtactttgttaagaaaggcatgcaggacatcttctccgcgtcctaccctttctccagccctctgcacctccagttggccccaagatcctgtggagacgggtctccttggcagcccccagccgatctgtctggcctctctatcgaagaagtcagcaaaagtctacgcttcatcggtttaagtgaggatgtaatcagcttcttcgttaccgagaagattgacggcaaccttctggtgcagctgacggaagagatcttgagcgaggacttcaagcttagcaaactgcaggttaagaaaattatgcagttcatcaatggatggcgtccaaagatctag

SEQ ID NO: 56276 - DNA, 2625 bp, Artificial Sequence
  Description of Artificial Sequence: Synthetic coding sequence
atggaaaagcttgcagcaggactggccggattacggtggagcatgggggcttttccacttgacctgatcgttagtcggtgcagattgcccaccctggcctgcctcggcccaggcgaatatgctgagggcgtcagcgagcgggacatactactgatccatagttgcaggcagtggaccacagtgaccgcccacactcttgaggaagggcattacgtcatcggccctaagatagacatcccacttcagtaccccggaaagttcaaactcctggagcaggccagagatgtacgcgaaccagtgcgttacttttcttccgttgaggaggtcgcctcagtgtttcccgacaggatttttgtcatggaagcaattaccttttccgtcaaagtagttagcggcgaatttagtgaagattcagaggtgtataatttcacactccatgcaggggatgagctgactttaatgggacaggctgaaatcttgtgcgccaaaacaactaaggagcggtctagatttacaacactcctacgcaaactcgggagggccggtgccttggccggtgttggcggtggaggtcctgctagtgcaggagccgcaggcggaacaggcggagggggtgcaaggccagtcaaaggtaagatgccttgtctgatatgtatgaaccaccgcaccaacgaaagcctctcattgccatttcaatgtcagggtcgcttttcaactcgcagtcctctagagctgcagatgcaagagggcgaacacactgtccgagccatcatcgagagagtccggctacccgtgaacgttctggtcccttctcggccacccagaaatccttacgaccttcacccagtccgcgagggccactgttacaaacttgtgagcattatatctaaaaccgtggtcctcggactggctctacgacgggaggggcctgccccactgcactttctgttgctgacagacacgcccaggttcgccttgcctcagggattactcgccggagacccacgtgttgagcggcttgttcgggacagcgcctcatactgccgtgagcggttcgaccccgatgagtactccaccgccgtaagagaggcacccgctgaacttgccgaagactgtgcgtcacctagaagggccaggctctgcttgccagctccaagagcacctggtctggctcgagctcccggaccactggcaccagctcccgctggcgagggagatcaagagtatgtcagccctgattgggccgcagctccagagccggctgccccacctgctgaaataccttacgaagagttgtgggcgcaccagggcccagaggggctggttagacccccaccaggcctggatttaataagttttggagcggcagggcctccgaggagagagcccgaggcccctccacctccggtaccgccaaagtccgaggctgttaaagaagagtgtcggctgctgaacgctccacccgtgcctcccaggggcggaaatgggtctggaagactgtccagttctcccccagtgccccctaggttccccaaactccagccggtacacagtccatccagctctctgagctattattcttctggcttgcaggacggcgctggatctaggtctgggagtggaagcccctcaccagacacatactcactgtattgttatccttgtacctggggagattgcaaggtcggtgaaagtagcagccgtcctgccccaggcccactgccatcgaccactcagccctcccaggcgtcaagggctctgacagagcctctcagtgggcgagccgcatcactgctgggggcagacacccccgtaaagacctatcactcatgccccccattgtttaagcctagtcatccccagaaaagattcgcccctttcggcgctctcaaccctttctccggccctgcttatccatcaggcccttctgcagccctttcaagcgggccaagaaccacatcaggccctgtggctacatcagggcctgcgtactcaccgggtcctgctagtcccggacaggcatatagcgccgcacctccaagttcctgtgcaccttcttcttcctcaagcagtgagtggcaggaacctgtgttagaaccattcgatccttttgagctcggtcaggggtcgtcacccgaaccagagctcttgcgaagtcaggaaccacgggcagtggggacacccggtcctggcccacgcctgagccctttgggacctagcaaagcattcgagcctgagggcctcgttttgcaccaggtccctacgccactcagccccgcagccctgcaggggcctgaggccggaggggctctgtttctcacccagggtaggctggaaggtcctccagcttcgcctagggacggggctaccggcttcggagtccgcgacgcttcttcgtggcagccacccgctgatctatcagccttatctttggaagaagtgagtcggtccctgagatttatcggtctcagcgaagacgttgtgtccttcttcgctagagaacgaatcgacggatccatcttcgtacaattgagcgaggatattcttgcagacgattttcacttaacaaagctgcaagtcaaaaagataatgcagttcatcaagggatggagacctaagatctag

SEQ ID NO: 56277 - DNA, 666 bp, Artificial Sequence
  Description of Artificial Sequence: Synthetic coding sequence
atgtttggctttcacaaacctaagatgtacagaagcatagaggggtgctgcatttgtcgcgctaagtcctcctcatcacgattcaccgatagcaaaagatacgaaaaggacttccagagctgcttcggtctgcacgaaacacgttcaggtgatatttgtaacgcctgcgttctgcttgtgaagagatggaagaagctgcccgcaggttcaaaaaaaaattggaatcacgttgtggacgcgcgtgccggtccttctctgaaaaccactctaaaacctaaaaaagtcaaaactctctctggaaatcgaataaagtccaaccagattagcaagctgcagaaggagttcaaacgccacaatagcgatgcgcatagtacgacctcttctgcttctccagcacaatctccttgctactctaaccagagtgatgacggtagtgacactgagatggcctcggggagcaatcggacccctgttttctccttcctcgacctgacttactggaagagacaaaaaatttgttgtggcattatctacaaaggtcgcttcggagaagtgttgattgatactcatctgtttaaaccatgctgctcgaataagaaagctgccgcagaaaagcccgaagagcaggggcctgaacctctgcctatctctacccaagagtggtag

SEQ ID NO: 56278 - DNA, 222 bp, Artificial Sequence
  Description of Artificial Sequence: Synthetic coding sequence
atggcgtccgggtccaataggacgccagtcttttcttttctcgatctgacttactggaaaaggcaaaaaatttgctgcgggatcatttacaaaggaaggtttggcgaggttttgatcgacacccaccttttcaaaccgtgctgcagcaataagaaggctgctgctgaaaaacccgaggagcagggcccagaaccgctgcctatcagcactcaagagtggtag

SEQ ID NO: 56279 - DNA, 789 bp, Artificial Sequence
  Description of Artificial Sequence: Synthetic coding sequence
atgtcatacctcccgacgaacccaccaggctcaatcctcgccggatcggcctccctgtcagctgtaaccggggttcccgagggcgaggccaggttcaccgaagattattgtccagaagagaagatgttcggcttccataagcccaaaatgtaccgaagcatcgaaggatgttgcatatgccgcgctaagtcttcctcctccaggttcaccgactcaaagcgttatgagaaggattttcagagttgtttcggactgcacgaaaccagatctggtgacatatgcaacgcttgtgtactgttggtgaaaagatggaaaaaactccccgctgggtccaagaaaaattggaatcacgtagtggatgcaagggccggacccagcttaaaaactacacttaaacccaaaaaagtcaaaaccctgtctgggaacaggattaaatcaaatcaaatttctaagctgcaaaaggaatttaagcggcacaattccgatgcccacagcacaacttccagcgcctctcctgcccagtccccctgttatagcaatcagtccgatgacggctctgatacagaaatggctagtgggagcaatcgcacccccgtcttctcctttctggacctaacatattggaaaaggcagaaaatttgttgcgggatcatctataagggccgatttggtgaagtgctgatagatacccatctgtttaaaccatgctgttctaacaagaaggccgctgctgaaaagcccgaggagcagggacccgagcccctgccaatatccacgcaggagtggtag

SEQ ID NO: 56280 - DNA, 666 bp, Artificial Sequence
  Description of Artificial Sequence: Synthetic coding sequence
atgttcggattccataagcctaaaatgtaccgctccatagaagggtgttgcatttgccgggctaaaagtagctcatctcggtttactgattcgaaaaggtacgaaaaggacttccagagctgcttcgggttacacgaaacccgtagtggagacatttgcaatgcctgcgtgctgttggtaaagcggtggaagaaattgccagccggtagcaaaaagaattggaatcatgtcgtagatgctagagccggaccttcgctgaaaaccactctgaagcctaagaaagttaaaacgttgtcggggaatcgtatcaaatccaaccaaattagcaagctgcagaaggaatttaagcgtcacaatagcgatgcacattccaccacatcttccgccagccccgctcagtcgccttgctatagcaaccagtccgatgacggcagtgacacagagatggctagcggcagtaaccgaacccctgttttcagcttcctagatctgacttactggaagcgacagaagatctgctgtggcattatctataaagggaggttcggggaggttctgattgatactcatctctttaagccctgttgtagtaataaaaaggctgccgctgagaaacccgaggaacaaggacctgagcctttgccaatcagcactcaggaatggtag

SEQ ID NO: 56281 - DNA, 405 bp, Artificial Sequence
  Description of Artificial Sequence: Synthetic coding sequence
atgtttggctttcataagcccaaaatgtatcggagcatcgaaggctgctgtatctgtagagctaaaagttcttccagccggtttactgattcgaagcggtacgaaaaggatttccagtcatgctttggtttacacgagacgaggagtggggatatatgcaatgcatgtgtactcctggtcaaacgatggaagaaactgccagcaggctcaaaaaaaaattggaaccacgttgtcgacgcacgggctggaccgtctctcaaaacaaccttaaaaccaaagaaagtgaaaacgctgtcagggaacaggattaagtccaaccagatctccaagttacagaaggagttcaaacgccacaacagcgatgcacacagcacgacctcgtcagcctcccctgcacaaagctag

SEQ ID NO: 56282 - DNA, 384 bp, Artificial Sequence
  Description of Artificial Sequence: Synthetic coding sequence
atgtttggctttcacaagccgaagatgtaccgatcaatagaaggctgctgcatatgtcgcgcaaagagttctagcagccgattcactgactcaaaacgatacgagaaggacttccagagctgtttcggcctgcacgagacgagatctggtgacatctgcaatgcctgtgttctgcttgtcaaacggtggaagaaactgcccgctgggtctaagaagaattggaaccatgtggtggacgcgagggctgggcctagtctgaagaccaccctaaagccaaaaaaggtcaagacactctccgggaatagaattaaatcaaatcagatctcaaagctgcagaaagaattcaaaagacataactccgatgctcacagtacgaccagctag

SEQ ID NO: 56283 - DNA, 984 bp, Artificial Sequence
  Description of Artificial Sequence: Synthetic coding sequence
atgaacattctatttctgcagtggaaggtgaaactgccaccccagaaggaagtcataacgagtgacgagctgatggcgcatctcggcaactgtctgctgtccatcaaacctcaggagaaatcagaaggcctccagctcaatttccagcaaaatgtggatgatgcgatgaccgtgctgcccaaactagccactggcctcgatgtgaacgtcaggtttacaggagtaagtgactttgagtatactcctgaatgtagtgtatttgatctgctggggataccactgtaccatggctggctggtagacccccaaagtccagaggcggtcagggccgtgggcaaattatcgtacaatcagttggtggaacgaatcattacctgtaagcactcgagtgataccaatttagtcactgagggtctgatcgcagagcagttcctcgaaactacagcagcccagttgacatatcacggcctgtgtgagctgaccgctgccgctaaggagggagaactctctgtgttctttagaaacaatcatttttcaactatgactaaacataaaagtcatctgtacctcctggtcactgatcaaggcttcctgcaggaggagcaggtggtgtgggagagcctccataatgtggatggtgactcttgtttctgtgatagcgattttcatttgtctcacagcctgggaaaaggtcccggagctgaagggggatcaggctcgccagaaacacagttgcaggtcgatcaagattatctaatcgcgttaagcctgcagcagcagcagcctaggggacccctaggactgacagatctagaattagcccaacagcttcagcaagaggagtaccaacagcagcaggcagctcagcccgtccgaatgcgtaccagagtgctgtcgctgcaaggacggggagcaacttccggccgacctgccggagagaggagacagaggccaaaacacgaatcagactgcatcttgctttag

SEQ ID NO: 56284 - DNA, 1554 bp, Artificial Sequence
  Description of Artificial Sequence: Synthetic coding sequence
atgcttctgggaccgcctccctttaatgaatctacaaagccatctccctccccttgccattccttcgccagccaggcttggctgcgccaggtccccgaggtgtctaaacatttgcaatgtccgtccgccaaaagccttctcactatggaatatcatcaaccggaagaccctgctccaggcaaggcaggaaccgctgaggccgtcatcccagaaaatcacgaagtgctggcaggccctgacgagcacccccaagacacagacgccagagacgccgacggcgaagcacgcgagcgggaacccgctgaccaagcgcttttaccatctcagtgcggcgacaacctcgagtcacccctgccagaagcatcatctgcgccaccaggccctacccttgggactttgcccgaggtggaaaccatccgagcgtgctccatgccgcaggaactcccgcagagtcctaggacgcgtcagccagagccagatttctattgtgtcaagtggattccatggaaaggcgaacagacgcccataataactcagtcgaccaacggtccctgccctcttttggccattatgaacatcttattcttacagtggaaagtgaagctgccacctcagaaagaggtgattacctctgatgaattgatggctcacttaggcaattgtctcctttccatcaagcctcaggagaaatccgaaggtttgcaactcaactttcagcagaatgtggatgacgccatgacggtgcttcctaaactggcgacagggctggacgtgaatgtcaggttcactggggtgtccgatttcgagtacactcctgaatgttctgtctttgacctcctgggcatcccattgtatcatggctggcttgttgatcctcagagccctgaggctgttcgcgctgtgggtaagctgtcttacaatcagctggtggaacggattattacctgcaaacacagctcagacactaatcttgtgacagaagggcttatcgctgaacagtttctcgaaactactgccgctcagctgacctaccacggcctgtgcgagctgaccgccgcagctaaggaaggagaactatccgtcttctttcgaaataatcactttagtaccatgaccaagcacaaatcccatttatacctgctggtgactgatcagggctttctgcaggaggagcaagtggtctgggaatcactgcataatgtggacggggattcttgcttctgtgattctgacttccacctatcgcactctcttgggaagggcccaggagctgagggcggatctggttcccctgagacccagctgcaggttgatcaggattacctgatcgcccttagcctccagcagcaacagccaagaggacccctcggattgacagatttggagttggcccagcagctgcagcaggaagagtatcagcagcagcaggcagcgcagccagtgagaatgagaactcgcgtgctttcccttcagggcagaggggctacaagtgggagacctgctggagaacgaaggcaacggcctaaacacgagtctgactgtatactgctgtag

SEQ ID NO: 56285 - DNA, 1410 bp, Artificial Sequence
  Description of Artificial Sequence: Synthetic coding sequence
atggagtatcaccaaccagaagatcccgctccaggtaaagcaggaaccgccgaggctgttattccagagaaccatgaagtcctcgctggtccagacgagcatcctcaagacacagatgccagggatgcagacggcgaggctagagagcgcgaaccagccgatcaagccctgctcccaagtcagtgtggagacaacttagagagccccctgcccgaggcctcatctgctccaccaggaccaaccctaggcacgctcccggaggtggaaactatccgcgcttgctcgatgcctcaagagctaccccaatctccaaggacacggcagccagaaccagacttttactgtgtcaagtggataccttggaagggcgaacagacaccgatcatcacccaatcgacaaatggaccctgccctctcttggctatcatgaacattctatttttgcagtggaaagttaagcttccccctcagaaggaggtgattacttccgatgaactcatggcacacctgggcaactgcttgctctctatcaagccccaggagaaatcagaaggccttcaactgaactttcaacaaaacgtggacgacgctatgaccgtgctgcccaagctcgccacaggactagacgtgaatgtgagattcactggagtatcagattttgaatatacaccagaatgtagtgtcttcgatctactcggcatccctctgtatcacggctggctcgtcgatccacaaagtcccgaagccgtgcgcgcagtgggcaagctctcctacaaccagcttgtggagagaatcatcacttgcaaacactcatccgataccaacctggttaccgagggccttatcgcagagcagtttctggaaacgactgctgcccagcttacatatcacggactgtgtgagttgacagccgcagcaaaggaaggtgagctgagcgtcttcttccggaacaaccacttttctactatgaccaagcacaagagtcatctgtatctgttggtcactgatcagggcttcctgcaagaagaacaagtcgtgtgggagagcctgcacaacgtggacggcgactcttgtttctgcgacagcgactttcatctatcacactcccttggcaagggacctggcgcagaaggtgggtccgggtcacctgagacccagctccaggtggaccaggactatctgatagcgctttccctacagcagcaacagccgagagggcctctgggcctgacagatctcgagcttgcccaacagttgcagcaggaggaataccagcaacagcaagccgcacagcccgtgaggatgcgcacaagagtgctcagcctccaaggcagaggtgcgacctccggtaggcctgccggagaacgaagacaaagacccaagcatgagagcgactgcattctgttgtag

SEQ ID NO: 56286 - DNA, 1125 bp, Artificial Sequence
  Description of Artificial Sequence: Synthetic coding sequence
atgccccaagaactgccccagtccccaaggaccaggcaacctgagcccgatttttactgcgtgaaatggattccttggaagggggagcagactcccatcattactcagtctacaaatggcccatgcccattgctggccatcatgaacatcctctttcttcagtggaaagtgaaactgccaccccaaaaggaggtgatcacctccgacgagctgatggcgcacttaggaaactgtttgctgagcatcaaacctcaggagaaaagcgagggcctgcagctgaattttcagcagaacgtggacgatgctatgacagtcttgccgaagttagctaccggcctcgatgtcaacgtacggttcactggagtctcagacttcgagtacactccagagtgcagcgttttcgatctattgggaataccactctaccacggctggctggtcgatccccagagtcctgaggccgtaagggcagtgggcaaactttcttacaaccaacttgttgaaagaattatcacctgcaaacactcatctgacaccaacctggtgaccgaaggtttgatcgccgaacagttcctggagactaccgccgcacagttgacatatcacggcctatgcgagttgaccgccgctgcaaaggaaggggagttatctgtattctttagaaacaaccattttagtaccatgaccaaacacaaatcccatttatatctgttagtaacagatcagggatttttgcaggaagagcaagtagtgtgggagagcctgcacaatgtggacggggattcttgtttctgtgactcagacttccatctgtctcactctttgggcaagggtccgggtgctgagggaggatccggctctcccgagacccaactgcaggtcgatcaagactatttaatagctttgtcactccagcagcagcagcctcgaggaccactgggattgaccgatctggaactcgcccagcagttgcagcaggaggaatatcagcagcagcaggcagcgcagccagttcgtatgaggacaagggtattgtccttacagggtcgcggtgccacctcgggacgaccagctggagaaaggcggcaacgcccaaagcatgaatcggattgcattctgctatag

SEQ ID NO: 56287 - DNA, 1863 bp, Artificial Sequence
  Description of Artificial Sequence: Synthetic coding sequence
atggaatcatccccagaatcattgcaaccgctcgaacatggagtggctgcgggtcctgcgtccggtaccgggagctctcaggaaggtctgcaggaaaccaggcttgcagcaggcgatggtcctggcgtttgggcagctgagacctcggggggtaacggactgggggctgcagctgctaggcgctccctcccagattccgcctcccccgctggatctcccgaggtgccaggcccttgcagcagctccgctggtttggacttgaaggattcaggacttgagtctccggctgctgcagaagcccctttacgtgggcagtacaaagtgacagcttcccccgagactgctgttgcaggtgtgggtcatgagctgggtacagccggtgacgctggggctaggcccgatctcgcagggacctgtcaggcagagttaaccgccgctggcagcgaggagccctcctccgctggaggattgtcatcgtcttgctcggatccaagtccgccaggcgaatctccttccctagatagcctggagtccttttccaatttgcattctttccccagctcatgtgagtttaacagcgaagagggagcagagaatagagtgcccgaagaggaagagggcgctgccgtcctgcctggagctgtgccactgtgcaaagaggaggagggcgaggaaacagcacaagtgctggccgctagcaaggaaagattccctggccagtctgtttatcatattaaatggatacaatggaaggaggagaacacccctatcattacccagaatgaaaacggcccatgtccacttcttgctatcttgaatgtactgcttctagcctggaaagttaagcttccgccaatgatggagataatcacagccgaacagctgatggaatatctaggagattacatgctggacgccaagccaaaagaaatcagtgagatccaaaggcttaattatgagcagaatatgtcagacgccatggccatactgcataaacttcagaccgggctcgatgtcaacgtgaggtttactggagtccgtgtgtttgagtacacccctgaatgcatcgtatttgaccttcttgatatccccctatatcacggctggctcgttgacccccaaatagatgatatagtaaaagcagtcgggaactgttcatacaaccagcttgtcgagaaaataatttcctgtaaacagagcgacaattccgagttagtctctgaaggattcgtagcagaacagttcttgaataatacagctactcagctgacctaccacgggctgtgtgagctgacctcgaccgttcaggagggagaactgtgtgtgttttttcgaaataaccacttctccaccatgaccaaatacaaaggtcaattatacctcctggtgaccgaccaggggtttctcaccgaggagaaggtggtgtgggaatctctacataacgtagacggagacggcaatttctgtgacagcgaattccatcttcgtcctccgtccgatccagaaaccgtttataagggccagcaggatcaaatcgatcaggattacctgatggcgttgagtctacagcaggagcagcagtcccaagaaataaactgggagcagatccctgagggcatctcagacctggagctagccaagaaacttcaggaagaagaggatcggcgtgcctcacagtactatcaggagcaggagcaggctgcagccgctgctgccgctgcctccacccaagcccagggccagcctgcccaggcctccccttcttctgggagacagagtggaaactccgagcggaagaggaaggagccacgtgaaaaggataaggaaaaggaaaaggaaaagaattcatgcgtgattctgtag

SEQ ID NO: 56288 - DNA, 1866 bp, Artificial Sequence
  Description of Artificial Sequence: Synthetic coding sequence
atggaatctagtcccgagagcctccagcccctcgagcacggagtcgccgctggcccagcaagcgggaccgggtcctctcaggagggtctccaggagacacgtttggcggcaggagacggcccaggcgtttgggcagcagaaacttctggaggtaacggcttaggagcggctgcagccaggaggagtctacccgacagcgcatctccagccggatcccctgaagttcccggaccttgttcgtccagtgctgggcttgatctgaaggacagcggcctggagagtcctgccgctgctgaggcaccccttaggggccagtacaaggtgacagccagccccgaaactgcagttgccggagtgggccacgagctgggcactgccggtgatgccggagcacgacctgatctggccggaacatgtcaagccgagctaacagccgctggcagcgaggaaccatccagtgccggaggattgtcatccagctgctccgacccatcacctcccggtgaatcgccttccctggattcgttggaaagtttttctaacttgcattcctttccctctagctgcgagtttaacagcgaagaaggcgctgaaaacagggtgcccgaggaggaggaaggggctgcagtccttcccggagctgtaccactgtgcaaagaggaggaaggcgaagagaccgcccaggtgctggcagcttccaaagagcgcttccccggacaaagcgtgtaccacatcaagtggatacaatggaaggaggagaatacccctatcatcacccagaacgagaatggcccatgtcctctcctcgcgattttaaatgtgctgctgttagcctggaaagttaaactcccccctatgatggaaataatcaccgccgagcagctgatggagtatcttggagattacatgctggatgccaagccgaaggagatcagtgagatccagcgcttaaactacgagcagaacatgagcgacgcaatggccattctgcacaagctgcagacaggcctggacgtgaacgtcaggtttactggagttcgggtgtttgagtacacgcccgaatgcatcgtgttcgatctgctggacattcctctatatcacggatggctggtcgatccacaaattgacgacattgtaaaagcagtggggaattgtagttacaaccaactcgtggaaaaaattatcagctgtaagcagtccgacaacagcgaattggtcagcgagggcttcgttgccgaacagttcttgaacaacacagcaacccagcttacataccatggactgtgtgaattgacatccaccgtccaagagggcgagctctgcgtcttcttcaggaacaaccattttagcaccatgaccaagtataaaggacaactgtatctactcgtaacagatcagggatttctgacggaggaaaaggtggtgtgggagtctctccacaacgtcgacggagatggaaatttctgcgattcagaattccacctgaggcctccctctgatccagaaaccgtgtacaaggggcagcaggatcagattgaccaggactaccttatggctctgtctcttcagcaggagcaacagagtcaggaaattaattgggaacagatcccagaaggcattagcgacttggagctagctaaaaagctgcaggaggaagaggataggcgagcatctcaatattaccaggagcaagaacaggccgcagcggcagccgctgccgcttccacccaggcgcagcagggccagccagctcaagcttctccatccagtgggagacagtcaggcaactcagaaaggaagcgaaaggaaccaagagagaaggacaaggagaaagaaaaggaaaaaaactcttgtgtgatactgtag

SEQ ID NO: 56289 - DNA, 2841 bp, Artificial Sequence
  Description of Artificial Sequence: Synthetic coding sequence
atgtctgtgcgactgcgttttctctctcctggagacacgggggctgtgggcgtggtaggcaggtcagcttccttcgccggattcagctccgcgcagtcccgtcgaatagccaagtctatcaatcggaattcagttcgctcccgcatgcctgccaaaagctccaaaatgtacggtaccctcagaaaagggagtgtgtgtgccgaccccaagccccagcaggtgaagaagatctttgaggcactcaaacgaggactcaaggagtatctgtgcgtacagcaagctgagctggatcatctcagcggaagacataaggacaccagacgtaattctcggctggctttttactatgaccttgataagcaaaccaggtgcgtggaaagacacattcgaaagatggagttccatatatccaaagtcgatgagctgtacgaggattattgtatccagtgcaggttaagagacggagcctcctctatgcagcgtgcgttcgctagatgtccaccgagccgggctgcaagggagtccctgcaggaactgggcaggagtctgcatgagtgtgcagaggacatgtggcttatcgaaggagccctggaggtgcacctaggcgaatttcacatcaggatgaaagggttagtgggctacgccaggctctgtcccggagatcactacgaagttctgatgcgcttgggtagacagagatggaagcttaagggtagaatcgaaagcgatgatagccagacatgggacgaggaggagaaggcctttattccaaccttacacgagaatctggatatcaaagtgacagagcttcgagggctgggcagcttggcagtgggagccgtcacgtgcgacatcgctgattttttcaccaccagaccgcaggtgattgtagttgacattacagaactcgggaccatcaagctacaactggaagtgcaatggaaccccttcgacacagaaagcttcctggtaagcccaagccctactggaaagttctcaatgggaagcaggaaggggtcactctacaactggacacccccatccacccccagtttcagggaacgctactatctcagtgtgctgcagcaacctacacagcaggcattattactgggagggccaagagctacgagtatcctcagctacctgtccgattctgaccttaggggtccctccctgaggtcccaatctcaggaactgcccgaaatggactcattttcgtctgaggaccccagagacacggagacaagcaccagcgcctctacaagtgacgtgggcttccttcctctgaccttcggtccacacgcgagtattgaagaggaggcgagagaggaccctctccccccaggtctcttgcccgaaatggcacaccttagtggtggtccatttgctgagcagccgggttggcggaacttgggtggtgagagtccgagcttgccacaggggagcttattccacagcgggacagcttccagttctcaaaatggacatgaagaaggagcgacaggtgatagggaagatgggccaggtgttgcactggagggcccactgcaagaggtgctcgagctgctgcggcctacagacagcacccagccacagttacgagaattggagtatcaggtgctggggttcagagacagactgaagccatgtcgcgctagacaggaacacacaagcgccgaatccctgatggaatgtattctggaaagcttcgccttcctgaacgctgattttgcactcgacgagctctcactgtttggaggatcccagggactgagaaaagaccgtcccctccctccccctagcagtctgaaggcctcaagccgggaattgactgctggggcacctgagctggatgtcctgctaatggtacatctgcaggtatgcaaggccctcctccagaagttagcctctccaaacttgtcccggcttgtgcaggaatgcttgctggaagaagtcgcacaacagaaacatgtcttagaaacactctccgttttagacttcgagaaggtgggcaaggccacgagcattgaagagattattccccaagccagccggacaaaggggtgcttaaaattgtggcgaggttgcacagggcctgggagagttttgagctgtcctgcgactaccctcctgaaccaactcaagaaaacgtttcagcacagagttcggggaaaatacccagggcagctggaaatagcgtgccgtcggcttctggagcaggtggtctcctgcgggggactgctgcccggtgcagggctgccagaggaacagatcatcacgtggttccagtttcactcgtatttgcagcggcagagcgtcagcgacttggagaagcattttacgcagctgacgaaggaggttacactgatcgaggagctccattgtgcaggccaggctaaagtcgtgaggaaactccaggggaagagattagggcagctgcagccgttgccacagacactgagggcatgggccctgctgcagctggacgggacaccgcgtgtgtgcagagccgcaagcgctagactcgctggcgctgtgcggaacagaagtttccgcgaaaaggcccttctattttataccaacgccctcgctgaaaacgacgccaggcttcagcaagccgcttgcctggccttgaagcatctcaaaggtattgagtcaattgaccagacagccagtctctgccagtcagacctggaagccgttagggcagccgctcgggagacaacactaagcttcggcgaaaagggaaggctggcatttgaaaaaatggacaaactctgctcagaacaaagagaggtgttctgtcaggaagccgacgtagagatcaccattttttag

SEQ ID NO: 56290 - DNA, 2841 bp, Artificial Sequence
  Description of Artificial Sequence: Synthetic coding sequence
atgtcggtgcggcttcgcttcctgtcaccaggagacacgggcgctgtgggcgtggttggacgctcagcctccttcgccggattttcctccgctcagtctcggcgtatcgccaagtctataaaccgtaacagtgtaagaagtagaatgcctgcgaagtcgtcaaagatgtatggaacactacgaaaagggtccgtgtgtgccgatcccaagccccagcaagtgaaaaagatctttgaggccttgaagagaggactcaaagagtacctatgcgtgcaacaggcagagcttgatcacctgtccggacggcacaaggacacccgaaggaacagtagactggccttctattatgatctggataagcaaaccaggtgcgtcgagagacacattcgaaaaatggagtttcacatttccaaggttgacgagctctatgaagactactgcatacagtgccgactgcgagatggggcaagcagcatgcagcgggctttcgcacgctgcccgccatctcgcgctgcgagggaatcgctgcaggaactcgggcgatcacttcacgagtgcgctgaggatatgtggctcatagagggcgctcttgaagttcacctgggcgaattccatattaggatgaaggggttagtcggctacgctaggctttgtcccggagaccattatgaagtgctgatgcgcctagggaggcaacggtggaagctgaagggcaggatcgagtctgacgacagtcagacatgggatgaggaggagaaagccttcattcccacgctgcatgagaacttagatattaaagttaccgaattgcgtggcctgggctctctggccgtgggggcagttacctgtgacatagccgacttttttacaacgaggccacaggtgatagtggtggatattactgaactgggtacaataaagctgcagcttgaggtccagtggaatccatttgacactgaatcgtttttggtgtccccaagtccaactgggaaattttcaatgggctcacgcaagggatccctctataattggaccccacccagtaccccgtccttcagggaaaggtactaccttagcgtactgcagcagccaacccagcaggcccttctgctcggaggaccacgagccacgagcatcctgtcatacctctctgattctgacctgagaggaccttccctgaggtcccaaagccaggagcttcccgaaatggactcgttctcctcagaggatccaagagacactgagacctcaacctctgcatcgacatccgatgtcggctttttgcctctgactttcgggccacacgccagcatcgaggaggaggcgagggaggatccacttcctccagggctcctacctgaaatggcccatttgtccggtggccctttcgcagaacaaccaggctggcggaatcttggaggcgagtctccaagcctcccacagggctctctgtttcacagcgggactgctagctcttctcaaaatggccatgaggagggcgctaccggcgacagagaggacggacctggggtcgccttggagggcccactgcaagaggtgctggaactgctgaggcccacagactctacacagccccagctgcgagagttagaatatcaggtcctcggttttcgagatcggcttaaaccatgcagggcccgacaggagcatacgtctgccgagtccctgatggaatgcatacttgaatctttcgcgttcctcaacgctgatttcgccttggatgaactgagcctgtttgggggaagtcaaggactgcggaaggatagacctctcccaccgccatcttcactgaaagccagtagcagagaattgacagcgggtgcaccagagcttgacgtgctcctcatggtccacctgcaggtgtgcaaggcactcctccagaaactggccagccccaatctcagcaggctagtgcaggagtgtttgctcgaggaagtcgctcagcagaagcacgtgctggagactttatcggtgcttgattttgagaaagttgggaaggccaccagcatagaagagataatcccccaggcctcccgtaccaaaggctgtcttaaactgtggcggggttgcacaggccctggcagagtgctgtcatgtccagccacgaccctgctcaaccagctcaagaaaaccttccagcatcgggtccgaggaaagtacccgggtcagctagaaatcgcttgcagaagactgctcgaacaagtggtttcatgtggtggcctgctgcctggtgcgggactgcccgaagaacagattatcacgtggtttcaattccattcctatctacagaggcagagcgtgagtgaccttgaaaagcattttacacagctgaccaaagaagtgaccctaatcgaagaactccactgcgctggtcaagcaaaagtggtccgaaagctgcaaggaaagagacttggccaacttcagcctctcccccagacactgagagcctgggccttactccagctggacgggacccctcgggtatgtcgggctgcctccgctcggttggccggtgccgtgcgcaatagaagctttcgtgaaaaagcattgctgttctacaccaatgctctggccgagaacgacgcccgtttgcaacaggctgcctgcctggctctgaaacatcttaagggcatcgagtctatcgaccagacagcctccttgtgccagagcgacctggaggcagtgagagctgcagctagagagacaacactaagctttggcgaaaagggtcggctggctttcgagaagatggacaaactttgcagcgaacagcgggaagtattctgccaggaggcagacgtggaaataaccattttctag

SEQ ID NO: 56291 - DNA, 2853 bp, Artificial Sequence
  Description of Artificial Sequence: Synthetic coding sequence
atggtcacgaccatgtccgttcggctgcgctttctatcaccaggggacaccggcgcagtcggtgtcgtgggaaggtccgcctcatttgccggtttcagctccgctcagtcgaggcgcatcgcaaagtcaattaatagaaactcagtgcggtccaggatgcccgcaaagtctagcaagatgtatgggaccctccgtaagggcagcgtttgcgctgatcccaaaccccaacaagtcaaaaagatattcgaggccctgaagcgcggtctcaaagagtacctgtgcgtgcagcaagctgaactggaccatttgagcggcagacacaaggatacccgcagaaacagtaggctcgccttttattatgacttggacaaacaaactcggtgtgttgagcggcatatccgcaaaatggaattccacatctctaaggtcgacgagctctacgaggattactgcatccagtgtcgcttaagggacggggcttcttccatgcagcgtgccttcgcgagatgtccaccttctcgggctgcaagggagagccttcaggagctcgggcgaagtctgcacgaatgtgctgaagatatgtggcttatagaaggcgctttagaagtccatctgggggaatttcacattagaatgaaagggctggtaggctatgccaggctgtgtcccggtgatcactatgaggtacttatgcgcctgggaagacagaggtggaaactaaaagggagaattgagtccgatgactctcagacatgggatgaagaggagaaagccttcatccccacgctgcacgagaaccttgatattaaggtcactgaactgcgtggcctgggcagtctagccgttggtgccgtaacttgcgacatcgccgacttcttcacaacaaggccccaggtgattgtggtagatattacagagcttggtaccatcaaactccaactagaagtgcagtggaatccctttgataccgaaagttttctcgtcagcccttcccctacaggcaaattcagtatgggaagcaggaaaggcagtctctacaattggacgcccccaagcactcccagcttccgcgagagatactacctaagcgtgctgcagcagccaacccagcaagcacttctgctggggggacctagggcgacttctattctttcctatttgtcagatagcgacttgcggggacctagcctgaggtctcaaagccaggagctgccagagatggattcttttagctctgaagacccgcgtgataccgagacctccacgtctgcctcgactagcgacgtaggttttttgcctctgactttcgggccacacgccagcattgaggaggaggctcgcgaagatcccctcccccctggcttattgcccgaaatggcacatttgtcaggcggaccattcgcggaacagccagggtggaggaacttaggtggcgaatccccatcacttccccagggcagcctttttcacagcggcaccgcatccagtagccaaaatggccacgaggagggcgctacgggtgatagagaagatgggccaggtgttgcgctagagggcccattgcaagaggttttggagctcctgagacccactgacagtacgcagccgcaacttcgggaactggagtatcaggtgctcggattccgagacagactgaagccttgcagggctcggcaggaacacacctcagccgaatcattaatggagtgtatcctggagagtttcgccttcttaaatgctgacttcgccctggatgaactgtcactctttgggggaagtcagggccttcggaaggacaggccactacctcccccttccagtcttaaggcatcatctagggaactgactgcaggagccccagaattagatgtgctgttgatggtgcacttacaggtctgcaaggccctgttacagaagctggcttctcccaatctcagtcggctggttcaggagtgtctgctggaagaggtggcgcagcagaagcacgtgttagagacattgtcagtgctcgattttgaaaaagttggcaaagcgaccagcatcgaggaaatcataccacaggccagcagaaccaaaggttgcctaaagctatggaggggatgtaccggcccaggcagggttttgagttgtccagccacgacccttctaaatcaactgaagaagacgtttcagcatcgtgtaagaggcaagtacccgggacaactagaaatcgcatgtaggcgcttgcttgagcaggtggtaagttgcgggggattgcttccaggcgctgggctcccagaggaacagattatcacctggttccagttccactcctacttgcagcggcagagcgtatcagatcttgagaaacactttacgcagcttacaaaggaagtgacactgattgaagagttgcactgtgcgggacaagcgaaggtggtcagaaagttacagggaaagcgactgggccagctgcaaccactgccccagactttgcgcgcttgggcgctcctccaactcgatgggactcctagagtgtgccgagccgcttccgcgaggctggctggcgctgttcgcaaccgcagtttccgagagaaggctttgttattttacacgaacgcactggcagagaacgacgcacggctgcagcaggccgcatgcctggcactaaaacatctcaaggggatcgagagcattgaccaaactgcttcactttgtcagtccgatctggaggcagtgagggccgctgccagggagactacattgtcattcggcgagaaggggaggttagcctttgaaaaaatggataagctgtgttctgagcaaagggaggttttctgccaggaagctgacgtggagattactatcttttag

SEQ ID NO: 56292 - DNA, 1269 bp, Artificial Sequence
  Description of Artificial Sequence: Synthetic coding sequence
atgaagaaaaatacctctaagacaactatgaggataaacaagcaagatgcactgtgcactcctcacagccatgaccctagagatctgcaaaacatgttggatggtggagagtacgcaccattcgtgagcccaccaatgctagagtccaatttcattcaggtgaaccgcagaggtgaaagcatttatcttcataaccgcgctaactgggtcaccgttggaatttgcttctcctccagcacacataaaattcctaacgtgatgctgctagcacacctgaccccgggagcccagaaggataccgaaacgctcttcaaatccctgttaacatctccccctgccgagaaacttgtcctgacgcgctttctgccactgcagttcgtgaccctaagtgtacacgacgctgaaaacatgagcttgaaggtcaaactggtgtctggccgtgcttactatctgcaactctgtacctccgcctataaacaggatacactgttttcccaatgggttgccctcatcagcttacttaaccaggagaaagcaaaagtctccaaggtgtctgaagtctctagcttgtcaggcatcacaaatagcactgatataactggctcaatggacgtgacagacgtcaccaccttcacagcgatcctgaccccctatatgtatgcgggtacaggacccgagcatgtgcgggattcaattgattttcctgaattcaccgacattactgacattactgatgtgacagacctgccagaaaatgaggtgccagaagtgccagatgtgagaatcgtgaccgaggtaattgaagtccgtgaggccactgaggtgactgattcatccgatatcacaaactgctcgggcgtgactgttgtgttcgaaaacaacgacctgatccgggctaagcaagaggaaaaggaaaagttaaaaaacattctgaaacccggatgcttacaggatactaaaagcaagtccgagttaaaggagtcatctaagcacgttaccatttcaaacatcaccttaacattcgaaggcaaaagatattttcaaacaaccctcacgccagttgagtcggaggccaacacgtccaaagaaatgaaagacaaaacaagcgaggaaaagatgcccgacttccagtcgacagcgttgaaggccgaagagtcaagaagcctaaggaccgaatctaacacttctgtgttgtccccccatatcaagtcgccgtccaactttctcaaacttgttccacacctgtcagccccattcagtagagagtag

SEQ ID NO: 56293 - DNA, 1785 bp, Artificial Sequence
  Description of Artificial Sequence: Synthetic coding sequence
atgaacgccgacttcctgttgccatattatactgcacagtctggctcctctatgtcaatgtttaatacaactatgggcaagctccagcggcagctctataagggcgagtacgacatctttaagtatgccccaatcttcgaaagcgatttcattcagatcactaaacgaggggaggttatcgacgtgcataacagagttaggatggtcaccatgggaatcgctaggacatccccgatccttccactgcccgatgtcatgttactggccaggccagccacagggtgtgaggagtatgcagggcatgggcaagcaactaaaagaaagaaaagaaaggctgccaaaaatttggagttaacacgactgctaccactgcggttcgtgcggatcagtgtgcaggaccatgaaaaacagcagctgagactaaagtttgctacgggaagatcttgttacctgcagctttgtcccgcattggacaccagagatgatctttttgcttattgggagaagttaatttacctcctgcgccctccaatggagtctaacagctcaacctgcggaatccctgccgaggacatgatgtggatgcctgtcttccaggaggatagaagaagcttgggcgcagttaacttgcagggaaagggcgaccaggatcaggtcagcattcaatctctgcacatggtctcagaagtatgtggagctacctcggctgcctacgccggtggtgagggtctgcagaacgacttcaacaagcctacaaacgtgctgaacgcctccatcccgaaaaccagcacagagttggctgaggagcctgcgactggaggcattaaggaggccgcagctgcaggcgctgcggctggggctgcgaccggcaccgtggcaggagcgctgagcgtggccgcagctaactcagcgcctggacaagtgtctgcagctatagccggagcagcgaccattggggctggcggtaacaaagggaacatggcacttgccggaactgcctccatggctccgaacagcacgaaagtagcagtggccggtgccgcagggaagagttccgagcacgtcagcagcgcaagtatgtccttaagtagagagggtagcgtatcgctagccatagctggcgtggtgctcacatccaggactgcagctgaagcggatatggacgctgcggctggccctcccgtgagcactagacaaagcaaaagttctctgtcgggacagcacggccgagagcggacccaagctagtgctgagggatgcaaggagggtagagagcgaagggagaaggacagggcactggggagaagtagtcaccgcagaagaacgggcgaaagtcgccacaagactaggggagacaaaatcgctcagaaaagttcgtccaggtcctcgttctctcatcgcgctaatcgggatgacaagaaagagaagggttgtggcaacccagggagtagtcgccaccgagactctcacaagggggtttcacatacaccgatctctaaggagtcgcgaacctctcataaaagtggccgaagcttatggactacctcgagcggttccagcaagggattgggaagagtgtccagctttctgaggaacgtacgagctaatcttacaactaaggtcgttgggacgccccacgggcgtgacgtaaacgtcatggccaagatggctgagagaagcactaacgtcgcaatagccgaaaccgcggaaggcggacagggactggagacagtgggctccatgactccagatattatggagacagtaacattcgaggcccactag

SEQ ID NO: 56294 - DNA, 1110 bp, Artificial Sequence
  Description of Artificial Sequence: Synthetic coding sequence
atggtcagcgaagtttgcggggctacttctgccgcatatgctggcggagaaggtttgcagaacgatttcaataagccaaccaatgtgctaaatgcctctatccccaaaaccagtactgaattagcagaagaaccagctactggaggcattaaggaggccgcagcagctggggcagcagcgggtgccgcaactggtaccgtagccggtgccctgagcgtggccgcagcaaacagtgcacccggtcaggtcagtgccgctatagccggagctgccacaatcggcgctgggggtaacaaagggaatatggcccttgcgggaaccgcttccatggccccaaattccactaaagtggccgttgcaggggcagctggcaagagctcagagcatgtttcatctgcaagcatgagtctatctagggaaggttcagtgtcactggccatcgcaggggtagtgctcacaagccggaccgctgcagaggctgatatggacgcggctgccggacctcctgtcagtacgcgacagtccaaatccagcctctcaggccagcacggtagggaaaggacccaggcatccgctgaaggatgcaaagaaggacgtgaacggcgtgaaaaagatagagcactgggtagatcatcccaccggagacggaccggagagtcccgccataaaactcgaggcgacaagatcgcccagaagtcaagcagtcggagcagtttttcgcaccgcgcaaatcgtgacgataaaaaagaaaagggctgtggcaaccctggctcctcccgccatcgcgactcacacaaaggcgtatcccatacacctatttcgaaagagagtagaaccagccacaagtctggacggagtctatggactacaagttcaggatcttcgaagggtttaggccgtgtcagctcctttttaaggaacgtgcgagcaaacttgaccacaaaggtcgtcgggactccccacggccgagatgtgaatgtgatggccaaaatggccgagcgttccacaaatgtggcaattgcagagacagctgagggcggtcaaggtctggagacagtcggcagtatgacccccgacatcatggaaaccgtcacattcgaggcacactag

SEQ ID NO: 56295 - DNA, 726 bp, Artificial Sequence
  Description of Artificial Sequence: Synthetic coding sequence
atggaagactgctgcatgctcccctattataccgctcagagctctcctgccatgggaatgtttaacacctcaatgggtaaactccaacgccagctttacaaaggtgagtacaccatcttcaggtatgccccaatgttcgaatctgatttcattcagatcagtaaaaggggggaagtaatagacgtccacaacagagccagaatggtcaccatgggcatcgttcggacaagtccttgcctgacattaccggacgttatgctgctggccagacccgctgccgtgtgtgacaacgccagatgtggcccagccactcagaaaagagagagtcctcccgctgaaattttagaattgaccaggctccttcctttgatgttcgtgaaaattaccatacacaattccgttaagaaacaactgcacctgaagctggcgacagggcgtagtttttatctgcaactctgcccgcctagtgatgcctcggaggatctgttcgtgcattgggagaatctggtttatatcctgcgacccccagtggaggcctactcagacaccagagctattctagcaggaaacacgctggatagtagcgtcctggaggaggtgcagcgttcacctgttggctatgctatgaaattctgtgaggaaaaagaacagttccgtatatcacgtttacatatgaacgctgaaatgttcggttctacctactgcgactataccatcgaaatttag

SEQ ID NO: 56296 - DNA, 696 bp, Artificial Sequence
  Description of Artificial Sequence: Synthetic coding sequence
atgggaccccctttatggccggacctgcaagaacccccacccccaggaacgagcagtcaaattaggtctccccttttatgcgacgtgatcaagcccgctccacaccacgacgtgaccgtccgcgtggtgccgccaccacgcttccttcccctcctgcttcggccactcccgagtgatggagatattgctatgcgaagggaccgaggccctaagcctgccctgggcggtgccggagaggtggaacccggtggcatggctgcatcaccgaccggcagaccaagacgtctgcagcgctaccttcaatctggagaattcgaccagttcagggatttccccattttcgagtcaaactttgtccaggtcacacgactaggcgaggtagccaatgaagtcacaatgggtgtggctgcctccagcccagccttggaactgcccgatttgctgctcctggcaggacccgctaaagaaaatggacacctgcagctgttcggcctgtttccccttaaatttgttcagttatttgtacacgacaagagtaggtgccaactggaagtgaagctgaatacctccaggacgttctatctccaactgagagctcccctaaaaacgagagacagggaattcggccagtgggtgcgtctcctgtaccggctgagattccttagtgcgagcgccgtgccgttcactcaagaatag

SEQ ID NO: 56297 - DNA, 744 bp, Artificial Sequence
  Description of Artificial Sequence: Synthetic coding sequence
atgggaccccctctgtggcctgacttacaggagcctcctcccccagggactagcagtcagattaggtcacccttactttgtgatgtaatcaagccagcaccacaccacgacgtcaccgttcgtgtggtaccccctcctaggttcctccctctcctgttacgccctctgccgtctgacggggacatcgccatgcggcgtgatcgcggtccaaaaccagcattgggaggtgccggagaagtcgagcccggaggcatggccgcttctccaaccgggcgtccacggcgtctgcagcgatacctgcagagcggagaattcgaccagttccgcgacttccctatctttgagtcaaactttgtgcagttttgcccagatatttacccggcaccgacgtctgacctgtggccacaagtgactaggctgggagaagtggctaacgaagtgacaatgggcgtggccgcatcgtcccccgcactcgagttgcctgacctgctcctgctggcgggaccggcaaaggagaacggacacctgcaactgtttggactgtttccactgaagttcgtgcagctttttgtccatgacaaatctagatgtcagctggaagttaaactgaacaccagtagaactttttacctgcagctgagggcacctctcaaaacaagggaccgggagttcgggcagtgggtgcgcctgctgtatcgcctgcgattcctgtcggcttccgctgtgccattcacacaggaatag

SEQ ID NO: 56298 - DNA, 2769 bp, Artificial Sequence
  Description of Artificial Sequence: Synthetic coding sequence
atgatctggctcagaaacaggcggtgcttagaacccctgcaggggacacccaaatgggtccccgtcctcggcgagctgcagaagactcttcaaaaaggtgaatacctgcccctgaggcctttgcccatgttcgagtccaacttcgtgcaggtgacccaccaggggggtcctgttttcgtgaaccacaggacaaacagattggccatgggagtggctgctagcctcccaggactggtcctgcccgacattctattgatcggacagccagccgaggaccgggactgtagcgggctcgtcttaactaggatgattcctctagatcttgttcatctctgtgtgcacgacctgtcagcctggcgactaaagctcagattagtgagcggtcggcagtactacctggctctcgatgcaccggataacgaggtcggattcctttttcattgctgggtgagactcattaatttgctgcaggagcctgccccaacctggacaccaaggacaactcgcaccgcaccattggacatgccccttgctgaagcccctgcctcaacctggcatttgcaggatcaacccatttccaggcacgccgtgcgggtagccgagcgtaactttccacataaaacagttgccgctcagcgccagcggaaagccaaggctctcaagaggagctttaaatcccaggctgttggagactcagttccactgatctggagtcaactggagcatgcagacgtgcgcaaaaagccggctgagaaaaaaagccatagcgatccccgacccgaccggacccatacccagatccgcctccccgagaagacaagcatcactacatggacaatctttagcatcattagctctactgccaaccagactcaaagttcccctaaagcttgcaccagcgcaagtgatgaagcgaccgggcagggacacgtagtagaaagtccatcccactgtgtatcagccgactccccggacggattctttctcgggtcatgtagtagtctggacccatgtctgtggcatcaagataccgaggatctcatggatagcgggggaagtacactgagctccgccgctagcgggctcgccccataccctcccgctgcttgcctctccactccctattcttcaattccaaggggacgcgagaaagccggaccgatgggcagccatcaaggacctggacctcctccgtgtcagaaagccccatctgggcttgtcacatcatgcaaggctccattccttgtggatcagtctcagaaactgcctgcagtgcccgcaagcagctggaagcctcctccaggcctggcccctccacagaaggccccagcagcgtctgcaccaccacggaaagcgccagctgtgcccgctccaagtcaaaaagcccctgcagtccctgctccatcacagaaagcgccagccatccccgctccgtctcggaaagcctcggccgcttccgcttctcccaggaaagccagcgctgttccagcccctccacaaaagacacctcccccttctcagaaggcgccttccgtgcccaccattcctcaaaaggccgtatcacctacagcccctaaaaaaaagagtcttctgcttcccgctccatcacagaaggcgttaccaacgtccccgaccgagtaccagatggcactgtccccacccgcttccagaggcaagctgccaggagatttcgatgtgttgccaaccgggatccccggtcgagccgtcttggagcgttctcagagcggcggtaagcctgaaccggtggtgaccgtgaggacccaagagactgacgtggttgaaatgacaactcaggcgaaatctcctgaaagcccttttaccgtgacgaaaaaggaatcaaaggacatactaatcagtcagacaaaggaggtgacactggaggctttccgcggtcaggggaagctggaggattgggctcactgggcaaagctggaggaacgatctccagacctgcctggcgtgagatctaaagagttggaacagaggaagagatgggttaaagccaaggagctggccgtagagggaccctcacaggagcattctcgtccttttagcgtggaagctctgactttgactaaactgatgatcaccgcgaactccaaggaacagccaagcaagtctgctctcgtgtccctacccagctggctgctagccacccctcaagccagcgctacttctatgatggcctccgttccctcccgtccagggcaattgtccttgttggaagggaagcctgtcgtggtgcgggaacaacctgagtcccatacctgggtgaaggaaggcaaaaggccctggggagagatgaaagagcagccttggggggagatgaaggagccaccttgggaccccaagggacctcccaaggtgccttttagatcaaagcctacttctgcttctttaaaaagggaagggatcagtcaggcccctatccccctgaccgccagtccctgggaggaccttaggccgagcccgctgtctgaaacactgatatcaaaaatggaggcaactgctagagccagtcagcagccaaagcgggtaagtcaagagcccatgcgcatgcccgctcagcatcccctggccaccgttgggagcagttccgaaatcctattgcccatgttgcttgagctggagaccgtgcgcaacactgcgactaaagcagaggagatccaggaggagagtggcgtactgaacctgctgcccagtctgcagcactcccagcacagtgaatggccagacgctggggcatag

SEQ ID NO: 56299 - DNA, 1035 bp, Artificial Sequence
  Description of Artificial Sequence: Synthetic coding sequence
atgctgagtagttttccacatcgaaagacatggaggaaatccaagaagaccgtgaaagtgacaaggagctatccaacctttcctagcctgaacgcttgggaggagttccgcggtctgcttcccgtagatggtgaacctaaccccggtgctggcctgggagtcgaggagggactgttgtgtcgtgtcgtgcacagtcccgaattcaatctgtttcttgactcggtggtgttcgagtcaaacttcattcaggtgaagcgcggtaggaactggagagatgtctacaaggcttcaaatactatggcgctaggtgtgacttccagtgtgccttgcctccctcttcctaatattctgctaatggcatctgtcaagtggcaccagggacagaaccagacttggaacagacccagcatagcacccaacatcttcttgaaacggattctccccctccgctttgtcgagcttcaagtctgtgaccactatcaacgcatcctgcagctccggacagtgactgaaaagatttactaccttaagctgcaccctgatcatcctgagactgtgttccatttttggattcgacttgttcagatcctgcaaaaagggctgagcatcactacaaaggatcctcggattttggtgacacactgcttagtgcccaagaattgctcaagcccttcgggggactctaaactggttcagaaaaagttgcaggcatcccagccaagtgagtccctcatccagctgatgactaagggggagagcgaagctttgagtcaaattttcgcagacctgcaccagcagaaccaacttagtttcaggtcctcaagaaaggttgagactaacaagaattcttcaggaaaggacagctctagagaggattctatcccttgtacatgtgatctgaggtggagggccagctttacctatggagagtgggaacgggaaaacccttcaggtttgcagccactcagcctcctgagcactctggctgctagcacaggaccccagttagctccccctattggcaatagcatttag

SEQ ID NO: 56300 - DNA, 903 bp, Artificial Sequence
  Description of Artificial Sequence: Synthetic coding sequence
atgtccaaaatcagaggtctgccacctgaagtgcgcgaaccaggacctggcgttgaactcggggtcgagaacgggctcctttgtcagctgatccatagcccagagttcaacctcttctcaaactctgttgtctttgagagcaatttcatccaagttacaaagcccggaaactggcgggacgtttgtgagggatctgctaccgtcattttaggtgttacctcctctgtcccctcactccctctcccaaatgtgctcctgatggccaatgtgacttggccgcagggcccattcactacctggagcactccgggtgacgcgcctgtcatcaatctgagcaggctcttgcccttgaaatatgtggagcttagaatctatgacaggctccagcggattctgcgagtgaggaccgtcactgagaagatttactacttgaagttgcatgagaagcacccagagatcgtttttcagttttgggtacggctggttaagatcttacaaaaaggcctgagtattactacgaaagaccccaggataaaatttacccattgcctggtcccaaagatgcctacaaacagcacagaaaccacgccagagaactcactcctgtcatcccctcagccttccgagcctttggtactcttagctgctgaacagacttccgggagcttctcacagctatccgggaaaccccagttgacagcggaccgcaacaatgacacagccatcgagatcgacaactgttcgagttataaaatcccttcgcctgtggccagccctattaatctgaacataccgatgcgcgcagccctctcacactccctgtgggagcaggaggattggaacgaacatctgctgcaagtgcacatcgcgtcttatctcggtgagcattttctgggagcgtag

SEQ ID NO: 56301 - DNA, 903 bp, Artificial Sequence
  Description of Artificial Sequence: Synthetic coding sequence
atgtcaaagattcgaggccttcctcctgaggtacgagagcccggtccaggggtagaattaggggtggagaacggtttgctatgccagctgatccattcacccgaatttaacctattttctaatagcgtggtcttcgagtcaaactttatccaggtcaccaagccaggcaactggcgcgatgtatgtgagggatccgcgaccgtaatcctcggagtgacatctagcgtcccatcactcccgcttcccaacgtactgctaatggccaatgtgacttggccccaggggcctttcaccacctggtcaacaccgggagacgcccctgtgatcaacctgtctcgtcttctgcctttgaaatatgtggaactgagaatatacgacaggctccaacggatcctgagggtgcgaactgtcacagaaaagatttactacctgaaattgcacgaaaagcaccctgagattgtgttccagttctgggtgaggctggttaagattttgcagaaagggctgagcatcactacaaaagaccctagaattaaattcacacactgtctcgtgccaaagatgccaaccaacagcaccgaaacaactcccgagaactcacttctgtcaagcccacagccatcagagcctttggtgttgttagccgctgagcaaacatcggggtccttcagccaactgtcaggcaaaccccagttgacggcagaccgcaacaatgacaccgcaatcgaaatcgataactgctcctcttataaaataccgtcccccgttgcgtctcccataaacctcaacattcctatgcgcgctgctttatcacacagtttgtgggagcaggaagattggaatgaacaccttctgcaggtgcacatcgcatcctacctaggagaacattttctcggcgcatag

SEQ ID NO: 56302 - DNA, 903 bp, Artificial Sequence
  Description of Artificial Sequence: Synthetic coding sequence
atgagtaagatccggggactgccgcctgaggttcgggagcccggacccggagtggagttaggagttgaaaatggactcctgtgccagctgatccattcaccagagttcaatctcttcagcaactctgtagtattcgagtcaaattttattcaggtaacgaaacctggcaattggagggatgtttgcgaggggagtgccactgtgattctgggtgtgaccagctcggtgcccagcctgcctctccccaatgtactcctcatggcaaatgtgacctggccacagggtccctttaccacttggagcacacccggagacgccccagtgatcaatctgagccggctcctcccattgaagtacgttgaacttaggatctatgatcggttacagcgaatcctgagagttcggaccgtgacagaaaagatctactacctgaaactgcatgaaaaacaccctgagatagttttccagttttgggtgcgattggtaaagattctccagaaggggctgtctatcaccacaaaggacccccgtatcaagttcacccactgtcttgtgccaaagatgcctaccaactctacagaaaccacacctgaaaacagcctcttgagctctcctcagccttcagagccccttgtcctcctcgccgcagagcagacaagcggaagctttagccaactatccggaaaaccccagttgactgcagataggaacaatgacaccgcaattgaaattgataattgctcgagctacaaaatcccttctcccgtagcttccccaattaacttaaacatcccaatgagagctgctctgtcccattctttgtgggaacaggaagattggaacgaacatctgttacaggttcatatcgcttcctatctaggagaacacttcctgggagcctag

SEQ ID NO: 56303 - DNA, 930 bp, Artificial Sequence
  Description of Artificial Sequence: Synthetic coding sequence
atgagcaagatcagaggcctgcctcctgaagtgagggagcctggcccaggtgttgaactgggtgtcgagaacggactgttatgtcaactgatccacagtcctgagttcaacctattttctaactcggtggtgtttgagtctaactttatccagactcacgtgcccgaggccgacttccaggtaaccaagccgggtaattggcgggatgtatgcgaggggtccgctacagtcatcctgggtgtcaccagcagcgtgccgagcctccctttacccaatgtactcttgatggccaacgttacttggccacaaggtccattcaccacctggtcaaccccaggagacgccccagtcatcaacctgtccaggttgctgccactaaagtatgtggagctgagaatttacgatcgtttacagagaatcttgcgggtccggaccgtgacggagaagatatattatctaaagcttcatgaaaaacatccagagatagtgttccagttttgggttaggctagtgaagattctacagaagggcctgagcattaccaccaaagatcccagaatcaaattcacccactgcctcgttccaaagatgcctaccaacagcactgagaccacccccgagaacagcctgcttagttctccgcagccaagcgaacctctcgtcttgttagccgcagagcaaacgtcaggcagcttctcgcaactgtcaggcaagcctcagctgactgccgaccgcaataacgacaccgccatcgaaatagataattgctcttcctataaaatcccatctccagtggcctccccaatcaacctgaacattcccatgagagcagcgctgagccacagcttgtgggagcaagaggattggaatgaacatcttctacaagtgcacatcgcgtcataccttggcgaacacttcttgggtgcgtag

SEQ ID NO: 56304 - DNA, 330 bp, Artificial Sequence
  Description of Artificial Sequence: Synthetic coding sequence
atgagtaccaatatttgttcattcaaagattccgcggttgatttcaccgggcgatgctattttacaaagatctgtaaatgcaaactgaaagacatcgcctgcttaaagtgcgggaatatcgtggggtaccacgttattgttccgtgtagtagttgcctcctcagttgtaataacggacacttttggatgtttcacagtcaggcagtgtatgatatcaacaggttagactctactggtgtgaatgttctcctgtggggcaatctgcctgagattgaagagtctacggacgaggacgtcctgaacatttctgctgaggagtgtatcaggtag

SEQ ID NO: 56305 - DNA, 450 bp, Artificial Sequence
  Description of Artificial Sequence: Synthetic coding sequence
atgtctaccaacatatgttccttcaaggatcgctgcgtgagcatattatgctgtaaattctgcaaacaggtgctatcgtcccgagggatgaaagccgttttattggccgataccgagatcgatctgttctctaccgatatcccccctaccaacgcagtcgactttaccggacggtgctatttcacaaagatctgcaagtgcaagctgaaggatatcgcctgcctcaaatgcggcaacattgtcggctaccacgtgatagtaccttgttcgtcctgcctcctgagttgcaataacggacatttttggatgttccatagtcaggccgtgtacgacataaacaggctggacagtaccggggtgaatgtgctgttgtggggaaacctgccagagattgaggaaagcactgatgaagacgtgctgaatatctccgccgaagagtgcattcgctag

SEQ ID NO: 56306 - DNA, 450 bp, Artificial Sequence
  Description of Artificial Sequence: Synthetic coding sequence
atgcccaccacgacagcactgcgttggactgctgccgctagggtgcggcgaaagggcagggggggatgggtgcctgccgctctgcggtctgtaagtcaggacggcgtgcccggatgcacagtaatggggggtgaaactaggtcccccgaaaatgcagttgactttacaggccgatgctattttaccaaaatatgcaaatgtaagctcaaggatatagcctgtttgaagtgcgggaatatcgtgggctaccacgtgattgtcccatgttccagttgtctgctgtcttgtaataatggccacttctggatgttccattcccaggcagtgtacgacatcaaccgcctcgacagtaccggtgtcaacgtgctcttgtgggggaatttgcctgagattgaggaatcgaccgacgaagatgtattgaatattagcgccgaagagtgtatccggtag

SEQ ID NO: 56307 - DNA, 330 bp, Artificial Sequence
  Description of Artificial Sequence: Synthetic coding sequence
atgtccactaatatttgctcattcaaggattccgcagtcgacttcaccggcaggtgttattttactaagatctgtaagtgcaagctgaaggacattgcttgtctgaaatgcggaaacattgtcggctaccacgtcatcgtgccatgttcttcatgcctcccttcatgtaataacggccacttctggatgttccactcgcaagctgtatatgatataaatagactcgattctaccggggtcaatattctgctgtggggcaacctccccgagattgaagaaagtactgatgaggacgtccttaatatctcggcagaggagtgcatcagatag

SEQ ID NO: 56308 - DNA, 450 bp, Artificial Sequence
  Description of Artificial Sequence: Synthetic coding sequence
atgtccaccaacatttgcagctttaaagatcggtgcgtctccatcttgtgctgcaaattctgtaaacaggtattgagttcacgcggaatgaaagccgtgctgctggctgacacagagattgacttgttcagcaccgatattccacccactaatgcggtggactttaccggcagatgctacttcactaagatttgtaagtgtaaactcaaagatatcgcctgtctgaagtgcggcaacattgtaggttaccacgttatcgttccctgcagttcttgtctgccctcttgcaacaacggacatttctggatgttccacagccaagcagtatacgacattaaccgcctggatagcacgggagtcaatatccttctctggggaaatctgccagaaatagaggaatcaacggatgaggatgtccttaacatctctgccgaggagtgcatccggtag

SEQ ID NO: 56309 - DNA, 363 bp, Artificial Sequence
  Description of Artificial Sequence: Synthetic coding sequence
atgaaagccgtgctcttggccgatactgaaatcgatttgtttagcaccgatatcccccctaccaacgctgtggactttaccggcagatgctatttcaccaaaatctgcaaatgcaaattgaaagacattgcatgtctcaagtgcggcaatatcgtgggctatcatgtcatcgtcccctgctcgagctgtttgccaagctgcaataacggacacttctggatgtttcattcacaggccgtctacgatatcaaccgattggacagtactggcgtcaatatcctgctgtggggaaacctcccggaaattgaggagtctactgacgaggacgtcctcaatatctctgctgaggagtgtatcaggtag

SEQ ID NO: 56310 - DNA, 363 bp, Artificial Sequence
  Description of Artificial Sequence: Synthetic coding sequence
atgaaggcagtgctgctcgctgacaccgaaatagacttattctctactgacataccacccaccaatgcagtcgatttcactgggaggtgttactttaccaagatctgtaagtgtaaactgaaggatatagcctgcctcaagtgcggcaatattgtggggtaccatgttatcgttccttgtagctcatgcctgccgagttgcaataacggccacttctggatgtttcattctcaggcggtctatgacatcaaccgtctggatagtaccggagtgaatattctgctttggggcaatctgccagagatcgaggaaagcaccgatgaggacgtgctgaacatctcagcagaggaatgtatcaggtag

SEQ ID NO: 56311 - DNA, 222 bp, Artificial Sequence
  Description of Artificial Sequence: Synthetic coding sequence
tgaggaaacattgtcgtttatcacgtcatagtgccctgtagctcctgcctgctctcctgtaacaaccggcacttctggatgttccacagccaggccgtctacgacataaacaggctggactcaaccggggtcaacgtgttactgcggggaaatctcccggagatcgaggaaagcacagacgaggatgtgctcaatatttcagccgaggagtgtataaggtag

SEQ ID NO: 56312 - DNA, 450 bp, Artificial Sequence
  Description of Artificial Sequence: Synthetic coding sequence
atgtctaccaacatatgcagctttaaagaccggtgcgtttccatattgtgttgtaagttctgcaagcaggtgctttcttcaagagggatgaaggccgttttgctggccgacacagagatcgacttattttctactgacatcccccctacaaacgccgtggatttcactgggcgatgctacttcactaaaatttgtaagtgcaagctgaaggatatcgcatgcctgaagtgcggcaacatcgttgggtaccacgtcatagtcccatgttcaagctgtttgctatcttgcaacaacaggcacttttggatgtttcactcccaggctgtctatgacattaatcgcctcgacagtactggagtgaatgtgctgctgcggggtaaccttccagagatagaagagagtaccgacgaggatgtgctgaatatttccgctgaagagtgtattaggtag

SEQ ID NO: 56313 - DNA, 549 bp, Artificial Sequence
  Description of Artificial Sequence: Synthetic coding sequence
atgaaaccttggtgggcacgcgattgggctcttccaagtaggggtcaatgcgtgtgtccaggagagacaaacgcctgtctggacgcagagcgtgcttgtcgtgagtgcccacgcggtctcgaggaaacctgggatctcttgtctcagctgcaatctctcttgggcacccatctggacaaaggtgattttgggcaactctccggacccgagccccctggcgaggtgggcaaaagggcgcctgacggtgctagtcgaagcagtctggaacccatggaggacgcagcaccaatcatctacctgttggcttccccggatccacgaattaagcaccctcaggacctcgccagcacgccaagcccgggaccaatgactaccagcgtgagcagcctgtcggcttctcaacctccagagccttctctacttctcgagagaccctcgccaaagccacctgcactgtttctaacacatcacacgccactgattttatggcccgcactgttgttgctccagaagacctcccttttgctaccttgcggaaccccgctctag

SEQ ID NO: 56314 - DNA, 1026 bp, Artificial Sequence
  Description of Artificial Sequence: Synthetic coding sequence
atggcagcactgtacgcttgtacaaagtgccaccagagatttccttttgaggcactaagtcaagggcagcaactctgcaaggagtgtagaatcgctcatcctgttgtgaaatgcacttactgcagaactgaatatcagcaggagcgcctggagtgcaatggaaccatctccgcccactgtaacctccatctgccgggaagttctgatagtcccgctagcagttctcgagtcgctggtatcacgggtattaagaccaacacgatctgtaagaagtgtgcccaaaacgtgcagctgtacggaacccccaaaccatgccagtactgcaacattatcgctgcctttatcggcaacaagtgtcaaaggtgcacgaactctgaaaaaaagtacgggccaccctactcttgcgagcagtgcaagcagcagtgtgcatttgatagaaaggacgacaggaagaaagtggacgggaagttactgtgttggctgtgtaccttatcatataagcgtgtgctgcagaagactaaggaacagcgcaagcacctgagttcatcctcccgtgctggtcaccaagaaaaggagcagtactcacgcctgtcaggcggtggacactataatagccagaagaccctgtccacgagttcaatccaaaatgaaattcctaagaaaaaaagcaagttcgaaagtatcacgacaaacggcgatagtttctcccctgatttagctctcgacagcccagggactgatcacttcgttattattgcacagcttaaagaagaagtcgccaccctcaaaaagatgctgcaccaaaaggaccagatgatcctggaaaaggaaaaaaagattaccgaactgaaggccgattttcagtaccaagagagccaaatgagagcaaagatgaaccagatggagaagacccataaggaagtcaccgagcaactccaggccaagaatcgcgagctgctgaagcaagccgcagccctcagcaagtctaagaagtctgaaaaatctggcgcaatcacctccccctag

SEQ ID NO: 56315 - DNA, 2352 bp, Artificial Sequence
  Description of Artificial Sequence: Synthetic coding sequence
atggaggatgagcagccagattctctcgagggctgggtgccggtgcgagaaggtctgtttgctgagccagagaggcatcgccttagattcctcgtggcttggaacggcgctgaaggtaaatttgcagtgacctgtcacgatcggactgcacagcaaaggaggctcagggaaggggctcgactcgggccagagcctgagcccaagcccgaagctgcagttagcccgtcatcctgggccggtttgctgtcagctgccggtctgcgaggggctcatcggcagttggcagctctctggcctccgctcgagagatgtttccccagactcccgcctgagctcgacgtaggagggggtggggcatggggcctcggactgggcctgtgggcgctcctgtggcctactcgcgctggacccggagaggccgcacttcaggagctgtgcggccagcttgagcggtatttgggtgctgccgcagatggctgtggaggcgctaccgttagggacgcactgttcccagcggaaggaggagcagctgattgtgaatcgcccagggaatttcgagaacgagctcttcgtgcccgttgggttgaggcagatgctcgtctgagacaggttatccaggggcacggaaaggccaacacaatggtggcgcttatgaacgtgtatcaggaagaggatgaagcttaccaagagctggtgaccgtggccacaatgttcttccagtacctcttgcagcctttcagggccatgagggaggtagccacgctctgcaaactggatattcttaagtccctggacgaggacgatctcggtcccaggcgcgtcgtcgcactagagaaagaggcagaagaatggacccgcagagctgaggaggcagtggtgtccattcaggacattacggttaactattttaaggagacggttaaagctttagcaggcatgcagaaggagatggaacaggacgctaaacgctttggccaggccgcatgggcaacagccatcccacgccttgagaagcttcagctgatgctcgccagagaaaccctgcagttaatgagggccaaagagctctgtctaaaccataagagagcagaaatccaggggaagatggaagacctgccagagcaggaaaaaaatacaaacgtcgtcgatgaactggaaatccagttttacgagatccagctggaactgtatgaagtcaagttcgaaatcctcaagaacgaggaaattttgttgacgacgcagttggattccctgaaacgtctgattaaagagaagcaggatgaggtggtgtactacgatccctgtgaaaaccccgaggaattgaaagtaatcgattgcgtggtgggactgcaggacgacaagaatctggaggtgaaagaactgcgaagacagtgccagcagctggaaagcaagaggggaaggatctgcgccaaaagggcctccttgagaagtcgcaaggaccagtgtaaagaaaatcatcgtttccgcctccagcaggccgaagaaagtattcgctattcgcgccagcaccactctattcagatgaaacgtgataagattaaggaggaagaacaaaagaagaaggaatggattaatcaagaacggcagaaaacactgcagcggctgcgaagcttcaaggacaagagactggcccaaagtgtgcggaacacttccggcagtgagcctgtggctccaaacttgccttccgatctgtctcagcaaatgtgcctgcctgcttctcacgcggtaagtgtgatacacccaagctcacggaagactaggggggtgcccttgagcgaagccggaaatgtcaaatctcccaaatgtcagaattgccacggtaacatccccgtgcaggttttcgtgccagttggtgatcagactcattcaaaaagctctgaagagcttagtctgcctccccctccccctcccccaccaccaccaccacctcctcccccacctcccccaccaccactccgcgcactgtccagctcgagccaggcagcaacccaccagaacctggggtttagagccccagtgaaggacgaccaacccagaccgctggtgtgcgagtcccccgcagagcgtcccagggattcactagaatcattcagttgcccaggatccatggacgaggttctagcttccctgcggcacgggcgagcccagggagtcaagctgaagaaagtgcatccggatctagggccaaatccctcatcgaaacccacatccaaccggagaaccagtgaccttgaacgatcaattaaggcagccctgcagcgtataaagagagtgtccgccgactctgaagaggattccgacgaacaggacccaggccagtgggatggatag

SEQ ID NO: 56316 - DNA, 837 bp, Artificial Sequence
  Description of Artificial Sequence: Synthetic coding sequence
atggccgcactgtatgcttgcactaaatgccaccaacgcttccctttcgaggctctttcacagggacagcagttgtgcaaagagtgtaggatagctcaccctgtggtgaagtgcacctattgtcgcaccgagtaccagcaggagtcaaagacaaataccatttgcaaaaagtgtgcacaaaatgtacagctctacgggacccccaagccctgtcaatattgtaacattatcgccgctttcatcggcaacaagtgtcagaggtgcaccaattccgagaagaaatatggcccaccctacagctgcgagcagtgcaagcagcagtgtgcttttgatcgaaaagacgatagaaagaaagttgacggtaagctcctttgttggctgtgtacactctcttataaaagggtccttcagaagaccaaggagcagcgcaagcacctgagcagttcctcaagggccggacaccaggaaaaagagcagtactcgagactgagcggcggaggacattacaattccttcagcccagacctagccttagattcgcctggaaccgatcatttcgtgattatcgcccagcttaaggaggaggtggcaactctgaagaagatgctgcaccagaaggaccagatgatcctggaaaaggaaaaaaagattactgagctgaaggccgactttcaatatcaggaaagtcaaatgagggcgaagatgaatcagatggaaaagacccataaagaggtcactgagcagttacaagctaaaaacagagaactgttgaagcaggctgctgctcttagcaaaagcaagaagtcagagaaatccggcgctatcaccagcccatag

SEQ ID NO: 56317 - DNA, 924 bp, Artificial Sequence
  Description of Artificial Sequence: Synthetic coding sequence
atggcggctttgtatgcatgtacaaagtgtcatcagcggtttccatttgaagcactgagtcagggacagcaactctgtaaggagtgtaggatcgctcacccagtggtgaagtgcacctactgcagaaccgagtatcagcaggaatcaaaaacaaacaccatttgcaagaaatgcgcacagaatgtgcagctctatgggacaccgaaaccatgccagtattgtaatattatagccgcattcatcggcaataaatgccagagatgtaccaattctgagaagaaatacggcccaccatactcgtgcgaacagtgtaagcagcagtgcgccttcgacagaaaggacgatcggaaaaaggttgacgggaaactcctttgttggctttgcactctgagctataagcgagtgcttcagaagaccaaagaacagagaaagcacctgtcttccagcagccgtgcgggtcaccaggagaaagagcagtacagccgcctctcaggcggtggacactacaatagccagaaaaccctcagcaccagttcaatccagaatgagatacccaaaaagaagagcaagtttgagagcattacaacaaacggcgattccttctcacctgacttggcactcgattccccgggaactgaccacttcgtcattattgctcagctgaaagaagaggtcgcgaccctgaagaagatgttacatcagaaggatcagatgatcctagaaaaggagaaaaagattaccgagctcaaagcagacttccagtaccaggagtcccagatgagggctaagatgaatcagatggagaaaacacataaagaagtgacggagcagctacaggctaaaaaccgtgagcttctgaaacaagctgccgctctgagtaagagcaagaaatccgaaaaaagcggcgctattacatcaccctag

SEQ ID NO: 56318 - DNA, 684 bp, Artificial Sequence
  Description of Artificial Sequence: Synthetic coding sequence
atggctgcactgtacgcatgtactaagtgccaccaacggttcccctttgaggcactgtcacaaggtcagcagctgtgtaaggaatgtcggattgctcacccagttgttaagtgtacatattgccgcaccgagtaccaacaggagagtaagactaacacaatctgtaagaagtgtgcacagaatgtgcagctttatggcactgtggacggcaagctgctgtgttggctctgcacgttatcctacaagagagtcctgcagaagacaaaagagcagcgaaagcacctgagcagctcgtccagggctggtcaccaggagaaagagcagtactcacgcctgtctggcggaggacattacaacagcttttcacccgacctcgccctcgattctcccggtactgaccacttcgtcattatcgcccaactcaaggaggaggttgccacccttaagaagatgctccaccaaaaggatcagatgatcctcgagaaagagaaaaaaatcacagagttgaaagcagactttcaatatcaggaatcgcagatgcgcgctaaaatgaaccagatggagaaaacacacaaggaggtgaccgagcagctccaagctaagaaccgcgaattgctgaagcaggccgcagccctttccaagagcaaaaaatccgaaaaatctggcgctatcacatctccttag

SEQ ID NO: 56319 - DNA, 1020 bp, Artificial Sequence
  Description of Artificial Sequence: Synthetic coding sequence
atggctgcaagtgctctctatgcttgcacgaagtgcacgcaaaggtacccctttgaggaattgagccagggccagcagctgtgcaaagagtgccgcattgctcaccccatcgtcaaatgtacatactgccggtccgagttccagcaggagtctaagaccaatacaatctgcaaaaaatgcgctcagaatgttaagcagttcggcacccctaagccatgtcaatactgcaacatcattgctgctttcatcggcaccaaatgccaacggtgtactaatagcgagaagaaatacggtcctccccagacatgtgagcagtgtaaacagcagtgcgcatttgatagaaaagaggagggaagacgaaaggttgatgggaagctgctgtgctggctctgcactctctcttataagagggtgcttcaaaagaccaaagagcaacgtaagtccctgggaagcagtcactctaattcttccagttctagccttaccgagaaggatcagcatcaccccaaacaccaccaccaccaccaccaccaccaccaccgacactctagttctcaccataaaatctcaaacctgtcacctgaggaggaacagggactatggaagcagagtcataagagttctgcgactatccaaaacgaaactccaaagaaaaagcccaaacttgagagtaagcccagcaacggcgactctagctcaataaatcagtctgcagattcaggaggtactgataattttgttttgatctcccagctgaaggaagaagtgatgtccctgaagcgtttacttcagcagcgggaccaaactatcctggaaaaggacaaaaagttgacagaactcaaggctgatttccagtaccaagaatctaatcttcgcacaaagatgaacagtatggaaaaagcacacaaagagacagtggaacaactacaggctaaaaaccgcgaactactcaagcaagtggcggcactctctaagggcaaaaaattcgacaaaagtgggagcatcctcacgtccccctag

SEQ ID NO: 56320 - DNA, 843 bp, Artificial Sequence
  Description of Artificial Sequence: Synthetic coding sequence
atgacgtcttacatcctgatctctttcgtgttactcattggtgtcggatgcatcgaaaaggaccaaagttgcccagtgtttggcggaaggaaacgactgcacctgctgtttgtgggcggacagctccgacaggtgagaatgctgagaggatctccagaagcaagcacagattgctgttggttacatcaggcgaccgggtccggctccgtaacccaagccggtgtacaatggtacgatctcggcagcttgcagcctctgccgcctcgcttcaagaggtttagctgtttgagtctccccagttcttgggattaccggagctcttgggagctgcccgatctgcaggagggtaagatccaggctatcagtgatagcgacggcgtcaactacccctggtatggtaatacgactgaaacttgcactatcgtgggtcctaccaaacgcgacagcaaatttatcatttcaatgaacgataatttttacccctccgtcacttgggcagtccccgtcagcgagtctaacgttgcgaagctgacaaacatttaccgtgaccaaagtttcactacgtggctcgtcgctaccaacacgtcgactaatgacatgattatactccaaacactgcactggagaatgcagctgtcaattgaggtcaaccctaatcgtcccttgggacagcgggcaaggctaagggagcctattgcccaggaccagcccaaaatcctgtcaaaaaacgagccaattccgccatccgcccttgtcaaaccgaacgctaacgacgcgcaggttctgatgtggaggccaaagtatgggcaaccattggtcgtgattccgccaaagcacagatag

SEQ ID NO: 56321 - DNA, 852 bp, Artificial Sequence
  Description of Artificial Sequence: Synthetic coding sequence
atgccaggttttttttgcgactgctggcccagtttggagataagggccctcctgtatgccatgggctgcatccaatcgatcggaggtaaagcacgagtgttcagggaaggaatcaccgtgatcgacgtgaaagccagtattgaccccgtccccacctcgatagacgagtcttcctccgtggtcctgcgatacagaactccccattttcgagcttcagctcaggtcgtcatgccacccattcccaaaaaagaaacatgggtagttgggtggattcaggcctgttcccatatggaattttataatcagtacggtgagcaggggatgagctcatgggaattgcccgacttacaggagggtaagatccaggctatcagcgactcagatggcgtgaactacccctggtatggcaatacaaccgagacctgcaccattgttggcccaaccaagcgcgactccaaatttatcatctcaatgaacgataatttctacccctctgtcacctgggccgtgccagtttctgaaagcaatgtggctaagctgactaacatataccgtgaccagtcttttaccacctggctggtggctaccaacacaagtaccaacgacatgattattcttcaaactctgcattggcgcatgcaactgagtattgaggtgaacccaaataggcctctcggccaacgggcacggcttagggaacctatagcccaggatcagcctaaaatcttaagtaaaaacgagccaatcccaccttccgcgctggtaaaacccaacgctaacgacgcgcaggtgctgatgtggaggcccaaatacggtcagcctctagtcgtcatcccaccaaaacacaggtag

SEQ ID NO: 56322 - DNA, 759 bp, Artificial Sequence
  Description of Artificial Sequence: Synthetic coding sequence
ggtcagggtatcgccgcagctctgatacacttgccctcaacaggcaacaagcactggaggcccaggagccccgaagcttcaacagactgttgctggctccaccaggctacagggtccgggtccgtgactcaggccggagtgcaatggtacgacctcgggtcgctccagccactgccccctcgctttaagaggttttcttgcttatctctccccagctcttgggactatcggtcttcatgggaactcccggacctgcaggaaggcaaaattcaggcaatttctgactcagatggggttaattacccctggtacggaaacacaactgagacttgcaccatagtgggacctacaaagcgtgactcaaagttcattataagtatgaacgacaacttttaccctagtgtcacatgggcagttcccgtgagcgaatccaacgttgcaaagcttaccaatatctaccgcgatcagtcatttacaacctggctggtggcaacaaacacaagtacaaatgacatgatcatcctgcagactcttcattggcggatgcagctgtccattgaggtgaatcccaacagacccttgggccagcgcgctcgcctcagagaaccaatcgcacaggaccagcccaaaatcctaagtaaaaacgagcccatccctccatccgccctggtaaagcccaacgccaacgatgcccaggtgctgatgtggagacctaaatacggccaacctctggttgtcatcccccctaagcatcgctag

SEQ ID NO: 56323 - DNA, 786 bp, Artificial Sequence
  Description of Artificial Sequence: Synthetic coding sequence
atgggatgcattcaaagcattacatgcaaagcacggattcgacgggagaatatagttgtttatgacgtgtgcgcaactatcgaccagtgtccgacccgcatcgaggagacttctccaatcgtgctgcgctacaaaacaccgtatttcaaggcttctgctcgggtggtgatgccacccatccccaggcacgagacatgggtcgttgggtggattcaggcctgcaatcagatggaattctttaacacttatagcgatctgggcatgtcttcgtgggagctgccagacttgcgtgaaggacgagtcaaggctatcagtgacagtgatggcgtgtcctacccttggtacggcaataccacagagactgtcactcttgttggacccacgaataagatatcccgcttcagtgtatcaatgaatgataatttctatccctcagtgacctgggcggtacccgtgagtgacagcaacgtgcccctgctcacccgcattaaacgagaccagtcatttaccacttggcttgttgccatgaataccaccactaaggagaaaatcatcctgcagacaattaaatggcggatgcgcgtggatatcgaggtggatccactccaactcctcgggcaacgagcccgtctggtgggcaggacacaacaagagcaacctcgtatcctgtcccgtatggagcctatcccgcctaatgccttggtgaagcccaacgccaatgatgcccaagtattgatgtggcgccctaaacgcggaccgccactagtcgtgatccctcctaagtag

SEQ ID NO: 56324 - DNA, 786 bp, Artificial Sequence
  Description of Artificial Sequence: Synthetic coding sequence
atgggttgtatacagtccataacttgtaaggctaggatccggagagagaatatagtcgtctacgacgtgtgtgccactatagatcagtgtcctacacgcatagaagagacctctccaatcgtgttgcgctataagaccccctactttaaggcatctgcccgagtcgtcatgcccccaatcccgcgacacgaaacttgggttgtgggatggatccaagcttgtaaccagatggaattttttaatacttatagcgatttagggatgtcgtcctgggaattacctgacttgcgcgagggaagagtcaaggccatatccgattcagacggagtttcatacccatggtatgggaacacgacggagaccgtgaccctggtaggaccaacaaataaaatcagcagattttctgtgtcaatgaatgacaacttctacccttccgttacatgggctgtgcctgtctccgattcaaacgtgcccctgttgaccagaatcaagagagaccaatctttcactacttggctagtcgccatgaacacaacaacaaaggagaaaattatcctgcaaacaatcaagtggaggatgagggtggatattgaggtggaccccctgcagcttttgggacagcgcgcacggttagtgggcagaacccaacaggagcagccacgtattctgagccgaatggaacccattcctccgaacgccctggtcaagcccaacgccaatgacgcgcaggtgcttatgtggcgacccaagaggggaccccctttagtggtcatccccccaaaatag

SEQ ID NO: 56325 - DNA, 1107 bp, Artificial Sequence
  Description of Artificial Sequence: Synthetic coding sequence
atggagaacatgcatttacgcagggttaggacaatgccacggcactcacagagcttgaccatggcgccttatagcagcgtgtctctggtggaacaattggaagaccggatactctgccacgaaaagaccaccgcagccttagttgagcatgccttccgcatcaaagacgacatagtcaactctctgcagaagatgcaaaacaaggggggtggcgatcgcttagccaggctgttcctcgaggagcacattcggaatattaccgccatcgtcaagcagttgaatcgagatattgaagtgctccaggaacagatcagagcccgagataatatcagttatgggacaaactctgctcttaagaccctggaaatgaggcagctgagcggactgggggacctgcggggtcgggtcgcacggtgcgatgcaagcatcgcgaggctcagtgctgagcataaaacaacatatgagggcttacagcatctcaacaaagagcagcaggcagctaaattgatactagaaaccaaaatcaaggacgcagagggacagattagccaacttttgaacagggtggatctgtctatttctgagcagtccaccaagttaaagatgtcacaccgggactccaatcatcagctacaactcctggatacgaaatttaaggggacagtcgaagaattaagtaaccagatactgtccgcgaggagctggttgcagcaggagcaggagagaattgagaaggaacttctgcagaaaattgaccagctctccttgattgttaaggagaatagtggcgcatcagagagagacatggagaagaagctgtctcagatgagtgcccgtctggataaaattgaagagggacagaagaagacctttgacggacagcggacgcgacaggaagaagagaagatgcatggcaggatcaccaaattggaattgcagatgaatcaaaatataaaggagatgaaggcagaagttaatgccggattcaccgctgtatacgaatccataggctcgctccgacaagtgctcgaagccaagatgaagctcgaccgcgaccagctgcagaaacagattcagctgatgcagaagcctgagacgccaatgtag

SEQ ID NO: 56326 - DNA, 207 bp, Artificial Sequence
  Description of Artificial Sequence: Synthetic coding sequence
atggaaaatatgcacctcaggcgggtgcgaacaatgccacggcattcccagagcctgactatggcaccctacagttcagtctctctggtagagcagctcgaagaccgtatcttatgtcatgagaaaaccactgccgctctggtagagcatgctttcagaatcaaagacgatatagtaaacagtcttcagaagatgcagaataagtag

SEQ ID NO: 56327 - DNA, 327 bp, Artificial Sequence
  Description of Artificial Sequence: Synthetic coding sequence
atggagaatatgcacctgcgccgtgtgaggacgatgccaagacatagccaaagtcttactatggccccttattcatctgtctcacttgtggagcaattagaagatcgtatactgtgtcacgagaaaaccactgccgctctggtcgagcatgcctttcgcattaaggatgatatcgtcaacagcttgcagaaaatgcaaaacaaagggggaggcgatcgtttagctcgactgtttctagaggagcacatccggaatatcacagccatcgtgaagcaattaaatagagatattgaggtgttgcaggagcagatcagggctcgggattag

SEQ ID NO: 56328 - DNA, 204 bp, Artificial Sequence
  Description of Artificial Sequence: Synthetic coding sequence
atggaaaacatgcaccttcgccgtgtgcgaaccatgcctcgccatagccagtcccttacaatggcaccctactcctcggtgagtctagtcgagcaactggaagaccgaatcctctgtcacgaaaagacaaccgccgcactagtcgagcatgctttccgcattaaagacgatattgtcaactcgttgcagaaaatgcagaactag

SEQ ID NO: 56329 - DNA, 348 bp, Artificial Sequence
  Description of Artificial Sequence: Synthetic coding sequence
atggaaaatatgcacctccgtcgagtaagaaccatgccacgacatagtcagtccttgacaatggctccctatagctcagtcagccttgtggagcaactggaggaccgcatcctgtgtcacgagaagactactgccgctctagttgagcacgccttcagaatcaaggatgacatcgttaatagtctccaaaaaatgcagaacaaaggagggggtgaccggctggctagactgttcctagaggaacatatcagaaatatcacagcaatagtgaaacagcttaacagggacatcgaggtactgcaggaacagatacgcgctagagataacattagctacggtacaaattag

SEQ ID NO: 56330 - DNA, 177 bp, Artificial Sequence
  Description of Artificial Sequence: Synthetic coding sequence
atggaaaatatgcatctccgccgtgttcggaccatgccaagacattcccagagtcttactatggcaccttattcatcagtctccttggtggagcagttagaagatagaatcctgtgccatgaaaaaactactgctgcacttgtggagcacgcattcaggatcaaggatgacatttag

SEQ ID NO: 56331 - DNA, 402 bp, Artificial Sequence
  Description of Artificial Sequence: Synthetic coding sequence
atggagaatatgcatctgaggagggtgcgcaccatgccacgtcatagtcagtctttgacgatggccccatactccagtgtgtcactagtggagcagctggaggatcggatcctgtgccatgagaaaaccactgctgctctggtagaacatgccttccggataaaagacgacattgttaattcactgcagaaaatgcagaacaaggggggaggagatcggctggccagacttttcttggaagagcacatcagaaacatcaccgcaatcgtgaaacagttaaaccgcgacatcgaggtgttacaggaacagattagagctagggataatatatcatacggtaccaactctgctttgaaaaccctggagatgcgccagctctcaggactcggagacctgcgctag

SEQ ID NO: 56332 - DNA, 351 bp, Artificial Sequence
  Description of Artificial Sequence: Synthetic coding sequence
atggagaacatgcacttgcgcagggttagaactatgcccaggcatagccagagtcttacaatggcaccgtattcatctgtgagtctcgttgagcagctggaggatagaatcctttgtcacgagaagactactgctgctctggtggaacacgccttccgtattaaggatgacatagtgaactcacttcagaagatgcagaataaaggtggcggagaccgcctcgcgcgactattccttgaggaacacattaggaacatcaccgcgattgtgaagcagctcaaccgggatatagaggtgctgcaagagcagatccgtgcccgagacaatattagctacggaaccaattcgtag

SEQ ID NO: 56333 - DNA, 1359 bp, Artificial Sequence
  Description of Artificial Sequence: Synthetic coding sequence
atgcagcttcagttccttggtaccctggcaagttctgagaagagaaagaagtcacagcgtctttttttcaaaaacattaagtccacaaagaacaaggctggtaaggccagcattatgagctctgacacaaacgtaaataagtctgcatccccaactgcaaccgcagaagaacagccagtcgagccggacggtccactgcctggcagcgataacaaccaagagaagaaggtgagattatccccagccaagatgtcaacaaagaatagtacagatctagtcgaatacgtggacaagtctcatgcttttttgcccatcatccctaacacccaaagagggcaattagaggatcggctcaataatcaggcaaggaccatcgcctttcttctggagcaagcctttcggatcaaagaagatatctctgcttgtctacagggcacgcacggattcaggaaagaggagtccctcgctaggaagctcctcgaaagccatattcagacaatcacaagtatagttaaaaagctttcacagaacatcgaaattctcgaggaccagattagagcgagagaccaggctgccacaggaactaacttcgcagtgcatgaaattaacataaagcacttgcagggcgtgggcgatctcagaggtcgggtagctagatgtgactcgtccattgttaagctgtcaggggacattcatcttttccggcaggaacaccgtcagattgagaaggccattcaggaattcgtgcccgctttggaaacattgtcaaagaacctggacatgaaggtgatgcagctgctcggtaaaattgaaacagcatccccagaacagacaagcaatctgaagatggttcagggggattatcgacatgagatgaacctgttggaattcaagttccactctttaagtagtaatctttatgaggaggtggagaacaataagaagtggacggaaaaccagttcctgaagtataggaaggaccacctgggtcacatcaatgaatgccttaaagtgctgcaagagaagcttgaaaagtccgaaaataaaatggaggaaaaactactccagctgtcttctaaggtggaaaatttcatcaacacccagaaacaggaaacccaattgtccaaggtgaaacacatggaaaataaactctccaaaaagatggaacagatggaaaagcagatttggggcgaactggaaacgatgcagaatgagtatcagtcaggctttaagtctattcacgatagcctgagctccctgcagcaaatacaaaaaaccaaaatggatctggagaagtacaaggtgcagaaagatctgaaaaaactccaaaggaagattgtggaactccaagaggtgtag

SEQ ID NO: 56334 - DNA, 1104 bp, Artificial Sequence
  Description of Artificial Sequence: Synthetic coding sequence
atgagccgctctcgccacctgggcaagatccggaaaagactagaagatgttaagtcccagtgggttcgacctgcgcgagcggatttctcagataacgaatccgccaggctcgccactgatgctctactggacggcggaagcgaggcttattggcgggtcttatcccaggagggagaggttgactttctgagcagcgtggaagctcagtacattcaggcgcaggctagggaaccaccatgtccacccgacaccctgggaggggcagaagctggaccaaaaggcctggactcatcctccctacagtccggcacctactttccggttgcgtctgagggaagcgagcctgccttgctccactcatgggcaagtgccgaaaaaccttatcttaaagaaaaatcttcagcaactgtttatttccagaccgtgaaacacaataatattagagacttagtgcggagatgcatcactcgtacgtcacaggtgctggtcatcctaatggatgtgttcacagatgtcgaaatcttttgcgatatcctagaggcagctaacaagagaggagtatttgtgtgtgtgctcctcgatcagggcggagtcaagctctttcaagagatgtgcgataaagtgcagatctcagattcccatctcaaaaacatatctatccggtcagtagagggagagatctactgtgccaaatccggaagaaagtttgccggacagatacgcgaaaagttcatcatctcagattggaggttcgtgcttagcggttcatacagtttcacttggctgtgcggccatgtgcatagaaatatattaagcaagtttactggtcaggcagttgaactcttcgatgaagagtttcgacacttgtacgcctctagcaaacccgtgatgggactcaaatcccctcgtctcgttgctcccgtacctccaggcgctgccccagctaacggtcgcctttctagctctagtggatctgcatcagatcggacgtccagtaacccatttagcggccgttcagccggtagtcatccggttccagagagtaagcagaataagactaagacaaagaagcaaaccacgctctggtttctgatggccttttag

SEQ ID NO: 56335 - DNA, 1305 bp, Artificial Sequence
  Description of Artificial Sequence: Synthetic coding sequence
atgagccgatctaggcatctgggcaaaattaggaaaagattggaggatgtcaaatcccagtgggtcagacctgctcgagcagacttctcagataacgagtcagcccgtctggccaccgatgcactgttggacggcggatccgaagcatactggcgggtgctttcgcaggagggggaggtagatttcctcagctccgttgaggcccagtatatccaggcccaggctcgggaaccaccctgtcctcctgacacattaggtggtgccgaagctgggcctaaaggcctcgatagctcatcactccagtctgggacatacttccccgtcgccagtgaaggatctgagccggctttgttacattcttgggcttcagcagaaaagccctatctcaaggagaagtcttccgcaaccgtctatttccaaacagtcaagcataataacatccgcgacctggttcgaagatgcatcacacggaccagtcaggtgcttgtgatcctgatggacgtctttaccgacgttgaaatcttttgtgacattttggaagccgctaacaaacgaggagtgttcgtctgcgtgctgctggaccagggaggagtgaagctgtttcaggaaatgtgcgataaggttcagatttcggacagccacctcaagaacatctcaatcagatccgtcgaaggcgaaatctattgcgccaagtcaggcagaaagttcgccggacaaattagagagaaattcattatatcagactggcgcttcgtcctgtctggttcgtactccttcacttggctatgtgggcatgttcaccggaacatcctgagtaaattcactggccaggctgtcgaactattcgatgaagagttccggcacttatatgcgagcagtaagccagtcatgggattaaagagtccacgcttagtggctcccgtcccccctggtgcggctccggctaatgggcgtttgtccagcagcagtggctcagccagcgatagaacttcatcaaaccctttctcaggacggagcgccggttcccatcccggtacccgaagcgtgtccgcaagttctggcccttgctctcccgctgccccacatccaccccctccgccacgatttcaaccccaccaggggccttggggggctccaagccctcaggcccatttatccccccgtccgcacgatggtccccctgcagctgtgtacagtaacctgggagcttaccggcctaccaggctccaactcgagcaactggggctggtgcccaggctcacgcctacatggcgtcctttcctgcaggccagcccccacttctag

SEQ ID NO: 56336 - DNA, 1305 bp, Artificial Sequence
  Description of Artificial Sequence: Synthetic coding sequence
atgagtcgctcgcggcatctcggaaaaatcaggaaacgcctagaagacgtgaagagccaatgggtgcggccagcaagggctgatttctccgacaacgagagtgcccgtcttgctaccgacgcacttcttgatggaggctccgaggcttattggagagtcctgtcccaagagggtgaggtggacttcctttcttctgtcgaggcccagtacattcaagcccaggctagggagccaccgtgccccccagacacactcggcggtgccgaggccggacccaagggacttgattcaagcagcctgcagtctggtacctactttccggtggcctcagaggggtcagaacccgctctgctgcattcctgggcctccgcagagaagccatacttgaaggagaagtcatccgcaactgtgtactttcagacggtgaaacacaacaacataagagatctggtgcggcgatgtataacaagaacttcacaagtgctggtgatccttatggatgtgttcacagacgtggagatcttctgcgacatcctcgaggccgctaataaacgcggtgtgtttgtctgtgtacttctggatcagggtggagtaaagctctttcaggaaatgtgcgataaagtgcagatttccgactctcacctgaaaaatatctctattaggtccgttgagggtgaaatatattgcgctaagtctgggagaaaatttgccggacagattcgagaaaagttcatcatttctgactggagatttgtcctatccggtagctacagttttacctggctctgcggccacgtgcatcggaacatactgtctaagtttaccggtcaggcagtggagctctttgatgaagaattcagacacttatacgcctcctccaaacccgttatgggattgaaatccccacgattggttgccccagtgcctccaggcgctgccccagccaatggtcggcttagttccagttccggttcggcctccgaccgtactagctccaatccattctcagggcgatctgcgggttctcaccctggaacccgctccgtgagtgcatcttccggcccttgtagccccgctgcaccacacccacccccacctcccagattccagcctcatcaaggaccttggggtgcaccttccccccaggcccacttgtccccaaggccacatgacggtccacccgcagcggtctactcaaatctcggagcgtatcgaccaacaagacttcaactggaacagctcggcctggtgcctaggttaacccccacatggagaccctttctccaggcctccccgcatttctag

SEQ ID NO: 56337 - DNA, 885 bp, Artificial Sequence
  Description of Artificial Sequence: Synthetic coding sequence
atgagccgctcccgacaccttgggaagattcgtaaaagactggaggatgtgaagtctcagtgggtgcgccctgcaagagccgattttagcgacaacgagagcgccagactggccactgacgccttgcttgatggcggatccgaagcatattggcgggtgcttagtcaggaaggagaagtggatttcctttccagcgtcgaagcacaatatatacaagcgcaagccagggaacctccatgtcccccagatactctgggcggagccgaggccggacccaagggacttgacagctcctctctgcaatctgggacatatttcccagtggcaagtgagggttctgagcccgctctgctacattcctgggccagcgccgaaaagccatatctgaaagagaaatcttcagctacggtgtattttcaaacggtgaagcataacaacatccgcgacctcgtgagacgttgtattactcgcacatcccagaacatcagcatccgtagcgtggaaggtgagatttattgcgcaaaaagcgggagaaaatttgccggtcagatccgcgagaagttcatcatttccgactggaggtttgtcctttcgggctcctacagtttcacatggctctgtgggcacgtacacagaaatattcttagtaagtttacagggcaggctgttgaactctttgacgaagaattccggcacctgtatgctagctccaagcctgtcatgggactgaagagtcctcgactggttgcaccagtgccccctggggcagctccggcaaacggcagactgtcatcttcaagcggcagcgccagtgatagaacgtcctctaatccattttcgggccgatcggctggcagccacccaggaacccgtacagacggatag

SEQ ID NO: 56338 - DNA, 1104 bp, Artificial Sequence
  Description of Artificial Sequence: Synthetic coding sequence
atgagtagatcaagacatttgggaaagatccggaagcgcctcgaggacgtgaagtcccagtgggtcaggcctgcaagggccgacttttccgacaacgagagcgcgcgactcgccaccgatgccctgttggacggtggctccgaagcctactggagagtcttgtcccaggagggcgaagtcgatttcctcagcagtgtggaggcacagtacatacaagcacaggccagagaacctccttgccctcccgatacccttgggggagccgaggccggaccaaagggattagattctagcagccttcaaagtggtacgtatttcccagttgcatctgagggtagcgaacctgccctactccactcatgggcctctgccgaaaagccgtatttgaaagagaaatctagcgccactgtctatttccagactgttaaacataacaacatacgcgatcttgtgaggaggtgcattacccgcacctctcaggtgctggttattcttatggacgtgttcactgatgtcgagattttctgtgacattttggaggcagccaacaaacgcggtgttttcgtgtgcgtgctgctggaccaggggggagtgaaactgttccaggagatgtgcgacaaggtccagatttcggattcccacctcaagaacatttcaattagatcggtggagggtgaaatctactgcgccaagtctggccgtaagttcgccggtcaaataagagaaaagtttatcatctctgattggcgttttgtgctcagcggctcgtactcctttacgtggctctgtggccatgtacaccggaacattctgtcgaagtttactggccaggctgttgaactctttgacgaagaattcaggcacttgtatgcgtcctcgaaacccgttatggggcttaaaagccccagactggttgcccctgttcccccaggcgcagccccagccaacgggaggctgagcagcagtagcgggtcagcatccgaccgcaccagcagtaatcctttttctggcagaagtgctggctcacatccagtgccagaatcaaagcaaaacaaaaccaagaccaagaagcaaacaacactctggtttctcatggctttttag

SEQ ID NO: 56339 - DNA, 885 bp, Artificial Sequence
  Description of Artificial Sequence: Synthetic coding sequence
atgagtcgtagtaggcaccttgggaaaataaggaagcgcctcgaggatgttaaaagtcagtgggtgcgaccagcacgtgcagatttttccgacaacgagtcggctcgccttgccaccgatgccctgttggatggtgggagcgaagcgtattggcgagttctgtcacaggagggtgaagtggattttctgtcatcggtcgaggctcagtatatacaggcacaggctagggaacctccatgccccccagacacattgggcggagccgaagcaggtccgaaaggactggatagcagcagcctccagtcaggcacgtattttcccgttgcgagcgagggatcggagcctgcactcctccactcttgggcaagcgccgagaagccttatctgaaggagaagtcaagtgccaccgtttattttcagaccgttaaacataataatatcagagatcttgttcgaagatgtatcacccgaacttcccagaacatctcaataaggtccgtggagggcgaaatttactgtgccaagagcggccgaaagttcgccggacagattagggaaaaattcataattagcgactggcggttcgtcctatccggaagctacagctttacttggctttgcgggcacgtccaccgcaacatactctctaagttcacgggccaggccgtagaactgttcgatgaagagtttcgtcacctgtacgcatcgagtaaaccggttatgggcctcaagagccctcggctagtggctcctgtccctcccggagctgcccctgcaaacggccgattatctagctccagcggctccgctagtgaccggactagctccaatcccttcagcggcagaagtgccggttcacaccctgggacccgaacagacgggtag

SEQ ID NO: 56340 - DNA, 3036 bp, Artificial Sequence
  Description of Artificial Sequence: Synthetic coding sequence
atggagacatcctctatgttaagctctctcaacgacgagtgtaagtcagacaactacattgaacctcattataaggagtggtatcgcgtcgctatagacattctgatcgagcacggtctcgaggcctaccaggaatttcttgtacaggagcgggtcagcgactttctggccgaggaggagattaattatattctgaagaatgtgcagaaagtggcgcaatccactgcgcacggaacagacgactcctgtgatgataccctctctagcggaacttattggccagttgagtccgatgtggaagctccaaatcttgatttgggctggccttacgtgatgcctggactcctggggggaacacatatcgacttgctcttccacccacccagagcacatctgctgactattaaggaaaccatccgtaaaatgatcaaggaggcacggaaggtgatcgctcttgttatggacattttcaccgacgtagatatcttcaaggagatagtcgaagcctcaacccgcggtgtttcggtgtatatcctgctggacgagagtaacttcaaccacttcctgaacatgaccgagaagcaaggttgctcagttcagaggctaagaaatatcagggtgagaaccgtgaaggggcaggactatctgtccaagactggcgcaaagttccatgggaaaatggaacaaaagttcctcctggtcgactgtcagaaagtcatgtatggcagttacagctatatgtggagcttcgagaaagcacatctgtcaatggtgcagattatcacgggacagcttgtagagtccttcgatgaagagtttcgtacgctgtatgccaggtcctgtgttcctagctccttcgcccaagaggagtctgccagagtgaagcacggtaaggccctgtgggagaatggaacctatcaacactcagtatcttctttggcatctgtttccagtcagcggaatctgtttggccgtcaggacaaaattcacaaacttgactcttcttacttcaagaacagaggcatatatactttaaatgagcacgacaaatacaatatcagaagccatggatacaaaccccactttgttcctaatttcaatggcccaaacgccattagacagttccagcctaatcaaatcaatgaaaattggaaacgacattcatacgccggagagcagcctgagacagtgccgtacctgttactgaatagggccctgaacaggacaaataatccccctggcaattggaaaaagccctccgattccctgagtgtagcctcttcgagtcgcgagggatatgtcagtcaccacaacacccctgctcagtcattcgcaaaccgccttgcgcagcggaaaaccacgaacctggctgatagaaatagcaacgtgcgaagaagcttcaacgggactgataatcacattcgctttttacagcagagaatgccgactttggagcatacgacgaaatcattcctgcgcaactggagaatcgaatcatatttaaatgaccattctgaggccaccccagacagcaacggatcggcccttggtgaccggtttgaagggtacgataatccagagaatctcaaggccaatgctctctatacccattcgcgcctgaggtcgtcactagttttcaaacctacactgcctgaacagaaagaggtgaattcctgcaccacagggagctccaacagcactattattggatcacaggggagcgaaacccccaaagaggtgcccgatactccaacaaatgttcagcacttgacagacaaaccactaccagagtccatcccgaaactgcctcttcagtcggaggcccctaagatgcacaccttgcaggtaccagagaaccatagcgttgctcttaatcagaccactaacggccatactgagtcgaacaactatatatataagacactcggtgtcaacaaacagactgagaatttgaaaaaccagcagacagagaatctcttaaaacgccgaagctttccactcttcgataactccaaggccaacctggatccgggtaactccaaacactacgtttatagcacacttacacgaaaccgcgtgcgccaacctgagaaaccaaaggaggacctgcttaaatcaagcaaatccatgcacaacgtaacacacaatctggaggaagatgaggaggaagttacgaaaagaaactcaccctcgggcaccaccaccaagtcagtatcaattgctgcattactcgacgtcaataaggaggagtcaaacaaggaattggcctcgaaaaaagaggttaagggatcccccagcttcctcaagaaagggtcacagaaactgcgatctctcctttccttaacccctgataaaaaggagaatttgagcaagaacaaggccccagcattctaccgattatgcagcagtagtgacactcttgtgtctgaaggtgaggaaaaccagaagccaaagaagtccgataccaaagtagactccagtcccaggaggaaacatagcagctcctcgaatagccagggatctatccataagtcaaaggaagatgtgactgtgtcacctagccaagagattaatgcacccccagatgaaaacaagagaacaccctcacccggacctgtagaatctaagtttttagaaagggccggagatgcgtcagccccacgcttcaacacagagcagatccaatatagggattcccgcgagatcaatgccgtggtcacaccagagcgtcgccctactagcagccccaggccgacctcctctgaactactcagaagtcacagcacagataggagagtgtactcccgattcgagccattttgcaaaatcgagagttctatccagccgacttcgaatatgccaaatactagtattaaccggccagagatcaagagcgccaccatgggaaactcctacggccgttcctctcccctgctgaactataataccggtgtttatcggagctaccagcccaatgaaaataagtttagagggtttatgcagaaatttgggaatttcattcacaaaaacaaatag

SEQ ID NO: 56341 - DNA, 2244 bp, Artificial Sequence
  Description of Artificial Sequence: Synthetic coding sequence
atgtttggaggtcctggtccaggtgtgctcggagcacaggggatggccggtccgctgagaggacgagtggaggagttaaagttaccttggtggagggagtcctctccactggtactgcggcattcagaagccgctcggctggcagctgatgctctgttagagaggggcgaggccgcatacctcagagtgatcagcgaggagagagaattgccttttctttcagctcttgacgtcgactacatgacaagccatgttcggggaggtcctgagctatccgaggcacagggccaggaggcgtctggcccagaccggctgtcattgctctcagaggtgaccagcgggacatacttccctatggcgtcagacattgaccctcccgacctagacctcggctggccagaagtgcctcaggccaccgggttctctcccacccaagccgttgtgcattttcaacgggacaaggcaaagaacattaaagatctcttgcgctttttgttctcccaggcccatacagttgtggccgtggtcatggacattttcactgatatggaactcctttgcgatttaatggaagcgagttctcgcagaggggtccctgtgtatctgctgctggctcaggaacacttgagacattttctggaaatgtgctacaaaatggatttaaacggtgagcacctccccaatatgcgggtgagatccacgtgcggggatacatactgtagcaaggccggaagacgcttcactggacaggcactcgaaaaatttgtcttaatcgattgtgagcaagttgtcgctggcagttacagctttacttggctctgcagccaggcccacaccagcatggtccttcagttgcgcggtcgaatcgtggaggactttgacagagaatttcggtgtttgtacgccgaaagccagcccgtggagggattttgcgggggagaagaccctctctccccccgtgcactgaggccccctccagtggcactagccttcaggccagacgtcccgtctcccaccagctctctgccttcttcaacaagcctgtctagtattaagcagagccctctaatgggaagatcctcttacctggctctcccgggtgggggtgactgctccgatacaggtgttgtctccagttctctagggccagctagaagagaagccagcggacagccctcgttgcacaggcagctgtcagacccaaaccacggttcccccccaggcctgtaccgggcaaaccttggaaaattgggcgcatacccctggtcccagagtagtccagccctgaatcacaatagtacctcccctttgacactcgccgtgggctccccactgctcccacggagcaggcctctgctgcagtttcacagaggtgctcccgctctatcacggtttcccgaaaatggacttcctgggtcccaagaaccatccccactgcggggtagatgggtgcccggtaccactctggaaactgtggaagaaaaagagaaaaaagccagcccaagtcagagtagagggcaactggacttgctggtgccctttcccagagctcgcgaagtcggagaccctgattctggtgtaaccccgaactcaggtcccctgcgtccaggggagcaagcccctgaggatcggaggttgagcccatctcaggcagacagccagctggaccttttgagccgggctctaggcaccggaggcgctccagagctggggtccttgagacctggggatcgggcattggaggaccggaggttgagcctgaatcagtcgcgaggccagtcggacttactcatgcagtaccccaaagcacagggaagccgcgttccgctagagacaaattctagcgcccgtcctgccaggagggctccggacgagcgccgacagacactgggtcactcgcagctggatttgattacaaaatttggccctttccgcggagaggggcctgggcctaatgggctgccaataagcagccccgcaagaacggccggagctgggtctggtgacgaaaagcggcttactctgggccattcaaaacttgatttgatcactaagtaccaccagctccatggcgcacgtcagggcacggaacccggaggacccaaaggtgggcacctcaatgggggaaattctgatctggtacgagacgagaagagactgacactcggccatagtaagcttgacctcattaccaagtacaacaagtctaagtttaagcagcttcggtcccgattcgagtcgtag

SEQ ID NO: 56342 - DNA, 1437 bp, Artificial Sequence
  Description of Artificial Sequence: Synthetic coding sequence
atggccgcatctcaactcgcggctctggagggcgtagatagtggaccacgcgtgcccggagcctcgcctggatttctgtactcagaggggcagcgcctcgccctggaagccttgctgagtaagggtgccgaggcctttcagacctgtgtccagagagaagaattgtggccatttctatccgccgatgaggtgcaagggttggcagccgcagccgaagactggacagttgcaaagcaggagcccagtggtatggcagaaggcgctactactaccgatgtagacgcagggagcctgagctactggcctggccagtcggaacagcctgctccagttctacggctgggctggccagtagactccgcctggaaggggatcacaagagctcagctatatacccagcctccgggagaggggcagcccccactcaaagagctggtgcggttagaaattcaggctgcacacaaactcgtggcggttgtgatggacgttttcaccgatccagacctgctcctcgacctggtcgatgccgcaactagaagatgggtgcccgtgtacctgctgctggaccgacagcaactccccgctttcctggagttagcccagcagctgggagtgaatccctggaatacagaaaacgtggacgtgagagttgtgagagggtgctccttccagtcccgctggcgcaggcaggtttccggaaccgtacgggaaaaattcgtgctgcttgacggggaacgagtgatttcaggctcctattcttttacctggtccgatgctagactccaccgcggtttggtgaccttgttaaccggcgagatcgtagacgccttcagtctggagttccggaccttgtacgcagccagttgcccgctcccgccagcgcctccccagaagcccagcgtgatcggaggactgcaacgaggtaggagccctcaccgggtttctagacggaggtcagtcgccccagcctcccctcccccacccgacggacccttagcccatcggctagcagcttgccgtgttagccccgctaccccgggtcctgccctgtcggatattctccgctctgtgcagcgcgcaaggacgccatctgggccaccagccaggccttctcgctctatgtgggatctgtcacgcctctcccaactgagcggctcatccgatggcgataacgagttgaaaaaatcctggggtagtaaagacacccccgctaaggctctgatgaggcagagaggcactggaggcggaccatggggagaagtcgattcaaggcctccatggggcggtgcactgcctttaccccctgcccacagattgcgctacctgagccccgcacgccgacgctttggcggagacgctacctttaaactccaagaacctaggggagtcagacccagtgactgggcccctagggctggactcgggggacagccatag

SEQ ID NO: 56343 - DNA, 1503 bp, Artificial Sequence
  Description of Artificial Sequence: Synthetic coding sequence
atggccgaatcgcagctgaactgtctcgacgaggcccacgtgaatgagaaggtgacggaggctcaggctgctttttactattgtgaaaggcgcagggccgctctcgaggctctgctcggcggaggcgaacaggcctacagggagcgactcaaggaggaacagctgcgggattttctcagtagtccagaacgacaagcattgcgggctgcttggagtccatacgaagacgccgttccagccgctaatgcaaggggtaagagcaaggctaaagccaaggctcccgctcccgctcccgctgagtcaggcgaaagtcttgcctattggcctgaccggagcgatacagaggttcctcccttagaccttggttggacagacaccggcttctaccgcggagtctctagggtgaccttgttcacacacccaccaaaagatgaaaaggcccctcacctaaagcaggtcgttcggcagatgattcagcaggcacagaaagttattgcagtcgtgatggatctgtttacggatggtgatatttttcaggacatcgttgatgccgcttgcaaacgacgtgtgccagtttacataattctggacgaagctggcgtcaaatactttttggagatgtgccaagacctgcaactgaccgatttcaggatccggaacatcagagtgcggtcagttactggcgtgggtttctatatgccaatgggcagaattaagggtactctctccagccgcttcctcatggtcgacggagataaggtcgctaccggttcatataggtttacctggtcctctagccatgtggatcgaaatctgctgctgcttctgaccggtcagaatgtggagcctttcgataccgagttcagggaattgtacgccattagtgaggaggtggacttgtatcgtcaactgtctttagcgggaagagtgggcttacactacagcagtactgtcgcccgtaagcttatcaacccaaagtacgccctagtttccggctgcagacaccctccaggagaaatgatgaggtgggctgctcgacaacagcgagaagcaggtggcaaccccgagggacaagaggaaggagctagtggcggtgagagcgcttggcgactggaatcttttttgaaagatctcgtaaccgtggagcaggttctgccccctgttgaacccatccctctaggcgagttatcccaaaaggacggacggatggtgagtcacatgcacagagatttgaagcctaaaagcagagaggcgccttctcgaaatgggatgggagaggccgctaggggcgaggcagcaccggcacggaggtttagttcccgcctcttcagtaggagagccaaaaggccagcggcacccaacggaatggcaagctctgtgtccacggagacttccgaagtggagtttcttaccgggaagagacccaatgagaacagcagcgcggatattagcggcaagacgagtccgtcatccgctaagccatctaattgcgtaattagctag

SEQ ID NO: 56344 - DNA, 2472 bp, Artificial Sequence
  Description of Artificial Sequence: Synthetic coding sequence
atggctttttcgcaggtccaatgcctcgatgataatcacgtcaactggcgatcaagtgagtcaaaaccagagttcttttattcggaagaacagaggttggcgctcgaggctttagtggcccgaggcagagacgctttctacgaggtgctgaagcgagagaacatccgcgacttcctgtccgagcttgagctgaagcgcatcctcgagacaattgaagtgtacgatcccggatccgaggaccccagaggcacaggaccatcacagggccctgaggataatggcgtcggagacggggaagaagctagcggagctgacggggttccaatcgaagcggaacctctgccctccctggagtactggccacaaaaatccgatagatcgatccctcaactggacctgggctggccagataccatcgcttataggggtgtcaccagggcgagcgtatatatgcaacccccaatcgatggccaagcccatattaaagaagtggtaaggaagatgatctctcaggcccaaaaggtgatcgctgtcgtcatggatatgtttaccgatgtcgacattttcaaagacttactcgatgctggatttaagcggaaggttgcagtgtacattattgtcgatgagtcaaacgtgaagtacttcctccacatgtgtgaaagggcctgtatgcacctcggccacctgaaaaacttgcgtgttcgcagttcgggtgggaccgagttttttacacgaagcgccacgaaattcaagggcgctttggcccagaagttcatgttcgtggacggtgacagagcggtgtgtggtagctactcctttacctggtccgcggcacgcacagacagaaatgtgatctcggtgttatcaggccaagtcgttgagatgttcgatagacaatttcaggaactctatcttatgtcacatagcgtgtcattgaaggggattcctatggaaaaggaacctgagccagagcccatagtcctcccgagtgtggtgccactggtgccagccggaactgtagcaaaaaaactcgtgaaccctaaatatgctctggttaaagctaaaagtgtcgacgagatcgcgaaaatttcgtccgagaagcaggaagccaagaagccacttgggctcaaaggacctgccctagcagaacaccccggagagctcccggaactgttgccgcctatccacccaggacttcttcatctggagcgcgcaaatatgttcgagtatctcccaacatgggtagaaccagaccctgagcccggttcggatattctcgggtatatcaacatcatagatcctaacatatggaacccccagccctcacaaatgaacaggatcaagatacgcgacacatcgcaggcttctgctcaacaccagctctggaaacaatcacaggacagccgtcccaggcctgagccttgtccccctcctgagccctcagcccctcaggacggagtgccggctgagaatgggttaccgcagggggaccctgaaccattaccgccagtgcccaagccccgaacagtccccgtggcagatgttcttgccagagactcttccgacattggatgggtgctcgagctcccaaaggaggaagccccacagaacggtaccgatcacagactccctcggatggccggaccaggacatgccccattacagcgccagctgtcagtgacacaggatgaccccgagtcactgggggttgggcttcccaacggactggatggtgtggaagaagaagacgacgacgattatgttactctgagtgatcaggattcccatagtggctcctccggacggggacctgggccaagacggccttcggtcgcaagctctgtttcagaggaatatttcgaggttagggagcactcagtgcccctccggaggaggcattctgagcaggtggctaatggcccaactccgccacccagaaggcagctgagtgcgcctcacataacccggggtacctttgttggccctcagggaggatcaccatgggctcaatcccgaggacgcgaagaagccgatgccctgaagaggatgcaggcccagcgctccacagacaaggaggcccaggggcagcagtttcaccaccaccgggtacccgctagcggcacccgagacaaggacggcttcccaggcccacctagataccgcagcgccgcagattcagtgcagtctagtactagaaacgccggacccgctatggccggaccccatcattggcaggctaaaggtggccaagtccctaggttgttacccgatccgggaagccccagactcgcccagaacgctcgtcctatgacggatggaagagccaccgaagaacatccctcccctttcggtatcccttactcgaagcttagccagtctaaacatttaaaagctcgaacagggggttcacagtgggcctcttcggactcaaaacgtcgcgctcaggctcccagagatcgcaaggacccctag

SEQ ID NO: 56345 - DNA, 2472 bp, Artificial Sequence
  Description of Artificial Sequence: Synthetic coding sequence
atggcattcagtcaggtacaatgcctggatgacaatcacgtgaactggcgctcatcagagagtaagccagagttcttttactccgaggagcaacgactagctctggaggctctggtggccagaggtcgtgacgccttttatgaggtccttaagcgcgagaacatccgcgacttcctttcagagttggagttgaagagaatactagagaccatagaggtgtatgatcctggcagcgaggacccacggggaactgggcctagtcagggacctgaggacaatggcgtgggggacggagaagaagcaagcggggctgacggtgtcccgatcgaggccgagcctctgcctagtctcgagtattggcctcagaagagtgatcggtccatccctcaactggacctgggctggcccgacacaattgcctaccggggtgtaaccagagcatcggtctacatgcagcctccgattgacggacaagcccacatcaaagaggtggtcaggaagatgatcagtcaggctcagaaagtgattgccgtggtaatggacatgttcacagacgtggatatttttaaagacctcctcgacgccggattcaagagaaaggtcgcagtctatattatcgttgacgaatcaaatgtgaaatactttctccatatgtgcgagcgcgcatgcatgcacctgggccaccttaagaatttgcgagtaaggagttcagggggaacagagttttttacccgcagcgcaactaagtttaagggcgctctggcacaaaagtttatgtttgtggatggggaccgtgcagtatgtgggagctattcttttacctggagcgctgcccgaacggataggaacgttatctctgtactgtccggccaggtcgttgagatgttcgacaggcaattccaggagctgtacttgatgagccactccgtcagtctcaaaggtatccctatggaaaaggagcctgaaccagagcccatcgtactgccatccgtagttcccctggtgcctgccggaacggtggcaaagaagctggtgaaccctaaatatgcactggtcaaagccaagtctgtggacgagatcgccaagatatcctcagagaagcaggaagccaagaagccactgggtcttaagggtcctgctctcgccgagcatcccggagaactgcctgaactgctgcctcctattcacccaggactgctccatctggaaagagccaatatgtttgaatatctcccaacttgggtcgagcccgacccggaacctggatcagacatacttggctacataaacataattgatcctaacatatggaatccacagccctcccaaatgaaccggattaaaatccgggatacatcccaggcctcagctcagcatcagctctggaaacaatcacaagactcccgacctagacccgagccttgtccaccacctgagccaagtgcaccccaggatggagtgcccgctgaaaacgggctaccccaaggtgaccctgagccattgccacccgtgccaaagcctaggaccgtgcccgtggcagatgttcttgcccgtgactctagcgacatcgggtgggtgcttgagctgcccaaagaggaggctccccagaacggaactgaccatcggctccctcgcatggcaggtcccggacatgctcctctgcagcgccagctgtctgtcacacaggatgatcctgaatccctaggggtggggctcccgaacggcctggacggtgtagaagaggaagatgacgacgattacgtcacgctatccgaccaggattcccattcaggatcttcaggtcgtggacccggtccacgacgaccttcagtcgctagcagcgtgagtgaagagtactttgaggtacgagaacatagcgtgccactgcgtcggaggcacagtgaacaggtcgccaacgggccaacccctcccccacgtcgccagttgtccgcccctcatatcactcggggaacattcgtcggtccccaaggaggctcaccctgggcacagagtcgcggacgggaggaagccgatgcgctgaaacggatgcaagcccagagatcgacggataaagaggctcagggccaacagttccaccaccaccgggtaccagcatccgggacacgggataaagatggatttcctggtccacctagataccgttccgccgcagattcggtccagagtagtacccgtaacgccggacccgcaatggccggtcctcaccattggcaggcgaagggaggccaggtacctaggctactgccggacccgggttcaccgagactggcccagaatgccagacctatgacagatggaagagccactgaggagcacccctctcccttcggtataccttattcaaagctaagccagagcaaacacctgaaagctcggacaggtggatcacagtgggcgtccagcgactctaaacgcagagcccaggccccaagagaccggaaagatccttag

SEQ ID NO: 56346 - DNA, 819 bp, Artificial Sequence
  Description of Artificial Sequence: Synthetic coding sequence
atggctttttcccaggttcaatgtttggacgacaatcacgtaaactggaggtccagtgagtccaaacctgaattcttctactctgaggagcaaaggctcgcgcttgaggccctggtggcccgaggcagggatgccttttatgaggtgctgaagagagaaaatataagagacttcctgtctgaattagaattaaagcggatcctggaaaccatcgaggtgtatgaccccggaagcgaggatccgcgaggcacgggaccaagccagggccctgaggacaatggagtcggagatggtgaggaggccagtggagcggatggggtgccaattgaagcagaacctttgccatcactggagtactggccccagaagagtgacaggtcaattccacaactggatcttggctggcctgacacaattgcgtaccgtggcgtcactagggctagcgtctacatgcagccgccaattgatggccaagcccacatcaaagaggtggtccggaagatgataagccaggctcagaaggtgatcgccgtggtgatggatatgtttacggatgtggatatcttcaaggatctgttggacgccggtttcaaacgcaaagtggctgtgtacataatcgtggacgagtctaacgtgaagtactttctacacatgtgtgagcgcgcttgtatgcatttgggccacctcaaaaatctgcgcgtgcggtcaagtgggggaaccgagtttttcactcgttccgccactaaatttaagggagccctggcgcagaaattcatgttcgtggatggtgaccgtgccgtgtgcggctcctaccggtag

SEQ ID NO: 56347 - DNA, 879 bp, Artificial Sequence
  Description of Artificial Sequence: Synthetic coding sequence
atgggaaatcaactagacagaattacgcaccttaattattctgagctgcctacaggcgacccaagcggcatagaaaaagacgaactgcgggtcggggtggcctacttcttctccgacgacgaagaggacttggacgaacgcggacagcctgataaattcggagtgaaggcccctccaggatgcacaccttgtcccgaaagcccctcccgccaccaccaccacctactgcatcagctcgtcctgaacgagacacagttttcagccttccgcggacaggagtgcattttcagcaaagttagcggaggcccacagggtgcagacctctccgtgtacgctgtaaccgcactacccgctctgtgcgaaccgggtgatctccttgaactcctttggctccagcctgcacccgaacctcccgctcccgcaccccactgggcagtgtacgtcggtggaggccagattatacacttgcatcagggcgagatcaggcaggattctctatatgaggctggtgccgcaaatgtaggccgtgtcgtgaactcttggtatcgctacaggcccctggtggccgaactcgttgtgcagaacgcgtgtgggcatttgggactcaagtccgaagagatttgctggaccaattccgagtccttcgccgcatggtgccgattcgggaagagagaatttaaggcgggaggcgaagtgcccgctggaacacagccaccccaacagcagtattatctcaaggttcatctaggtgagaacaaagtgcatacggcaagatttcacagcctagaagatctcatacgggaaaagaggagaattgacgcaagcggacgcttgcgcgtcctccaggagctggccgatttggtggatgacaaagaatag

SEQ ID NO: 56348 - DNA, 879 bp, Artificial Sequence
  Description of Artificial Sequence: Synthetic coding sequence
atgggaaatcaactggaccggattactcaccttaattattctgaactccccaccggcgacccatcagggatagagaaggacgaattaagagttggggtggcttatttcttctctgatgatgaggaagatctcgatgaacgaggccagccagacaaattcggcgtaaaggcacccccagggtgcacaccatgccccgagtcaccatcccgccaccaccatcatctgctccatcagcttgttctcaacgagactcagttctctgcatttcgaggccaggagtgtatcttctctaaagtttccgggggtcctcagggagccgatctaagcgtctacgccgtgacagccttgccagctttgtgtgaacccggagacctgctagagttactgtggttacagccagcaccggaaccccctgcacccgcaccacactgggccgtttacgtaggtggagggcaaataattcatctccatcagggcgaaatccgccaggattcactgtacgaggccggtgccgcaaacgtggggagagtcgtgaattcctggtatcgctaccggcctctggtggctgaacttgtcgtgcagaacgcctgtggccacctaggcctgaagtctgaagaaatctgttggactaactcagagagcttcgccgcttggtgtcggttcggcaagcgcgagtttaaagcaggcggagaggttccggctgggacccagccaccgcaacaacagtattacttgaaagtgcacctgggcgaaaataaggtgcacactgcacggtttcactccctggaagacctcatcagggagaaaaggaggatcgacgcctcaggccgtctacgcgtcttacaggagctggccgacctggttgatgacaaggaatag

SEQ ID NO: 56349 - DNA, 1068 bp, Artificial Sequence
  Description of Artificial Sequence: Synthetic coding sequence
atgggaaatcagctggatcgtataacgcatttaaactactccgagcttccgacaggggaccccagtggaatcgaaaaagacgagctgcgcgtgggagtagcgtatttcttttccgatgacgaagaggacctcgacgaacggggacaaccagataaattcggtgttaaagcaccacccggatgcacaccttgccccgagagcccgtcccgccaccatcaccacttgttacaccaacttgtccttaatgaaacccagtttagtgctttcaggggacaggagtgtatcttcagcaaggtgtctgggggtcctcaaggcgcagacctaagcgtgtacgcagttaccgctctgcctgcgctgtgtgaacccggtgatctgttggagctattgtggctgcagccagccccagagcccccagcacccgctccgcattggtgggcatcccgcgcacgcagaagcgcaggcagaaccagaagagcctccccacccggagccgctctagcaagtggatcttcacgacgggagggtagatgcaggcaggccaggagtcctaggagctccagcactattagtcgatgcacttgggagagaactcgatcgacaccacccggtttcaccgcatggaaaacctcatcggctagaagcgcagtctccacgcccgctgccgcttgtgagtgctcgcgcagctcgccaacctcatggaccacacgatcttcaaggcttggtgctgctggcccaagtgcgagccccgctcctaggtcactcccctttccggctccagggctgcgaagccagcgattctctacatcagctccgcctaggcacgccaggccccctccagtggccagagcgagggccgcaccacctcaccctcaggcatcgggccgaaagagccaagaactcccccaggggaggaaaggcgctgccgcaagtgcttggctgacagccactgcagtggtaaccgtgttgggggacccagcttgtgcttttccattgaggtgtaagcctggcaccgggaaaggattgagaggtgagcgaacctggccctccccaagggtgcatggacaatag

SEQ ID NO: 56350 - DNA, 594 bp, Artificial Sequence
  Description of Artificial Sequence: Synthetic coding sequence
atgcacctctttcagtcagaaaggtggccatcaggcaggagaccaaagcgcttgagaggacatcgagccgctagcgccttacgaacacgcagacctgctggcgctgcagtcgccgcagcccgtgcgggtgctgctagagcacggcctgccctcggccgactgagaggccgaagggccgatcacccgcctgccccacgccgagacccaccaggccagcccgaggctggtgccgcaaacgtgggacgtgtcgtcaacagctggtataggtataggccactggttgctgaactagttgtacaaaacgcttgcggccacctgggtcttaagagcgaggaaatatgttggacaaacagtgaatcctttgcagcctggtgcagattcggaaaacgcgagtttaaggccggaggcgaagttccagctgctgcacccgcagctgccgtgctaagccagggcgctccgggtcgggaacagggcccacaccgctttcacagtctagaagatctgatcagagaaaagaggtacaggagacagaggccaccggcatctgctcctggagcaaggcgccctcgaggaaggcaaggagttgctgcctag

SEQ ID NO: 56351 - DNA, 993 bp, Artificial Sequence
  Description of Artificial Sequence: Synthetic coding sequence
atggccccagaagaaaatgccggaactgagctcttgctgcagtccttcgagcgtcgattcctggcagccaggacactgcgcagcttcccatggcaatcgcttgaggctaaactcagagattcatctgatagcgagcttctcagagacattctacacaaaactgtgaaacatcctgtgtgcgttaagcaccccccttctgtgaagtatgctcgctgcttcctctccgaactaataaaaaaacacgaagcagtgcacacagagcctctcgatgaactatatgaggccctcgcagaaaccctcatggccaaagaatctactcagggtcatcggtcataccttctgccatctggtggtagcgttaccctgagtgagagcactgccatcatatcctatggcacaacggggctcgtgacatgggatgctgccctgtacctcgccgagtgggctatcgagaatccagccgtgttcacgaaccgaactgtcctggagttaggcagcggagcaggactcacgggattagcaatctgcaaaatgtgtcgacctcgggcttacatcttctcagattgccattcccgggtcttggaacagttgcggggaaacgtgctcctgaacggcctctctttggaagctgatatcaccgcaaagctggacagtccccgtgtaacagtggcacagttggattgggacgtagccactgtccaccagctcagcgccttccaacccgatgtcgtcattgcagccgatgtcctgtattgccctgaggccatcatgtccttggttggggtcctgaggcgactagccgcatgtagggaacaccagagggccccagaggtctatgtcgcctttaccgtacgcaaccctgagacttgccagctgttcactactgagttgggaagggcgggaattcggtgggaggttgagccgagacatgaacaaaaactttttccatacgaggaacacctcgaaatggcaatgcttaacctaacactttag

SEQ ID NO: 56352 - DNA, 891 bp, Artificial Sequence
  Description of Artificial Sequence: Synthetic coding sequence
atggcacccgaggagaatgccggaactgaactgctgctgcagagtttcgagcgtcgctttcttgcggcaaggactctccgctcattcccgtggcagtctttggaagcaaagctccgtgattctagcgatagcgagcttttaagggacattcttcataaaaccgtgaaacatccagtgtgcgtaaaacatccacccagcgtcaaatatgccagatgttttctatccgaattaataaaaaagccttccggcggaagtgtaaccctgtccgagtcaacggcaattatctcttacggcaccacaggtctggttacatgggacgcagctctgtatctggccgaatgggccatcgagaaccccgcagtcttcactaatcggactgtgctggaacttggaagcggtgccggtctaaccggcctcgcaatctgtaaaatgtgcaggcccagggcttacatctttagcgattgccacagtcgtgtccttgaacagctgagaggtaatgtactgctgaatggcctttcccttgaagctgatatcactgccaagctggatagccctagggttacagtggcacagctggactgggacgtagccactgttcaccagttgtctgccttccagcctgatgtggtgatagcggctgacgttctttattgcccagaggcgattatgtcactagtcggggtgctgcggagactcgcagcctgtcgagagcaccagcgtgccccagaggtgtacgtggcttttaccgtgaggaatccggagacatgccagctgttcaccactgagttgggtcgggctgggatcaggtgggaagtggagcccagacatgaacagaagctcttcccttacgaagaacatcttgagatggctatgctgaacctgaccctctag

SEQ ID NO: 56353 - DNA, 390 bp, Artificial Sequence
  Description of Artificial Sequence: Synthetic coding sequence
atgcctccaagcaccttgcagaatggcccttctagaacgcgccagcctagcctgactgacgtgctttattgcccagaggctattgtctccttagtaggtgtgctacagcgcctggcggcttgtcgggaacataagagagcacctgaggtgtatgttgcatttaccgtcagaaaccctgagacgtgccagttgtttactaccgagttgggagaacccccacgtcccccagggccaacttggtgtccctcatgtccatgtcgtacacctgtcgaggtcaaggaacttggcgctggagagaaattggggtgctcaacactgccacactatgcgggaaatagtgggcgaggccgtcccggatgggatcagatgggtagcggctcaagctcatag

SEQ ID NO: 56354 - DNA, 462 bp, Artificial Sequence
  Description of Artificial Sequence: Synthetic coding sequence
atggcacctgaggaaaacgccggtactgagttgcttttacagggtttcgaacgccgattcttggctgtccgaacgctgcgctcattcccttggcaatcactcgaagctaagctccgggactcaagtgactcagaactgctgagagatattttgcaaaagaccgtgcgtcacccagtttgtgttaagcaccccccttctgtgaagtatgcgtggtgcttcctctccgaactaatcaagaaatcttcaggcggaagtgtaactctgtcaaaaagtacagcaatcatctcgcacgggactacaggtttagtaacctgggatgcagctctatatctagctgagtgggctattgagaatcccgctgccttcattaataggagagccgtgcttccacgcagtcaccgcgttgccggaagaggccctgcagaggctgggtgcttgcccggtgcacaggctgggagctag

SEQ ID NO: 56355 - DNA, 993 bp, Artificial Sequence
  Description of Artificial Sequence: Synthetic coding sequence
atggcaccagaagaaaatgcgggaactgagctcttgttgcaggggtttgaacgaaggttcttagcagtgagaacccttcggtccttcccttggcagtcacttgaggctaaattaagggactcctcagacagcgaactcctgcgagatatcctccaaaagactgtgcgccacccagtatgcgtcaaacatcccccaagtgtcaagtatgcctggtgctttctgtccgagctcatcaaaaaacatgaagcagtacatacagagcccctagacaagttatatgaggtgttaaccgagacactcatggcaaaggaatctacccaggggcaccggtcttatctgctgtcttccggaggtagcgtcaccctctccaagagcacagcgatcattagtcatggcaccaccggtttggtgacctgggacgccgcactgtatctcgccgagtgggccatagagaatccagccgcattcatcaatagaacagtcctggaactcggctccggcgctgggctaaccggtctcgcaatttgcaagatgtgccggccacgcgcttacatcttctcagacccacattcccgcgttctcgaacagttgaggggtaatgtgctgctcaatggactttccctcgaggctgatattaccggaaacctggactctccaagagtgacagttgcgcaactggattgggacgtggcgatggtccatcagctctctgcgttccagcctgacgtggtcatcgccgctgatgtactctactgtcccgaagctattgtgtccctagtgggagtgcttcagagattagccgcatgcagggagcacaaacgggcaccggaggtgtacgtcgccttcacagttaggaacccagaaacctgtcagctcttcacaacagagttaggacgggacggcattcgctgggaagcagaggcccaccatgatcaaaagcttttcccatacggagagcacttggagatggctatgcttaacctcacgctttag

SEQ ID NO: 56356 - DNA, 891 bp, Artificial Sequence
  Description of Artificial Sequence: Synthetic coding sequence
atggcgcctgaggaaaacgctggaactgagctcctgctgcaaggcttcgagagacggttcctggccgtccgtaccctgcgcagctttccgtggcaaagcctggaagctaagctgcgggactccagtgacagcgagctccttcgggacattctgcagaagacagttcgacaccccgtgtgtgtcaaacatccaccatccgtgaaatatgcctggtgctttctctctgaactaataaagaagagctctggaggatctgtgacactgtccaagagtacggctattatctctcacggtacaaccggcctggtgacatgggacgccgctctgtacttagccgagtgggctattgagaaccccgctgccttcattaacagaactgtgctggaacttggatctggggcaggcctgactggattggccatctgcaaaatgtgccgccctcgggcttacatcttctccgacccccactcccgcgtactagagcagctgcggggaaacgttctattgaacggcctgtcactcgaggccgacattacaggcaacctggattccccacgtgtgacagtcgctcagctggattgggacgtggccatggtgcaccagctgagcgcgttccagcccgacgtcgttatcgccgctgacgtactgtactgtcccgaggccatcgtctctctggtcggcgtgctgcaacggcttgcggcttgccgtgaacataaaagagctccagaggtctacgttgcttttaccgtcaggaatccagagacttgtcagctttttacaactgaactagggagagacggtatcagatgggaggcagaggctcatcatgaccagaagttattcccatacggtgagcatttggagatggccatgctcaatctgaccctctag

SEQ ID NO: 56357 - DNA, 462 bp, Artificial Sequence
  Description of Artificial Sequence: Synthetic coding sequence
atggcaccagaggaaaatgccggtaccgaacttcttcttcaaggcttcgagagacggttcttggccgtgaggactctccgctcattcccttggcagagccttgaggccaagctgcgggattctagcgattcagaattgctgcgtgacattcttcaaaaaacagttaggcatccagtatgcgtcaaacacccaccatcagtgaaatacgcgtggtgtttcttgagcgagctcattaagaaatcctccgggggtagcgtcactctcagcaaatctacggccattattagccatggtacaactggattagtaacgtgggatgcggctctttatttggcagaatgggcaatcgaaaaccctgccgcatttatcaatcgaagagccgtgttgccacggtcacacagggtcgccggtagagggcctgcagaagcaggatgtcttcctggcgcacaggccggttcctag

SEQ ID NO: 56358 - DNA, 993 bp, Artificial Sequence
  Description of Artificial Sequence: Synthetic coding sequence
atggctcctgaggagaacgctgggacagagctgctgctgcaggggttcgagaggcggtttttggctgtgcggacgttgcgcagcttcccatggcagagcttagaggccaagcttcgagattctagtgactctgagctcctgcgcgacatcctgcaaaaaacggtgaggcatcctgtgtgcgtaaagcaccctccatctgttaaatatgcgtggtgctttctgtctgagctcatcaaaaagcatgaggcagtgcacactgaacctcttgataaactgtacgaggtgcttgctgagaccttgatggccaaagagtcgacacagggacaccgttcctacctcctgagctctgggggaagcgtgacgctctcaaaatctaccgctatcatctcacatggcaccactggcctggtgacctgggatgccgcactgtatctcgccgaatgggcgatcgagaatcctgcagctttcattaaccgcactgttttggaactgggctccggtgccggtttgaccggtctggctatctgtaaaatgtgccgcccacgcgcttatatcttttcagacccccattcccgcattcttgagcaactgcgcggtaatgtgctgcttaatggactctccctggaggcagatattacaggtaacctcgattcacctagggtaaccgtcgcacaactggactgggatgttgccatggttcaccaactatctgccttccagccagacgtggtgatcgctgcagatgtactttactgccctgaagcaatagtcagtctggtcggagtccttcaaaggctagcagcctgtagagaacacaaacgggctccagaagtctacgtggcgtttaccgtacgcaaccccgagacttgccagctgtttaccacggagttgggaagggacggaatccgctgggaagccgaagcccatcacgatcaaaagttgttcccctacggcgagcacctcgaaatggctatgctcaaccttactctgtag

SEQ ID NO: 56359 - DNA, 462 bp, Artificial Sequence
  Description of Artificial Sequence: Synthetic coding sequence
atggcacccgaggagaatgctgggacggaactcctcctgcaagggtttgaacgtcgattcttagcagtgcgaactttaagaagtttcccctggcaatccctagaggccaaactgagagactcttcagattccgagttattgagggacatcctgcaaaagactgtgcgccaccccgtgtgcgtgaagcaccctccgagcgtgaagtacgcttggtgttttttgtcagagctcatcaaaaaatcctctggaggatcagttaccctgagcaaaagcacagccattattagtcatgggacaacaggcttggtcacttgggacgcagccctgtatcttgccgagtgggcaatcgagaaccctgccgcattcatcaatcggagggccgttctaccgaggagccaccgggtggcaggaagaggcccagccgaggccggatgcctgcctggagctcaggcagggagctag

SEQ ID NO: 56360 - DNA, 891 bp, Artificial Sequence
  Description of Artificial Sequence: Synthetic coding sequence
atggcccctgaagagaacgccggtactgagctcctactgcaggggttcgagcgtcggttcctagctgtgcgcactctgcgcagcttcccttggcagagtctcgaggctaaactaagggattcctccgactcagagttgctccgcgacatcctccaaaagactgtgaggcacccagtctgcgtgaagcatcctccaagcgtgaaatatgcatggtgttttctcagcgagctgatcaagaagtcgtcaggcggatccgtaactctgagcaaaagcactgctataattagccacggaacaactggactcgttacttgggacgctgctctctatctcgccgagtgggcaatcgaaaaccctgctgccttcatcaaccgtactgtgctggagttaggtagcggcgcaggcctcaccgggcttgcgatctgcaagatgtgcaggccgagagcctatatcttctctgatccgcactcaaggatcctggagcagttgcgcggaaacgtgctgttgaacgggttatccttagaagccgacataaccggtaacctagactcaccacgagtgactgtggcacagctggattgggatgtagcaatggttcatcagctttccgcattccaaccggatgtcgttatcgcagccgacgtcctctattgccctgaggccatcgtttccctagtgggcgtcctacagaggcttgccgcatgcagagaacacaaacgagcacctgaagtttatgtggcatttaccgtcagaaatcccgaaacgtgccaactgttcactaccgagttaggacgggacgggattcgatgggaagcagaggcgcaccacgaccagaagctattcccatatggcgaacacctcgagatggctatgctgaacctgaccctatag

SEQ ID NO: 56361 - DNA, 390 bp, Artificial Sequence
  Description of Artificial Sequence: Synthetic coding sequence
atgcctcccagcactctgcagaatggtccttccagaaccagacaaccttcactcactgatgttttgtactgccccgaagcaattgtcagccttgtcggtgtgctccaacggctggccgcttgtcgggagcataagcgagccccagaagtctatgtcgcctttaccgtccggaatcccgaaacatgtcaacttttcacgacagagctgggcgaaccaccacgaccccctggacccacctggtgcccatcttgtccatgccgaacgcctgtagaggtcaaggaacttggcgcaggcgagaaactaggctgctctacgctgccccactacgcaggaaatagcggcagagggcgacccggatgggatcagatgggttccggttcttctagctag

SEQ ID NO: 56362 - DNA, 888 bp, Artificial Sequence
  Description of Artificial Sequence: Synthetic coding sequence
atggccccagaggaaaacgctggcactgagttactccttcaaggcttcgagaggagattcctggctgttaggactcttaggtcatttccctggcaatcactcgaagcgaagctgagagactcctctgactcggagttgctccgcgatatcttacaaaagacagtgcggcatcctgtgtgcgtgaagcatccccctagcgtgaagtacgcatggtgtttcctgtcagagctgatcaaaaagtcctccggcggtagcgtgacactctctaaaagtactgccatcatctcccacgggaccaccgggctggtaacttgggatgcggctctatatttagccgaatgggccatagaaaacccagccgcttttattaaccgcaccgtgctcgagctcgggagtggcgctggcttgaccggtctcgcgatttgtaagatgtgtaggcccagggcctacatcttctctgatccgcattccagaatcctcgagcagctcagaggcaatgtactcctgaacggcctgtcacttgaggctgatattaccggcaacttggatagtcccagggtcaccgtcgctcaactcgactgggacgttgctatggtccaccagctgtccgccttccagcctgatgtggtgatcgcggctgatgttttgtattgtccagaagcgatcgtaagtctagtgggagtcctgcagcggttagctgcctgccgtgaacacaagagagccccagaggtgtacgttgcttttacggttcgcaatcctgagacatgtcagctcttcacaaccgaactcgggagggatggtattcggtgggaagctgaagcgcatcatgaccagaagctcttcccgtacggcgagcatttagaaatggctatgctgaacctcacctag

SEQ ID NO: 56363 - DNA, 450 bp, Artificial Sequence
  Description of Artificial Sequence: Synthetic coding sequence
atggcccctgaggagaacgccggtactgagctcctcctgcaggggttcgaaagaaggttcctggcagtacggaccctccgctcatttccttggcagtccttggaagcgaagcttagggattcttccgacagcgaactgctcagagacatcttgcagaagacagtgcgccatcccgtctgcgttaaacatccccctagtgtcaaatacgcttggtgcttcttatctgaactgatcaagaaatcttctgggggatccgtgacgttgtcaaaatctacagcgattataagccacgggactaccggattagtgacatgggatgcagctctgtatctcgccgagtgggctatcgagaatccagctgcttttatcaaccgcagagcagtgttgccaaggagccaccgagttgcgggtcgagggcctgccgaagctggctgtctcccaggggcttag

SEQ ID NO: 56364 - DNA, 396 bp, Artificial Sequence
  Description of Artificial Sequence: Synthetic coding sequence
atggcgccagaggagaatgctggctcagaactcctgctccagagctttaagagacgattcctggctgcccgtgcattgcggagcttccgatggcagtccttggaagcaaaacttcgcgacagctccgacagcgaattgctcagggacatcctgcagaaaacctgttgcatcgcacaaaagccaagctgccgatggtccggcagctgtggcggatggctcccggctgggtccactagcggccttttgaatagcacctggccgctaccttctgcgacgcaaagatgcgctagttgcagccccccttcctacgctggtttgggcagcgacggaaagcgaaaactgattatgaccaggaactgcttccctactgagagcacatggcgctggcaaagctag

SEQ ID NO: 56365 - DNA, 498 bp, Artificial Sequence
  Description of Artificial Sequence: Synthetic coding sequence
atggcacctgaggagaacgccggttccgagctgctgcttcagagcttcaagcggagatttttagccgcaagagctctccgctcctttcggtggcaaagcctggaggccaaactgcgcgactccagcgactctgagctcttgcgggatattcttcaaaagcacgaggccgttcacacagaacccctcgacgagctctacgaggtgctggtggagaccctgatggctaaggagagcacccagggccaccggagttatttgttgacatgctgtatcgcgcagaagcctagctgtcggtggtctggaagttgcggcggatggctgcctgctggctctacatcagggctgcttaactccacgtggcctctgccctctgctacgcagaggtgcgcatcctgttcaccgccaagctacgctggcttaggatccgacggcaagaggaaactgattatgactaggaactgtttcccaactgagagtacatggcggtggcaatcctag

SEQ ID NO: 56366 - DNA, 477 bp, Artificial Sequence
  Description of Artificial Sequence: Synthetic coding sequence
atggccccagaggaaaacgcaggaagtgagctcctgttgcaatcctttaagagaaggttcctagccgctagggccctgaggtcattcagatggcaatccctcgaggccaaattgagagacagtagtgatagcgaactgttgcgggacatcttgcagaaaactgtgaaacatcccgtgtgtgtcaaacaccccccaagtgtgaagtacgcccgttgtttcctgtccgagttgattaagaaaacctgctgtattgcgcagaagccttcatgtaggtggtcgggaagttgcggcggatggctgcctgctggttctacctctggcctcctgaatagcacctggccactgcctagcgccacacagagatgcgcaagttgcagccccccatcatacgctggtttaggatccgatggcaaaaggaaactcatcatgactcgaaactgcttccccaccgaatcaacatggaggtggcagtcatag

SEQ ID NO: 56367 - DNA, 555 bp, Artificial Sequence
  Description of Artificial Sequence: Synthetic coding sequence
atgagcggcgcacgcgctgcacctggcgctgccggtaatggagccgtgaggggtcttagggtggacggactgcccccactgcccaagtctctttccggccttttacattctgctagcggaggcggagcaagtggcggttggagacatctggagcggctgtacgctcagaagtctagaatccaggatgagctgagccgcggtggacccggaggcggtggagcgagggccgcagctcttccggctaaacctcctaacctcgacgctgccttagccctcctgaggaaggaaatggtgggcctgagacaattagatatgagcctattgtgtcaattatattcactgtacgagagtatacaagaatacaagggagcgtgtcaggccgcttctagccctgattgtacctatgccctagaaaacggttttttcgacgaggaagaagaatatttccaagaacaaaattctctccacgacaggcgcgaccgcggacctccacgagatctatcactgccagtctcatccctgtctagttcagattggatcctggagtctatttag

SEQ ID NO: 56368 - DNA, 531 bp, Artificial Sequence
  Description of Artificial Sequence: Synthetic coding sequence
atgaatggtctgccatccgctgaggccccaggaggcgctggctgcgccctcgccggattacccccactgcccagggggctcagcgggcttctcaacgcctctgggggatcttggcgggagctagaaagggtctactcccagcggagccgcattcacgacgaactgtcacgggcagccagagcccctgacgggcctcggcacgccgcaggcgctgcgaacgccggacccgcagccggtccacgcagaccagtgaacctggattctgctctggctgccctacgcaaagagatgctgtgggggctttacgaaagcatccaagattacaagcatttgtgtcaggatctgtctttctgtcaggatctgtcctcttccctgcattccgacagttcatacccccctgacgctggcctcagcgatgatgaagaacccccagacgccagcctgcctcctgatcccccaccattaacagtgccacagacacacaatgctcgtgaccaatggcttcaagacgcttttcacattagcttgtag

SEQ ID NO: 56369 - DNA, 489 bp, Artificial Sequence
  Description of Artificial Sequence: Synthetic coding sequence
atgaatgggctgccatcagctgaggctcccggaggggctggttgcgccctcgccggattacccccactcccccgaggcctgtcagggcttctcaatgccagtgggggatcttggcgtgagttagaaagggtctactctcagcgcagcagagtggtcctgtctacctcaacacagagatggccccgatgcgctagacgctgctgtctccaggtgggcctgaggcagctggatatgagtcttctgtgtcagttatgggggctatacgagagtatacaggattacaaacatttgtgccaggatctgagcttctgccaggacttatcctccagcctgcactccgactcaagctaccccccagatgccggtctctcagatgacgaagagccccctgatgccagtctgccccctgacccacccccattgacggtgcctcagacgcataacgcacgtgaccagtggctgcaggatgcctttcacatctccctgtag

SEQ ID NO: 56370 - DNA, 465 bp, Artificial Sequence
  Description of Artificial Sequence: Synthetic coding sequence
atgaatggactgcctagcgccgaagccccaggtggcgcaggttgtgcacttgcgggactgcctccattaccacgcggtctgagcggtctgctgaatgcgtctgggggtagctggagggagctggagagggtgtatagtcagagatcccggattcatgatgaactgagccgcgctgcgagggccccagatggacctcggcacgcggcaggagccgcaaatgcaggacctgcggctgggcctcgccgaccggtgaacctcgacagtgctttagccgctctgcgcaaggagatgctcagcgccggaggggcagcggctgtggggcacgttcttgtggtgcctgctgtgggcccagtccgcgtcaaccccggacttcagactcccgtgccccgaccggagttgcttccgggaccagtaatcctgcccccttttggccagctgcttcctactggatgcggccctgtctag

SEQ ID NO: 56371 - DNA, 570 bp, Artificial Sequence
  Description of Artificial Sequence: Synthetic coding sequence
atgaacggtcttcccagcgccgaagcgccagggggagctggatgcgcacttgcaggcctcccaccacttccccgagggctgtcaggtcttctcaacgccagcggagggtcctggagggaattggaacgggtatatagccaaagaagcagaatacatgatgaactgagtagagcagccagagccccagatggcccacgccacgcagcaggtgccgctaacgcagggcctgctgccggtccacgacgacccgtgaacctggattcagcattggccgcactgagaaaagagatggtcggtctgcggcagttagatatgagcttactgtgccagttgtggggactttatgagtctatccaagattacaaacatctgtgccaggatttgtccttctgccaagacctctcttcttccctgcattccgactcttcctacccaccagacgccggactctccgacgacgaggagccccctgacgcaagccttcctccagaccccccacctctcacagtgccacagacacataacgctagggaccagtggcttcaggacgctttccatatttccctgtag

SEQ ID NO: 56372 - DNA, 2517 bp, Artificial Sequence
  Description of Artificial Sequence: Synthetic coding sequence
atgaatatagacgttgaatttcatattcgacataactatccttggaataagttaccggctaatgtgagacaatccctgggtaattcccaaagagaatatgaaaaacaagtggtgctatacagtatacgcaatcaattgcggtacagaaacaatctggtgaaacacgtgaaaaaggatgagaggcgttattacgaagagctgttgaaatactcccgcgatcacctgatgttgtacccttatcacctgagcgatatcatggtgaagggcctccggattacccctttcagctactacactggcattatggaagacataatgaattctgaaaagtcctacgactcccttcccaacttcaccgcagccgactgtcttagacttcttggcatcgggaggaaccaatatattgacctaatgaaccagtgccgatcatcaaagaagttcttccgtcgcaagactgcacgtgacctcctcccaatcaagcctgtcgaaatagccatcgaagcgtggtgggttgtgcaagccggttacatcacagaagacgacatcaaaatctgcaccctccctgagaagtgtgctgttgataaaatcattgatagcggccctcagctgagtgggtccttggattacaatgtggtgcactccctctataataagggctttatctacctcgacgtccctatctccgatgacagttgtatcgcagtgccacccctggaggggtttgtaatgaatcgagtccagggtgactactttgagacccttctgtacaaaatttttgtgagcatcgatgagcacactaacgtggcagaactggccaacgtgctcgagatagacttgtccctcgtgaaaaacgcggtcagcatgtattgcagactcgggttcgcacacaaaaagggccaggtcattaacctagaccagttgcatagcagttggaaaaacgttcccagtgtgaaccgattgaagagcactctggatccacagaaaatgctgctctcatgggatggtggagagtcaaggtctcccgtacaagaagcatcatcagccactgacactgatactaattcccaggaggacccggcagacactgctagtgtgtcttcgctctccctttcaaccggccacactaagcggatcgcctttctgttcgacagcaccttaaccgcgttcctgatgatggggaacctgtcgcccaacttaaaaagccacgccgttacaatgttcgaggtggggaagctcagtgacgagtccctcgactccttcctaatcgagctagagaaagtacagagtactggcgaaggcgaggctcagagatacttcgaccatgcactgacactgcgcaacaccatcctgtttttacggcataataaggatcttgtagcgcagacagcccagcccgaccaacctaactatgggttccccttagatctgctgcggtgtgaaagcctgctgggccttgaccctgctacttgttctcgtgtgctcaacaagaactatacactgttggtgtccatggcacccttgactaacgaaataagacctgtctcttcttgtacaccacagcatattggaccggctatccctgaggtcagctcagtgtggtttaagctgtatatctaccacgtcacggggcagggtcctccatccctgttgctgagcaagggaacgcggctgcgcaaactgcccgacattttccaaagctatgaccgcctgctgatcaccagctggggacatgaccccggagttgtgcccacatcaaacgtactaacgatgctaaatgatgctctgacacactccgcagtgctgattcagggacacgggttgcatggaattggggagaccgtgcacgttcctttcccgtttgacgagactgagctgcagggcgagtttacccgagtcaacatgggagtccataaggccctacagattcttaggaatcgggtggatctccaacacctgtgcgggtatgttactatgcttaatgcatcttcgcagctggccgacaggaaactgtcagacgcaagcgatgaaagaggcgaacccgaccttgcttccggctccgacgtgaacggttcgaccgagtcatttgagatggtgattgaggaggcaacaatcgatagtgctactaaacagacaagcggcgcaaccaccgaagcggattgggtgcccctggaattatgcttcggcattcctctttttagctccgagttaaaccgcaaagtgtgcagaaaaatcgcagcacatggtctgtgtcgcaaagaatcgctgcaaaaccttctgcacagctcaaggaaactctctctgcaggtgctgaacttcgttcacagcttccaggaaggcgcaagtatcctggatattcacactgagccaagcttcagcagcctgctgtctcagagtagctgtgccgacatgggagtaccattacctgctaagaacctgatcttcaaggacggggtgttgagcgagtggagcgggaggagccccagctccctgctaatcgcaaatctccaccttcagtag

SEQ ID NO: 56373 - DNA, 276 bp, Artificial Sequence
  Description of Artificial Sequence: Synthetic coding sequence
atgaatattgacgttgagtttcatataagacacaactatccctggaacaagttacccgcaaacgtgagacaaagcctgggaaactcccaacgcgaatatgaaaagcaggtggtgctgtacagcatccgaaatcagcttcgttacagaaataacctggtgaagcacgtgaagaaggacgagaggaggtactatgaggagctcctgaagtactctcgcgatcatttgatgttgtacccatatcacctctccgattcagtctgttatgtgtgtctgtag

SEQ ID NO: 56374 - DNA, 819 bp, Artificial Sequence
  Description of Artificial Sequence: Synthetic coding sequence
atgatgcgcagaacactggaaaataggaacgctcagacaaagcaactacaaacagccgtgtccaacgtcgaaaagcatttcggcgagttgtgccagattttcgccgcatacgtccgcaaaaccgctcgcctgcgggataaggctgacctgctcgtgaacgagattaacgcctacgcagccactgaaacaccacacctcaaactgggactcatgaatttcgctgacgagttcgctaaactccaggattaccggcaagcagaggtggagaggctggaggcaaaggtggttgagccactgaagacatacggaactattgtcaaaatgaagagggacgatttgaaagcgaccttgactgctcggaatcgggaggctaagcagcttactcaactggaaagaacgagacagaggaatccatcagaccgacacgtcattgcacaagccgaaacggagttacaaagagctgcgatggatgcctcaaggacaagtagacacctggaagaaacaatcaacaacttcgaacgccagaagatgaaggacataaagaccatcttttccgaattcataaccatcgaaatgctttttcatggcaaggctctggaggtgtacactgccgcttatcagaatatccaaaatatagatgaggacgaggatctcgaggtgttcagaaatagtctttacgcgccagactacagctcacgtctcgacatagttcgtgcaaattccaagagcccccttcaaaggtccctctctgctaaatgcgttagtgggacgggacaacaggaggccggttgggctgccacatgccaaacactgatctag

SEQ ID NO: 56375 - DNA, 756 bp, Artificial Sequence
  Description of Artificial Sequence: Synthetic coding sequence
atgatgcggaggacactggaaaatagaaacgctcagaccaagcagctgcagaccgctgtgagcaatgtggagaaacacttcggagagttgtgtcagattttcgccgcatatgtcaggaagacagccagactgcgcgataaagccgacctcctagtgaacgagattaatgcctacgctgccacagagacccctcatttgaagcttggcctgatgaactttgctgacgaatttgccaaacttcaggactacaggcaggccgaagtggagcgccttgaggctaaggtggtagaacccctcaagacatacgggactattgtaaaaatgaagagagacgatctcaaagccacactcactgccaggaacagggaggcaaagcaacttacccagctcgaaaggacccgccagcgcaacccgagcgacaggcacgtgatcgctcaagcagagacagaactgcagcgcgcagccatggacgcaagtcgcacatcaaggcacctggaggagactatcaacaactttgagcggcagaagatgaaagacatcaaagtgtttcggaattcactgtacgccccagattacagctccagactcgacatagtcagggctaactctaagtcaccactgcagcggagcttaagcgcaaagtgcgtatctggcacgggacaggtttctacatgtcgcctccgcaaagaccagcaggccgaagacgacgaggatgatgaactggatgtgacagaggaagagaacttccttaagtag

SEQ ID NO: 56376 - DNA, 870 bp, Artificial Sequence
  Description of Artificial Sequence: Synthetic coding sequence
atgatgcgacggacgctggaaaacagaaacgcccagactaagcagcttcaaacagctgtgagcaatgttgagaagcatttcggagagctttgtcaaatctttgcagcttacgtgcgcaagacagctcgactcagagacaaggctgatttgttggtgaatgagattaacgcttacgctgccactgaaacacctcacctcaagctggggctgatgaacttcgctgacgaattcgctaagctccaggattaccgccaggctgaggtggaacgcctggaagctaaggtcgtggagccacttaagacctacgggaccattgtgaaaatgaagcgtgacgacttgaaggccactctgaccgcgcgaaaccgggaggccaagcagctgactcagctggagcggactcgccagcgaaatcccagcgacaggcacgtaatctctcaggcagaaaccgaactccagcgcgctgccatggacgccagccgaacctcccggcacctcgaggaaaccatcaataacttcgaacgccagaagatgaaggatataaaaacaatcttttccgagttcataacaatagagatgctttttcacggaaaggccttagaagtgtacaccgcagcttaccagaacatacagaatatcgatgaggatgaagatttagaagttttccggaacagcttatacgctccagactactcctccaggctcgacattgtgcgggcaaactcaaagtcccccttacagagaagtctgtcagccaaatgcgtatcaggaaccggacaggtatcaacctgcagattgcggaaagatcagcaggcagaagatgacgaggatgatgaactcgatgtaactgaagaggagaactttcttaagtag

SEQ ID NO: 56377 - DNA, 789 bp, Artificial Sequence
  Description of Artificial Sequence: Synthetic coding sequence
atgatgcggagaactcttgaaaataggaatgcccagacgaagcagcttcagacggccgtctccaacgtggagaaacacttcggagaactatgtcagatcttcgccgcttatgtgcggaagaccgcccgtctgagagacaaggccgatctgctggttaacgaaatcaatgcctatgcggctactgaaaccccccacttaaaactcggcttaatgaactttgctgatgaattcgctaagcttcaagattataggcaggcagaagtagaaaggctcgaggccaaagtggtggagcctttgaaaacctatgggacaatcgttaagatgaagcgagatgatttaaaggcgactttaacggcaaggaatcgggaagctaagcagttaactcaactcgaacggacccgtcagcgtaaccccagcgataggcacgtgatagcccaggcagaaacagaactccagagggcagccatggacgcatcaaggaccagcagacatctggaagaaactatcaacaactttgaacggcagaaaatgaaggatattaaaaccatcttcagtgagttcatcacaatcgagatgttgtttcatggcaaggcactggaggtttatacagcagcctatcagaacattcagaatatcgatgaggatgaagatctagaacggtggtcttttgctatgcttcctcggctggttctgaacagttgggggtcttcagaccctccagccctagcgagtcagtccgtgcggttttcggaaattctgtgtatgcatcagattatacatctggtatag

SEQ ID NO: 56378 - DNA, 309 bp, Artificial Sequence
  Description of Artificial Sequence: Synthetic coding sequence
atgcaaagagtgtcaggcctcctatcatggacacttagcagagtactgtggctcagtggtttgagtgagcccggagctgctagacagcctcgcatcatggaggaaaaagctcttgaggtgtacgacttgataaggaccattcgggatccggaaaagcctaacaccttagaggaattggaggtggtgtccgaatcttgcgtggaagtccaagagatcaacgaggaggaatatcttgtcattatcaggttcacccccacagtgcctcattgttctctggctacactgattgtcggaaacctgcacttttag

SEQ ID NO: 56379 - DNA, 483 bp, Artificial Sequence
  Description of Artificial Sequence: Synthetic coding sequence
atgcagagagtctccggactcctcagctggactctgtcacgggtgctgtggctgtcagggttaagcgagcccggagctgccaggcagccccgaattatggaagagaaagcactggaggtctacgacctcatccggaccattagagatcctgagaagcccaacacactggaggagctggaggtagtttctgaatcttgtgttgaagttcaggagatcaatgaggaagagtacttggtgatcatcagattcacacctacagtgccccactgctcactagccacgttgatcggcctctgccttcgtgtcaagctgcaacggtgcctgccatttaaacataaactcgaaatttatatttctgaagggacacactcaacggaagaggacattaataaacagatcaacgataaggagagagtagccgcagctatggaaaaccctaatctcagggagatcgtagaacagtgtgtgttggaacccgattag

SEQ ID NO: 56380 - DNA, 309 bp, Artificial Sequence
  Description of Artificial Sequence: Synthetic coding sequence
atgcagagagtgtccggcctcctgagctggactctcagccgggtattgtggctttctggtctgtcggaacccggagccgctcgccagcctcggattatggaggagaaggctttagaagtatacgacctgatccggaccattcgggacccagaaaaacctaacacactggaagagttggaagtggtttcagagtcttgcgtcgaagtgcaggaaattaatgaagaggaatatctagtcatcattcgctttacaccgactgttcctcattgctccttggcaactcttatcgtgggtaacctccatttctag

SEQ ID NO: 56381 - DNA, 1557 bp, Artificial Sequence
  Description of Artificial Sequence: Synthetic coding sequence
atggaatgtgatctgatggaaacagacatactggagtctttagaggacttaggctacaaaggcccacttctcgaggatggagcactctctcaggcggtgtcagctggcgcttctagtccggaattcaccaagctctgcgcttggctggtctcagagctccgagtgctgtgcaagctggaggaaaacgtccaggccaccaactccccttcagaagccgaggagtttcagttggaagttagcgggttgctgggcgagatgaattgcccctatctttccctcaccagtggagacgtgacaaaacgcctgctaatccagaaaaattgtctgctactgcttacttacctcatcagtgaactagaagctgctagaatgctgtgcgtgaatgctccccctaagaaagcacaggaaggcggaggctccgaggtgttccaagagttaaagggcatttgtatcgccctgggcatgtccaagccccctgcaaacatcacaatgtttcagttctttagcggtatcgaaaaaaaactgaaggaaactctggccaaagttccacctaatcacgtcggcaaacccctgctgaaaaaaccgatgggacctgctcattgggaaaaaattgaggcgataaatcaggcgatagcgaacgaatatgaggttagacggaaattactaatcaagaggctggatgttaccgtgcagtctttcgggtggtctgacagggcaaaaagccagaccgagaaattagctaaagtctatcagcccaagaggagcgtcctctcccccaagactacaatttctgtggctcacctgctcgccgctaggcaggatctgtctaaaatactgagaacctcatcaggaagcatacgggagaagacggcatgtgcgatcaataaggttctgatgggcagggttcccgataggggtggccgtccaaatgagatagagccgcctccgccagagatgccaccctggcagaagcgccaggacggcccacagcagcaaacaggcggacggggagggggtagaggcggttatgagcacagttcatatgggggaagggggggacatgagcaagggggaggtaggggcggtcggggaggatatgatcacggaggcagaggcggtgggaggggaaacaagcaccagggcggatggactgatggagggagcggtggaggcggtggctatcaggacggtggataccgcgattcaggtttccagcccggaggctaccatggcggtcacagtagcggcggttaccaggggggaggctacggcggattccagacttcttccagctacacggggagcggttatcaaggcggagggtaccagcaggacaataggtaccaggatggaggtcaccatggagataggggcggaggcagagggggaaggggcggacgcggtggtcgcggaggccgagcgggacagggcggaggttgggggggacggggttcgcagaattatcatcagggtgggcagttcgagcagcacttccagcatggaggctaccaatataaccacagcggatttggtcagggacgccattacacaagttag

SEQ ID NO: 56382 - DNA, 1560 bp, Artificial Sequence
  Description of Artificial Sequence: Synthetic coding sequence
atggagtgcgacctcatggagacggacatattagagagtttagaagacttgggctacaaaggccctctcctcgaagacggcgcactgagccaagcagtctctgccggagcctcaagcccagagttcacgaaactgtgcgcctggcttgtgagtgagttaagggtgctgtgtaaactggaggagaacgtgcaggccaccaactctccatcagaggctgaggaatttcagctggaggtgtcaggactccttggagaaatgaactgcccttatttgtccctgacatctggggacgtgacgaagcggctgctgatccaaaagaactgccttctactcttgacatacctcataagcgaactggaagcagcccgaatgctgtgcgttaacgctccacctaagaaagcgcaagaggggggaggctctgaagtgtttcaggaactcaaaggcatctgcatcgccctgggcatgtcaaaaccacccgctaacattacaatgtttcagttctttagtggtattgagaagaagaagttgaaggaaactctcgctaaggtgccccctaaccatgtgggaaaaccactgctgaagaaacctatgggcccagcccattgggaaaagatcgaagccatcaaccaggcgattgcaaacgaatatgaggtacgtcgaaagttgctgatcaagcgcctcgatgtaaccgtccagagctttggttggtcagacagagcaaagagtcaaacggagaagcttgccaaggtgtatcaacctaagcggtccgttctgtcacctaagacaactatcagtgtggcccatcttttggccgcaagacaggatttgtcaaagatccttcgtacctctagtgggagtatccgggaaaaaacagcctgcgcaatcaacaaggtgctgatgggccgagtgccagacaggggtggacggcctaacgagattgagccaccacccccagagatgcctccctggcagaaacgacaggacggtccacagcagcagacaggcggaagagggggagggagaggcggatacgagcactcctcctacgggggtagagggggacatgaacagggcggtggtcgcggagggagaggagggtatgatcatggcggaagaggtggtggaaggggcaacaagcaccaggggggatggactgacggcggatcaggcggtggaggtgggtaccaagatggaggatatagggactcagggttccaacccggtggttatcacggaggtcattcttccggcggttaccaagggggtggatatggcggatttcaaacatcttcctcatacacaggcagcggataccagggcggtgggtaccagcaggacaaccggtaccaggacggaggccaccatggtgatcgtggcggtgggagagggggacgaggtgggagaggaggtcgcggtggaagggctgggcaaggaggtggatgggggggaaggggcagtcagaactaccatcagggtggacagtttgaacaacatttccagcatggtgggtaccaatacaatcacagcgggtttggtcagggcaggcattacacatcttag

SEQ ID NO: 56383 - DNA, 972 bp, Artificial Sequence
  Description of Artificial Sequence: Synthetic coding sequence
atgggcccagcccactgggaaaaaattgaggcaatcaaccaggccatcgcgaatgagtacgaggtgcggagaaagctgcttattaagaggcttgatgtgactgttcagtccttcgggtggtcggatcgggctaaaagtcagactgaaaaattggccaaggtgtaccagcccaagaggagcgtcctgtctcccaaaacgacaatctccgtggctcatctgctcgctgccaggcaggatctttctaagatcctgcggacctcttccgggagcattagggagaaaaccgcatgcgccataaacaaggtgctcatgggacgggtacctgacagaggcggtcgacctaatgagatagaacccccacccccagaaatgcccccatggcagaaacggcaggatggcccacagcaacagacagggggaaggggcggaggacgagggggatatgaacacagcagttacgggggacgcggtggtcatgagcaaggcggtgggagagggggaaggggaggatacgaccatgggggtcggggtggcggaaggggcaacaaacatcagggaggctggactgacggcggttcaggcggtggtgggggatatcaggacggcggttacagagacagtggatttcagccagggggataccatggtggccattccagcgggggttaccagggaggcggatatgggggattccagacatccagttcttatacaggcagcggatatcagggtggcggttaccagcaggataaccgataccaggatggaggtcaccacggtgacaggggcggaggaagaggaggcagagggggacgtggtggaagaggaggcagagccggtcaggggggaggctgggggggacgcggaagtcagaattaccatcagggtggccagttcgagcagcattttcagcacgggggttatcagtacaaccactctgggttcgggcaaggccgacattatacatcttag

SEQ ID NO: 56384 - DNA, 1302 bp, Artificial Sequence
  Description of Artificial Sequence: Synthetic coding sequence
atgagggggcctgagcctggccctcagcccacgatggagggagatgtgcttgatactctcgaggccctgggctacaagggcccactgctggaagagcaggcattgaccaaagctgcggaaggagggctgagtagccccgaattttccgaattgtgcatctggctcggatcacaaatcaaatccctatgtaatttagaggaatctatcaccagcgccggacgcgacgacctcgaaagtttccagctggaaatctccggattcctgaaagagatggcatgtccgtactcggtgctgatcagcggtgacattaaggatcggctaaaaaagaaagaagactgtctcaagctgctattgttcctcagcacagagttgcaggctagccagattcttcagaacaagaagcacaagaactcccagctggataagaatagcgaggtgtaccaggaggtgcaagcaatgttcgacaccctgggaatacccaagagcacgacaagcgatattcctcacatgctcaaccaagttgagtcgaaggtgaaagatatcctgagcaaggtgcagaagaatcatgtgggaaagccccttctgaagatggatttaaactctgagcaagctgaacagttagaacgcattaatgatgccctcagctgcgagtatgagtgccgacgaagaatgctgatgaagaggctcgacgttacagtgcagtcattcgggtggagcgatagagccaaagtcaagactgatgatatcgcaaggatttatcagcccaaacgatacgcactcagtccaaaaacaacaataacgatggcacacctgctggcagcacgtgaggatctgtcaaagatcatcaggacatcatccggaacgtcacgagagaaaaccgcctgcgcgattaataaggtcctgatggggagggtaccagataggggcggtcgaccaaacgagatcgaacctccaccacctgaaatgcctccctggcagaagcgccaagagggaggcggaggtaggggaggctggggaggagggggaggaggaggaggtcgtggcggtggcggtgggggtggaggaagaggtggctggggcggtggagggggtgggtggggcggaggcggaggcggtggaggcggttgggggggagggggaggcggagggcgaggcggatttcaagggagaggagactatggcggacggggtggttatggcggaagagggggttatgggggaaggggatatggcgatccctatggaggaggtggcggtggtggaggtggcggaggcggagggggtggctataggcgctactag

SEQ ID NO: 56385 - DNA, 993 bp, Artificial Sequence
  Description of Artificial Sequence: Synthetic coding sequence
atgaggggaccagaaccagggccacagccaaccatggagggcgatgtcctggataccttagaggcgctgggatataagggcccattgttagaagaacaggctctgactaaagccgctgaaggaggcctgtcatcaccagagttctctgagttgtgcatttggctgggatcacagattaaatccctgtgtaatctagaggagtccattacttctgcgggtagagacgacctggaaagtttccagctagagatctccgggttccttaaagaaatggcttgcccatattcagtccttatctcaggggacatcaaggacaggctgaagaaaaaagaggattgcctgaaactcctgttgttcctgtcgacagaacttcaggcatcccagattcttcagaataagaaacacaagaacagccaactggataagaattccgaggtttaccaggaagtgcaggcaatgttcgatacactaggaatacccaaaagcactacgagtgatatccctcacatgttaaaccaagtggagtcgaaagtgaaagacattctgtcaaaagtgcagaaaaatcacgtgggcaagccactgctgaaaatggatctgaatagcgaacaagccgagcagctagagcggattaacgacgctctttcatgtgagtatgagtgccgtcgtaggatgcttatgaagcgtcttgacgtgaccgtccagtcattcggatggagcgaccgggcaaaggtgaaaaccgacgacatagcccgtatttatcaaccgaagcggtatgccttgtcccctaagactacgataaccatggcacacctgctagctgccagagaagacctatccaaaatcattcgcacttcttcagggacctctcgggagaagacagcatgcgctattaataaagtgggcgtaagcttctccaccgtagaaaacgaactgatgatctcctacctgatgttcctgcagatcctagtgtacttctcatttatgagctggtag

SEQ ID NO: 56386 - DNA, 549 bp, Artificial Sequence
  Description of Artificial Sequence: Synthetic coding sequence
atgatgcaagaatcacccgatcctgaagacgatgaaacgccaacgcaaagcgatcggctttctatgttatcccaagagatccagaccctgaagcgctcatcgacagggagctatgaggaaagagtcaaacgattaagtgtctccgagctgaatgagatcctggaggaaatagaaaccgcaatcaaagaatactctgaggagctcgtgcagcagctcgccctgcgcgatgagctggagtttgagaaagaagttaaaaacagctttatttctgttcttatcgaggtgcagaataagcagaaggaacataaggagactgctaaaaagaaaaaaaaactcaaaaacggaagtagccagaatggaaagaacgagaggtcacacatgccaggcacatacctgacgacagtgatcccatatgagaagaaaaatggtccaccttctgtggaggatctacagattttgacaaagatcctaagggccatgaaggaggactccgagaaggtcccaagcctactgacagattatatactgaaggtgctatgccccacttag

SEQ ID NO: 56387 - DNA, 1062 bp, Artificial Sequence
  Description of Artificial Sequence: Synthetic coding sequence
atggccgctgacggtgattggcaggatttttatgaatttcaagaacccgctcgctccttgcttgatcaggagaactgcaatgcctcgcccgagcctggtgccgaggctggtgccgaggccggaggcggtgccgacggctttccagctcctgcctgctcgttggaggaaaaactgagtttgtgcttccgcccatcggatccaggagcagagccaccacggactgccgttcgacccatcaccgagagaagtctgcttcagggtgacgaaatttggaacgcgcttaccgacaactacggaaacgtaatgccggttgattggaaaagcagtcatacccgtaccttgcacctcctgacactcaacctaagtgagaagggggtatctgactctctgctgtttgacaccagtgatgacgaggagttaagagaacaactggatatgcactctataattgtatcctgtgttaatgacgagcccctcttcaccgctgaccaagtgattgaagagatcgaagagatgatgcaggaaagccccgatccagaggacgatgagaccccaacacaatctgataggctgtcgatgctgagccaagagatccagactctgaaaaggtcttcaaccgggagctatgaagagagagtgaaacggctttcagtgagcgagctcaacgaaatcctagaggagattgagaccgccataaaagaatattcagaggagctcgtccagcagttagctctgcgcgacgaactggagtttgaaaaagaggtaaagaactctttcatctccgttcttatcgaagtacagaacaagcagaaggagcataaagagacggccaagaagaaaaagaagctgaagaacggcagctcccagaatggaaagaacgaaagatctcatatgcccggaacatacctcactactgtcatcccctacgagaagaagaatggccctccgtccgtggaggacctgcaaatacttaccaaaatcctgagggccatgaaggaggacagtgaaaaggtgccctccctgcttacagactacatactgaaggtgttgtgcccaacatag

SEQ ID NO: 56388 - DNA, 1143 bp, Artificial Sequence
  Description of Artificial Sequence: Synthetic coding sequence
atggccgcagacggagattggcaggatttctatgaatttcaggagcccgcaaggagtttgcttgaccaagaaaactgtaatgcatctccagagcccggagccgaggctggggcagaggcaggaggcggtgcagatgggtttcccgcaccagcatgcagcctagaggagaaactgtccttatgctttcggccaagtgatccaggggctgagcctccaaggacggccgtcagacctatcaccgaacgatccctcctgcagggcgatgagatttggaatgcactcaccgacaattatggaaatgtgatgcctgtcgactggaaatcatcccacaccaggactttgcacctgttaaccctgaacctgtctgagaagggcgtgtcggattcgctcctcttcgacacatcggacgatgaggagctccgcgagcagttggatatgcacagtattatcgtgagctgtgtgaacgatgaaccactgttcactgctgatcaagtgatcgaggaaattgaggagatgatgcaagaatccccagatcccgaggatgacgaaacccccactcagtcggacaggctgtccatgctgagccaggagattcaaacgctgaagcggagttccactgggtcctatgaggagcgtgttaaaagactttccgtttctgagctcaacgagattctcgaagaaattgaaacagccatcaaggagtacagcgaagagttagtccagcagctggccttgcgcgacgagctggagtttgagaaggaggtgaagaatagcttcatcagcgtgctgatcgaggttcagaataaacagaaagagcataaagagaccgctaaaaagaaaaaaaagttgaaaaacggctcctcacagaatggcaagaacgagcgtagtcacatgccgggtacgagattttctatggagggaatttctaacgtgatccagaatggactgcgccacacgttcggcaactctgggggagagaaacagtaccttactaccgtgattccttatgagaagaaaaatgggcctcccagcgtggaagacttgcagatcctgacgaagattctgagggccatgaaggaagatagtgagaaagttcccagtcttctcacggactacatattgaaagttctgtgcccgacctag

SEQ ID NO: 56389 - DNA, 423 bp, Artificial Sequence
  Description of Artificial Sequence: Synthetic coding sequence
atgatcgatcagctccagggcacttggaaatctatctcgtgtgaaaactcggaggactacatgaaggaacttggcatcggcagagcctcgcggaagctcggccgattggctaagcctaccgtcacgatcagtaccgacggagacgttatcaccatcaaaacgaagtctatatttaaaaacaacgaaatcagtttcaagttaggggaagaattcgaggaaattacaccaggagggcataagacaaagagcaaggtgactctggacaaagaatctctcatacaggtgcaagattgggacggaaaggagactactatcactcggaagctggtcgatggcaagatggtcgtagaatccaccgtgaacagtgtaatttgcactagaacatacgagaaggtgtcatctaattccgtttccaactcctag

SEQ ID NO: 56390 - DNA, 2208 bp, Artificial Sequence
  Description of Artificial Sequence: Synthetic coding sequence
atgactccagagcttatgatcaaagcgtgcagcttttacactggacatctggtcaagacccacttctgtacctggcgcgatatcgctcgaactaatgagaacgtggtgctggcagaaaagatgaatcgcgctgtgacctgttacaacttccggctgcaaaaaagcgttttccatcactggcactcctatatggaggaccaaaaagagaagctgaagaatattttactgaggattcagcagatcatttattgtcacaagttgaccattattctgacaaagtggcgcaatacagcgaggcacaaatcaaaaaaaaaagaggatgagctgatcttaaagcacgaacttcagctgaaaaaatggaaaaacagactgattctgaaacgagccgcagccgaagagtccaacttccccgagcgcagcagctccgaggtatttctggtcgacgagaccctgaaatgcgatatctctctgcttcccgaaagggccattctgcagatatttttttatcttagcctcaaggacgtcatcatttgtgggcaagtgaatcacgcctggatgctaatgacacaacttaattctctgtggaatgctatagatttcagttcagttaagaatgtgataccagacaagtatatcgtgtcaactttacaacgatggaggcttaatgtgttaagactgaattttcgaggttgtttgcttcgtcctaaaaccttcagatcagtgtcccattgtcggaacctgcaggagctgaacgtgagcgactgcccaacattcacagacgagtccatgagacatattagtgaaggatgcccaggagttctctgcctaaacctcagcaatacaactatcacaaaccgtactatgcgactgttaccgaggcatttccataacctccaaaacttaagcctggcttattgtagaagattcactgataaaggattgcagtacctgaacttgggaaatggatgccataagctgatttacttggatctgagtgggtgtactcagatctcggtgcaggggtttagatacattgcaaactcatgtaccggtatcatgcatctcaccattaacgacatgccgaccctgaccgataactgcgtgaaggcgttggtagaaaaatgtagtaggatcacttcactcgtgtttacaggtgcaccgcacatcagtgactgcaccttccgtgcgctgtcagcctgcaagttgcggaagatacgctttgagggcaacaagcgagtaacggatgcctcctttaagtttatcgacaagaactaccccaacctctcccacatttacatggcagattgcaaaggaattacagattccagcctgagatctctgagtccactgaaacagctaacagtgcttaatttggcaaactgtgtgaggataggtgacatgggtctgaagcagttcttggacggcccagcctctatgcgaatcagggaattaaatctgagcaattgcgtcagactttcggacgcaagcgtgatgaaactctctgagagatgcccaaatctgaactacctgtcattgagaaactgtgagcacctaaccgcccaaggaattggctacatcgtgaatattttttctcttgtgagtatagacttatcaggtaccgatatttctaacgagggcctgaatgtcctgagtagacataagaagctgaaggaactgagcgtgtctgagtgctacaggattaccgacgacggtattcaggccttctgtaaatcgtctctgattctggagcatttagatgtatcatactgcagccagttgtccgatatgatcattaaagccttggcgatctactgcattaacctcaccagtctgagtatagcaggttgtcccaagataaccgatagtgccatggagatgcttagtgccaagtgtcactacctgcatattctggacattagtggttgcgttcttctcacggatcagattcttgaagacctgcaaatagggtgtaagcagctgcgaatcctgaagatgcaatactgcacgaacatctctaagaaagccgctcagcgtatgtcttcaaaagtacagcagcaggagtacaacacaaacgatccccctcggtggtttgggtacgatagagaaggcaatcctgtcactgagctggataatatcacttcaagtaaaggcgcactggaacttacggtcaaaaagagcacttactcaagcgaggatcaagccgcatag

SEQ ID NO: 56391 - DNA, 1371 bp, Artificial Sequence
  Description of Artificial Sequence: Synthetic coding sequence
atcctgttgcgcattcaacaaatcatttattgtcacaaactgacaatcatcctgacaaagtggaggaatacggccaggcacaagtctaaaaagaaagaagacgaactgattctcaaacatgaactgcaattaaaaaagtggaagaaccggctaatcctgaagcgcgctgccgcagaggagagcaactttcccgagaggagctcatccgaagttttcttagtggatgagactctgaagtgcgacatttccttactgccagaacgagccatcttgcagatattcttttacctaagcttaaaagacgtcatcatatgcgggcaggtgaaccatgcttggatgctgatgacccaattgaacagcttatggaacgcaattgatttcagctctgtcaagaacgtgatcccagataagtatatcgttagtacactgcagcgttggcgcctgaacgtcctgcgtctgaatttcaggggctgtcttctacgccctaaaacttttcgttcactcagcccccttaaacagctcaccgtcctgaacctcgccaattgcgtccggatcggtgacatgggcctgaagcagtttctggacggcccagccagcatgcggatcagggaacttaacctctccaattgcgtacggttgagtgatgcaagtgtaatgaagctgagtgagcggtgtccgaacttaaactacctgtccctgagaaactgtgagcatctgaccgcacaggggataggatacattgtgaacatcttttccctggtctcaatcgaccttagtggcaccgacatctctaatgagggactgaatgtgctttcccgccataaaaaactgaaggagctgagcgtctcagagtgctaccgcatcacagatgatggcatccaggccttctgtaaatcctctctcattctggagcacctcgatgtatcatattgcagtcagctgtcggatatgatcatcaaagccttagccatttattgtattaatctcactagcctttccatcgcgggatgccccaagattacagattccgctatggaaatgctcagcgctaaatgtcactacttacacatcctggacatatctggatgcgtgctattgactgaccagattctggaagacctccagatcgggtgtaagcagctgcggattctaaaaatgcagtactgtaccaatatatctaaaaaggctgcacagcgaatgagcagcaaggttcagcagcaggagtataacaccaacgacccccctcgctggttcggctatgatcgggagggaaacccagtaaccgaattggacaatataacatcaagtaaaggcgctctcgagctgactgtaaagaagtcaacctacagctcagaagaccaggcagcttag

SEQ ID NO: 56392 - DNA, 2124 bp, Artificial Sequence
  Description of Artificial Sequence: Synthetic coding sequence
atgacacccgagctgatgattaaggcttgctcattttatacaggccacctcgtgaagactcacttttgtacgtggcgcgatatcgcacgcaccaatgagaacgtggttttggctgaaaaaatgaaccgggctgtgacttgctataacttcaggctgcagaagtcagtcttccatcactggcactcctacatggaggaccaaaaagaaaagctcaagaacatattgttgaggatccagcagatcatctactgccataagctgaccatcatccttacaaaatggaggaataccgctcggcataaaagcaagaagaaagaagacgaactcatcttgaagcatgaactccaactgaaaaaatggaaaaatcgcttgatcctgaaaagagccgcagcagaagaatccaactttcctgaacgttcgtcaagcgaggttttcctggtggatgaaaccctgaaatgtgatatttccctgttgccagaacgcgctatactgcagatcttcttctacctctccctgaaggatgtgatcatctgtggacaggtgaaccacgcatggatgctcatgacccagctcaacagcctgtggaacgccattgactttagcagcgtcaaaaacgtgatccctgacaagtatattgtgagcactttgcagcggtggcggttgaacgtgctgaggctgaactttagaggttgcctcctgaggcctaagacttttagaagcgtgtcccattgtcggaatttgcaagaattaaacgtttctgattgtcccaccttcactgacgagagcatgcggcacatttcagagggatgtcccggtgttctgtgcttgaacctttcaaacacaacaatcactaacaggacaatgcgccttctgcctcgccattttcacaatctgcaaaatttgtctttagcgtattgtagaaggttcacggataaggggcttcagtacctaaatctggggaatggatgccataagctcatctatttggacttgtccgggtgtactcagatcagcgtccagggctttcggtatatcgccaattcttgcactgggataatgcacttgactatcaatgatatgcctaccttgaccgataactgcgtgaaggctttggtagagaagtgttcaagaataacttcgctcgttttcaccggagctccccatatctccgactgcactttccgcgcactttcagcttgtaaactacgaaaaatcagattcgaaggaaataaacgggtcactgacgcctcttttaaattcatcgacaaaaattaccccaacctcagccacatatatatggccgactgtaaaggcattactgattcctccctccgatcgttgtccccccttaagcagctaaccgtcctgaacttggcaaattgcgtgcgaattggagatatgggcctgaaacaatttctggatggccctgcatctatgcgcatcagagagctgaatttatcaaactgcgtccgattgtccgacgcctcagtgatgaagctcagtgagcgatgccctaacctcaactacctgtccttgagaaactgtgagcacttgacagcacagggaattggttacattgtaaacattttttcactggtgagtatcgatttgtccggaaccgatatcagcaatgaggctttctgtaaatcctccctgattttggaacatctcgatgtttcctactgtagccagctgtcagacatgataattaaggccctggctatttattgcatcaacctcacctcgctctctattgcgggttgtcccaagattactgactctgccatggaaatgttgtctgctaaatgccattaccttcatatcctggatattagcggatgcgtgcttctgaccgaccagatactggaagaccttcagattggatgtaagcaactgcgcatcctgaaaatgcaatactgcacaaatatttctaagaaagctgcccagaggatgtcctccaaggtgcagcagcaggagtacaacacaaatgacccaccccgttggtttgggtacgatcgagaggggaacccggtgacggagctcgataacatcacgtcttcaaagggagccctagagctgaccgttaagaaatcgacctacagtagcgaagatcaggctgcttag

SEQ ID NO: 56393 - DNA, 1362 bp, Artificial Sequence
  Description of Artificial Sequence: Synthetic coding sequence
atgacccccgagctcatgattaaagcctgcagtttttatactggccatttggtaaaaacgcacttttgcacttggagggacatagctcgcaccaacgaaaacgtggtcctggcagagaagatgaatagagcagtgacctgctataacttccgactgcagaagagcgtgttccaccactggcacagttacatggaggatcagaaagagaaactcaaaaacatcctgctgcgtatccaacagatcatctattgccacaaactgactattatcttgaccaagtggagaaataccgcaaggcacaaatccaaaaaaaaggaggatgagctgatcttaaaacacgaactgcagctcaagaagtggaagaataggctgattttgaagcgtgctgccgcagaggaaagcaactttcctgagcggtcgtcttccgaagtttttctggtggacgagaccctcaaatgcgacatatcactgctgcccgagagagctatcctacagatctttttttacttgtctctgaaggacgtcatcatctgcggtcaggtcaatcacgcgtggatgctaatgacccagcttaattctctgtggaacgcgatcgatttctccagcgtgaaaaacgtgatccccgataaatacattgtcagcaccttgcagcggtggagactgaacgttctgagactgaactttcgcggatgcctactgcgtccaaagactttccggtctgtgtcacactgccgcaacttacaagagttgaacgtatccgattgtcccactttcacggacgagtccatgcgccacattagcgaggggtgcccgggtgtactttgtctgaacctgagtaacacgacgatcaccaaccgaacgatgagactgcttcccagacacttccacaatttgcagaatctgtccctggcttactgcagacggttcaccgacaaaggactgcaatacctcaaccttggcaacggatgtcataagcttatttatttggacctgtcaggatgtactcagatcaccgattctgcaatggagatgttaagcgctaaatgtcattacctgcatatactcgacatatccggctgtgtactactcacagaccagattcttgaagacctgcaaattgggtgcaaacagctgcgcatcctgaagatgcagtactgcactaacatatcaaagaaggccgcacaacggatgtcatctaaggtccagcagcaagagtacaataccaacgatcctccgaggtggtttgggtacgaccgcgaaggcaaccctgtaaccgaattagataacattaccagctcgaagggagccctggaacttacagtgaagaagtccacatactcatctgaagaccaggctgcctag

SEQ ID NO: 56394 - DNA, 2073 bp, Artificial Sequence
  Description of Artificial Sequence: Synthetic coding sequence
atgactccagagctaatgatcaaggcttgctcattctacacagggcacctggtgaagacgcacttctgcacatggcgtgatattgcccgtaccaatgagaatgtggtgttggctgaaaagatgaatagagccgtgacttgctataactttcgcctgcagaagagcgtttttcaccattggcacagttacatggaagatcaaaaagaaaaacttaagaatatcctactaagaatccagcagataatctattgccataagttgacaatcatcctcactaaatggcggaacactgcacggcataagagtaagaagaaggaggacgaacttatcttgaaacacgagttgcagctgaagaagtggaagaaccgcctgattcttaagcgggcagcagctgaagaatcaaattttcctgagagatcttcttctgaagtcttcctggtggacgagacactcaagtgcgatatctctcttttgcctgagcgcgctatactccagatcttcttttatctgtcccttaaagacgtgattatctgcggccaagtcaaccatgcgtggatgcttatgactcagctaaattccctctggaacgcaatcgactttagctccgtaaagaacgtgatccccgataaatatatcgtttcgactttacagagatggcgactcaacgtgttgcggctgaactttcgaggatgcctgctcagacctaagacgtttagaagcgtgtctcattgcagaaacctgcaagagctaaatgtcagcgactgccccactttcactgatgaaagcatgcggcacatatcggagggatgtcctggcgttctctgtcttaatttgagtaatacgaccattaccaatcggacaatgagactgttgcccagacatttccacaacctgcagaatctcagtttagcatattgcaggaggtttaccgacaaaggcctgcagtacctgaacctggggaatggatgccataagttgatctacttggatctcagcggatgcacccaaatcagtgtgcaaggctttcggtacatcgccaattcctgtacagggatcatgcaccttaccattaacgatatgcccacgctgaccgacaattgtgtgaaggcgctggttgagaaatgcagccggatcactagcttggttttcaccggcgctccccatatctctgactgcacatttagagctctctctgcatgcaaattacgcaagatccgcttcgagggaaataaacgtgtgactgacgcctccttcaaattcatcgataaaaactacccaaatttaagccacatttatatggctgactgcaagggcattacagattcatcacttcggtcactgtcacctctgaaacagcttacagtgctcaacttggcaaattgcgtgcggatcggggatatgggcctgaagcagttcttggatgggcctgcttcaatgcggattcgagagctgaacttatccaattgtgtgcgcctctctgacgcaagtgtgatgaaactatccgaaaggtgtccaaatctgaactacttgagtcttcgcaattgtgaacacctgactgcccaaggcattggctacattgttaatatcttctccctggtgagcatcgacctcagcggtacggacatcagcaatgaggggctgaacgtattgtcacgccacaagaagctgaaggaactcagtgtgtctgagtgttaccggatcaccgatgacgggattcagataacagattcggccatggaaatgctaagtgctaagtgccactacctgcacattctggatatctcgggctgtgtgttactaactgatcagatcttggaagacttgcaaattgggtgtaaacagttgcggatcttgaagatgcagtactgtacgaatataagtaagaaagcagctcagaggatgtcctcaaaagttcagcagcaggagtataatactaacgatccaccccgatggtttgggtatgatcgagagggcaatccagtgaccgaactggacaacattacttcaagtaagggggcattggaactcaccgttaaaaaaagcacatattcgtcagaggatcaggcagcctag

SEQ ID NO: 56395 - DNA, 2124 bp, Artificial Sequence
  Description of Artificial Sequence: Synthetic coding sequence
atgacccctgagctgatgattaaggcatgctccttttataccggtcacctagtcaagactcacttttgtacctggagagatattgcccgtacaaacgagaatgttgttttagcggagaaaatgaatcgcgcagttacttgctataacttccggcttcagaaatctgttttccatcactggcacagttatatggaggatcagaaagaaaagctcaagaatattctgctgagaattcaacagataatctactgtcacaagctaacaattattctgaccaagtggcgtaacaccgctcggcacaaatctaaaaaaaaagaggacgagctaatcctgaagcacgagctgcaactgaagaaatggaagaatcgcctgattctaaagcgcgctgctgctgaagagtcaaattttcccgagaggtcgagctccgaggtcttcctggtcgacgagaccttgaagtgcgacatttctctcctgcccgagcgcgctatcctgcagatttttttctatctttctctcaaagacgtgattatctgcggacaagtgaaccatgcgtggatgctaatgactcagctgaacagtctgtggaatgcgatagactttagcagtgtgaagaacgtcattccggacaaatacattgtcagcacactccagcggtggagactgaacgtgctgcggctcaactttcggggttgtttactgcggccaaagaccttccgcagtgtgagtcattgccgaaacctccaggagcttaatgtatctgattgccccacctttaccgacgagtcaatgaggcacattagtgagggttgccccggagtgctgtgcctgaacctaagtaatacaactataacgaatagaaccatgcgtttactccctcgacactttcataacctgcagaacctcagcctggcatactgtaggcggtttacggataagggcttacagtacctgaatctcggaaatgggtgccacaaactcatctacctcgacctgtccggatgcacccagatttccgtgcagggattccggtacatagccaactcgtgtacagggatcatgcatctcaccattaatgacatgcctactctgacggataactgtgtaaaggcgctggtcgaaaagtgtagtagaatcacctccttagtgttcacgggggctcctcacattagcgattgcacgtttagggccctgtctgcctgtaagctcaggaagatccgttttgaaggaaacaagagagtgaccgacgcatccttcaagttcattgacaaaaattaccctaatctgtcgcacatttatatggcagactgcaagggtatcacagacagttcgttgcgctccctgagtcccctgaagcagttgacggtcctgaacctcgcgaattgtgtacgtatcggagatatgggtctgaaacaatttctcgacggccctgcctccatgcgaatcagggagctgaatctctcaaattgtgtgaggctgtccgacgccagtgtgatgaagctaagtgaacgctgccccaacttgaactatctgagcttgcgcaactgcgagcacctcactgcgcagggaatagggtacattgtgaacatcttctccttagtgtccatcgatctctccggaactgatatctctaacgaagcattctgtaaatcaagtttgattctggaacatctggacgtctcttattgctcacagctgtccgacatgataatcaaggctctggcaatctactgcattaacctgacctctctcagtattgcagggtgcccaaaaattactgattctgctatggagatgctctctgccaaatgccattaccttcatatactagatattagtggctgtgtgttactcactgaccagatcttagaggaccttcaaataggctgtaagcagctaagaatattaaagatgcagtactgtaccaatatttctaagaaagccgctcagcggatgtccagtaaggtccagcagcaagagtacaacacaaatgatcccccaagatggtttggatatgacagggagggcaacccggtcaccgagctggacaacattacaagcagcaagggtgccctggagctcactgtgaagaagtccacctattcgtctgaagatcaggcagcctag

SEQ ID NO: 56396 - DNA, 2208 bp, Artificial Sequence
  Description of Artificial Sequence: Synthetic coding sequence
atgacccctgaactgatgataaaggcatgctcattctacaccggtcacctagttaagacacatttctgcacatggcgagatatcgccaggactaacgagaacgtggtcctagctgaaaagatgaaccgggctgtaacttgctataattttaggctccagaagagcgtgtttcatcattggcattcctacatggaagatcagaaagaaaaattgaagaacatactgctgcggatccaacagatcatctattgccacaagttaacaattatcttgacaaagtggcgtaatactgcacgtcataagagtaagaaaaaagaggatgagttaatattaaagcacgagctgcagctgaaaaagtggaagaataggttaatactcaaaagagcagcggctgaggaaagcaactttcccgaaagatcctcctctgaagtctttctggttgatgaaacattgaaatgtgacatctccctgctgcccgagcgcgctatcctgcagatcttcttctacctgtctctgaaggatgtcattatttgcggccaagtcaaccatgcttggatgttgatgacccagctcaatagcctctggaatgcaatcgatttcagctccgtgaaaaacgtcataccagacaaatatattgtgagcactctgcagaggtggaggctgaatgtattgagattgaattttcgtggatgcttgctgcggcctaaaacatttagatctgtttcccattgtcgcaacttgcaggagctcaacgtaagtgactgccccacatttacagacgaatctatgcgccacatctctgagggttgccccggtgtactgtgcctcaatctgagtaatactaccataaccaacaggactatgcgtctcctgcccaggcattttcacaacctccaaaatctatctctggcatactgtagacggtttacagacaagggcctgcagtacctgaatctcggcaatggttgtcataaactgatttacctcgacctatccggatgtacgcaaatctctgtccagggattccgatatatcgcgaattcttgtacagggatcatgcacttgacaataaatgacatgcccacactgaccgataactgcgtgaaagcactggtggagaaatgctctaggatcaccagcctggtgtttaccggcgcacctcacatctccgactgcaccttcagagcactttctgcctgcaagcttcgcaaaatccggttcgagggcaacaaacgggttacggacgccagtttcaaattcattgacaagaattaccccaatttgagtcatatttacatggcagattgtaagggaattaccgactctagtctgaggtccctcagtccactgaaacagttgactgttctaaacctagcaaactgcgtgcgaattggcgatatggggcttaaacagttcctggacggaccagcctctatgagaatccgcgagctgaatctgtcgaattgcgtgagactgtccgacgcgtcggttatgaaattatctgagcggtgccctaatctcaactatcttagcttgcgcaattgtgaacatcttactgcgcagggcattggatatattgtgaatattttctcactggtgagcatcgatctatcaggtaccgacatctccaatgagggcctgaatgtgctgtctcgccacaagaaactgaaagagttaagcgtcagtgagtgttatagaatcaccgacgatggaattcaggctttctgcaaaagctctctgatcttagaacaccttgatgtgagttactgttcccagctctctgacatgatcatcaaagctcttgccatatattgcattaacctgacctcactctctatagcgggttgccctaagatcacagacagcgcaatggaaatgttgtccgcaaagtgccattatttgcacatcctggatatctcaggctgtgttctcctgacagaccaaatactggaggatctgcagatcggctgtaaacagcttagaatactcaagatgcagtattgcacaaatatttccaagaaagccgcacaacggatgtcctcgaaagtgcagcagcaggaatacaacactaatgacccaccccgatggtttggatatgacagggagggaaaccctgtcactgagctggacaacatcaccagttcaaaaggtgccttggagttgaccgtcaagaagagcacttactcatcagaagaccaggctgcgtag

SEQ ID NO: 56397 - DNA, 2073 bp, Artificial Sequence
  Description of Artificial Sequence: Synthetic coding sequence
atgaccccagagctgatgatcaaagcctgcagtttttatacaggacacctggttaagacacacttttgcacctggcgcgacatcgccaggacaaatgagaatgttgtgcttgccgaaaagatgaacagggcggttacatgctacaatttccggctccaaaagtctgtctttcaccattggcattcctacatggaagatcagaaagagaaactgaaaaacattctgctcaggattcagcagatcatttactgccacaagctcaccattatcctgacaaaatggagaaacactgctagacacaagtcgaaaaagaaagaagatgaacttattttaaagcatgagctccagctgaaaaaatggaaaaatcgcctcatcctgaaacgtgccgctgcagaggagtctaatttccctgaacgctctagttcagaagtttttcttgtggatgaaactctgaagtgcgatatatccctactacccgaaagggctattcttcaaatcttcttctacctctctttaaaagatgtgataatctgcggccaggtgaatcatgcgtggatgctgatgacgcagctgaactctctctggaacgccattgatttctcctcggtcaagaatgtgatccctgacaaatacatcgtgtccacattacagaggtggcgcctcaacgtactgcggctgaattttcgcggatgtcttctgaggcctaagacttttaggtcagtaagtcactgtaggaaccttcaggaactgaacgtcagcgactgtcctactttcacagatgagagtatgcgccacatcagcgaggggtgcccaggcgtactctgtctgaatctgtctaacactactattactaaccgtacaatgagacttctgcccaggcattttcataatctccagaaccttagcctggcctactgtcgtagatttaccgacaagggcctgcagtatctgaacctcggcaacggctgtcataagctcatttacctggatctgtctgggtgtacccaaatcagtgtgcagggattcaggtatatcgccaattcctgcaccggtattatgcacttaactatcaacgacatgcccacactcaccgacaattgcgtgaaagccctggtcgaaaagtgtagtagaatcacttctctggtgttcaccggagcccctcacatcagcgactgcacgttccgagccctgagcgcctgcaaactgcgcaaaatccgctttgagggaaataagcgagtcactgatgccagttttaaattcatcgacaaaaactaccccaacctctcccatatatacatggccgactgtaaggggataaccgacagcagcctccgcagtctaagtccactgaagcagcttaccgttcttaaccttgccaattgtgtgagaatcggcgacatggggctgaaacagtttctggatggtccggctagcatgagaattagagagctcaacttgtcaaactgcgtaaggctgagcgatgcttcggtcatgaaactgtctgaaagatgtccaaacttgaattatctttccctgcgaaattgtgagcacctcactgcgcaggggatcggctatatcgtgaatatattctcgctggtgtcaatcgatctgtcagggactgacataagtaacgagggtctcaatgtgctgtctcgtcataaaaaactgaaagaactcagcgtcagcgagtgctacagaattaccgacgacgggattcaaattacagatagtgccatggagatgctaagcgcaaagtgtcattacttgcacatcctggacatttccggctgtgtcctgctaactgatcagattctcgaggatctgcagattgggtgtaaacagcttcggatcctgaaaatgcaatactgtaccaatattagtaagaaagcagcacagcggatgtcaagcaaggttcaacaacaggaatacaacacaaacgaccctccacgctggtttggctatgatcgagaaggtaatccagtaaccgaactagacaatataacaagctccaaaggcgcactggaactgaccgttaaaaagtcaacatactcttctgaggaccaagccgcttag

SEQ ID NO: 56398 - DNA, 1362 bp, Artificial Sequence
  Description of Artificial Sequence: Synthetic coding sequence
atgactccagaacttatgatcaaggcctgttcattttataccggacacttggtgaaaactcatttctgtacctggagagatatcgcgaggacaaatgagaatgtggtgctcgcagaaaagatgaaccgggctgtcacttgttacaactttagactgcaaaagtcagtgttccaccattggcattcatatatggaggaccagaaagaaaagctgaagaacatcctgctgcgaatccaacagattatctactgtcacaagctgacaattatcctgacgaaatggcggaatacagccagacacaagagtaagaaaaaggaagacgagcttattctgaagcacgagctccagttaaagaaatggaaaaaccgactcatccttaaaagggcagccgcagaggaatcaaactttccagaaaggtctagctcagaagtgtttctcgtggacgaaaccctgaagtgcgatataagtctacttcccgaacgggctatactccagatattcttttacctttccctgaaggacgtgattatttgcgggcaggtgaatcacgcttggatgcttatgacccagctgaacagcctgtggaatgcaatcgacttctctagcgtcaaaaatgtcatacccgacaagtatatagtgagtacgctgcagcgatggagactgaatgtcctcagactgaatttcaggggttgcctcctgcggcctaagacatttcgatctgttagccactgtcgcaacttacaagagctaaacgttagcgactgccctacctttaccgacgaaagcatgagacacattagtgaggggtgtccgggtgttctgtgtctgaatctatctaacactactataacaaaccgaaccatgcgtcttctgcccagacattttcacaatctccagaacctgtctttagcttattgccggcgatttactgataagggactccagtatttgaacctcggaaatggttgtcacaaactgatctatttggatctttcaggttgcacacagattacagactcagccatggagatgctgagcgcgaaatgccattatctgcacatacttgacatatcgggctgcgttctgttgacagaccaaatcctggaggacctccagatcgggtgtaagcagttacgcattctgaaaatgcaatattgtaccaatatctccaagaaggctgcccagaggatgtctagtaaggtgcagcagcaggagtataacacaaatgatccccctcggtggtttggctacgaccgcgaaggaaatccagtaaccgaacttgataatattactagctccaaaggcgcattggagctgacagtgaagaagtccacctattccagtgaagaccaggcagcctag

SEQ ID NO: 56399 - DNA, 1440 bp, Artificial Sequence
  Description of Artificial Sequence: Synthetic coding sequence
atgtcatcccctggaatcgacggggacccgaagccaccatgtttgccgaggaatggcctggtcaaacttccaggccagccaaatggactcggagctgcatcgattacgaaagggactccagcaacgaagaatcgcccttgccaacccccaccaccacctaccctgccacctcctagcttggctgctcctctttccagggctgctctcgccggtggtccttgtacaccagcaggcggtccagcaagcgccttggcccctggtcatcccgcagagagaccccctctcgccacagacgagaaaattctgaatggactcttctggtacttctccgcttgcgaaaagtgtgtcctcgcacaggtctgcaaagcctggcgtcgagttctctaccaaccgaagttctgggctggactaactccagtcctacacgcaaaagaactttataacgtgctacccggaggggagaaggagttcgtcaacctgcaggggttcgcagcccgaggattcgagggtttctgtctggtgggcgtttccgatctcgacatttgtgagtttatagataattatgccctgtcaaagaagggggtgaaggccatgagcttaaaacggagcacaataacagatgccggtctggaggtgatgctggaacaaatgcaaggtgtggtgcgactggagctgagcggatgcaacgacttcactgaagccggtctgtggtctagcctgagtgcccgtatcacttccttgtcagtgtcggattgcataaacgttgcagatgacgccatcgccgctatcagccaactattgccaaatctggcggagctctctctccaggcctaccatgtgactgataccgccttggcatacttcacagcgcgtcagggacattccacacatactttacgtctgcttagttgctgggaaataaccaaccatggggtcgtgaacgtagttcacagcctgcccaacctaacagctttgagcttgagtggatgctccaaggtaaccgacgatggcgtcgaactcgttgccgaaaaccttagaaaattgcgcagcctcgatctgagttggtgtcctagaataaccgatatggccttggagtacgttgcatgtgatctgcatcggctggaggagctcgtgctcgacaggtgcgtcagaattacagacaccggactgtcgtaccttagcaccatgtcttcattacgcagcctctacttgcggtggtgctgccaggtgcaggacttcggcctgaagcacttattagctctgggctccctacgtctgctctcccttgcagggtgccctttgctgaccaccactggcctatccggccttgtccagctccaggaattggaggagcttgagttaacgaattgccctggcgcaaccccagagctcttcaaatacttctcgcagcacctacctagatgcctggttattgagtag

SEQ ID NO: 56400 - DNA, 1440 bp, Artificial Sequence
  Description of Artificial Sequence: Synthetic coding sequence
atgtcttctccgggaatcgatggcgaccctaaacctccttgccttccacgcaacgggttagttaaactccctggacagcctaacgggttaggtgccgcttcgatcaccaagggcacccccgcaactaaaaacagaccatgtcagcctcccccaccccctactctgcccccaccgtccctcgccgctccactatcaagggcagccctcgctggcggaccctgcacaccggctgggggtcccgcatccgcacttgcgccaggccatccagcagagcgtcctccacttgctactgatgaaaagatcttgaacggtcttttctggtatttttccgcctgcgagaaatgtgtcctggcccaggtgtgtaaggcttggcggagggtcctgtatcaacccaaattttgggcgggactgacacctgtgctgcacgccaaggagctgtacaacgtgctcccaggcggagagaaagagtttgtgaacttgcagggcttcgctgctaggggcttcgaaggcttctgtctcgtgggtgtctccgatctcgatatctgcgaatttattgataactacgctttgagcaagaagggtgtgaaagctatgtctctgaaaaggtccaccatcacagatgccggattggaggttatgttggagcaaatgcagggagtggtacgactcgagcttagcggctgtaacgacttcactgaagccggtctttggagcagcctgagcgcccgaatcacatccctcagcgtgtccgattgtatcaatgttgccgatgatgctatcgccgctatctcccaattgctaccaaacctagctgaactgtccctgcaggcctatcacgtgacagatactgccctggcatacttcacagcgcgtcaggggcactctacacataccctgagattgctaagttgttgggaaataactaatcacggcgttgtaaatgtggtccactcccttcccaatctgaccgcactgagtctttccggctgcagcaaggttacagacgatggggtggagttggtagcagaaaacctgcgcaaactccgatccttggacctatcctggtgccctcgtattaccgacatggcattagaatatgttgcatgcgacctccacagattggaagagctggtattggaccgctgcgtgagaattactgacaccggtctcagttacctgagtacgatgagcagtttacgcagcctctatctccggtggtgctgccaagtgcaagatttcgggcttaagcatctattggcactcggctccttgcgcctgctctcccttgctggctgcccactgctcaccaccaccgggctctccggccttgtccagctacaagagttagaggaactggaattaaccaactgtccaggcgctacccctgagttgtttaagtatttctcacagcatctcccacggtgtctggtgattgaatag

SEQ ID NO: 56401 - DNA, 780 bp, Artificial Sequence
  Description of Artificial Sequence: Synthetic coding sequence
atgcatgctgtgccacggggatttggaaaaaaggttcgcgtgggagtccagagctgtccccctttgctcgggccaggcgttcctcctgctttgctgagagtcctcgtaagtgctgaagagcctgccttacctggaaccccgcgagccgattgggttcagctgcttctgaggcacgcgccacagcgagccagacatccccagctggctcccacccttcagccacgaactgagtgtcgcggactgggcggtggcagacacagaccagcagggctccccgctgcgcctgacgctcggacagcagctcaaaggccttacgggttaagggctggtcagtacagacccgctgtgcctgccgtggctgtgcccgttgctgggcagcccggtcacgatggggaaggcggagtacacgctagggcgcttcgccatgttgaagctttgcaagctgctgaaggtccgcaggcaggtgccgctctgctgcaaagacagcgtcctgtcctccccggtgccgagccagtgcctttagccgcagctcctgttcctggactgtcccagagacaccccccagctcgctgtagggccggtctccatgggtctctcccagccggttgtcacgttccaccagtccaccggggtgtgcccaggcacctacaggaaccggctgcggtcgcttcgccacagctgccaggcagagccgctcgcgttaaaagacggcatctgccaagcgccccacggggacctgacagacggcatcccggtcgtccgcctggcgcacccggatag

SEQ ID NO: 56402 - DNA, 2418 bp, Artificial Sequence
  Description of Artificial Sequence: Synthetic coding sequence
atggcttccagtggcgaggatatcagtaatgacgacgatgatatgcacccggcagctgctggcatggccgatggagtgcatttactcggtttctctgatgaaattctattgcacattttgagccatgttccaagcactgacctgattttgaacgtgcgcagaacatgccgaaagctggcggctttatgtctcgataaatccttgattcacacagtccttcttcaaaaggattaccaggcttccgaggataaagtgagacaactcgttaaagaaataggaagggaaatccagcaacttagtatggccggttgctactggctgcccggaagcacagtcgaacatgtggctaggtgtcggagccttgtgaaggtgaacttgtccgggtgtcatcttacttccttaaggctgagcaaaatgctcagtgccctccagcatctccgctcattggctatcgacgtgagtcccggatttgatgcctctcagctgagtagcgagtgcaaggctactttgtcgagagtccgcgaattgaagcagactctgttcacgccctcgtacggcgtggtcccttgttgcactagcttggaaaaactgctcctgtatttcgagattctcgatagaacaagggagggtgccattctgtccggacagttgatggtgggacagagcaacgtgccccactaccaaaatctgagagtgttttacgccagactggcccctggctacattaaccaggaggtagtgaggctgtatctggcggttctgtccgaccgtacacctcagaacctgcacgctttcctgatttctgttccgggtagcttcgcagagtcaggagcgaccaaaaacctgctcgactctatggcgcgaaacgttgttctggatgctttgcaattacctaagagctggctgaatggtagcagcctgctgcagcacatgaaattcaacaaccccttctacttcagctttagccgttgcaccttaagtggaggacaccttatccagcaggttattaacggtggaaaggacttgaggtctctggccagcctgaacctctcaggatgtgttcactgcctgtctccagactcccttctccggaaggctgaagatgacatcgatagcagtatcctggagactttggttgcctcatgctgcaacttgagacacctcaacctgtcggcggcacaccaccacagttccgagggtctaggtagacacctatgccagctcctggcacgtttgagacatttgagaagcctatcccttcctgtctgctcagtcgctgactctgcacctcgtgctgaccgcgctcctgcgcagcccgctatgcatgctgtgcctaggggatttggaaagaaggtcagagttggcgtgcagtcatgtccaagccctttcagcgggcaggcttgccctcagcccagttccgtgttttggtctcttctcaagaacctccccttcctggaacatctggagctgattggaagcaattttagctctgcaatgcccaggaatgagcccgctattagaaactccttacccccatgtagccgggctcagtcagtcggcgactcagaagttgcggctatcgggcagcttgctttcctgcgtcatctgactcttgctcagttaccatccgtcctcacaggctcaggtttggtaaacatagggttacagtgtcaacagctgcgtagcctgtctttggctaatcttgggatgatggggaaagttgtgtatatgcccgcactgtccgatatgctcaagcactgcaagcgcctccgcgatcttcgccttgaacagccttatttcagcgcaaatgcccagttcttccaagcactgagtcaatgcccgtcgctgcagcgcttgtgcctcgtttctagaagtggtaccctgcagcccgatgccgtgttagctttcatggccaggtgtctacaggtcgtgatgtgccacctcttcactggggagagcctcgctacgtgcaaatctttgcagcagtccctgttgcgtcgctggggcgaggtcactggtcggcgaccacagcttttcactgagcttcgcgaggagccctctgctcgtacctcgcgggcaacgggcaggcgccaaccctgtcttcctgactccggggtcgtgtgctgtccctgcgggaggcccctggcagtgtccggaatcattctggtcggagtctccccgtcgctcgtcgtgaagacaacatgcgtttatagagtgctgtttaagaatcttgactatgcatcaatattctttcttgtctgtctgttcgagacagaatcccattcggtggtacaggcgggagtgcagtggcgtgacttgtcttctcttcaacccctattaagcgggttgcagcctcaaccccctgagcagttggagaacgagttagaaatcggattcagttactgtttcgtcatctag

SEQ ID NO: 56403 - DNA, 2157 bp, Artificial Sequence
  Description of Artificial Sequence: Synthetic coding sequence
atggcatcctccggtgaggacattagcaatgatgatgatgacatgcatcccgctgccgctggcatggccgatggagttcacctgctcggattttcggatgagattctgctccacatcctttcccatgtgccaagtacagaccttatcctgaacgtccgcaggacgtgtaggaagttggccgcactctgccttgataagtccctaatacacactgtgctgctccagaaagactaccaagccagcgaggataaggttcgacagctggtgaaagaaatcggcagggaaatccagcagctgtctatggccggttgctattggctgcctggaagtaccgttgaacatgtggccaggtgcagaagtctggtaaaggtgaatttgtccggatgtcacttgacaagcctgcgcctgagcaagatgctgagcgccttacagcacctcaggtctttggcaatcgacgtctccccagggtttgatgcatcccaactgagctcagaatgcaaagcaaccttgtctagagtacgcgaactaaagcaaaccttattcactccctcctacggggtggtcccgtgttgcacaagcctggagaaattgttgctgtacttcgaaatcctggatagaacgcgcgagggggcaatcctgagcggtcagctgatggttggacaaagcaatgtgcctcactatcagaatctgcgcgtgttctacgcccgtcttgctcccggatatatcaaccaggaggtagtgagattgtacttggccgtgttgagtgacagaaccccccagaatctccacgccttcttaatctccgttcctggatcattcgccgagtccggagcaacaaagaatttgctcgatagcatggcgcgtaacgtcgtgctcgacgctctgcagcttcccaagtcctggctgaatggtagtagcttgttgcaacatatgaagtttaacaatccattctacttctcattttcgcggtgcactctgtccggaggccatttgattcagcaagtcatcaacggcggaaaggacctccgatctttagcgtcccttaacctgtcaggctgcgtccattgcctctcacctgattcccttctgcgcaaagccgaagatgacattgacagctcaatcctggagacactggtcgccagctgttgtaatttgagacatctaaatctctctgcagctcaccaccacagctcagagggattaggcaggcatctgtgccagctgctggcaagactgcgccaccttagatccttgtccctgcccgtgtgctctgtagctgactcagctccccgtgcggatagggcgccagcgcagcctgcgatgcacgctgtgccaagaggattcggaaaaaaggtccgtgtgggggtgcagagttgtccttccccattctccgggcaggcttgtcctcagccatcctccgtgttctggtctcttctaaagaatctcccttttctggaacatctcgaactgatagggtcaaatttcagctccgctatgcccaggaacgagccagccatccgtaactctttgcccccttgctctagagcccaatccgtgggggactctgaagtggccgctataggacagctcgctttcttgcggcacctgaccttagcccagcttccttccgtgttgaccggttctggactcgtgaacatcggcctgcagtgtcaacagttacgcagcttaagtctggccaacctgggcatgatgggcaaagtagtgtacatgcccgctctaagcgatatgctgaagcactgcaaacggctgcgagatctcagattggagcagccctacttttctgccaacgctcagtttttccaggcacttagtcagtgccctagtctccagagattatgtctggtgagccggtccgggactctccagccagacgcagtgttggcatttatggctcgatgcctccaagtggtcatgtgccatctgttcactggcgagtccttagccacctgtaagagtctgcagcagtctctgctgcggagcttccaggccgaacgaccagcgctgaacgttgtcatcttcccactgctgcatgaaggccttactgacgtgattagagatgtacccttggtgcatctcgacgagattacattgttcaagtcaagagtcgctgaagagccacctaacctgtggtggtag

SEQ ID NO: 56404 - DNA, 2406 bp, Artificial Sequence
  Description of Artificial Sequence: Synthetic coding sequence
atggctagcagcggcgaggacatcagcaacgatgacgatgatatgcatcctgccgctgcgggaatggcagatggggtacacctcctaggattctctgatgagatcctgctgcatatcctgagccacgtaccaagtactgatctgatcttgaacgtgcgtagaacttgcaggaagcttgccgctctgtgcctggataagtccctgatccacaccgtgctgctccagaaggattaccaagccagcgaggataaggtgaggcaattggttaaagagatcgggagggaaattcagcagctctctatggcaggatgctactggttacccggttctactgtcgagcatgtggcacggtgccgcagcttggttaaagtcaaccttagtggttgccacctaacgagcctcaggctgagtaagatgttgtccgctttacaacatctccggagtttggctatcgacgttagtccgggtttcgatgcaagtcagctgtcgagcgagtgcaaagctaccctgagcagggttagagagctgaaacagaccctctttacgccctcttatggcgtggtaccttgctgcacctctttggagaagctgctcctctactttgagatcctagacagaacacgtgagggggcaatactgtctggtcagctgatggtcggacagagcaacgtgcctcattatcagaacctgcgtgtattctacgctcgactcgcccctggctacatcaaccaggaggtggtcaggctgtaccttgcggtcctctcagatcggacaccacagaacctgcacgcgttcctcatctcagtacccggaagctttgcagagagcggggcaacgaagaatctgttggactcaatggcacgtaacgtagtccttgacgcattacagctgcccaagtcttggctgaacggaagttccctcttgcagcatatgaagttcaacaatcctttctacttctcatttagcagatgcaccctctccggaggccatttgattcagcaagtgattaatggtggcaaggacctgagatctcttgcctccctgaacctgagtggttgtgtgcactgtcttagccctgattctcttctacgaaaggctgaggacgatatagactcgagcatcctggagacccttgtcgcctcctgttgcaacctcaggcacctcaacctaagcgccgctcaccaccattcaagcgagggcctgggccgtcatctatgtcaattgcttgccagactgaggcacctgagatcattatctttacccgtgtgctcagtcgcagacagcgccccacgtgctgaccgggctccggctcagccagccatgcatgccgtgccacgtgggttcggcaagaaggtacgagtgggcgtgcagtcctgcccaagccctttcagcgggcaggcctgtccacagccatctagcgtcttctggagccttcttaaaaatctgccttttcttgagcacttggagttaattggtagcaatttttcatctgccatgccacggaacgagcctgccatccgaaatagcctccccccttgcagtcgggctcagtctgtcggggatagcgaagtggccgcaattggacagctggccttcttacgccatctgacccttgcccagctgcctagcgtgttgacgggctcgggacttgtgaacattggcttacaatgtcagcagctccgtagcctgagcctcgccaacctcgggatgatggggaaagttgtctacatgcccgctctgtccgatatgctcaagcactgcaaaaggctccgagatctcaggttagagcagccatatttctctgctaatgcccagttctttcaggcccttagtcaatgcccctcactgcagcgcttatgcttggtgtctaggtccggcacattgcagccagacgcagtgctagcctttatggctcgttgtctgcaagtggtcatgtgccatctctttactggtgagtccctggcaacatgcaagtccttgcaacaatccttactgagacgatggggggaggtgacaggcagaaggccacagctgttcaccgaactgagggaggagcctagcgccaggacatctagggccaccgggaggcgacagccctgtctgcctgacagtggcgtcgtctgttgcccttgtggtcgacctctggccgtctctggtattatactggtgggggtgtcgccctccctggttgtcaagaccacatgtgtctatcgcgtgcttttcaaaaaccttgactatgcttcgatcttctttctcgtttgtctcttcgagaccgagtcccactcagtagtgcaggcaggtgtccagtggagggacttgtctagcctgcaacccttgctgagtggattgcagccacagccccctgagcagctggggttacaggtttgtacaaccattcctgggtag

SEQ ID NO: 56405 - DNA, 726 bp, Artificial Sequence
  Description of Artificial Sequence: Synthetic coding sequence
atgcatatcactcagctgaaccgcgaatgcctcctgcacttgttctcatttctggacaaagactccaggaaaagcctggcgaggacttgctcccagcttcatgacgtctttgaagatcctgccctttggagcctgctgcacttccggagcctgacagagttgcaaaaagacaacttcctgttgggcccagcgttgcgtagcctcagcatttgttggcacagttcccgggtccaggtgtgctccattgaggactggctgaaaagtgcatttcagcggtccatttgcagccgacatgagagcctagttaatgactttttactgagagtatgcgaccgcttaagcgccgtcagatcacccaggaggagagaggcccctgcaccgtcctctggcactcccatcgctgttggcccaaagagcccaagatggggtggccctgaccacagcgagttcgccgacctgcgaagtggagtgacaggtgctcgggcagcggctaggcggggactgggatccctgcgcgcagaaagaccatcggagactccacccgcacctggggtaagctggggccctccgcctcctggcgctccagtggtaatttccgtgaagcaggaggagggcaagcaagggagaactggacggcgaagccaccgagcagctcctccatgtggtttcgcgcgaactcgggtgtgtccacccacttttccaggagctgacgcgttcccccagtag

SEQ ID NO: 56406 - DNA, 1620 bp, Artificial Sequence
  Description of Artificial Sequence: Synthetic coding sequence
atggccgctcccgcatcccgccaggttcggcgacgagccagggccgctccgagaccaagatccgccgaggattggtggtgggataggctagctccgcgaggttctggctatcatcttctacaaagcgactccatgttgcttgtccttagcgagcctggaccagctcgccctcgcgcacagcggcgtgccagccggaggacccccagacagcccccaagagggccatctgccgctgccaaaccgaaggcgggattgcggtcagaggccgctgccgctccagcacctgccccagctccaacacctacccctgaggagggacccgacgccggatggggggaccggatccccctagagatactcgtgcaaatctttgggctgcttgtagcagccgacgggcctatgcccttccttggccgagccgctcgtgtgtgccgacgctggcaggaagccgcatcacaaccagccttgtggcatacagtcacactgagctccccgctggtggggaggccagctaaaggaggagtgaaagccgaaaagaagctccttgcctcgctcgaatggctgatgcctaacaggttttcccaacttcagcggctcacccttatccactggaagagccaagtccaccccgtcctcaaacttgtcggggagtgctgccctcgcctcacttttctgaaactgtcgggttgtcatggcgttacagctgacgcgctggtgatgctggctaaagcttgttgtcaactgcattccttggacttgcagcactcaatggttgagtcaacagccgtggtaagcttcctagaggaggccggttcacgtatgaggaaattatggctgacctactcctcgcagacgaccgctatcctgggcgctcttctgggcagctgttgcccccaactgcaggtgttagaagtgtctaccggcatcaaccggaactccatacctctgcagcttccggtggaagccctgcaaaagggctgcccacaattgcaagtgctgcgtctgttaaatctgatgtggctacctaaaccacctggccgaggtgttgccccaggtccgggatttccatccctggaggaactctgtctagcctcaagcacctgcaattttgtgagtaacgaagtgcttgggcgactacttcacgggtcgccgaacctgcgcctgctggatctacgagggtgcgccaggattacaccagccggtctgcaggacctcccctgccgagaactggagcaactgcacttgggcctttacgggactagcgaccgattgacacttgccaaggaagggagtccgtttttgactcagaaatggtgtcacacactcagggagctcgacctgtcggggcagggattcagcgaaaaggatctcgagcaggctctggccgcatttctttcaactcccggagggtcacacccagccctttgtagtttgaatctcagaggaacccgagtaacccccagcacagtgagcagcgtgatcagcagctgccctggtctcctgtacctaaatttggaatcttgtcgctgtctcccgcgtggcctgaagagagcttacagaggtttagaagaagttcagtggtgcctggagcagctgctgacctcgccatccccaagctag

SEQ ID NO: 56407 - DNA, 1602 bp, Artificial Sequence
  Description of Artificial Sequence: Synthetic coding sequence
atggctgcacctgcaagccggcaagtgcgcaggcgcgctcgggctgcgccacgccctagatccgcagaggattggtggtgggataggctcgcacctcggggatctgggtatcacttgctgcagagcgattcgatgctgctcgtgctgtcagaacccggacccgctcggcctcgcgctcaacgacgggcatctcgcaggacaccgaggcagccccctcgcggaccctcagccgcagctaagcccaaggcgggactcagatccgaagcagccgctgccccagccccagctcctgcaccaacgcctactcccgaggaaggtcctgacgctggttggggcgataggatcccgttggaaatcctggtgcagatttttgggctcctggtggccgcagatgggcctatgccattccttgggagagccgctagggtttgcaggcgttggcaggaggccgcaagccagccggctctatggcacaccgtgacactgtcttcccctctggtagggcgacccgcaaaggggggagtgaaggcagaaaagaaattgctcgcgtctctggagtggctgatgcctaatagattttcacagttgcaacgcctcaccttgatccattggaagtcacagctggtcggtgaatgctgccctcgcctgacctttcttaagttaagcgggtgtcatggcgtgacagccgacgctttagttatgcttgcaaaagcatgctgccagctgcattcattggacctgcagcactccatggtcgagtcaaccgccgtggtcagcttcctggaggaagccggatcccgtatgagaaaactgtggctgacgtactcttcccagactacagctatactgggagcactcctggggtcatgctgtccacagcttcaggtcctcgaagtgagtacaggcatcaaccggaactcgatcccactgcaacttcctgtggaagcgctacagaaggggtgcccacagctccaggtgttaaggttgctgaacttaatgtggctgcccaaaccacccggtcgtggcgtggcccctggacccggtttcccgagcctggaagagctgtgtctggcctcatccacatgcaatttcgtgtctaacgaagtcctcggacggctcctgcacggctctccaaatctgaggctccttgacttgcgcggatgtgccagaattacccccgctgggttacaggacttgccctgccgagaactggagcagctgcatttggggttgtacggtaccagcgatcgtctgacacttgccaaggagggttcacccttcctgactcagaagtggtgccatacacttagagaactggacttatctgggcagggatttagtgagaaagatctcgagcaggctctggcagcttttctgtccacacccggaggcagccaccccgcactctgctcactgaacctgcgaggtacacgggtcaccccatccaccgtgagttcagtaatcagcagctgccccggactgctgtacttaaacttagagtcctgccgatgtcttccccgaggtctgaagcgcgcttatagaggactagaagaggttcaatggtgtctggagcaactgttaacgtcccctagccccagctag

SEQ ID NO: 56408 - DNA, 1125 bp, Artificial Sequence
  Description of Artificial Sequence: Synthetic coding sequence
atggccgagcccggtgaggggctgcccgaggaagtcctagctctgatttttcgtcaccttagcctgcgtgaccgagccgctgccgcacgcgtatgtagagcatgggcagcagcagccacctgttctgcagtttggcatgacacgaaaatcagttgcgagtgcgagctggagggaatgttgccaccttacttatctgcctgcttagaccacattcacaacctccgactggagtttgagcccagcagaaaaccctcgcgcagagccgcaatcgaactgctcatggtgctggctggacgtgcgccaggcttaagaggcctacgcctcgaatgcagaggagagaaacctcttttcgacgccggacgagacgtgctcgaggccgtgcatgccgtgtgcggcgcagcctcccagctgaggcacttggacctgcgccgactctctttcactctggacgatgctttggtgctgcaggctgcccgttcttgcccagaactccatagtttgttcttggacaacagtacactggttggtagtgtggggccaggcagcgtgttagaactgcttgaagcctgccctagacttcgcgctcttgggcttcacctggctagtcttagccacgcaatcctggaggcgctggccgctcctgaccgagccccattcgcgttgctggccctccgctgcgcatgccccgaggatgcacgagctagtccactgccaaacgaggcttgggttgccctcaggaggcggcacccaggcctagcagtggagctagagctcgagcccgctcttcccgctgagagtgtcacaagggtgttgcagcccgcagtacccgtggcagctcttagactcaacctaagcggagatacggttggtcctgttaggtttgccgctcatcactacgccgcaacactctgcgcactcgaagtgcgcgcagccgcatcggccgagttgaacgccgctttggaggagttagccgcacgttgcgcagcgctacgagaggttcattgtttttgtgtcgtgtctcactccgtgctggacgcattcagagcacactgccccagactgaggacctacactttaaaattaactagggagccacacccttggcgacccactttagtagcttag

SEQ ID NO: 56409 - DNA, 492 bp, Artificial Sequence
  Description of Artificial Sequence: Synthetic coding sequence
atggccgaacctggagaaggccttccagaagaggtgcttgccttgattttccgccatctctctctgagagatcgtgctgcagcagcgcgtgtgtgccgcgcatgggcagcagctgccacatgctccgctgtctggcatgacaccaaaatatcatgtgaatgtgaacttgaaggcatgctgccaccgtacctctcggcctgtctggaccatattcataacctgcgtctcgaatttgagccgtcacggaagccatctaggcgagctgctatcgaacttctgatggtgctggctgggcgagctcctggcctgagaggactgaggttagagtgtcgcggtgagaagccgctgttcgacgccggtagggatgtgctggaagctgtgcacgcggtgtgcggcgctgccagtcagctccgccacctggacctacggaggctcagctttacactcgacgatgcactggttctgcaagccgctcgctcctgcccggaatag

SEQ ID NO: 56410 - DNA, 1125 bp, Artificial Sequence
  Description of Artificial Sequence: Synthetic coding sequence
atggcagaacccggagaggggctgcccgaggaagttctggctctcatctttagacatttatcgttgagggatagggcagccgcagcgagagtctgccgggcatgggcggctgcagcaacctgctcagccgtgtggcatgatacaaagataagttgcgagtgcgagctggagggcatgctgcctccataccttagcgcatgcctggatcacatccacaatctgcggttggaatttgagccaagtaggaaaccctcacgcagagcagccattgagctgttgatggtgctagccggaagggcgccaggactgcgcggtctcaggctcgagtgcagaggagaaaagcccctgttcgacgcaggacgggacgtgctcgaggcggttcacgcagtgtgtggggcagcctctcagctccggcacctggatctgcgccgtctttcttttacgttggatgacgccttggtcctacaggcggcacgtagttgtcccgagctccactcgctcttcctggacaattccactttggtcgggagcgtagggccaggtagcgttttggaattgctcgaagcttgtcctaggctcagagcccttgggctacatttggcctcgttgagtcacgcaatacttgaagccttggctgcgccagatagggctccattcgccctcctcgcactgagatgcgcatgcccagaggacgcgcgtgcttcgcccttgccaaatgaagcttgggtcgccctacgcaggcgccacccaggacttgctgtggagctggaattggagcccgctcttcccgcagaatctgtgactcgcgtcctccagccggcagttccggtggctgcccttcgacttaacctcagcggtgatacagtaggcccagttcgctttgcggctcatcactatgccgctacactctgtgccttggaggttagagccgcagcgtctgccgaactgaacgctgccttagaggaattagccgctcgttgcgcagctctgcgggaggttcactgcttttgcgtcgtctctcattcagtgttagatgctttcagggcacattgcccacggctgcgcacatataccctcaaactgacaagggagccccatccctggcggccaactctggtggcctag

SEQ ID NO: 56411 - DNA, 390 bp, Artificial Sequence
  Description of Artificial Sequence: Synthetic coding sequence
atggccgaacctggggaaggacttccagaggaagtactggcgcttattttccggcacctctcacttagggaccgtgcagccgcagctagggtgtgtcgggcttgggcagccgctgctacctgctccgcagtgtggcacgacaccaaaataagctgcgagtgtgagctcgaaggcatgctgcccccatacctgtctgcctgtctcgatcacatccataacctgcgcctggagttcgagcccagcagaaagcccagccgcagggccgcaatagagttattgatggtactggcaggaagagcaccagggctgaggggccttcggctcgagtgtcgcggagaaaagcccctattcgacgcaggacgcgatgtactagaggccgtgcacgcctag

SEQ ID NO: 56412 - DNA, 1701 bp, Artificial Sequence
  Description of Artificial Sequence: Synthetic coding sequence
atggacgaaggaggtacgccattactgccagatagcttagtatatcagatattcctgagcctcggacctgcagacgtgctggccgctggactggtgtgcagacagtggcaggctgtgagccgtgatgagttcttgtggagagagcaattctaccgatattaccaggtcgcccgagatgttcctagacaccctgcagcaatgtcgtggtacgaggagtttcagaggttatacgacactgtgccttgcgtagaggtacagactctgcgggagcatactgatcaggtgctgcacctatctttctcgcattccggataccaattcgcttcatgttcaaaggactgcactgtaaaaatctggtcaaacgatttgaccatatccctccttcacagcgccgatatgagaccctacaattggtcttacacacagttttcacagttcaataaggatgatagcctccttctggcttctggggtgtttttggggccacacaacagttcaagtggcgagattgccgtcatcagccttgatagctttgccctcctctctcgggtgcggaacaagccatatgacgtatttggctgttggcttaccgagacatcacttatcagtgggaacctgcaccgaatcggcgacatcaccagttgctctgtgctgtggctgaacaacgcattccaggatgtggaatcagaaaacgtcaatgtcgtgaagcgcttgtttaaaatccagaaccttaacgcctccacagtgaggacggtcatggtggctgactgtagccggttcgacagtcctgatctcctgctcgaggccggagacccagcaacgagcccttgtcgcattttcgacctgggctctgataacgaagaagtggtggcgggtccagctcccgctcatgcaaaagaggggctgcgtcattttctcgatagggttctggaaggacgggctcagccccaattgtcagaacggatgttagagactaaggtggcggaactattagcacagggtcatacaaaaccaccggaaagatccgccacaggggcaaaatccaagtacctcatctttaccactgggtgtctgacctattcgccacaccaaattggcatcaagcaaattctgccccaccagatgacaaccgctgggcctgtgttaggggagggtagggggagcgatgcgttttttgacgccttggaccatgtgattgatatccacggccacattattggtatgggactgtctcccgataatcggtatttgtatgtaaactcaagggcgtggccaaatggtgcagtcgtcgccgatccaatgcagccaccaccaatcgcggaggagattgaccttctcgtattcgacttgaaaacaatgcgagaggtacggagggcgttaagagctcatcgcgcttatacccctaacgacgaatgtttcttcatttttctcgatgtgtccagggacttcgttgcaagcggggcagaagataggcatggctacatttgggacaggcactataacatttgcctggccagattgcgccatgaggatgttgtcaactcagtcgtgttcagcccacaggagcaggagctactgttgaccgcaagcgatgacgccacaatcaaggcttggcggtcccctagaactatgcgtgttctacaggcacctcgaccaaggccacgcaccttcttttcctggctggcatcccagcgcaggtag

SEQ ID NO: 56413 - DNA, 603 bp, Artificial Sequence
  Description of Artificial Sequence: Synthetic coding sequence
atggatgaagggggaactcctctgctccccgactcactggtttatcagattttcctgtccctgggcccagcagatgtactcgctgctggcctagtctgcaggcagtggcaggccgtttcaagggatgaatttctgtggcgggagcagttttaccggtattatcaggtggccagagatgttccgagacaccccgctgctatgtcctggtatgaagagtttcagagactctatgacacagtgccgtgcgtcgaagtccagactctccgtgagcacactgatcaggtgctacacctgtccttttctcattccggatatcagttcgctagctgttccaaagactgcacagtgaaagccatcaccactgcagctccggcagaacagatatggtcgaacgacctgacaatttctcttctgcactccgccgacatgcgcccttataattggagttatacccagttctcccagtttaataaagatgacagcttactgctggctagcggcgtgttcctcggcccacacaactcctccagtggagaaattgcggttattagcctggactcgttcgccctgctcagtcgagtgagaaacaagccgtacgactag

SEQ ID NO: 56414 - DNA, 804 bp, Artificial Sequence
  Description of Artificial Sequence: Synthetic coding sequence
gactccctgagctcacctggtctgcctacagacagcttcgccctactgtcaagggtgcgtaacaagccatatgacgtattcgggtgctggctcactgagacgtccctgattagtgggaatttacatagaatcggcgacatcaccagctgctctgtcctatggctgaataacgcctttcaggacgttgaatctgagaacgtgaacgtggtaaagagactctttaagatccagaacttgaatgcttctactgttaggactgttatggtggcagactgctcgagattcgattcccctgacctcctgctggaggctggagaccccgctactagcccttgtcgcatctttgacctgggctccgataatgaagaggttgttgctggccctgcccctgctcacgccaaggagggactaagacactttctcgaccgcgtactcgaaggaagggctcagccacagctgagtgaaaggatgcttgagaccaaggtagccgaactcctggcacaggggcacacaaagcctcctgagagaagtgccactggggcaaaatcaaagtacttgattttcacgacaggatgtctcacctattctccccaccagataggaatcaagcaaatactccctcaccagatgacgacagcaggaccagtcctgggcgagggacggggatcagacgccttcttcgatgcgcttgaccacgtgatcgatattcacggacacatcattggcatgggactttcgcctgacaacaggtatttatacgttaattctagagcgtggcctaacggagccgtggtcgcagattag

SEQ ID NO: 56415 - DNA, 390 bp, Artificial Sequence
  Description of Artificial Sequence: Synthetic coding sequence
atggacgaggggggaacacctcttctgcctgacagtttggtttaccaaatttttctgtctctgggacccgctgacgtgttagccgcaggattggtttgtagacagtggcaggctgtaagtcgtgacgagtttctttggagagaacagttctaccggtactatcaggttgccagggatgtccctaggcatcccgcagccatgagttggtacgaggagtttcagcggctctatgacacggtaccatgcgttgaagtacagaccctgcgggaacatactgaccaagtgctacatctatcctttagccactctggttaccagttcgccagttgtagcaaagactgtacggtcaaaatctggtctaatgacctaaccattagtcttctgcactag

SEQ ID NO: 56416 - DNA, 1467 bp, Artificial Sequence
  Description of Artificial Sequence: Synthetic coding sequence
atggagctaccacttggcaggtgtgacgatagcaggacctgggacgacgactccgatccagagtccgaaactgaccccgatgctcaagctaaggcgtatgtcgcgagggtgttaagcccacccaagagcgggcttgccttttctcgcccaagccagctgtcaaccccagcggcatccccttctgcgtcggaacctcgggctgcatccagagtgtctgccgttagcgaacctggcttgctgtctttacctcccgagctgttgttagagatctgttcttatctggatgcccgtctggtcctgcacgtgctgtctagggtgtgtcacgccttaagggatctcgtgtctgaccatgttacctggcgcctgcgggctctcagaagggtccgggctccttaccctgtcgtggaggagaaaaatttcgactggcctgcagcatgcattgcactagaacaacacctatccaggtgggccgaggacggacgctgggttgaatacttctgcttggcagagggtcatgtggctagcgttgactctgtgctgttgcttcagggtggctctctctgcctctccggcagtcgcgaccgtaacgtaaacctctgggatctgcggcaattgggaacagaatctaaccaggtattgattaagaccttaggtaccaagaggaattcaacccacgaagggtgggtctggtccctcgccgcacaggaccacagggtgtgctcaggtagctgggatagcaccgtgaagctctgggacatggctgccgacggccaacagttcggggagattaaggcctcatccgccgtgctctgtttatcttatctgcccgacatactcgtgaccggaacctatgataaaaaagtaactatttacgatccgagagataggatggaaacgagggatgcgctgatgggttggggcggaccatctaggggaagtgacatcccgcctcaccggcctattacccacgaggcaggacctgcccttttgaaacatcagcagttacacagcagaccagtcctcacattactggcagacgaccgacatattatatctggcagcgaggaccacactttagtcgtggttgacagacgtgcgaacagcgtcctgcagcggctgcagttagatagctatctgctttgtatgtcctaccaggaaccacaactgtgggcaggagacaatcaaggtctgctccatgtttttgccaatagaaatggatgcttccagcttattcgtagcttcgacgtgggtcactcatttcccatcacaggtattcagtactctgtgggggcactctacacgacatccactgacaagaccattcgagtgcatgtgccaacagatccccctcggaccatctgtaccagacgtcacgataatggcctgaaccgggtgtgtgccgaagggaatctcgtggtcgcaggcagtggtgatctgtccctggaggtgtggaggctgcaggcttag

SEQ ID NO: 56417 - DNA, 1377 bp, Artificial Sequence
  Description of Artificial Sequence: Synthetic coding sequence
atggagctgcccttgggcaggtgtgatgatagtaggacctgggatgacgactccgatcctgagtcagaaactgaccccgatgcacaagccaaggcttatgtcgctcgagtgctgagcccgcctaaaagcgggctggcttttagccgcccttctcagctgagcaccccagctgctagtccaagcgcatccgagcccagggccgcttctcgggtatcagctgtgtctgaaccagggctgctgagtctccccccagagttgctgttggaaatctgtagctacctggacgcaaggctcgtgcttcatgtcctcagcagagtgtgccacgccttgagagacctggtctctgaccatgtgacctggaggctgagggctctcagacgagtgcgtgctccttaccctgtagtcgaggagaagaatttcgattggcccgcagcctgcatcgcattagaacagcaccttagccgatgggctgaggatggacggtgggttgaatacttctgtctcgccgagggccacgttgccagtgtggattctgtactgctgctgcagggcggttccctgtgcctgtctggttctagggatcgcaatgtaaacttatgggacctcaggcagctgggtacagagagcaaccaggttctcattaagaccttaggaacaaaaagaaatagtactcatgaaggctgggtgtggagcctggccgcacaggatcaccgggtgtgcagcggtagctgggattccacagtgaaactctgggacatggcagcagacggacagcaatttggcgagatcaaagcctccagcgccgtcctgtgtttgtcttatctgcccgatattctggtcacaggcacttacgacaagaaggtgactatatatgaccctagagccggacctgcccttctgaagcaccagcaactgcacagccggccagtgctgactctcctcgccgacgacaggcatatcatttctggaagcgaggatcacacactggtagtggtggaccgccgtgctaactccgtgctccagaggctgcagctagattcttacctgctttgcatgtcctaccaagaacctcagttgtgggctggcgacaatcagggactgctgcacgtattcgcaaatagaaatggttgcttccagctgatccggtctttcgacgtgggccacagcttccctatcaccggaattcagtactcagtgggagcactctataccacatcaactgacaaaacaatcagagtccatgtgcctaccgacccgcctcgaacaatttgcacaagacgccatgataacggactcaacagagtttgtgctgagggcaacctggtcgtggcaggttccggcgacctgtccctagaggtgtggcggctgcaagcatag

SEQ ID NO: 56418 - DNA, 591 bp, Artificial Sequence
  Description of Artificial Sequence: Synthetic coding sequence
atgcgagcgtcctctgccgtcctatgtctgagctacttgccagacatactggtgacaggcacatatgataagaaggtgactatatacgatcctagggccggtccagctcttctaaaacatcaacaactgcatagtaggcctgtgctcactctcttagctgacgatcgacacattatatcaggatcagaagatcacactctagttgttgtcgacagacgcgctaatagcgtcttgcagcgcctacaactggatagctatttgctttgtatgagctaccaagaaccacagctgtgggccggtgataatcagggccttcttcacgtctttgccaaccgcaatggctgttttcagctgatccgatccttcgatgtgggccactcatttcccattaccggtatccagtatagtgtgggcgcactgtacactacatccaccgacaaaactatacgggtgcatgtccctaccgatccgcctagaacaatctgtactcgcaggcacgacaacggcctgaatagggtctgtgccgagggtaatttagtggtggccggatcgggagacctgtctctggaagtgtggaggctacaggcttag

SEQ ID NO: 56419 - DNA, 468 bp, Artificial Sequence
  Description of Artificial Sequence: Synthetic coding sequence
atgcacaagaactcaaagagaaacaataatctgcgcgtctcccataccgaggccaactccgttgacgctgaaaaggaaaaaaacgagtcacagaacaactttttcgagctcctgcccgcagaaatcacattcaagatcttttcacagttggacattagaagtctgtgtcgggcttccctaacctgcaggtcctggaatgacaccattcgcaattctgattcactgtggaagcctcattgtatgacagtgcgtgccgtgtgtagaagagagatcgacgacgatctggagtccggctactcttggcgcgtcatactccttcggaactaccagaagtctaaggtgaagcacgaatggttgagcggcaggtactcaaatatctgttcacccatttctctaccagaaaagataatgtaccctatggatgccgatacctggggggagatcctcgaagccgaactcgaacggtag

SEQ ID NO: 56420 - DNA, 744 bp, Artificial Sequence
  Description of Artificial Sequence: Synthetic coding sequence
atgtggccgctgctaactatgcatataactcagctcaatagggagtgcctgctacacctgttctcatttctcgataaagacagccggaagtcactggccaggacatgctcacagttacatgacgtgttcgaggaccctgcgctgtggtctctgttacacttcagatcacttaccgagttgcaaaaagacaacttcctgctgggtcctgcactgaggtcactgagcatttgctggcatagttcacgggttcaagtatgctctattgaagattggctgaagtccgcctttcaacgaagtatctgtagccgccacgaatcccttgtaaacgacttcttgctacgggtctgcgaccgcctcagcgcggtgcggagcccccgacgtagggaggcccctgccccatcctcaggtactcccattgccgtcgggccaaaaagtccccgatgggggggaccagaccattcagagtttgctgatctccggtccggagtgacaggtgcaagagccgcagcaagacggggtctcggctcgttaagggcggagagaccttcggagaccccgccagcgccaggtgtgtcatggggcccaccccctcccggagcccctgttgtgatctcagtcaagcaagaggagggtaagcagggacgcacaggacgccgaagtcaccgtgccgcacccccttgtggcttcgcgaggacacgagtctgccccccaacattccccggagcagacgcttttcctcagtag

SEQ ID NO: 56421 - DNA, 177 bp, Artificial Sequence
  Description of Artificial Sequence: Synthetic coding sequence
aactcgacagaccccgtgaaagccgctcagttcgagatgtccaaccccagtcatctcctgtttttcctcccttgtccatttagccctgtctcgtctttgtttgcgtttgtgaatgccaaacttaaatggaggctgggattaaagacacccgaacaaactaagccccctgggccatag

SEQ ID NO: 56422 - DNA, 2073 bp, Artificial Sequence
  Description of Artificial Sequence: Synthetic coding sequence
atgcagcccccacctcgcaaggtgaaaccggcacaggaagtaaaactgcggtttctggagcaactctctatcttgcaaacatggcagcagcgcgaagctgacttgctggaagacatccgatcttactcaaaacaacgggcagccattgagcgagaatacgggcaggcgctccagaaactcgcagggccattccttaagcgtgagggccaccggtctggagaaatggacagtcggggacggactgtgtttggcgcttggcggtgcttgttagatgctaccgtggctggcggacaaacacgccttcaagcaagcgatcgctatagggatctggcgggtggaacaggcaggtcagctaaggaacaggttctgagaaagggcaccgagaaccttcagcgggcacaggccgaagtgctgcagtcggtgagagaactcagtcggagccggaaattgtatggacaacgggaaagggtttgggcccttgcccaggagaaggctgccgacgttcaggccaggctcaataggtctgatcacggcatcttccattcccgaacctctctgcagaagctgtcaacaaaactctccgcacagtctgcccaatactctcagcagctccaggcagccaggaacgaatacttgttgaacttagtcgccacgaacgcccatcttgaccactactatcaggaagaactgcctgccctgctgaaggctctcgtgtctgagctgagcgagcaccttcgcgacccactgacatctcttagtcacacggagctggaggctgcagaggttatcttagaacatgctcaccgaggggagcagaccacaagtcaggtttcctgggaacaggatctgaagctcttcctgcaggagcccggagtctttagccctactccgcctcaacagttccagcccgctgggacagatcaggtttgtgtgctcgaatggggggctgagggcgttgctggcaaaagtggtctggaaaaggaggtgcagcgtctgacatcccgcgcagcgagagactacaaaattcagaaccatgggcatcgcgtcctgcaaaggttagagcagcgcagacagcaggcaagcgagcgggaagcgccttcaatcgaacagcgcctacaggaagtacgggaatctattcgcagagctcaggtgtctcaggtgaagggcgctgcgcgactggccctccttcagggcgctgggctggacgtggagaggtggcttaagcctgccatgacacaagcccaggacgaagttgaacaggaaaggcgactcagcgaggcgagactgagccagcgagatcttagcccaactgccgaggacgctgagctctcggacttcgaagagtgcgaagagactggcgagctgtttgaggagcccgctccgcaggcactggcaacaagggctctcccatgtcccgcacatgtggtgtttcgctatcaggcaggccgagaggacgagctgaccataaccgagggcgagtggctagaggtgattgaggaaggggatgccgacgaatgggtcaaggcgagaaaccagcatggggaggtgggatttgtgccggagagatacctcaattttcccgacctcagcttgccagagtcatcacaggattccgataatccgtgcggcgcagaacctacagcatttttggcgcaggcactgtacagttacaccgggcagtccgccgaggagctgtcattccccgaaggagccctgatccgtctgctaccacgagcacaggatggtgtggatgatgggttttggcgcggtgaattcggcggacgcgttggcgtcttcccaagcctgcttgtggaggagcttttagggccacctggtcctccagagctgagcgaccccgaacaaatgctgcccagtccttccccgccttcattttcccctcccgctcccacttccgttctggacgggccacccgctcctgttttacctggggacaaggccttagattttcccggatttcttgacatgatggcaccacgcctgcgccctatgcggcctcccccacctcctccagccaaggccccagatccgggacaccctgatcctctaacatag

SEQ ID NO: 56423 - DNA, 2055 bp, Artificial Sequence
  Description of Artificial Sequence: Synthetic coding sequence
atgcagaagctggctagtcagtatctgaaaagagactggccaggggtgaaagctgacgatcggaacgattataggtccatgtaccctgtgtggaaatccttcctggaaggcacaatgcaggttgcacaaagccgaatgaatatctgtgaaaattacaaaaacttcatctctgaacccgcacgaacggtgagatccctcaaggaacaacagctgaaacgctgtgtggatcaactgaccaagatacaaactgaacttcaagagaccgttaaagatctggctaaaggaaaaaagaagtattttgagacggaacagatggcccacgccgtgcgcgaaaaagcagatatcgaagcaaaatccaaattgtctttgttccagagcaggatctccttacaaaaagcatctgtgaagctgaaggctcgaagatctgaatgcaacagcaaggctacgcacgccagaaacgactatctgctgacactcgccgctgctaacgctcaccaggatcgttactaccaaacggatctggtcaacatcatgaaagctttggatggaaatgtctatgaccacctaaaggactacctgattgcctttagcagaacggagctcgaaacctgccaggcggttcagaacacattccagtttctcctggaaaactcatcaaaagtggtgagggactataacttgcagctctttcttcaagagaatgcagtcttccacaaaccacaacccttccagttccagccctgcgactcagatactagccgccagctagagagcgagactggaactacagaggagcactccttgaacaaggaggcacgcaagtgggctactagggtagctcgtgaacataagaatatcgtgcatcaacagagggtattgaatgatctggagtgtcacggagccgctgttagtgaacagagccgtgctgaactagagcagaaaatagacgaggccagagagaacattaggaaagcagagatcatcaaattaaaggcagaggcacggttggacctgctgaaacagataggtgttagcgtagatacttggctgaagtctgctatgaatcaggttatggaagagctagagaatgaaagatgggccaggccacccgctgtgacctccaacggcacactccacagtctcaacgcggacaccgaacgcgaagagggcgaagagttcgaggataacatggacgtctttgacgactccagtagctcgccatctggcactctgcgcaactaccccctcacatgtaaggttgtgtactcttataaagcatctcaacccgatgaattaacaatagaagagcatgaagtcttagaagtgatcgaggacggtgacatggaggactgggtgaaggccaggaacaaagtaggacaggtggggtatgtgcctgagaaatatctgcaattccccacctcaaatagcctgctgagcatgctgcaatccttagccgcactggattcgcgaagccacaccagtagcaattctacagaagccgagttagtctccggcagccttaatggggatgctagtgtatgtttcgtgaaagccttgtacgattacgaaggacagacagatgacgaactgtctttccccgagggcgcaattattagaattctcaacaaggagaatcaagacgatgacgggttttgggaaggcgaatttaatgggaggattggcgtttttccctccgtccttgtggaggaactctcagcatctgagaatggcgacaccccttggatgagagaaatccagattagtccgagtccaaagcctcacgctagcctgcctcctcttccgctgtatgatcagcctccttcatccccctatcccagccctgacaaacggtcctctctctactttccgcgttcaccttcagcaaacgagaagtccctacatgcggagagccctggcttttcccaggcatctagacacacaccagaaacatcctatggaaagctgcggcctgtgcgggctgcaccgcctccccctacgcagaaccatcgacggccagctgaaaagatcgaagacgtggaaattaccctggtgtag

SEQ ID NO: 56424 - DNA, 2223 bp, Artificial Sequence
  Description of Artificial Sequence: Synthetic coding sequence
atgcagcccccaccgaggaaggtgaaggttacgcaagagcttaaaaatattcaggtggagcagatgacaaagctgcaggccaagcaccaggcggaatgtgatctgttagaggacatgagaacatttagtcagaaaaaggctgccatcgagcgcgagtacgcgcaggggatgcagaagctggcttctcaatatctgaagcgggactggcctggcgtgaaggccgacgaccggaatgattatcgaagtatgtaccccgtatggaaatcttttttagaaggcactatgcaggtcgcccagtcaagaatgaacatatgtgaaaattataaaaattttatctccgagccagctcgtactgtgaggagcctcaaggagcagcagttaaagcggtgcgttgatcagctgactaaaattcagaccgagctccaggaaactgtcaaggatctggcaaaggggaagaagaagtacttcgagactgagcagatggcgcatgctgtcagagaaaaggccgatatagaagccaaatccaagctcagcctgttccagagtaggatatctctccagaaggccagcgtgaaattgaaggctaggagaagcgagtgtaatagcaaggctacacacgcccgaaatgattatctgcttaccttggctgccgcaaatgcccatcaagacagatactatcagaccgacctcgttaatattatgaaggcgcttgatgggaacgtctacgatcatctcaaagactatctcattgcattctcccggacagagcttgagacttgtcaggcagtgcagaacacatttcaatttctgctcgaaaactcctctaaagtggtacgggattacaatctgcagcttttcttgcaggaaaacgcagtgttccacaagccgcaacccttccagttccagccttgcgattctgacaccagccggcagctcgagagcgagactggcacaacggaggaacactcgttgaacaaggaggcacggaagtgggcaactagggttgctcgggagcataaaaatatcgtccaccaacagcgggtactcaatgacctggaatgccacggcgcagccgtgtccgagcaaagcagggctgaattggagcagaagattgatgaggcccgtgagaacattagaaaagccgagatcattaagctgaaggctgaggctaggctggatctactcaagcaaatcggtgtttccgtcgacacctggctgaaaagcgcaatgaaccaagtcatggaggaactggagaatgagcggtgggctaggcccccagccgtgacctctaacggtacccttcacagtctaaacgcggacaccgagcgagaggaaggcgaagagttcgaagacaacatggacgtgtttgacgactcgtcctcaagcccttccggaaccctgcgcaactaccccttgacttgcaaggtcgtttacagctacaaagcctcccagccagacgaacttaccatcgaagaacatgaggtacttgaagttattgaggatggcgatatggaggactgggtaaaagctcggaataaggtcggtcaggtgggctacgttcccgaaaagtacctgcaattccctacctcaaacagtctgctgtcgatgttgcaatcgctggctgccctcgattcaagatcccatacctctagcaattctaccgaggccgagctggtctctggttctctcaacggggacgctagtgtgtgctttgtgaaggcattgtatgactacgaggggcagaccgacgatgaactctcttttccggaaggggcaattatcagaattctgaacaaggagaatcaagacgatgatggtttttgggaaggagaattcaatgggaggatcggcgttttccctagcgtcttggtcgaggaactctccgccagcgaaaatggcgacacgccctggatgagagaaattcagatcagcccttctcctaagccccatgcttctttgcctcccttgccactttacgaccagccaccctcttccccttatcccagcccagacaagagatcatccctttactttccacgatctccttctgccaacgagaaaagcctccacgccgaaagtccagggtttagccaagcttccagacataccccagaaacttcttatggcaagctgcgccctgtgcgcgcagcccctccacccccaacccagaatcatcggaggcctgcagagaaaatcgaggacgtggaaattacattggtttag

SEQ ID NO: 56425 - DNA, 1548 bp, Artificial Sequence
  Description of Artificial Sequence: Synthetic coding sequence
atgcagaagctggcctctcagtatcttaagagagattggccgggagtgaaggccgacgacaggaacgactatagatcaatgtatcccgtctggaagagtttcctagaaggaaccatgcaggttgcgcaaagccggatgaacatctgtgaaaattataaaaatttcataagcgagccagccagaaccgttagatcactgaaggagcaacagctcaaacggtgtgtggaccagctcactaaaatccaaaccgagctccaggaaacggttaaagatctggcaaagggaaagaagaagtatttcgaaaccgaacagatggctcacgctgttagagagaaggctgacattgaagcaaagtccaaactcagcctctttcagagccgaatttcattgcagaaggcctctgttaagctaaaggctcgcaggtctgaatgcaactccaaggccacacacgccagaaacgactatctactcacgctggcggcagccaatgcacaccaggatcggtactaccagactgaccttgtcaacatcatgaaagctttggatggcaatgtctacgaccacctgaaggattatcttattgccttctctcgaacagaactggagacctgccaggctgtacagaacacctttcaatttcttcttgaaaatagctcaaaggtggtgcgcgattacaatctgcagctgttccttcaagagaacgctgtgttccacaaaccgcagcccttccaatttcagccatgtgattctgacacaagcaggcagttagagagcgagaccggcactactgaagagcacagcctgaataaagaggctaggaagtgggctacccgcgtagcaagagagcataaaaacatcgtacaccagcagcgggtgctcaatgacctggaatgtcacggtgctgccgtgtcggaacagtccagagccgagctggaacagaagatcgacgaggcccgagagaacattcgcaaagccgagatcatcaagctgaaggcagaagctagactggatcttctgaaacagattggcgtgtcagtcgacacttggctcaagagtgcaatgaaccaggtaatggaagagctggaaaatgaaagatgggcacggcctcctgctgttacttccaacgggaccctgcactccctgaacgccgacactgagagggaggagggcgaagagtttgaagataatatggacgtctttgacgactcctctagtagcccatcggggacgctcagaaattatcccctcacttgtaaagtggtgtactcttacaaggcctctcagcccgatgagcttaccatcgaagaacatgaggtcctggaagtcatcgaggacggagatatggaggattgggtgaaggcacgcaacaaggtgggccaggtcggatacgtgccggagaagtacctccaattccctactagtaactctctgctgtctatgctgcagtcacttgcggcactggacagccggagccatactagcagtaacagcactgaggcagagctagtatccggaagcttaaacggcgatgcttcgggtaaagactag

SEQ ID NO: 56426 - DNA, 1854 bp, Artificial Sequence
  Description of Artificial Sequence: Synthetic coding sequence
atggacctgaagaccgcagtgttcaacgccgctagggacggcaagctgaggctcctcaccaagctcctcgcctcgaagtctaaagaagaggtttcctcactgattagcgagaagacaaatggagcgactccactgctgatggcggctagatacggccacctggatatggtagaatttttgctggagcagtgttccgccagcatcgaagttggaggcagcgttaatttcgacggtgagactatcgagggcgctccaccgctctgggctgcctctgcggcagggcatctaaaagtcgttcagtctctactcaaccatggagcgtctgtcaataacacaaccttaaccaattcgactcccctgagagccgcatgcttcgatggccatctggaaatcgtgaagtacctcgtggaacataaggccgacctggaggttagcaatcgacacggacatacgtgtttgatgatatcttgctacaaggggcacaaagagattgcacagtatctgctggagaagggcgctgacgtcaataggaagtccgtgaagggtaatacggctctgcatgattgtgccgagagtggctctctagatatcatgaagatgctgctgatgtactgtgctaagatggagaaggacggctacggcatgacgcctctcctctctgcaagtgtgaccggccacacgaacatcgtcgattttctcacacatcacgcacaaacaagcaaaacggagaggattaatgcgctagaacttttgggggctactttcgtggacaaaaagagggaccttctgggggctctgaagtactggaagaaggctatgaacatgaggtattccgaccggaccaacataatcagcaagccagtcccgcagacactgatcatggcatacgactatgcaaaggaagtaaacagcgccgaggagcttgagggcttaattgctgatcccgacgaaatgcgcatgcaggctctgctcattagagagaggatccttggccctagtcatcctgacacttcctattatatccggtacaggggagctgtgtacgcagactctggtaactttaaacgctgcataaacttatggaaatacgctctggacatgcagcagtccaatctggaccccctgtctcccatgacagcgtccagccttctctccttcgctgaacttttttcctttatgctgcaggatcgcgctaagggattgctaggaaccactgtgactttcgatgatctgatggggatcctttgtaagtctgtcctggagatcgaaagggccatcaaacagacgcagtgcccagcggaccctcttcagttgaacaaggcgctgtctattatcttgcacctcatctgtctgcttgaaaaggtgccctgcactctggagcaggaccattttaaaaagcagaccatatataggttcctgaagttacatcccagaggaaagaacaacttcagtcctctacaccttgcagtggacaagaacaccacctgtgtgggacggtacccggtgtgcaagtttccttctctgcaggttacagcaatcctgatcgagtgcggggctgacgtgaacgttagggattcagatgacaacagcccacttcacattgctgccctgaacaaccatcccgacattatgaacttgctgatcaagtcgggagctcacttcgacgcaacaaatttacacaaacaaacagcctcagacttgttggatgagaaagagatcgccaagaatctgattcagcccatcaaccacacaacactgcagtgtcttgcggctagggtgattgtgaatcatagaatatactataaaggccacatcccagaaaagctcgaaacctttgtgtcactccaccgttag

SEQ ID NO: 56427 - DNA, 5433 bp, Artificial Sequence
  Description of Artificial Sequence: Synthetic coding sequence
atggaaacccttgattcccaacgcgtacaagaccggttgctggccgcacccggttgcagtagccctagtggccagcaggagctattcagctcccatgtgatgcaggaggaatccgctaatgatatggagtgcgagcagctaccagcggagattcttcgccaggtgacagtccacagagacccgatctacgggttcgggttcgtcgcaggtagtgaacggcctgttgtggtcagaagtgtgcgtcccggtggaccatctgagaacaaactgctggcaggtgaccagatcgtggcgataaatgaggaggatgtgagtgaagctccaagagaaagactaatcgagcttatccgatccgcaaaagagtttatcgtcctaacggttctgcatacccaccaaagccccaaatcagccttcatatcggccgcaaagaaggctaagctccgttccaacccggtgaaggttcggttctccgagcaagtggccgtgggcgagaccgacgccaagatgatgaaaaaggaggcattacttctcatacctaatgtcctcaaggtgtttttagaaaatggacagatcaagtctttcacttttgatggtcggactaccgtaaaggatgtcatgctgacgctgcaggatcgcctgtccttacggttcatcgaacatttcgcgctggtgcttgagtacgctggtccagaacagaaccacaaattcctcctgttacaggataagcaacctctggcctatgttgtccaaagaacccactatcacggcatgaagtgcctcttcaggatatctttcttcccaaaagatcccgtcgagctgctcagacgcgatccagctgccttcgaatatctgtatattcagagtagaaacgacgtgattagggagagatttggcatggaccctaaacccgagatgcttctcggactggcggctttgcacatctatattactgtctccgctactaggccaagtcagaagatctcgctcaagaatgtggaaaaggaatggggcctggaaccctttctcccgccttctctgcttcaggtgatcaaagagaagaacctacggaagtccctgtctcaacagctgaaagctcatcaaacccaccccagctgtggcaccaaaggtagtgctatccaggctaaactgcagtacctccgtatcctgaatgaactgcccacattcactggggtcttgttcaacactgtgggactggacgagaagcagagcgctacgacgctgctggtcggcccacgacacgggatctctcacgtcatcgaccttaagaccaacttaaccactgtgctttcagagtttagcaagatctcaaaaatccagctgtttagagagaatcagggtgtggccagggtggaaacttcaataatggacgccaaacccttagtgttgctcatggagtggcccgaagccactaactttgcctgcctgatcgccggttactgtcgcctgctgctcgactctcgcaagatggtattctcccgcccagccagccagcccttgccccctccaatgattaaagcagactacatgcactcagcgcaccgacctgtcacggggggtcacctgggcaaaaaagaaagctcgtacgttgggtcggtcggaacttcacctagaaaaagtagtcgctgtacaccacctcctgccgactctgagctggttagcttctgctatcttcatatgcgcgagcaacgaaaggagcaggagtcacgcactgacgttaatgaaaatctcattttctttgaagagacccgaccacggactaaaagcgaccccacctcaaagagtagcggccagggatacgaagtggtgcccgatgactttgacgctgcctccctggatcatgaaccttgtgcatcaagagccaggagttataccctggataatagtctcggcgctgaagctctgaacttctactgcgacagctgtaaggccaagctgcaggaacagctgggacctcggaaagggggaaaacccggttcgagcagagataacatagttgacttgatgagcctccccccaccagggagcgaagaagaagaagaggaggaagatgagacgacctccttgcttcccgcaattgcagcacctcctcccggattccgggataacagtagcgacgaagacgatccaaaacgccgagcagtgcagtcgcaggagcagggcaggcacctcaggggcctcttgtacgatgaaatcccagtcacacttattgactcagtgcagacccggaccgttagagaccacgcccaggaattggacgacgccctcgtgagtaccctgcaggccttagaagccctggccgcaagtgaagatgggcctcatcccccaccccctcagactgcaggactgatcgtcctagccaccataacacctgagtcaagtctggactccggacacgagacaaactcttcagagctgaccgatatgagtgagatgatgagtgccatgaaacagcaccagaatactacatatttccttgcacagcatctgaataaggacagcctgctggctcggaaagacttgcccttccggattcagtcctgtgcagctcaggcggttctcacagcaccgtactccctgggaaggcccgatcccaacccaagcctacagcctattgccaccggtcagtctccaggtccgccaggtgctaggagaaagcttccgcaaagtgaaggccaggtgcagggcgaacgcacctactctctggcagtgcatccagcgttgtccccccagctttctgagcagaaaaacctgtcccttctctccccggttccagaagacaaaggacccggtcatacccgcgcagggttggaaatgagccttagagccgcaacatccagcctttctgaggaacaggtgtcagaattacgggataatctcccgaaggaagtaaggctgagtcctaaactcattctagatccgaagtcatccgtgactccggctatcatcagcgctgcccttcagcaggtggtgcataataagtcacttgtgaccgcaggcggagctctggggaatcctccctctcgcggagagcggcgattggaggcctctatggggaggcctgaagtttcgatgatgtcttcctctgcctctaaaaacctcaaatttaagatctcaccaagtgctccagagacgagttggaattctcagcaccagcttggggcagaagtgtcttcaagcccgagagctccaacgggctctagagctgacagcctgcatctctcgcagcaggaggactccctaccggtgcagaactttccgccaaagtcctatctgttaagaacatctagagagagcgtgggaaaacaggcgaccggcgaggtggccggaaagggcggacccgtagggggaaagcccaccttacaaaagcagggcaccatatccagtcagggagagaaggcccagctggagtcaacaccaaagcgttccaagctagaggagacgtccctcgttcccagggctacctaccccatggctctgcagagcccgtcatgccagagcagaagccactcaccgagttgtcagccccatggccactctccatccagtcagtcccgcggacagtctcctagctgtcaaccgagagggcagagtccccttcgtagccaagccgcttcacgccaggtcagcacgatgccctcccggaaactcgagaccacactgaatggcgctcacagcacatccgagggccctgccaagcccaagagctccagagggcctttccgtctccggaatttgttctccgcaaccttccccactcggcagaagaaagagaccgatgaaaggcaggcacagcttcagaaggtcaaacaatatgagcttgaatttcttgaggagctccttaaacctccgtcacaaggcgagcttccagggacagaatacctccagccaccggctcccggaagatgctcatgccagctgaggagtagccctgtacagcagggcccaggaatgagtcgggagcagcggcgaagctgtgactgtaaacgaatctgccggggagggaggcctcaggcaactcaaacccccgtgccttccctacgaggacgggaaagggacagggtgcttcccagccagagacagcccgaggccggtccaggcgtgtccctgtcaagcccaatcaatgtccagcgaatccggtccacatccctggagtccagagagtgcaggagtgatcctgaatccggcgtgtcctgcttaaccacttgcgctagcgggggagagtgcttgggggctcccaattacaggaaactgatgcggagatatagcataagtgaactcgaccagggagatcgggcttcgcttacctctgacgtgtatccccatcctcccctgggcatgcttccgagagaggctaaggaagtcgaggcctccctcccgatcgccttggggccaaaaagccggtccctagagtctccaactctaggcgatccatcatacgtccaggtggcgccagaaacaaaggggcctagacagatggcagtcttctcactgcccgaagaggtgtatcgaaagccagcagagcttgatgaagactctgagtccagcaagtgttgctctatccgctattgtttctactatcgaaaatgcgatatggccgacgacgcaagcgatgggaaggacgagctctcttacagcatcccaatgaagattcttcctggaatgaagctcgatgagcaggtcgtaccagtggtgtcacggactctgcaggtactggacgcggctacatgtagctctagttccccagaggctagccgtactcaagagatcgatttgagagtcagcacattcgaaggtagcctcgccaagatcaacgcgctgcgggctcatgcttacgggctgcccgacggcttcctagctgcgagattggataccaacgaactcctcaccgtgcttaggcagtgtgtagctagccccgaggccagggccccaaagccctatgtgtcccagatatccgagtacaagcttgaactcgccttgaagtttaaagaactgcgagctagctgccgccgagtcgctaacgtggacaaatctccaacccacatgctagccgcaatcaccggttcttttcaggtgctctccagcttgatcgagacatttgtgcgcctcgtttttatcgtacggtccgaggctcaacgccaagaattgctggccaaagtggaggaggtagtacggaattatacgttcttactgcgggctgctgaggaaagcaccgcaagaaacctcaaccaacagcaacagcagcaacaacagcaacagcaacagcagcaacaacagcagcagcaacagcagcaacaacagcagcagcaagtcgcggctgctgccggagcggcaaccgaacacccaccgggaagcccaacctccgctaccgtgatgagcacattcacccatagtctcaagacactcatcaaatat

SEQ ID NO: 56428 - DNA, 1650 bp, Artificial Sequence
  Description of Artificial Sequence: Synthetic coding sequence
atggccgtgccaccgagaggtcggggtatcgatcccgctcgcaccaatccagatactttcccccctagcggcgctaggtgcatggagccctctccagagaggcctgcttgttctcagcaggaaccgacgcttggaatggacgcaatggctagcgagcacagggatgtcttagtgctgctgcctagccgggagcagctgaggctcgccgtgggagtgaaagcaacaggaagagaactctttcagcaggtgtgtaacgtcgcatccattcgagacgcgcaattcttcgggttatgcgttgtgagaaataacgagtatattttcatggaccttgagcagaaattgtccaagtacttttccaaagactggaaaaaagagagaaacgagggaaacgaaaagcccagggcacctttcgtggcatttttgagagtgcagcactatgtcgaaaatgggagggtgatttccgaccatcgcgctcgccatctctattattgtcaccttaaagagcgggtgctgcgctcacagtgtgcccacagggaagaggcttatttcctgttggcagcttgtgccctgcaagcagacctgggagaacatcgcgagagcgcccacgcgggtcggtattttgaaccccattcctattttccgcagtggataatcacaaaacgtggcatcgattacattctgaggcatatgccgacacttcatcgagaacgccagggtctgtctccaaaggaggcaatgttgtgcttcattcaagaagcttgccggctggaagacgtgccggtccatttcttccggctccacaaggataagaaggaggggcgtccaactgttattttaggcctggccttgcgcggagtgcatatctaccagggcaagaaactggagatacagttagatggtcttcccgctgcccagaaactggtgtactacacaggatgcacctggcgcagtaggcatctgctgcacctactccgggcttcccaccagctacatcttagggtgcgcccaaccctccagcagctgaggcagcgtgaggaggctgaggagaaacagcactatagggagtcctacataagtgatgaactggaactggacttggccagtcggtccttccctggctccggtgtgagctcacaacactgcccgcactgtctatctcgacattcagctgactcacacgggtcttcgtatacctccgggatcaaggcaaacagttggctgcgtgagagccgggaaatgtctgtcgatgtcccgctcgaagttcacggattgcacgaaaaagagccatcgtccagtccacggaccagccgttcacacccatctaccaggggagattcacaagcaactaggcaggagccctgtacacaggtacgaacgagggggcagtctgccgaggcggttcatcaaatccaggagatgaccgccggagtgtctgaagagcagcactcccacggcttggacgatatgcagttacatcagctggctctccaccccgcacccaccagtttatcccacaccttccatagggcactcgactgccgattggctggcccatgtgagacgcgggctactctcccaagtaaaagatcttccaattgtcttgcactagatctgtttggcgaggcccctcctcaagagttcgtggtttag

SEQ ID NO: 56429 - DNA, 1446 bp, Artificial Sequence
  Description of Artificial Sequence: Synthetic coding sequence
atggatgacgttaaggcaacaggcagagagctgttccagcaggtctgtaacgtagcttccatccgcgacgcccaattcttcgggctgtgcgtggtgcgcaataacgaatatatatttatggacctggagcagaagctctccaagtacttcagtaaggattggaagaaggagcgcaatgagggcaacgagaagccacgggcaccgtttgtagcgtttctacgggtccaacattatgtggagaacggccgagtaatatccgaccacagggccaggcacctttattattgccatttaaaagaaagagtgcttagatcccagtgcgcacaccgggaggaagcttatttcttactggcagcttgcgcactgcaggcagatctaggcgaacacagggagagtgctcacgctggaaggtacttcgagccgcacagttatttcccacagtggattatcaccaaaagaggtattgattatattctgcggcatatgccgacccttcatagagaacggcaaggcctgagtccaaaagaggccatgctctgcttcattcaggaagcctgtcggttagaggatgtgcccgtacacttctttagattgcacaaggataagaaagaagggaggcccacagtcattcttggactggccctgcggggtgttcatatataccaagggaagaagctggaaattcaactagacggcctgcctgccgctcaaaagctggtctattatactgggtgcacatggcgaagtcgccacctcttacatctgttgcgggcatcacatcagctccacctcagggtgaggcctaccttacaacagctgcgccaaagagaagaagctgaagagaagcagcactatcgggaatcctacatctccgacgaactggaactggatctagcctccagatcatttccaggttctggagtgtcgtctcagcactgcccacactgtctgtccagacacagtgccgactctcatggctcatcttatacctcaggcattaaggccaactcatggcttcgtgaaagtcgtgagatgtccgtggacgtgccactggaggtccatggcctgcatgaaaaagagccctcttccagtccaaggacctcacgctcccacccctcaacgcgcggagacagccaagcgacacgtcaggagccctgtacccaggtgcgaactcgcggacagtccgccgaggccgtccaccagatacaagaaatgacagcaggggttagcgaggagcagcactcccatggccttgatgacatgcagcttcaccagctcgcgctccaccctgcccctaccagcctctcacacactttccaccgggctttagattgccgactggctggaccatgtgagacaagggcaacattacccagtaagcgtagttctaactgtttagcactcgacctgtttggtgaggctcctccccaggaattcgtggtgtag

SEQ ID NO: 56430 - DNA, 963 bp, Artificial Sequence
  Description of Artificial Sequence: Synthetic coding sequence
atgcctacactgcatcgcgagcgacaggggctttctcctaaagaggccatgctgtgcttcatccaggaagcatgcagactagaagatgtgcccgtacacttctttcggctccacaaggacaaaaaggagggcagaccaacagtcatcctcggcctggccctcaggggtgtccacatctatcagggcaaaaagcttgaaattcagctggatgggctgcctgcggcacagaagctcgtctattataccggatgtacctggcgtagcaggcacctactacacttgctacgcgcatcccatcaactgcacctccgagtaagacccacactgcagcagctgcgccagcgcgaggaggcagaagagaaacagcactaccgggagagctacatttctgatgagctcgaacttgatctggcttcgcggagttttcccggatctggtgtgagttcacaacattgtcctcactgcctgtctcgccactccgccgactctcacgggtcatcctacacatccggcatcaaggctaactcatggctccgggagagccgggagatgtcagttgacgtgcctctggaggtgcacggcttgcacgagaaagagcctagctcatcccccaggacttcgagaagccacccaagtacacggggagattcacaggccaccagacaggagccctgtactcaggtgcgaactcggggtcagtcggccgaggctgtgcaccagatccaggaaatgaccgctggcgtgtctgaagagcagcacagtcacggactcgatgacatgcagttgcaccagctggctctgcatccagccccaacctctctttctcacacttttcacagagctctcgattgccgcctggccggtccctgcgagactcgcgcaacccttccaagcaagcgatcatccaattgcctggcccttgatcttttcggagaagcccctccccaggagttcgtggtttag

SEQ ID NO: 56431 - DNA, 1395 bp, Artificial Sequence
  Description of Artificial Sequence: Synthetic coding sequence
atggacggtaccgaaggttctgctggacaacccggacccgctgagcggtctcataggagcagtgtaagttctgtgggagctagagccgctgatgtgctggtgtatctggctgacgataccgttgtccccctcgccgtcgagaaccttcctagcctgagcgctcatgaactgcacagggccgttcgagaggtgctgcagttaccagatatcgctctcgacgtgttcgccctctggctggtgagccctctgctggaggtgcagcttaagcccaagcaccagccctacaaactcggacgccaatggcccgagctccttctgcgattcacctccgccccagatgacgacgtcgctatggacgagccgtttttacaatttagaagaaacgtgtttttccccaagcggagggaactgcagatacacgacgaagaggtcttgcgtctgttatatgaggaagctaaggggaacgttttagccgctagatatccctgtgacgtggaggactgcgaggccttgggggcacttgtgtgtcgggtccagctcggcccataccagccgggacgtccagctgcatgcgacctgcgggagaagttggactcttttctccctgctcatctgtgcaagaggggtcaatctctcttcgcggctctaagaggacgcggagccagggcagggccaggcgagcaggggctccttaatgcatatcggcaggttcaggaggtcagctcagacgggggttgtgaggccgctctgggtacacattacagggcgtatctcctgaagtgtcacgagctgccattctacggttgtgcgttttttcacggcgaagttgacaaacctgcccagggtttcctccataggggcggtagaaaaccagtgtctgtggccatctctctggaaggcgttcacgtaatcgattcccgggaaaagcatgtgctgttgggtctcaggtttcaagagctcagctgggatcatacttcccccgaggaagaggagcccatcctgtggctggagttcgatggggattcagaagggacccccgtgaacaagcttctgaagatctactctaagcaggccgagctgatgagttccttgattgagtattgcatcgagctgtctcaggcagctgagcccgctgggcctcaggactctgctaccgggtcacctagcgacccaagctctagccttgcccctgtgcagcgaccgaaactcaggcgacaggggagcgtggtgtcctcccgcattcagcatctgtccacgattgattatgtggaggatggtaaagggatccgcagggtaaaaccaaagcggacgacaagttttttcagcaggcaactgagcttgggacagggctcttacaccgtcgtgcagcctggtgacagcctcgagcaaggttag

SEQ ID NO: 56432 - DNA, 1293 bp, Artificial Sequence
  Description of Artificial Sequence: Synthetic coding sequence
atggacggcaccgagggctctgcgggacagccgggtcctgctgagcgcagccatcgcagctccgtctcatccgtgggagctagggcagcagacgtcctcgtgtaccttgccgacgacaccgtggtgcctctcgcggtggagaacttaccaagcctatcagcgcacgagctccatagagccgttcgagaggtgctgcagctccctgacattgccctggacgtttttgccctctggctagtgtctcctctcctggacgaaccattcctgcaatttaggcgaaacgtcttcttccctaagcgccgagaactgcagatccatgacgaagaggtcctgagactactgtacgaggaggccaaggggaacgtgctggctgcgaggtacccctgcgacgtagaagattgcgaagcgctgggagccctggtttgccgcgttcagcttggcccttaccagcccggtcggccagccgcatgtgatctgcgggagaagctagactccttccttcccgcacacttgtgcaagaggggccaatctttattcgccgcattgaggggcaggggtgcaagggcaggccctggagaacagggactactgaatgcatacagacaagttcaggaagttagtagtgacggtggatgtgaggcagccttgggcacccactatcgggcatatctccttaagtgtcacgaactgcctttctatggttgtgctttctttcacggagaagttgataagcctgctcaaggatttctgcaccgaggtggcagaaagccagtgtccgtcgcaattagcttagagggtgtgcatgtgattgatagcagggagaagcacgtgctgctggggttgaggttccaggaactatcgtgggaccacacctccccagaggaggaagagccaatcctgtggcttgagttcgacggagattcagaaggcacacctgtgaacaagctgctgaagatttatagtaagcaggcagagcttatgagctccctcattgaatattgcatcgagctttctcaggccgctgagcctgctggccctcaagattcggcaaccgggagcccaagtgacccctccagttctttagcccctgttcagcgaccaaagctccgtcggcagggcagcgtggtgagctcacggattcagcacctgtctactatcgactacgtggaagacggcaaaggcataaggagggtcaagccaaagagaactaccagctttttctctagacagttatcattaggccagggaagctacaccgtggttcaacctggtgatagcttggaacaaggatag

SEQ ID NO: 56433 - DNA, 273 bp, Artificial Sequence
  Description of Artificial Sequence: Synthetic coding sequence
atggatggcaccgaaggctcagcgggacagcctgggccagcagagcgctcccaccggtcttccgttagcagcgtaggtgctcgtgctgcagatgtcctcgtttatctggcagacgacacagtggtccctcttgcagtggaaaaccttccttccctctcagcacacgagctgcaccgtgctgtccgtgaggtactgcagctgccagatattgccctcgatgtgttcgccctgtggctggtttctcctctgctcgaagtgcagctcaaaccatag

SEQ ID NO: 56434 - DNA, 1875 bp, Artificial Sequence
  Description of Artificial Sequence: Synthetic coding sequence
atggcccctcgcagactgctgttggtaggagagggcaacttcagcttcgcggcagccctgtctgaaacattggatcagtcaacgcaactgactgccacctgcctgcagcggcctgccgagctggccagggatccgctcgcttgggagaacctccagtgcctccgggagcgaggaattgacgtgagattcggggtggattgtacccagctcgctgacgttttcgaactgcacgaaagagagtttgaccaaatatacttcatctttccgcactgtgggcgtaaagccggagttgctaaaaatcgcgagctccttgccaaatttttccagtcctgtgcggacgtgctggctgaagaaggggaggtccatgttgccttgtgtcggggtcaggggggaactccggcagacaaaccccaaagggaatggcataactcatggcaggtggtggctatggcagcactggggggactgatcctttctgatgtgtaccccttctcttgtaaagctgtggctggttataaatgcacaggctatcgcagccaggataaatcatttcacgtcgaaggcgcacttaatcatattttcacacgcagtcttccattcgagggttcccagccacgcatattccgcattaagttaggaaatcagtggttcagcttcccagagcccgaggcgctggtggggaaactaaacaggggattcttggaagctccatcttgtcaccccattaagactataaacgaaaagctcatagctgaactcggtaaggtttttccactcaaacgtctcaagtgctcgtatccgttactcccccaggaaggcacatctgttcttcctttctggaactgcgattttctctctgccgctttttggatctcgctgcacgaggataactccaactccgaatcgctgaccggcggtacatctcaggatgtcgaagactttctggtgtcattttccgaattgtcacttctgaaaaacccaggccgagatggaaaggaagaagcatgcgaaggtacatgcggtcaggcaaagatctgcctgagaccgagtctactcgtccatgtgcaggatgttattgaggtgccggatttcctgtcgggctcactgcacatcctgagcggccctgtgtttcagaagtgccacatactgccctttaccatgccagcctttcacgaaacactgttcatcttgggcgtaaaccaaaacctcaaagatggttgcttgcaaagcctcctggaccacctaaaggggatcctggatagtttgctgacccagaccctgcctgaatcctcgaagctgtcctctctggtgaagtttgtcctccaaagtaatggtaaagattacatgatacgggtaaaaactcacaacttttcgcccgactgtaccgaggacttgattatcggttctgtcatcacctcagctacaagtgtcatacataaagaccaatgcttcgttttcgtgagcatgaatttagatctgctggctatgctcgtctggtgcatttcggattggagaatgttgtggaccttcgacaatcgattccttaaaaacttcgtgcccggaaagattgaacccttcaagtcccacagcctgtatcccccttgttatgtccacgatgttagcttctggatagatcagaaaaaggggtttgatgagctggaattccacacggtggccagagccgtcagccaagacacaattatcagtatccagttcctaagcagatttcaacatcccaagacacagcaagtttctttgtgctatcggctgacatatcaaacatgcgataaggcgctaacccagcaacaggtcgctagcatgcagtcacaatttcggaaggagatccagcagcacttatacgtgatccctagatag

SEQ ID NO: 56435 - DNA, 1428 bp, Artificial Sequence
  Description of Artificial Sequence: Synthetic coding sequence
atggccgcactgggcggtttgatccttagcgatgtctatcccttttcttgcaaggctgttgccggttataaatgcaccggctatcgctcccaggacaagagttttcatgtcgagggggctctgaatcacatattcacgcgttcactcccatttgagggcagtcaacccaggatctttcgaatcaaacttgggaaccagtggtttagcttcccagagcccgaggccttggtgggtaaactgaacagagggttcctggaagccccttcttgccatcctatcaaaacaatcaacgagaaactgattgcagaactcgggaaggttttccctctgaaacggcttaaatgctcttacccattacttcctcaggaaggaacttctgtgctccctttttggaactgtgactttctgagcgcggcattctggatttcacttcacgaggataactctaatagtgaaagtctgaccgggggtacgtctcaggacgtagaggatttcctggtgagtttctctgagctgtctctgttgaagaaccccggtagagacggaaaagaagaggcatgtgaaggtacatgtgggcaggcaaaaatatgtcttcggccttcattgttagtccacgtgcaagacgtaatagaagttcctgactttctctcaggcagtctccacatcctgtctgggcctgtcttccagaagtgccacatactgccatttactatgccagcattccatgagaccctgttcatattaggggtaaatcagaacctgaaagatgggtgcctccaatctctactggatcacttgaaggggattcttgacagcctgctcacccagacgttacccgaaagctcaaagctttcttccttagtaaagtttgtgctgcagtctaacggcaaggactatatgatacgggtcaagacccataatttctcgccggattgtaccgaagacttaataatcggcagtgtgatcacctccgcgacttcggtaatccacaaggaccagtgctttgtgttcgtgtccatgaacctggatctgcttgcaatgctggtatggtgtattagtgactggaggatgctctggaccttcgacaacagatttcttaaaaacttcgtccccggaaagatcgagccctttaaatcgcactccctgtacccaccctgctatgttcatgacgtcagtttttggattgatcaaaagaagggctttgatgaactggagttccacacagttgcacgggcagtatctcaagacactattatcagcattcagtttctgagcaggttccagcaccccaaaacacagcaggtgtctctctgttacaggcttacatatcagacctgcgacaaagctttgacccagcagcaggtggcttccatgcagtcccagtttcgaaaagagattcagcagcacttatatgtgattcccagatag

SEQ ID NO: 56436 - DNA, 1656 bp, Artificial Sequence
  Description of Artificial Sequence: Synthetic coding sequence
atgtctgggggtgagcagaaaccagagcggtactacgtgggtgtcgacgtggggacaggtagtgtcagagctgccctggtggaccagtccggcgttcttctggccttcgccgaccagcctatcaagaactgggagccacaattcaaccatcacgagcagagttccgaggacatatgggcagcctgttgtgttgtgactaagaaggtagtccaagggatcgatctcaaccagatccggggactaggcttcgacgccacgtgtagcctggtggtgcttgataagcagtttcacccactgcctgtcaatcaagagggagatagccaccgaaatgtcatcatgtggctggaccatcgggcagtgagccaggtcaacagaattaacgagacaaaacacagcgtgctacagtatgtcgggggtgtgatgagcgtggaaatgcaggcacctaaactcctgtggcttaaagagaacttacgggaaatttgttgggataaggcaggacattttttcgacttaccagatttcctgagttggaaggctaccggcgttacggcacgcagcctgtgctctctcgtgtgcaagtggacttactcagccgagaagggatgggacgattcgttctggaaaatgatcggcctggaggactttgtagccgataattatagtaagattgggaaccaggttttgccgccaggtgcgtccctgggaaacggcctgacccctgaggcagcaagagacttgggcctccttcccggaattgctgttgcagcatcactaatcgacgctcatgcaggcggtctaggagtaatcggcgctgatgtgagaggacacgggttaatttgtgagggccagccagtaacaagcaggcttgctgtgatttgcggaacatcaagttgccacatgggcataagcaaggaccccatttttgttccaggagtttggggcccttacttcagcgccatggtgccaggcttttggttaaacgagggaggtcaatcagtcactggcaaactgattgatcacatggttcagggtcacgccgcattccccgaactgcaggtgaaagctacggcaagatgtcagtccatatatgcctacttgaatagtcacttagatctgattaaaaaggcgcaaccagttggctttttaacagtggacctccatgtttggcccgacttccatggaaaccgatcacccctagcagatcttacactgaaaggcatggtgaccggcctgaaactatcgcaagacttagacgatctggctattctatacctggcgacagttcaggcaatagctctcggcaccaggttcataatcgaagcaatggaggcagcaggtcattctatcagcacactattcctgtgcggtggactcagcaagaacccactgttcgtccagatgcatgctgacattactggaatgccagtggtgctgagccaagaagtcgaaagcgtgctggtgggggctgcagtacttggtgcttgcgcgagtggtgactttgcgagcgtacaggaggccatggcaaagatgagcaaagtagggaaagtcgtctttcccaggctgcaagataagaaatattatgacaaaaagtatcaagtctttctgaaactcgtggagcaccaaaaggagtatctcgccattatgaatgacgactag

SEQ ID NO: 56437 - DNA, 558 bp, Artificial Sequence
  Description of Artificial Sequence: Synthetic coding sequence
atgagtggcggagagcaaaaaccagagcgatattatgtgggcgtggacgtcggaacaggctcagtccgagcagctctcgtggatcagtctggagtgttactggccttcgctgatcagccgattaaaaactgggagccccaatttaaccatcacgagcagagttccgaggatatctgggctgcatgttgcgtcgtgactaagaaggtggtgcaaggtatcgatctgaaccagatacgcggactgggctttgacgccacttgctccctggtcgtgcttgataaacagttccacccactgcccgtaaaccaggagggtgattcccacagaaacgtcataatgtggctggaccacagagccgtctcccaggtcaacaggattaatgagactaagcatagcgtactgcagtatgtaggcggtgtaatgagtgtcgagatgcaggcgccaaagctactgtggcttaaggaaaatttgcgggagatctgctgggataaagccggacatttttttgatctgcccgacttcctgagctggaaggctacaggcgttaccgcccgttag

SEQ ID NO: 56438 - DNA, 1392 bp, Artificial Sequence
  Description of Artificial Sequence: Synthetic coding sequence
atgtcaggaggtgaacagaaacctgaacgatactacgttggagttgatgttggtacggggtcagtgagggctgcactggtcgatcagagcggggtgctgttagcatttgcagaccagcccatcaaaaactgggagccgcagtttaatcatcacgaacagagctcagaagacatttgggcagcttgttgtgtcgtcacaaagaatttacgcgaaatctgttgggataaagctggacactttttcgacttgcctgactttctgagctggaaagctacaggagttaccgcaagatccttatgctcccttgtttgcaagtggacgtacagtgccgaaaaaggctgggacgattcattttggaaaatgataggtctcgaggatttcgtggctgacaactatagcaagatcgggaatcaggtgcttcccccaggagcatccttaggtaacggtttgacacctgaggctgcccgtgacttaggcctgctgcctgggatagccgtggccgcaagtttaattgacgcccacgcaggcggattgggggtgatcggggctgacgttaggggccacggactgatctgtgaaggacagcccgtcacgtcaaggctggccgtgatttgtggcactagctcctgccatatgggtatctctaaagacccaatcttcgtgcccggtgtgtggggcccttattttagtgcaatggtccccggtttttggttgaacgagggaggccagtcagtaaccggaaaactgatcgaccatatggtgcagggccacgctgccttcccagagctacaagtgaaggctacagcgaggtgtcagagtatctacgcttacctgaactctcatttagatctcatcaagaaggctcagcccgtcgggttcctgacagtcgatttacacgtgtggcccgattttcatggaaaccgctccccactcgccgatctgacgttgaagggtatggtgacagggctcaaactatcccaggacctcgacgatctggcaatactctatctagccactgtgcaagctatagcgcttgggacaagattcattattgaggccatggaagccgctggacactccatttcaactttatttctatgcggaggcttaagtaagaacccactattcgtgcagatgcacgccgacataaccggtatgcctgtggtgctctcccaggaggttgaatccgtcttggttggcgcagcagttcttggcgcatgtgccagtggggattttgccagcgtgcaagaagcaatggctaaaatgagtaaggtcggcaaggtggtcttccctagactgcaggataagaaatactatgataaaaagtaccaagtctttcttaagctggtcgagcaccagaaagagtacctggccatcatgaatgacgactag

SEQ ID NO: 56439 - DNA, 1728 bp, Artificial Sequence
  Description of Artificial Sequence: Synthetic coding sequence
atgtctggaggcgaacagaaacctgagagatactacgtcggggttgacgttggcactggttcggtccgcgctgcactagtcgatcaatcaggagtactgctggcattcgccgatcagccaatcaaaaactgggaaccacagttcaaccaccacgaacagtccagcgaggatatttgggccgcttgttgcgtggtaaccaaaaaggtagttcagggtatcgatctgaaccagatcagaggactggggtttgatgctacatgtagcctcgtagtcttggataaacaatttcatcctttacctgttaatcaggagggcgacagtcataggaatgtcatcatgtggcttgatcatcgagccgtgagccaggtgaacaggataaatgagactaaacacagcgtgctgcaatacgtgggtggggtgatgagtgtagagatgcaggcccctaaacttctctggttgaaagaaaatctgcgggaaatctgctgggacaaggctggtcacttcttcgacctgcctgatttcctatcctggaaggccacaggagtgacagccagatccctttgctccctggtctgtaaatggacctacagcgcagagaaggggtgggacgactctttttggaaaatgatcggactggaggactttgttgcggataactatagcaaaattgggaatcaggtgttaccaccaggggctagtttgggaaatggattaacgccggaggccgctagggatcttgggctgctccctggaatcgctgtggcggcatcgctgatcgacgcgcacgccggaggcctgggcgtgatcggcgctgacgtacggggtcatggcctcatctgtgagggccagccggtcacatccaggctggccgtgatctgtggaacaagctcttgccacatggggatctcaaaagaccctattttcgttccaggggtgtggggcccttatttctctgcaatggtcccagggttctggctgaatgaaggcggacagagcgtcactgggaagctgatcgaccacatggtgcaggggcacgcagccttcccagaattacaggttaaagcaactgccaggtgccagagcatttacgcctacctcaattctcatttggatcttattaaaaaagcccagccagtgggcttcctgaccgtggatcttcacgtttggcccgatttccatggaaatcggtctcccctcgcagacctgaccctgaaggggatgcgcacaactggctacctgtacatcccagcattagccgctctccattctccctcaagcctgcttagcccccaggtgacgggacttaaactcagtcaggaccttgatgaccttgcaatactgtacttagccacagtgcaggctatcgccctcggtacacgattcattatagaagctatggaggccgcaggacattccatctctaccctgttcctctgtggaggactgagcaagaaccccttgttcgtgcagatgcatgcggatattactgggatgccagttgtgctgtcacaagaggttgaatccgtgctggtaggcgctgctgtcctgggtgcatgcgcctctggtgacttcgctagtgtgcaggaggcaatggccaaaatgtctaaggtgggaaaggtagtgtttcctcgcctccaagacaagaaatactacgataaaaagtaccaggttttccttaaactcgtggaacaccagaaggagtatttggccattatgaatgacgattag

SEQ ID NO: 56440 - DNA, 3432 bp, Artificial Sequence
  Description of Artificial Sequence: Synthetic coding sequence
atgcatgtcatgaactgcgtaagtctggtctccgacaaggaaaacggaaacattgctacagccccagggttcatgattggacaaactccaccaccagctccccctccgccaccaccgccaccacccccatcacccccatgtagttgctcccgcgaggagtgcccttcatccccccctcctccccctcccccaccactacctggagaacctccaatcccacctcccccaccaggcctccccccaaccacccatatgaatggatattctcaccttggcaaaaaaaagcggatgagaagtttcttctggaagactatacccgaggaacaagtgcggggaaagacaaatatctggacccttgcggcacggcaagagcaccattaccagatagatacaaagactatcgaagagctttttggacagcaggaagatacgacaaaaagctctttgccacgacggggtaggacactaaatagttccttccgagaggcacgtgaggagatcactatccttgacgcaaaaaggtctatgaatatcggaatttttctcaaacagttcaaaaagtcacccagatctatcgtggaggatatacatcagggcaaaagtgaacactatgggtcggaaactcttagagagttcctgaaattcctgccagagtctgaagaggtcaagaaactgaaggcttttagcggcgacgtgtctaaacttagtttggctgacagtttcctttatggcttaattcaagtgcctaactattctctccgtatagaggccatggtcctgaaaaaggaatttctgccctcatgctcctctttgtatacagatataactgtcctcaggaccgcgatcaaagaactgatgtcatgcgaggaactccatagcatattgcacctggtcctccaggctggaaacattatgaatgccggtggatacgccggtaacgcggtaggatttaagctctcgagcttattgaaactggcggacaccaaggccaataagccagggatgaacctgctgcacttcgtagctcaagaggctcagaagaaggacacaatccttttgaatttcagcgagaagctgcaccacgtccagaagactgcccgtctgtcactggagaacaccgaggctgagctgcatctgctgttcgtgcggactaagtccctgaaagagaatatccagcgggacggtgagctgtgccagcagatggaagactttctgcaattcgctattgagaaactgcgggagctcgagtgttggaagcaggagctgcaggatgaagcatacacactgatcgactttttctgcgaggataagaagacaatgaaactggacgaatgcttccaaatctttagggacttctgcacgaagttcaacaaagccgtaaaagacaatcatgatcgcgaggctcaggaattgcggcagctgcagcgcctcaaggagcaggagcaaaaacagcgtagttgggctacaggcgagttgggcgcttttggccgttcttccagtgaaaatgatgtcgaactgctcacaaaaaagggcgcagaagggctgttgccattcctgcatccgagaccaatctccccgagctccccaagctatagacctcctaacacccgcaggtcccggttaagtctgggcccatcagcagaccgcgagttactcacattcctggagtccagcacaggctcacccgaggaacccaataaattccatagtttaccacgcagttcaccacgccaagcacggccaaccatcgcgtgcttggaacctgccgaggtacgccatcaggactccagtttcgcacataagccccaagcgtctgggggacaggaggaagcgccaaacccaccttcagcacaggctcatcagctagccgcagctcaacccgagaaccacgctagtgcctttccaagggccagaaggcaaggggtctctgttcttcgcaaacgctattcagagcccgttagcttgggatctgctcagtcccctcctctctccccacttgcactgggcatcaaggaacatgagctggtaacagggctagcacagttcaacctacagggttctcagggaatggaagaaacaagtcagttgaccttgtctgatttctctcccatggaattggaaagtgtgggccataggggacctcaatctttatctgcaagctccagctccttgactcccatgggcagggacgccttgggttcactctctcctgctttagaagatgggaaagccgcacccgacgagccagggagcgcagccctgggtagcgtaggtagcagtgacccagagaacaaagacccaagaccactgttttgtataagcgacacaacagactgctccctgacactggattgctccgaaggcacagactctagaccacgcggtggagaccccgaggaggggggagagggggacggctccatgagttcaggagtgggtgaaatgggcgactcacaggttagcagtaatcctacttcctcacctcctggggaagccccagctccagtgtccgtggacagtgagccttcctgcaaaggcggtctcccgagagataaacccactaaaaggaaggacgtggtggctccaaaacgcggaagtctaaaggaagcctccccaggagcatccaaacccggttctgccagacggagtcagggggctgttgccaaatccgtgagaactctgacggccagcgagaatgaatctatgaggaaagtaatgcccattactaagtccagtcgtggcgcaggctggcgtaggcctgagctaagctcgcgaggacctagccaaaatcctccaagctctacggatactgtttggtcgcgccaaaattctgtgcggagagccagtaccggcgctgaggagcaacggcttcctcgtggcagtagtggcagcagctccactaggcctgggcgagatgtgccgctgcagcctaggggttctttcaaaaagccatccgccaaacccctgcggaacctaccgcgtcaaaagcccgaggagaataagacttgtagggctcatagcgagggccctgagtccccaaaggaggagcctaaaactccatccgtcccttcagtgcctcacgagttgcccagggtaccttcttttgctcgcaatacagttgcttccagctcacggagtatgcgaaccgatctgcctcccgtcgcaaaggctccaggtatcacacgaacagtgagccaaagacagctacgcgttaaaggagacccagaggacgcagcccctaaggacagtagcaccctgcgacgcgcatcatccgccagggcccctaagaagcggccagaatctgccgagggcccaagtgctaataccgaggcgcctttgaaggcgagaggggcaggggagagggcctccttacggcgaaaggactcatctaggaccacactggggcgtattctcaaccctctgcggaagtag

SEQ ID NO: 56441 - DNA, 3432 bp, Artificial Sequence
  Description of Artificial Sequence: Synthetic coding sequence
atgcatgttatgaactgcgtgagcctcgtgtccgataaggagaatggtaacatagctacagctcccggttttatgataggtcagaccccacccccagctccccctccaccaccacccccaccacccccatctcctccatgcagttgtagtagggaggaatgtccaagtagcccgcctccacctccgcctccaccactgcccggagagccaccaatccctccccctccaccaggtcttccccctactacacacatgaatggatattctcacttaggaaaaaagaaacgtatgcgatcctttttttggaaaactatccctgaggaacaggttcgcggaaagactaatatctggaccctcgcggcacgtcaggagcatcattaccagattgatacgaagactattgaagagctgttcggacagcaagaggacaccaccaaatcaagcctgccacgtagaggccgaacccttaactcttcattccgtgaagccagggaagagataaccattttggacgctaagagaagtatgaacatcggtatctttcttaagcagtttaagaagtccccccgatccatcgtcgaagacatccatcaggggaagtccgagcactatggctctgagactctcagagaattcctgaaatttctgccagagtccgaggaggtaaagaaacttaaagcgttttcaggtgatgtgtctaagctgtcccttgcagattcgttcctgtatggcctcattcaggtgccaaattacagcctgcggattgaggccatggtgctcaagaaagagttcctccctagttgcagttcactgtacaccgatatcactgtcctgcgaaccgccattaaggagctgatgtcgtgcgaagaattgcactccatactccatttggtattacaggcgggaaatattatgaacgcaggaggctacgccggtaatgccgtaggctttaaattgagttccctccttaaattagctgataccaaggcaaataagcccggaatgaacctcctacacttcgtggcccaggaagcccagaagaaggataccatcctgctcaacttttccgaaaagctgcatcacgtccagaaaaccgccagactctccttagagaatactgaggccgaactgcaccttcttttcgtccgtacgaagagtctcaaagaaaacattcagcgtgatggcgaactgtgccaacagatggaagattttctccaatttgctattgaaaagcttcgtgagctggaatgttggaaacaggaattacaggacgaggcttacaccctgattgacttcttttgtgaggataaaaaaacgatgaaattggacgagtgcttccagattttcagagatttttgcaccaagtttaacaaggccgtgaaggacaatcacgaccgcgaagcacaggaacttcgccagctccagagacttaaggaacaggaacagaagcaaaggagttgggcaactggggaactaggcgcattcggtcggagcagtagcgaaaatgatgttgagctgctgaccaaaaagggtgcagaaggcttactccccttcctgcatccccgacccataagcccctcatccccaagctatcggcctcctaacaccagacgtagtaggctaagcttgggcccttccgccgatagggagctgcttacctttctagagtcaagtacgggctcccccgaggaaccaaataagttccactctctgcctagaagctcccctcggcaggcccgacccaccatcgcttgcctggaaccagctgaggtgcggcaccaggactcctctttcgcccataagccgcaagcctccggcggacaggaagaagcccctaacccaccatccgctcaggctcaccagctggccgctgcccagccagagaaccatgcctcggcatttcctcgtgcgcgaagacaaggtgtttccgttctaagaaaacgttattcggagcccgtctctttgggctcggcacagtccccacctctaagccctctcgcgctcgggatcaaggaacacgaactggtcaccggactggcccagttcaaccttcagggttcccagggcatggaagagaccagccaactgacgctcagcgatttctctcccatggaactggagtctgtgggacatcgtggaccccagagcctctctgcatcttcttctagccttacacccatgggccgagacgcccttggttcgctgtcgccagccttggaagatgggaaagctgcacctgacgagcccggaagcgctgccttggggtctgttggatcttcagaccccgagaacaaagaccctcgccctctcttttgcatttctgatactaccgattgctcgctcacccttgactgcagcgaagggaccgactcccgacccagaggcggagaccccgaggaggggggtgagggtgatggctctatgagcagcggcgtaggcgaaatgggtgactcgcaagtgagcagtaatccaacaagctccccacctggcgaagcacctgcacctgtgagtgtggatagcgagccgagctgcaaaggcggactaccaagggataaaccgaccaagcgtaaagatgtggtcgcgccaaagaggggatcactgaaggaagccagtccaggggcatcaaagcccggaagcgcaaggagatcacagggcgcagtggcgaaatctgtcagaacactcaccgcgtcagagaacgaatcaatgagaaaggtgatgcccataactaagagctcccgtggggcaggatggagaaggcctgagttgagcagcagaggacccagccaaaatcccccaagcagcactgatacggtctggtcacggcagaactctgtgagacgagccagtactggagccgaggagcagcggctacccagaggctccagtgggtcctcatctacccggcctgggagggacgtcccactccaaccacgcggttcctttaagaagccgtcggccaaaccgttacgcaatttgcccaggcagaagccagaggagaataagacatgtagagcacatagtgaagggccagaatcccccaaagaagagcctaaaacgccatctgttcctagtgtaccacacgagcttcctcgggtcccctcatttgcgaggaatacggttgcctcaagtagcaggagcatgaggacggacctacccccagtggcgaaggccccaggtattactcggaccgtgtctcagcggcagctgcgtgtgaagggagaccccgaggacgccgcacccaaagacagtagtacccttagacgagccagctcggccagggctccgaagaaaagaccagaatccgcagaggggccatccgcaaatactgaggctcctttgaaggcacggggagccggagagcgggcatcactcagacgcaaagatagttcccgcacaacgctgggacggattctgaatcctctccgtaaatag

SEQ ID NO: 56442 - DNA, 2250 bp, Artificial Sequence
  Description of Artificial Sequence: Synthetic coding sequence
atggaggaggagagtggcgaagagctgggactggacaggtcaacccccaaggacttccatttctaccacatggatttgtatgatagcgaggacaggttgcaccttttcccggaagaaaatacccggatgaggaaagtagttcaagccgagatggcaaatgagtctaggggtgccggagacggcaaagctcagagagatcttcaagaggaagtcgatgagctagtccatctttacggtctggaagacgaccacgaactgggtgacgaattcgtcgacgagaatattcctaggactggcgtgagtgaatatcccccatacatgatgaagcgcagggacccagccagggaacagagagattggcgattgtccggggaagctgcggaagccgaagatcttggctttgggggttggggcagcgcaggtcaatgtcaggacctgagagaagcatacagatacactcatggacgcgcttccgaagagtatgagtgctacgtaatccctgaagaggaggacgaggaagaggcagcagatgtgttttgcgttacgtgtaagactccaatcagggccttccagaaggtgtttgacgagcacaaagagcacgaagtaatccccctgaacgaggccttggaatccgcaaaagacgagattcacaaaaacatgtataagctggaaaagcagattatagagatggaaaactttgccaatcacctggaagaagtgttcatcactgtggaggagaacttcggcaaacaggagcagaatttcgaatcacactacaacgaaattttagagaccctcgcacaaaagtacgaggagaagattcaagccttaggagagaagaaaaaggaaaaattagaagcactttatgggcaactcgtcagttgcggggaaaacctggacacgtgcaaagagttaatggaaacaattgaggagatgtgccatgaggagaaagtggacttcatcaaagatgcagtggctatggcggatcgccttggtaaatttctgaagaccaaaacagatgtggagatcagcgcacaacctgagttcgaagatcagaccttggacttctccgacgtggagcagctgatggggtccatcaacaccatcccagcgccatccgccccagttatcaatcctcaagtgcctaacagtgctacggggagtagcgtccgggtctgttggtccttatatagcgacgacacagtagaatcataccaactttcctaccggcctgtgcaggacagtagcccgggaaccgaccaggcagaattcacagtcacagtgaaggaaacatactgttcagtgaccaacctggtccccaacacccagtacgagttctgggtcacggcacacaaccgagcaggccctagcccttctagcgaacgcgctgtgtacatgacagcaccctcaccgccaattatcaagaccaaggaaattcgcagctgcgaagaagccgtactcatttgttgggaaagcggcaacctcaatccggtagactcatacacagtggaactgacacaagctgaatctcccgaggcctccggagtaaccgaatctgtcgttggcatccccacctgcgaatccgtggttcagctgcagcccggaagatcatacattatatacgtccgagccctcaatatgggcggaccttctgttcggagcgaacctgcaactgtccataccatcggctcgtacttccgcctcaacaaagatacttgccatccctggttaacaatcagtgaagatgggctgaccgctgtccggagtgaacgcagaacacctgcccgagagctgagtccctccgacacgcactttaccagatgtgtagctgtcatgggaaacttaatacccgtccggggacatcattactgggaagtagaagtggatgagcatctagactaccgggtcggcgtggcatttgcagatgttcggaagcaggaggacctgggtgcgaattgcctcagctggtgcatgcgccacacttttgcgagcagcaggcacaagtatgagtttcttcacaatagaactacccccgacatcaggatcactgtgcctcctaagaaaattgggatcctcctggattacgagcattctaaactaagcttttttaacgtggatctgtctcagcacctttatactttttcctgtcaactccatgaatttgtgcatccgtgttttagtttagaaaagcccggatgtctcaaggtacacaatggcatatcaatgcctaagcatgtgacgttttattag

SEQ ID NO: 56443 - DNA, 306 bp, Artificial Sequence
  Description of Artificial Sequence: Synthetic coding sequence
atggaagaagagagcggagaagagctcggcctcgacagatccacccctaaggattttcacttttaccacatggacctgtacgactccgaggatcggctgcacctgttcccagaggagaacactcgtatgagaaaggtggtccaggcagaaatggccaacgagtctcgcggagctggcgatggtaaagcgcaaagggaccttcaggaagaggtggatgagctggtccatctatatggcctggaagacgaccatgaactgggagacgagtttgtggatgagaatattcccagaactggtgtctcttag

SEQ ID NO: 56444 - DNA, 975 bp, Artificial Sequence
  Description of Artificial Sequence: Synthetic coding sequence
atggctagtgaagccctgcatcaagtgggcgacggagaggaggctgtgctcaaaaaggaaaattttaatatgatgaatgccctggaccagttgccaaaacctttctctaacccaaagtcaatgaaccgcaccgtgactacaaagggactgccattagcttccaagggcaacctggtgaattttctggaagacgacaccattaacctccttaaaccgctgcccgtggaagattctgactgttccagtgacgagacatctatctcggcattcagtagcaccctcctcaatcccatcaagttggctgtcactcagcccaacagctcctttttcgccggaatgctggaaggtgaactgaacaaactgagtttctcccctatggcaaagaatgcagaaaatgaagacctggctttaggcccttgcccttgtccaagcaaatcacaaatggcaacacggggactgctagacctcgataaccctgaattggagaccgaaacaagcagtacgcacagcgaaagttctgtggtcgtggacctccccgacactccttttatctttgagcacacagtgaacaattctaccgccgtgataagctggacttatgctctcgggaaacaacccgtgagcttttatcagcttctgctccaggaagtggccaaaactcaggaaaatgaacttccagaggcaaagaataggccctggatctttaacaagatcctgggcaccaccgtcaagttgatggaactgaaaccaaacacatgttactgcctttctgtgagggcagctaatactgccggagtgggaaagtggtgtaaaccctacaagttcgctaccctggccactgacttctcttccttccctgagaattatcccatacagatcactgtccgccgtaaagagccacgccagaaaatcgtttctatcggtcccgaggaaatgaggcgactcgaggacctagaatatttgttcccctgttag

SEQ ID NO: 56445 - DNA, 1383 bp, Artificial Sequence
  Description of Artificial Sequence: Synthetic coding sequence
atgtttgagaaatatcccggtaaaatggaggggctttttaggcacaacccatatacggccttccctccggctgtgcccggattgccccctggattgccccctgcagttagcttcggatcgttacaaggggcttttcagccaaagtccacgaatcctgagttgcctcctagattgggtcctgttccttctggtctctcccagaaaggtacccaaatcccagaccattttcggcctccattgcgaaagcccggtaagtggtgtgcaatgcatgtgagggtggcctacatgattttacggcaccaggagaaaatgaagggcgactcacataagctggattttcggaacgacctgctgccttgtttgccaggaccttacggtgcccttcccccaggtcaagaattgagccatccagcaagtctgtttaccgcgaccggcgcagttcatgctgcagccaatccattcacagccgctcccggtgcccacggcccatttctgtccccatcaacccatattgacccattcggccgacctacttctttcgcttcactcgccgctctttctaatggggctttcgggggtctgggatctccgacgtttaattcaggagctgtctttgctcagaaggaatctcccggtgctccccctgcctttgccagcccccctgatccttggggaagactacatcggagtcccctcacctttccagcctgggtgcgccctcccgaagccgctagaactcccggaagtgataaagagcggccagtcgaaagaagggagccgtccatcaccaaggaagagaaagaccgggacctcccattctcacgccctcagttacgtgtcagtcctgccacaccaaaagcccgagcaggagaggagggacctagacctactaaggagagcgtgagagtgaaagaagagagaaaggaagaagcagctgcagcagcagctgctgccgcagcagcagctgcagcagctgccgctgctgccaccggtccacaggggctccatttgttattcgagaggcccaggccccctccttttctaggtccttcgccgcctgatcggtgcgcaggattcctggagcccacatggcttgccgctcctccaaggctggccaggccacctcgtttctatgaggcaggcgaggagctgaccggacccggagcagtggcagctgctagactgtacggactggagcccgctcaccctttgctctactcgaggcttgccccacctccaccaccggctgctgcccctggtacgccccatctgctctctaagacccctccaggcgctctcttgggggctccgcctccacttgtccctgcccctcggcctagttcgccaccgaggggtccaggcccagcaagggctgatcgctag

SEQ ID NO: 56446 - DNA, 1200 bp, Artificial Sequence
  Description of Artificial Sequence: Synthetic coding sequence
atgcatgttcgcgtggcctacatgatccttcgccaccaagaaaaaatgaagggggactcccacaaattagactttcggaacgatctgctgccctgcttgcccggaccatatggcgctctgccccctgggcaggaactatcccaccccgcatccctatttacggccacaggggctgtacacgcggcagctaaccccttcaccgctgctcccggagcccatggacctttcttatctcctagcacccacattgatcctttcggcaggcctacctccttcgcctctctggccgcactgagcaatggggcattcggcggactgggatctcccaccttcaattctggcgcagtgttcgcccagaaggaatcccccggagccccacccgctttcgctagtcctcctgacccatgggggcgtctccatcggtcccccctcactttcccggcttgggtgcgaccacccgaggcggcacggacccccggatccgataaggaaaggcctgtcgagagaagggaaccgtccatcacgaaggaggagaaagaccgagatctgcccttcagccgcccacaactgcgcgtgtctcccgctaccccaaaggcccgagccggagaagaagggcctcggcctaccaaggaatctgttcgggtcaaagaggaacggaaggaggaggcagccgcagctgccgctgcggctgccgctgccgctgccgcagccgcagctgcagccacaggtccccagggattacatctactgttcgagcgccctagaccacctcccttcctgggaccatccccaccagataggtgtgctggctttctggaaccaacctggctcgcagctccaccgaggttggctagacccccaaggttttacgaagcaggtgaagaattaaccgggcctggcgcagtggccgcagccaggttgtatggactggagccagctcatcccctcttgtacagccgactagcgccacccccaccaccggcagcggcaccgggtacccctcatttgttatcaaaaaccttctgtacttttcttcagggatgtccatcccaacagttcccctcctggttaatcaagcctagcgattggtgttgtgtcccaagcctttggcccctgtgcggcgagcgaggattgcaaggcgaggagccaggtagagattcccaagcttctccatgggaaggcggtgcttcacgacgatag

SEQ ID NO: 56447 - DNA, 2919 bp, Artificial Sequence
  Description of Artificial Sequence: Synthetic coding sequence
atggaggctaaagaggaggaggtcatcgatgggtttgctatagcttccttttccaccctggaagctttagaaaaggacatggctctgaagccccacgagcgcaaggagaaatgggaacggagacttattaagaagccgagagagagtgaaacatgtcctcctgctgaaccaagcgagaaccggaggccattagaggcaggtagccccggtcaggacctggagcctgcttgcgatggcgcaagaaaggtcccactgcagccttcaaagcagatgaaagtcaccgtcagcaagggaggggacagagactctgacgatgactccgtgctggaggcgactagttcacgcgatcctctgtcagacagttcggctcacgctgtctctggcagaggttacagttgcgactccgagtcaggccctgatgacaaagcctcggtgggttcagagaagctgttcgcacctggcacggacaagggaccagccttagaaaagtccgaggccaaggctggtccggtgcctaaggtgtcgggcctcgaacgctccagagaactttctgctgaatccttcctccctaccgcgagcccggctccgcatgctgcaccatgtccgggacccccaccaggctcgagagctaatccgctagttaagaaggagcctcctgctccccatcggcacaccccgcagcctccccctcctcaacctcgtggtctgcttccaacccacgtccccgcaagccttggcgcttttgccggacactcgcaagccgcagcaaacggcctccatggattgagccgaagctcctctgcgcctttagggttgggaaaacatgtatcactctctccacacgggccaggcccacaccttagtacctcccatttggcgctacggagccaggcccagcaccaactgcacgccgctatgtttgccgcaccccctacgctgccaccacccccagccctcccggctagctcgttagttctgccagggcaccccgcagaccatgagctgctgcggcaggagctgaacactcgcttcctggtgcagtccgctgagaggcctggagcgtctcttggccctggggctctgctgcgcgctgaattccaccagcatcagcatacccatcaacatacacaccagcacacacaccagcaccagcacaccttcgcccctttccccgctgggcttccgcctacgccacccgcagctcctccacctttcgataagtacgctcctaagctggacagtccttactttaggcattcctcagtgtcatttttcccgagcttccctccagcaatcccaggtctgcccaccctgctcccccaccccggaccattcggctcactacaaggcgcatttcaacccaaggtttcggatccctacagagctgttgtgaaggtaagtacttgctgggaagggccatggcaagggaggactttagtcccacccggtcgaccgaggggagctagagattctagatcgctacagaagacgtgggtgggcgtagctcccgcaccactgagcgcaagtatactgtcacagaagccaggacggtggtgtgcggttcatgtgcaaattgcttggcagatctacaggcatcaacagaaaataaaggagatgcagttggacccgcataagttggaggtgggcgctaaactcgacctttttggccgaccgccagcccctggagtgttcgctgggttccactatccacaagacctcgctcgcccactgtttccttctacaggggctgctcatcctgcttcaaatcctttcggcccatccgcccatcccggtagtttcctgccaaccggcccactgacagaccctttctcccggccatcaacattcggaggactcggaagcctgtcatctcatgccttcgggggactgggtagtcacgctttggccccaggaggttcaatctttgctccgaaagagggttcaagcgttcatgggttaccatcgccacatgaggcctggaacaggctccatcgcgctcccccatcctttccggctcctcccccatggcccaagagcgtggatgctgaacgggtctcggcccttaccaaccatgatagagagcccgataacggtaaagaggagcaggaacgggacctgctggagaagacaaggctgttgtctcgcgcatcacctgctaccccggctgggcacccagtctccggactgctactccgggctcaatccgaactgggacggagcggggctcccgctgagcgggaggctgagccacgggtgaaagagagcaggagccctgcaaaggaagaggccgcaaagatgccggcacgggcaagcccaccacatagcaaagcggctcctggagatgtgaaggtcaaggaagaacgcggagaggacgaggctagcgaaccacccgcaggcggactgcatcccgcacccctgcagctgggactggggcgtgagcggcttggcgctccaggctttgcatgggagccatttcgcggactagagttgcctcgcagagcctttcctgcagccgcacctgccccagggtctgctgccctcctcgagcctcctgaacgcccatatcgagacagggagccccatggttactccccagagcgcctgcggggtgagctggaacgagccagggccccacatcttccacctgctgccccagcactggatggggcactcttgccctccctaggggctctgcacttcccccgtctgtccccggcagcccttcacaatggcctgttagcccgaacaccccctgctgctgccgcactgggagcaccacctcctttagtgaccgctgccggtccaccgacaccacccggacctcctcggagccgaacgacgccacttgggggtttaggtcctggcgaagcacgggattacagtccttcaaggaatccgcctgaggtagaggcaaggtag

SEQ ID NO: 56448 - DNA, 3138 bp, Artificial Sequence
  Description of Artificial Sequence: Synthetic coding sequence
atggaggccaaggttcggccatctcgcagatcccgggctcagagggacagaggacggaggagggaggctgctagagatgcaagggcccagagcccttcgtccggcgacgagcccgaaccttcgccagggaaggaaaacgctgggttgcgtggggctccccctaggggagccgcacccgcacccaggactgcgcgtcccccacgtcgcagacgcagagagtcgtcttcgcaggaggaagaggtcatcgatggtttcgctatcgcctcctttagcaccctggaggctctggagaaggacatggccctgaaacctcatgagcgcaaggagaaatgggagcggagactgatcaaaaagccgagagagtcggagacctgcccccctgccgaacccagcgagaatagaaggcccctagaagccggatccccaggacaagacctcgagcccgcttgtgacggggcaagaaaagtgcctcttcagccctcgaagcagatgaaggtgacagtctctaaggggggagacagggacagcgacgatgattcggttttggaggctacaagtagccgcgatcccctatcagattcctcagcacatgctgtgagtggtcgaggatactcctgcgatagcgaatctggcccagatgataaggcttccgttggctccgaaaagctcttcgccccaggaaccgataaaggccctgcactggagaaaagtgaggcaaaggccggtcccgtacccaaggtgtccggcctcgaaaggtctcgcgaactgagcgcagaatctttcctgcccacagcctcacccgctccccatgccgctccatgcccaggaccacctcctggctctcgcgctaatcctctggtaaagaaagaaccacccgcaccccaccgccacacccctcagcctccaccccctcagccaagaggtctcctgcctacccacgttccggcaagcttgggagctttcgctgggcattcccaggccgctgcaaatggcctgcatgggctttctaggtcctcttccgctcctttaggtctggggaagcacgtctctctgtcccctcacggtcccggtccgcatttaagcacgtcacatcttgctttaagatcacaggcccagcatcagctccatgccgctatgttcgccgctccaccaaccctgcctcccccaccagctttgcctgcctcttccctagtgcttccgggacaccccgctgatcacgaacttctgagacaggagttaaatacacgtttcttggttcagtcagccgagaggcccggtgcctccctgggacccggtgcgcttctgcgagccgagttccatcaacaccagcacacccatcaacacacgcaccagcacactcatcagcaccagcacaccttcgctccgtttcctgctggcttgccgcctacacctcccgctgcacctcccccttttgataaatatgcacctaagctcgactccccttactttcgtcattcctccgtatcttttttccctagctttcctcccgcaatcccgggtctgccgaccttgctaccccacccgggtccttttggaagcctacaaggagcgttccagcccaaggtcagcgacccgtacagggccgtggtgaaggtgtcaacatgttgggaagggccttggcaggggagaaccctggtgcccccaggcagacctcggggagctcgggactccagatccctgcagaagacatgggtgggcgttgctcccgctcctttgtccgcctccatactctcccagaaacccggtcgctggtgcgccgttcacgtgcagatagcgtggcaaatctatagacaccagcaaaagatcaaagagatgcaacttgatccacacaagttggaagtcggggcaaaactggacctgtttggcaggcctcccgcacctggcgtgttcgccggttttcactacccgcaggacttagctcgcccactctttccctctactggtgccgctcaccccgctagtaatcctttcggtcctagtgcccatcccggttcattcttgccaacaggccctctcacggacccctttagtagaccaagcacattcggaggtctcggctccctgtcatctcacgcgttcgggggattagggtcccacgctctggcccctgggggtagtatatttgcacctaaggaaggttctagtgtccacggactgcctagtccacacgaggcctggaaccgattacatcgtgccccaccaagttttcccgctccccctccatggcctaagagcgtagatgcagaacgcgtctcagcactgactaaccatgaccgggaacccgataacggtaaggaagaacaggagcgcgacctgctggaaaaaacacgacttctgtccagagcttctccggcaactccggcaggccacccagtgagtggactgttgttacgagctcagtcagagctggggcgaagcggagcaccagcagaaagggaggcagagccccgtgtgaaggagtccagatcaccagccaaggaagaagctgccaaaatgcccgcaagagcctctccccctcattcaaaggccgctcctggggacgtaaaagttaaagaggaaaggggggaggatgaagctagcgaaccaccagccggtggactgcatccggctccactacagctcggtctgggcagagagcgcctcggggcacctggcttcgcctgggagccgttcagaggcttagagctgccacggagggccttccccgcagcagctcctgctccagggagtgcggctctccttgagcccccagagaggccatatagggaccgggaaccccatggctactcgcccgaaagactcaggggagagttggagcgagcaagggccccacatcttcctcccgctgccccagcgctcgacggggctctgctcccctctctgggggcactgcactttcctaggctttcgcctgccgctctccacaatgggttgctagctcggactccacccgctgctgctgccctcggagcacctccccctctcgttacagccgcaggacctcccaccccaccaggacctcctaggtcaagaaccacccctctcggcggtctggggcctggagaggccagggattactctccaagccgaaatccaccagaagtggaggctcgatag

SEQ ID NO: 56449 - DNA, 1746 bp, Artificial Sequence
  Description of Artificial Sequence: Synthetic coding sequence
atggatattataaagggcaaccttgacggtatctctaaacctgcgagtaactcgcggatcaggccaggcagccggagttccaacgcgtcactggaggtgctgtccacagaaccgggaagtttcaaggtggataccgctagtaatctgaacagcggcaaggaggatcatagtgaaagcagtaacactgaaaacaggcgcacaagcaatgacgataaacaggaatcctgttccgagaaaattaaattggctgaagaaggaagcgatgaagatttggatttggtgcagcatcagatcatttcagagtgctcggatgaacctaagctcaaggaattggacagccagctccaggatgccatacaaaaaatgaagaagctcgataagattctagccaagaagcaacggagggagaaagaaataaagaaacagggcctagagatgcgcattaagctctgggaggaaatcaagtccgccaagtattcagaggcatggcagtccaaggaagagatggagaatacaaagaagtttttaagcctcacagcagtctccgaagaaaccgttggcccttcccatgaagaagaagatactttctctagtgtgttccacacccaaatccctccagaggaatacgagatgcagatgcagaagctgaacaaagactttacctgtgacgtggagcggaacgaaagccttatcaagagtgggaaaaagccctttagtaacaccgagaagatcgagttgagaggcaaacacaaccaggatttcatcaagcggaatatcgagctggccaaagaatcccgcaatccggtcgttatggtggacagggaaaagaagcggctggtggagctgctgaaagatctggatgagaaagactccggactcagctcctctgaaggcgatcagagcggatgggtagtaccagtgaagggatacgagttggccgttacccagcatcagcaacttgcagaaattgatattaagttacaagagctgagtgccgcttcccctacaatttcatcattttccccacgccttgaaaatcggaacaatcaaaagccggaccgggacggagagcggaacatggaggtgactccaggggaaaagatcctcaggaacacaaaagaacagcgggacctccataatcgcctccgggaaatcgatgagaaactgaagatgatgaaggaaaacgtattagagtccacaagctgtctcagcgaggagcagctcaagtgtctgctcgacgaatgtattctgaaacagaaaagtataataaaactgtcatctgagaggaagaaagaagatatcgaagacgtcacccctgtctttcctcaactgtcacgttctatcatatccaaattacttaacgaaagtgagactaaggtacagaaaacagaggtggaggacgctgatatgttggagtctgaggagtgcgaggcctccaagggatattatctgaccaaagcattgaccggacataacatgtcggaggctctggttacagaggccgaaaatatgaaatgcctgcagttttccaaggacgtgatcatttctgacaccaaggattatttcatgagcaagaccctcgggatagggagactgaaaagaccctcgttcctggacgatcccttatacggaattagtgtctccctgtcatctgaggatcagcacctgaagttgtcttctccagagaataccatcgctgatgaacaggaaactaaagatgccgctgaagagtgtaaggagccttag

SEQ ID NO: 56450 - DNA, 48 bp, Artificial Sequence
  Description of Artificial Sequence: Synthetic coding sequence
taagaacaggagactaaagatgccgcagaggagtgcaaggagccatag

SEQ ID NO: 56451 - DNA, 7919 bp, Artificial Sequence
  Description of Artificial Sequence: Synthetic coding sequence
atgtcaagcagtcatagcagagccggacaaagcgctgcaggcgctgcgcctgggggtggggttgatacaagggatgctgaaatgcctgctacagaaaaagacctcgcagaagacgccccatggaagaagatccaacagaacacattcacccgttggtgtaatgagcacctcaagtgtgtcagcaaacgtattgctaacctgcagactgacttgtccgacggcctgcgactcattgctctcctcgaagtcctttcccagaagaaaatgcatagaaaacataaccagaggccgacattccggcagatgcaactggagaacgtttcagtggcactggagtttctggaccgcgaaagtatcaagctggtgagcatagattctaaggcaatagtcgacggcaacctcaaattgatactgggtttaatctggactctgatactccactactccatttctatgccaatgtgggacgaggaggaggatgaggaagcaaagaagcagacacccaagcagcgattgctggggtggattcagaataagctgccacagctgcctattacaaactttagtagagactggcaaagcggtagagctttgggcgcactggttgactcctgcgcccctggactctgtcccgactgggatagttgggacgctagcaagcctgtgactaacgcacgtgaggccatgcaacaggccgatgactggctggggatcccccaggtaattaccccagaagagatcgtggacccaaacgtcgatgaacactctgtgatgacatacttatctcaatttcccaaagctaagctgaaacctggagcccctctgcgccctaagctgaatcccaagaaggccagagcctatggaccgggaatcgaacctaccggcaacatggttaaaaaaagagccgaatttactgttgaaacccggagtgccggacagggggaggtgctggtgtatgtggaagatcctgccggtcaccaagaagaagccaaggtcactgcaaacaatgataaaaacaggacgttttccgtctggtacgtgcctgaggtgacgggcacacacaaagtgaccgttctgtttgccggacagcacatcgccaaatcccctttcgaggtttacgtggataaaagccagggagatgcctccaaggtgaccgcccagggacctggcttggagccttcaggtaatattgctaataagaccacttacttcgagatcttcaccgccggagcagggactggagaggtggaggtggtgattcaggatcctatgggacaaaagggtacagtagagccgcagctcgaagccaggggcgattcgacctatcgctgctcctatcaaccaacaatggagggtgttcataccgtgcacgtgacatttgctggcgtgccgattcccagaagcccttacacagtcacagtgggccaagcttgcaacccatccgcctgtcgagcagtcgggaggggactgcagccaaaaggcgtgcgggtgaaggagaccgctgacttcaaggtttatactaaaggggctggctctggggaactcaaagtgacagtcaaagggcctaagggggaagaaagggtgaagcagaaggatctgggcgatggcgtctatggattcgagtactatcccatggttcctgggacctacatcgtcaccatcacctggggcggtcagaatattggacgctcccccttcgaggtgaaggtaggaactgagtgcgggaatcagaaggttagagcctgggggccaggcctcgaagggggtgtcgtaggcaaatcagctgactttgtggtagaggctatcggcgacgatgttgggacccttggattttctgttgaaggtccctcccaggccaaaattgagtgcgatgataaaggtgacggttcttgtgatgtccgatattggcctcaggaggctggcgagtatgccgtgcacgtcctttgcaattctgaggatatccgactctcaccatttatggctgatatccgcgatgccccacaggacttccatcctgatcgggtgaaggcgaggggacccggtctagaaaagactggggtggccgtgaacaagcctgccgagtttaccgtcgacgcgaagcatggtggcaaggctccactgagggtgcaggtccaggataacgaaggctgtcccgtcgaggccctggtgaaggacaatggcaacgggacttatagttgctcctacgttcccagaaaaccggtgaagcatacagcaatggttagctggggaggcgtgagcataccgaactctccattccgggttaacgtcggggctggcagccaccccaacaaagtaaaggtgtatggtccgggagtcgcaaagactgggttaaaggcccatgagccaacctatttcactgtggattgtgccgaggcaggccaaggagatgtctcaatcggcataaaatgcgctcccggtgtggtcggacctgccgaggcggacatcgacttcgacatcatcagaaatgacaatgacacctttaccgtcaagtatacacctcggggagccggatcctacactattatggtccttttcgcagaccaggccactccaaccagcccaatacgggtgaaagtggagcccagtcatgatgcttcaaaggtgaaagctgaggggccaggattgtcccggaccggagtagaactgggtaagcccacgcacttcaccgtcaatgcaaaagccgcaggaaagggtaagttggatgtccagtttagcggcctaactaaaggggacgctgtgcgggacgtggacatcatcgaccatcacgacaacacctacaccgtgaaatacaccccagtccagcaggggccagtcggcgtgaacgtcacgtacggcggagaccctatccccaaatcccccttctctgtggccgtgtcacccagtcttgacctgtcaaagattaaggtctcgggtctgggcgaaaaagtggacgtggggaaggaccaggagttcactgtcaagtcgaaaggggcagggggacagggcaaagtggcatccaaaatagtggggccaagcggggcagcagtcccctgcaaggttgagcctggcctgggagccgacaatagtgtcgtgcgcttcctgccccgagaggagggcccttacgaggtggaagtgacatatgatggtgtgcctgtccccggtagcccattcccactggaggcggtcgccccaaccaaacccagtaaggtgaaagcatttggtccaggactgcaggggggttcagctggatcccccgctaggttcactatcgacaccaaaggggcaggcacgggaggcctgggactgacagtggagggcccatgtgaagcacagttggaatgcctggataacggcgatgggacatgctcggtgtcctatgtaccaactgaaccgggagattacaatatcaacatccttttcgccgatacacatatacctggtagccctttcaaggcccatgtcgtgccctgctttgacgcttccaaggtaaagtgctccggcccaggtctcgaacgagctactgccggagaagttggtcagttccaggttgattgctcatcggctggatcggccgagttgactatcgagatctgtagcgaagcagggctgcccgcagaagtttacatccaggaccacggcgacgggacccatactattacctatattcccctgtgccctggggcatacactgtgaccattaaatacggagggcagcctgtccctaactttccatctaagctccaggtggagcctgctgtggataccagcggagtccagtgttacgggccaggaattgagggccaaggcgtcttccgagaagccacgacagagtttagtgtggacgctcgggctcttacacagactggtggccctcacgtgaaggccagggtggccaaccctagcgggaatctcaccgagacctacgtgcaggatcgaggggatggcatgtataaagtggaatataccccttacgaagaaggcctccatagcgtggacgtaacttatgacggcagtccggtgccctcctccccattccaagtgccggtcacagaagggtgcgaccccagtcgggtccgtgtccacgggcctgggatccagagcggaacgacaaacaaacctaacaagtttacagtcgaaacaaggggcgcaggaaccggcggtctgggacttgctgttgagggcccatctgaggccaaaatgtcttgcatggacaacaaagatgggagctgctcggtggagtacatcccctacgaggccggaacttactctctcaatgtaacctatggaggccatcaagtccctggaagccccttcaaggtgcctgtacacgatgtgactgacgcttctaaggtaaagtgctcagggcctggtctctcaccaggcatggtccgggcaaaccttccgcagtcattccaggtcgacacaagcaaggcaggagtcgccccactacaagttaaagtgcaggggcctaagggactggtggagcctgttgatgtagtcgataatgccgatggaacgcagacagtaaactatgtgccctctcgggaaggaccttactccatcagcgtgctttacggtgacgaggaggttccgcgatctccgtttaaggtcaaggtgctgccaacccacgacgcctccaaagtcaaagcaagcggaccgggtctaaataccactggagtgcctgcttccttgccagtggagttcacgattgatgctaaagatgccggagaagggctgctcgctgtccagatcactgacccggaagggaaaccaaagaaaactcatattcaggacaatcacgacggcacctacaccgtagcttacgtccctgatgtcaccggcagatacactattctcattaaatatggaggagatgaaattccatttagtccttaccgggtgagagccgtccccaccggagacgcctctaaatgtacggtcactggagccggtataggtcccaccatccagatcggtgaggaaaccgtgataacagtcgataccaaggccgctgggaagggaaaggtgacctgtactgtctgtacccctgatgggtcagaagtggatgtggatgttgtggaaaatgaagatggtaccttcgatatcttctataccgccccacagcctgggaagtatgttatctgcgttaggttcggcggagagcatgtgccaaatagtccgttccaggtcacagctttggcaggggaccagccttcagtgcagccgccactaaggtcccaacaactcgccccacagtatacttatgcccagggcggacagcaaacatgggcccctgaaaggccgcttgtgggcgtgaacggattggatgtaacaagcctgagaccattcgacctcgtgattccattcaccatcaagaaaggggagattactggagaagtgagaatgccttcagggaaagtcgctcagccgacaatcaccgacaacaaagatggcaccgtcacagttaggtacgccccatctgaggctggcttgcatgaaatggatatccggtacgacaacatgcatattcccggtagtcctctgcagttctacgtcgactatgtgaattgcggacacgtgacggcttatgggccaggtcttacacacggtgtggtcaacaaacccgctacattcactgtaaatacaaaagacgctggggaagggggtctgtcactggctatagagggcccttcaaaagccgagatcagctgtacagataaccaggatgggacctgcagtgtgagctatctgccagttctgcccggagactattccatccttgttaaatataacgaacaacatgtgcccggaagcccattcactgctcgcgttacgggagatgactctatgagaatgtctcaccttaaggtcggttccgccgcagatattcccataaacatttcagaaacagatctgtcccttctcacagccaccgtagttccaccatccggccgtgaagaaccatgcctgctcaaacgtcttcggaatggtcatgttggcattagctttgtgcccaaggaaactggcgagcacctcgttcacgtcaaaaaaaacggacagcacgtcgctagcagccccatacccgtagtcatctcacagagcgaaattggagatgccagccgggtgagggtaagcggacagggactgcacgaaggccacacctttgaacccgctgaattcataatcgacacccgggacgcaggctacggcggactcagccttagcattgagggcccatcaaaggtggatattaacaccgaggacctggaggatgggacatgccgtgttacttactgcccaacagagcctggtaattacattatcaacatcaagtttgcagaccagcacgtgcccggatcacctttttcggtgaaggtcactggggaaggcagagtaaaggaaagcatcaccaggcgtcggagagcccctagcgtcgccaacgtgggctcccactgtgatctctctctgaagattccagaaatcagtatccaggatatgacagcccaggtgacaagtcctagtggtaaaacccatgaggccgagatcgtggagggggagaaccatacctattgcatccgcttcgtcccagcggagatgggcacacacaccgtgtccgtcaaatataagggacaacatgttcccggaagtcccttccagtttacggtggggccactgggtgaagggggagcccataaggtgagagctgggggtcccggactggagagagcagaagctggggtgccagccgaattctccatctggacgcgtgaagccggtgctggaggacttgcaatagctgtggaaggcccaagcaaggccgagatcagctttgaagataggaaagacggatcctgtggggtcgcatacgtggttcaagaaccaggtgactacgaggtgtctgtcaagttcaatgaagaacacattcccgattctccattcgtagtgcccgtggcgagtccatctggggatgcacgtcgcctgacagtgtcctcactgcaggagtccggcctgaaggtaaatcaacccgcttcatttgccgtctctctaaatggagccaaaggcgcaatagatgccaaggtacattcgccctctggcgcactcgaagagtgctacgtgacggagattgatcaggacaagtatgccgtccgctttatccctagagaaaacggggtgtaccttatcgatgtgaaatttaatggtacgcacataccaggtagtccgttcaagatacgggtaggcgagccagggcatggcggtgaccccggtctcgtgagtgcctacggggctggattggagggaggcgtcactggtaatccagctgagttcgtggtcaatacctctaacgctggggctggtgctctttcagtcacaatcgatggccctagcaaggttaagatggattgccaggagtgccccgagggttaccgagtaacatacacccccatggcccctggctcatatttgatctctattaagtacggcggtccctaccatattgggggaagtcctttcaaggccaaggttacaggccctaggctcgtttccaatcactccttgcatgagacaagctcagtttttgttgattcactgacgaaagccacctgtgccccacagcatggagctcctggccctggcccagccgatgcatccaaggtggttgcaaaaggacttggactgtccaaagcctacgttggtcagaagagttcttttaccgtggactgcagcaaggccggaaacaatatgttgctggtaggcgtgcacggaccacgcaccccctgtgaggagatcctcgtcaaacacgtggggagccgcctctattcagtttcctacttactgaaggataagggggagtacacgctagtcgtgaaatggggagatgaacacatacccggttccccctacagggtggttgtgcctta

SEQ ID NO: 56452 - DNA, 3642 bp, Artificial Sequence
  Description of Artificial Sequence: Synthetic coding sequence
atgaggtctaggaaccagggaggcgagagtgccagcgatggtcatatcagctgcccgaagccctcaattataggcaacgccggagagaagtccctctctgaggatgctaagaaaaagaagaagtccaaccgcaaggaagatgacgtgatggccagcgggacagtgaaaaggcatctcaagacttcaggcgaatgtgagcgtaaaacaaaaaagtctctggaactttccaaggaggacctaattcagttgctgtcaatcatggaaggcgagctgcaagctagagaagacgtgatccatatgttgaagaccgagaagaccaagccggaggtgctggaagcccattacggatcagccgagcccgagaaggtcctgcgcgtgttgcatagagacgcgatactggcccaggagaaatcaataggggaggatgtgtacgagaagcccattagtgagttagaccgcctggaggaaaagcagaaggagacataccgcagaatgctggagcagcttctgctggccgaaaaatgccatcgtaggacagtttatgagctggagaacgagaaacataaacatacagactacatgaataagtccgatgactttactaacctgcttgaacaggagcgagagcggttgaagaaactccttgagcaggaaaaggcttaccaggctagaaaggagaaagagaatgccaagaggctgaacaaattacgtgacgagctggtcaaactgaaatcattcgccctgatgcttgtggacgagcgacagatgcatattgaacagctaggcctacagtcccagaaggtgcaggacctaacccagaagctccgtgaggaagaggaaaaactaaaagcgatcactagcaagagcaaggaagaccgccagaaattactaaaattggaggtggacttcgagcacaaagcgtctcgattttcacaagaacacgaggaaatgaatgcaaagctggcaaatcaagaaagccataatcggcagctgagactcaagctggtggggctcacacagagaatcgaagagctggaggagactaacaaaaacctgcagaaagcagaagaggagctgcaggaactacgcgacaagattgccaaaggggagtgtggcaacagtagtctaatggcagaggtcgagaatctgcgaaaacgagtcctggaaatggaagggaaggacgaagagatcaccaagacggagtcgcaatgtagagagctcaggaagaagctccaagaagaagaacaccactcaaaagagcttcggctagaggtggaaaagctacaaaaacgaatgtctgagcttgaaaaacttgaggaagccttttccaaaagcaaatcagaatgcacccagcttcacctaaatctggaaaaagagaagaacctgacgaaggatctgttgaacgagttagaggtcgtgaagagcagagtcaaggaattggaatgtagtgaaagtaggctggagaaggccgaactgagtttgaaagacgacctaaccaagctgaagagctttacagtaatgctggttgatgagcggaaaaacatgatggagaagatcaaacaggaggagaggaaagtcgatggccttaataaaaattttaaggtggaacaaggcaaggtgatggatgtcaccgaaaagttaatagaggaatctaaaaagcttctgaaactcaagtctgagatggaagagaaagtttataatctcactcgcgaaagggacgaactgattggaaagttgaaaagcgaagaggaaaagtcatctgagctgtcctgttcggtcgatctgctgaagaaaaggctggacggaatcgaagaggtggagcgcgagatcacacgcggtcgatcacggaagggtagtgagctgacttgcccagaggataacaaaattaaagagctgacgctcgaaatagaacggctgaaaaaacgactgcaacagctcgaggtggtggagggggaccttatgaagaccgaagatgaatatgaccagctcgagcagaagtttcgcacagagcaggacaaggctaacttcttgtcccagcaactggaagaaatcaagcaccaaatagccaaaaacaaggcaatagagaaaggggaggtggtcagccaggaagctgagctcagacataggttcaggctggaagaagctaaatcaagagacctcaaggccgaagttcaggccctgaaggaaaagatccacgagttgatgaacaaggaggatcaactgagccagcttcaagtggactacagcgtgctccagcagcggtttatggaagaggaaaacaaaaacaagaacatgggtcaggaggtgctgaaccttacaaaagagctggaactgagcaagcggtattcccgtgccctccgaccctccgttaacgggcgacggatggtggacgttcctgtgacatccacgggggttcagacggatgcggtctctggtgaggctgcggaggaagaaacaccagcagtgttcataaggaagtcctttcaggaagagaatcatataatgagcaatttaagacaggtggggcttaagaaacctgtggagcgaagttctgtgctggataggtaccctcctgcagcaaacgagcttaccatgagaaaatcttggatcccctggatgcgtaaacgcgagaatggcccttcaatcacccaggagaaagggcctcgtactaactccagtcctggacatcccggagaagtcgtactgtcaccaaaacagggacagccattacatatacgggtgactcctgatcatgaaaatagtactgccaccctggagatcacatcaccaacgagcgaagagttcttctcatctaccaccgtgattccgactctaggcaaccagaagccacgcatcaccattatccccagtccaaatgtgatgccccaaaaacagaagtccggcgatacgaccctaggcccagagcgcgcaatgtctcccgtgactattactacattttcaagagagaagacccccgagagcggcagaggcgctttcgccgacaggcccacatcacctattcagattatgaccgtctcaaccagcgccgcaccagccgaaatcgcagtctctcctgaatcacaggaaatgccaatggggagaacaatcctgaaggtaacgccagagaagcagacggtccctacaccggtacggaaatataactccaatgccaacatcataacaactgaagataacaagatccatattcacttgggctctcagtttaagcgatcgcccggaacctccggcgaaggagtgagcccagtgatcacagtcaggccagtgaacgttactgccgagaaggaggtgtccaccggaacagtgctgcggtcccctcgaaaccatttgtcaagccgcccaggtgcttcgaaggtaacttccacaatcactataaccccagtcacaactagctctgccagagggacacaatcagtatcgggtcaggacggatcctctcagaggcctacacctacccgaattcctatgtccaaaggcatgaaggctggcaaaccagtggtggcagccccaggggcagggaacctgaccaaattcgaaccgagagccgagacacagagcatgaagatcgagttgaagaaatcagccgcatcttctacaacgtccctcggcggtggaaagggctag

SEQ ID NO: 56453 - DNA, 3345 bp, Artificial Sequence
  Description of Artificial Sequence: Synthetic coding sequence
atgctgaagaccgagaaaacaaagcccgaggtcctggaggcgcattacggctcggccgagccagagaaggtgctgcgggtacttcaccgtgatgcgatcctggctcaagagaagtcaataggcgaggatgtgtatgagaagcccatctctgaattagataggttggaggagaagcagaaggagacatatcgaaggatgctggagcagctgcttctggcagaaaaatgtcatcggcgtaccgtatacgagttggagaacgaaaagcacaaacatacagactatatgaacaagagcgacgattttacgaacctgcttgagcaggaacgagaacgcctgaagaagttgttggagcaggagaaagcctaccaggccaggaaggagaaagagaacgcaaaacgactgaataagctgagggacgaactagtgaagctgaaatctttcgccctcatgctcgtggacgagaggcagatgcatatcgagcagctgggactgcaatctcaaaaggtccaagatttaactcagaaactgcgggaagaggaggagaagctgaaggcgatcacctctaaaagtaaagaggacaggcagaagcttctgaagttggaagtcgatttcgaacacaaggcgtcccgctttagtcaggagcacgaggagatgaatgcaaagttagccaaccaggagagccacaataggcagttgcggcttaaactagttggcctcacacagcgcattgaagaactcgaggagactaataaaaacctccagaaagcagaggaggagctgcaggagctgagagacaaaatcgcaaagggagagtgcggtaactcaagcctcatggcagaggtagaaaatctgaggaagagggtcctagagatggagggcaaggatgaagaaatcacaaagacagaatcccagtgcagagaattacggaagaagcttcaagaggaagaacatcactccaaagagttgcgtctggaagtggagaagctgcagaaacggatgagcgaattggagaagctggaggaggcattctccaagtcaaaaagcgagtgtacacaactgcacttaaatttggagaaagaaaagaacctcaccaaggaccttctgaacgagctggaggttgtgaaaagtcgagtaaaggaactggaatgcagcgagtccaggttagagaaggccgagctttccctcaaggacgatctcaccaagcttaaatccttcaccgttatgctcgttgacgagcgtaaaaatatgatggagaaaatcaagcaggaagagaggaaggtggacggcctcaataagaatttcaaagtcgaacagggtaaggtgatggatgtaacagagaagctgatcgaggagagcaagaaactgctgaaactcaagtcggagatggaagagaaagtttataacctcaccagagagcgtgacgagctcatcggaaagctaaaatctgaggaggagaagagttctgagctcagctgttccgtggacctcctcaaaaagaggcttgatgggatcgaggaagtagaacgcgaaatcactcgtgggcgatcccgaaagggttccgagctgacttgcccagaggacaataagattaaagagctgactctggagattgaaagactgaaaaagcggctgcagcaactcgaggtggtggagggggatctgatgaaaacggaggacgagtacgatcagctggaacaaaaattccggacggaacaggacaaggctaactttttaagccagcagctggaggaaatcaagcatcagattgccaaaaataaggccatagagaagggtgaggtagtcagccaggaggcagagctgcgccataggttccggctggaggaggccaagtctcgtgatctgaaagccgaagtgcaggccctcaaggagaagatccacgagcttatgaacaaggaggatcagttaagccagctgcaggttgactactctgttctgcagcagcgctttatggaggaggagaataaaaacaaaaatatggggcaggaggtactcaatctcaccaaagaattagagctgagcaaacggtactctcgagccctgcgccctagcgtgaatgggaggcggatggtggacgtcccggtgacctctactggagttcagaccgacgccgtctccggcgaagccgcagaagaggaaacccctgcggtgttcatcagaaaatctttccaggaggagaatcatattatgtccaacttgcgccaggtaggtctcaagaagcccgtcgagaggagctcagtgctggatcgctacccaccagccgcaaatgaacttactatgaggaagagttggatcccctggatgcggaaacgggaaaacggcccttcgatcactcaggagaaggggccaaggacaaactcatcccctggacatccaggcgaggttgtattaagccccaaacagggccagccattgcacataagggtgacgccagaccatgaaaactccacagccactcttgaaatcacaagcccaacatccgaagagttcttctcctctactactgtgatccctaccttgggcaaccagaaaccacggatcaccattatcccctccccgaatgtgatgcctcaaaaacagaaaagtggcgataccacactgggcccagaaagggccatgagtccagtgactatcacaacctttagccgggaaaaaacccccgaaagcggtagaggggcattcgccgacagaccgacttctccaatccaaatcatgaccgtgtcaacgtcagctgctccagccgagatcgctgtgtctcccgagtctcaggagatgccaatgggcaggaccattctcaaggtgacacctgagaagcagactgtgccaacacctgtgcgtaagtataacagcaacgcgaatataatcacaactgaggataataaaatacacatccacctcggaagccaattcaaacgctcaccaggtacaagtggtgaaggcgtgtctcctgtgatcaccgtaaggcctgtgaatgttaccgctgagaaggaggtaagcactggaaccgtgcttagatcgcccagaaatcatctgagctcaaggccaggcgctagtaaggtgacctcaactataactattaccccggtcactactagtagcgctcggggaactcagtccgtcagcggtcaggacgggagctctcagaggccaacacctacaaggattccaatgagcaagggaatgaaggccggaaaacccgtggtcgccgctccaggggctggcaatctcactaaattcgaacccagggccgaaactcagagcatgaagatcgaattaaaaaaatcagctgccagcagcacaacatccctcggcggaggcaagggatag

SEQ ID NO: 56454 - DNA, 3534 bp, Artificial Sequence
  Description of Artificial Sequence: Synthetic coding sequence
atgagatcccgtaatcagggaggtgagagtgctagtgatggccatatttcttgccccaagccctcaatcataggcaatgctggagagaagagcctgtccgaggacgcaaaaaagaagaagaaatctaaccgcaaagaagacgatgtgatggcaagcggcacagtcaaaagacacctgaagacctctggggagtgtgagcgtaaaactaagaagtccctcgaattaagcaaggaagatctgatacaactgctaagtattatggagggggaactccaagcgcgtgaggatgtgatccacatgcttaaaaccgaaaaaactaaaccagaagttctggaggcacactatggctccgccgagccggaaaaggtgctgagagtgttacatcgtgacgccatcctcgcacaagagaagagtattggcgaggatgtatatgaaaaacctatctcagagctggatcgtctggaagagaagcagaaagagacttaccgtcggatgttggagcagctcctcttagccgagaagtgtcacagacgaacagtttacgaactcgagaatgagaaacataagcacacagactatatgaacaaaagtgacgactttacgaacttgctggaacaggagcgtgagcgacttaaaaagctgctggagcaggaaaaggcctaccaagctcgaaaagaaaaagagaacgcgaagaggctaaacaagctgcgggatgagctcgtgaagctaaagagcttcgcattaatgctcgtggacgagcgccagatgcatattgagcaattgggactgcaatctcaaaaggtccaagacctgacacagaagttgagggaggaggaggagaaactgaaggcaatcacatctaaaagcaaagaggaccggcagaaactgctcaagttggaagtcgacttcgagcataaagcatcccgctttagtcaagagcacgaagagatgaacgcgaagttagccaaccaggaatctcacaataggcagctcagactgaagctggtgggcctgacccaacggattgaagagctggaggaaaccaataaaaatctgcagaaggccgaagaggagctgcaggaactgagagataagattgcgaagggcgaatgcgggaattctagcttaatggccgaagtcgaaaatctgagaaagcgtgttctggagatggaaggcaaggacgaggagatcactaagacagagtctcagtgtcgggagttgcgaaagaagctgcaggaagaagagcaccactctaaggagttaagactggaggttgagaagcttcagaaacggatgagcgaactggagaagctggaagaagctttttcaaaatctaaatcagaatgtacgcagctgcacctgaacctggaaaaggaaaagaatctgactaaggaccttctgaatgaattagaggtagtgaagtctcgggtgaaggagcttgagtgttccgaatccagactagagaaggccgaactctctttgaaggatgacctgacgaagttaaagtcgtttacggtcatgcttgtggatgagcgcaagaatatgatggagaagattaaacaagaggaacggaaggtcgacgggctaaataaaaatttcaaggtggagcaaggcaaggttatggacgtcactgagaagttgatcgaagagtctaaaaagctgctgaaactgaagagcgaaatggaggagaaagtgtataatctgacgcgggagcgcgatgagcttatcggcaaactgaaatcagaagaggaaaaatccagcgaactgtcttgctctgtggatctgctcaagaagaggttggatgggattgaggaagtggaacgcgagataacccggggtaggtccagaaaaggatcagagctgacatgtccggaggataacaagatcaaagagctcactttggaaattgaacggctgaagaaacggctgcagcaactggaggtggtggagggcgatctgatgaaaaccgaagacgagtacgatcagctggagcagaagtttcgaactgaacaggacaaagcaaactttctgagtcagcaactggaggaaataaagcaccagatcgctaaaaataaggcaatcgagaagggggaggttgtctcacaagaggccgaactccgccacaggttccgattggaggaggccaaatctagagacctcaaagctgaggtccaagcattgaaagaaaagattcatgaactcatgaataaggaggaccaactatcccagctgcaagtcgattattctgtgcttcagcaaagatttatggaagaggaaaataaaaataaaaatatggggcaagaggtgctgaacttgacgaaggagttggaactttccaagagatactccagggcattacgcccttcagtgaatggtcggagaatggtggacgttccagtgacctctactggtgtgcaaacagacgccgtcagcggagaggctgctgaagaagagacacctgcggtcttcattaggaagagctttcaagaggagaatcatattatgtcaaacctccgccaggtcggcctgaaaaaaccagtggagcgctccagcgtgctcgacaggtatccgccagccgctaatgagctcacaatgagaaaaagctggataccgtggatgcgaaaacgcgaaaacggaccaagtatcacccaggaaaagggccctcgtaccaactcgagtcccggacatcccggtgaggttgtgctctccccgaagcaaggacagccccttcacatcagagtgacacccgaccacgaaaactccaccgctactctggaaattacatctcccactagtgaggaattctttagctcaacgacggtgatccccacacttggcaaccagaaacctaggatcacaattatccctagccccaacgtgatgccacaaaagcaaaagagtggtgataccaccctcggcccagaacgggcaatgtcccctgtgactataacgacattctcccgggagaagacaccagagagcgggaggggtgccttcgctgacagacctacaagcccgattcaaatcatgaccgtgtctacttctgcagcgcctgcggaaatagcagtttccccagagtctcaagaaatgccaatgggccgaacaatcctgaaggtaacgccagaaaagcagaccgttccaacccccgttagaaagtataatagtaatgctaatattatcactacggaggacaacaagattcacattcatttgggatcccaatttaagaggtcccctggcacctcaggagagggggttagtcctgtgattacagtcagacctgtgaatgtgacggcagaaaaggaggtgagcactggaaccgtactgcggtccccgagaaaccatctgtcaagccgacccggagcctctaaggtcacctccaccataaccatcaccccagtgacaaccagctccgcccgaggtacccagtccgtgagcggtcaggatggcagctcacagcgtcccaccccaacccgtatacccatgtccaaagagtctattatcattcatcagctaagaatgaactcccgctag

SEQ ID NO: 56455 - DNA, 279 bp, Artificial Sequence
  Description of Artificial Sequence: Synthetic coding sequence
atgggcgtgcacgtcgaaactatctcccctggcgacgggatgttggaagacggaaaaaagttcgattccagcagagacagaaacaaacccttcaaattcatgctgggaaagcaagaggtgataagaggctgggaagagggggtggtgcagatgtctgtaggtcagcgggctaagttaactatctctcctgattatgcctacggagcaacaggacaccccggaattatccccccacacgccaccctggtcttcgatgtggaattactgaaacttgaatag

SEQ ID NO: 56456 - DNA, 327 bp, Artificial Sequence
  Description of Artificial Sequence: Synthetic coding sequence
atgggcgttcatgttgagaccatttcacccggagactggcgcaccttcccaaagaggagccaaacctgtgtgatgcactacacaggcatgctggaagacggcaaaaagtttgactctagccgagaccgcaacaagcccttcaaatttatgttgggtaagcaggaggtgatccggggatgggaagaaggcgtggtccagatgtccgtgggccagcgcgctaaattgactattagtcctgactacgcatacggcgctacaggacacccagggatcatccccccacacgccacactcgtgttcgatgtcgagttacttaaactcgaatag

SEQ ID NO: 56457 - DNA, 774 bp, Artificial Sequence
  Description of Artificial Sequence: Synthetic coding sequence
atgcccaaaaccatgcactttctattcagatttatcgtcttcttttacctatggggcctgttcacagcgcaacgccaaaagaaagaagaatccactgaggaggtcaagattgaggttctacataggccagaaaattgcagcaaaacatccaagaaaggggatttgctcaatgctcattacgacggctacctcgcgaaggatgggtcaaaattctattgtagccggacccagaacgaaggtcaccccaaatggtttgtgctgggcgtggggcaggtaataaaaggcttggatattgctatgacggacatgtgcccgggtgagaaacggaaagtggtaattccaccttcatttgcatatggaaaagaggggtatggcattctcgaagaagtctttctactgcaaaatatcctggtcagctgccaccgtacgaccctccacgtgcttaagtgcatgctgctggtgaataacaacacttgcgccgaaggcaaaattccgcctgatgccactttgatctttgaaatcgaactatatgctgtgacaaaaggcccacgttcaatcgagacgttcaagcaaattgatatggacaatgataggcagttatccaaagcagaaattaatctgtacttgcagcgagaattcgagaaagacgaaaaaccccgagataagagttatcaggacgccgtgctggaggacatattcaaaaagaatgaccacgacggcgacggttttatatcgcccaaggaatacaatgtgtaccaacacgatgaactttag

SEQ ID NO: 56458 - DNA, 669 bp, Artificial Sequence
  Description of Artificial Sequence: Synthetic coding sequence
atgcccaagaccatgcattttctgtttagattcattgtgttcttctacctgtggggcctgtttaccgctcaaaggcaaaaaaaggaagaatccaccgaggaagttaagattgaagttctgcatcgacccgagaattgcagcaaaacctccaaaaaaggagaccttctgaacgcgcattacgacggatatctggctaaagacggcagcaagttctattgcagccgcacccagaatgaaggtcaccccaagtggttcgtcctaggcgtgggacaggtaattaagggtctggatattgcaatgaccgatatgtgtccaggtgaaaaacgcaaagtcgttatcccaccttcttttgcctatgggaaagaaggttacgctgagggaaagattcccccagatgctaccttgattttcgagatcgagctctatgcagtgacgaaaggacccaggtccattgaaacatttaaacagattgacatggacaatgatcgtcagctgagcaaagcagagatcaatttgtatctgcagcgggaattcgagaaggatgagaagccgcgagataagtcctaccaggacgcagttctggaggatatctttaaaaaaaatgatcacgacggcgacggcttcatttcgccaaaggagtacaatgtctatcagcatgacgaattgtag

SEQ ID NO: 56459 - DNA, 666 bp, Artificial Sequence
  Description of Artificial Sequence: Synthetic coding sequence
atgcctaagacaatgcactttctgtttagatttatagtgttcttttacttgtggggcctgtttacagctcagcgccagaaaaaggaagaaagcactgaagaagtgaagatcgaggtcttacataggccagaaaactgctcaaagaccagcaagaaaggcgacctactcaacgcccactatgacggctacttagctaaagacggttctaagttttattgttccaggacacagaacgaggggcatcccaagtggtttgtgctgggcgtcggccaggtcatcaaaggtttggatattgccatgacagatatgtgccccggagaaaagcggaaagttgtaatacctccctccttcgcttatggcaaggaaggttatgaagggaagatcccacccgatgccaccctgatcttcgaaatcgagctgtacgccgtgaccaagggcccacgatccattgagacgtttaagcagatagatatggacaatgacagacagttaagcaaagctgagatcaacctttatctccaacgcgagtttgagaaggacgagaagcctcgagataaaagctatcaggacgccgtgctggaagacatatttaagaaaaacgatcacgacggggatggctttatctccccaaaggaatataacgtatatcagcatgatgaactgtag

SEQ ID NO: 56460 - DNA, 1050 bp, Artificial Sequence
  Description of Artificial Sequence: Synthetic coding sequence
atggagaccccccctgttaatacaatcggcgagaaagacaccagccagccacagcaggaatgggaaaaaaaccttagggaaaatttggattctgtgattcagattcgtcagcaaccgagagatccaccgactgagacgctggaactggaggtctctccggaccctgcctctcagatcctggaacacacgcagggagcagaaaagcttgtggcagaactcgaaggtgatagtcataaatcgcacgggtctacctcccaaatgccggagacgctgcaggcatccgatctgtggtattgccccgacggaagctttgtgaagaaaatagtgattagggggcatggcctggataaacccaagctaggaagctgttgtagggtgctcgcactggggtttcccttcggatcaggaccgccagaaggctggacggagctaacgatgggcgtgggcccatggcgtgaggagacttggggagaactcatagagaagtgtctggagagcatgtgccaaggagaagaggcagaactgcaactgcctggacacagcggtccacccgttcggctgactctggccagtttcacccagggtcgagactcctgggagttggagacatccgagaaggaggctctggctcgggaggaacgcgcacgtgggacggagctatttcgggctggtaaccctgagggggctgctagatgttacggcagagctctcagactgctactgactttgccacccccaggaccccctgaacggacggtcctgcatgccaatctcgcagcctgccagctgctactgggccagcctcaactcgccgctcagagttgcgatcgtgttctggagcgagaaccgggacatctgaaagccctttatcgcaggggggtagcccaggctgccctggggaacctcgaaaaagctaccgcagatctaaagaaggttctggcaatcgaccccaagaatcgggctgctcaggaagagttaggaaaagtcgtgatccagggcaaaaatcaagacgcgggtcttgcccaagggctcaggaagatgtttgggtag

SEQ ID NO: 56461 - DNA, 423 bp, Artificial Sequence
  Description of Artificial Sequence: Synthetic coding sequence
atgcccctccctgaaccatccgaacaggagggggagagtgtcaaggctagccaggagccatcacctaaacctggtactgaagtcatccccgcagctcctcgtaaacctcgaaagttttcaaaacttgttcttctgaccgcttctaaagattcaactaaagtggctggcgcaaagagaaaaggggtccattgcgtaatgtccctaggagttccagggccagccacactggccaaagcactccttcagacccatcctgaggcccagagagccatcgaagccgcaccacaggagcctgagcagaagagaagcagacaggatcctggtacagaccgtacagaggattctggattggctgctgggcctccggaagccgcaggcgagaactttgctccgtgctcagttgcgccaggtaagtccttgtag

SEQ ID NO: 56462 - DNA, 423 bp, Artificial Sequence
  Description of Artificial Sequence: Synthetic coding sequence
atgccattgccggagccctccgagcaagaaggcgagagcgtcaaagcctcgcaggagcccagccctaaaccaggcacagaggtcatccccgctgcaccacggaaaccacgcaaattcagcaagctggtcctgttgacagcttctaaggacagcaccaaggtggccggagctaaacgcaagggtgtgcactgcgtcatgtccctcggcgtgcctggtcctgccactctcgctaaagctctgctacagacacatccggaggctcaacgcgcaattgaggcggcacctcaggaacccgagcagaaaaggtctcgccaggatcccggtacagacaggacagaggattcgggcctggccgctggccctccagaggccgcaggcgaaaacttcgctccctgtagcgtcgccccaggaaagagcttgtag

SEQ ID NO: 56463 - DNA, 735 bp, Artificial Sequence
  Description of Artificial Sequence: Synthetic coding sequence
atggacatggcttggcagatgatgcagttattactgttagcactcgtcacggcagccggttctgctcaacctcgcagcgccagagctaggaccgatctcctgaacgtgtgcatgaacgccaaacatcacaaaacccagccttcaccggaggacgagctgtacgggcaatgcagtccctggaagaagaacgcatgctgtacagcaagcaccagtcaggaactccacaaagacactagtcggctgtacaatttcaattgggatcactgtggcaaaatggagcccacttgtaagagacactttattcaggacagttgcctggagtgctcaccgaatttaggaccttggattagacaggtgaaccagagctggcgaaaggaaagaatacttaacgtgcccctgtgcaaggaagattgtgaacggtggtgggaggactgcaggacttcatacacttgtaagagcaattggcacaaggggtggaactggacctcaggcataaatgagtgccccgcaggagcactgtgttcaacctttgagagttatttccctactccagcagccttgtgtgaaggactgtggagtcattccttcaaggtgtccaactattctagaggcagtgggcgttgtatccaaatgtggtttgactcagctcagggaaatcccaacgaagaagtcgccaagttttatgcagctgctatgaatgcgggagccccttcacggggtatcatcgattcttag

SEQ ID NO: 56464 - DNA, 864 bp, Artificial Sequence
  Description of Artificial Sequence: Synthetic coding sequence
atggacatggcctggcaaatgatgcagcttttgttgctcgctctcgtgacggccgctgggtctgctcagcctcggtccgctcgagcaaggactgacttactgaatgtttgcatgaatgcgaagcatcacaaaactcagccgtcccccgaggatgagctttacggccaggtgggcgcaccccagggtccatctcctggcagcgtcccacttgatgacctcccaggcgcagaggagcccgagtacggaggagacggctgtgggggtgagcggctctcccctgtcagcagtcccccatccgctgtccccggacggaggatgcccgctgctcgacccgctccagcacggtcttgtaccagaacacccccagcctgcaccaccttaaccggcatcacggtggtgaggtggaatccaccagcgtcggcaactctgtcaagaaccgcagtaagtgagtgttctccgaacctcggtccgtggatcaggcaagttaaccaaagctggcggaaggagcgcattctgaacgtccctttatgtaaggaagattgcgaacggtggtgggaggattgccggaccagttatacatgcaagagcaattggcacaaaggctggaactggacctctgggatcaatgaatgcccagctggtgcactatgttctacctttgagtcctatttccccactcccgcagcactctgcgagggattatggagccattcgttcaaagtgtccaattattcgcgaggatcaggtaggtgcatccagatgtggttcgatagtgcccaagggaatccaaatgaggaggtggctaagttttacgcagcagcgatgaatgcaggggctccatccaggggcataatcgattcctag

SEQ ID NO: 56465 - DNA, 1380 bp, Artificial Sequence
  Description of Artificial Sequence: Synthetic coding sequence
atgacactgagcaccgagatgtccgatgcgagcggtcttgcagaagagacggatattgacgtggtgggcgagggcgaggacgaagaagacgaggaggaggaggacgacgatgaagggggaggaggcggaccgaggctagcggtgccggcacagcgtaggcgccgaagacggtcctacgccggagaggatgaacttgaggacctcgaggaggaggaggacgacgacgatatcctgttggcccctcctgcgggaggaagccccgctcctcctggtcctgcgcctgcagctggcgcaggagcagggggtggcggtggcggtgggggagcaggagggggagggtcagcaggaagcggcgcaaaaaacccgctggtgaagcccccttatagttatatcgcactgatcaccatggcaatcctgcagagtccaaagaagcggctgacactgagtgaaatatgtgagttcatatctggtaggtttccatactatcgcgaaaaatttccagcctggcagaacagcattcgccacaacctatctctaaatgactgctttgtcaaaatccccagggagcctggcaaccccggaaaaggcaactactggaccctcgaccctgaaagcgcagatatgttcgataatggaagcttcctacggagaaggaagagattcaaaagacagccccttcttcctccaaatgccgctgccgctgagagcctgctcctacgaggggcaggtgccgctggcggagccggagacccagcagccgcagccgcactgtttccaccagctcccccacccccaccccacgcatatgggtacggcccttatggatgcggatacggactgcaacttccaccttacgccccaccctcagccttgtttgctgccgcagcgaggcgacgccgaaggcggttgccaccggctttggcacccgctgctccggctacagcccgaagagggaggcgggctgggcctgacagactgcgcctacctgcagctcctgcgcgtagacggcctacccgccctcccgctggattgcgaggacaggggggacgacccggacggttgagtgcaggggctcttgccctgttgcatcgcgaacatcaccgcggacagttgggtcccggtcggagatgtaggaggaggagagccggaagaaggaggcgtagcgggctcgccctggccctggccggaggcggagcggcatcctctaggattcagaggcgccgacttaggggcgctggcggacgaggcccagggggacgcgctcatcccataccacgcggacggagggggaggcgacgcctcctctctcttctagtgcggcgtctgggcgactcagcacctcgggactgtcccgtgcagtgcagagagctgtattgttag

SEQ ID NO: 56466 - DNA, 2202 bp, Artificial Sequence
  Description of Artificial Sequence: Synthetic coding sequence
atggcagaggtgggtgaggacagtggagcacgcgcattattggcccttcggagcgcaccatgctctcccgtcctttgcgctgccgcagcggctgctgcttttccagctgcagcccctccacccgctccagcccagccgcaacccccacctggaccccctccacctcctccacctccgttgcctcccggagccatcgccggagccggatcttcgggcggatcctctggcgtgagtggtgacagtgccgtcgctggcgctgccccagccctggttgccgctgcggcagcatccgttcgccagtcgcctgggccagcccttgcgaggttggaagggcgagagttcgagtttctgatgagacagccgtctgtgaccatcggcagaaactcctctcaaggcagtgttgatttgagcatgggactcagctctttcatctctcggaggcacttacagttaagcttccaggaaccgcatttttatctgcggtgcctgggcaaaaacggagtgttcgtggacggcgctttccagagaagaggagctccggctctgcagctgcctaagcagtgcacttttagatttcctagtactgcgattaagattcaattcactagcctctatcataaggaagaagcacccgcttccccactgcgccctctctatcctcagatctctccactaaaaatacacatacctgagccagacttgaggagcatggtaagtcccgtgcctagcccgacagggactatttccgttcctaattcctgccctgcgtcgcctcggggtgctggatccagctcctatcgattcgtgcagaatgtgacaagtgacctgcaactcgctgcggaattcgcagcgaaggctgcaagcgagcagcaggctgatacaagcggtggtgacagcccaaaagacgagagcaaaccgcctttttcctacgcccagctaatcgtgcaggcaataagctctgcccaggaccgccaactgaccctctctgggatctatgcccacattaccaaacattacccatactacagaacagcagataaaggttggcagaatagcatacggcacaatctctccctgaatagatactttatcaaggtcccacgatcccaggaggagcccggaaaaggcagcttctggaggatagatcctgcttcagaagcaaaactggttgagcaagcttttagaaaacgcaggcagcggggagtgagctgctttcggaccccctttggacctttgtcctctcggtcagcaccagctagtcccactcatcccggacttatgtctccgcgatctggcggactccagaccccagagtgtttgagcagggaaggaagccccatcccccacgatccggagttcggctccaaactggcctcagtgcccgaataccgctacagtcagtctgcccctgggtcgccggtctcggcacagcctgtcatcatggccgtgcccccaagaccctcctccttggttgccaaacctgttgcctacatgccggcaagcattgtgacttcccagcagcctgcgggacatgccattcatgttgttcagcaggcacccacagttactatggtccgggtcgttactacgtccgccaacagtgcgaatggctacattttgacctcgcagggcgcagcagggggatctcatgatgctgctggcgcagctgtactggacctcggtagtgaggcacggggtctggaggagaagcccactattgccttcgccactattcccgctgccggtggggtcattcaaaccgtcgcttctcagatggcacccggagtaccagggcatactgtaaccatccttcaaccagcaacacccgtgacgctaggacagcaccaccttcctgtgcgagcggtgacccagaatggcaagcacgctgtacctacaaatagcctcgccggaaacgcctacgccttgactagtcctctgcagttgctagcaactcaggcatcctccagcgcacccgtagtggtgactagagtctgtgaagtggggccaaaagaacccgctgccgctgttgccgcaactgcaaccactacacccgctaccgcaaccactgcgagcgccagcgccagctcaaccggggagcccgaagtcaagaggagccgagtagaggaacccagcggcgcagttacaacgccagccggagttatcgccgcagcaggtccacaaggcccaggcactggagaatag

SEQ ID NO: 56467 - DNA, 1713 bp, Artificial Sequence
  Description of Artificial Sequence: Synthetic coding sequence
atggcctactgtctgggtgtaaattttgttccaagtaggttttgctaccagcttcatcgcttgctcctgcgctgtacgttccgttttccaagcaccgctatcaaaatccagtttacttccctttaccataaggaagaggcacccgcttccccactccgacctctgtacccccagatttcaccactgaaaatacacatccctgagcctgacctgagatctatggtgtcaccagttcccagccctactggtactatctctgtaccaaacagttgtcccgcaagcccaaggggagcagggtcaagcagctatcgttttgtacagaacgtgacatcagacctccagctggctgccgagtttgcggctaaagcagcttcagagcaacaggcagacacatccggtggggacagtccaaaagacgaatcaaaacctcctttttcatacgcccagctgatagtccaggctatcagttcggcacaggaccgtcaactgacattaagtggaatctatgcccatatcaccaagcactacccttattacagaacggcagacaagggctggcagaatagtatccggcataaccttagcttgaaccggtattttattaaagtgccacggtctcaggaagagccaggtaaggggagtttctggcggatcgaccctgccagtgaagccaagttagtggaacaggctttcaggaagaggcggcaaaggggcgtgagttgcttccgcaccccgttcggtcccctaagctcccggtctgcccctgctagccccacacaccccggactcatgtctccacgtagcggcggactgcagaccccagagtgcctgtcaagggaggggtctccaattccccacgaccctgaatttggctctaagctggcctcagtgccggaatatcggtacagtcagagcgccccagggagcccagtctcggcccaaccggtgattatggccgtccccccacgccctagttccctggtcgcaaaacctgtggcatacatgcccgcttctatcgtgacctctcagcagcctgccggacatgctattcacgttgtgcagcaggctccgacggttacgatggtgcgggtggtgactacaagtgctaacagtgctaacggatacatactgacttcacaaggggctgctggcggaagccatgacgcggcaggtgccgctgtcttggacctgggatccgaggctagaggactcgaggagaagccgaccattgcgttcgcaactattccggcagcgggtggcgttattcagactgtagccagccaaatggcccctggcgtgccgggacatactgtcacaattctacaacccgctacacccgtgactctagggcagcatcatctgccggtgagagccgtcactcagaatggtaagcatgccgtacctactaactcactggcaggaaacgcgtatgcactgacaagcccactccagctgctggcaacacaagcttcgagcagtgcaccagtggtggtgacacgtgtgtgcgaagttgggcctaaagagcccgctgccgctgtggctgctacggcaacaacgacccctgcaacagcaactaccgcctctgcttctgctagcagtacaggagagcccgaagtgaagagatctcgtgtggaagagccctctggagcggtgacgacacccgcaggtgttattgcggcagccggaccgcagggtcccggaacgggcgaatag

SEQ ID NO: 56468 - DNA, 1470 bp, Artificial Sequence
  Description of Artificial Sequence: Synthetic coding sequence
atggtcagtcccgtcccatcccccacaggtaccatctccgtccctaacagctgtcctgcctccccgcgaggtgctgggtcttcctcctataggttcgtccagaatgtaaccagcgatctccaattagccgctgagttcgcagccaaggccgctagcgagcaacaagcagatacaagcggtggagactctccgaaggatgaaagcaagcccccattcagttatgcacagttgattgtgcaggccatcagctctgcccaagatcgccagctgacattgtctggaatctacgcgcacataacaaagcattacccatactatcgcactgctgacaaaggctggcagaactccatacgacataatttgtccctgaacagatactttataaaagtgccacgctcgcaagaggagcccggaaagggatccttttggcggatcgaccccgcaagtgaggccaagctcgtggaacaggccttccgcaaaagaagacagcgcggtgtgtcctgtttccgtaccccatttgggccactgtcttctaggagtgcacccgcttctcctacccacccagggttgatgtcacctcgttctggcggtctgcagaccccacctattccgcacgaccctgagttcggctcaaaactggccagcgtgccagaatacaggtactcccaatccgctccgggtagcccagtgtcagctcagccggtcatcatggccgttccccctaggccaagttctctggttgccaaaccagtggcttatatgccagcaagcattgtgacgtctcagcagccagcgggacacgcaatccatgtggtgcagcaggcgcctacggtgactatggttagggttgtgaccaccagcgccaattcagccaatggatacatcctgaccagccagggagcggcaggcggaagccacgacgcggctggagccgcagtgctggatcttggttcagaggctcgaggactggaggaaaagcccacaatcgcttttgccactattcctgcagccggaggagtgattcagaccgtggcaagccagatggctccaggtgtacccggacacactgtcaccatcttacagccggcaacaccggtaacactgggccagcaccacctacctgtgcgcgctgtgacccaaaatggaaaacatgcagtgcctaccaattccctggccggaaacgcatacgcattgacatcccctctgcagctgcttgctacgcaagcgtcctcttcagcacccgtggtcgtgacccgcgtgtgcgaagtcggcccaaaggagccagcagcggcagtggcagccacagccacaacaactcctgccaccgccacgacagcctcagcatcggctagcagcaccggggaacccgaggtaaagaggtcccgcgttgaggagccgtccggggctgtgaccaccccagccggagtgatcgccgcagcaggtcctcaaggccctggtactggcgaatag

SEQ ID NO: 56469 - DNA, 1752 bp, Artificial Sequence
  Description of Artificial Sequence: Synthetic coding sequence
atgaggcaaccttcagtcaccatagggagaaactcgtcccagggaagtgtcgacctgagtatgggcctgagcagctttatcagtcgcagacatctgcaactgagctttcaggagccacacttctatctccgttgcctgggtaagaatggcgtttttgtcgatggagcttttcagaggagaggggcaccagccctgcagttaccaaaacagtgcacattccggtttcccagtaccgccatcaaaatccagttcacatctctctaccataaagaggaagcaccagcgtcccctctgagaccgttatacccacagatttctccgctgaagatccacatccctgaacccgaccttagatccatggtctccccagtgccgagtcctaccgggaccatcagcgtgccgaacagttgcccagcttcccccagaggcgctgggagcagcagctacagatttgtgcaaaacgtgacaagcgaccttcagctagcggctgaatttgcggcaaaggccgcttctgagcagcaagctgacacctcaggcggtgattcgcctaaagacgagtcaaagccccctttctcttatgcccagctgattgtccaagcaatctcttcagcccaagataggcaacttacactttctgggatatacgcccatatcacaaaacactacccttactataggaccgccgataaggggtggcagaacagtattaggcataatctgtcgttgaatcggtacttcatcaaggtgcctaggtctcaggaagaacctggcaagggatccttttggcggattgatcccgcatcagaggcaaagttagtggaacaggcctttcgtaagcggaggcagcgtggggtgtcatgcttccgcacaccatttggcccactgtcgagccgatcggctccagcttccccaacacacccgggactcatgtctcccaggtcggggggtctgcagacacctgaatgtctgtctcgtgaagggtcgccaatccctcacgatcctgaattcggctccaagctggctagcgtgccagagtaccgctacagccagtctgcgccaggcagccccgtgagtgctcagcctgtcatcatggccgtccctccacgcccttcctctctggttgccaaacctgtcgcatacatgcctgcctccattgtgaccagccaacagccagctggccacgctattcacgtggttcagcaggccccaacagtgactatggtgagggtggtgactacgtctgccaattccgcaaacggctacattttgacttcacagggcgcagcaggcggatcacacgatgcggcaggtgctgccgtcttggacctgggatccgaggccaggggacttgaggaaaaacctactatcgcgttcgctaccatccccgcagcaggcggagtcatccagaccgttgcgagccagatggcacctggtgttcccggacacacagtgaccatcctgcagcccgctacaccagtcacccttgggcagcaccacctgcccgtcagggccgttacccagaacgggaagcacgccgtgcctacaaatagtctcgcaggtaacgcctacgctctgacttcccctctgcagctgttggctactcaggcctcatcaagcgccccagtggtcgtcactcgagtgtgtgaggtaggccctaaagagcctctgcctccgcctccgctgccaccacctcttcctctggaatccccacggagtaaagggccaggttggaggtccccagtcgttctgtag

SEQ ID NO: 56470 - DNA, 1947 bp, Artificial Sequence
  Description of Artificial Sequence: Synthetic coding sequence
atggtgtctttgcctcccccacagtccgacgtgaccctccccggtcccacaaggctcgaaggggagcggcagggcgatttaatgcaagcacccggactgccaggatctcctgcgccacagagtaagcatgcgggtttttcctgttcttcattcgtgtccgacggtccgcctgaaagaaccccaagccttccgcctcactcacctagaatagcaagccctgggcctgagcaggttcagggccattgcccagctggccctgggccaggtccctttcgtctcagtccttctgataagtaccccggatttggatttgaagaggctgcggcttcttccccaggcaggttcttaaaaggatcacacgctcccttccacccctataagagaccttttcatgaagatgtgtttccagaggcggagaccaccctggctttgaaaggccattcatttaagacccccggacccctggaggctttcgaggaaattcccgttgacgtggccgaggctgaggcatttctgcccggattttcagctgaggcatggtgtaatgggctgccatatccttctcaagaacatggccctcaggttctcggaagcgaagtgaaggtaaagcctccagtgctggaatctggcgctgggatgttctgctatcaacctccgctccagcatatgtattgctcctcccagcccccatttcaccagtacagcccaggcggtggcagttacccaatcccttacctgggctctagccattatcagtaccagcgaatggccccacaagcgtctaccgacggccaccagcccctctttccgaagcccatctactcctacagtattctgatctttatggcactcaagaacagcaagaccggtagccttccagtgtcagaaatatataatttcatgactgaacactttccctactttaagaccgctcctgacgggtggaagaatagcgtgcgccacaacctgagtttgaataaatgctttgagaaggtggagaataaaagcggctcttcgtctagaaaagggtgtctgtgggcacttaacccagcaaagattgacaaaatgcaagaagagctacagaaatggaaacgcaaggatcctatcgcagttcgcaagtctatggcaaaacccgaggagcttgattccctcatcggagacaaacgggaaaagctgggctctcccctgctgggctgtccaccccctgggctcagcggcagcggacccatcagaccactcgctccgcctgcgggattgagtccaccgctgcactcgctacacccagcccctgggccaatcccaggcaaaaaccccttgcaggatttgctaatgggtcacaccccgagttgttatggtcagacgtatttgcatttatcacctggtctggcaccacccggaccacctcagcctctttttccccagcccgacggccacctcgagttgagagcccagcccggaacgccccaggacagccccttacctgctcacactccacccagtcacagcgccaagctgctagcagagccgtccccagcgaggacaatgcacgacaccctcctgccggacggcgacttgggaactgatctggacgctatcaacccctccctcaccgatttcgatttccaaggaaacctgtgggaacagttgaaagatgacagcctggccctggacccacttgtcctggtcactagctctccaactagtagttcaatgcccccaccccagccacccccacattgtttccctccgggaccctgcctcaccgagaccgggagcggggcaggcgacctggccgcacctggttcaggcggttccggggcactcggcgacctgcacctaactaccctttattccgcctttatggagctggaacctacaccaccaactgcccctgccggaccatctgtttacctgtctccctctagcaagcctgtggccttagcctag

SEQ ID NO: 56471 - DNA, 1191 bp, Artificial Sequence
  Description of Artificial Sequence: Synthetic coding sequence
atgcctaaccctagacccggaaaacccagcgccccaagcctggccctcggcccatctccaggcgctagtccttcttggagagctgctcccaaagcatctgacctcctgggagccagggggccaggcggaacttttcagggcagggatctccgcggtggtgcacatgcctcctcgtcaagtctcaacccgatgccacccagccaactgcaactctcgaccgtggatgcgcatgctcgaacgcccgtcctgcaggttcaccctctggagagtcctgccatgataagcctcactccgcctacaactgctacaggagtgttttcattgaaagcacggccagggctgccgcctgggattaatgtggcatccctggagtgggtcagcagagagcctgccctgctctgcacctttcctaatccgagcgctccgagaaaggatagcacactctcagcggtgcctcagtcctcctatcctctgctagccaatggggtatgcaagtggcccggatgcgaaaaggtcttcgaggagccagaggattttttaaaacactgccaggcagatcaccttttggacgagaagggcagagcccagtgcctactgcagagagagatggtgcagtcattggaacagcaactggtcctggagaaggagaaacttagtgctatgcaggctcatctcgccggaaagatggccctgacaaaggcatccagtgtggctagttcagataaaggaagctgctgcattgtagctgccggtagtcaagggccagtcgtgccagcttggtctggtccacgcgaggccccagatagcctgttcgcagttaggcggcatctgtggggctctcatggtaatagcacattccctgaattcctacacaatatggattatttcaaattccacaacatgagacctccctttacgtacgctacattgattaggtgggctatcctcgaggctcccgagaaacagagaaccctgaatgagatctatcattggtttactaggatgtttgccttttttcgcaatcatcccgctacctggaagaacgcaattcggcacaatttgagcctgcacaagtgctttgtgagggtggagtctgaaaagggggcagtctggacagtggacgagctcgaatttagaaagaaacgcagtcagagaccatccagatgcagcaaccctacccctggtccatag

SEQ ID NO: 56472 - DNA, 2052 bp, Artificial Sequence
  Description of Artificial Sequence: Synthetic coding sequence
atgcaggagctagagagcctgctggcacaacagaaaaaggccctcgctaagtctatcacccaggaaaaaaatcgcgtgaaagaagccctggaagaggagcaaacacgggtgcaggagctggaagaacgtctcgctcgtcagaaggagatctccgagagcaatatcgcctatgaaaaacggaaagctaaagaggctatggagaaggaaaaaaagaaagttcaggatctggaaaaccgactgactaaacagaaggaggagctggaactcaaggagcaaaaagaggatgtactgaacaacaaattgtctgatgcgttggccatggtagaggagacgcaaaaaaccaaggctacagaatcgctcaaagccgaatcactggctctcaaactgaacgagactcttgccgagttggagactactaaaaccaagatgattatggtagaggagcgactgattctacagcagaagatggtgaaagcgttgcaggatgagcaagagagtcagcgtcacggtttcgaagaagaaatcatggagtataaagagcaaattaaacaacacgcccaaactattgtcagcctggaagagaaactgcagaaggtcacccaacaccataaaaaaattgagggggagattgccactctgaaggacaatgatcccgctccaaaagaggagagaccgcaggacccactcgtggcccctatgaccgaatcttctgccaaagatatggcctatgagcacttgattgacgacctcctagcggctcagaaagaaatactatcccagcaggaggttataatgaagctaagaaaggacctgacagaggctcatagccgaatgtcagatcttcgaggcgagctgaatgagaaacaaaagatggagctggaacagaacgtcgtactagtgcaacagcagagtaaggaactgtccgtgcttaaggaaaagatggcgcagatgtcttcattagtcgaaaagaaagatagggagttaaaagcgttagaggaagcgctccgcgcttcacaagagaagcacagactccagctgaatacagagaaggaacagaagcccagaaagaaaactcagacctgcgacacttccgtgcaaattgagcccgtgcacacggaagccttttcctcctcacaagagcaacagagcttctccgatttgggcgtgcgatgtaagggatctcgtcatgaggaggttatacagagacagaagaaggccttgtccgagctgcgcgctaggatcaaggagttagagaaggccaggagccctgaccacaaggaccaccagaatgagtctttcctcgacctgaaaaatcttcgcatggaaaacaatgttcagaagatcctgctggacgccaagccagatttgcctaccttgtctcggattgaaatcttagctccccaaaatggcctatgcaatgccagatttggtagtgccatggaaaaatcgggcaagatggatgttgccgaggcgctggagctctctgagaagttgtatctggacatgtccaagaccctggggagccttatgaatataaagaatatgtccggtcacgtgtctatgaaatacctttccaggcaagaaagagaaaaagtgaaccaactaaggcagcgggaccttgacctagtgtttgataaaatcactcaactgaagaaccagctcgggaggaaggaagaactgctccgtggctacgagaaagacgtcgaacaactaaggcgctccaaggtgagtatcgagatgtaccagagtcaggtggcaaagttagaggacgacatatacaaagaagcagaagaaaaagccctgctcaaggaagccctcgagcggatggaacaccaattgtgtcaagagaaaagaataaatcgtgctatccgtcaacagaaacggagggtgtttgtcgagatggtcaaaaataggatgcaaaattccaattcacaagtcggcacccgcaaagctagcctcaaaatggaccaagagcgggagatgcttcgcaaagagacatcttccaaatcatcacagtccctcttgcattccaaaccatctggtaagtactag

SEQ ID NO: 56473 - DNA, 4239 bp, Artificial Sequence
  Description of Artificial Sequence: Synthetic coding sequence
atgaaagcgtatctgaagagcgcagaagggttcttcgtgctgaataaaagtacaactattggccgacacgaaaactcagacctggtgctccaaagcccggatatcgacaaccaccacgccctgatagagtataatgaggccgagtgttcctttgtactccaggacttcaacagtcgcaatgggacctttgtgaacgagtgtcacattcagaatgtggcagttaagttgatccccggagacatcctcaggttcggaagtgctggacttacttacgagctcgtgattgagaatcctccccctgtaagctttccttggatgcggggtcccgcaccatggcccggtcctcagcccccaagagcaacccagcagcccaaccaggccccaccccctagtcatataccgtttcatcagggcgtacagcctgctccaatgcagagaagctggtctcaggccttcccaagacctacggtggttctgccggctagtcatcgcaggccggtttcagctaataaggagatgttcagttttgttgttgacgatgccaggaagcccccagtaatcaaacaggtctggacaaacgccatgaaactttcggagaaaagtgtggccgagggcattccaggagccgtgccccctgccgaaatttatgtggaggaggacctggcacagcaggataaagatgagatcatattgcttctgggaaaagaagtttcccgattaagcgattatgaaatcgaatccaaatataaagacgtcatcattgccaatctgcaaaacgaggttgcagagctatcccagaaagtgagcgagactacaacctccaggcaaaacgaaaaggaaatcagccaaaaatgccaggtgcttgacgaggatatagatgctaagcagaaagaaatccagtccctgaaatcccaaataagtgccttacagaaagggtactccaaggtcctgtgccagaccctcagcgagcgcaattccgaaatcaccagcttaaaaaatgaaggagagaatctcaaacgggacaacgccataacctctggaatggttagtagtttacaaaaggatattctggccaaggacgagcaggtccaacagttgaaagaggaagtgagccacctcaagtctcagaataaggataaggatcaccagctcgaggcattaggatccagatgtagtgttctcaaagaggaactgaagcaagaggacgcccaccgggagctgagagaggcacaggaaaaggaactgaagctgtgcaaaacacagattcaggacatggaaaaagaaatgaagaaactgagggccgaactgagaaaatcctgtactgagcaaagtgtaattagccggactctccgcgagaaaagcaaagtggaagagaagcttcaagaggactcacgacggaaactgctgcagctgcaggaaatgggaaaccgtgaatctgtgatcaagattaacctggagcgcgcagtggggcaactcgaacatttccgttctcaggtcatcaaggcgacatacggcagagccaaaccatttagagataagcccgtaactgaccagcagctcattgagaagatcacacaggtcaccgaagacaacatcaactttcagcagaagaagtggaccctgcagaaggagacgcagttatctaattccaagcaggaggaaactaccgagaacatcgagaagctgaggacatccctagacagctgccaagcgtgcatgaagataagctgctgctcacatgatctcaagaaagaggtcgatctgctccaacatctgcaggtcagtccacctgttagcgggttacaaaaagttgtgctagatgtcctcaggcatgcgttatcctggctggaagaagtggaacagctcctgcgggatctcggcattctacccagctcacctaacaaggaccaggtgcagcagtttagcggaaatagtgcagtattcactgcagggaaggccgctggcgcatccggcagagaaggtgaggcggagcgcggagaagctcgcgcaaggggcgaggcccagtcccagaaccaagcaaccgacggcagagagggcggaaaggcactagaagagtatataacccaagagagaaatcgagcaaaggagactctggaagaagaacggaagcggatgcaagagctagagtcactgctggctcagcaaaaaaaggctctggctaagagcataacacaggagaaaaacagggtcaaggaggctctggaagaggaacagacccgggtgcaggagctcgaggagagacttgctaggcagaaagaagtgctagaatcttccattgcccacgagaaaagaaaagctaaagaggcccttgagtctgagaagagaaaagtgcaggatctggaaaatcaccttacacagcagaaagagatcagcgaatcgaatatcgcatacgaaaagaggaaggcgaaggaagccatggaaaaagaaaagaagaaagtccaggatcttgaaaatcggctgacgaagcaaaaagaagagcttgaactgaaagaacagaaagaagacgtattgaacaataagctgtctgatgccttagccatggtagaagaaacccagaagaccaaagcaaccgaaagccttaaggccgagtcgttagcactgaagctgaatgagaccctggccgagctggagaccaccaagaccaagatgatcatggtcgaagaacgcctaattctccagcagaagatggtgaaggccctccaagacgaacaggaaagccaaaggcacggctttgaggaggagatcatggagtacaaagaacagataaaacagcacgcccagaccatagtgtccctagaagaaaagctacagaaagtcacacagcatcataagaagattgaaggggagattgccaccctcaaagataatgatccagcaccgaaggaggaaaggccccaagacccactcgtcgcaccaatgacagagtcttctgccaaggatatggcgtacgagcatctgatcgacgacctcctggctgcccagaaggagattctcagtcagcaggaggttattatgaagttaaggaaggacctgactgaggcccacagccggatgagtgatctacgaggggagctgaacgagaagcagaagatggagctcgagcaaaatgtggtgcttgtgcagcaacaaagtaaggagttaagcgtcctgaaagaaaagatggctcagatgtcatccttggtggaaaaaaaagaccgagagctgaaggccctggaggaagcacttcgtgctagccaggaaaagcataggcttcagctcaatacagagaaagaacaaaagcccaggaaaaagacacaaacctgcgacacctctgtgcagatcgagccggtccacacagaggctttctcatcatcacaggagcaacaatccttttcagatctgggggtccgctgcaaaggtagccgccatgaagaggtgatccagaggcaaaaaaaagccttgtccgagcttcgtgccagaattaaggagttggaaaaggccaggtctcccgatcataaagatcaccaaaatgagtcctttttggatctaaaaaacctgaggatggaaaataatgtgcagaagattctgctggacgcgaagcctgatctgccaacgctgtcccgtatagagatcctcgcaccccagaacggtttgtgtaacgcgaggtttggcagcgccatggaaaagtccgggaagatggacgttgcagaagccctggagctgtctgagaaattatacctagacatgtcgaagacgctgggttctcttatgaatataaagaacatgagcggccatgtcagtatgaaatatctgtcccgtcaggaacgcgaaaaggtcaaccagcttcggcagagggatctggatcttgtctttgataaaatcacccaattgaaaaatcagctgggtcggaaggaagaactcctccggggatatgaaaaggacgtggaacagctgcggagatccaaagtaagtatagaaatgtaccagtcccaggttgctaaattggaggacgatatctacaaggaggccgaagagaaggcccttcttaaagaagcactggagcgcatggaacaccagctttgtcaggagaaaagaattaaccgggcaatcaggcaacaaaaagtgggcactaggaaagccagtttaaagatggatcaggagcgtgagatgctccgaaaagagacctcctcaaagagttcccagtccctgcttcattccaaaccgagcgggaagtattag

SEQ ID NO: 56474 - DNA, 4362 bp, Artificial Sequence
  Description of Artificial Sequence: Synthetic coding sequence
atgaaggcttacttgaaatcagcggagggattttttgttctcaataagagtacgaccatcgggcgtcatgaaaatagcgacctggtgctacagtccccggacatcgacaatcatcatgctcttatcgagtacaacgaagctgaatgtagctttgttctccaagactttaattcccgtaacggtactttcgtaaacgagtgtcacattcagaatgtcgcagtgaagctcattcctggcgatattctgaggttcgggtccgcaggattaacttatgagttggtcatcgagaatccgccacccgtgtcttttccttggatgcggggtcctgctccttggccgggaccgcagccaccccgagcaacccagcaaccaaaccaagctcctccacctagtcatatccccttccaccagggcgtgcagcccgcacccatgcagaggtcctggagtcaggcgttccccagacccactgtggtcttacccgctagtcatcgcaggcctgtgtctgccaataaggaaatgtttagctttgtcgttgacgacgccaggaagcctcctgtgatcaaacaggtttggactaatgcgatgaagctaagtgaaaagagtgtggctgaaggaatcccgggtgcagtgccacccgctgagatctacgttgaagaggacctggctcaacaggacaaggatgaaattatactactgctgggcaaagaagtctcccggctgagcgattacgaaatcgaaagtaaatacaaggacgtgatcatcgccaatctgcagaacgaggtcgctgaactgtctcaaaaagtgagtgagactaccacttccagacaaaatgagaaggaaatctctcaaaaatgtcaagttctggacgaggatatcgatgccaagcaaaaagaaatccagtcgctgaagtcacagatatcagctctgcagaaagggtactctaaggtgttatgccagactctgagcgagcgcaactctgaaattacttcgcttaaaaacgagggcgagaacctgaaacgcgacaacgctatcacaagcggaatggtgtcctctttacagaaggacatcctggccaaggatgagcaggtgcaacagctcaaggaagaagtatcccacctgaagtctcaaaataaggataaggaccaccaactggaggcattaggctccagatgctcagtgctgaaggaagagctcaagcaagaggatgcacatagggaactcagagaagcccaagagaaagaactcaagctgtgtaagactcaaattcaagacatggagaaagagatgaaaaagttgcgagcggagctcaggaagtcttgcacggaacagagtgttatttccaggactcttagagagaagtctaaagtcgaagagaagcttcaggaggactctcgcaggaaactgctccaactgcaggagatgggtaaccgcgaatctgtgattaaaatcaatctcgagcgcgcagttggacagttagaacattttagatcacaggtaataaaggcaacgtacggccgtgccaaacccttccgcgataagccagtgaccgatcagcagcttatcgagaaaatcacgcaggtcaccgaagacaatatcaattttcaacagaaaaaatggactctccagaaggaaacccagctgtccaacagcaagcaggaggagactacagaaaacatcgaaaagctgcgaacgagtcttgacagctgccaggcgtgcatgaagatttcttgttgttcccacgatctgaaaaaagaagtggacttgcttcagcacctgcaggtctctccacctgtttccggcctgcaaaaagtggtgctggatgtgttgcggcatgcactgtcctggcttgaggaggttgagcaactgctgagggatctagggatcctgcccagttcaccaaataaagatcaggtccagcagttttccggaaacagtgccgtgttcactgctggaaaagcagccggtgcgtcaggaagagagggagaggccgaacgaggcgaagcaagagcaagaggtgaggcccaatcgcaaaaccaggcaacagacgggcgtgagggcggaaaagctttggaagagtacatcacccaggaaagaaatcgggcaaaagagactctggaagaggagagaaagcgtatgcaagagctggagagcttgcttgcccaacagaagaaagccctggctaagtcaatcacacaggagaagaaccgagtaaaggaagccctcgaagaggagcaaactagggtacaggagttggaagaacgcttggctcgccagaaagaggtgctggagagttctatcgcccatgaaaaaagaaaagccaaggaggctctcgagtctgagaaaaggaaagtgcaggacctggaaaaccacttgacgcagcagaaggaaatttcagagtcaaacatcgcctatgaaaaaagaaaggcaaaggaagccatggaaaaggagaagaaaaaggtgcaggatctggagaaccggctaacaaaacagaaagaggagctggagctgaaagagcaaaaagaggatgtgctgaacaataagttatcggacgctctggccatggtggaggagacacagaaaacaaaagctaccgaaagcctcaaagctgaatccctggcattaaaactcaatgagaccttggccgaactggaaacaactaagacaaaaatgatcatggtcgaagagcgtctcattctgcaacagaagatggtcaaggcgcttcaggatgagcaggaatcacagagacatgggtttgaggaagaaattatggaatacaaggaacaaataaaacaacacgcccaaacaattgtgtccttagaagagaaacttcagaaagttacgcagcatcataagaaaattgagggagagattgccaccttgaaggataacgatcccgctcccaaggaggaacgtcctcaggacccactcgttgcgcctatgaccgaatcgtctgccaaggacatggcgtacgaacacctcatagacgacctcctggctgctcagaaagaaattcttagccaacaggaggtaataatgaagctccgaaaagatcttactgaagcccattcgagaatgagtgatttaaggggtgagttaaacgagaaacagaaaatggaattagaacagaatgtagtgctggtgcagcaacaaagcaaggaactctctgtgctcaaggagaagatggctcagatgagcagcttggtcgagaaaaaagacagggagcttaaggcacttgaagaggccctgcgagcttcccaggagaagcatcgcctgcaacttaatactgagaaggagcagaagcctaggaaaaagacccagacgtgtgacacatctgtgcaaatcgaaccagtgcataccgaggccttcagctcaagtcaggagcaacagtcattctccgatttgggcgttaggtgtaaaggaagtcggcacgaggaagtcatccagaggcagaagaaggcactatcagaactacgggctcgaattaaagagctggagaaggcgaggagccctgaccacaaggatcaccagaacgaatctttcctcgatctgaaaaacttacgaatggaaaacaacgttcagaagatcctgctggacgctaaacccgatctcccaactttatccaggatcgaaatcctcgcaccccagaacggcctctgcaacgcaagattcggctctgccatggaaaaatctgggaaaatggacgttgcggaggctctcgaattgtctgagaaactttacttggacatgtccaaaacacttggctccctgatgaacatcaagaatatgagtggccacgtcagcatgaagtatctatcgcgacaggagcgtgaaaaggtgaatcagctgagacagcgcgatttggacctggtctttgataaaatcactcagctgaaaaatcagctgggtcgaaaagaggagttgttgcggggatacgaaaaggacgtggagcagctgcggagatccaaggtctctatcgaaatgtatcagtcacaagttgcaaagctggaagatgatatttataaggaagcagaagagaaagcgctgttgaaggaagctctggaacggatggagcaccagctatgccaggagaaacgcattaatcgggcaattagacaacagaaaatgcgcaagttgaggctgcgggaacttagaggggcacaggtccacactgctgccggtaaagattcatgggacctgacccccgacccctccgacccagggtcaccagcggtatgccgtgtgggacgtaaatgcagaggagcccgtaccgaaaagcggaagcgcatcgacacattacagctctgcttgcagcgcgaacggcaggctgggccagcaccccctgcctgcagcctaaacgggtag

SEQ ID NO: 56475 - DNA, 951 bp, Artificial Sequence
  Description of Artificial Sequence: Synthetic coding sequence
atgattctgcgccctcccagaccttgcggcactatcagcgctctgcagaagggatattcaaaagtgctgtgtcagaccctcagcgagagaaatagtgaaatcacatcactcaagaacgagggggagaacctgaaacgtgacaacgccattacgagtggcatggttagctccctacagaaagatatcttagcaaaggacgagcaggtgcagcagcttaaagaagaggttagtcatctaaagtcacagaacaaagataaagatcaccagctggaggccttgggttcccggtgttccgtgctcaaagaggaactcaaacaggaggatgcacaccgagaattgagagaggctcaggaaaaagaactaaaactgtgcaaaacacaaatccaggacatggaaaaagagatgaagaagctgagggcagagctgcggaagagttgtacggaacagagcgtaataagcaggaccctgcgggaaaaatcgaagcttgagcattttaggagccaagtgattaaggcaacgtacgggagggccaagccgttccgggacaagcccgtgactgaccagcagttaatcgagaaaatcacacaggtgaccgaggacaacattaactttcagcagaagaaatggaccttgcagaaagagacacaactctcaaacagcaagcaagaggagactacggagaatattgaaaagttaaggacatcattagactcatgccaagcctgtatgaagatatcatgctgttctcacgatctgaagaaagaggtcgacttactccagcacctccaggtctcaccaccagtttccggcctgcagaaagttgtcctggacgtcctgcggcatgccctctcctggctcgaggaggtagaacagctcttacgggatttgggaattttacctagctcccccaataaaggctattgggactttttcagtcacatggtcgcctag

SEQ ID NO: 56476 - DNA, 4131 bp, Artificial Sequence
  Description of Artificial Sequence: Synthetic coding sequence
atgaaggcctatctgaaaagcgctgaggggttcttcgtcctcaacaagagcaccacaatcgggcgacacgaaaattctgatctcgttcttcagagtccagacatcgacaaccaccacgcccttattgagtataacgaggcagaatgcagtttcgtgttgcaggattttaattcccgcaacggtaccttcgtgaacgaatgccacatccaaaacgtcgccgtgaagttgatccccggagacatcctcagattcggcagcgctgggttgacttatgaattggtcatcgaaaatcctcccccagtctctttcccatggatgcgaggccctgctccttggcctgggccacaacctccacgtgccactcaacagcccaaccaagcaccaccacccagccacattcctttccatcaaggggtgcaaccagccccaatgcagaggtcatggtctcaggccttcccaaggccaacggtggtgctgcctgcctctcacagacggccagtttccgccaacaaggagatgttttcctttgtcgtggatgatgcgagaaagccaccggtgattaagcaggtatggaccaatgccatgaagctgagtgaaaagtcggtggccgaaggtatacccggtgctgtgcccccagccgaaatatatgtggaggaggatttggctcagcaggacaaggacgagatcatcctcttgctgggcaaggaggtatctcgcttgtccgattatgagattgagtccaagtacaaagatgtgattattgccaacctacagaacgaagtggccgaactgtcacagaaagttagcgaaactactactagtaggcaaaacgagaaggaaatttctcagaagtgtcaggttctggatgaagacattgatgcaaagcagaaagaaattcagtccctgaagtcacagatctcagccctccagaaaggttactctaaggtattgtgccagaccctttcggagcggaattcagagatcacgtctctaaagaatgaaggggagaacctgaagagggacaatgccattacgagtggcatggtaagttctctgcagaaggatatcctcgccaaggacgagcaagttcaacagctgaaggaagaggtgtcccacctaaagtcacagaacaaggataaggaccaccagcttgaagcactgggtagtcgatgttccgtgcttaaggaggagctcaagcaggaggatgcccatagagaacttcgggaggcacaagaaaaagagctgaagctgtgcaaaacgcagatccaggatatggaaaaggaaatgaaaaagctgcgggcagaactccggaaatcttgcaccgagcaaagcgttatttctcgaacgcttagagaaaaatccaaggtggaggaaaaattgcaagaggattccagaagaaagctacttcagctccaggaaatgggcaatagagagagcgtcatcaagatcaatctcgagcgggctgtggggcagctggagcactttaggtcccaggtaattaaggccacatatgggagagcaaagccctttcgcgacaaacctgttaccgaccagcagctcatagaaaaaatcacgcaggttaccgaagacaatataaatttccaacaaaaaaagtggaccttgcaaaaagaaacacagttaagcaactcaaaacaggaagagactaccgaaaacatcgagaaattgaggacttcactggatagctgccaggcatgcatgaaaatctcatgctgctctcatgatctgaagaaggaagtggatctgttgcaacatctgcaggtttcaccgccagtgtctgggttacagaaggtcgtccttgatgtcttaagacatgcccttagctggcttgaggaagtcgaacaactgctacgcgacttgggtattctgcctagcagcccaaacaaggatcaggtgcagcaattctcgggcaactctgcggtgttcacagctggaaaagccgctggcgcatccggtcgcgaaggcgaagcagagagaggggaggcacgcgcaaggggcgaagcccagagccagaaccaggccacagacggtcgtgagggcggaaaggcgctagaagaatatattacacaggaaaggaaccgggcaaaagaaacattagaagaggagagaaagaggatgcaggagttggagagcttgctggcacagcagaagaaagccctggctaaaagcatcacccaagagaagaatagggtcaaggaagctcttgaagaggaacagaccagggtccaggaactggaggagcgtctggctcgccagaaagagatcagcgagtctaacatcgcctatgagaagcgcaaggcaaaagaggcaatggagaaagaaaaaaagaaggtccaggatctggagaaccggcttacaaagcagaaggaggagcttgagcttaaagagcagaaggaagatgtcctcaataacaaactatcggatgctcttgccatggtggaagagacccagaagactaaagccaccgagtccctgaaggcggaatcattggcgcttaagctgaacgagaccctagctgaattggagacaacaaaaaccaaaatgataatggttgaggagagactaatacttcaacaaaagatggtgaaagccctccaggacgagcaggagtcacagcggcatgggtttgaggaggagattatggagtacaaggaacaaatcaaacaacacgcccaaactattgttagtctcgaggagaaactgcagaaagtgactcagcaccacaaaaagatagagggagagatcgctacgctgaaagacaacgatccagcccctaaagaggagcggcctcaagaccctctcgtagctcccatgaccgaatcttcggctaaagatatggcgtatgagcatctgatcgatgacctgttggccgctcagaaggaaatcctcagccaacaggaagtgataatgaaactcagaaaggatctgaccgaggcccattctagaatgtccgacctgcgaggtgaattgaacgagaagcaaaaaatggagttggagcagaacgtcgtgctggttcagcagcagtccaaagagttaagcgtcttgaaagagaaaatggctcagatgagctcactagttgaaaaaaaggacagggagctcaaagcactcgaggaagctctgcgtgcttctcaggagaaacataggctgcaattaaacacagagaaagaacaaaaacctaggaaaaaaacccaaacttgcgacacgtctgtccagattgaaccagtgcacactgaggctttttcaagctcacaggagcagcagtcgttcagtgaccttggggtccgctgcaaagggtccagacatgaggaggtgatccagcgccagaaaaaagcactatccgagctgcgggcacgaatcaaggaattggagaaagcacgatccccagaccataaggaccaccaaaacgagagcttcctggaccttaaaaacctacggatggagaataacgtgcagaaaatcttgctggatgctaaaccggacctacccacccttagccgaatcgagattctggctccccagaacggcttgtgcaatgctcgatttggcagcgctatggagaagtccggcaagatggacgtggctgaggcgcttgaactctctgagaaattgtatctggatatgagcaagactttaggaagcctgatgaacattaagaacatgagtggacatgtgtcaatgaaatacctgtcacggcaggagagggaaaaggtcaatcaactacgtcaaagagaccttgacttggtgtttgataaaatcacccagcttaaaaaccagcttggtagaaaagaggaactgctgcgcggatacgagaaagacgttgaacagcttagaaggtccaaggtttccatcgaaatgtaccaatcgcaggtagccaagttggaggatgatatctacaaagaggcagaagaaaaggccctcttgaaggaagctttggagcgaatggagcaccaactctgccaggaaaagagaattaaccgggcaatccgacagcagaaggtggggactcgcaaggcctcattaaaaatggaccaggaacgggaaatgttgcggaaagaaaccagctctaagagctctcagtcactgctccatagtaagccctctggaaagtactag

SEQ ID NO: 56477 - DNA, 1656 bp, Artificial Sequence
  Description of Artificial Sequence: Synthetic coding sequence
atgagctggggtaccgagctgtgggaccagtttgattcactggacaagcacacccaatggggcattgatttcctggagaggtacgcaaagtttgtcaaggagcgtatagaaatcgagcagaattacgcaaagcagctgcgcaacctcgtgaaaaagtattgtcccaagaggagcagtaaagacgaggaacccagattcacaagctgcgttgctttttttaacattctaaacgaactcaatgactacgcaggccagcgcgaggtcgttgccgaagagatggcgcatcgggtctacggcgaacttatgcgatatgcacatgaccttaaaactgagcgtaagatgcatctgcaggagggcaggaaagcgcagcagtacctagatatgtgctggaaacagatggataacagtaagaagaagtttgaacgagagtgcagggaagccgagaaagcccaacagtcttacgagagactggataacgatacgaatgcaacaaaagccgacgttgagaaagccaagcagcagctgaacctgcgtacgcacatggccgatgagaataaaaatgaatatgcggcacaattacagaattttaacggcgaacaacacaagcacttctacgtcgtgatcccgcaaatctacaaacagctgcaggaaatggacgagcggaggacgattaagctttcagagtgttaccgtgggtttgctgattcggaacggaaggtcatccccataattagtaaatgcttggagggaatgatcctggctgcgaaatcagtcgacgaaagaagggatagccagatggtggtggactcttttaagagcgggtttgaaccccctggagatttccctttcgaggattacagccagcacatatacaggaccatttcagatggcactatttcggcaagtaagcaagaatccggaaaaatggacgccaagaccacagtgggaaaggcgaaaggcaaactgtggctgtttgggaaaaagcctaaagggcctgcattagaagacttcagtcacttacctcctgagcaaagacgcaagaagctccagcagaggattgacgagttgaatagagagctgcagaaagagtctgatcagaaggatgcgttgaataaaatgaaagatgtctacgagaagaatccccaaatgggggaccccggttctctccagcccaagctcgctgagaccatgaataacattgaccgcctccgaatggagatccataagaacgaggcctggctttctgaggttgaggggaaaaccggtggcaggggagaccgacgccacagctcggacatcaatcaccttgtgactcagggccgtgagagtccggaaggtagttatactgacgatgccaatcaagaggttagggggccacctcagcagcacggacaccacaacgaatttgatgacgaatttgaagacgacgatccattaccggctatcggtcattgtaaggctatctaccctttcgacggccataatgagggaacactcgcaatgaaggagggagaggttctttatattattgaggaggataagggcgacggatggaccagagcaagaaggcagaacggagaggaggggtacgttcccacctcctatattgacgtgactctggagaaaaactcaaaaggcgcagtgacatatatctag

SEQ ID NO: 56478 - DNA, 1818 bp, Artificial Sequence
  Description of Artificial Sequence: Synthetic coding sequence
atgtcttggggaaccgagctatgggatcaattcgattccctcgataagcatacacagtgggggatagactttctagaacggtatgccaagttcgttaaggaaaggattgaaatcgaacaaaattacgctaagcagctccgtaacctggtaaaaaagtattgtcccaagcgctctagcaaggacgaggagcctcgtttcacctcatgcgtggcctttttcaatattctgaacgaactcaatgattacgctggacagcgagaagtcgtagcagaggagatggcccaccgggtgtatggggagcttatgaggtacgcacacgatctcaaaaccgagcggaagatgcacctgcaggaaggcaggaaggcacagcagtacctcgatatgtgctggaaacagatggacaactccaagaagaaatttgagagagagtgccgggaggctgaaaaggctcaacagagttacgagaggttggacaacgacacaaacgccaccaaggccgatgtggaaaaagccaagcaacagctgaatctgcgcactcatatggctgatgagaacaagaatgaatacgccgcacaactgcaaaatttcaatggggagcagcataaacatttctacgtagtgatcccgcagatctataaacagcttcaagaaatggacgaaaggcgcaccatcaaactttctgaatgttataggggattcgctgactctgagagaaaagtgatccccattataagcaaatgcctggaaggcatgattctggccgcaaaaagcgtcgacgaacgccgtgactcccagatggtggtggattcgttcaaatctggatttgagccccctggggattttcccttcgaggactactcacagcacatatatcggaccatctccgatggcactatttctgcatccaaacaagagtctggcaagatggacgccaagacaacagtggggaaggctaaaggaaagttatggctctttggcaaaaaacctaaacctcagagcccgccactgaccccaaccagcctgtttactagttccactcccaacggatcacagttcctcacatttagcattgagccagttcactattgtatgaacgagataaagacaggcaaaccacgcattcctagttttcgcagcctcaagagggggtggagcgtcaagatgggccctgcgctggaggactttagtcatcttcctccagagcagagacgcaagaaactccagcagagaatcgacgagttgaatagagagctgcagaaagagagtgatcagaaggacgccctgaataaaatgaaggatgtttacgaaaaaaacccacagatgggcgatcccggatctctgcagccgaagctcgctgaaaccatgaataacatcgatcggttacgaatggagatccataaaaatgaagcgtggctttccgaggtggaggggaaaacagggggacggggagatcgacggcactcgtcagatattaaccatctcgtcacacagggcagggagtccccagagggctcctatacggatgacgcaaaccaagaggtccggggacctcctcagcaacatgggcatcataatgagtttgatgatgaatttgaggacgacgatcccctccctgctatagggcattgcaaggcaatctaccctttcgatgggcacaacgaaggtactctcgccatgaaggagggagaggtgttgtacattatagaagaagataagggcgatgggtggactagagcacgcaggcagaacggggaagagggatatgtgccaaccagctatatcgacgtgacactggagaaaaattctaaaggcagttag

SEQ ID NO: 56479 - DNA, 1815 bp, Artificial Sequence
  Description of Artificial Sequence: Synthetic coding sequence
atgtcctggggcacagagttatgggaccagttcgactcccttgataaacacacgcagtggggcatcgattttctcgaacgttatgccaagtttgtgaaagagcggattgagatcgagcagaactacgcgaaacagctccggaatctggtgaaaaagtattgtcccaaaaggtcatccaaggatgaggagcctcgtttcacaagctgtgtcgctttctttaacatcctcaacgagctcaacgactatgcgggacagcgagaagtagttgcagaggaaatggctcatcgcgtttacggtgagttgatgcgctacgctcatgacctaaagacagaaaggaagatgcatctgcaggaaggaagaaaggcgcagcaatacctagacatgtgctggaagcaaatggataattccaaaaaaaagttcgaaagggagtgtagggaagccgagaaagcacagcagtcgtacgagagacttgataatgacactaacgcaacgaaagcagatgtggagaaggctaaacagcagctgaatcttcgcacacatatggcggacgagaacaagaatgagtatgccgcacagctgcagaattttaacggcgaacagcacaaacacttttacgtggtgatcccacaaatctacaagcagctccaggagatggatgagcggagaactatcaaactgtctgaatgctatagggggttcgccgattctgagcgcaaagtgatccccataatatcaaaatgtctggagggaatgatcctcgcggctaagagtgtggacgaaaggcgtgattctcagatggtggtcgactcgtttaaatccggttttgaaccccctggggatttcccatttgaagactatagccagcacatctaccgcaccatttcagatggaacaatctccgcgagcaagcaggagagtggcaaaatggatgccaagaccaccgttgggaaggccaaggggaaactctggctattcggcaagaagccgaagcctcagagccctccgttgacccccacatccttgtttacctcttcaacgcccaacggtagccagtttctcacattctcgatagagcctgtgcactattgtatgaacgaaattaagacaggtaagccacgcatacccagcttccgatcattaaagcggggaggacctgccctggaagatttttcacacctccccccagaacagcggaggaaaaaactccagcagaggattgatgagctgaatcgtgaacttcagaaggagagcgaccagaaggatgccctgaataagatgaaagacgtgtacgagaagaatccacaaatgggtgatccaggttcgctccagcctaagttagctgagacaatgaacaatatagacagactcagaatggagatccataagaacgaggcatggctttcagaggtggaaggaaagaccggaggtcgtggcgacaggcggcattctagcgacatcaatcaccttgttacccaaggtcgagagtccccagaaggatcatacaccgatgatgcgaatcaggaggttagggggccaccccagcagcatggacaccacaacgagttcgacgacgaatttgaggatgatgatcccctgcccgctatcggccattgcaaggccatttatccatttgacggccataatgagggaacactggccatgaaggaaggggaggtgctgtacatcatagaggaagacaaaggggacggctggacgcgggcacgtagacaaaatggcgaggagggctatgtgcccacctcatatatcgacgtcaccctagaaaaaaactcaaagggggctgtgacttatatctag

SEQ ID NO: 56480 - DNA, 1803 bp, Artificial Sequence
  Description of Artificial Sequence: Synthetic coding sequence
atgtcatggggtaccgaattgtgggaccagtttgattcgttagataagcatacccaatgggggatcgatttcttagaacgatacgccaaatttgtgaaggaacgaattgagatcgagcagaactatgcaaagcagctgcgtaatctggtgaaaaagtactgccctaagaggagcagcaaggacgaggaaccccgattcacgagctgcgtggctttttttaatattctcaatgagttgaacgactacgccggacagcgtgaggttgtcgctgaggagatggctcatagagtgtacggggaactgatgcggtacgcccacgacctcaagacggaacgcaagatgcatctgcaggagggcaggaaagcccagcagtacctggatatgtgttggaagcagatggacaacagtaaaaaaaagtttgagcgggagtgtagggaagcagagaaggcccagcagtcttacgagcgccttgataacgatactaatgcgactaaggccgatgtggagaaggccaagcaacagttgaacctgcggacacacatggcggacgagaataagaatgagtatgctgcccagcttcaaaactttaacggggaacagcataagcacttctatgtcgtcatacctcagatttacaaacagctgcaagagatggacgaacggaggacaattaagttaagtgagtgctaccggggttttgcagacagtgaaaggaaggtaattccaataattagtaagtgtctggaaggaatgatcctcgccgcaaagtccgtggatgagagacgcgattcacagatggtagtcgattcgttcaaatctgggttcgagccaccgggagactttccatttgaggattactctcaacatatttatcgcacgatatctgatgggactatttccgcctcaaagcaggaatctggcaagatggacgccaaaacgactgtgggcaaggccaaaggcaagctctggctcttcgggaaaaagccaaaaccgcagtccccacccctgacaccgaccagtctgtttacgtccagcacacccaatggatcccagtttctgaccttttctatcgagcccgtgcattattgtatgaatgagattaagacaggcaagccaagaattccttctttccgctcactgaaacgcggagggcctgccctcgaggacttctcacacctgcccccagagcaacgccgaaagaaactgcagcagcgaattgatgagctgaatagagagctacagaaagagtcagaccaaaaggacgcccttaataagatgaaagatgtttatgagaaaaaccctcagatgggcgatcccggatccctgcagcctaagctcgctgaaaccatgaataacatcgaccgactgcgaatggaaatacacaagaacgaggcctggctttcggaagtggaaggcaaaaccggcggaagaggcgatagacggcacagttccgacataaaccacctggtgactcaaggtagagagagtccggagggaagctataccgacgacgccaatcaggaggtgcggggaccccctcaacagcacgggcaccacaacgagtttgatgatgagtttgaagacgatgaccccctgccagcaattgggcattgtaaggctatttatccgtttgacggccataacgagggcacacttgctatgaaggaaggggaagtgctttacatcatagaagaagataaaggcgacggctggacacgagctcgcagacaaaatggggaagaaggatatgtgcccaccagctacatcgacgtgactctcgaaaagaactccaagggcagctag

SEQ ID NO: 56481 - DNA, 1257 bp, Artificial Sequence
  Description of Artificial Sequence: Synthetic coding sequence
gacaattccaagaaaaagttcgaaagagagtgccgcgaggccgagaaagcacagcagtcttacgaaaggctggataacgacaccaacgccacaaaggccgatgtggaaaaggcaaaacagcaattaaacctgagaacccatatggccgacgagaacaagaacgagtacgccgctcaactgcagaactttaatggcgaacagcacaaacacttttacgtggtgatcccacagatttataaacagcttcaggaaatggacgagaggagaacaattaagctttctgaatgctatcggggtttcgctgactccgaacgcaaggttatacctatcatcagtaaatgtctggaaggcatgattcttgccgctaagtcagttgatgagaggagggatagtcagatggtggtggactccttcaaaagcggttttgaacctccaggagactttccctttgaggattactcccaacatatatataggacaatttcagacggtactatcagcgcaagcaaacaggaatccggcaaaatggacgctaaaacaacggtgggtaaggctaaaggtaaactatggctgttcggcaagaaacccaagggaccagccctggaggatttttcacacctcccaccagaacagcgaaggaaaaagctgcagcaaaggatcgacgagctcaaccgggaactccagaaagagagcgaccaaaaggatgcccttaacaaaatgaaagacgtgtatgagaagaacccacagatgggcgatcctggatcgctccagcctaagctcgcagagacgatgaataacatcgatcgacttcgaatggagattcacaagaatgaggcatggcttagcgaagtcgagggaaagacgggaggcagaggcgataggcgccacagctcagatattaaccacttagttactcaaggtcgggaatccccagaggggagctacaccgatgatgcaaaccaagaagtaagaggaccaccccagcagcacgggcaccacaatgagttcgatgatgaattcgaagacgatgatcctttgccagccattggccattgtaaggccatatatccatttgatggccataacgaaggcactctggccatgaaagagggagaggtgttgtatatcattgaggaagacaaaggcgacggctggacgagagccaggcggcaaaacggtgaagaggggtacgttcctacatcttatattgatgtgaccctcgaaaagaactctaagggtgccgtgacttacatttag

SEQ ID NO: 56482 - DNA, 747 bp, Artificial Sequence
  Description of Artificial Sequence: Synthetic coding sequence
atggacgctaagactacagttggcaaggctaaaggcaagctttggttgtttggaaaaaaaccaaagcctcagagccctcccctgactcccacctctctgttcactagttctacacctaatggtagtcagtttcttacgttctccattgagcccgtccattactgcatgaacgaaataaaaacgggtaaaccaaggattcccagtttccgatcactcaagaggggctggagcgtgaagatgggacctgccctggaagactttagtcatttaccaccggaacagcgacggaaaaagcttcaacaaagaattgatgagttaaacagagagctgcagaaagagagtgaccagaaggatgctctcaacaaaatgaaggatgtctacgaaaagaatcctcagatgggtgatccaggcagtctccagccaaagttggccgagaccatgaataatatagatcggttgcggatggaaattcataagaacgaggcgtggctgagcgaggttgaaggcaaaactggaggccgaggagatcggagacacagcagcgatatcaatcacttggttacacaagggagagagagccctgaggggtcttacactgatgacgctaatcaggaggtacgcggacctcctcaacagcatggccaccacaacgagttcgatgatgagtttgaagacgacgacccccttccagcaatcgggcactgtaaggctatctatcctctgatggatataatgaaagtactttag

SEQ ID NO: 56483 - DNA, 3054 bp, Artificial Sequence
  Description of Artificial Sequence: Synthetic coding sequence
atgggaaaaaagtctagagccgttccgggacggaggcccattcttcagctgagtcctcccggacccagggggagtactcccggacgagaccccgaacccgaaccagacaccgagcctgattctaccgcagcagtgccatcacagcccgcaccttccgccgctacaaccacaaccacagccgtcaccgctgcagcggcatctgacgacagcccatctgaagatgagcaggaggctgttcaggaagttccaagagtggtccagaatccacccaaaccagtgatgactacacgccctaccgccgtcaaagccaccggcggtttatgtctgctcggtgcttacgccgacagtgatgatgatgataacgatgtttcagaaaagctagctcagagcaaggaaacaaacggcaatcagtctacagatattgatagcactctggccaacttcttggccgaaatcgatgcaatcaccgctcctcaacccgctgctccggttggtgcttcagcgccacctcccactccccctagacccgagcctaaggaggcggcaacttcaaccctttctagttctacatctaacggcacagactccacccagacctccggctggcagtatgatactcagtgttcgctcgctggggttggaatagagatgggagactggcaggaggtctgggacgagaacactgggtgttactactattggaatacccagaccaatgaagtgacttgggaacttccacagtacttagcaacacaggtccagggcctacagcactatcagccctcaagtgtgccaggcgctgaaacctccttcgtagtgaatacggatatctatagcaaggaaaagaccatttcagtctcaagttctaagtccggacccgtcattgccaaacgggaggtaaagaaagaggtgaatgagggcatacaggccctgagtaactctgaggaggaaaaaaagggggtcgcagcctcattgctcgcacctctgctccccgaagggatcaaggaagaggaggagcgctggagaaggaaagttatatgcaaggaagagccggtttcagaggtgaaggagacgagcacaaccgtcgaagaggctacaactatcgtgaagccacaagaaatcatgctcgataacattgaagacccttcccaagaggatttatgcagcgtggtgcagtcgggcgaaagtgaagaggaggaggaacaagacaccctggaactggagctggtattggagcggaagaaggccgaattacgggcattagaagagggagacggaagtgtgagcggctcctcacccaggtctgacatctcccagcccgcatcccaggacggcatgcggcgtctcatgagcaagcgtggcaaatggaagatgttcgtaagggccacgagcccggaatctacatcccgctcaagctccaaaacaggaagggacaccccagagaacggagagacagctatcggtgctgaaaacagcgaaaaaatcgatgaaaattcagacaaggaaatggaggtagaggagtccccagagaagattaaagtccagactacgcccaaagtagaagaagagcaagatcttaaattccagattggagaactggctaatacccttacctccaagttcgagtttttgggtatcaaccgccagtcaatctctaatttccacgtgctgctgcttcagaccgagacaagaatagcagattggcgagaaggggctcttaacggcaactaccttaaacggaaacttcaggacgctgctgaacagcttaaacaatacgaaatcaatgctacacctaagggatggtcctgccattgggatagggatcaccgaagatacttctacgtcaacgagcagagtggcgagagtcagtgggaatttcctgatggcgaagaagaggaggaggaatcacaggcccaagagaacagagatgagactctggcaaaacaaactttaaaagacaagactggaactgacagtaattctacagagagttccgagacatccacaggcagcctgtgtaaggagtcgttctctggccaggtgtctagcagcagcctcatgccactgacaccgttctggacactgttgcagagtaatgtcccagtactgcagccacctctccccttggagatgcctcctccacctccaccccctcctgagagcccccctccgccacccccacctcctccacctgcagaagacggcgagatccaggaggtggaaatggaggacgagggatctgaggagccccctgcccctggaaccgaagaagacacaccactgaagccatctgcacagacgactgttgtaacaagccagtcctccgttgacagcaccataagttcgagttctagtactaagggaattaaaagaaaagcgaccgagatcagcactgctgtggtacaaaggagcgccaccatcgggtctagcccggtcctgtatagccagtcggccattgcaaccgggcatcaggcggctgggatagggaatcaggccacagggattggccatcaaacaatcccggtctccctaccagctgccggtatggggcaccaagccagagggatgagtctgcagagcaactaccttggcctggcagctgctcctgccattatgtcatacgctgagtgttcggtcccaattggcgtaactgctccgtctctccaaccagttcaggccaggggggcagtccctaccgccaccattatagagcctccccctcctcctccaccccctccaccccctccccctcctgctcctaagatgccccctcccgaaaagacaaaaaagggaaggaaagacaaggccaaaaagtcaaaaaccaagatgccgagcttagtgaaaaaatggcagtccattcaacgcgagctcgacgaggaagacaattctagctctagtgaagaagatagagagtccaccgctcaaaagaggatcgaagaatggaaacaacagcagctcgtttctggcatggcggagcggaatgccaattttgaggccctgcctgaggattggcgtgctcgtctgaaacgccgaaagatggcgccaaacacgtag

SEQ ID NO: 56484 - DNA, 3279 bp, Artificial Sequence
  Description of Artificial Sequence: Synthetic coding sequence
atgggtaatgccggaagtatggactcacagcagacagattttcgagcacacaacgtacccctgaaactgcctatgcctgagccaggggagttggaggagcgatttgctattgtgctgaacgccatgaatctgccgcctgataaggcaaggctgctcaggcagtacgataacgagaagaagtgggaattgatctgcgaccaagagcggtttcaggtgaaaaatcccccacatacatacatacagaaactcaaaggctaccttgaccctgctgtcacacggaagaaatttaggcggcgagtgcaggagagtacacaagtcctgagagaactggaaatctccctcagaacgaaccacataggatgggttcgcgaatttttgaacgaagaaaacaaagggttggatgtcttagtggagtatctgagtttcgcgcaatacgcagtaactttcgatttcgagtctgtggaaagtactgtcgagagctcggtggacaagagtaagccctggtcgagaagcattgaggatctgcaccgagggtctaatcttcccagcccagtgggcaactctgtctcacgctccgggcgacattccgccttacgttacaataccctgccgagcaggcggaccttaaaaaatagccggttagtctccaagaaagacgacgtccacgtgtgcattatgtgtctcagggccattatgaactatcaatacggctttaacatggtgatgtcccatccccatgcagtgaacgaaatagccctgtccttaaataacaaaaacccccgaaccaaagcactcgtgctggagcttcttgccgctgtgtgccttgtcagaggaggtcacgaaatcatcctctcagcttttgacaattttaaagaagtatgtggcgagaagcagcgctttgagaagttaatggagcatttcaggaacgaggataataacattgatttcatggtggcaagcatgcagttcattaatattgtggttcattctgttgaagacatgaatttcagggtccatcttcagtacgagttcacaaagcttgggttggacgagtatctggacaaattgaaacatacggagagtgataagcttcaggtgcaaattcaggcatacttggacaatgtttttgacgttggcgctctgctggaggacgccgaaacgaagaacgcagctcttgaaagggtcgaggaactggaggagaacatctctcacctgagcgagaagcttcaagacaccgaaaacgaggccatgtccaagatcgttgaattggaaaaacagctcatgcagcgaaataaggagctcgatgtcgtgcgggagatttataaggatgcaaacacgcaggtccacacactccgaaaaatggtgaaggaaaaggaagaagcaatccagcgccaaagcacactggaaaaaaaaatccacgagcttgagaaacagggtacaattaagattcagaagaagggagacggcgatatagccatcctccccgtagtagcatccggcacactgagcatgggatccgaagtggtggccggtaatagcgtgggccctaccatgggggcagcctcatctggacctttgccacctccaccccctcctcttcccccatcatcagacacccccgagaccgtacagaatgggcctgtcactcccccaatgccaccacccccacccccacctccaccaccgcctcctcctccccctccacctccccctcctccattaccagggcctgctgcagaaacagtgccggcacccccactggcaccgccattgccatctgcaccccctctccctggcacttccagtccaacagtcgtgttcaatagcggtctggcagcagtcaagataaaaaagcccatcaagaccaaattcagaatgcccgtcttcaattgggtggctttgaagcctaaccaaatcaacggaaccgtgtttaacgaaatagatgacgagagaatcctggaggatctgaatgtcgatgaatttgaggagattttcaaaaccaaagctcaggggcctgctatcgatctgtcctcgtccaagcaaaagatacctcagaaaggctccaataaggttaccctgctagaggcaaatcgggcaaaaaacctggcgattaccctgcggaaggcaggcaagaccgcagatgagatttgcaaggccattcacgtgtttgatctaaagactcttccagtggactttgtcgagtgtctcatgcgctttttgcccactgaaaacgaggtgaaagtgcttcggctttacgagagagaacgaaagccccttgaaaatctgtccgacgaagatagattcatgatgcaatttagtaaaatcgaacgacttatgcagaaaatgactattatggcgttcatcggtaactttgccgagtccatacagatgttaacaccccaactgcacgccattatcgccgcttccgtctccataaaatctagtcaaaaactgaaaaagatcctggaaattatcctggcattaggcaattatatgaattcgtcgaagcgaggagccgtttacgggttcaagcttcaatctctggacctgctgttggataccaaatctaccgacagaaaacagacccttttgcactatattagtaacgtcgtgaaagagaagtaccatcaagtgagcttgttttacaatgagctgcactacgtcgaaaaagccgcagcggtgtcactggaaaatgttttgttggacgtgaaagaactgcagcgtggcatggacctcacaaaaagagagtacactatgcatgatcacaataccctgttgaaggagttcattctgaacaatgagggcaagttaaaaaaactccaagacgatgccaagatcgcgcaagatgcatttgacgatgtggtgaaatatttcggtgagaaccccaagaccaccccaccatcggtgttctttccagtgtttgtccgcttcgttaaggcatacaaacaggccgaagaggaaaacgaattgagaaagaagcaggaacaggccctgatggagaagctgctagagcaggaggctttgatggagcaacaagaccccaagtcccccagtcataaaagcaaacgtcaacagcaggagctgatcgctgagttacggagacggcaggtcaaggacaaccggcatgtctacgagggcaaagacggcgctatagaggatattatcacagaccttcggaatcagccctatagaagagctgacgcagtgcggcgttccgtgcggcgacgcttcgacgaccagaatctgcgaagcgtgaatggggcagagatcacgatgtag

SEQ ID NO: 56485 - DNA, 1707 bp, Artificial Sequence
  Description of Artificial Sequence: Synthetic coding sequence
atgggcagtgaggtagtggccggtaactccgtgggcccaaccatgggcgcagcgtccagcggtccgctacccccacctccaccaccattaccgccatcgagcgatacacctgagacggtgcagaatggacccgtgactccccctatgcctccaccacccccacttccagggccagccgctgaaaccgttcctgcccctcctcttgcgccacctctgccctccgctccccctctgcccggaacatcttctcccaccgtagtattcaatagcggacttgccgcagtgaaaatcaagaagcctataaagaccaaattccgcatgccagtgttcaactgggtggctctgaaacctaaccaaataaacggtaccgtgttcaatgaaattgatgacgagaggattttagaggacctaaatgtggatgaatttgaggagatcttcaaaactaaagcccagggccctgccatcgacctgagtagtagcaaacagaaaatacctcaaaaaggctccaacaaagtgaccctactcgaagcaaaccgcgctaagaacctcgccataacactgagaaaggccggtaagaccgcagacgaaatctgtaaagctatccacgtgtttgacctgaaaactctgccagtggattttgtcgagtgcctgatgcggttccttcctaccgaaaatgaggttaaggtgcttcgcctctatgaaagggaacgcaagccactggaaaatctctcggatgaggaccgcttcatgatgcagttttccaaaattgagcggctgatgcagaaaatgacgatcatggcctttatcggtaactttgcagagagcattcagatgttgaccccacaactgcacgccattatcgccgctagcgtgagtatcaagtcctctcagaagctcaagaaaatactggagataatcttggctctaggtaactatatgaatagttccaagcgcggagctgtctacgggtttaaactacagagcttggacctgttgctggatactaaatccaccgacaggaagcagacgctgctgcattacatttctaacgtcgtgaaggaaaaataccaccaggtctccctcttttacaacgagctccactatgtggagaaggcagctgcagtctctctcgagaacgttctgctggatgtgaaggagctgcagagagggatggacctgaccaaacgggaatacacgatgcatgaccacaatacactgctgaaggagttcatccttaacaacgagggaaaactaaagaagctacaggatgacgccaagatcgcacaggacgcttttgacgatgttgtgaaatattttggcgagaaccccaagacaactccaccctccgtttttttcccagtttttgttcgttttgtgaaggcctacaagcaggctgaggaagaaaatgagctgcgtaaaaaacaggaacaggctttgatggagaaattactggagcaagaagccttgatggaacagcaggatccaaaaagtccaagccacaaaagcaagagacagcagcaggaactcatcgcagaattgagaagacggcaggttaaagataatcggcacgtatacgagggcaaagatggcgcaattgaagatattattactgctctgaagaagaataacatcactaagttccctaatgtgcactccagagtgcgaatttcaagtagcactccagttgtagaggatacgcagtcatag

SEQ ID NO: 56486 - DNA, 3087 bp, Artificial Sequence
  Description of Artificial Sequence: Synthetic coding sequence
atgggaaacttggagtctgccgaaggtgtgccaggcgagcccccttccgtgccactgcttctcccacccggtaaaatgcctatgcccgaaccgtgcgaactcgaagagcgatttgccctagtactgtcatctatgaatctacctccggataaggccaggcttcttcggcagtacgataacgagaaaaaatgggaccttatatgcgatcaggaaaggtttcaagtgaaaaatccgcctcatacatacattcagaagctccaaagtttccttgaccccagcgttacccggaagaaatttagaagacgcgtacaggaatcaacaaaagtgttacgagaactggaaatctctcttcggactaaccatattgggtgggtgcgtgaattcttgaacgatgagaataagggattggacgttttagtggattacctctccttcgcccaatgctccgtgatgttcgattttgagggactggaatccggcgacgacggcgcttttgacaagctgaggtcttggagcagaagtattgaagacctgcagccaccttcagccctctcagcacctttcaccaactccctcgcacggtctgccaggcagagcgtactgagatatagcacacttccgggtcgacgggctcttaaaaatagcagattagtgtctcaaaaggatgacgtacacgtttgtattctgtgccttagagccatcatgaattatcagtacggctttaacctggtgatgtcacatcctcacgcggttaacgagattgctctgagtctgaataacaagaatcccaggaccaaggctttagtcctcgaattgctcgctgccgtctgtctggttagaggaggacatgaaatcatcctcgccgctttcgataactttaaggaggtctgtaaggagctccataggtttgagaaactcatggaatatttccgaaatgaggatagtaacattgactttatggtcgcgtgcatgcagtttataaacatcgtggtccactctgttgaggacatgaactttagggtgcaccttcagtatgagttcacaaagttagggttggaagagttcctgcagaaatcgcgccacaccgagagtgagaagctacaagtccagatccaggcctacttggataatgtgttcgacgttgggggactgttagaggatgcagaaaccaaaaacgtggccctcgagaaagtagaggaacttgaggagcatgtgagccatcttacagagaaactactggaccttgaaaacgaaaatatgatgagagtagccgagctggagaaacagctgctgcaacgggaaaaagaactcgagtctatcaaagagacctacgagaatacttcgcaccaagtgcatactctacgtcggctcattaaagaaaaagaagaagcatttcagaggagatgccacctggaacccaatgtgcgcggtctggagtcagttgacagtgaggcccttgcaagagtaggccctgcagaactttctgagggcatgcctccaagtgacttggacttgcttgccccagctcctcccccagaagaggtcctccccctgcctccccctcccgcaccaccccttccaccgccaccacctcccctgccagataaatgccctcctgcaccgcctcttcccggagccgctcccagcgtggtgctgaccgtgggtttgtcagctatcaggatcaagaaaccaatcaagactaaattccgcctgcccgtctttaactggactgccctgaagcctaaccagatctccggaactgtattcagtgagctcgatgacgagaagattctggaggatctggacctcgacaagttcgaagaattattcaagaccaaggctcaaggacctgctttggatctgatctgtagtaaaaataagacagctcagaaggctgcaagcaaggtaactttactcgaagcgaatcgcgctaaaaatctggcaatcaccctgcgaaaggccggtcgttccgctgaagaaatttgccgggctatccacaccttcgatttgcagactctgcctgtggacttcgtggaatgtctaatgcgatttctcccgactgaggctgaggtgaagttactgcggcagtatgaacgtgagcgacaacctctagaggagcttgccgctgaagaccgattcatgcttctgttttccaaagtggaacgactcacccagcgcatggctggaatggcttttcttggtaacttccaggacaacttacagatgcttaccccacaattaaacgcgataatcgcggcatcagcaagcgttaaaagcagtcagaaattaaagcaaatgttggagatcatcctcgccctaggaaattacatgaattcttcgaagcggggagcagtgtacggcttcaaactgcagtccctggatcttctgctggatacgaagagcactgatcggaagatgactctcctgcatttcatcgcactgacagtgaaggagaagtaccctgatctggctaacttttggcacgagctgcatttcgtagagaaggcagcagccgtgtcactggaaaatgtgctactggacgtgaaagagctgggcagaggtatggaacttattcggcgagaatgttccatccacgacaactccgtactgagaaatttcctgtccactaacgagggcaagctcgataagcttcagcgagacgctaaaaccgcggaggaagcctacaacgccgtggtaaggtattttggagagtcccctaaaactaccccccctagcgttttcttccccgtcttcgttaggttcattcgctcatacaaagaagccgagcaggaaaacgaggctcggaaaaagcaggaagaggtcatgcgcgagaaacagctcgcccaagaggctaaaaaattagatgctaaaacacctagtcagaggaataaatggcagcagcaggaactgatcgcagaactgcggaggcggcaagcaaaagaacaccgtcccgtttatgaaggtaaggacggaactatcgaggacattatcacagtgctcaaaagtgttccctttaccgcgcgtaccgccaagcgagggagcagattcttttgcgacgccgctcatcacgacgaatccaattgttag

SEQ ID NO: 56487 - DNA, 3084 bp, Artificial Sequence
  Description of Artificial Sequence: Synthetic coding sequence
atgggcaacctggaaagcgcagagggagtgcccggagagcccccttctgtacctttgctcctgcccccaggcaaaatgcccatgcccgaaccatgtgaattagaagagcggtttgcactggttctctcctccatgaaccttccacccgataaggcacgtttgctgaggcagtatgacaatgaaaaaaagtgggatctgatatgcgatcaggaaagatttcaggtgaaaaatcccccacacacctacatccagaagctgcagagttttctcgatcccagcgtgaccaggaaaaaatttagacgcagagtgcaagaatccacaaaggtcctgcgggagctggagatcagtctgagaacgaatcatatcggttgggtgcgtgaattcctgaacgatgagaacaagggactggacgtgttggtcgattatctcagctttgctcagtgctccgttatgttcgatttcgagggcctggagtccggtgacgacggagctttcgataagctgcgcagctggagccgctctattgaggaccttcagccaccatcagctctctccgcccctttcaccaacagcttggcccgatccgccagacagtcagtcctgagatactcgactttgccgggaaggcgggctcttaagaattctaggctggtgtctcagaaggacgacgtccatgtgtgcattctctgcttgcgcgctatcatgaactaccagtacgggttcaatcttgtaatgtcccatccgcatgctgtgaatgagattgccttgtctctgaacaataagaacccacggactaaggcccttgtcttagagcttctggctgccgtgtgtctggtgcgcggtgggcacgaaataatcctcgcagcatttgataacttcaaggaggtgtgtaaggagctgcatcggtttgagaagctcatggagtatttccggaatgaagactctaacatcgattttatggtcgcctgtatgcagttcataaatattgtggttcacagcgtggaggacatgaactttagggttcacctgcagtatgaattcactaaactgggcctggaagaattcttgcagaaatctcgccacactgagtctgaaaaactgcaggtgcagattcaggcttatctggataacgtctttgacgtgggaggcctgctggaagacgccgaaaccaagaacgtagctctggaaaaggtggaggagttagaagaacacgtttcccatttgaccgagaagctcttagatcttgagaacgagaacatgatgcgcgtcgcagaacttgagaaacaactgctgcaaagagagaaagagctcgagtccattaaggagacctacgagaacacctcgcaccaggttcatacgctacgtcgactgattaaagaaaaggaggaagctttccagcgtagatgccacctggaacccaatgtcaggggactggaaagcgtcgattccgaggctctggcccgtgtagggcctgccgaactttcggaaggtatgcctcctagcgatctggacctgttagcgccagcacctcctccagaggaggtactacccttgcccccacctccagccccacctcttcctcccccacctcctccactgccggataagtgcccacccgctcctcccctgccaggcgctgctcctagcgttgtccttactgtgggactgtccgccattcggatcaaaaagccaataaaaactaagttcaggctccccgtctttaattggaccgccctcaaacccaaccagatatccggcaccgtcttttctgagctcgatgacgaaaagattctggaggacctggatctcgataaattcgaggaattattcaaaactaaggcccagggaccagcactcgatcttatatgttctaaaaataagacagcgcagaaggcagctagcaaagttactctcctggaggccaacagagcaaagaacctcgcaatcacccttcgtaaggctggtaggtccgccgaagagatctgtcgggctatccacacctttgatctccagaccttgcctgtggacttcgtggaatgtctgatgcggtttctgcccactgaagccgaggtaaagctccttcgccagtatgaacgcgaacgacagccacttgaagagttggccgctgaagacagatttatgctgctgttcagcaaagtggagaggctcacacagcggatggcaggaatggcgtttctgggcaatttccaagataacctacagatgctcactccccaactgaacgccatcatagctgcgagcgccagcgtgaaaagcagtcagaaactgaagcagatgttagagattattctggcccttgggaactatatgaacagttctaagcgtggcgcagtttatgggttcaagctccaatccttagatttgctgctggataccaagtctactgaccgaaaaatgactctcctgcactttatcgctctgactgtgaaagaaaagtaccccgacctggcaaatttttggcacgaactgcactttgtcgaaaaagccgcagctgtgtccctcgagaatgtgctgctggatgtaaaagaactcggcaggggtatggagctcatacgtcgggagtgttccattcacgataattcggtgttaagaaactttctcagcacgaatgaaggcaaacttgataagctccagcgagatgccaagactgccgaggaagcatacaatgccgtcgtgagatacttcggtgagagccccaagacaactccccctagcgtattctttcccgtcttcgtgagattcatccggtcctataaggaggcggagcaggaaaacgaggctagaaagaaacaggaagaagttatgcgcgaaaagcaactggcgcaggaggcaaaaaagcttgatgcaaagaccccttcgcagcggaataagtggcagcagcaggagcttatagcagaactgagaaggcgtcaggcgaaggagcatcgccctgtttacgaggggaaggacggaaccattgaagatatcataaccggtttacactgccagcccatggtagtccgccatcaggcacgcagcgcagctccccctagcggaccccctagggcgcctgggcctcattag

SEQ ID NO: 56488 - DNA, 2931 bp, Artificial Sequence
  Description of Artificial Sequence: Synthetic coding sequence
atggggaatctggagagtgccgagggggtacctggtgaacctcctagcgtgcctctccttctgcctccgggaaagatgcccatgccagaaccgtgtgaactggaagaacgatttgctctggtgttgtcctccatgaatctacctccggacaaggctaggcttcttagacagtacgacaacgagaaaaagtgggacttgatttgcgaccaggaacggttccaggttaagaacccaccacacacttatatccagaagctccagtctttcctggacccgtccgtgactaggaaaaaatttaggaggagagtgcaggaatcgaccaaggtgctccgggaattggagatctcactcagaactaaccatatcggatgggtgagggagtttctcaacgacgagaataaaggcctggatgtcttagtggattatctgtcctttgcccagtgctctgtcatgtatagcactctgcccggaaggagagcactcaagaacagccgcttggtgtctcaaaaggatgatgtacacgtttgtatcctgtgtctcagggcaattatgaattaccagtacggcttcaacctggtgatgagtcatccgcatgcagtaaatgagattgccctgtcgctgaacaataaaaacccccgtactaaagcattggtgttagagctgttagccgcagtgtgtctggtacgaggcggacacgaaatcatcctggcggctttcgataattttaaggaagtttgcaaagagctacatcgttttgagaagctcatggagtatttccgcaatgaagactccaatatcgattttatggtggcttgcatgcagttcattaacattgtcgtccactcggttgaggacatgaattttcgggtgcacctgcaatatgagttcacaaagttaggacttgaagaattcttgcagaaaagccggcacactgagtctgagaagttacaggtgcagattcaagcctacctggataacgtttttgacgtcggaggcttgttagaagacgccgagacaaagaacgtggccctggagaaggtggaagagctcgaggaacatgtgagccatctgacagagaagctgcttgaccttgagaatgaaaacatgatgcgagtagctgaactcgaaaaacagctattgcagagagaaaaggagttggagtccattaaggagacgtatgagaacacctcccaccaggtgcacaccctaaggaggctaataaaggaaaaggaggaggccttccagcgcaggtgccatcttgagcccaatgttcgaggcctcgagtctgtcgacagcgaagcactcgctcgagtgggtcccgctgagctgtccgagggtatgccgccaagtgaccttgacttgctcgctcccgctcccccaccagaagaggtcttgccactcccaccgcctcctgcacccccactgcctccccctccccctcccctccctgacaaatgtcctccagcacctcccctgccaggagcggctccctctgtggtgctcacggtgggactctctgcaatacgcatcaagaagccaatcaaaactaaatttaggttgcctgtcttcaattggaccgccttaaagcccaaccagattagcggtactgtcttttccgaacttgatgatgagaagatcctggaggacctggatctcgataaatttgaagaactgttcaaaacaaaggcgcaaggccctgcgctcgacttgatttgctccaagaataagactgcgcaaaaagctgcttcaaaggtgactctgctggaggcaaatcgcgctaaaaatctggccataactttacgcaaagcaggccgaagtgccgaggagatatgccgtgcgatccacacattcgacttgcagactctcccagtggatttcgtcgagtgtctcatgagatttctgccaacggaagccgaggttaagcttcttcgccaatatgaacgggagcgccaaccactggaagagctggcggctgaggatagattcatgctgcttttttcgaaggttgagcgcctaactcagaggatggctggcatggcctttctgggtaatttccaggataacctgcagatgctaacgccacaactgaatgccatcatagctgcgagtgcaagtgttaaatcaagtcaaaagttgaagcagatgctggaaattatacttgccctcggaaattatatgaactccagtaagcggggagcggtgtatggtttcaaactgcagagcttggacctgctgctggatacaaagagcacagaccgcaagatgaccctcctgcatttcatcgccctgaccgtcaaggaaaagtatccggacctggcgaatttttggcacgagcttcattttgtggagaaagcagccgctgtctcattagagaacgtcctgctcgatgtcaaggagctggggagggggatggagcttattcgcagagagtgtagtatacatgacaatagcgtactgagaaacttcctttctacaaacgaaggaaagcttgacaagctgcagcgagacgcaaaaacagcggaagaggcttacaacgccgtggtgaggtactttggcgagtctcccaagaccacaccaccatccgtgttcttccctgtgttcgtgagatttatacgctcctacaaagaagcagaacaggagaatgaagcccgtaagaagcaggaggaagtaatgcgggagaagcaactcgctcaggaggcgaaaaaactggatgcgaaaactcctagtcaacgcaataagtggcagcagcaagagctgatcgccgaactccggaggcgacaagcgaaagaacacagaccagtatacgaaggtaaggatggcacgatcgaagacatcatcacaggcctacactgtcaaccaatggttgtccgccaccaagccagatcagcagccccaccaagtggaccacctcgagccccaggcccacactag

SEQ ID NO: 56489 - DNA, 3084 bp, Artificial Sequence
  Description of Artificial Sequence: Synthetic coding sequence
atgggcaacctggaatctgccgaaggtgttcccggtgaacctccaagcgtccccttgctgttacctcccggaaagatgcctatgcccgagccgtgtgagctggaggagaggtttgccctggttctgtccagcatgaacctgccccctgataaggcgaggctgttgagacaatatgataacgaaaaaaaatgggaccttatctgcgaccaggagagatttcaggtcaagaacccacctcacacctatatacagaaactacagagctttctcgacccaagtgtaacaaggaagaagttcagacgtcgcgtacaggagtccaccaaagtgctacgagagctagagatttctctgaggacaaatcacatcggctgggtgcgggaattcttaaatgatgagaataagggacttgacgtgttggtcgactatctttctttcgcacagtgttctgtgatgtttgattttgaaggcctagaatctggagatgatggggcatttgataagctgcggtcttggagtaggagtatcgaagatctccagccacccagcgcgctgagtgctcccttcactaactcactggctaggagtgcgagacagtcagttctgaggtactcaacattgccgggaagacgagctctgaagaatagccggttagtctcccagaaggacgacgtgcacgtttgcatactgtgcttaagggccattatgaattaccagtatgggtttaaccttgtaatgtcacatccacatgccgttaacgagattgctctctccctcaacaacaaaaaccctcggaccaaggccctagtactagagctgcttgctgctgtttgcctggtccgcggtggccatgagataattttggccgcattcgataactttaaagaggtttgcaaagaattgcacagatttgagaaactaatggaatatttccggaacgaggacagtaacatcgattttatggtcgcgtgcatgcagttcattaacatagttgtccattccgtcgaagatatgaacttccgcgtccacctgcagtacgagtttaccaaattgggacttgaggagttcctgcagaaatccagacacactgagtcggaaaaacttcaagtgcagatacaggcttacctggacaacgtcttcgacgttggcggactactcgaagacgccgagacgaaaaacgtggccctcgaaaaggtagaagaacttgaagaacacgtttctcatctgacagaaaagctgctagacctagaaaacgagaatatgatgcgtgtggccgaactggaaaagcagcttttgcaacgcgaaaaggagttggaaagcatcaaggaaacgtatgagaacactagtcaccaggtacacactctgagacgactcatcaaggaaaaggaagaggcattccagcgaaggtgccaccttgaacctaacgtgcgcggactggaatcggtggacagcgaggccttggccagagtgggccctgccgagctgagcgagggcatgccgccaagcgatctggatctgctagcacccgctccccctcccgaagaagtgttaccactcccccctcctcccgcacccccattaccccctcctccaccaccgctgccggacaaatgtccacctgcacctcctctcccaggagccgcacccagcgttgtgctaaccgtaggactcagcgcgattagaatcaagaaacccattaagactaagtttcggttgcccgtgttcaactggacggctttaaaaccaaaccagatatctggtacagtcttttcggaactggatgatgaaaagattcttgaggacctcgatttagataagtttgaggaactgtttaagacaaaagcgcagggaccagctctggatctgatctgctctaagaataagactgcccagaaagcagcctctaaagtaacactcttggaagccaaccgggcaaagaacctggctataacattacgaaaagccggaagatcagccgaagagatctgtcgcgctatccacaccttcgacttgcagacccttccagttgattttgtcgaatgtcttatgcggttcctccccactgaggcggaagtaaagctcctgcgccagtatgagcgagagcggcagccactggaggagcttgcagctgaagaccgctttatgcttctgttcagcaaggtggaaaggctcactcagcgtatggcagggatggctttcttggggaatttccaggacaacctgcaaatgcttacacctcagctcaacgcaatcatcgccgcatcagcctcagtcaagtcatcccagaagcttaaacaaatgctcgagattattctcgctcttgggaattacatgaactctagcaagcgcggagctgtgtacggatttaagttgcaaagtctggatctcctgttggatacaaaaagcaccgaccggaaaatgacgctgctgcactttatcgctctcacagtgaaagaaaagtatccggatctggcaaacttctggcacgaattacatttcgtggagaaggcggcagcggtgagcctagaaaatgtgttgctagatgtaaaggagctggggagaggcatggagttgattcgacgggagtgtagcatccacgataactccgtgctgaggaatttcctcagcaccaatgagggaaagcttgacaagctccagagagacgccaagacagcagaggcatacaacgccgtggtacggtactttggcgagtcccctaaaactacacccccatcagtgttcttccccgtcttcgtgagattcatccggagctacaaagaagccgagcaggaaaacgaagcccgtaagaaacaagaggaggtgatgcgtgagaagcagctcgcccaggaagccaagaagcttgatgctaagacacccagtcagagaaataagtggcagcagcaggagctcatcgccgaattgagaagaaggcaggccaaagagcaccggccagtgtacgaagggaaagatgggactatcgaagatattatcaccgtgctgaaaagcgtcccattcaccgctcgtaccgctaaacgcggaagccggtttttttgtgacgctgcacaccatgatgaatcaaattgttag

SEQ ID NO: 56490 - DNA, 1227 bp, Artificial Sequence
  Description of Artificial Sequence: Synthetic coding sequence
atgagcaaaagagatattgtcctgacaaatgtgaccgtggtacaacttcttcgacagccatgcccagtgacccgggcacccccacccccagaacctaaagccgaagtggaaccccagcctcagcccgaacccacacctgtccgggaagaaatcaaaccacccccaccacccttgcccccacaccctgcgacgcccccaccgaagatggtgagtgtggcccgagagttgacagtgggtataaacgggtttggcaggatcggcaggctcgtactcagggcatgcatggaaaagggtgtcaaagtggtcgccgtgaacgatccctttatcgacccagagtacatggtctatatgttcaagtacgactcaacccatggacgctacaaggggtcagtggaattcaggaacgggcaactggtggtggacaatcatgaaatcagcgtctatcagtgcaaggagcccaaacagataccatggagagcagtgggaagcccgtacgtggttgaatctaccggcgtgtacttatctatccaggctgcctccgaccatatctctgccggagctcagcgggtcgtgatttccgctcccagtcccgatgcgcctatgttcgtgatgggagtgaatgagaatgactacaaccccggatcaatgaacatcgtgtctaacgcaagttgtactaccaattgtttagcccctctagcaaaggtgatccatgaaaggtttggcatcgtagaggggctgatgacaacagttcacagctacacagctacacagaagactgtggacggacccagcaggaaagcttggcgagatggaagaggggcacaccagaatatcatcccagctagcactggtgccgcaaaggcagtaacgaaggtcattcccgagttaaaagggaaactgaccgggatggcattccgagtcccaacacctgacgtttcggtagtcgatctcacatgtcgtctggctcaaccagcaccctatagtgccatcaaagaggccgtaaaggccgctgcgaaaggtcctatggccggaattttggcttacacagaagatgaggtggtgtccactgattttcttggtgacacacatagctcaattttcgatgctaaggccggaatcgccttgaacgacaatttcgttaagttaatttcgtggtatgacaacgagtacggttactcccaccgggtggtcgatcttctgcgatatatgttcagcagagataagtag

SEQ ID NO: 56491 - DNA, 2811 bp, Artificial Sequence
  Description of Artificial Sequence: Synthetic coding sequence
atggcagccgctcgggatccccctgaagtgtctctgcgcgaggccactcagcggaaactcaggcgtttttctgagttacgcggaaagctggttgctagaggggagttctgggatattgtcgcaattacagccgcagatgagaaacaagaactggcatacaatcaacaactcagcgagaagttgaagagaaaagagcttcctttgggggtgcagtatcacgtctttgtggaccctgcgggagccaaaatcggcaacgggggaagcaccttatgtgccctgcaatgcctcgagaagttgtacggcgataagtggaattctttcaccatcctgctgattcacagtgacgaatggaaaaagaaagtgtctgagagctacgttatcactatcgagcgacttgaggatgatttgcaaattaaggagaaagagttgaccgaactaaggaatatcttcggcagtgacgaagcctttagtaaagtgaaccttaattatagaactgaaaatggcctgtccctcctgcacctttgttgtatctgcgggggaaagaaaagccatattaggacactcatgctaaaggggctgagaccttctcgattgactaggaacggttttactgctttgcacttggccgtgtataaggataatgccgaactcataacgagcctgttgcattctggagcagacatccaacaggtaggctatggcggacttactgcccttcacattgctacaattgcagggcatcttgaggccgcagacgtgctgctacagcacggggctaacgtgaacatccaggatgcagtgttttttacccctcttcatattgcagcctattatggccacgaacaggtcacacgcctgctgctcaaatttggtgccgatgttaatgtgtccggagaggtcggagatcgacctttacatctggccagtgccaaggggttcttgaacattgcgaagcttctaatggaggagggaagtaaggccgacgttaatgcccaggacaatgaggaccatgtgccactccacttttgctctaggttcggccatcatgacatcgtcaaatacctcctgcagtctgatctagaagtacagccgcatgtggtcaacatttatggtgataccccactgcaccttgcttgttataatgggaagttcgaggtggcaaaagagataatccagatcagtggaacagagagtttaaccaaggagaatattttttcagaaaccgctttccattctgcttgtacctacggtaaatctatcgacctggtgaaatttctcctggaccagaacgtgatcaacattaaccaccagggacgcgatgggcatacaggcttgcacagcgcctgctatcacggccatatccggctggtgcagtttctgctggacaatggcgctgacatgaatctggtcgcctgcgacccgtcccgctcttccggtgagaaggatgaacaaacttgcctgatgtgggcatacgaaaagggccacgatgctatcgtgaccctgctgaagcactacaaaagaccccaagacgaactgccttgcaatgaatattcacagcctgggggagacggttcgtacgtgagcgtaccaagcccactgggcaagatcaaatcgatgactaaggagaaagcggatatcctgctgttaagagcaggtctgccttcccactttcatttgcagctgtcagaaattgaattccacgagatcatcggctcagggtcttttgggaaagtttacaagggcaggtgtagaaacaagattgtagcaatcaagcgatatagggctaacacctactgctcaaaatctgacgtcgacatgttttgtcgcgaggtgtccatcttgtgccagctgaatcatccgtgcgtgatacagttcgtcggcgcttgcctcaatgatcccagccagtttgctattgtcacccagtacatctctggcggaagcctgttctctctactgcacgagcagaaacgcattttggatcttcagtctaagctgattattgcagtggacgtggctaaaggtatggagtacctgcataacctcacccaaccaattattcaccgggatctgaatagccacaatatcttactctatgaagacggccacgctgtggttgccgattttggggagtcaagattcctgcagtccctcgacgaggataacatgacgaagcaaccagggaacctcaggtggatggccccagaggtgttcacgcagtgtacaagatacaccatcaaagctgatgttttcagttatgccttgtgcttatgggaaatcctaaccggggagattccttttgcacacttgaaaccagctgccgcagctgcggatatggcctaccaccacatccgacctcccattggttacagtattcccaagcctatcagcagcttacttatcagagggtggaacgcttgtcccgagggcaggccagaatttagcgaagtcgtgatgaagctggaagagtgcctttgcaatatcgaactgatgagcccagcctctagcaatagcagtggctcattgagccccagttcttctagcgactgtcttgtaaatagagggggaccagggagaagccatgtggccgctctgcgcagtcgattcgagcttgagtatgccctaaatgcccgatcatacgctgcactgtcccagtccgcgggtcagtacagctcccagggtctgagtctcgaagaaatgaaaagatccctccagtacaccccgatcgataagtatggttacgttagcgacccaatgtcatctatgcactttcactcatgcagaaattcaagtagctttgaggatagcagttag

SEQ ID NO: 56492 - DNA, 2532 bp, Artificial Sequence
  Description of Artificial Sequence: Synthetic coding sequence
atggccgcagccagggatccccctgaggtgtccttgagagaagctacacagaggaagttaagacggttctccgagctccgcggaaagctggtggcgagaggggagttttgggacatcgtcgcaataacagctgccgatgagaaacaagagctcgcctataatcagcagctgtccgagaagttaaagcggaaggaactgccactcggagttcagtatcacgtttttgttgaccccgcaggagccaagattggtaacggcggatccaccctctgtgcgctccagtgcctggaaaagttgtacggagataaatggaactctttcacaatcctgttgatccattcagatgaatggaaaaaaaaagtgtccgaaagctatgtcattacaattgagcgtctggaggacgatctacagattaaagagaaagaacttacagagctgcggaatattttcggcagtgatgaggcctttagcaaggtcaatctcaattatcgaacagaaaatggtctcagtctactgcacctatgctgtatttgcgggggaaagaagtctcatattcgaaccctgatgctcaaaggcctccgtccatcaaggttgacccgtaacggtttcaccgccctgcacctggccgtatacaaggacaacgccgaattaattaccagtttactgcacagtggcgctgatattcagcaagtggggtacggcggactcaccgctctgcacatcgccacaatcgcaggccatctggaggcggctgacgtgctcctccaacacggcgcaaacgtgaacatccaggacgccgtcttttttacccccttgcacattgcggcttactatgggcacgaacaagtcactcggttgttgcttaagttcggtgctgacgttaacgtgtcaggtgaagtgggtgatagaccactgcatctggcatccgccaaaggttttttaaatatcgcaaagttgctgatggaggagggcagtaaagcagatgtcaatgcccaggacaacgaggaccatgtcccactgcatttttgtagtcgctttgggcaccacgacattgtaaaatacctgctgcagtcagacctcgaggttcaaccccatgtagtcaatatctatggcgacactcctctgcatctggcctgctacaatggaaagtttgaagtcgctaaagagataattcagatctccggaacagagtcgctgaccaaggaaaacattttttcggagaccgcctttcatagcgcatgtacctacgggaaatcgatcgacttagtaaagtttctgttagatcaaaacgtcattaacatcaaccatcaggggagagacggccatactgggctgcacagcgcatgctaccacggccatatccgactcgtacagtttctcctggacaacggcgctgatatgaacctggtcgcatgcgatccatctcggtcgagtggggaaaaggatgaacaaacctgtctgatgtgggcgtacgagaagggccacgatgcaattgtgacactgctgaaacattacaagcgcccacaggacgagcttccttgtaatgaatactctcaacctggaggtgatgggtcttatgtgtctgtaccaagtcctctaggaaagatcaagtctatgaccaaggaaaaggcagatatccttttgttgcgggctggtctgccctctcatttccatctgcagttgtccgagattgaattccatgagatcataggatccggttcattcggaaaagtatacaaagggcgatgtagaaacaaaatcgtggctataaagcgctatagggcaaacacatactgctccaagtctgacgtagacatgttctgcagagaagtttcgatcctgtgccaactgaaccatccttgcgtgatccagttcgtcggagcgtgcctcaatgatccctcccaatttgccatcgtgacgcagtacatctccggtgggtctctattttccttgctccatgagcaaaaaagaatcctcgacctccagtctaaattaatcatcgcagttgatgttgctaaagggatggaatatctgcacaatttgacccagcctattatccacagagacctgaactcacacaacatactcctttacgaggacgggcatgctgtggtggcagactttggtgaatcccgcttcctgcaatctctggatgaggacaatatgactaagcagcccggaaacctgaggtggatggcgccagaggtgttcacacagtgtacccgttatactatcaaggcggacgtttttagttacgcactgtgcctatgggaaatcctcaccggagagataccttttgcacacctaaaaccagctgccgctgccgcagatatggcttaccaccacataagaccaccaatcggttattccattccgaagccgatatccagcctgctgatccggggatggaacgcatgccctgaggcaaagagcaggccttcgcattatccagtatcttcagtttatacggagaccctgaaaaagaagaatgaggatagattcggaatgtggatcgagtacctgcgcagatag

SEQ ID NO: 56493 - DNA, 444 bp, Artificial Sequence
  Description of Artificial Sequence: Synthetic coding sequence
atgtccttccggtttggtcagcatctgatcaaacccagcgttgtgttcttgaagaccgagttgagtttcgcgctcgtgaatcgaaaacccgtggtccctggacacgtgctggtatgtcccttgcgccctgtggagcgcttccacgacctgagacccgacgaggttgccgatctgtttcaaacaacccagcgggtcgggactgtagtggaaaagcacttccacggcacttcgctgactttctcaatgcaggatggccctgaggccggtcagacagttaagcacgttcacgtacatgtgctccctcgaaaggccggtgactttcataggaatgattccatctacgaagagctccagaaacatgacaaagaggatttccctgcatcctggagatctgaagaagagatggccgctgaggcagctgctcttcgagtctactttcagtag

SEQ ID NO: 56494 - DNA, 930 bp, Artificial Sequence
  Description of Artificial Sequence: Synthetic coding sequence
atggaacagcttctgagagccgagttacggacggcaacactgcgggcatttggcggacctggtgctggttgtatctctgagggccgtgcctacgataccgacgccggacctgtttttgtcaaggttaatcgtagaactcaagccaggcagatgttcgaaggcgaggtagcaagcctcgaggcactccgtagcacgggcctggtgcgggttcctagaccgatgaaggtcatcgacctgcccggaggcggagcagccttcgtgatggagcatctgaaaatgaaatccctgagttcacaggcaagcaaactgggcgagcagatggctgaccttcacctctataaccagaagctaagggagaagctcaaagaagaggagaacacagttggacggcgtggggagggcgctgaaccccagtatgtcgataaatttggttttcatacagttacgtgctgcggcttcatcccccaagtcaatgaatggcaggacgattggcctaccttcttcgccaggcaccggctccaagctcagctggatctaattgaaaaggattatgcagaccgggaggctagggagctgtggtcccgtctccaggtgaaaattccagacctgttctgtgggctggagattgtgccagccctgctgcacggcgacctgtggtccggcaatgtggctgaggacgacgttggacctattatttatgacccggctagcttttacggtcactcagaattcgaactcgcgattgctctgatgttcggcggattccctcggagcttctttaccgcttaccacaggaagatacctaaagcacccggatttgaccaacgactgctcctgtaccagctgtttaactatctgaatcactggaatcacttcgggagagaatataggagcccgtccttgggaacgatgcgcagactactcaaatag

SEQ ID NO: 56495 - DNA, 609 bp, Artificial Sequence
  Description of Artificial Sequence: Synthetic coding sequence
atggagcagctcttgcgggcagaactcaggacagctaccctccgcgctttcggcggacctggtgccggatgcatttctgaaggaagagcctacgacaccgacgcgggtcccgttttcgtgaaggtgaatcgccgtactcaggcacgtcagatgttcgagggggaggttgcaagcctggaggccctgcgtagtactggtcttgtccgggtgccaaggcccatgaaagttattgacctgcctggaggcggagctgcatttgtcatggagcacctcaagatgaagtcattgagtagccaggcctctaaactgggcgagcagatggccgatctccacctgtataatcaaaaactcagggaaaaacttaaggaggaggagaacacggtgggacgaagaggcgagggagctgagccccagtacgtggacaaattcggctttcacacagtcacgtgttgcggatttataccacaggagcccctggaaccaagttccttgaaatcagttaagttccagcgtcgtctctggactgcccagctcccatgcgcatcactggaggaggccaatattggcccatatttcgggtttgtgagaaatacggcacctatcatttag

SEQ ID NO: 56496 - DNA, 534 bp, Artificial Sequence
  Description of Artificial Sequence: Synthetic coding sequence
atgcaggctcgacagatgttcgaaggtgaagtagctagtctcgaggcgctgcggtccaccggactggtgcgggtacctaggcctatgaaggtgatagacttgcctgggggaggggctgcctttgtgatggaacatctaaaaatgaagtctctaagcagccaggcttctaaattaggcgaacaaatggctgacttgcacctgtacaaccagaaactgagagagaagctcaaggaagaagaaaatactgtggggagacgtggtgagggggctgagccccagtatgtagacaagtttggctttcacacggtgacctgctgtggattcatcccccaggtaaatgaatggcaagacgattggccgacattttttgctaggcatcgcttgcaggcccaactggatctgatcgaaaaggactacgccgatcgcgaagcccgagagctgtggtcgcgccttcaggtgggaacagcggttacaagcctcggaaagtcttggagttcccatgacccagccgcttttgtaagagtgcacctctag

SEQ ID NO: 56497 - DNA, 1212 bp, Artificial Sequence
  Description of Artificial Sequence: Synthetic coding sequence
atgcccgaacccctggcgcctgaaagctatcccgaatccgtgtgcgaggaggatgtgaccttggccttgaaagaactcgacgaacgatgcgaggaggaagaggctgacttctctggactgtcaagccaggacgaagaggagcaggatggatttcccgaggtgcaaaccagtccgctgccctcacctttcctttcggccatcatcgctgctttccaaccagtggcttatgatgatgaagaagaggcttggcgatgtcatgtgaaccagatgctgtctgacacagatggatcctccgccgtcttcacctttcatgtgttttctcgcctcttccagactattcaacggaagtttggagagattacaaacgaggctgtgagcttcctcggggattccctgcagaggatcggcaccaaattcaaatcctccctggaggtaatgatgctctgttctgaatgtcccaccgtgttcgtggacgccgagacccttatgagctgtgggctgcttgagactttgaagtttggtgtcctcgagctacaggagcatttagacacctacaatgtcaaaagagaagcggcagagcagtggctggacgactgcaaaaggacatttggcgcaaaggaggacatgtaccggattaacacggatgcccaggaactggagctgtgtaggaggctttacaagctgcatttccagttacttcttctgttccaggcctactgcaaactaattaaccaggtcaataccatcaaaaatgaggccgaagtgattaacatgagtgaagagcttgcgcaactggagtccattctaaaggaggccgaatccgcttctgagaatgaggaaatcgacattagtaaagcagcccaaaccacgattgagacagccatacactccctcatcgaaacgctgaagaacaaggagttcattagcgctgtggcccaagtcaaagcttttcgatccctctggccttctgatatcttcggcagctgcgaggatgatccagtacagactttattgcatatctatttccaccatcagacgctgggccaaaccggaagcttcgctgtcattggctccaatcttgatatgagcgaagccaattacaagctgatggagctgaacttggaaattagggagtcccttcggatggtgcagtcctatcagctgctggctcaggccaagcccatgggtaatatggtatcgaccggcttctag

SEQ ID NO: 56498 - DNA, 9041 bp, Artificial Sequence
  Description of Artificial Sequence: Synthetic coding sequence
atgtcgaacattacaatcgaccccgacgtcaaacccggtgaatacgttataaagagcctttttgcagagtttgcagtgcaggctgagaagaagattgaggtggtcatggcagagccccttgaaaagctcctgtctaggtcactacagagaggcgaggatttacaatttgatcaactgatcagtagcatgtcctcagtggcggagcactgtctcccttccctgttgcgaacactgtttgactggtacagacggcagaacggcacagaagatgagagttacgagtacagacccaggtcatcaacaaaaagcaaaggtgatgaacagcagcgcgagagggattaccttctggaaaggagggatctagcagtagactttattttctgcctggtgttagtagaggttctgaaacagatcccagttcacccagttcctgaccctttggtgcacgaagtactcaatttagccttcaagcactttaagcataaggaagggtacagtggtaccaacacaggcaatgttcacataattgctgacctctatgcggaggtgatcggagtgttagcccagtccaaattccaagctgtgagaaaaaagttcgtgacggagctaaaggagctgcggcagaaggagcaatcaccccacgtggtccagagcgtcatttcactgatcatggggatgaaattctttcgcgtcaaaatgtatcccgtcgaagacttcgaggccagcttccaattcatgcaggagtgtgctcagtacttcttggaggtcaaagacaaggatatcaagcacgccctcgcgggactttttgtggagatcctaatccccgtggcagctgccgtgaaaaatgaagtgaatgtgccgtgcctgaagaatttcgtcgaaatgctctaccagacaaccttcgaactgtcttcccggaagaaacactcattggcgctgtaccctctgatcacatgtctcctctgcgtgtcccagaaacagttctttttgaacaattggcatatattcctgcagaactgtctaagccatctgaagaataaggatccaaagatgagccgcgtggctcttgagtcactgtatcgcctcctttgggtttacgtcatccgtattaaatgcgaatccaatacagtgactcaaagtaggctgatgtctattgtttcagctctgtttcctaaaggatctcgctcggtggtaccgagggacacccctctgaatatcttcgtgaaaattattcagttcattgcacaggagcggctcgattttgcaatgaaggagatcattttcgacctgttatctgtgggcaagagcacgaaaaccttcaccattaatcccgagcggatgaacataggattaagagtgttcctggttatagccgattctctccagcagaaagacggggaacccccaatgccaacaacaggcgttattctgccttcaggaaacaccctccgagtcaaaaagatttttcttaataagactctgactgacgaagaggccaaagtgattggaatgtctgtgtactaccctcaggtcagaaaggcactcgattccattctaagacatttagacaaggaggtgggcagaccgatgtgcatgacttcagtacagatgtccaacaaggagccggaggatatgatcacaggtgaacgcaagcccaagattgacctatttaggacttgtatagctgccatcccacgcctgatcccagatggaatgtcacggacagatctaatcgagcttctcgctcggcttacgatccatatggacgaagagctgcgcgctttagcttttaatacattacaagccctcatgctcgatttcccagattggcgcgaggacgttttatcgggtttcgtctatttcatcgtccgggaggtgaccgacgtgcatcctactcttctggacaacgccgttaagatgttagtgcaacttataaatcagtggaaacaagccgctcagatgcataacaagaatcaggacacccagcatggcgtcgctaacggcgctagccacccccctcccctggaaaggagcccgtattccaatgtgtttcatgtggtggaggggttcgcactggttattctgtgtagtagtcgaccagcaactagacggctggcagtttctgtgttgagagagattcgagcgttgtttgccttactggaaattccaaaaggcgatgatgagctcgcgatcgacgtgatggaccggctttctcccagcattcttgagtccttcattcacctgaccggcgctgaccagacaacgttgctctattgtccatccagcatcgaccttcaaacactggccgaatggaatagcagtcctatcagtcatcagtttgacgtgattagtccatcacatatatggatatttgcccatgtaacccagggccaggatccttggatcatctcgctgtccagctttttgaagcaggagaatttacccaaacattgcagcacagctgtgtcttacgcttggatgttcgcttatacccgacttcagctcctttctccccaggtcgacattaattcccctataaacgctaagaaggttaacaccactacgtctagtgactcatatattggtctctggagaaactacctcatcctgtgctgcagcgctgccacatcttcctccagcacaagtgcgggttctgtccgctgctccccacccgaaaccctggccagcactccggattccggatactctattgatagcaagattatcgggattccctcaccctcttctcttttcaaacatatcgtgcctatgatgcggtccgagtctatggaaatcacagagagcttggtcttgggcttgggacgaactaatccaggagcctttagagagctgatcgaagaactccatcctatcatcaaggaagctctggaaagaagacctgaaaatatgaagcggcgacgacggagggatatccttcgggtgcagctggtacgtatttttgagttactcgctgatgcaggtgtcatctcacattccgcctccggaggcctcgacaatgaaactcacttcctcaataacaccctgcttgaatatgtggacctgacaaggcagctgctcgaggccgagaacgagaaagatagcgacacactgaaggatatccggtgtcatttcagcgcactggttgccaacattatccagaatgtaccagtgcatcagcgcaggagcattttcccgcagcagagcctcagacactctcttttcatgttatttagccattgggcgggtcctttctctattatgtttacaccgcttgatcggtattccgatcgcaacatgcagatcaacaggcaccaatactgtgctctgaaagccatgagcgccgtgttgtgctgcggtcctgtggcagataacgtagggttgtcatcagacggatatttgtacaaatggttggacaatatcctggacagcctggacaaaaaggtgcatcagctaggttgtgaggcagtgacactcttgttagagctcaatccggatcagtccaatctaatgtattgggcagtcgacagatgttacaccggctcaggacgcgtggccgctggctgctttaaagctattgctaatgtgtttcaaaacagagattaccagtgtgacacggtcatgctgctgaatctcattttgttcaaagcagctgatagctctcgctctatctacgaggtggctatgcaattgctccaaattcttgagcccaagatgttccgttacgctcataaactcgaagtgcagaggacagacggggtgctgtcccaattgtcccccctgccacatctgtactccgtttcatactaccagctgtctgaggagctggcgagggcctaccctgagcttactctcgcaattttcagcgagattagccagcgaatacagactgcacacccagccggacgacaggtgatgctccactacctccttccttggatgaacaatattgaactggtcgatctgaaaccactccccacagcaaggagacatgatgaggacgaggacgatagcctaaaggatagagagttgatggtgactagcaggaggtggctcagaggggagggttggggatccccgcaggcaacagccatggtgctcaacaacttgatgtatatgactgcaaaatacggtgatgagcttgcttggtctgaagtggagaacgtctggaccacactcgcagatggttggcccaagaatctgaaaatcattctgcatttcctgatctcaatctgcggcgttaactcagagccgagcctgcttccttacgtgaaaaaggtaatcgtctatctgggacgagataagactatgcagctgctagaggaactagtgtccgagttgcagctgaccgatccggtgtctagcggcgtcacccacatggacaatccaccctattaccgcattacttctagttataaaatccccagcgtcactagtggtaccaccagctctagcaacacgatggtggcccctactgacggaaacccagacaataaacccattaaagagaacatcgaagaatcttacgtgcatctggacatttactctggacttaatagccacctgaaccgccaacatcaccgcctagagtctaggtactcctcaagctctggaggaagttatgaggaggagaagagcgattccatgccactatacagtaactggaggctcaaggttatggagcacaatcagggcgagcctctgcccttccctcctgccggaggttgctggagccccctcgtggattacgtgcctgagacctctagtcctggtttacccttacacagatgcaacatagcagtaatcctgctcacagacctcatcatcgatcactctgtgaaagtggagtggggaagctacctgcatctgctattgcatgctatcttcatcggattcgatcattgccatccagaagtgtatgaacattgtaaacgattgctgctgcacctgctcatcgtcatgggacctaactcaaatatccgcacagtggcctcagtgctgctgcggaataaagagttcaatgagccgcgagttctgactgtcaagcaagtggctcacctagactataacttcacagctggcatcaacgactttattcccgattatcagccttccccaatgaccgatagtggactctctagtagctccaccagtagtagtatatcattaggcaataattctgcagctatttcacatctgcacacaacaattctgaacgaggtggacatctcagtcgaacaggatggcaaagtgaaaacactgatggagttcatcacttcaaggaaaagaggtcctctttggaatcatgaggatgtttccgctaagaacccttcaatcaaaagcgcagagcagctcacaacttttctgaagcatgtggtgtcggtcttcaagcagtccagcagtgagggtatccatctcgaacaccacctgagtgaggtggctctgcaaaccgctctctcttgcagctctcgccactacgccggtcgcagctttcagatcttcagggcgctaaaacaaccccttacagcaacaactttgagcgatgttctgtcacgcctcgttgaaacagtgggagatcctggggaagacgcccagggattcgtgatcgaattgttgctcacattagagtccgccattgacacgctcgctgagaccatgaaacactacgacctgctatcggccctctctcaaaccagctatcacgaccctatcatgggcaacaaatacgctgccaatcggaagagcaccggacagttgaacctctcaacctctccaatcaactcaagctcttacctgggctataactccaacgcacgttcaaatagtctccggctgtccttgatcggggacagaaggggagatcgcagacggtccaacaccctcgatattatggacggtaggataaatcacagcagtagtctggcgagaacgcgcagcctatctagcctccgggagaaagggatgtacgatgtgcagtccaccactgaaccgactaatttaatggccacaattttctggattgccgcatctctgctcgaaagtgattacgagtacgagtacttgctcgctctgcgcctgctgaacaaactgcttattcaccttccgctcgataagagcgaatcccgagaaaagatcgaaaatgttcagtccaaactgaaatggactaatttccccggactgcagcaactttttctaaagggcttcacaagcgccagtactcaggaaatgaccgtgcacttgctgtcaaagctgatttccgtgtcaaagcacacgctggttgatccgtctcagctgtccgggtttcccctgaatatcctgtgccttctgccacacctaatccagcactttgattcgccaacccagttttgcaaggagaccgcttcaaggatcgctaaggtttgtgctgaggagaaatgccccacactggtgaacctcgcccatatgatgagtctatacagcacacatacctatagtagggactgctcgaattggatcaacgtggtgtgcaggtatctgcatgacagcttttccgacactacatttaacctggtgacatacctggccgaactgctcgagaagggactttcaagcatgcagcaaagtctgctgcaaatcatctattctctgctaagccacatcgacctctccgccgctcctgccaaacagttcaatctggaaataatcaagatcatcggaaagtacgtacaaagcccctactggaaagaggcactgaatatccttaaactggtcgtttctaggtcagccagtttagtcgtccctagcgatatccctaagacctatgggggagacactggcagccctgagatctcttttactaagatcttcaacaatgtcagtaaggagctgcctggtaagaccctggacttccactttgacattagcgagaccccaattattgggaataagtatggggatcaacactcagcggcaggcaggaacgggaaacctaaagtgatcgccgtgactagatcgaccagctccaccagctccggatctaacagcaacgctcttgtgcccgtcagctggaaacgaccccaactttcacagcggcgaacaagggagaagctgatgaacgtgctatccctatgcggccctgaatccggactaccaaagaatccgagcgtggtgtttagcagcaatgaagatctggaggtaggagaccagcagacttcacttattagcactacagaagacattaatcaggaagaagaagtggctgtggaagacaatagttctgagcagcagttcggagtcttcaaagattttgacttcttagatgttgagcttgaagacgcagagggcgaaagcatggataatttcaactggggggtccggcgtcgaagccttgattctatcgataagggcgacacaccctccttacaggaataccagtgctcctcttccactccaagcctcaatttgactaaccaggaggatactgacgagagtagcgaagaggaggctgccttgaccgcatctcagattctgtccaggacacagatgctcaacagtgattccgcgactgatgaaaccattcccgaccaccccgacctgctgctgcaatcagaagatagcactggatctattactacagaagaggtgctgcagatcagggacgagacaccaacattggaggcctccctggacaacgcaaactcacgccttcccgaagacaccacgtccgtccttaaggaggaacatgtcactacattcgaggacgagggtagctacataatccaggagcagcaagaaagtctggtgtgccagggcatattggatctcgaggaaactgaaatgccagagccactcgctcccgaatcttacccggagtctgtgtgcgaggaggacgtgaccttggccctcaaggagttagatgagcggtgtgaagaagaggaagccgatttcagcggtttatcatcccaggacgaagaggagcaagacgggttcccggaggtgcagacttcacccctcccctccccctttctctctgctatcatagcagcatttcagccggtcgcttatgatgacgaagaggaagcctggagatgccatgtgaatcagatgctcagcgacacagatggatcatcggcggttttcactttccacgtgttttctcgcctatttcagacaatccagcgcaagttcggtgaaatcacaaatgaggccgtttcttttctcggagattcactgcagcgaatcggcactaaatttaagtcctccctcgaggtcatgatgctgtgctccgagtgccctaccgtttttgtggatgcagagaccttaatgagttgcgggcttctggaaacattaaaatttggcgtcctcgagttacaggagcaccttgatacctacaacgtgaaaagggaggctgctgagcagtggctggacgactgcaaaagaacttttggcgcaaaggaggatatgtatagaattaatacggatgcgcagcagatggagattcttgccgaattggagctgtgcaggaggctgtataaattgcactttcagctgctgctcctgttccaggcctactgcaagctgataaatcaagtgaacactataaaaaacgaagccgaggttatcaacatgagcgaggagttagcccaactagagagcatcctgaaggaagctgaaagcgctagcgagaatgaggaaatagatatatccaaggccgcacagacaaccattgagacagccatccattcgcttatcgaaacacttaagaacaaggagtttattagcgccgtcgctcaagtgaaagcctttcgttccctctggccctccgacatctttggaagttgcgaagatgaccctgtgcagacacttctccacatttacttccaccaccaaacattaggccagactggttcgtttgccgtcataggatctaaccttgatatgtcagaggccaactataaattaatggagctgaatctggaaatacgtgagagccttaggatggtgcagtcatatcaactccttgcacaggcaaagcctatgggcaatatggtttccacaggttttta

SEQ ID NO: 56499 - DNA, 9041 bp, Artificial Sequence
  Description of Artificial Sequence: Synthetic coding sequence
atgagcaacataactatcgatcccgacgtgaagccaggtgagtacgtcatcaaatcactgtttgccgagttcgctgtgcaagcagaaaaaaaaatagaagtcgtgatggctgaacccctggagaaactgctgtcccgctctctccaacgcggagaggatctgcagttcgaccaactgatctcaagtatgagcagcgtggctgagcactgtctgccttccctgctcagaacactgtttgattggtatcggagacaaaatgggacagaagacgaaagctacgagtacaggccaagaagcagcaccaagtcaaaaggtgacgagcaacaaagggagagagattatttacttgaacgcagggacctggcggtggacttcatattttgtcttgttctggtcgaggtgctgaagcagattcccgtgcatcctgtgccagacccactggtgcatgaggttctcaacctggcgttcaaacatttcaagcacaaggaagggtatagcgggaccaataccggcaatgtgcacattatcgcggatctgtacgctgaggtaattggggtgctggctcaaagcaagttccaagctgtgcgaaagaagttcgttaccgagctgaaggagctgcggcagaaggagcagtcgcctcatgtcgttcagagcgtgatatcactcattatgggcatgaagttttttcgtgtcaaaatgtatcccgttgaggactttgaggcaagttttcagttcatgcaggaatgcgcccaatactttctggaagtaaaggataaggacattaaacacgccctcgctggcctgtttgttgagatactcatccccgtcgctgccgctgtcaagaatgaagtcaatgtgccatgtctaaaaaactttgtggagatgctctatcagacgactttcgagttgagctccagaaagaagcactctctggcactgtacccacttatcacttgcttgctctgtgtgagtcagaaacaattctttcttaacaactggcacatttttctgcagaactgtcttagtcaccttaaaaacaaggatccaaaaatgtcacgagtggccctggaatcactgtatcgcttactctgggtatacgtcatcaggattaagtgcgaatccaataccgtgacgcaatcgagattgatgtcaatcgtttccgccttgttccctaaggggtcccgcagcgtggtgccccgtgatactcccctcaatatctttgtgaagatcatccaattcatcgcccaagaaagactggatttcgcaatgaaggagattatattcgatctgcttagtgtgggaaagagcacaaaaacttttaccatcaacccagaaagaatgaatataggcctcagggtcttcctggtgattgctgatagcctccagcagaaggacggtgaaccccctatgcctactaccggcgtcattctgccctctgggaacaccctgcgcgttaaaaaaattttcctcaacaagactctcaccgacgaggaagccaaagtgatcggcatgtccgtctactaccctcaggtccgaaaggcactggactctattttacggcacttggacaaggaagtgggcagaccaatgtgcatgacatctgtgcagatgagcaacaaagaacccgaggatatgataacaggcgagcgaaagcccaagatagatctgtttaggacatgcatagcagcaatcccaagattaatcccggacggtatgtcccgcaccgaccttatagagcttcttgctcgtcttacgattcacatggacgaggaattgagagctttggcctttaacacactgcaagctctaatgctggatttccctgactggagagaggacgtcctaagcggattcgtgtactttatcgttagggaggtgaccgatgtgcaccccaccctgctggacaacgcagtgaagatgcttgtccagttgatcaatcagtggaagcaggccgctcagatgcataataagaaccaggacacacaacacggcgtggctaacggcgcttcgcacccacctcccctggaaagatcaccttattcaaacgtgttccacgtcgttgagggattcgcgctggtgattttgtgttccagccggccagctacccgcagattggctgtgtccgtgttgcgggagatcagagcgctgttcgctttattggagatcccaaaaggtgatgatgaactagccatcgatgtaatggataggctctcgccatcaatcttagagagcttcattcacttgacaggcgctgatcagacaacactgctgtactgcccatcttccattgatttgcagacccttgctgaatggaatagcagccccatcagccaccagttcgacgtgatctcaccctcacatatatggatcttcgcccacgtcacacagggacaggacccatggatcatttccctatcaagctttttaaaacaagaaaacctccctaagcattgctcaactgcagtctcctatgcatggatgtttgcgtatactcgcctccaattgctctctccacaagtggatatcaattccccaatcaacgcaaagaaagtcaacacaaccacttcaagtgatagttacattggcctgtggcgcaattacctgatcttgtgctgctcggcagccacttcaagtagcagcacttcggccggatcggttcgatgctccccaccagaaaccctggcaagcacgcccgattccggctattctatagattcaaagattataggtatcccctcccctagtagtctatttaaacatatcgtgccaatgatgcgaagcgagagcatggagattaccgagagcctcgtcctcgggttgggaaggaccaatcctggcgcttttcgtgagcttatagaggaactgcacccgataattaaggaagctctcgagagaaggcctgaaaacatgaaaaggcgccgtagacgggacatactccgcgtgcagctcgttagaattttcgaactcctggccgatgccggtgtgataagtcacagcgcatctggaggtttggacaacgaaacccactttctgaataatacattattggagtacgtggatctcactcggcagctgctagaagccgagaatgaaaaggacagcgacacacttaaagatatccgttgtcatttcagcgcgctggtggcgaatattattcaaaatgtccctgtacaccagagacgatcaatattccctcaacagtctctgagacattcgctcttcatgctcttttctcactgggcaggccctttttctataatgttcacaccgttggataggtattcagatagaaatatgcagatcaatcgtcaccaatactgcgctcttaaagcgatgagcgcggtcctgtgttgcggaccggtggccgataatgtgggcctctccagcgatggttacctctataagtggctagataacatactcgattccctggacaaaaaggtgcatcagttaggctgtgaggcagtaacattgctgctggagctgaatccagatcagagcaacctgatgtactgggccgttgataggtgttacaccggcagcggaagagttgcagctgggtgtttcaaagcaatcgccaacgtgttccagaaccgtgattaccagtgcgacaccgtgatgttgctgaatctgattctgtttaaggctgccgattctagcaggagtatatacgaggtggcaatgcagctgctccagatactcgagcccaagatgttccgctacgcacataaactggaggtccagagaaccgatggcgtgttgagtcagctctctcctttgccacatctgtacagcgtgtcatattaccaattatcggaagaattggctcgggcttacccagaattgacactggctatatttagcgaaatttcacagcgaatccagaccgcccaccctgccggtcgtcaggtgatgctgcactatctgctcccatggatgaataacatagaacttgtggatctgaaaccactgccaacggctcggagacatgatgaagatgaggacgattctcttaaggacagagagcttatggtgacctcgaggcgctggctaagaggcgaaggctggggtagtccgcaggccaccgccatggtccttaataatctcatgtatatgacagccaaatacggggacgagctggcatggtcagaggtcgaaaacgtctggactaccctggctgacggctggccgaagaacttaaagattattctgcactttttgatctcaatatgtggtgtaaactctgagccgagcctcttaccgtacgtcaagaaggtgatagtttacctaggaagagacaaaactatgcaactgctggaggagctggtgtccgaattgcagctcacggaccctgtttctagcggcgttactcatatggataatccgccatattatcgtataacctcctcctacaagatcccttcagtaacttctggcactacaagctcgtctaacaccatggtggcacctactgatggaaatcctgataataaacccatcaaagaaaatatcgaagaaagctacgtccacttggacatctactctggccttaactctcatctcaacagacagcatcatcgactggagtccaggtactcatcaagcagcgggggttcctatgaagaagagaagagcgactcaatgccactgtattccaattggcgcctcaaagtgatggagcacaatcaaggcgaaccactgcccttccctcccgcaggaggatgttggtctcctctggtagattacgtccctgaaactagctctcctgggttgccccttcaccggtgcaacatcgctgtgatcctcctgactgacctcatcatagaccattcggtgaaggttgagtggggctcgtatctccatttgcttctgcatgccatcttcattggcttcgaccactgtcatcccgaagtctacgagcattgtaaaagactgctccttcacctccttatcgttatgggcccaaatagcaatattagaaccgtcgcttctgtgttgcttcgaaataaggagttcaacgagcctcgagttctgacggttaaacaggtcgctcaccttgactataatttcaccgccggtattaacgattttattccggattatcagccatcacctatgacagactccggcctctcttcctcaagcacgagtagttcgattagccttggcaataactcagctgcaatttctcacctccatacaacgattctgaacgaagtggatatcagtgtggagcaagacgggaaagtgaaaacactcatggaattcattaccagccgcaaaaggggaccgctgtggaaccatgaagacgtgtccgcgaagaacccttccatcaaatctgctgagcaattgaccacttttttaaagcatgtcgtaagtgtattcaaacagtcttcaagcgagggaatccacctggagcaccacttgtcagaggtggctctccagaccgctctctcttgctcttcacgccattacgccggacggtcattccagatttttcgcgctctgaagcagcctttaacggcaaccactctatccgatgtactttctcgcttagtagagacagtgggagacccgggagaggacgcacaaggctttgtgatagaactgctgttgaccctcgaatccgccatcgatacgctcgcagaaacaatgaaacattatgacttgctaagtgcactatcgcagactagctaccacgatcctattatgggaaacaaatacgcagcaaacaggaagtctaccggccaacttaacttgagtacctctcccattaattcaagttcatatttaggatataatagcaatgctagatctaattcgcttcgcctttcactgattggggataggaggggagaccggcgacggagtaacactcttgacattatggacggtcgaatcaaccactcctcttctctcgcccgtacccggtccttgtcctccctccgtgagaaaggcatgtacgacgtgcagtcaactacggagccaacaaatctgatggccaccatcttttggatagcagcctcactcctcgagtcggactacgagtacgaatacttgctggcactgcgtctgctgaacaaactgctgatccacctccctcttgataaatcagaatcaagggagaagatcgagaatgtacagtcaaagctgaagtggacaaattttccgggactgcagcagctctttttgaagggttttacgtcagctagcacgcaagaaatgaccgtgcacctccttagcaagctgatcagcgtcagcaaacacacccttgttgatccgtcacagctgagtggctttccgttgaacatcctctgtctcctcccacacctgattcagcacttcgacagcccgacccagttctgcaaagaaactgcctcgaggatagccaaggtttgcgccgaggaaaagtgtccgactctcgtcaaccttgcgcacatgatgtccttgtatagcactcacacatattctcgagactgtagtaattggatcaatgtagtctgcaggtatctccatgacagcttcagtgataccacctttaatcttgtcacctaccttgctgaattgctggagaaaggactctccagcatgcagcagtcccttcttcaaattatctactcccttctaagccatattgatctgtccgccgctccagctaagcagttcaacctggaaattatcaagattataggcaagtacgtgcagagcccttattggaaagaagcactgaacatccttaagctggtggtgtctcgaagcgctagcctcgttgtcccttctgacatcccaaagacctacggtggcgacaccggctcgcccgaaatttccttcaccaaaatcttcaataatgtatcgaaagaacttccaggtaaaacactggacttccacttcgacatatcagagacacctattattggcaacaagtatggcgatcagcattctgcagccggaaggaatggcaaaccaaaggtgatagcagttactcggtccacatcctccacttcctccgggtctaattctaatgcactcgtgcctgtgagttggaaacggccacagctgtcccagcgacgaacccgcgaaaaacttatgaatgtgctcagcctttgcggacccgagagcggcctgcctaagaatccatccgtggttttctcgtcaaacgaagatctggaagttggggaccagcagacctctttgatttctaccacagaagatatcaaccaagaagaagaagtggccgttgaggataactcttctgagcagcagttcggggttttcaaagacttcgactttctcgatgtggaactggaggatgccgaaggcgaaagtatggataattttaactggggggtgagaagaagatcgttggactctatcgataaaggcgacacaccaagtctgcaggaataccaatgctcttcctccactccatcactgaacctgactaaccaggaggacactgatgagtcaagtgaagaggaggcggctctgacagctagccagatcctcagtcgcacccagatgttgaacagtgactctgctactgacgaaacaattccagaccaccccgatttgctattacaatcggaggactctaccgggtccattaccactgaagaggtactgcagattagggatgagacacctactctcgaagctagtctggataacgccaattcaaggctgccggaagataccaccagcgtgcttaaagaagagcacgttaccacctttgaggacgaaggctcatacattatccaggagcagcaggagagcctggtctgccaggggattttagacctggaggaaacagaaatgcctgagcccctggctccagaatcatatcctgagagcgtttgcgaagaggacgtaaccctggcactcaaagagctggacgaacggtgtgaggaggaagaagctgattttagtggcttgtcttcacaagacgaagaagagcaagatggctttccagaggtgcagacaagtccattgccctcgcctttcctgagtgccatcatcgcagctttccagcccgtcgcgtacgacgatgaggaagaagcctggcgttgccatgttaatcagatgctgtcggacacagacggctcttccgctgtgttcacatttcacgtgttttcacgcctctttcaaacgatacagcggaaatttggggagatcaccaacgaagccgtgagcttcttgggagattccctgcagagaatagggacaaaatttaaatcttcactcgaggtgatgatgctgtgcagtgagtgtcccaccgtatttgtggatgccgagaccctgatgtcttgcggccttctggagactttgaagttcggcgtgttagaactgcaggaacaccttgatacttataacgtgaagcgggaagcagccgaacaatggctggatgattgcaagcgaactttcggtgctaaggaagacatgtaccggattaacaccgatgcccaacagatggagatcctggcagagcttgagttatgtcggagactgtataagttgcacttccagctgctgctcctctttcaagcttactgtaaactcataaaccaggtgaataccataaagaatgaggccgaagttataaacatgagcgaagagctggcccagctggagtctatcttgaaggaggcggaatcagcatcagagaacgaggagatcgatatcagtaaagccgctcagacgacgatcgagacggctatccactcactcatcgagacgctgaagaacaaagaattcatttcagcagttgctcaagtaaaggcctttcgcagtttatggccgtctgatatattcgggagttgcgaggacgatcccgtgcagacacttttgcacatttacttccatcaccagaccctcggtcagacaggaagttttgccgtcattggttctaacctggacatgagtgaagcaaactataagctgatggagctaaaccttgagattagagagtctctcaggatggtgcaatcttaccaattgctcgcacaggccaagcctatggggaatatggtctctaccgggttcta

SEQ ID NO: 56500 - DNA, 1212 bp, Artificial Sequence
  Description of Artificial Sequence: Synthetic coding sequence
atgcctgaacccctggctccagaaagttaccctgagagcgtgtgtgaggaggatgtcaccttagccttgaaggaactcgatgagagatgcgaggaggaggaggcagatttttctggcttgtcttcccaagacgaggaagaacaagatggattcccagaagtacagacatccccactgccctccccttttctgagtgccatcattgccgcattccaacctgtggcctacgatgatgaggaagaggcttggaggtgtcacgtcaatcagatgctgagtgacaccgacggttccagcgcggtatttacattccacgtcttttcccggctgttccaaacaatccagcggaaatttggtgaaattacaaatgaggcagtgtcattcctgggtgattcattgcaacgcatcggaaccaagtttaaatcttccctcgaggtaatgatgctctgctccgaatgtccaaccgtgtttgttgacgcggagacgctgatgagctgtgggctcctggaaacgttgaagtttggagtgttggaactgcaggagcacctggacacctacaatgtgaagcgcgaggctgcagagcagtggctggatgattgtaagcgaacctttggagctaaagaagatatgtacagaataaacacagacgctcaggaactcgaattgtgtcgaaggctctataaactccattttcagctcctcctgttgtttcaggcgtactgcaaactcattaatcaggtgaacacgataaagaacgaagccgaggtgattaacatgtccgaggaactggctcagctcgaatctatcctcaaggaagcagaaagcgcttctgagaatgaagaaatagacatatctaaggccgcacagactaccattgagacggcaattcattctctgattgaaacgctcaaaaataaggagtttatttccgccgtggcgcaggttaaggccttcaggtctctgtggcccagcgacattttcgggtcttgcgaagatgacccggtgcaaaccctactgcacatttatttccaccatcagactctgggccaaactggctctttcgccgttatcgggagtaatctggatatgtcagaagcaaactataagctgatggagctaaatctagagattcgggaatccctaaggatggttcagagctaccagctacttgcacaagcaaagcccatgggtaatatggtctcaacagggttctag

SEQ ID NO: 56501 - DNA, 9041 bp, Artificial Sequence
  Description of Artificial Sequence: Synthetic coding sequence
atgtctaatattacaatcgaccctgacgttaagcctggcgaatatgtaatcaagagtctcttcgccgagttcgctgttcaggccgaaaaaaagatcgaagtagttatggcagagcccctcgaaaagctcttgtcgagatccttgcagcgcggtgaagatctgcagttcgatcaactcatttctagtatgagttctgtggccgaacactgtttaccaagtctcctccggaccctgtttgactggtataggaggcagaacgggactgaagacgaaagttatgagtaccggcctcgttcctccaccaaatccaaaggagacgagcagcagagagaacgggactatctgctcgaacgtcgcgatttagcagtggattttattttttgccttgtgctggtggaagtgctcaagcaaatccctgtgcaccccgtgcctgatccactggtccacgaagttctcaatttggccttcaaacactttaaacacaaagaaggatacagtggtacaaacacaggcaacgtgcacatcatcgcagacttatacgccgaggtaattggggtactggctcagtccaaatttcaggcagtgaggaagaagttcgtgacagaactgaaggaactgagacagaaggaacagagccctcatgtcgtgcagtcggtgatatctctgataatggggatgaaatttttccgggtgaaaatgtaccctgtggaagactttgaggcatcctttcaatttatgcaggagtgcgctcagtatttcctggaggtcaaggacaaagatatcaaacacgctctggctggacttttcgtagagattctcattcccgtggccgctgctgtgaaaaacgaagtaaacgtcccttgtttgaagaactttgtggagatgctgtaccaaaccacgtttgagctttcatcccgaaaaaagcactcgttagcactgtatcctttaatcacctgtctcctctgcgtcagtcagaagcaattcttcttgaataactggcacatcttcttacagaactgtttatcacacttgaaaaacaaagatcctaagatgagccgcgtcgcactggagtctctttacaggctgctctgggtttatgtcatacgtataaaatgtgagtcaaacaccgtgacccagtcccggctgatgagcatcgtgtctgcactgtttcctaagggtagtagatcagtcgtgccacgggacacacccctcaacatcttcgtaaagatcatacagtttattgcccaggaacgactcgattttgccatgaaggagatcatctttgatttactgtccgttggaaagagcactaagacctttactattaatcccgaacgtatgaatatcggcttacgtgtgttcctggtgatcgccgattcactgcagcagaaggacggagagcctccaatgccaaccactggagtaatcctacctagtggcaacaccctacgagtgaagaagatcttcttgaataaaacgttaactgacgaagaagcgaaggtaattggtatgagcgtctattaccctcaggtgcggaaagcactggatagcatccttagacacctggacaaggaggttgggagaccaatgtgcatgaccagcgtccagatgtccaacaaggagccagaagacatgatcacaggtgaacggaaacctaagattgatttatttcgcacttgtatcgccgctattccccgtcttatccctgacgggatgagtaggaccgaccttattgagctgctggctcgcctcacaattcatatggatgaggagctgagggccttggcatttaacactcttcaggcgctaatgcttgattttccggattggcgcgaggacgtactctcggggttcgtctatttcattgtgcgcgaggtgacagacgtccatcctaccttattggataacgctgttaaaatgctggtgcagctgattaaccagtggaaacaggcagcacagatgcataacaagaaccaagacacgcagcacggggtggccaatggagccagtcatccgccacctcttgaacgcagcccatactctaatgtattccacgtggtagaaggatttgcacttgtcatactgtgttctagccgaccagctacaagacgtctggcagtatctgtgctgcgggagataagagctctgtttgccttgcttgagatcccgaagggcgacgacgagctagccatcgacgttatggacaggctgagccctagtatccttgagtcatttatccatctgaccggggctgatcaaacaacattactgtactgcccgagcagtatcgacctccagacactggccgaatggaacagctcccctatttcccaccagttcgacgtgatttcccctagtcatatctggatttttgcgcacgtgacccagggccaggacccttggatcataagtctctcgtctttcctgaaacaggagaatctgccaaagcattgctctaccgctgtaagctacgcctggatgttcgcgtacacaagactccagttgctgtcaccccaggtagatatcaacagcccaattaatgccaaaaaagtcaataccaccacgtcctccgacagctatattggcctgtggagaaactaccttatcttgtgctgcagcgccgctacctccagttcatccacgagcgctggctctgtgagatgcagccccccagagaccctggcctctaccccagattcgggttatagcattgatagtaaaatcatcgggatacccagcccgagtagcctgttcaaacacatcgttcccatgatgcgatcagaatctatggaaatcaccgagtcgctggtcctcggattaggacgaacaaacccaggcgctttcagggagcttatagaggagcttcaccccattattaaggaggcgctggagcgcagaccagagaacatgaagaggcgcaggagacgggatatcttgcgggttcagcttgtgcgcatctttgaattgttagctgacgcgggagtcatttcacacagcgcctcaggcggacttgacaatgaaacccacttcctgaataatactctgctggaatatgttgacctgacacgacagttactagaggctgagaacgagaaggacagtgacacactgaaggacatacgatgtcattttagcgcgcttgtggccaacataattcagaacgtgcctgtacaccagcggcgatccatttttccccagcagtcacttaggcacagcttgttcatgctgttctctcactgggcgggacccttctcaataatgtttacacccttggaccggtattctgatagaaacatgcagattaaccggcaccaatactgcgccctgaaggcaatgagtgcggtgctgtgttgcggccctgtagcagacaatgtaggactctcaagcgacggctacctctacaagtggctagataatattttagacagccttgacaagaaagtgcaccagctgggatgtgaggcggttaccctgctgctcgaactgaatcctgaccagtccaacctcatgtattgggctgttgatcggtgttatacaggttccggcagggtggcagccggttgctttaaagccattgccaatgtttttcaaaaccgggattatcagtgtgataccgtgatgttgttgaatctgatactctttaaggctgcagactcttctcgatccatttacgaggtggcaatgcaacttttacagattttagaacccaaaatgtttagatacgctcacaaattggaggttcagaggactgacggggttctgagccagctgagtccactccctcatctctattcagtcagctactatcagctgtctgaggaactggcgagagcctaccccgagctgactctggctatcttttccgagatttcccagcgaatccagaccgcgcatcctgccggacggcaagtgatgttacattacctattgccatggatgaataatatcgagctggtggacttaaagcccctgccaacagccagaaggcatgatgaggacgaggatgattctctcaaggatagggagctgatggtcacttcaagaaggtggctccggggagaagggtgggggtctccccaagcaaccgccatggtcttgaataatttgatgtacatgactgcgaaatacggtgatgagctggcctggagtgaggtggaaaatgtctggacaacacttgcggatggttggccgaagaatctgaagattatcctgcacttcctgatcagtatctgcggtgtgaactccgagccctctctgctaccatacgttaagaaagtgatcgtctacctgggcagggacaagaccatgcagctactcgaggagctggtcagcgaactgcaactgaccgaccctgtgtcctctggcgttactcacatggataatcctccctattacagaattacatccagttacaaaattcccagcgtcacgtccggaacaacttccagttcaaataccatggtcgctcccactgacggaaatcctgacaacaaacctatcaaggagaacatcgaagagtcctacgtgcatttggacatctatagcggtttaaatagtcatttaaatcggcagcatcatcggctggaatctcgttattccagtagttctggcggaagctatgaggaggagaaaagcgatagcatgccattgtactctaattggagactaaaggtcatggagcataaccagggcgagccgctgccattcccgcctgccggaggctgctggtcccccctcgtggactatgttcctgaaacatcatcaccaggcctccccctgcacaggtgtaacatcgctgtgattctcctgactgacctcatcatagatcacagcgtcaaggtagagtggggatcatatcttcaccttctgttgcatgcaatcttcattgggttcgaccattgtcatcccgaggtgtacgaacactgcaagcggctcctgctgcacctgcttatcgttatggggcctaattcaaacattcgtaccgtcgccagcgtcctactcagaaacaaggagtttaacgagcccagagtactgactgtgaagcaagtggcacaccttgactataattttactgctggtatcaacgatttcatcccagattaccagccctctccaatgaccgacagcggactgagctcaagtagtacttcatccagtatcagtctggggaataacagtgctgcaattagccacctacacactacgattctcaatgaagtggatatctcagtggagcaggacggaaaggtgaagactctaatggagttcatcacatccaggaaacgcggtccactgtggaaccacgaggacgtgagtgctaaaaacccttcaattaagagtgccgagcagctaacgaccttcttgaagcatgttgtgtcagtctttaaacagagctctagcgaggggattcacctcgaacaccatctgagcgaagtggctcttcaaaccgccctgagctgttcctcccgccattacgccggacggtcttttcaaatttttagagccttgaaacagccactaaccgcgaccacactctcagacgtactgtcacggcttgttgagactgttggagatcctggtgaggatgcccagggattcgtcatcgaattactgttaacgcttgagagcgccattgatacgctggcggaaacaatgaagcattacgaccttctaagcgcgctatctcagacgtcatatcacgaccctatcatggggaacaagtacgctgccaataggaagagtactggacaacttaatctatccacatcacctattaattcttccagttacttaggctataattcaaatgccaggagtaacagcttacggctcagccttattggtgaccggcgtggcgaccggagacggtccaatactctggatataatggacggacggatcaatcactctagctctctggctagaacccgctctctgtcctctctgagagaaaaaggaatgtacgacgtacaatcaaccacagagcccaccaatttgatggcaaccattttctggatagccgcttccctgttggagtctgattatgagtatgagtatctgctggccctcagactgcttaacaagctgctgatccacctacccctagacaaaagcgaatcccgcgaaaagattgagaacgtccagagcaaactcaaatggacaaatttccccggtctgcagcagctctttctaaaagggtttacgtccgcttccacccaagagatgacggttcacctactgtccaaactgatctctgtctctaagcacactctggtggacccttctcaacttagcggcttcccactgaacatcctttgcctcttaccacatctgatacagcactttgacagtcctacccaattctgcaaggaaacagcctcccgcatcgctaaagtctgtgccgaagagaagtgtcccaccttggtaaaccttgctcacatgatgagcctatactccacacacacctattcgagggattgttccaattggattaacgtggtctgcagatatctgcatgattcgttttctgacacaacttttaatctggtcacctacctggccgagctgttggagaaaggtttgagttcgatgcagcaaagcttgctgcagataatctactccctcctctctcatatagacttatctgccgctccagccaaacagttcaatcttgagattattaagatcattggcaagtacgtacaatctccatattggaaggaggcattgaacatcttgaagcttgtcgtatcacgctccgcttccctcgttgtgcctagcgatatccccaagacgtatggaggggatacgggctcccccgagatctcattcactaagattttcaacaatgtgagcaaggagctacccggaaaaactctcgattttcactttgatatcagtgagaccccaattatcgggaataagtacggagatcaacattcagccgcagggagaaatggaaaacctaaagtgatcgctgtgacccggagtacctctagtacgtccagcggctccaattccaacgccctcgtgcccgtgtcttggaagcggcctcagctatcccagcgaagaacgcgcgaaaagctgatgaacgtgctgtcactgtgtggcccagagagcgggctccccaagaatccaagtgtggtgttttctagcaatgaggacctggaggttggagatcagcagacatctctgatctccaccaccgaagacattaatcaagaagaggaagtggccgtggaagataactcaagcgagcaacagttcggggtctttaaagactttgatttcctggacgttgagctggaggatgccgaaggagagtcaatggacaactttaattggggggtgagacgtcggtcactggatagcatcgacaaaggcgacacaccctctttgcaggaatatcagtgtagtagctctaccccatcactgaacctgacaaaccaagaggacacggacgaatcttctgaagaagaggctgctttgacggcttctcagatcttgtccaggactcaaatgctcaactccgatagtgcaactgatgagaccatcccggaccacccagatctgctgttgcaatcagaggattccacaggcagcattaccaccgaggaggtgttgcagattagagatgagactcccacactagaggccagcttagacaacgctaattcacgtttacctgaagacaccactagcgtgctgaaagaggagcacgttacaacttttgaagatgagggcagctacatcatccaagaacagcaggaaagccttgtgtgtcagggcattttggatctggaggaaaccgaaatgcccgagccactagcacctgaatcatatcctgagagtgtgtgcgaagaggacgtaacgctggcactgaaagagctggacgaaaggtgtgaagaggaggaagcggactttagcggtctgtctagtcaggacgaagaggagcaagatggattccctgaggttcagacatctcctctccctagtcctttcctttctgctattatcgccgctttccagccagtagcgtacgatgacgaagaggaggcttggcgttgtcatgttaaccagatgttgagcgatacagacggatcttccgccgttttcacctttcatgtattcagcagactgtttcaaactattcaacgaaaattcggcgaaattacgaatgaggctgtcagtttcctcggagattccctccagagaatcggaacaaaattcaagtcctctcttgaggtaatgatgttgtgctctgagtgccctaccgtttttgtcgatgcagaaacacttatgtcttgcgggttgctggaaaccctgaagttcggcgtactggagctgcaggagcacctggacacatataacgtcaagcgcgaggcggctgaacagtggctcgatgactgtaaaaggactttcggagccaaggaagacatgtaccggatcaacaccgatgcccagctaaacgagatcctggtagagctcgagctgtgcaggcggctgtataagctccattttcagctattgctcctctttcaagcgtattgcaagttaatcaatcaggttaataccatcaagaatgaggccgaggttattaatatgagcgaagagctggctcagttggagtcgatcctcaaggaagcagaaagcgcatccgagaatgaggaaattgatatttccaaggctgcccagactactatagaaactgccatccactctttaattgagactttgaagaacaaagaattcatcagcgccgttgctcaggtgaaagcgttccggtctctttggccatcagatatctttggctcttgcgaggatgacccggtgcaaaccctgctgcacatttacttccaccaccagacactgggccagactggttctttcgctgttataggctccaacctcgatatgagcgaggcaaactataagctaatggaattaaacctcgagattagggaatcattgcgaatggtccagtcctatcagctgctggcccaggctaagccgatggggaatatggtatcaacaggtttcta

SEQ ID NO: 56502 - DNA, 549 bp, Artificial Sequence
  Description of Artificial Sequence: Synthetic coding sequence
atgcgggaacctatatatatgcactctaccatggtctttctcccttgggagctccacactaaaaaaggacccagtcctccagagcagtttatggccgtgaagctgtctgactctagaatcgcacttaagtccggctacggtaagtatctgggcataaacagtgatgagctcgtcggacacagcgacgccatcggtccaagggagcagtgggaacccgtgttccagaacggcaagatggcactgctggccagcaacagttgcttcatcaggtgtaatgaagccggtgacatcgaagcaaagagcaagaccgcaggggaggaagagatgattaagatcaggagttgtgctgagaaagaaaccaagaaaaaggatgacatcccagaagaggataaaggcaacgtcaagcaatgcgagatcaattacgttaagaaattccagtctttccaggaccacaagctgaaaattagtaaggaagagagcaaaattttgaaaaaggcccagaaggacggcttcctgcatgagaccttactcgatagggaacccaactag

SEQ ID NO: 56503 - DNA, 549 bp, Artificial Sequence
  Description of Artificial Sequence: Synthetic coding sequence
atgagagagcctatctatatgcactcgactatggtgttcttaccttgggagttacataccaagaagggcccatctccacccgagcagtttatggcagttaagctgtccgatagtcgcatcgccctgaaaagtggatatgggaagtatctgggtatcaatagcgacgaactggtcgggcacagtgatgccatcggccctagggagcagtgggaacccgtgtttcagaatggaaaaatggcactgctcgcttctaattcttgtttcattcggtgcaacgaggctggcgatattgaagcaaagtcaaagactgccggagaggaagaaatgattaagatacgcagttgtgccgagaaagagacgaaaaaaaaagacgatatccccgaagaagacaagggcaatgtgaaacagtgtgaaattaactacgtgaaaaagttccagagctttcaagatcataagttgaagatctctaaagaggaatcaaagattttgaaaaaggcccaaaaagatggattcctccacgaaaccctgctcgatcgtgagcccaattag

SEQ ID NO: 56504 - DNA, 369 bp, Artificial Sequence
  Description of Artificial Sequence: Synthetic coding sequence
atggatgagggaacctacatccatgcgctcgacaatggtttatttacgctaggggctccacacaaggaggatattgacgagggccctagcccgccagagcagtttatggccgtgaagctgtctgattcccgcatcgctctgaagtcgggatacggaaagtacctcggaattaactccgatgaactggtaggccattccgatgccattgggcctcgggagcagtgggaacctgtattccagaacgggaagatggcactattggcgagcaattcatgcttcatccgctgtaatgaagctggcgatatcgaggctaaatcaaaaactgcaggggaagaggagatgataaaaatgttgtcacatcatctttag

SEQ ID NO: 56505 - DNA, 837 bp, Artificial Sequence
  Description of Artificial Sequence: Synthetic coding sequence
atgggcaaggggaatgaagatagcgacctgcattgcagcagtatccagtgtagcaccgaccagccccctttccagcagatctcctttaccgaaaaaggatcagatgagaagaaacctttcaaggagaaaggcaaaacagcctttagtcactccagcgagaagcacatccaacgccagggatcagagcccaatcctaataaggagaactcagaagagacgaagttgaaagcgggtaactcaaccgccggaagtgaacccgagtcttcctcctatagagaaaattgcaggaagcggaaaatgtccagcaaagacagctgtcaggacacagctggaaattgcccggagaaagaatgcagcctgtcactgaataagaagtcgcgttcctcaacagcggtgcataattcagagatccaagaaacgtgtgacgcacaccacaggggccattcacgtgcatgcaccgggcacagtaagaggcatcgttcccgggcactgggcgtgcagactccgagtattcggaaatccttggtgacatccgtcagagccatgagcgaggccgtctaccaggatctggctcaggtttgggctcagcagatccattcccctctgacgtgcgagcagctcacgctgctgactagactcagagggcctttgtgcgcgcaggtccagacactatacagcatggcaactcaggccgcatacgtctttcctgctgagagttggttggtgcccgcaactctgccgggacccggagagtccgcattggaccgggaggcacatccctttccaggacaggagataactgagacagtgtccgggtctgacgaagccaaactctag

SEQ ID NO: 56506 - DNA, 849 bp, Artificial Sequence
  Description of Artificial Sequence: Synthetic coding sequence
atgggaaagggaaacgaggatcccgatctgcactgttcaagtatccagtgcagcaccgaccagcctccctttcagcagatctcgttcacggaaaaaggcagcgacgagaagaagcccttcaagggtaaaggcaagactgcattcagtcactcttctgaaaagcatactcagagacaggccggaagcgacccgaaccccaacaaagaaaactctgaggaaaccaaactgaaggccggaaactccacagcagggagcgaaccggagtctagttcctaccaggaaaattgtagaaagagaaaaatcagctctaaggatatctgtcaggatagagccggaaactgcccagaggaggaatgcaacttgaccttgaataagaaatcgaggtcatccaccgcagttcataattctgagattcaggaaacatgtgacgcccaccatagaggaagctctagggcatgtaccggtcgatccaagagacacagatctagagcactggaagtgcagacccccagccttcgcaaatcattagtgacatcggttcgtgcgatgtctgaggctgtttatcaggacttagcccaagtctgggctcagcagattcactcccctttgacatgcgaacagctgactctgctgacccgacttagaggaccgctctgtgcccaggtccaaacactgtattctatggctactcaggctgcatacgtgttcccggctgagagctggctcgtaccggctaccctgccaggacccggagactcagctctcgatagggaggcacacccgttcccaggccaggagatcactgaacctgtgagtggcagcgatgaggctaagctgggcgctccctag

SEQ ID NO: 56507 - DNA, 984 bp, Artificial Sequence
  Description of Artificial Sequence: Synthetic coding sequence
atgggccgtacctccaaagataagagagacgtgtactaccgtctggccaaggaaaacggctggcgtgccaggtccgcttttaagttgctccaactggataaggagttccagctattccagggcgtcacccgggctgtggatctatgcgcagccccagggtcatggagtcaagtcttgtcccagaagatcgggggacagggcagtggacacgtggttgctgtggaccttcaggcaatggcccctctccccggtgtggtgcaaattcagggagatatcacacagctgtctaccgccaaggagatcatccaacactttaaaggatgccctgctgatctggtggtgtgtgacggcgctcccgacgtcacagggctgcatgatgtggacgagtatatgcaggcacagctcctcctggcagccttaaacattgcaacgcacgtgctgaagcccggaggatgcttcgtggcaaagattttccgtgggagagacgttacgttactgtattctcaactccaggtgttcttcagctctgtgctgtgcgccaagcccaggtcatccagaaactctagtatagaggcctttgccgtgtgccagggttatgacccacccgaggggtttatcccagatctgtctaagcctctactcgatcacagttatgactttaatcagcttgacgggcctactagaatcattgtccccttcgtgacatgcggcgatctgtccagctacgattcagaccggagttacccactggacctagaagggggaagtgagtataagtacaccccgccaacccaaccgcctatcagtcctccttatcaggaggcgtgcaccctgaaacggaaagggcagttggctaaggagattagaccccaagattgcccaatttcacgcgtggacacctttccgcagcccctcgccgctccccagtgtcacacactgctcgcccctgagatggaggataacgagatgagctgcagtccgtag

SEQ ID NO: 56508 - DNA, 984 bp, Artificial Sequence
  Description of Artificial Sequence: Synthetic coding sequence
atgggcagaacttccaaggacaaacgagatgtctactatcgtctcgcaaaagagaatgggtggcgggctagaagtgcattcaaactgctgcaactggataaagagttccaactattccaaggggtgacacgggcagttgacctgtgtgctgcaccgggttcttggtcacaggttctatcccagaagatcgggggacagggcagcggccatgtggtggccgtggatttacaggccatggcaccacttcctggcgtggtccaaatacagggagatataacgcaactatctactgccaaagaaatcatccaacacttcaagggatgtcccgcagacctcgtggtttgtgacggggcacccgatgtaaccgggctccacgacgtggatgagtatatgcaggcccagctgctcctagctgccctgaatatcgcaacccatgttctgaaaccaggcggatgcttcgtagcgaagatcttcagaggaagggacgtgactcttctgtactcccaacttcaggtgttcttcagttctgttttgtgcgctaagcctagaagctctagaaactcttctatagaagcattcgccgtgtgccagggttatgaccctcctgaaggtttcattcctgatctatctaaaccacttcttgaccatagttacgacttcaatcagttagatggcccaaccaggattatcgtgccattcgtgacctgcggggacctgtccagttatgatagcgatagatcataccccctggacttagaagggggttccgaatacaaatataccccccctacccaacctccaatcagccctccttaccaggaggcttgcactctaaagagaaaagggcagttggctaaggagatcagacctcaagattgccccatatctagagtggatacatttccccagcctcttgccgctcctcaatgtcacacactgctcgcccctgagatggaagataatgagatgtcgtgctctccgtag

SEQ ID NO: 56509 - DNA, 411 bp, Artificial Sequence
  Description of Artificial Sequence: Synthetic coding sequence
ctgcttggggagagggcaatccctagagcagggtctcaggcgggatggcggcctaccctggggtccgttgggggtcgtgtggggtcccctagctcagcggaatgttgtagaccttttcccggacagaggaggtggaattttgttgcactgcagccccctgctaggcgctgggatctgacaatgttgccaaggctcgtgttaaatagctgggcgcaggccatacttcctcctcagccccctaaggtgctgggcctgcaggatcctggcgcaagcttcggaagtcggctgcacccagctctagaaaggtcgccaggcatgatttactcgtgggccgtattcttgtacccaggcgtgcacccagtgcatccccgtaatacagacctgataactgtgacgaagtctgacgggtag

SEQ ID NO: 56510 - DNA, 450 bp, Artificial Sequence
  Description of Artificial Sequence: Synthetic coding sequence
atgaagcctgccggtaacgggttcccttctcctctggccggaccagggtcacgtcggggatgcgtgccaggcctgaccacctggatcagagcacgggctagggaaacaggttcgcgaaggggccgaaatgtgttctcgcctgagagggcggctggcagtggtggctgtttttgttctgggcgaatcccgcgtgtgagcgccgtagacgctcttcgcgtggccggtgctaggcgcgcagctgtgtctcgcggaaaggccggagttccactccggtacagggaacggcatcttgagcttagcgagtggcccaggaaacccgctcgtgcccatttccctgctagaactggctgttggtggttttggtggctcctgtctgggggaacacctggcaccagcaaaggtggtttcatttggttatatttaacttggcagtttttgctgaataagtag

SEQ ID NO: 56511 - DNA, 747 bp, Artificial Sequence
  Description of Artificial Sequence: Synthetic coding sequence
atgggaattatggcggcttcccgccctctgagtcggttctgggaatgggggaagaatattgtctgcgtgggacgcaactatgcggatcacgtgagggagatgagaagcgcggtcttgagtgaacctgtgctgtttttaaaaccttcaactgcctatgccccagagggtagtccgatcctgatgcccgcatatacccggaacttacaccacgagttggagctgggggtggtcatgggaaagcgttgtcgtgccgttcccgaggctgccgctatggactacgtaggaggatatgccctgtgccttgacatgacggctagggacgtacaggacgagtgtaagaaaaagggacttccgtggacgctggctaagagcttcaccgcaagctgtccggtttcagccttcgtgcctaaggaaaagatacccgacccgcacaagcttaagctgtggctgaaagtgaacggcgaactccgtcaggagggtgaaacatcatccatgattttttccatcccttacatcatcagctatgtctccaagatcatcaccctagaggagggagacatcatcttgactgggacgcctaaaggcgtgggacctgttaaagagaacgatgagattgaggccggaatacacggtctccgacaaggtctgactctgtctccgaaactcgaatgttccagcgctattactgcacattgctccctggaactccccggtagtagtaacccacccagtgcatctcgcttttag

SEQ ID NO: 56512 - DNA, 681 bp, Artificial Sequence
  Description of Artificial Sequence: Synthetic coding sequence
atgggcattatggcagcctcaagaccactgtctcggttctgggagtgggggaaaaatattgtgtgcgtggggcgaaactacgccgaccacgtgagggagatgagaagcgctgtgctgagtgagcctgttctgtttctgaaaccatccacagcttatgcaccagaaggatcccccatccttatgcctgcatacacacgtaatctgcaccatgagctcgaactcggagtcgttatggggaagagatgtcgggcagttccagaagcggctgcaatggattacgtcggcggttacgccctctgtctcgacatgaccgcaagagacgtgcaggatgaatgcaaaaagaaggggctcccatggaccctcgctaaatcttttacggcgtcttgcccagtgtctgcgtttgttccgaaggaaaaaatcccagaccctcacaaactgaaactttggctgaaagttaatggtgaattgcggcaggaaggcgaaacgagcagtatgatcttctctattccttacataatatcttacgtgtcaaagatcatcacactcgaggaaggcgacatcatcttgacaggcacacctaagggtgttgggccagtaaaagaaaatgacgaaattgaggccggaatccacggactcccgaaagtgagcagtgcaacgctccctgtgcgactgcaagaatag

SEQ ID NO: 56513 - DNA, 675 bp, Artificial Sequence
  Description of Artificial Sequence: Synthetic coding sequence
atgggaatcatggcagctagcaggccattgtcaaggttctgggaatggggaaaaaatatcgtctgcgtcggtcgaaattatgcagatcacgttcgagagatgcgttcagcggtgctgtcagagcctgtactttttctaaaaccaagtactgcctacgcccctgaagggagccctatactcatgcccgcatatacccggaatcttcaccacgagttagagctgggcgttgttatggggaaacgatgtagagccgtgcctgaggccgcagctatggattatgtcggagggtacgctctttgcctcgacatgacagcccgtgatgtgcaggatgagtgtaagaagaagggtcttccttggaccctagcaaaatcatttaccgcttcctgtcccgtgagtgcctttgtccccaaggagaaaatcccggaccctcataaactaaagctgtggttgaaggtgaacggtgaactgcggcaagaaggagagacttcttccatgattttttcaatcccttacattattagttatgtgtccaagatcattacactggaggaaggagatatcattcttacaggcactcctaaaggagttggacctgtcaaagagaacgatgagattgaagcaggaatccacggcctggtatcaatgaccttcaaagtggagaaaccagagtactag

SEQ ID NO: 56514 - DNA, 1134 bp, Artificial Sequence
  Description of Artificial Sequence: Synthetic coding sequence
atgtacaccttcgtggtgcgcgatgagaactcatccgtttacgcagaggtgtcacggctcctgctggccactggccattggaagagactgcggcgtgacaacccgaggttcaacctgatgctgggcgagagaaatcgcctccccttcggtagactaggccacgagcccggattagtgcagctggtcaattattaccgcggagcagacaagctgtgtcggaaggcctcactcgtgaaactgataaaaacctcgccagaactggccgagagttgtacttggttccccgaaagctatgttatttaccctacaaacctgaagacacctgtggcacccgcacagaacggtattcaacccccaatctccaacagccggacggatgaaagagaattcttcttggcgtcctataataggaagaaggaagacggcgagggtaacgtgtggattgcgaaaagttcagccggagccaagggcgaagggatcctgatttcctcagaggcttctgagttgctggactttatcgataatcaagggcaagttcacgttatccagaaatatctggagcacccactgctgttggaacctgggcacagaaagtttgatatacggtcatgggtgctggtcgaccaccaatacaacatttacctgtacagggagggcgtgctaaggaccgcgagcgagccataccacgtggataacttccaggataagacctgtcaccttaccaatcactgcattcagaaggagtattccaagaactatggtaagtacgaggaagggaacgagatgttctttaaagaatttaaccagtatctgacttctgctctcaacatcactttggaatcgagcatactactccagataaagcacataatacgcaactgccttttgagcgtggaacctgcgatcagtactaagcacctgccttatcagtcctttcagttgttcggttttgactttatggtggatgaggaactaaaggtctggttgatagaggtgaatggcgcacccgcatgcgctcagaaactatatgcagagctctgccagggaatcgtcgacatcgccatctcatctgtcttcccccctccagacgttgaacagcctcaaacacagccagctgcctttatcaaactttag

SEQ ID NO: 56515 - DNA, 384 bp, Artificial Sequence
  Description of Artificial Sequence: Synthetic coding sequence
atgttggtttcgggccgtcgcagactgttgactgtcctgctgcaggctcaaaagtggccctttcaacctagccgggacatgagactggtgcagttcagggcacctcacttggtgggaccccatctcgggttggaaaccggaaatggcggaggcgtgataaatttgaatgcatttgatccgacactgcctaagacaatgacgcagtttcttgagcagggggaagccacactttcagtggcacgacgcgcactggcagcccaactgccagtgctcccacgtagcgaagtgacttttttagcccctgtgactaggccagataaggtggtctgcgtggggatgaactacgtggaccactgcaaagagcaaaatgtgcccgtgccttag

SEQ ID NO: 56516 - DNA, 246 bp, Artificial Sequence
  Description of Artificial Sequence: Synthetic coding sequence
atgcttgtgtccggcagacgtaggctgctgacagtgttactccaggcgcagaagtggccgttccagcctagtcgagacatgagacttgtgcagttcagagctcctcacctggttggaccccacctgggtctcgagaccggcaacgggggaggggtcattaatttgaacgcattcgaccccacccttcccaagacgatgacccaattcttggagcagggagaggctacccttagcgttgccagatag

SEQ ID NO: 56517 - DNA, 945 bp, Artificial Sequence
  Description of Artificial Sequence: Synthetic coding sequence
atgttggtgtccggcagaaggaggttactgaccgtcttgctgcaagcccaaaagtggcctttccagccaagcagggatatgagactggtgcagttccgagcaccccatctggtggggcctcatctgggccttgagactggaaacgggggaggggtaatcaacctgaatgcatttgatcccacactgcctaagacaatgacgcagttccttgaacagggagaagccaccctaagtgtggctaggcgagcactggccgctcaactaccagtgctgcctagaagtgaggtaacctttcttgccccagtgacccgacctgacaaagtggtttgcgtcggtatgaattacgttgatcactgcaaagagcaaaacgtccctgtgccgaaggaaccaataatcttctccaagttcgcgtcttcaatcgtaggaccctacgatgaagttgtgctgccccctcagtctcaggaagttgactgggaggtggagctcgcagtcgtaattggaaagaaaggcaagcacatcaaggcaactgacgccatggctcacgtcgccggattcaccgtggcacacgacgtctccgctcgggactggcagatgaggaggaatggcaaacagtggctgcttggcaagaccttcgacacattttgcccattgggaccggctctagtgacaaaggattcggtggcagacccacataatttgaaaatttgctgtcgggtgaacggcgaggtcgtgcagtcggggaataccaatcagatggtgtttaaaacagaagatctgatagcgtgggtgagccagttcgttactttttatccaggagacgtgatcctgacagggactccaccaggggtgggtgtgttcagaaagccacccgtgttcttgaaaaaaggagacgaggtccaatgcgaaatcgaggaactcggtgtgataattaacaaggtggtctag

SEQ ID NO: 56518 - DNA, 945 bp, Artificial Sequence
  Description of Artificial Sequence: Synthetic coding sequence
atgcttgtatccgggcgaagaagactccttactgcacttctgcaggctcaaaaatggccctttcagccttcacgcgacatgagactagttcagttcagggcaccccacctcgtgggtccccacctaggtctagagaccggcaacggaggaggtgttataaatctgaacgcatttgaccctactctgcccaagaccatgactcagttcctggaacagggcgaagcgacattgtctgttgccaggcgcgcattagcagcgcagctccctgtacttccatggtctgaagtcacattcctcgctccagttacatggcccgacaaggttgtgtgcgtcggaatgaattatgtggatcactgtaaagagcagaacgtgcctgtccctaaagaaccaataatctttagcaagttcgcgtcaagtattgtggggccatacgatgaagtggttctcccaccgcagtcccaagaggtcgactgggaagtagagctcgctgtagtgattggcaaaaagggcaagcatatcaaggccacagatgcgatggcacacgtggcaggttttaccgttgctcacgatgtcagtgctcgggactggctcacaagacgaaacggcaagcagtggcttctcggtaagactttcgatactttttgcccgttggggccagccctcgtcacaaaggacagcgttgccgaccctcacaatcttaaaatctgttgccgcgtgaacggggaggtggtccagtcttctaacactaatcaaatggtgttcaaaaccgaggacctgatcgcctgggtaagtcagttcgtgacattctaccctggcgatgtgattctgacaggcacaccaccaggcgtgggagtatttcgaaagcctccagtgttcctcaagaaaggtgacgaagtgcagtgcgaaatcgaggaattgggggttatcattaacaaagttgtgtag

SEQ ID NO: 56519 - DNA, 945 bp, Artificial Sequence
  Description of Artificial Sequence: Synthetic coding sequence
atgctggtgagcggccgtagaaggctgcttaccgccttgctgcaggcgcagaaatggccttttcagccaagtagggatatgaggttagtgcagttcagggcccctcatttggtgggtccccacctggggttggagacaggtaacggaggtggggtgatcaacttgaatgccttcgatcctaccctgcctaagacaatgacacagttcctggaacagggggaggccacacttagcgtggcgcgtcgcgcattggcagcccagcttcccgtcctgccatggagcgaagtcactttcttagcaccagtaacatggccagataaagtggtgtgcgtcgggatgaattacgtggatcactgcaaggaacaaaatgtgccagtacctaaggagcctatcatcttttccaaatttgcttctagcatcgtgggaccttatgatgaagtggtcctccccccacagagtcaagaggtcgattgggaggtggaactggcagtggtgattggcaagaaggggaaacatataaaagccaccgatgcaatggcgcatgttgcgggattcaccgtggctcacgacgttagcgctcgcgattggttaacacgacggaacggcaaacaatggcttctcggcaaaaccttcgatacattctgtcctctaggtcccgcactcgtaactaaggattccgttgcagatccacataatttgaaaatttgttgcagagtgaacggcgaagtcgtccagtcaagtaatactaaccagatggtatttaagaccgaagatctcatcgcatgggtgagccagtttgtgacattctatcccggagacgtgatccttaccggaactcccccaggcgttggtgttttcaggaaaccaccagtgttcttaaaaaagggagatgaagtgcagtgcgagattgaagaactgggtgtgatcatcaacaaagtggtgtag

SEQ ID NO: 56520 - DNA, 945 bp, Artificial Sequence
  Description of Artificial Sequence: Synthetic coding sequence
atgctggtcagcggccgacggcgtcttcttaccgccctcctgcaagcgcagaagtggccttttcagccgtcgagagatatgcgcctggtgcaatttcgagcacctcatctggttggccctcatctgggactcgagactgggaacggcggtggcgttatcaatctgaatgccttcgaccccactctgcctaagaccatgactcagtttctcgaacagggggaggccacactgagtgttgcacgacgggcattggccgcacaactgccagtcctgccttggtctgaggtcacattccttgcccctgtgacttggcctgacaaagttgtgtgcgtcgggatgaattacgtcgaccactgtaaggagcagaacgttcccgtcccaaaggagcccataatcttctctaagttcgccagtagcattgtgggaccgtacgacgaagtggtgctgccccctcagagccaggaagtggattgggaagtggagttagctgtggtgatcggcaagaaaggtaaacatatcaaagcaacagacgccatggcccatgtcgccggatttacagtggcacacgatgtgtctgctcgtgattggctgacacggcgtaacgggaagcagtggcttctagggaaaaccttcgacactttctgcccccttggtccggctctcgtgaccaaggattcagtggcggacccccacaatcttaaaatctgttgtagagtgaatggcgaggtggtacagtcaagtaacaccaatcaaatggtcttcaagacagaggacctaattgcatgggtcagccagtttgtcacattttatcctggcgacgtgattctcaccggtacccccccaggcgtgggcgtgttcaggaaaccacctgtttttttgaaaaagggagacgaggtgcagtgcgagatagaggaactgggtgtgattatcaataaagttgtgtag

SEQ ID NO: 56521 - DNA, 468 bp, Artificial Sequence
  Description of Artificial Sequence: Synthetic coding sequence
atggccacgcgaaaccctccccctcaagactacgagtctgacgacgatagctatgaggtgctagaccttaccgagtacgcgagaagacaccagtggtggaacagggtgtttggacactcgtcaggcccaatggtggaaaaatactcagtggcaacccagatagtgatggggggagtgaccggctggtgtgcaggttttttgtttcaaaaagtagggaagctggcagcaactgcagttggcggtggctttcttttgcttcagatcgctagccatagtggctatgtgcagatcgactggaaacgcgtggagaaagacgtgaataaagcaaagcgtcagattaagaagcgggcaaataaagcagcacctgagatcaacaacctcatcgaggaggcgacagagtttatcaaacaaaacatcgttatcagcagcggcttcgttggaggtttcttactcgggctcgcatcctag

SEQ ID NO: 56522 - DNA, 339 bp, Artificial Sequence
  Description of Artificial Sequence: Synthetic coding sequence
atggagctcgtgttggtgttcctgtgttccctgttagccccaatggtgttggcgtctgcagcagaaaaagaaaaagagatggacccctttcactacgactaccagaccttgcgtattggcggactggtgtttgctgtagtgctgttcagcgtgggtatcctactgatactgaggccccaggagatgaggaagccgaggtggagaacaagctctccgccaatgcagcagagccccagaaagcagcgcacggaagtgcagccctctggaggccgaagacagcctcagggtggtaggggacctgttctcctctggcaaaaaatccctctgtgggggcagtag

SEQ ID NO: 56523 - DNA, 339 bp, Artificial Sequence
  Description of Artificial Sequence: Synthetic coding sequence
atggagcttgttctggtgtttttatgtagtctgttggctccaatggttctggcctcagctgctgaaaaggagaaggaaatggaccctttccattacgattatcaaaccttacgaataggaggacttgtcttcgctgtagttctcttcagcgtgggtatcctgctgatcctgagaccgcaggaaatgaggaagcctcgttggcgcacgtcttccccacctatgcagcagtcgcccaggaaacagaggacagaggtacaaccctctggcggacgaaggcaacctcaaggtggcagaggtcccgtgctcctgtggcagaagatcccgctgtggggccagtag

SEQ ID NO: 56524 - DNA, 3537 bp, Artificial Sequence
  Description of Artificial Sequence: Synthetic coding sequence
atggggcaggatgctgaagacacatccgaagagcccccagagaaagaggaacttgctggagtgcaggaagcagaaactgcaactgactgccctgaggttctcgaggaaggctgcgaggaagctactggcgtgaccggcggtgagcaagtggatttgagcgaacctccagaccacgagaaaaagactaaccaggaagtcgctgccgcaactctcgaggaccacgcccaggatgagtcggcagaggaatcatgtcaaattgtgcctttcgaaaacgattgcatggaagactttgtcacctctttaactggttctccatatgagtttttccccaccgagagcacctctttttgctcagagtcatgcagtccactcagcgagtcagctaaagggctggagtctgaacaggccccaaagctggggttgcgtgccgaggaaaaccccatggtgggcgcactgtgcggccagtgtggcagccttcagggcggagccgcagaaggccctgccgcacccgatgtggtcgtggtgctcgaagaggaagcgctcgatgatgccctggccaacccttacgtcatgggcgtggggcttccgggacaggctgcccctggggagggcggacaagctgcatctgacgctttgggcggatacggaagcaaagaggagctgaattgcgaagccgagggaggcctggtgcccgctgaccgaaagaacacttctacccgggtaaggccccacagtgggaaggtcgcaggctatgtgccagagacagtgccagaggaaacaggaccagaagccggtagtagcgctccaggcatcggaggcgctgctgaagaagtggggaaaactctgttgtccttagaaggtaaacccctggaagcaagtcgagcactccctgctaagcccagggcctttaccctgtatccaaggagcttctccgtggaagggcgtgagataccagtgtctgtttaccaggaacctgaaggcagcggccttgacgaccatagaatcaaacgaaaggaggataacctgtcactgtcatgtgttatagggagcagtggcagttttagtcagcgcaaccatctcccatcctctggcacatccaccccatcatccatggtggatatccccccaccattcgatcttgcatgcattaccaagaagccgatcacaaagtccagccctagcttattaatcgaatctgacagcccagacaaatataagaagaagaagagctccttcaagagattcttggcattgactttcaaaaaaaagacagagaacaagcttcacgttgacgttaacgtgagctcatcacggtccagctccgaatcatcttaccatggaccatcacgaattctcgaagtggaccggaggagtctcagcaattcgccgcaactgaagtcccgcaccggaaagttgagggcttcagagtccccaagcagtctgattttctaccgcgacggaaaacgcaaaggtgttccattttcaagaacagtcagcagagttgagagttttgaggacaggagtaggccacctttcctgccattaccgctgactaaaccaagatccatttccttcccgtccgccgacacctcggactacgagaacatccccgctatgaactccgactacgaaaatatacagattccaccgcgtagacccgctagagcgggtgcctttaccaagctctttgaagaccaaagtcgcgctctcagcactgccaacgaaaacgacgggtatgtcgatatgtcatccttcaatgcatttgaatccaagcagcagtctgcagatcaggatgccgaaagtgcatatacggagccatacaaggtctgtccaatctcctcagctgccccaaaagaagacttaacctcagatgaggagcagcgctcgagcgaggaggaggacagcgcttctcgggacccttctgtgacccacaaggtggagggccagtcacgcgcattagtcattgcgcaggaactcctgtcttctgagaaagcctacgtagagatgttgcagcatctgaatctcgacttccatggtgcagtgatgcgggcactggacgatatggatcacgaaggtcgggacacattggccagggaagagctccgccaaggcctgtctgagcttccggcaatacatgacttgcatcaaggcatcctggaggaactggaggagagactcagcaactgggaaagccagcagaaagttgccgacgtttttctggccagggaacaggggtttgaccaccacgccacacacattttgcagtttgatagatatcttggtctgctttctgaaaactgcttgcatagccccagactagccgcagcagtgcgggaattcgagcagagcgtgcaagggggatcacagactgcaaagcaccggttgttaagggtagtccagcgcttatttcaataccaggtactgctgactgattatctcaacaacctgtgcccagactccgctgagtacgataacactcagggcgctctgagtcttatctctaaggtcaccgaccgggctaacgattccatggagcagggagagaacctgcaaaagctggtgcatatcgagcacagcgtccgcggtcagggggacctcttacagcctggccgagagttcctgaaggaaggaaccctaatgaaggtgacggggaagaaccgtcggccacggcatctctttctgatgaacgacgtgctcctgtacacataccctcaaaaggatggcaaatatcggcttaagaacacccttgcagtcgctaatatgaaggtgtcacggcctgtgatggagaaggtgccatacgcactgaagatagaaacctccgaatcctgcttaatgcttagcgcgagcagctgtgcggagagagatgaatggtatgggtgtctgagccgagctctgccagaagattacaaagcacaggccctggcagcttttcaccatagtgtggagatacgggagcgattaggcgtgagtcttggagagaggccaccaacgctcgtacctgttacacacgtcatgatgtgcatgaactgtggctgcgacttttccttgacactgaggcggcatcattgtcacgcctgtggcaagattgtgtgtagaaactgcagtcgcaacaagtatccccttaaatacttgaaggatcggatggcaaaggtgtgtgacggctgctttggagagcttaagaagaggggacgggcagtccccggtctgatgcgcgaaagacctgtctctatgtctttcccactttcgtccccgagatttagcgggtctgccttttcttcagtgttccagtccattaatccaagcacattcaagaaacagaagaaagtgcctagcgcactgaccgaagataaagtggccctggaatcaatgccgctgctcggctttaccattgcccctgagaaagaagaaggctctagcgaggttggaccaatctttcatctttaccacaaaaagactctcttctattcattcaaagcggaggacactaattccgcgcaacggtggattgaggcaatggaagatgctagcgtcctatag

SEQ ID NO: 56525 - DNA, 24 bp, Artificial Sequence
  Description of Artificial Sequence: Synthetic coding sequence
taagagaagcagtctcagtgctag

SEQ ID NO: 56526 - DNA, 354 bp, Artificial Sequence
  Description of Artificial Sequence: Synthetic coding sequence
atgtcatggaggggtcggtccacctattattggcccagaccaaggaggtacgtgcagcctcctgaaatgattggccctatgagacccgagcagttttccgacgaggtggagcccgctaccccagaggagggcgaacccgctacgcaatgccaagatccagcagccgcacaggagggggaggacgaaggagcatcagctggacagggccctaaacccgaagcccactcacaggagcagggccaccctcagaccggttgcgagtgcgaggatggtccggatggccaggagatggatccccctaaccccgaggaggtgaagactccagaggagggtgaaaaacagtctcaatgttag

SEQ ID NO: 56527 - DNA, 354 bp, Artificial Sequence
  Description of Artificial Sequence: Synthetic coding sequence
atgagttggcggggtcggtcaacttattattggcccagaccaagacgttacgtccagccacccgaaatgattggtcctatgcgcccagagcaattcagcgacgaggtggagcccgctacccccgaggagggtgagccagccacccagtgtcaagaccccgctgcagcgcaggagggagaagacgaaggggcttctgcaggccagggaccaaagcctgaagctcattcccaggaacagggccacccccagacagggtgtgagtgtgaggacggccctgacggacaggagatggatcctcctaatcccgaagaagttaagacacctgaggagggcgagaaacagagccaatgctag

SEQ ID NO: 56528 - DNA, 354 bp, Artificial Sequence
  Description of Artificial Sequence: Synthetic coding sequence
atgtcatggcggggaagaagcacttattactggcctcggccaagaagatacgtccagcccccagaaatgattggacctatgcgccctgagcaattttctgacgaagtcgaaccggctacaccggaggaaggcgaaccagcaacccagcgacaagacccggctgccgctcaggagggcgaagacgaaggagcatctgccggacagggccctaaaccagaagcccactcgcaggagcagggccatcctcaaaccggatgcgagtgcgaagatggccctgacggccaggagatggacccccctaaccccgaggaagtgaagacgcccgaggaaggcgaaaagcagtcacaatgctag

SEQ ID NO: 56529 - DNA, 354 bp, Artificial Sequence
  Description of Artificial Sequence: Synthetic coding sequence
atgagctggagggggaggagcacttactactggcctagaccgcgtcgttacgtgcagccacccgaaatgattggaccaatgcggccagaacagttttcagatgaggtcgaaccagccacaccagaggaaggagagcccgctactcaacggcaggaccccgctgcagctcaggagggggaagacgagggcgcttctgcaggacagggccctaagccagaggcccacagccaggaacaaggtcatccccagacgggatgcgaatgcgaggatggtcccgatggacaagaaatggaccctcccaaccctgaggaggtaaagactcctgaagagggcgagaaacagtcacagtgttag

SEQ ID NO: 56530 - DNA, 354 bp, Artificial Sequence
  Description of Artificial Sequence: Synthetic coding sequence
atgagctggcgcggtaggtccacgtactattggcctcgtcctcgcagatatgtgcagcctccagagatgatagggcctatgcgtcccgagcagttttcggatgaggttgaacccgctacgccggaggagggagagcccgctacacagcgtcaggacccagctgccgcacaagagggcgaagatgagggggcttccgctggccaggggcctaagccggaggcacattctcaggagcagggtcatccgcagactggatgcgaatgcgaagacggtcccgacggccaggagatggatcctcctaacccagaggaagtcaagacacccgaagagggcgaaaaacagagtcagtgctag

SEQ ID NO: 56531 - DNA, 354 bp, Artificial Sequence
  Description of Artificial Sequence: Synthetic coding sequence
atgtcttggcggggacgatccacgtattattggcccaggcccagacggtatgtgcaacctccagaaatgatcggacccatgcgacccgaacaattctctgacgaagtcgaacctgcgactcccgaggagggagaacctgcaacacagcggcaggatcctgccgcagcccaggaaggtgaggatgagggcgcatccgcaggccagggaccaaagccagaagccgattctcaggagcagggccatcctcagacagggtgtgaatgcgaagacgggcctgatggccaggaaatggacccgccaaaccccgaggaagtgaaaacacctgaggagggggagggccagagccagtgctag

SEQ ID NO: 56532 - DNA, 1131 bp, Artificial Sequence
  Description of Artificial Sequence: Synthetic coding sequence
atgtttggcgcagctgggcgtcagcctattggtgcccctgccgcaggcaattcctggcacttctccagaactatggaagagctggtccacgatcttgtgagcgcacttgaggagtctagtgaacaggcccgaggcggattcgctgagaccggcgatcattcccgtagcatttcatgtcccctgaagcggcaggcaagaaaaagaaggggacgcaaaagacgaagttataacgtgcaccatccttgggagaccgggcattgtctgagtgaaggtagcgactccagcttggaggaaccttctaaagactaccgggagaatcataacaacaataagaaagatcattcagattccgatgaccaaatgctggttgcaaagcggagacctagctcaaacctgaacaataatgttcgaggaaagcgccctctgtggcacgagagcgatttcgcagttgataacgtaggaaaccggacactgcgtcggagacgtaaggttaaacggatggctgtcgacctgccccaggacatctccaataagcgcaccatgacacagccacctgagggttgcagagatcaggacatggattccgaccgggcatatcagtatcaggagttcacaaaaaataaggtgaagaaaagaaagctgaagatcattaggcagggtcctaaaattcaggatgaaggggtggtgctggagtctgaggagacaaaccagactaataaagacaaaatggaatgcgaagagcagaaagtctcggacgagctgatgagtgagtctgactcctcatccctgtccagcacagatgccggactctttaccaatgatgaaggcagacagggcgacgatgaacaaagtgattggttttacgaaaaggagtcgggcggtgcgtgcggtattaccggtgtggtgccctggtgggagaaagaagatcctaccgagctggacaagaacgttcccgatcctgtctttgagagtatcctgactggatcttttcccttaatgtcacacccgtctagacgtggattccaggccaggctgtcacgtctccatgggatgtccagcaaaaacattaaaaaaagtggtggtaccccaaccagtatggccaccaattggaccagtgaaattcccctgtag

SEQ ID NO: 56533 - DNA, 1587 bp, Artificial Sequence
  Description of Artificial Sequence: Synthetic coding sequence
atgttcggcgctgctggtaggcagcctattggtgccccagccgctggtaattcctggcacttttcgaggactatggaggaactggtgcacgacctggtatcggcgctggaggaaagctcagagcaggcaagggggggatttgcagagactggtgatcactcccgaagtattagttgtccccttaagagacaagctaggaaaagaagagggcgtaagcgtaggagttataacgtgcatcatccttgggaaactggccactgcctttccgaagggtcagactcatccctggaagaaccgtccaaggattatcgggagaaccataataataataagaaagatcactcagacagtgacgatcagatgctggttgcaaaacgacgacctagttctaatcttaacaacaatgtacgaggcaagagacccttgtggcatgagagtgatttcgccgtcgataacgtgggcaatagaacgttgagaaggcgtcggaaggtcaaaaggatggcagtggacttgccacaggatatcagtaataagcggaccatgacgcagccccctgagggctgtagggaccaggacatggatagcgacagggcctaccagtaccaggagttcacaaaaaataaagtcaagaaacggaaactgaaaatcatcaggcaggggccaaagatccaagacgaaggggttgtgcttgaatccgaggagacaaatcagactaacaaagataagatggagtgcgaggagcagaaggttagtgacgaattgatgtctgaatctgactctagcagtcttagctcaacagacgcaggcctatttacaaacgatgaggggagacagggtgacgatgagcagagcgattggttctatgaaaaggagtccggaggcgcatgcgggatcacaggcgtcgtcccgtggtgggagaaagaagatccgaccgaattagacaaaaatgttcctgaccctgtgttcgaaagtattttgacgggctctttccccctcatgagccacccgtctcgcagaggcttccaggctcggctttctaggctgcacggaatgtctagtaagaatataaaaaagtcaggaggaactccgacatcgatggtcccgatccccggtcccgttggcaataagcgcatggtgcacttttctcccgacagccaccaccatgaccactggttctcccccggtgcccgaacagagcatgaccagcaccagttactgcgggacaatcgtgcagaacgtgggcacaagaaaaattgttccgtgcgcactgcatcaaggcaaacaagcatgcatctaggctccctctgcactggtgatattaagaggcgacgaaaagctgctccccttccaggacctaccaccgccggtttcgttggagagaatgcacagccgattctagaaaacaacattggaaatcggatgcttcagaacatggggtggacccccggaagcggtcttggtcgcgacggtaagggaatttcagaaccaatccaagccatgcagagacctaagggactcggtctcggattcccattgcctaagtccacaagcgcaacaacaaccccgaatgctggtaagtctgcgtag

SEQ ID NO: 56534 - DNA, 1578 bp, Artificial Sequence
  Description of Artificial Sequence: Synthetic coding sequence
atggcagtgcctggggaagcggaggaggaggccactgtctacttggtggtgagcgggatcccctctgtactgcgcagtgcccatctccgctcctacttctctcaatttcgggaggagcgcggagggggattcctatgtttccactaccgccacagacccgagagagccccaccacaagccgcacccaatagcgctctgattcccaccgaccctgccgcagaagggcaactgctatcccagacatccgccaccgacgtcaggcccctatcaacaagagacagtacccccattcagacccgaacctgctgttgtgtgatctctgtgaggggactggcccaagcacagagactaatccgcatgtactcggggcgaaggtggctcgatagccacggtacatggctgcccggacgctgcttaatcaggagactgaggctcccgactgaggcaagcggcttgggctcctttcccttcaaaacgcgcaaagaattacaatcttggaaggccgaaaatgaggcattcacccttgccgatctgaaacaactgccagagctcaatccacctgtgctgatgccacgcggaaacgtcggcacacctctccgtgtcttcctggaattgattcgcgcatgcagactcccgcctagaattatcacccaacttcagttgcaattccctaagaccgggtcctcgcgaagatatgggaacgtgcccttcgagtacgaggattcagagaccgttgaacaggaggaactggtatatactgcagaaggggaagaaatcccccaagggacatatctggccgacatccctgcgagcccctgcggagaacccgaagaggaagtggggaaggaagaggaggaagaatcccacagcgatgaggatgatgacagaggcgaggaatgggaacggcacgaggcacttcacgaagacgttactggtcaagagcggactaccgagcaattgtttgaggaagagattgagttgaaatgggaaaaggggggttcaggactggtgttctatacggatgcacagttctggcaggaagaagaaggcgatttcgacgagcagactgccgatgactgggatgtcgatatgtccgtgtattatgaccgggatgggggtgacaaagacgctcgcgacagcgtacagatgagacttgaacagcggctgagagatggacaagaggacggttccgtgatcgaaagacaggttggcacttttgaacggcacactaagggaattggcaggaaagttatggaaagacagggctgggccgagggacagggattagggtgtcggtgctctggggtgcccgaggcattagatagcgacggacagcacccacggtgcaaaaggggactcggctatcacggcgaaaagctgcaaccgttcggccagctgaaaagaccacgcagaaatggcctgggcctcatctcaactatttacgacgagcccctccctcaggaccagacagagtccctgcttagacggcagccccctacttccatgaagttccgcacggatatggcattcgtgagggggagcagctgcgctagcgattcgccatccctgccagactag

SEQ ID NO: 56535 - DNA, 714 bp, Artificial Sequence
  Description of Artificial Sequence: Synthetic coding sequence
atgccgaggggcaacgtgggaaccccgctcagggtattcttggagttaatccgggcttgccgcctccctccgaggatcatcacccagctccagttgcagtttccaaagaccgggtcctctaggaggtatggaaacgttcctttcgaatacgaggattctgagacggtagagcaggaggaactcgtgtacacagctgaaggcgaggagatccctcagggcacttacctggctgacattccagcctcgccctgcggagagccagaagaggaggtgggcaaggaggaagaggaagagagccatagcgacgaggacgacgacagaggcgaggaatgggagcgtcatgaggcactgcatgaagatgtgactgggcaggagaggactacagagcagctgttcgaagaagaaatagaactgaagtgggagaagggtggatccgggctcgtgttctacaccgatgctcaattttggcaagaagaggagggcgatttcgatgaacaaactgcagacgactgggacgtggatatgagcgtttactatgacagggatggcggagataaagacgcccgagattccgtccagatgaggcttgaacagcggctgagagatggccaggaggatggctccgttatagaaagacaggtgggcacattcgaaagacatacgaaaggaatttttactaagagtccactgcccagtcctcctctcgggtattag

SEQ ID NO: 56536 - DNA, 231 bp, Artificial Sequence
  Description of Artificial Sequence: Synthetic coding sequence
tgatttgatgaacagacagctgacgactgggatgtggacatgagtgtctactacgatcgcgatggtggggacaaagatgccagagacagcgtccagatgaggttagagcaacgcttacgtgacggccaggaagacggatcagttattgagaggcaagtgggaacttttgagcgacataccaaaggcattttcaccaaaagcccacttccctctccccctctcggatactag

SEQ ID NO: 56537 - DNA, 387 bp, Artificial Sequence
  Description of Artificial Sequence: Synthetic coding sequence
atgagactggaacaaagactgcgggatgggcaggaggatggatcggtgattgagcgacaggtaggtactttcgaacggcatacaaaggggatagggagaaaagtgatggaacggcaaggctgggccgagggccagggactggggtgtaggtgcagtggagtccccgaagctctggactctgacggccaacatccacggtgcaagcgcggtctgggctatcatggagagaaactgcagccattcggccagctcaaacggcctcgcaggaacgggctaggcctcatctctacaatctacgacgagcctttgcctcaagatcaaacagagagtttgctccggaggcagcccccaacttccatgaagttccgcaccgatatggccttctag

SEQ ID NO: 56538 - DNA, 1524 bp, Artificial Sequence
  Description of Artificial Sequence: Synthetic coding sequence
atggccgtgcctggcgaggcggaggaggaagcaaccgtttatctggttgtgtccggcataccttcggttttacgatccgcacacttgaggagctattttagccagtttagggaggaacggggtggtgggttcctttgctttcattatcgtcaccgcccagagcgtgcccctcctcaagcagccccaaacagcgccctcattcccactgaccctgctgctgagggccaacttctgtcccagaccagtgcaacggatgtccgccctctcagtactcgggactctacccccatccagacccggacgtgctgttgtgtgatctcagtgagaggcctggctcaggcccagcggctgataaggatgtactctggtcgtcggtggcttgatagccacggcacctggcttcctgggcgttgtctgataaggagacttagactgccgaccgaggcgtccggattagggagctttcctttcaagacacggaaggaacttcctgagctaaatccacccgtcctgatgcccagaggcaacgttggcacccccctccgcgtatttctcgagctgatccgggcatgccgtctgcctcccagaattatcacgcagcttcaactacagtttcctaaaactgggagctccagacgttacggcaacgttccatttgagtacgaagacagtgagaccgtggaacaggaggaactggtgtatacagcagagggggaggaaattccgcaggggacatatctggccgatatccctgccagcccttgcggcgagcctgaagaagaggtaggcaaagaggaagaagaagaaagccactctgatgaagacgatgatcgcggagaagagtgggagaggcacgaggccctgcacgaggacgtgacaggtcaggaacggacgactgagcagctgttcgaagaagaaattgagctgaagtgggaaaaaggcggatcaggcctcgtgttttatacagacgcccaattttggcaggaggaagaaggtgacttcgatgagcagactgccgacgactgggatgtcgatatgagcgtttactacgatcgagacgggggagataaagacgctagggactcagtgcagatgcggctggaacagaggctcagagacggccaggaggacgggtcagtcatcgaaagacaggtggggacatttgagcggcacacaaaagggataggcaggaaggtaatggagcgccagggatgggcggaaggccagggactaggctgcaggtgtagtggagtccctgaggctctcgatagcgatggccaacacccccgatgtaaaagaggtctggggtaccacggagaaaagttgcagcctttcggtcagttgaagcggccacggaggaatggcctcgggctgatttccacaatatatgacgagcctctcccacaggatcagaccgagtccctcctgaggagacagccacccactagcatgaagttccgcactgacatggccttcgtcagaggttcgtcttgcgcctccgattccccaagtctgcccgattag

SEQ ID NO: 56539 - DNA, 420 bp, Artificial Sequence
  Description of Artificial Sequence: Synthetic coding sequence
atggacggcctcaaggtgggccacgatcccgcaaaagagtttaccaatcactggtggaacgaactatttaacaaaactgctgcgaacctcgtcgtggagaccggacaggatggcgtccagatcagaagtttgtccaaggagacaactcggtataaccacccgaagcccaacctgctgtaccagaaattcgtgaaagttctggaggccgttgggaatcgggtccaccccttctctcttccctggttcccgtgggggcttaattcttgtcttgtgtgtctgatcaattctcagaactttcccaatattgtcggctcatgcgatcagccgtgctgctgtctacttcgattgccacgcccatcagctggaatcgaaatctttcgcttccgcggaagttgccacctgttacgagaacagcagtag

SEQ ID NO: 56540 - DNA, 1338 bp, Artificial Sequence
  Description of Artificial Sequence: Synthetic coding sequence
atgaacgttacaccagaggtgaaatctcggggtatgaagttcgccgaggagcagctgctgaagcatgggtggacgcagggaaaggggctcggacgtaaggaaaacgggatcacccaagctctgcgagttaccctgaaacaggatacccacggagtgggacatgatccagccaaagaatttaccaaccactggtggaatgagttgtttaacaaaaccgccgcaaacctggtggtcgaaacgggccaggacggggtccagatacgctctttgtcaaaggagactacccgctacaaccacccaaaaccaaatttgttatatcaaaaatttgtcaagatggcaaccttgacctcaggaggcgagaagccgaacaaggacttggagagttgctcagacgatgataaccaaggtagcaaaagccccaagatcttgacagacgaaatgctcctgcaagcatgcgaaggtcggactgcgcacaaggctgcgagactggggattaccatgaaggccaaactggccaggctggaggcacaagagcaagcctttctggccaggttaaaagggcaggacccaggtgctccccagctgcagagcgaatctaagcccccaaaaaaaaagaaaaaaaaacgtcggcagaaggaagaagaggaggctacagccagcgagcggaacgacgccgatgagaagcacccggagcacgctgaacagaacattcgaaaaagtaaaaagaaaaaacgcaggcaccaggaaggcaaagtgagcgacgaacgcgaaggtaccaccaagggcaatgagaaggaagacgccgctggtacgtctggccttggagaacttaactctagggaacagaccaatcagtcactgcggaagggaaaaaagaagaagaggtggcaccacgaggaagaaaagatgggtgttctggaagaaggtgggaaaggcaaggaggccgctggaagcgtgcggacggaagaagttgagtcccgggcatatgctgacccctgctctagaaggaagaagcgccaacaacaggaagaagaagatttgaacctcgaggatagaggcgaagagacactgggcggaggcactagggaggccgagagtcgcgcatgctctgacggccgtagcagaaagagcaagaaaaaaaggcaacagcaccaggaggaagaggatatattggatgttcgcgatgaaaaagatgggggtgcaagggaggccgaaagtcgagctcacacgggaagttcatcgcgcggaaaaagaaagcggcaacagcatccaaagaaggagcgggcaggtgtgtctaccgtgcagaaggcaaagaagaaacaaaagaagcgggactag

SEQ ID NO: 56541 - DNA, 1113 bp, Artificial Sequence
  Description of Artificial Sequence: Synthetic coding sequence
atgaacgttacacccgaggtcaagtccaggggcatgaagtttgccgaagaacagctcctcaaacatgggtggacacaaggcaaaggacttggcaggaaggagaatggaataacacaggccctgagagtcacactgaagcaagacacccacggcgtggggcatgacccggctaaggaattcaccaaccactggtggaatgagctctttaacaagactgctgccaatttggtcgtggagactgggcaggacggggttcagatcagatctctttctaaagagacaactagatacaaccaccccaagccaaatcttttgtatcagaagttcgtgaagatggctacactgacaagtggcggagagaagcctaataaagacctcgagagctgcagcgatgatgacaaccaagggtcaaagtcccctaagatccttactgacgagatgttattacaggcatgcgagggcaggactgctcacaaggcagccagactaggcatcaccatgaaagccaaactggccaggttagaggcccaagaacaggccttcctcgcaagactaaagggacaggatccaggggcaccacagctgcagtctgagtctaagccacccaagaaaaaaaaaaagaaacgacggcagaaggaagaggaggaggccaccgcctccgaacggaatgatgctgatgagaagcatcctgagcatgccgagcaaaatattagaaaatcaaagaagaagaagcggagacatcaggaggggaaggtttccgatgaaagagaggggacaactaaagggaatgagaaggaggacgccgctggtacctctgggctcggcgagttaaattcccgagagcagaccaaccagtcgctccgaaaaggaaagaagaagaaacggtggcatcacgaagaggaaaaaatgggggtgctggaagagggtggcaagggaaaggaggctgcaggcagtgtgcgaaccgaagaggtggaatccagggcctatgcagatccctgttcaaggcggaagaaaaggcagcagcaggaggaagaagacctaaacctggaggacaggggtgaggaaacattccgatggtggaatcaaggctcaagggagcagtccatgcaatag

SEQ ID NO: 56542 - DNA, 1128 bp, Artificial Sequence
  Description of Artificial Sequence: Synthetic coding sequence
atgttccctcgttccggtccttctaatgatgaagtcaaaagcaggggaatgaagttcgcagaagagcaactgctcaagcacggctggacgcaaggcaaaggcctgggccgtaaggagaatggaattacacaggccttgcgagtaactctgaaacaggacacccacggcgtggggcatgaccccgcaaaggaatttacaaatcactggtggaatgagcttttcaataagactgccgcaaacctggtggtcgagaccggacaagatggcgtgcagattcgttccttaagcaaggagaccactagatataaccacccaaagccaaacctattgtatcagaagttcgtgaaaatggccactcttacctctggaggcgagaaacccaataaggacttagagtcttgcagtgatgacgacaaccagggctccaaatctcctaagattctaacagatgagatgctcttgcaagcttgcgaaggcagaaccgcccataaggctgctcgcctggggataacgatgaaggcgaagctcgcacgcctcgaggcacaggagcaagcattcctcgcacgtctgaaaggtcaggatccaggagcccctcagctgcagtcggaatcgaagcccccaaaaaagaaaaagaagaagcggagacagaaggaggaggaagaagccacggcttccgaacgcaacgatgctgatgagaaacatccagagcacgccgaacaaaacatcaggaagtccaagaagaagaaaaggaggcaccaagaggggaaggtgagcgacgagagggaaggaacaacaaagggtaacgaaaaagaagacgccgctggaactagtggcctgggagagctgaacagcagggaacagactaaccagtcgctgcggaagggtaagaagaagaagaggtggcaccatgaagaagaaaaaatgggggtgctggaagaaggaggcaaaggaaaagaagccgctggaagcgtcaggactgaggaggtagaatcaagggcatacgctgatccctgttctcgtcgaaagaagaggcagcagcaagaggaggaggatttgaatcttgaagacagaggcgaggaaactttccggtggtggaatcaaggatcccgcgagcagtcgatgcagtag

SEQ ID NO: 56543 - DNA, 1218 bp, Artificial Sequence
  Description of Artificial Sequence: Synthetic coding sequence
tgatcgctggtgttaggcgttatcacctgtgcccctgagcggcttaatttccccgcttcagcctgcgccctgaaacgggctgcctggctgctgcggggtcgaggagtgtttcacaacgggctcaaaatctgtgagaagtttggaccaaatctggacacatgtccagaggggaccatcttgggcctaagactagattcatccggtgggctacacctacatgttaacggcgtggaccagggagtagcagttccagacgtgcctcagccatgtcacgccttagttgacctttacggtcagtgtgagcaagtcactatcgtgaatccagaaccaggcgcagcctccggcaaatcagctgggacacagggtgatatggagaaggcagatatggtagacggtattaaggagtccgtgtgttggggtcctccccctgcggcttcaccgctcaagagctgcgaataccatgctctgtgtagtagatttcaggagcttttgctgttacccgaggattattttatgccaccgccaaaacgttccctgtgctattgtgaaagctgtcggaagctgaggggcgacgaggcccatcgcaggcggggtgaaccaccaagagagtatgcactgccctttggctggtgccggttcaatctacgagtcaacccgaggctggaggctggtacccttacaaaaaagtggcacatggcttatcacggaagcaacgttgccgcagtgagacgcgtgctagaccggggagagctcggcgctgggaccgccagcattcttagttgtcgtcccttaaagggtgaaccaggcgtaggattcgaggagcccggtgaaaactgtgcccctcccagggaggagcaaccacctcccgtgctcctctcccccagcctccagtacgcgggtgcagagacgctcgcttccaaggtgcagttcagggatcctaagtcacagaggactcatcaggcccaggtagccttccaacgatccctaagcctgtgtccccatgaggccgctttctcaggtgcaacagggcgtgagtggggccgagtcggagcaagaaagatgggggcaagcgtccaattgcttctgactctaatttctaaagaaccaatcaacacagtgtctgagccacccccacgaccactctccagggccccactgtcaggagcccgagtaccgtggggggctactcgttgggctcgggagataaaagaatcttag

SEQ ID NO: 56544 - DNA, 1377 bp, Artificial Sequence
  Description of Artificial Sequence: Synthetic coding sequence
atgagtagttcacgacctgagcccggaccatgggcccctcttagtcccaggttgcagcccctctcccagtcgtccagcagcttgctcggcgaggggcgagagcagcggcctgaattgcgcaaaactgcctcgtccaccgtctggcaggcccagctgggcgaggcaagcaccagaccacaggccccagaggaagagggcaaccctccagagagcatgaaacccgctcgcgcttctggtccaaaggcccgacccagcgcaggagggcactggtggtcaagtactgtgggtaacgtgtctaccatgggtgggtcagatttgtgccggcttcgagccccttctgctgcggcaatgcagcgttcccattctgatctggttcgttccacgcaaatgcggggacacagcggtgcacgcaaggcttcattgagctgtagtgcacttggttcttctcctgtgcaccgcgcacaactgcagcctgggggaacgagtggccaagggggtcaggcccctgccggtctcgagagggacctggcacctgaagatgagacttccaatagcgcatggatgttgggagccagtcagctctccgtcccccctctggatctcggggacaccaccgctcattctagctcagcccaagctgaacccaaggctgctgagcaactggccacaactacttgccatgcactcccacccgcagccctattatgtggcatgagagaggtccgcgctggaggttgctgccacgccctacccgcaactggtattctggcctttcctaagctcgttgccagcgtttcagagtcaggccttcaagcacagcacggagtgaagatccactgtcgactgagcggagggttgccaggtcatagtcactgctgcgctcacttgtggggcccagccggtctggtcccggaaccaggctctcgtaccaaagacgtctggactatgacatcagctaatgatctggcacctgccgaagcatctcctctgtctgcacaggacgctggggtgcaggctgcacctgtggctgcctgcaaggcagtggccaccagtcctagcctagaagcccctgccgctctgcacgtgtttcccgaagttaccctggggagctcgctggaagaggttccaagcccagtccgggatgttcgatgggatgcggaggggatgacatgggaagtgtacggtgctgccgtggacctggaggtccttggagtggctatccagaaacacttggaaatgcagttcgagcagctgcaacgagctcctgctagcgaggatagcctgagcgtcgagggaagaagaggcccactgcgggctgttatgcaatcactccgcagaccctcgtgctgcgggtgttctggggctgcccctgaatag

SEQ ID NO: 56545 - DNA, 1377 bp, Artificial Sequence
  Description of Artificial Sequence: Synthetic coding sequence
atgtccagttccagacctgaaccaggaccctgggcaccattaagcccacggctgcagccgctgagtcagtccagctccagcctgctgggcgagggaagggagcagcgacccgagcttcgaaaaaccgcgagtagtactgtgtggcaagcgcagctgggggaggcttcgactcggccacaagctccagaggaggagggcaatcctcccgaatctatgaagcccgcacgtgccagcggccctaaagctcgcccatcagccggaggccactggtggtcctccaccgtggggaatgtcagtactatggggggatccgatctgtgtagactcagggctccctcggctgctgctatgcagcgcagccattccgatctcgtaaggtccacccaaatgcgcggacactccggcgctcggaaggcctcgcttagttgtagcgccctgggttcatcacccgtgcatcgagcccagctccagccaggcggaacttccggtcaggggggtcaggcccctgccggacttgaacgtgacttagccccagaagacgaaacttccaattccgcttggatgctcggggcatctcagcttagtgtcccacccctcgaccttggagatacgacagctcactcatcgtcagctcaagctgagcccaaggccgctgagcagctggccaccactacttgccatgccttgccgccagctgcactgctgtgcggcatgagggaagtgagggcgggagggtgttgccatgcactcccagctacgggaattctggcatttccaaagctggtcgcctccgtctccgaatctggtttacaggctcagcacggggtgaagatccattgtcgcctctcgggcggtttacctgggcacagccattgttgcgctcacctttggggcccagccggtctcgttcccgagccaggatccagaactaaagatgtgtggaccatgaccagtgccaacgacctggcacccgctgaggccagtcctcttagcgcgcaggacgctggcgtgcaagcggctccagtggccgcatgtaaggcagtggccactagcccatcactggaggctcccgcagcccttcatgtctttccagaggtgacattgggtagtagcctggaggaagtgcccagccccgtacgcgacgttaggtgggatgctgagggaatgacctgggaggtgtacggggcagccgtggatttggaggtattaggagtggctatccagaagcatttggagatgcagtttgagcaactccaacgagccccagcttccgaggattctctgtccgtggaggggagacggggaccactgcgcgctgttatgcagtctctgcggaggcccagttgttgtggctgctctggagctgccccagagtag

SEQ ID NO: 56546 - DNA, 1377 bp, Artificial Sequence
  Description of Artificial Sequence: Synthetic coding sequence
atgtctagctcccggccagagcctgggccatgggcaccgctgtcacctcggctacagccactgtcccagtccagcagctctctccttggggaaggcagagagcagcgacctgaattaaggaagaccgccagctctactgtctggcaggcgcaattaggggaggcgtctacaaggcctcaggcccctgaagaagaggggaatccgccagagagcatgaagcctgcccgtgctagtggccctaaagctaggccttctgcgggaggccattggtggagctctaccgtgggaaacgtgtccacaatgggaggttctgatctttgtaggctgcgagcaccctcagctgccgctatgcagagaagccatagcgacctcgtcaggagcacacagatgcggggtcacagcggcgctcgaaaggcctctctaagctgcagcgcactcggttccagcccggtacacagggctcagctgcagcccggtggcactagcgggcagggcggacaggcacctgcgggactggaacgtgacctcgccccagaagatgaaacgtccaactccgcctggatgttgggagcaagccagctttcagtaccgcctctcgacctgggagatactaccgcacactcttctagtgctcaagcggagcctaaggccgcagagcaactcgccaccacaacctgccacgcccttcccccagccgctctcctctgcgggatgcgggaggtcagagcgggaggctgctgtcatgctctcccagctaccggcatactggccttccccaagcttgtggcatctgtctccgagtctggcctccaggcacagcatggagtgaagatccactgccgcttgtctggtggcttacctggccactcacattgttgtgctcatttatgggggcctgccggattagtacccgagcccggtagtagaacaaaggacgtgtggacaatgacctccgctaatgacctggccccagcagaggcaagcccgcttagcgcacaggacgccggagtgcaggcagcaccagtggctgcatgcaaagctgtggccacatccccgtccttggaagccccagcagccctacatgtttttcctgaagtaactctgggatccagccttgaggaagtgccgtctccagtgcgagacgtgagatgggatgcagaagggatgacctgggaagtgtacggagctgccgtcgatttagaggttttgggagtcgctatacagaaacatttggagatgcagttcgagcagctacaaagagcccctgccagcgaagatagcctcagcgtagagggcaggcgcggaccgttaagagcggtgatgcagtccctgaggaggccaagctgctgcggttgcagtggagctgctcccgagtag

SEQ ID NO: 56547 - DNA, 1641 bp, Artificial Sequence
  Description of Artificial Sequence: Synthetic coding sequence
atggaactcgagaatatcgtggctaactcattgcttcttaaggctcgtcaggaaaaggattactccagtctgtgtgataaacaacctatcgggagacgcctgtttcgacaattctgcgatactaagccaaccctaaagcgccacattgaattccttgacgccgtggctgaatacgaggtcgccgatgacgaggatcgctcagactgtggcctgtccattctggacagattcttcaacgacaagctggcagccccactccctgagatccccccagatgtcgttactgagtgtcgactcgggctcaaagaagagaacccatccaaaaaagcgtttgaggaatgcactagggtggctcacaactatctgcggggtgagccatttgaagagtaccaggagtccagttatttctcccagttcttgcagtggaagtggcttgagcggcagccagttaccaagaacactttccggcattaccgggttctcgggaaggggggattcggtgaggtgtgcgcgtgtcaagtaagagcgacaggcaagatgtatgcttgcaaaaagttgcagaaaaagcgcatcaagaagcggaaaggggaggcaatggcactgaatgaaaagcggattcttgagaaagttcagagcagatttgtagtatctctggcctacgcttacgaaaccaaagacgccctatgcttggtgcttacaatcatgaatggtggtgatctgaagttccacatctacaacctgggcaatcccggattcgacgagcagcgagccgtgttttatgccgctgagctttgttgtggcctggaggatctgcagagagaaagaatcgtttacagagacctgaagccagagaacatcctcctcgatgaccggggacatatccgtatcagcgacttaggtctggcaacagagatcccagaaggccagcgagtgaggggccgagtcggtaccgtgggctacatggcgcctgaagtggtgaacaatgagaagtacaccttttcaccagattggtggggtctgggttgccttatatacgaaatgatccaaggacatagcccattcaaaaagtataaagagaaggttaagtgggaagaggtagaccaaaggatcaaaaacgacaccgaagagtatagtgagaagttttctgaagacgcaaagagcatatgtcgcatgttgctaacgaagaaccccagtaaacgtctggggtgtaggggcgagggagctgcaggggtgaagcagcatcccgtttttaaggatattaattttcgaagactggaggcgaacatgcttgaacctcctttttgccccgacccgcacgcagtctattgcaaggatgttttggatatagagcagttttctgtggtcaaggggatatacttggacaccgccgatgaagacttttacgccagattcgccactggatgcgtgtcgataccatggcagaatgagatgatcgagagcggatgcttcaaagacattaataaatcagagtccgaggaagccctgccgctcgatctggacaagaacattcatacgccagttagccgacccaaccgcggatttttctacagactcttccgtagaggagggtgtcttactatggtgccatctgagaaggaagtggagccaaagcagtgttag

SEQ ID NO: 56548 - DNA, 1503 bp, Artificial Sequence
  Description of Artificial Sequence: Synthetic coding sequence
atggagctcgagaatatagtcgcaaacagcttactgctgaaagcaaggcaggagaaggactattcaagtctgtgtgataaacagcccatcggccgtcggctttttcggcaattctgcgatacaaagccaacgctcaaacggcacattgaatttctcgacgcggtcgccgaatatgaagtcgcggatgatgaggacagaagcgattgcggattgagcattttggacaggttttttaacgataagttggccgctccactccccgaaatccccccagacgtggtcacagagtgtagactcgggctcaaggaggaaaatccgtctaaaaaggcatttgaagagtgcacccgagtggctcataactacttaagaggggagcctttcgaagagtatcaggaatcaagttacttctcgcagttccttcagtggaagtggcttgagcgccaacccgtcaccaagaatacttttagacactacagagtgcttggaaagggcggatttggtgaagtatgtgcatgtcaggtgagggcaacaggaaaaatgtacgcttgtaaaaaactccagaagaagcggatcaaaaagcggaaaggagaggcgatggcgttgaatgaaaagagaatcctggaaaaagtgcagagtagatttgtggtgagcctcgcatacgcctacgaaaccaaagacgcactctgcctggtgcttaccataatgaacggcggtgatctgaaatttcatatttacaatctgggaaaccctggatttgacgagcagcgggctgtattttacgccgcagagctctgctgcgggctagaggacctccagagagagagaatcgtatatcgggatctgaagcccgagaacatcctgctggatgacaggggacatattcgcatttccgatttaggactggcaaccgagattcccgagggacagcgggtgaggggcagggtggggaccgtcggctacatggcccctgaagtggtaaacaacgagaagtacaccttttctccagattggtggggtctcgggtgtttgatctatgagatgatccagggtcactcaccatttaagaaatacaaggagaaggtgaagtgggaggaagtggaccaaaggattaagaacgacactgaagagtattccgaaaagttctccgaggacgccaaatccatctgtcgtatgttgctgacaaagaacccaagcaagaggttaggatgtagaggcgaaggcgcagcaggggtcaaacagcatcccgtctttaaggatattaactttcgtagactggaagccaatatgctagagccaccattttgtccagatcctcacgccgtgtactgcaaagatgttttggatatcgagcagttcagtgtagtgaaaggcatttacctcgatacagctgacgaggatttctacgctagattcgcaaccggatgcgtttctatcccctggcagaacgagggctgtcttacaatggttccctccgaaaaggaagttgaacccaagcaatgctag

SEQ ID NO: 56549 - DNA, 405 bp, Artificial Sequence
  Description of Artificial Sequence: Synthetic coding sequence
atgcacggtgggggtggggtttcttcctgttcagcaagttctgtgagctctgttagccagaatcctcctgcggctgccgctcctggacacggggctagagagcacaggggacagctggctgcagccgaaagcgcctcttccccactgcacccggcaacaaaagcttcagttgggcctgctctgcaaagagagacgcctactattctgtgtgcaatactctgcctgggaccacacgtatccttagcctgtgtctctcgagagcttgcgacagagccgcgaacctccagtccgtgcgcaagccatgggagcagctcgcatccggtaaccttaaccgagctcctgatctctagtatctctctgagagacggcgctgccctcctgggcttgtgtagtcgtactgtttag

SEQ ID NO: 56550 - DNA, 1599 bp, Artificial Sequence
  Description of Artificial Sequence: Synthetic coding sequence
atggaacttgagaatatcgtcgcaaatagcctactgctcaaggctagacagggcggatacggcaagaagtcaggcagatcgaaaaaatggaaagaaatccttacgctcccacccgtctctcaatgcagtgagctgagacatagcatcgagaaggattattccagcttatgcgataagcagcccatcgggagaaggctctttcgccagttttgcgatacaaaacctaccctcaagaggcatatcgaattcctggacgcagtggctgagtacgaggtggcggatgacgaggaccggagcgattgcggcctcagcattctggatcgtttcttcaatgacaagctggcggcacctctgcctgaaattccgccagacgtggtcaccgaatgccggctggggctcaaagaagaaaacccaagtaagaaagcttttgaggagtgcacccgagtcgctcataactacctgcggggagagcctttcgaggaataccaggagagttcatactttagccagtttctgcagtggaaatggctcgagcgtcagcctgtgacgaagaacactttcagacactaccgcgtgctgggaaagggtgggttcggcgaggtgtgcgcgtgtcaggtgcgcgctactggaaagatgtacgcgtgtaagaaactccagaagaaacggataaagaaacggaaaggggaggcgatggctctgaacgagaagagaatcttggaaaaggtgcagtccagatttgttgtgagtttggcgtatgcatatgaaacaaaggacgcgctctgtttagtcctaacaatcatgaatggtggcgatcttaagttccacatctataatctgggcaacccgggttttgacgaacagagggccgtattttacgccgctgagctgtgctgtggcctggaggacctgcagagagagcggattgtataccgggatctcaagccggagaatattctcctggacgaccgagggcatattcgtatcagtgacttgggcctggctaccgaaatacccgaaggacaaagagtccggggacgcgtgggaaccgtgggttacatggctcctgaagtggtgaacaacgagaagtacacattttcacccgactggtgggggctgggttgcctgatctatgagatgatccagggacactctccttttaaaaaatataaagaaaaagttaagtgggaggaggtggaccaacgcattaagaatgacacagaggaatacagcgaaaagttttctgaagatgccaaatcaatatgcaggatgctgctgaccaagaacccgtcgaagcggctcggttgtaggggtgagggtgctgctggcgtgaaacaacaccctgtattcaaggacattaacttccgaaggctggaagcaaatatgcttgaaccccctttttgtccggatcctcacgccgtgtattgcaaggacgtgctcgacatcgagcaattttccgtggtgaaggggatctatctagacaccgcggacgaggacttctatgcacggtttgccaccggctgcgtgtcgatcccctggcagaatgagggttgcctgaccatggttccctctgaaaaggaggtagagccgaagcagtgttag

SEQ ID NO: 56551 - DNA, 942 bp, Artificial Sequence
  Description of Artificial Sequence: Synthetic coding sequence
atgaagtcccctccgctcctctctccatgcctgagctggaaaaggatggctggtatcttttttttgccctttatctcttctggtttcgccccacgttttaagcaggaggaaaatttcatgttaggaagagctcatccgtcccagcctcgcttcaactggtcccacctgaccccactggaactcaaaaatagaagcgtgggattgggcaccgaatctacgggaaggggtaaacctcatttcaccctagagggtcacaagtttttgatctttggcggatctatccactatttccgcgtccctagggagtattggcgtgaccgccttcttaagcttaaggcttgtggattcaacacggtgacaacgtacgtaccatggaaccttcacgaacccgagaggggcaagtttgatttctctggaaatctcgacctggaggcttttgtgctgatggcagctgagatcggcctgtgggtcatcttgaggccaggtagatacatatgctcagaaatggatctcggtgggctcccttcctggctgctccaggatcctcggctgctgctccggacaacaaacaagagcttcatagaggcagtagagaagtacttcgatcacctgataccccgtgtcatcccgctgcagtatagacaggcaggacctgtgatcgcagtgcaggttgagaacgagtatggaagctttaacaaagacaagacgtatatgccttacttgcataaggccctccttaggagagggatcgttgaactcctacttacctcagatggggaaaagcatgtgctcagtggacacaccaagggcgtgctggccgctattaacctacagaagctgcaccaagatacgttcaaccagctacacaaggtccagggcgcatcaatcgacgctgggctactctccgacgcctctcaggctgcaacctcctccagcttgtag

SEQ ID NO: 56552 - DNA, 1962 bp, Artificial Sequence
  Description of Artificial Sequence: Synthetic coding sequence
atgaagagcccccctcttttgtctccctgtctgagctggaagcgaatggcaggcatcttttttctaccatttatctcctctggcttcgcgcctagatttaagcaggaagagaatttcatgcttgggagggcccacccaagtcagcccagattcaattggagccatctgaccccactggagttaaaaaataggtcggtgggtcttggtacggagtcgacaggccgtggaaaaccacacttcaccctcgagggacataaatttcttatttttggcggatcaattcactacttccgagtgcctagagagtactggcgcgacaggctgctgaaactgaaggcttgtggatttaataccgtcactacttatgtgccctggaacctccacgagccggagcgcggtaaattcgactttagcgggaaccttgatctggaggcttttgttttaatggccgcagaaatcggcctgtgggtcatcctgcggcctggcaggtacatctgctcagagatggatcttggtggtctcccctcttggctgctccaagatccgagacttcttttgcggaccacgaacaaaagctttattgaagcagttgagaagtacttcgaccacctgattcctagagtgattcccttacagtatcgccaggctggccctgtaatagctgtccaagtggaaaacgagtatggtagctttaacaaggataaaacctatatgccttacctccataaagccttgctgaggagggggattgttgagcttctgctgacatccgacggagagaaacacgtcttgagcggtcataccaaaggggtcctcgcagccatcaacctacagaaactgcatcaagatactttcaaccagttacataaagtgcagcgggataagccattgctgatcatggagtactgggtgggatggtttgacaggtggggtgacaagcaccatgtcaaggacgccaaagaggtcgagcatgccgtttccgaattcatcaagtacgaaatatcctttaatgtatacatgttccacggtggtaccaactttgggttcatgaatggcgcaacctattttggcaagcactcagggatcgtgacaagctacgattatgacgccgtgctgaccgaggcaggggactatactgagaaatacttgaaattacaaaaactcttccagtctgtgagtgcaactccattgccccgagtacccaagcttccccctaaggctgtctaccccccagtgagaccaagtctctacttgccactctgggatgcactcagctatctgaacgaaccagtgcgtagtaggcagcctgtgaacatggaaaacctcccaatcaacaacgggagtggccagagctacgggctggtcctttatgagaagtccatctgctccgggggtagacttcgggctcacgcacacgatgttgcccaggtgtttctcgacgaaacaatgatcgggatactgaacgagaataacaaagatcttcatatccctgagttgcgagattgtcgatacctgaggatcctcgtagagaatcaggggagagtcaatttctcctggcagattcagaatgagcagaagggcataaccgggtctgtaagtattaacaacagctcgctagaaggatttaccatctactccctcgagatgaagatgagtttcttcgaacgtctgcgcagcgccacttggaagcctgtgcccgatagtcatcaaggcccagctttttattgcggaaccctgaaagccggtccatctccaaaagacacctttttgagcctcttgaactggaattacggatttgtgtttatcaacggaaggaacctgggaaggtattggaacatcgggcctcagaagactctgtacctgcctggggtgtggctgcacccagaggataatgaagtcattttattcgagaagatgatgtccggatcagatataaaaagtacggataagcccaccttgtag

SEQ ID NO: 56553 - DNA, 447 bp, Artificial Sequence
  Description of Artificial Sequence: Synthetic coding sequence
atggagcctgaggcttttgagatttgtccatatgaccctcaccatcggatccccctttcccggtttcaatatcacttggcgtcatgccggcgaaagaacccaaaaaaggccaaaaagatggctacctgtaaatacaatgcctgtcacgtcgttccaatcaaaaatctggaagagcacgaagcggtgtgcgtgaatagatctgccgtcgaggaagaggacaccgaaaatcctttgaaggtttcccctccttcttcagagcagaacgatgatacccaacaggtgtccccgtgcctaccctctcctgatatctggaacgtcgacggtgcaaattgtcagcacgtatttgtcctgaagactttttttccccaaaaggtggtgtgcgaaaacgacaccaaggaatctgctcgcgaaaccagcccacaaaagatccttcgtcctggacagtag

SEQ ID NO: 56554 - DNA, 372 bp, Artificial Sequence
  Description of Artificial Sequence: Synthetic coding sequence
atggaaccggaagctttcgaaatctgtccctatgaccctcaccaccgaatccccctgtcccgctttcagtatcatctagcgtcttgtcgtagaaagaaccctaagaaagctaaaaagatggctacatgcaagtataacgcatgtcacgttgtgcctatcaagaatctagaagaacatgaggccgtgtgtgtaaataggtctgccgtggaagaggaggatacagagaaccctctcaaagtgagccctccatccagcgaacagaacgatgatacacagcagacctttttccctcagaaggtcgtgtgtgagaacgacaccaaggaatccgccagagagacatccccacaaaaaattctccggccaggtcaatag

SEQ ID NO: 56555 - DNA, 1491 bp, Artificial Sequence
  Description of Artificial Sequence: Synthetic coding sequence
atggacccactaggcgcaccaagccagtttgtggacgtcgacaccctgccgagttggggtgacagctgccaggatgagctcaactcctccgatactacagccgaaattttccaggaggacacggtgcgctcaccatttttgtacaacaaagacgtgaacgggaaggtggttctttggaaaggtgacgtggcgctacttaattgcactgcaatagtgaatacttccaatgagagtctgaccgacaagaaccctgtctcggaatctattttcatgttggccggaccagacctgaaggaggatcttcagaaactgaagggctgcagaaccggtgaggctaaactcactaaggggtttaatctcgccgcacgatttattatacatacagtcgggcctaagtacaagagtagataccgcactgctgctgagagctccttgtactcatgttataggaatgtcctgcagttggcaaaagagcaaagcatgtcgagtgtcgggttctgtgtgatcaacagcgcgaaacgtgggtacccattggaggatgcaacccacatagcgctgcggacagtgcggagattcctggaaattcatggagagacaatcgaaaaggtggtgtttgccgtgtccgacttggaggaaggaacctaccagaagctccttcccctgtatttcccccgaagcctaaaggaggaaaataggtccctcccgtatctgccagctgacatcggtaatgccgagggcgagcccgtcgttcccgagaggcagatccgtattagtgagaagccaggcgcacctgaggataatcaggaggaagaggacgagggcttgggtgtggacctttctttcatcggctctcatgcatttgcacgaatggaaggcgacattgataagcaaaggaagctcattctgcaaggacagctgtctgaggccgcactgcagaaacagcatcagcgcaattataaccggtggctgtgtcaggccagaagtgaggacctgtcagatattgcatccctcaaggcactataccagaccggcgtggacaactgtggaagaactgtaatggtcgtagtggggcgaaacatcccagtcacactcattgacatggacaaggccctcctgtatttcatccatgttatggaccacatcgccgttaaagagtatgttttggtgtattttcatacgctcacgtcggaatacaatcacctggatagcgattttctgaaaaaactttatgacgtggtcgacgtaaagtataagcggaatctgaaggctgtctatttcgttcaccctacatttcgaagcaaagttagcacctggttttttaccaccttctctgtgtcaggactcaaagacaagattcatcatgtggacagcctgcaccagttgttctcagcgattagtcctgagcaaattgactttccaccatttgttttggagtatgatgccagggtcaggtccactaggtccagtccctctccaggaatggtctactag

SEQ ID NO: 56556 - DNA, 1494 bp, Artificial Sequence
  Description of Artificial Sequence: Synthetic coding sequence
atggatccacttggagctccctcgcagttcgtcgacgtagacacactccctagctggggcgactcctgccaagacgaactgaacagcagtgatacaaccgccgagatcttccaggaagataccgtacgaagtcctttcctgtacaataaagatgtgaacggcaaggtggtcctgtggaaaggagacgtggcattactcaactgtactgccattgtgaacacaagcaacgagtcgctaactgataaaaaccctgtttcagagagtatcttcatgcttgcagggcctgatctgaaggaggatctccagaagctgaaggggtgtaggacaggagaggccaagttgacgaagggcttcaacctagcagcaaggttcattattcacaccgtaggcccaaaatacaagagccgttaccggacggcggctgagagtagtctctattcatgctaccgcaatgtccttcagctggctaaggagcagtcaatgtcttccgtgggcttttgtgttatcaacagcgcgaagagaggatatcccctggaagacgctactcatattgccctgaggacagtaagacggttcctagaaatccacggcgaaactattgagaaagtggtgttcgccgtcagcgacctggaggagggtacataccagaaactgctccccctttacttcccgagatccttgaaggaagaaaatagatcgctgccatatcttccagccgatatcggcaacgccgaaggcgaacccgtggtcccggagcggcagatcagaatctccgagaaaccaggggctccagaggacaatcaagaagaagaggatgaggggctcggtgtggacctctcttttataggtagccacgccttcgcccgaatggagggagacattgacaagcagcggaagctcatacttcaggggcaactgtccgaggctgctctacagaagcaacatcagagaaattacaataggtggctgtgccaggcacggagcgaggatttatccgacatcgccagtcttaaagcactctaccagaccggtgtggacaactgtgggagaaccgtgatggtggtagtaggccgaaacatccctgtgacattgatcgatatggacaaggcccttctctattttatccacgtaatggatcacatcgccgtgaaagagtatgtcctggtgtacttccatacacttacctccgaatataaccacctcgactctgatttcctcaagaaactctatgatgtagttgacgtgaagtataagagaaatttgaaggctgtttacttcgttcatccaactttccgttccaaggtttcgacctggttttttacaacatttagcgtctcgggcctgaaagacaagattcatcacgtggactccctccaccagctcttctctgccatttcaccagagcagatcgactttccccctttcgtcctcgaatacgatgcacgtgaaaatggaccttattacacatcatatcccccttccccagacctgtag

SEQ ID NO: 56557 - DNA, 384 bp, Artificial Sequence
  Description of Artificial Sequence: Synthetic coding sequence
atggccaagatccttgaacacgatgacgtgtcctacttgaaaaaaatcctaggcgagttagcaatggtgcttgaccaaattgaggctgaattggagaagcgcaagctggaaaacgaaggtcagaagtgtgagttgtggttgtgtggctgcgcttttaccctggccgacgttctcctcggcgctaccctgcaccgattaaagttcctcggtctgtcaaaaaagtattgggaggacggctctagaccaaacctccagtccttttttgaacgggtccagcgccgattcgcgtttcgcaaagtgagccggtggaactgtggtgactggttgggaagcgaaggaacgttgccacaggacaaggccgacataaaaacccagctcctttag

SEQ ID NO: 56558 - DNA, 1104 bp, Artificial Sequence
  Description of Artificial Sequence: Synthetic coding sequence
atggcaacacctaataaccttacgcccacaaattgttcctggtggcccatttctgcactggagagtgacgccgctaagcccgctgaggctcctgacgcccctgaggccgcttcacccgcacactggcccagggagtctctcgtactctaccactggacccagagtttctctagccaaaaagtcagactggtaatcgccgagaagggactggtctgcgaagagcgggacgtgagcctaccacaatcagaacacaaggagccttggttcatgcgactgaaccttggagaggaggtgcccgtgatcatccacagggacaatattatcagcgactatgaccaaattattgattacgtggagagaacgtttactggcgaacacgtggtcgccctgatgcccgaagtgggtagccttcaacatgctagagtactgcagtatcgcgagctgctggatgccttaccgatggatgcgtacacccatggctgcatcctccatcccgaactcaccacagactctatgatacctaaatacgccaccgccgagatccggaggcacctggcgaacgcaacgaccgacctcatgaagctggaccacgaggaagagcctcagctgtcggaaccgtatctatccaagcaaaaaaaactaatggctaaaattcttgagcacgacgacgtctcatatctcaagaaaattctcggagagttggcgatggtgttagaccagattgaggccgagttggagaaacgtaaacttgaaaatgaagggcagaagtgcgagttatggctgtgcggctgtgcatttactttggccgacgtgctgcttggcgcaacactccaccgcttgaagtttctgggcctgagtaaaaagtactgggaggatggaagtagaccaaacctgcagtctttcttcgagagggtccaacggcgtttcgcctttagaaaggtcttgggcgatatacatacgacactgctatctgcagtaataccaaatgccttcagattagtgaaaagaaaaccaccgtctttcttcggtgcaagtttcctgatggggtctctgggcggtatggggtatttcgcatattggtatctcaagaagaagtatatctag

SEQ ID NO: 56559 - DNA, 930 bp, Artificial Sequence
  Description of Artificial Sequence: Synthetic coding sequence
atggcaacgccaaataacttgacccccactaactgctcgtggtggccaatttccgccctcgaaagcgatgctgcgaagcctgctgaagcccctgacgctccagaggccgcaagcccagcgcattggccaagagagagtctggtgctttatcactggacccaaagcttctcaagtcagaaagtgcgcctagtaattgccgagaaaggcttagtctgtgaggaacgcgatgtgagccttcctcagtctgaacacaaagagccatggtttatgagactcaatctcggcgaggaggttccagtaatcatccacagagataatataattagtgactatgatcagatcatagattatgtcgagcgaacatttactggagggcacctggcaaatgctactaccgacctgatgaaactggaccacgaggaggagccacagctgtctgagccatatctgagtaagcagaagaaactaatggctaaaattctcgagcacgatgacgtgagttatttgaaaaagatattgggcgaattggccatggtcctggaccagatcgaggccgagttagagaaacgtaagctcgagaacgagggtcagaagtgtgagctatggctgtgcggttgtgccttcaccctcgcagacgtgttactgggagccaccttgcacaggctcaagtttctcggcttgagcaaaaagtattgggaagacggatcacggccaaatttacagtctttcttcgagcgggtgcagcgtagatttgcctttcgcaaagtccttggagacattcacacaaccctgcttagcgctgtgatcccaaatgcattccgactagtgaaaaggaagccgccaagtttcttcggtgcatctttcctgatgggttcgctgggcggtatggggtatttcgcatactggtaccttaagaagaagtacatctag

SEQ ID NO: 56560 - DNA, 1089 bp, Artificial Sequence
  Description of Artificial Sequence: Synthetic coding sequence
atggcaacgccaaacaatcttacgcctacaaattgctcttggtggcctatcagtgcactagaaagctgtggccaagccagcggcggacctagaaggtctaggggcggtcagccccattggcccagagagagcctggtgctgtatcattggacgcagtcatttagttctcagaaagtgcggttggtaatcgcggagaagggactcgtgtgtgaggaaagggacgtttctctcccccagagcgagcacaaagaaccatggtttatgcgcttgaatcttggcgaagaagtgcccgtcattattcatcgcgacaatattatcagtgactatgatcagatcatcgattacgtggagaggacatttaccggtgagcatgtggtggctttgatgcctgaagtaggttcattggctcgcacgggcgcagccgtgcgcgaactactggacgccttacctatggacgcatacacccatgggtgtatactgcaccctgagctgacaactgattctatgattccaaagtacgctacggcagagattcgaaggcacctggcaaacgcaaccactgatctaatgaagctggaccatgaggaagagccacagttgtccgaaccttacttgtctaagcagaaaaaactgatggctaagatcctggagcacgatgatgtgagttacctgaagaagatcctgggcgagctcgctatggtgcttgatcagattgagggagccggtgaggaagaggccggagagcgtggggctgaaatgcgggctgtggccctctggctctgcctgcatgccgatgtactgttgggtgctacgctccacagactgaaatttctgggactttcaaagaagtattgggaagacggcagtcgcccaaatctgcagtcattttttgagcgggttcagcgacggttcgcctttcgtaaggtgttaggggatatccacacgaccctattgtctgcagtgatcccaaatgcattcaggctggtgaagaggaaaccacctagcttttttggcgcttccttcttgatggggtctttaggaggcatgggatactttgcctattggtatctgaagaaaaagtatatttag

SEQ ID NO: 56561 - DNA, 444 bp, Artificial Sequence
  Description of Artificial Sequence: Synthetic coding sequence
atggcaacgcccaataacctgacccctaccaattgctcctggtggcccatttctgccctggaatcagacgccgctaaaccagccgaggccccagatgctccggaagccgcaagccccgctcattggcccagagagtctcttgttctgtaccattggacccagtcctttagctcacagaaagtccggttggtgatcgcagagaagggcttagtatgcgaagaacgagacgtatcgttgccccagagtgaacacaaggaaccatggttcatgcgactgaacctgggcgaggaggtgcccgtgattattcatcgcgacaatatcatcagcgactacgatcagatcatcgattacgtcgagcggacatttaccgggggtccacgtctggccgcatcccttgaactgaggggcgcaaaccccaggggacagctgggccgtgcacaatag

SEQ ID NO: 56562 - DNA, 867 bp, Artificial Sequence
  Description of Artificial Sequence: Synthetic coding sequence
atggctactccgaataatctgacgccaacaaactgcagttggtggcccatctcagctctagagtcagacgcagcaaaacctgcggaagcacccgacgcacccgaagccgcttcacctgcccactggccccgagagagtttagtgttgtaccactggacccagtcttttagctcacagaaagtgaggctagtgatcgccgagaaagggctggtgtgtgaggaaagggacgtctctctcccacagtctgagcataaggagccttggtttatgcggctcaacttaggggaggaggtgccagttatcattcacagggataacatcattagcgattacgatcagattatcgactacgtagagcgcaccttcactggaggacacctagccaacgccactactgaccttatgaagctcgatcacgaagaagagccacagctctccgaaccctacctgagcaagcagaagaagcttatggctaaaattctggaacacgacgacgtgtcttatctcaagaagatcctgggggagctggccatggttctcgaccagatcgaggccgaactggagaagagaaaactggaaaacgaggggcagaagtgcgagctgtggctgtgtggctgtgctttcactttagctgatgtgcttctcggcgcaacactccatcggttgaaatttttgggactgagtaagaaatattgggaagacggatctcgcccaaacctccagagttttttcgaacgggtgcagcggcgattcgcttttcgcaaagtgttgggggacatccacacaaccctcttatccgcggtgataccgaacgcctttcggctagtgaaacggaaacctcctagcttttttggcgcatctttttag

SEQ ID NO: 56563 - DNA, 756 bp, Artificial Sequence
  Description of Artificial Sequence: Synthetic coding sequence
tagtcattttcctcgcagaaagttcgcctagttattgccgaaaaaggcttggtgtgtgaagaacgggatgtttcactcccccagagcgagcacaaagagccctggtttatgcgccttaatctcggggaggaagtgccagtgatcatccacagagacaacattatctcagactacgaccagatcatcgactacgtcgagcgcactttcaccggcgagcacgtggtagccctcatgcctgaggtgggatctctgcagcatgctagggtacttcaatatcgcgagctgttagatgccctccctatggacgcttacacacacggttgcattttgcatccagaattgactaccgatagtatgattcctaagtatgccaccgcggagatccggagacatctagctaatgccaccacagacctgatgaaacttgaccacgaagaagagccacaattatccgagccctatctgtcaaaacagaaaaagctgatggccaaaattctggagcacgacgatgtgagctacttgaaaaagattctgggcgaactggctatggttttggaccagatcgaggcagaactcgagaaacggaagcttgagaatgaagggggatgtcagccttggggtagatgggggttgcagcccacccaaccaactttacccctcccatctctcagcttgttcttcccccaaaagagccaaaggacctctcaggtggttaagcgcatgggctatggggtacgcttgcggttcaaaagctag

SEQ ID NO: 56564 - DNA, 372 bp, Artificial Sequence
  Description of Artificial Sequence: Synthetic coding sequence
ttggagcacgacgacgtttcttatttgaaaaagatcctaggagaactggccatggtccttgaccaaatagaagcagaactggagaagcgaaagctggagaatgaagggcaaaagtgtgaactctggctttgtgggtgcgcttttactttggccgatgtattactaggagccacactccaccgcctgaaatttttgggactcagtaaaaaatactgggaggacggttctcggccaaacctacagtctttcttcgaacgagttcaacggaggttcgctttccgtaaggtctctcgctggaactgtggggactggctcggatccgagggtacgttaccccaagataaggcggatattaagacccagctgttatag

SEQ ID NO: 56565 - DNA, 528 bp, Artificial Sequence
  Description of Artificial Sequence: Synthetic coding sequence
atgaagctcgatcatgaggaggagcctcagctgtctgaaccctacctgtcaaagcaaaaaaaactgatggccaaaattctggaacacgatgatgtgtcctacctaaaaaagattttgggagagctcgccatggtgctcgaccagattgaagcagaactagagaaacgcaagctagagaacgagggccaaaagtgtgagctttggctctgtggatgcgctttcaccctggctgacgtgcttctcggggcaacgctgcacaggctaaagttcctcggtctgtccaagaagtattgggaggatggatctagacccaacctccagtcatttttcgagagagtgcaacgcagattcgccttccggaaggtgctcggggatatccataccacactgctaagtgcagtgatccccaatgccttccgactggttaaacgcaagcctccgtctttttttggggcttccttcctgatgggttcactaggaggaatgggatatttcgcatattggtacctaaaaaagaagtacatttag

SEQ ID NO: 56566 - DNA, 1002 bp, Artificial Sequence
  Description of Artificial Sequence: Synthetic coding sequence
cctagacgctcccgaggcggtcagcctcattggccacgagagtcgttggtactgtatcactggactcagtcattctcatcacagaaggtccgtttggtcattgcagagaaagggttggtctgtgaggagagagatgtgagcctaccacaatccgagcacaaagagccttggtttatgcgcctgaacttaggggaggaagtgccagtgattattcatcgtgataatattatttcagactacgaccagattatagactacgtggaaagaacatttaccggtgaacacgtggtcgcactcatgccagaggtagggtctcttgcccgtactggggctgcagtacgagaactcctcgacgcactgcccatggatgcctacacccacggctgcattttacacccggaacttacaacagactctatgataccaaagtatgcaacagccgagattcggagacacctggccaacgctactaccgatctgatgaaattagatcacgaagaggagccacagctttccgaaccttacctgtccaaacaaaaaaaactgatggcaaagattttggagcacgacgatgtcagttatcttaagaagatcctaggtgaacttgctatggtgttggatcagatcgagggggctggcgaggaggaggctggcgagagaggcgcagaaatgcgagcggtggcattgtggctgtgcctccatgcagacgtgttactgggggcaactcttcaccgcctgaaattcctgggactcagtaagaagtattgggaagacggcagcaggcctaacctgcagtccttcttcgagcgcgtccagcggaggttcgcattccgcaaggtgctcggagacatccataccaccctcttgagtgctgtaataccaaatgcattccggctggttaaacgaaaacctccatcgtttttcggcgcatcatttctcatgggtagtctgggcggaatggggtactttgcctattggtatctcaagaaaaagtatatctag

SEQ ID NO: 56567 - DNA, 1302 bp, Artificial Sequence
  Description of Artificial Sequence: Synthetic coding sequence
atgggtgattggtcctttctgggcaatatcttggaagaggtcaacgagcattccaccgttatcggacgcgtgtggctaaccgtgctattcatctttagaatcctgattctgggcacagcggctgaattcgtctggggagacgagcaatccgatttcgtctgtaacacccagcaacccggatgcgagaatgtgtgttacgatgaggcattcccaatttcacatataaggctgtgggtcctccagattatttttgttagtactccatcgctgatgtacgtaggccacgccgtgcactacgtgaggatggaagagaaaaggaaatccagagaggccgaggagcttggccagcaggccggtacaaacggcggtcccgatcaagggtcagttaaaaagagtagcggctccaagggaacaaaaaagtttcggctggaaggcaccttgctgagaacctacatttgtcatattatctttaaaacactcttcgaagtgggattcattgtcgggcactacttcttgtacggctttagaatccttcctctctataggtgcagccgatggccatgtcccaacgtggtggattgcttcgtgagtcgaccaacagaaaagaccatctttatcctcttcatgctctccgttgcaagcgtgagcctttttctcaacgtaatggaactggggcacctgggacttaagggcattcgatcagctcttaagcgcccagttgaacagcctctgggcgaaatccccgaaaaatccctgcactccattgcagtgtcgtccatccaaaaagctaagggctatcagctgctggaagaagagaagattgtaagtcactatttcccactaaccgaagtcgggatggttgagacatctcccctcccagcaaaacccttcaatcagttcgaggagaagatttcaacgggcccactgggagatttgagtaggggttatcaagagacactccccagttacgcacaggtgggagcgcaggaggtggaaggcgagggcccacccgcagaagagggcgctgaaccagaggtcggcgaaaagaaggaggaagccgagcggctcacgacggaggaacaggagaaggtagctgttccagagggcgagaaggtggaaactccaggagttgacaaagagggggaaaaggaggaacctcaatctgaaaaagtttccaaacagggactgcccgctgagaagaccccttccttatgtcctgaattgaccacagacgatgcaagaccactgagcagacttagcaaagcgtcttccagagctcggagcgacgacctgacagtgtag

SEQ ID NO: 56568 - DNA, 1455 bp, Artificial Sequence
  Description of Artificial Sequence: Synthetic coding sequence
atgggtagtgcattcgagagagttgtcagaagagtggtgcaggaactggatcacggtggagaattcatcccagtcacttcccttcagagtagcaccggctttcagccttattgcttagtcgttcggaagcctagctcctcctggttttggaaaccgaggtataagtgcgtaaacttgtccatcaaggacattctggagcccgacgctgccgaacccgacgttcagagaggcagatccttccacttttacgatgcaatggatggccaaatacaaggctcagtggaactggccgctccgggacaagcaaagatcgcaggtggggcagccgtgtctgactcttcatcaacctctatgaacgtgtatagtctctctgttgacccaaatacctggcaaactctcctccatgagaggcatttacggcagcccgagcacaaggtgctgcaacagctgagatctcgcggagataatgtctacgtggtgaccgaggtactccagactcagaaagaggtggaggtgacccgtacacacaaaagggaggggtctggccgtttcagcttgccaggagcgacatgccttcaaggtgagggacagggccatctgagccagaagaagacagtgacaatcccgagtggatcaaccctggctttccgggtggcccagctggtgatcgactcagacctcgatgtactcctctttccagataagaagcagcgcacctttcaacctcccgctactggacacaagaggtctacttctgaaggcgcttggccccagctcccctccggacttagtatgatgagatgtctgcataattttctgactgatggggtgccagcggaaggagccttcacagaagactttcaaggcctccgtgcggaagtagaaaccatctctaaggaactcgaactgctcgaccgggagctttgtcagctgctgctggagggcttagagggggtgcttcgggaccagttggccttgcgggcactggaagaggcactggagcaggggcaaagtctcggcccagtggagccattggacgggccagcaggagccgtcttggaatgtttagtgctcagttcagggatgctggtaccagaactggccatcccggtcgtgtatctgctcggtgccctgactatgttaagcgaaacccagcataagttgctcgctgaggctctggagtctcaaacattgctgggcccactcgagctggtgggctctctgctggaacagagtgccccttggcaggagagatccaccatgtcacttccaccagggctgttgggcaatagttggggcgaaggcgctccggcttgggtgttattagatgaatgcgggctcgagttgggagaggacacgccacatgtatgttgggaaccacaggctcaggggagaatgtgtgcgctgtacgctagcctcgccctcctcagcgggctctctcaagagcctcactag

SEQ ID NO: 56569 - DNA, 345 bp, Artificial Sequence
  Description of Artificial Sequence: Synthetic coding sequence
atgggatccgcgtttgagagggtggtccgcagagtcgtccaggagctagaccacggcggtgagttcatacctgtcaccagcctgcagtcaagcactggatttcaaccttattgcttagtcgtccgaaaaccttccagtagctggttctggaaacctcggtacaagtgtgtgaatctcagcattaaggatatcctggagcccgacgccgctgagcccgatgttcaacgaggacgtagctttcacttctacgatgctatggatggtcagattcaggggtcagtggaactcgctgcccctggacaggctaagatagccggaggtgccgctgtgtcagactcatcttag

SEQ ID NO: 56570 - DNA, 1455 bp, Artificial Sequence
  Description of Artificial Sequence: Synthetic coding sequence
atgggttctgcatttgaacgggtggtgcgccgtgtagttcaggagttggatcacgggggagaatttatcccagtgactagcttacagagcagtactggtttccagccctattgcctggtggtgcgcaagccttcatcgtcctggttctggaaacctaggtataagtgtgtcaatctttcaatcaaagatattctcgagcccgatgccgcagaaccagacgtgcaacgtggccgatctttccatttctatgacgccatggacggccagatccagggctcagttgaactggccgctccgggtcaagcgaagatcgcgggtggggctgccgtgagcgactcctcctcaacttcaatgaacgtctatagtctgtcagtcgaccccaacacctggcagactctcctccacgaacgacacctccggcagccggagcataaggtcctgcagcagcttcggagcaggggtgacaacgtgtatgttgttaccgaggttctgcagacacagaaggaagtcgaagtcactcgcacacacaaaagggaaggttcagggagatttagtttgcctggggctacatgtctacaaggagagggccagggccacctttcccagaaaaaaaccgtcacaattccttctggctcaacgctcgcctttagagttgcccagctggtcattgacagtgacctcgatgtgctgctctttccagacaaaaagcaaagaacatttcagccgccagccaccgggcacaagcgaagcacctcagagggggcttggccccagttgccctctggtctcagcatgatgcggtgcctgcacaatttcctcacagatggagttcctgccgaaggagccttcactgaggacttccaagggctgagagctgaagtggaaactatctcaaaggaattggaactgcttgatagggaactatgccaactcctccttgaagggctggagggcgttttgagggatcagctcgcccttagggctctggaggaggcgctggagcaggggcaaagccttggaccggtggagccgctcgacggccctgccggagcagttttggagtgcctagtgctgtcctcaggaatgctggtgccggagttggccataccagtggtctatctgctgggggcactgacaatgttgtccgaaacccagcacaaactcctggctgaggccctggaaagccagacactattgggaccactggagctggtgggatcactgcttgagcagagtgcaccatggcaggaaagatctactatgtccctgccaccaggcttgctggggaacagttggggtgagggggctcctgcctgggttctcctggacgaatgtggcttggagcttggtgaggacaccccccacgtgtgttgggagccccaggcccagggcagaatgtgtgccctgtatgctagcctggcgctgttatcgggattatcccaagagcctcactag

SEQ ID NO: 56571 - DNA, 147 bp, Artificial Sequence
  Description of Artificial Sequence: Synthetic coding sequence
atggggagtgccttcgaacgcgtggttcggagagtggttcaggagctggaccacggaggtgagttcataccggtcaccagcctccaatcatcaacagggttccagccatattgcctggtagtacggaagccgtcctcgagttggtag

SEQ ID NO: 56572 - DNA, 495 bp, Artificial Sequence
  Description of Artificial Sequence: Synthetic coding sequence
atgggatccgctttcgaaagagtggttcgccgagtcgtgcaggagctagaccatggaggggagttcatcccggtgacctccttgcaaagcagcacagggttccagccctactgcctggtggtgcgtaagccgtctagttcttggttctggaagccccgatacaagtgtgttaatctgtccattaaagacattttggaacctgacgctgccgagcctgatgtgcagcgcggtcggagctttcatttttacgacgccatggatggtcagatccaagggtccgtggagctggctgcaccaggccaggcaaagattgccggtggggctgcagtaagtgactcctctagtacgtctatgaatgtgtactctttatctgtggaccccaacacctggcaaacgctgttacacgagagacacttgcgtcaaccagagcataaggtcctacagcaactgcggtctcggggagacaacgtgtatgttgtgactgaggtactctag

SEQ ID NO: 56573 - DNA, 465 bp, Artificial Sequence
  Description of Artificial Sequence: Synthetic coding sequence
atgggatccgccttcgaaagggttgtcaggcgcgttgtccaagagctggaccatggaggagaattcatccctgtcaccagcttgcagtcatctaccggatttcagccatactgcctagtggtcagaaaaccttcgtctagctggttttggaagcctcgatataagtgtgtaaatctcagcataaaggacatactcgagcctgacgcagccgagcccgatgtgcagagaggacgctcttttcacttttacgacgctatggatgggcagattcagggttcagtcgagttagcagcccctgggcaggctaagatcgccggtggcgctgccgtgtcagactcctcttccacatccatgaacgtctacagccttagtgtcgacccgaacacgtggcaaaccctgttgcatgaaaggcatctcaggcagccggaacacaaagttctccagcagctccgctccaggggctag

SEQ ID NO: 56574 - DNA, 810 bp, Artificial Sequence
  Description of Artificial Sequence: Synthetic coding sequence
atgccacttggcttaaaaccaacttgcagcgtatgcaagaccaccagttcgtctatgtggaagaagggcgctcagggcgaaatcctatgtcatcattgcactggccgagggggtgccggtagcgggggtgccggttctggcgctgccggaggcactggagggtccggcggagggggatttggggctgccacctttgcttctacctctgccacccccccacaaagcaacgggggtggcggtggcaagcagtccaagcaagagatccaccgcagatccgctcggctgcgtaacaccaagtataaatcagcacctgctgccgaaaaaaaggtttctactaagggaaagggacgtcgtcacatctttaaactgaaaaatcccatcaaggccccagagtcagtgtccacaatcatcacggccgaatctatcttctataaaggtgtgtactaccaaatcggcgatgtagtgtccgttatcgacgaacaggatggaaagccctattatgcacagatcaggggcttcattcaggatcagtactgcgagaagagcgcggcactcacttggctaataccgaccttgagctccccacgtgaccaattcgaccccgcaagctacattatcggaccagaggaggatcttccaagaaagatggagtatctggaattcgtgtgccacgcaccttcagagtatttcaaatccagatccagcccattccctacagtgccgacgcggcctgaaaagggttacatatggactcatgtcgggccaacacctgcaattaccattaaggaaagcgtcgccaaccacttatag

SEQ ID NO: 56575 - DNA, 990 bp, Artificial Sequence
  Description of Artificial Sequence: Synthetic coding sequence
atggagctgcatatcctcgaacaccgtctacaggttgccagtgtggccaacgaatctattcccctattcacgtatggcctgattaagctggccttcctttccagcaaaaccaggtgcaagtttttttctttgaccgagacgcccgaggactatactattatagtggatgaagagggattcctggagctgccgtcatcagagcatttgtctgtcgctgatgctacgtggctggctcttaacgtggtctctgggggtggaagcttctcctcttcccagcctatcggagtgaccaaaattgctaagagtgtcatagcacccctcgcagaccagaacatatcagtatttatgctctcaacgtatcaaaccgatttcatactggttcgagaaagagatcttcccttcgtgacccataccctgagctccgagtttacgatcctccgcgttgtaaatggggagacagtagccgctgagaatctgggcattactaatggtttcgtaaaacccaagcttgtccagcgacccgtgatccatccattgagctctccctcgaacaggttctgcgtgaccagtctggaccccgacacactcccagctgtggcaacgttgctgatggatgtcatgttctatagcaacggcgtgaaggacccaatggccaccggggacgactgcggccatatccgattcttcagtttcagcctgattgagggctacatctccctggtgatggatgtgcaaacccagcagaggtttccaagtaatctgctgtttacttcagctagcggcgagctctggaaaatggtgcgaatagggggtcaacccctgggattcgatgaatgtggaattgttgcgcagatcagtgaaccactcgcggcagccgatatacctgcttactatatcagtacattcaagtttgaccatgctctggtgcccgaggaaaacatcaatggtgtcataagcgcactgaaagtgtctcaagctgaaaagcactag

SEQ ID NO: 56576 - DNA, 990 bp, Artificial Sequence
  Description of Artificial Sequence: Synthetic coding sequence
atggaactccatattctcgagcatcgcctgcaggtggcatcagtggctaaagagagtatccccctattcacgtatggcctgatcaagcttgcctttctctccagtaagacaaggtgcaagtttttttctctcacagaaaccccagaggattacactatcatcgttgacgaggagggattcctggagctgccttcaagtgaacacctgtcagtggccgatgctacatggcttgccctaaacgtcgtgagcggcggaggttctttttcttcaagtcaacctattggggtgaccaagattgctaaaagtgtgattgctccgctagcagatcagaatatctccgtcttcatgctcagcacctaccaaaccgactttatcctggtcagggagagggacctgcccttcgtaacacataccttgagctctgaatttacaatcttgagggtggtaaatggcgaaaccgtagccgcagagaacttgggtataaccaatggcttcgtgaagccgaaattggtacagcggcctgtgatccaccctctgtcatcccccagcaacagattctgtgtgacgagcctggaccccgacacgctgccagccgtagccacgctgctgatggacgttatgttctattcaaacggagtgaaggatcctatggctactggagatgactgtggccacattaggttcttttcattcagtctcattgagggttatatcagcctggttatggatgttcagacacaacaaagatttcctagcaatcttctgttcacaagcgcaagtggtgagttgtggaaaatggttaggattggcggacagccacttgggtttgacgagtgcgggattgtggcacaaataagcgaaccgctggccgctgctgatataccagcttactacatctccaccttcaaattcgaccacgctctggttcctgaggagaatattaacggcgtgatcagtgccctgaaagtgagccaggctgaaaaacactag

SEQ ID NO: 56577 - DNA, 990 bp, Artificial Sequence
  Description of Artificial Sequence: Synthetic coding sequence
atggaacttcatatcctggaacatagggtgagggtgctgagtgtagcccgacccggtctgtggctgtacactcatccacttattaaattgttgtttctgccgagacgctctcgttgtaaatttttcagcctgactgaaactcccgaagactacaccttgatggtagacgaagagggattcaaggagcttccgccttctgagttcctgcaggttgccgaagcaacatggctggtactcaacgtctcatcacattctggcgctgcagtgcaagcagctggagtaacgaagattgcgagaagtgtgatcgcaccgttggcggagcatcacgtgtctgtgctgatgctgagtacctaccagaccgacttcattttggtgagagagcaagatttaagtgttgtgatccatacacttgcccaggagtttgacatttatcgcgaggtgggtggtgaacctgtcccagttactagagacgattccagtaacggttttcctaggacacagcatggccctagcccaaccgtccatccaattcagagtccgcaaaaccggttctgtgtactgacgctggaccctgaaactctgcccgcaatcgccacgactctcatcgacgttctcttctattcccacagcaccccgaaggaagcagcgtcctccagccccgagccttccagtattactttcttcgcgttttccctgatcgagggctacatttcaattgtgatggatgctgagactcagaagaagttcccatccgacctccttctcacttctagctcgggggagctctggcggatggtgcggataggaggccagcctctcggcttcgatgaatgtgggatcgttgcccagatcgccggaccactggccgcagcggacatcagtgcctactatatctctactttcaattttgaccatgccctcgtgcctgaggacgggatcggatctgtgatcgaggtactgcaaagacgtcaggaaggattggctagctag

SEQ ID NO: 56578 - DNA, 492 bp, Artificial Sequence
  Description of Artificial Sequence: Synthetic coding sequence
atgagctgccggggtcgcggtgcagggggtaggtggaactccacaagctggagcacaggttgcaagcttccggcttcccccagacgggtgtcgcgttgctcacccacaggattgatcaagctcgccttcctgttcagcaagacacggtgtaagtttttctcactcacggagactccggaggattacaccattatcgtcgatgaggaaggcttcttggagctgccatcttctgagcatttgtcagtcgccgacgccacatggctggcccttaatgttgtgtcggggggaggctccttttccagctctcagcctatcgggatgaccaagattgcaaagagtgtgatcgcgccacttgccgatcagaacatctctgtgttcatgctttccacttaccagaccgattttattctcgtacttaagcgggatttaccctttgtgacacacacactctctagcgagttcacgattctttggagcgtcgccaggctttag

SEQ ID NO: 56579 - DNA, 1164 bp, Artificial Sequence
  Description of Artificial Sequence: Synthetic coding sequence
atgaaggcactcattctcgtgggcggttatgggactagactgagacccctcaccctcagcacaccgaaacccctcgtggatttttgtaataagcccattttgctccatcaggtcgaagccctggcagccgctggtgttgatcacgtaatactggctgtaagttacatgagccaggtcttggagaaggaaatgaaggcccaggaacaaaggctgggaattcgcatctcaatgtcacatgaggaggagcctctggggacagcgggacctctggcccttgcgcgagatttgctgagtgagaccgccgatcccttcttcgtgctcaactccgacgtcatttgcgattttccgtttcaagctatggttcagttccatcgccatcacggacaggagggcagcattctggttactaaagttgaggagccctcaaagtatggcgtcgttgtgtgtgaggccgacacgggccgtattcacaggttcgtggagaagccccaagtgttcgtcagtaataagattaacgccggtatgtacattctctcccccgcagtgctccagaggattcagctgcagcctacaagcatagaaaaagaagtgtttcctattatggccaaggaggggcaactgtacgccatggagctgcaagggttttggatggacatagggcagccgaaagacttcctgactggcatgtgtctgttcttacagagcctgagacagaagcagccggagcgactgtgctccggacccggtatcgtgggcaacgtgctggtggatccctccgctcgaataggccagaactgctccattggccctaacgtgtccttgggacccggagtcgttgttgaagatggagtgtgtatccggagatgcacagtactgcgggacgcaagaatacgctctcatagctggttagaatcatgtatcgttggatggcggtgtcgtgtggggcagtgggttagcctttgggcgggactgggaggagaacgagggggtgaatgcgcgtgtctgcccgataaagcgtaccccctgttggaagtgcggatggagaacgtgacagtccttggggaagatgtgatcgtaaacgatgagctctacctgaacggcgcatctgtactgccgcacaagtcgattggcgaatccgtcccagaacctcgcatcattatgtag

SEQ ID NO: 56580 - DNA, 1083 bp, Artificial Sequence
  Description of Artificial Sequence: Synthetic coding sequence
atgaaggcacttatcctggtgggcggttacgggacacggctccgccctctcacactatctacgccaaagcccttagtggatttttgtaataaacccattctgctgcaccaggtggaagctttagccgcagctggtgtagatcacgtgattttggcggtttcctacatgagtcaggtcctggagaaagagatgaaagcacaagaacagcgtttgggaatccgcatctcgatgtctcacgaggaagaacccttagggacagcgggtccgttggctctcgccagggatttactgtcagagacggcagatcccttcttcgtgctcaactcagacgtgatctgtgacttccctttccaagccatggtgcagttccatagacatcacggtcaggaagggagcattctcgtcacaaaggtagaagagcctagtaagtatggagtcgtggtgtgtgaggccgacactggccgtattcaccgcttcgtggagaagccacaggtgttcgtttccaacaagatcaacgcaggcatgtacatactgagccctgcggtgctgcagagaattcagctgcagccaacttctatcgagaaggaggtgttccccataatggccaaagagggccagctctatgccatggaactccaaggtttttggatggacatcggccagcccaaagactttctgacaggtatgtgtctgttcctgcagtcgctcagacagaagcagcccgagaggttgtgttctggaccaggcatcgtcggcaatgtgctggtggatccatccgccagaattgggcaaaattgctcgattggcccaaatgtttccctgggacccggagtcgtcgtggaagatggggtttgcatccgcaggtgcacggtcctgagagatgcacgaatccgctcccattcctggttggaatcttgcatagtaggatggagatgtcgcgtggggcagtgggtacgaatggaaaatgtcactgttctgggtgaagacgtcattgtgaatgacgaattatacctgaacggagccagcgtgctgccacataagagcataggtgagtccgtgcccgaaccacgcatcatcatgtag

SEQ ID NO: 56581 - DNA, 1083 bp, Artificial Sequence
  Description of Artificial Sequence: Synthetic coding sequence
atgaaggccttgatcctggtcggcggatatgggactcgcctgaggcccctcaccttgtcaactccaaagccgttggttgacttctgtaataagcccattttactgcatcaggtggaagcactggctgcggctggggttgatcacgtgattctggccgtatcttatatgagccaggtgctcgagaaagagatgaaggcccaggagcagcggcttgggatccggatttctatgtcacacgaggaggaacctctcgggaccgccggacccctggccctcgcaagggacctgctgagcgaaactgccgatcctttcttcgtcctaaactccgacgtgatctgcgatttccccttccaggccatggtgcagttccataggcaccacgggcaggaagggagtatcctagtaaccaaggtggaggagccaagcaagtacggggtggtggtatgtgaggcagacactggaaggatacacagattcgtcgaaaaaccacaggtattcgtcagcaacaaaatcaacgccggtatgtacattttgtctcctgccgtgctgcagcgtatccaactacagccgacctctatagaaaaggaagtttttccaataatggcaaaagaagggcaactgtacgccatggaactacagggcttctggatggacattgggcagccaaaggactttctcactggtatgtgtctgtttttacagtctcttagacagaaacagccagagagactctgtagcggccctgggatcgtggggaatgtactggtggacccttctgcaagaatcggccaaaactgttccatcggaccaaacgtctctttaggacctggagtagtggtcgaagacggagtttgtatcagacgctgcacggtgctgagagatgcacgaattcgttcccacagttggttagagagctgtattgtgggttggcgatgtcgcgtgggtcagtgggtacggatggagaatgtgacagtgcttggggaggatgtgattgttaatgacgagctgtatctgaatggcgcaagcgttctcccgcacaaatccatcggcgagtcagtgcccgagcccagaatcatcatgtag

SEQ ID NO: 56582 - DNA, 555 bp, Artificial Sequence
  Description of Artificial Sequence: Synthetic coding sequence
atggatctgggtccactgaatatttgcgaggagatgacgattctccacggcggttttttattagcagagcagctgttccaccctaaagcccttgcggaactcacaaagagtgattgggaacgggtgggcaggcccattgtggaagctctccgggagatcagtagcgccgcagcccacagccagccttttgcgtggaagaagaaagcgcttatcataatttgggctaaggtgctacaaccccaccccgtgacaccaagcgatacagaaaccaggtggcaagaagatctgttctttagtgtggggaacatgatccctacaatcaaccacaccatcctgttcgagctcctcaagagcctggaggcttctgggctgttcatccagttgctgatggccctgcctactaccatttgccatgccgagctggagcgttttcttgagcatgtcacagtagatacttctgccgaagatgttgcattcttcttggacgtatggtgggagcgtacgacacctcgcaggtgtttgcagccatgtatatggacaaattggccacgttag

SEQ ID NO: 56583 - DNA, 1188 bp, Artificial Sequence
  Description of Artificial Sequence: Synthetic coding sequence
atggatgaggagccggagcgcaccaaaaggtgggaaggaggctacgagagaacctgggaaatcctgaaagaagatgaatcagggtcactcaaggctaccatcgaggatattctgtttaaggccaaacggaagagagtgttcgaacatcacggtcaggttaggttgggaatgatgcgtcatctatacgtcgtggttgatggatctaggactatggaagaccaagacctgaagcccaataggctgacgtgcacacttaagctgctcgagtacttcgtggaagagtactttgaccaaaatccgatctctcagatcggaatcatcgtgactaaaagcaagcgggctgagaaactcaccgaacttagcggaaacccccgaaagcacatcaccagcctaaaaaaggcggttgatatgacctgccacggcgaaccctcactctataattcgctaagcattgccatgcagacactgaaacatatgcccggacatacctccagggaggtccttatcatattttcctctctcacaacctgtgatccatccaacatttacgacctcatcaagaccctgaaggccgctaagatacgcgtgagcgtgataggactcagcgcagaagtgagagtgtgcacggtgctggcacgtgaaacaggaggcacatatcatgtcatcttggatgagtcccactacaaagagctgctgacccaccacgtttcccccccaccagcctcaagcagtagcgaatgcagccttatccggatggggtttccacagcatactatcgcaagcctatcagaccaagacgccaagccttcattctcaatggcccacctggacggcaacaccgaacccggactgacactgggcggttatttttgcccccagtgcagagctaagtactgcgaacttcctgtggagtgcaaaatttgcggcctgactctggtctcggctcctcacctggcccgatcttatcatcacctatttcctctcgacgccttccaagagatacctctggaggagtacaacggtgagcgcttctgttatggatgtcaaggcgaactcaaagaccagcacgtgtacgtgtgcgcggtatgtcaaaatgtgttttgcgtggattgtgacgtttttgtgcacgactctcttcattgctgtcctggttgtatccacaaaattccggcacctagcggcgtatag

SEQ ID NO: 56584 - DNA, 1188 bp, Artificial Sequence
  Description of Artificial Sequence: Synthetic coding sequence
atggatgaagagcccgagcggaccaagcgttgggagggagggtacgaaaggacttgggagattctaaaggaggacgagtccgggagtcttaaagccaccatcgaagacatcctttttaaagcgaaaagaaagagagtgttcgaacaccatggtcaggtcaggctgggcatgatgagacacttgtatgtggtcgtggacggctctcgcacgatggaagaccaggatctgaagcccaatcgcctcacttgcaccttgaaattgctcgaatatttcgtggaggagtattttgatcagaatccgatcagccagattggcatcatcgtgacaaagagcaagagggccgagaagttaacagagctgtcaggtaatcctaggaaacacattacctcattaaaggaagcagtggacatgacatgccatggcgagccctctctgtataacagcctgagtatggcaatgcagaccctgaaacatatgccaggccacacatcacgcgaagtcctgattatcttctcatctcttaccacatgcgatccttctaacatttacgacttaattaaaaccctcaaagccgctaagattcgcgtcagtgtgatcgggctttccgcagaggttcgcgtctgtactgtgcttgctagagagaccggtgggacgtaccatgtgatactcgacgagagccattacaaggaactgctgacccatcaccttagtcccccacctgcctcttcaagttcagagtgcagcctgattaggatgggctttccacagcacactatcgccagcctgtctgaccaggatgccaaaccaagcttctcaatggctcacctggacggaaacacagagccaggcctgactctgggaggctacttttgtccccagtgtagagccaagtactgtgagcttcctgtcgaatgcaagatttgtggcttgacattggtgtctgctccccatttagcaaggagctaccaccacctgtttcctctggatgcctttcaagaaattcccctcgaggagtataacggggagagattttgctacggctgccagggggagcttaaagaccaacatgtctatgtgtgcgctgtttgtcagaatgtgttctgtgtggactgtgacgtcttcgtgcacgattctctgcactgctgtcctggttgcatacacaagatcccggcaccttcaggcgtgtag

SEQ ID NO: 56585 - DNA, 537 bp, Artificial Sequence
  Description of Artificial Sequence: Synthetic coding sequence
cagtatatatgctcatttgaggattgcaaaaaaaccttcaaaaagcaccaacagctcaagattcaccagtgccaacacaccaacgagccattgttcaagtgcacgcaggaaggttgtggaaaacatttcgcatcaccttccaagctgaagagacatgcaaaagcccatgagggatacgtctgccagaaggggtgttcctttgtcgccaaaacttggactgagctgctcaagcacgtcagggaaacccacaaggaggaatcaagaccattcgtgtgcgaacatgctggatgcggtaaaaccttcgccatgaaacagagcctgacaaggcatgcagtggtgcacgatcctgataagaaaaagatgaagctgaaagtgaagaaatcccgggagaaacgttctttagcctcacacctaagcggatacattcctcccaaaagaaaacaaggccaagggctgtcgctttgccagaatggagagtcccccaactgcgtcgaagacaagatgctatctactgtggcagtgttgacactggggtag

SEQ ID NO: 56586 - DNA, 1098 bp, Artificial Sequence
  Description of Artificial Sequence: Synthetic coding sequence
ctggatcctcccgctgttgtagccgaatcagtgtcctcattaacaatagccgacgctttcattgccgcaggagagtcatctgcacctactccacccagacccgctctacctaggcggtttatatgttcctttccagattgctccgctaattactccaaagcatggaaactggatgcccacttatgtaagcatacaggtgagcggcctttcgtgtgcgattacgaagggtgtggcaaagccttcatacgggattaccatctcagtaggcacattctgacacatacaggcgagaagccatttgtgtgcgccgctaatggctgcgatcagaagtttaatacgaagagcaacttgaaaaaacacttcgaaaggaagcacgaaaaccagcagaagcagtacatctgttcttttgaggactgcaagaaaactttcaaaaaacaccagcaattaaaaatccaccaatgtcagcataccaacgagcccctctttaagtgcacacaggaagggtgcgggaagcacttcgcatcgcccagcaaacttaagaggcatgcgaaagctcacgagggctatgtatgccaaaagggctgttcctttgtggcaaaaacatggactgagctgctaaaacacgttcgcgaaacccacaaagaagaaattctgtgtgaggtatgtcggaagacctttaaacgcaaagattatcttaaacagcacatgaagacacacgcccctgagagggatgtttgtaggtgtcctagggaggggtgcggcaggacctacactaccgtgtttaatctgcagtcacatattttgtcctttcacgaggaaagtcggccattcgtctgtgagcacgctgggtgtgggaaaacatttgcgatgaagcagtctctgacacggcatgccgtggtccacgaccccgataaaaagaaaatgaagttgaaagttaaaaaatcacgcgaaaagagaagcctcgctagccacctcagtgggtacatcccaccaaagcgaaaacaagggcagggactgtctttatgccaaaacggggagagccccaattgtgtggaggacaagatgctgtccaccgttgctgtgctgactctgggctag

SEQ ID NO: 56587 - DNA, 1089 bp, Artificial Sequence
  Description of Artificial Sequence: Synthetic coding sequence
atgtccgatcctagtcagttgacacagaatgtgtgtctgactcaagaaatggagttaagcaaggcctttagtggccagcgaacactgcttagcgcaatcttgagtatgcttagcttgagtttttctacaacctctcttctgagcaactattggtttgtgggcacacagaaggtgccgaagcctctgtgcgaaaagggcctagctgccaagtgtttcgacatgcccgtatccctcgatggagacaccaatactagcacacaggaagtggtgcaatataattgggaaactggcgatgaccgattttcttttcgcagctttaggagcggtatgtggcttagctgcgaagaaacagtggaggagcctgccttgctgcatcctcagtcatggaagcagtttagggctttaagatcctccggtaccgctgctgcaaagggcgaaaggtgtcgcagctttattgaactcacaccacctgctaaacgggagatcctgtggctaagcttgggtactcagattacctatatcggtttacaattcatctcctttctattgctgttgaccgaccttttactgaccggaaatccagcttgtgggctgaaactttctgcttttgccgcagtgtcaagcgtgctgtccggcctcctgggtatggtggcccatatgatgtacagtcaggtgttccaggcaactgtgaacctgggtcccgaagactggcggcctcacgtttggaattacggctgggctttttatatggcgtggctttcgttcacatgctgcatggcctccgcggtgaccacctttaacacttacacaagaatggtcctggagtttaagtgtaagcattctaaatcatttaaggaaaatcctaattgcttaccacaccaccatcagtgttttccccgtcgactttcaagcgccgctcctaccgttggaccgctcacttcatatcaccagtaccacaatcagccaatccattctgtgtcagagggcgtcgacttttactcagagctccgaaacaagggtttccagagaggtgcatctcaggagttaaaagaggctgtccgctcatcagtggaggaggaacagtgttag

SEQ ID NO: 56588 - DNA, 981 bp, Artificial Sequence
  Description of Artificial Sequence: Synthetic coding sequence
atggccaagatggagttgtcaaaagctttctcaggccagcggacattgctctctgcaattctatctatgctgagccttagtttttcaaccacgagcctcctgtccaactactggtttgtgggaacacagaaagttcccaaacctttatgcgagaaggggctggccgcaaagtgtttcgacatgcccgtatccctggatggggacaccaacacttctactcaagaggttgtgcagtataattgggagaccggggacgatagattcagcttccggagcttcagatccggtatgtggctgtcttgtgaagaaactgttgaagagcccggagaaagatgtagaagcttcatagagctgacgcctccggctaagagagaaatattgtggctgtctctcggcacccaaattacctatatcggtctgcagtttatctcttttctcctgctgctcacggatctgcttctaacggggaaccccgcttgcgggctgaagttgtccgcattcgcagcagtgagttccgttctgagcggactcctgggaatggtggctcatatgatgtatagtcaagtcttccaagcaaccgtgaatctcggacccgaagattggcgaccgcacgtgtggaattacgggtgggctttctatatggcctggctgtccttcacatgttgtatggcctcagccgtgacaacgttcaatacctacacgcgcatggtgctggagtttaaatgtaagcactctaaatcttttaaggaaaaccctaattgtctcccccatcaccatcaatgtttccctaggaggttaagttctgccgcacccactgtgggcccactgactagctaccaccagtaccacaatcagcccattcattctgtgagtgagggcgtggatttctactcagagttacgaaataaggggttccagcggggagccagtcaggaattgaaggaagctgtgaggtcgtccgtcgaagaggaacaatgttag

SEQ ID NO: 56589 - DNA, 966 bp, Artificial Sequence
  Description of Artificial Sequence: Synthetic coding sequence
atgtcagatcctagccaactgacccagaacgtttgtctgacacaggagatggagctttccaaagctttttccggtcagcggaccctattatccgctatcctaagtatgctttctttaagcttctctaccacttcactgctgagcaactattggttcgtgggcacacagaaggttccaaaacctttgtgtgaaaagggcctagccgctaagtgttttgacatgcccgtctccttagacggcgatactaatacatctacacaggaagtagtgcagtataactgggagacaggcgatgaccggttttccttcaggtcattccggtccggaatgtggctatcctgtgaggagacagtggaagagccagccctgttgcacccccagtcttggaagcagttccgggcactccgatccagtggcaccgcagccgctaagggtgaacgatgcaggagcttcatagagctcactccgccagcaaaacggggagaaaaaggattactggagttcgcaactttacaggggccatgccatcccacattacgttttggaggcaagcggctcatggagaaagcatctctgcctagcccaccattgggcctctgtggcaaaaaccccatggtgattcccggtaatgctgaccacctgcatcgaacatctatccaccagctgccgccagcaaccaatcgattggcaacccactgggagccatgtttatgggcccaaacagagaggctctgttgttgtttcctgtgtcctgtgcggtcacccggtgatggcggacctcacgacgttttcacttctctgccttctgactgccagctcgggtcccgacgcttggagaccacatgtcttgagctttggttaggcctcctccatgggctcgcgctcttgcacctgctgcacggcgtgggatgtcaccatcttcagcatgtgcaccaagatggggctggtgttcaggtacaagcttag

SEQ ID NO: 56590 - DNA, 858 bp, Artificial Sequence
  Description of Artificial Sequence: Synthetic coding sequence
atggccaagatggaactcagcaaagctttttctggccagagaaccctgctctcggccatcctttccatgttatctctcagtttctctacgacatctctgctgagcaattattggtttgtcggcacccagaaagtgcccaagccactctgtgaaaaaggcctggctgctaaatgcttcgacatgccagtgtcgctggacggtgacacaaatacctccacccaggaggtggtgcagtataactgggagaccggagacgatcgttttagctttcgatcttttcgtagcggcatgtggctgtcctgcgaagaaacagtggaagaacctggcgaacgctgtagatcgtttatcgagctcacaccccctgctaaaagaggggagaaaggcctgttggagttcgccaccttacagggtccatgccatccgaccctgaggttcggaggaaagaggcttatggaaaaggcatccctgccaagcccgcctttaggtttatgtggcaagaatccaatggtaatcccgggtaatgctgaccatctccacagaacatccatccatcaactgccaccggctaccaacagactggcaacgcactgggagccatgtctgtgggcccagaccgagaggttgtgctgttgctttctgtgcccagtgaggtcccccggagatggcggtccccatgacgtgttcacatccctcccttcagactgtcaactgggtagccgcagactggaaacgacttgcctggaactgtggctgggcctgctgcacggcctggcccttcttcatctactgcacggtgtcggttgtcatcatctgcagcacgttcatcaggacggagcaggcgtgcaagtccaggcatag

SEQ ID NO: 56591 - DNA, 888 bp, Artificial Sequence
  Description of Artificial Sequence: Synthetic coding sequence
atggagctcagtaaggcattttccggtcagcgaaccttgcttagtgctatattgtccatgctgtccctgtctttctctaccacaagcttgttgtccaactactggtttgtgggtacacagaaagtcccaaagcctctgtgtgagaagggcctggctgccaaatgcttcgatatgccagttagcttggacggcgataccaacacaagcactcaagaggtggtacaatacaattgggaaacaggggacgatagattttccttcagatcctttcggagtggaatgtggctgagttgtgaggaaacggtagaagaacccgctctcttacacccccagtcctggaaacaattcagagctctgcgaagctctggcaccgcagccgcaaagggagaacgctgtcgcagctttatcgagttgacccccccagcaaagagaggattgttaggtatggtggcccatatgatgtattcccaggtgtttcaggccacggtcaatttgggcccagaggattggcgtccccatgtgtggaactacggttgggctttctatatggcgtggcttagctttacctgctgcatggcatcagccgtgactaccttcaacacctacactagaatggttctcgaatttaagtgcaaacatagcaagtcattcaaggagaaccccaactgtttgccacaccaccatcagtgctttccacggcgactgtctagcgccgcacccaccgttggtcctctaacctcttaccatcaataccacaaccagcctattcacagcgtgtcggagggcgtggatttttatagtgagctccgtaacaagggattccagcgtggtgcctcacaagaattaaaagaagccgtccgtagttccgtagaggaagagcagtgttag

SEQ ID NO: 56592 - DNA, 1023 bp, Artificial Sequence
  Description of Artificial Sequence: Synthetic coding sequence
atggagctatcaaaggcattcagcggccagagaacgctcctctctgccatattgagcatgctgtccctctcctttagcacaacatcgctcctctccaactattggttcgtaggaacacagaaggttcccaaaccgctgtgtgaaaaaggcctggctgcaaaatgtttcgatatgcccgtctccttggatggcgacacaaacacatccacacaggaggtggtgcagtacaactgggagaccggggacgaccgcttctcattcagatctttccgcagcggcatgtggttgtcgtgcgaggagactgtagaggagccaggcgaaaggtgcagaagctttatcgaactcacccccccagccaagaggggggagaagggcctccttgagtttgcaaccctccaggggccatgtcacccaacgttgcggtttggcggaaaacgcttaatggaaaaggcttctttgcccagcccccctctgggtctgtgcgggaagaacccaatggtgatccctggaaacgccgaccatttgcaccgtaccagcattcatcaactgccacctgcgactaaccggctcgccactcactgggagccctgcctgtgggcacaaaccgagcgcctctgctgctgctttctctgcccagtaagaagtccaggagatgggggacctcacgatgtatttacatccctgccttcagattgccaactcggcagcaggcggctggaaacaacctgcttggaactgtggttaggactcctacacggcctggctctcctccacctcttgcatggggttggttgccatcatctacagcatgaccaccaccaatgctttcctcggaggttgagttctgctgcccctacggtagggccacttacatcataccaccagtatcacaaccagcccatccatagtgtgagcgagggagtggacttttacagcgagctgaggaataagggttttcaacggggtgcaagtcaggaactgaaagaggctgttaggagcagcgtggaggaggaacaatgttag

SEQ ID NO: 56593 - DNA, 1020 bp, Artificial Sequence
  Description of Artificial Sequence: Synthetic coding sequence
atgtccgacccttcccagctgacccagaacgtgtgtttgactcaggaaatggaactgagtaaagccttttccgggcagaggaccctgttgagcgccatcttgtccatgctttctctcagcttctccacaacttcccttctgagcaactactggtttgtcggcacacagaaagtaccaaaaccactatgcgagaaagggctggcggctaagtgctttgacatgcctgttagcctcgatggtgacacaaatacgagcactcaggaggttgtgcaatataactgggagacaggtgacgacaggttttctttcaggagcttccggtctggaatgtggctgtcctgcgaggaaactgtagaggaaccgggagagcggtgtagatcttttatcgagcttacgccacctgccaaaagagaaattctgtggctgtcactaggcactcaaattacatatataggtttgcagttcatctcctttttactgttgcttacagacctccttctgactgggaacccggcttgcggattgaagctctctgccttcgctgcggtgtcatccgtcctctccggcctgcttggaatggtggctcatatgatgtacagccaggtattccaagccactgtgaacctgggaccagaagattggcgcccacatgtttggaattatggctgggccttctatatggcctggctgtccttcacgtgttgtatggcttccgctgtgaccactttcaatacctatacccggatggtcttggagttcaaatgtaagcacagtaagtcgttcaaagaaaaccccaactgcttgccacatcaccatcaatgctttcctaggaggctttcttcagcagccccaacggttggcccactaacgtcttatcaccaataccataatcagcccatccactcggtgtcggaaggtgtcgacttttatagcgagttacgcaacaaaggttttcagcgtggagcgagccaagagctgaaagaagcagtacgttcaagcgttgaggaggaacagtgttag

SEQ ID NO: 56594 - DNA, 828 bp, Artificial Sequence
  Description of Artificial Sequence: Synthetic coding sequence
atggcaaaaatggaactgtccaaagcttttagcgggcagcgcactttgctgagcgccatcctctccatgctctcgctatcattctcaacgactagcctgctctccaattactggtttgtcggtacacagaaagtgcctaagccactttgcgaaaaaggcctggctgctaagtgtttcgacatgcctgtgtctctggatggtgatacaaatacaagtacacaagaggtcgttcagtataattgggaaactggggacgatagattcagcttccgaagcttcaggagtggaatgtggctttcatgcgaagagaccgttgaggagcctggcgagagatgccggtcctttatcgagttgacccctccggctaagagaggcctccttggcatggtcgctcacatgatgtatagccaagtatttcaggctacagtgaacttgggacctgaggattggcgtccgcacgtctggaactacgggtgggctttttacatggcctggttaagttttacatgttgtatggccagcgccgtcaccacatttaatacatataccagaatggttctggaatttaagtgtaaacacagtaaatctttcaaggaaaatcctaactgcttaccgcatcaccaccagtgctttcctcgccgactgagcagtgcggcaccaaccgtgggaccacttacctcctaccaccagtatcataatcagcccatacattcggtgtctgaaggggtggacttctactccgagctgaggaataagggctttcagagaggggcatcacaagagctaaaagaggccgtgcggtcttctgtcgaggaagagcaatgctag

SEQ ID NO: 56595 - DNA, 897 bp, Artificial Sequence
  Description of Artificial Sequence: Synthetic coding sequence
atggccaaaatggaactgagcaaggccttctcgggacaaaggacactgctgtccgccatactgtcaatgttgtctctcagttttagcactacttctttgctgtcaaactactggtttgtgggtacacagaaagtgccaaagcccttgtgtgaaaaaggtttggctgctaaatgctttgacatgcctgtttctttggacggagacaccaatacaagcacacaggaggttgttcagtacaattgggagacaggtgacgaccggttctcatttcgctcttttcgcagtggtatgtggttaagctgtgaagaaaccgtggaagaacccgcattgttacacccacagtcctggaagcagttccgggctctaagatcgagcggtaccgctgcggcaaaaggcgagaggtgcaggtccttcattgaattaactcctccagccaaacgcggactgctggggatggtggctcatatgatgtactcccaggtctttcaagccacggtgaatttaggtcccgaggactggagaccacacgtttggaattacggctgggccttctacatggcctggctctcctttacctgctgtatggctagcgccgtgacaaccttcaatacctacaccaggatggtcctcgagtttaagtgcaaacatagcaaatcgtttaaagaaaacccaaattgtctacctcaccatcaccagtgcttccctcggaggctgtcttccgctgcacccacagtgggcccactcaccagctaccatcagtatcacaatcagcccattcactccgtttccgaaggcgtagacttttatagtgaacttcggaacaagggttttcaaaggggtgcgagccaagaactgaaggaagccgtcagatcatctgtggaggaagagcaatgctag

SEQ ID NO: 56596 - DNA, 462 bp, Artificial Sequence
  Description of Artificial Sequence: Synthetic coding sequence
atgagtgaaagcttggtggtgtgtgatgtggccgaggatctggtcgagaagttgagaaaattccgattcagaaaagagaccaataatgccgcaattataatgaaaatcgacaaagataaacgcctggtcgtgcttgacgaggagctcgaaggcatctcacccgatgaattaaaagacgaactaccagaacgacagcccaggttcatcgtctattcttacaagtatcagcacgatgacggaagggtgtcataccctctgtgttttatttttagcagtcctgtggggtgtaaacctgagcagcaaatgatgtacgccggatctaaaaataagctggttcagacagccgaactgacaaaagtttttgagattcgcaacacggaagatctcacagaggaatggctccgcgaaaagctcttctttaccaatgtgaacttctgtgtcagcaaagtgtttatgtattag

SEQ ID NO: 56597 - DNA, 429 bp, Artificial Sequence
  Description of Artificial Sequence: Synthetic coding sequence
atgagcgagagtctggtcgtgtgcgacgtggcagaggacctggtcgaaaagcttcgcaagtttaggtttcgcaaggaaacaaacaacgccgcaatcatcatgaagattgataaagataagagattagttgttcttgacgaggagttagagggcatcagccccgacgagctcaaagacgagctgccggaacgccaacccagattcattgtgtatagttataagtaccagcacgacgatggaagggtgagctaccccttgtgttttatcttttcctctcctgtgggatgtaagcccgagcagcagatgatgtacgccggatctaagaacaagctcgtgcaaaccgctgagctgaccaaagttttcgagattcgcaacacagaggatctgactgaagaatggctcagagagaaacttggcttcttccattag

SEQ ID NO: 56598 - DNA, 1785 bp, Artificial Sequence
  Description of Artificial Sequence: Synthetic coding sequence
atggccgttgaggagctgcaaagcattatcaagcgatgccagatcctggaggagcaagacttcaaagaggaggatttcggactctttcaactggccggacagcggtgcatcgaggagggccacaccgatcagttactcgaaattatacagaacgagaaaaataaggtcattatcaagaacatgggatggaaccttgtgggacctgtagtgcgttgtctactttgtaaggataaagaggattcaaaacggaaagtctacttcctgattttcgacctactcgtcaaactctgcaatcctaaggaactcttgttaggactgctagagctgatcgaggagccttcaggcaaacagataagtcaatcaattttgcttttgctgcagccattacagactgtgatccaaaagctccacaataaggcctacagcattggcctcgccctctccaccctatggaaccaactttccctgttgcctgttccctatagcaaggagcagatacaaatggatgattatgggctgtgccaatgctgcaaagcgttaatcgagttcacaaaacctttcgtggaggaggtgatcgacaacaaagaaaactctttagagaatgagaaattaaaggatgagctgcttaagttctgtttcaaaagcttaaaatgtccgctgctgactgcacagttctttgagcaaagcgaagaaggcggaaacgatccattccgctactttgcgagcgagattatagggtttctaagcgccatcgggcacccgttcccgaaaatgatctttaaccatggtcgcaagaaaagaacttggaactatctagaatttgaggaggaggagaacaagcagttggctgactccatggcctctttagcttaccttgtctttgttcagggaatccacatcgaccagctgcccatggtcttgagccccctatacttgcttcagttcaacatgggtcatatcgaggtgttcctccaaaggacggaggaaagtgtcatatccaaaggcctcgagctactcgagaactctctactcaggattgaggacaactccctgctgtatcagtacctcgagatcaagtcctttctaacagtgccccagggattggtcaaagtgatgacactgtgtcctatcgagactttaaggaagaaatcccttgccatgctccagctgtacataaacaagctggactcgcaaggaaagtataccctctttcgatgccttcttaatacgtccaaccattccggggtcgaagctttcattatccaaaacattaagaaccagatcgatatgtcactgaaacgaacacgcaacaacaaatggtttacaggaccacagctgatttctcttcttgatttggtgctcttcctgccggagggagccgaaacggatctgctccagaactccgatcgtataatggcatcactcaatctcctgcgatatctcgtaattaaggataatgaaaacgataaccaaacaggcctttggactgaactcgggaatatcgaaaacaatttccttaagccattgcacatcggactgaacatgtccaaagctcactacgaagccgagatcaagaactcccaggaagctcaaaagtcgaaggacctgtgcagtatcacagtgtccggggaggagatccccaatatgcccccagaaatgcagcttaaagtcctgcacagcgctctgtttacgtttgacctcattgaatctgtgctggccagggtggaggagttgatcgaaattaagacaaagtctacctctgaagagaatattgggataaagtag

SEQ ID NO: 56599 - DNA, 1743 bp, Artificial Sequence
  Description of Artificial Sequence: Synthetic coding sequence
atggcggtggaagaattgcagagcataatcaagcggtgtcagatcctcgaggagcaggactttaaggaagaagactttggattgtttcagttagccggacagcgttgcattgaggaaggacacaccgatcagcttttggagattatccagaacgaaaagaataaggtgattatcaagaatatgggctggaatttagtggggcctgtcgtgaggtgtttgctctgtaaggataaggaggactccaagcggaaggtgtacttcctgattttcgacctgttggtgaagctgtgcaatccaaaagagttgctactcggcctattggagttaatagaagaaccctcagggaagcaaattagtcagagtatcctcttgctactgcagccgctgcagaccgtcattcaaaagctgcataataaagcctactctatcgggctcgctctatctaccctgtggaaccagctgagcctgctcccagtcccttactccaaggaacagatacagatggacgactatggcttgtgccagtgttgtaaggcgctcatcgagtttaccaaaccctttgtggaggaggtgatcgacaataaagagaacagtcttgagaacgagaagcttaaggacgagctgctgaaattttgctttaagtctttgaaatgtccactgctgactgcacagttcttcgagcagtcagaagaaggtgggaacgatcctttcagatattttgcatctgagatcatcggctttttatctgctatcggacatccattccccaagatgatcttcaaccacggacggaagaagagaacctggaactatcttgaatttgaggaggaagaaaataagcagctcgctgattccatggcctccctggcttatttggtctttgtgcagggtattcatatcgaccagctgcctatggtcctctccccactgtatctgttacaatttaacatgggacacatcgaggtgtttttgcagagaacagaagagtcagtcatctccaaggggctggaactgctcgagaattccctccttagaattgaggacaactcactgctgtatcagtatctcgaaatcaaaagtttcttaacggttccacaacgcaagaaaagtctggccatgttacagctctatattaataagcttgacagccagggcaaatacacgttatttaggtgcctcctgaatacctccaaccattccggagtggaggcctttattatccagaacattaagaaccagatcgacatgagccttaaaaggaccagaaacaataagtggttcacaggcccacaattgatttcactgttggatctcgtcctttttttgcctgagggggcagagaccgatctcctgcagaattctgacagaatcatggcaagcctaaatctcctgcggtatcttgtcataaaggacaacgaaaatgacaatcagaccggcttgtggaccgagctcggcaacattgagaataacttcttgaagcccttacatataggcctgaacatgtctaaagcccactacgaagcagagatcaagaacagccaggaagcccaaaaatcaaaagatctctgctctattaccgttagtggcgaggaaatacccaatatgccacccgagatgcagttgaaggttcttcactccgccctttttacttttgatctcatcgaatccgtactggcccgagtggaagaactcatcgagattaagacaaagagcacctccgaggaaaacatcgggatcaagtag

SEQ ID NO: 56600 - DNA, 768 bp, Artificial Sequence
  Description of Artificial Sequence: Synthetic coding sequence
aatggcaagactgtgcaggtactgccttccgccctgtccacaatgtttggcatcgactcctgcccatattatgtgctggaaaatcactacattaccactcccctgagcactgaagaggccgctttccccttggcctacgtcatgacgattagccaagacttcgacacttttgaatggttattttgggctatatatatgccccaaaacgtgtattgcatccatgtggataaggccgctacgattgattttaaaattgcggtgagcgagctactggagtgtttctcgaacgccttcataagctctcagtcggagtatatcatttatgggggtaaatcaagactgcaggctgacttggcctgtatgagagatctcattgccagcaccgtgcaatggcgatatgttaccaataccggtgaccatgattttcctctgaaaacaaatagggagattgtgcagtacctgaaaacaatgaactggactaatatcacccccaatctcgtaagcgtcctgaagagcacagagagaatcaagtacacacaccgcgagtatagaaccagagcacatgcctttgttctcaaaaagcacaagaaaaaatcaccaccacccaggcagctcaagatacattttggaagtagctacgtggcactcaccagagagttcgtacactttgcactatataacaagatagccattgagcttttgcagcgcagccaggatacctactcccccgacaaacacttctggatcactctgaacaacattccttag

SEQ ID NO: 56601 - DNA, 1176 bp, Artificial Sequence
  Description of Artificial Sequence: Synthetic coding sequence
atgaaggtgtggtcttgctatctatgcatcatcacactgcagataattataattgtcaccgtcctgtacaacgttcacgttagccagccggactcgggacagatcgatgacgtgggcggtgagtatcaagcactgtcccgactgcatatctgcgacgcggcactcaatggaaagacagtccaagtactgccttcagccctctctaccatgttcggaatagattcctgtccctactatgtcctggagaatcactatatcaccacgcccttaagcactgaggaagccgcttttcccctggcatatgttatgaccatttctcaggatttcgatacttttgagtggttgttctgggctatctacatgccacagaacgtatactgcattcatgtggataaggccgctacaatcgacttcaagatcgctgtgtccgagttactcgagtgtttcagtaatgcgttcatttccagtcagtcagaatacattatctacgggggtaagagcaggctgcaggctgatctggcatgcatgagagatctcatcgcgtcaacagtccagtggcggtacgtcactaatacaggcgaccacgactttccactgaaaacgaaccgagaaatagtccagtaccttaagaccatgaattggactaacataacccccaacctggtatctgtgctcaaaagcaccgagaggatcaagtatactcaccgtgagtaccgcacacgtgcccacgccttcgtgctcaaaaagcacaagaagaaatcacctccaccgagacaactgaagattcactttggtagcagctacgtggccctaacccgggaattcgttcacttcgctttgtataataaaatagcgatcgagctgctgcaaagaagccaagacacttatagcccagacaaacatttttggatcactctgaataatatcccggtagagtgcaccggcccttggatactcgctgtgaactccggcagttgccaaaacaggcacatttgcccaagaggtttggagttccagcagcagtatcctgtgaactcctttgggggaaacaactgctcaattgcagccggtaccgctgccccacgcgaggctctcggcccattccatctcaaggcagcatgctctgctcatcaaaataaatggggtttctggaactgctatcttcacctgaagtag

SEQ ID NO: 56602 - DNA, 909 bp, Artificial Sequence
  Description of Artificial Sequence: Synthetic coding sequence
atgtgcctgcagccactgcaggagcagaagcaatgggccctcgacggtgctgaataccggaccatacaggccaactgcacgggcacaggcatcggatataatataatctgggtccccatggccagctgcgactttagcatcaggacatacacctatgcggacactcccgacgatttccagttacacaacttttccctcccggaggaagacaccaagttgaagataccactaatccatcgggctctccagctggcccagcgaccagtgtcacttctggcatcaccgtggaccagccctacacgactgaaaacaaagggagccggtaatggcaaaggtccccttaaaggacagccccgagacatttatcaccagacctgggctaggtatatcgttaaatttttagatgcctacgcagaacataagctgcagttttgggccgtgaccgcggagaacgaaccttcagcgggacttctctccggatatcctttccagtgcctgggttttacccctgagcaccagcgtgacttcatcgccagagacttgggccctacactggccaacggtacgcaccacaacgttagactgctgatgctggacgatcaacggctgttacttccccactgggccaaagttgttctgacagatccagaggctgcaaaatacgtgcacgggattgcagttcactggtacttggactttcttgcacctgcaaaagccaccctgcgagagacacatcacctgttcccgaacacaatgctgttcgcttctgaggcatgtgtgggctctaagttttgggagcagtcggtgagactgggttcctgggatcggggaatgcagtactctcactctataatcaccaaccttctgtaccacgttgttggctggactgattggaatccctccctgtag

SEQ ID NO: 56603 - DNA, 1080 bp, Artificial Sequence
  Description of Artificial Sequence: Synthetic coding sequence
atgtgccttcaaccgttgcaggagcagaaacagtgggctctggatggagcggagtatagaactatccaagccaactgtactggcaccggtattggatataacatcatatgggtgccaatggcctcatgtgatttctctattcgcacatatacgtacgcggatactccggacgatttccagctgcacaacttttctcttcctgaggaggataccaagctgaagatcccactcatccaccgggctctacagctagcccagagacctgttagtcttctggcgagcccctggacttctccaaccaggctcaaaacaaagggagccggaaacgggaaggggccactgaaagggcagcccagagacatttaccatcagacctgggctagatacattgtgaaattcctcgacgcctatgccgagcacaagctccagttttgggctgtgaccgcagagaacgaacctagcgcaggactcttgtcaggctacccctttcaatgccttggctttactcccgaacaccagcgggactttattgccagagatctgggtcctacacttgctaacggaacacatcacaatgtgcggcttttaatgttggacgaccagcgactgttgcttccacactgggccaaggttgtgctgactgatccagaggccgctaagggcctgtgtggctttcaggtgcttggtgctgagtgcgcggcaaggctgctcgggagtagggatgcagttcagccccaacaccaccataagcctcccgtcccctgcggtagactggatcggctggaaccaatcatcgtggacatcacaaagcacacattctacaagcagcctatgttctaccatctgggacacttttctaaattcattcctgaggggtcccagcgggtaggattagtggcctctcaaaaaaacgatccagacgctgtggcgttaatgcatccagatgggagccctgtggtggttgtccttaacaggtcctccaaggatgttccgctcaccatcaaagatccggctgttggtttcttggagacaatttcaccaggctacagtatccacacttacctctggcgcaggcaatag

SEQ ID NO: 56604 - DNA, 1566 bp, Artificial Sequence
  Description of Artificial Sequence: Synthetic coding sequence
atgtcctcagattcagatagacagtgtccagtggatggtgacatcgaccagcaagagatgataccgtcaaagaagaatgctgttctggtggacggggtcgtgctgaacggcccaaccacagacgccaaagccggagaaaaatttgtggaggaagcgtgtcggctgataatggaagaggtggtattgaaagctaccgacgtaaatgaaaaggtttgcgagtggcgccctccagagcagttgaaacagctgcttgatcttgaaatgcgcgactccggtgagcctcctcataagctgttggaactgtgtcgcgacgtgatacattatagtgtgaaaactaaccaccctagattctttaaccagctctatgcagggctcgactactactcactggtggcccgatttatgactgaggctttaaatccctctgtatacacatacgaggtgtcgcccgtgttcttgctcgttgaggaggctgtgctgaagaagatgattgagtttattggttggaaggagggtgacggcattttcaatccagggggatctgtaagtaatatgtacgcaatgaatcttgctaggtacaaatactgccccgatattaaggaaaaagggctatccggttccccacggttaatactttttacgtcggccgaatgccactacagtatgaaaaaggccgcaagtttcctgggcatcggaaccgaaaatgtctgctttgtggaaaccgacggacggggaaagatgatcccggaggaattagaaaaacaggtctggcaggctcgaaaggagggtgctgccccattcttggtctgtgcgacctccggaaccactgtgctcggagcctttgatccgctcgacgagattgctgacatctgtgagaggcactccctttggctccatgtcgacgcatcatggggcggaagcgccttgatgtcccggaagcaccgaaaattgctccacggcattcaccgggctgattcagtggcctggaacccccataagatgctgatggcaggcattcagtgctgcgcccttctggtcaaggacaaatccgatctgcttaagaagtgctactctgccaaagcctcgtacttgttccagcaggacaagttctacgatgtgagctatgacaccggtgacaaatccattcagtgttctagaaggccagacgcattcaagttctggatgacttggaaggctttgggaaccttgggattagaagagcgggtaaatagggccctcgctctgtctcggtatctcgtggatgaaataaagaaacgggaggggtttaagctgctgatggaacctgagtatgccaacatttgcttttggtatatccctccaagtctccgggagatggaggagggtcccgaattttgggcaaagctgaacctggtggcacccgctataaaagagagaatgatgaaaaagggctctctcatgctgggctaccagccccacagaggcaaagtgaacttcttccggcaggtggtgatttccccacaagtaagtcgagaagatatggatttcctattggacgagatcgacctcctgggaaaggacatgtag

SEQ ID NO: 56605 - DNA, 1116 bp, Artificial Sequence
  Description of Artificial Sequence: Synthetic coding sequence
atgagccatgagaagagtttccttgtatccggggataactatcccccacccaatccgggatatcctggtggacctcagccaccgatgcccccatacgcacaacctccctatcccggtgcaccttacccacagcctccctttcagcccagcccctatggccaacccggatacccccacggcccttctccgtacccccagggcggatacccccaggggccatacccacagggtggctacccacagggcccttaccctcaggaagggtatccccaggggccataccctcagggtggatacccacaggggccatacccgcagagtccttttcccccaaatccatatggccagcctcaggtattccctggccaggacccagactctccccagcatggaaattaccaggaggaaggaccaccgtcatactacgataatcaggatttccctgccacaaattgggacgacaagtccatcaggcaagcgtttattcggaaagtgttcctcgtgctgacactgcagctgtccgtgaccctgagtaccgtgagcgttttcactttcgtggccgaggtgaaaggcttcgtccgagaaaatgtgtggacctactacgtctcctacgccgtgtttttcatctctctgattgtactttcttgttgcggggactttcgcagaaaacatccctggaatctagtggcactgtcggtgttaactgcaagcctgtcatatatggttggcatgatagcctctttctacaacaccgaggcagtaatcatggcggtgggcataaccacagccgtctgctttacagttgtgattttctcaatgcagacaaggtatgattttacctcttgtatgggcgttttactggtgtccatggtggtgctgttcatttttgctattctgtgcatcttcatccgaaaccgcatcctggaaatagtgtatgcctctcttggcgctcttctgtttacgtgtttcttggcagtcgatacgcagctcctgctgggcaataagcagctaagcctgtctccagaggaatatgtgtttgcagccctaaatctttatacagacatcatcaatatttttctttacatactaacaataattgggagagcaaaggaatag

SEQ ID NO: 56606 - DNA, 1332 bp, Artificial Sequence
  Description of Artificial Sequence: Synthetic coding sequence
atggctgcacatagaaagcacgtctttgtcgagaaagtcctccagagactgttccccccagttccatccgggcaggggaagagagaaccgcaaacgctggctgttcagaaccctcctaaaaaggtgacctctgagaaggtatcccagaagcacgctgagcctctcaccgacaccgggagtgagacaccgactgctaggaggctttacaccgccagtggcccaccggaaggctacgttccatgttggccagaaccatcctcttgtggaagccctgagaatgccagcagcggcgatgacacggaagaccaggacccgcacgatcagcctaagcgacggagaattcgaaagcacaaaagcaagaagaaattcaagaaccccaacaatgttctgatagaacaagcagagctggagaaacagcaaagtctccttcaggagaaatcccaacggcagcacacagacggaacaacgataagcaagaacaaaaagaggaagctgaaaaagaaacagcagattaagcggaagaaggcagccggattagccgcaaaggctgccggagttagcttcatgtaccagccagaagatagttccaatgagggcgagggagttggagaggcgtgtgaggaggacggggtagatacatccgaggaggatcctacactggccggagaggaagatgtaaaagacactcgtgaggaggatggtgcagacgcatccgaggaggatctcactagggcccgtcaggaggaaggcgctgacgcatccgaggaagacccaactcctgcaggcgaggaagatgttaaggacgctcgtgaagaggacggggtggacacaatcgaggaggatttgacccgtgctggcgaagaggatggcaaagacactagggaagaagatggcgcagacgcatccgaggaggaccccacttgggctggggaggaggagggagctgactcgggggaagaggatggagccgacgccagtgaagaggatgataccattaccaacgagaaggcgcactcgattctgaactttctgaagagtacacaagaaatgtatttctatgatggggtaagtcgagacgcagcctctgctgctttagcagacgctgcagaagaactccttgaccgcctcgcttcgcattcaatgctcccttccgacgtcagtattctgtaccacatgaagaccttgctgctgctgcaggatacagagagactgaagcatgctctggagatgtttccagaacactgcacaatgcctcccgaccatgccagggttatcagtgcgttcttctcctattggatcacacatatccttccggaaaagtctagtgattag

SEQ ID NO: 56607 - DNA, 1269 bp, Artificial Sequence
  Description of Artificial Sequence: Synthetic coding sequence
atggccgctcatcggaaacacgtgttcgtggagaaggttctgcagcgactgttccccccagtgccatccggacagggaaaaagagagccacagacgctggccgtccagaatccgcctaagaaagtaacatccgagaaggtgagccaaaagcacgcggaacctctcacggataccggcagtgaaacaccaacagccagacggctgtacacagcttcaggccctccagaaggctacgtcccatgttggccagagccttcatcttgtgggtccccagagaatgcctcctctggcgacgacacagaggaccaggatccccacgatcagccaaaacggaggcggattcgaaaacataagtctaagaagaagtttaaaaaccctaataatgttctcatcgagcaggcggagctcgagaaacaacagtctctgcttcaagaaaaatctcagagacagcacacagatgggacaacaatttccaaaaacaagaaacggaaacttaaaaaaaagcagcagatcaagcgcaagaaagccgctggcctggccgctaaggcggcaggagtctccttcatgtatcagcccgaagactcctccaatgaaggcgagggcgtaggcgaagcctgtgaggaagacggggtggacacctctgaggaggatcccacactggccggagaagaagacgtgaaggacactcgggaggaggatggtgcagatgcctctgaagaagatctcactcgagcaaggcaggaggagggggctgacgcttctgaagaggatcccacaccggcaggtgaagaagatgtcaaagatgctcgggaagaggatggagtggacaccatcgaagaggaccttacccgggcaggagaggaagacggcaaagacactcgggaggaggacggggctgacgcttctgaggaggacccaacgtgggctggtgaggaagagggagcagacagtggggaggaagacggtgctgacgccagcgaagaagacgataccatcaccaacgaaaaagcacatagtatacttaacttcctgaagagcacgcaagaaatgtacttctacgatggagtttcacgggacgcggcttctgccgcattagccgacgccgctgaagagttgttagatcggctggccagccacagcatgctccctagcgatgtgagtatattgtatcacatgaagactttactcctactgcaggatacggagcggttgaaacacgcgctggagatgttcccggagcactgtacaatgcctccagcgttgacgtag

SEQ ID NO: 56608 - DNA, 3948 bp, Artificial Sequence
  Description of Artificial Sequence: Synthetic coding sequence
atgaatttcctgtcgacggccgaatcacgcactgctcaagctgccgcatccggcaccacgctgctgccgcagttccgagctccgagctggcagactggaatgcactcatcggccgctaccgaactctttgccaccggaccccttccaagcactgggacgctgcctccgagcctgagcgcgtatcagcatccaactaccttctctaaccgcaactttgctacaaccagccccctggttcttcaggatagtacatttaatactaccagcaacggaatcctgtctcaccacgacccccttcttcagataaaaaccagtcaagggaccgtgccaacggctctcgcctttgaacgcttgggatcttccgtcctctctaactctattccccctcagagttctacctatcgctccgctcaggaatcagctcctcacttactacaaccacaatttagtctgctgccaagtgcgctgggcggatcacaacaaacccctcaggcctatagttctaccttgttcactagctcaaccgcaagcattgaaagggcactgctgagggaatgtagtgtgatcaagcaccatcaacgcccatccggcacacagagcattcaggctcagttaaccggatcacagcacagcctgcactcttatctttcaaacagctcggtggtcaattttcaggagactacgagacagagctctctgtcttgtagcccgattggggatagtacccagaatctgcccgactccagccctacgcagaactatattagcatgcatagctcccaaaacgtacagacacaggaatcgagctcaccacagagtcaaaagtttctgccagccgtgcagtcatcgagcttcgcaagttctacccattgccagactctgcagaacaatataacctcccccgatcccaaaagctatgctgagaggaaattagactccgatgtgtacccgtcatccaaacaagaggatgggtttcctatgcaggagctacaagtgttgcagcctcaggcatcattagagtcctctacacagcgcttgagcgacggtgagatcaacgcccaggaatcaacctataaagttagcaaagcggatgaccgctattcgcagtcggtcatccgttccaattctagactggaagatcaggtaattggtgtggcccttcaggcaagcaagaaggaggaatctgtggtcgggtcagtaacccaacttaatcaacagattggccaagtgaacaatgctgcaactctcgatctcaagaactctaccaatcttattcagaccccgcaaattagactcaataccaaggacctgaaacagcaacaccctctgatccttaaagttcacgagtccaaagtacaagagcagcatgatcaaataatcaatgccagctctcagatacagattccaaatcacgccttaggtcacggccaccaggcatccctgccgaacactcaggtactgctcgatagtgcgtgcgacctgcagatactgcaacagtcaattcttcaggccggactcggacaggttaaagctagcctgcaggcgcagcgagtgcaatcaccgcagcagattgtgcacccttttttgcaaatggagggccatgtaatccagtctaacggagatcattcacaacagcaattgcatccccaaaacagcgaggtaatgaagatggacctgtctgaaagctcaaaaccattgcagcagcatctcactacaaaaggccattttagtgagacaaaccagcatgacagcaagaatcagtttgtgtcattggggagtatgtgctttcctgaagctgtcttgctttcagacgaaaggaacatcctcagcaatgtggacgatatcctcgcagccaccgctgccgcatgcggcgtgacaccaaccgacttcagtaagtccacctcaaacgaaactatgcaggccgtcgaggacggggatagcaagtcacactttcagcaatctctagacgtgcgtcatgtgacgtccgactttaatagcatgacggctaccgtcggaaagcctcagaacatcaacgatacgagtctaaacggaaaccaagtgacagtgaacctcagccctgtacccgcattgcaatcaaagatgactcttgatcagcagcacatcgaaactcccggacagaatatccccacaaaagtgacaagcgccgtcgtgggaccttcacatgaggtccaggagcaaagttcaggccctttcaagaaacaaagcgccacaaatctcgaatctgaggaggacagcgaagcccctgtcgacagcacattgaacaacaacagaaatcaagagttcgtgagttctagccggagtatttcaggcgaaaatgctacttccgagagcgaattcacacttggcggtgacgactctggcgtgtctatgaatcctgcacggagtgctctggctcttctcgcgatggcacaaagcggtgacgcggtaagtgtgaagattgaagaggaaaatcaggacctgatgcattttaacctccagaagaaacgagccaaagggaaggggcaggtgaaggaggaagacaattcgaatcagaaacaactcaaacgcccagcacaaggaaaacggcagaacccaagaggaacagatatctacttgccctatacaccccctagctcggagtcatgtcacgacggataccagcaccaggaaaaaatgcggcaaaagatcaaagaagttgaggaaaaacagcccgaggtgaaaactgggttcatagcctcgttcctggactttctgaaatctggcccaaaacagcagttctccaccctagctgtccggatgccgaaccgaactcgcaggcctggcacccaaatggttagaacattctgtccgcctcctctccctaagccgtcatcaacaactcctactcccctggttagtgagacaggcggaaattccccatcagataaggtggataatgagctcaaaaacctagagcacttgagttcgttctcctctgatgaggatgatcctggctactcccaggatgcatacaagtctgtgtctacgcctcttactactctggacgcaacgagcgacaaaaagaagaaaacagaggcactccaggtggccacaacttcacccaccgcaaacactacagggaccgctacaacgtcctctaccaccgtaggggctgttaagcaggaacctttgcactcgacttcctatgccgtaaacatactggagaatatttctagctccgagtccagtaagcccattgagctggacggcctgccttcggaccagtttgcaaaaggacaggataccgtggcgattgaaggatttaccgatgaggaggacactgagagcggaggagaaggtcagtaccgggaaagggatgagtttgtggtgaagatcgaagacatagagacgtttaaagaggcactcaaaacgggaaaggaacccccagctatatggaaggttcagaaggccctattacagaaattcgtccctgagattcgagacggccagagggagtttgccgctactaacagttacctggggtacttcggcgacgcgaagtccaagtacaaacgcatctacgtcaagtttattgaaaacgctaataagaaagagtatgtgcgcgtatgtagcaagaaaccccgaaacaaaccatcgcagaccattcgcactgtgcaagccaaacctagctcctctagcaaaacaagcgacccactcgcatctaaaaccacgacaactaaagccccttcagtcaagcctaaagtgaagcaacctaaggtgaaggcggaaccaccacccaagaagcggaaaaagtggaaggaggagtttagctcttctcaatcagatagcagcccagagatccacacctcctctagcgatgacgaggagtttgagccccctgcccctttcgtcaccagatttctgaatacccgagccatgaaagagacgttcaaatcgtatatggaatag

SEQ ID NO: 56609 - DNA, 5207 bp, Artificial Sequence
  Description of Artificial Sequence: Synthetic coding sequence
atgaatttcctttctaccgcagagagtaggacagcccaggctgcagcatctggtacgaccctcctcccgcagtttcgcgctccctcctggcagactggaatgcattcatccgccgcaacagagctttttgctaccggacccctcccctccaccgggactttgcccccttctttaagcgcctatcagcaccccaccactttctcaaaccgcaattttgccaccacgtctcccctggtgcttcaggactccacattcaatacaacctctaatggcatcttgagccaccacgaccccctgctgcagataaagactagccagggcaccgtgcctaccgcccttgctttcgaacggcttggctcttcggtgctctcaaacagcatccctcctcagtcctcaacatacagatctgcacaagagtccgcccctcacctcctgcagccccagttttctctgcttccaagtgctctggggggatcccagcaaactccacaagcctactcctctacccttttcacttcttctacagcttcaatcgagcgcgcactgctccgcgaatgctcagtcattaagcatcatcaacgcccttccggcacccaaagtattcaggcacagctgacaggttcccagcacagcttgcacagctacctttcaaatagtagtgttgttaacttccaggaaactacgagacagagctccttatcatgcagccccatcggtgacagtacacaggtttccaacggaggcctgcagcagaagacatcccaagttagcgtggaactcgctcagagctactccagcgcgatccccagttcagggtatcctcctagcacaaccaagatcaaaagctgctccacagagcaaccacttacgtctactaaaacccctaagccacaaagtattattccacctgtgcagaccctatcatattctaaacctttacacaatcagtctagcgtgatcagtggacaggcacagatttacagtacagctcagctccctagccttctcagtgtgagtcagagtcagaactacggattggtacaaccacacaacgtcccgtccattgtgcacagccaggtgtatagatcatctaaggtcgagaaactgcctccactttacaagacgctcacgttttcaggcagctctcagacagttacccctgaaaatcaaacacttaactactcatcaaaccagcaggaggtgttgagctccgtgaccaatgagaattatccagctcagactcgcgacctctcctctgttagtcagtctcaaagttatagctcagggcactctcagggcctaagccctgtgagccagacccaagtgtcctactcaagccagtctcaggtactctccgtagtgtctctgagcgagagctacgcttcgggagaatctctgacgctgaccgccccttcccttagctactcttccgcaagtcgggcacagaacctgccagatagtagcccaacccagaattatataagtatgcattcttcccagaacgtgcagacccaggaatccagctctccccagagtcagaagtttctacctgccgtgcagagctcatcattcgcctcatctacgcactgtcagaccttgcaaaacaacataacttcccccgacccaaaatcttatgcagagcggaaactcgacagtgacgtgtatccctctagtaaacaggaggacggattccccatgcaagaactgcaggtgctccagccccaagcctccctggaaagctccacccagaggctgtcggatggtgagatcaacgcacaagagtctacatataaagtgtccaaagccgatgacagatacagccagtctgttatacgctctaattccaggctggaagatcaggtgattggagtggctttgcaggcttccaagaaggaagaatctgttgtgggtagtgtaacacaacttaaccagcagattgggcaggtgaacaacgctgctacccttgatttaaagaacagcacaaatcttattcaaaccccgcagattagactgaacactaaggacctcaagcaacagcaccccctgatattgaaggtccatgaatctaaggtgcaggagcagcacgaccagataataaatgcgtccagccagatccaaatcccaaaccatgcactgggacacggtcaccaggcaagcctgccgaacacccaagtcctgctcgactcggcgtgcgatttacaaattcttcagcaaagtatactccaggccggactaggacaggtgaaggcttcattgcaggcccagcgcgtgcaatctccccaacagatcgttcatccatttctgcagatggagggacacgttattcagtctaatggcgaccatagccaacagcagctgcatccacaaaacagtgaagtcatgaagatggacctcagtgagagctccaaacccctacagcagcatctgacaaccaagggacacttctcagagaccaatcaacacgattctaaaaaccagtttgtgtcattgggtagtatgtgcttcccggaggctgtgctgctatccgatgagcggaacattctgtcaaacgtggacgatatcctcgccgcaacagctgctgcttgcggcgtaacccctaccgacttcagcaagtctactagcaacgagaccatgcaggcagtggaggacggggacagtaaatcacatttccagcagtccctcgacgtaagacacgtcacttctgacttcaatagtatgacagctacagtcgggaagccccagaatattaatgacacttctctgaatggtaaccaagttacagtcaacctgagtcctgtacctgctttgcagtccaaaatgacactggatcagcagcacatcgaaacccctggtcagaatatccccaccaaggtgacctcagcagttgtgggcccaagtcatgaagtacaggaacaatccagcgggccatttaagaaacaaagtgccacgaatctcgagtcagaagaggactcagaagcccctgtcgattcaaccctcaataataaccggaatcaggaattcgtgtcctcttcaaggtccattagcggtgagaacgcaacaagtgagagtgaatttaccctcgggggagacgatagcggcgtcagcatgaaccccgctagatctgctctggcactgctggccatggcccagtctggagatgcagttagtgtgaagattgaagaggaaaaccaggacctaatgcattttaacctgcagaaaaagcgcgcaaaaggaaaaggccaggtgaaagaggaggacaattcgaatcaaaaacagctgaagcgccctgcacaaggtaagaggcagaacccccgagggaccgatatctatttgccctataccccaccatcttctgaatcttgccatgatggttatcagcaccaggaaaagatgcgccagaaaataaaggaggtcgaagaaaagcagcctgaagtcaaaactgggttcatcgcttccttcctcgactttttaaagagtggtccaaaacaacagttttccaccctcgccgtccgtatgccgaaccgaacgcggagacccggaacgcagatggtcaggactttttgccccccacccctgcccaaaccatcctctactactcccacccccttggtatcagagactgggggtaatagtccatccgacaaggtcgataatgagctcaaaaaccttgagcacttgagcagcttctcttccgatgaggatgaccctgggtatagccaggatgcctataagtctgtctcgactcctctgaccacactagatgctacatcagataagaaaaagaaaacagaggccctacaagtggccacgaccagtcccaccgccaataccacaggtactgctaccacgtctagtacaactgtgggggcagtgaagcaggaaccgttacattccacatcctatgccgtgaatatactggaaaacatctcgtctagtgaatcaagtaaaccaatcgaattggatggcctcccatctgatcagttcgccaagggacaagacaccgtggctatcgaggggttcaccgacgaggaggacactgagagcggcggtgagggccaatacagggaacgggacgagttcgtcgtaaagatagaggacatcgagaccttcaaggaggccctgaaaactgggaaggaacccccagctatctggaaggttcagaaagccttgctccagaaattcgtgcccgagattagagatggacagcgcgagtttgctgctacaaacagctacctgggctacttcggagacgccaaatcaaagtacaaacgtatctacgtcaaatttatcgagaatgcaaataaaaaggaatatgtgcgggtatgcagtaaaaagcctcgcaacaaaccgtcccagactatccgaacggtccaggcgaagcccagttcctcctccaaaacttctgatcccctagcctctaagaccaccacaaccaaagccccatcagtgaaacctaaagttaaacaacctaaagtcaaggcagaaccccctcccaagaaaaggaagaagtggaaggaggagttctcatcaagtcagtcggattcctccccagagatccatacctccagcagtgatgacgaggagtttgaaccccctgcgccattcgtaactaggtttctgaacacacgagccatgaaggagacgttcaagagctatatggagctgctggtaagtatcgctctggaccccgacaccatgcaggccctggagaaatccaacgacgaactactgttgccacacatgaaaaagatcgatggtatgctgaacgataaccgcaagcggctgctgctcaacttacacctggaccagagctttaagaacgcattggagtcatttcccgagctcactattataactcgcgatagcaaagcaaaaagtggtggaacagcaatttcaaagataaagatgaacgggaaagcctacaacaaaaagacactcaggaccagtaaaaccaccaccaaatcggcgcaggagtttgccgtggatcccgagaagattcagctttattcactgtaccacagcctgcaccattacaaataccacgtgtatctgatctgcaaggacgagatctctagtgtgcagaaaaaaaacgaggatctcggccaggaggagatcgtccagctttgcatgaaaaacgttaagtgggtggaggatctgttcgagaaatttggagagctactgaatcatgttcagcagaagtgcagcta

SEQ ID NO: 56610 - DNA, 195 bp, Artificial Sequence
  Description of Artificial Sequence: Synthetic coding sequence
atgaatttcctgtctactgcagagtcccggacagcacaggcggcagctagtggcactaccttgcttccccagttcagagctcccagctggcagacaggcatgcattccagcgctgccaccgagttattcgccaccggccctcttccctcaactggcaccttgcccccaagcctttcagcttaccagcatccgtag

SEQ ID NO: 56611 - DNA, 4992 bp, Artificial Sequence
  Description of Artificial Sequence: Synthetic coding sequence
atgaaggatgccgcagaggagctgtcctttgcccgagtgctgctccagagggtggatgagcttgaaaagttgtttaaggatagggaacagtttctcgagctagtgtcacgtaagctgtccctggtccctggcgctgaggaagtgacgatggtgacttgggaggaactcgagcaggccatcactgatggctggagagccagtcaggcagggtcagagaccctcatgggattcagtaagcacgggggatttacaagcctgacatcacctgagggtaccctatccggagacagtacaaaacagccgagcattgagcaagccctagatagcgcctctggcctggggcctgaccggactgcatctggcagtggcggtaccgcccaccccagtgatggcgttagtagtcgcgaacaatccaaagtccctagcggcaccggacgtcagcagcaacctagagccagagatgaggcaggcgtgcctcgactgcatcagagctccactttccagttcaaaagcgattcagatcgacaccgctcacgcgagaaactcacatctacccaaccgaggaggaatgcacgtccaggaccggtgcagcaggatttgccattggcgcgagaccaacccagctcagtgcccgcttcacagtctcaagttcatctacgccctgaccgcaggggcctcgagcccaccggaatgaaccagcccggtctggtgcccgctagcacatacccccacggggtggtccccctgagcatgggccaacttggagtgcctcctccagagatggatgaccgagagctgatcccgtttgtggtggatgagcaacgtatgctgccacccagcgtgcccggacgggatcagcagggtctggagctcccgtctaccgaccagcatggattagtgtctgtgagtgcctaccagcatggaatgacatttccaggcacagatcaaagatcaatggaaccactcggaatggatcagagaggttgtgtgataagcggaatgggacagcaggggctggtgcccccaggcattgaccagcaaggcttgacactgcccgtcgtggatcagcatgggcttgtgctgccctttaccgatcagcatggactcgtgtcacctgggctcatgcctattagtgccgatcaacaaggtttcgttcagcccagtttggaggccacaggctttatccaacccggaaccgagcagcacgatctgatccagtcagggcgttttcagagagccctcgtacaacgcggagcgtaccagccaggcttggtgcagcccggtgccgatcagagagggttggtaaggccaggtatggaccagtcgggactggcccagccaggggctgatcagagaggactggtctggcctggaatggatcagtctggccttgcgcagccaggcagggaccagcatggcttgatccagccaggaaccgggcagcacgacctggttcagtctggaacaggacagggtgttctggtacagcccggagttgatcagccagggatggtgcagcccggtcgctttcagagagctctggtacagccaggtgcataccagcccggtcttgtccagcccggtgctgatcaaatagatgtggtacagcctggagcagatcagcacggactggtacagtccggtgccgatcagtcagatcttgcccagccaggggctgtgcaacatggtctcgttcaacctggtgtcgaccaaagagggctcgcacagcctcgggcagaccatcaacgcggactggtacctcccggagccgaccaacggggattggttcagcctggagctgaccagcatggtttggtgcaaccgggagtcgatcagcatggactggcacagcctggcgaggtgcagaggtctctagtgcaacccggaattgtccagcgcggtttggtacagcccggtgcagtgcagaggggtttggtacaacccggagccgtacagcggggtcttgtccagcctggcgtggatcaacgtggtcttgtgcagcctggtgctgttcaacgcggattggtgcagccaggtgcagtccaacacgggctagtccaaccgggtgccgaccaacggggtctggtgcagcccggagtcgaccagagaggcctagttcagcccggagtcgaccaacggggactggtccagcccggaatggatcaacggggtctcattcagcccggagctgaccaacccggtttggtccagcccggagcgggacagctggggatggtgcagcccggtattgggcagcaaggaatggtgcagccccaggctgatccgcacggactggtgcagcctggagcttatcccttaggcctagttcaacccggagcttaccttcacgatctgagccagagtggcacttacccaagaggcctggtccaacccggaatggaccaatatggtctcaggcaaccaggtgcttaccagcctggactgattgcgccaggcaccaagttgagaggatcttctactttccaggctgactcaaccggattcatttcagtgaggccataccagcatggaatggtgcctcccggaagggagcaatatggccaggtttcccctctgcttgctagccagggactggcaagtcccggaatagataggcgctcgttagtgcccccagaaacctatcagcagggactgatgcaccctggcacagaccagcattcaccaattccactttcaacaggactgggtagcacacaccctgatcagcagcacgtggcttccccaggccctggggagcacgatcaggtttatcccgacgcggcacaacacggacacgcattttcgctgttcgactctcatgacagcatgtatcccggataccgcggtcccggatatctgtccgctgaccaacacggccaggaaggcctggacccaaacaggacaagggcaagcgatcgtcatggcatcccggctcagaaagcccctggccaggatgtcacacttttccgctcaccagatagtgtggaccgggtgttatccgagggttcggaggtgagctcagaggtgctgagcgaacgacgaaacagtttgagacggatgtcctcttcattcccgactgccgtggaaacattccacctgatgggcgaactaagtagcctgtacgtgggcctgaaagaatccatgaaagatcttgacgaagaacaggccggacaaaccgacctcgaaaaaatccaattcctattggcccagatggttaaaagaactattccacccgagttacaggaacagttaaagactgtgaagaccctcgctaaagaagtatggcaggaaaaagcaaaggtggagcgccttcagcgcattctggaaggagagggtaatcaagaagccggaaaagagctcaaagcaggagagctgaggctccagctaggtgttttgcgcgtgaccgtggctgatatagagaaagagcttgcggaacttcgggagtctcaggaccggggtaaggccgcaatggagaatagcgttagcgaagcttccctgtacctccaggaccagctggataagctgaggatgatcatcgaaagcatgcttacttccagcagtaccctgctgtcaatgtcaatggctccgcacaaggcgcatacactggctcccggacagatagatcctgaagccacttgcccagcctgctctctggacgtctcgcatcaggtgagtaccttggtgcgcagatatgaacaactacaggacatggtgaactctttggctgtgtctcgaccttccaagaaggcaaagttacaacggcaggacgaggaactgctgggcagggtgcagtcggcaatccttcaggtgcaaggggactgtgagaagctgaatatcacaacttcgaatcttattgaagaccacagacaaaagcaaaaggacatcgccatgctgtatcaggggcttgagaaacttgagaaggaaaaagctaatagggaacacctggagatggaaattgatgtgaaggccgataagtctgcattggccactaaagtgtccagggtgcagttcgatgccacgacggagcaactgaatcacatgatgcaggaactggtagctaagatgagcggccaggaacaggattggcaaaagatgttggacaggctgctgactgagatggacaataagttggataggctggagctggatcctgtgaagcagctgcttgaagacaggtggaaaagtctgcgccagcagctccgtgaaaggccaccactttaccaggccgacgaggccgctgctatgcgcagacagctcctggcccacttccactgcttaagttgtgaccgccctttggaaactccagtcactgggcatgcaattcctgtgaccccagcaggaccaggcctgccaggccaccacagtatccggccatatactgtgttcgaactcgaacaggtgagacaacactcaagaaatctgaaactcgggtctgctttccccagaggtgatctggcacagatggagcaatccgttggcagattgcgcagcatgcatagcaaaatgctgatgaacattgagaaggttcagatccactttggtggcagcaccaaggcatcttcccagatcatccgggaactattgcatgcccagtgtctgggatctccatgttataagagggtcactgatatggccgattacacctactctactgtgccccgaagatgtggagggtcccacacactgacctacccctaccataggagcaggccacaacacctgccgaggggcctttacccgaccgaagagatccaaatcgccatgaagcacgacgaggtcgacattttgggattggatggccatatttacaagggaagaatggatacacgattgcctgggatcctccgcaaagattccagtggcacgagtaaacggaagtcccagcagcccaggcctcatgtgcatcgaccaccatcattatcgagcaacggacagttgccgagtcggccacaaagtgcccagatcagcgctggtaacacctccgagaggtag

SEQ ID NO: 56612 - DNA, 4290 bp, Artificial Sequence
  Description of Artificial Sequence: Synthetic coding sequence
atgaaagacgccgcagaggaactgtctttcgcacgcgtgctactacagcgcgtggacgaactcgagaagctttttaaagatcgagagcagttccttgagctggtcagtcgtaaattgtctcttgtaccaggcgctgaggaagttactatggtgacctgggaggagcttgagcaggctatcacagacggctggagggcgtcccaagcaggcagcgagacacttatgggtttttccaaacatgggggatttacatcacttacctcgccagagggcacgctctctggagactctacaaagcagcctagcatcgaacaagcgctggattctgcgtctggccttggacccgatagaacagcttctggaagcggaggtaccgctcacccttctgatggagtaagtagccgggagcagagtaaggtgccttctgggacgggccgtcagcagcagcctagggccagggacgaagccggagttcccagactccatcaatctagtacattccagtttaagtcagatagcgacaggcatcggagtagagagaaacttacttcgactcaacctcgaaggaacgccaggcctggtcccgtacagcaggaccttcccctggctagagaccaaccctcatctgtgccagcaagccagagccaggtgcatctcagacccgatcgcagggggttggagcccaccggaatgaaccagccaggccttgttcctgcttctacttatcctcatggagtggtgcccctgtcaatgggacagctgggagttcccccacctgaaatggacgatcgcgagctgatcccttttgtggtcgacgaacagcgcatgttgcccccaagcgtacctggaagagatcagcagggcctggagctcccatccacagatcagcacggcctagtgtccgtgagtgcctaccagcatggcatgacctttcctggcaccgatcagaggagtatggaaccccttggtatggaccagaggggatgtgtcatcagtggcatgggccagcaaggtctggtgccgcctgggattgaccagcagggtctcacgctccctgtcgtagaccagcacggcctggtgctgccctttacggaccagcatggcttggtgtctcccggactgatgccgatcagcgccgatcagcagggtttcgtccagccgagtctcgaggcaacgggctttatacaacctggcacagagcagcatgatttgatccagagcggaagatttcagcgggctctagtgcaacgcggagcctatcagcctggtttagtgcagcctggagccgaccagagggggttagtgagacccggtatggatcagtcagggctcgctcagcccggagccgatcagcgcggtctggtgtggcctgggatggatcagagcggcctggcccagcccggacgcgatcagcacggtcttatccagcctggaacaggacagcacgatctggtgcaatctgggacggggcagggagtgttggtgcagcctggcgtagaccagcctggtatggtccagcccggaagatttcagcgagccttagttcagcccggagcttaccagccgggtctggtgcagcccggtgctgatcagattgacgttgtgcagccaggggctgatcagcacggcctggttcaatctggagccgatcagagcgacctcgcccagccgggagctgtacagcatggcctggtccagcccggtgtggaccaaagggggctggcacagcctcgcgctgatcaccagagagggttggtacccccaggcgcagatcagaggggccttgtccagcctggcgcagatcagcacggtttggttcagcccggagttgatcaacacggactcgcacagcccggtgaggttcaacggagtctggtacaaccaggcatcgtgcagcgcggactagtgcagcccggtgcagtgcaaagaggcctggttcagccaggtgccgtgcagcgtggattggtgcagcctggagtagaccagcgcggattggtgcagcctggggcagtccaacggggtttggtgcagcctggcgcagtccagcacggattagtacagcccggagctgaccagcggggtctggtgcagccgggagtggaccagagaggtctcgtccagcccggtgtcgaccagaggggcctcgtgcagcctggcatggatcagagaggacttatccaacctggggctgaccagccaggattagttcagcccggagctgggcagctgggtatggtccaaccgggaattggccagcaagggatggttcaaccacaggccgatccacatggacttgtgcaacctggcgcttacccactaggactggtacagccaggtgcctatctgcacgacttaagccagagcggcacgtaccctcgtggcctggtgcagcccggtatggaccagtatggcctcaggcagcctggcgcatatcagccaggactaattgctccaggtaccaagctgcgcggatctagcaccttccaggcagattccacaggctttatttctgtccgaccttatcaacatggcatggtgcccccagggcgtgaacagtatgggcaggtgtcgcctctcctggcctcccaggggttagcctctccagggatcgaccggaggtctctggtccccccagaaacctaccaacagggcctgatgcacccaggtaccgaccaacatagtcctattccactgtcaacagggctggggtctacacacccagaccagcaacacgtggcctcaccgggtcctggcgaacatgatcaggtttaccctgacgccgcacagcacggccacgccttttcactcttcgacagtcatgactccatgtacccaggctaccgcggtcctggctatctctccgcagatcagcatggccaggagggcctggatccaaataggacaagagcttcggatcggcacggcatcccggcacagaaagccccaggacaagacgtgaccttatttcgatcgcccgactccgtggaccgagtgctgtctgaggggtccgaagtgtcctctgaggtcttgagcgaaagaaggaactccctgcggaggatgtcttcatcattccccacggcggttgaaacattccatctgatgggcgagctgtccagtctgtatgtcggactgaaggagagtatgaaggacctagacgaggagcaggccggacaaactgatctcgaaaagatacaatttctcctggcccagatggtcaagcgcactataccccctgagctacaagagcaacttaagactgtgaaaaccctagcgaaggaggtgtggcaggaaaaggccaaggtggagcgcttacagaggattttggaaggagaaggaaatcaggaggcaggcaaagagctgaaagcaggcgagctgagactgcagttaggagtactcagggttacagtggcagacatcgagaaagagctggccgagttgcgcgagagccaagatcgcggaaaggccgctatggagaactccgtaagcgaggcatccctctatctccaggaccagctggacaagctgcggatgatcattgagtccatgttaacctcatccagtactttgctgtccatgtctatggcccctcataaagcccacacactggccccaggtcaaatcgatccagaggccacatgtccggcatgcagtcttgacgtcagtcatcaggtgagcaccctagtcagacggtatgagcagttgcaagacatggtgaactcgctggctgtctcccgaccttctaagaaagctaaactgcagagacaggacgaggagctccttggacgcgtgcagtccgccattcttcaagtgcagggtgactgtgagaagctaaacatcaccactagcaacttaatcgaagaccacagacaaaagcagaaagacatcgccatgttataccagggcctggaaaaattagagaaggaaaaagctaacagagaacacctggaaatggaaattgatgtgaaagctgataagtcagcattggctaccaaggtcagtagagtgcaattcgacgccaccacagaacagctgaatcacatgatgcaggagttagtagctaaaatgtcaggtcaagagcaggattggcagaagatgctcgatcgtctgttgaccgaaatggataataagcttccgggaatcctgcgtaaggacagttcaggcaccagcaaacggaaaagtcaacagcctagaccccacgtccataggccaccatcactgtcgagcaacggtcagttgccttcacgtccacagtcggcgcagatctcagcaggtaataccagtgaacggtag

SEQ ID NO: 56613 - DNA, 2331 bp, Artificial Sequence
  Description of Artificial Sequence: Synthetic coding sequence
atgaacaactcactggaaaacacaatctcattcgaagaatacatccgcgttaaggcaagatccgtcccgcaacatcgaatgaaggaattcctggattccttggctagtaaggggccagaggccctgcaggaattccaacaaacagccaccactaccatggtctatcagcaggggggaaactgcatatacacggacagtacagaggtagcaggctcattgctggaattggcctgccccgtgacaacttctgtgcagccccagacacagcaagagcagcagatccaggttcagcagccccaacaggtgcaggtgcaagtgcaggttcagcagagcccacaacaggtgtctgctcaattgtcaccccagttgacagtgcatcagccaactgagcagcccattcaggtgcaggtgcagatccaaggacaggcaccccagagcgctgctccttctatccagactccaagcctgcagagcccatcaccttcccagctgcaggcagcccagattcaggttcagcacgtgcaagcagcccaacaaatacaggccgctgagatccctgaggagcatattccccatcaacaaatccaagcacagctcgttgcaggccagagtctcgcgggaggtcagcagattcagattcaaacggtcggcgctctaagccctccccctagtcagcagggctcgcccagagaaggggaaagaagggtgggaacagctagcgtcttacagccggtgaaaaaaaggaaagtagacatgcccattacagtatcttatgccattagcggccagccagtggctaccgtgctcgctattccccagggccagcaacagtcctacgtgagcctccgcccagacctgctgacagtcgatagtgcccatctctactccgcgactggtacaataacgtcacctacaggcgagacttggacaattccagtttactccgctcagccgcgaggggatccccagcagcaatcaatcactcacattgccattccacaggaagcttataacgctgtccatgtcagcgggagcccaacagcgttagccgcagtgaagctagaagacgacaaggagaagatggtggggactacatcagtggtgaagaactcccacgaggaggtggtgcagacactcgccaattccttatttcctgcccaattcatgaatggcaatattcatattcctgtagccgtgcaggctgtggcaggtacctaccagaacaccgcccaaacagtgcatatctgggatccgcaacagcagcctcagcagcaaacaccccaggagcaaacacctccccctcaacagcagcagcaacaactgcaagtgacatgttccgcacagactgtgcaggtggccgaggtagaaccgcagtctcagcctcagccttcacccgaactattactgcccaacagcctgaaacccgaggagggcttggaggtctggaaaaactgggcgcagacaaagaacgccgaactggagaaggacgcacagaaccgactagcaccaatcggacgacggcagctcttgaggtttcaggaagatctaataagtagtgccgtcgccgaactcaattacggcctttgcctcatgactagggaagcgcgtaacggcgagggcgagccttacgatcctgatgtgttgtactacatcttcctgtgcattcagaagtacctgtttgaaaacggacgggtggatgatattttctctgatttatattatgtgcgcttcacagagtggctccacgaggtcctgaaagacgtccagcctcgggtcacccctctgggctacgtgctgcctagccacgtaacagaggagatgctgtgggaatgtaaacagcttggcgctcatagtccctccacactcctcacgacattaatgttctttaatactaagtatttcctgctgaagaccgtcgatcaacatatgaaactggctttttcaaaggttctcagacaaacaaagaagaacccgagcaatccaaaggataaatcaacaagtattaggtatttgaaagcactgggaattcaccaaacaggacagaaggtgaccgacgatatgtatgcggagcaaacggagaaccctgagaacccacttcgttgcccaatcaaactgtacgatttctatctgttcaaatgccctcaaagtgtcaaagggagaaacgatacattctacctgactccagagcccgttgtggcgccaaatagtccgatctggtacagcgtccaacctatctctagagagcagatggggcagatgctgactcgcatactggtgatcagggaaattcaggaagcgatcgccgttgccaacgcaagcacgatgcattag

SEQ ID NO: 56614 - DNA, 2331 bp, Artificial Sequence
  Description of Artificial Sequence: Synthetic coding sequence
atgaacaactccctggaaaacacaatcagctttgaggaatatatcagggtaaaagctcgatctgtgcctcaacatagaatgaaggaatttctagatagcttggccagtaaaggaccagaagctcttcaggaatttcagcagactgcaaccaccaccatggtgtaccagcaggggggtaattgcatctataccgattcgacagaggtggctggatctctgctcgagctggcctgcccagtaacgacttccgtacaaccccagactcagcaagaacagcagattcaggtccaacagccccagcaggtccaggtgcaggtgcaggttcagcaaagcccacagcaggtcagcgctcagctttcaccacagctgacggtgcaccagcctaccgagcagcccatccaagtgcaagttcaaatccaaggccaggctccccagtcagcagcaccttctatccagaccccttctttgcagagcccgtccccgtcccaactccaggccgcacagatacaagtgcagcatgttcaagccgctcaacagatccaggccgctgagattcctgaggaacacatccctcaccaacagattcaagcgcagctggtcgcaggccaaagcctcgccggagggcagcagattcagatacaaaccgtcggagccctttccccacccccatcccagcaaggaagcccccgagagggtgagcgacgcgtgggcacagcctctgtgctgcaaccggtgaaaaagagaaaagtcgatatgcctatcaccgtgtcatacgcaatatccggccaacctgtcgctaccgtgctggctatcccgcagggacagcagcagtcatacgtcagtctccgtccagacctcctgaccgtcgactccgctcacctgtacagcgcaacaggcacaataacaagtcccaccggggaaacctggaccatacccgtgtatagcgcccagccacggggagatcctcagcagcagtccatcacccatatcgcaataccgcaagaggcatataacgctgtgcacgtctcgggatctcccactgcactggccgctgttaagctggaggacgataaggaaaagatggtgggcaccacaagcgtggttaaaaattctcatgaggaggtcgttcaaacactggcaaactccctttttcctgctcaattcatgaacggaaacatccatataccagtagctgtgcaggctgtcgcgggaacataccagaatactgcacagactgtccacatatgggacccgcagcagcaaccccaacaacagacccctcaggagcagacacctccccctcagcagcaacagcagcagctgcaagtgacctgctcagctcagacggtgcaggtggccgaggtagagcctcagtcccagccccagccgtctcccgagctcttgcttcccaattctttgaaaccagaggaggggttggaggtgtggaagaattgggcccagacgaagaatgccgaactcgagaaagatgcacaaaatcgtttagccccaattggcaggagacaactgctgcggttccaggaggaccttatttcgtctgctgtcgctgagcttaactacggcctttgtctgatgacacgcgaggctcggaatggggagggagagccatatgatccggacgttctctactatatatttctgtgcattcagaagtacctctttgagaacggacgcgtggatgatatttttagcgatttatactacgtgagattcaccgagtggctgcatgaagtgcttaaagatgtccagcctcgcgtcacaccattaggctatgtgctgccgtcccatgtaacagaagagatgttgtgggaatgtaagcagctgggagcacacagcccgtctacccttttaaccacccttatgtttttcaataccaagtactttctactcaagacggtagatcagcacatgaaactcgcatttagtaaagttctcaggcagacaaagaagaatcctagcaacccaaaagacaaaagcacctcaatccggtatctgaaggcactcggaatccatcagacaggccagaaagttaccgacgatatgtatgcagagcaaaccgagaatcctgagaatcctcttcgatgtccaatcaaactgtatgatttttatctgtttaaatgcccacagtcggtgaaggggagaaatgataccttttatctgactcctgaacctgtcgttgccccaaattccccgatctggtattccgtgcagcctatttcacgggaacaaatgggacagatgttaactagaatcctcgtcatcagagaaatccaagaagcgattgccgtggcgaacgctagtacgatgcactag

SEQ ID NO: 56615 - DNA, 2331 bp, Artificial Sequence
  Description of Artificial Sequence: Synthetic coding sequence
atgaacaattcgcttgaaaataccatctcatttgaagagtacattagagtgaaagcacggagcgtgccccagcatcgcatgaaagagttcctagattccctcgccagcaagggtccagaagcactgcaggagttccaacagactgctaccactacgatggtctatcagcaaggaggaaattgtatctatacagactccacagaagttgcgggttccctgctagaactggcttgtcctgttactaccagcgtgcagcctcagacccagcaagagcagcagatccaggtgcagcagccacaacaggtgcaggtgcaggttcaggtccagcaaagtccacagcaagtatctgcacagttatctccacagctgactgttcatcagcccaccgaacagccaattcaggtgcaggtgcagatacaggggcaagcccctcagagcgctgcccctagcatccagactcctagtctgcagtctccaagcccatctcagctgcaggctgcgcagattcaggtgcagcacgttcaggctgcccaacaaatccaagccgcagagattcctgaagagcacattccacatcagcagattcaagcccagctcgtcgccggacagagtcttgctggaggacaacagatccagatccagacagttggcgcattaagtccaccaccctctcagcaggggtcccctcgtgaaggtgagcgcagggttgggacggcctctgtgttacagcccgtgaaaaagcgcaaggtcgatatgcccatcaccgtatcttacgcgatcagtggtcagcctgttgctactgtgctggccatcccccaagggcagcagcaatcttatgtgtccctgcgaccagacctgctaacagtggattctgcacacttatacagcgcaacagggaccatcacctcgccaactggcgaaacgtggaccatccctgtctactctgcccagcccaggggcgatcctcagcagcagtctattactcacatagccataccgcaggaagcctataacgcagtgcacgtctctggcagccccactgcacttgctgctgtcaagttagaagatgataaagaaaaaatggtaggaaccacttcagtagtcaagaattcccatgaggaagtcgtgcaaacacttgccaattcactattcccagcacaatttatgaatgggaatattcatatccctgttgccgtccaagccgtggctgggacataccaaaataccgcccaaacagtgcatatttgggacccacagcaacaaccccaacagcagactccacaagaacagacaccccctccccaacagcaacagcaacaactgcaggtaacctgtagcgcccagacagttcaggttgctgaagttgaacctcaaagccagccccagccaagtccggagcttctcttaccaaactctttgaaaccagaagagggccttgaagtgtggaagaactgggcccaaactaaaaatgcagaactcgagaaagatgcacagaatcggctggcacccattgggaggaggcagctgctgcggttccaagaggatctcatttcctccgcagttgctgagcttaactacggactgtgtcttatgacacgtgaagcccgtaacggagagggagagccctacgaccctgacgtgctgtattatatcttcctgtgcattcagaaatatttgtttgaaaacggccgagtcgacgatatcttttccgacctctactatgtaaggttcactgagtggctacacgaggtactcaaagatgtgcaacctagagtcacaccattaggctatgtacttccatcacacgtaactgaggagatgctttgggaatgcaaacagctgggagctcatagcccttctacccttctgactacactgatgttctttaatacaaaatacttccttctcaagaccgtggaccagcacatgaagctcgccttttcaaaagttctgagacagacaaaaaagaatcccagcaatccaaaagataagtcaacatccattagatacttaaaggccctcggtatccaccagacgggtcagaaagtgacagacgatatgtatgccgaacagacggaaaacccagagaaccccctgcgatgtcccataaagctgtacgacttttacttgtttaagtgtcctcaaagtgttaaaggtcggaacgatacgttttacctcacacccgagcccgtcgtggcacccaattctcctatctggtactccgtgcagccaattagccgagaacaaatggggcagatgttgaccagaatcctggtgataagagagatccaggaagccatagcagtggccaacgcatctactatgcactag

SEQ ID NO: 56616 - DNA, 747 bp, Artificial Sequence
  Description of Artificial Sequence: Synthetic coding sequence
atggaggatcctgaaaagaaattgaatcagaagtccgacggtaaacccaggaaagtcagattcaagattagtagttcctatagtggtcgggttctgaagcaggtcttcgaagacggacaggaactggaaagcccaaaggaggagtacccacactcattcttgcaggaatccctggaaacaatggacggagtttatggatcaggtgaggttccacggcctcagatgtgttctcccaagctaaccgcacagcgaattagcgtatttcgagaaggcaatgcttatactttggcagggggacagcctaggttcaacgattacaaggctaacgaccataagcctctcccaataattgattttggtaaaatcattatttacactaataacctaaaaattatccggacaccaatggataagcgagacttcgtgcgaaagattttacagaaggaggaagaagcagaggaagagtctcttatgaacaaagaggaatcatacggaggtagagaccaacacgataggcccctggtagaggccgaaagcacactccctcagaaccgttacactcaagagggcgatattcctgaagacagttgtttccattgcaggggatctggctccgcaacttgttccctctgccatggtagcaagttctcaatgctagctaacaggttcaaggaatcatacagagccctgaggtgtcccgcttgcaatgagaacggtcttcagccctgccagatttgtaaccagtag

SEQ ID NO: 56617 - DNA, 666 bp, Artificial Sequence
  Description of Artificial Sequence: Synthetic coding sequence
  Description of Combined DNA/RNA Molecule: Synthetic coding sequence
atgttccagcagttccaagcctcttgtctggtcttgttttttctggtaggcttcgctcagcaaaccctaaaacctcagaataggaaggtggactgtaataaaggggtaacgggcacaatctacgaatacggggctctaacactcaacggtgaagaatatatacagtttaagcaattcgctggaaagcacgtcctctttgtaaacgtggctgcttacugaggcctggccgcacagtacccagagctgaacgccttgcaggaggagttaaagaattttggcgtgatcgtcctggccttcccttgtaaccagttcggcaagcaggagcccggtacaaactcagaaatcctgctgggattgaaatatgtgtgtcccggatctggattcgtcccaagcttccagctgtttgagaagggagatgttaacggtgagaaggagcagaaagtgtttacctttttgaagaatagttgccccccaactagcgacttgcttggatcctcttctcaacttttttgggaaccaatgaaggtgcacgatatcaggtggaatttcgagaagtttttggtcggtcctgacggggttcctgtgatgcattggttccaccaggccccagtttccactgtgaagtctgatatactagaatatctgaaacaattcaacacgcattag

SEQ ID NO: 56618 - DNA, 216 bp, Artificial Sequence
  Description of Artificial Sequence: Synthetic coding sequence
ctgacttcttttcgcgtcgtgcacaccatccccatgattaagtccttcttcaattatctctcccccaagcatctgaagttccaggttgattgcaacaagggcgttaccggtaccatatacgaatacggcgcactgactctcaacggcgaggagtacatccagttcaaacaatttgcgggaaaacatgtcctgttcgtcaacgttgcagcttactag

SEQ ID NO: 56619 - DNA, 1590 bp, Artificial Sequence
  Description of Artificial Sequence: Synthetic coding sequence
atgtctggtctcctgaccgaccctgagcaaagggcacaggagccaaggtaccccggttttgtgctgggtcttgatgtaggttcctccgtgatcaggtgccacgtttatgatagggccgctagggtttgcggcagctcggtccagaaggtcgaaaacttgtatccccagatcggctgggtagaaatcgatcccgatgtactgtggatccagtttgtggccgtgataaaagaagccgtgaaggccgcaggtattcagatgaaccaaatcgttggtctggggatcagtactcagagggccacctttattacatggaacaagaagactgggaatcactttcataatttcatcagttggcaagatctcagagctgtcgagctggttaagagttggaacaattctcttctgatgaagatcttccacagttcctgccgagtcttacattttttcactcgctccaagaggctatttactgcttccctgttcacttttactacacagcaaacctccctaagattggtgtggattctgcaaaacctgaccgaggttcagaaggcagtcgaggaagagaactgctgtttcggaaccatcgatacttggctcctgtataaacttacaaagggcagtgtgtacgcaactgactttagtaatgctagtaccacgggattattcgatccgtacaaaatgtgttggtctgggatgatcacttccctaatctcaattcccctctctctgcttccaccagtacgggataccagccataatttcggcagcgttgacgaagaaatatttggagtgcccattcccattgtggccttagtcgctgaccagcagtctgccatgtttggggaatgctgttttcagaccggcgatgtgaaacttaccatgggtaccggcacgtttctcgacattaacacaggcaactccctacagcagaccaccggaggtttttatcccctcattggatggaaaataggccaggaagtcgtgtgcctggcagaatccaatgctggcgatactgggacagcaataaagtgggctcagcagttagatctgttcactgatgcggctgagaccgagaaaatggcaaagtccctcgaggattcagagggagtctgcttcgtgccttccttcagcgggcttcaggctcctttgaacgacccctgggcttgtgcctcctttatggggctaaagccttcgacctcgaagtatcaccttgtgagagcgattctcgagagtattgcattcaggaacaagcaactctacgaaatgatgaaaaaagagatccacattcccgtacgcaagattagagccgacggaggggtttgtaaaaatggctttgtgatgcagatgacatcagatctgattaacgagaacattgatcgccctgcagacattgacatgagctgtctgggggctgctagcttggcaggtcttgctgtcggcttctggactgacaaagaggaactgaagaagctcagacagagcgaagttgtgtttaagcctcagaaaaagtgccaggagtacgagatgagcctcgaaaattgggctaaggcggttaagcgctctatgaactggtataataaaacctag

SEQ ID NO: 56620 - DNA, 906 bp, Artificial Sequence
  Description of Artificial Sequence: Synthetic coding sequence
atgtcagggcttctcacagatccagaacagcgggcacaggagcccaggtaccctggcttcgtgcttgggctggatgttgggagcagcgtcatcagatgtcatgtttacgatcgagctgctcgtgtttgtggttcatccgtacagaaagtggagaatctgtatccacagataggatgggtggagatcgacccagacgttttatggatccagttcgtcgcagtgatcaaagaggccgtgaaggctgccggaatccaaatgaaccagattgttggtctgggtattagtacccagcgcgctacgttcatcacctggaacaagaagaccgggaaccacttccataattttatcagctggcaagacttgagagcagtagagttggtcaaatcctggaataactccctcctcatgaaaatattccatagcagttgtagggtgctacacttctttacaagatccaagaggctatttacagcctcgctgtttacattcacaacccagcagacttccctcagactggtgtggatactgcagaacctgacagaagtccagaaggcagttgaggaagagaattgctgcttcgggaccatagatacatggctgctgtataagctcacaaaagggtctgtgtatgcaactgatttctctaatgcgtccactactggtcttttcgatccctacaaaatgtgctggtcagggatgatcacctctctgatcagtatcccactttctttactgccaccggtgcgggacacctctcataatttcgggtctgttgacgaggagatctttggagttcctatccccatcgtggccctgctgaaggtgcccggatacgatcagaacatttgctatattttcgggaaagggacaattgagccagtgttttatcatgggagcaccctgtag

SEQ ID NO: 56621 - DNA, 360 bp, Artificial Sequence
  Description of Artificial Sequence: Synthetic coding sequence
atgagcgtcactgaccaagccttcgtgactctggcaacagacgacatctactgccagggggctcttgttctcggccagagcttgaggaggcatcgccttacgcggaagctggtcgtgcttattaccccccaggtgtcatccctgctacgcgatatggacgaggccggtaaccacgacagtgagcagacaattgccggaattgagaaccaaacactgcacgtcctcacccatcggtgggagctaaacaacgagaatacctggacacagggcggagaacaccacaccctcgaacctgtggtcggtagaggggagggtggtgggatagctctcggagacattccaaacgtgaacgacgaatag

SEQ ID NO: 56622 - DNA, 291 bp, Artificial Sequence
  Description of Artificial Sequence: Synthetic coding sequence
atgagtggtagccatagcgtgacgcaggcaggtgttgaatggtataatcattcatcactgcagccacaaacacctcgactcaaatacccccctacttctgcctcgcaggtggccgttacaaccgttaccgatcaagctttcgtgacactggccaccgatgacatttattgccagggtgcacttgtgcttggacagagcttgcggcgacaccgtctgacgaggaagctggtcgtcctcattacaccccaggtgagttccctgttacgggtatccctcgtagcccaggcctag

SEQ ID NO: 56623 - DNA, 195 bp, Artificial Sequence
  Description of Artificial Sequence: Synthetic coding sequence
atgtccgtgaccgaccaggctttcgtgactctagccactgacgatatctactgccagggagcgttagtgctcggccagtcccttagaagacaccgtctgacacgcaagctcgtcgtactgattaccccacaggtgagctcattattgcggcctgctgccagtctggtgttgagtagagtgtccagtcgcccatag

SEQ ID NO: 56624 - DNA, 192 bp, Artificial Sequence
  Description of Artificial Sequence: Synthetic coding sequence
atgtcagtgaccgatcaagccttcgtcacgctggccaccgacgacatctactgtcagggggcactggtgcttgggcagtccttgcgtcgccaccggcttacccgtaagctcgtagtattgatcaccccacaggtctcctcccttttaagcttgtcaaagagatgtaaaatctcgagcagccacctagactag

SEQ ID NO: 56625 - DNA, 966 bp, Artificial Sequence
  Description of Artificial Sequence: Synthetic coding sequence
atgagcccttcccccacagccctgttttgtcttggattatgtcttggccgtgtgcctgctcagtccggccctcttccgaaaccttctctccaggctcttccctcttcactggtcccactcgaaaagccggttactctgcgatgtcagggacctcctggcgtggacctttatcgcctggaaaagctcagctcttcaagataccaagaccaggctgtgctcttcataccggctatgaagcgctccttggcagggagataccggtgtagttatcagaatggtagtctgtggagcctcccaagcgaccagcttgagcttgttgccactggggtgttcgccaaaccatccctgagtgcgcaacctgggcctgctgtctctagcggaggcgacgtgacccttcaatgtcagacacggtatggatttgatcagtttgccctatacaaggaaggcgatcctgcaccatacaagaaccctgaacgctggtatagagcttccttccccataattaccgttaccgctgctcatagtgggacctataggtgctacagcttcagctctagggacccttacctctggtcagccccttcagaccccctggagctagtggttacagagtttagcgaggctactgctgagttaacggtgagcttcaccaacgaagtgtttactactgaaacctcccgttcaataaccgcctcacctaaagagagcgactctcctgcaggccctgctcggcagtattacacaaagggcaacctggtccgtatctgtctgggcgcagtgatcctcattattctggccggatttttggcagaagattggcactcccgcaggaagagactcagacaccgtggtagagcagtgcagagaccccttcccccacttccacccctgcccctaaccaggaaatcaaatgggggtcaagacggcggacggcaggacgttcactctcgaggactatgtagctag

SEQ ID NO: 56626 - DNA, 966 bp, Artificial Sequence
  Description of Artificial Sequence: Synthetic coding sequence
atgtctccatccccgaccgccctattctgtctgggcctgtgcctgggaagagttccggctcagtccgggccactgccaaagcctagcctgcaggcactccctagcagcctggtccctctggaaaagcctgtgactctgaggtgtcaaggacctccaggagttgacttgtaccggctggaaaagctgagctctagtcggtaccaggaccaggccgtccttttcatcccagctatgaaacgtagcctggctgggagatatagatgtagttaccagaatggaagcctctggagtctcccttccgatcaactggagctagtggcaaccggggtcttcgccaaaccgtccctgagtgcgcagcccggtccagccgtgagttccggcggagatgttacccttcagtgtcaaactaggtatgggtttgatcagttcgccctctacaaagagggggatcccgcaccctataagaaccccgaacgttggtaccgagcaagcttccccatcataactgtgacagcagcccacagcgggacctacagatgttactccttcagctcccgggacccatatctgtggtctgcaccatccgatcctctggaactagtcgtcactgaatttagcgaagccaccgccgagctcacggtaagctttaccaatgaggtgttcacgactgagacgagcaggagtatcactgcgagcccgaaggaatcggattctcccgcaggacctgctagacaatactacaccaaaggaaatctagtgagaatttgtctcggcgcagtcattctgattatcctagcagggtttctggccgaagattggcactcccggagaaaaaggctccgacaccgagggagggccgtgcagaggcctttgccgccactgccccctctgccccttaccaggaaatctaacgggggtcaagatggaggcagacaggacgtccattcccggggtctgtgctcatag

SEQ ID NO: 56627 - DNA, 966 bp, Artificial Sequence
  Description of Artificial Sequence: Synthetic coding sequence
atgtccccatcccccactgctctcttctgcttgggcctgtgcttgggcagggtgccagctcaaagtggcccactgccaaagccgagcctccaagccctccccagcagccttgtgccactggaaaaaccagtgactcttcggtgtcaggggcctcctggcgtcgacttgtaccggttggagaagctgtccagttcccgataccaagaccaagccgtgcttttcatacccgcaatgaagcggtcccttgccggacgttaccggtgtagctatcagaacggctccctgtggagccttccatccgaccagctcgagctagtggccacaggagtgtttgcgaagccaagtctgagcgcacagcctggccctgctgttagcagcggtggggacgttactttgcaatgccagacaagatatggattcgaccagtttgcgctctataaagagggagatcctgccccttacaaaaatccagagcgctggtatagggcctcatttcccatcatcaccgtgactgccgctcattctgggacctaccggtgctattcattcagtagcagagacccctatctctggagcgcaccaagtgacccactggaactggtcgtgacggagttcagcgaagccaccgccgaactgacagtgtcatttactaatgaggtatttactactgaaacaagcaggagcatcaccgccagcccgaaggagagtgattcgccagctggtccagcaaggcagtattacacaaaaggcaatcttgtgaggatttgccttggcgctgtcattctgatcattctggccggtttcttagcagaggactggcacagccgcagaaagcgccttcggcatagagggcgtgctgtgcagcgccctctgcctccactccctcccctgccgttgacacggaaatcaaacgggggacaagatggaggccgacaagatgtgcactctcgcggactatgctcatag

SEQ ID NO: 56628 - DNA, 966 bp, Artificial Sequence
  Description of Artificial Sequence: Synthetic coding sequence
atgtctccatcaccaacagctctgttttgcctcggtctatgtttagggagggttcccgcacagtccggcccactgcctaagcctagcctccaggcgctgccctcatccctggtgcctttggagaaacctgtgacgctgcggtgtcagggaccacctggggtggacctgtacaggttggagaagctgtccagttccaggtaccaggaccaagctgtgctgttcatcccagccatgaaaagatctctggctgggcgatatagatgctcatatcaaaatggctccctgtggagtctcccatctgatcagctggaattagtggccacaggagtatttgcaaaacccagtctgtcagcccagcccggacccgcagtttccagcggcggtgatgtcaccctgcagtgtcaaaccagatacggattcgaccaatttgccctatacaaggagggcgatcctgcgccatataaaaaccccgagaggtggtatcgggcatccttccctattatcaccgtcactgccgcacattcaggaacctaccgctgctattctttcagttcaagagacccttacttgtggtccgccccttcagaccccctcgaactggtagtcacggaattctcagaggccacagccgagttgacagtttccttcacaaacgaagtattcacaactgagactagtaggagcatcacggcgtccccaaaagaatctgattccccagccggacctgcacgccagtactacacaaagggaaacctggttcgcatctgccttggcgcagtcattttgatcattctcgcgggattcctcgctgaggactggcacagccgccgaaagcggctgcggcataggggtagggccgtacagagaccactgcccccactacctcccctacctctgacgaggaagtccaacggcggacaagacggcggaaggcaggacgttcactcacgtggtctgtgcagctag

SEQ ID NO: 56629 - DNA, 966 bp, Artificial Sequence
  Description of Artificial Sequence: Synthetic coding sequence
atgtccccatcgcccactgcactcttctgcctggggctgtgcctgggccgagtgcctgcacaaagcggcccactccccaaaccatctctgcaagctttacctagctcactggtcccattggagaagcctgtgacactacgctgtcaaggccctcctggtgtggacctgtaccgccttgagaagttatccagctcgaggtatcaggatcaggcagtcctgttcattccagctatgaagaggagcctggcaggcagatacaggtgcagttatcaaaacggtagtctctggtctttgcccagcgatcagctggagctggtagccaccggagtatttgccaagccaagcctgtctgcccagcccggacccgcagtctccagcggaggggatgtaacgttacagtgccagaccagatatggctttgaccagttcgccctttataaggagggcgaccccgcaccatacaagaaccctgaacgttggtatagggcaagttttccaataatcaccgtcaccgctgcacacagcggcacatatcggtgttacagtttttccagccgggatccttacctctggtcggccccttctgaccctctcgagctggtggtgaccgaattcagcgaagctacagcagaattaactgtgtcttttactaatgaggtatttaccaccgagacctccagatcaatcaccgcctcgccaaaggagtccgactcgcctgcaggtcctgccagacagtattacaccaagggcaatcttgtaagaatttgccttggtgctgtgatattgatcattttagctgggtttttggccgaggactggcactctaggcgaaagagactgaggcaccggggaagggccgttcagaggcctttgccccctctgccccctctcccactcacccgaaagagcaacggagggcaggatggtggaaggcaggacgtgcactcccgcggtctttgcagctag

SEQ ID NO: 56630 - DNA, 966 bp, Artificial Sequence
  Description of Artificial Sequence: Synthetic coding sequence
atgagcccctcccctacggccttattctgtctcggcttgtgtctgggtcgggttcccgctcagtccggcccattgcctaaaccctctctgcaggctcttccctccagcctcgttccgctggaaaagcccgtgacactccgctgccagggtccacccggtgtcgacctgtaccggcttgaaaagctgagttcttccagatatcaagaccaggcggtcctgttcatccctgccatgaagcggagtttggctggacggtaccggtgcagttatcaaaatggcagcctttggagcctccccagtgaccagcttgaactcgtggccacaggagtctttgccaaaccctcactcagtgctcaacctggcccagcagtgtcttcaggcggtgatgtaactctgcagtgtcaaactcggtacggcttcgatcagttcgccctatacaaggagggggatcccgcaccttacaagaatccggagcgttggtacagggcgtcttttcctatcatcacggtgacggccgcacatagtggtacctatagatgttacagcttctcaagcagggacccgtacctgtggtccgcaccatctgatccactggagctcgtcgtgactgagttcagcgaggctacggccgaactgacagtgtctttcacgaatgaggtgttcactactgaaacctctagaagtataactgcatcgcccaaggagagcgactctccagctggtcccgctagacaatactataccaaagggaaccttgtgcgtatctgcttgggcgctgtgatcctgatcatactggcgggattccttgccgaggactggcattctagaagaaagagattgaggcatcgcggtcgtgccgtgcagcgtcccctgccaccgctgcccccattaccgcttacccgcaaaagtaacgggggacaggatggaggccgacaggatgtacacagtaggggcctgtgctcctag

SEQ ID NO: 56631 - DNA, 966 bp, Artificial Sequence
  Description of Artificial Sequence: Synthetic coding sequence
atgagccccagtcccaccgctctgttctgcctcggcctctgcctggggcgagtccctgctcagtcaggacctctacccaagccttccctgcaagcacttccatccagtctcgtgcccttggagaagcccgttaccctcaggtgccagggcccacctggcgtggacctgtatcggctggaaaagctctcaagctcccggtatcaagaccaggccgtactattcatccctgccatgaaaagaagcctggccggacgctacaggtgctcataccagaacggctcgctatggtcactcccttccgaccagctggaactggtggccacgggcgttttcgccaagccttccttgagtgctcaaccagggcctgccgtcagctccggtggcgatgtgaccctccagtgccagacacgctacggttttgaccagtttgccttatataaggaaggagaccctgctccatacaagaatcccgagaggtggtatcgggcaagttttccaatcattacggtgactgctgcacactctggtacctaccgatgttactcatttagtagcagggatccatacctttggtccgcacccagtgatccactggaacttgtggtaaccgagttctctgaagcgactgccgagctcaccgtttctttcacgaacgaggtgttcacgaccgaaacctcccgatctataaccgccagtcccaaagagtccgactcccccgctgggcctgctcgacagtattatactaagggcaacttagtgcgtatctgtctgggggctgtaattctgataattcttgccggattcctggcagaagactggcattcccgacgcaagcgcctgcgccacagaggacgggctgtccaacgtccactgcctcccctaccaccactccctttaaccaggaaatctaatggtggccaggacgggggacggcaggatgttcattcccgcggactgtgttcatag

SEQ ID NO: 56632 - DNA, 966 bp, Artificial Sequence
  Description of Artificial Sequence: Synthetic coding sequence
atgagtccatcccctacagccctgttctgtttgggcctctgcctgggcagagtgcccgcacagtctgggccactgcctaagccctctttgcaagcactgccgagttcccttgtccctctggaaaagcctgtaaccctacgatgtcagggccctccgggagtggatttatatcgcctggagaagttgagctcttcacggtatcaggaccaggctgtgctatttatccctgcaatgaaaagaagcctggccggaagatacagatgcagctatcagaacggcagtttgtggtccctgcccagtgaccagctcgagctcgtggcgaccggcgtgtttgccaagccaagtctcagcgctcagccaggtccagctgttagtagcggaggagatgtgacactccagtgtcaaacgcgctacggatttgatcagttcgccctgtacaaagagggagatccagccccatataaaaatcccgagcgctggtatagggcaagcttccccatcattaccgtgacggctgcacactctgggacataccggtgctatagcttctcctctcgggacccatacctttggtctgctccgagtgatcctcttgaacttgtggtgacagagttttcggaggccacagcagaattgaccgtcagtttcaccaacgaggtgttcacaaccgagacatcgagaagcattacagcctcccccaaggagtccgattctccagctggcccagctcgccagtactacacaaaaggaaacctggtgcgaatctgtctcggtgctgtaatcttgatcatcctggcaggtttcttggctgaggattggcacagccgtaggaaacgcctgagacatcgcggacgagctgttcaaagacccctgccccctttgccaccactgccccttaccaggaagtcaaacggcggtcaggatggaggtcggcaggacgtgcattcacgaggtctttgtagctag

SEQ ID NO: 56633 - DNA, 1116 bp, Artificial Sequence
  Description of Artificial Sequence: Synthetic coding sequence
atgagcttcagaaaggtgaatataattattctggtcttggccgtggctctatttctgctagtgttgcatcacaactttctttctttgtcaagcttgctacggaacgaggttacagattccggaatcgtcggaccgcagcccatcgatttcgttcccaatgccctaaggcacgcagtggacgggaggcaagaggaaattcctgtcgtcatcgctgcctcggaggatagactcggtggcgcaatagccgcaattaatagcatccagcacaataccagaagcaacgtgattttctacatagtgacccttaacaataccgccgatcaccttaggtcctggctaaattctgacagcctgaaaagcattaggtacaagatcgttaacttcgacccaaagctgttggagggaaaagtaaaagaggatcccgaccaaggcgagagcatgaaaccactcacatttgccaggttctacctgcccatactggttccgtctgccaaaaaggccatatacatggatgacgatgtcatagtccagggcgacattctcgccttgtacaacacagcactaaaacccggtcacgcagctgcttttagcgaggactgcgacagtgcctctacaaaggtggtaattagaggcgctggcaatcagtacaattatattggctatctggactacaaaaaggaacgtatccggaagctgtccatgaaggccagtacctgtagtttcaatcctggcgtgtttgttgccaatcttacagagtggaaaaggcagaatatcacaaaccaactcgagaaatggatgaaactgaacgtcgaagaaggactctattctcggaccttagccggatccataaccaccccaccactgctaatcgttttttatcagcagcacagcacgatcgaccctatgtggaacgtgaggcatcttggctcaagtgcagggaagagatattcccctcagttcgttaaggcagctaagctgcttcattggaatgggcacctcaaaccgtggggcaggaccgcatcttacacagatgtatgggagaagtggtacatcccagacccgaccggcaagttcaacctgatccggcgatatactgagatctcaaatatcaaatag

SEQ ID NO: 56634 - DNA, 1116 bp, Artificial Sequence
  Description of Artificial Sequence: Synthetic coding sequence
atgtccttcagaaaagttaatataattatcctagtcctggccgtagcactcttcctgcttgtgctgcaccataattttttaagcttgtccagccttctgcgcaacgaagtgaccgacagcggaatcgtgggccctcagcctatagactttgtccctaacgctctgcgccacgcagtggatggacgtcaggaggagatacccgtggtcatagcggctagcgaagacagactgggaggtgctattgccgctataaactcaattcagcataataccagaagtaatgtcatcttttacattgtgacactgaataataccgccgaccatctgcggtcatggctgaacagtgatagcctgaaaagcatccgatacaagatagtcaatttcgaccccaaactcctggaaggaaaagtgaaggaggaccccgaccaaggcgaatcaatgaagcctctgacatttgctagattttatctcccgattctggttcccagcgcgaagaaagcgatatatatggatgacgacgtgatcgtgcagggggacatcctcgccctttacaatacagctttgaagccaggccatgctgcagcattctcagaagactgcgattccgcatcaacaaaggtggtcattaggggagccggaaatcagtataattatattggatacctggactataagaaagaaaggatacggaaactgagcatgaaggctagcacctgcagcttcaatccaggcgtgttcgtggcaaatctcaccgaatggaagagacagaatattacaaaccaattagaaaagtggatgaagttgaacgtggaagaagggttgtactccagaacacttgccggaagcatcacaactcctcccctgttgattgtgttctaccagcaacacagcacaatcgaccccatgtggaatgtgcgccatttgggcagcagtgcgggtaaaaggtactcgccgcagtttgttaaggctgccaagctactgcattggaatggccatctgaagccgtgggggcgaacagccagttatacagatgtttgggaaaagtggtatatccccgacccaactggaaagtttaatcttatcagaaggtatactgaaattagcaatatcaaatag

SEQ ID NO: 56635 - DNA, 681 bp, Artificial Sequence
  Description of Artificial Sequence: Synthetic coding sequence
atggacgacgacgtcattgtgcagggggacattctggcgctttacaacaccgctcttaagcctggtcacgccgctgctttcagtgaagattgcgactctgcctcaactaaggttgtgattagaggggcaggaaaccaatacaattacatcggttacctagattataagaaagaaagaatccgtaagctttccatgaaagctagcacctgtagtttcaatccaggtgtgtttgtggccaacttgacagagtggaaaaggcagaacatcacaaatcagctcgaaaagtggatgaaattgaatgtggaggagggactgtacagccgcacactggctggatccataaccaccccaccactactgatcgtgttttaccagcagcacagcaccatagaccctatgtggaaccctcctccttggtttcagtgttggaaaacaatatttacaagtgtgtgcaaagggtgccaggtgacgcattggaatgggcatctcaagccctggggtagaacggccagttatacttgcctcggaaaaatggtgtatagtcgcccaaaccgtcagattcagcccaatcccaagatttacagagacttaaagcataaggttaaacagaaccttaactgcaagcaagcttttctacgcaagtcatggaagattgcttgtgtgggctctaatagctgctag

SEQ ID NO: 56636 - DNA, 1116 bp, Artificial Sequence
  Description of Artificial Sequence: Synthetic coding sequence
atgtcctttagaaaggtgaacattatcatcctggtcctggcagttgctctcttcctcctggtgctacaccacaacttcctgagtctaagtagtctcctgcggaatgaggtcaccgactctggtatcgttggtccccaacctattgacttcgttcccaacgctctccgccatgcggtggacggacgccaggaggagatccctgtggtaatcgccgcatctgaagacagacttggaggggctatcgcagctatcaactcaatacagcataacacgaggagcaatgtaattttttatatcgtgactttgaataataccgccgatcatctgcgttcttggctgaattcagactccctcaagtcaattcgctataaaatcgtgaattttgaccccaaactgctcgaaggaaaggtgaaggaggacccagatcagggggagagcatgaaacctttgaccttcgcaagattttacctgcccatccttgtgcccagtgcaaaaaaggctatctacatggacgatgacgtcatcgtgcagggcgacattctagctctttacaacaccgccctaaaacctgggcatgccgcagcattcagcgaagactgtgactccgcttcaacgaaggttgtgatcagaggagccggtaatcagtataactacataggatatcttgattataaaaaggaaaggataaggaagctgagcatgaaagcgtccacatgttccttcaatccaggcgtattcgtggccaatctgaccgagtggaagagacagaatattacgaatcaactcgagaaatggatgaagttaaatgttgaggaaggcctgtacagtcgaacattagcagggtccatcaccacgccgccactactaattgtcttctaccagcagcattcaacgatcgatcctatgtggaacgttcggcatctcggatctagcgccggaaagcggtactccccccaatttgtgaaggcagcaaaactgttgcattggaacgggcatctgaagccctggggacggactgcctcatacactgatgtctgggaaaaatggtacatacccgacccgaccggtaagtttaacttgattcgaaggtacacagagatctctaacatcaagtag

SEQ ID NO: 56637 - DNA, 93 bp, Artificial Sequence
  Description of Artificial Sequence: Synthetic coding sequence
atgtctttcaggaaagtcaatataatcattcttgtactagccgtggctttgtttctgctggtgctccatcataactttctaagtctgagctag

SEQ ID NO: 56638 - DNA, 1116 bp, Artificial Sequence
  Description of Artificial Sequence: Synthetic coding sequence
atgagcttccggaaggtgaacatcatcatcctggtgcttgcagttgcgttgttcctgctggtgttgcatcataacttccttagtctcagctccttgctacgtaacgaagtgactgacagcggaatcgtgggaccgcagcccattgactttgtcccaaacgccctccggcacgcagtggacggcagacaggaggaaattcccgttgtaattgccgctagcgaggaccggctcgggggagccattgctgccatcaattcaatccagcacaatacgcgtagtaacgtgattttttatattgtgaccctgaataacactgctgatcatctccgcagctggctgaatagcgatagtttaaaatctatccgctacaaaattgttaattttgaccccaaactgctggaggggaaagtaaaagaagacccagaccagggcgaaagcatgaagcccctgacgttcgcacgcttctacctaccgattcttgttccgagcgctaagaaggcaatctacatggatgacgatgtcatcgttcagggcgatattcttgcactttataataccgcactgaaaccgggacacgctgctgcattcagtgaagattgcgacagtgctagcacaaaagtcgtcattagaggcgctggcaatcaatacaattacattggctatctggattataaaaaggagaggataaggaaactctccatgaaggcttccacatgcagctttaaccccggagtgttcgtggctaacctgacagaatggaaacggcagaacatcacgaatcagctagagaagtggatgaaattgaacgtcgaagagggtctctattccaggactcttgcaggatccataactactcctccattgctgatagtcttttatcagcagcattcgacgatcgatccaatgtggaacgtgagacatctgggatcctctgcaggcaagcgatattccccacagtttgtgaaagccgcaaagcttctgcactggaatggccacttgaaaccctggggcaggaccgccagctacaccgatgtgtgggaaaagtggtatatcccagatccaaccggaaagttcaatctgattaggagatacaccgagatctcaaatattaagtag

SEQ ID NO: 56639 - DNA, 525 bp, Artificial Sequence
  Description of Artificial Sequence: Synthetic coding sequence
atgtcattccgaaaggtgaacattatcattctggtcctggccgtggccctgttcctccttgttcttcaccacaattttcttagcctgagcagccttcttcggaacgaagtgacagactccggcatagtgggccctcagcccatcgacttcgttccaaacgcgttgagacacgccgtggatggacgacaggaagagattccggtagtgatcgctgcctccgaggatagactgggcggagcaatagctgccattaattcgattcagcataacactcgaagtaatgtgatcttttacattgtgactttaaacaacacggctgatcacctgcggagctggctaaacagcgattcactgaaaagcattcgctacaaaatcgtgaacttcgatcctaagcttcttgaaggtaaggtaaaggaggaccctgaccaaggggagtcaatgaagcctctcactttcgccagattttatttgcctatattagtccctagtgcaaaaaaagcaatatacatggatgatgacgtgtag

SEQ ID NO: 56640 - DNA, 189 bp, Artificial Sequence
  Description of Artificial Sequence: Synthetic coding sequence
atgtcgtttagaaaggtcaacatcatcatcttggtacttgctgtggccctgttcctgctggtgctgcaccataactttttaagcctctctagtctgctcaggaatgaagtgaccgatagtgggattgtcggaccccagccgatagacttcgttcccaatgccctgcggcatgctgtggatggcagatag

SEQ ID NO: 56641 - DNA, 333 bp, Artificial Sequence
  Description of Artificial Sequence: Synthetic coding sequence
atgtcgtttagaaaggtgaatattatcattctggttcttgcagttgcgcttttcctgctggtgcttcatcacaattttctgagcctgtccagcttgctgcgcaacgaagtcacggactctggcatcgtagggcctcaacctatcgatttcgttcccaatgccttgcgccatgctgtcgatggacgacaggaggagatccctgttgtcattgccgcttcagaggaccggttgggtggggctatcgccgcaatcaacagcatccaacataacactcgatccaatgttatcttttacattgtgaccctaaacaacaccgctgaccatttgcggtag

SEQ ID NO: 56642 - DNA, 1116 bp, Artificial Sequence
  Description of Artificial Sequence: Synthetic coding sequence
atgtccttccggaaggtgaacataattatattagtgctcgccgtagccttattcctgctggtgctccatcacaatttcttaagtctgagcagtctgctaaggaatgaagtcactgactccggcatcgtgggaccacagcccattgacttcgtccctaacgctcttcgtcacgccgtcgacgggaggcaggaggagattccagtcgtgatagcagccagcgaagaccgattgggaggtgccatcgcggcaataaattctatccagcacaacacccgttcaaatgtgatcttttacatcgttacactgaacaataccgctgaccacctgcgaagttggctcaactctgactctttgaagagcatcagatacaaaattgtgaatttcgacccaaagctcttagaggggaaggtgaaggaagatccagaccagggcgagagcatgaagcccctgacttttgcacgtttctatctgcccatcctggttccttccgccaagaaggccatctacatggatgacgacgtgatcgtgcagggtgatatcctagctctatacaatactgccctgaagccagggcacgctgcagcgttttctgaggactgtgacagtgctagtacaaaagttgtaatcagaggtgctgggaaccagtacaactatataggctacctggactacaaaaaggaacgcatccggaagctatctatgaaggcaagcacgtgttctttcaaccccggtgtgtttgtggccaacctgaccgaatggaaacggcaaaacatcactaatcagctcgaaaagtggatgaagctgaacgtcgaggaaggtttatacagccgtaccttagccggaagcatcacgaccccacccctgctgatcgttttctaccagcagcatagcaccatcgacccaatgtggaacgtccggcatttgggctcttcagcaggcaagcggtactcaccgcagtttgtgaaagctgctaagctcctgcattggaatggccacctgaagccatggggaagaactgcctcatataccgacgtttgggaaaagtggtacatccccgatccaaccggcaaatttaaccttataaggaggtataccgaaattagcaacattaaatag

SEQ ID NO: 56643 - DNA, 270 bp, Artificial Sequence
  Description of Artificial Sequence: Synthetic coding sequence
atgtcgttcagaaaggtgaatattatcattttggtcctggccgtggctttgttcctcttagtgcttcatcacaattttctgtctctgagctctctgcttaggaatgaggttactgattccggcatcgtgggaccccagccaatcgacttcgtgcccaacgccttgagacatgcagtagacggaaggcaggaggaaatcccggttgttattgctgcctcggaagatcgactcggaggagcaattgcagcaattaactcaatccagcattag

SEQ ID NO: 56644 - DNA, 192 bp, Artificial Sequence
  Description of Artificial Sequence: Synthetic coding sequence
atgtcctttagaaaggtgaacattatcatcctggtgctcgcggtggctctgtttctcttggttctgcaccacaattttttgagcctgagctcactgctgaggaatgaggtaacagacagcgggatcgttggccctcagcccatcgattttgtgcctaacgccctacgccatgccgtggacggacggcagtag

SEQ ID NO: 56645 - DNA, 483 bp, Artificial Sequence
  Description of Artificial Sequence: Synthetic coding sequence
atgctacggcatttgccctcacggttgccagtaaagatgtggggacgtaccctcgagaagcaaagttggcgggacagctctcaaactcctcctccatgcctgatccggcgtctggatcatatcgtgatgaccgtgaagagtataaaggacacaaccatgttttattccaaaatactggggatggaggtgatgacgttcaaggaggatcgtaaggctctctgcttcggagaccagaaatttaatctccatgaagtgggcaaagagttcgagccaaaagccgctcacccagtccctggatcgttggatatttgtctcatcacagaggtgccgctggaagagatgatacagcatctaaaggcttgcgacgtccccattgaggagggccctgttccacgcactggggcaaagggtcctatcatgtctatatatttcagggatccagataggaatctgattgaggtgtctaattacatttcttcgtag

SEQ ID NO: 56646 - DNA, 384 bp, Artificial Sequence
  Description of Artificial Sequence: Synthetic coding sequence
tgaataagaaggctcgaccacattgttatgacggtgaaaagtatcaaagatacaacaatgttttattcgaaaattttgggcatggaagttatgacattcaaagaggaccggaaagctctgtgtttcggtgaccagaaattcaatttacacgaagttggtaaggagtttgaaccaaaagcagctcaccccgtgccgggtagcctcgacatatgtctgattactgaagtgccgctcgaagaaatgattcagcacctgaaggcctgcgatgtccctatcgaggagggtcccgtcccccgtaccggtgctaagggacctatcatgagcatatactttagagatcccgaccggaatctaatcgaagtgagcaactacatttcctcatag

SEQ ID NO: 56647 - DNA, 2082 bp, Artificial Sequence
  Description of Artificial Sequence: Synthetic coding sequence
atgtggcctcagccttacttgccacctcacccgatgatgctggaggaatcgaggcagaacaaactggccgcagccaaaaaaaagctgaaggagtatcaacagaggaaatcccccggaatacctgctggcgctaagacaaagaagaagaaaacggactccagccctgaaaccaccacatcaggagggtgccactcccccggagatagccagtaccaggaactggccgtagctctcgaaagtagctccgtgactatcagtcaacttaatgaaaacattgagagcctgaagcagcagaagaagcaggtggagcaccagctggaggaggccaaaaaaactaacaacgagatccataaagcccagatggagcggctggaaactatcaatatactgaccctggaaaaggccgatctaaagacaaccctgtatcatacgaaacgggcagccagacactttgaagaagagagtaaggacctggccggtcggcttcagtacagtctgcagagaatccaggagttggagcgcgctctctgtgcggtgtccacccagcagcaggaagaggaccggagtagttcctgtcgggaggctgtgctgcaaaggtggctgcagcagaccatcaaggagcgcgcattgttgaatgcccacgtaacccaggtgaccgagagcctgaagcaggtgcagctggaacgcgatgagtacgcaaaacatatcaaaggagaacgagctagatggcaagaacgcatgtggaagatgagcgtggaggcccgaacactgaaagaagaaaaaaagcgggatatacaccggatccaagagttggagaggtccctgtcagaattgaaaaaccagatggccgagcccccttcgctagcaccgccagccgttactagcgtggtggaacagctacaggacgaggctaagcacctgaggcaggaagttgaggggctggaaggcaaactgcagagtcaggttgaaaacaaccaggcactgagcctactgagcaaggaacagaaacaacgcttgcaggaacaagaggagatgctgagagagcaagaggcacaaagggtaagagagcaggagcgattgtgtgagcagaacgagaggctccgagagcaacagaagacattgcaggagcagggggaacggttaaggaaacaggaacagcgactgcgaaaacaggaagaaagattacgcaaagaggaagaacgcttgcaaaagcaggagaaaaggctatgggaccaagaggagcggctgtggaaaaaggaagaacggcttcagaaacaggaagagagactcgccttgagccagaatcataagttggataaacagttggccgagccccagtgcagctttgaggacctcaacaatgaaaaaaagagtgccctccaactcgagcagcaggtgaaggaattgcaagagaaactagacgaagaacacttagaggctgcgtctcaccagaatcagcagctagagacccagttgagtctggtggcactccccggtgagggagacgggggtcagcatctggattctgaagaagaggaggcacccagacccacacccaacatccccgaagatctcgagagccgggaagctacctcaagcttcatggacctcccgaaagagaaggccgacggaaccgaacaggttgagcggcgagagctcggcttcgtgcagccatccggtgtcaccgatggtatgcgcgagtccttcaccgtgtacgagtcccaaggtgccgtgcctaatactagacaccaggaaatggaagacgtcatccgactcgcccagaaggaggaggagatgaaagtcaagttactcgaacttcaggagctcgtcctgcctcttgtgggaaaccatgagggccacggtaaattccttattgctgcccagaatccggcagacgaaccaaccccaggtgccccagcaccacaggagctcggcgcagccggagagcaagacgttttctacgaggtttcgttagataataacgtagagcctgccccaggcgcagccagggaagggagtccacacgacaatcctaccgtgcagcagatcgtgcagctgtcccctgtgatgcaggacacatag

SEQ ID NO: 56648 - DNA, 2082 bp, Artificial Sequence
  Description of Artificial Sequence: Synthetic coding sequence
atgtggccccagccatacctgccccctcatccaatgatgctcgaggagagccggcagaataagctggcggctgcaaagaagaagttgaaagaatatcagcagcggaagagccctggcattcccgcaggggctaaaacgaagaaaaagaagacggactcctctcctgagactaccactagtggaggtgggcactcccctggagattctcaataccaggaattggccgtggcgttggagagcagttctgtgacaatctctcagctcaacgaaaatatcgagtctctcaaacagcagaaaaagcaggttgagcaccagctggaagaggcaaagaaaaccaataacgagatccacaaggcccaaatggagcgacttgagactatcaacatcttaaccctcgagaaagctgatctgaagactacactctatcacacaaagcgcgctgcacgacacttcgaggaggaatccaaagaccttgccggacgactacagtactccctacagagaatacaggaattggaaagggccctctgcgcagtctctactcagcagcaagaagaggataggtctagctcttgccgcgaggccgtgctgcataggcggctccagcagactatcaaggaacgcgcattgctgaacgcacacgtaacccaggtcacagaatcacttaagcaagtgcagcttgaaagagatgagtacgccaagcacataaagggcgagagggccagatggcaagagcgcatgtggaaaatgtccgtcgaggcccgaaccctgaaggaggagaagaagagagacatacaccggatccaggagcttgaacgctccctgtcggaactgaagaaccagatggccaagcctcctagcctcgcaccacccgctgttaccagcgtggttgaacagctccaggatgaagccaaacacctaaggcaggaggttgaaggactggaagggaagttacagagtcaggtggagaataatcaggcactcagtttgttatcaaaagaacagaaacagcgcctccaggagcaagaggagatgctgcgcgaacaggaagtccagagggttagggagcaggagcgcctgtgtgaacagaacgagcggctgagggagcaacagaaaactctccaagagcagggcgaacgccttcggaaacaggaacagcgtctgagaaaacaggaggagaggctgagaaaagaggaagagcgacttcagaagcaggaaaaacgcctgtgggaccaggaagaacggctgtggaagaaagaagagagactgcagaaacaggaagaacgattggccctttcacagaaccataaactggacaagcagctcgccgagcctcagtgtagcttcgaagatctcaacaacgagaagaagtccgcgctgcagctggagcagcaagtcaaggagctgcaggagaaattggacgaggaacacctggaagcagcttcacagcagaaccagcagttagagacacagttaagcttggtggccctacctggtgaaggggacgggggacagcacctggattcagaagaagaggaggctcccaggcctactcctaacatacctgaagacctggagtcccgagaggcaacctccagcttcatggacctgccaaaggagaaggcagacggaactgaacaggtcgaacgtagggaactgggcttcgtgcagcccagcggagtcacagatggtatgcgggaatcatttacagtttatgaaagccagggagctgtccccaatacacggcatcaggaaatggaagacgttatccgactggcacaaaaagaagaggagatgaaggtgaagctgctggagctacaagagctggtactacctctggtgggcaaccacgaaggccatggtaaattccttatcgcagcacaaaatcccgcagacgagccaactcccggagccccagccccacaggaactgggcgcagccggtgagcaggacgacttctatgaggtcagccttgacaataacgtagagcctgctcccggagccgcacgcgaagggtcaccacacgacaatccaaccgtacagcagattgtgcagctctcgcctgtaatgcaggacacttag

SEQ ID NO: 56649 - DNA, 2082 bp, Artificial Sequence
  Description of Artificial Sequence: Synthetic coding sequence
atgtggccacagccctacctccctccacatcctatgatgctcgaagagagcaggcagaacaagctggccgctgcaaagaagaaactaaaggagtaccaacagcgtaagtcccctggcattccagccggtgccaagactaagaagaaaaaaacagattccagtccagaaacaacaacgtccggtggtggtcactcacccggtgattcgcaatatcaggagctggccgtcgctctggagtcttccagcgtaacgattaatcaactcaatgaaaacattgagagtctcaagcagcagaaaaaacaggtagagcaccagcttgaagaggccaaaaaaactaataatgagatccataaggcccagatggagcagctggagacaatcaacatcttaaccctggaaaaggccgatctgaagaccacactttatcatacgaagagagcagcaaggcactttgaggaagagagtaaagaccttgcaggcaggctgcagtacagtttgcagagaatccaggagcttgaaagagcactatctgccgtttctacccagcagcaggaagaggaccgctcctcatcctgtagggaagcggttctgcagcggaggcttcagcagactattaaggagcgagcgctcctcaatgcgcatgtcacccaagtaactgaaagcctcaaacaggtccagcttgaaagagatgaatatgcaaagcatattaagggagaacgggcacgctggcaagaaagaatgtggaaaatgagcgttgaagcgcgaacactgaaagaagaaaaaaagagggatattcaccgtatccaagagctggagcgctctctatcggagctcaaaaaccagatggccgaaccgcctagcttagccccaccagctgtcaccagcgttgtggaacagctgcaagacgaagctaagcatcttcgtcaggaggtggaagggcttgagggaaagctgcaatctcaggtcgagaacaaccaagccctctctctcttatcaaaagagcagaagcaacggctgcaagagcaggaggagatgctgagagagcaggaggcccaaagggtcagggagcaggagcggttgtgtgaacagaacgagaggcttagagagcagcaaaaaaccctgcaggagcagggggagcggctgagaaagcaggaacagaggctgcgaaaacaggaagagaggctgcgaaaggaagaagagagactacaaaaacaggagaaacgcctgtgggaccaggaggagaggctttggaagaaggaggagaggctgcaaaagcaggaagaacgccttgccctctcacaaaatcacaagttagacaaacagctggcagagccccagtgctcctttgaagacctcaacaatgaaaaaaagagcgccttgcagctcgagcagcaggtcaaagaacttcaggagaagctggatgaggagcatctcgaggctgccagtcagaggaatcaacaattggagactcaactgtcgttagtcgctctgcccggagagggagatggaggccagcatcttgactccgaagaagaagaagccccacgaccaaccccaaacatcccagaggacctggaaagccgtgaagccacatcgagcttcatggacctgccaaaagagaaagccgatggaaccgagcaggttgagcggagggaactcggctttgtacagccctccggcgtgactgatggcatgagagagtctttcaccgtttacgaatcacagggagccgtaccaaacaccagacaccaggaaatggaggacgtgatacgactagcccaaaaagaagaggaaatgaaggtcaagcttctagagctgcaggaattggtccttcccctggtgggtaatcatgaaggacacggaaaatttctgatcgctgcgcaaaaccccgcagatgaaccgacaccaggcgctccagcgcctcaagagttgggggctgccggagagcaggatgatttctacgaggtctcactggataataatgttgaacccgcaccgggagctgccagggaaggctccccacatgacaatccccctgtgcagcaaatcgttcagctgagccctgtgatgcaggatacatag

SEQ ID NO: 56650 - DNA, 2082 bp, Artificial Sequence
  Description of Artificial Sequence: Synthetic coding sequence
atgtggcctcagccatacctcccccctcatcccatgatgctggaggagagccgccagaacaagctggcagctgctaagaagaagctgaaagaataccagcagaggaaatcacctggcatacccgctggcgcaaaaactaagaagaaaaaaaccgattcgtcacccgaaacgacaacctcaggcggtggccattctccgggagatagccaatatcaagaactggcagtcgcgcttgagagcagctccgtgactatcaatcaattgaacgaaaatatcgagtccctgaagcagcagaagaaacaggtcgagcaccagctggaggaagcgaagaaaaccaacaatgagatccataaggctcagatggagcaacttgagacaataaatattctgacattggagaaagccgatctgaaaaccacgctgtatcatacgaaaagagccgcaaggcattttgaagaagagagcaaggatctggctggtaggctgcagtactcactccagcacatacaggagctggaaagagccctgtgcgccgtctctactcagcagcaagaggaagacaggtcctccagctgtcgagaggcagtgcttcagcgcaggctacagcagacaataaaagaacgtgccctcctaaatgcccacgtgactcaggttacagagtccctgaagcaggtccagctcgagcgggacgagtacgccaagcacattaagggagaacgcgcacgctggcaggagcgcatgtggaagatgtccgttgaggctcgcacactgaaagaggagaagaaaagggatatccaccgcatacaggagctggagcgttctctatcagaattgaaaaatcagatggctgagccaccgtctctcgccccacctgccgttacctccgtggtggagcagttgcaggacgaagccaagcacctgagacaggaggtggagggattggaaggtaagctccagtcccaagtcgaaaacaatcaggccctttccttgttgagtaaggagcagaagcagaggctgcaggaacaggaggaaatgctgagggaacaggaggctcagcgggtccgtgaacaagagcggctatgcgaacaaaatgagaggcttagggagcagcagaagaccctgcaggagcagggtgaacggctgaggaagcaggagcagcgcctgcggaaacaggaggaacgattgaggaaagaggaagagcggctgcagaagcaggaaaagcggctatgggaccaagaagagagactctggaagaaggaggaaaggcttcagaagcaagaggagagacttgctctctctcagaaccacaaactagacaagcaactggctgaaccacagtgcagctttgaggacctgaataacgagaagaagtctgccctgcagctcgaacaacaggtgaaagaactgcaggaaaagcttgacgaggaacacttagaagccgcaagtcagcgtaatcagcagcttgaaacccagcttagtctcgtggcactgccgggagagggagacggtgggcagcacttagattctgaggaggaagaggcaccgagaccaacaccaaatatccccgaggatctagagtctcgggaagccacaagctcattcatggacctccctaaagagaaggcggatgggaccgaacaagtggaacggcgagaactaggcttcgtccagccatccggggtcacagatggcatgagagaaagctttactgtctacgagtcccagggcgctgtgccaaacaccaggcaccaggagatggaggatgtgatcagattggcccaaaaagaagaagagatgaaggtcaaattattagaactgcaggaactcgtgctgcctctcgtggggaaccatgagggccatggaaagtttctcatcgccgcacagaatccagcggacgaaccaacccccggagcaccagctccacaggagttaggtgctgctggggagcaggatgtgttctatgaagtcagtttagataataatgtggagcccgctcctggtgtggcgagggaggggtctccccataacaatcctaccgtgcagcaaattgtgcaactttcccctgttatgcaggacacttag

SEQ ID NO: 56651 - DNA, 2007 bp, Artificial Sequence
  Description of Artificial Sequence: Synthetic coding sequence
atgctaatgtggccccagcctcatctgccgacccatccccatctgccgacacacccgcatttaccaactcatcctcaccttccaactcatcctcatcttccaactcatccacatctgccgacgcaccctcacttgcctacccaccccatgatgagtaaagagacacggcaatcaaaattggcggaggctaaggaacaactcacggatcatcatcctcaaaccaacccatctgtcgggacggcagcaagcgatactaaaaagaagaaaatcaataatggaacgaatcctgaaactactacgagcggcggatgccactcacctgaggatgaacagaaggctagccatcagcaccaggaggcactacgacgggaactagaggcccaggtacataccatccggatcctgacatgtcagaaaaccgagctgcagatggcactttattattcccagcatgccgttaagcagctcgaaggtgaggcccgtgaccttatctctagactacacgattcttggaaattcgcaggtgaactggagcaggctctgagcgccgttgcgacgcagaaaaaaaaagctgatcggtacatcgaggagctgacaaaagagagagacgcgctgtctctagagctgtatagaaatacaatcacagacgaggaactcaaggagaaaaatgccaaactccaggagaaactccagctcgttgagagcgagaagtctgagatccagctcaacgtcaaggagctgaaaaggaagctcgaacgcgctaagctcttgctgccccagcagcagctgcaagccgaagctgaccacctaggtaaagagctgcagagtgtgtccgctaaactgcaggcacaggtcgaggagaacgaattgtggaatcgactgaaccagcagcaggaagagaaaatgtggaggcaggaagagaagatccaggagtgggaagaaaagatacaggagcaggaggaaaaaatacgagagcaggaggaaaagatccgagagcaggaggagaagatgaggcgccaggaagaaatgatgtgggagaaggaagaaaagatgcgcagacaggaggagatgatgtgggagaaggaggaaaaaatgcggcgtctcgaggagatgatgtgggaaaaagaagaaaagatacgagaactcgaggagaaaatgcacgaacaggagaaaattagagaacaagaagagaaacggcaagaggaagagaaaataagagaacaggaaaagcgacaggaacaagaagcaaaaatgtggcggcaggaggagaagatcagggaacaggaggagaagataagagagcaggaaaaaaaaatgtggaggcaggaggaaaagatccatgagcaagaaaagattagggaggaagagaagagacaggaacaggaggagatgtggagacaggaggagaagatcagagagcaggaggaaatttggagacagaaggagaagatgcacgagcaagagaagatccgaaagcaggaggaaaaagtctggcggcaggaggagaaaatgcacgatcaggaggaaaaaatccgcgaacaggaggagaagatgtggagacaggaggaaaaaatcagagaacaagaagagaagatccgcgagcaggaggagaaaatccgagagcaggaagaaatgatgcaggagcaggaggagaagatgggagagcaggaggagaagatgcaggaacaggagaagatgcgtcggcaagaggagaagattagggagcaagaagagaagattagagagcagaaagagaaaattagagaacaagaagagaagatttgggagcaggaggaaaaaatccgcgagcaggaggaaatgatgcaggaacaggaggagaagatgtgggagcaggaagaaaagatgtgcgaacaggaggagaaaatgcaggagcaggaggaaaagatgcgcagacaagaagagaaaatgtgggaacaggaggttcggctccgccaacaggaagaaaaaatgcaggagcatcaggagcaccttgaggccgctatctag

SEQ ID NO: 56652 - DNA, 1857 bp, Artificial Sequence
  Description of Artificial Sequence: Synthetic coding sequence
atgatgtctaaggagaccagacagagcaaactggcagaggctaaagagcagctgacagatcatcaccctcaaaccaacccttctgtcgggaccgctgcaagtgatactaagaaaaagaagatcaacaacggaaccaatccggagactacaacatcaggcggttgtcactctcctgaggatgagcagaaagcttcacatcagcatcaggaagctctgcgtagagagctggaggctcaggtgcatactattagaattttgacctgccagaaaacagaactacaaatggccctttattacagtcagcatgccgtgaagcaattggagggcgaggcacgcgacttaatatcacgattacacgattcctggaagttcgccggagagctcgagcaggctctgagcgccgtcgcgacacaaaagaagaaagccgataggtacattgaggaattgaccaaagagcgcgatgcattaagcttggaattgtatcggaacacaataactgatgaggaattgaaagagaagaatgcaaagctgcaggaaaaacttcaattagtagaaagcgaaaaaagcgagatccagcttaatgtgaaagagttgaaaaggaagcttgagagggccaagctgctccttccacaacagttacaggccgaggcagaccatctgggaaaagaactgcagagtgtttctgccaaactgcaggcccaggtcgaagagaacgagctgtggaatcgcctgaaccaacaacaagaggagaagatgtggcgccaggaggaaaagatacaggagtgggaggagaaaatccaggaacaggaggaaaaaattagggagcaagaagaaaaaatccgcgagcaggaggagaagatgcgcaggcaggaagagatgatgtgggagaaggaggaaaaaatgaggcgacaagaggaaatgatgtgggagaaggaagaaaagatgagaagacttgaggagatgatgtgggagaaggaggaaaaaatccgagaactggaagaaaagatgcacgagcaggaaaaaattcgagagcaagaagaaaagagacaggaagaagagaagatcagagagcaggaaaagagacaggagcaagaggccaagatgtggaggcaggaagagaagattcgcgaacaggaggaaaagatccgagagcaggaaaaaaaaatgtggagacaggaagaaaaaatccacgagcaggagaaaatcagggaagaggaaaagcggcaggagcaggaagagatgtggagacaggaagagaagatccgggagcaagaggagatttggcgccagaaagagaagatgcatgagcaggagaagatcaggaaacaggaagagaaagtctggaggcaggaggagaaaatgcacgatcaagaggagaagattcgggaacaggaagaaaaaatgtggcgccaggaggaaaaaatccgagaacaggaagaaaaaattcgcgagcaggaggagaagatccgagagcaggaagaaatgatgcaggagcaggaagaaaagatgggcgaacaggaggagaaaatgcaggagcaggagaagatgaggcggcaggaggaaaagattcgggagcaagaggagaagatacgtgaacaaaaggagaagatacgcgaacaagaggagaaaatctgggaacaagaagagaaaatccgcgagcaggaggagatgatgcaggagcaagaggagaagatgtgggagcaggaggaaaagatgtgcgagcaggaggagaaaatgcaggagcaggaggagaagatgagaaggcaggaggaaaaaatgtgggaacaggaggtgaggttgcgccagcaagaagagaaaatgcaggagcatcaagaacacctcgaggcagcgatctag

SEQ ID NO: 56653 - DNA, 1143 bp, Artificial Sequence
  Description of Artificial Sequence: Synthetic coding sequence
atgtggccccaacctcgactgccgccacaccccgcaatgagcgagaagacccagcaaggtaaattggctgccgctaagaagaaactgaaagcttattggcagcgcaaaagcccaggaatccccgcaggagcgaacaggaagaaaaaggtcaatggttcaagccccgatactgccacctccggtggataccatagccctggtgattccgctacaggtatttacggtgagggacgtgctagtagcaccaccctgcaggatctggaatcgcaatatcaagagctggccgtggcccttgactcaagctcagcaataatttcacaattgaccgagaatatcaattccttggtccgcacctccaaggaagagaaaaaacacgagattcatctggtacagaaactcggcagatctctctttaagctgaaaaatcaaactgctgagcccctcgcacccgaacctccggctggcccatccaaagttgagcagctgcaggacgaaaccaatcatctgcgcaaagaactggagagcgtgggcaggcaacttcaggccgaggtggagaacaatcagatgctgtctcttctcaatcgacgccaagaagagagactccgggagcaggaagaacgactccacgagcaggaagagagacttcacgagcaggaggagcggctatgcgaacaggaagagagactgtgcgaacaggaggaacgcctgcgcgaacaggaagagcgcctgcgtgaacaggaggagaggttgcacgaacaggaagagcgcctgtgcgagcaggaggagcgtctttgcgaacaagaagagagactgtgtgagcaggagaagttaccaggccaggagaggttactggaggaagtcgagaagcttctcgaacaagaaagaaggcaggaggaacaggagcgcttgctggagagagagagactctggaccaggtggaggtcctcctggtccagaagaggcttcggcaatcgtatgcgcggatgtgggagccgcagactttgtgggtcctggagaggttgcgggtcatggcgcggttgtggaagctggcgaggttgtggttcttggcgcggatgctggagctggggcggaaagccctgcacctcatctggacccagccacgccgcagcttccaggtcctag

SEQ ID NO: 56654 - DNA, 1440 bp, Artificial Sequence
  Description of Artificial Sequence: Synthetic coding sequence
atgtggccccagcctcggctcccacctcaccccgcaatgagcgaaaagacacagcagggaaagctggctgctgccaagaagaagctgaaggcctattggcagcgtaagtcacctggcattcccgcaggtgctaatcgaaaaaaaaaggttaatggcagcagccccgacacggcaacaagcggcggataccacagcccaggggactccgctacagggatttatggcgaaggtcgggcatcgtctacaacgctacaggacctggaaagtcagtaccaagagctagctgtggctttggattcctcttcagcgatcataagccagttgacagagaatataaactcgttagtccgaacttctaaggaagagaagaaacacgaaatccatttagtgcaaaagctgggccgttccttatttaagcttaaaaaccagactgccgagccgttggcccctgagcctccggcaggaccttccaaagtggagcagctgcaggacgaaaccaatcatctgcgcaaggagctcgagagtgtaggtcgccagctgcaggccgaggtggaaaataaccagatgttgagcctcctgaatcggcgtcaggaggaacggttgagagagcaagaagagcgtttgcatgagcaggaggaacggttgcacgaacaggaggagcgtttgtgtgaacaagaggagaggctgtgcgagcaggaagaaaggctgcgggaacaggaagagcgattacgcgaacaagaggagcggctgcacgagcaagaggagagactgtgcgaacaggaggaaagactctgtgagcaggaagaacgattatgcgagcaggagaagcttcccggtcaagagcggctgctagaagaggtcgaaaaactgttggaacaggagcggaggcaggaggaacaagaacgactattagagagagagcggcttttggatgaggtcgaggaattgcttgaacaggagcgattgagacagcaggacgagagactgtggcaacaagaaactcttagggagctggaaaggctgagagagctggagcgtctcagagagctcgaaagactacgggaactggagagaatgctcgagctgggctgggaagcactgtacgagcagcgcgctgaacctagatcaggcttcgaggaactgaataatgaaaacaagtctaccctgcagctcgaacagcaggtaaaggagctcgaaaagagcggaggagccgaggagccccgaggaagcgagtccgccgcagcggcaaggcctgtgccgggtgctccagttcctcagggcgcttggatgtgcggacaggcgggatggacaccgcaggagcatcccggacttagtggcgaggccgtgggaaccggcgaggcagctggcggtgcggaagaggctgcctgtcatagcttcagagcagcagagaatcgtgagctgaacatcaccataatctag

SEQ ID NO: 56655 - DNA, 1953 bp, Artificial Sequence
  Description of Artificial Sequence: Synthetic coding sequence
atgtggcctcagccccaccttccccctcacccaatgatgtcagagaagacaagacaaaacaaattggccgaagccaaaaaaaaattcaccgactacagacagtggaacatcgctggggtgggcactagagctaccgacactaaaaagaagaaaatcaacaatggcaccaaccccgagaccacgacaagcgagggatgccactcacccgaggatacacagcagaacagagcccagttgaaagaggagaagaaagcctcccatcagcaccaggaggcgctgcgcagagaaatagaggcgcaagaccacactatcagaatactgacgtgtcagaaaacagaacttgagactgcactttattactcacaagatgcggctcgcaaatttgaggatggcaacctgggcacaccttcatccttcaatctcgccctgtcccaagctttccggggtagtccactaggttgcgtgagcacatctcttattcctggcgaaagcaaagatctcgcaggacggctgcaccattcctggcattttgcaggcgagttgcagagggcgttgtcagctgttagcacatggcacaaaaaagccgataggtatatcgaagagttaaccaaggaacgggacgctctctcactggaactttataggaacaccataactaacgaggagttgaaaaaaaaaaacgccgaactacaggagaagctccggctggccgagagcgaaaaaagcgagattcaacttaatgtaaaggagctgaagcgcaaattggagcgagctaagttcctcctcccccaggtacaaactaacacactgcaggaagaaatgtggcggcaggaggaggagcttcgggagcaggagaaaaaaatcagaaaacaggaggaaaagatgtggcgtcaggaggaacgtctcagagaacaggagggtaagatgcgtgaacaggaagaaaagatgagacggcaggagaaacgcctgcgcgaacaggagaaggaactccgcgagcaggagaaggaactccgcgaacaaaagaagctccgcgaacaggaggaacaaatgcaggagcaggaagagaaaatgtgggagcaggaggagaagatgcgggagcaggaggagaaaatgtggcggcaggaggagcgactgtgggagcaggaaaaacagatgcgggaacaggagcagaaaatgagagatcaggaggagagaatgtgggagcaggacgaacgacttagagaaaaagaggagaggatgcgcgagcaggagaaaatgtgggagcaagtagaaaagatgagagaagagaaaaagatgcaggaacaggaaaagaagacaagagatcaggaggagaaaatgcaggaggaggaaaggatcagagaacgcgagaaaaaaatgagggaggaggaagagaccatgcgtgagcaagaggagaagatgcaaaaacaggaagaaaatatgtgggaacaggaagagaaggagtggcaacagcagagacttccagaacagaaggagaaactctgggagcaggagaagatgcaggaacaggaggagaaaatttgggaacaggaagagaagatccgtgaccaagaagagatgtggggacaagaaaagaagatgtggaggcaggaaaaaatgcgtgagcaggaggacgagatgagagagaaagaagaacggatccgggatcagaaggagaagatgcaggagcggctccctgaacatgaagaacgttgctcagaaccttgcctgcccccatccaaagttctgtgtaatatgagtcatacggggagcgtggaacctgccggtggtgaggccggtgaaggaagccctcaggataatcccaccgcccaggagattatgcagctgttctgtggtatgaagaatgcccagcagtgcccagggctgggatctacctcctgcataccctttttctacagaggggataagaggaaaatgaaaatcatcaatatctag

SEQ ID NO: 56656 - DNA, 945 bp, Artificial Sequence
  Description of Artificial Sequence: Synthetic coding sequence
atgtggcgccaggaggaggagctgcgggaacaggagaagaagattcggaagcaggaagagaaaatgtggagacaggaggagagactccgcgaacaggagggaaagatgcgcgagcaagaagaaaaaatgagacgccaagagaagcggctcagagagcaggagaaggaactccgcgagcaagaaaaggagttaagggaacagaagaaactgagggagcaggaagagcaaatgcaggagcaggaagaaaagatgtgggagcaagaagagaagatgagggagcaggaagagaagatgtggcgtcaggaggagcgcttgtgggagcaggagaaacagatgcgcgagcaggagcagaaaatgcgggatcaggaggaacgtatgtgggagcaagacgaaaggttgagagagaaggaagaacgcatgagagagcaggaaaagatgtgggaacaggtggagaaaatgcgagaagaaaaaaaaatgcaggagcaggaaaaaaaaacaagagaccaagaggagaagatgcaggaggaggagcggatccgggaacgcgagaagaaaatgagggaggaggaggaaactatgcgggaacaggaagaaaaaatgcagaagcaagaagaaaacatgtgggaacaggaagaaaaggaatggcagcagcagcggctgcccgagcaaaaggaaaagctgtgggagcaggagaaaatgcaggaacaggaagagaaaatatgggagcaagaggaaaaaatacgggaccaggaagaaatgtgggggcaggagaaaaagatgtggcggcaagagaagatgcgcgagcaggaggatgttggagccggaggcgatgcccgtgagggcggagaggacactcggagtgagagagaggacgccggtgaagcagccagagccaggggtgccgttctgcgtgccctgcctcctagcctgcagagctcgttgtag

SEQ ID NO: 56657 - DNA, 753 bp, Artificial Sequence
  Description of Artificial Sequence: Synthetic coding sequence
atgctttcccttctcaaccgtaggcaggaggagaggctgagggaacaggaagagcgcctgcgcgaacaagaagaacgactcagagagcaggaggaacggctgtgtgagcaggaagagcgattgcgcgaacaggaggaaagattgtgcgagcaggaaaagttaccgggacaggaacggcttctagaggaggtcgaaaagctcctggaacaggaaaggagacaggaggagcaggagcgactgcttgaacgtgaaaggctgcttgaggaggtcgaaaaactgctggagcaggaaagactccggcagcaggacgaacgactgtggcagcaggaaaccttacaggagctggagaggttgagagagctggaaaggctgagggagctcgagcgcatgttggaacttggatgggaggccctgtatgagcagcgagccgagcctagatcggggtttgaggagcttaacaatgaaaataagtctaccttacagcttgaacaacaggtgaaggagctaaagaagagcggtggtgctgaagaacccagggggtctgaatcggccgcagcagctcggccagtggcaggtgccccagtgccacaaggcgcttggatgtgcggacaagccggatggacaccccaggaacatcctggactctccggcgaggccgtaggaaccggagaagcagctgggggagctggagaggcagcctgccactccttcagagctgcggagaatagagagctgaatatcacaatcatttag

SEQ ID NO: 56658 - DNA, 348 bp, Artificial Sequence
  Description of Artificial Sequence: Synthetic coding sequence
catttgcggcttaggcagcaggacgaacgcctttggcaacaggaaaccctgcaagagttggagcgactaagggaactggagaggctgcgtgagctggaaagaatgctggaactgggctgggaggcgctgtatgagcagagagccgagcctcgtagcgggtttgaagagttgaacaacgaaaataagtccaccctccagctggagcaacaagtcaaggaactcaagaaatcaggtgaactgaaggaaaccgtgactagcgatccatcgaaaaaaatgtgggaggccggaacttcgctgtggggcggagaagttcccggtcatcgacaactacagccaggcgatcgatag

SEQ ID NO: 56659 - DNA, 2253 bp, Artificial Sequence
  Description of Artificial Sequence: Synthetic coding sequence
atgctgatgtggccccagccacacctaccgacccatccccacctgcccactcaccctcacctgcccactcaccctcacttaccaacacacccacacttgccaactcacccacatttaccaacccatccacacttacccactcacccaatgatgagcaaagagactaggcagtctaagctcgccgaggcaaaagagcaattgaccgatcaccatccccagacaaatcccagtgtcggcacagctgcgagcgacacaaaaaagaaaaagatcaacaacggtaccaatcccgagaccaccacgtccggtggctgccactcacctgaagacgagcaaaaggcctctcatcagcaccaagaagccctccgtcgcgagttggaggcccaagtgcataccattcggatccttacctgtcagaagacagagctccagatggccctctactacagccagcacgctgtgaagcagctcgaaggagaggccagagacctgataagtagattgcatgattcttggaagttcgcaggggaacttgaacaagctctgagtgccgtggccacccagaagaagaaagctgacagatatattgaggagctcactaaggagcgggatgccctatccctcgagttataccggaatacaatcacggatgaagaacttaaggaaaagaacgctaagctgcaggagaaactccagttagttgaatccgagaagagcgaaattcaactcaacgtcaaggagttgaaacgtaagctagagcgagccaagctgctgttaccacagcagcagcttcaggcagaggccgatcatttgggcaaggagctgcagagcgtgagtgcaaaattacaggcacaggtggaggagaacgaattgtggaatcgcctgaaccagcagcaggaagaaaagatgtggcggcaggaggaaaaaattcaggaatgggaggaaaagattcaggaacaagaagagaaaatccgagagcaagaggagaaaattagggaacaagaggagaagatgcggcgtcaggaagaaatgatgtgggaaaaagaggagaaaatgcggagacaggaagaaatgatgtgggaaaaggaggagaagatgaggcggcaggaggaaatgatgtgggaaaaggaagaaaagatgcgcaggcaggaggagatgatgtgggagaaagaggagaagataagagagctcgaagaaaagatgcacgagcaagaaaagatccgggaacaggaagaaaagcggcaggaggaggagaaaattcgggaacaggaaaagcgccaggaacaagaggccaagatgtggcgacaagaggaaaaaatcagggagcaggaggaaaaaatacgcgagcaggagaagaaaatgtggagacaagaggagaagattcatgagcaggaaaagattcgtgaagaagagaaacggcaggaacaagaggagatgtggagacaggaagagaagatccatgaacaagaagaaatctggcgccagaaggagaaaatgcatgagcaggaggagaaaatccgtaaacaggaggagaaagtctggcggcaagaagagaaaataagggagcaagaggagaaaattcgcgagcaagaagaaaaaatgtggagacaggaggaaaagatccgggaacaggaggagatgtggagggaggaggaaaagatgcacgagcaggagaaaatttgggaggaagaaaagcggcaggaacaggaggacaaaatgtggcgccaggaagagaaaatccgcgagcaagaggaaaaagtgtggcggcaggaggagaagatcagagaacaggaggagaagaggcaagagcaggaggaaaaaatgtggaagcaggaggagaaaataagggaacaggaggagaaaatccaagagcaggaagagaaaattcgagaacaggaggaaaaaattcgagagcaggaagaaatgacccaagaacaagaggagaagatgggtgagcaggaggagaagatgtgcgaacaggaagagaagatgcaagaacaagaggaaaccatgtggcgacaagaagaaaagatccgagaacaggagaagaagataagagagcaagaggaaaaaattcgcgagcaggaagagatgatgcaggagcaagaggagaagatgtgggaacaagaggagaagatgtgcgagcaggaagaaaaaatgcaggaacaggaagagaaaatgcggcgacaagaggaaaaaatgtgggagcaggaagtaagactacggcaacaggaggagaagatgcaggaacactag

SEQ ID NO: 56660 - DNA, 1299 bp, Artificial Sequence
  Description of Artificial Sequence: Synthetic coding sequence
atgtggccacagccgagattaccgccacacccagccatgtctgagaagacccaacagggcaaactggctgccgctaagaagaagctcaaagcttattggcagaggaagtcacccggaatacctgccggagcaaatagaaagaagaaggtgaatgggtcctcccctgatactgccacctcgggaggataccacagccctggcgattcagctaccggcatttatggggaaggcagggcaagcagcactacactgcaagatctggaatctcagtatcaggaattagccgtggcactagactcctcctcggccatcattagtcaactgacagagaacatcaactctctggtcagaacaagcaaggaggaaaaaaagcatgagatccacctcgtgcagaagctcggtagatccttattcaagctcaaaaaccaaaccgccgaacctctcgctccacagccgccagccggaccttctaaggttgaacaactacaggatgaaacgaatcacctccgtaaggaattggagagtgtcggacgccagttgcaagctgaggtggaaaacaatcagatgctgtcacttctcaatcggagacaggaggaacgcctgagagagcaggaagagcgactgcgcgagcaagaggaacgactgtgtgagcaagaagagcgcctgtgtgagcaggaagagcggttgcgcgagcaggaggagaggctatgcgagcaggagaaactgcccggacaggaacggctactagaagaagtagagaagctcttgaagcaggagcggagacaagaggaacaagagaggttgttggaacgagagcgcctcttggatgaggtcgaggagctcctcgaacaggagcggctgcgtcagcaggacgagcgactctggcagcaggaaacattgagagaactggaaaggctgagggaattggagagaatgctggagttggggtgggaagccctttatgagcaaagagcggagccccgatccggctttgaggaactgaacaacgaaaacaagtccacactgcagctcgagcaacaggtcaaggaactcgaaaaatccggcggtgcggaggagcctcgcggatcagagtcggccgctgcagcccgaccggtgccgggagcccctgtcccgcagggggcttggatgtgcggacaggcaggctggactcctcaggagcatcccggtttatctggggaagcagtcgggacgggggaagcagctggcggtgccggagaagcagcctgtcactctttccgggctgctgaaaacagggaactaaacataaccattatctag

SEQ ID NO: 56661 - DNA, 1812 bp, Artificial Sequence
  Description of Artificial Sequence: Synthetic coding sequence
atggccgaagagacgggtcagtccaagttggcagctgctaagaagaagttcaaagagtattggcagaggaacagacctggagttccggctgcagccaaaagaaatactaaagccaacggatctagccctgaaactgccgctagcgggggttgtcacagttccgaagcctcctcgagtgcttccagctcgctgcacgcacgtcagagcccctgtcaggaacaggcggcagtgctgaactctaggtcgataaagatatcaagactgaacgatacaatcaaaagtctgaagcagcagaagaaacaagttgaacaccagctggaggaggaaaaaaaagcaaacaatgaaaagcaaaaggctgagcgtgagttagaaggccagatacagaggttaaatactgaaaaaaagaaactgaacacagacttgtaccacatgaagcacagcctccgctattttgaagaagaaagcaaagacctcgccggtaggttacagcggtcttcgcagaggattggagagctggaatggagcctgtgcgctgtggccgcaacccagaagaagaaacccgacggtttttcgtctcgttcgaaggcccttcttaagagacagctggaacaatctatacgggaacagattctcctgaagggacatgttacacagcttaaggaaagcttaaaggaggtgcagctggagcgtgaccagtacgcggaacagatcaagggcgagagggcccagtggcaacaacggatgaggaaaatgtcccaggaagtctgtaccttgaaagaggaaaagaagcacgacacccatcgggttgaggaactggagaggtctctgagcaggttgaagaaccaaatggctgagccacttccccctgatgctccagcagtgagttccgaagtggagctgcaggacctgagaaaagaattagagagagttgccggtgagctgcaggctcaggtcgagaataatcagtgcatctcccttctaaatcggggtcagaaagaacgccttcgtgaacaggaggagcgactgcaagagcagcaggagcggctcagggaacgtgagaaacgactccagcagctggcagaaccccaatctgacctcgaagaattgaaacatgaaaacaagtctgccttacaattggaacagcaggttaaagagcttcaagagaagctcggccaagtgatggaaactctgactagcgctgagaaggagccagaagcggctgtgcccgcttccgggaccgggggtgaaagctctgggctgatggatctgttggaagaaaaagccgatcttagagaacacgtggaaaaactggaacttggctttattcagtaccgcagagaacgctgccaccaaaaggtgcaccgattattaaccgagcctggcgattccgctaaggatgccagtccaggcggtggccatcatcaggccggtcccggacagggtggggaggaaggagaggcggcaggtgccgctggcgacggagtagccgcatgcggttcctactccgaagggcatggaaaatttctggctgctgcgagaaatcccgcagctgaaccgtccccgggagcgcctgctccacaggagctgggcgctgccgataagcatggggacctgtgtgaggcgagcctgacaaacagtgtggagccagcccagggcgaggctagagaaggctctagccaggacaaccccactgctcagcccgtcgtccagctacttggtgagatgcaggaccaccaggagcaccccggattgggaagcaactgttgcgtgccttgtttttgttgggcctggctgccaagacggaggaggtag

SEQ ID NO: 56662 - DNA, 1812 bp, Artificial Sequence
  Description of Artificial Sequence: Synthetic coding sequence
atggccgaagaaacaggccaatcaaagctcgctgccgcaaaaaaaaagttcaaggagtattggcagcgcaatagacccggtgtgcctgccgctgccaagcggaacactaaggctaacggcagtagcccagagactgctgcctcgggcggttgccactcaagcgaggctagttcttctgcgagcagctccctgcatgcccgacagtccccctgccaagagcaggccgcagtgttaaactcccggtccataaaaatctcccgcttgaacgataccatcaaaagcctgaagcagcagaagaaacaggtggaacatcagctagaagaggaaaagaaggcaaataatgaaaagcagaaagccgagcgcgaattggaggggcagatccagaggcttaataccgagaaaaagaaactgaatactgacttatatcatatgaagcatagtctgaggtatttcgaggaggagtcaaaagaccttgcagggcgactgcagcggagctctcaaaggatcggagagttggaatggtcactgtgcgctgttgcggcaacccagaagaaaaagccagacggtttctctagccgctctaaggccctcctcaagaggcagcttgagcagtccatccgggaacagatactcctgaagggtcatgtgactcaattgaaggagtcacttaaagaggttcaactggagagggatcagtatgccgaacagataaagggagaaagggcccagtggcagcagaggatgagaaaaatgagtcaggaggtgtgcaccttaaaagaagagaagaaacacgacacgcacagagtggaggagctggagagaagcctgtcacgtctgaagaatcagatggccgaaccgcttccacccgacgctccagccgtcagcagcgaggtcgagcttcaagatttaagaaaggagttagagagagtggcgggagagttgcaggcacaggtcgaaaataatcagtgcatctcgttactgaacaggggccaaaaagagcggctgcgcgagcaggaggaacgccttcaggaacagcaggagaggttgcgtgagcgagagaagagactgcagcagcttgccgagccgcagtctgatttggaggagctaaaacatgaaaacaagtccgcgctccaactcgagcaacaggttaaggagctgcaagaaaaactggggcaagtcatggagacactgacaagcgccgagaaagagcccgaggctgccgttcctgcctctggtactggaggtgaatcttccggattgatggatctactagaagagaaggcggatttacgcgagcatgtggagaagcttgagcttggcttcatccagtaccgccgagagcgctgccaccagaaggtccaccgcctcctcactgagcctggggactccgctaaggacgccagtcccggaggcggtcatcaccaggcaggccctggacaggggggagaagaaggggaagctgcgggagccgctggcgatggtgtggcagcatgcgggagttactcagaaggccacggcaagttcctggctgcagcccgtaatccagcggcagagcctagtccaggcgctcccgcaccgcaggaactcggcgctgccgataagcatggagatctgtgcgaagcgagtctcaccaactcagtggagccagcccagggcgaggccagggaagggtcctcccaggataatcccaccgctcagcctgtcgtgcagcttttaggcgaaatgcaggatcatcaggagcaccccggtctgggctcaaattgctgcgttccatgtttttgctgggcctggctcccaaggcggagaaggtag

SEQ ID NO: 56663 - DNA, 1902 bp, Artificial Sequence
  Description of Artificial Sequence: Synthetic coding sequence
atgcttcctgtggatggggaagagcggaaatccgaagggtcagacactgagggcgacaggacatctccctgcgccggacctacctctagcgcaacactcaaggacttagaagtggggggaagcggcagaaggtgttcggatcctgctggccaaccatctaatttgcttcctcaacgaggactgggtgccccactgccagccgagaccgcccacacacaaccatctccgaatgacagatcgctttatctgagtcccaagagcagcagcgcctctagctcactgcacgccagacagtccccctgccaagagcaagctgccgtcctgaattctaggagcattaaaatttcacgactgaacgacactattaagtctttaaaacagcagaagaagcaagttgaacaccagttggaggaggaaaagaaagcaaataatgaaaagcagaaggccgaacgggagctggagggacagattcagcgccttaacacagaaaaaaaaaagctcaataccgacctgtatcacatgaaacattctttacggtacttcgaagaggagtccaaggatctagcgggacgtctgcaaaggtccagccaaaggatcggtgaactcgagtggagtttgtgtgcagtcgccgcaacccagaagaagaagcccgacggctttagctctcgctctaaggcactgcttaaaaggcaattagagcagtccattagagagcagatccttctgaagggccacgtgacacagctgaaggaaagcctgaaagaggtccagctagagagagaccagtatgctgaacaaattaaaggagaaagggcacagtggcagcaacgaatgagaaagatgtcacaagaggtttgcaccctgaaggaagagaagaaacatgacacccaccgggtggaggagttagagcggagcttgtcccggctaaaaaatcaaatggctgaacccctgcctcctgacgctcctgctgtatcatcagaggtggagcttcaggacctgagaaaggaattggagcgggtggccggagaactccaagcacaggtggaaaataatcagtgcatttctctgctgaatcgtggacagaaagagcggctgagggaacaggaggagcggttacaagagcagcaggagcggttgcgggaacgggagaaacgcttgcagcagcttgcagagccacagtctgacctcgaagaactgaagcatgaaaacaagagtgctctgcaattggagcagcaagtaaaggaactccaagaaaaactgggacaggtgatggagactctcacatctgccgagaaggaaccggaagctgcagttccagcctctgggactggcggagagtcctccggcttaatggatcttctcgaggaaaaagctgacctcagagagcacgtggagaaattggagctaggcttcatccaatatcgcagggagaggtgtcatcagaaggtccatagactcctcaccgagcctggagattctgcaaaggacgcatctcccggaggcggacatcatcaggctggacctggccaggggggtgaggagggagaggctgcaggtgccgcaggggatggcgtcgccgcttgcggatcatactccgaggggcatggcaaattcctagcagctgcacgcaaccctgcagccgagcctagtcccggagcgcctgctccgcaggaactcggagcagccgataagcatggcgacctgtgtgaagcttcactcaccaattcagtggagccagcccagggtgaggcgagagagggcagttcccaagataacccgactgcacagcccgtagtccagctgctgggagaaatgcaggatcaccaggagcatccaggcctagggagcaattgttgtgttccctgtttttgttgggcctggcttccacgcagaagacggtag

SEQ ID NO: 56664 - DNA, 1383 bp, Artificial Sequence
  Description of Artificial Sequence: Synthetic coding sequence
atgaaacactcccttcggtatttcgaagaagaatccaaggacttagccggtaggctccagaggagctcacagcgcattggcgaactcgaatggagtctgtgcgcggtagccgctacccagaaaaagaagcccgacggattttcctctagatctaaggcgctgcttaagaggcagctggagcagagcatccgggagcagatattgctaaaaggacatgtgacccagttaaaagaaagcttaaaagaagtccagctggagcgagatcagtatgcagaacagatcaagggcgaacgagcccagtggcagcaacggatgaggaagatgagccaggaagtgtgtaccttgaaagaagaaaagaagcatgatacccatcgtgtcgaggagctcgagagatcactgtcgagactaaaaaaccagatggctgagcctctccccccagatgccccagctgtgtcatcagaggtggaactacaagaccttagaaaggagctcgagagagttgccggtgaattacaggcccaggtggagaataaccagtgtatcagcctcctgaaccggggtcagaaagaacggttacgtgagcaggaggaacgcctgcaggagcagcaggaacggctgcgcgaaagggagaagaggctacagcaactcgcagaaccccaatctgatctcgaggagcttaaacacgagaacaaatctgcactacaactagaacaacaggttaaagagctccaggagaaactcgggcaggtgatggagactctaaccagtgccgagaaggagcccgaggcggctgtgccagccagcggtacaggtggagagtccagcgggctgatggatctgctcgaagaaaaagctgacctacgcgaacatgtagaaaagctcgagttggggtttatccaatatcgacgagagcgatgtcaccagaaggttcatcgactgctgactgaaccaggagactctgccaaggatgcaagcccaggcggtggtcaccatcaggccggacccggtcaaggtggggaagaaggcgaagcggcaggggctgctggggatggagtcgccgcttgcggaagctactccgaaggtcacgggaagtttctggctgctgccagaaaccccgcagcggagccatcacccggagcacctgctccacaagagctgggcgctgcggacaagcatggagacctttgtgaggcttccttaaccaattctgttgaacctgctcaaggagaggcgagagagggatcaagccaggacaatcccaccgcgcagccagtggtgcagctcctgggtgaaatgcaagaccatcaggagcacccaggcttggggagtaactgctgtgtaccttgtttctgctgggcatggctcccacgcaggcgtaggtag

SEQ ID NO: 56665 - DNA, 1899 bp, Artificial Sequence
  Description of Artificial Sequence: Synthetic coding sequence
atggctgaggaaacccagcataacaagcttgcagctgccaagaagaagctgaaggagtactggcagaaaaacagcccaagggtccctgccggtgctaataggaataggaagacgaatggcagcatcccccagactgcaacctccgggggatgccagcctcctggagatagcgctaccggatttcacagagaaggccctacgtcttccgccactctaaaggacctggagagcccgtgtcaggagagagctgtagtgctagacagccgctccgtggaaatatcccagctgaaaaataccattaagtcactgaagcaacagaagaagcaagttgagcaccagctggaagaagagaaaaaggcgaatatcaaaaagcagaaggctaagcgagtgctggaggttcaaatccagaccttgaatatacagaaagaggaactaaacaccgacctgtatcacatgaaaagaagtcttcggtattttgaggaaaaatcaaaagatctcgccgtgcggttgcagcacagcctgcagcggaaaggcgagctggaaagtgtgctctccgacgtcatggccacccagaagaaaaaggcaaaccagttatcgtccccgagcaaggccggtacagagtggaaactcgagcagtctatgcgcgaagaagccctgttgaaggtgcagttgacacagctcaaagagtcgttccagcagcttcaactggagagacacgagtatgccgagcatctgaagggggaacgggcaagatggcagcaaaggatgcgtaagatgagccaggagatctgcaccttgaagaaagaaaaacagcaagacatgaggagagttgagaagttggaacggtccctaagtaagcttaaaaatcaaatggctgagccactgccaccagagccacccgctgtcccgagcgaggtggagcttcagcatctccgtaaggaactggagagggtcgccggtgccctgcaagcccaggttaaaaacaaccaaaggatcagtctactgaatagaggccaggaggagcgcatccgggagcaggaggaacggctcagaaaacaagaagaacgaatccaggagcagcataagtcactgcagcagttggctaagccccagtccgtgttcgaggaacctaataatgaaaacaagagcgccctccaactggaacaacaggtgaaagaattgcaggaaaagttgggggaagagcacttggaagccgctagtcagcagaaccagcagctgaccgcacagctgtctcttatggctctaccgggagagggtcatggcggtgaacaccttgatagtgaaggtgaggaggcgcctcaaccaatgcctagcgttccagaggacctggaatcaagagaagcaatgtcaagtttcatggatcacctggaagagaaggctgatctcagtgaactggttaaaaagaaagagctctgctttattcaccactggagagaaagatgtcaccagaaaactcaccatctgttgtccgagcccggtgggagggctaaagacgccgctctgggtggcggtcaccatcaggcaggcgctcagggaggcgatgagggggaggctgccggtgccgcagccgatggaatagccgcatactctaattacaacaacggtcaccgcaaattcctcgcagctgcacataaccctgccgacgagcccggtccgggtgcccctgcaccccaagaactgggagccgcagacaaacacggcgacctgtgcgaggtcagccttacctcctccgctcagggtgaggcaagagaagatcccctcctggataagcccacagcccagccaatagtgcaggaccaccaagaacaccccggactgggaagtaattgttgcgtgccatttttttgctgggcttggctgccccgaagacggagatag

SEQ ID NO: 56666 - DNA, 1338 bp, Artificial Sequence
  Description of Artificial Sequence: Synthetic coding sequence
atggcaacacagaagaaaaaagcgaaccagctgagttcccggagtaaagcacgaacggagtggaagctagaacaaagcatgagggaggaggcactgctgaaagttcagctgacacagtttaaggaatcatttcagcaggtccagctcgaacgagacgagtactctgaacatctgaaaggtgagcgcgctcgatggcagcaacggatgcgtaaaatgtcccaggaaatctgtacactgaagaaggaaaaacagcaggatatgaggcgagtggagaaacttgaacgctctctgagtaaactgaagaaccagatggctgaacctctgcccccagagcccccagcggtgccatctgaagttgagctgcagcatcttcgaaaagagttggagagagtagctggagaattgcaagcccaggtcaagaacaatcaacgaatcagtcttctgaatcaacggcaggaggaacggatcagagagcaggaggagaggcttcgaaagcaggaggagaggattcaggagcaacacaaatccctgcagcaactggcaaaaccacagtccgtgttcaaagagccaaacaacgagaacaaaaacgccttgcaattggagcaacaggtgaaggagctacaggagaaactgggcgaagaacacctcgaagccgctagtcagcagaaccagcagctcacagcccagttgagcttaatggctcttcctggagagggtcatggaggagaacatctcgatagcgagggagaggaggcaccccgacctatgccctctgtacctgaggaccctgagtcaagggaggcgatgagctcatttatggaccatctcgaagaaaaggcagatctgtccgaactagtcaagaaaaaagagctgtgttttattcatcactggagagagcggtgccatcagaaaacacaccatctgctgagcgaacctggaggtagggcaaaggatgccgctctcggtggcggacaccatcaggctggcgcacaggggggagacgaaggggaagccgcaggtgccgcagctgatggaattgccgcatattcaaattacaataatggtcaccgcaagttcctcgctgccgctcataatagtgctgacgaacctggacccggtgcccctgcaccacaggaactgggtgctgccgataagcatggacatttgtgtgaggtgtccctgactagctccgcacaaggcgaggccagagaggaccccctgttagacaaacccactgcccagccgattgtgcaggatcaccaggaacatccaggcttagggagcaattgttgtgtcccatttctgtgttgggcttggctacctcgacggcgacgatag

SEQ ID NO: 56667 - DNA, 1299 bp, Artificial Sequence
  Description of Artificial Sequence: Synthetic coding sequence
atgtggccacaaccccgattgccgccacatcccgctatgtccgaaaagacacagcagggtaagctggccgcagccaagaagaaattgaaagcgtattggcagcggaaatctcctggaattccagcaggcgcaaataggaagaagaaggtaaacggctcaagccccgacacagctacctctggcggatatcacagcccgggtgactctgccactggaatatacggcgaaggacgtgctagtagcactaccttgcaggatctcgaaagccaataccaagaattggctgtcgctcttgacagcagctctgctattatctcccagcttacagaaaacatcaattcccttgtaaggacctctaaggaagagaaaaagcacgaaattcacctggtgcagaagctggggaggtcattatttaagctaaaaaatcaaacagcggagccgctggcaccacagcctcccgcagggccttccaaagttgagcaactgcaagatgagacaaaccatttgcgcaaggagctggagagtgtgggcaggcagttacaggccgaagttgaaaataaccaaatgttaagcctgctgaatcgtcggcaggaggagcggctacgggaacaagaagaacgtttaagagaacaagaagagaggctgtgcgagcaggaggagcgcctgtgcgaacaagaagagcggctaagggagcaggaggaacgcttatgcgaacaggagaaacttcctgggcaggaacgtctcctcgaggaggttgaaaagctactgaagcaggaacggcgtcaggaggagcaggagcgtcttctcgagcgggaacggctgcttgatgaagtggaggagctgctggaacaggaacgcttgcggcagcaggatgaaagactgtggcagcaggaaacacttcgcgagctggaaaggctgagggagctcgaacgaatgctggagcttggctgggaagccctatacgagcagcgcgctgaacctaggagcggattcgaggaattgaataacgaaaataaatccacgttacagttggaacaacaggttaaagagttagaaaagagcggtggcgcagaggaacctagaggcagtgaaagcgcagctgctgcacgtcctgtgcccggagcacccgttccacaaggcgcttggatgtgtggtcaggcgggatggacaccccaggagcaccccggactgtccggagaagccgttggtaccggtgaggccgctgggggtgccggagaggcagcttgccactccttccgggcagctgaaaatcgcgaactgaacatcactatcatttag

SEQ ID NO: 56668 - DNA, 1896 bp, Artificial Sequence
  Description of Artificial Sequence: Synthetic coding sequence
atggctgaagaaacccagcataacaagcttgctgccgcaaagaagaaactgaaggagtattggcagaaaaacagacctagggtgcctgccggtgtcaataggaataggaagaccaatgggagcattccagaaacagctacatcaggcggatgccaaccccctggcgactcagccaccggcttccatcgagagggaccaactagtagtgctactctaaaggacctggagtccccttgccaggagagagccgtcgttctggattccacaagtgtgaagatttcacggctcaaaaataccattaagtctctgaaacaacagaaaaagcaggtggaacaccagttagaagaggagaagaaggccaacaacgaacggcaaaaggcagaacgcgttcttgaggtgcagattcagacattaattattcagaaagaggagctgaacaccgatctgtaccatatggaacgtagccttcgttacttcgaggaggagtcaaaggacctagccgttcgtctgcaacattcattgcagtgtaagggcgagctggaacgggcattatccgccgtgatcgccactgagaagaagaaggctaatcagctgtcatcctgctcaaaggcccacactgaatgggagctcgagcagagcttgcaagaccaggcactgctcaaggcccaactgactcagttaaaggaatcattccaacagctgcagcttgagagagacgaatgcgctgagcacattgaaggtgagagagcccgatggcaccagagaatgtcaaaaatgtcacaggaaatttgtacgttaaaaaaggagaaacaggatatgcgctgggtggaacagctggaatggagcctgagtaaactcaagaaccagaccgccgaacctctgccgcctgagccccctgctgtgcctagcgaagtcgagctgcaacatctgagaaaagagctggagcgagtggctggcgagctgcagagccaggtcaaaaataatcaacacatttctctgctgaaccgcaggcaggaagaaagaatcagggaacaggaagaaaggttgcgtaagcaggaagagcggctgcaagagcagcacgagaaactgagacagctggccaaacctcaaagcgtatttgaggagctcaacaacgaaaacaagtccaccctgcagctcgagcaacaggtcaaggagttgcaagaaaagcttggcgaagagcacttggaggtggcaagccaacagaatcaacagttaacagcccagctttctctgatggcattgccaggcgaggggcacgggggagagcatctggattctgaaggtgaggaagcaccacaacccatgccatcagtgcccgaagaccccgaaagccgtgaagcgatgagctcatttatggatcatctcaaagaaaaagccgacctgtctgaacttctaaaaaagcaagaattgcggttcatccagtattggcaggaacgctgccatcagaaaatacatcaccttctgagcgaacccggtggcagggcaaaagatgcagcacttggcggaggtcaccaccaggccggtgctcaaggcggtgatgaaggggaggctgccggagccgctgctgacggaattgctgcctattcaaattataacaatgggcaccggaaattcctcgccgcagcccataattctgctgacgagcccggtcccggagctcccgcaccccaggagctgggggctgctgataagcatggtgatttacgagaagttactctcacaagctccgcacagggggaggcaagggaggatccgctgctcgacaagccaacagcccagccaattgtacaagaccatcaggagcatccgggacttgggtctaattgttgcgtccctttgttctgttgggcgtggctgccgcgtaggagaaggtag

SEQ ID NO: 56669 - DNA, 885 bp, Artificial Sequence
  Description of Artificial Sequence: Synthetic coding sequence
atggccgaagaaacacagcataataaactggccgctgccaagaaaaagctgaaggagtactggcaaaagaaccggcctagagtgcctgccggagtcaaccggaataggaaaactaacggatccataccggaaaccgctacaagcggtggatgccagccacctggcgatagcgccaccggcttccatcgcgaggggcctacaagctctgccacactcaaagatctcgagtcgccttgccaggagagggctgttgtcctggactccacatcagtgaaaattagtcgtttgaagaatactatcaaatctctcatctgtaccctgaagaaagagaagcaggatatgaggtgggtcgagcagttggagtggtctcttagcaagctgaagaaccagacagcagaacctctgcctccggagccacctgccgttccatccgaagtagaactacagcacctgcgaaaggagctcgagagggtagctggtgagctacagagccaggtgaagaataaccaacatatctccctgcttaaccggaggcaggaagaacggatccgcgagcaggaggaaagattaagaaaacaggaggagaggctgcaagagcaacacgaaaaattgaggcagctggcaaaaccacagtccgtgtttgaagaattgaataatgagaacaaaagcacactacagctggaacagcaggtgaaggaacttcaggaaaagctgggggaagtgaaggagactgaaacgtctacgccttccaaaaaggggtgggaggctggctcctctctgctcgggggtgaggtcccagggcagaggcaactgccagcgtggggtctcgtgactacagcacctcgccgagctgtattgaggctgttcttgactagctgtctttag

SEQ ID NO: 56670 - DNA, 519 bp, Artificial Sequence
  Description of Artificial Sequence: Synthetic coding sequence
atggcaggagcagctcccaccaccgccttcggccaggccgtgattgggcctccgggtagtgggaaaaccacatattgtctggggatgagcgaatttcttagggctctgggccgaagggtcgccgtggtgaaccttgaccctgccaatgagggcttgccttacgatattttctcacaaatggcacagtgggatctgagactaactgcagttcaccttgtggacagccattattgtaccgacccagccaaatttatctcagtcctgtgcacaagccttgccactatgttacacgtggagttgcctcacattaatttactatccaagatggaccttatcgaacattatggaaagctcgcctttaatctggactactatactgaggtgctggacctgtcttacctgctcgatcatcttgcttccgatcccttttttcgccactacaggcaattaaacgagaaattagtacagttgattgaagactacagtttagtgagttttattccgttaaatatacagtag

SEQ ID NO: 56671 - DNA, 396 bp, Artificial Sequence
  Description of Artificial Sequence: Synthetic coding sequence
atgttggccggacttgagctgctgacaagcgccttcaatctcgattattatacggaagtgctggacctgtcttatttactagaccaccttgcatctgatccatttttccgccactacagacagctgaatgaaaagctggtacagcttatcgaagattactctctagtgtctttcatccccctcaatatccaagacaaagagtcaatccagcgagtgctccaggcagtggacaaggcaaatggatactgcttccgcgctcaagagcagcgatccctcgaagctatgatgtctgctgccatgggcgcagacttccatttcagctcaacccttgggatccaggaaaaataccttgctccgtctaaccagtccgtcgagcaggaggctatgcagctctag

SEQ ID NO: 56672 - DNA, 933 bp, Artificial Sequence
  Description of Artificial Sequence: Synthetic coding sequence
atggcaggagcagccccaaccactgcattcggacaggccgtgattggcccaccaggatctggcaagactacctattgtctgggaatgtccgagttcctccgcgctttaggtaggcgcgtcgccgtggtgaacttagacccggcaaatgagggactcccatacgagtgcgccgtggatgtgggagaattagtgggcctgggggacgtgatggatgctctgcgccttggccctaatggaggactcctatattgtatggagtatcttgaggcaaaccttgattggctccgagcaaagctcgatcccttgcgaggccactattttctgttcgattgccccggacaggttgaactttgtacccatcatggcgcactccgatcaatctttagccagatggctcaatgggatctgcggttgaccgccgttcacctggtggactctcactactgcactgatccagccaaatttattagtgtcctttgcacttcactggctaccatgctgcatgtggaactgccacacatcaatctcctctctaaaatggacctgatagagcattatggcaaactggccttcaatctcgattactatacagaggtgttagacctttcgtacctgctggatcacctcgcctctgatcccttttttcggcattataggcagttaaatgagaagctggtgcaactcatcgaagactattccctcgtcagctttatccctctgaatattcaggacaaagaatccattcagcgcgtgctgcaggccgtggacaaagccaatgggtattgcttccgcgctcaggagcagagaagtctagaggccatgatgtccgctgccatgggggcagattttcacttttctagcacactcggcattcaggaaaaatacctggctccctcaaatcagagcgtcgaacaagaggctatgcagctgtag

SEQ ID NO: 56673 - DNA, 519 bp, Artificial Sequence
  Description of Artificial Sequence: Synthetic coding sequence
atggccggtgccgctccaaccacagcctttggacaagcggtgatcggacccccaggctcgggcaagacaacctactgtctgggcatgagtgagtttttgagggccctcggcagacgcgtcgctgttgtgaacctggaccccgcaaacgaggggttgccatacgatatcttttcccaaatggcccagtgggatttgaggctcacagcagtgcacctggtggactctcactattgcactgatccggcaaagtttatctccgtcctttgcacaagcctggctaccatgctgcacgtggaactgccacacatcaatctactcagcaagatggacctgatagagcattatggaaaactcgcattcaacctggactactataccgaagtgctcgacctctcttacctcctcgaccatctggcatcagacccattcttcaggcactaccgccaactaaatgaaaaactggtgcagttaattgaggattactcattggtgtctttcatacccctcaacatccagtag

SEQ ID NO: 56674 - DNA, 537 bp, Artificial Sequence
  Description of Artificial Sequence: Synthetic coding sequence
atgcccgcataccattccagcctcatggatcccgacacaaaattaattgggaatatggctctgctgccgataaggagtcagttcaagggccctgcgcctcgagagactaaagacactgatattgtcgatgaggctatttactattttaaagccaatgttttctttaaaaactacgaaatcaagaatgaggctgataggactctgatttatattacactatatatctccgagtgtctcaagaagctgcagaagtgtaattcaaaaagccagggtgagaaggaaatgtatactttggggataactaacttccccatacccggtgagcccggattccccctgaacgccatttacgcgaagccagccaacaaacaggaagatgaagtgatgcgggcatatctgcagcagttgcggcaagagactggattgcgtctctgcgagaaagtgtttgatccccagaatgacaagccgagcaaatggtggacttgcttcgtcaaacgacagtttatgaacaaatccttaagcggtcctggtcagtag

SEQ ID NO: 56675 - DNA, 885 bp, Artificial Sequence
  Description of Artificial Sequence: Synthetic coding sequence
atgcctcggtacgctcagttggtgatgggtcctgcgggaagcggaaaagtcagaatttgtggggataaggagaggaaatctacatactgcgctaccatggttcagcattgtgaagccctgaataggagtgtacaggtcgtgaacctggatcccgctgccgaacatttcaactatagtgtgatggccgatataagggagctcatagaggtggatgatgtgatggaggacgattcactcagatttgggccaaatgggggactcgtgttctgcatggagtactttgctaataattttgactggctggagaactgcttgggtcacgtggaagatgactacattctgtttgattgtcctggccagatcgagctgtacacccacctgcctgttatgaagcaactggtgcagcagctcgagcagtgggaatttagggtgtgcggcgtcttcctagtggacagccagttcatggttgagtcctttaagttcatatcggggattctggccgcattgtcggcgatgatcagccttgagatcccccaagttaatattatgacaaagatggatcttctcagcaagaaggctaagaaagagatcgaaaagttcctcgacccagacatgtacagcctgctagaggattctacttcagatcttagaagcaaaaaatttaaaaaactcacaaaggccatctgtgggcttattgacgattattccatggtgaggtttctgccatatgatcagagcgacgaagaatctatgaacattgttttacagcatatcgacttcgccatacagtatggcgaagatctagagtttaaagagcccaaggagcgggaggatgaaagctcatcaatgtttgatgaatacttccaggagtgccaagacgaatag

SEQ ID NO: 56676 - DNA, 972 bp, Artificial Sequence
  Description of Artificial Sequence: Synthetic coding sequence
atgcttcccaaaacccgcggagcctttcatttttccattccagacccccagcacatttgtaagtctaggggatctccctaccggtccaacgtatgcacacagaccaccgatcggtcaacgtggagaaaggacgcggagttataccttttgtctgtgatcacccagagcacatactgcgcgacaatggtgcagcactgcgaggccttaaataggtctgtgcaggtggtcaatctagacccagcagccgagcactttaattattctgttatggcagacattcgtgagctgatcgaggtggacgacgtgatggaggatgattcactgcgtttcgggccaaatggagggctcgtgttttgtatggagtattttgctaacaatttcgactggctggagaattgcctggggcatgtggaggatgattacattttatttgactgccctggccaaatcgaactctacacacacctgccagtgatgaagcaacttgtgcagcagctggaacaatgggagttccgggtttgcggggtgtttttagtggactcacagttcatggtcgaaagctttaagttcatctccggaattctcgcagccttgtctgcaatgatcagcctggagatcccgcaggtcaatattatgactaagatggatctgctgtccaagaaggcgaagaaagaaattgaaaagttcctggacccagacatgtattctctcctggaggactctacctccgacctccgcagcaaaaagtttaaaaaattaaccaaggccatttgcggcttgatcgacgactacagtatggtaagattcctgccctacgaccaatctgacgaagaaagcatgaatattgtgttgcagcatatcgactttgccattcagtacggggaggacttggaattcaaggaacctaaggagcgcgaggatgagtctagctctatgtttgatgaatattttcaggagtgtcaagacgagtag

SEQ ID NO: 56677 - DNA, 2331 bp, Artificial Sequence
  Description of Artificial Sequence: Synthetic coding sequence
atgggaaccgttccagacccactaaggtctgccaagacgtctctgattgcagccagcggaaaagaagatgatttaggagaaccgcaagccgcttccccacggcaccgcccagctctcctgtgcaaaaatgcaaacggattttctggcgcacctgccgagccagacctgagcccgcgagccgcagctgaagccttgatgcaggtctgtgagcacgaaactacccagcccgacatgtcaagtccaggggtttttaatgaggttcagaaagcacccgctacattcaattctcctggcaacccccaactgccagggagcagtcagccggcagcgtcggcccctagctcagcagcaggaagagacctgatccacaccccactcacgatgcccgctaaccagcatacttgtcaatcgatacccggtgaccagccgaatgccatcacatctagtatgccggaagactccctgatgcggtcccaacgaacctccaatagagaacaaccggagaaacctagttgccccgtggggggagtacttagtagctccaaagaccaagtgtcatgtgaattcccctcccccgagactatacagggaacggtacagactcctgtcacagccgctcgtgtagtgtcacattcctctagccctgtggggggaccagagggcgagaggcaaggcgctatttgtgattcagagatgagaagctgcaagcccctgactagggagtcaggttgtagcgagaacaagcaacccagtgtgacagcttccgggccacagggaaccacaagcgtgacaccacagcccaccccgctgacctccgaaccatccgcctgccccccagggccagaaaaggtgcccctacctgcccagcgacagatgagccggttcaaggaggccagcacaatgacaaatcaggctgagtctgagatcaaagaagttccctccagagcctggcaggatgccgaagtgcaggccgtggcctcagtcgaaagcagaagcgtttccacatctccatctatcctgaccgccttcttgaaagaatcccgtgctcctgagcactttgaacaggaacaactcagggtgatttgccactcgagcggcagtcacacattagaactcagtgacagcaccctggcaccccaggagagctcacagtgtcctggcattatgcctcaggtccatatccaggcggcagctgctgaatctacggccttccaacgggaaaataagctggcaagcctgccaggaggcgttttgaagacatctagcattaacctggtaagctctaacgctcaacatacctgcaaagaggatggccgtctcgccggtatgactcctgtgagagaggaatccaccgcaaagaagctggccggaactaactctagtagtctgaaggcaacagctattgaccagatcagcatttccgcatgttctcaggccgagactagttacggactggggaagttcgagactcggcctagtgaatttgcagagaaaaccaccaacggacataagaccgaccccgattgtaaactgtccgacagctgcgggtcaataagcaaggccgatcactcaggcagcctcgaccccactaacaaaggagacgccagggagaagaagccagcttccccccaggtggtgaaggagaaagagtccaccggaactgatacctcggacgcgaaaacactcctgctgaaccctaaaagtcaggagagcggaggcacagaatctgctgccaatcccacacctagcccgatccggaagaatcaggaatcaacactggaagaaaatcggcagactaaaaccgcaacaagcttgagcctgcccagtgaccccatgggagactcgagccccggaagtggcaagaagactccctcacgatcagtcaaagcatccccgcgaagaccatcaagagtttcagagttcctgaaagagcagaagctaaatgtcacagcagccgctgctcaggtcgggctgacccccggagataaaaagaagcagctgggagctgattcaaagttacagctgaagcagtctaagagagtaagggacgtcgtctgggacgaacagggcatgacctgggaagtgtacggcgcatccctggacgccgagagtctaggaattgcaattcagaaccacctgcagcgccagattcgggagcacgaaaaactgatcaagacccagaattcccagacccgaaggtccatatcttctgatacctcttctaacaaaaaactgagggggcgtcaacatagcgtcttccagagtatgctccagaattttaggaggccaaattgttgcgtgcgaccagccccttctagcgtgctggactag

SEQ ID NO: 56678 - DNA, 1299 bp, Artificial Sequence
  Description of Artificial Sequence: Synthetic coding sequence
atgacggagcttcagcaagatgttgaggatacaaaacctgcgaaagtgcttggcaaacgggagagcaagctaggcagtgctcactctgaggccgagaacggggtggaagagaagaaaaaagcatgccgaagtcctacggctcagtctcccacccccagcgtagaggcagatagccctgaccagaagaaaatcatcagcctgtggtctaaatcctcgtttgatggcgctagtttggcatctgacaaaaatgactgtaagaccgaatcaaaaaacgacccaaagaccgaacgcaagaaatcgagctcatctagtcagtacaaagccaatatgcatttccacaagctctttctatcagtgcccactgaggaacctttgaagcagtccttcacatgcgctctgcagaaagagatcctgtatcaggggaaactgtttgtctctgagaattggatttgctttcatagcaaggtatttggcaaggataccaaaatcagtatccccgcatttagtgtaactctgattaagaaaacaaagactgccctgctggtgccgaacgctctgataatagcgacggtgacggacagatacatctttgttagtctcttgagtcgagattctacttataagctgcttaaaagtgtgtgcgggcacctcgagaacacttcggtcggtaattcaccaaacccttcttcggcagaaaatagctttcgagccgatcgcccatcttctttgcctctggattttaatgacgagttctcagacttggatggcgtggtacaacaacggaggcaggacatggagggctactcttcttcagggtctcagacaccagagtccgagaactcccgggattttcacgcaacagagtcccagactgtcctaaacgtgagtaaaggagaggccaaaccaacccgggctgacgcccatgtaaaccgagttccagagggtaaagccaaatctctgcctgttcagggactgagcgagaccgttggcatcctgcataaggtgaagtctcagaagtgccctatgctgcaccacatcctgatcttttacgctattgtcgtgtgcgcccttattattagcaccttctacatgcgttacagaattaacactttagaggagcagctgggactactgacttcaatagtagacacacacaatactgagcaggctgctcctagtggactgagatcccaggtgcagtttaatgtcgaggtactgtgccaggagctgacagccaacattgtgaagcttgagaagatccagaacaatctgcagaaactgctcgaaaacggagactag

SEQ ID NO: 56679 - DNA, 1323 bp, Artificial Sequence
  Description of Artificial Sequence: Synthetic coding sequence
atgtggaagacccagtctctaagaaaatgtagcgggaggggaagggctaatctggcacagccgacacagcgactgcgcatggtctggaggaggaagcgcaagcccgctggacgccagcagcctaatcccctgccacatctgtggcggaggacgccccagactcggcgaaagtctctcgcgtacgctcacatcttctctcctaatttgtgtttcatccaggatcaggagtccaaatcaagttttgatggagcttctctagctagcgacaagaacgattgcaaaaccgaaagtaaaaacgaccccaagacagaacgcaagaaatcatcctcatcctcccagtacaaagcaaatatgcattttcacaagctgttcctgagcgtgcctactgaggagccattgaaacagtcattcacctgcgccctgcaaaaggaaattctgtatcaagggaaactgttcgtgagcgaaaactggatctgttttcactctaaagtgtttggcaaagatactaagattagcattccggctttcagtgtcacacttattaaaaaaacgaagacagctcttttagtccccaacgccctcattatcgccacagtgacagataggtatattttcgtgtcccttctcagccgggacagcacctacaagctgctcaaatctgtgtgcgggcacctcgaaaacacttcagtagggaacagtccaaacccaagttcagctgaaaatagcttcagggctgataggccatcaagtttgcctctggactttaatgatgaattctctgacctggatggcgtcgtccagcagcggcgtcaagatatggaagggtactccagcagcgggagccaaaccccagagagcgagaactcccgggatttccatgctacagaaagccaaacagtgctaaacgtgtccaagggcgaggcgaagcccacacgagcagatgcgcatgttaatcgggtgccggagggaaaagccaaatccttacccgtccagggactgtccgagactgtgggcatcctccacaaggttaagtcacagaaatgcccgatgctccaccatattctcatcttctatgctattgtggtgtgcgccttgatcattagcacgttttacatgagataccggatcaacacgttggaggagcagctcggcctgctgacctctatcgtcgacacgcataacacagagcaagccgcacctagcgggctgagatcgcaggtgcagttcaatgtagaagttctatgccaggaactgactgcgaacatagtgaaactggagaagattcagaataaccttcagaaacttctggagaatggcgattag

SEQ ID NO: 56680 - DNA, 1116 bp, Artificial Sequence
  Description of Artificial Sequence: Synthetic coding sequence
atgactgaactacagcaggacgtggaggataccaagcctgccaaggtgttaggcaagagggaatccaaactggggtccgcccatagcgaggctgagaacggagtggaggagaaaaaaaaggcctgccggtcccccacggcacagtcccctacaccgtccgtcgaggccgatagtcctgaccagaaaaaaattataagcctctgcccatacttactcagcaagtccatgcttcactctgggcctagatacaaggctaatatgcacttccacaaactgttcctgagtgtgccgacagaagagcccctgaagcagtcttttacttgcgctctgcagaaagaaatcttataccagggcaaacttttcgtgagcgagaactggatttgcttccactcgaaggtgttcgggaaggataccaaaatctccataccagcatttagcgtaacactcatcaagaagactaaaaccgctctactggtgccgaatgcgctgattattgctaccgtcacagacaggtatattttcgtgagtctgctgtcgagggattctacctacaaactcttgaagtccgtttgtggccacctcgagaacacaagcgtgggcaactcaccgaacccctcctctgcagagaacagcttccgcgctgacagacccagtagcctgcctctcgattttaatgacgagttcagcgatcttgacggcgtggtgcagcagcgtcgacaggacatggaggggtacagctcttcaggatctcaaacccccgaaagcgagaactcccgcgtggactttcacgccaccgagagccagacagtgctcaacgtctcgaagggcgaggccaagcctacccgggcagacgcacacgtgaatcgcgttcccgaaggaaaagctaaaagtttgccagttcagggcctctccgagacagtcggtattctgcacaaggtgaagtcacaaaagtgtcccatgctccatcatattttgatattttacgcaattgttgtgtgtgcactgattataagcaccttctacatgagatacagaattaacaccctcgaggagcaattggggttgctcaccagtatcgtggacacacataatacggagcaacaccatctggcctag

SEQ ID NO: 56681 - DNA, 879 bp, Artificial Sequence
  Description of Artificial Sequence: Synthetic coding sequence
atgtccaaggtgaaacggtttccatttttcttcagctctgaagcagaaaatggggttgaagagaagaagaaggcttgtcgcagtccaacagcccagagtcccacgcccagtgtggaggccgactcacccgatcagaagaaaataatcagcctgtggagtaagtccagttttgacggcgcttcattggcgagtgacaaaaatgactgcaagaccgaaagcaagaatgaccccaaaacggagcgaaagaaatcctcctcttccagccaatacaaagccaatatgcatttccacaagctgtttctgtcggtgcctactgaggaacctctcaaacagtcttttacttgcgccttacaaaaagagatactataccaggggaaactgttcgtatccgaaaactggatctgttttcattcgaaggtgtttggcaaagacacaaagatatcgatcccagctttttccgtgactctcattaagaaaactaagaccgccctactcgtgccaaatgctctcatcatagctaccgtcaccgatcggtacatcttcgtctcgctgttatccagggattcgacttacaagttgcttaagtcggtgtgtggacacctggagaatacctccgtgggcaattcccctaacccctcctccgcagagaacagtttcagagcggaccggccatcctcactcccactcgacttcaacgatgagtttagcgatctggatggagtcgtgcaacagcggagacaggacatggagggttacagtagctctggctctcagaccccagaaagcgaaaattctcgcgattttcacgcgaccgagtcacagacagtgcttaatgtaagcatttttttgtatagcatgcaactccttagtgtgcattag

SEQ ID NO: 56682 - DNA, 987 bp, Artificial Sequence
  Description of Artificial Sequence: Synthetic coding sequence
atgtataaggctaatatgcactttcacaagctcttcctttccgtcccaactgaggagcccctgaagcagtccttcacatgtgcactgcaaaaggaaatcctgtaccaaggaaagttatttgtgtccgaaaattggatttgttttcattctaaagtatttggcaaggacactaagatcagtatacctgccttcagtgtgacactgatcaagaaaacaaagaccgcattacttgttcccaacgctctaataatcgctaccgtgaccgatcgctatatctttgttagcctgctgagtcgcgacagtacatacaaactgctcaaaagtgtgtgcggtcatctcgaaaataccagcgtgggtaattctcctaaccccagtagcgcagagaactcatttagagccgatcgaccttcgtccctgccactggatttcaatgatgaattttctgatctcgacggagtggtgcaacagcggagacaagacatggaggggtattcctcgtcggggtcccaaactcctgagtcagagaactccagagattttcacgccaccgaatcccagactgtcctgaatgtaagcaaaggggaggcaaagcccacccgcgcagatgcacatgtgaatcgggtgcccgaagggaaagcgaagtcattgcctgtgcagggactgagcgaaacggtgggcatcttgcataaagtaaagagtcagaaatgccctatgctgcaccacatcctgattttctacgccatcgttgtatgtgccctgatcatttccacattttatatgagatatcggatcaacactctggaggagcagctcggccttttgacctccattgtcgatactcacaacacagagcaggcagcaccaagcggtctgcgaagtcaggtgcaatttaacgtagaggtgctatgtcaggagctcaccgcgaacatcgtgaagctggagaaaattcagaataatcttcagaagcttctggagaatggggactag

SEQ ID NO: 56683 - DNA, 1251 bp, Artificial Sequence
  Description of Artificial Sequence: Synthetic coding sequence
atgtccaaagtcaagcggtttccattttttttttcttccgaagccgagaacggggtggaggaaaagaagaaggcatgccgtagccctactgctcagagtcccacgccatctgtcgaggcagattcccctgatcagaagaagatcatctctctctggtccaaatcgtccttcgatggggcttccctggctagcgataagaacgactgtaaaactgagtctaaaaacgatcccaaaacggagcggaagaaaagttcaagctcctcccagtacaaagccaatatgcactttcacaagctctttctgagcgtccctaccgaggagccccttaagcagagtttcacatgcgcactacagaaggagatactgtaccaaggaaagctgtttgtgagtgagaactggatctgttttcacagtaaagttttcggcaaggacactaagataagtatccctgccttctcagtgacattaataaagaagaccaaaaccgccttacttgtgcccaatgctctgataatcgccaccgtgaccgaccggtacattttcgtgagtctgctgagccgggacagtacctacaagctgctcaaatcagtgtgcggtcatctggaaaacactagtgtgggcaatagccctaacccatcctcagccgagaactcatttagagccgaccggccatcaagtctgccgctggactttaatgatgaattctccgacctggatggagtcgttcagcagcgcaggcaggacatggaagggtattcatcctcgggaagtcagaccccagaaagcgagaatagccgtgactttcacgcaactgaaagtcagactgtgcttaacgtcagtaaaggcgaggccaaacctaccagagcggacgcccacgtgaatcgtgtgccagaggggaaagccaaatcgctgccggtacaggggttatcagagaccgtcgggatactccacaaggttaagtcccagaagtgtccaatgctacatcatattctgattttctatgcaattgtggtttgcgctttgatcatttctactttctacatgcgctatcgtatcaataccctggaggagcaactgggacttctgaccagtatcgtcgatacgcataatacagaacaagccgcacctagtggtctgcggagccaggtccaatttaatgtggaggttctatgccaggagttaacagccaatatagtgaagctggagaagattcaaaacaacctgcagaaattacttgagaatggcgactag

SEQ ID NO: 56684 - DNA, 1344 bp, Artificial Sequence
  Description of Artificial Sequence: Synthetic coding sequence
atgacccgaaggcagcaggtacttcaggccaaacgatccatccaacagacttttcaagcccagctgatgccttggaaatcaatgttccacgggagggaggtgaaacccgttggacccgacttagaactgtccgaagctgaaaatggtgtggaggagaagaagaaggcctgcaggtcccccacagcccaatcccccacgccaagcgtggaggccgactcaccggatcagaagaagattatttccctctggagtaaaagttctttcgacggcgcttcattggccagtgacaagaacgattgtaagactgaatccaagaacgaccccaagacagaacgcaaaaaatccagttcttcctctcagtacaaagcgaatatgcacttccataagcttttcttgtctgtgccaaccgaagagccactgaagcagtctttcacttgtgccctgcagaaagaaattctgtatcagggaaaactgttcgtctccgagaattggatctgctttcatagcaaggtctttggcaaggatacaaagatttctatccctgccttttccgtgaccttgatcaaaaagaccaaaaccgcccttctcgtcccaaatgccctgattatagccacggtgacagacagatatatattcgttagtctcctgagccgagatagcacttataaattgttaaaatctgtttgcggccacctggaaaacacttccgttggtaatagccccaatccctccagcgctgaaaactccttccgcgctgatcgaccctcctcgttgccactggactttaatgacgagttctcagacctggatggggttgtccagcagagacggcaggacatggagggctactcatcttccggctcacaaactccagaaagtgagaacagtagggatttccacgccaccgagtcgcagacagtgctgaacgtcagcaagggggaggccaaacctactagggctgatgctcacgtgaacagagtccccgagggtaaagctaaatcactgcccgtgcagggcctttcagaaaccgtagggatattgcacaaagtgaagagccagaagtgtcctatgcttcaccacatcctgattttttatgcaattgtggtctgtgcactgattatctctaccttttacatgagatatcgcataaatacgttggaagagcagctggggctattgacaagcattgtcgacacgcacaacactgaacaggctgcccctagcggactgcgatcacaggttcaatttaacgtggaggtgctgtgtcaggagttaacagccaacatcgtgaagctcgagaagattcagaataatttgcagaagctgctagaaaacggggattag

SEQ ID NO: 56685 - DNA, 1761 bp, Artificial Sequence
  Description of Artificial Sequence: Synthetic coding sequence
atgagtgccggagacgccgtttgcaccggatggctagtaaaatcccctccggagcgtaagttgcagcggtacgcatggcgaaagcggtggtttgttcttcgaaggggcagaatgagcgggaaccctgacgttctcgagtactatcgtaataagcactctagcaaaccaatccgggtgatcgacctgagtgaatgcgcggtctggaagcatgtgggcccatcctttgtgaggaaggagtttcagaataacttcgttttcatcgttaaaaccaccagtcgtactttttaccttgtggctaagactgagcaggagatgcaggtgtgggtccactctatctcacaggtttgtaatctgggacacctggaggacggggctgattcaatggagagcctcagctatacgccgagcagcctacaaccctcctccgcttcctctctcctgacagctcacgctgctagttcatctcttcctagagatgatccgaataccaatgcagtggccactgaagaaacgaggagtgagagcgagctgctctttctcccagattatctggtgctaagcaactgtgagactggacgcctccatcatacctctttaccaacccgctgcgactcatggtccaacagtgataggtctctggaacaagccagcttcgatgatgtcttcgtggattgcctgcaacctctgcccagttcccatttggtacaccctagttgtcatggatcgggagcacaggaggtgccgagttccagacctcaggccgcacttatatggtcacgagagattaacggacccccacgagaccatctctcgtcttcccctctgctggagagtagccttagcagcaccattcaggtggataagaatcagggcagcctcccctgcggcgctaaggagctggacattatgagcaatacacctcctccccgtccacccaagccgagccacctgagcgagcgacggcaggaagaatggagcactcacagcggttccaagaagcctgagtgcacgttggtccccagaagaatttctttgagtggcttggataatatgcgcacgtggaaggcagatgtggaaggccagtctctgcgtcaccgggataaaagactgtcactgaacctgccttgtagattctcgccaatgtatcccactgcatctgcttctattgaagattcatacgtccctatgtcccctcaggcaggggctagcggtctagggcctcactgcagcccagatgattatatcccgatgaatagtgggtccatctccagtcctctgcccgaactccccgctaatctagaaccaccacctgtaaaccgtgacctgaagcctcaacggaagagtaggccacctcctctggacttacgtaacctcagtatcattcgagagcacgccagtctcacacggacacgcacggtaccttgcagccgaacctctttccttagccccgaaagaaacggaataaatagcgccagattttttgctaaccctgtttcacgcgaggatgaggagagttatatagagatggaagagcacagaaccgccagcagcctctctagcggggcactgacttggaccaaaaagttttccttggactatcttgctctggacttcaattcagctagcccggcaccaatgcaacagaagctcctgctgtctgaggagcagcgggtcgattatgtccaagtcgacgaacaaaaaacccaggctctgcagtccacaaagcaggagtggaccgacgagcgtcaatccaaggtgtag

SEQ ID NO: 56686 - DNA, 1764 bp, Artificial Sequence
  Description of Artificial Sequence: Synthetic coding sequence
atgtccgccggagatgccgtttgcactggctggctggttaagagccctcctgagcgaaaattgcaaaggtatgcttggagaaaaagatggttcgtcctcaggcggggtcggatgagcggcaatccggatgtgctggagtactataggaataaacattcatcaaagccaattagagttatcgatctcagcgaatgtgctgtctggaaacacgttggccctagctttgtgcggaaagaatttcagaacaacttcgttttcatcgtcaagacaacgagcagaaccttctacttggttgccaaaaccgaacaggaaatgcaagtttgggttcacagcatctctcaagtgtgcaatctgggccacttagaggatggcgctgcagattctatggaatccctatcgtatactccttctagtctgcaaccttcatcagctagctcgcttctgactgctcacgccgctagttcatcgctgcccagagatgaccctaatactaacgcggtggctaccgaggaaacccggagcgaatccgaactcctgtttcttccagactacctggtactttctaattgcgagactggcagacttcatcacactagcctgcctactaggtgtgactcctggtccaactcagaccgcagtttggagcaggcaagcttcgacgacgtctttgttgactgcctccagcccctgccttcttcccacctggtccaccctagttgtcacggaagcggggcacaggaagtcccctcttcaaggcctcaggcggctttgatatggtccagagagataaacggcccacccagagatcacctcagctcttcccctctcttagaaagtagcttgtcatctacaattcaggtggacaagaatcaaggcagtttgccctgtggagcaaaggaactggacattatgagcaacacccccccaccaagaccaccaaagccgtcccacctctctgaacggcgtcaagaggaatggagtacacactccgggagcaagaagccggaatgcactctggtgccacgccgtatcagcctaagcggcctggataatatgcggacgtggaaggccgatgtggaaggccagagcctcaggcatagggataaacgcttgtctctcaatctgccatgcaggttctctcccatgtacccaacagcatcagcgtccattgaggactcgtacgttccgatgtctcctcaagcaggagcttcaggtcttgggcctcattgtagtccagacgattatatccccatgaattctgggtccatcagctcccccctgcccgagctccccgctaacttggagcctcctcctgttaatcgtgatctgaagcctcaaagaaagagccgtcccccaccgctagacctccgcaacctttccatcatcagggagcacgctagtttgaccagaactcgtactgtcccatgtagcagaaccagctttcttagtcctgagcgcaacggaatcaactccgccagatttttcgccaatcccgtgtcacgggaggatgaagagtcatatattgagatggaagaacaccgaactgcttcatctctgtcctccggcgctctcacctggactaagaaattctctctggattatctggctttggattttaattctgccagccccgcacctatgcaacagaaactgctccttagcgaggaacagcgggtggattacgtgcaggtcgacgaacaaaaaacacaagccctgcagagtaccaaacaggaatggaccgacgagaggcaatctaaggtgtag

SEQ ID NO: 56687 - DNA, 1725 bp, Artificial Sequence
  Description of Artificial Sequence: Synthetic coding sequence
atgtctctaccctctccaagcccttcaagagagttatgccctccggatcctgcattcgcccctctgagcagttggcctgggagtggcccagctggcggatccacacgtagcggccatgtgttatattcaggctggttgcgcaaatccccacctgagaaaaagctgcgtctctttgcatggcggaaacgttggttcattctcagaagaggtcagactagctcagacccggatgtgttggaatattataagaacgacggcagtaagaaaccattaagaacaattaaccttaacctgtgtgagcagctggacgtggatgtaaccctgaattttaacaaaaaggagatacagaaaggatacatgtttgatattaagactagcgagcggacattctaccttgtagctgagacacgggaggatatgaatgaatgggtgcagagtatctgtcagatctgcggctttagacaggaggagtccaccggattcctcgggaatatcagctctgcatcacacgggctgtgctcaagccccgcagagccaagctgtagccaccagcacctgccgcaggaacaggaacccacatccgagccaccggttagtcactgcgtcccccctacctggcccatcccagcgccaccaggctgccttagaagtcatcagcacgcctctcagcgtgccgagcacgctaggtctgccagcttcagccaaggctcggaggccccatttattatgcgacgcaatactgccatgcagaaccttgctcagcatagcggttattccgtggacggtgtttcaggacatattcacggtttccatagccttagtaagccttcgcagcataatgccgagtttcgcggaagcactcatcgcatcccctggtctcttgctagccatggacatacgcggggaagtctgacgggctccgaggctgataatgaggcttcatcaggcaaatacacccagcatgggggaggtaatgcctcacgaccggcagaatcaatgcacgagggagtttgcagcttcctgccaggcaggacacttgtcggcttaagcgattcaatcgcttccgaggggagctgcgtgcccatgaaccccggatcccccaccctgccggcagtcaaacaggctggagacgattctcagggagtgtgtattcccgtaggtagctgtctggtccggttcgatttgctcggatctcccttgaccgagctcagtatgcaccaagacctttctcaaggccatgaggtgcagcttcctccagtgaatcgatccttaaagcctaatcagaaggccaatccgacaccaccgaatctcagaaacaacagagtgattaacgaactgtcatttaagccgcctgtgactgaaccttggtccggaacctcacataccttcgattcatcctccagtcagcacccaatttctacccagagcataaccaataccgattccgaggactccggcgaaaggtacttatttcctaaccccgctagtgccttccctgtgagtggtggtacatcctccagcgcacccccacgttcgaccggaaatatacactacgcagctttagatttccagccttcaaagcctagtattggctcggtcacctcgggaaagaaggtcgattacgtgcaggtcgatttagaaaagactcaggctttgcagaagacgatgcacgaacagatgtgcctgcgacagtcctctgagccgccaaggggggcaaagctttag

SEQ ID NO: 56688 - DNA, 357 bp, Artificial Sequence
  Description of Artificial Sequence: Synthetic coding sequence
atggagtcggtcgccctctatagctttcaagctacagaatcggacgaattggcattcaataagggcgataccctaaaaattttaaacatggaagacgaccaaaattggtacaaggcagagttgcgcggtgtggaaggcttcataccaaagaattacatcagggtcaagcctcacccttggtactccggcagaattagtcgtcaactcgcagaggagattctgatgaagcgcaatcacctcggagctttcctcattcgcgaaagcgagtcttccccaggagagttcagtgtgtctgtaaataatagagcccagcggggaccgtgcctggggcctaagtctcactctaggctgggctag

SEQ ID NO: 56689 - DNA, 567 bp, Artificial Sequence
  Description of Artificial Sequence: Synthetic coding sequence
atggaagatgaccaaaactggtataaagcagagttacgcggtgtcgaaggttttattccaaaaaactacatccgggttaagcctcacccttggtattcaggtcggatcagccgccagctggcagaggaaatccttatgaagaggaatcatctcggcgcatttctgattcgggaatcggagagttcgcctggcgagttcagtgtgtctgtcaattacggcgatcaagtgcagcactttaaggttttaagggaagcttcaggaaagtatttcctatgggaggagaagttcaactcattgaacgagctagtggatttttacaggactactaccatcgcaaaaaagagacagatcttcctgcgagatgaggagccgcttctgaagagccccggagcatgttttgcacaggcccagtttgatttctctgcgcaggacccctcccagctgtcctttagacggggagatattattgaggtgctcgaacgtcctgacccacactggtggaggggaaggagctgtggcagagtcgggttcttcccacgatcctacgttcagccagtccatctgtag

SEQ ID NO: 56690 - DNA, 123 bp, Artificial Sequence
  Description of Artificial Sequence: Synthetic coding sequence
atgttactcagggagataacctacagcattactccactgtcacttcacggcacttcactcctgaactgcaattggagggctacaggtctcgtaacgcttgagggccatcggccattccaatag

SEQ ID NO: 56691 - DNA, 801 bp, Artificial Sequence
  Description of Artificial Sequence: Synthetic coding sequence
atggtgctgtccggagcacaggcccagatggatcagaacccaggctattaccaccagctgcttcagggcgaacgaaatccccgactcgaagatgcgattcgtaccgatctcaatcgcaccttcccggataacgtgaaatttcgcaagaccactgacccatgtctgcagcgcaccctctacaatgtcttgttggcctacggtcaccataaccagggagtaggctactgccagggaatgaattttattgcagggtatctgattttgataaccaataacgaggaggagtcattctggctcctggatgccctggtgggcaggattcttccagactactattcccccgctatgctgggcctcaagaccgaccaggaagtgctcggagaattagtgagagccaaacttccagccgtcggagccttgatggaacgtctgggtgttctatggactctgctcgtctcacgatggttcatatgtttgtttgttgacattctccccgtcgaaaccgttctacgaatctgggactgcctgtttaatgaaggttctaagataatctttcgcgtggccctaactcttatcaagcagcatcaggaattgatcctagaggcgacctcggtgcctgatatctgcgacaaattcaagcagatcacaaaaggtagtttcgtaatggagtgtcacactttcatgcaagtatgtggcgcagcacgcggtagcgtgccctcacaaggcgcaccaccccatctgcagcccggaggatgtagcgaccatcccgaaggtgcgcaggacggacatcaatgggcttag

SEQ ID NO: 56692 - DNA, 1035 bp, Artificial Sequence
  Description of Artificial Sequence: Synthetic coding sequence
atgcagcctgccgagcgtagcagggtgcccaggattgacccatatggctttgagagaccggaggacttcgacgatgccgcttacgaaaaatttttctcaagctacctggtgacactcaccagacgcgctatcaagtggagtcggctcctccaaggtgggggagtcccacgctcgcggactgtcaagaggtacgtgagaaagggcgtgcctctcgaacacagggctcgggtttggatggtgctatccggtgcacaggcccagatggaccagaaccccggatactaccatcagctgttgcagggggaaagaaatccacgcctcgaagacgccatcaggaccgacctgaatcgcacttttcctgacaacgtaaagttccggaagactaccgatccctgtctccaacgaactctttataacgtgttgttagcctatggccaccacaatcaaggagttgggtattgtcaggggatgaatttcatagccggttatcttatcttgatcaccaataatgaggaggagagcttctggttacttgacgcactggtgggacggattcttccggattactattcccccgctatgctggggttgaaaacagaccaggaagtcttaggggagttagtgagggcaaagctgcccgctgtgggggctctcatggagcggctgggcgtactgtggactttattggtgtcgagatggttcatttgcctgttcgtcgacatcctgccagtggagactgtcctgcggatttgggattgtctgttcaatgagggtagcaagattatatttagagtcgcccttactctcattaagcagcatcaggagctgatactggaggccaccagtgtacccgatatctgcgataagttcaaacaaatcacgaaaggaagctttgtcatggaatgccacacatttatgcaggtgtgtggagcagccagaggcagcgtgccatctcagggcgctccccctcacttgcagcccggagggtgcagcgaccatccagagggagctcaagacgggcatcagtgggcgtag

SEQ ID NO: 56693 - DNA, 1011 bp, Artificial Sequence
  Description of Artificial Sequence: Synthetic coding sequence
atgcaacccgctgaacggagtcgagtgcctcgcattgacccttatggcttcgagcgaccagaagactttgatgacgccgcttacgaaaaatttttctctagctacttggtcacactcacgcgacgtgcaataaaatggagccggctgctgcaagggggtggagtgcctagaagccgcactgtcaaaaggtacgtgcggaagggtgtgcctctggaacatagggccagggtctggatggttctcagtggagcacaggctcagatggaccagaatcctggctattatcatcagctgctgcagggggagcggaacccgagattggaggatgccattcgaaccgacctgaatcggacattccccgataacgtcaaattccgaaagacgaccgacccgtgcctgcagcgcacactgtacaacgtgctcctggcctacggccatcacaatcagggagtggggtattgccagggcatgaacttcattgcgggttacctcattctgatcacaaataacgaggaagagagcttctggttacttgatgcccttgtaggacgcatcctgcctgactattacagccccgcaatgttaggactgaagaccgatcaagaagtgctcggagaactcgtgcgcgcaaaacttcccgctgtaggggcactgatggagcgcctcggcgtcctatggactctcctggtgagtcgctggtttatttgcctctttgtcgacattttgccagtggagactgtgctccgcatatgggattgcctatttaatgaaggctcgaagattatcttcagagtggccttgactttgatcaagcagcaccaggaattgatattggaagctaccagcgttccagacatatgcgataagttcaagcagattacaaagggctccttcgtgatggagtgtcacactttcatgcagaaaattttttccgaacccggatctttatcaatggctactgtcgcaaaattacgcgaatcttgtcgcgcaagattgctggcccaaggctag

SEQ ID NO: 56694 - DNA, 3654 bp, Artificial Sequence
  Description of Artificial Sequence: Synthetic coding sequence
atgaagggaatgtcacatgaacctaaaagcccttcattagggatgctctccactgctaccaggacaaccgccaccgtgaaccccttaactcctagcccgctgaatggggcacttgtgccatccggctctcccgcaaccagctccgccttaagtgcacaagccgcaccatccagttcattcgctgcagcacttcgcaaactggccaagcaagctgaggagccaaggggttccagtctgtcctctgagagcagccccgtttctagtccagccaccaaccattcgtccccggctagcactccaaaaagggttccaatgggcccaatcatcgtgcccccaggcggacacagcgtaccatctacccctccggttgtgacaattgcaccgacaaagaccgtgaatggagtctggcggagcgagtccagacaggatgccggaagccgctcaagcagtggaggacgggagcgcctgatcgtagaacccccactgccgcaagaaaaggctggtggcccagccatcccaagccaccttctcagcacaccctatccatttggcttgagcccttccagtgtcgttcaggattctcgttttccacccttgaatttgcagcgcccagtgcatcatgtggtgccaccatccactgtcacagaggactatctccgcagcttccgaccctatcacacgaccgatgacctgcgaatgtcctctctcccccctctgggtttagatccagccacagctgcagcctactaccacccctcttacctggccccacacccttttccccacccggctttcagaatggatgacagctactgtttgagcgctctgaggtcccccttttaccctatccccacacctgggagccttcctcccttacatccttccgcaatgcacctacatctctccggcgtaagatatcctcccgaactaagtcactcctctctcgcagctctgcactccgaaagaatgtctggactgagcgccgagaggttacaaatggacgaagagctgcggcgtgaaagggaacgcgaaagagagagggagcgcgaacgagaggcagaccgtgagagggaaaaagaaagggagcgtgagagagagaaggaacgcgagcaggaaaaggaaagagaacgggaaaaagaacgtgaaagggaactggagagacagagggagcagcgggcaagggagaaggaactgctagctgcaaaagctctcgaaccgagcttcctccctgtagcagaactgcacggtctccggggtcatgcaacagaggagcgcggtaagcccagcgagcaactcacccctacgcgggcagagaagcttaaggatgccggattgcaggctcccaagcccgtacaacatccacttcatcctgtcccaacgcctcaccatacagtgcccagcctcatctctaaccacgggatattttccctgccatcaagctctgcggctactgccttgctgattcagcggaccaatgaggaagagaaatggctcgccaggcagagaaggttaaggcaggagaaagaggaccgccagtcccaggttagcgagttcagacagcaggtcctcgaacagcacctcgacatgggacgtccgccagtgccagctgaagcagagcaccgccctgagagtaccacacgaccagggcctaataggcacgagccagggggaagggatccaccgcagcattttggcggacccccaccgttaatctccccaaagccccagctgcatgccgcaccgaccgccctctggaatccggtgagcctgatggataataccctggagacacggcgagctgaaagccactccttgcattctcaccctgccgcattcgagccatcccgccaggctgccgtgcctctggtaaaggtggagcgggtgttttgccctgagaaagccgaggaggggcctcgaaaaagagagccagcccctctcgataaatatcaaccaccaccccctccgcctcgagagggagggagtctcgagcaccagccctttctccccggtccaggcccttttctagccgagctagaaaagagtacccagaccatactcgggcagcagcgtgcatctcttccccaggcagccacttttggagaattgtctggacccctcaaacccggatcaccttatcgacctcccgttccacgcgctccggacccagcttatatctatgatgagtttctgcagcagagaaggcggctggtatctaagttagacctggaggagcgtcggcgacgcgaggcccaggagaaaggctattactacgacttggacgactcctatgacgagtctgatgaagaggaagttagagcacacctgagatgtgtggccgaacagcctccacttaagctggatacttccagcgagaaattagaatttctccaactttttggcttgaccacgcagcagcaaaaagaggagctggtggcccaaaaacgccgaaaacgcaggcggatgctgcgcgaacgttccccctcccctcccaccatccagagcaagcggcaaacaccctctccacgacttgccttgtcaaccagatactcaccagatgagatgaataactccccaaattttgaagaaaagaaaaaatttctgacaatttttaatcttacacatatatccgctgaaaagcgcaaagataaagagcgactcgtggaaatgctgagggcaatgaagcagaaggcattgtccgccgctgttgccgactcactaacaaacagccccagagactcccctgccgtgagtctttctgaaccagccactcagcaggccagtctcgacgtggagaagccagtcggcgtggcagcctccctcagcgacataccaaaggccgctgagcccggaaagctagaacaggtccgccctcaagagctttcaagagtgcaggagctggccccagcatccggagaaaaggcccgattatcagaagccccaggcggtaaaaagtccctgtcaatgctccactacattcggggagcagccccaaaagatattcccgtgcctcttagccacagtactaatggcaaatccaaaccttgggagcctttcgttgccgaggaattcgctcaccagttccacgaaagcgtcttgcaatctacacagaaagccctacagaagcataagggctccgtggcggtcctatcggctgagcagaaccataaggtggacacctcagtacactataatatccctgagttgcagtcctccagccgagcccctccacctcaacacaacggacagcaggagccgccaaccgcccgaaagggtcccccaacacaggaactggaccgggattctgaagaggaggaagaggaggacgatgaggatggtgaggacgaggaggaagtgccaaaacggaagtggcagggtattgaggcggtttttgaagcctaccaggagcatattgaggagcagaatctggaacggcaggtgttacagacgcagtgtcggaggctggaagctcgccactattcactgtccctgactgctgagcagctttcacactccgtggcagagcttagatctcagaaacagaagatggtttccgaacgcgagcgcctacaagctgagctggatcatctccgcaaatgcctagcgctgcccgcaatgcattggcctagggggtatctgaaaggttatccccgatag

SEQ ID NO: 56695 - DNA, 3342 bp, Artificial Sequence
  Description of Artificial Sequence: Synthetic coding sequence
atgggcccaatcattgtgcctcctgggggacactccgtcccatcaactcctcctgtcgtcactatagctccaactaagacagtaaatggcgtctggagaagcgaatcgcgacaggatgcaggatcccgcagcagctcaggcggaagggaaagactcatcgtggagccccctctgccccaggagaaggctggtggtcctgctattccctcccaccttctgagcacaccgtatccctttggactatccccatcttcggttgtgcaggactccagatttcctcccctcaatcttcaacgaccggtgcatcacgtggtgcctccctctacggtcacggaggactatctgcgcagctttcgcccttaccacaccaccgatgatctacggatgtcaagcctccctcctttggggctcgacccggctactgcagcagcctactaccatcccagctatctggctccacacccgtttccccaccccgcattccgaatggacgacagttactgcctttcggccttgcggtcgccgttctatcctataccgacaccagggtcccttccaccgctgcacccatcggccatgcacctgcacctgagcggggtgcgctatccccctgaactctcgcactcttctcttgcagccctccattctgaaaggatgtccggattatccgccgagcggctacagatggacgaggagctgaggcgtgagagggaaagagagagagaaagggaaagagagcgagaagccgatagagaacgcgaaaaggagagagagagggaacgtgaaaaggagcgcgagcaagaaaaggagcgtgagcgcgagaaagaacgggagagagaattggagcggcagcgcgagcaacgcgctcgcgagaaagaacttctggccgcaaaggcactggagccctctttccttccagtggccgagctccatggcttgcgtggacatgccacagaggaacgtggaaagccaagcgagcagctcacaccaacaagagcagaaaagctgaaggacgctggcttgcaagctcctaagccagttcagcatcctctgcatccggtgccaacgccccaccacaccgtacctagtctcatctcaaaccacggcatctttagcctgcccagtagctcagccgctaccgctctccttattcagcgtaccaacgaggaagagaaatggcttgcccgtcaacggagacttagacaggagaaagaggacagacagtcacaggtgtctgaattcaggcaacaagtgctggagcagcatctcgatatgggcaggcctcctgtgcctgctgaggcggagcatcgccctgagtcgacaactaggcctgggccaaaccgccacgaaccgggaggccgagaccccccacaacactttggaggccctccacccctcatctccccaaaacctcaattacacgccgcacctactgctttatggaacccagtctccttgatggacaataccctagagaccaggcgagctgaatctcacagcttgcatagtcaccctgcagccttcgaaccaagtcgccaagccgctgttccccttgtcaaggtggaaagggtgttttgccccgagaaggctgaagagggaccgcgaaagcgcgagccggcacccttggacaaataccagcccccacctccaccccctcgtgagggcggtagcctggaacaccagccatttctgcctggtccagggccttttctagcagaactcgagaagtcaacgcaaacaattttaggacagcaacgggcttccctaccgcaggcagctacgttcggcgaattgtcaggccctctgaagccaggaagcccctaccggccacccgtgccgagagcccctgatcccgcatatatttacgatgaattccttcagcagcggagacgcctcgtatcgaagttagatttggaggagcgtcggaggcgagaagctcaggaaaaaggatactattatgatctagacgactcttacgacgaatcagacgaagaggaagtacgggctcatctgcgatgcgtagccgagcagccgcctctcaagcttgacacatcaagtgaaaaactagagttccttcagttgtttgggctgacgactcagcagcaaaaggaagaattggtggcccagaaaagaaggaagaggcggaggatgctacgggaacgctctccctctcctccaacaatccaaagcaagcggcagactcccagccccagactcgcccttagcactcgctacagccccgatgagatgaacaactcacccaactttgaggagaaaaaaaaatttctgactattttcaatctcactcatattagcgcagaaaaaaggaaggacaaggagagattggtcgagatgcttcgggctatgaagcagaaggcactgagcgctgccgtggctgacagcctgacaaattcgcccagagacagcccagccgtctccctcagtgaaccagcaactcagcaggcctccctcgatgtagagaaacccgtcggggttgccgctagcctgtcggatattccaaaagcggctgagcccggtaaactggagcaagtgcgaccacaagaactcagccgggtgcaagagctggctcctgcatccggagagaaggccagactgagcgaagctccaggcggaaagaagtccctcagcatgctgcactatatcagaggtgctgcaccgaaagatatccccgtgccccttagtcacagtacaaacggtaaatccaaaccctgggagcctttcgtcgccgaggagtttgctcaccagttccatgaaagcgtgcttcagagcacacagaaagctctgcagaagcacaaaggttcggttgcggtgttgtccgctgagcagaaccataaggtggatacaagcgtccattataacattccggagctacagtcaagttccagagccccaccgccacagcacaacggacaacaagagccgcctaccgctaggaagggtcccccaactcaggaacttgatcgagatagtgaggaggaagaggaagaggacgatgaagacggggaggacgaagaggaggttcccaaaagaaaatggcagggaattgaggctgtgttcgaagcctaccaagagcatattgaagagcagaacctcgaacggcaggtgctgcaaacccagtgccggagattagaggcccgacattattctttgagtttaacagctgaacagcttagtcacagcgtggccgaattgagaagccaaaaacagaagatggtgtcagagcgcgagcgactccaggcagagctggatcatctgcgtaagtgtctggccctcccagccatgcattggccaaggggctaccttaaaggctacccccgatag

SEQ ID NO: 56696 - DNA, 2463 bp, Artificial Sequence
  Description of Artificial Sequence: Synthetic coding sequence
atggtggttgacttctgtaggcgattcgtggcacgcagtctatgcattatcttaatgaaacatttctgcagttcttctgtgagcgaagaccttggatgtagacgtggcgatttctcaaggaaacactatggttccgtggagctgttgatctcctcagacgcagacggagccatccagcgggctggtagattccgcgtcgagaacggctccagtgacgaaaatgctactgctttgcccggaacgtggagacgtacagacgtgcacctggaaaaccctgagtaccataccagatggtatttcaagtacttcctgggacaggtgcaccaaaactacatagggaacgatgccgagaaatcacccttcttcctgtccgtaacgctctccgaccaaaataatcagcgcgtgccccaatacagagctatcctgtggaggaagaccggcacacaaaagatatgcctgccttactcaccaactaagactctgtccgtaaagtccattctgtccgccatgaatcttgataaatttgaaaagggcccaagggaaatattccaccccgagatacagaaagacctactcgtacttgaggaacaggagggttccgtcaattttaagtttggtgtgttatttgccaaagacggccagctcaccgacgatgaaatgttttctaacgaaatcggaagcgaaccgtttcagaagtttcttaatttgctcggagacacgatcaccttgaaaggctggactggctatcggggaggactggacaccaaaaatgacacgacaggtatccattcagtctacacggtttatcaagggcacgaaatcatgtttcacgttagcacgatgcttccttatagcaaggaaaacaagcagcaggtggagagaaaaaggcacataggaaacgatattgtgaccattgtgtttcaggagggtgaggagagcagtccagcattcaagccctcgatgatcaggagtcacttcacacacatattcgcactggttagatataatcaacagaacgacaactacaggcttaagattttctcagaggaaagtgttcctctgttcggaccgccactgccgacccctccagtctttaccgaccaccaggagtttagggactttcttctggtgaagctgataaacggggaaaaggccactttagagactcctaccttcgcgcagaagagaaggaggaccctggatatgctcatccggtcgctgcaccaggacctcatgccggacctgcataagaatatgctgaacaggcgttcattcagcgacgtcttgcccgagagccccaagagcgccaggaaaaaggaagaagctcgtcaggcagaatttgttagaatcggccaggccctcaaactaaaatctattgtgcgtggggacgccccttctagcctcgcagccagcgggatatgtaaaaaggagccatgggagccccagtgtttttgcagtaactttcctcacgaagccgtttgcgccgatccatggggccaggctctcctagtgagcactgacgctggagtcctcctggtcgatgacgacttgcctagcgtgcctgttttcgacaggaccctacctgtgaaacaaatgcacgtacttgaaaccctcgacctgcttgtgttgcgcgctgataagggaaaagatgcccgtctttttgtctttcggctgtccgcgctgcaaaaagggctggaaggaaagcaggcaggaaagtcaaggagcgactgtcgtgaaaacaagctggagaagaccaaagggtgtcatttatacgccatcaatacccatcattcaagggaactcaggatcgtggtcgccatccgaaataaactgctcctgataacacggaagcataataagccctctggggtgacatccacctctctgctatccccgctctccgaatccccagtggaagaatttcagtacatcagggagatctgcttaagtgactcaccaatggtaatgaccttagtggatggccctgctgaggagtccgacaacctgatttgtgttgcctatagacaccagtttgacgttgttaacgaatcgacaggtgaggcatttagactacaccatgtcgaggccaaccgagtgaatttcgtagccgctatcgacgtctacgaagacggggaggccggactgctgttatgctacaattattcctgtatttacaagaaagtttgtccgttcaatgggggatcctttctggttcagccgtccgcttcagactttcagttctgctggaatcaggctccctatgccatcgtttgtgcatttccgtatttgctagctttcaccacggattccatggagatacgattagtggttaacggaaacctggtgcacacagctgtggtccctcaactgcagttggtggcctccagagtcaagttcaaccagaagatatgcacaagatttcacctggagaccagctgggctgaggcttcaaacgacctttag

SEQ ID NO: 56697 - DNA, 3042 bp, Artificial Sequence
  Description of Artificial Sequence: Synthetic coding sequence
atggttgtcgacttctgtcgacgtttcgtggctagaagcttgtgtatcattctcatgaagcatttctgcagttcgtcggtgtctgaagatctgggctgtagaagaggagacttcagtaggaaacactacgggtccgttgaattgctaatctcatccgatgcagacggagcaatccagagggcagggcgttttagagttgagaacggctccagcgatgagaatgccactgccctgcctggcacttggcggaggacagacgtgcacctggagaatcctgaataccacaccagatggtacttcaagtactttctgggccaagtgcaccagaattacattgggaatgacgctgagaagagtcccttctttttgtctgtgacactgagcgatcaaaataatcagagggttccccagtaccgtgcaattctctggcgtaaaacaggaacccagaaaatatgcctaccgtacagccctactaaaaccctgagcgtgaagtccatccttagcgcaatgaatctggacaagtttgagaaagggcctcgagagattttccatcctgagatccagaaggacctcctggtattggaggaacaggagggctccgttaattttaagtttggcgtgctatttgccaaagatgggcaattaacagatgacgagatgtttagcaacgagatcggatctgaaccttttcagaagtttttgaacctgctgggcgacaccattacattgaagggttggaccggataccgcggtggtcttgacacaaagaacgacactactggcattcattcagtgtacacagtttaccagggtcacgaaatcatgtttcacgttagcaccatgcttccttatagtaaagaaaacaagcaacaagtggagagaaagaggcacatcggtaatgacatagtgactatcgtattccaggagggcgaagagtcctctccagcctttaaaccttctatgatcagaagccatttcactcacatcttcgcactcgtcaggtacaaccagcagaatgacaactatcggctcaagattttctctgaggaaagcgtccccctcttcggcccacctttacctacaccccctgtgtttactgatcatcaggagttccgcgatttcctcttggtgaagttgattaatggtgagaaggccactttagagacaccaaccttcgcccagaagcgccgaaggaccctggatatgctcatcagaagtctacatcaagaccttatgcctgacctccataaaaatatgttgaaccgacgcagcttctcagacgtcctgcctgaaagcccaaagagcgctaggaaaaaggaagaagcccgacaagcagagttcgtccgtataggccaggccttgaagcttaagtctatcgtgaggggcgatgctccatcctcactagcggcttcagggatctgtaaaaaggagccctgggagccccagtgcttctgcagcaatttcccgcatgaagcggtctgcgctgatccctggggccaggcgctcctggtatcaaccgacgctggcgtgctcctcgtggacgacgatctgccgagcgtgcctgttttcgatcgcacattacccgttaagcaaatgcacgtactggaaactttggaccttttagtgctgagagccgacaaagggaaagacgccaggctgttcgtgttccgcctgtctgccctgcagaaaggcctcgagggcaaacaggccggtaagagcaggtctgactgtagagagaacaaactggaaaagactaaaggctgccatctgtatgctatcaacacccaccattccagggaactacgaatcgtcgtggcgatccggaacaagctgctgttgattacgagaaaacacaataagcctagtggcgtaacctccacgtcacttctgtcacccctgtcagaatcccccgtggaagaatttcagtacatccgggaaatttgtctgtccgacagcccaatggtcatgactctggttgatggacccgctgaagagagcgacaatctgatctgtgtggcttatagacatcagttcgacgttgtgaacgagagcaccggcgaggcgtttcgcttgcaccacgtcgaggctaatagggtgaactttgtggccgctatcgatgtgtatgaagatggggaagccggtttgcttctgtgctacaactattcctgtatttataagaaggtgtgccccttcaatggcggttcctttctggttcagccttcggcttctgacttccagttttgctggaatcaagccccttacgccatcgtttgtgctttcccctaccttcttgcattcaccactgacagtatggagattcggctggtggttaacggcaacctggtgcacacagcagtggtgccccaactgcagctagtggctagtcggtccgacatctacttcactgccacggccgctgtcaatgaagtgtcatcggggggaagctctaaaggggcatcggccaggaattcacctcagaccccccctggacgggacacaccagtgtttcccagctctctgggagaaggcgaaatccagagcaaaaatctgtacaagattcccttgcgaaacttagtaggcaggtcaatcgaacggccactgaaatccccccttgtgagtaaagtgatcactccacccaccccaatttcggtgggcctggctgccattcccgtgacacattcgttgtcactgtcaaggatggagattaaagaaatcgctagcagaaccagacgcgaactcctcggcttatctgacgagggcggacccaagtctgaaggtgcgcctaaggccaaatctaagccgcgaaaaagactcgaggaatcccagggcggtccgaaacctggcgctgtccgcagcagttcctccgacagaatccccagcggctccctcgaatcagcctctacatccgaagctaatcctgaggggcactctgcctcatctgaccaggaccccgtggctgaccgagagggcagccctgtgagcggatcttccccgtttcaactgaccgccttcagcgacgaggatatcatcgacttgaaatag

SEQ ID NO: 56698 - DNA, 807 bp, Artificial Sequence
  Description of Artificial Sequence: Synthetic coding sequence
atggatcctttgaccaaggttccatgtgggtctcagatcgctcaaaccatactctggaaggcgaagtcttccttatcatttgggatccagccattgcaaacatggcctacgaaggatccagaacttgaatcccaagtaaatttgagcgtctctgaagatctgggatgtcgcaggggggacttttcgcgcaaacattacggcagcgtcgagctgctaataagctcagacgccgatggggcaatacagagagctggacgtttccgggtcgagaatggctccagcgacgagaatgcaactgcattgccgggtacatggagacgtacagatgtccacctcgagaacccggagtaccacacaagatggtatttcaagtattttctcggacaagtacatcagaattacatcgggaatgacgcagagaagagcccgttctttttgagcgtgacactttctgatcagaacaaccaaagagtgcctcaatatcgggcaatcctatggcgtaagacaggcacacagaagatttgccttccttacagccccactaaaacgctgtctgtaaaaagcatcctttcagccatgaacctggacaagtttgagaaaggacccagggagatcttccacccagagattcagaaggaccttttggtgctggaggaacaggagggtagcgtcaatttcaagtttggagtcctttttgccaaagacggtcagctgactgacgacgaaatgttcagtaatgagataggcagtgagccatttcagaaattcctaaaccttttgggcgatacaattactttaaaagggtag

SEQ ID NO: 56699 - DNA, 2976 bp, Artificial Sequence
  Description of Artificial Sequence: Synthetic coding sequence
atgaagagcagcgtctccgaagacctcggctgcaggcggggagatttttcccgtaagcactacggctccgttgaactgctgatttcatccgatgctgacggcgctatccagcgagccggtcggtttagggtggaaaatgggagcagcgatgaaaacgcaaccgccctgcctggcacttggaggcgaaccgatgtgcacctcgagaatccggagtatcacacccgatggtattttaagtactttttgggccaggtgcaccagaactatataggaaacgacgccgagaagtcaccttttttcctttcagtgaccctgagtgatcagaataatcagagagtccctcagtatcgggctattctttggaggaaaacaggcacccagaagatatgtctcccttactctccaacgaagactttgagtgttaagtctattttaagcgccatgaatttggacaagttcgaaaaagggcctagggaaatcttccacccagaaatccaaaaagaccttctggtgctggaagaacaggaaggctccgtcaatttcaagttcggcgtgctctttgccaaagacggccagttgaccgacgacgaaatgttcagcaacgaaatagggtccgaaccctttcaaaagtttctcaacctcctgggggacacaattacattgaagggctggactggatatcgaggaggactggacactaaaaacgacactaccggtattcatagcgtttatacagtgtatcagggacatgagattatgttccatgttagtaccatgctgccctactctaaagaaaacaaacaacaagttgagaggaaaaggcatatcggcaacgatattgtgacgatcgtattccaggagggcgaggagtccagccctgcatttaagccctcgatgattagatcgcactttacgcatatcttcgcgctggtgcgctataaccagcagaacgataattaccggctgaagattttctcagaggagtctgtccccctattcggtcctccactccccacacctcctgtttttaccgaccatcaggagtttcgtgactttctgctggtcaagctcattaacggggagaaggcgaccctggagacgccaacttttgctcagaagagacgccgtactctcgacatgttaatcagaagcctccatcaggacctcatgcccgacctccataagaacatgcttaaccgaagaagctttagtgacgtgctgcctgagtcccctaagagcgctcgaaaaaaggaagaagcgcgacaggccgaattcgttaggattggtcaggcactgaagttgaagtccatcgttcggggagatgcaccctcctcattggctgctagtggcatctgtaagaaggagccttgggagccccagtgtttctgcagcaactttccacatgaagcagtatgcgcggatccctggggacaggcgctgctggtgtccactgatgcaggcgtcttgcttgtggacgacgatctgccctccgtgccagtattcgaccgcacattgcctgtgaaacaaatgcacgtattggagactctggacttgctggttcttagagctgacaaaggaaaggatgctagactttttgtgttccggctctcagcccttcagaaagggcttgaaggcaaacaggctggcaaatcgcgctcggactgtcgagagaataagctggagaagactaagggatgccatctgtacgctattaatacccaccactctcgggaactgaggatagtggttgcgattcggaataaattgctactgattacccgcaagcataacaagccctccggagtgacaagtacaagcctcctgagcccgctgtcagaatcaccagtcgaagagttccagtatatcagagaaatatgcctgtcagactcccccatggtaatgacactggttgatggccctgctgaagaaagcgacaacctcatctgtgtcgcctacaggcatcagttcgacgtggttaatgagtctactggtgaggcctttagactgcaccatgtcgaggccaacagagtcaactttgtggccgctattgacgtctatgaagacggcgaagccggtctcctgctgtgttacaactactcatgcatttacaagaaagtctgtcccttcaacggaggatcctttttggttcagccatcagcctccgacttccagttctgctggaaccaggctccctacgctattgtgtgtgccttcccttacctgctagccttcactactgactcaatggaaatacggctggtcgtgaatggcaatctcgttcacaccgctgttgtgccccagctgcagctggtggcctctagaagcgacatctacttcactgccacagcagccgtgaacgaagtttcttctggaggctcaagcaagggggctagtgctcggaattctccacagaccccccctggaagagacacaccagtgtttccaagctctttgggggaaggagagatccagtctaagaatttgtacaagattcctctgcggaacttggtaggtagatctattgaacggccactgaaaagccccctggtgagtaaggtgattactcctcccacacctatatctgtgggtctggccgctattccagttacacactccctgagcctgtccagaatggagattaaggaaatagctagtcgcacgaggcgggaactgctgggactttctgatgaaggtgggcctaaaagtgaaggcgctcctaaagcaaaaagcaagccacgcaagaggcttgaggagagtcaaggtggtcccaagccaggagctgttcggagcagcagcagcgaccgaatcccatcaggctcacttgaaagtgctagcacctctgaggctaatcccgaaggccactctgctagctcggaccaggatccagtcgcggatcgggagggatccccagtgtccgggtctagtcctttccagttgactgcattttctgacgaggatataattgacctcaagtag

SEQ ID NO: 56700 - DNA, 807 bp, Artificial Sequence
  Description of Artificial Sequence: Synthetic coding sequence
atggacccacttactaaggtcccatgtggctcgcaaattgcccaaaccatcctgtggaaggccaagtctagcctctctttcggcatccaaccccttcagacctggccgacgaaagatccggagctcgaatcccaggtcaatctttccgttagtgaggacctgggatgtcgcagaggcgacttttctcgaaaacactacggcagcgtggaattactgatcagctctgacgcagacggtgctatccagagggccggaaggttccgcgttgagaacggcagctctgatgagaacgctactgctctccctggaacttggaggcgcactgacgtccatttagagaacccagaatatcacacgcgatggtacttcaagtatttcttgggacaggttcatcagaactacatcggcaatgatgccgagaaatcaccctttttcctgtcggtgaccctgtctgaccagaataaccagcgggtcccacagtatagggcgatcctgtggcgcaagactggcacccagaagatctgtctgccttacagccctactaaaaccttgagtgtcaagtctattctcagcgcaatgaatctggacaaatttgagaaaggtccgagagaaatcttccaccctgagattcagaaagatctgcttgtgctcgaggagcaggagggaagcgtaaactttaagttcggcgtgcttttcgccaaagacggtcagcttacggacgacgagatgttttcaaacgagatcggcagcgaaccattccagaaattcctcaatctgctcggagatacaataactctgaagggatag

SEQ ID NO: 56701 - DNA, 903 bp, Artificial Sequence
  Description of Artificial Sequence: Synthetic coding sequence
atggccgagtctgaggaccgatctctgagaatcgtccttgtgggaaaaactgggtccgggaaatccgcaacagccaacactattctgggcgaggagatcttcgacagtcgcatcgccgcacaggctgtgaccaagaactgtcaaaaagccagccgagagtggcagggccgagatctactagttgttgacacaccaggactattcgacacgaaggaatccttggacaccacctgcaaagaaatctctaggtgtatcatctccagttgtcctgggccacatgccatcgtgctggtgctgctcctcggcagatataccgaagaggaacagaaaactgtcgccctgataaaagccgtcttcggcaaatcagcaatgaagcacatggtgatcctttttacccggaaagaggagttggagggccagtccttccatgacttcattgccgacgccgacgtcggcctcaagagcatcgttaaggagtgtggcaatagatgctgtgccttcagtaattctaagaagacctcaaaagcagaaaaggagtcccaggtgcaggagcttgtggagctgatcgaaaaaatggtgcagtgtaatgagggcgcttacttctccgatgacatttataaagacactgaggaacgcctaaaacagcgcgaggaggtcctgaggaaaatctacacagaccagttgaatgaggagattaagctggtcgaggaggacaaacacaagtctgaggaggagaaggaaaaggagatcaagcttcttaaactgaaatacgacgagaaaataaaaaacatcagggaagaggccgagaggaacattttcaaagatgtgttcaatagaatttggaagatgctctcagagatctggcacagattcctcagtaaatgcaagttttactctagctag

SEQ ID NO: 56702 - DNA, 207 bp, Artificial Sequence
  Description of Artificial Sequence: Synthetic coding sequence
atgagcgggttttcaagcgtagccgcaacaaaaaaagttgtgcagcaactgcaactggaggcaggactcaattccgtcaaggtctcccaggcagctgccgatctcaagcagttctgtttgcagaacgcccagcacgacccgctcctgactggcgtctcatctagtactaacccattcaggccacagaaggtttgcagctttctctag

SEQ ID NO: 56703 - DNA, 1569 bp, Artificial Sequence
  Description of Artificial Sequence: Synthetic coding sequence
atggtaagatctgggaagaacggtgaccttcacctgaaacagatcgcctattacaagcgtacaggtgagtaccactccacaaccctgccatcagaaagatcggggatcagacgtgctgccaaaaaattcgtgtttaaggaaaagaagctgttttatgtcggaaaggacaggaagcagaaccggctggtcatcgtatctgaagaggagaaaaagaaagtgttgcgggagtgtcacgagaacgactccggagcccatcacggcatctcaagaacgctgaccctcgttgaatccaactactattggacatccgttaccaacgacgtcaagcaatgggtgtatgcgtgccagcactgccaagtggctaagaacacggttattgtagctcccaaacaacacctattgaaggtggagaatccttggagtcttgtgaccgtagatctgatgggcccttttcatacgtcaaatcgctcccatgtgtacgctatcattatgacagacctttttacgaagtggatcgttatcctgccgttgtgtgatgtatctgccagtgaagtctcaaaagcaattattaatatattcttcctctatgggccaccacagaagataatcatggatcaacgggacgagttcattcagcagatcaacatagagctgtataggctgtttgggatcaagcaaatcgttataagtcataccagcgggacagtgaaccctactgaatccacccccaatactataaaggcatttctgagcaagcactgcgccgaccatccaaataactgggatgatcacttaagtgctgttagttttgccttcaacgttacacaccttgaaccaacaaagaatacaccatacttccagatgttcagtcggaacccatacatgcctgaaacttccgattccctgcatgaggtggatggggataatacgtccatgtttgccaaaatattggacgcaataaaggaggccgataaaataatggaaaataagacaacatcccttgggcagatggagaataacaacctggatgagctgaataagagcaagatcatcgtcaagaaaaaaccaaagcagctgaatcctttccacctgaaggttggacatgaagtgctccggcagcgcaagaattggtggaaagatgggagattccagtcagagtgggtgggcccatgtgtcatagattacattacagagtccggttgtgcggtgctgagagataacaccggcgtccggctcaaaagacctataaaaatgtctcacctcaagccgtacatacgagagagctcagagcaggaatccctgtatttgctgcaaggatcagtggtggctgatcacgactatatcgggttgccggagatcccaatcggggcttaccaggctaatattctggtggaagatgcaactatcggcattgttgacaatgagcttctgacttcatcaaaggacagagagttgctggagtatcgcaacactaagatcagtcctcttatcgatgaccattccagcttagaaaaacaaaccttctctcttctggactcatccaatcaggtgctggagtatctttcatag

SEQ ID NO: 56704 - DNA, 669 bp, Artificial Sequence
  Description of Artificial Sequence: Synthetic coding sequence
atggtccgatccgggaagaatggcgacctccacctgaagcagatagcctattacaaaagaactggcgaatatcattccacaaccctgcctagcgaaagaagtgggattagaagggcagctaagaagttcgtgttcaaggagaagaaacttttttacgtgggtaaggaccgaaaacagaacaggctggtgatcgtgtctgaagaagagaaaaaaaaagtcctgagggagtgccatgagaacgacagcggggcacaccacgggattagtcggaccctcaccctcgtggagtctaactattattggactagtgtgacgaacgatgtcaagcagtgggtttatgcatgccagcattgccaggtggctaaaaacacagttatcgtagcccctaagcaacacctcctgaaggttgaaaacccatggtcattagtcacagtggacctgatgggtcctttccacacttctaaccgaagtcacgtgtacgccattattatgaccgatctgttcactaagtggatcgtaattttacctctctgcgacgtctcagcctccgaggtctcgaaggctatcattaatattttcttcttgtatgggcctccccaaaagatcatcatggatcagagggacgagtttattcagcagaaagttttcataagttgtaaagttcagtag

SEQ ID NO: 56705 - DNA, 687 bp, Artificial Sequence
  Description of Artificial Sequence: Synthetic coding sequence
atggccgctcctccacagcccgtgacacatctaatatttgacatggatggcctgctgctagatacagagcgcctgtactcggtggtgtttcaggagatttgtaaccgctatgataaaaagtattcctgggacgtgaaatcactggttatgggtaagaaggcccttgaagcagctcagatcatcattgatgtgttacagctgccaatgagcaaggaggaactcgtggaggagtcacagacgaaattgaaagaggtgttccctactgctgcactaatgcccggagcggaaaaactgatcatacacctgagaaagcacgggataccctttgcccttgccaccagcagcggatcagcctcatttgatatgaaaacttcacgccataaagagttcttttcactgtttagccatatcgttttaggcgatgatccagaggttcaacacggcaaacccgatcctgacatattcctggcatgcgctaaaagattttctccgcctcccgctatggagaaatgcctcgtctttgaagatgccccaaatggtgttgaagccgcactagctgccggtatgcaggtggtgatggtgcctgacggcaacttgtcaagggacttaaccactaaagccaccctagtcctgaatagcctccaagactttcaacctgagctcttcggcctgccatcctacgagtag

SEQ ID NO: 56706 - DNA, 756 bp, Artificial Sequence
  Description of Artificial Sequence: Synthetic coding sequence
atggccgctccgcctcaacccgttacccacctgatcttcgacatggatggcctgctgttgggctataccgggtctatcgtggccgcagcctccggcgagagcagtcgcggtctgcagagtaggtggacagatactgagcgtctgtattcggtggtcttccaggaaatctgtaatagatatgataagaaatactcatgggacgtaaaatcattagtaatggggaagaaggcgctggaggctgcccaaatcatcattgatgtgctccagttgccgatgtcgaaagaagagttagtggaagaatcacagaccaaattgaaggaagtctttccaacggctgccttgatgcccggtgctgagaaactgatcattcacttgcgaaagcacgggataccatttgccttagccacctctagcgggtcagcttcattcgatatgaaaacctcgagacataaagaattcttcagcctcttcagtcacattgtcctgggcgatgacccagaagtacaacacggaaaacctgatccagacatctttttggcatgcgctaaacggttttcaccacctcctgccatggaaaagtgtcttgtgttcgaggacgcgcctaatggggtagaagcggctctagctgctggaatgcaagtggttatggtgcccgacggcaacctgtctagagatctcacaaccaaagcaacattagtgctcaacagccttcaggatttccaacccgaactgttcgggctgccctcctatgagtag

SEQ ID NO: 56707 - DNA, 627 bp, Artificial Sequence
  Description of Artificial Sequence: Synthetic coding sequence
atggcagcaccgcctcaaccagtaacacacctcattttcgacatggacgggctgctgctggataccgagcggctgtattcagtcgtctttcaggagatttgcaatagatacgataaaaagtactcatgggacgtcaagagcctggtcatggggaagaaagcactcgaagcagcacaaatcattatcgatgtcctgcagctgcccatgtcaaaggaagagcttgttgaggaatcccaaacaaaacttaaagaagtgtttcctacagctgcccttatgccaggagccgagaaactgatcatccaccttcggaaacatgggattccctttgcactggcgacttcatcaggttctgcgtctttcgacatgaagacatcccggcacaaggaattcttttcactgttttcccacatcgtgctcggggatgacccagaggttcagcacgggaaaccggaccccgatatctttctcgcttgcgctaagaggttctcgccaccacctgccatggaaaaatcctctattcaccgacctaggctgctaaccgcccaaaaatgtcagggatgccgtgaccctttttcagctctgcttttactctgtaaccagcttctgctgtgctcggacgatacctag

SEQ ID NO: 56708 - DNA, 735 bp, Artificial Sequence
  Description of Artificial Sequence: Synthetic coding sequence
atggccgctccaccccagcctgtgactcacctgatctttgacggcaggacaagtagcggttgggtcgtggccgctgcatcaggtagaagttgtgtgggtgtgggaaccgatacggagagactttattccgtcgtattccaggagatttgcaacaggtacgacaagaagtacagctgggatgtgaagtcattggttatggggaaaaaagctttagaggccgctcagatcattatcgatgtcctccagcttcctatgtcaaaggaagagcttgtagaagagagtcagaccaagcttaaagaggtgtttcccacggcggctctcatgcctggtgccgagaagctgataatccacctgaggaagcatggcataccctttgcccttgccacgtcctctggaagtgcgagcttcgatatgaagacctctcgtcacaaggagttcttcagcctcttttctcatatcgtgctgggtgacgaccccgaagtccagcacgggaagcccgatcctgacatctttctggcctgcgccaaacggttctctcctccccctgccatggagaagtgccttgtttttgaagatgcacccaatggcgtggaggctgctctagcagcaggcatgcaggtcgtgatggtgcccgacggcaacctgagcagagacctgacaaccaaagcaactcttgtgctgaattccctgcaggattttcagcctgagctcttcgggcttccctcgtacgagtag

SEQ ID NO: 56709 - DNA, 558 bp, Artificial Sequence
  Description of Artificial Sequence: Synthetic coding sequence
atggccgcaccgccacagcctgttacacatctcatctttgacatggatgggctccttctcgatacagaaaggttgtatagcgtagtatttcaggaaatttgtaaccggtacgacaaaaaatacagttgggacgtgaaatcgctggtgatgggagcagagaagcttatcatccacctccgcaagcacggcatcccgtttgcccttgccacctcctctggctcggcaagttttgatatgaaaacgtccagacataaggaattcttttccctgttcagtcacatagtcctcggagacgaccccgaagtacagcacggaaagcccgatccagatatcttcctggcttgcgctaagcgatttagcccccctcctgctatggaaaaatgcctcgtcttcgaggacgcgcctaatggtgtcgaagccgcactggcggctggtatgcaggtggtgatggtcccagacggcaatttgtcaagagacctgaccacaaaagcgaccttggtccttaactccctgcaggattttcagcccgagttgttcggcttgccatcctacgaatag

SEQ ID NO: 56710 - DNA, 780 bp, Artificial Sequence
  Description of Artificial Sequence: Synthetic coding sequence
atggctgcatgccgcgctctgaaggctgtgctggtagatctttccggtactttgcacattgaagacgctgctgtgcctggagcacaagaagccctgaagcgattaaggggcgcttcagtgatcatccgatttgttactaatacgactaaggagtccaaacaggacctcctcgagagattaagaaagcttgagtttgacattagcgaggatgagatcttcaccagcttaactgcagcaaggagtctacttgaaagaaagcaagtgaggcccatgctcttagtcgatgacagagctctccccgatttcaaaggaattcagacttccgacccaaacgccgtggttatgggattagcccctgagcatttccattaccagatcttgaaccaggctttccgcctgctcctcgatggcgctccattgattgcgatccacaaagctcgttattacaaacgtaaggacggactggctctcgggccaggaccttttgtgacagccctggagtatgccacagacacaaaagctactgtagtgggcaagcctgaaaaaaccttctttttggaggccttacgcggaacagggtgtgagccagaagaggctgttatgattggggatgattgtcgggacgacgtcggaggagctcaagacgtcggcatgctcggtatcctggtgaagactgggaagtaccgggcttccgacgaggagaaaatcaaccctcccccttacctcacctgcgagtcatttcctcacgccgtggatcacattctgcaacatctgctatag

SEQ ID NO: 56711 - DNA, 132 bp, Artificial Sequence
  Description of Artificial Sequence: Synthetic coding sequence
atggcaatccccatcacagtgctggactgtgatttgctactgtatggtagaggccatagaacacttgataggttcaagctcgacgacgtaactgacgaatacttaatgtctatgtacggattcccacggtag

SEQ ID NO: 56712 - DNA, 255 bp, Artificial Sequence
  Description of Artificial Sequence: Synthetic coding sequence
atgaagcgggagcccaagaatctttcatcggagcaggtactaaagccgacatactcacaaagtaaaccaaacaggattagattgtattactggggtttgggtttgaacttaagggccgcagcgtccgaagccaatagaatggagtccaaaaaggtcggaaagcgcctcggcgctggcaaacagcaaatgggcgcagaactgacggaacagcacatggctcggatctcccttcctgcgaaaatccttggctattag

SEQ ID NO: 56713 - DNA, 180 bp, Artificial Sequence
  Description of Artificial Sequence: Synthetic coding sequence
atgcagaccgggggatgcgaacctaagcacaggcgaatgtgcccagatgattcctccgaaaacattatgaagtggaggacgttcctgcctgaggagcgtacagtaacccaggccggagatgtgactcacaccctgggttccaaaggaccaaaggccggagtgccgttcactggaccatag

SEQ ID NO: 56714 - DNA, 369 bp, Artificial Sequence
  Description of Artificial Sequence: Synthetic coding sequence
atggtagtggtagaaaaaggcgcaagtctcatgagccgagccagtttaatgccagctcaagcgagagcaccatttcagcgcttgcgggactgtcgaggaccagctgattcttcccacgcatttaagctgcaatgctttccttctcattgcaggaggcctccctgggtcatctcacgaaaaggacgggctattaataagtactctatatgcatttcatgcgttgccctacatctggaaatcagttttatatggcagctactgcagaatgagccaaatttggagggtgggttgggacggttcatgctcgcctcattgtcccttcaacaagtaatttctatcctggcgttcacaagagtgaaacaactgtag

SEQ ID NO: 56715 - DNA, 183 bp, Artificial Sequence
  Description of Artificial Sequence: Synthetic coding sequence
atggccctgccttgcggcatgggtaccgcctggtatctcgatagtacagagaatgcactgacagtgaatgttcccagagcacaaaaccacaaagccagtcacaactccatgtggaagctgggaagtcatttctattgcatcttactggtgaccaaggatcccccaggctttactatggtgtag

SEQ ID NO: 56716 - DNA, 393 bp, Artificial Sequence
  Description of Artificial Sequence: Synthetic coding sequence
atgagcctgtgctcactgttgtcaccacggagcggcttccgctgttgttgcgctgcacctccacctccagctcagccacatcaggaggcccagggtggactggtagagctgctcatgcacgctgcagcccgtaagacgctcttcaatttccccccagctccctcacgtgccagtccaggccatcgggttgcttgtcagcccgatcgtgctcgcaaaagtggatcatgggctgtcgcacagcgaaggagggagcaagaagaagctggggctcgtgcaggcgctgttgatccgctggggctcccgctggttagctctatctcatgtgtccagcattgtaatcttgctgcaggtgtccaaacaggcaggccccctgcctctagcacagactgctag

SEQ ID NO: 56717 - DNA, 162 bp, Artificial Sequence
  Description of Artificial Sequence: Synthetic coding sequence
gccacccaagaccttcaattcagaatacggcgaccgcgacctcctgcccgaggcagaggcggagagacgcgatcatgcgatctaggccgatgccatctgaagggacttgatttacttgaggcccgaactgccgaggaggatggtgaaagaaatgctagatag

SEQ ID NO: 56718 - DNA, 414 bp, Artificial Sequence
  Description of Artificial Sequence: Synthetic coding sequence
atgttccacttctttaggaaacccccagagagcaagaagccctctgtgccggagacagaggctgacggcttcgtgttgttaggggacacaactgacgaacagagaatgactgcccgtggcaagacttctgatatcgaggccaaccagcccctcgagaccaataaggagaattccagtagtgtgaccgtgagtgaccctgagatggaaaacaaagctggtcagactctcgaaaacagtagtctgatggccgagcttctcagtgacgtccccttcaccctcgcaccccatgtgctggccgtgcagggcaccattacagacctcccagaccatctgctgtcctacgatggcagcgagaacctttcgcggttttggtatgacttcacgctcgagaacagcgtcctgtgtgacagctag

SEQ ID NO: 56719 - DNA, 876 bp, Artificial Sequence
  Description of Artificial Sequence: Synthetic coding sequence
atgcccggtaagttgcttcccgagaaatgcgcattgatgtggctgcatttgggtacacgcgcacctcagagacccaagagggagtcccgtggatttccagggtggggctgccggacagggcaagctctgccgtgtcgagccaggcctcctgcacccgcacccagtcaccctagctcctcactatccctgactcccggacctggcagcccacgccagacaggccctccatgccagacagtcgccgcattgtacggcttaggggcttggcaaagtcactgtggaggcggtgtcgggtgccatggccagggccgacaaccattaggatgccagggttggtggagcactctgaacccgtatcttctcgagtccccaggccttttccacactagaagttgcgggaaactgtgggacccaaaggccgttttgattagcggcgtgacctctagccatagttctctggggagtcctggcaccagaccaggcgtatccctgtgtaaggaacttcccggatgttgggctgagttgtgctgccgcccacgcaagatgactaaaaaggacagggccgagccccacctgcccctgcttggcggacccgagggtgctcgggcacagcagtctcccatcctgcactccctgggaagtaagaggctgcctagatgcggctggcagctcctgacctcctcgggcggagctgcaggaggactctgccccatgggacatagacgggagaaagacggcggtagagtctgcaccctgggcagaacaggcggaagacaccgtcctgaacaggttgcctgggcccacgaaaagggcgtgagcgaaaccggctgcctgtcacagatgcccggtgtggatgaagccgacgaatggcagtag

SEQ ID NO: 56720 - DNA, 234 bp, Artificial Sequence
  Description of Artificial Sequence: Synthetic coding sequence
atgaaagccccaggccttgcccaggccgctgtagccgaggagactccggactgggctcccgaattgtgtccgagtagtgaggcacggtcgccggagccccctgccaatcgactgcaggatttcgatactttggtcacagtgggcaagcaactcgaggcaatctgtgtcaaaaaaaatgtggacctgttggcacgaatgcagcggagagagcgattattgatcaggtgttggtag

SEQ ID NO: 56721 - DNA, 414 bp, Artificial Sequence
  Description of Artificial Sequence: Synthetic coding sequence
atgactagccctctcgtgttcgcatccctctccccagatgcaatggccaaaatgttggagatggcggctttaaacgtgggcaccattcgaatctcacttaatacggagcccaggccccctgtgatcactcagctggccccttcgccagaaacactcccgttttgccctgaatggggagcggagaaccagagccgtcacttgaagttgccacccttttttatttgccggtgccgagggccactctaccaggaagagagcctctcagagatacactgtcacagtgggctttttctagatcagctttcgctccccactcctttcagttcactttcagtgtccttgatacattggacgttcatctccaccaagtacgtccctggaataatgttggcgttcgggggtacaaacaagtag

SEQ ID NO: 56722 - DNA, 141 bp, Artificial Sequence
  Description of Artificial Sequence: Synthetic coding sequence
cgtgaagggcatgcggatgggaacatccctgctggacccggtctgtgttcgcctcagctcttgctccccggagggcagttgttttgggctccagaagtcctccggagtccctttccgggtcctgggacaccatcagcctag

SEQ ID NO: 56723 - DNA, 444 bp, Artificial Sequence
  Description of Artificial Sequence: Synthetic coding sequence
atggggcttttgtcattgattctgtttctgggcgcaaaggttaccactgctaataagaccgacagctttctgttctcaactggtctcaccgtgttgagttctcctggtctgaagatgcgcgtgctgggttgccctccaactcccccacagctcactcaagggcatacctccgggtatgtagacctccataagggccctttcttgtctccaatgagacatcctcgagggcacacagggcctcagatcctgccccaggcttgggagcctatagggagacgagtgcgacagtgcagggggccacaaaccttcttgaaaggaccggaaagtaaatacttccgcctgtgtaggcctgatgtgctctgttgtaaaacacagttttgttactgctcttctaaggcagccatagacaactccgaggttaatgagtgtgtagtgtcccagtag

SEQ ID NO: 56724 - DNA, 84 bp, Artificial Sequence
  Description of Artificial Sequence: Synthetic coding sequence
gatattttgcagcacaaccatcctgtggtcggactattgcaagtgggaagcgaacacggtagcgaggaagctgccctctcctag

SEQ ID NO: 56725 - DNA, 555 bp, Artificial Sequence
  Description of Artificial Sequence: Synthetic coding sequence
atgccagtaaaaggagcctcttccttattgttcctgccactgcctccaagcgcatggcagctctgcctcctgagtaaacgaagagtacaccctatcagaacccctttgccctttcacagctggattaaggccctggtgatttctaaccagaaggtgccagagagggaaaggccagaaggaacaggagtcctgtctgatggatgcctggggcagtcccaggagggggaacctttgctctcccctcccgctctcgcacacttcccactgcatgcacgctgttgcggatcttcttgggcctggccgggaagcgccggtgaggctattagaatggtgtcaggggctcccttcctatgctttcttgacggtctggatggccttccctgctcgtccccaatggctgctctgcctgcccctatggctgccctgcccgctaggaggcagcgccaagaacacatcgagggaggcagccagggttgtggggtgaggtcccccgctccctgccggggtaagcccggatctgccacatcctctactctgaggctctgtcctgcctag

SEQ ID NO: 56726 - DNA, 417 bp, Artificial Sequence
  Description of Artificial Sequence: Synthetic coding sequence
atgctagagaagtggagagagaccgaggaagctagaggcctattgactcgcactcagccgactgccagtggcccaccttgctctcacgcccatagccagctcctgctggaccgacttaaaggcaacctggccaggcgcggaggcgtcggcagagccagcctggagactgtgctgtggcggccaggggaaaccgcattttatccacagcattggggcgagcaggcctcaattccagcattcgcctgtaggccttcaagctttcctttaaaagcctacccagcagcccctgccctgagaaatgccctcctctcatatcagctgtgggagcgccaggatcgcctggccagcggcagacgaggacgtcactgcctcccaagcgggccaggcccacacagataccctcagctgcaggactag

SEQ ID NO: 56727 - DNA, 429 bp, Artificial Sequence
  Description of Artificial Sequence: Synthetic coding sequence
atgggcctctaccacgtgggacaggctggtctggagctgctgacaagtagcgatccgcctacaagtgcgtctcagaatgcagagataacaggggtttcccacagagcccagagtaaagcccataatctccagcggaaattgcgccttagccacaagtcatctcccccatgcacctatacccagcatgccggaggtgtcgacagtcaccccctcacccaggatatgtgtgtgatcgtaaacgtgatcgcgaggccgtttgacaaatgtaactgcgatatttacttggggctcgctagtgagctctttgtggtatcttgggtgcaacttactgttccttaccactggatacaaacattgggtaacgtcatattgttctgcctggatacagcacaccggggacattgtgacattgccggacactgtacctag

SEQ ID NO: 56728 - DNA, 303 bp, Artificial Sequence
  Description of Artificial Sequence: Synthetic coding sequence
atgcgaccaaagcacctccagggcatagctccggaggtcttccgaaccccgacgggatcacacggccagatgcctggacagcccttgcaacgcggacacgcgctcgatatcaggccccctttgagaccacaccccctgattagcgggcatgccctcaggggagaccggtggcaaactccagctcttgccttgggccctgctctttgtggatttgtccctgctcactgggtgctgaccgttccccctcctcagaggccttccatcccttcccgttctgctgatacatgtcctgccagccggtag

SEQ ID NO: 56729 - DNA, 246 bp, Artificial Sequence
  Description of Artificial Sequence: Synthetic coding sequence
atggtattcttaaattacaagtgcacaacccccttgattctgctgctgccctctcaaatacccaggtcatacaaacaggactggctcctgtactgctcaaaactgatctctctggcttatcatgcattcctcatctttatgccaagcctcatgatgttttccctgctcgagatctaccacattttgctgcctcagctcctgttacaggtgaattttctcctaaaagctgagcctgaccagatctag

SEQ ID NO: 56730 - DNA, 435 bp, Artificial Sequence
  Description of Artificial Sequence: Synthetic coding sequence
atgaaagtcagctctctcacacgtcagcagcgtcctcctcagggcactgaagccggtacgcgcggtggagggcctggtcgcttgtcacccgagagatgtagactgctggattcacctctccaattacagggccctgcgtctttgcctcaaccgggtggaagagagagagccgtggccacgccccctcaggccaccaggagaggagggtccgagcggactagagattcacttctgggggctgtgggaccttctggcgcaaagaggccattcttctcctcagcactgcccaagggatgcaggcgtgtcggcgctacctggggacctagacagagggggtggggcaacgcgaccggcggacctggcgagggagcacgacgtagtaggcctgatccacaggctctgttctggcatgccccacacttgagagctcagtag

SEQ ID NO: 56731 - DNA, 318 bp, Artificial Sequence
  Description of Artificial Sequence: Synthetic coding sequence
atggcacactgttccctggatctcagcgggtctggcgaccctcctacatctacaagccaggttgcccgaaccattggagcctgtcaccacgtccagcttatattcgtcttttttggggagaccgggtttcaccatgtcgctccactagtgctggagctgcttgactctagcgaccccccaaccctcgcgtctcaatccggaggaaatcggcacgaaccacctcacagagctctgaaacatatcttcctgaaacacatctggttgttttctttttatttccatcaaaacgggcatgaagagacgatggaccagatttag

SEQ ID NO: 56732 - DNA, 396 bp, Artificial Sequence
  Description of Artificial Sequence: Synthetic coding sequence
atgccattttggagactggataagctgtcccccggtggcgttaaacgattgcgggtgacccagccggctacaggaacaggagtggtgagatcacaatgtcaaaaatgggtcaaagaactgggcaacgtgcctcgcttagctgcacggaaaccgggtttgggtgttcccggatcctcgggggctgtgaaacgacagggccagaagtgggtgaaagagttgggcaacatcccgaggctggcagtcggccgagatcaaggtcttggctctctggatccgggaagcgctacagagttgctgtgcgattgctccgtgcctctgctgccgctgtcaggagggtatcgaaaagcagacgtggctcatcaccctgcctgcgctatagtatggctgcattattag

SEQ ID NO: 56733 - DNA, 444 bp, Artificial Sequence
  Description of Artificial Sequence: Synthetic coding sequence
atggtaacagggccttgcctgacatgcgtgtcttccctgatcgagagagcttcgcccaaccaccccacgaataaaggcctcaccctgctcccctggctggagtgttccggtcccattatcgcacattgcagtctggactttcctgccagtgtagatccacccacactgatatctcgggtcgccggaactgcaggcttactgatactcagattttcatccgcttctgctaacccagaaactgcaagaccgatcccccctttgccatgccctcccccacgattactgcatatgaagaccacccgtatgaagactttcatgatgatccatttccatttgatgaataaactgcaagagatcatccaagaagagagacacggcggaatgctcgagagcctgctcagcctaaaggtgggtaaccccggatcttgctcatgctcccactag

SEQ ID NO: 56734 - DNA, 204 bp, Artificial Sequence
  Description of Artificial Sequence: Synthetic coding sequence
atgttccacctctgcaaactgaacccaagctacctgaaaataacctgcggaaaaaggtccaaacaaatcacacccacatattacccaagcagactgcctcctgtaaagcgtaaattttcggtctacgatgctaaactcaccattgtccatctgtctacgttttccattgaagatttccccctatacctttctatggcagggtag

SEQ ID NO: 56735 - DNA, 423 bp, Artificial Sequence
  Description of Artificial Sequence: Synthetic coding sequence
atgggtagcgaggctgctcagcttctcgaggccgcagactttgctgccagaaagcacaggcagcagcggcgtaaggatcccgaaggtactccgtatataaatcacccgataggggtagccaggattctcacgcacgaggccggtatcactgacattgtggtgctccaggcagcgctcctgcatgacacagtggaagatactgatacaactttggacgaagtggagttacatttcggcgctcaggtgcggagactcgtcgaagaagttacagacgataagactctccctaaactcgagcgcaaacgtttgcaggtcgagcaagcaccccactcctcacccggtgccaaacttgtgaaactggccgacaagctttacaacctgagagatctaaatagatgtacgcccgaggtgaaaatccagtag

SEQ ID NO: 56736 - DNA, 540 bp, Artificial Sequence
  Description of Artificial Sequence: Synthetic coding sequence
atgggtagtgaggctgctcagttgcttgaagccgctgatttcgctgcacggaagcatcgacagcaaagacgcaaggatccagaaggcacaccttatatcaaccacccaatcggggtggccagaatactcacccacgaggcagggattaccgacatagttgtgctacaggctgctctgctgcacgacactgtagaggacactgacactaccctcgatgaggttgaactgcactttggcgctcaggtacgcagacttgtggaagaagtaactgatgataagactctgccaaagctagagagaaaaaggctgcaggtcgaacaagcgccacactcgtctcccggtgccaagctggtgaaactcgcagataaattgtacaatttgcgagacctgaatagatgtacacccgagggatggagcgaacacagagtgcaggaatatttcgagtgggccgcacaggtggtgaaaggcctacagggcacaaataggcagcttgaggaggccctgaaacacttgtttaagcagagaggcttaactatctag

SEQ ID NO: 56737 - DNA, 1632 bp, Artificial Sequence
  Description of Artificial Sequence: Synthetic coding sequence
atgccgaatccgaagaatagtaaggggggtagaaaaaacaagcgtgccaattcgtccggagacgagcaggagaatggggcaggcgcactagctgctgccggagctgcaggggctgccgcaggtggtgctctggctgccgctgccggttgtggagccgctgccgcaggcgctcccggagccggtggagctgcgggagcaggaggtgcgggaaccggcgctgccaacgccgcagctgcagccggtgctgctgcggcaggggacgcaaaaaacgaagccccatgtgctaccccactcatttgcagcttcggcagacctgtcgacttggaaaaagatgactatcaaaaagttgtatgcaataatgagcattgcccatgttccacctggatgcacctgcaatgcttttacgagtgggaaagctctattttggttcagttcaactgcattggaagggctcgaagctggaatgagaagcagtgtcggcaaaacatgtggaccaagaagggctacgatcttgcctttaggttctgtagttgtcgctgcggccaaggccaccttaagaaggacaccgactggtaccaagtcaagcggatgcaggacgaaaagaaaaaaaagagtgggtccgagaagaataccggccgaccgccaggagaggccgctgaggaagcgaagaagtgccgccctcctaataaaccgcagaaagggcctagccacgatctgccccgacgccacagcatggacaggcaaaactcgcaggaaaaagctgttggagccgctgcctacggcgcacgatcaccaggaggtagcccaggtcagagtcccccaaccggatatagcatactgagtcccgcacatttttctggtccacggtcttcacgctatttgggagagttcctgaaaaatgccatacacctggagccacacaaaaaagctatggccggagggcatgtgtttagaaacgcccactttgactattcaccggcaggtctggctgtccaccgaggagggcatttcgatacacccgttcaattccttaggcggcttgatctgtcagagttgcttacccacatccctcggcacaagcttaacacttttcacgttcggatggaggacgatgctcaagtgggccagggcgaggacctgagaaagttcattctcgctgccttgagcgccagtcatcgtaatgtggtgaactgcgccctgtgccatagagcgctgcccgtgttcgaacagtttcctctggtagacggcacactgtttctcagtccatcccgacatgatgagattgaatacgatgtgccctgtcacttgcagggacggctgatgcacttatacgccgtatgtgtcgactgcctggaaggtgtccataagataatttgtatcaaatgcaaatcgagatgggatggttcatggcaccagcttggaaccatgtacacgtatgatattctcgccgcatccccttgttgccaggcgaggctgaactgtaagcactgcgggaagcctgtcatcgatgtcagaatcggaatgcagtacttcagcgagtacagcaatgtacaacagtgtcctcactgcgggaatctggactatcacttcgtgaagccattttcctctttcaaggtcctggaggcatactag

SEQ ID NO: 56738 - DNA, 2568 bp, Artificial Sequence
  Description of Artificial Sequence: Synthetic coding sequence
atggctgctcttggagttgccgaggccgtcgctgcccctcacccagctgaaggagctgagacagcggaagccgtggaactgtcccgcgctctgtcccgccttctgcctggcctagaggccgattccaaacctggcagacgcagggcccttgaggctctcagacgtgcactcgaagagccagggcctgcggcagatcccacagccttccaaggtccttgggcaaggctgctcctcccccgactgctgaggtgtctctcagatccagcggaggggtgccgcgctttagctgtccacctgctggaccttggacttaggagagcagccaggcctcgtgatgctcttccacggcttttgcctgctttggccgctagactcgctgggcctgtgcccgcaagaagaccacccgaagcttgcgaagaattgcgcctcgccctggtgcagcttctgggtttagctgtagatttatgcggggcagccctcgctcctcatctggatgacgcactacgagctttgcggtgcagtctgctggaccctttcgcggctgtccgccgtgaaagctgttcgtgcgccgctgccctcgcccaggctacccccgatcatttccacatgcagagcgaatctctgatcggcccacttatgcaaacaatcagtcaccagcactggaaggtcagggtggctgccattgaagccactggagctgtcatccactttgggaatggcaagtccgtagacgatgtcctgtctcactttgcacaaagacttttcgacgacgtaccacaggtccggagagctgtcgcaagtgtcgtgggagggtggcttctgtgtttaagagatcgatactcattttttcataagctgatacctctgctgctctcctcacttaacgacgaagtacctgaagttcgtcaattagcggcttctctttgggaggatgttggactgcagtggcaaaaggagaatgaggaggatctgaaagataagctcgattttgccccacccaccccaccccattatccaccccacgaaaggcggccagttctgggatgccgggagctggtgttcagaaatttgagtaaaattcttcctgcactgtgtcatgacatcactgattgggttgtagggacaagagtgaagtcagctcaactgctccctgttctgctgctgcacgcagaggatcatgctacccagcacctagaagtggttctgaggaccctcttccaggcctgtacggacgaagaggccgctgtggttcagtcatgcaccaggagcgccgaactggtggggacgtttgtatcgcccgaagttttcctcaagctgatactcagcaccctgaagaaaaccccttccgcgagcggactgttggtacttgctagtgcgatgcggggatgcccgagagaagcattgcagcctcacctcgctgccatcgccaccgaactggctcaggcccacatttgccaggcaagcgaaaatgacctttacctggagaggctgctgctctgcgtccaggccctcgtgagtgtatgccatgaagattgtggcgtcgcctcactgcagttgctggatgtgctgctgacaattgtcgccctggccggtgcaaccgggctcagggataaggctcaagaaacaatggacagcctggctatggtggaaggcgtgtcgtcttgccaagatctgtaccggaaacatattggcccattattggagcgtgtgactgcgtcacacctcgattggacagcccattcaccagaattgttgcaattcagtgtgatcgttgcacagtccgggcctgccctgggagaagcacttccgcacgttgttccgacactccgtgcatgtctgcagccatctcaggacccccagatgcgacttaaactatttagcattttatccacagtgctcctgcgagccactgatacaatcaattcacaggggcaatttccttcgtatcttgagaccgtgactaaagatatcctggccccaaatcttcagtggcacgccggtaggaccgccgcagctattcgcaccgcagcagttagctgcttgtgggctttgacaagttctgaggttctcagtgctgagcagattagagatgtgcaagaaaccctgatgccacaagtgctgacgacattagaagaagattccaagatgaccagactaataagctgcagaattatcaacaccttcctcaagacttccggaggcatgactgatcctgagaagcttattaggatctatccagaactgctgaaacggctggacgatgtctctaacgacgtccgcatggctgccgctagtacgcttgtgacatggctgcagtgcgtaaaaggcgcaaacgctaaatcttactaccagagttcggtccagtatttgtatcgggagctgctagtgcacctcgatgatccagaaagggccatccaggatgctatacttgaagtgctcaaagagggatctgggctcttccctgacttactcgttcgcgagaccgaggctgtcattcacaagcataggagcgctacgtactgcgaacagctgctgcagcatgttcaggcggtgccggctacacagtag

SEQ ID NO: 56739 - DNA, 2532 bp, Artificial Sequence
  Description of Artificial Sequence: Synthetic coding sequence
atggccgctttgggggtggcagaggctgttgctgcacctcatcccgcagagggtgcagaaacggcagaggcagtagagttgtcacgtgcgttgagtagattgctccccggattagaggctgatagcaagcccggtcgcaggagagccctggaagccttgaggcgagcgctggaggagccaggacctgctgcagaccccaccgccttccaggggccttgggccaggctgctgctcccgcgactattaagatgcctcagtgaccccgctgagggttgccgcgctcttgccgttcatctgctggacctcggactccgtcgtgcagccaggccccgtgacgcgctaccccgactccttccagctctggcagccaggctggctggccctgtgcccgctaggcggccacccgaggcatgtgaggagctgaggttagcgctcgtgcagctgctcggcctggcggtggatctttgcggcgctgctttggccccacacttggacgatgcactccgggcactccgctgttcgttgctcgacccttttgccgctgttcgtcgtgaatcctgttcctgtgccgctgcgctagcgcaggccactcctgatcatttccacatgcaaagcgaatctttaattggtcctctgatgcagaccatttcccaccagcactggaaggtgcgggtggccgctatagaggcaaccggagccgttattcatttcggaaacggcaagtccgtggatgacgtgctgtcacactttgcccagagacttttcgacgatgtacctcaggttcgcagggctgtggcctccgtcgtcggagggtggttactctgcctgagggataggtactctttctttcataagctcatcccactattgctctccagtctgaatgatgaggtgcctgaggtccggcaacttgctgccagcctatgggaagatgtgggtttgcaatggcaaaaggaaaatgaggaagacctgaaggacaagctggactttgcaccacccacaccaccccactatcctccgcatgagcggcgaccagtgctgggatgcagagagttagttttcaggaatctgtcgaaaatcctgcccgctctctgccacgacataaccgattgggtggtcggaacacgtgtgaaaagtgcgcaactcctaccagtgttattactccacgctgaggaccatgccacccaacatctggaagttgtattgcgcaccctcttccaggcttgtaccgacgaggaggccgctgtcgtgcagtcgtgtacgcggtccgcggagttggtcgggactttcgtttcccccgaggtgttcctgaagttgatattgagtaccttaaagaagactccctctgcttcaggtctactagtgctcgcgagcgccatgagagggtgtccgagagaggctctccaaccgcacttggccgctatcgccactgagctggctcaggcacatatctgccaagccagcgagaatgatttatatctggaaaggcttctgctgtgtgtgcaggccctggttagcgtatgtcacgaagattgcggtgtcgcctcacttcagcttctcgatgtgttgctgaccattgttgccttggcgggtgctaccgggctaagggacaaggcccaagaaaccatggatagtcttgccatggtggagggtgtctcgtcttgtcaggacctgtaccgcaagcacatcgggcctcttttagagcgcgtgaccgctagtcacctcgattggacagcacattctcccgagctcctccagttttccgtgattgtggctcagtcgggcccagcgctaggggaggctcttccgcacgtcgtgcccactcttcgtgcttgtctacagcctagccaggatccgcagatgcgactgaaactattttctattcttagcaccgtgcttctgcgggcaaccgatacaattaattcccagggacagtttccgtcttacctcgagacagtgacaaaggatattctggcccctaatcttcagtggcacgccggaagaaccgccgctgcaatcagaacggcagcagtaagctgcctatgggccctcaccagttcggaggttttgagcgctgagcagattcgagacgtccaggaaactctgatgcctcaggtgctaacaaccctggaagaggattccaagatgaccagactcatctcatgccgaataatcaatacctttttaaaaacatcggggggaatgacagatcccgaaaagctcatcaggatttaccccgaactcctgaaacggctggatgatgtcagcaatgatgtcagaatggccgctgcctctactttggtgacatggctccagtgtgtcaagggagccaacgcaaagtcttactatcagagcagcgttcagtacttgtatcgcgagctccttgtgcatctcgatgacccagagcgggctatccaggacgcgatactggacgtaccaggatctccatctccgtcagccatgatcgggagctttctgcgcccacctcatccttggcgcactgtgagccagctcaatctgttcagctcttag

SEQ ID NO: 56740 - DNA, 1806 bp, Artificial Sequence
  Description of Artificial Sequence: Synthetic coding sequence
atggactctttctcagaggtccgtagagccgtggcttctgtcgtgggaggctggctgctctgcctgcgggatcgatactcattctttcataagctaatccctctcctcctctcctctttgaatgacgaagtccccgaagtccggcagctagctgcttctctttgggaggatgtggggttgcaatggcagaaggagaacgaggaggacctcaaggataagctcgacttcgccccaccaacacctccacactatccccctcacgaacgccgaccagtgctggggtgccgagaactagtttttcgtaacctgtcaaaaatcttgccagccttgtgccacgatatcaccgattgggtcgtagggactcgggtcaagtcagctcagctgttacccgtgctcctgctgcacgccgaggatcatgccactcagcacctggaggtcgtcttgcgcacattgtttcaggcctgcacggacgaggaagccgcagtggtgcagtcatgcacgaggtccgccgaactggtcggcacctttgtctctcccgaagtttttctcaagctgatcctcagtaccctaaaaaagacaccgagtgcatcaggcttactcgtgctggcctctgctatgcgtggttgccccagagaagctttacagccacatctggctgctatcgctaccgagcttgcccaggcacacatctgtcaggctagcgagaacgacttgtacctggaacgtctgctactatgtgtgcaggctctggtgtccgtatgtcacgaggactgtggagtcgccagcttgcaactgctggatgtccttctaaccatcgtagctttggccggagccactgggctacgcgacaaggcacaggagacgatggatagtttggccatggtggagggggtgtcctcctgccaggatctctatagaaagcacattggaccccttctggaaagagtgacagcgtcacatctggactggactgctcattcccccgagttgcttcagttctccgtgatcgtcgcccaatctggccctgccttgggcgaagctctgccccatgtcgtgcccaccttacgagcctgtttgcagccctcccaggaccctcagatgaggctgaaattgttcagcatcctgagcacggtccttctacgggctacagacaccattaattcccagggacagtttccttcttatcttgagacggttaccaaggatatcctggctcctaacttgcagtggcacgcgggtcgtacagctgctgccatcagaactgccgcagtctcatgcctatgggcccttacatcaagtgaggtactctcagctgaacaaattagggatgtgcaggaaacccttatgcctcaggtgctgacaactctggaagaggattcaaaaatgacccgcctgatttcttgccggatcataaacacctttctcaagaccagtggtggtatgacagatccagaaaagcttattaggatataccctgagctgcttaagcggcttgacgacgtctccaacgacgtcaggatggcggctgcgagtacgctggtgacctggctgcagtgcgtcaaaggagccaatgccaagagctattaccagtcttcagtgcagtatttgtatcgggaattgctggttcatctagacgatcctgagagagcaattcaggatgccatacttgaggtactgaaggagggctcgggcctgtttccagacttgctggtgcgtgaaaccgaagccgtgatacataaacacagaagtgctacctactgtgagcagcttctgcagcacgtgcaggctgtgccggctacccagtag

SEQ ID NO: 56741 - DNA, 2043 bp, Artificial Sequence
  Description of Artificial Sequence: Synthetic coding sequence
atgggcaagagcagaacgaaacgtttcaagcggccacagttttcgccgactggagattgtcaagctgaggcagctgcggcagcgaatggcaccggtggcgaggaggatgatggacctgcagctgagctattagaaaagctacagcacccgagtgccgaagtgcgcgaatgtgcatgcgcgggactggccaggctggtgcaacaacgcccagctctgcccggattagcgagaagggacgccgttcgaagacttggccctctgctactggacccgagcctcgccgtgagggagacagctgcgggtgccctgaggaatttgagcgcttgcgggggttttgaggtctgtgacgatatggtaaccaaggacatcatgacccctctcgtggccctgctgaaagagtgctcggccggtcttgatagcaacgagatgtccttacaggaaaaaaaagaccaaaaccgtaactccattgaaaacattgccaatgagactgtgaacgtgctttggaatatctgcgagtgttcaagtcgggctgtgagcattttcaataaggagggctgtcttgagatcgtgctcaagtatctgagccggttccctaccaacgtggatcttgcaatctcagtggcttactgtctgcagacagtgactgaggataatcctgagttactgaaatcctttagtgcaactgccttgaatatgctcgaatccgctttactctcccctgtcagcagtatggaaagtctactcctcaagaccttagtggccggaactatttggaatttgaaagacatcataccatgcaaatcccaggcggaaataatcaatgcactgctgaagattttgtcagaggtactgggaatggacgctggtgagatggtgatccaaatgaaagaagccgagacccagaggttaaagaccgccgcagaggctgaagagatcttggagaacactaatggcgacgatctgatagaggacgatgaaatggagggcatctctcacaagcgacgggtgcggagaaagacatttgtgagcgacctgctcccacccacagataaagagctaagggaaaccattgccctcctgacagcacagcagacggctctcgaaattatcgtcaacatgtgttgtaatgaggatcctagtgatgatgagtgggaagaactaagttcttcagatgagtcagacgctttcatggagaatagtttctcagaatgcgggggacagctattttctccactgtgcttgagccatgaagtccatactgcattgacgaactacctgattcctaaaaagatcttcgaaaaaaccgctttccctaatagtatcgccgtggacctgtgcagccgaaatcccacctggaagcctcttatccgaaagatgaatactattcagtgtagagctctgttctgtcttcagagtctcgtgtcattgctcgatgtggaacatctaggcggagccgcagcccttcagacgctggcccaacatttatcgcagcttttgttttcacagccagatttcgccaaacatgtggattttctggaggctatttcatcggctctgcgggctctgctgcaaactatggcttccaagaacatctcacaatgcatgacacccgaccaactcatgacactgtgcaaagccggtatacacagtagtaacgtgggtgtgcgggtaaatgttgtcagcatcctggggattactgggtcagtgttagctaaggaagacggtactcttgagactctgaagaacattggttgcttcctgctggaagtaacaaccaaggatccctcacttgtggttgcaggagaagctctggacgcgctgtttgacgtatttgctgatggcaaggaagccgagcgcgcaagcattcagattaaattgctctcggctctgaaagagttccagccagtgttcaagatgaagatccgcaaagagggcaggggcaactactccaccgatcagctctgcgttctcgataatgtgaagatgaacctgaggagattcattgcttaccaggagaccgtggaaaaacgactaacatcctag

SEQ ID NO: 56742 - DNA, 3081 bp, Artificial Sequence
  Description of Artificial Sequence: Synthetic coding sequence
atgactaggacacaaaagggcaagacgtttcttccccactgcttctatcagtctcttcctccccgactcgggtggggcatgattctgaattacagcaagcttaaagggaaagaggaatgtgcctccgtctcctccgtgcctatggtgttcttcagttctcagtacaggcttcaccgaaagtcacagtatttgaaaatggccgctgcgaatctgactttctctcaagaagttgtgtggcaaagggggctgccaagcattccttattctcagtattcttttgaccacctgtacaataccaacgacatcatccacacgcctcaaatccgaaaagcccgaccacagaagcccgtctcttttaagtttctgggctcatcaagccccctgaccggggacacctcactggctgtgaaaactgagagcagcgcaaatcccgagaaaaaattgaaaaaaagcaagcccgcttctaccgtgagggaagcgccacggcctcttattcaccacccctgcatgcatcccgatatgctcgggagacccccaagcctcgacgtcaacctggaagagcgggaggcctggctactgcccccagagaaggaggcccgtgcctgggaggcaacagtattggaaaaactgaatgaacgcaccgcacgttggatccagtcgaagaggcctaggcggccaggagccagccccaataaatggcagagctttctgcgccaacaatacgactggtcacacatccgggatgagctgacgtcagccagtgacttggaattgctgaaacagcttgaagccgaggaaacggcagagtttgaagaccaatcagtgattctgcctccgcaggaaaagaagaaacccgagctcctactgcctgtttactacaggttgccttcctacttccaacaggcggaaaccgtggagataatgcccggtaataagagcacggaggatatacatgagaaaacctccctgtctcagccacagactcagtcatatttcagacaggtgacacccagggcgggtaagtttgcgtactccacagataacacatttgagcaggagatctattttgatgaagtgcagatcattcaccagataggggctaaaagggatcagatcgtgctcgagaacctgaacaggtacaataagcaactctcaaaagtgttccccgagacaccagagaagtggtcagcacaggcaatacccgaggcctcctacaggcccgtacaaggcgcactgcgatggaccgccctccctactcctgccaaggacatgctgttgcaggtaggtgaaaaggacgttcctattaagactagacgcttgaagaaacaggcaaaatccctgcaagaggatgtgacatgggaacttgtagtgcttagacggatgctcaaagaatggaagacagcatgggcgctaatcatcgagtggcatcacgaaacagtcgagaatctcctgcagtcactgggcgatttacacgacgacgtacgcattaaggccatcactacatgcgcaacagccgcattggagaggccccgaattgcgacctcccaacgggattcagataagactatccaggaccttccggaggtcctgttgcctgctctagaggcagccctctgtgacaagaacgcgcacgtgcgcatggcggctgcaatctgccaatatgcaattcagtcccacaaccctctcgcccgaaatattatgcagactgccctgctcaaggggaattctgtggactcttgggcggctgcccagtgcctggcgctggagggtaccgccacatacccagtaataaagcgcatcttgcaccagttatttacaaaaaagaatgaggacacggaagagcagtcctacattcttctctcctacctgagtgagaaaactaccctgatacacacaatgcttgctgtcgaacttaattcttgccaatggaagaatagaattgtcgcgtgtcaggccttttcacgcatctcgggcaatgtatgtcttgacatgaagcacaaactgattcaactcatgtggaatgactggaacaaggaggtgcggcgtgctgcggcacaagctctcggccagatgagcttaggaaaggaagtccacgatattatcagagtgaagttgggccagggcaacagccaggaaagggtagaagccttgtatctgattggcgaactaaagctcatgactgctaagttgctgccctcttttctgcattgcttttcagacgacttcactgcagtgcgacgcgctgcctgtcttgctgcaggggcattacagattcgcgacaagatggtattggaatgtctgcttaacctgatgcaacgagatccttactggaagattaaggcattcgctatcagggctcttggtcagatcggccaggtctcccctgagctgacggacctcttactatgggccattcactacgaggagagtcctggtgttcgtctcgaagcctgtcgatccattcttgctctaaagttacaaggggaccgggtgcgtgacacatttctggatgtgttgctactcgagaatcatgatgccgtgttgaaagagatgtatcaaacgatgaaaattctgaacctgggcaacgaagggaatcaggagatgttgcaggagatcaaaaatcggattaaaactctgtctcagaaggacctgttgacccacaaaattcttaaactggaaatggttatgggcaaggtgagggaggaggctaagagggtgtatctgaaaccgaaaggagaacaggggccattgaccctccaaacactgcttcaggagacttttcaggacgagatggtactgcctagacgaccctcggaagtgtgcgacaccgaggctgtcatcaaaccagtgaaaccacgggcacctaatccttggctgcagtccagcgtacccggattgacaacaaggagtaaagtcagatcttcactggttaaggatttgcgcacaagccccgagaaaagaatcgcagtgggacctttccggtccgactaccctgccctctacctaggcaagttcagtgaacgcacctttttctccccaattatgtcatcacccagcgggaagaaaggcgcacatctgtag

SEQ ID NO: 56743 - DNA, 3081 bp, Artificial Sequence
  Description of Artificial Sequence: Synthetic coding sequence
atgacccggacccagaaaggcaaaactttccttccccactgtttctatcagtctctgccacctcggctcggctggggtatgattttgaactactcaaaactcaagggtaaagaggagtgtgctagcgtgagcagcgtacctatggtgtttttttcctctcagtaccgcttgcaccgcaagtcccaatacttgaaaatggctgcagcaaatctgacattttcccaggaagttgtgtggcagcgcggattaccatccatcccttattcacagtacagctttgatcacctatacaacacaaacgacataatccatactccccagatcagaaaagctcgccctcagaagcccgtgtccttcaagttcctcggctccagtagcccgctgaccggggacactagccttgcagtgaagaccgagtccagcgctaatccggagaaaaaactgaaaaaatctaagcccgcttcaacagtcagggaagcccctcggccacttatacatcatccgtgcatgcaccccgacatgctggggagacctccatcactggacgtgaatctggaggaacgcgaggcgtggcttttgccccctgagaaagaggcaagggcatgggaagccactgtccttgaaaagctgaacgaaagaaccgcccgttggatccagagcaaacggccaaggagacccggtgcatccccaaacaagtggcagagctttctgcgccagcaatatgactggtctcacattagagacgaactaaccagcgcctccgatctcgagttgctaaagcagctcgaagctgaggagaccgcagagtttgaagaccaaagtgtgatactgccaccacaggaaaaaaagaagccagaacttctgctgcctgtctattaccgtctgcccagttacttccagcaggctgaaaccgtggagattatgcctggtaataaaagtaccgaggacattcacgaaaaaactagtctcagccaaccccagacacaatcatatttccgccaggtgacccccagagctggaaaattcgcatactccacagacaacacttttgaacaagaaatctattttgatgaagtgcaaataatccaccagatcggtgcgaagagagatcagattgtgttggagaacctgaaccgatataacaagcagctgagtaaagtgttccccgaaactccagaaaaatggtctgcacaagccataccggaagcttcatatcgccctgtgcagggcgctctccgctggactgcactccccacaccagcaaaagatatgttattacaggtgggagaaaaggacgttccaattaagacacgccgacttaagaaacaagcaaagtctcttcaggaggacgtgacctgggaactggttgttttgcgccgtatgctcaaagaatggaagacggcatgggcccttataatcgagtggcatcacgaaaccgttgagaatctgctgcaaagtctcggcgacctccacgatgacgtccggatcaaggctatcaccacttgcgcaaccgccgctcttgaacggccacgtatcgccacctcccagcgagatagcgacaaaacaatccaggatttgcctgaagtcttgctgcctgccctggaggctgcactttgtgacaagaacgcacatgtgcggatggctgcagccatctgtcaatacgctatccaatcccacaaccccctggcacggaacatcatgcaaacggcccttttaaaaggtaactccgtagattcttgggccgctgcacagtgtctcgcccttgaagggaccgcgacctatccggtgatcaaaaggattctgcaccaacttttcacaaaaaagaatgaggacacagaggaacagtcttatatccttctcagctatttatcggaaaaaacaaccttgattcacacaatgctggcggtcgaactaaattcctgccaatggaaaaataggatagtggcctgtcaagcattctctcgcatttctggcaatgtttgcctggatatgaagcataagctgattcaactaatgtggaacgactggaacaaagaggtccggagagctgccgctcaggccctcggccagatgagcctggggaaggaggtgcacgatatcatccgcgtgaagcttgggcagggcaactcccaggagcgggtggaggcactctacctgattggtgagctgaaattgatgaccgcgaaacttctgcccagctttctccattgcttttctgacgacttcaccgctgtgcgcagagccgcttgcctcgccgctggagccctgcagattcgcgacaagatggtgcttgagtgcttactcaatctaatgcagcgcgatccctattggaaaatcaaggccttcgccataagggccctgggacagatcggccaggtgagtcctgaactgaccgacctgcttttgtgggccattcattatgaggagagccccggagtgcggttggaggcctgtcgatctattctggccctgaaactacaaggagatagagtccgcgatacctttctggatgtcctactgctggaaaaccatgacgcagtactgaaagaaatgtatcagactatgaaaattctgaatctgggtaacgagggaaaccaggagatgctgcaagagatcaagaacaggataaaaacgttatcgcaaaaggacttgctgactcataagatcctgaaacttgaaatggtaatgggtaaggtgcgagaagaagccaagagagtttacttgaaacccaaaggagaacaggggcctctgactctgcagactttgctgcaggagaccttccaggatgagatggtattgccaagaaggccatccgaggtctgcgataccgaggccgttattaaaccagtcaaaccgagagcacctaatccgtggctccagtcaagcgttcccggactaacgacccggtccaaggtgcggagcagtttagtgaaagacctccgcactagcccggaaaaacggatcgccgtgggcccttttcggtccgattatcccgctctttacctggggaagttcagcgagcggaccttcttctcgcccatcatgtcttctccctctgggaagaaaggcgctcatctgtag

SEQ ID NO: 56744 - DNA, 576 bp, Artificial Sequence
  Description of Artificial Sequence: Synthetic coding sequence
atgacaagaacccagaaaggcaagacatttctcccacattgcttttatcagtctctgcccccaaggctcggatgggggatgatcctgaattattctaagctaaaaggcaaggaagaatgcgcttcggtaagcagcgttcctatggtcttcttctcttcccagtatcggctgcaccgcaagtctcaatatctgaagatggccgctgccaatctgaccttttcccaggaagtcgtgtggcaaagaggcctgccttctatcccctatagccaatacagttttgaccacctctataatactaatgatataattcatactccgcagatccgcaaggctcgcccacagaagcctgtctctttcaaatttttgggcagtagctctccactgaccggtgacacatcgttggcagtgaagacggaatcttccgctaatcccgagaagaaattgaagaagtcaaagcccgcttcaacagtgcgcgaggcccctagaccgctgattcaccacccgtgcatgcaccccgacatgttgggcagacccccatccctcgatgtgaacctcgaagaacgagaagcttggtag

SEQ ID NO: 56745 - DNA, 120 bp, Artificial Sequence
  Description of Artificial Sequence: Synthetic coding sequence
atgacgcggacccaaaaaggaaaaacatttttacctcattgcttttatcagtcacttcccccacgtttaggctggggcatgattctgaattattctaaactgaaagggaaagaggaatag

SEQ ID NO: 56746 - DNA, 2940 bp, Artificial Sequence
  Description of Artificial Sequence: Synthetic coding sequence
atggtgtttttttccagtcaataccgcctgcacaggaaaagtcagtacctcaaaatggccgcagctaatctgacattcagccaggaggtagtgtggcagcgagggttgccgtctatcccttactcccagtattctttcgatcatttgtacaacacaaacgacatcattcatacacctcagatccgcaaagccaggccacaaaagccggttagcttcaagtttctgggtagttctagcccactcactggcgatacatcactcgccgtgaagacagaatcctctgcaaacccagaaaagaagctgaaaaaatccaagccagcaagtactgttcgcgaagccccacggccactcattcatcatccttgcatgcatcctgatatgctcggtcggccaccaagtcttgacgtgaatctcgaggagcgcgaggcctggttactgcccccagagaaagaggcgagagcgtgggaggcaacagtcctagaaaagctcaatgagagaactgcgaggtggatacagtcaaagcgtccgcgtaggccgggagcctccccaaataaatggcagtccttccttcgacaacagtatgattggtcacacatccgggatgagctgacatccgcgtctgacctggagctgctcaaacagcttgaggcagaggagaccgcggaatttgaggaccaatccgttattttaccgccacaggaaaagaaaaaacccgagctgctgttgccagtttactacagactgccttcctattttcagcaggctgagactgtggagatcatgcccggtaataaatcaacagaagatattcatgagaagaccagtcttagccagccacagacccagtcgtattttcggcaggttaccccacgtgccggtaagtttgcctattccaccgacaacacttttgagcaagagatttatttcgatgaagtgcagattatacatcaaatcggagcaaagagagatcagatcgttctcgaaaacctgaatcggtataataagcagctttctaaagtcttcccggagacgccggagaaatggtcagcccaggccattcctgaggccagctatagaccagttcaaggcgcactgcgctggactgccttacccacccctgcaaaggacatgcttctgcaggtcggggagaaggacgtgcctatcaaaacccgtcgcctgaagaaacaggccaaatctctccaggaagatgttacctgggaattggtggtcctgaggcgcatgctgaaggagtggaagacagcctgggccctgatcattgaatggcaccacgagacagtggagaatctcctccagagcctcggagatctccatgatgacgtgcgcataaaggccatcactacatgcgctacggccgctttagaacgccctcgcatcgccacgtcacagcgggatagcgacaagaccattcaggacctaccagaagttttactccctgccctggaagccgctctgtgcgataaaaacgcccacgtaaggatggcagccgctatctgccagtatgcaattcagagccacaatcctctcgcccgtaacataatgcagacagctctgctgaaggggaacagtgtcgactcctgggccgctgcacagtgcctcgcacttgaaggcacagccacctatcccgttataaaaagaatactccaccagttattcactaaaaaaaatgaggacaccgaggagcaatcgtacattctcctaagctatctgtccgaaaaaacaaccttgatccacaccatgctggccgtggagctcaacagttgccaatggaagaatcggatagtagcttgtcaagctttctcccgtatctccggaaacgtctgcctggacatgaagcataaactcattcagctcatgtggaatgactggaataaggaagtgaggcgcgcagccgctcaggctctgggccaaatgtccctagggaaggaggtccacgacattattagggtgaagctaggccagggcaattcccaggagcgcgtcgaggcactttacctaataggagagctcaaattgatgaccgcgaaactcctgccttccttcctgcactgtttttcggacgacttcactgccgtccgaagagctgcttgtttagctgccggtgccctccaaatccgtgataagatggtactcgagtgtctgctaaatctgatgcagagggacccttactggaaaatcaaggcttttgcaatccgggctctcgggcagatcggccaggtttcccccgagctgactgacctgctgctctgggctatccactacgaggagagtccaggtgtgaggttagaggcctgtagatctattttggccctgaagttacagggggaccgggtgcgagataccttcctggatgtcttactcctagaaaatcacgatgccgtgctgaaagagatgtaccagacaatgaaaattctaaacctggggaacgaagggaaccaagagatgctgcaggagataaagaaccgcattaagacactgagccaaaaagacttgctgacccacaagatccttaaactggagatggtgatgggaaaggtgagagaagaggctaaaagggtgtatttgaagcctaagggagaacagggacctttaaccctccagacacttctccaagagaccttccaggacgagatggtcctgccaaggagaccttcagaagtctgcgatactgaggccgttattaagcctgttaagccgcgagcacccaacccatggctccagtcttcagtgcctggattgacaacgcgcagtaaggtccggtcgagtctggtcaaagaccttaggacgtctccagagaaaaggattgcagtgggccctttcagaagcgactatcccgctctgtatttgggtaaattcagcgagaggaccttcttttcacccatcatgtccagcccgtcaggaaagaaaggtgcccacctctag

SEQ ID NO: 56747 - DNA, 6122 bp, Artificial Sequence
  Description of Artificial Sequence: Synthetic coding sequence
atggagttagctcactctttgctgctgaatgaggaggcatacaaccagctcggcgaggtccagaaggcggagttcatctttgaatggctccgctatctggaaaagctcctgcttgccacctctcggaatgacgttagggagaagcagaagaccctagtggaacagctcctcagcctccttaattcctctcctgggcctcctacgcgcaaattacttgccaagaacctagccatcttgtacagtataggggatactttctccgtgcatgaggctatcgataagtgtaatgatctgattcggtcgaaggatgattcaccgtcttacctgcctacaaaactggctgccgtggtatgtctgggtagcctttataaaaagcttggcagaatcctgggcaacacttttaccgatacggtcggcaatatccttaaggcgatgaagtccgccgaatcccaaggaaggtatgaaattatgttatctctgcagaatatcctgaatgggctgggcgctgcggcagctccatgccatcgagacgtgtacaaggcagctcggtcatgcttgaccgatcggtccatggccgtgaggtgtgcagccgctaagaatgaggccatctttatgtggagcacggacctcgacagtgtagccaccttgtgcttcaaaagttttgagggcagcaactatgacgtaaggatatctgtgagtaagctcctgggtatcatcttagccaaagctgtgatcagcaaacatcctgggacagcagcctcaaggcaaagcattagaagagtatctcttgaagaggtacttgagctcctgggaaccgggtttcttagggggtctagtgggtttctgagagctagcggcgacatgcttaagggtacctcatcggtctccagagatgtgcgggtgggcgtaacccaggcgtatgtagtgtttgtttccacgctcgggggtgcttggctcgaaaagaatttcgcagcctttttctctcatattctttctcttgcttccccaagccatcctaaagccacacagactcagatcgatgccgtttgttgcaggcgttgtgtgagtttcatactgcgcactacaattggcggactgctgggcgaaaaagcgcagcttgctgcggttaaggacatatgtcaggccatttggaagttgaaaaaggttatggatgctgtcatgtcagatggtaatctagaaacccggctgggcagtactgatgtagcagctagtcaacatatgctagtgtgcgcactgcaagagctggggaatctcatccataacctgggcacaactgcggcacctctgctccaggactcaagcacagggttactcgactccatcctgtccgtgatcctgcaccccagcatcagcgttaggttggcagcagcctggtgtcttcattgtattgccgtcgccttaccttcctatctaacacctttactggataggtgcctggagcggctgacaggccataaatcaagcccagaagccgttaccggattctccttcgccgtagctgctctgttgggcgcagtgaagcactgtccattgggaatcccccatggaaagggtaagatcattatgaccttggctgaggacttactctgctctgcagcccagaactccagactgagtgcccagagaacacaggccggttggctgcttatctcggcccttatgactttgggcccagccgtagtgagccaccacctggccagggtgctactcttatggaaatgtgtgtttcctgcaagccctaaggacctggagacagaaaagagcaggggcgattcctttacttggcaagtgacactggaggggagggcaggggcattatgcgcgatcaaaagcttcgtttcccactgcggggacctgttgacagaggaagtcactcagaggctactgccgcctttgccttgcgccgtggatctgctcacccagctctctagtatcctcaaaatgtatgggagtccactgaagaccccttccgtggtgtatcgacagagactgtatgagctcttgatccttctgccccctgaaacatacgaggggaacctctgcgcgatcctccgtgaactggcagccgatctgacagctcccgacatacaggtggcggcttccacctttcttttgcccccactctgccaccaagacgacctcctaatcctgagtccgtttctgcaggagaccgatcaccgattcatcgaagaacagctactgctcggcaacggcgtggcctgcggatcactggagtatgacccctactccatttatgaaaaggacgtggagggcgattccgtccccaagcctcttccacccgcactgtcagtgattagcagcgctagtaagctgtttggtgtggtctgtgcccacgtgggcgaaactcagcgcctgctgatactggaacagctgctcgactccatcaaacacacgaagggggcaagacagcaggtggtgcagctgcatgtggttagcagtgtaagttcatttctgaaatacgtggccggttctaaagggtgcctgggccctgaagagatgaagagattcgctctgacattagttatgggagccctcgaaagtcccaatcccttgctgcgctgcgctgctgctgaaagttgggctcggctggcccaggtggttgacgatggtgcgttcaccgctggcctggcacaggttagctttgacaaactaaagtctgcacgagacgtggtgacacggacgggacactcccttgccctcggcagtctacacagatatctgggaggtataagttctagtcagcatctaaacagctgtattggcatcctgtacacgcttgctcaggacagtacgagtcccgacgtacagacatgggccctccattccctgtccctgatcatcgatagtgctggacccctctactatgtgcacgtggagcctactctctcgctgatcatcatgctgcttttaaatgtgcccccaactcatgccgaagttcaccaaagccttggacgctgcctgaatgcactgatcacaactctcggacctgagctacagggtaattcgacaagcatatctacactgaggacaagctgcctgctggggtgcgccgtcatgcaggataatcccgattgcctcgtgcaagcacaggccattagctgcctgcaacagctgcatatgtttgcacccaggcacgttaatttgtcatccctcgtgtcttgtctctgtgtaaacctgtgctcaccctacctcctgctaagaagagcagtgttggcctgcctcaggcagttggttcagcgagaagccgctgaggtgtctgagcatgccgtgatgctggccaaggacagtcgcgaggaacttacacctgatgccaatatcagagaggtaggtctggaaggggctctgttgattctgcttgacaaggaaacagatgagagactctgtcacgatataaaggagacactaaattacatgttgaccagtatggcagtcgaaaaattgtccctgtggctgaagctgtgtaaggacgttctagccgcttcagctgactttaccgctgtgacatgcgtggacacaatgcaagaggaggagggagataagggggacgacgcgagtgtgctgacgacacggagggacgagaagagccatcctttcacgaaccctagatgggctacacgggtgtttgccgcagaatgcgtctgtagaattatcaatcagtgtgagaatgcgaactcagcccatttcgatattgccctcgctcaagaaatgaaaaagcgggacagcagaaatgattttctggtactccatttagccgacctgatcaggatggcattcatggccgcaacagatcattcagatcagctgcggcttagcgggttggagatgctccttgttgtgatccgccgttttgcaacagtcccggagccagagttccctggccatgttatactggagcagtaccaggcgaacgtcggagccgctctccgtcccgcatttaccagcgaaaccccccctgacgtaacggcaaaggcctgccaggtatgctcagcgtggatcgcatccggggttgtgtctgatctcaatgacttgcggagagtgcaccaactcctggtcagcagcctcaccaaaattcaagccggaaaagaagctctcagtcacctttacaatgaatcagcaagtaccatggagatcctagctgtcctgaaagcgtgggcggaggtgtatattatcgcagtgcagcgacacaagaatcatagacaaccactcaagacaacaacatgcttagaggatggtattaggaatgggagctgctctagcgatggtctcctggatctggtgtacgcggaccttggcaccctgagccggctgtggctggccgcactccaggactttgccctactcactctaccttctgagtttgcaagtcaactgcccgctgaggggggtgcattttataccgccgaaacgagcgagaacgcaaagctgcactactataactcttgggctctcattcttcacgcaaccgcactgtggctcaccagtactgggtttgtggtggcagatccggacgagggggcttcaaacctgagtcgacccgtgactccaactagtatgtgtcaggggtcctcaagcggagccactattaaatctcccgaagatgtttacacagatcgctttcatcttatcttggggatcagcgtcgagttcctgtgcagcctgcgttcagacgctaccatggagagcattaccgcctgtctacacgcactgcaggccctgctcgatgtgccatggcccaggagtaaaattggtagcgaccaggatttaggcatcgagctgctgaatgtcctgcaccgtgttattttgaccagggagtctccaagcatccaattggcaagcctcgaagtggtaagacagattatctgcgccgcacaagagcatgttaaagaaaagcgcagatccgcggaagtcgatgacggcgcagccgaaaaagaaactttgcccgagtttggggaggggaaggatactggtggcctcgtccccggaaaatccttggtgtttgcaactttagaactttgcgtctgtattctggtgcgtcaactcccggaactgaaccccaagcttacaggttcacctggagtgaaggccacaaagccccagatcctcctggaggacggaagtagactcgtttctgccgctcttgtgatcctttccgaattgccagccgtctgttcacctgagggaagcatctctatactgcctacaattctgtatctgactatcggggtgctaagggaaacagccgtcaagctaccagggggtcagttgagttctaccgttgccgcatcactccaagctctcaaaggaatcctgtcaagtcccatggccagggcagaaaagtcgcgcaccgcctggacagacttgctcagatctgctttgactacaatccttgattgttgggatcccgtcgatgaaacccatcaggagctggatgaagtttctcttctgacagcaatcactgtttttatcctctctacaagccccgaagtgacaaccatcccctgcttgcagaagcggtgcattgacaagtttaaggcaaccctagaaatcaaggatcctgttgtacaaataaagacctaccagcttctgcattctatcttccagtatccaaaccctgcggtttcatatccctacatctatagcttagcctcatgcattatggagaaactgcaggaaatagataaacgtaagccagaaaataccgcggagctggaaatctttcaagagggcataaaggtcttagaaacgttagttactgttgctgaggagcaccatcgggctcagctcgtggcctgcctcctcccaatcttgatctccttcctgctggatgaaaattctttgggcagcgcgaccagcataatgcgaaacttgcacgatttcgcactccagaacctgatgcaaattggtccacagtatagcagtgtgttcaagagtttagtggcaagcagtccggcattgaaagcaaggcttgaagctgcaattaaaggaaaccaagagtccgtgaaggtaaagatccccacatccaagtacacaaagagtcctggcaagaacagcagcattcagctgaaaacgagttttttata

SEQ ID NO: 56748 - DNA, 3423 bp, Artificial Sequence
  Description of Artificial Sequence: Synthetic coding sequence
atggagcttgctcattccttgctgcttaacgaagaggcatacaaccagcttggcgaagtgcagaaagcggagtttattttcgaatggttacgctacttggagaagttactgcttgcaacaagccgcaatgacgtgcgtgagaaacagaagacgctggtggagcagctgcttagccttctgaacagtagccccggaccgccaaccagaaaactactcgccaagaacttagcaattctttattccattggtgacaccttctctgtgcatgaagctatagataagtgtaacgatcttatccgatcaaaggatgatagcccaagctacttgcctacgaagttggcagcagtcgtttgtctggggagcctgtacaagaagttagggcgaatcctgggtaacacatttaccgataccgtgggaaatatcttaaaggccatgaagtctgccgagtctcagggcaggtatgagataatgctctccctgcagaacatcctgaacggacttggagctgcagcagccccatgtcacagggatgtttacaaggcagccaggtcctgtttaaccgatcgctctatggccgttaggtgtgccgctgccaaatgcctgttggagctgcagaatgaggcgattttcatgtggagcacagacctggattccgtcgcaacactctgtttcaagagctttgaaggcagcaattacgacgtccggatttctgtcagtaagctgctggggattatcctcgcaaaagccgtaatttcgaagcaccctggcactgctgcttcgagacagtcaatacgcagagtatccctagaggaggtacttgaattgctgggtacaggctttctgcggggatcatcaggttttctgcgggcttccggcgacatgcttaaggggacctcctccgtgtcccgcgacgtgcgggtgggagtaacacaagcctatgtcgtgtttgtgagtacactgggaggcgcatggctggaaaaaaattttgccgcttttttctcccacatcttgagtctcgcctctccctcccatcctaaagccacccagacgcaaattgatgctgtgtgctgccgtcgctgcgttagtttcatactgagaaccacaattggcggactcctgggcgagaaagctcaactggccgcagtgaaagacatttgccaggcaatctggaaactcaaaaaagtcatggacgccgtgatgtcagacggcaatttggagaccagactcgggtctacagatgtcgccgctagtcagcacatgctggtgtgcgcgctgcaagagcttggaaacctgatccataacttgggcacaaccgccgctcccctcttacaggactctagcaccggtctcctggactccatcttgtctgtcattctgcacccaagtatttccgtccgccttgctgccgcatggtgtctgcactgcattgctgtggccctgcctagctacttgacccctctgctcgaccgctgcctggaaagattaacaggccacaagagcagtcccgaggcagtcaccgggttttcatttgccgtggcagccttattaggcgctgtgaaacactgtcccctgggaataccccacgggaaagggaagatcatcatgacgctcgctgaagatctgttatgcagcgctgcacagaatagtagacttagcgcccagcgcacacaggcaggctggctactcattagtgctctgatgactctcggacccgctgttgtcagccatcacttggcacgggtcttactactgtggaagtgtgtgtttcctgccagccccaaagatctggaaaccgagaagagccggggagacagcttcacctggcaggtgactctagagggacgcgcaggtgccctctgcgctattaagtcttttgtctcacactgcggggatttgcttaccgaggaggtgacccagcgccttctgcctcccttgccatgcgcagttgacctgctgacacagctgtccagcatacttaagatgtatggctcccccctgaagacgccttcagtggtgtaccggcaacggctgtacgaactgcttatactgctcccgccagagacttacgaagggaatctgtgtgctatcctccgagagctggctgcagacctgactgcgcctgatatacaggtcgccgcttccaccttcctccttcctcctttatgccaccaggatgatttgttgatactctctcccttcttacaggaaactgaccataggttcatcgaagagcagctccttctgggcaacggagtggcatgcgggtccctggagtacgacccctattccatttacgaaaaggatgtggaaggcgacagcgtaccaaagcctctgcctcccgcactctccgtaataagttctgcttctaaacttttcggagtcgtttgtgcacacgtgggagagacccagcgtctgctcatactggagcaacttttggattccatcaagcacaccaagggggcaaggcagcaggtggtccagttgcacgtcgtaagcagcgtaagttcctttttgaaatacgtggctggatccaagggatgcttgggccctgaagagatgaaaagatttgccctgacgctcgtgatgggcgcactggaaagtccgaaccctctgctgagatgtgccgcagctgaaagttgggctagactggctcaagttgtggacgatggtgccttcacagcaggactggcccaggtgtcattcgataagctgaaaagcgccagagacgtggtgacccgtaccggacatagtctcgctctcggctctcttcaccggtacttgggcggtatatcttcttctcagcacctgaacagttgcatcggcattctctacacgctcgcacaagacagtacttctcctgatgtgcagacttgggcgctccacagccttagtctgattattgacagcgctgggcctctgtactatgtccacgtcgaacctaccctctcgctaatcatcatgctactcttaaatgtcccccctacacatgctgaagtacatcaaagtcttggtagatgcctcaatgcgctgattacgacactcggacctgaactgcagggaaatagcaccagtataagcacactccgcacctcttgcctccttggctgtgcggtgatgcaggacaatcccgactgcctggtacaggcgcaggccataagctgtctgcagcagcttcacatgttcgccccacgccacgttaacttgagcagtctggtgtcatgtctgtgtgtgaacctgtgctccccctatcttcttttacgtcgcgctgtgctggcttgtctgcgtcagttagtgcagagggaagccgcagaagtgagcgaacatgctgtcatgctggctaaggatagcagggaggaactgactcctgtgttcaccgcctcctctccaggggtggactctatctgtaggaaccacctcgagtag

SEQ ID NO: 56749 - DNA, 5897 bp, Artificial Sequence
  Description of Artificial Sequence: Synthetic coding sequence
atggaacttgcgcactccctcctcttgaacgaagaggcctacaatcagttgggtgaagtccagaaagcagaatttatttttgaatggcttaggtatctggaaaaactcctccttgcaacctccagaaacgacgtccgggagaagcagaagactttagtcgaacagctcctctcattgctcaatagttcacccggtcctccgacaagaaagctgcttgccaaaaacttggctattctctattccattggcgataccttttccgtacacgaggctattgataagtgcaatgatctgatacggtctaaagacgacagcccctcctacctcccaacaaagttggcggcagttgtttgtctaggaagtctgtataagaagctgggcagaatactgggaaatacgtttacagatactgtgggtaatattctcaaggctatgaaaagtgcagaatcccaggggagatatgaaattatgctcagtcttcagaatatattgaatggcctcggagcagccgctgctccctgtcatagagatgtatacaaggccgcaagatcgtgcctcactgatcggtccatggctgtgcgctgcgccgcagccaagaacgaggccatattcatgtggtccaccgatctcgactctgtcgcaacgctatgttttaagagtttcgaagggagtaattatgacgttagaatcagcgtgagcaagttgcttggcatcatcctcgctaaggctgtgatctctaagcacccaggtactgcagcctcccgacagagcatccggagagtctccctcgaggaagttcttgaattgctgggcactggattccttcgagggtcttccgggttcctcagggcctccggtgatatgcttaagggcacttcctcagtgtccagagatgtccgggtgggagtcacccaagcttacgtcgtctttgtgagcactctgggtggtgcctggctggaaaagaactttgcggcttttttctcccatattctgagcttggcatcaccttcccatccaaaggcaactcagactcaaatcgatgctgtatgttgtcgaaggtgcgtctcttttatcctaagaaccacaatcgggggtctgctgggagagaaagcacagctggctgcagttaaagatatctgtcaagcaatttggaagctgaagaaagtgatggatgctgtgatgtctgatggcaaccttgagacaagactggggagtactgatgtagctgcctcccaacacatgctggtctgcgcgctccaagaactgggcaatctgatccacaaccttggaaccaccgccgcacctctgctgcaagattctagcaccggcctactggactccatactctcagttatcctacacccttcaataagtgtcagactcgcagctgcgtggtgtctccactgtatagcggtagctctcccctcctatcttacgcctctgctcgatcgatgcttggaaaggctgaccgggcataaaagttcacccgaagctgtgactgggttctcatttgccgtggccgcactcttgggagctgtgaagcactgtcctctgggtatccctcacggtaaagggaagattattatgaccctggccgaggacctgctgtgctccgccgctcaaaatagccgcctatcggctcaacggacacaggccggttggctgctgatctcggctcttatgacgcttggacctgccgttgtgtcccaccacttggcgagagttttgctcctctggaagtgtgtatttcctgcgtcccctaaggacctggagactgaaaagtctcgcggagattcattcacttggcaagtcacacttgaaggcagggctggggctctgtgcgcgatcaaatctttcgtctcccactgcggcgacctcttaaccgaggaggtcacgcagcggctgttacctccacttccatgcgcagttgatttactaacgcagctgtccagcatactcaagatgtacggatctcctctaaagactccatccgtggtttatcggcagcgattatacgagttgctaatattattgccccctgaaacctacgagggcaacctgtgcgcaatcctgcgcgaactggccgcagacttaaccgccccagacatccaggtcgcagcctctactttcctgctgccacccctttgtcatcaagatgatctgctgattctttccccctttttgcaagaaaccgatcaccggttcatcgaggagcagcttctgctgggtaatggcgttgcttgtggatcattagagtacgacccctactccatttatgaaaaggacgttgaaggcgattcagtacctaaacccctgcctccagcgctgagcgttataagctcggcttccaaattgttcggcgtggtttgcgcacacgtgggggaaacacagcgcctgctaatcctggaacagttgttagattctatcaaacacacaaaaggcgcaaggcagcaggtcgtgcaattacatgtcgtctcatccgtttccagtttcctgaagtatgttgccggaagcaagggatgcctgggccctgaggaaatgaagagatttgcactgactttggtaatgggagccttggaaagccctaatccattgctgagatgcgccgctgctgagagctgggccagactggcccaagtagtcgacgacggcgctttcaccgccggactggcccaggtaagtttcgataaattaaaaagcgctcgcgacgtcgtgacgagaaccgggcacagcctggccctaggaagtctacacaggtatctcggtggcattagttcttcccagcatctgaacagttgcatcgggattctgtatacactcgcccaggactccaccagccctgacgtccagacttgggccttacactctttgagcctgatcatcgattcagctggaccgctttactatgtacacgtagaaccgactctatcactgatcatcatgctactgctgaacgtaccacccacccacgcagaggtgcatcaaagcctagggagatgtctgaacgctctgatcaccacattgggacctgagctccaggggaactccaccagcatttctacgctcagaacatcctgtttgctggggtgcgccgtgatgcaagataaccctgactgtctcgtccaagcacaggccatctcttgtctgcagcaactgcacatgttcgctcccaggcacgtgaacctgagctctctcgtgagctgtctgtgcgtgaacctctgcagcccctatctcctgttgcgaagggccgtgctcgcttgcttgaggcaactggttcagcgggaggccgctgaagtctccgaacacgctgtgatgctggcaaaagacagtagggaggaactgacgccagacgccaacatccgggaggtgggcctcgagggagcgttgcttattcttcttgacaaggagaccgatgagcgtctttgtcacgatatcaaggagaccctgaactatatgctgaccagcatggccgtcgagaagctgagtttatggttgaagttgtgcaaagatgtattggctgccagcgctgacttcacagcagtgacgtgcgtggacaccatgcaggaggaggagggcgacaaaggggacgatgcctccgtactaaccacacgcagggacgagaagtcgcatccattcacaaatcctagatgggccacgagggtgtttgccgcagaatgcgtgtgtaggattattaatcaatgcgaaaacgccaattccgcccactttgatattgcattggcccaggaaatgaagaagagggactcacgcaacgatttcctggtgctccatctggccgatctgatccgcatggcattcatggccgctacagaccactccgaccaacttagactctccgggcttgaaatgctgttggttgttattaggcgatttgccacggtgccagagcccgagtttccgggacacgtcattcttgaacaatatcaggccaacgtaggggctgccctgcggcctgcctttacttccgagacaccccctgacgtcaccgccaaggcttgtcaggtgtgttcagcgtggattgcaagcggcgtggtgtccgatctgaacgaccttaggcgcgtccatcagctgctggtgagttctctgactaagattcaggcaggaaaggaggccctctcccacctgtacaacgagagcgcctccacaatggagatcctggccgtcctgaaggcctgggcagaagtgtatatcatcgcagtgcagcgccataaaaaccatagacaaccactcaagaccaccacttgcctagaggacgggatcagaaatggaagttgttcatctgacggtttattagatctagtttacgccgaccttggaacactgagccgcttgtggctggcagcccttcaagactttgccctcctcacgcttccaagcgaattcgccagccagctgcccgcagagggtggggctttctatactgcagagaccagcgaaaacgcaaagctccattactataatagctgggcccttattctccatgccaccgcactttggctgacctccaccgggttcgtggtcgctgatcctgacgagggagcaagcaacttgtctcgccctgtgacccccactagcatgtgccagggttcttctagcggagccacaattaaatcacccgaagatgtctacaccgaccgcttccacctaatcctcgggatctccgtggagtttttgtgctcattgcggagcgatgccactatggaatctattacggcctgcctgcacgcccttcaagccctcctggacgttccatggcccagatcaaaaatcggcagtgaccaggacttggggattgagttgctgaacgtgctgcatcgggtgatcctaactagagagtcaccgagtattcaactggcaagcctcgaagtggtaaggcaaataatctgcgccgcacaggaacacgtcaaggagaaacggagaagcgccgaggtggacgatggagcagctgaaaaggaaaccttgcccgaatttggagaaggcaaggacacagggggacttgtgccaggcaagtccttggttttcgcaactctagaactatgcgtgtgcatactggtccgtcagctgccggagttgaatcccaaacttactggatccccaggggtgaaggcgacgaagccacagattctgctagaggatggcagccggctcgtgtccgctgcccttgtgatcttgtctgagctccccgctgtctgctcacccgaggtcgacgagacccaccaggagctggatgaagttagtcttctcactgctatcactgtattcattctttccactagtcccgaggtgaccaccattccctgtctgcagaagaggtgtattgacaagttcaaagccaccctggaaatcaaagatcctgtcgtccaaatcaaaacataccagctcctgcatagcatattccagtacccaaacccggcagtcagttatccatacatatatagcctggccagctgcattatggagaagctgcaggagatcgacaaaaggaagccagaaaacaccgcagaactcgagatatttcaggaggggatcaaagtactggagacactcgtgaccgtggcggaggagcaccatagggcacagttggtggcatgtctactcccaatactgatctcctttctgttagatgagaatagtcttggcagtgccacatctattatgcgaaatctgcacgattttgccttgcagaacctcatgcagattggcccacagtattctagtgttttcaaatcgttagtcgcatcctcccccgcactcaaggcccgtctggaagccgcaattaaaggaaatcaggaatcagtcaaagttaagatccccacctctaagtatactaaatcccccggtaaaaacagctctatccaattgaaaactagctttctgta

SEQ ID NO: 56750 - DNA, 5261 bp, Artificial Sequence
  Description of Artificial Sequence: Synthetic coding sequence
atgctgaagggaacctctagcgtttcccgagatgtgcgcgtgggcgtcacacaggcctacgtggtcttcgtcagtacactggggggagcgtggctcgagaagaattttgccgcatttttctcccatatcctgtcactggcatcgccttcccatccgaaagccactcaaacacagatcgacgcggtgtgctgtcgtaggtgcgttagcttcatactgcgaacaactatcggagggttattgggagagaaggcccaactcgcagctgtgaaggatatttgtcaggctatatggaagctgaagaaagtgatggatgccgtgatgagcgacggaaacttagaaacacgcctgggctcgacagacgttgcagcaagccaacatatgctcgtctgcgccctgcaagagctcgggaatctgatccataacctgggaactacagcagcacctcttctgcaggactcaagcacaggtctactcgattccattctgagtgttatcctgcacccttctatcagcgtgcgcctagcggcagcatggtgtctacactgcatcgcggtggccctgccatcctatttgactccgctgttggatcgatgcctggagaggctgactggtcacaagtcaagcccagaagccgttacaggattttcttttgccgtcgcagctctcctaggcgctgtaaaacattgcccccttggtatcccccacggcaaggggaagattatcatgacgttggccgaggacctgctttgttcagcagctcagaactctcgtctctccgcgcagcggacccaggccggatggctcctgatctctgcacttatgactctggggcctgctgtggtgtcccaccatctcgcacgtgtgctcttactttggaaatgtgtgttcccggcaagccccaaagacctcgagacagaaaaatccagaggcgactcttttacttggcaggttacactcgaaggcagggccggtgccttgtgcgctataaagtcttttgtgagccactgcggggacctgctcacagaagaggttacccagcgactgcttcccccactcccctgcgcagttgacctgctgactcagctgtcttcaatcttaaagatgtacggatcccctcttaagacgcctagcgtggtgtatagacagcggctgtatgaactgctgatcctgctccccccagagacttatgagggaaatctgtgcgctattctaagggaattggctgccgatctcacagccccagatatacaagtcgctgcctccaccttcctgctgccgccactctgtcaccaggacgatctgctaattctaagtccgtttctccaggagaccgatcaccgatttattgaagagcaattattgctgggcaacggggtcgcctgtgggtccttagaatacgacccctattccatctatgaaaaagacgtagagggggattctgtgccaaagcctcttccgcctgcactgagcgtgatctccagcgctagtaagctgtttggagtggtctgcgctcatgtaggagagacccagaggctcttgattttagagcagctgctcgactccattaaacacaccaagggcgctcgtcagcaagttgtccagctgcatgtagtgtcaagcgtgagcagtttccttaaatatgttgctggctccaaaggctgccttggcccagaggagatgaaacgatttgcactgacacttgtcatgggcgctctcgaaagtcctaacccactactgcggtgcgccgctgccgaatcctgggccaggctggcacaggtcgtggacgacggcgcatttacggccggtctggctcaagtgtcattcgacaaactgaagtccgctcgcgatgtcgtcactcggacaggacatagcctcgccctgggatctttgcacagatacctagggggaatatcttcctctcaacatctcaacagctgcattggtatactttataccttggcacaggactctactagcccggatgtccaaacctgggcactccactccttaagccttataattgattctgccggacccctgtactatgtgcatgtggagcccacactgagtctgattatcatgctgctcctgaacgttccgccaacgcatgctgaggtgcaccaaagtctaggtaggtgccttaacgcccttatcaccacccttggccctgagctacaggggaatagcacatccattagcacattgaggacctcgtgtctcctggggtgtgcagtgatgcaagacaaccctgactgcctggtccaagcccaggctatatcttgtctgcaacagctgcacatgtttgccccacgtcatgtaaatctatcaagtttggtctcctgcttatgcgtgaacctatgctctccctatctgttgctccgacgggcagtcttggcatgtttgcggcagctcgtccagcgggaagcagccgaagtgtcagaacatgctgtgatgctggccaaggactcaagagaagaactgacccctgacgccaatatacgggaggttggcctcgaaggggcactgttgattctgcttgacaaagaaacggacgagcgcctgtgtcacgatattaaggaaacactgaattacatgctgacttccatggctgttgagaagctgagcctgtggcttaaactctgtaaggatgtgctggcagcctcagccgatttcaccgcggttacctgtgtggacactatgcaggaggaagaaggggacaagggggacgatgcctccgtgcttaccacccgccgagatgagaagagccatccatttactaatccacggtgggctaccagggtttttgccgcagagtgtgtatgtcggattatcaaccagtgtgagaacgccaacagcgcacacttcgacattgccctcgctcaggagatgaaaaaaagggactccaggaatgatttcctagtgcttcacctggccgacctgatacgcatggcgttcatggcagccacagaccattccgatcagctccggctaagtggcctggaaatgcttctcgtagtaattagacgattcgctacagttcccgaaccagagttccctggccatgtcattttggaacagtaccaggctaacgtcggtgctgccctgcgcccagcctttacctcagaaacccctcctgacgtgactgctaaagcctgccaggtctgcagcgcctggattgccagcggagtcgtctctgatctgaatgatctcaggagagtgcatcagctgctggtgtcaagcctgaccaagatacaggccggaaaggaggcgcttagccatctctataacgagagtgcttcaactatggagatcctcgccgttcttaaagcatgggcggaggtgtacattatcgctgtccagcgtcacaagaaccataggcaaccactgaagacaaccacctgcctggaggatgggataagaaatgggtcgtgctccagtgacggactcttagatctcgtgtatgctgatctggggacgctgtcccgcctgtggctggcagctctgcaggacttcgccttactgacactgccgagcgagttcgcctcacagttacccgctgagggcggagctttctacacggcggagacatccgagaatgccaagctacactactacaacagctgggccctgattctgcatgctacagccctttggctcacaagtactggattcgtcgtggccgacccagacgagggggcaagtaatctgtcgcgccctgtgacacctacatcaatgtgtcagggcagttccagcggagcaaccattaaaagtccagaggatgtgtacaccgaccgtttccatctcatcctcggcatctctgtggaattcctctgtagcctgaggtccgatgccacaatggagtccatcaccgcctgtttacatgcgctgcaggcactgctggacgtaccctggcctcgatccaaaatcgggtccgatcaggacctgggcattgaactgttgaacgtgttgcatcgcgtgatcctgaccagagagtcccccagtatccagttggcgtctctggaagtggtgaggcagatcatatgcgccgctcaggaacacgtaaaggaaaagcgtcgctctgcggaggtggatgacggagccgctgagaaggagaccctgcctgagttcggcgagggtaaggatacaggaggactggttccaggcaagtccctcgtatttgcaaccctcgagctctgcgtgtgtattctagtgcgccagctgccggaactgaaccccaagctaactggaagccccggagttaaggccaccaaaccgcagattttgctggaggacgggtcgagactcgtgtcagccgctctggtgatccttagcgaactgccagctgtgtgttcccctgaagggagcatttccatcctgcccactatattatatttgaccatcggggtccttagggagacagctgtaaaactgcccggaggacaactctcctctactgtggccgcttcgctgcaggccctgaagggaatattatctagccctatggcacgagcggagaagtcgcgaacagcttggaccgatctcctaaggagcgctctcaccactattttggattgctgggaccccgttgatgagactcaccaggagctcgatgaggtgtccctgcttacggccatcaccgtgttcatcctgagcacctccccagaggtgacaaccattccctgtctccagaagcgatgcatcgacaaatttaaggctactttagagatcaaggaccccgtggtgcaaatcaagacataccagctactgcactccatcttccaatacccaaatcctgccgtatcatacccctacatctacagtctggcttcatgtataatggagaaactgcaagagattgacaagaggaaaccggagaacaccgctgagctggagatctttcaggaaggcatcaaggtgctagaaacactggttaccgtggcagaagaacaccatcgcgctcagctcgtcgcatgcctattacctattctgataagctttctgcttgacgaaaacagcctcgggtcagcgacctctataatgcggaaccttcacgatttcgcattacagaacctgatgcagatcggaccccagtacagtagcgtatttaaatctctggtggcttctagtcccgcactgaaggctcgcttagaagctgcaatcaaaggcaatcaggaaagtgtcaaagtgaagattcccacgtccaagtacacgaaaagcccaggaaagaactcctccatccagctaaaaacgtcatttctgta

SEQ ID NO: 56751 - DNA, 6140 bp, Artificial Sequence
  Description of Artificial Sequence: Synthetic coding sequence
atggaactggcccacagcctacttcttaacgaagaagcctataaccagctgggggaagtccagaaagccgagtttattttcgagtggctgcgctatctggaaaaactgctattagccaccagtcgtaatgatgtgcgggagaaacagaaaacacttgttgaacagctcctcagtttactgaacagctcacccggtcctccaacacgtaagctgttagcaaaaaacttagctattctctactcaatcggagataccttctctgttcatgaggccatcgataagtgcaatgacctgatccgctccaaagacgactcgccatcatacttgccaaccaaattggccgcagtggtctgccttggatctctgtacaagaagctgggcagaattctggggaacacttttaccgatactgtggggaacatcctcaaagcaatgaaatccgccgagtcccaaggacggtatgaaatcatgctgtccttgcaaaacattctgaacgggctaggcgctgccgcagccccatgccatagggacgtttataaggccgcacgatcttgcctgactgatagatctatggctgttagatgtgccgcagcaaaatgcctcctggagctccagaacgaagccatctttatgtggtctactgatctggatagcgtggcaacactgtgctttaagagcttcgaaggctcaaactacgacgtcaggataagcgtgagtaaactgctggggataatcctggctaaggccgtcatatcaaaacatccaggaaccgcggcttcccgccagtccattcggagagtaagtttggaagaagtcctggagcttctcggaactggattcctgaggggatcttcaggcttcttgagagcttcaggtgacatgctcaagggaacaagttccgttagcagggacgtgagggtgggggtgacccaggcctatgtcgtgtttgtgtctaccttaggaggcgcttggctggaaaaaaactttgctgccttcttctctcacatcctgtccctggctagtcctagtcaccctaaagcgacacaaacgcagatagatgccgtctgctgccggaggtgcgtgagtttcattctgcgcactactatcgggggactgttgggcgaaaaggctcaactggcagctgtgaaggacatatgtcaagccatttggaagcttaaaaaagtgatggacgcagtaatgtcagatggtaatctcgagaccagactgggttcaacggatgtcgccgcttcacagcatatgcttgtgtgtgctctccaagaactgggaaatctgattcataatctgggaaccacggccgctccactgctccaggatagctctactgggctcctggactcaatcctgtccgtgatactccacccctccatctccgttcggttagccgctgcatggtgtttgcactgcattgcggtcgccctccctagttatctgactcccctgctggatcggtgtttggaacgactgacaggccacaaaagtagcccagaggccgtcacgggtttctcatttgctgtggctgccctgctgggagcggttaaacactgtcccctcgggatcccacatggaaaaggcaagatcattatgacactcgcagaggaccttctttgtagcgcagcccagaacagcagactgtcggcccagagaacacaggcaggatggctgttaatctctgctctgatgaccctgggacctgcggtggtgtcgcatcatttagcaagagtactgctgctgtggaagtgcgtgtttcccgcatcccctaaggacctagagaccgagaaatcacggggagactcatttacatggcaggtaacgctcgagggcagggccggagccctctgtgcaatcaaaagctttgtgagtcattgtggcgatctgctcacagaagaggtaacacagcggcttcttccacctctcccctgcgctgtggatctgctgacccagttatccagtatcctgaaaatgtatggaagcccacttaaaacaccaagcgttgtctatcgacagagactttatgagctgttaattctcctgccccctgaaacctacgaagggaacctttgcgccatactgcgcgaacttgcagcagaccttacagctcctgatatacaagttgctgcttctacgtttcttctgccccctctctgtcaccaggacgacctgctcatactgagcccattcctacaggaaaccgaccacaggtttatagaggagcagttgctcctcggtaacggagtcgcgtgcgggtcactggaatatgacccttacagcatttacgaaaaagacgtagagggagactccgtgcccaagcccctaccgccagctttgagcgtgatcagctctgcatctaaactcttcggggtggtttgtgcccacgtgggcgagacgcagaggctgttaatcctggaacagctcctagactccatcaagcacactaagggtgcgaggcagcaggtagtgcagttgcacgtggtttcaagcgtctcgagtttcttgaaatacgtggccggatcaaagggttgcctgggaccggaggagatgaagaggttcgccttgacactggtgatgggcgctctagaatcccccaacccgctgctccgctgcgctgctgccgaatcatgggcacgtcttgcccaggtcgtcgatgacggagccttcacagcagggctcgcccaggtgagcttcgataaacttaaatcagcccgtgacgtggtcacaaggacgggacactcactggccctcggcagcctgcatagatatcttggaggaatatctagctctcagcaccttaatagctgcataggcatactctacactcttgcacaggattccacctcacccgatgtgcagacttgggctctgcattctcttagcctcattatcgacagcgcagggcctctgtattacgtgcacgtagagccaacactttctcttatcattatgctgttactgaacgtgcccccaacccacgcggaggtccatcagtctctggggagatgtctcaatgcccttattaccacacttggccctgagcttcaggggaactcaacctctatttccaccctacgcaccagctgtctccttggatgtgctgtaatgcaggacaatccagactgcttggtgcaagctcaagcgatctcctgcctccaacagctccacatgttcgctccgaggcatgtgaacctcagtagtctcgtgtcttgtctgtgtgttaatctgtgcagtccataccttctcctcagacgcgcagttctggcctgtctcaggcagctcgtccagcgagaggcagcagaggtatcagagcatgctgtgatgttagccaaggacagccgggaggaacttactccagacgcaaatattcgggaagttgggctagagggagcactcttgatactgctcgacaaagaaacagatgaacggctttgccatgatattaaggagacgctcaattatatgctgacgagcatggctgtcgaaaagttgtccctgtggttaaagctgtgcaaagatgtactggccgcatcagccgacttcaccgccgttacctgcgtggacactatgcaggaggaggaaggcgataagggcgatgacgcgtccgtgttgacgacccggagggatgagaagtcacacccctttactaacccacgttgggccacaagggtgtttgccgctgaatgtgtgtgtcggattataaatcaatgcgaaaacgccaatagcgcccacttcgatatcgccctggctcaagagatgaagaaacgggactccagaaacgattttctggtactgcatttagccgatctcatcagaatggcttttatggccgctaccgatcattcagaccagcttcgtctctcagggttagaaatgctcctggtggtaataaggcgcttcgcaactgtgcctgaacccgagttccctggtcacgtgatcttggagcaatatcaggccaacgttggcgctgctctgcgacctgcattcaccagtgagaccccccctgatgtgactgcgaaggcctgtcaggtctgcagcgcgtggatcgctagcggggtggtgtctgatctcaatgacctgcgacgggtgcaccaactcctggtgagctcactgactaagatccaagccggtaaagaggcactgagtcatctctataacgagagcgcatcgacgatggaaatcttggcagttctgaaggcctgggcggaagtctacatcatcgctgttcaacggcataaaaatcaccggcagccgctaaaaacaaccacgtgcctcgaggacggaattcgcaacggaagctgctccagtgacgggttactcgatctggtgtatgccgacttggggacactaagtaggctttggctagcagcgctccaggactttgccttattgacgttacccagcgaattcgcctcacagctccctgccgagggcggtgccttttacactgcagagactagcgaaaacgccaagctccactactacaacagctgggccctgattttgcacgcgaccgctctgtggctgacctctactgggttcgtggtggcagaccccgacgagggagcttcaaatctgagcaggccggtgactccaacatcgatgtgccaggggagcagttcgggggcaacaatcaaatctccggaggacgtgtacaccgatcgcttccacttgatattgggcatttccgtggaatttctgtgttcactaaggtccgatgcaacaatggagtctattactgcctgtttacatgctttgcaggcccttctcgacgtgccatggcctcgctccaagatcggctccgatcaggacctggggatagagcttctcaatgtgctgcatagggtgatcctaactcgcgaaagtccgtctatccaacttgccagtttggaagtggttaggcagattatatgtgccgctcaagagcacgtaaaggaaaagaggagatccgcagaggtagatgacggtgccgctgagaaagaaaccctcccggagtttggtgagggaaaagacacaggaggcttagtgccgggaaaatctctagtctttgcaactctggaactgtgtgtgtgcatcctggtacgccaattacctgaattgaatccaaaactaacaggaagtcctggtgttaaggctaccaagccacaaatcctcttagaggatgggagtagactggtctctgcagccctggtgatcctgtctgagctgccagccgtatgctctcccgaaggctccatctctattctgcctactattctgtacctcacgatcggcgtgctcagggaaactgcggtaaaactcccaggtgggcagctgagcagtactgtggctgcgtctttgcaggctctcaagggaatcttgagctctccaatggctagagccgagaaatcacggacagcctggacagacttgctcagaagcgctctcactacaattctcgactgttgggatcccgtggacgagacccaccaggagctagacgaggtgagcttgctcacagcaataaccgtgttcatcctgtccacaagcccagaggtgaccactattccctgtctgcagaaaaggtgcatcgataaatttaaggccacacttgagattaaggaccctgtcgtgcagatcaaaacctatcagctcctgcacagcatcttccagtaccctaaccctgccgtgtcctacccttatatctattctctggcaagctgtattatggagaaactgcaggagatcgataaacgcaaaccagagaacacagccgagctcgagatttttcaggagggcatcaaagttctggagactctggtcaccgtggcggaagagcaccacagagcccagttggtggcatgtctgttgcccatcctgatctcttttctgctggatgaaaactctttagggtcagctacctccattatgaggaacttacacgacttcgcattacagaacctgatgcagattgggcctcagtattcctccgttttcaagtctctggtagcatcctcacccgctttgaaggctagactggaagccgcaattaaaggaaaccaggaatctgtcaaagtaaagatacctacatctaagtatactaagagccctggtaaaaattcttccatacagctgaaaacatctttcctgta

SEQ ID NO: 56752 - DNA, 2223 bp, Artificial Sequence
  Description of Artificial Sequence: Synthetic coding sequence
atggccgctttttccgaaatgggcgttatgcctgaaatcgctcaggctgtcgaggaaatggattggctcctgcccacggacatccaggccgaatccattcccctgattctgggaggaggcgacgttctgatggccgctgaaacaggttccggaaagaccggagcctttagtataccggtgatccagatcgtttacgagactctgaaggaccagcaggaagggaagaagggcaagacaacaattaagaccggcgcaagcgtgttgaataaatggcagatgaatccctacgataggggatccgccttcgccatagggagtgatggcctttgctgtcagtctcgtgaagtgaaggagtggcacggttgtcgcgctaccaaggggctaatgaaaggaaaacattattacgaggtctcctgtcacgaccaaggcctctgccgagtcgggtggtccaccatgcaggcttccctcgatctggggaccgacaaatttggattcggctttggtggtaccggaaaaaagagtcacaacaagcaatttgataattacggtgaagaatttacaatgcatgacaccatcggttgctatttagatattgataaaggacatgtgaaattttcaaagaacgggaaagatctgggactcgcatttgagatccccccacacatgaagaaccaggccctgttccctgcatgtgttctaaagaacgcggaattaaaatttaacttcggggaagaggagtttaagtttcctcctaaggatggcttcgttgccctgtcaaaggccccagacggttacattgtgaagtctcagcacagcgggaacgcccaggtcactcaaactaaattcctcccaaatgctccaaaggccctgatagtggagccgtccagggaactggctgagcaaaccctgaataatatcaagcagttcaaaaagtatatcgataatcctaagcttagagagttactgatcattggcggagtcgctgcaagagatcagcttagtgtgctggaaaacggtgtggacattgtggtcggaacccccggtaggctcgatgatctggtgagtactggcaagttgaacctttctcaagtgagattcctggtgttagatgaagctgacgggctcttgagccagggatacagcgattttattaaccgtatgcacaaccagatcccacaggttacctccgatggaaagagactgcaagtcatagtttgttctgccactctgcattcatttgatgtgaagaagctgagcgagaagattatgcatttccctacatgggttgatctcaaaggtgaagacagcgtgccagataccgtccatcacgtcgtggtgccagtgaatccaaagacagacaggctctgggaaagacttggcaaatcccatattcgaaccgacgatgttcatgctaaggacaacactcggcctggagcaaatagccctgagatgtggtcagaggccatcaaaatactcaagggagagtatgccgtaagagccataaaagagcacaagatggatcaggccattattttctgcaggaccaagatcgattgtgacaacctcgaacagtacttcatccagcagggtgggggacccgacaagaaaggacatcaattcagttgcgtctgtttacacggcgaccggaagccccacgaacgcaaacaaaatttggaaagatttaagaagggcgatgtgcgcttcctgatctgtaccgatgttgccgctagggggatcgatattcatggagtgccctacgtgattaatgtaacgctccccgacgagaagcagaattacgtgcaccgaattgggagggtgggcagggcggaacgcatgggactggcaatctccctcgtcgccactgagaaagagaaggtatggtaccacgtttgctcgtcccgaggaaagggctgctataatacacgcctgaaagaggacggcggttgcaccatttggtataatgagatgcagctgctgtctgagatagaagagcacttgaattgcacgattagtcaggttgaaccagatatcaaagttccagtggatgagtttgacggcaaagtcacttacgggcaaaagagggccgcagggggaggctcctataaaggtcatgtggatattttagcccctaccgtgcaggaactggccgcactagagaaagaagcccaaacaagcttccttcatctcggctatctgcccaatcagcttttccgcactttctag

SEQ ID NO: 56753 - DNA, 5948 bp, Artificial Sequence
  Description of Artificial Sequence: Synthetic coding sequence
atggagctggcacatagcctcctgctcaacgaagaagccctggcacagataaccgaagccaagagaccagttttcatctttgaatggctgagattcctggacaaagttcttgtcgctgcgaacaagacggatgtcaaggagaagcagaagaaactggtggagcaattgactgggttgattagctccagccctggaccccctactcgcaagctgctagccaaaaacctggccgctctctactctataggcgataccttcactgtctttcagacgctcgacaagtgtaacgacatcatacgaaataaggatgatactgctgcttacctgcctaccaagctggcagccgttgcttgcgtgggggcattctatgaaaagatgggaaggatgctggggagtgctttccctgaaactgttaataacctgttgaaaagcctcaagtcagccgagtcacagggccgttcagagatattaatgtctctccagaaggtgcttagtggcctcggcggtgccgcagctagttctcacagagacatatataaaaatgcccgatcgctgctgactgaccggtctatggcagtccggtgcgctgttgccaagtgtctcctcgagctgcaaaacgaggccgttttcatgtggactgctgagctggagaatattgcaaccctgtgtttcaaggcactagagaactcaaactacggggtgcgcgttgctgtctcaaagctcttggggaccgtcatggccaccgctctgatgcctaagcaagcaacggtgatgaggcagaacgtgaaacgcgctacgttcgatgaggttctggaactcatggccacaggatttctgagggggggtagtgggttcctcaaaagtgggggagagatgctgaaggtgggcggaagcgtaaaccgagaggtgcgagttggtgtaacccaagcctacgtggtctttgtcacgacattggggggtcagtggttggagcgctcttttgccactttcctgtcacatgtgctcgacctagtgtctcacccgagagccacccagacacatgtcgaggcagtgtatagcagacggtgtgtctcctttattttaagagctactgtagggtcactgcttggggagaaagcccagattgctgcagctaaagagatctgccaggccatagggaaacagatgaaagccgtcgaggcggttgttaacgatacttccggcgaaaataagtctggagcagccgacatcgcagcatcacagcacgttatggtgtgcgccctacaggagctcgggagcctggtgcagagcttgaatgcaacagccagcccacttattcaggaggcctcaatcggccttctcgagatagtgacctcggtgctgctgcaccccagcatggctgccagactggcagcggcatggtgtctgcggtgtgtggcggtggcgcttccgtttcagctaacaccctttttagatagatgtgccgagaggctcaacaatttaaagacctcgccagaggcagtctctgggtacagcttcgccatggccgctctactcgggggagtgcatcagtgtcctctcggcattcctcatgctaagggcaaaatggtggtgtccatagccgaagatcttctgaggaccgccgcacagaactctcggctctccttgcagaggacccaggccggttggctgctactgggtgcgctgatgacgcttggcccttccgtggtgaggtatcacctgcccaaaatgctgctgctctggcggaatgtgtttcctcggtctttaaaagagctagaggccgaaaaagccaggggggactcctttacttggcaggtgacactggagggcagagcgggagcactttgcgcaatgcgctccttcgtcgcacactgtccggaattgctgacggaagatgtcatcagaaagctcatgactcccatcgaatgcgccatgaccatgatgtcccacatcccatctgttatgaaggcccatggcgctcacctgaaggcatctgccgctatggtgagactccgactttacgacatcctagccctcttgccccctaagacatacgaaggaagtttcaacgccctcctgagagagcttgttgccgagtttactcttactgataatagcgctaacacgactacctctctcctcagatccttgtgccactacgacgattccgttctcctcgggtcctggttgcaggagaccgatcacaagtctatcgaggatcagctgcagcctaattccgcatcggggtccggagctctggagcacgacccgtcctcgatatacctgagaattcccgcaggtgaggccgtgcctggcccactgcctctcggggtttcagtgattgatgctagcgtcgccctcttcggcgtggtcttcccccatgtttcttacaagcatcgcctgcagatgctagatcatttcgctgaatgtgtcaagcaggccaaaggagttaggcagcaggccgtgcagcttaacatcttcaccgctgtgctgagtgccctcaaggggctggcagaaaacaaaagcaccctagggcctgaagaagtcaggaaaagcgctcttacattagtcatgggcccactagataacccaaatcccattcttagatgcgctgcgggtgaagccctgggccgtatggcgcaagtcgtcggtgaggcaacattcatcgcacgcatggcccagtactccttcgataaactgaaaagtgcgagggatgtggtgagccgaacaggacactctttagcattggggtgcctgcatcgatatgtggggggaatcggttcgggccagcacttaaaaacgtcagtgagcattttactggcactggcccaggacggaaccagcccagaagtccagacatggtccctgcattccctggcgctcatcgtggattccagcggccctatgtaccgaggctacgtggagcctacactgtctttggtgttaaccctgcttttgacagtcccgccttcacacaccgaagtgcaccagtgtcttggacgatgtctaggggcaattattacaacagtgggccctgagcttcagggcaacggagcaacaacttccaccatccggagctcctgtctcgtggggtgtgccattacgcaggaccatagcgattcattagtgcaagccgcagctatcagctgtttgcaacaattgcacatgtttgcacccaggcacgtcaacctgagtagtctggtgcctagtctttgcgtccatctctgctcttctcacctgcttttgcggagagccgctgtcgcctgtctgcgccagctggcgcagcgagaggccgctgaggtatgtgagtatgctatgagccttgcaaagaataccggggacaaggaaagcagctccgccaacgtcagcccttttgctcccggagtcagttccagaacagacatccattgccgacatcagggggttaacatcaccgagacaggactggagggcctgctcttcggcatgctggatcgcgagactgaccggaagctctgtagcgatattcatgacacccttggccacatgctgtccagcctggctgttgaaaaactctctcactggttaatgctgtgtaaggatgtcctggccgcttctagcgacatgagcaccgccactctgctcagcagcggaaaagacgaggaagcggagaagaaggatgagatggacgatgataccatgttcacgaccctgggcgaggaagacaagtcaaagccttttgtagccccacgatgggccacacgcgtgtttgctgctgactgcctctgccgcataatcaacctttgtgaaaacgccgaccaggcacattttgatttggcgctagcccgatcagctaagctaaggaaccctacaaatgacctccttgtccttcaccttagcgacttgatccgtatggcttttatggctgcaaccgatcatagtaaccagttaagaatggcaggcctccaagcactggaggacatcattaagaaatttgcatctgtgcccgaaccagagtttcccggacatgtcattctggaacagtatcaagcaaacgtgggtgccgcactgcggccagcctttagtcaagataccccaagtgatatcatcgccaaggcatgtcaggtatgctccacttggataggctctggggtggtgagcgaccttaacgatctacgcagagttcacaacttactagtgagttctcttgacaaagtccaggccggaaaaggctcctcttcccaactatatagggagtcagccacaacgatggagaaactcgcagtgctgaaagcttgggcggaggtctacgttgtcgctatgaatataaaaaaagaggccgagagcaagccaaagagagctatcaagaacaccgatgatgacgatgacgattgcggaactattgacgaacttccccctgattccttaattactctggtgcaacctgaactgcccactctgagcaggctctggctcgcagcccttaaagattacgcccttctgacactgcccgctgaattctctagccagttacctcccgacggtggggcattctatacccctgagacaatagacactgcgaggttgcactacaggaatagctgggcaccaattctccatgctgtggccttgtggttgaattctacagggttcacctgctccgagagcacagaagccgctgccatcagcggactccagaaaaggagcacttctgtgaacttgaaccaggcctcaggggctgtcggatcggcaaaaagtctgcccgaaattaacaaagatcggatgcacctgattttaggggtctctatacagtttttgtgttctcccagacccgaggagcccatcgagcacgtgacagcttgccttcaggctctccacactctgcttgatagcccgtacgctcgcgtgcatatcgctgaagaccagctcattggggtggagttgctcagtgtgttgcaccgacttttactcacctggaaccctagcagcgtgcaacttttggtgaccggggtggtacaacagatcgtgcgagccgctcaagattatctgcaggagaagaggaatacgctgcggtgcatgaccattcttcctactattttattcctaattgcgagaattcttaaagacaccgcgatcaaaagcgctgacaaccaggtgcctcctcccgtcagtgccgcactgcagggcattaagtccattgtaacactgtcaatggccaaaacagaagccggtgtccagaaacagtggaccgcactgatccggagcaccctggcctgtatactggaatatagccagcccgaggatagtgtaccaacacctgacgaggtctctatgctgactgcgatcgcattgttcctgtggagcgccagcaacgaaattattggcgtgcagagcctgcagaacggatgcatgaaccggttcaaaaatgcactgaacagctgcgatccatgggtccaggccaagtgttatcagttgctgctgagcgtttttcaacactccaaccgggctttgagtactccatatattcattctctcgctcccatcgtggttgaaaagcttaaagcggtggagcgaaatcgtcccgcttcaaacatcgagctattggctgtccaggaggggattaaagtcttggaaacgctggtggccttgggggaagagcagaatagagtacagctcctagctttacttgtgcccaccctaatcagctatctcctcgacgagaatagcttcgcctcggcctctagcgcatcgaaggatttacacgaattcgccctccagaacttgatgcacatagggccactgtatcctcacgcattcaagaccgttatgggggctgcaccagagctgaaggtgcgcctggagacagctgtgagggcttcacaggcttccaaagccaaggccgcagccagacagcccgcaccagctatccacagtgccccaactatcaaactgaaaacaagcttctttta

SEQ ID NO: 56754 - DNA, 2307 bp, Artificial Sequence
  Description of Artificial Sequence: Synthetic coding sequence
atggaattagcccacagtcttctgctgaatgaggaggcacttgcacagatcaccgaggccaagagacctgtcttcattttcgaatggctgcggtttcttgacaaagtactggtggccgcaaataagaccgacgtcaaggagaagcagaagaagctggtggagcagctaactggcctgatcagttcatcgcctgggccacccacacgaaagctgttggcaaaaaatcttgccgctctctatagtataggggacacattcaccgtgtttcagaccctcgacaagtgcaacgacatcataagaaataaggacgataccgctgcgtatctacccacaaaactggcggctgtagcttgtgttggagccttctacgagaagatgggtaggatgctgggcagtgcttttccagaaactgtaaacaaccttctgaaatccctgaagagcgcagagtcccaggggagatcagaaattctcatgtcgctgcagaaagttctcagcggactgggtggtgcagccgcttctagccaccgagacatctacaaaaacgcaaggagtctactcaccgaccggtccatggccgtgcgctgcgccgtggccaagtgtctactggaacttcagaatgaggcagtgttcatgtggacagccgaactggaaaatattgcgactctttgctttaaagccttagaaaattctaattacggagtcagagttgctgtcagcaagttactcgggaccgtcatggccactgcactcatgccaaagcaggccacagttatgcggcagaacgttaaaagggcaacttttgacgaggtcctagaactcatggctacaggattcctgcggggtgggtcggggtttttgaaatctggtggagagatgctgaaggttggtggcagcgtaaacagagaagtcagagtcggtgtcacccaggcgtacgtggtgttcgtcactaccctggggggacagtggctggaacggtcttttgccacatttctgtctcatgttttggacctagtttcacatcctagagctacgcagacgcatgtggaggccgtctactcgcgcagatgcgtgtcttttatattgagggcaacggtagggtcactactcggtgaaaaggcgcagatcgcagcagctaaagagatttgccaggcaatcgggaagcaaatgaaagctgtggaggcggtggtgaacgacacctccggagaaaacaaatccggagccgctgacatcgcagcctcacaacacgtgatggtctgcgcattacaggagcttgggagtttagtgcaatcactgaacgcgacagcttcacccctgatacaggaggcctcgatcgggttgctggagatagtgacctcagtgctcttacacccctccatggccgcacgcctggccgcagcttggtgcctgcgctgtgtcgcagtagcactgcccttccagttgactccatttctcgaccgctgtgccgagaggctgaataatctcaagaccagccccgaagctgtgtcaggatactcgtttgccatggccgcactgctggggggtgtccaccagtgcccactcggaatcccacatgccaaaggcaaaatggttgtctcaatcgccgaggacctgctgaggactgccgctcagaattcaagactgagcctgcagaggacacaggccggatggctgctgctcggcgcactcatgacattgggcccttccgtcgtccgctatcacctcccaaaaatgctgctgctgtggcgtaatgtgttcccacggagcctgaaggagctggaagccgagaaggctagaggggatagtttcacgtggcaggttaccctcgagggaagagctggcgcactgtgcgctatgaggagtttcgtggctcactgccctgagttgctcactgaagacgtcattcggaagctaatgacacctattgagtgcgccatgaccatgatgtcacacataccgtccgtaatgaaagctcacggagctcatctgaaggcctccgccgcaatggttaggctccgcctgtatgacatcctggctctcctgccccctaaaacttacgaggggtccttcaatgctttactgcgggagctggtggccgagttcaccctgactgataactcagcaaatacaacaacaagcctgctgcggagcctgtgccactacgacgattctgtcctgctggggagttggttacaggaaactgaccataaatccatcgaggaccagctacagccgaacagcgcttctggctccggtgcactggaacacgatccatcctccatttacttacttctctttttggtacattag

SEQ ID NO: 56755 - DNA, 3546 bp, Artificial Sequence
  Description of Artificial Sequence: Synthetic coding sequence
atggccgctgtgcaagtcgtgggcagctggcctagtgtccagcctcgggaggctcctcgggaagcaataccggagcggggtaatgggttcaggctcctgtccgccaggctgtgcgctctaagacctgacgattcgagttctgccagaaccgaaatacatcttttattcgaccagcttatcagtgaaaattactccgagggatccggcgttgccccagaggacgtgtcggcccttctggtccaagcctgcagactggttccacttaatcagaatcacttggtttctaaagtgtctcagctgatccaccacttgctgaacagactgcaggttatcgtggacgaacaacacctggactttctgctcgcttacacaatcagcgccattcaccagtgcagtagttggacgcatcgggagattctgcaggcgctggccgctctggtgtactgcaacggcagtaagtgccaaaaatacctcccggagctccttggaaacactggcctgcttatgaagctctcagacctcgcacagtcagatcccgaagtgaggcgcgcagcagtgcactgtatggccaacctctgtctttccgtgcccggacagccatacttggaggagccttaccagaatgtctgctttcaggcattcctcactatcctgcagagcccgaagtccagcgatatggacgatatcaccttctgcatgttgctgcagaacgctttgaagggcatccagtcactccttaacggaggcaggatgaagcttacacagaccgatgaattaggcgctctgctcgccgtgctcaaaaagtttatgttccatgggctgcctggactcaacatcgagatgcctacagttctgtatcccactccgctcccacagtatgatggtcggactcccattaagccccaacagtctgaatcaagtgcatcacgtccgacactgaacaaaaaaaagaaaagcaaggtcaagccaaaaaaaatccaacagggcgaggaggaagagaaggaatcgtcaggggaaattgaggccgcacctgtgacaggtacagggagggttaatttgcacgaggggaacacctggtgtccaagcagcctcggcgtgcaatcgcttccactggacggatctggtgctgccgaaaaggacggcgtgagtagcagcttcagcagctcatcttggaagagagtgagcagctcggaatccgactttagcgacgcggaagggggaatgcagagtaagatgcggagttaccaagccaaggttcgccagggagcactggtttgctttctgagcaccatcaaatccatcgaaaagaaagtgctgtacggttactggtctgcatttattccagatacgcctgaactgggctccccacagagcgtgagtctgatgacactcacgctgaaggatccctcgccgaaaacaagggcctgcgcactgcaggtgctgagcgcaatcctggaggggagtaagcagttcctgtctgtggcagaagatacatcagatcaccggcgagcctttacacctttcagtgtgatgatagcatgctccattcgagagcttcaccggtgcctgcttctggccctggtagccgaatcgagttctcagactgtgactcagataattaaatgcttggccaacctggttagcaacgcaccatacgatagactgaagttatcattgctgaccaaagtgtggaaccaaatcaagccctacatccggcataaagacgtgaacgtgcgagtgagctccctaaccttactgggtgctattgtgagtacacatgctccattacctgaagtgcaactcttgctgcagcagccatgttcgtctggtctaggcaacagcaactcagctacaccgcacctgtccccccctgactggtggaaaaaggctccagccggacccagtttggaagagacgagcgtaagtagcccaaaaggcagttccgagccctgctggctcattcgtctgtgcatcagtattgtggtcctccctaaagaggactcttgctcagggtcagacgcaggaagcgccgcaggctccacctacgaaccaagccctatgaggctcgaagcactgcaggttttgacactcctggccagaggctactttagtatgacacaggcttatttgatggagcttggggaagtgatttgtaaatgcatgggagaagcggacccaagcattcagctccatggggcaaaacttttggaagaactgggcacaggactgatacagcaatataaacctgattccacagctgctccagaccaaagggctcccgtctttctggtggtcatgttctggaccatgatgctgaatggacccctgcctagggctctgcaaaactccgagcaccccactctccaggcatcagcctgcgacgctctgagctctattcttcctgaggcgtttagcaacctcccaaacgataggcagatgctgtgcatcactgtcctgctgggtctgaatgactctaaaaacagattagtgaaagcagccacaagtcgagccctaggcgtgtacgtccttttcccttgtttgcgccaggacgttatctttgttgctgacgcagcgaacgctatattgatgtcacttgaggacaaatctcttaacgtcagagctaaggcggcttggagcctgggaaacctaaccgacaccctgattgtgaacatggaaacgcctgatccctcttttcaggaggagtttagtggcctactcctgttgaagatgctacggtctgcaattgaagctagcaaagataaggacaaggtgaagtctaatgcggtgagagccctcggaaacctgctccactttctgcagccttctcatatcgaaaaacccactttcgctgagattatagaggagtccatacaagcgttgatctccactgtactcaccgaggccgctatgaaggtgcggtggaatgcctgttacgctatgggaaatgtgttcaagaatcccgcactgcccctggggaccgcaccctggacatcacaggcttacaacgccctgacaagcgtggttacctcatgcaaaaactttaaggtacggataaggtccgccgcagctctgagcgtacctggcaaaagagaacagtacggatcagtggaccagtatgctaggatctggaatgcactggtcactgctctgcaaaagagtgaagataccatcgacttcctcgagttcaaatactgcgtcagcctcaggacacagatctgccaggcactgatccaccttttgtccctcgcctccgcgagtgacttgccatgcatgaaagagactctcgaattgagcggcaacatggtacaatcttatattctgcagttcctgaagtcaggggcagagggtgatgataccggggcaccgcatagtccccaggaaagagaccagatggttcggatggccctaaagcacatggggagtattcaggctcccactggcgatacagccaggcgggctatcatgggttttctagaggagatactggccgtctgcttcgacagcagcgggtcacagggcgctctgccaggactgacaaaccagtag

SEQ ID NO: 56756 - DNA, 2751 bp, Artificial Sequence
  Description of Artificial Sequence: Synthetic coding sequence
atgtccaagtatctcccagagctcttaggcaataccggcttactcatgaagctgagcgacctggcacagagcgatcccgaagtgaggagggctgcagtgcattgcatggccaatctttgcctttcagttccaggacagccttacttagaagaaccttaccaaaatgtatgctttcaggcttttttgaccattcttcaatcaccaaagagctccgatatggacgacattacgttctgtatgctgctgcagaacgctctgaagggcatacaaagcctgctgaatgggggaaggatgaagctgactcagaccgacgagctgggggctctccttgctgtcttgaagaaattcatgttccatggcctgccaggactaaatatagagatgccaactgtcctgtaccccacaccgttgcctcaatatgatggtagaaccccgatcaaaccacaacaatctgagtcctccgcctcccgcccaaccctgaataagaagaagaaatcaaaggttaagcctaagaaaattcagcaaggagaagaagaagaaaaagagtcctccggcgagattgaagcagcacctgttacaggcactggacgggtcaatttgcacgaggggaatacctggtgtcccagctctcttggcgtgcagtcacttcctctcgatggatcaggcgctgcagaaaaagacggagtaagttcaagttttagttccagcagttggaaacgggtctcttcctctgaaagtgatttcagcgacgctgaaggtggcatgcagtctaaaatgagaagctatcaagccaaagtaaggcagggtgcgctggtatgctttcttagcactatcaaaagcatcgaaaagaaagtactctatggttattggtctgccttcattccagatacccctgagctgggcagcccacagagcgtgtctctaatgacactgacacttaaagatccctcaccaaaaacgcgggcatgcgcgctgcaggtactgtccgcaatcctagaaggctcaaaacagttccttagtgtcgctgaggacacttctgaccatcgccgtgcgttcacccctttctcggttatgatagcctgctcaatccgagaactgcaccggtgtctcttactagctctagttgccgaatcgagttcacaaacagtcacacagatcattaaatgcctcgccaatctcgtgagcaatgccccatacgaccggttgaaactttctttgctgaccaaagtgtggaatcagattaagccctatatccgccacaaagacgtgaatgtccgggtcagtagtcttacactccttggggctattgtctccacgcacgccccactcccagaggttcagttgctcctccaacagccatgcagcagcggtttggggaattcgaacagtgcaaccccccatctctcaccccctgactggtggaagaaggcacccgcaggtcctagcctggaagaaacatctgtttcgagccccaagggttcaagtgaaccttgctggcttatcagactctgcatctctatcgtggtgctgccgaaggaagattcctgcagcgggtcagatgctggttcagccgcaggtagcacctacgagcccagccctatgcgactggaggccttcagcaacctacctaatgaccggcagatgctgtgcatcaccgtgttgctcggcctaaatgacagcaaaaaccgtcttgtaaaggcagccacttcaagggcccttggtgtttatgtgctatttccctgcttgagacaggacgtgattttcgtggccgacgctgccaatgccatccttatgtcattagaagacaagtcccttaatgtgagggctaaggctgcctggtctcttggcaatctaactgacacgctgatcgtgaacatggagacaccagaccctagttttcaggaggaatttagcggtctccttttattgaaaatgttaagaagtgctatagaagcctcaaaagataaggacaaggtaaaaagtaacgcggttcgggcactggggaaccttcttcactttctccaaccatctcacatcgaaaaacctaccttcgccgagatcatcgaggaatcaattcaggcccttataagcacagtgctgaccgaggcagccatgaaagtgaggtggaacgcatgctacgccatggggaacgtgtttaagaaccccgctctgcctctcggcacggccccatggacctcacaggcctacaacgcactaacaagtgtcgttacaagttgtaaaaatttcaaggtgagaattaggagcgcggctgcactttccgtgccgggaaaacgggaacagtacgggagcgttgaccagtacgcacggatctggaacgcactggtgacggccctgcagaaatccgaagatactatagattttcttgagtttaaatattgcgtctctttgagaactcaaatctgtcaggcattgatacatttgctctcactggcctcagccagcgacctgccttgcatgaaggaaactctggaattgagcggcaacatggtgcagtcatatatattacagttcctcaagtcaggcgcagagggggacgacactggtgctccgcactcgcctcaggagagagatcagatggtaaggatggctttgaagcacatgggttccatccaagctcctacgggggataccgcacggagagcaatcatgggtttcttggaggaaatcctagctgtgtgtttcgatagcagtggaagtcaaggcgcactgccaggattaactaaccaatag

SEQ ID NO: 56757 - DNA, 4926 bp, Artificial Sequence
  Description of Artificial Sequence: Synthetic coding sequence
atgacagagagttcaatgaagaagcttgcaagcacgttactggacgcaatcactgacaaagatcctcttgtgcaggaacaggtgtgtagcgctctctgttccctgggggaagccagacctgtggagactcttcgggcttgtgaggaatacttaagacagcacgataagctcgctcacccataccgggctgccgtcctacgcgctatggagcgtgtcctgagctcacgggcaagcgagctggacaaagatacagcttcaactataattttgctggccagctccgagatgaccaagacaaaggatctcgtgtgggattggcagcaggcagccagcggagtgctagtcgccgtgggacgtcagttcatatccaaggtgatggaagagctgctgaggaggctgcaccccggaacattgccacactgtgccgtactgcacaccctggcaagcctgtcagtggccaatgcgttcggagtggtccccttcctgccctccgttctgagttctctcctcccggtactcggagtggccaagcaggacacggtccgcgtggctttctgtagcgctttacagcgtttttctgagggggcacttgagtacctggccaatctggaccgcgctccagatcccacagtgcgcaaagatgcttttgccaccgatatattctcagcgtatgacgtgctcttccaccagtggcttcagagccgagaggcgaagctcaggctagcagtggtggaggctctgggacccatgtcccacctgcttcctagtgagcggctcgaggaacagctaccaaagctcttgccaggcattctcgcactttataagaagcacgctgaaaccttttacctgagcaagtcactgggccagatcctggaggccgctgtgtccgttgggtcccggaccctggagacacagctggatgctctgctggccgctttgcacagccagatttgtgtcccagtggagtcatcttcacccctggtcatgtccaatcaaaaggaggtgcttaggtgtttcacagttcttgcctgttcttcccctgacaggctgctcgcatttctcctgccgaggctagacacatcgaacgagcgcactagagtgggtactttgcaagttgtgagacacgtgatcaactcagccgctgcccagatggaggataagaagccttttattctaagtagcatgaggctgcccctgttggacactaactcaaaggttaaaagggcagtcgttcaggtgatttcagcaatggcacatcatgggtatttggagcagccagggggtgaggccatgattgaatacatcgttcagcagtgtgccctccctcctgagcaggagccagaaaaacctggccctggcagcaaggatccaaaagcagacagcgtgagagccatcagcgtaagaactctctacctcgtgtctacaacggtggaccgtatgtctcatgtgctctggccttacctgctccagtttcttactcccgtgaggtttaccggggctcttaccccgctgtgccggtcattggtgcacctggcccaaaagagacaggaggctggggcagatgcctttctcatccagtatgatgcccacgcctctctgccttccccgtatgccgtgacaggcagactacttgtggtgtcaagcagtccctatctgggcgatgggaggggcgctgcagcactccgacttttgtctgtactgcatccaaatattcatccccttctaggtcaacactgggagactactgtgccgctgctgctcgggtatctggatgagcatacagaggaaactttgccccaggaagagtgggaagagaagctcctcatgttcttgcgggatacactggccatcatctcagacaatgcttggatctgtcagcttagtctggagctctgccgccaactcccttgctatgatgaagcccctcaggaaaagaacttcctctacaaatgcattgggacaacacttggggcagcgtccagcaaggaagtcgttcgcaaacatctccaggaactgctcgagaccgcacgctaccaggaggaagccgaacgggaaggactggcctgctgcttcggcatttgtgcaataagccatctggaagatactttggctcaactcgaggacttcgtcagatccgaggtctttcgaaagtcaattgggattttgaacatatttaaggataggagcgagaacgaagtagagaaagtgaaaagcgccctcattttgtgctacgggcatgtggctgcccgtgcccctagggagcttgtgctggccaaagtcgagtccgatattctgcgcaatatctgccagcacttcagcacgaaagtgctgggcatcaaagtggaaacaaaggaccctgccttgaaattgtgtcttgtgcagtctgtgtgtatggtgagtagagctatctgctcgtcgacccaagccggttctttccactttacacgcaaagcggagctggtggcccagatgatggaattcattcgtgctgagccaccggattctttgcgaacccccatccgcaagaaggcgatgctcacatgtacttacttagtgtccgtagaacccgctctggacgagcaggctcgggctgatgtcattcacggctgcttgcacagcattatggccttgttgccagagccaaaggaagaagacggaggctgtcagaagtctttgtacctggagactctccacgcactggaggatttgctgaccagtctactccagcgcaatatgacaccacaggggttgcaaatcatgatcgaacacctgtcgccttggatcaagtctcccagggggcacgagcgggctcgagcgctggggctatcagctctgctgttgcgttacttcctggagcacttaagggtatccgccttggtcccatttcataacctggggctcctgataggcttattctcaccaaggtgcgccgatctgtggccggcaactagacaagaggcagtcgactgcgtgtactctcttctgtacttacagctcggctacgaggggttctccagagattatagggacgatgtcgctgagcgccttctttcgttaaaggacggtctcgttcacccagatcctgctatccttttccacacatgccatagcgtaggacagatcatcgctaaacgactgcccccagaccaactgatctccttattgctaaccatgttcgaggccctgggtgatccagaaaagaattgctcaagagccgctacagttatgatcaactgtctgctgcaagagaggggcggagtcttgcaagagaaagtgccggagatcgtgtctgtcttgagatccaagctgcaggaagcccaaggcgaacacgtgttgccggctgcccaacactccgtgtacctgctggccacccagcattgtgctgctgttgtcagcagccttctaggctcaccgttgccccttgacagtcacacttgcatgttgtggcgtgccctggccgttgagccgagattggctgctcaggtgctcgggttgctcctggagaagatgtctagggatgtcccattcaaagaatcaagggctttcctgctggggaggacccccgatagggtcgccacactcctgcctctttctgctacttgcgccctctttgaggttatgagcacacctgccgcagggccagctgtgctggaattatatcctcaactttttgtcgtgctgctactccgagtatcctgcacagtcggcgtgcagctgccaaggaacttacaggcacaggagcgacggggagcttcccccgctcttgccacccgcaatttggaaccatgctcaagtgctgtggataccctaaggagtatgcttctgcgttcggggagtgaggatgtggtacagcgcatggatttagaaggcggatgggagctgctgcgcacttctgctggacatgaagagggagccacacgtctggctagggcaatggccgagcacgccggtcccaggctgccactggtcctgaaaaccctggcatgcacccactcgagcgcatacgaaaaccagcgcgtcaccactaccgcctttctggcggagctgctgaatagtaatgtggccaatgatctgatgttgctggactctctgctggagtccttagcagcaagacagaaagacacatgcgcctccgtgagacgtctggttctcaggggcctggctaatctcgcctccggctgtcctgacaaggtacgaactcacgggcctcaactcctgaccgccatgattggcggattagacgatggagataatccccactctcccgttgctctggaagctatgttgggcctggcacgcctggtccatctggtcgaaagctgggacctacgttctggcttactgcacgtggcgatcagaattcgtcccttcttcgattccgagaagatggagttccgcaccgcatctatccgtctgttcgggcacttaaataaggtttgtcatggcgactgtgaggacgtcttcctcgatcaggttgtcggcggtttagcccctttactgctgcatctgcaggaccctcaggcaaccgtggcctccgcatgtaggtttgccttgcggatgtgcggacccaacctggcctgcgaagaactcagcgccgcttttcagaagcacctacaggaaggcagggccttacacttcggggagttccttaatacaacgtgcaaacatctgatgcaccacttccccgatctgctggggagactgcttaccacttgccttttttattttaagtcatcatgggagaatgtgagggcagccgcaccattatttacagggtttctcgtgctgcatagtgagcccagacagcaaccacaggttgatcttgaccagctcatcgctgctctgcagatactcttgaaggatcctgctcctgaagtgcggaccagggcagcggaggccctgggcagactggtcaaactggcatag

SEQ ID NO: 56758 - DNA, 1023 bp, Artificial Sequence
  Description of Artificial Sequence: Synthetic coding sequence
atggagcgggtcctttcaagtagagcatcagagctggataaggatacggcgagcaccataatcctcctagcttcttctgagatgacgaagacgaaagacctcgtttgggactggcagcaggccgcttccggcgtgttggtcgcagtgggacggcaatttatttctaaagtgatggaagaactcctcagacggttgcaccccggaacactcccgcactgtgctgttctccacacgctagcctccctctcagtcgccaatgcctttggagtggtaccctttctgccaagcgtcttgagctctctgctgcccgtgctgggggtggccaagcaggatactgtgagagtggcgttttgctccgctctgcagagattttccgagggggctctagaatacctggccaatctcgaccgggctcctgaccccacagttcgcaaggacgccttcgcgaccgacatattctctgcctacgatgtgctgtttcaccagtggctccagtctcgcgaggccaagctcagactcgctgtcgtggaggcgctcggccctatgtcccacttacttccctcggagcggcttgaggagcaacttcctaaactgctccctgggatcctggccttatacaagaagcatgcggaaacgttttacttaagcaaatccctgggccagattcttgaggctgcggtgtctgtcggaagcagaactctagagactcagcttgatgccctgctggccgctttacacagccagatctgcgttccggtcgaatcctcaagtccccttgtgatgagcaaccagaaagaagtcctgaggtgcttcacagtccttgcgtgtagctcacccgacaggttgctggccttcttactgcctcggctcgacactagcaatgagcggaccagagtggggacactccaggtcgtaaggcatgtcataaattccgcaggtgagtgtctgcatgcctctctcgcagctacacccggacacgtccaagatggagccggaccgggacggctgtgtccatcaaagtag

SEQ ID NO: 56759 - DNA, 4926 bp, Artificial Sequence
  Description of Artificial Sequence: Synthetic coding sequence
atgaccgagtcctccatgaaaaaactagcaagtaccctcctcgacgccatcacggacaaagatcccctggtccaagaacaggtgtgctcagcactgtgctccctgggagaagctcgacccgtggaaacgctgcgcgcatgtgaagaatacctgcggcaacacgataagctggctcacccataccgcgcagcagtcctcagagccatggaacgagttctatcctcccgcgcttcagagttagataaagacactgctagtaccattatcctgctggcttcttcagaaatgaccaagacaaaggacttagtgtgggactggcagcaggctgccagtggtgttttggtcgccgtggggaggcagttcatctccaaggttatggaggagctgctcagacgactccaccccggtacactcccccattgtgctgtactgcacactctcgccagtctatcagtggctaatgccttcggcgtggtcccttttctccctagtgtattgtcctctttgcttccagtgttgggagtggctaaacaggacacagtcagagtggcattttgcagtgcattgcagaggttctcagaaggcgctctggagtatctggccaacctggaccgcgctcccgaccccacagtgagaaaggatgcattcgcaactgacatcttctcagcctatgatgtgttgtttcatcagtggctgcagagtcgggaagctaagctccggctcgccgtggtagaagcgttaggtcccatgagtcaccttttacctagtgagagattggaagagcagctgccaaagctcctgccgggaatcttggcattgtataagaagcacgccgagacgttctacctgagcaaatcactgggccaaattttggaagccgctgtcagcgtagggtcacgcaccctggagacgcaactcgacgcactgctggcagctctccactctcagatttgcgttccagtggagtcgagtagccccctggtcatgtcaaatcagaaagaggtactgagatgtttcacagtgctggcttgtagctctcccgacaggttgctggcgttcctgctgccacggttggacacttccaatgagcggactcgcgtaggcactctgcaagtcgtgaggcatgtcatcaatagcgctgccgctcagatggaagacaaaaaaccgttcattctgtcctctatgaggttacctctgcttgacactaatagcaaggtgaaacgggctgtggtgcaggtgatttctgctatggcccatcatggctatttagaacagccaggtggagaagccatgattgagtacatcgtgcaacagtgtgccctccctcccgaacaagagcctgaaaaaccgggtccagggtctaaggatccaaaagccgacagcgtgagagcgatctccgttcggactctttatctcgtctctactaccgtcgaccggatgtctcacgtgttgtggccttacctcctgcagtttttaacccccgtgcgcttcaccggagccttgacgccgctgtgtcggtccttggtacacctagctcagaagcgccaagaagctggcgctgacgcattcctcatacagtacgacgcccacgcgtcgctcccctctccctacgcagttacagggagactgctggttgtttcgtcttccccttatctaggcgatggacgcggagccgcagcgctgcggctcctgagcgtcttgcatccaaatatccacccgttgcttggccagcactgggaaaccaccgtaccactgctcctaggttacttggatgagcatacggaagaaacgcttccgcaggaggagtgggaggagaaactcttaatgttcttgcgcgacaccctagcaatcatttccgataatgcctggatttgccagctgagcttagagctctgccggcagttgccatgctatgacgaagcccctcaggaaaagaatttcctgtacaagtgcattggcaccactcttggagcggcaagtagtaaagaggtggtaagaaaacatctgcaggaactcctggaaaccgcgaggtaccaagaggaagcagagagagaaggccttgcctgctgcttcggaatctgcgctatctctcatctagaggatacattggctcagcttgaagatttcgtaagaagtgaagtgttccgcaagtccattggcatacttaatatttttaaagataggtccgaaaacgaagtggaaaaagtgaaaagtgcccttatactgtgttacggtcatgtggcagcacgcgcaccaagggagcttgttctggccaaagtggaatcagatatcttgcggaatatttgccagcacttctctaccaaggtgttggggataaaggtggagacaaaggaccctgctcttaagttgtgcttagtccaaagcgtttgtatggtgtctcgggcaatttgctcctccacacaagctggaagcttccattttacgcggaaagctgagcttgtggcccagatgatggaatttatccgagccgagcctcccgatagcctcagaactcccattagaaaaaaggcaatgctgacatgtacttacctcgtttccgttgaacccgcactagatgagcaggccagggccgacgtgattcacggctgtctgcattccattatggccctactccccgagcctaaagaagaggatggcggatgtcagaagtccctgtacttagaaactcttcacgctctcgaagatctgctaacgtccttgctacagcgaaatatgacaccccagggtctgcagataatgatcgagcacctgtccccctggataaaaagcccaaggggccatgagagggctagggcattggggttgtcagctcttctcttgagatacttcctagaacacctgcgggtttccgcgctcgtcccctttcacaacctgggactccttattggacttttcagtccaaggtgcgccgacctgtggcctgctacccgccaggaggccgtcgactgtgtgtactcccttctctatctacagttaggttatgaaggattctcacgcgattaccgggacgacgtagcagaacgacttctgtctctaaaggacgggctcgtacacccagaccccgctatcttgttccatacatgccacagcgtgggacagataattgccaagcggctgccccctgaccagctgatttctctcctcctcaccatgttcgaggcactcggcgatcctgaaaaaaattgctccagagcggcaaccgtgatgatcaactgcctgttacaggagaggggtggtgtactccaagaaaaagtgccagagattgtctctgtgctgcggagcaaactccaggaggctcagggagaacacgtgctgcccgctgcccagcatagcgtgtacctcctggctacccagcactgcgccgcagtcgtgagttctctcttgggctcccctctacccctcgactctcacacgtgcatgctgtggagggccctggctgtagagcccaggttggccgctcaggtcctgggccttctcctagaaaagatgagccgggatgttccctttaaggagtctcgtgctttcctcctcggcaggactccagacagggttgccaccctcctgccccttagcgccacatgcgctctgttcgaggtcatgtctactccggctgcgggacccgctgtcctggaattgtatccacaattatttgtcgtacttctgctgagagtgtcatgcacggtaggggtgcagctcccccgaaatctccaggctcaggaacggagaggggcatcacccgcattggcaacacggaatctggagccctgttcatcggctgttgacacactcaggtcaatgctgctccgtagcggctccgaggacgtggtacaaaggatggacttagaaggaggctgggagctcctgcggacgtcggccggacatgaagagggagctactaggctcgccagggcaatggcagaacatgccggtccaagattacccctcgttttgaagacattagcgtgcactcatagtagtgcctacgagaatcagcgagtgaccacaactgcattcctcgccgagttacttaattctaacgtagcaaatgacctgatgttgttagactcactactggagtccctggccgctcggcagaaggatacgtgtgcgtctgtccgcagactggtcttgaggggtctggcaaacctagcatccgggtgccccgataaggtgaggacacatggacctcagctgctgactgccatgattggagggcttgatgacggggacaacccacactctcccgtggctttggaggccatgctcggtttggcacgattagtgcaccttgtggagtcttgggatctacgctctggattattacatgttgctattcgaatccgacctttctttgactcggagaaaatggagtttagaactgcctccatccgactatttggacatctgaacaaggtttgtcacggggactgtgaggatgtgttcctggatcaggttgtgggcggattggcaccactactcctgcatctccaggatccccaggcgacagtcgcttcagcttgtcggtttgctttacggatgtgcgggcctaaccttgcctgcgaagaacttagcgccgcttttcagaaacatctgcaggaaggcagggctctacattttggggagttcttaaacacaacctgtaagcaccttatgcaccacttcccagaccttctgggacggctgctgaccacctgtcttttctatttcaagagctcctgggagaatgttagggctgctgcccctctgtttaccgggttcctggtgctccactccgagcccagacagcagcctcaggtggatctggaccagttgattgcggctctccagatattactgaaagacccagcccctgaagttcggactcgcgctgccgaggcactggggagactggtgaaactagcttag

SEQ ID NO: 56760 - DNA, 1653 bp, Artificial Sequence
  Description of Artificial Sequence: Synthetic coding sequence
atgatcaactgtcttctccaagaacggggtggcgtgctccaggagaaggttcctgaaatagtcagcgtcctacgctctaaattgcaggaggcacagggtgagcacgtgctgccagcagctcagcactcggtgtacctcctggcaacacagcactgcgccgcagtcgtgtcgtcactcctggggtctcctctcccgctggactcccacacttgtatgttgtggagagctttagctgtggagccaagactggcggcacaggtgcttggcctacttctggagaagatgtcgcgtgatgtcccttttaaagaatcaagagcctttctgctggggcgaacacctgatagggtagccaccctactgccattaagcgcaacgtgtgcgctatttgaagtcatgtcaacacctgccgcaggcccagccgtgctggagttgtatccccagttgtttgtggtgcttttgttgagagtgagctgtactgttggcgtgcagttgccccgtaacctccaagcccaagaacggaggggtgcgtccccggctttagctacacggaatctagagccttgttctagcgcagtggacactctgaggtccatgttgctgcgatccgggagcgaagacgttgtgcagaggatggacctggaggggggatgggaactgttgcgcacttctgctggccatgaagaaggggcaacccgcctggctcgggctatggccgaacacgccggtccgagactgccactggtccttaagactcttgcgtgcacccacagctccgcctacgagaaccagcgtgtaacaacgacagcgtttttggctgaactgctgaatagcaacgtggctaatgacctcatgcttctggattccctgcttgagtccctagccgcaaggcagaaagacacctgtgctagtgtgcggcgactcgtccttcgagggctggcaaatctcgctagcggctgtccagataaagtgaggacccatggaccacaactgttgaccgccatgatcggcggtctggacgacggtgacaatccgcattctccagtggccctggaggccatgctgggactggccagactggtgcacttggtagagagctgggatctgcgctcaggcctgctgcatgtggcaattagaatacggcctttttttgatagcgagaagatggaattcagaactgccagtattaggctgtttggtcatctgaacaaggtctgccacggggattgcgaagacgtgtttttggaccaggttgtggggggactggcccctctgttgttgcacctgcaagaccctcaggcaacagtggcctcagcatgtcgattcgccctcaggatgtgtggacccaacctcgcatgcgaggagctgagcgccgctttccagaaacatttgcaggaggggagagctctgcattttggggagttcctaaataccacatgtaagcacttgatgcaccacttcccagatctgctgggcagactcctcactacatgcttattctattttaaaagttcgtgggaaaacgtgcgggcagccgctccattgtttaccggcttcctggtcctgcacagcgagcccagacagcagcctcaggtcgatctggaccaactgatagctgccccattactgtacccacagaggagtaggtcatgctag

SEQ ID NO: 56761 - DNA, 1269 bp, Artificial Sequence
  Description of Artificial Sequence: Synthetic coding sequence
atgacagagtcctcaatgaagaagctggcctctacattgcttgacgctatcacagacaaggatccgctggtccaggagcaggtgtgcagcgctttgtgttcccttggcgaggctcgacctgtggagacactccgcgcttgtgaagagtatttacgtcagcatgacaaactggcccacccctaccgggcagcagttttgagagccatggagcgagtactgagctctagagcttcagaactggataaggataccgcaagtacgattatcctgctggcaagttctgaaatgactaagacaaaagatctcgtgtgggactggcagcaagcagcgtctggggttctggtggctgtgggtcgtcagtttataagcaaagtaatggaggagctactgaggagactacacccaggcacacttccccactgcgccgttctgcacacactggcctcgctgagcgtagctaatgcttttggcgtcgtaccgttccttcccagcgttctctcgtccctgttgcctgtgcttggagtggctaagcaggatactgtccgcgtggcattctgctcagcacttcaaagattttcggaaggggcactggagtatttggccaacctagaccgagccccagaccctactgtccgaaaagatgccttcgccacagatattttttccgcctatgacgtgctgtttcaccaatggctgcagtcacgcgaggccaagcttcggcttgctgtggtggaggcactgggtcctatgagccacctcctgccatctgaacgattggaggaacagctcccgaagcttctacccggtattctggcattgtataagaagcacgcagagacattctacctctcaaaatcactgggacagatactcgaggcagccgtaagtgtcggcagccgtacacttgagactcagctggacgctctcctcgccgctctgcacagtcagatctgtgtcccagtggagtctagctcccctcttgtgatgtcgaatcagaaggaagtgctacgttgtttcacggtgcttgcttgttcctctcctgacaggctgctcgcctttctgctgcctcggctggacaccagcaatgagcgcactagagtgggaactctgcaagtggtgaggcacgtgatcaatagtgccggtagcactaatacgagaataacattaatgttacctagcgccgtaactagacttaaacatgaggattgccccgcaagagctgctcctcaacccgcagaccttactgcagcaccagccagtgttgcatag

SEQ ID NO: 56762 - DNA, 4926 bp, Artificial Sequence
  Description of Artificial Sequence: Synthetic coding sequence
atgaccgaatcctccatgaagaaacttgccagcaccctacttgacgcgatcacagacaaggacccgctcgtccaagaacaggtctgttccgccctctgctccctcggggaggcacggcctgtggagacgctgcgggcttgcgaagaatacctccgccagcacgataaattggcccacccataccgggctgccgtcctgagggcaatggagagagtgttgtcctctagagccagcgaactcgataaggatacggcatccacaattatcctgctggcgagctcagaaatgacgaagacaaaggacctcgtgtgggactggcagcaggccgcttccggagtcctggtggccgttggtcgccagttcatctcaaaagtgatggaggagcttctgaggagactgcaccccggaacacttccccattgtgccgtcctgcatacactagcttcactgagcgttgccaatgccttcggcgtggtacctttcctgccttcagttctctcatctctcctgcctgttttaggagttgccaagcaggatacagttcgtgtggctttctgctcagcactgcagcgctttagtgagggagctctcgagtacctggctaatctggacagggcgcctgatcctaccgtgcgcaaagacgccttcgctacggatatcttcagcgcctacgacgttcttttccaccagtggctgcaatcccgggaagccaagctcaggctcgcggtggtggaggcactgggtcccatgtcccatctgttgccgtccgagcggcttgaagagcagcttccgaaactgttgccagggatattggccctgtacaaaaagcacgcagagactttttacctgagtaagtcactcgggcagattttggaggcagctgtgagtgtgggttcccgtaccctagaaactcagttggatgcactcctagccgcactgcactcacagatttgtgtccctgtggaatcttcctctcctctggttatgtccaatcagaaggaggtgctgcgctgcttcaccgttctcgcttgcagctccccagatcggctccttgcattccttctcccacggttggacaccagtaatgagagaactcgggtgggtacattgcaggtggtccgccatgtcatcaactcagcagcggcacagatggaggataagaaaccatttatcctctccagtatgaggttaccgctcctcgacaccaattccaaagtaaagcgcgcagtcgtccaggtcatcagtgccatggcccaccacggataccttgaacaacctggaggcgaggctatgattgaatacatcgtccagcagtgtgccctgccccctgaacaagaacctgagaagcctggaccaggttcaaaggatccaaaagctgattctgtgagggctatcagcgttcggacgctgtacctcgtctctacaactgtggaccgcatgagccacgtgctttggccttatttgctccagttcctgacaccggtacgcttcacaggcgcactcacccccctttgccggagtttggtgcacctagcccaaaagcgccaggaggcgggtgccgacgcctttttaatccagtatgacgcacatgcaagccttccaagtccatacgccgtcacaggacgtttgcttgttgtctcatcatctccatatctgggggatggtagaggcgcagcagcgctgaggctgcttagtgttctgcaccctaacattcatccgttgcttgggcagcattgggagacgacggtgccccttctcctcgggtatctcgacgagcacacagaagagactctgccccaagaggagtgggaggagaaacttcttatgtttctgcgggacaccctggctatcatttcagacaacgcctggatttgccagctgagcctggagttatgtcggcagctgccctgctacgacgaagctccacaggaaaagaacttcctgtataaatgcattgggaccaccctaggagccgctagcagtaaagaggtggtgcgcaaacacctccaagaactcctggagacggctaggtaccaagaggaagccgagagagaaggactggcctgttgttttggaatatgtgcaatctcacaccttgaagacacactggcgcagctagaagactttgttaggagcgaggtgttccggaagtccattgggatccttaatatcttcaaagatcggtctgaaaacgaggtcgagaaggtgaagagcgctctaatcttatgctacgggcatgtggctgcccgagccccacgcgagctggtgctggctaaggtggagagcgatattctgaggaatatatgtcagcatttctccactaaagttctcggcattaaggtggagactaaggaccctgcccttaaattgtgccttgtacaatctgtatgtatggtgagcagagccatctgttcctctactcaggcaggatccttccactttaccaggaaagctgaattagtggcccagatgatggaatttatcagagcagagcctcccgactccttgcgaacacctattcgaaagaaggcaatgttgacatgcacttatctcgtttcagtcgaacccgctctggatgagcaagccagagcagacgtgatccacgggtgtctccatagcataatggctctccttccggagcccaaagaagaggacggcggttgccagaagagtctatatttggaaacgctccacgccctggaggatctccttaccagcctcctgcagcggaacatgacaccgcaaggactgcagatcatgattgaacacctttccccttggatcaagtctccaaggggtcatgagcgggctcgggctttaggcttatcagccctgttactccggtactttttagagcatctgcgagtctcagctctagtccctttccacaatctcggtttgctgattggactgttctcacccaggtgtgcggatttgtggccagcaacacgacaggaggctgttgactgtgtgtacagcctgctgtatctgcaactgggttacgaagggttctcacgtgattatcgggacgatgtggctgaacgcttgctaagcctgaaggatggcctggtgcatccggatcctgctatcctatttcatacttgtcattcagtgggtcagataattgccaagcgccttcccccagatcagttgattagcctgctgctgaccatgtttgaagccctgggagatccagaaaagaattgctcacgcgctgccacagtgatgattaattgtctattgcaggagcggggtggagtgttgcaagagaaagtgccggaaattgtgtccgtgctacgttcaaaactacaggaggcacagggcgagcacgtgctgcccgctgcacagcacagcgtgtatctgctggccacgcagcactgtgcagctgtggtatcttcgctgctcggttcaccgctaccactagacagccacacttgtatgttgtggcgggcactggcagtcgagcctaggctggccgctcaagtgctgggtttattgttggagaagatgtcacgtgatgtacctttcaaagagtcacgtgcctttctgcttggtcggacacctgacagagtcgccacacttctacctctaagcgccacctgcgcccttttcgaggtcatgtccacacccgctgcaggccctgccgtgcttgagttgtatccgcagctgttcgtcgtgcttctcctacgagtctcatgtacagtaggtgtgcaactgccacgcaatttgcaagcgcaggagaggagaggcgcttcccccgctcttgcaacccggaatttagaaccctgtagctcagctgtcgatactttgcggtcgatgcttcttagatccgggtctgaggatgtggtacaacggatggacttggagggcggatgggagcttcttcgtacctccgccggacacgaggagggggcaacgcggttagcccgagccatggcagagcatgccggtcccagattgcccctcgttctaaagaccttggcctgcacccatagttccgcctacgagaatcagcgggtgaccaccactgccttcttggccgagctactcaactccaacgtggccaatgacctcatgctcctcgattccctgctggagtccctggcggcacggcagaaggacacgtgtgccagtgtgcgaagattggtcctgaggggattagcgaaccttgcaagcgggtgccccgataaggttagaacacacgggccacaactcttaactgcgatgattggtggtcttgacgacggggataatccgcattcgcctgtcgcattggaggctatgctcggccttgcccgactagtccatctggtggaatcgtgggatcttcggtccgggcttctgcatgtggctattagaattcggcctttttttgattccgagaaaatggagtttaggacagcttcgatccgcctgtttggccacctgaataaggtgtgccacggagactgcgaggatgtgtttttggaccaggttgtcggtggtttggctcccttgctgctgcacctgcaagacccacaggccactgtcgctagcgcctgtagatttgccctccgcatgtgtggccctaaccttgcgtgtgaggagctcagcgcagccttccagaagcatctgcaggaggggagggcattacactttggggagtttctgaatacaacatgcaaacatctgatgcaccattttcccgatttgctcgggcgattgctcacgacatgcctcttttattttaagtcctcatgggaaaacgtgagagctgccgctcctttgttcacaggttttctcgtgctgcacagcgaacccaggcagcaaccccaggtcgacttagatcaattaatcgccgctctgcaaatcctgctgaaagaccccgctccggaggtgcgtaccagagccgctgaggcgttgggtagactggtgaagcttgcatag

SEQ ID NO: 56763 - DNA, 1848 bp, Artificial Sequence
  Description of Artificial Sequence: Synthetic coding sequence
atgagaatcattgcgaaaaggctgccccctgaccaattgattagtctgcttctaactatgttcgaggccctcggcgaccccgaaaagaactgttctcgcgcagccactgtgatgattaattgcctgctacaggaaaggggaggggtgcttcaggagaaagttcccgagattgtgagcgttctaagatctaaattacaggaagcccaaggcgaacacgtgctaccagctgctcagcacagtgtgtatctgttggccacccagcactgtgctgctgttgtctcaagtttgttaggatcgcctttgcccctggacagccacacgtgcatgctgtggagggcactggcagtagaaccccgtctagctgcacaggtgctcgggttgctccttgagaaaatgtctcgagatgtgcctttcaaagagtcccgagcctttctgctgggcaggacgccagaccgcgtagccactcttctccccctgtctgcgacctgcgccttgtttgaggttatgtcgaccccagcagcaggtcccgctgtgctggaactgtaccctcagctctttgtagtcctcctgctacgtgtgtcctgtactgtcggagtccagctccctagaaacctgcaggcccaggaacggagaggtgccagtcccgctttggcgaccagaaacttggaaccatgctcaagcgccgtcgacacactgcgctccatgctgcttcgcagcggatctgaggatgttgttcaaaggatggacttggaaggtggctgggaactgctcaggaccagtgccggtcatgaggagggcgcaaccagactggccagagccatggctgagcacgcgggacccagactgcccctcgtgctcaagactctggcctgtacgcattcaagtgcttatgaaaaccagcgggtgacaaccaccgcattcttagccgaactgttaaattctaacgtcgcaaatgatctgatgctgctggactcactcctggagtctctggcagcacgacagaaagatacatgtgccagcgtgcggaggttagtcctgaggggcctggccaatctggcatctggttgccccgataaagtcaggactcatggtccgcagctgctcacagctatgattggcggattagatgacggcgataacccccacagtccagtagcgctcgaggctatgttaggactggcaaggctggtgcatctcgtcgagtcctgggatttgaggtcagggttgctgcatgtggcaattcgcattagacctttttttgactccgagaagatggaattcaggacagcgagcatccgtctcttcggccacctgaacaaggtgtgtcacggtgattgtgaagacgttttcctggatcaggtggtgggcggtctcgccccactgttactgcaccttcaagacccccaggccactgtcgccagcgcatgtagattcgcccttagaatgtgcgggccaaacctggcatgcgaggagctgagcgccgcatttcagaaacacctgcaggaaggcagagccctgcatttcggagagttcctgaataccacctgcaagcacctcatgcaccacttccccgacctgctcggccgactattaacaacttgcctgttctactttaagtcaagttgggaaaatgtccgcgctgctgcccctttgttcacgggcaaacatcatccgttgccccaccctcatgctgctcggcagccacgcctcatgcctccactccaccgggtgcctggggcagcccttggagctcaggccgctgcggctggcggaccaggtccggctcattgtggagccccagatcccgcagaaggacctggcccacgcggtgctgacgagggctgttag

SEQ ID NO: 56764 - DNA, 4926 bp, Artificial Sequence
  Description of Artificial Sequence: Synthetic coding sequence
atgacggaatcgagcatgaagaaactggccagcacattactcgacgcaatcaccgacaaggatcccttagtgcaggagcaggtttgttcagccctctgttcgctcggagaggcacggccagtcgagacattgagggcttgtgaggagtaccttcggcaacatgacaaactggcgcacccctacagggcggcagttctgagggccatggaaagggttctctccagccgtgctagcgagctggacaaagatacggccagcacaatcatcctgctcgcttcctccgaaatgacgaagacaaaggatcttgtgtgggactggcaacaggctgcatccggagttctggtcgcggtagggagacagttcatcagcaaggtgatggaggagctacttaggcgactccatcccggaacattgcctcattgcgctgtcttgcacactctggccagtttgtccgtggccaacgctttcggagttgtcccctttttacctagcgtcttgtcttccctccttcccgttctgggggtggcgaaacaggatacagtgcgagtggctttttgctcagccttgcagagattctcagagggtgcattagagtatctggccaacttggatcgtgctcccgacccgaccgtaagaaaagacgcattcgccacagatatattttccgcttatgatgttctattccatcagtggctacagtcacgggaagctaagctgcgtctggccgtggtggaggccctgggccctatgtcccacctccttccgagtgaacggctggaggaacagttgcccaaactcctgcctggaattctggctctgtacaagaaacacgctgagacattttacctctccaagtccctgggacagatcctggaggctgccgtttcggtgggcagccgcactctggagacccaacttgatgcactcctcgccgctctgcacagccagatctgcgtccccgtcgagtctagctccccgctagtgatgtccaaccaaaaggaggtcctgagatgctttacagtcctcgcttgttccagcccagatcgcctgttagcctttctgttaccaaggttggacacctcaaacgagaggaccagggtcggaacccttcaagtcgtccgccatgttataaatagtgctgccgcacagatggaggacaagaaaccatttattctttccagcatgaggctgcccctgctggacactaacagtaaggtgaaaagagccgtggttcaggtgatatccgctatggcgcaccacggttatctggaacagcctggcggtgaggctatgattgaatacatagtacagcagtgcgcactgcctccagagcaggagccagagaagccaggacccggtagcaaggaccctaaggctgacagtgtccgggctattagcgtgcggacattgtacttggtaagtacaaccgtggataggatgagccacgtgctgtggccatacttactgcagtttttgactcctgtgcgattcaccggagccctaacaccactgtgtcgctctctggtgcatctcgcccagaagaggcaggaagcaggagctgatgccttcttgatccaatatgatgctcatgcgtcgttgccatcaccctacgcagtcaccggccgtctcttggtcgtcagcagtagtccctatctgggtgacggtcgcggtgctgcagccctccggttgctgagcgtactgcatccaaacatccaccccttattgggacagcattgggaaaccacggtccctctgcttctgggctacctagatgagcacactgaagaaacactgcctcaggaggaatgggaagaaaaactgcttatgtttctcagggatactctggccatcatcagtgacaacgcctggatctgtcagctgtccctcgaactgtgcagacaattgccttgttatgatgaggcaccccaggaaaagaatttcctctacaaatgcatcggcaccacccttggtgccgcatcgtctaaggaggtggtgcgaaaacacttgcaggagctgttggaaacggcacgctatcaggaggaggccgaacgcgagggccttgcctgttgctttggcatttgcgccatttcccacttggaagacactctggcacagctggaagattttgttcggtccgaggtgtttcgtaagtccattggaatcctgaatattttcaaagaccggtcagagaacgaggtggaaaaagtcaagtctgcgctgatactttgttatgggcatgtggctgctcgcgcacctcgagagctcgtactggctaaggtggagtccgacattttgaggaatatatgccagcacttcagcacgaaggtgcttggaatcaaggtggagactaaagatccagccctgaaactttgcctagtgcagtccgtgtgtatggtttcacgtgctatctgctcttcaacccaagccggatccttccactttacgcggaaggctgaattagtggctcagatgatggagttcattagggcggagccaccggattcactgagaacacccattcgaaaaaaggccatgctgacttgcacctacctcgtgtccgtcgagccggcactagacgagcaagccagagctgatgtgatacacggatgcctccactccatcatggccctgctgcccgagcctaaggaggaagatgggggatgccagaagtctctctacttagaaacccttcatgcgttggaggacttgctgacatcccttctacagaggaatatgactccgcagggcctacagattatgatagagcatttaagtccctggataaagagccccaggggccacgagagggcgagggcactgggtctgtccgctctactcctgcgctatttcctggagcatctcagagtgtcggcactggttccattccacaatctcggcctgctaatcggactgtttagcccaagatgtgctgacctgtggcccgctacccgccaggaggctgtagactgcgtgtacagcctcctttatctgcagctcggatacgaggggttcagccgggactatcgggacgacgtggccgagcggttgctctctctgaaagatgggctggtgcacccggaccctgccatactgtttcatacatgtcattcagtgggacagatcattgctaaacgccttccccctgatcaacttatctccttgctgcttaccatgttcgaagctctgggcgatcctgagaagaactgttcccgggcagccacagtgatgatcaactgcctactacaggagcgcggaggagtattgcaggagaaggttcccgagatcgtctcagtcctgcgtagtaagctgcaggaagcccagggggagcatgtgttgcctgccgctcagcactctgtgtacctcctagctacacagcactgtgccgcagtggtgagcagcctgctgggatcaccactgccactggattcacacacatgcatgttatggcgggctttggctgtcgaacccagattggccgctcaggtgttagggttgctgctggagaaaatgtcacgggatgtccccttcaaggagagcagagccttcctgcttgggagaacccccgatagggttgcaaccttactccctctgtcagccacttgtgctctgttcgaggttatgtctacaccggcagcaggcccagcagtactggagctgtatccgcagctctttgtagtgttgcttctgcgcgtgagctgcaccgttggtgtgcaattgcccaggaatttgcaggcccaggagaggcgaggggcaagccctgcactggctaccaggaatttagagccatgctcgtctgcagtggacaccctcaggtccatgttattgaggtccggttcggaagacgtggttcagcgtatggacctggaaggaggctgggaactgcttaggacaagtgccggacacgaggaaggcgctacgaggctggccagagccatggctgagcacgctggcccacgcttgccgcttgtcctgaaaaccttagcctgcacccattcctctgcatatgagaatcaacgggtgacaacaactgccttcctcgctgagctccttaattccaatgtggccaacgacttaatgctcctggactctcttctagaatctctggcggcacgccagaaagatacctgtgcatctgtgagacggctcgtactgcgcggtctcgcgaaccttgcgagcggatgccctgataaagtgcgcacgcacggaccccagctgttaactgccatgatcggcggactggatgacggcgataatccccacagccctgtggcactggaagcgatgttggggcttgctaggttggtgcacctggttgagagttgggacctccgatccggtctgctgcacgtcgccatcagaattaggccgtttttcgactctgagaagatggagtttagaaccgcatcaatccgcctgtttggacacctgaataaggtatgccacggggactgtgaggatgtgttccttgaccaggtggtgggcggtctggccccattgctactccacctgcaggatccgcaggcgaccgttgcatctgcctgtaggtttgcactccggatgtgtggccctaacctggcgtgtgaggagctcagtgccgcttttcagaagcacctacaggagggcagagctttacatttcggcgagttcctgaacaccacctgtaagcatctgatgcaccatttccccgacctccttggtcgcctcctgaccacttgcctcttctacttcaagtcatcgtgggaaaatgtacgagcagcagcaccgctgtttaccggattcttagttttacactctgagccacgccagcaaccccaggtggatctggatcagttgatcgcagcacttcagatcttgttgaaagatccagcaccagaagtgagaacccgcgctgccgaagccttaggcagactggtcaaactggcttag

SEQ ID NO: 56765 - DNA, 3873 bp, Artificial Sequence
  Description of Artificial Sequence: Synthetic coding sequence
atgaaagctagcagttgtttcctcatactggcgcattccaatccaggtgaactgatggagttctttgatgagcaagtccggtctaacaatgaggcaattcgggttggcatcctcactctgcttcggctcgccgtgaacgccgatgagcccaggctgcgcgaccacataataagcatcgagcgtacagtgaaaattgttatgggcgacctatcgacaaaggtgaggaactccgttctgttgcttattcaaaccatgtgtgagaaaagttacattgaggctcgggaaggatggcctttaattgattacgtcttttctcagtttgccaccctgaacaggaacctcgagaagccagtaaagaccaactttcacgaaaatgagaaggaggaggaatcagtgagagagaccagtctggaagttctgaagactctggatccccttgtgatcggcatgcctcaggtgctgtggcctcgcatacttacttttgtggtgccagctgagtacacagaggccctggagcccctcttcagcatcatccgaattctcatcatggcggaggaaaagaagcaacattctgcgaaggagtctactgcactggttgtcagcactggagccgtcaagctcccttcaccacaacaactgctcgctagacttctggtaatatcaatgccagcctccctgggcgagctgcgtggcgctggcgctattggccttcttaaaatcctaccagagatcattcatccgaaactggtggatctgtggaaaactagactaccggagttacttcaacccttagaaggaaaaaatatctccaccgtcttgtgggaaaccatgctgcttcagcagttgttaaaggagtccctgtggaagatctctgacgtggcctggacgattcagcttacccaagactttaagcaacagatgggcagttattctaacaattcaaccgagaaaaaatttctctggaaagcgttgggtaccactcttgcctgctgtcaggacagcgacttcgtcaacagtcaaatcaaggagttcctgaccgcacccaatcagctcggagatcagcgccagggcatcacatctatcttgggatactgtgctgagaatcacctggatatcgtccttaaggtgctgaaaaccttccaaaatcaggagaagtttttcatgaatagatgtaagtctttatttagcggaaaaaaaagcctgaccaagacggatgtgatggtgatttatggcgcagtagctctacatgctcccaagaaacagctgctctccaggttgaatcaagatatcatttcgcaagttcttagccttcacggccagtgcagtcaggtgcttgggatgtcggttatgaataaggatatggatttgcagatgtcctttaccagaagcataacggagataggcatagcagtgcaagatgccgaagatcagggcttccagttctcatataaggaaatgctgattggctatatgctcgacttcatccgggacgaacccctcgattctctggccagcccgatccggtggaaggccctgattgctatccgctatctgagtaagctgaagcctcagctgtccctacaggatcacttgaatattctcgaagagaatatacgacggttgctccccctgccacctctggaaaatctgaagtcagaaggccaaaccgataaggacaaagaacatatccagttcctatatgaacgttcaatggacgctctcggtaagcttctgaagactatgatgtgggacaacgtgaacgctgaagattgccaggaaatgtttaatttgttgcagatgtggctggtcagccaaaaggagtgggagagggaacgagcattccaaatcactgcaaaggttctcaccaacgatatcgaggcccctgaaaactttaaaatcggcagcttgctcggtttactcgcccctcattcgtgcgatacccttcccacaatacggcaggcagctgcctcttctacaattggtctcttctacattaaaggcatccaccttgaagtcgagaggctccaagggctgcaggagggcctggaaagcgacgacgtccaggtgcagattaagatttcctccaagatcgctaagatagtcagcaaatttataccaaatgaagaaatattgatgttcctggaggaaatgcttgatggccttgaaagccttaatcctacctgtacaaaggcgtgcggcatttggatgattacagtcctgaagcaacagggagcggcactagaggaccagcttctggaaatactcgggaccatttatcaccatatgcctgtgctcagacagaaagaggagtctttccagtttatcttagaggccatctcgcagatcgcatccttccatatggataccgtcgtggtcaacctgctgcagaaacctctgccatttgatcgagacacaaagaccctctggaaagcgctggccgaaaagcctgccagcagcggcaagctgctgcaggccctgatcgataagctggagactgagctagaagacgacatcgccagagtagaagcgatctccgtagcctgtgcgatgtacgaagtaatttccatgggaacatccgtgacaggcttgtatccggagcttttcactcttctactgaaactggtctcttgcacgttgggccaaaagatgctgacctgcccatggtcacatcgtcggcatgtgatgcaacagggggagcagcagcagatccccgacccctgccgcttatctacggccacacttaaatgtctgcaggcccaggccatgcgcgaaggcttggccaaagagtccgatgaaggggacaatttgtggacattactgtcttccccatctacccaccatatcggagtctgttctctcgctagatcgatggccgtctggcagcatggcgttattctcgatatcatggaacagctacttagttcactgacgagcagctctgagaattatcggattacaggagcagcctttttttcagaattgatgaaggagccaattctgtggaagcacggcaacttgcgcaacgtgctgatcttaatggatcaatctgcatgggactcgaacgccaccctgaggcaaatggccataagagggttggggaatacagcgtccggagcaccccataaggtgaagaaacacaaacagcttatgcttgagagcatcattaggggtctgtatcacttggcgcgtacggaagttgtgtgcgaaagtctaaaggcccttaagaagatacttgagctactcaccgacagagacgtaagcttctatttcaaggaaattgtgctgcagacgcgaaccttctttgaggatgaacaggacgacgtcaggttaactgccatttttctgtttgaagatcttgccccattaactggaagaaggtggaaaatcttttttgcagaagagataaagaagtctttgataagcttcctcctccatctttgggatcctaatcccaagatcggtgtcgcctgccgggatgtgttgatggtgtgtattccttttctcggactgcaagagctgtacggcgttcttgatcggctactcgaccaggatctgccaagagccagagacttttacaggcagttctgcgtaaaactggcgaaaaaaaaccaggagatcctgtggatcctgcatacccatagtttcacattcttcactagtacgtgggaggtcatcagaagtgcggctgtgaaactcacagatgcagtggtcctgaaccttacaagccagtacgttgagctcctggacagggagcagttgaccacacgcctgcaggccctgcggcaggatccctgtatctcagtgcaacgggctgccgaggctgccctccagaccctgcttcgaaggtgcaaggaaacctctattcctctgtag

SEQ ID NO: 56766 - DNA, 4758 bp, Artificial Sequence
  Description of Artificial Sequence: Synthetic coding sequence
atgaccttatcaactgaagagtctattgaaatgttcggggatataaacctgactcttggcatgcttaacaaagaggacatcgttaataaggaggacatttactctcacttgacctctgtgatacagaacactgatattttggacgacgcgattgtgcaaagacttatctattacgcctctaaagacatgagggacaataatatgctccgagagattcggatgctcgctggtgaggttctggtgtctctggctgcccatgattttaacagcgtcatgtacgaagtacagagcaatttccggatcttggagctcccagacgaattcgttgttttggccctcgcagagcttgccacctcctatgtgagccagagtatacctttcatgatgatgacacttctgactatgcagaccatgctacgacttgccgaggacgaaaggatgaaaggtacattctgcattgctttggagaaatttagcaaggccatctacaaatacgttaatcattggagagactttccctatcccagactggatgcgaatagactgtccgataagattttcatgctgttctggtatatcatggagaaatgggctccactggccagccctatgcagacactttcaatcgtgaaggcacatgggccaacagtgagcctcttattacacagagaggacttcagaggttacgctcttgggcaggtcccctggcttttgaatcagtataaagacaaggagattgatttccatgtgactcagtccctaaagcagatacttaccgcagccgtgctgtatgatatcggactaccgagatcgctgcggcgttcaatttttattaacctactacagcaaatttgtagggccccagagcctcctgtgaaggaaaacgagatgaaagcatcctcatgtttcctgatcttggcccacagtaacccgggagaactgatggagttctttgacgagcaggtacgcagtaacaacgaagccatccgcgtggggatccttaccctgttacgcctggccgtgaatgcagatgagcccagattgagggaccacatcatttcaatcgagaggaccgtaaaaattgtgatgggcgaccttagcacgaaggtgagaaacagcgtacttctcctgatacagactatgtgtgaaaagtcatatattgaagccagagagggctggcccctgatcgattacgtattttcccagttcgctacattgaaccgaaatctggagaaacccgtgaaaacgaattttcatgagaacgaaaaggaagaagagtcagtgcgggaaaccagtctggaggtgctcaagacactggatccactggtaatcggcatgccccaggtactatggcctcgaatccttacattcgtcgtcccagccgaatacacagaggctctcgaacccttgttctccatcatccggatactgatcatggctgaagaaaagaaacaacacagcgctaaagagagcactgcgctggtcgtgagcacaggagccgtgaagctgccctccccccagcaactgctggctagactgctggtcatttctatgccagctagtctgggtgaattgcgcggtgccggtgcaattggcctccttaaaatcctgcctgaaattatccatcctaaactggtcgacctgtggaaaacaaggctgcccgagttactgcaaccccttgaaggtaagaacatttccactgttctgtgggagaccatgcttttgcagctgctcaaagagagtctctggaaaatctccgatgttgcatggacaattcagctgacccaagatttcaaacagcaaatggggagttattccaataactctacagagaaaaagttcctgtggaaagcccttgggactacattggcctgctgccaggattcagacttcgtaaactcacagattaaggagttcctgacagctcccaatcagcttggagatcagcggcagggcatcacctctattctgggatactgcgctgaaaaccatctcgacatcgtgctgaaggtcctgaaaacctttcaaaaccaagagaagttttttatgaaccggtgcaagtccctttttagtgggaagaagtctctgacaaaaaccgacgtgatggtgatctacggggcagtggctctgcacgcacctaaaaaacagttgctctcccgtctgaaccaagatattatctcacaggtgctttctctacacggacagtgtagccaggtccttgggatgagcgtgatgaataaagacatggatctccaaatgagttttacaaggagcatcactgagatcggtattgctgtacaggatgctgaggaccaggggtttcaatttagttataaagaaatgttgattgggtatatgctggactttatcagagacgaaccgctggattcacttgcctcacccattagatggaaggctctcatagctatacgatacctcagtaaacttaaaccacagctgagcctgcaggaccacctaaatatcctggaggagaacatccgaagactgctgcctctcccccctctggagaaccttaagagcgaggggcagactgacaaagataaagaacatatccagttcctatatgagagatccatggatgcacttggtaagctgctgaagactatgatgtgggacaacgtaaacgccgaagactgtcaagagatgttcaacctgttacagatgtggctcgtgtctcagaaggaatgggaacgagaacgggctttccagatcaccgccaaggtcctgacaaatgacatcgaagccccagagaactttaagattggaagcctgctgggcctcctggcaccgcacagctgcgataccttgcccaccatcagacaggctgccgctagctccaccattggtttgttttatattaaaggaatacacctggaggtggagcgcctacaggggctgcaggagggcctggaaagtgatgacgtccaggtgcagattaagatttcgtctaagatagctaaaattgtgtctaaatttatccctaacgaggaaatccttatgttcctggaggagatgctcgacggtcttgaaagcctaaatccgacttgcaccaaggcttgtgggatctggatgattactgtgctcaaacagcagggagcggcacttgaagaccagctccttgagatcttgggtaccatttaccatcatatgcctgtcctgcgccagaaggaggaatccttccaatttatcctggaggctattagtcagatcgcctccttccacatggatacagtggtcgtgaatctgttgcagaagcccctacctttcgatcgggacactaaaacgctttggaaagctttggccgagaaacctgcaagtagcggtaaactgctgcaagccctcatcgacaaactggagactgaactggaagatgacattgctcgggttgaggccatctctgttgcatgtgccatgtacgaggtgatctccatgggaacatcagtaacgggattgtaccccgaactgttcaccctgctgctcaagcttgtctcttgcactttgggacagaagatgctgacctgcccctggagtcacagacggcacgtcatgcagcagggtgaacagcagcagatcccggacccatgccgcctctccactgcgacactgaaatgtctgcaagcccaggccatgcgggaaggactcgctaaagagagtgacgagggcgacaatttatggactcttctctcttccccgtccacccaccacattggtgtatgctctctggcaaggagcatggctgtgtggcagcacggtgtaatactggacattatggagcagcttctcagctcacttacatcttcttcagagaactaccgcattaccggtgctgcgttttttagtgagcttatgaaggagcccatcctgtggaagcacggaaacctgcgtaatgtcctgattctgatggaccaatctgcgtgggacagtaacgcaactctgagacagatggcaattcgcggactcggcaacacagctagcggcgctcctcacaaagtcaaaaagcataagcagctgatgctggaaagcatcattcgaggactctaccacctcgcccgtaccgaagtcgtgtgcgagtccttgaaggcactgaagaaaatactcgagttgctgacagacagggacgtaagcttctactttaaggagatcgtgcttcagactcggaccttcttcgaggatgaacaggatgatgttcgcctcactgcgatcttcctgtttgaagaccttgccccactgaccgggaggcgctggaaaattttctttgctgaggaaatcaaaaagagcttgatttcatttctgttacatctctgggaccctaatccaaaaattggagtcgcctgtcgtgacgtcctgatggtctgtattcccttcctgggtttacaggaactgtacggagtcctggacaggcttctcgatcaggatctgcctcgggcacgggatttctaccgacagttctgtgtgaaactggctaaaaaaaatcaagaaatcctctggatcttacacacacactcttttaccttcttcaccagcacctgggaagtgataagatctgccgctgtcaaattgacagatgcagttgtcttgaacctaacctcacagtatgtggaactcctggatcgggaacagctcactacaagactccaggctctccgacaggatccctgcatatccgtgcagagagccgcagaggcagcactgcagaccctccttcgcaggtgcaaggaaacctccattccactgtag

SEQ ID NO: 56767 - DNA, 225 bp, Artificial Sequence
  Description of Artificial Sequence: Synthetic coding sequence
atggacgtgaggggtccagaagcacctggtggaagagccctcagggatgctgccgagaatctgttccaggaactgcaggaacatttccaggcccttacagcaactcttaatcttcggatggaggagatgggcaaccggattgaggacctgcagaaaaatgtcaaggacctgatggtgcaagctggaattgagaattccattaaagagcagatgctgaaaacatag

SEQ ID NO: 56768 - DNA, 549 bp, Artificial Sequence
  Description of Artificial Sequence: Synthetic coding sequence
atgtccggtaggagcgtgccccatgcgcatccagccaccgccgagtatgagttcgcaaatccttcacgcctaggtgagcaaagattcggtgaggggctcctcccagaggagattctaactcccactctctatcacgggtactatgtgcgaccacgagccgcaccagccggtgaaggttccagggcgggtgcatctgagcttcgtctttcggagggcaagttccaggcctttcttgatgtgagccattttacgcctgacgaagtcacagttagaactgtggacaatctattggaggtgtcagccagacatcctcagcgcctggaccgacatggcttcgtctccagagagttctgccgcacatacgtcctgcctgccgacgtcgacccatggcgggtccgcgcagcactgtcacacgacggtattttaaacctggaagcacccaggggaggcaggcaccttgacacagaggtgaatgaagtctacatctcactgctgcctgccccaccagatcctgaggaagaagaggaggcagccatcgtagaaccttag

SEQ ID NO: 56769 - DNA, 435 bp, Artificial Sequence
  Description of Artificial Sequence: Synthetic coding sequence
atgagaaaaatcgatctctgcctcagttcagaagggtctgaagttatactggctacatctagtgatgaaaaacacccaccagaaaatataattgacggcaatccagaaacgttctggacaactactggaatgtttccccaagagttcataatttgctttcataaacatgtccgcattgaacggttagtcatccagtcctatttcgtccagacactcaagattgaaaaatctacgtctaaagagccagtggattttgaacaatggatcgagaaagacctggtccacactgaaggacagttacagaacgaggaaattgtggctcacgatggatcagccacctatctacggtttataattgtcagcgcattcgatcactttgcgagcgtgcactccgtgagtgctgagggtaccgttgtgtctaacctgagctcttag

SEQ ID NO: 56770 - DNA, 225 bp, Artificial Sequence
  Description of Artificial Sequence: Synthetic coding sequence
atgcgcaaaatcgatctctgcctatctagcgaaggcagcgaggttattctggcgacttctagcgacgagaagcatccccctgagaatataatcgacggtaacccggagacattttggacaactacaggaatgtttccgcaagaattcatcatctgttttcacaagcacgtgagaatcgagaggctagtgatacagtcctactttggaaaacagattctccactag

SEQ ID NO: 56771 - DNA, 339 bp, Artificial Sequence
  Description of Artificial Sequence: Synthetic coding sequence
atgcgtaagatcgacctttgcctatcgtctgaagggagcgaagtcatactggctacgagttccgacgagaaacatccccctgaaaacattatcgatggcaaccctgaaaccttttggacaacaacgggcatgtttccccaagagtttataatctgttttcataaacacgtgagaatcgagagactggtcatacagtcttattttgttcagacactgaagatcgagaagtccacatcaaaagagccagttgatttcgagcagtggatcgaaaaggatctggttcataccgagggccaactgcagaatgaagagattgtggttagcgaatacactttatag

SEQ ID NO: 56772 - DNA, 435 bp, Artificial Sequence
  Description of Artificial Sequence: Synthetic coding sequence
atgcgcaagatcgacctgtgtctcagttccgaaggctccgaagtgatcctcgctacatcctccgacgagaagcacccgccagaaaacatcattgacggcaaccctgaaaccttttggactacaaccggtatgtttccacaggagttcataatctgtttccataaacacgtcagaatcgaacggctcgtgattcagtcatatttcgtccagacccttaagattgagaaatccacctccaaagagccggtggacttcgaacagtggatagaaaaggatctggtccacacagaagggcagttgcaaaacgaagagatcgttgcgcacgatggtagcgcgacttacctgcgctttataattgtttctgccttcgatcattttgctagtgtccactcggtgtcggccgagggaaccgtggtctctaacttgagcagttag

SEQ ID NO: 56773 - DNA, 417 bp, Artificial Sequence
  Description of Artificial Sequence: Synthetic coding sequence
atgggtgtgtccaatcagggctgtagccgcaacgctcgccaccaaaaggcaaggtccatgcctttgcaggatcagcacttggccttggccatcctactcgagttagccgtgcagcgcggtactctctcccagatgctgtcggctatcttgctccttctgcagctgtgggactcaagagcccaggagactgataatgaaagatctgctcaggggactagtacattgcttctttcactcctccagacgttccagtctattatttgtgggaaagatacgcctcctagcgaaggtaacatgcatttactatccggccctttgagcccaagtgaatcgttcctgagatatcttacccttcataagacaacatcactgcccctaatttgcaacaaaagacagctgctttcttggcctatttag

SEQ ID NO: 56774 - DNA, 7839 bp, Artificial Sequence
  Description of Artificial Sequence: Synthetic coding sequence
atggccgacgtcgatcctgacacactgctagaatggctgcagatgggacagggcgacgagcgggacatgcagcttatcgcattggaacagttatgtatgctactgctcatgagtgacaatgtcgatagatgctttgagacttgcccacccaggaccttcctgcctgcactttgtaagatattcctggatgagagcgcccctgataatgtgctcgaggtgacagcgagagcaataacatattacttggacgtcagtgccgaatgtacaaggagaatagtaggcgttgacggagccattaaagctttgtgtaacaggctcgtcgtcgttgagcttaacaatcgaacctcacgcgacctggccgagcaatgtgtcaaagttctggagctgatctgtacccgggagagcggagctgtatttgaagccggagggttgaactgtgttcttaccttcatccgtgatagcgggcaccttgtgcacaaggataccctgcactctgccatggccgtcgtatctcgcctgtgcggtaaaatggaaccccaagactcttcccttgaaatttgcgtggagtcgctctcctccctgttgaaacacgaagatcatcaggtgtctgatggagctctacgatgctttgccagcctggctgatcggtttacccgacgaggtgtggacccagcaccgctcgcaaaacacggactgacagaggagttactgtcgagaatggctgccgcaggcggaactgtaagcggcccttccagcgcctgtaagccaggacgctccactacgggagccccatccactaccgctgatagcaagttatcgaatcaagtttccaccattgtgtcactgctcagcaccttatgtagaggttctcctgtggtgactcacgatctgctgagaagcgaactcccggatagtatagaaagcgctcttcagggagatgagcgatgcgttctcgataccatgcgtctggtcgacctgctgctagtcctgctgtttgagggacgcaaggctctccctaaatcaagcgctggatccactgggcgaatccccggactgagacggttagattcaagcggcgagcgtagccatcggcagctaatcgactgtatcaggtctaaggacacggatgcactgatcgatgctatagatacaggcgcttttgaggtcaacttcatggatgacgtcggccagaccctgctgaattgggcaagcgcatttggcacccaggaaatggtcgaattcttgtgtgagcggggagccgatgtgaatcgagggcagcgcagtagttctctgcactatgccgcttgcttcggcaggccacaagtggctaaaacattgctgaggcacggcgctaaccccgacctgagggacgaggatgggaagacacccctggataaggccagggagaggggacacagcgaagtggtggccatccttcaaagccccggagactggatgtgtcctgtgaacaaaggggatgataagaaaaagaaagacaccaacaaggacgaagaggagtgcaatgaaccgaagggagatcccgagatggctcccatttacctgaagcgcctcctcccagtgttcgctcagacatttcagcagacgatgctgccctctatacgcaaggcaagcttagcacttatccgcaaaatgatacacttctgctctgaggccctgctcaaggaggtgtgtgacagcgacgtcggccacaatctgcctactatcctagtcgaaataaccgctactgtgcttgatcaggaggacgatgacgacggccatcttctggctctgcagatcatcagggatctcgtggataaaggcggtgacatatttctcgaccaactcgctcgccttggggttatttcgaaggtttcaactctggccggacctagtagtgacgacgaaaatgaggaggagtccaagcctgaaaaggaggacgaacctcaggaggacgcaaaagagctgcaacagggaaaaccataccattggagggactggagcatcatcagaggaagggattgcctctacatctggagtgacgcggcagcattagaactgagtaacggctccaatggctggtttcgattcatcctcgatgggaagctggcaaccatgtattctagcggaagtccggaaggtggcagcgactcctccgagtccaggagtgaatttttggagaagcttcaacgggcacggggacaggtgaagccatctacctccagtcagccaatcctcagtgccccagggcctactaagctaacagtgggaaattggtctcttacatgcctgaaggaaggggaaatcgccatccacaattcagatggccagcaggctacaattcttaaggaggatctccctggtttcgtgtttgagagtaatcggggaactaagcactcctttaccgctgagactagtttggggtctgagtttgtgaccgggtggactggtaagcggggacgcaaactgaaatcaaagctagagaagactaagcaaaaagtgcgaacaatggccagagatttatacgatgaccactttaaggcggtggagtccatgccacgcggagtcgtcgttacactacggaatattgccacccagctggaaagttcatgggaactgcatactaaccgccagtgcatcgagtccgagaatacttggagagacttgatgaagacggccctggagaacctgatcgtactgttgaaagatgagaatacaatcagcccctacgaaatgtgttccagcggactcgtccaggccttactcacagtattgaacaacgtgagtctgtcatcttccaaggagcaaaaatactctttcacaccaagcgttgaaataaacgtattcaagaccgctttctctgaaaatgaagatgatgagagccgcccagcagttgcacttataaggaagctcatcgccgtgctggaatccatagagaggctccccctgcacttgtacgatacgccaggaagcacatataacctccagatcctgacaagacgcttgagattccgcctcgagagagccccaggcgagaccgcactcatcgaccgcacgggcaggatgctaaaaatggagccactagccaccgtcgagtctctagagcaatacctgcttaagatggttgcaaagcagtggtatgatttcgatagatcctcctttgtgtttgtcagaaaattgcgcgaggggcagaacttcatatttcgtcaccagcacgacttcgatgaaaacggcataatctactggattggcacaaatgccaaaacagcctacgaatgggtgaaccctgccgcatatgggctcgttgtggtgacgtccagcgaggggaggaatctgccttacggacgcttggaagatattttgtctagggacaactctgcccttaactgtcattctaacgacgacaagaatgcatggttcgctatcgacctggggctgtgggttatacccagcgcctacactttgagacatgccagggggtatgggagatctgccctaagaaactgggtgttccaggtcagcaaggacggccaaaattggaccagcctctatactcacgtcgacgattgctctctgaacgagcccggtagcactgcgacctggcccttagatcctcccaaagacgagaagcaggggtggagacacgtcagaattaagcaaatgggcaagaatgcgtccggacaaacacattatttgtcgctaagcgggttcgaactttatggtactgtgaatggagtatgtgaagaccagctgggcaaggccgctaaagaggccgaagctaatttacgcaggcagcggaggctggttaggagccaggtcctgaagtacatggtgccgggagccagggtgattagaggcctcgattggaagtggcgcgatcaggatgggagccctcagggggaaggaactgtgacgggcgaactgcataatgggtggattgatgtgacatgggacgcaggcggttccaacagttacaggatgggcgcagaaggcaaatttgacctgaaattggctcccggttacgaccccgatacagtggcatccccgaagcctgttagttccacagtgagcggcaccactcagtcatggtcttctctggtaaagaataattgcccagacaagacaagcgcagcagccggatcctcctccagaaaaggatcttcgagttcagtgtgttccgtggcgtcttcctcagatatatccctcgggtccacaaagacagagaggagatcggaaattgtgatggagcactcaatagtctcaggggctgacgtgcacgagcccattgtggtgttgtcatccgctgagaatgtgccgcagaccgaggtaggttccagcagtagtgccagtacctccaccctcactgctgagaccggcagcgaaaatgccgagcgaaagctcggtccagactcttccgtgcgcacaccaggggaaagcagcgccatcagtatggggatcgtcagtgtgagttccccggatgtttctagtgttagcgagctcacaaataaggaggcggcatcccaaaggcccctctcctccagtgcgtcaaatagactgtctgtctcatccttgctggctgccggagcacccatgagctcctcagcatccgtgcccaatctgtcctcaagggaaacaagcagtctcgaatccttcgtcaggagagtggcgaacatcgctaggaccaacgccaccaataatatgaatttgtcacggagtagcagcgacaataacacaaacactttgggcaggaacgtgatgtccacggcgacaagtcccctcatgggcgcacaatcattcccgaacctgaccactcccggaacgacctcgactgtcacaatgagtacctcaagcgtaacttccagctccaacgtagcaactgcaactactgtgctgagtgtgggccagtccttgtccaataccttgacaacttctctcacttctacgtctagtgaatcggatacaggacaagaggctgaatattcactttacgacttcctggattcttgtagggcaagtacattacttgccgaactcgatgacgatgaggacctcccagagcccgacgaggaggatgacgagaatgaagacgacaaccaggaagatcaggaatatgaagaggtgatgatcttgcgtagaccctcactgcagcgcagggccggttctagaagcgacgtcacccatcacgccgtgacctcacagcttccccaggtgcctgcaggcgctggcagccgtcctatcggagagcaggaagaagaggagtacgaaaccaagggcggtcgacgaagaacttgggatgacgactacgtcttaaagagacagttttctgctctggttcctgcgtttgacccgaggcccggtcgcactaacgtgcagcagaccactgatctggagattccgccacctggaactccccacagcgagctgctggaggaagtggaatgtacgccctcacctcgtctcgcccttactctcaaggtgaccggcctcggcaccactcgagaggttgagctgccacttacaaactttcgttccaccattttctactatgtacagaaattactccaactcagctgcaacggcaacgttaagtcggacaaactgcggaggatttgggaacccacatatacaattatgtatagagaaatgaaggatagtgataaagagaaggagaatggtaagatgggctgctggtctatcgaacacgttgaacagtaccttgggactgacgagttgcctaagaatgaccttatcacttatctgcagaaaaacgcggacgcggctttcctacgccactggaagctgacgggaactaacaagtctattcgcaagaaccggaattgctcgcagctgatcgctgcctacaaggacttttgcgaacacgggactaagagtggcctgaaccagggggcaatcagcactttgcagtcgagtgacatcttaaaccttactaaggagcagccccaggcaaaggccggaaacggacagaattcatgcggggtcgaggatgtcctccagctactgcgcatattgtacattgtcgcttcagatccctacagcagaatttcccaggaggatggcgacgagcaacttcagttcacatttcctcccgacgagtttactagcaaaaagatcactaccaaaatactgcagcagatcgaggagcctctagctctggcttccggagccctgccagattggtgtgaacagcttaccagcaaatgtcctttcctcatccctttcgagactagacaactgtacttcacatgtacagcttttggagctagtcgtgccatcgtctggttacagaaccggagagaggccacagttgaacgaacacggacaacctcgtccgtaaggcgggacgaccctggcgagttcagagtgggcaggctgaagcatgaacgggtgaaggtaccccgtggggagtcacttatggaatgggccgaaaacgtgatgcagattcatgctgaccggaagagcgtacttgaggtggaatttctgggcgaggaggggaccggtcttggtccgacgctggagttctatgccctcgtagcagctgagttccaacggaccgatcttggcgcatggctgtgtgacgataattttcctgatgacgagagccggcacgtggacttgggaggagggctcaaaccccctggctattacgtgcaacggtcctgtggcttgtttactgcccctttccctcaagactcagacgagctggagcgaattaccaaactgttccatttcctcggcatcttcctggccaagtgtatccaggacaataggctcgtggacctgcccattagtaagcccttttttaagttgatgtgtatgggggatatcaagtccaacatgtccaagctgatctacgagtctcggggagacagggacctgcattgtacggagagccagagcgaggcgagcacagaggagggacacgacagtctgtccgtgggtagctttgaggaggactccaagagcgaatttatcctcgaccccccaaagccaaaaccacccgcttggttcaatgggattctgacatgggaggattttgagctcgtgaatccccaccgcgctcgattccttaaagagattaaagacctcgccataaagcgcagacagatactgtccaacaagggcctgagcgaggacgaaaaaaatacaaagctccaggaactcgtgctcaaaaatccgagtggcagtgggccaccattgtccattgaagatctcgggctcaattttcaattctgtccgagttcccgcatctatggcttcaccgccgttgacctgaaaccaagcggcgaggacgagatgattaccatggataacgccgaggagtacgtggacctgatgtttgacttttgtatgcacaccgggatccagaagcaaatggaggcttttcgtgacgggttcaacaaagtcttccccatggagaaacttagttcattctcccatgaggaagtgcagatgattctttgtggaaatcagtccccatcctgggcagccgaagatatcattaattacacagagcccaaactgggttacacgagggactctccaggctttctgcggtttgtaagggtgctgtgtggcatgagctctgacgagcgcaaagcttttttgcagttcaccacgggatgctccacactgccacctgggggactcgctaatctccacccgagattaacagtggtccgcaaggtcgacgctacagacgcctcttatcccagcgttaacacatgtgttcattacttgaagctccctgaatatagctctgaggagatcatgcgggagaggttgctagccgcaacaatggagaaaggcttccacctgaattat

SEQ ID NO: 56775 - DNA, 516 bp, Artificial Sequence
  Description of Artificial Sequence: Synthetic coding sequence
aaggtcttcctgaaggctgtcgccggaaattaccacattttccgtcacaccggtatccagaaacagatggaggcgtttcgagacggttttaacaaggtgtttcctatggaaaagctgtcctccttctcccatgaagaagtacagatgatcctttgtgggaatcagtcaccttcatgggccgctgaggatatcatcaactacaccgaacccaaactcgggtacacccgcgattccccgggatttctgcgctttgtcagagtgttatgtgggatgtctagtgatgagcgaaaggcatttcttcagttcacgaccgggtgttctacactgccacccggagggctggccaatcttcatcctcgtctgactgtcgttcggaaggtcgacgctaccgatgcctcatatccgtctgtcaacacctgcgtacactacctcaagctccctgagtattcaagcgaggagatcatgagagaaagattattggccgcaacgatggagaagggcttccatctgaattag

SEQ ID NO: 56776 - DNA, 7832 bp, Artificial Sequence
  Description of Artificial Sequence: Synthetic coding sequence
atggctgatgtggatcctgatacattgctggagtggctgcaaatgggtcaaggcgatgagagagacatgcagctgattgccctggagcaactgtgcatgctcctactcatgtcagacaacgtagacaggtgtttcgaaacctgcccaccaaggacatttttacccgcactgtgcaaaatcttcctcgacgagagtgctccagacaacgtgctcgaggtgacagccagggccatcacgtactatctggacgtaagcgcggaatgcactcggcgaattgtcggggtggatggggctattaaggccctgtgtaaccgactcgtagtggttgaattaaataaccgcacatcaagagacctcgctgagcagtgtgtgaaggtcttggagctgatctgtactcgggagtctggagcggttttcgaggcgggtggactgaattgtgtgctgacatttatccgtgacagtggacacctggtgcacaaagatacgctccactccgccatggctgtggtttcccggttgtgcggcaagatggagccccaggacagctccctcgaaatttgcgtagagtcactgtccagccttttaaagcacgaagatcatcaggtgagcgatggcgctcttaggtgtttcgcttcattggccgatagatttactcggagaggcgtagatccggctccactcgctaaacacggcttgaccgaagagttactgtcaagaatggcggctgctggtggcaccgtgtccggacctagttcagcctgcaagcctgggaggtccacaaccggtgctccgtctaccaccgccgatagcaagctaagcaaccaggtgtcaacaatagtgtcattgttgagtacgctctgtcgcggatcccctgtggtaacccacgatctgcttcgtagtgaactccctgacagcatcgagagtgcgctccagggggatgaaagatgtgtcctggatactatgcgcctcgtagacttgctcctcgtgctcctcttcgagggaagaaaagcactccccaagtcttccgctggatctaccggtagaataccgggtctccggagactggacagtagcggcgaaaggtcccatcgccagctgattgactgcatcagaagcaaagatacagatgcactcatcgatgccattgatactggtgccttcgaggtgaactttatggacgacgttgggcagacactgctgaattgggctagcgcgtttggaacacaagagatggtggaattcctgtgtgagcgcggagctgacgtgaatagagggcagcgcagctcaagcctccattacgcggcttgtttcggaagaccgcaggtggctaagacgctgctccgccatggcgctaaccccgacttgcgggacgaggacggcaaaactcccttggataaggctcgtgaaaggggacacagcgaggtcgtggctatcctccaatctcctggggattggatgtgtccggtgaacaaaggtgatgataaaaagaagaaggatacaaataaggatgaggaagaatgtaacgagccgaagggagacccagagatggcccctatatacctgaaaagactcctgccagtattcgcgcagacttttcagcagaccatgcttcccagcattagaaaggcctcactagcccttattcgcaagatgatccatttctgctcagaggcattactgaaggaggtctgcgattccgacgtcgggcataacctgcctactatcctggtggaaatcaccgccactgtgctcgatcaagaggacgatgacgacggtcatttgctggccctgcagatcatcagagatctggttgacaagggaggcgacatctttctcgatcagctggctcggctgggcgtgatctcgaaggtcagcaccctcgcaggtccaagcagcgatgatgagaacgaagaagagtctaagcccgaaaaagaagacgagccacaagaggatgccaaggaactccagcagggcaaaccttaccattggagggattggtccatcataaggggtagggactgcttatacatttggtcagacgccgcagcacttgaactgagtaacggatcaaacggatggttccgctttatactagacggaaaactggctacaatgtatagttccggatctcctgaaggcggtagtgattcgagcgaaagccgatccgagtttcttgagaagttacagagggctcgcggacaggtaaaacccagtacttcaagtcagccaattttgtctgcccctgggcctaccaaactgactgtgggaaattggtccttgacatgcctcaaggaaggggagattgccattcacaatagcgatggccagcaagccacaatcttgaaggaagacctacctggcttcgtgtttgagagcaatcgaggcacaaaacacagctttacggcggagaccagtctcggctctgagttcgtgacgggctggactggaaagaggggacgcaagttaaagtctaagctggagaagaccaagcagaaagtccggacgatggccagagacctgtacgacgaccatttcaaggccgtcgagtctatgccccgtggagtcgtggtgaccctccgaaacattgccacccagcttgaaagtagttgggaactccatacaaatagacagtgcattgagtctgagaatacctggcgagacctaatgaaaaccgctcttgagaatctgattgttttgcttaaagacgaaaacaccatctccccctacgagatgtgctctagcgggctggtgcaggccctgctgacagtcctcaacaactccatggatctcgacatgaagcaggattgcagtcagttggtggagcggatcaacgtgttcaagactgcatttagcgagaacgaggatgatgagtctagacccgctgtggccctcattcgaaaactgattgcagtgctggagagtatagagcggcttccacttcacctgtatgacacaccaggctctacgtacaacctgcagatcctgacgagacggttgcggttccgtctggaaagggctccaggcgaaactgccctgattgaccgcacaggcaggatgcttaagatggagccattagcaactgtcgagtctttagaacaataccttctgaagatggtggcaaagcaatggtatgacttcgatcgatccagtttcgtttttgtacgtaagctaagggagggacagaacttcatttttcggcaccaacatgattttgatgaaaatggcattatctattggatcgggaccaacgctaagactgcttatgaatgggttaacccggcagcatacggcctggtggtagttacatctagtgaaggcagaaatctgccatacggaagactagaggatattctgtcccgcgataattcggccctaaactgccattctaacgatgacaaaaacgcatggtttgccattgatctggggctctgggtgattccatccgcatatactcttcgccacgccagaggctacggccgttccgccctacggaactgggtgttccaggtgtctaaagatggtcagaattggacttcactctatacgcatgtggatgattgctctttgaatgaaccagggtccaccgcaacctggcctttagacccacctaaggacgagaagcagggctggcgccacgtccggatcaagcagatgggaaaaaacgcgagtggacaaacacactatctgagtctgagtggatttgaactgtacgggacagtcaacggagtgtgcgaagaccagctgggcaaggcagccaaagaagcagaagcaaatctcaggcgccagcggagacttgtgcggtctcaggtgctgaaatacatggtgcctggagctcgcgtcattagaggtctcgactggaagtggcgagatcaggatggtagcccacaaggcgagggaaccgtgacgggagaactacacaacggatggatagacgttacttgggatgcaggcggttcaaactcgtatagaatgggtgctgagggtaaattcgaccttaagctggctcctgggtacgatccagacactgtggccagccccaaaccggtaagcagtaccgttagcggcactactcaaagctggagctctctagtcaagaacaattgcccagataaaaccagcgctgccgctgggtctagctccagaaaaggttcaagctcgtccgtgtgtagcgtggctagcagtagcgacatctctctgggaagcaccaagactgagagacgttcagagattgttatggagcatagcatcgtctcaggagccgacgtgcacgagccaatcgtcgtgttgagctcagccgaaaacgttcctcagactgaggtcggttcttccagcagtgcaagcacttcaacactcaccgccgagaccgggagtgagaatgcggagaggaagctgggtcctgacagctccgtccggacccctggggagtcttctgccattagcatgggcattgtgtccgtgtcatctcccgacgtatctagcgtgagcgaactgacaaacaaagaggcagcctcacagcgtcctttatcaagctcagcaagtaaccgtctgagcgtctcctccctgctcgctgctggggcacccatgagttcctctgcaagcgtcccgaacctttcaagccgcgagacatcctctctggagagcttcgtgaggcgggttgcgaatatcgccaggacaaacgctacaaataatatgaatctctcccggtcctcgtccgacaacaacaccaacaccttgggccgtaatgtcatgagcacagccacaagccctttgatgggagcccagtcttttcctaacctgactacgcccggtacaacgtctaccgtgaccatgtcaacttcttccgttacctctagcagcaacgtcgccaccgctacgacagtcctgtccgtgggtcagtccttatccaatacactgaccacctcattgacatcaacctctagtgaaagcgatactggccaggaggccgaatatagtctgtacgacttcctggattcttgccgcgcttccaccctcttagctgagctcgacgatgatgaagacctgcctgagcctgatgaagaggatgacgagaatgaagatgataatcaggaggatcaggagtacgaggaagtcatgatcttacgcaggccgagcctgcagagacgtgcgggaagtagaagcgatgttactcatcatgctgttacatcccagctcccacaggtcccggctggcgctggttcccggcctattggtgaacaggaagaggaagagtacgaaaccaagggaggccgtaggaggacatgggacgatgactacgtattgaaacggcagtttagtgctctggttccagcctttgatcccagacccggacgcactaacgtgcagcagacgaccgacctcgagatccccccaccaggcacaccacacagcgagttgctcgaagaagtcgagtgtaccccttctcctcggctcgcactgacacttaaggttacagggctgggcacgacccgtgaggtcgaattacccctgacgaactttcgatctaccattttctattatgttcagaaactcttacagttgagttgtaacggcaatgtgaaaagtgacaaactgcgcagaatctgggagccgacgtatactattatgtatagggaaatgaaagactccgataaggagaaggaaaatggcaaaatggggtgttggtctatagagcacgtagaacagtacctagggaccgacgagctgcccaagaacgatctgattacatatcttcagaagaacgcggacgccgcatttctccgtcactggaagctgaccgggaccaacaaaagcatccggaagaacagaaattgctcccagcttattgccgcatataaggacttctgtgaacatggcaccaaatctgggttgaatcagggggctataagcacacttcaatcgtccgacatcctgaacttgaccaaggagcagcctcaagcgaaagcaggcaacggccagaattcttgtggcgtggaagacgtgctgcaactcctcaggatcttatatatcgttgcatctgacccctattctcggatctctcaggaggatggagatgaacagctccagttcacctttccgcctgacgagtttacatccaaaaaaatcactaccaaaatactccagcagatcgaggagccgctggccctggcatccggagctctcccagattggtgcgagcagttgacatccaaatgtccgtttctaatccccttcgaaacaaggcaactgtattttacctgtactgccttcggagccagtcgggctattgtgtggctgcagaaccgcagagaggccacggtggagaggaccaggactacaagcagcgtgcgcagggatgatccaggcgagttcagggttggaagactgaagcacgagagagttaaggtacctaggggcgaaagcctgatggaatgggccgaaaacgttatgcaaattcacgcagatagaaaatccgtgctcgaggtggaattcttaggcgaagaagggactggactaggtccaacacttgagttctatgccctggttgccgctgagttccagaggacagatctcggggcttggttgtgcgatgataattttcccgacgatgagtccagacacgttgatctaggtgggggactgaagccccctggatactatgtgcagaggtcctgcggccttttcaccgcccctttcccacaggattctgatgaactggaaaggataacaaagttatttcattttcttgggatctttctggccaagtgtatccaagacaaccgcctcgtggatttacctattagcaaaccattctttaagctgatgtgcatgggagacatcaaatcgaacatgagcaaactcatttacgaatccagaggcgatcgggacctgcattgcactgagagccagtccgaagcatctacggaagaagggcacgatagtttgtccgtaggctcattcgaggaggattccaaatccgaattcatactggacccccctaagccaaagccccctgcctggttcaacgggatactgacatgggaagatttcgaactggtcaacccacaccgggctcggttcctgaaggagatcaaagatcttgcgattaaacgaaggcaaattttaagcaacaagggactcagtgaggacgaaaaaaatactaagcttcaggaactggtacttaagaatcccagcggctcaggccctcctttgtccatcgaagacctcggcctcaacttccagttttgcccaagctccagaatttatggcttcacagccgtggatctgaaaccctccggtgaagatgaaatgattactatggataacgccgaggagtatgttgatctgatgtttgatttctgtatgcacacaggtatacagaagcagatggaagctttcagggatggattcaacaaagtattcccaatggaaaagcttagttctttctcccatgaggaagtgcagatgattctctgcggaaaccagtccccaagttgggcggcagaagacatcattaattatactgaacctaaactgggctatacacgcgattcgccgggattcttgagatttgtaagggtgttgtgtgggatgagctcggacgaacggaaagccttcctgcagttcacaacagggtgttcaactctgccccctggaggcctcgctaacctgcacccaagactgactgtggtgaggaaggttgatgcaacggacgcaagctacccctcagtaaatacctgcgtacattacctgaagctgcccgaatattcctctgaggaaataatgcgcgagcggttactagccgcaacgatggagaaggggtttcatctcaatta

SEQ ID NO: 56777 - DNA, 7832 bp, Artificial Sequence
  Description of Artificial Sequence: Synthetic coding sequence
atggcggacgttgatccagacaccctgctggaatggctccagatggggcagggggatgagagggatatgcaactgatcgcactggagcagttgtgcatgctactcctcatgtctgataacgtagaccggtgtttcgagacctgtccccctagaaccttcctgcctgcactgtgcaaaatcttcctggatgaaagcgcccctgataatgtgctggaagtgactgcaagagcaattacctattatctggatgtctctgcagagtgcacacggcgaatagtgggcgtagacggggcaatcaaagccctctgtaacaggctagtcgtcgtggagcttaacaaccggacaagcagggacttagcagaacagtgtgtcaaagtgctggaattaatttgtacccgagagtcgggagcagtcttcgaagctggcggactgaattgcgtcttgacctttattagggacagcggtcatctggtacataaggatacgctccacagcgctatggcagtggtgtcccgcctgtgcgggaagatggagccacaggactcctccctcgagatctgtgtggagtctctatccagtcttctaaaacacgaggatcatcaggtgagcgatggggcactgaggtgctttgcctctctggcggacagatttaccagacgtggcgtggatccagcacccctcgccaaacatgggctgacagaggaacttttgtcccgaatggctgccgcaggcggtacagtctccggccctagctcagcctgtaagcccggacggtcaaccactggagctccaagtaccaccgccgattcaaagctcagcaatcaggtttccacgatcgtgtcacttctcagtaccctctgtcgcggatccccagtggtcacacatgacctgttaagaagcgagctgccggactccatcgagtcagctctccagggcgacgagcgttgtgtcttggacactatgcgtcttgttgacctgctgctcgtcttgctctttgaggggaggaaggcgctgccaaaaagttcagcaggaagtactggaagaatacccggtttgcggagactggactccagcggcgagcgttcccataggcagttgatagactgtatacgcagcaaagataccgatgccctgattgacgcaatcgatactggagcattcgaagtgaattttatggacgatgtgggacagactctgctaaactgggcttccgccttcggaactcaggagatggtggagttcctatgcgaacgcggagctgatgtcaaccgcggtcagaggtcttcatctctgcattacgccgcatgttttggcaggccccaagttgcaaaaacactcctacgacacggggctaacccagatctgcgagatgaagatggcaagactccccttgacaaagccagagagcggggtcacagcgaggtggtggccattttgcagtctcccggtgactggatgtgcccggtcaataagggagatgataagaaaaaaaaggatacaaataaggacgaagaggaatgcaacgagccgaagggggatccagagatggctcctatctacctgaaaaggctcctgcccgtattcgcacagactttccagcagacgatgctccctagtattaggaaggcaagcctggcgctgatccgtaagatgatacatttctgttcagaggccctgctcaaagaagtctgcgactccgacgtgggtcacaacttacctactattctggtcgaaataaccgccacagtccttgatcaggaagacgacgatgacggccacctgctggccctgcagatcatccgggatctcgttgataaaggcggagacattttccttgatcaactcgctcgtctgggcgttatcagtaaggtctccacgctggccggacctagttctgacgatgagaatgaggaagaatctaagccagagaaagaagacgaaccacaagaggacgctaaggagctgcagcagggaaaaccttaccactggagggattggagtatcatcagaggccgagactgtctttatatctggagcgatgccgctgccctggagctgagtaatgggtccaatggctggttccgtttcattttagacggcaagttagcaaccatgtatagctctgggagcccagaagggggttcggatagctctgagagcagatccgagtttctagagaagctgcagagggccagagggcaagtaaagccttcaacgtcctcccaacccatcctgtccgcacccggacctactaagctgactgtggggaactggagccttacatgcctcaaggaaggggagatcgctatccataatagtgacgggcagcaggctaccattttgaaggaggatttgcccggttttgtgttcgaatcgaacagaggaacgaaacatagcttcactgcggagacctccctgggatccgaattcgttaccgggtggacgggaaagcggggtcggaagctaaagtctaagctggagaagaccaaacagaaagtacgcaccatggccagagacttgtacgacgaccattttaaggccgtggagagtatgcccaggggcgtggtcgttactctcaggaatatcgcaacccagctagaatcttcttgggagctgcacacaaaccgacagtgtatagagtccgagaatacatggagggatttgatgaagaccgctctggagaatctgattgtgttgctgaaagacgagaacacgatcagtccctacgagatgtgctcctcaggtttagtgcaggccctgctgaccgtgctgaataacagcatggatttggatatgaaacaggactgcagccagctcgttgagagaatcaatgtcttcaagacagcgttttccgaaaacgaggacgatgagtcgagaccagctgtcgccttgatcagaaagttaattgccgtgctcgaaagcatcgagcgtcttccacttcacctgtacgacacaccaggctccacctataaccttcagatactcacacgcaggctccggtttagactagagcgggcacctggggagaccgcattgattgacaggacaggcagaatgctgaagatggaaccactggcgactgtagaatcactggaacagtacttgctgaagatggtggccaaacaatggtatgatttcgaccgcagctcttttgttttcgtgcggaaactccgagagggtcaaaactttatttttcgacaccagcatgacttcgacgagaatgggatcatctactggatcggaaccaatgctaagaccgcatacgagtgggtcaacccagccgcatatggactggtcgtggtcacttcttccgaaggcaggaacctgccttacggtagattggaggatattctctcccgagacaatagcgcactgaactgtcactctaatgatgacaaaaacgcctggttcgcaatagatctgggcctgtgggtcatcccatccgcttatacactgagacatgcacggggatacggccgaagtgccctcaggaactgggttttccaggtgagcaaggacgggcagaactggaccagtctgtacacacacgtcgatgactgtagtcttaatgagcccggtagtactgctacctggccgctcgatcctcctaaagacgagaagcagggctggaggcacgtgaggattaagcagatgggcaagaacgcctccggccagacacattatctttccttgtccggctttgaactatatggcaccgttaatggagtttgtgaggatcaactgggtaaagccgctaaagaggcagaggcaaatcttaggcggcaaagaagactcgtgcgtagtcaggtcctgaaatatatggtgccaggagccagagtcataagagggcttgactggaaatggcgggatcaggacggttccccccagggcgagggcactgttacaggcgaattacacaacggctggatagacgtgacatgggatgcagggggtagtaacagctacaggatgggagcagaaggaaagtttgacctgaagctggcccctggctatgatccagacaccgtggccagccctaagcctgtgtcatccaccgtctcaggcacgacacagagctggagttcccttgtgaagaataactgcccggacaaaacttccgccgctgcgggatcttccagcagaaaaggctcctcatcatctgtgtgctcagttgccagcagctcggacatcagtctgggctctaccaagactgagaggcgctctgagatagtgatggaacacagtatcgttagcggggctgacgttcacgagccgatagtggtcctctcttccgctgaaaatgtcccgcagacagaagtggggtcgtcctcctctgctagcacatccacgctgaccgccgaaacagggagcgagaatgctgagaggaaactagggcctgactccagcgtgcgaacccccggtgagtcctctgccatcagcatgggaattgtgtccgtgtcgagtcctgacgtgagtagtgtcagcgaactaacaaataaagaagccgctagccagagacctctttcttcttccgcttctaacagactctccgtgagttccctgttagccgcaggagctcctatgagttccagcgcttcagtccctaacctttcatcaagggagacctcatccctcgagtcattcgtcagaagggtcgcaaacattgccagaacgaatgccaccaacaacatgaatctgtctaggtcttcaagtgacaataatacaaatactctggggaggaacgttatgtctactgccacgtctcccctcatgggcgcacaaagcttcccgaatctcaccactccaggcaccacctccaccgtgacaatgtccacatctagcgtgacttcaagctctaatgtggctacagcgaccaccgtactgagtgtaggccaaagtcttagcaatacactcacaacctctctgacttctacaagttccgaaagcgacaccggccaagaggctgaatactcactttacgatttcctcgattcttgtcgcgcatccactttgctggcggaattggatgatgatgaggacctccccgagccggacgaggaggatgatgaaaatgaagatgataaccaggaggatcaggaatatgaagaggtcatgattctaaggagaccaagtttgcagcggcgagcagggtccaggagtgatgtaacccaccatgcggtgacctcccagttgccacaagtacccgctggggctggctctcgacccatcggagagcaagaggaagaagagtacgagacaaagggcggtagacgtaggacgtgggacgatgactacgtgctcaagcgccagttctctgccctcgtaccggctttcgacccaaggcccggtaggacgaacgtgcagcagacaacggacttggagattccaccccctggcacccctcactccgaactcctggaggaggttgaatgtactccgagtccgcgactggctctgacactgaaagttaccggcctgggaactacccgagaggttgagttgcccctgactaacttcagatccaccatcttctactacgttcaaaagttgctgcagttgagctgcaatgggaatgtgaagtctgacaagttgcgcagaatctgggagcccacctacactattatgtaccgcgagatgaaggattctgacaaagaaaaagaaaatggaaagatgggatgttggtccatcgaacacgtggaacagtacctggggactgacgagctgcctaaaaacgatctgattacttaccttcagaagaatgctgacgcagcattcctgcgccactggaaattgactgggactaacaagagtatccggaaaaatcgaaactgttcacaattaattgcagcctataaggatttctgcgagcatggcactaagagcggcctgaatcaaggcgctatcagcaccctgcaaagttccgacattctgaacctgaccaaggaacaaccccaggcaaaggccggaaacggacaaaattcttgcggtgtggaggatgtgctccagttgctgagaattttgtatatcgtcgcctctgatccttacagccggatctcacaggaagacggagatgaacagttacagttcacattcccaccagatgaatttacttcaaagaagattaccacaaaaatcctgcagcaaattgaggaaccgctagccttggcttcaggagcccttccggactggtgcgagcagctcactagcaaatgccctttcctgatacctttcgagactcggcagctttatttcacgtgcactgccttcggggcttctagggctattgtttggctgcagaacagacgagaagctacagttgagcggacacgtacaacgtcttcggtgcggagagatgacccaggggaatttagagtcgggagactaaagcatgagcgtgtcaaagtccccaggggagagagcctcatggagtgggcagagaatgtgatgcagatccacgccgaccggaaaagtgtactggaggtggagtttctaggggaggagggaaccggtctcggcccaaccctcgagttctatgctctggtcgctgcagagttccagcggaccgacctgggggcttggctttgcgatgacaacttccctgatgacgaatcgaggcatgtggacctgggtggcggactgaagccccctggatactacgtgcagcgcagttgcgggctgtttactgccccatttccacaggatagcgatgagctggagcgcattacaaaactatttcacttcctgggcatttttttagccaagtgtattcaggacaacagactggtggaccttcccatctctaaaccctttttcaaacttatgtgtatgggcgatatcaagagcaatatgtcaaaactgatttacgagagtcggggtgatagagacttgcactgtaccgaatcacaaagcgaagcttccactgaagagggccacgactcgctgtctgtcgggtcgttcgaggaagattccaaatcagagttcattctggatcctcctaagccaaaaccccctgcttggtttaacggcatcctaacttgggaggattttgaattggtaaacccccacagagcgaggtttctgaaagagataaaagatctggccatcaagcgcaggcagatactgtcgaataaagggctcagtgaagacgagaaaaacactaaacttcaggagttggtactcaaaaacccaagcggtagtggtccacctcttagcatcgaagatctgggcctgaatttccagttttgcccttcctcgcgaatttatggcttcacagccgttgatctaaagccttccggggaagacgaaatgatcaccatggataacgcggaggagtatgtggacttgatgtttgacttctgtatgcacaccggcattcagaagcagatggaggcatttcgagacgggttcaacaaagtttttcccatggaaaagctgtcgtcctttagccacgaagaggttcaaatgatcctgtgcgggaatcagtcgccaagttgggcagcagaggacatcatcaattatacagagcctaaacttgggtacacacgtgattctccaggttttttgcgttttgtccgagtcctgtgtgggatgagtagcgatgagaggaaggccttcctccagtttacaaccggatgctctactctgcctccaggtggccttgctaatctacatccccgactcaccgtagtcaggaaagtggacgccaccgatgccagctacccgagcgtgaacacatgcgtgcattacttgaagctgcctgaatatagctccgaggaaattatgcgcgagaggctgttggcagccactatggagaaggggttccacctgaacta

SEQ ID NO: 56778 - DNA, 2781 bp, Artificial Sequence
  Description of Artificial Sequence: Synthetic coding sequence
atggccgatgttgaccccgacaccctgttagaatggttgcagatggggcagggagacgaacgggacatgcaactaatagcactggaacagctgtgcatgttgttactaatgtccgacaatgtcgatagatgcttcgagacctgcccacctcgcacttttctcccagcgttgtgcaagatcttcctggatgagtctgctccggataacgtgctggaagttactgcgagagcaataacatattacctcgacgtgtcagctgaatgcacgcgccgaattgtcggcgtggacggagctatcaaagctttgtgcaataggctcgtggttgtggagctgaacaataggaccagcagagacctagctgaacagtgtgtcaaggttctggaattaatatgtacaagggaaagcggcgctgtattcgaggcaggtgggttgaattgtgtcctgacctttattagagatagcggccacctggtccacaaggatactttgcactctgccatggcagtggtttccaggctgtgcggcaaaatggaacctcaggattccagcctcgaaatctgcgtagagagtctcagctccctactgaaacatgaggatcaccaggtgtccgacggggctttgcgttgttttgctagcctcgctgacaggttcacacggagaggtgtggatcctgctccactcgctaaacatggcctaacagaagagctgctgtctaggatggccgctgcgggtggtactgtctctggaccctcgtcagcttgcaagccgggtcgctcaacaaccggcgctccctctactacagcagatagcaagctctccaaccaggtcagtactatcgtttccctgctttctacactgtgcagggggagtcctgtagtgactcatgacctgctgcgctccgagctcccagattctattgagtctgcgcttcaaggcgatgagcggtgcgtgctggacaccatgcgcctggtcgatctgctgctagtgctactctttgaaggcagaaaagcgctcccaaaaagtagcgccggtagtacggggaggatcccagggctgaggcgcctggactcctccggcgaacgttctcacagacagctcatcgattgcatccgatctaaggataccgatgctctaatcgacgccatcgatacaggcgcttttgaggtgaactttatggacgatgtgggacagacactactaaactgggccagcgcttttggcacccaggaaatggtggaatttctctgtgagcgtggcgcagacgttaatcgcggacaacggtcatcttccctgcactacgccgcatgtttcgggaggccacaagtcgccaagacgttgctgagacacggggctaatcctgatctgagagatgaagacgggaaaactccccttgataaggccagggagcgcggacactcagaggtcgtcgctatcctccagtctcctggagactggatgtgtccagtgaacaagggggatgacaagaagaaaaaggatacgaacaaagatgaggaagagtgcaacgagcctaaaggggatcctgaaatggccccaatctatttaaagaggctcctgcctgtgtttgctcagacctttcagcagaccatgctcccttcgattcggaaagcgtccctcgccctaatccgaaagatgatccatttttgcagtgaggcactcctgaaagaggtttgcgactccgacgtggggcataatttgcccaccatcctggtcgagatcaccgcaacagtactggatcaggaggatgatgacgacggacatctgctcgccctgcagatcattcgcgacctcgttgacaaggggggtgacatcttcctggatcagctggcaaggctcggggtgatttctaaagtttccaccttggcagggccatcatcagacgatgaaaacgaagaggagagcaagcctgagaaggaagatgaacctcaggaagatgccaaagagcttcagcagggaaagccctatcactggcgtgactggagcattatccggggaagggattgcctgtatatctggtctgacgcagccgcactggaattaagtaatgggagcaacgggtggtttcgctttattctcgacggaaagctcgccacgatgtacagcagcggctcccccgagggtggaagtgattcgtccgaatctagatccgaattcttggagaagttgcaacgggcacggggacaggtgaaacccagcaccagctcacagcctatactgagcgcacctggcccaacaaaactgactgtgggcaactggagcttaacatgtctcaaagagggggagatcgcgatacataacagcgacggccagcaagcgactattttgaaagaggacctccctggtttcgtgtttgaatcaaatagaggaacaaaacactcttttactgcagagacatccctcggctccgaatttgtgaccggttggacggggaagaggggtagaaaactgaagagtaaattagaaaaaaccaaacagaaagtcagaacaatggctagagatctgtacgacgatcatttcaaggcagtcgaaagcatgcctaggggagtcgtggtgactctgcgtaatatcgccacccaacttgagtccagctgggagctgcatactaacagacagtgtatcgagagtgaaaatacatggagagatttaatgaagacggcactcgaaaatctcattgtgctccttaaagacgagaataccataagcccgtatgaaatgtgttcgagtggactggtccaagcattgctcaccgtgcttaataattag

SEQ ID NO: 56779 - DNA, 2331 bp, Artificial Sequence
  Description of Artificial Sequence: Synthetic coding sequence
atgtcagaggcggtgagagtgccttctccagcaacacctctggtagttgccgcacctgcgccagaagaaaggaagggaaaggaatccgagagggagaaactgcctccaattgtctccgcaggcgctggagcaaccgcgggactggatcgcggtgctaaggggcagatatcaacatttagcagcttcatttctgcagtcagccctaaaaaagaagcagccgaaaaccggtcatctccagctcatttggtttttcctaacataaagaatgtccgcgagccaccacccatctgcctggacgtccggcaaaaacaacggaccagcatggacgcaagctcttccgagatgaaagctccagtactgcctgaacccatcctgcccatacagcccaagacagtaaaggactttcaggaagatgtggagaaagtgaaaagctctggtgattggaaggccgtccacgatttctacctgaccaccttcgattcctttcctgagctgaatgccgctttcaaaaaggacgcaaccgcctcgtttaatacgatcgaggacagcgggattaatgctaagtttgtaaacgctgtgtacgatactctgctgaatactccacaggacgtccaaaagacggttctcaagggcattatcaattccctattgcgtgaatggaaaggacccagaacaaaggatgatctgcgggcatacttcatactcctgcaaaaccctcagttcaataatacttcaacatatgtcatctacgctcacctgctgcgccaaatcgccactttggtggaggccgaccaccacttcctggtgcattggtttaaaaagctatcccagaagcggttcaaacaattagtcgagaggctactccagttcatcagtctgcggctcttccccgctaagcctgaagagtttccaccgattactaaatgttcctggtggattccttctgctgcaaaagtgctggctttgctgaataccgccaataaccttgtgcatcccccactgataccctacactgacttctacaatagtaccctggaccatatcgatctgatggaggagtaccacacttggcagaatttcggcaactctcaccgcttcagtttctgccagtacccttttgtgatatctgtcgctgccaaaaagataatcattcagagggatagcgagcagcagatgatcaacattgctcgccagtcattagtggataaagtctcccggcgacagagaccggatatgaatatcctgttcctgaacatgaaagtgcgcaggactcatctggtcagtgattctctagacgaactcactagaaaacgcgcagacctgaaaaaaaaactcaaggtcaccttcgttggtgaagcaggcctggatatgggcggactcacgaaggagtggttcctcctcctgattagacagatcttccatcctgattacggcatgttcacataccataaagactctcattgtcactggttctcttcattcaagtgtgataattactcagagtttaggctggtgggcatcctgatggggttggctgtatataactccataaccctggatatacggttccctccttgctgttataaaaagcttctgtcccccccaattataccatcagatcagaatattccagtcggcatttgcaacgtgacggtggacgatctgtgccaaattatgcccgagttagcccatggtctgtccgagcttctcagtcacgagggtaacgtagaggaggacttctacagcacttttcaggtgtttcaggaagagttcggcatcattaagtcctacaatctgaagcccggaggggataaaatcagtgtgacaaaccagaaccgcaaagagtatgttcagctctacactgacttcctgctgaacaagagcatctacaagcagttcgcggctttctattacggctttcacagtgtctgtgcatcaaacgcgcttatgctgctgcggcctgaagaggtggaaatactcgtttgcggaagcccagatttggatatgcacgccctccagagatcgacccagtacgacggttatgccaaaactgacctaacaattaagtacttctgggatgtagtgcttggatttcccctggatctgcagaaaaagctgctccattttacaactgggtccgatagggtccctgtgggcggaatggcggatcttaactttaagattagtaaaaatgagacatctacaaattgcctaccagtagctcatacatgctttaaccagttatgccttcccccatataaatccaaaaaagatctcaaacagaaattgatcataggcattagtaacagcgaaggctttgggctggaatag

SEQ ID NO: 56780 - DNA, 1281 bp, Artificial Sequence
  Description of Artificial Sequence: Synthetic coding sequence
atggaggaatatcatacctggcaaaattttggcaatagccacaggtttagcttttgccagtacccattcgtaatatccgtggccgcaaaaaagatcataattcaacgcgactccgagcagcagatgatcaatatcgccaggcagtcgttagtagataaggtgtcaagaaggcagagaccagacatgaacatcttgtttctcaacatgaaggttcgcagaacccacctcgttagcgattctctggacgagttgactcgcaagcgcgctgacttgaaaaagaagctgaaagttacctttgtgggcgaagctgggctggatatgggagggctgacaaaagaatggtttctactactaattcgccagattttccacccagattacgggatgttcacgtatcacaaggacagccactgtcactggttttcctccttcaagtgtgataattatagcgagtttagactagttggcattttgatgggactcgccgtttacaattcgatcaccctcgacattcgatttccgccatgctgttataagaagctcctttccccccctatcattccatccgatcagaacataccagttgggatttgtaatgtgacggttgacgacctttgccagatcatgcctgaactcgcccacgggttgtctgagctgctcagtcacgaaggtaacgtggaggaagatttctactccacttttcaggttttccaggaggaattcgggataatcaagtcttacaacttaaaacccggaggcgacaaaatcagtgtgactaaccaaaatcgcaaggagtacgtccaactgtatacagacttcctgttgaataaatcaatctacaagcagttcgcggcattctattatggctttcattcagtgtgcgcctctaatgctctcatgctgctgaggccagaggaagttgagattttggtgtgtggtagccccgatcttgatatgcacgcactgcagcggtcaacccagtatgacgggtacgcaaagacagacttgaccatcaaatacttctgggacgttgtactgggtttcccactcgacctgcagaaaaagttattgcacttcactacaggttccgatcgcgtccccgtgggcggtatggctgatctcaattttaaaatatctaaaaatgagacaagtaccaattgtctcccagttgcgcatacttgtttcaatcagctgtgcctccctccctacaagtcaaagaaagatttaaaacaaaagctcattataggcataagtaatagcgaagggttcggtttggaatag

SEQ ID NO: 56781 - DNA, 444 bp, Artificial Sequence
  Description of Artificial Sequence: Synthetic coding sequence
ttgtctcaaaagcgctttaaacagttggtcgaaaggctgctccaatttatttctcttcgtcttttccccgctaagcctgaggagttcccaccaataactaaatgttcctggtggatacccagcgcggcaaaggtactggccttactgaacaccgctaataatctggttcatcccccattaatcccatacacagatttttacaattcaacacttgaccatattgatctaatggaggaatatcatacatggcagaacttcggcaacagccacagaatggcagtgagaattaaacgcaactacactcacaccatcatactgtacatggtgaagcacaaccctaaagtgatgttctatatcgccactagggggacgctagattctcttagtatcattctgctgaagatacatcatttcgctttctccttttttcacctgctttcttag

SEQ ID NO: 56782 - DNA, 624 bp, Artificial Sequence
  Description of Artificial Sequence: Synthetic coding sequence
atgagcgaagccgtccgcgttccaagtccagccacgcctctggtggtagcggcaccggctcctgaagagcgcaaagggaaggaatcagagagagaaaagttacctcctattgtgagcgccggagctggggcaaccgccggactggatcggggtgccaaggggcaaatctctaccttcagctccttcatctccgctgtctctcccaagaaagaggccgctgaaaatcgcagcagcccagcccatctggtttttcctaatattaagaacgtccgggaacctcctcccatatgccttgatgtgcgccaaaagcagcgcacctccatggatgcaagttcgtcggagatgaaggctccggtcctgcctgagcctattttaccaatccaacccaagacagtgaaagactttcaagaagacgtggaaaaggtgaaaagctcaggggactggaaagcggtgcatgacttttatctgaccacttttgacagcttcccagagcttaacgctgcttttaaaaaggacgccacagcatccttcaacacgattgaggactccgggatcaacgccaaatttgtgaatgcagtgtatgacacgctgctaaataccgtgagcataatgacttgcaagtag

SEQ ID NO: 56783 - DNA, 2343 bp, Artificial Sequence
  Description of Artificial Sequence: Synthetic coding sequence
atgagcgaagcagtgagagtgccatctcctgcaaccccccttgttgtagcagcaccagcacccgaggaaagaaaggggaaggagtctgagagggaaaaattgccacccatcgtgtccgctggtgccggagctaccgcgggattggataggggggctaaggggcaaataagcaccttcagttctttcatctctgctgtgtcccctaagaaggaagccgctgagaatcggtccagccctgctcacttggtgttccctaatatcaaaaatgtgcgggaacctcctccaatttgcctggatgtgcgacagaaacagcgtacctccatggacgcctccagctctgaaatgaaagcccctgtgctgcctgaaccaatccttcccatccaacccaagacagtgaaggacttccaagaggacgttgaaaaggtcaaatcttccggcgattggaaagcggtacatgatttctacctgacaaccttcgactctttccctgagctcaacgccgcttttaaaaaggatgccaccgcaagcttcaacaccatcgaggattcggggatcaatgctaaatttgtgaatgcagtctacgacaccctgctcaacacaccccaggacgttcagaaaacagtgcttaaaggaattatcaacagtctcctgagagaatggaaggggcctaggactaaagatgacctaagggcatacttcatcttactgcagaatccccagtttaacaacactagcacctacgtgatctacgctcatctgttacggcagatcgccactctcgtggaggctgaccatcatttcttggtccactggttcaaaaaacaatactcaaggctcagccagaagcggtttaaacaattggtggagagactccttcagtttatctcgctgagactttttccagctaaaccagaggaatttccgccaattactaagtgctcctggtggattcccagcgccgctaaagtcttggcccttctgaacacagccaataatctcgtccatcccccattgattccttacacggacttctacaactctaccctggatcacatcgatctcatggaagagtaccatacttggcaaaactttggtaactcccaccggttcagcttttgccagtacccatttgtcatatctgtcgcagcgaagaagatcatcatccagcgggactccgagcagcaaatgattaacattgcgagacagagcctggtcgacaaagtgagccgcagacagaggcctgacatgaacattctgttccttaatatgaaagtgagaagaacacatctcgtcagtgacagtcttgacgaactcacgaggaagagggccgacctgaagaaaaaattaaaggtcacctttgtgggtgaggcgggacttgatatgggtggcctgaccaaagaatggttcctcttgctgattcgtcagatttttcaccccgattacggcatgtttacttatcacaaggactcccattgtcactggtttagctctttcaagtgcgacaattacagtgagttccgattggtgggcatattaatgggactggcggtttataatagtataacactggacatccgttttccaccatgttgttataagaaactgctctctccacctatcatcccaagcgatcagaacatccctgtcggcatctgcaatgttaccgtcgatgacctgtgccaaatcatgccagaactggcccatggcctgagtgagttactcagccacgaggggaacgtggaggaagacttttattctaccttccaggtttttcaggaagaattcggcatcattaaaagctataacctcaaaccaggcggtgacaagatttctgtgacaaatcagaatagaaaggagtacgtgcagctctacactgactttctcttgaacaagtctatttacaaacaattcgccgctttctactacgggttccattctgtctgtgccagtaatgcactcatgctactgcgacccgaggaggtcgaaattctagtgtgtggtagccccgatttggatatgcacgctctccaacggtccacacagtacgatggctacgcgaaaactgatttgaccatcaagtatttctgggatgtggtgctggggtttcctttagatctccagaagaagctgttgcactttaccacaggcagtgaccgagttcctgtgggtggtatggccgaccttaatttcaagatttccaaaaacgagacctcaactaactgcctacctgtggcacacacatgcttcaatcagctctgtctaccgccttacaagtcgaagaaagacctgaaacagaagctgataatagggatctctaactctgaagggtttggcctggagtag

SEQ ID NO: 56784 - DNA, 1098 bp, Artificial Sequence
  Description of Artificial Sequence: Synthetic coding sequence
atgaatattctgttcctcaatatgaaagtccgacgtacacatctggtgtctgatagtctagacgagctcaccaggaagagggccgacctcaagaagaagttgaaggtgacgttcgttggggaggctggtttggacatgggagggctcacaaaggaatggttcctactgctgatacggcaaatctttcatccggactacggcatgttcacataccacaaggactcccactgccattggttctctagctttaaatgcgacaattattccgagtttcgcctagtcggtatactaatggggctagccgtttacaactccattactctagacatcagatttcctccctgctgctacaagaagctgctgtctccacctatcattccaagcgatcagaatatccctgtcggcatctgcaatgtgacggtagatgacctctgccagattatgcctgagctggctcacggcctgagcgagctgctttcacacgagggaaacgtcgaggaggacttctatagcacattccaggtgtttcaggaagaattcggtatcatcaagagctataatctgaagcctggaggagataagattagcgttaccaaccagaatagaaaggagtatgtacaactgtatacagactttttacttaacaagagcatctacaagcagttcgcagcattctattatggatttcacagtgtgtgtgcaagtaatgccttgatgcttcttcgtccggaggaagtggagattctcgtatgcggcagtccggatctggatatgcatgccctgcagagaagcacacaatatgatggttacgccaaaacagatctgaccattaaatatttctgggacgttgttcttggattccccctggacttgcaaaagaaactcctccattttaccaccggatccgatagggtacctgtgggaggaatggcagacctaaacttcaagattagtaagaacgaaaccagcaccaactgtctacctgtagctcatacctgcttcaatcagctttgtcttccaccatacaagagcaaaaaggatttgaaacaaaaacttataatcggaatctcaaacagcgaggggtttggcctggagtag

SEQ ID NO: 56785 - DNA, 3306 bp, Artificial Sequence
  Description of Artificial Sequence: Synthetic coding sequence
atggacgagtgtggatcacgaatcagacggagggtcagtctgcctaagaggaaccgcccttccctgggctgcatcttcggggctcctacagctgcggagctggtgcccggtgatgaggggaaggaggaggaggagatggtggctgagaacagaaggcgcaaaactgcaggcgtgctccccgtagaagtgcaaccactcctgctctccgatagccctgaatgcctggtgttaggcggaggagatactaaccctgatctgctgagacacatgcctacagaccggggagtcggggaccaaccaaacgacagcgaagtggatatgtttggggactatgacagtttcacagagaatagttttatcgcacaggtcgatgacctggagcagaagtatatgcagctacccgaacacaagaaacacgcaactgattttgctaccgaaaacctatgttctgagtccattaaaaataagctctctattacaaccatagggaatctcactgaactccagactgacaaacacaccgagaatcaatctgggtatgaaggcgtaactattgagcctggagctgacttgttgtatgatgtaccaagcagtcaggccatctacttcgagaaccttcagaatagcagcaatgatctcggagatcatagcatgaaagaacgcgactggaagagcagcagccataatacagtgaacgaggagctcccccacaattgtatcgagcaacctcagcagaacgatgagagttccagtaaagtgaggaccagctccgacatgaataggcgcaaaagtatcaaggaccatctaaagaacgctatgacaggcaatgcaaaagcccagaccccaatctttagccggtcgaagcagctcaaagatacactcctcagcgaagagataaacgtggctaaaaaaacagtggagtcatcatccaacgaccttggccctttttattcgttgccatcgaaggtcagagacctgtacgcacagtttaagggcatcgagaaattatacgaatggcagcacacgtgccttaccctcaatagtgtacaggagaggaaaaacctgatatactccctgccgacctctgggggaaagactttagtggccgagatattaatgctccaggagctcctgtgttgtagaaaggacgtcctgatgatcttaccctacgttgcaatagttcaggaaaaaatctccggattatccagttttggaattgaacttggtttctttgtcgaggaatatgctggcagtaaagggagattcccccctactaaaagaagggaaaaaaagagcctctatatcgccactatagagaaaggtcactctctcgttaactcactgatcgagaccggaagaattgatagcctgggcctggtggttgtggatgaactccacatgatcggcgaaggcagccgcggtgccacactggagatgaccctcgcgaagatactttatacgtccaagactactcagatcatcggcatgagtgccacgctgaacaatgtggaggatctgcagaagttcctgcaggctgaatactatacttcgcagttccggccagtggagttgaaggagtacttaaagattaacgacacaatctacgaagtggactccaaggccgagaacggcatgacattctcccgccttctgaactacaaatattccgacaccctgaaaaaaatggatcctgaccacttagtcgcactcgttacagaggtgattcccaactactcctgcctcgtgttctgcccgtcaaagaagaattgcgagaacgtcgccgaaatgatatgcaaattcctctccaaggaatatctcaaacataaggagaaggagaagtgcgaggtgattaagaatttgaagaacatcggaaatggcaatctttgccccgtcctaaaaaggacgatccccttcggagtcgcgtatcaccactccggtctgacgtccgatgaaaggaagttgctggaagaagcttactctacaggcgtgctgtgcctgttcacatgtacgagtacgctagctgcaggcgtcaacttgcctgccaggcgagttattctccgcgcaccatacgtggcgaaagaattcctgaagaggaaccagtacaaacagatgataggtcgagcaggaagagctggaatcgacaccatcggtgaaagcatactgatccttcaggagaaggacaaacagcaagtcttggaactgatcactaaacctctagagaattgctattcacatctggtccaggaatttactaaggggattcaaactctgtttttgtctctgatcggactcaagatcgcaaccaatctggacgatatctatcacttcatgaacggaaccttctttggtgtccagcagaaagtgttgctcaaagaaaaatccctgtgggaaataactgtggagtctctgcgttatttgacagagaaaggattgctacaaaaggataccatctacaaatccgaagaagaagttcagtacaacttccatatcactaaacttgggagggcctcgtttaaaggtaccatcgatctggcttattgtgatattttgtatcgcgaccttaagaaaggactcgaagggttggtactagaaagtcttctgcacctaatctaccttaccaccccgtatgatctagtatcccagtgcaatcctgattggatgatctacttcaggcagttttcacaactgtccccagccgagcagaatgtggcagcaatcctgggtgtttccgaatctttcatcgggaaaaaagccagtgggcaggccataggcaagaaagtggacaaaaatgtcgtgaataggctctaccttagctttgtgttgtacaccctgcttaaggagacaaatatttggactgtctcagagaagttcaacatgccacgagggtacatacaaaatctgttgaccggtacagccagcttctcaagctgtgttctgcatttctgcgaggaactggaagagttttgggtgtaccgagccctcctggtggaactgactaaaaagctcacatactgtgtaaaggctgaactgattcctctaatggaagtgacaggggttctggagggcagggcgaaacagctgtattcagctggctacaaaagcctcatgcatctcgctaatgctaacccagaagtccttgtgcgcacaattgaccacctgtctcgtcgtcaggcaaagcagattgtttccagcgctaagatgctgctccacgaaaaggccgaagcccttcaggaagaggtagaagagctactgagacttccctcggactttcccggtgctgtcgcctcttctactgacaaagcatag

SEQ ID NO: 56786 - DNA, 546 bp, Artificial Sequence
  Description of Artificial Sequence: Synthetic coding sequence
atgaccacaaccactacctttaaaggcgttgatccaaatagtagaaacagctcacgagtgttacggcctcctggcggtggcagcaactttagcctgggattcgatgaacccacagagcagcccgtcagaaagaataaaatggcgtcaaacatctttggaacacctgaagaaaatcaggcctcctgggcgaagtcggccggtgcaaagtcgagtggtggccgagaagatctagaatcatctgggttacagaggcggaattcgtcggaagcgtctagcggagatttcctcgatttgaagaaaatgtggacccagacctgtcaggccgcatgggggagagtgaaacggtccccctgcctgctaaggttatgccctgcaagatggcctaggccgcagtgccaccctgaagagatacctctggctgctagcccagcgagctcctgggtctcatctgattgccccgagaggtgccggtccgtgtgctttctgcatgcatgcgagctgcacaacctgtcccttaccgttcatcttttagacctcttccattag

SEQ ID NO: 56787 - DNA, 327 bp, Artificial Sequence
  Description of Artificial Sequence: Synthetic coding sequence
atggcaagcaatatctttggtacccctgaggagaaccaagcatcttgggctaaaagtgccggtgccaaaagctctggaggtcgtgaagacttggaatcatccggcctccagcgtaggaatagctccgaagcatcctcgggtgacttccttgatctgaaaaccagcggcggtaaaatcgaaaatgtggacaccgacctgcctggaagtctgggtcagagcgaagaaaagcctgtccctgccgctcctgtgccatcgcctgttgcccctgcccctgtgccgagccggcgtaatcccccagggggaaaatcatctttggtgctcgggtag

SEQ ID NO: 56788 - DNA, 327 bp, Artificial Sequence
  Description of Artificial Sequence: Synthetic coding sequence
atggcctccaatatttttggaacacctgaagaaaaccaggcctcctgggcaaagtctgcaggggcaaagtctagtggagggagagaagacctggaatcatcaggattgcaacggagaaattccagtgaggccagcagtggggactttcttgacctgaaaggtgaaggtgacattcacgagaacgttgatacagacctgcccggatcactgggacagagcgaggagaagccagtgcccgcagctcctgtccctagtcctgtagctccggcaccagtgccaagtaggcgaaaccccccaggcggaaagtcgagtttagtgctcggctag

SEQ ID NO: 56789 - DNA, 465 bp, Artificial Sequence
  Description of Artificial Sequence: Synthetic coding sequence
atgacaaccacaaccactttcaagggcgtcgatccaaattccaggaatagttcccgggtccttagaccccctggtggcggtagcaatttctcactcgggttcgatgaacctactgaacagcctgtccgaaaaaataaaatggcctcaaatatctttggtacacctgaagaaaatcaggctagttgggcgaagtcggctggtgctaaatcaagcgggggaagagaagatttggaaagctccggcttgcaacgtaggaatagctcagaagcctcttctggggacttcctggacctgaagggcgaaggtgacattcacgagaacgtggacacggacttgcctggctcgctcgggcaaagtgaggaaaagcccgtgccggcagcccctgtgcctagccctgtcgcgcctgctcctgttcctagtagacgaaatccccctggagggaagagttcgctggttcttggctag

SEQ ID NO: 56790 - DNA, 198 bp, Artificial Sequence
  Description of Artificial Sequence: Synthetic coding sequence
atgcagtccgaggtgcagcggcagcccgaccgctctatccagaatccacttacggtcggatctcacaccccctgtcttacgcctcctaccatgtcttgcaacaactcccaggtctggtggtgcgtgcccgtggtaccggctacatgggaacccgaggcaggcggaagtctggaatcttcttctagcagactgcagtag

SEQ ID NO: 56791 - DNA, 663 bp, Artificial Sequence
  Description of Artificial Sequence: Synthetic coding sequence
atggccctgagtagtgtcgggcgagcgtggtgtccaccagggtttatccgccagaacggagtgtgcacagacctggacgaatgtagggtgaggaacctctgtcagcatgcatgcaggaataccgaaggatcctaccagtgcctgtgtccagccggttaccgactgttgccgagcgggaagaactgccaggatatcaacgagtgcgaagaagaatctatagagtgcggacccggacagatgtgctttaatacccgtggctcatatcagtgcgtagacacaccatgtcctgctacataccggcagggaccctcacccggaacatgcttcaggaggtgtagtcaagattgcggcaccggcggtcccagtacacttcagtataggctgttgcctctcccactgggagttagggcccatcatgacgtggcaagattaactgcattctccgaagttggagtcccggcaaaccggactgaactaagcatgctggagcccgaccctagatccccatttgctctcagacccctgcgcgcagggcttggagccgtgtatactagaagggccttaacccgggcaggactctatcgccttacggtcagagctgcagcccctcgccaccaatccgtatttgttttactcattgcagtctcgccctatccctactag

SEQ ID NO: 56792 - DNA, 990 bp, Artificial Sequence
  Description of Artificial Sequence: Synthetic coding sequence
atgatggcaccggtggtgttaacgtgtcacagcacaggcattcccgctcccaccgtgtcttggtctaaagccggtgcccagctgggagcacgaggttcaggatacagagttagcccctccggcgctcttgaaatcggccaggctttacccattcatgccggacggtacacatgcagcgcacggaattctgcaggcgtggcccataaacatgtgttcctgacagtgcaggcctcacccgtggtgaaaccactcccttcggtggtgagggccgtcgcggaagaagaagtgttgctgccttgtgaggcatcaggaatacctcggccaacaattacctggcagaaggagggacttaacgtggccaccggggtgtcgactcaggttttgcccggaggtcagctccgaattgcccacgcatctcccgaagacgccggtaattacctgtgtattgccaaaaatagcgcaggctctgctatgggaaaaactagactagtcgtgcaggttccacctgtgatcgagaacggactgccagatctttccacgacagaaggctcacacgcattccttccctgcaaagctcgcggaagccccgaaccaaacatcacttgggataaggacggccagcctgtctcaggcgctgagggcaagttcaccatccaaccttccggagagctcctggttaaaaacctggaagggcaggatgccggaacctacacctgcactgctgagaacgctgtcgggagagcccgaagaagagtccatctcacaatactggtcctgcctgtgtttactacgctgccaggcgacagaagcctacggttaggagaccgcctgtggctacggtgtgccgctcgcggatccccaactcctaggattggctggaccgtgaacgatcgcccagtgacggggctaggcctgctaggaatgggaggaacggagtctcaagatacagggagacttcgacgagaaggcaggtggggcgacccaacctag

SEQ ID NO: 56793 - DNA, 462 bp, Artificial Sequence
  Description of Artificial Sequence: Synthetic coding sequence
atgagaggcgcttccgctagacctcctctgcttggctcggaggagcctttctgccctgcctcacgtagcgttagggagggaggcggaggggtctcaccacctcccggacagcctccatgcccagagggcagatggggcggtcagccacccgctcggcctgccgatccatccggcagggaggttgggggttctgccccatgtcccgcttcccggcctgtgagggaagtccgaggagcctctgccaggcctccactcctcggatctgaggagccgctgtgcccagcatccaggcctatctgggaaggcggtggcggagtctcgcccccaccttgtcaaccaccttgccctgggggacggggagctagcgccagaccaccacttcttggcaatgaagaaccattgtgcccagccacaaccccttcaggccgatgcactcagcagttggtggagaatggcccttag

SEQ ID NO: 56794 - DNA, 1866 bp, Artificial Sequence
  Description of Artificial Sequence: Synthetic coding sequence
atgtcacccgtgttccctatgttgaccgtgctgaccatgttctactatatctgtttgagacgcagagcacgcaccgccaccaggggagaaatgatgaacactcaccgggctatcgaatccaactcacagacctctccattgaacgctgaggttgtgcagtacgcgaaagaagtggtggacttctccagtcattatggctccgaaaattctatgagctacacgatgtggaacctggcaggggtgcctaacgtatttcccagctctggcgactttacgcagacagctgtctttcggacctatggcacatggtgggaccagtgcccatctgcaagtctgcccttcaaaagaacacctcccaactttcagagccaagactatgtggagctcaccttcgagcagcaggtctatcctactgccgtgcatgttttagaaacttatcacccaggcgctgtgatccgcattcttgcttgttcagcaaacccatattcacccaacccccctgccgaggtccgatgggagatcctctggtcagagcgtccaacaaaagttaacgccagtcaggcacgccagtttaaaccgtgtattaaacaaataaatttccctaccaacctgatccgactggaggtcaatagttcattgcttgaatactacaccgaacttgacgcagtcgtgctgcacggagtgaaagataaacccgtactctccctgaagaccagcctgatagacatgaacgatatcgaagacgacgcttatgctgaaaaagacggttgcggcatggactccctgaacaaaaaattttcttctgcggtgctgggcgaaggccctaataatgggtacttcgacaaactgccatatgaactgatacagctcatccttaaccatctgaccctgccggacctgtgccgactggcccagacatgtaagctactgtcacagcactgctgtgacccgcttcaatatatccaccttaatctccagccttactgggctaagttggatgatacatcactcgagttcttacagtcacgctgtacgctggtgcagtggcttaatctttcctggaccggaaaccgaggatttatatcagtcgctggattttcacgcttcctcaaagtgtgcgggagcgaattagtgcggctagaactgtcttgctctcactttctcaatgagacatgtctggaagtcattagtgaaatgtgtccaaatttacaagctctcaatttaagttcatgcgacaaactgcctcctcaggcattcaatcacattgccaaattatgttctctcaagaggctcgtcctgtacaggacaaaagtggagcagaccgccctgctcagtatactgaatttctgttctgagctgcagcatctatcccttggcagctgtgtaatgattgaggattatgatgtcatcgcatctatgatcggcgctaagtgcaaaaaactgcggaccctcgacttgtggcgatgtaaaaacataactgaaaatgggatagcagagttggcctctgggtgtcctctgctggaggagctggatctgggatggtgccccacattacagagttctactggctgtttcactcgcctggcccatcagctccctaacctgcagaaacttttccttaccgcaaatcgatctgtatgtgatactgatatcgatgagttagcttgcaactgtacgcgccttcaacaactagatattcttggcacaaggatggtgtctcctgcttccctgcgaaaattgctggagtcatgtaaggacctgtccctcctcgacgtttctttttgcagtcaaatcgacaaccgcgcagtcctagagctcaatgcttccttccctaaggtatttatcaaaaagagtttcacccagtag

SEQ ID NO: 56795 - DNA, 756 bp, Artificial Sequence
  Description of Artificial Sequence: Synthetic coding sequence
atgtccgcgtacgggatgcccatgtacaaatctggtgacctggtgttcgcaaagttgaaaggttacgctcactggcctgccagaattgagcacatgacgcagccaaacagataccaggtgttcttctttggcactcatgaaacagcctttctgagtccgaagaggctgtttccatacaaggagtgcaaggaaaagtttgggaagccaaacaagagacggggattctccgcaggcctgtgggagatcgagaacaaccctaccgttcaggcaagtgattgcccgctggcgtctgagaaagggtccggagatgggccatggcctgaaccagaggccgctgagggcgacgaggacaagccgacacacgctggtggaggtggcgacgaactgggcaaacctgacgacgacaaacccactgaagaggaaaagggtcccttaaagagatccgctggtgatcccccagaagatgccccaaagcgccctaaagaagcagctcctgatcaggaggaggaggccgaagctgaaagagccgcagaagccgagagagccgcagccgctgcagcggcaaccgctgtggacgaggaaagtccattccttgtggctgtagagaacggatctgctccttctgagcccggattagtttgcgaaccgccacagccggaggaggaagagctacgggaggaggaggtggcggacgaggaggcctctcaggaatggcacgccgaggccccaggcggaggggacagagattctctctag

SEQ ID NO: 56796 - DNA, 345 bp, Artificial Sequence
  Description of Artificial Sequence: Synthetic coding sequence
atgttcggcgcttgctacaaacagcctctgaagccatcagggtccgaaccgccagcagaagagtgtcggatgacaccgcgacacgcaggctgcgacgtgacagagatgcaacgcattctcagccagcccacctttacagagcatctgctgcgcgcagtgtgcaccaaactggccaacatgtacagcactagcacggactgccgggaacattgcagacggggaatgaaagctaagcaattgaaagcagaggctggtcgcagctgtcagagaaagggcgtcccgatccagacgcctcgtgaacacagctggatttcgtgcaaaaaggaattcgaagcgaacccatag

SEQ ID NO: 56797 - DNA, 231 bp, Artificial Sequence
  Description of Artificial Sequence: Synthetic coding sequence
atgttcggggcatgttataagcagccgcttaaacctagcggctctgaacccccagccgaggagtgccgcatgacaccacgacacgccggatgtgatgtgactgaaatgcaacgcatcctttctcaaccgacattcactgaacatctgttgcgggctgttctctccacagagcgagggccatacccagatcctaaacgcgcattcctagacttgctccaagaaagaatttag

SEQ ID NO: 56798 - DNA, 366 bp, Artificial Sequence
  Description of Artificial Sequence: Synthetic coding sequence
atgtttggcgcatgctacaagcagcccttaaagcctagtggctcggaacccccagccgaggagtgtcggatgacaccacgacacgcaggctgcgatgttacagagatgcagagaattctcagtcagcctacattcacagagcacctgttgcgagctgtttgcttagtgaacggaaagggctctctatctcggcctcaggaatctattttaggcagcctcgccagaaaaaatctgcgaagaatccatcgggtgtctttagttatgtgcgtgcggccactatcccctagtaaggctataataagccccgtgacatgtatgtatacatcccgttggcccgaggccagcgaggagagccagaaaaagtag

SEQ ID NO: 56799 - DNA, 465 bp, Artificial Sequence
  Description of Artificial Sequence: Synthetic coding sequence
atgttcggcgcttgctataaacagcctctgaaaccaagtgggtctgagcctccagccgaagaatgtagaatgacacctaggcatgctggctgcgatgtaaccgagatgcagaggatcctgagtcagcccacctttaccgagcatctgctacgagccgtctgcaccaagctggcaaatatgtattccacctctacagattgccgcgagcactgtcggaggggcatgaaagctaagcaattaaaggccgaggccggaaggggtttggtgaatggcaaggggtccttgtcccgccctcaggagtccattcttggctcactggcccgaaagaacctgcggagaattcaccgggtgagcctagtcatgtgcgtcagaccactgtccccgtccaaggccatcattagcccagtgacttgcatgtatacgtccagatggccagaagcatccgaggaaagccagaaaaagtag

SEQ ID NO: 56800 - DNA, 345 bp, Artificial Sequence
  Description of Artificial Sequence: Synthetic coding sequence
atgtttggcgcttgttacaaacagcccctgaagccctcagggtctgagcctcctgctgaggagtgtaggatgactcccaggcacgccggatgtgacgtgactgaaatgcagaggatcctaagccagccgacctttacagagcatttattacgagcagtatgtactaagctagcaaatatgtattccaccagcactgattgtcgggagcattgccgacgcggaatgaaggccaagcagctgaaagctgaagccggaagatcttgtcagcgcaaaggcgtgcctatccagaccccgagggagcatagctggattagctgcaagaaggaattcgaagccaacccatag

SEQ ID NO: 56801 - DNA, 1350 bp, Artificial Sequence
  Description of Artificial Sequence: Synthetic coding sequence
atgatgctgtcgacagagggcagggagggattcgtcgtaaaggtccggggtcttccttggtcatgctcagcagatgaagtgatgcgcttcttctcggattgtaaaatccagaacgggacttccggaatccggtttatttacactcgggaagggaggcccagcggcgaggccttcgtcgagctcgaatccgaggaggaagtgaagcttgctttaaaaaaagatcgcgagacaatgggacacaggtatgtcgaggtttttaagagtaatagtgtggagatggactgggtactaaaacacaccggtccaaatagtcccgacacagcaaatgatggctttgtgcgtctcaggggcctacccttcggttgcagcaaggaagagatcgtgcagttcttttccggactcgagatcgttcccaacggtatgacactgcctgtagacttccaaggtaggagcaccggtgaggccttcgtccagttcgcttcccaagagattgccgaaaaggccctcaaaaaacacaaggagaggattgggcaccggtacatcgaaatctttaagagcagcagagcggaagtgcgtacgcactatgaccccccaaggaagttgatggcaatgcagcgtcccggaccgtacgaccgccctggcgcagggagaggttacaactccattggcagaggggctggatttgaacggatgcgaaggggagcctacggcggaggctacggaggttatgatgactacgggggttacaatgacggctacggcttcggatcggacagattcggcagagatttgaactactgtttcagtggcatgtccgaccatagatacggggacggcggatcatccttccagtccactactgggcattgcgtgcacatgcgcggactaccttaccgcgctactgagaatgacatctacaattttttttcacctttaaaccctatgcgcgtgcacatcgaaatcgggccagacggcagagtgactggtgaggcggatgttgagttcgcaacccatgaagatgctgtggcagctatggctaaagataaagccaatatgcaacaccgatacgttgagctgtttttgaacagtaccgcgggaacgagtggaggggcatatgaccactcctacgttgaattgtttctcaactctacggcaggggcttctggaggcgcttatgggagccagatgatgggcggtatgggactgtccaatcagtcctcctatggcggtccagcaagtcaacagctttccggaggatatggcggaggatacggtgggcaatcctcgatgtcaggctacgatcaagtgttgcaagagaactcttccgactaccagtctaacctggcttag

SEQ ID NO: 56802 - DNA, 1656 bp, Artificial Sequence
  Description of Artificial Sequence: Synthetic coding sequence
atggacgagggggtcaactttaaaccaacagaggcgggaaggctcatggcgtggtactatatcactttcgaaaccgttaagaagttttacacgatatccggtaaggagacgctctctgatctggtcaccctgattgccggttgtaaggaattcctcgacattcagctgcgcattaatgagaagaagacactgaataccctgaacaaagacccaaaccggataacaatccgctttccgatggagggacgcatcaagacccgcgaaatgaaagtgaattgtctgatccaggcccagctaggatgtattcctatccaagactttgcacttacccaagatactgcaaagatctttagacatggcagcaggattacacgatggctcagtgactttgtggccgctcaggaaaagaagtttgctgttttgcttaattccttgatcctggctaaatgctttcgatgtaaactatgggaaaatagtcttcacgtgtctaagcagctggaaaaaattggcattacactgtctaacgccatcgtgaatgccggactgacctccttcaagaagatcgaggagaccgatgcgagggaactggaactgatcctcaacagacatcccccttttggtactcagataaaagaaaccgtgatgtatctcccaaagtacgagctgaaggtagagcagattacccgttactcggatactaccgctgagatcctggttaccgtcatcctgcgaaacttcgaacagttacagacgaaacgcactgcctccgattctcattacgtgactctaattatcggcgatgcagacaaccaggtggtgtacttacataagattacagacagcgtccttctgaaagccggatcctgggctaaaaagatcgccgtgaagcgagctctgaaaagcgaagatctgagtatcaatctcatatccagcgaattcgtggggttggatatacagcagaagctgacggtcttctatctcgaacccaaaaggttcggaaaccagattaccatgcagaggaagtctgaaacgcagatctcacacagtaagcactctgacattagtacgatcgcaggacctaacaagggaacgacggccagcaagaagcctggaaatcgagagtgcaaccatctttgtaaatcaaagcacacctgcgggcacgactgttgcaagataggcgttgcccagaaaagtgagataaaggagtctacaatttctagctatctgtccgatctaaggaaccgcaacgctgtatcttccgtacctccggtgaaacgactgaaaatacagatgaacaaatcccagagtgtagacctgaaggaattcggcttcacccctaagcctagtttgccgtctatctcacgcagcgagtacctcaacatttccgagttacccattatggaacagtgggatcagccggagatatacgggaaagttcgccaggagccgtcggagtaccaggataaagaagtacttaatgtgaacttcgagctcggcaatgaagtctgggacgacttcgacgacgagaatctggaagttacatctttctcaacggacacagagaagactaaaatctctgtgcttttccaccacatgcggtgtaggatattcctgtatcagattctactttgtccctctagcgtccatcctccctag

SEQ ID NO: 56803 - DNA, 2493 bp, Artificial Sequence
  Description of Artificial Sequence: Synthetic coding sequence
atgattgcctgttttctgtggaagatatgcttcttgaaaaaccagatgaagctgaaaatggcccctatcaaggccctctgtagccagaggtttgatgactggaaggagaaatttgggccaattgggttgaattgtaaggaattgacgggagacaccgtgatggacgacctgttcgagatccagcatgcgcacatcatcatgactacccctgaaaagtgggactccatgaccaggaagtggcgagataacagcctcgttcagttagtacggctgtttctgatagatgaggtgcatatcgtgaaagatgagaaccgcggaccaacccttgaggtggtggtgtctagaatgaagaccgtgcagtccgtgtctcagaccctgaagaacacaagcactgctattcctatgagatttgtggctgtgagcgcaacaatccccaacgctgaggacatcgccgagtggctctctgatggcgagcgccctgctgtgtgtctcaaaatggacgaatcacaccgacctgttaagctccaaaaagttgttctgggctttccctgctcctcaaaccagacggagtttaagttcgacctgaccctgaattataagattgcttctgtaatccaaatgtatagtgaccagaaaccaacattggttttttgtgccacccggaagggcgtgcagcaggctgcctccgtgctggttaaggatgctaaattcatcatgaccgtggaacagaaacaaaggttacagaagtacgcctattcagtccgcgattcaaagctgcgcgatattctgaaggatggagcagcctatcatcacgcgggaatggagcttagcgacagaaaggtggtggaaggcgcttttacagttggggaccttccggtgctgtttacgaccagcacattagctatgggggtcaacctccccgctcaccttgtggtcattaaatcaaccatgcactacgccggaggcctgttcgaggaatatagcgagactgacattctgcagatgatcggacgagcgggtcggccacagttcgacaccactgccactgctgtcatcatgaccagacttagcactcgcgacaaatacattcagatgctggcctgccgtgatactgttgaatcctcattgcatcgacacctaatcgaacacctgaacgcagagattgtgcttcatactatcaccgatgtgaatatagctgtggagtggatcaggtctacccttttgtacatccgggcactcaaaaacccaagccactacggattcgcatccgggctcaataaggatggcattgaagccaagcttcaggagctttgcctgaaaaatttgaacgacttgagctctctggatctcatcaagatggacgaaggagttaatttcaaacctacagaagccggtcggctgatggcgtggtactatatcaccttcgagactgtgaaaaaattctacactatttcaggaaaagagacactttcagacttagtgactttgatcgctgggtgtaaggaattcttggacattcagctgcggatcaatgagaagaagaccctgaacacacttaacaaagaccctaaccgcataacaatccggttccccatggaagggaggataaaaactcgcgaaatgaaggtaaactgtctcatccaggcacagctgggctgtattcccatccaggattttgccttgacccaggacactgccaagatttttagacatggttctaggatcactcggtggctatccgattttgtagccgctcaggagaagaagtttgccgtgttgctgaatagcttgattctcgcaaagtgttttcggtgcaagctatgggagaactcccttcatgtgagtaagcagctagagaaaatcggaattactctgtccaacgcgattgtgaatgctgggctcacctctttcaagaaaatagaagaaactgacgctagagagctggaactcatccttaaccggcaccccccattcggcacacagatcaaagagacagtcatgtatctgccaaaatatgaactgaaggtggagcagatcacgagatacagcgacactaccgccgaaattctggttaccgtgattctacgaaattttgagcagctgcagaccaagcgaactgcaagcgattcccattacgttaccctgatcatcggggacgccgataaccaggtagtgtatctgcacaaaataactgattcagtgctcttgaaggccggatcttgggccaagaaaatcgcggtcaaaagagcgcttaagtcagaggatctctccataaatctaatctcaagcgagttcgttggccttgatattcagcaaaaattgaccgtgttttacctggaacctaaaaggtttggcaatcagatcaccatgcaacggaagagcgaaacgcagatttcccatagcaaacacagtgatatatccactatcgcaggccctaataaggggacaacagcaagcaagacctgggagccccgaatgcagtccagtctgtag

SEQ ID NO: 56804 - DNA, 3345 bp, Artificial Sequence
  Description of Artificial Sequence: Synthetic coding sequence
atggaggtgccgctcccttggcttaacatcaagatcgtctatatggcgcctattaaggcattatgctctcagcggtttgacgactggaaagagaagttcggccctatcggcttaaactgtaaggaactaactggcgatactgtaatggacgacctgtttgaaatccagcatgcccacattatcatgaccaccccggagaagtgggacagcatgaccagaaagtggcgcgataactccctagtccaactagtgagactcttcctgatagacgaggtgcatatagttaaggatgaaaaccgagggccaactctggaggttgtcgtttcacgcatgaagacagtgcagagtgtaagccagacactcaaaaacaccagtaccgctattcccatgcgattcgtggctgtgagcgctacgatacctaacgcagaggacattgccgaatggctcagcgacggagagcgcccagcggtatgtctgaagatggacgagtctcatagacctgttaagctccagaaagtagtcctcgggtttccttgctcctctaaccaaaccgaatttaaatttgatttgacactgaactacaaaatcgcctctgtgatccaaatgtactccgaccagaagccaactctcgtattctgtgcaacccggaagggggtgcagcaagcagcctctgtgctggtgaaggatgccaaattcataatgacggtcgagcaaaagcagcgactgcagaagtacgcttatagtgtgcgcgattccaaattgcgggatatacttaaagatggagcggcttatcaccatgcaggcatggagctgagcgacaggaaagtggtcgagggcgcattcacagtaggggacctccctgtactttttactacttcaacgctggcaatgggcgttaacttgccagcccatctcgttgtaatcaaaagcactatgcactatgccggaggcctgtttgaggagtacagcgagacagacattttgcaaatgatcgggagagccggacgtccacagttcgatactactgcgacagctgtgatcatgactcgcctctcaactagagataagtatatccaaatgctggcttgccgagacactgtggaaagctctctgcatcggcacctgattgaacatttaaatgccgagatagttctccacacaattacagatgtgaacattgcagtcgagtggatcaggtcaacattgctttacatcagggcactcaagaacccaagccactacggttttgcttccggcctcaacaaagatggtattgaagcgaagctgcaagagctatgtctgaagaatctgaatgacttatcctcgttggatctgattaaaatggatgagggagtgaacttcaaaccaaccgaagcaggtcgtctgatggcgtggtattatatcacttttgaaactgtgaaaaagttctatactatcagcgggaaggagactttatccgatctcgtcacgctgatagcaggttgcaaggagtttctggacattcagctgagaattaacgaaaagaagacactcaacacccttaacaaggatcccaacagaattaccatccggtttccaatggagggcaggatcaagacacgcgaaatgaaggtcaattgcctgattcaggcgcaactcggctgtatccccatccaggactttgcattgacccaagatacggcaaaaattttccgacacggtagtcgcataacacggtggctgagtgattttgtcgccgctcaagagaagaagttcgcagtccttttaaattcactgatactggcaaagtgtttccgatgtaagctgtgggagaactcactgcacgttagtaagcagctagagaagattggcataacactgagtaacgccatcgtaaacgccggactgactagtttcaagaagatcgaagagacagatgccagggagctggaactcattcttaatagacacccgccatttggaacacagataaaagagaccgtgatgtacttaccaaagtatgagctcaaagtggagcagattacgcgctatagcgatactacagctgagatactcgtgacagtaatcctaaggaactttgaacagctgcagacaaagaggactgccagcgatagtcattacgtaactttaattatcggcgatgctgataatcaggtggtctacctgcacaagatcactgatagcgtactgctgaaagccggaagctgggcaaagaagattgctgtaaaaagagctttgaagtctgaggatctgagtatcaatcttatctcatcggaattcgtcggattggacattcaacagaagctgaccgttttttacttggagcctaagagattcggtaaccagatcacgatgcaaagaaaaagtgagacccagatcagccattccaaacactccgatatcagcactatcgccggtcctaacaagggaactaccgccagcaaaaagcccggaaacagagaatgcaaccacctatgcaaatcaaaacatacatgtggacacgattgttgtaagattggggttgcgcagaaaagcgagataaaggaaagtactatctcctcatacttgtccgacctcagaaacagaaacgctgtgtcttcagtcccgcctgttaaaaggctcaaaattcagatgaataagagccaatctgtggatctcaaggagttcggatttactcccaaacccagccttccttctatatcccgttctgaatacttgaatatctccgagctacccatcatggagcagtgggatcagcctgagatatacggcaaggtcagacaggagccctctgagtatcaggataaggaagtgctgaatgtgaacttcgagcttggaaacgaggtctgggacgactttgacgacgaaaacctcgaagtgacttccttttcaacagacacggaaaagactaaaatcagtggttttggaaatacactttcctcatctacacgcggtagtaaactccccctgcaagaatctaagtctaagtttcagagagaaatgtcaaattcgtttgtgagttctcatgaaatgtctgatatctcgctttccaactccgcaatgccaaaattctctgccagttctatgaccaagctcccccagcaagccggaaatgccgtcatcgtgcattttcaggagcggaagccacaaaatttgagcccagaaatcgagaagcagtgtttcacattctccgagaaaaatcctaactcttctaactataaaaaagttgattttttcattcggaactctgaatgtaagaaggaagtcgactttagcatgtatcaccccgatgatgaggccgacgagatgaaatctctcctcggcatcttcgatggcatcttctag

SEQ ID NO: 56805 - DNA, 4308 bp, Artificial Sequence
  Description of Artificial Sequence: Synthetic coding sequence
atgctgaagtccaacgactgtctgttctccttggagaatctgttcttcgaaaaaccggacgaggtcgagaatcatccagataacgagaaatcccttgattggttcctgccccctgcaccactgatctcagaaattcctgatacccaggaattggaggaagaactggaatctcacaaactgctaggtcaggaaaaacgccctaagatgcttacctccaatctaaaaatcacaaacgaagacaccaattacatttcactgacccagaagtttcaatttgctttcccatcagacaagtatgaacaggatgacctgaacctggagggggttggtaataatgacctgtctcacatagcaggcaagttgacttatgcatctcaaaaatacaagaaccacatcgggacggaaatcgctccagaaaagtccgtccctgacgataccaagctcgtgaactttgccgaggacaagggagaatcaacttccgtcttcagaaaaaggctgtttaaaattagtgataatattcacggatcagcttactccaatgacaacgagctggacagccatatagggtcggtgaagattgtgcagaccgaaatgaataaaggtaaatcacggaactactcgaacagtaaacagaagtttcaatattccgcaaacgtctttaccgccaacaacgccttctccgcctccgagatcggggagggaatgtttaaagctcctagcttttccgttgctttccagccccatgatattcaggaggttaccgagaatggcttgggttctctcaaagccgtgaccgaaatccctgccaagtttcgcagcatctttaaggagttcccctattttaattatatccaaagtaaagcattcgacgatctattatatacagatcggaacttcgtgatatgcgctccgactgggagtggcaagacagttgtctttgaactggccattacaaggctgttgatggaggtgccactgccttggctgaacattaagatcgtgtatatggcaccgatcaaggcattgtgcagtcagaggtttgacgattggaaggagaaattcggacccattgggctcaattgtaaggagttgaccggcgatacggttatggacgacctcttcgagatacagcacgcgcacattataatgactacaccggaaaagtgggattcaatgaccagaaagtggagggacaacagcctggtgcaacttgtaaggctgtttcttatagacgaggtccacattgtgaaggatgaaaaccggggacccactctggaggtcgtcgtgtcccgaatgaaaactgtgcaaagtgtcagccagactcttaagaacacctcgacggccattcctatgcgctttgtggctgtgtccgcgaccattcccaacgccgaagacatcgcggagtggctctctgacggcgaaaggcctgccgtctgtctgaagatggatgagtcgcatcggccagtcaagctacagaaggtggtgctcggtttcccatgtagcagcaatcaaacagagtttaaattcgatctgacgttaaactataagatcgcgtctgtgatccagatgtattcggatcagaagcccacactggtgttttgcgcaacccgcaagggggtgcagcaagcagccagcgtgctggtcaaggacgccaaatttattatgactgtggaacagaaacagagattacagaagtatgcctattccgttcgggatagtaagctacgcgatatcctgaaagacggcgctgcttatcaccacgccggaatggagctttctgacagaaaggtggtagaaggcgctttcacagtcggcgacctccccgttctgtttacaacatccactcttgccatgggggtgaatctgccagcacacctggttgtgattaagtccaccatgcactacgccggaggtctctttgaggagtacagtgaaaccgacattctgcagatgattgggcgagccggtcggccacagttcgataccaccgccactgcagtgattatgacaaggctgtcaacccgcgacaagtatatccaaatgttagcctgtcgggataccgttgagagcagtctgcatcggcatctgatcgaacatctgaatgctgagatagtgctgcacacaataaccgatgtgaatattgccgtggaatggattaggtctacccttctttacattagggcgcttaagaaccctagtcactacggcttcgcttcaggcttgaataaagatggtattgaagccaaactgcaggagctttgtctgaaaaacctgaacgacctgagcagtcttgacttaatcaagatggacgagggggttaactttaaacctaccgaagcaggccgacttatggcttggtattacattactttcgaaactgtgaagaaattctacacaattagtggaaaagagactctctccgatctggtgacgctgatcgcagggtgtaaagagttccttgatatccaactccggataaatgaaaagaaaacgctgaacacacttaataaggacccgaaccgaatcactatccgctttcctatggaagggcgtattaagacgcgcgagatgaaagttaattgcctgatccaggctcagttaggatgcattccgattcaggatttcgctctgacgcaggataccgcgaagatttttaggcatggttcacggataactcgttggctctccgattttgtcgcagcccaggaaaagaagtttgccgttctattgaattccctgatcttggcaaagtgcttcaggtgcaaactctgggagaactctctgcatgtgagtaagcagttagaaaagattggcattacactgagcaacgccatagtgaacgctggactcacatcattcaaaaagatagaagaaaccgacgcaagagaactagagttgatcttgaatcgccaccctcctttcgggactcaaatcaaagagactgtgatgtacctaccgaagtatgaactcaaagttgagcagatcacacggtacagcgatacaaccgctgagatattggttacagtgatactgagaaactttgaacagttgcagactaaaaggaccgcctcggattcgcactatgttacacttataatcggcgatgccgataaccaagtggtctacctacataaaatcacggacagtgtgctgctgaaggcgggatcgtgggcaaagaagatagcagtgaagcgtgccctcaaatcggaagacctctcaatcaatctcatctcatctgaatttgtgggtttggacatacagcagaaactgactgttttttatttggaaccgaaaaggtttgggaatcagattaccatgcagcgaaaaagcgaaacacaaatttctcacagtaagcactcagacattagtacaatcgcaggccctaacaagggcacgacagcctctaagaagcccggtaacagagagtgcaaccacctttgtaagagcaagcatacctgcggtcatgactgctgtaaaatcggggtcgcccagaagtcagaaattaaggagagcactatctcatcatatctgtctgaccttcgcaatcgtaatgcggtgagcagcgtacccccagtgaagcggctgaagatccaaatgaataagtcacaaagtgtcgacctgaaggaattcgggttcaccccaaaaccaagcctaccctccatctcaaggagcgagtatctgaacatctcagagctaccaatcatggaacagtgggaccagcctgaaatttatgggaaggtacgacaggagccatctgaataccaggataaggaggttctgaatgttaatttcgagttggggaatgaggtgtgggatgacttcgatgacgagaatctggaggtgaccagcttcagcacagataccgagaagaccaagatctctggcttcgggaacactctgagctctagcacacgtgggtctaagctgccactgcaggaaagcaaatctaagtttcagcgcgagatgtctaactcattcgtcagtagtcacgagatgtccgacatttctctctctaatagcgctatgcctaaattctcagccagcagcatgacaaagctgccccaacaggcagggaatgctgtcattgtccactttcaggagcgcaaacctcagaacctctctcccgaaatcgaaaagcagtgctttacattttcagagaaaaatccgaattcgagcaattataaaaaggtggatttttttatccgcaactccgaatgtaagaaggaggtggattttagcatgtatcacccagacgacgaggctgacgaaatgaagagcctcctcggaatcttcgatggtattttttag

SEQ ID NO: 56806 - DNA, 417 bp, Artificial Sequence
  Description of Artificial Sequence: Synthetic coding sequence
atgttaaaaagtaacgactgtttgttctccctggaaaacctgttcttcgagaaacccgatgaggtcgagaaccatccagataatgagaagtccctcgactggttccttcctcccgcacctctgatctcggaaattcctgacactcaggaattggaggaggagctcgagtcgcataaactgttgggacaagagaaaagaccaaaaatgctgacgtcgaacctcaaaatcactaacgaggacacaaattatatcagtctgacacagaaattccagttcgcatttccttccgataagtatgaacaggacgatctgaatctggagggcgtgggcaacaacgacctcagtcacatcgcaggaaagttgacctatgcaagtcaaaagtataagaaccacatcgggaccgaaattgccccttag

SEQ ID NO: 56807 - DNA, 2187 bp, Artificial Sequence
  Description of Artificial Sequence: Synthetic coding sequence
tcccaggcctggcggtccagcgagggcctcataaaccgccgatccaccggcttgggggcagtccggagagaaatctatgacaaggtccaattttctaccatgttaaagtcgaatgattgcctgtttagcctggagaacctgttttttgagaagcctgatgaagtcgagaatcaccccgacaacgagaagagtctggattggttcttgcctcccgcaccactgatctccgaaatccccgatactcaagagttggaggaagaactggaatctcataagcttttagggcaggagaagagacccaagatgttgactagcaatttgaaaattactaatgaagatactaattacatttctctgacccagaaatttcagttcgcattccccagcgacaaatatgaacaggacgaccttaacctggaaggggttgggaacaacgatctctcacatattgcgggaaagctgacatatgcctcccaaaagtataaaaaccatattggaaccgagattgcccctgagaagagtgttcccgacgatacgaaacttgtcaactttgccgaggacaagggcgagtccacgagtgtttttcgaaagaggctgttcaaaatttctgacaatatccacggatctgcctactctaacgacaacgaacttgatagtcatatcgggagcgttaagattgtacagaccgagatgaacaaaggtaagagcaggaactattcaaactctaagcagaagtttcagtattctgctaacgtgttcactgccaataacgccttttctgcatctgagatcggcgaaggtatgtttaaagccccaagtttcagcgtggcatttcagcctcacgacatccaggaggtcacagaaaatggtctgggatccctgaaagctgtgaccgaaattccagcaaaattccggtccatttttaaagagttcccatactttaactacatccagagcaaggcctttgacgacctgctgtatacagatagaaacttcgtgatctgcgctccaacaggatcagggaagacagtggttttcgaactggccatcacgcggcttctcatggaagttccgcttccctggctcaatatcaagatcgtttatatggcaccaatcaaagcattatgtagccaaaggttcgatgactggaaagaaaagtttggccctatcggactgaactgtaaagaattgaccggcgataccgttatggatgacttatttgagatccagcacgcccacatcattatgaccacaccagagaagtgggacagcatgaccaggaagtggcgcgataattcattggtccaactcgttagactgtttctcattgatgaagttcacatcgttaaggacgagaatagagggcctacgctggaagtagtcgtgtctcgcatgaagactgtgcaatccgtgtcccagactttgaagaacacatccaccgccatcccaatgagattcgtcgcagtgtccgccactattcctaatgccgaggatattgctgagtggttgtcagacggggaaaggccggctgtctgtctgaagatggacgagtcacacagaccagtaaagctacagaaggtcgttctggggttcccatgctcctccaaccaaacagagtttaagttcgacttgacgctaaattacaagatagcgtccgtcattcagatgtattcagatcagaagcccacacttgtgttctgtgcaactaggaagggagtgcagcaggccgcttctgtgcttgtgaaggatgctaagtttataatgacagtcgagcaaaagcagagactccagaagtatgcatattccgtcagagactctaaacttcgagacattctcaaggacggagcggcatatcatcatgccggaatggaattatctgaccggaaggtagtcgagggggcttttaccgtcggcgacctacctgtgctgttcacaacttctacgcttgccatgggagtgaacctcccagcacaccttgtagtaatcaagtctaccatgcactacgcaggcggacttttcgaagagtatagtgaaactgatatccttcagatgattgggagagccggaaggccacaattcgacacaacggcaactgccgtcatcatgacccgactgagtaccagggataaatatatccaaatgctcgcttgtcgtgataccgttgagtctcgccttcatgcacattag

SEQ ID NO: 56808 - DNA, 294 bp, Artificial Sequence
  Description of Artificial Sequence: Synthetic coding sequence
atgtccagtgacaaccaatggagcgcagatgaagacgaaggtcaattatctagattgattagaaagtcacgagactccccctttgtgcccattggaattgccggattcgtgacggtcgtgtcctgcgggctctataagctgaagtatcggagggatcaaaagatgagcattcacctgattcatatgcgcgtggccgcacagggcttcgtagtgggggcagtaacactgggggtcctctactccatgtataaggactatatccgtcctcgattcttcagtgagtcaaagaaatag

SEQ ID NO: 56809 - DNA, 603 bp, Artificial Sequence
  Description of Artificial Sequence: Synthetic coding sequence
atggccaagggcgatccaaaaaagccaaagggaaagatgtccgcctatgcttttttcgtgcaaacatgccgcgaggagcacaagaagaaaaaccctgaggtccccgtgaacttcgcagaattctctaagaagtgtagcgaacgttggaaaaccatgtcaggaaaggaaaagagtaagtttgacgagatggctaaggccgacaaagttaggtatgatcgtgaaatgaaagattacggtccagccaaaggcggaaaaaagaaaaaggatcctaacgcccctaaacgccctccatcgggctttttcctgttttgctccgagtttcggcctaagatcaagagcactaatccaggcataagcataggcgacgtcgcgaagaagctgggagagatgtggaacaacctgaatgactcagaaaaacaaccctacatcacaaaggccgcaaaattaaaagagaagtatgagaaggacgttgccgactacaaaagtaaagggaagttcgacggagctaaggggcctgctaaggtcgctagaaaaaaagtcgaggaggaagatgaggaagaagaggaagaggaagaagaagaagaggaggaagaggacgagtag

SEQ ID NO: 56810 - DNA, 267 bp, Artificial Sequence
  Description of Artificial Sequence: Synthetic coding sequence
atgccaaagagaaaagcaaaaggggacgcaaaaggcgataaagccaaaagacgaagtaccagactgagcgcaaaacctgctcctcctaaacctcagcccaaaccaaaaaaggccccagccaagaagggtgagaaaattcccaagggcaagaagggcaaggcggacgcaggtaaggaaggtaataatcccgctgagaatggtgacgcgaaaaccgatcaggcacagaaggctgaaggagccggagtggccaaagctagtgacgagtag

SEQ ID NO: 56811 - DNA, 576 bp, Artificial Sequence
  Description of Artificial Sequence: Synthetic coding sequence
atgggaaaaactaactctaaactcgccccagaggtgttggaggatctggttcagaatacagaattctctgagcaagaactcaaacagtggtataaaggctttttaaaggattgcccgagcggaatcctgaacttggaggaatttcagcagctgtacattaaatttttcccctacggagatgcgtccaagttcgcgcaacatgcattccggacctttgacaaaaatggagacgggaccattgacttccgggagttcatatgcgctttgagtgttacctcgaggggtagcttcgagcagaagctgaattgggcatttgagatgtacgacctggatggtgacggtcgaatcacccgactcgagatgctcgaaatcatcgaggccatctataagatggtggggaccgtgatcatgatgcgcatgaatcaagacgggctgacgccccaacagcgtgtggacaagatttttaagaagatggaccaggataaagatgaccaaataaccctcgaggaatttaaggaagctgctaagagcgatccttcaatcgtcttactactgcaatgcgatatgcagaaatag

SEQ ID NO: 56812 - DNA, 552 bp, Artificial Sequence
  Description of Artificial Sequence: Synthetic coding sequence
atgggaaagaccaattctaagctggcccctgaagtcctagaggacctggtgcagaatactgaattctctgaacaggaactcaaggattgtcccagtggcatccttaaccttgaagaatttcagcagttgtacattaagttctttccctacggcgacgctagtaagtttgcccagcatgcctttcggacctttgataagaacggcgatggcacaatcgattttagggagtttatttgcgctctgagcgttacctcccggggatcctttgagcaaaagttgaactgggcttttgagatgtatgacctggacggtgacggccgaataactagactggagatgctggagattatcgaggccatctacaaaatggtcgggaccgtaatcatgatgagaatgaaccaggatggcctcaccccgcaacagcgcgttgacaagatattcaagaaaatggatcaggataaagacgaccagattaccctcgaagaattcaaggaagccgcaaagagcgaccccagcatagtgctgcttctccagtgcgacatgcaaaaatag

SEQ ID NO: 56813 - DNA, 1065 bp, Artificial Sequence
  Description of Artificial Sequence: Synthetic coding sequence
atggccgaggtgctgcggaccctcgccggtaaacctaaatgtcatgccctgcggccaatgatcctcttcttaataatgcttgtgctggtccttttcgggtacggcgtgcttagcccaagatcactgatgccaggaagcctcgaaaggggcttctgtatggcagtgcgcgaaccagatcatctccagagagtaagtctccctagaatggtctaccctcagccaaaggtcctcactccttgccggaaggatgttttagtggttactccatggctagccccaatcgtttgggaaggcacctttaacattgatatcctgaatgaacaatttcggctccagaataccacgataggcctaaccgtgtttgctataaagaagtacgtcgcctttttaaaactgttccttgagactgccgagaagcatttcatggtcggccacagagtgcactattatgtgttcacagatcaactggcagcagtgccccgtgtaaccttgggaaccgggcgacaactttctgtcctcgaagtgagggcctacaagcgctggcaggacgtcagcatgagacgaatggaaatgattagcgacttctgtgaacgtcgatttctgagcgaagtggactatcttgtctgtgttgacgtggacatggaattccgggatcacgtgggagtggagattcttacaccattatttgggactctgcaccctggcttctatggctcaagcagggaggcgtttacatatgagcgcagaccccagagccaggcctacatccccaaggacgagggcgatttttactatctgggtggtttctttgggggaagcgtgcaggaagtgcaacgtctgactagggcttgtcatcaggccatgatggtagaccaagctaatggaattgaggccgtctggcacgatgaatctcatctcaacaaatacctactgaggcataagcccactaaggtgctaagtccagagtatctgtgggaccagcaactgctcggatggcccgcagtactgaggaagctgcgattcaccgcggtccccaagaaccaccaggccgtgaggaacccgtag

SEQ ID NO: 56814 - DNA, 126 bp, Artificial Sequence
  Description of Artificial Sequence: Synthetic coding sequence
ttagaggaacaacctgagtgtcgggaagagaagcgaggatctcttcacgtgtggaaatccgaacttgtggaggtcgaggacgacgtctaccttcggcacagctcgtctctgacgtatagactgtag

SEQ ID NO: 56815 - DNA, 3648 bp, Artificial Sequence
  Description of Artificial Sequence: Synthetic coding sequence
atgacatccactgggcaggacagcaccacgactaggcagcgcaggtccagacagaatcctcagagccctccccaagactcctcagtcacttcaaagagaaatatcaagaaaggagcagtgcccaggagcattccaaatctggccgaggtcaagaagaagggcaagatgaaaaaactcggacaagctatggaagaagatctcatcgtggggctgcagggcatggacctgaatctggaggccgaagctcttgccggaaccggattggttctggatgaacagctcaacgaatttcattgcctgtgggatgacagcttccccgagggcccagaaagattgcatgcgattaaggagcagcttatccaggagggtctactcgaccgctgtgtttcttttcaggctagattcgcagagaaagaggaactgatgctggtgcactcactggaatacatagacctgatggagactactcagtatatgaacgaaggtgagctgcgtgttctggccgacacatatgattccgtttatttacatccaaattcttattcttgcgcctgtctggcaagtggcagcgtcctcaggttggtggacgcagttctgggagccgaaatccgtaacggcatggccatcattcgccctccgggacaccatgcgcaacattccttgatggatggatattgcatgtttaatcacgtggcggtggccgctaggtacgcgcagcagaagcatcggatcaggagggttctaatcgtggactgggacgtccaccatggccagggcacccagttcacatttgaccaggacccaagcgtgttatacttcagtatacacaggtatgaacaaggccgtttttggccccacctcaaggcatcaaattggagcactactggattcggccagggtcaaggctacactatcaacgttccatggaatcaagtgggcatgcgggatgctgactacatcgctgctttcctccacgtcctcctgcccgtggcattggaattccaacctcagctggtgttggtagctgcaggcttcgatgcccttcagggtgacccaaagggcgagatggcagcgacccctgccggttttgcccagctgacacacctcctgatgggcctggcaggaggtaagttaatcttaagcctggaaggcggatacaacctgcgagccttggctgagggagtttccgcttctctccacactctgctgggggatccatgtcccatgcttgagtcacctggcgcaccatgtcgctctgcccaggcctccgtgtcttgcgccctcgaggctttggagccattctgggaggttctcgtgcggtcaacggagactgtggagagagacaacatggaggaagataatgtcgaagagtctgaagaagaaggaccctgggaacccccagttctgcctattctcacctggcccgttctccaatctcgcaccggtctggtgtatgatcagaatatgatgaatcactgtaacttatgggatagtcatcaccccgaagtgcctcagaggattcttcgcatcatgtgcagactcgaggagcttggactcgcagggaggtgcttgaccctgacgccaaggcctgcaaccgaggcggagttgcttacatgtcatagcgccgagtacgtggggcacctgcgtgcaacggaaaagatgaagactagagaactgcatcgggagagcagcaattttgattcaatctacatttgtccaagcacttttgcttgcgcacagcttgccaccggagctgcttgccgcctggttgaggctgtgctctcaggtgaagtgttaaatggggctgcagttgttcgtccaccgggtcatcacgccgaacaagacgcggcatgtggcttttgtttttttaactctgtggctgtcgcggctcgtcacgcccaaacgatctcaggccatgctctgcggattttaatagtggattgggacgtacatcatggaaacggtacacagcatatgtttgaagatgacccgagcgtcctttacgtttcgctgcaccggtacgaccacgggacattttttccgatgggtgatgagggggcatcatctcagattggacgggcagccggaactggtttcaccgtgaatgtagcttggaacgggccaaggatgggggatgctgactacttagctgcctggcatagactcgtgcttccaattgcctatgagtttaacccagagctggtcctggtgtcagcaggcttcgatgccgctcggggtgatccattaggtggctgtcaggtctccccagaaggatatgcacacctgacccacttgcttatgggactggcttcaggaaggatcatcttgatcctggagggaggatataacctcacaagcatatcagagagtatggcagcatgcaccagatcgctcctcggggacccaccccctctcctgaccctccctcgccctcctctgagcggagccctcgcatccatcaccgaaaccatccaagtgcaccgtaggtactggaggtctcttcgcgttatgaaggtcgaggatcgagagggtccttcctctagtaagctggtgaccaagaaggcaccacagcctgccaaacctcgtctcgctgaaaggatgacaaccagagagaaaaaagtgttggaggctggcatgggcaaagtgacctctgccagttttggagaagaaagcacccccggtcaaacaaactcagagactgcagtcgtcgctttaacccaggatcagccctccgaggccgcaactggcggagccacccttgcgcaaactatttcagaggccgcaatcggaggcgcaatgctaggacagacaacctctgaggaggccgtgggaggggctaccccagatcagacaactagtgaagaaacagtcgggggagcaatactggaccaaaccacttcagaggacgccgtcgggggagccacactaggccagacaacctcagaagaggccgtcggaggggcaactctcgctcagacaacctctgaggcggcaatggagggcgctactctcgatcagaccaccagcgaagaggctccagggggaactgagctaattcagactcctctggcttcctccacggaccaccagaccccacctaccagtccagtgcaaggcacaaccccccaaataagtccatcaacgctaatcgggagcctgcggactctggaactcggaagcgagagccagggggcatcagagagtcaagcgcctggcgaggaaaatcttttaggggaggccgcaggcggtcaggatatggccgattccatgcttatgcaggggtccagaggcttaaccgaccaggcaatcttttatgcagtcacccccctgccgtggtgtcctcacctggtggctgtgtgcccaatccctgccgcaggactggacgtaacccagccatgcggagattgcggcacaattcaggaaaactgggtgtgtcttagctgttaccaagtctattgtggaaggtacatcaacggtcacatgttacaacaccacggcaattctggccatcctttggtgctgtcgtacatcgatctgtccgcttggtgctattattgccaagcatacgtccatcaccaggcgcttctggacgtgaagaatatagctcaccaaaataagtttggcgaagatatgccccaccctcactag

SEQ ID NO: 56816 - DNA, 312 bp, Artificial Sequence
  Description of Artificial Sequence: Synthetic coding sequence
atgagtggtcgtggtaagggcggaaaagggttgggaaaaggcggtgccaaacgacatcggaaagtgctcagagacaatattcaagggatcacaaagcccgctatacggaggctcgcacgcagaggcggagtgaagcgaattagcggcctgatatatgaagagacccgtggcgttctcaaagtcttcctagagaatgtaatcagagacgcagtgacctacactgagcatgcaaagaggaagaccgtaactgccatggatgtggtctatgccctaaagagacagggcaggactctttacggttttggcggatag

SEQ ID NO: 56817 - DNA, 312 bp, Artificial Sequence
  Description of Artificial Sequence: Synthetic coding sequence
atgtctggtcgaggaaagggcggtaaaggactggggaaagggggagccaaacgccacaggaaagtcctgcgggacaatatacagggaattacaaagccagcaatcaggcgcctggcgcgacgcggaggtgtaaaacggattagcggactgatctatgaagagacgaggggggtgctaaaggtattcttggaaaatgttattcgcgacgccgtaacctacaccgagcatgccaagcgaaagactgtcacggcaatggatgtagtgtatgcattgaagaggcagggtcggacactctatggattcggaggctag

SEQ ID NO: 56818 - DNA, 2145 bp, Artificial Sequence
  Description of Artificial Sequence: Synthetic coding sequence
atgcctgcagccgctggggacggacttctcggcgagcccgctgcaccagggggtgggggtggcgcagaggatgctgcgagacccgctgccgcatgtgaaggaagctttctgccggcttgggtgtctggagtccctcgggagagactgagggacttccagcatcacaagcgagtcggtaattacctgatcggcagtcgaaagctgggggaaggctcattcgctaaggtgagagagggactgcatgtgctaactggagagaaggtggcaatcaaggttattgacaaaaagagggcgaagaaagacacatatgtgaccaaaaacttgagacgggagggccagatacagcagatgatcagacacccaaatataactcagctcctggatattctcgagacagaaaactcatattacctcgtaatggaactttgtcctgggggaaatctgatgcataagatctatgaaaagaaaaggctggaagagtcggaagcacgcagatacatccggcaattgatatctgcggtcgaacacctgcaccgtgccggagtggtgcacagggatctgaaaatcgaaaacttactgctggacgaggacaataatattaagctgattgattttggcctgtctaactgcgctgggatcctggggtattctgatccgttctcaacacagtgcgggtcccctgcatacgcggctccggaactcctggctcgtaaaaagtatggcccaaagattgatgtatggagcattggggtcaatatgtatgccatgctgacagggacactgccttttaccgtagaaccattctctctgagggcgctgtaccagaaaatggtcgataaggaaatgaacccattacccacacagctctccaccggagccatttcatttctacgcagcctacttgagcccgaccctgttaagcgtccaaatatacagcaggccctcgcaaaccgatggttaaatgaaaattacactggcaaggtgccatgcaatgtcacctaccccaataggatctcccttgaggatttgtccccaagcgtggtgctgcacatgaccgagaaacttggatacaagaattcagatgtcattaacacagtgttatccaatagagcatgccacatcctggctatatactttctcctcaataagaaactggagaggtatctcagtggcaaatccgatatccaggattctctctgttataaaactagactttatcagatcgagaaataccgcgcaccaaaggagtcctacgaagcttccctcgacacttggacacgagacctggagttccatgcagtgcaggacaaaaagcccaaagaacaggaaaaacggggagattttctccaccggccattcagcaaaaaacttgataagaaccttcctagccacaagcaaccctctgggagcctgatgacgcagatccagaacacgaaggctcttctcaaggacagaaaagcctccaaatcatccttccccgacaaggactcattcgggtgtaggaatatcttcaggaagacgtcggattctaactgcgtcgcctcctcatccatggaatttattcctgtcccaccgcctaggaccccacgcatcgtcaagaagcccgaacctcatcaacctgggccaggatcaactggtatcccccacaaggaggatccgttgatgcttgatatggttcgtagctttgagtcggtcgatagggacgatcacgtcgaagttctctcacctagtcatcactacagaatactgaattcccccgtgtcattggctagacgcaacagctccgagagaacactgtcccctggactgccttccggatctatgtcgccactgcacacgcctctgcaccctaccctggtttctttcgcgcatgaagataaaaattcaccgcctaaagaggagggcttatgctgcccgcctcctgtccccagcaatgggcctatgcaaccactgggctctccaaattgcgtcaaaagccgcggacggttccccatgatgggtattgggcagatgctgagaaagagacaccagtccctgcagcccagtgcagatcgcccactcgaggcgagtctgcctccactgcagcccctcgccccagtgaatctcgctttcgatatggccgatggggtgaaaactcaatgttag

SEQ ID NO: 56819 - DNA, 762 bp, Artificial Sequence
  Description of Artificial Sequence: Synthetic coding sequence
atgggtttaagcccaggggctgagggagaatatgccctcagactgcccaggattccccctcccctgcccaaacctgcgtcacggaccgcctctactggaccaaaggatcagcctcctgcgcttcggagaagcgccgtgccccatagtggcctgaactcgatctcccccctcgaactcgaagaatcagtgggatttgcggcattagtacagttaccagcaaagcagcctccccctggcaccctcgaacagggaaggtcgatccagcagggagagaaggccgtagtgtcgctggaaaccacgcctagccagaaagctgactggtcatctattcctaaacctgagaacgagggtaaactaattaaacaagccgctgagggcaagcccaggccgcgtccaggggatctgatagaaattttccggataggttatgagcattgggccatctacgttgaagacgattgtgtagtgcacctggctccgccatctgaggagtttgaagtaggcagtatcacgtcaatattctccaacagagctgtagttaagtacagtaggctggaggacgtcctacatggctgctcctggaaggtcaacaacaagttggacggtacttatctgcccctcccggtcgataaaatcattcaaagaaccaagaagatggtcaataagattgtgcaatacagcttgatcgagggcaattgccgtgctcgacctgacgggcgttcagagggttgttggtcctcttatttctcttgttctggctag

SEQ ID NO: 56820 - DNA, 810 bp, Artificial Sequence
  Description of Artificial Sequence: Synthetic coding sequence
atggggctgtctcccggagccgaaggagaatatgcgctaagactccctcggattccacccccactgcccaaacctgccagcagaacagcctccacaggccctaaagatcagcctccagctttgagacgttcagcagtcccacacagtgaggagtcggtgggtttcgcggctctcgtgcagctgccggcaaaacagcctcctccaggcactctcgagcaaggtcggtcaattcaacaaggagaaaaggcggttgtttctctcgagaccaccccctcccagaaagccgactggtccagcatccctaagccagagaacgagggaaagctgatcaaacaagccgcagagggaaagcctagacccaggccaggcgatctcattgagattttcaggatagggtacgagcattgggccatttatgtggaagacgactgcgtggttcaccttgcgcctccctcagaggagtttgaggtgggatcgatcacgtccatcttttctaatcgggctgttgtgaaatatagccggctcgaggatgtgctgcacggttgctcctggaaggtcaacaataaattggacggtacctacctgcccttgcccgtggataaaatcatccagaggacaaaaaagatggttaacaaaattgtccagtatagcctcatcgaaggaaactgcgagcactttgtcaacgggctgcgttacggagttccccgttcacagcaggtcgaacacgcactcatggagggcgctaaggctgccggagcagttattagtgcagtcgtggactcaattaaacccaaacctatcaccgcctag

SEQ ID NO: 56821 - DNA, 840 bp, Artificial Sequence
  Description of Artificial Sequence: Synthetic coding sequence
atgggcctgagccccggtgcggagggcgaatatgcccttagactgcccagaatccccccaccactcccaaaaccagcaagcaggaccgcttctactggacccaaagaccagccaccagcccttaggagatctgccgtaccccacagcggacttaattccatcagcccccttgagctcgaagaatccgtgggttttgcagcattggtgcagcttccagcgaagcaaccccctcccggaacccttgagcaagggagaagtatccagcagggcgaaaaagcagttgtatcgctagagacaacaccttcccagaaagctgactggtcttcgattcctaaacccgaaaacgaaggcaaactgatcaagcaggcagctgaaggcaagccgagacccaggccgggtgatctgatcgagatcttcagaataggatatgagcattgggctatttacgtcgaagatgattgtgtagtgcacctcgccccaccaagtgaagaattcgaggtcggctccatcacgagcatcttctccaatcgagccgtggtaaaatacagtcgattggaggatgtgttgcacggttgttcttggaaggtaaataacaagctggacggcacctacctgcctttacccgtggacaaaataatacagcgcacaaagaaaatggtgaacaagatcgttcagtattccctgatcgagggaaattgcgaacatttcgttaacgggctgcgatatggtgtccccaggagtcagcaggtggagcatgccttaatggagggagccaaagctgcaggagctgtgatctccgcggtggttgacagcatcaaacccaaacctataaccgcatag

SEQ ID NO: 56822 - DNA, 2961 bp, Artificial Sequence
  Description of Artificial Sequence: Synthetic coding sequence
atggatcggatggccagttcaatgaagcaggtgcccaacccgctccccaaggtcctttcccggagaggggtcggcgcagggctcgaggccgcagagagggagagctttgaacggacacagaccgtctcaattaacaaggcaattaatacgcaagaggtggccgtgaaggaaaagcacgccagaacttgtattctgggaactcaccacgagaagggcgctcagactttctggtccgtggtgaatcggttacccctgtcctctaatgcagtgctgtgctggaagttttgtcatgtttttcataaattgttgagggacgggcatcctaatgtgctcaaggacagtctgcgttatcgaaacgagctgagcgatatgtcccgcatgtggggacatctgtctgagggatacggacagctgtgttcaatttatctgaagttgctgcgaacaaagatggagtaccacactaagaatcctaggtttccaggaaacctgcaaatgtctgacagacagctcgatgaggccggtgagtccgacgtgaacaacttttttcagctgactgttgagatgtttgactacttagagtgtgagctaaatctgtttcaaacggtttttaactccctggacatgagtcggtctgtgtccgtcactgcagcaggtcagtgtcggttagcgcctttgatacaagtcatcctcgactgtagtcacctatacgactacacagtcaaactgctttttaagttgcattcctgtctgccagctgacactctccagggtcacagggataggttcatggaacagttcactaaacttaaggatctattttaccgtagctccaacctgcagtatttcaagagactcattcagattccccagttgcccgagaacccccctaatttcctgcgcgcttctgcactttctgaacatatttctcctgtcgttgtgatcccggcagaagcttccagccccgactccgaaccagtgcttgaaaaagacgatctcatggacatggacgcgagtcaacaaaatctgtttgacaacaaatttgacgacatcttcgggtccagcttcagctctgacccatttaacttcaactcccaaaatggtgtcaacaaggacgagaaggatcatttgatagagaggctgtacagggagatatccggtctgaaggcgcagctcgagaacatgaagacggagtcccagcgagtcgtgctgcagttgaagggccatgtgagcgaattggaggccgatcttgctgagcagcagcacctcagacagcaggccgcagacgactgcgaattcctgcgggcagagttggatgagttacgcaggcagagggaagatactgagaaggctcagagaagcctgtccgagattgagaggaaagctcaggcaaatgagcaacgatactcaaagctgaaagagaaatactctgagctcgttcagaatcacgccgatctgcttaggaagaacgcagaggtaactaaacaggtctccatggctagacaagcgcaagtggacttggaaagggagaaaaaggagctggaggatagtctggagcgcattagcgatcaagggcagcggaaaacacaggaacagctagaggtgctggaatcactgaagcaagagctcgccacatcccagcgcgaacttcaggtcttgcaggggagccttgagaccagcgcacagtccgaggccaactgggccgcagaattcgccgagctagaaaaggagcgcgacagccttgtaagcggtgccgcacatcgagaagaggagctttcagcactgcggaaggagttgcaggatacacagctcaagctggcctctactgaagaatcaatgtgtcagttggctaaggaccagcgaaagatgctgctcgtaggctcccgaaaagccgcagagcaggttatccaggatgccttgaatcaacttgaggagcccccacttatatcctgtgccggaagcgccgaccatttgctatcgacggtcacttccatttcttcttgtatcgaacaattggagaagagttggtctcagtatctggcttgtccagaagacatttcagggcttttacattccattacattgttagcccacttgacctccgacgccatcgctcacggtgctacaacgtgcctacgagcaccacccgagcccgctgactccctgactgaggcttgtaaacagtacggcagagagaccttagcatacctagctagtctcgaagaggaaggttctctggaaaacgctgattccaccgccatgcgcaattgcctgagtaaaatcaaggccataggagaagagttactccctcgtggcctcgatattaagcaagaagagctaggtgacttggttgacaaggagatggctgctacgagcgctgccatagagaccgcaaccgccaggatcgaagggaccgcatcccctaaagaattctatgctaagaacagccgttggacagagggactcatttcagcctccaaggctgtgggctggggggctacagtaatggtagacgccgctgaccttgtggtccaaggacgaggcaagttcgaagagctgatggtgtgttctcatgagatcgcagcctccacagctcagctcgtggccgcatcaaaagtgaaggctgacaaggattcccctaacctagcgcaacttcaacaggcctcccgtggagtgaatcaggccacagcaggtgtggtggcaagcacgatctccggcaagagccagatagaagagacagataatatggatttttcgtccatgactctgacccagatcaagcgccaggagatggactctcaagttagggtgctcgagcttgaaaacgagctccagaaagagcgacaaaagttgggagagctgaggaagaagcactatgaactggctggagtagccgaaggatgggaagaaggcacagaagccagtccaccaacgcttcaagaagtagtcaccgagaaagagtag

SEQ ID NO: 56823 - DNA, 1308 bp, Artificial Sequence
  Description of Artificial Sequence: Synthetic coding sequence
atggccgctcacctcctgccgatttgcgcactgttccttaccttgctggatatggctcaaggctttcgtggcccactgcttcccaacaggccgttcacgacggtctggaatgctaatacccagtggtgtctcgagagacatggagttgacgtggacgtgtccgttttcgatgtcgtcgctaatcctgggcagacattccgtggacccgacatgacaattttctacagctctcagctgggcacatacccctattacacgcccactggcgagcctgtgttcggtgggttgccccagaacgcgtctctgattgcacacctcgcacgaaccttccaggacatcttagccgcaatcccggcaccggattttagcggcctggccgtgatcgactgggaagcctggcgaccgagatgggcgtttaactgggataccaaagacatctatcgtcagcgttcacgcgcactggtacaagcccaacaccccgactggcccgctccccaggtggaagccgtggcccaagaccagttccagggagccgctagagcctggatggctggaactctacagctagggagggctctgcgccctaggggcctctggggcttctatgggttccctgattgctataattatgatttcttgtcgccaaattacactgggcagtgcccaagcgggattagagcccagaacgaccagttgggatggctctgggggcaaagcagggctctttatccatctatctacatgcccgctgtgctggaaggcacaggtaagtcacagatgtatgtgcaacatagggtcgcagaagcttttagggtcgccgtggcagcgggtgacccgaacctacctgtcctcccttacgtccagattttttatgataccactaatcattttctccctttggacgaactggaacacagcttgggagagtccgcggctcagggggcagctggagttgtactgtgggtctcctgggagaatacacgaacaaaagaatcgtgccaggccattaaggagtatatggatacaacactgggcccttttattctcaacgttactagcggtgccctgctttgctcccaggctttatgctcaggccatggcagatgtgtgcgcagaacgtctcaccccaaagcacttttgttactgaatcctgcctcattctcaatacagctcacccccggtggaggtcccctgtccctgaggggtgcactctccctggaggaccaggctcaaatggctgtagaatttaagtgtagatgctatcccggttggcaggcaccctggtgtgagcgaaagtctatgtggtag

SEQ ID NO: 56824 - DNA, 1308 bp, Artificial Sequence
  Description of Artificial Sequence: Synthetic coding sequence
atggctgcccacctcctgcccatctgcgctctgttccttacattactcgacatggctcaaggctttcgtggacccctcctgccaaacaggcccttcactaccgtctggaacgcaaatacgcagtggtgcctggaacgacatggggtggacgtagatgtttcggtgtttgacgtggtggcaaaccccggacaaacattcaggggcccagatatgacaatcttctactcctcgcagctgggcacctacccatactacactccgacaggggagcccgtgtttggcggactgccccagaatgcttctcttatagcacacctcgccaggacttttcaggatatcttggccgctatccctgcccctgacttctcaggcctggccgtgattgattgggaggcttggcgtccacgatgggcattcaactgggataccaaggatatttatcggcagaggtcccgagcactggttcaggcgcaacaccccgactggccagcacctcaggtcgaagcggtcgcccaggaccaatttcagggcgcagcgagagcttggatggccggtactctgcagcttggtagagcgctccgacctcgtggtctctggggtttctacggcttcccagactgttataactacgatttcctgagtcccaactatacgggtcaatgcccttctgggataagggctcagaatgaccagttgggctggctctggggccagagccgggctctctatcccagcatttatatgccagccgtgcttgaaggtactggcaagagccagatgtatgtacagcatagagttgcggaagcattccgcgtggccgtcgccgctggtgaccccaatctgcctgtcctgccttatgtgcagattttctatgacaccactaatcattttttgcccctggacgagctcgaacactctttgggtgagagcgctgcccagggggctgccggtgtcgtactgtgggtgagttgggagaatacccggactaaggaaagctgccaggctattaaggagtacatggacacaactcttggtcctttcattctgaatgttacatccggtgccctactctgttcacaggccttatgctccgggcatgggagatgcgtgaggagaacatcccatcccaaggcactcctccttttaaatcccgctagcttttccatccagctgaccccgggtggagggcctctcagcctgcgcggagcactgagcttggaggatcaagcccaaatggcagtcgaatttaaatgcaggtgttaccccggatggcaagctccatggtgtgagagaaagtctatgtggtag

SEQ ID NO: 56825 - DNA, 1422 bp, Artificial Sequence
  Description of Artificial Sequence: Synthetic coding sequence
atgagagcgggtccagggccaaccgtcacgctcgctcttgttctggccgtgtcctgggccatggaattaaagcccacggcgcctcccatctttaccggtcggccttttgtagttgcatgggacgtgccaactcaggactgcggacccagactcaaagtgcctctggacctgaacgctttcgacgtgcaggcaagtccaaacgagggttttgtcaaccagaatattaccatattttaccgcgatcgccttggactctatcctcgcttcgacagtgccggaagaagcgtccatggcggagtgccacagaacgtgagcctgtgggcccaccgcaagatgctgcagaagagggtagaacactacattcgtacacaggagtccgccggtttggccgttatagattgggaggattggcgacctgtttgggtgcgaaattggcaggataaggacgtctatcgccgattaagccggcagctggtggccagcaggcaccctgactggcccccagacaggattgtcaagcaggcacaatatgagtttgaattcgcggcacagcaatttatgttagaaaccctacggtatgtcaaagccgtgcgcccaagacatttgtggggattttatctgtttccagattgctataaccatgattatgtgcagaactgggaatcttacaccgggagatgccctgacgtggaggtcgcccgaaatgaccagctcgcttggctttgggcggagtccaccgctttgttcccgtctgtgtacctcgatgagactttggccagttctcggcacggcagaaactttgtatcgtttcgggtgcaggaagctctacgggtcgcgagaacccaccacgctaaccatgccctgcccgtctatgtattcacgcgaccgacctattccagacgactgaccggactctctgagatggacttaatctccaccataggagaatctgccgctctaggagccgctggagtaattctgtggggagacgccggttacaccactagtacagaaacctgtcagtacctgaaggattatctgaccagactgctcgttccttacgtggtcaacgtgtcttgggccacacagtactgttctcgggctcaatgccatggacacggacgatgtgtacggagaaacccatccgctagcaccttcctgcatctgtccacgaacagtttcaggttggtgcccggtcatgcccctggagagccacagctgaggcccgttggcgagctttcgtgggccgatatcgaccaccttcagactcattttaggtgccagtgctatctcggctggtccggggagcagtgccagtgggaccacaggcaggcagccggtggagcctcagaggcatgggcgggtagtcatttaacttccctgctcgctcttgcagcacttgccttcacctggacactgtag

SEQ ID NO: 56826 - DNA, 1422 bp, Artificial Sequence
  Description of Artificial Sequence: Synthetic coding sequence
atgagagccggacccggtcccactgtgaccctagcgctggtcctggccgtatcttgggctatggagctgaaaccaactgctccaccgatttttacggggcgtccgtttgtcgtggcttgggatgttccaacacaggactgtggccctagactgaaggtgcccctcgatttaaatgcattcgatgttcaggcgtctccaaatgagggcttcgttaaccagaacatcacgatcttctatagggaccggctgggactgtatccacggttcgattctgcgggaagaagcgtgcacgggggagttccgcaaaacgtgagcttgtgggcccaccggaaaatgttgcagaagcgagtagaacattacatcaggacccaggagagtgccggactggctgtcattgattgggaagactggagaccggtgtgggttaggaactggcaagataaggatgtctatcgcaggttgtctcggcagctcgtggcatccaggcatccagattggcctccagataggatcgttaagcaagctcagtacgagtttgagtttgccgcacagcagttcatgctggagactctgagatatgtgaaggccgtgcggcctaggcatctttgggggttttacctgtttcccgattgttataatcacgactacgtgcagaattgggaatcttatacagggaggtgtccagatgtcgaagtagcacgcaacgaccagttggcatggctgtgggccgagtcaacagccctgtttcccagtgtctaccttgatgagaccctggccagttcacggcatggcaggaacttcgtcagttttagagttcaggaggccctgcgggtggcaaggactcatcacgctaaccacgctcttccggtgtatgtgttcacacgcccaacttattctcgtcgcttgaccgggctcagtgagatggatcttatctcgaccataggggagagcgccgctttgggtgcagccggagttattttatggggggatgctgggtataccacgtctactgaaacctgccagtacctgaaggactatctgacacgactgcttgtaccatacgttgtcaatgtctcctgggctacgcagtactgctcacgtgcgcagtgccacggacatggcaggtgtgtgcggaggaacccctcggccagtacctttctccatctctccacaaattccttccgacttgtacccggacatgccccaggtgagccacagttacgccctgtgggcgagctgtcctgggccgacatcgaccaccttcagactcatttccgctgtcagtgttacctcggctggagcggcgaacagtgtcaatgggaccaccgccaggctgcagggggagcatctgaagcctgggcgggaagccacctgacatccctgttggcacttgccgcactagcttttacatggaccctgtag

SEQ ID NO: 56827 - DNA, 1164 bp, Artificial Sequence
  Description of Artificial Sequence: Synthetic coding sequence
atgactacgcagttgggaccagcacttgtcctgggcgtggcgctctgtctggggtgcggacagccattgccacaagtgcctgaacggcctttctccgtgctgtggaacgttcctagcgcccactgcgaggctcggtttggggtgcacctgccactaaacgcattagggattattgccaataggggccagcactttcacggtcagaacatgaccattttttataagaatcagttgggactctacccctattttggccctcggggaacagcgcataatggcggaatcccccaggcgctgccactggatcgtcatctggccctggctgcctaccagatccaccactcgctgcgtccaggttttgcaggcccagcagtgttggactgggaagagtggtgccccctttgggcagggaactggggacggcgtagagcatatcaagccgcatcctgggcctgggcccaacaggtgttcccagacctggatcctcaggagcagctgtataaggcctatactggcttcgagcaggcagccagggccctcatggaggataccctgagagtggcgcaggccctgagaccacatggactctgggggttctatcactatcccgcatgtggcaatgggtggcactcaatggcttcaaattacacaggcaggtgtcacgccgcaactctggctcgcaatactcaactgcactggctgtgggctgcatcttctgctctgttcccatcaatctaccttcctcctagactgccgcctgcacaccaccaagccttcgttagacatcgtctcgaagaggcctttcgtgtggccctggtggggcatcggcacccactgcccgtgctcgcttatgtccgcctgacgcaccgccgtagcggacggttcctgagccaagaggagtgctggcacctccatgactatctggtggacactttagggccatacgtgatcaacgtcacgagggctgccatggcctgttctcaccaacgctgtcatgggcatggaaggtgtgcgagacgcgaccctggacaaatggaagccttcctgcatctctggcccgacggcagcctcggggactggaaatccttctcatgtcactgttactggggatgggccggacctacttgccaggaaccccgtccaggtcccaaagaggccgtctag

SEQ ID NO: 56828 - DNA, 612 bp, Artificial Sequence
  Description of Artificial Sequence: Synthetic coding sequence
atgaaggtcaaggttattcctgtactggaggacaattatatgtatctggtgatcgaggaattgacacgtgaagccgtggccgtcgacgttgcagtgccaaagaggttgctggagatcgttggcagagagggcgtatctctgacagcggttctgacaactcatcatcattgggatcatgccaggggcaatcccgagcttgcccgtcttcgccctggcctggccgttctaggagccgacgaacgaatattttcactcacccggagattggcccatggggaggagctgagagtcagcgccagatctcgagaagggagaggcggacgtccaggcagcacacgtcctcaccgcagcgcctgtagctccgccgctgtacgcggtcacccccgagctcttccaccagatgccaggccacacagacgaccgcacgaactcctccctgtgggcggaagattaccaggccctactcggcctgtcttgggccgacgggcagtggggggacggttacgtctggttcccggtggacagcggccagctgatgtccccgaaccgggacgggctggttacccagctcccagagatgaaggggtcctgagacctcgtgcccatgcatag

SEQ ID NO: 56829 - DNA, 849 bp, Artificial Sequence
  Description of Artificial Sequence: Synthetic coding sequence
atgaaagtgaaggtgattcccgtgctcgaggataactacatgtacctcgtgatagaggaactaacaagggaggcggtggctgttgacgtggcggttcccaagcggctgctggaaattgttggacgggaaggggtgtccttgactgcggtcctgactactcatcaccactgggaccatgctaggggaaaccccgaactggcgcgacttaggccaggactggctgtgctgggggcagatgagagaatcttctcactgacccgtaggctcgcccacggagaagaactcaggttcggcgcaatccacgtgagatgtctgctaaccccgggtcataccgcagggcacatgtcctacttcctgtgggaagacgactgcccagaccctcccgctctgtttagcggagatgctctgagcgtggccggttgcggtagctgtctggaggggagcgctcaacaaatgtaccaaagtttggcagagttgggcaccctgccccctgaaactaaagtattttgtgggcacgagcatactctctctaatctggaatttgcccagaaggtcgaaccatgcaacgaccatgtacgagcgaaactgagctgggctaagaaacgggacgaggatgatgtgccaaccgtgccatctacccttggggaagagagattgtacaatcccttcctccgggtggccgaagaaccggtccggaagtttactggaaaggctgtgccagccgatgttttggaggccttatgcaaagagcgcgcacgctttgagcaggctggggaacctaggcagcctcaagccagagctctcttggcactgcagtgggggctgttgagtgcagcaccccacgactag

SEQ ID NO: 56830 - DNA, 609 bp, Artificial Sequence
  Description of Artificial Sequence: Synthetic coding sequence
atgaaggtgaaggtgatacccgttctagaggataattacatgtatctggtgatcgaagagctgacacgggaggccgtggctgtggacgtcgctgtgcccaagagattgctggagattgtggggagggagggggtttcactgacagccgttcttactactcatcaccattgggaccacgcccgaggcaaccccgaactggccagattgagacctgggctggccgtgctcggtgccgatgaacgtatattcagtttgacacggaggctggcccatggggaagagctcagatttggtgccatacacgtcagatgtctgctgactcccggtcatacagctggacatatgtcttattttctctgggaggacgactgccctgaccctcctgccctgtttagtgggacccgctccgcagagcgagcccatcccgcaagccgcaggcctagaccaatctgctccgatccaccaagccccgcacgaagaagggcggtgggaggaaggttaagacttgtgcccggtgggcagagaccagccgacgttcccgagcctgggcgtgcgggatatccagccccaagggatgagggcgtgctgaggcctagagctcacgcatag

SEQ ID NO: 56831 - DNA, 507 bp, Artificial Sequence
  Description of Artificial Sequence: Synthetic coding sequence
atgttcccactgataagcagccatcacttatggtggggaggcctccgcagaactgtctgcctgaacctgccggtgctgacactgcagcattttcaacatatgcatatcaaggtcggcgacagagcggagctgcgccgagcattcactcagaccgacgtagccacattctcggagctcactggggatgtcaaccctctgcatttgaatgaagacttcgctaagcatacaaagttcgggaacaccattgttcatggagtgctgatcaacggattaatcagtgcactgcttggtacaaaaatgcctggacctggttgcgtgtttctttctcaggagattagttttcccgctccactctatatcggagaggtggttcttgctagcgcagaggtgaaaaaacttaagcgtttcatcgcaataattgccgtgagttgcagtgttatcgagagcaaaaagaccgttatggaaggctgggtgaaggtgatggtcccagaagcttcaaagtcatag

SEQ ID NO: 56832 - DNA, 1164 bp, Artificial Sequence
  Description of Artificial Sequence: Synthetic coding sequence
atgaacaggcatcacctgcaggaccattttctcgaaatcgacaagaagaactgttgtgtgtttcgggatgattttatagcaaaggtccttccgcctgtactgggactcgagtttatctttggcctcctggggaatgggcttgcactgtggattttctgttttcacctgaagtcttggaagagcagcaggatctttttatttaatctagcagtggccgattttctcttaattatctgcctacccttcgttatggactattatgtgaggcgctccgattggaaattcggtgatatcccatgcagacttgtcctgttcatgtttgccatgaatcgccaggggtccattatatttcttactgtggtagcagtcgacagatattttagggtggttcatccacaccacgcactgaataaaatctctaactggaccgccgcaattatcagctgtctcctatggggcatcactgtcgggctcaccgtccacctcctgaagaagaaactgttgattcagaacggtactgccaacgtatgtattagcttcagcatctgtcacacatttagatggcacgaggccatgttcctcctggagttctttttgccactcggtatcattctgttctgtagtgctcgtataatttggagtctccgtcagcggcagatggatcgacacgccaagatcaagcgcgctataacttttatcatggttgtagctatcgtttttgtcatttgtttcctgccatcagttgtcgtgcggatccacatcttttggctgctgcacacctctggcacacagaactgtgaggtttacagatctgtggaccttgccttctttatcaccctgtcttttacgtatatgaattctatgctggacccagtagtctactactttagctcaccatctttccctaatttcttctccactttgatcaacaggtgcctccagagaaaaataactggggaacctgacaataatcggtctacaagcgttgaattaaccggcgacccaaataagactcgcggtgcaccagaagcattaatcgccaactctggcgagccatggtctcccagctatctgggacccacatctaataaccacagcaagaaggggcactgccaccaagaacccgctagccttgaaaaacagctcggctgctgtattgaatag

SEQ ID NO: 56833 - DNA, 966 bp, Artificial Sequence
  Description of Artificial Sequence: Synthetic coding sequence
atgtccgggaatgggaatgcggctgccaccgccgaggaaaactcgccgaaaatgcgcgtcattcgagtggggacgcggaaatcccagctggcaagaatccaaacggattcagtggtcgccaccctgaaagcatcatatcctggacttcaatttgaaatcattgccatgagtactactggggacaaaattctcgataccgctctatccaaaattggtgagaagtcgttgtttaccaaagaattagaacacgcactagagaaaaatgaggtggaccttgtcgtccacagcctgaaagacctgccaacagtgttaccacccggattcacaattggggctatttgcaagagggagaacccacacgatgccgtggtgtttcaccccaaatttgtgggcaaaacactggagacactgccagaaaagagcgtcgttggaaccagcagcctccgcagggcagcccagctgcaaagaaagtttccccatctagaatttcgttcaattcgcggaaaccttaacactcgattgagaaaattagacgagcagcaagaatttagtgctatcatacttgccactgctggtctgcagcggatgggatggcacaatagggtcggtcagatcctgcatcccgaagagtgcatgtatgcggtaggacaagaaggagggtgcagtgtgccagtcgccgtgcatacagccatgaaagacggacagctgtacctcaccggcggtgtttggtccctcgacgggagtgattccatccaagaaactatgcaggcaaccatccacgtccccgcacagcacgaggacgggcctgaagatgatccccagctggtggggattacagcccgaaatatacccagagggccacagctggccgcacaaaacctcggcatctccctagccaacctattgttatccaagggagcgaagaatattttggacgtggcacgacagttgaatgatgcgcactag

SEQ ID NO: 56834 - DNA, 1035 bp, Artificial Sequence
  Description of Artificial Sequence: Synthetic coding sequence
atgagggtcataagggttggcaccagaaagtcccagctggccagaatccagaccgactccgttgtcgctactttgaaagcgtcatatccgggtctccagtttgagatcatagctatgtccaccaccggagataagatactggacaccgctctgagcaagattggagagaagagcttgttcaccaaagagctcgaacatgctcttgaaaagaacgaggttgatctcgttgtgcactcattaaaagacctgccgacagttctaccgcctggctttaccattggggctatttgcaagcgcgagaatccacacgacgctgtcgttttccacccgaagttcgtcggcaaaaccctggaaacactgccagagaaatctgtggtgggcacctctagcctccggagagcggctcaactgcagcgtaagttccctcacctggagttccggagtatccgaggcaatctgaacacgagactgcgtaaactggacgagcagcaagagttcagtgccatcattttagcaacagcaggactgcagcgtatgggatggcacaaccgggtggggcagatactgcaccccgaggaatgcatgtacgcggtaggccagggagctctgggtgtggaggtgagggctaaagaccaggacattctggaccttgtcggtgtgctgcatgatcccgaaacactgctgagatgtatcgctgaacgggcttttctcagacatcttgaggggggttgtagcgtgccagtcgctgtgcacactgcgatgaaagacggccagttatacctgactgggggagtttggtccttagatggcagcgactccatccaggaaacgatgcaggccacaattcacgtgcctgcacagcatgaggacggacccgaagacgaccctcaactcgtagggatcaccgccaggaatatacccaggggcccacagctcgctgcccagaatctagggatcagcctagccaacctcttattgagtaaaggggcaaagaatatcctcgacgttgcccgtcagttgaacgacgcacactag

SEQ ID NO: 56835 - DNA, 915 bp, Artificial Sequence
  Description of Artificial Sequence: Synthetic coding sequence
atgagggtaatccgcgtcggcacgcgaaagtcccagctggctcgcattcaaacggactctgtggtggctactctgaaagcctcctatcccggacttcagttcgagatcatcgcgatgagtacaaccggcgacaaaatcctggacactgccctgtccaaaattggcgaaaaaagcctgttcactaaagagttggagcacgcactggaaaagaatgaagtcgacctggttgtccattcattaaaggacctccccacggtgctgccgcctggatttaccattggcgcaatttgcaaaagagagaacccgcatgatgcagtggtgttccaccctaagtttgtgggtaaaaccctcgaaaccctaccagagaaatccgtggtaggaacctcatcacttaggagggccgcacaacttcagagaaaatttccacatctcgagtttcggagcattagggggaatctcaatactcggcttcggaaactggatgagcagcaggagttcagcgccatcattttggccacggcaggcctgcagagaatggggtggcacaaccgggtggggcagattctgcatccagaagagtgcatgtacgcagtgggccaggaaggtggatgcagcgtgcccgttgccgtgcacactgccatgaaggacgggcaattatatctgacaggcggagtgtggagcttagatggcagcgattccattcaggagacaatgcaggccaccatccatgtcccggctcagcacgaggacgggcctgaggatgatccccagctcgtggggatcaccgcaagaaacatcccgagaggcccacagctggctgcccagaacttggggatatcattagcaaacctcttgctgtccaaaggggctaagaacatcctggacgtggccagacagctcaatgatgcacattag

SEQ ID NO: 56836 - DNA, 834 bp, Artificial Sequence
  Description of Artificial Sequence: Synthetic coding sequence
atggccccactgaggttctctgccaacctttcatggctgttcccagagctgtctgggctccccgctcgggtgcgcgcagccggatctagtggctttgaagcggtggaggtggcttggccttatgctgaaacgcctgaggcactcgcgagagcagcacgggaagctggtctgcgactggtgttgatcaacacgccaccgggagaccaggagaagggggagatgggcctgggggctgtcccaggcaggcaagcagctttccgagagggcttggagcaagcggtccgctacgcgaaagcactgggatgccccagaattcatctgatggccggaagagtcccacagggcgctgatcggattgctgttaaagcagaaatggaagcggtgtttctggaaaacctaagacacgccgcaggggtgctcgcccaagaagacctggtgggactcctggaacccattaatactcgtatcacagatccccagtactttttagatacacctcagcaagcagcagccatactccagaaggtggggaggcctaatctgcaattgcagatggatatcttccattggcagatcatggatggcaatctgaccggaaatattcgcgaattcctaccgatcgtgggacacgtccaagttgcacaggtgcccggtcgtggcgagccatcaagcccaggcgaactgaacttcccttatctgtttcaactactcgaggacgaaggctacaaaggatttgtagggtgcgagtaccagcctcgcggagataccgtggaaggcctttcgtggctgagaagctactgggatagaagggggcatcctgaggccggacagtag

SEQ ID NO: 56837 - DNA, 690 bp, Artificial Sequence
  Description of Artificial Sequence: Synthetic coding sequence
atgggcctcggcgcagtgcctgggaggcaggcggctttcagggaaggtttagaacaggctgtgcggtcgggccattgtctcatgggacggaaattgagcgtaccgtgtaaaggagccgtcgcaaggggaggtctggtctacctggcagcttttttgcggctcgatatgattcacctcatggctggaagggtcccccagggtgcagacagaatcgctgtgaaagctgagatggaggcagtttttctggaaaacctgaggcatgctgccggagtactagcccaggaggacctggtgggactgctggaaccaatcaatacgaggattaccgaccctcagtacttcttagacacccctcagcaagctgccgcaatactccaaaaggtgggcagacccaacttgcagcttcaaatggacatctttcactggcaaatcatggacggtaacctgacagggaatatccgggagttcttgcccatcgtgggccacgtccaggttgcccaggtaccgggtcggggagagccctctagccctggtgagcttaacttcccctatctatttcagctgctggaagatgaggggtacaagggtttcgtgggttgcgagtaccaaccacggggtgacaccgtggagggtctgtcctggttgagatcatattgggacagacgcggtcatccggaagcaggccaatag

SEQ ID NO: 56838 - DNA, 615 bp, Artificial Sequence
  Description of Artificial Sequence: Synthetic coding sequence
atgggactcggcgcagtccctgggaggcaagccgctttccgcgaggggttggagcaggccgtacgatacgctaaggcattaggctgtccaagaatccacctgatggcgggtcgcgtaccccagggtgctgataggatcgcagtaaaagctgagatggaagcagtgtttcttgagaatcttaggcacgccgctggagtactcgctcaggaggacctagtcggcctgctggaacctataaacacaaggatcaccgatccccaatacttcctagataccccccaacaggctgcggctattctgcaaaaagttggacgaccaaacttgcagctgcagatggacatattccattggcagatcatggacggaaacctcacgggtaatatcagggagtttctccccatagtgggtcacgtccaggtggctcaggtgcctggaaggggtgagccttccagcccgggagaactcaacttcccttacttattccagctgctggaagacgaaggctataaagggttcgtaggctgcgagtatcagcctcgaggtgacaccgtggaggggcttagttggctgcgctcttattgggataggagaggacatcctgaggccggacaatag

SEQ ID NO: 56839 - DNA, 744 bp, Artificial Sequence
  Description of Artificial Sequence: Synthetic coding sequence
atggccccactgcgtttctctgctaacctgtcttggctgttccccgaactgtccggtctgccagccagggtgcgggctgctggttcctccggcttcgaagccgtggaggtcgcctggccatacgccgagacacccgaagccctggctcgagccgcaagggaggctggactcaggcttgtgctcataaatactccacccggtgaccaagaaaaaggcgagatgggactcggcgcagtccccggtcgccaggccgcatttcgtgaaggtctcgagcaagctgtgcgttatgctaaagcgttgggctgtccaagaattcacttgatggcaggaagggtgcctcagggggcagatagaatcgccgttaaggctgagatggaagccgtctttctggagaatctgcgccacgcggcaggcgtgcttgctcaagaagacctggtcggattgctcgagcccatcaatactcgaataaccgacccacagtattttctcgacacaccgcagcaggccgcagcaattctgcaaaaggttggcagaccaaatttacaactgcagatggatatctttcattggcagatcatggatggcaatttaacggggaatatacgggaattcttaccaatcgtaggccacgttcaggttgcccaggtgccgggtcgcggagaacccagctcacccggagaactgaatttcccctacttgttccagctgcttgaggacgagggctacaagggctttgtgggttag

SEQ ID NO: 56840 - DNA, 909 bp, Artificial Sequence
  Description of Artificial Sequence: Synthetic coding sequence
atggctccactgcggttctctgccaatctgtcctggctattccccgaactctctggattacccgctcgtgtccgtgctgctggtagctcaggattcgaggccgtagaagtggcatggccttacgcagagacacctgaggcacttgccagagcagctagagaggctgggcttagactggtcctgataaataccccaccgggtgatcaggaaaaaggcgagatgggactgggtgcggttcctggacgtcaggccgcttttagagagggcctcgaacaggccgtaaggagcggacactgcttaatgggaagaaagctatctgtgccctgcaaaggagccgtggctcgcggaggcttggtttacttagcggcttttctgcggctcgacatgatccatctgatggctggcagggtgccacaaggagctgatcggattgccgttaaggcagagatggaggctgtattcttggagaacctgaggcatgccgcaggtgtcctggctcaggaggacctagttgggttactggagccaatcaacacccgcattaccgatccacagtactttttggacacaccccaacaagccgcagcaatactgcaaaaagtgggcaggccgaacctccagctccagatggacatcttccactggcaaatcatggatggaaacctgacaggcaacatcagagaatttttgccaattgtgggacatgtccaggtggcccaggtaccagggagaggggagccatcctcccccggtgaactcaacttcccatatttatttcagttgctggaggatgaagggtacaaaggctttgttgggtgtgagtatcagcccaggggagataccgttgaaggtcttagttggttgcgctcctattgggaccgcaggggccatcctgaggccggtcagtag

SEQ ID NO: 56841 - DNA, 162 bp, Artificial Sequence
  Description of Artificial Sequence: Synthetic coding sequence
atgtgctcctactaccacatgaagaaacgaagtgtcagtgggtgcaatattacgatcttcgccgtgatgttttcccatttgagcgccggtaaatcaccgtgcggcaaccaggctaatgtcctgtgtatttcccgccttgagtttgtgcaataccaatcctag

SEQ ID NO: 56842 - DNA, 1011 bp, Artificial Sequence
  Description of Artificial Sequence: Synthetic coding sequence
atgccaccaccagctcccggagccagactgcgcttactggctgccgcagcactggctgggctagcagtgatcagcaggggactgctgagccagtcgctggaattcaactctccagccgacaattataccgtgtgcgaaggggacaacgctaccttgagttgtttcattgatgagcatgtgactagagtcgcctggctgaatcgcagcaatatcctttatgcaggaaacgatcggtggactagcgaccctagagtgcgtctgcttattaacactcctgaggaattttcgatcctaatcaccgaggtgggcctgggcgacgagggcctgtacacatgctcattccagactcggcaccagccatacacgacccaggtctatctgatcgtgcacgtcccagctaggatcgtgaacataagcagccccgtcaccgtgaacgaaggcggaaacgttaacttgctgtgtctggccgtggggagacctgagcctactgtgacctggcggcagttgcgggatggtttcactagcgaaggcgagatcctggaaatcagcgatatccagcgaggtcaagccggagaatacgaatgtgtgactcataacggcgtgaactctgcgcctgattccaggcgcgtgctggttacagtaaattatccaccaactatcactgacgtcacttcggccagaaccgcattgggtagagcagcacttctccggtgcgaggcaatggctgtccccccagcagatttccaatggtataaggatgaccgattgctcagctctggaacagccgaaggtctgaaggtgcagacggaaaggacccggtcgatgcttcttttcgctaatgtgtctgctcgacattacggaaattacacctgccgagccgcaaacagactgggggcaagctccgcttctatgcgtttgctccgtcccggatctctcgaaaacagcgccccaaggccacccggtctattggccctcctgtccgccctcggctggttatggtggcgaatgtag

SEQ ID NO: 56843 - DNA, 1215 bp, Artificial Sequence
  Description of Artificial Sequence: Synthetic coding sequence
atggagtgcgcactcgacgcacagtccctaatttcaataagtctcagaaagattcatagctcccgtactcaaaggggcggtatcaagctgcataaaaatctattggtttcatacgttctgaggaatgcaaggcagctctatctgagcgagcgttatgcagaactatataggagacaacagcagcagcagcagcagcaaccgcctcatcatcagcatcagcatctggcttatgccgctcctggcatgccagctagcgccgcagactttggaccgcttcagctgggaggtggcggtgacgcagaagccagggaaccagccgctcggcatcagctgcatcagttgcaccagctgcaccaactccacctgcaacaacaattacatcaacatcagcatcccgcacctcggggttgcgctgcagctgcagctgccggtgctcctgccggtggcgctggagccctatccgagcttcccggttgcgcagccctgcaacctccacacggagctcctcatagaggccagcctcttgagccacttcagcctggcccagcccctttgcccctccctctcccaccccctgcaccagctgccctgtgtccacgtgacccacgcgctccagccgcatgctccgccccacctggtgccgctccacctgctgccgcagctagtccccctgcctcccctgctcctgcgagctccccagggttttatagaggcgcttatcctactccttctgattttggcctccattgtagctcccagaccaccgtgctggacttggatactcatgttgtgactaccgtggagaacggctaccttcaccaagattgttgcgccagcgcacattgtccatgttgtgggcagggcgctcccggtcctggcttagcatcagccgcaggctgcaagcgaaagtactatcccggtcaggaagaagaagaggacgatgaggaagatgccggaggccttggcgctgaaccaccaggcggagcgccattcgcgccttgtaaacgtgcccgtttcgaggacttctgccctgattcatcaccggacgcgtccaacatttccaatctcatatccatttttggcagcgggttctccggcttggtgagtcggcagcctgattcttccgagcagcccccacctcttaatggccagctttgcgccaaacaagctctcgcgtcattaggcgcatggacccgcgcaatagtcgctttctag

SEQ ID NO: 56844 - DNA, 1392 bp, Artificial Sequence
  Description of Artificial Sequence: Synthetic coding sequence
atggcaacctccaagctccccgtcgttcccggtgaagaggaaaatactattttaatggccaaggaacgactggaggccttgagaaccgcctttgagtcaggagacctgcctcaggcagcctctcatctgcaggagttattggcctcgaccgagagcatccgtctcgaagtcggagttaccggggaatcgggcgctggcaaatccagtttgatcaacgctctgaggggcttggaggccgaagatcctggggcagccctgaccggcgtgatggagaccacaatgcaaccttcaccctatccgcacccacagtttccagatgtaacattgtgggacctgcctggggcaggaagtcccggatgtccagcagacaagtatcttaagcaggtggatttcagccggtacgattttttcctgctggtctcacctagaagatgtggcgcagtggaaacccggctggcagctgagatcctgtgtcaggggaagaagttctattttgtgaggaccaaagtggatgaggacctggcagctacacggacccagcgaccctccggattccgagaagctgcagtcctgcaggaaatacgcgaccactgtgctgaacggctgcgcgaggccggagttgccgacccccgaatctttctggtcagcaatttgtctccagccaggtatgattttccgacgctggtttccacctgggaacatgatctccctagtcatagaaggcatgcaggcctcttgagcttacccgatatatccctggaggcgctacagaagaaaaaggccatgctgcaggagcaagtacttaaaaccgctttagtattgggggtgattcaggctctgccagtgcctggcctagcagcagcctacgatgacgccttactcatacattccctacgcggataccaccgcagttttggactggacgacgactcactggccaagctcgcagaacaggtgggcaagcaggccggtgacctgcgttccgtgataagaagcccgctggcgaacgaagtgagcccagagaccgtcctgcgcctttactcccagtcttccgatggtgccatgcgtgtagcgagagctttcgagagaggcatacctgtgttcggtactctcgtcgccggtgggattagcttcggggcagtgtacacaatgcttcagggatgcttgaatgagatggctgaggatgctcagagagtcaggatcaaagctctggaagacgatgaaccacaacccgaggtctcgctggaagttgcttctgacaacggggtggaaaagggtggctcaggagagggtggcggagaggaagcccctttgtctacatgtcggaaattgggccttttactgaagtatattttagacagttggaagaaacacgactctgaagaaaagtag

SEQ ID NO: 56845 - DNA, 1872 bp, Artificial Sequence
  Description of Artificial Sequence: Synthetic coding sequence
atgcccccacctcagggtgatgttaccgcgctcttcctgggaccgccaggcttaggaaagagcgcgctgatcgctgctctgtgcgataaggacgtagagaccctcgaggcgcctgaagggagaccagacagcggcgtcccctctcttcgggcagcaggtccaggcctgtttctcggggagttgagctgtcctcctgccgcacctggcccatgggccgctgaggccaatgtgctggtcttagtgcttccaggtcctgaagggaatggcgaacctctcgcccctgctctgggagaggccgctcttgctgccctggccagggggaccccccttctggctgttagaaacctgagacccggtgatagccagaccgcggcacaggcgcgagaccagaccgcagcacttctgaactccgctggactcggagctgccgatctctttgtgctgcctgccaattgtggatcatctgatggatgcgaggagctggagaggttgcgggctgccctgcagagccaggccgaggccctgagacggttactcccacccgcacaggacggctttgaggtgctcggtgccgctgagttagaggctgtgcgtgaagccttcgaaaccggcggtctggaggcagcattatcttgggttcggagcggactggaaaggcttggatctgccaggttggacttagctgtggctggcaaagctgacgtgggcctggtcgttgacatgcttctgggactggatcctggggaccccggagccgcaccggcatccgtcccaacagccccaactccatttccagccccagaaagaccaaacgttgtactgtggactgtcccactcggccacactggcactgcaaccaccgctgccgctgccagccaccccacccattacgacgccctaatcctggtgacgcccggagcaccaacggaaaaggattgggctcaggtgcaggccctgcttttgcctgacgcacccctcgtctgtgttcggaccgatggggagggcgaggaccctgagtgcctcggggagggcaaaatggagaacccgaagggtgaatcactgaagaatgccggtggcggagggctcgagaacgcactgtctaagggcagggaaaagtgcagcgctggtagtcaaaaagcgggaagtggcgaggggccaggaaaagccggatccgagggactgcagcaggtcgtcggcatgaaaaagtccgggggtggcgactccgagcgagccgcagccctctccccagaagacgaaacttgggaagttctcgaagaggctcccccacccgtgtttcccttaaggcccggagggctaccaggcttatgcgaatggctgcggcgagctctcccgccagctcaggccggtgcccttctgctcgcacttcctccggctagtccaagtgcagctcgcaccaaggccgctgctctacgggctggtgcctggcgaccggcacttctcgcctccttggctgccgctgcagccccactgccaggacttggttgggcctgcgatgtggcgctgctcagggggcagctggctgagtggcggagaggtctggggctagagcccaccgccctggctagaagggaaagggccctcggattagctagtggagaactggccgcaagagcccactttccaggtcctgtcacccgtgctgaggtcgaagctcgcctgggagcctgggccggagaagggactgcaggcggagccgcattgggggctctgtccttcctctggcccgctggaggcgcagccgctactggcggtctgggatacagagctgcgcacggagtactgttgcaggcgctggatgagatgagagctgacgccgaagccgttttagccccacctgagccagctcagtag

SEQ ID NO: 56846 - DNA, 3981 bp, Artificial Sequence
  Description of Artificial Sequence: Synthetic coding sequence
atgacgacgatccactcaaggcagatgctccaggagcacgtgtctatggagtttagcagcagcaccacccacgtccagactttctcccagactaccaagatcgtaggagaggaagtagtccggaggaagagctctagtattgtcgagttctttagcctagtgactcggtctagcaacatccctgccggagatagcgtgccagaattcgtggaaaagccccaaccagtgacggccccagaaggagacaaagctgtttttcgtgctcgagttcagggaaatgctaaaccccacatctcatggaaacgagaatccggcatacccattaaggagtctgctaagatattttacgattcaattaacaaggagcatgtgctcaagctggagccccttacttcggacgattctgataactataagtgcattgcctcaaacgaccacgcggatgctatctataccgtttccctgctagtaacggaggggcaggagaagatggattttaaaaagatgctcaagaaacgcgcacctccagctcctaaaaagaaacagaaaaaagtggccaacgagaaggaaatgcttgagattctgtctaaggttcccaaaaaggacttcgaaaaagtttgcatggagtacggattcactgattttaggggtctgctgcgcaaactgaaggagatgaaaaaaaaagtcgaggttgaagctattaggatcctgaagcccttggaagacaaggagacgaaagtcgacaccactgtcgtcttcgactgcatcatggagttgaaggatccaaatgtaaagatgatttggatcaaaggaaccgaacccctgaggatccagtactcactggggaaatatgacgttaaacagatgggcaccaaatatatgctggtgatatccaacgtcaatatgaatgacgctggaatctattctctgtctgtcggcgacaagcgtatgtcagcagagctgaccgtgttggatgaacctcttaaatttctgggcgagatgaagcctgtcaaagttaccgaacgccaaacagcagtgttcgagattcgactgtcgaaaaaggagcctaattttgtatggaagtttaatggcaaagagcttaagcgagacgataagtacgagataacggtatctgaagatggtcttactcacactctaaaaatcaaagacgcacgactttctgatagcggagagttctctgcagaagctggtaacctggtgcagaaagcacagctgacagtggacagaattccaatcaagtttgtctcaaacctcaagaacgtgagggtaaaggaacgcagcagggcatgtctggaatgcgaactgaccagcaaggacgtgaccctgcggtggaagaaggatggccagcttttgatgcatggtacaaagtattccatgaaccacgaggggaaaagggcggaactcattatagaagacgcccagctctcggatgggggtgagtacacggtcgttgccatgcaggatggagaccctaccgagtattactcaaccgcgatagtcaccgtcgaggaaaggctcgccacagtgaaaagtggcatgtctgacgtacacgccgctactggctcccccgctgaactgtgcgtcgtactcaatgacgagaaggtcgaaggcgtgtggctgaaagacggcaaggagattacagatttacccggtatgcagattgtgaagcaaggcgcagtgcacaagctgatctttccctctatggggccagagcacgaaggtaagtacacctttcgggcaaaaggcaccgagagtgaggctagcgttttcatcgccgacccaccgactatcgatccatcagtgctagaagcactcgcagcccacgcaattacggtgaaggtaggacacacagctcatattaaggtgccattccggggtaaacccctgccaaaggtcacctggtacaaagacggcatggaagtaaccgaagaggaaagagtgtcaatggagcgcggtgaggatcaggccctcctgactatatccaactgcgtgcgggaagacagtggtttgatcctgctcaagctcaagaatgatcatgggtctgcaactgcaacgttgcacctgagtgttctcgatcggcctaagccccctcaggggagggtggagtttctggaactgtctggcagctgcgtccatatgaagtggaaggctcctaaagataatggcggacgcccagtaactcaatttattgttgaaagaagagccgtggggaagaaatcctggattaaaatcggcgaagtggacgggaaagtcaccaacttcagtactaacaaagtggaggaaggaaaggcttaccagtttagaatcttggccgtgaactctgagggtgtatccgaccctctggagaccgaagaggtattcgcagggaacccgattgaacctcctggatttgcctcgcagccccaggtaaccgatgttacaaaagaggctgtgacgatcacatggaacgcccctacacaggatggaggggcacccgtgctgggctacattgtggaacgtaggaaaaaaggttccaacctttgggttcccgtgaataaagaccccatacagggtacaaagtgtaccgtggatggactgctcgaagatacggaatacgaatttagagtgattgctgtcaataaggctggccctggccagccatcggtccccagctcctctgtcgtggcgaaggacccggtaaaaccccctggtctggtacaggatctgcacgtttccgacagctccaactcatccattagccttgcttggcgggaacccgcagagggggatccaccctcagggtatatcctcgaaatgagggccgaagacaccaaagagtggtctaagtgcaccaaaatcccaatcagcggaacctgctataccgtgggaggactgattgagcgacagaagtatttttttcggattcgtgcggttaacgaggcgggagtgggcgagccagtggagctggacaagggagtccgagcgatgcctccaccggcagccccaaagtttgatctctcagcgcgactgaaatcccacatggtagttcgtgcaggcaccgccttgtgcatccacgccgcattttccgggtcccctcctcctgacgtaatttggcaaaaagatggcgtgccaaccaaagggcgtgaaacgattaccaagtccaaaaatcattctcagtttttgatcaattcaactaagaggtcagattcgggggtctaccggatcctactccagaacgagttcggagaagctagatacgacatccatgtccgggtggcagatttcccaagacctccgactaacctccggctgttcgaagaagtgcctaatacagtcactctgacgtggaaccattctcccgacgtgcaggaggacggcgaggctcactacatcattatgaagcgcgatgcttccaccgctacttggtacacagcagctgaacgagtcttttcgaacaagtacactgtgacaggcctgctgcctggccgtaaatattactttcgggtggtcgctcgtaacgagatcggggacagcgagccactggattctagggatacctggctgattaacaaagaccagatccaggacttgagcgccaaattgaagccatatgagaaaaaagactggaggcatgcacctcgcttcgtgaccccactgaagcctcatacggttttacgtggccaggattgcacgatgacatgcgccttcttgggcaatcccaggcccacagttacactgtacaaaggggatgttaacatcactgccaactcaaagttttggtataattcaacttcaggcgtctgtacgctagtcatccccacttgtaccctcaaggatagtggagactactctgttttggtcgaaaacgagctgggaaaggacagaagctcttgcacactgaccgtctatgacaaggacgacaaatcagttgtagcctccatcacagagtctcttcagaagaaatctaaacatctcatgtag

SEQ ID NO: 56847 - DNA, 1827 bp, Artificial Sequence
  Description of Artificial Sequence: Synthetic coding sequence
atgggatggcagccgatgggagaaaattgggggtgtctggaagagatgctgaacgaagatcagagccgggaaccaccaggacacctgggctcccgccgaagcggaaaggacggcagactagatatttacggcgaacgacgagacgcaacccgctcctcaaccagccgttacaaacccggtacgggctcattctcaaaagatgcacaaggccctatgggtcacttctctcagggcctggccgatatggaagtacaaccaggtgaagcggctactctctcttgtacacttacttccgacttaggtcccggaacttggttcaaggatggcgtcaagctgacaactcaggacggcgtcatatttaagcaggacggcctggtgcactctctgttcatcacacacgtgcagggaacgcaggcaggcagatacacattcgtcgctggtgaccagcaaagtgaggcgacactaacagttcaagactccccaacaattgcaccagatgtgaccgagaagctgagggaacccctggtggtcaaggccggtaaacctgtgatcgtgaaaatccccttccagagccatctgcccatccaggctgcatggaggaaggatggagctgaggtggtagggtcatctgaccgggaagcccaggttgatctcggtgacgggtacaccaggctgtgtctccctagcgctggaagaaaagactgtggccaatattccgtcactcttcgatctgaaggaggttcagtgcaggctgaattgacactccaagtgattgataaaccagatcccccacaggggcctatggaggttcaagattgtcatagggccggtgtgtgcctccgatggcggcctccgagagacaacggaggtcggacagtagagtgctacgtagtcgagcgaaggcaggccggaagatcgacctggctcaaggtgggcgaggccccagctgattctactaccttcacagatgcgcatgtggaacctggcagaaagtacaccttccgggttcgcgctgtgacgtccgaaggcgcaggagaagctctagaaagcgaggagattctagtggcacccgaagcccttcctaaagcacccagcgcccctgctattttaagcgccagttcccaaggaatcactctaacatggacagccccaaggggaccaggcagcgcacatattctggggtatctgattgaacgcaggaagaagggctccaacacgtggactgcagtcaatgaccaacctgtaccagaaaggaggtggaccgtggcagatgtccgccaggggtgccaatacgaattcagggtgactgctgtagctccttctgggccaggcgaaccgggtccgccttctgacgcggtgttcgcgcgagatccaatgaggcccccagggcttgtaagaaacttgcaggtcaccgatcgctctaacactagtattacgctatcctgggccggacccgacactcaggagggagatgaagcgcagggctatgtcgtggagctgtgctcaagtgactccctgcagtggctcccatgtcatgtgggtactgtgcctgtcacaacatatacagccaagggactgcgtcccggtgaaggttacttcgtacgtgtcaccgccgtaaacgagggtggccagtctcagccgtctgcactcgatacgcttgtccaggccatgccggtaaccgtttgccctaaattcctcgtggacagttccactaaggaccttttgaccgttaaggtgggggataccgtgagagtgccagtttcttttgagcatgcgaggaggccactgggacctagtacctgcagacggacttgcctcggaagatag

SEQ ID NO: 56848 - DNA, 11127 bp, Artificial Sequence
  Description of Artificial Sequence: Synthetic coding sequence
atggctggaaagctgagaaagtcacacatccctggagtttcgatctggcagctggtcgaggaaatcccggagggctgtagcaccccagatttcgagcagaagcctgtgaccagcgctctgcccgagggcaaaaatgccgtcttcagagctgtggtgtgcggggaacccagacccgaggtccggtggcagaacagcaagggtgatctgtcagactctagcaagtataagatcagttccagcccagggtctaaagagcacgtactccagataaataagctgactggggaagacacagatctttaccggtgcacagctgtgaacgcatatggcgaagctgcttgctcagtgcggctcacagtgatcgaagttggtttccggaagaatcgcaaacgccatagggagccgcaggaggacctccgaaaagagctgatggactttaggaagctgctgaaaaagcgcgcaccacccgcacccaagaaaaaaatggacctggaacagatctggcagctcctgatgaccgcagacagaaaagactacgaaaagatttgtctaaaatacggcattgttgactacagaggcatgctgagacgtctgcaagaaatgaagaaagagcaagaagacaagatggctcagtatatcaacacaatatccagcctgaggcacatccgagtaactaaggacgggaacgccaaattcgatctcgagctcgacctaaaagacagtcagtctaaaatttatctctacaaagacggggagatgatcccttacggctttaacaaccagacaaagcactgtcttagaagattgggaaagaggtacgaatttcaaatccaggacctccggccagaggatagcggaatttaccaagtcaaggtagaggacgccgtggtcttcagcaccgaattggaagcaagcgctatccctcccagagttgtcgttccattggcagaaacccactgcgaagagcagggtgacgccgtctttgagtgtacgttgtcttctccatgcccttccgcagcctggcactttaggcacaggttgcttcacccatcagacaaatacgaggtctatgtgagccctgatggcctgacacaccgcctggtggtccggggtgcacggttttccgatatggggccatactccctcggaacaggcctctatacctccagtgcctggctagtggtggaggccggtaaagacaaggatttgcagtctacgagcgctgaccataaactgcagagacaaggtgcgcaagcctctggggctgaggagtccggcagcattgaaagccagggggaaaaatcccgggagcagggccctcggggtggatccctggagggcgcaggtcccgcaagtggactccagcacatagcatcacccgatagagatggcctcggcaggcacgggtacagtctgatgggggataaaggcactgccgatagcgcatggggacccggacaggagggggaagggttccctgtggctgaagggtcacgggcaacattgcccagagagaaccaaagccaccgagagggcggatgggcgagatctctcgccgaacgccctcacctgcagggtgaaagcagcgagtctggactggggctccccgagaagcagcagcaggaccggggacgagatagtaattcagacgagtgttggcggaaggcaggcggatgggaggctgggagctcacgactacaggctggcggtctaggaagtagtcgagagggcaaggaacaccgaggggactctgggcgacaactcgaccggcacgctcctgagcagctgtgggatgctcgcctggggccaggaagggggaagtctgatctgcagggctgtcagtctgaccccgtgggatcgtggccacgcggaaagcagatagagatctcacaggatgactcccttgcggagatggatagaggagatgcaccatcacgtgagagggggcgtggtatagtagtatggggtgggggaactggcctcggagaagcaggagacagtaacggtgcaggcggaccgggaaccttggaactgacaggaggcagagggtctggctcaaaggtgggcatggcaccagaaagttggggatcacagggcggacgcgatgcagattatggggaggccagaggatactgggggtccggtgagcttcttgaacagatacccggtgggaaggatttccaggagccatccatctccggagggcgtaagtttttgctcggcgacgggtcccccgagataaaagcggaggattccttgcaagaagctgacgggatatgccggggagagtcagtagtgacgggaagcgcttacaaaaccggtcccggtggccctggagatcctagaggctgcgagggagttttacaagaacttagggggcgtgacggccaggagaccgcatgggcctctggcgaagtggaatatgatccacggtcattccagagctcacagggttggacggcagggcaccgtgccgctgggggaattgggaggatcgaatccaaaggcacctccccttgggacgataccccatcttcgctgaggaagactggtgcccatcatgggccaggggttttaggcccttcagggggtcaggagggaatgggtggcatctgggtggccggtcttacagagtctgggcagggggtcgacgccaggtcacactggctgagcagagctcctgggctgggcgcacagggatccggaggaacactgggagataaaaagggactgcggggacctggcagtattgggagcgaaccagacttttggaacggaagtggctcatctagggttaaggggccaagaggggaaacaggctataaggatggcctggagggtccagggaggatggaatcccgttatgagggcggattgggctattcccgcgagatttcaagtaagtcgggggcaggatacagttatggatcaggcgtgcccggtgagatggggagtgggcacggagccggttgtagggtttcccctcgtgcaccagccggagtcgaaagcgaggagggaggagggtatcggcacggctccggagcgcctggtggcgtgtggtcagggaacgaggactctggccctgccggtggtggatccggacgggttgcttccctcaagaatggaagtggcggtccggatggagctccaatgaacgatacccgaaattgggcatctgcttgtcaggccggaatggatcctcgtggaggacatcactcagacggcggactcgggagtcccggtgtgaccggcagcgccggaaggggtggtctcaaggccccaggagtcgtagaaactgtcggcatgggatgcgtagaagctgagcctgagtcctctgggcgaatacggccatggggtcaaacaggcaactatggcggttttagagcgagcgaggcactgggggcattcggggaggggggatatgaagatggtagcggaggacccggtgcaatgggaccgggttccttacgagctggatctaaagttggcgagggcgacggaacccgatgcccgggagcgaaggcatctggggcaggcgctggctacagggatgatactaggcatcctgagagtctcgctccccataatggtgccgctagcggcagccagtgggcctatggtgcaggcaacgtgctcggatacgaggacggatccgagctgccgggtccacaaggtactggggtaagaaccgcctacggcgagcggagccgcggactggggccacgtagcaccggacctggaggagaggctggcttccgcgacggctccggcggactgcagggcatgggttccgcagacggaccgggttgcagaaagggtatcgggtcaagtggggagatgggatccgtggacaaagaaggctataagaaggatcttggtgctcctgaaaatatgggcagtggatccaaggcagattacagagatggcgttggtggcagcggcgctatggggagcatggatgaagcgggttatagaaaggatctgggggcacccgaggggatctcatccgggtccaaagccgattaccggggaggcctccaagactcccgggaggcagggtcaggctccaaagcggactactcaggcggactgaagggctctcgtgagattggtagtatggatgagaccgataacaggaaagatctgggggtccccgaaggtatgggtgcgggatacagggctggcctgcgaggcccaggagagatgggctccctcgatgaatctggacacagaaatgggatcggaggatatggggaaatggggtcagggtatcgggaagatctgggggctccagaaggcatgggaaccggcagcaaggctggatatcgcgatggtctaagaggatctggggagatgagatcaatggatgaagctggttaccggaagaacctcggagctccggaacgtatggattctggttctaaggcaggatacaggggaggcttgcgaggctctggcgagatgggcctcatagaggccggataccgaaaggacctcggcgtttccgaaggaggcggaagtggcagcaaggctggctacagaggagggctgggtagtggagagatgggcagtgttgacaaggcgggatatagaaaggacctgggtgccagcgaggcaatcggctccgggagcaaggctggttttactgacgggctgggaggctccgaagaaatgggatctgtgaataaagccggataccggaaagaccttggagctccgaaagggatggggagtggctcaaaggcatcttttcgcgacgggttaggtggatcaggcgagatgggaagcgtgaacgaggcaggctaccgcaaagacctcggagtgcccgaaggtatcgggtccggatctaaggcaggattccgagacgggcttggtggctcagaagagatgggttctgtgaacaaggccggatacagaaaggacttgggagcccctaagggtatcggctccggctcaaaagcaggattcagagacggcctggggagctccggtgaaatgggatccatggacgaggccggataccgcaagaatctgggtgcccctgaaggaattgggtcgggcagtaaagccggattccgggacgggctggggagcagtgtggaaatgggctcggtcaacgaagctgggtacaggaaggatttgggtgccccagaagggatgggttcgggctctaaggctggctttagggatggcctgggtggctctggcgagatgggaagtgtcaacgaagccggttacagaaaggatcttggtgcacccaaagggatcggatcaggctctaaagctgacttcagggatgcactgggttcctcaggcgaaatgggctccatggatgaagcaggataccggaaggacctgtgggcacccgagggaattggatccgggagcaaggccggtttcagagatgggctggggtcctcagtggaaatgggatccgtcaatgaggctgggtatagaaaagacctgggagcgccagaggggatggggtcggggagtaaagctggatttagggacggccttggtgggtctggagaaatgggaagcgtgaacgaagccggatacagaaaggatttgggcgctcccaaaggcattggttcggggtccaaagccgattttcgggacgccctgggctcttccggcgaaatggggagtatggatgaagcaggctacagaaaagatctgtgggcaccagaaggaattggtagcggctcgaaggctgggttccgggatggcttaggctcttcggtcgaaatgggaagcgtaaacgaggctggatatcgcaaagacctgggtgcccctgagggaatgggctctggtagcaaagaggggtttagagacgggctcggcggatctgaggagatgggatctgtcaacaaggctggatacagaaaagacctgggtgccccaaaagggatgggaagcggctctaaggagggcttccgcgatggcctgggcggatctgaagagatggggtctatggatgaagcgggttatagaaaggatctcggggctccggagggaatcggttctggcagcaaagctgggttccgagatggactcgggggatccgaggaaatgaggtccatggacgaggcaggctatcggaaggacttgggagctcccgaacgcatcggcagcggatctaaagccggatttagggacggcctgggttcctctgtcgaaatgggctccgtcaacgaggctggctacagaaaagacctgggcgctccgaaagggatggggtcaggctcgaaaactgggttccgcgatggcttggggggatcagaggagatggaaagcatggatgaagccggttaccggaaagatcttggagcccctgaggggattgggagtggaagcaaggctgggttccgagatgggctgggatcctccacagagatgggaagtgtgaatgaggccggttacaggaaagacctcggcgcaccgaaggggatgggctccgagagtaaggcagggttccgggacgggctgggctcatctggcgaaatggggtctatggacgaagcaggctatagaaaggacctcggagcgcctgaaggcatgggctccggatctaaggcgggatttcgcgatggtctcggtggctcggaagagatggggagtgtgaataaggccggataccggaaggatttgggggcacctaaaggaatgggctccggtagcaaagccggatttcgcgatgggttgggatcttcaggcgagatgggctccatggacgaggccgattatagaaaagatcttggagctcccgaggagatgggctctgggtcctacacggattatcggaacgggttgggatcatcagggaagatttcaagtggagacgaagccggttataaaaacgtgctggggggttccggtcgtaatcctctgggatctgaggcgggaagcagaggaagtttggaggattcggggtacattctgtcttggaatgaggccggatcccggcaggggtttggcggaacaagtggcatggggtcgggctcagaagtcagctataggggtgggtcgggcggatccggggaaacaggtcccgagggtaagatgggctatggggacggctcggggaggcttggagttccaggctctctggctggcatagggcacgaggccggacctaggggccataaagcaatggggcacaggtccggctactgggtcgccagcgagggtgatactaactcgaaggatgggccagaacgtgccagggagacacggctagtggatggcgctgggcctggggttgagcctggaatggccggaatgcccggtaccgctggcggtatggcacatagggatagccttcgtggtacgggtgtgttgggcagccagggaggtcgccagacgctaagcgacgagcggggttcaacaaaggatttgggtggttacgggacctctgggattccagaggcaagcgaggcggctggtgcgaaaggaaagccagacgtgaaggaatggcaagacagcagtggaactcccggttctagccgtgatcgtggagcccctcgagtgaaggatcgaagccccgaccaggccggaataatgggcgcttccggatttctggatgggaagggcgctgtggaaggcgagacttgggccggaatggcagcccttgggagtggatacgaacgtgacatatggaaagccggaccaggaatgaccgatagggggcgagtggctggccagggcggtcttgcatcccaagggggtggagattcacttttgggcggtcgacgcgtgggatctggatcaagcgttggtaccggtcaggatttggacagtggatctatgcctggtggcaggggcaaatccactagcggacccgctgatcgacagggtacctccaatgcctgggcccctgactgggaaaatcagggcttttcccaggggagtatcgacgcaggaaaacagcctgcaggaagccgagcttcaggtagcttacaggaaaaagatgccgcattcggcggaacacacgagggcccaggcggattcaaaggtggcgaaggagcccctgggcaggaagccgcaggtggatgtcgctctccatggagccttgatagtaaaggatcgtctcccggtaggggcagtagcgtggatgccgaggatagtgggatactgggtaagggaaattctacagagtgggggaatgcactgactcccaagcccggtgaaagtggaccacagggagcatggaacggcctagacggcccatttggccgaaaggccagcagggatcggtctggaggcactcaagacctcagcagccagcgtgggaaaggtcagagaggaggaaaacgctctctcggtgaacagggctctctggaagctgaaaatggagaagttcaaggcccaggtgcactgaaggaagacgagggtcagggtgtggaagaggccggacgctctggcagacgcccaggcagtctgcggagccggtcccaggctcaatccggggcagaagtggggggaggcaagcgtcgtggtgcagacgaggccggtagcatgggctggcaacccatgggagagaattggggttgcttagaggaaatgctaaacgaagaccaaagtcgtgaacctcctgggcatctaggatcgcggcgtagcggcaaagatggtagactggatatatatggggagcgacgggatgccactcgaagctctacatcccgttataaaccagggacggggtccttttcgaaggatgcacagggcccaatgggccacttttcccagggcctcgccgatatggaggtgcagccaggtgaggcagccactctctcctgtaccctaacgtctgatctagggccaggcacatggtttaaggatggggttaaattgacaacccaagacggcgtgatatttaagcaagacggactggtgcacagcctgttcattacacacgtgcagggcacccaggccggacggtatacttttgttgcaggagaccagcagtcggaagcaacactgactgtgcaggactcccctaccattgcacccgacgtcaccgaaaaactgcgtgaaccgctcgtggtgaaagccggtaaacccgtaatcgtgaaaattccctttcaatctcaccttcccatacaggctgcttggcggaaggatggagctgaggttgtgggttctagcgatagggaagcccaggtggatcttggagatggctacacaagactgtgcttgccatcagccggacgaaaggattgtggccagtacagtgtgactctccgttcggagggtgggtctgtgcaagcagagctgaccctccaagttatagacaaaccagatccaccccagggacccatggaagttcaagactgccaccgcgcaggggtgtgtctgcggtggcggccacctcgtgacaacggtgggaggaccgttgaatgttatgtggtggagcgtaggcaggccggtcgttccacctggctgaaagtgggggaggcccctgccgactcaacaacttttacagatgctcatgttgagcccggaagaaagtatacatttagggtgcgagctgtgacttcggagggcgctggcgaagcactcgagtctgaggagattttagtggcacccgaagccctgcccaaggcgccatccgcccctgcaattctctcagcgtcgtctcagggaatcaccttaacctggaccgctcctcgaggacccggatctgctcatatactcggctacctgatcgagcgaagaaagaaaggatcaaatacctggacagccgtgaatgatcagcccgtacctgagcgaaggtggaccgtggcagatgtgcggcagggctgtcagtacgaattccgcgtcactgccgttgccccaagtggcccaggagagccgggaccgcctagtgatgctgtgttcgcgcgagatcccatgaggccaccgggtctcgtacggaatctacaagtaacagatcgctcaaacacaagcattacactgagctgggcaggtccagacactcaggagggcgacgaggctcaaggttatgtcgtggaactgtgttctagcgacagccttcagtggctgccgtgtcatgttggaaccgtgccagtcactacatataccgccaaaggactgcgacctggcgaaggctatttcgtgcgggtcaccgcagtaaacgagggcggtcagtcccagccttcagcactggatacgctggtccaggcgatgcctgtgacggtgtgccctaaattcctggtggactcgagcacgaaagacttgcttactgttaaagtgggcgacacggtgcgagtccccgtgtcctttgaagcaatgcccatgccggaggttacttggctgaaggacggcttgcctctgcccaaacgtagcgtgaccgttaccaaggatggtctcacgcaactcttgattcccgtcgcagggctcagcgactccggactctacaccgtcgtccttagaaccttgcaggggaaagaagttgcacactcttttaggatacgagtggcagcatgtccccaggctccagggccaatccacctgcaagagaacgtccccggtactgtgactgccgagtgggagccgtcgccagatgaggctcaggacgtgcctcttcactacgcggtgtttacacgtagctccgcacacggcccatggcacgaagctgccgaccgtatccacacaaataggttcacactactggggatcctccctggacatgagtatcattttagggtcgtggcaaagaatgaactcggcgctagcaagccgtccgacacctcacagccatggtgtattccaagacagagggatcgtttcacagtcaaagccccatgttatcgagagccggacctctcacagaaaccacggtttttagtgggtcttaggagccacctgcttccacaagggtgcgagtgctgcatgtcctgtgctgtccaggggtcaccacgaccgcacgtaacttggttcaagaacgatcgctcccttgagggcaatcccgctgtgtactccacagatttgctgggcgtgtgtagtctgacaatcccgtcagtttctcccaaggacagtggtgagtacaaagccgtagccgaaaacacacttggacaggctgtctcgaccgccaccctaatcgtgatcgagccctctacataa

SEQ ID NO: 56849 - DNA, 1713 bp, Artificial Sequence
  Description of Artificial Sequence: Synthetic coding sequence
atggcagggaagctgcggaaatcacacatacccggtgtatccatctggcagcttgttgaagagattcccgagggatgttccacacctgacttcgagcagaagccagttacatccgctttaccagaggggaagaacgccgtatttcgagctgttgtatgtggcgaacctagacccgaggtgcgctggcaaaactcaaaaggagacctatccgactcgagcaaatataagatcagcagcagcccaggctccaaggaacacgttctgcagatcaacaaacttaccggagaagacacagatctgtacaggtgcaccgccgtcaatgcttatggagaagcagcctgtagcgtgcgcctgacagttattgaagtagggttccggaaaaaccgcaagagacatcgggagcctcaggaagatctgaggaaggagttgatggatttccgcaagcttcttaaaaagcgtgcacctcctgcacccaagaagaagatggacctggagcagatctggcagctcctgatgacggcagatagaaaggattacgaaaaaatctgtctgaaatacggcattgtggattatcggggtatgctgcgtagactccaggaaatgaaaaaggaacaggaggacaaaatggcccagtacattaataccatctcatcacttcgccatatacgcgtgaccaaagacgggaacgcaaagttcgatctcgagctggacctgaaggatagccagtcaaaaatctacctgtataaggatggtgaaatgatcccctatggatttaataaccagactaagcattgcctgaggcgcctgggcaaaaggtatgagttccagatacaggacctgcggcctgaggattccgggatttatcaggtaaaagtcgaagacgctgtcgtcttctccaccgaattggaagcctctgccatccctcccagagttgtggtgcccctcgcagagacacactgcgaagaacagggagacgccgtgttcgagtgtaccctgtcgagcccatgccccagcgctgcgtggcactttcggcataggctcttacatccttcagataaatatgaggtgtatgtcagccctgacggcttaactcatcgcctggttgtccggggtgcccgattctctgatatggggccttacagcctcgggaccggcctctacactagtagtgcttggcttgtcgtggaggctggcaaagataaagacctgcagtccacatcggcagatcacaagttgcagtcccggcgtagcggaaaggacggccgactcgatatctatggcgagcgcagggacgcgacaaggagctctacatctagatacaaacctggaacgggaagcttcagcaaggatgctcagggacctatgggccatttcagccagggcctggctgacatggaggtgcagcccggagaagccgctacattgtcatgcactttgacttctgacctgggaccagggacctggttcaaagatggggtcaaacttacaacccaggatggcgtaatcttcaagcaagatggtcttgtgcactctctgtttattactcacgtccaggggacccaggcgggacgctacacattcgtggccggagatcagcagtccgaagcaactctcacggttcaagatagccccacaatcgctccggatgtcaccgagaagctcagggagcctctggtggtcaaggctgggaagcccattcagacctatcattag

SEQ ID NO: 56850 - DNA, 1446 bp, Artificial Sequence
  Description of Artificial Sequence: Synthetic coding sequence
atgatgctgaaatcaattacagaaagctttgcgacggctattcatgggttaaaagtgggacatctcactgacagagtaatccagcggtccaaacggatgatcttggacacgctgggtgccggattcttgggtacaactacagaagtgttccatattgcgtcccagtacagcaaaatctattccagtaatatttcctctactgtttgggggcagcccgatatccggctccctccaacatatgcggctttcgtgaacggagttgccatacactccatggatttcgacgacacttggcaccccgcaacccacccatccggcgctgtgttgccggtcctcacggccttggccgaggccttgccccgttctcccaaattttccggcttggacctgctcctcgcgtttaacgtgggtatcgaagtgcaggggaggctcttacacttcgctaaggaggccaacgatatgccgaaaaggttccatcctccatccgttgtcggcactttgggatcagccgctgcggctagcaaatttcttgggctcagttcaactaaatgtagagaggcgctggccatcgcagtcagccatgcaggggctccaatggccaacgccgctacacaaacaaaaccgctgcacataggcaatgccgctaaacatggaatagaggccgcattcctggccatgctcggattgcaaggtaacaagcaggtcctcgatctggaggccggattcggggctttttatgccaattactcgcctaaagtcctgccctctatagcatcttactcctggttactcgaccagcaggacgtagcatttaaaaggttccctgcgcatcttagtacacactgggtggctgacgccgcagcaagtgtaaggaaacatctggtagccgaacgcgcattgctccccaccgactatatcaagcgtatagtgcttcgcattcctaacgtccaatacgtgaacagaccatttccagtgtcggagcatgaggctcggcactcattccagtacgtcgcatgcgccatgctcctcgacggagggatcacagtgccctcatttcacgagtgccaaatcaataggcctcaggttagggagctgttgtctaaagttgagctggaatacccaccagataatctccctagcttcaatatcctctattgcgagatctccgtgaccctgaaggatggggctaccttcaccgacagatctgacactttctatggtcactggcggaaacccttgtcgcaggaggatctggaagaaaagtttagggccaacgccagcaagatgctgtcctgggataccgtcgaatctctgatcaagatagtgaagaacctggaggacctcgaggattgcagcgtgctgacaacgttactcaagggtccatctcctccagaagtggcgtcaaacagtcccgcttgcaataactccattaccaatttatcatag

SEQ ID NO: 56851 - DNA, 1446 bp, Artificial Sequence
  Description of Artificial Sequence: Synthetic coding sequence
tttccactgaagtccatcacagagagtttcgccacagccatacatggcctgaaggttgggcacctgacagaccgggtcatccagcggagtaaacgaatgatcctcgacacactgggcgctggttttctgggtaccaccaccgaagtcttccatatcgcctcacagtactccaagatctactcgagcaatatcagctccacagtgtggggccagcccgacataaggctgcctcccacttacgccgcttttgtcaatggcgtggcgatacatagtatggacttcgacgatacgtggcatcctgccacgcacccaagcggggcagttctaccggtattaacagccctcgctgaggccttgcccagatcacccaaattttctggactggatctgctgctggcatttaatgtggggatcgaggtccagggaaggttgctccatttcgctaaggaagcaaacgatatgccgaagcgctttcaccctccaagcgtcgtggggaccctgggatcggccgctgctgcttccaagtttctgggtctgtctagtaccaagtgccgcgaagctctggctatcgccgtatcccatgcaggagccccaatggccaacgccgctacccagacgaagccacttcatattggcaacgctgcaaaacacggtatcgaagcagcgtttctggctatgctgggccttcagggcaataagcaggttctggatctcgaggccggtttcggcgcattttatgctaactactcacctaaggtactgccctcgatagccagttattcttggctcttagatcagcaagatgtcgcttttaagagatttccagcacatttaagtacacattgggtagccgacgccgcagcttccgtgaggaaacacctggtcgcggagagagccctcttgcccactgactacatcaaacgcatcgtcttgcgaattccaaacgtgcaatacgtaaacaggcctttccccgtatctgagcacgaggcacgccatagctttcagtacgttgcatgtgctatgttgctcgatggtggaatcacagtaccttccttccacgagtgccagattaatagaccgcaggtcagagagctgcttagcaaagtggaactggagtatcctcctgataacctgccatctttcaatattctctattgtgaaatttcagttaccctgaaagatggcgcaacttttactgacagatcagatactttttatgggcattggcgcaagcctctgtcacaagaagatcttgaggagaagtttagggccaatgcttccaagatgctgagttgggacacggtcgaatctctgattaaaattgtgaagaaccttgaggatctggaggattgctcagtactcaccaccctgctgaaagggccatcaccaccagaggtcgcaagcaactctccagcctgtaataacagcatcacgaacctctcttag

SEQ ID NO: 56852 - DNA, 963 bp, Artificial Sequence
  Description of Artificial Sequence: Synthetic coding sequence
atggccgagggtgatgcaggaagcgatcaacgacagaacgaggagatcgaggctatggctgcgatttatggggaagaatggtgtgtcatcgacgattgcgccaagatcttttgtatccgaatatctgacgatattgatgatccgaagtggaccctttgcctgcaggtgatgctgcccaacgagtacccaggaaccgccccacccatttatcagctgaacgccccatggcttaaggggcaggagagggctgacctgtccaattcgcttgaagagatctacatacagaatattggggaatctatattgtatctgtgggtcgagaagattcgcgacgttttaatccaaaagagccaaatgacagaacccggtccagacgtgaaaaagaaaactgaagaggaggatgtggagtgcgaggatgacctgattttggcctgccaacccgaatcgtcactgaaggcactcgacttcgatatttctgaaacacgaacggaggttgaggtcgaggagctaccgccaatcgatcacggcattcccattactgatcgcaggtcaacctttcaagcccacctcgcccctgttgtctgtcccaaacaagtgaaaatggttttgagcaagctgtacgagaataagaagattgcttccgcaactcacaacatttacgcataccgcatctattgcgaggacaaacagacatttctgcaggattgtgaggatgatggtgagacggccgcaggtggccgtctgctccatctgatggaaatcttaaacgtgaaaaacgtgatggtggtggtttccagatggtatggtgggatactcctgggcccagatcggtttaagcacatcaataactgtgccagaaatatacttgttgagaaaaactatactaactctcctgaagaaagttcaaaggcactgggcaagaacaaaaaagtgagaaaggataaaaaacgtaacgagcattag

SEQ ID NO: 56853 - DNA, 492 bp, Artificial Sequence
  Description of Artificial Sequence: Synthetic coding sequence
atgtctaccaatgagaatgcgaatacccaagccgctcacctgcataggtctaagaataaggggaaggacagtacggagacacgcaggcaccgtattgaggtgaacgttgagctccgcaaggcaaaaaaggacgaccagatgcttaaacggaggaatgtgtccagcttccctgacgatgctacgagtccgctccaggagaactgtaacaatcaaacaccagcactccgtgccattggaaatatcgtcacagggactgatgaacagacacaggttgtgatcgatgccggagctctcgcggtgttcccttcgcttttaaccaaccccaaaaccaacatccaaaaagaggctacctggaccatgtctaatatcaccgccagccgccaggatcaaattcagcaggtcgtgaaccacggcctagtccctttcctcgtatccgacttgtcaaaaatcctcagacacaaaagaaagctctacggtccgtggaattcctag

SEQ ID NO: 56854 - DNA, 156 bp, Artificial Sequence
  Description of Artificial Sequence: Synthetic coding sequence
atgagtggaccattatcacccgtttgctcgtgccctcaactgccttttatgctgtccccatgccacatgcatcatcaccctggtcacgtcgccctctctcagactgtctcccctgcatccctcctcactcagggtcttgggctgccgcaacattag

SEQ ID NO: 56855 - DNA, 2775 bp, Artificial Sequence
  Description of Artificial Sequence: Synthetic coding sequence
atggagatcaaagaggagggggctagtgaggagggacaacacttccttcccacggcccaggctaacgatccaggggactgtcagtttacctcaatccaaaaaacgccaaacgagccccaactcgaatttatattagcgtgtaaagatctggtggctccagtaagggacaggaagttaaacacgttggtgcaaatatccgtcatccacccagtggagcagagcctgacccggtactcatccacagaaatcgtggagggcaccagggatccactgtttctcacgggcgtaacatttccgagcgagtaccctatttacgaggagaccaaaattaagttgactgtgtatgacgtcaaagataagtcccacgacaccgtccgcacaagcgtgttgcccgaacataaagatccccctcccgaggttgggaggtctttcctcggctatgcatcattcaaggtgggggaacttctcaagtctaaggaacagttgctagttctgtccctgaggacatccgacggcggaaaagtcgtgggcacaatcgaagtcagtgtggtgaaaatgggagaaatagaagacggcgaggccgaccatattaccaccgacgtgcagggacagaagtgcgcgctggtgtgtgagtgcactgcaccagaatcagtgtcggggaaggacaatttgcctttcttgaacagtgtgctgaagaaccccgtgtgcaagctgtatagattcccaacctctgataataagtggatgcgaatccgggagcaaatgtctgagtcaattctctccttccatatcccaaaagaattgatatcgctgcacattaaggaggacctttgtcggaaccaggaaattaaggaactcggagagttatctcctcattgggataatctgagaaaaaacgttttaacccactgtgaccagatggtgaacatgtatcaggatattctgacagagttaagcaaggaaaccggatcttccttcaaaagtagcagttctaagggcgaaaaaactctcgaatttgttcctatcaacctgcacctgcagagaatgcaggtgcactcccctcacctcaaggatgcattatacgatgtgataactgttggtgcccctgcagcccacttccaaggcttcaagaatggcggactgagaaagcttctacacagattcgaaacggagagaagaaataccggctaccaatttatttactactctcctgagaacactgccaaagctaaggaggtattgtctaatatcaaccaactccaaccactcatcgctacgcatgccgaccttctcctgaacagcgccagtcagcacagtcccgactcactgaaaaattctctcaagatgctcagcgagaaaactgagctgtttgtccatgcatttaaagatcaacttgttcggagtgctcttctggctttatacaccgctagaccaggaggaatcttgaagaagccccctagcccaaagtcttccaccgaggaaagctctccacaagatcagcccccagtcatgaggggccaggacagcatcccacatcactccgactacgatgaagaagaatgggatagagtttgggctaatgtaggtaagtccctcaactgtatcatagcaatggtcgataaacttatcgagcgtgatggtggtagcgagggctcaggtggaaacaacgacggggaaaaggagccctcgcttacggatgccattccgtctcacccccgagaagactggtatgaacagctgtaccccctaatcctgacccttaaggactgcatgggggaggtcgttaacagagccaagcagtcactcacttttgtactgttgcaagaactggcgtattccctgcctcagtgcctcatgctcaccctgcggagggacatcgtcttctctcaggccttggcgggactggtgtgtggctttattattaagctgcaaacgtctctgtacgacccaggttttctgcaacagctgcacaccgtcggattgatcgtccagtatgaaggcctcctgtctacttacagtgacgaaatcggcatgctggaagacatggctgttggaataagcgacctcaagaaggtggctttcaagattatcgaggccaaaagcaacgatgtgctgcctgtgatcactgggcgaagagaacattacgttgttgaggtcaagttgccagcacgcatgtttgaatcactacccctccagatcaaggaaggacaacttctccacgtttaccctgtgctgtttaatgtgggcattaatgagcaacaaaccctcgccgagagattcggggacgtctccttacaggagtctataaaccaggaaaattttgagctgctccaagagtactataagattttcatggaaaaaatgccacctgactacatcagtcacttccaagagcaaaacgacttaaaggccttgttagagaatctgttgcagaacatccaatctaaaaagcggaaaaatgttgagatcatgtggttagcggctaccatttgcagaaaactgaatgggatccgctttacttgctgcaagagcgcaaaggatcggacttccatgtccgtgaccctcgaacagtgttctatacttagggacgaacatcagcttcacaaagacttttttatccgagctttagactgcatgaggagggaggggtgccgcattgagaacgtgttgaaaaatattaagtgtaggaaatacgccttcaacatgctgcaattgatggcatttcccaagtattacagaccaccggaggggacttacggtaaagcagatacttag

SEQ ID NO: 56856 - DNA, 2775 bp, Artificial Sequence
  Description of Artificial Sequence: Synthetic coding sequence
atggaaataaaggaggagggtgcgtctgaggaggggcaacatttcttgccaacggcccaggccaacgatcctggagactgccagttcaccagcattcagaaaacccctaatgagccccagctggaattcatactggcgtgcaaagacctggtcgccccagttagggacaggaaactgaatacactcgtacaaatctccgtgatccatccagtggagcagtctctgacccgctattcaagcactgaaattgtggagggaaccagagaccctctgttcttgacaggggtcactttcccctccgagtacccgatttatgaggagaccaaaatcaagctgaccgtgtatgatgtgaaggataagtcccacgacacagttcgtacctctgtcctgccagaacacaaggacccaccccctgaagttgggaggtccttcttagggtacgccagtttcaaggtgggagagctcctgaagtcaaaagagcaattactggtgttgagtctgcggacctcagatggcggaaaagtagttggcactatcgaggtatccgtcgttaaaatgggtgaaatcgaggacggcgaggctgaccacatcactacagacgtccaagggcaaaagtgcgcacttgtgtgcgagtgtactgcccctgaaagtgtgtcaggcaaggataacctcccatttctcaactccgtgctgaagaatccagtttgtaaattgtatcgattccctaccagtgacaataaatggatgagaatacgggaacagatgagcgaatctatattatcgtttcacatcccaaaggaactgatttcactacatataaaggaggatctgtgccgcaaccaagagattaaagaactgggagagctgtcccctcactgggataatctccgcaaaaatgtgcttactcactgtgatcagatggttaatatgtatcaagatatcctgacggagctgtcaaaggagacagggagcagcttcaaaagttcttccagcaaaggagaaaagacgctagagttcgttccaattaatcttcaccttcagcgaatgcaggtgcatagccctcatctgaaggacgctctgtacgacgtcatcactgtcggtgccccagcagcacactttcaagggttcaagaacggcggtctgcgaaagctgctccacaggtttgaaactgaacggcgtaacaccgggtaccaattcatctactattcacctgagaatactgcaaaagcaaaggaagttctgagcaatattaatcagctccaaccactgattgccacacatgctgacttactacttaactcggcttctcagcatagccccgattcgctgaagaattcactgaagatgctgagtgagaaaactgagttattcgttcacgcatttaaggatcagttagtaagatctgcacttctcgcactatacacagctcgacccggagggattctgaaaaagccgcctagccccaagagttctacagaagaaagtagcccgcaggaccagccaccagtgatgagaggtcaggatagtatcccccatcactctgattacgacgaggaggaatgggaccgcgtctgggcaaatgtgggaaaaagcctgaattgtattattgcaatggttgacaagcttattgaacgggacggcggttctgaggggagcgggggaaataacgatggggagaaagagcccagtctcaccgacgcaatcccttcccatcctcgtgaggattggtacgagcagctgtatcctctcatattgacgcttaaagactgtatgggagaggtggtgaaccgagccaagcagtccctgacattcgtgcttctccaggagctcgcttactccctgccacagtgccttatgctgaccctccggagagatatcgtgttttcccaggcattggccggtttggtgtgtggatttataattaaactccagacttctctgtacgatccgggattcctacaacagctgcacacggtgggcctgattgtgcagtatgaagggctgcttagcacctatagcgatgaaattggaatgcttgaggatatggctgtgggaatatccgacctgaagaaggtagccttcaagattatcgaagcaaaaagcaatgacgtgctcccagttatcaccgggaggcgggagcattatgttgttgaggtcaaactgcccgctagaatgttcgaatcccttccgcttcagattaaggagggtcaactgctgcacgtgtaccccgtgctgtttaatgtggggattaatgagcagcagactctcgccgaacgctttggcgatgtatccttgcaagagtccataaatcaagagaactttgaattactgcaggaatactacaagatctttatggaaaagatgcccccagactacatctcacactttcaggaacagaacgatctcaaggctctgctggaaaatttacttcagaacatacagtccaagaagcgaaagaatgtggagattatgtggctggctgcaacaatctgccggaaactcaacggcataaggtttacctgttgtaagagcgctaaggaccgcactagcatgagtgtgactctggagcagtgtagtattctacgagacgaacatcagttgcacaaggacttcttcattagagccctcgactgtatgcgcagagagggctgccggatcgaaaatgtgttgaagaacattaaatgcaggaagtatgccttcaacatgctccaactcatggccttccctaaatattaccggccaccagaagggacgtacgggaaagccgacacatag

SEQ ID NO: 56857 - DNA, 120 bp, Artificial Sequence
  Description of Artificial Sequence: Synthetic coding sequence
atggaaatcaaggaagagggtgcaagcgaagagggtcagcatttcttgcccaccgcccaagccaacgatcccggtgattgccagttcacatctatccagaagacgccaaatgagccctag

SEQ ID NO: 56858 - DNA, 396 bp, Artificial Sequence
  Description of Artificial Sequence: Synthetic coding sequence
atggaaataaaggaggaaggggcaagcgaggaaggccaacactttcttcccacagcgcaggcaaatgaccctggcgattgccagttcacatccattcagaaaactccaaacgaacctcagctcgagttcattctcgcctgtaaggatctggtggcaccggttcgggatcgcaagcttaacacactggtacagatttctgttatccacccggtggagcagagcttgaccagatattcctccaccgagatcgtggaaggcaccagagaccccctgtttttgaccggggtgacattcccctctgagtaccccatttatgaggagactaaaataaaactgaccgtgtacgatgtgaaggataagagtcacgatactatcgccaactcaagtaggatctag

SEQ ID NO: 56859 - DNA, 255 bp, Artificial Sequence
  Description of Artificial Sequence: Synthetic coding sequence
atggaaattaaagaagagggagcttccgaagagggccaacactttctccccactgcacaggcaaacgatcccggtgactgtcagtttacctctatccagaaaacccccaacgagcctcagctggagtttatcttggcttgcaaggatctggtcgctcccgtccgggatagaaaactgaacacactcgtgcagatcagtgtgatccatccagtggagcagtccctcacccggtactctagcacagaaatcgtgtag

SEQ ID NO: 56860 - DNA, 162 bp, Artificial Sequence
  Description of Artificial Sequence: Synthetic coding sequence
atggaaattaaggaggagggcgcttctgaagaaggccagcacttcctccccactgctcaggcaaacgaccccggtgactgccagttcacatcgattcagaagacccctaatgaaccacagctggaattcatcttagatctcaaccaagagctcagggattag

SEQ ID NO: 56861 - DNA, 2775 bp, Artificial Sequence
  Description of Artificial Sequence: Synthetic coding sequence
atggaaatcaaggaagaaggcgctagcgaagaagggcaacattttctgcccaccgcgcaggcaaacgatccgggtgactgtcagtttacctctatacaaaagacaccaaatgagcctcagttggagttcatcttggcttgcaaggatcttgtggctccagtgcgtgacaggaagctcaacacgttagtgcagatttcagtgatccatccagtggaacagagtctgactcgctattcctccacagaaatcgtggaaggcaccagggatcccctgttccttaccggcgtgacgttccctagcgaatatcctatttacgaagagacaaagataaaactgactgtctatgatgtgaaggacaagtcccatgacacagtcaggaccagtgttctgcccgagcacaaagaccccccaccggaggtcggcagatcctttctggggtatgcctcttttaaggtgggcgagctgcttaagtctaaggaacaactgctggtactgtctttacggaccagtgatggcggaaaggttgtcgggaccattgaagtcagtgtagtaaaaatgggtgagatcgaggacggcgaggctgaccacatcacaacagacgtgcagggccagaaatgcgccttagtctgcgagtgtaccgcgcctgagtccgtctctggcaaggataacttgcctttcctcaactctgtgctgaaaaacccagtgtgcaaactttaccgctttcctaccagtgacaacaaatggatgcggatccgtgagcaaatgtccgagtctattctgtcctttcatattccaaaagaactgatttccttgcatatcaaggaggatctgtgcaggaaccaagaaataaaagaactgggagagttatctccacattgggacaatttgagaaagaatgtcttaacacattgcgaccagatggttaatatgtatcaggacatcctcaccgagttatccaaagagacagggagttccttcaagtccagctccagtaagggcgaaaaaaccctggaattcgttcccatcaacctccacctgcagcgaatgcaggtacattcgcctcacctgaaagatgctctttacgatgtgatcacagtcggcgcacccgctgcacacttccagggattcaaaaatgggggtcttcggaaactacttcatcgcttcgaaactgaacgcagaaataccggctaccaatttatttactactccccggaaaatacagctaaagcaaaagaggttctcagcaatatcaatcagctccaaccccttatcgccacccacgccgacctgctgcttaacagcgcttcgcaacactctcccgacagcctcaagaacagcctcaagatgttgtccgagaaaacggaactatttgttcacgcctttaaagatcagcttgtgcggagtgctctcctggctctatataccgctcgcccaggcggtatcttgaaaaaaccaccgtcgcctaagtccagcaccgaggagagcagccctcaagaccaaccacctgtgatgcgcggacaggatagcataccccatcattcagactacgatgaagaggagtgggaccgtgtgtgggctaatgtcggcaaatctctcaactgtatcatagccatggtggacaagctgatagaacgcgatggaggaagcgaaggcagtgggggaaacaatgacggcgagaaagagccctctctcaccgacgccataccttctcacccaagagaggactggtatgagcagttgtaccccctgatactgactctgaaggactgcatgggtgaggtggtgaatcgagccaagcagagcttgaccttcgttctcctgcaggaattggcttatagcttgcctcagtgccttatgctaactctgcgtagagatattgttttttcacaagcacttgccggacttgtatgcggattcatcattaagctgcagacaagcctttacgaccctggatttctgcagcagttgcatacggtggggcttatcgttcaatacgaaggactcctaagcacgtatagtgacgagatcggaatgcttgaagacatggcagtcgggatatctgaccttaagaaagtggcatttaaaatcatcgaagctaagagtaacgatgtgctgcccgtaattacagggaggcgcgagcattatgtggtagaggtcaaactccccgctcggatgttcgagtctctaccgctgcagatcaaagaaggccagctgctgcacgtatacccagtcctgttcaatgtggggatcaacgagcagcagacactggcagagagattcggagatgtatcattacaggagtccataaaccaagagaactttgaacttctgcaggagtactacaagatttttatggagaaaatgcccccagactacatctctcattttcaggaacagaacgatctgaaggccctgttggagaacctgctgcagaacatccaatccaagaaaaggaagaatgtggagattatgtggcttgccgctacgatttgtaggaagttgaacggcatcagattcacttgttgcaagtcagccaaagacagaacctccatgtccgtgacactggaacagtgttccatcctacgcgacgagcatcagctacataaagacttttttattcgggcactggactgcatgaggagagagggatgccgcatcgagaacgttcttaagaacattaagtgtaggaaatacgcattcaacatgcttcagcttatggcctttcctaaatactatcggccacccgagggaacgtacggtaaagcagatacttag

SEQ ID NO: 56862 - DNA, 2817 bp, Artificial Sequence
  Description of Artificial Sequence: Synthetic coding sequence
atggagatcaaagaagaaggtgcttctgaagaaggccagcattttttacctacagcccaggccaacgaccccggtgactgccaatttacaagtatccaaaagaccccaaatgagccccagttggagtttatattggcctgcaaggacctggtggctccagtgagggatagaaagcttaataccctcgtccaaataagcgtgattcatcccgtcgagcagtctctaaccaggtattcctcgactgagatcgtcgagggaacccgggatccattatttctgacgggtgttaccttccctagtgagtaccctatctatgaggagaccaaaatcaagctgacggtatacgacgtgaaagataagtcacacgataccgtacggacctccgtcctccctgagcacaaagacccaccccctgaggtcggcagaagttttctcggctatgcctcctttaaagtgggggagcttctgaagtcaaaggaacaactgctcgtcctatcactgagaaccagtgacgggggaaaggtcgtgggtactattgaggtgtcagtcgtaaaaatgggggagattgaagacggcgaggcggaccatatcactacagatgtccaggggcagaaatgcgctctggtatgtgagtgtactgcccctgagtctgtgagtgggaaggacaatttacctttcctcaacagtgtcctgaaaaaccccgtctgcaagctgtaccggtttcctacctcagacaacaagtggatgaggatccgcgaacagatgtctgaatccatcctgtctttccacatcccaaaggagctcatttccctccatatcaaggaggacctttgtcgaaaccaggaaattaaagagctcggcgaactgtcgccccattgggataacctgcgaaagaacgttctgacacattgcgaccagatggtaaatatgtaccaggatatactgaccgaattgagcaaagaaacaggaagctcctttaaatcttcctcatcaaagggagagaagacattagagttcgtgcccatcaatcttcacctccaacggatgcaagtacattccccgcacctcaaggacgcactttacgacgtgatcactgtgggcgctcctgctgcacacttccaaggctttaagaacgggggtctccgaaaactgttgcaccggtttgagactgaaaggcgcaacaccggctatcaatttatttactacagtcctgagaacacagccaaggccaaggaggtcctcagcaatattaaccagctccagccccttattgctacccatgcagacctgctgcttaacagcgccagccagcattctcctgactcattgaaaaacagcttgaagatgctctccgagaagacagaactgttcgtacacgccttcaaggaccaacttgtacgctccgccctcttggcactctacacagcaaggcccggtggcattctgaagaagcctccaagccccaaatcctcaaccgaggaatcatcccctcaagaccagcctcctgtgatgcgcggtcaggactcaataccacaccactcggactacgacgaggaagaatgggatcgggtctgggcaaacgtgggaaagtccctgaattgcatcattgctatggtggataagctcatcgaacgggatggaggcagtgaggggagcggcggaaacaacgatggagagaaggaacctagcctaaccgatgctataccttcccatccgagggaggattggtatgagcaactgtacccgctgatcctgaccctgaaggattgtatgggcgaggttgtcaacagggccaaacagtctcttaccttcgtgctcctgcaagaactggcttatagcttgccacaatgtctcatgttgacactgcggagggacattgtgttctctcaagcactcgccggacttgtgtgcggatttatcatcaaactgcagactagcttgtatgacccgggatttttgcagcagttgcatactgtgggccttattgtgcaatacgaaggcttactgtctacttacagcgacgagattggtatgttggaagatatggccgtcggcatctcagacctgaagaaggttgcatttaaaatcatcgaagcgaaatctaatgatgtgctccccgttatcacaggcaggcgggaacattatgtcgtggaggtgaaactgccagctaggatgtttgaatcactgccgctgcaaatcaaggaggggcagctgctccacgtgtaccctgtactgtttaacgtggggataaacgagcagcagaccctggccgagcgcttcggcgacgttagcctgcaagagtcgataaatcaagaaaactttgaactgctgcaggagtactacaagattttcatggaaaagatgcctccagattacatcagtcattttcaggagcagaacgacctgaaagccctgctggagaacctgctacagaacattcaatccaaaaagagaaagaacgttgagataatgtggctggccgctacaatctgtcggaagttaaatggaatccgatttacgtgttgcaagagcgcgaaagataggacttccatgagtgtcaccctggaacagtgctctatcctgagggatgaacaccaactgcacaaggattttttcatcagggcactagactgcatgcgcagtcgtcagactcagggggctctgaacgagtcggacgatcctgagacgggatgtcttacggacaataagcccacaagccggcacttttaccccgttgccctcctgctggtatcttcccatctgctagtagtttggctgattttaagcctcgccctgctgttggccaaatatcagtag

SEQ ID NO: 56863 - DNA, 2454 bp, Artificial Sequence
  Description of Artificial Sequence: Synthetic coding sequence
atggagattaaagaggaaggagcatccgaagaagggcagcatttcctccctactgctcaggctaatgacccgggtgattgccagttcacaagtatacagaagacaccaaatgagcctcagttggagttcatcctggcctgtaaagaccttgtggctccagtcagagacagaaagctgaacactctggttcaaatctccgtgatccacccggttgagcagtcccttacgagatactcttccaccgagatcgtggaagggacgcgcgatcccctctttctgaccggtgtcacattcccatccgagtatccgatctatgaggaaactaaaattaagctgacggtatatgatgtgaaggataagagccatgatactgtgaggactagcgtgttaccggagcataaagacccaccccctgaggtaggacggtcgttcctgggatatgcctcgtttaaagttggggagctgctcaaaagcaaggaacagctgcttgtgttatctctgcgtaccagcgacggtggaaaggttgtcggcaccattgaggtcagcgtcgtgaagatgggcgaaatagaggacggagaagccgaccatattacgacggacgtgcagggtcaaaagtgcgctctggtttgtgagtgtactgccccagaaagtgtatccgggaaggacaacctaccattcttgaactccgtacttaagaacccggtgtgcaagctgtacagatttccaaccagcgataataagtggatgcggattcgcgaacagatgagcgaatccattctgagctttcatatcccgaaggaattaattagcctccacatcaaggaggatttgtgtcgtaaccaggagatcaaagagttaggggagctgtctccgcactgggataatcttaggaaaaatgtcctgacccactgtgaccaaatggttaacatgtaccaagacatactgacagagctgagcaaggaaacaggcagctcttttaaatcctcatctagtaagggggaaaaaacactagagttcgttccaatcaatctgcacctccagagaatgcaggtccattccccacacctgaaggacgccctgtacgacgtgattaccgtgggagctccagccgcacatttccagggattcaaaaatggcggtcttcgaaaactgctccatcgtttcgaaaccgagcggaggaataccggataccagtttatctactacagtcctgaaaacaccgccaaagctaaggaagtgttatccaatataaatcagcttcagcctctgatcgcaacccacgctgacttactgttaaacagcgccagccagcattccccagacagcctcaagaatagcctgaagatgctgagcgaaaaaacggaacttttcgtccacgcctttaaggaccagctcgtcaggtcagccctgcttgcactctacacagccagacctggcggtatcctgaagaaacctccttcccccaagagttcaaccgaagaaagttctcctcaggatcagcccccagtaatgcggggacaggacagtattccgcatcactctgattatgatgaggaagaatgggacagggtatgggccaatgtggggaaatccctcaattgcatcatcgcaatggtagacaaattgatcgagcgagacggaggctccgagggctcaggcggtaataatgatggagaaaaagaaccgtctttaaccgacgcaatcccatcacatcccagggaggactggtacgagcaactctatccgctgattctgaccctgaaggattgtatgggcgaggttgtgaatcgagctaagcagagtctgacattcgtgctcctgcaggagcttgcctactcacttccacaatgcctgatgttgactctgcgacgggacattgtgttttcgcaggcacttgctgggctggtatgcggttttattatcaaattgcagaccagcctgtatgaccctggattcttacaacagctccacacagtcgggctgatcgtgcaatacgaaggcttattgagtacatacagcgacgagatagggatgctcgaggacatggctgttggaatctcggaccttaaaaaagtcgcctttaaaatcatcgaggcaaaaagcaacgatgttctcccggtcattaccgggaggcgtgagcactacgttgtagaggtgaagctcccggcacgtatgtttgagtccctgcccttacagataaaggagggccaactgttgcacgtttaccccgtgctattcaacgtaggcattaacgaacagcagacactcgcagagcgctttggcgatgtctctctccaggaaagtatcaatcaagagaacttcgaactgcttcaggagtattataagatctttatggaaaagatgcctcccgactacatcagtcactttcaggagcaaaacgatctgaaagccctgctggagaacctgctccaaaatatacagtccaagaagtag

SEQ ID NO: 56864 - DNA, 2775 bp, Artificial Sequence
  Description of Artificial Sequence: Synthetic coding sequence
atggagataaaggaggagggcgctagtgaagaggggcaacattttcttcctaccgctcaggccaacgatcctggcgactgtcagttcacatctatacagaaaaccccaaatgaaccacagctggagttcattttggcctgcaaggacttggtggcacctgtgagggacagaaaactgaacactctggtacagatcagtgtgatacacccagtcgaacagagtctgactcgatactcctcaacggagattgtagagggaaccagagacccactgtttttgaccggcgttactttcccatcggaatacccgatctacgaagagactaagatcaagcttacggtgtatgatgtgaaggacaagagccacgataccgtgcggacatcggtgttacccgagcataaggacccaccccctgaggtcggtagaagctttttaggctacgcctcatttaaggtcggggagctcctgaagtcaaaggaacaactgttggtcctgagtttgcgcacctcggatggcggaaaagtggtgggaaccatcgaggtgagcgttgtaaaaatgggggaaatcgaggacggggaagcagaccacattaccactgatgttcaggggcagaagtgcgcgctagtatgcgagtgtacggcccctgagagcgtttccggcaaggataacctgccatttttgaattctgtcttgaagaacccagtctgtaagttgtatcgattccccacctccgacaacaaatggatgcgaatcagagagcagatgtcagaatctatactatcctttcacattcctaaagaactgatctctctgcacattaaggaagacctgtgtaggaaccaggagattaaggagctgggcgaattaagccctcactgggacaatctgcggaagaatgttctcacccattgtgaccagatggtgaatatgtaccaggacattctgacggagctgtcgaaggaaacaggatccagcttcaaaagctcctcgagcaaaggggagaaaacgctggaattcgtcccgatcaacctccacctgcaacggatgcaagtccactcacctcacctaaaagacgccttgtacgatgtgataaccgtgggggctcccgctgcacatttccagggctttaagaacggcggtctacgcaagctgctgcatcggtttgagaccgagcgcaggaacacagggtaccagttcatctactattctcctgagaatacagcaaaggccaaagaggttttgtcaaacataaatcagctgcagccgctcatcgcgacccacgctgatttgcttctcaactcggcctcccagcattcccctgactccttgaaaaatagtctgaaaatgctctccgagaaaacagaactgttcgtgcatgcattcaaggaccagctcgtgaggagcgctctgctggccctttacaccgcaagacctggagggatcctgaagaagccaccttcccccaagtcttcaactgaagaaagctctcctcaggaccagccccctgttatgaggggtcaggactccattcctcaccacagcgactacgacgaggaagagtgggaccgcgtatgggcaaatgtcgggaaaagtctgaactgtatcatagccatggtggacaagctgattgagagggacggtgggtctgaggggtcaggtggaaacaatgacggagagaaggaacctagtcttaccgacgccataccctcgcaccccagagaggactggtatgagcaactttatccgctgattctgaccctgaaggattgcatgggggaagtagtcaaccgcgctaaacaatccctgacattcgtgctactgcaggagctagcctacagcctgccgcagtgccttatgctgacgttgagacgcgatatcgttttctctcaggcactcgcgggtctggtttgcggttttataatcaagttgcaaactagtctgtatgaccccggattcctgcagcagctccacactgtggggctgattgtgcagtacgaaggcctgctgagtacgtactctgatgagatcgggatgttggaggatatggccgtcggaatttcagacctcaagaaagtggccttcaagataatcgaggcgaaatctaacgacgtgctccccgtgattactggcagacgagagcactacgtcgttgaagtaaagttgcccgcacgcatgttcgaaagtctacccctgcaaataaaggaagggcagctcttacatgtctatcccgtgttgtttaatgtgggaataaacgaacagcagacactcgctgaacgattcggcgatgtgtctctccaggagtctattaaccaggagaatttcgagttgttacaagagtactacaaaatctttatggaaaagatgccaccagattacattagccattttcaagagcaaaatgacctaaaggcactgttagaaaatttgctgcaaaatatccagtcaaagaaacgcaaaaatgttgagattatgtggctggctgcgaccatttgtcggaaacttaacgggattagatttacatgctgtaaaagcgctaaggatcggacctcaatgagcgtcaccttggagcagtgttcgatcctgagagacgaacaccagctgcacaaggactttttcatccgggcactcgattgcatgagacgagagggttgcaggatagaaaatgtcctgaagaatattaagtgccgaaagtatgccttcaacatgctgcagctcatggcctttccgaaatattatagacccccagagggcacctacggcaaagctgatacgtag

SEQ ID NO: 56865 - DNA, 1971 bp, Artificial Sequence
  Description of Artificial Sequence: Synthetic coding sequence
atgggggagattgaagatggtgaggctgaccacatcactaccgatgttcaaggacagaagtgcgccctggtgtgtgaatgcaccgccccagaatccgtctccggaaaagacaatctgcccttcctaaattccgttctgaaaaatcctgtttgtaagctttatcgtttcccaactagtgataacaaatggatgagaatccgggagcaaatgtccgaatctatcctgtcgtttcatattccaaaggaactgatctcactgcacattaaagaagatttgtgtcgcaatcaggagatcaaagagctgggggagttatctccacattgggacaacctgagaaagaatgtactcactcactgcgaccagatggtgaatatgtaccaggacatcttaaccgaactatcgaaagagactggaagcagttttaagtcttcttcttctaaaggtgagaagacactagagttcgtccctataaacctccacttgcagcggatgcaggtgcacagtcctcacttaaaggacgccctgtatgacgttatcacagtgggagctcccgctgctcattttcaaggctttaagaatggcggactccggaaactgctacaccgttttgagaccgagagacgcaatacaggataccagttcatttactactcacctgaaaacaccgccaaagcaaaggaagtgctctctaatatcaaccaactccagccactgatcgcgacccatgcagacctgctgctcaacagcgctagtcagcattcccctgacagcctgaagaactcgttgaagatgctgagcgaaaagactgagcttttcgtccacgcttttaaggatcagctcgtacgcagcgctctgttggccctgtacactgcgcgtccaggtggcattctgaaaaagcccccaagtccgaaatcttcaaccgaagagtcaagccctcaggaccagccacccgtgatgcgaggtcaagacagtatcccccaccactcagattacgatgaggaggagtgggaccgagtttgggcgaacgtcggcaaatctttgaattgtatcatcgctatggtagacaagctgatcgagcgggatggaggttccgagggatccggcggaaacaatgacggagagaaggaaccatccctgactgacgctatccccagccacccacgcgaagactggtacgaacagctttatcccctgattctgacactgaaggactgcatgggcgaggtggtgaatcgagcaaaacagtctctaacgttcgttctgctccaggagctggcctactctctgccgcagtgtctcatgttaacactccgtagagacatcgtgttttcccaggctttggcaggactagtctgtggtttcatcatcaaattacagactagcctgtacgacccaggattcctgcagcaattgcatacagtggggctgattgtgcagtacgagggcctcctgagcacgtactcggacgaaatcgggatgctagaggatatggccgttggtattagcgacctgaagaaggtggctttcaagattattgaggccaaaagcaatgacgtgctgccggtcatcaccgggagaagggaacattatgtggtggaggtaaagctgcctgccagaatgtttgagtctctcccccttcaaatcaaagaagggcaattattgcacgtctatcctgtgctgttcaacgtaggtattaacgagcaacaaaccctggctgagaggttcggggacgtgtcactgcaggagtctatcaaccaggagaacttcgaactgctgcaggaatactacaagattttcatggagaaaatgccgccagattacattagccattttcaagaacagaacgatctcaaggccctgctcgaaaatctcctccaaaacatccagagtaagaaaaaagagtgccgcaactatgtcgctgggtgcaacgacctcccccaaaccgagtggtattctttccatttactgtag

SEQ ID NO: 56866 - DNA, 2061 bp, Artificial Sequence
  Description of Artificial Sequence: Synthetic coding sequence
atgatccattttcaccctcttatactgcctcacgagcggtcattccttggctacgcaagcttcaaagttggtgaactcctcaagtctaaagagcagctgctggtactgagtcttcggacgtctgacggcggaaaagttgtgggcactatcgaggtctctgtcgtgaagatgggtgaaatcgaggacggcgaagcagaccatataactactgatgtccaaggccagaaatgtgcactggtatgtgaatgcacagcaccagaatcggtgagcgggaaagataatcttcccttcttaaattcggtgctgaagaatcccgtgtgcaagctgtataggttcccgacgtccgataataagtggatgaggatccgggaacagatgtctgaaagcatcctgtccttccacatccctaaggagctgatctcgctccacatcaaggaggatctgtgtcgtaatcaggagatcaaggagcttggagagctctccccgcactgggacaatttacggaagaacgtgctgactcactgtgaccaaatggtcaatatgtaccaggacattctgaccgaactgtccaaggaaacaggctcttcatttaaaagcagctcttccaagggcgaaaaaaccctagaatttgtgcccattaacctgcacctgcaacgtatgcaggtgcattctcctcacttaaaagacgctttgtatgatgtgatcacggttggggcacctgctgctcactttcaaggatttaaaaacggaggtctgagaaaactgctgcacaggtttgagacagagaggagaaataccggctaccaatttatctattactccccagagaataccgcgaaggccaaggaagtcctgagcaacattaaccagttgcagccactcattgcgactcatgccgaccttctcctgaattctgcttcccagcattctccagatagtctcaagaattccttaaagatgttgtctgagaaaaccgaactcttcgtccacgcgttcaaggatcagctcgttaggtcagcactccttgctctttataccgcccgtccagggggtatcctaaaaaagcccccttcacctaaaagctcaactgaagagtcttccccccaagaccagccccctgtaatgaggggacaggacagtatcccgcaccactccgattatgatgaggaggagtgggatcgcgtttgggccaatgtcggcaagtcattaaattgtattatagctatggtcgacaaactcatagagagagatgggggaagtgaagggtcaggagggaataatgatggtgagaaggaaccaagccttaccgacgccataccgtctcacccccgagaggactggtatgagcagctttatccactgatactgactttgaaggattgcatgggggaagttgtgaatagagccaagcagagccttaccttcgttctgctccaggagctggcctactctctgccccaatgcctcatgttgaccctgaggcgtgacatagtcttttcacaggcactagccggactggtgtgtgggtttataatcaagcttcagacctccctgtacgatcctggattcttacagcagttgcacacagttggcctcatcgtgcaatatgaggggcttttgtcaacgtatagcgatgaaatcggcatgctggaagacatggctgttggaatcagtgatcttaagaaagttgcttttaagatcatcgaggctaagagcaatgatgtcctcccagtcatcactgggagacgcgaacactatgtcgtggaagtcaaactgccagctagaatgttcgagagtctgcccctccagatcaaggaaggccagctcctccacgtgtatcctgtgttatttaatgtcggtatcaacgaacagcagacactcgctgagcgcttcggggatgtgtcactgcaggagtcaatcaatcaggagaattttgagctgctccaggaatattataaaatcttcatggagaaaatgcccccagattacatctctcattttcaggaacagaacgacttaaaagccctgttagagaaccttctgcagaacatccagagctag

SEQ ID NO: 56867 - DNA, 3399 bp, Artificial Sequence
  Description of Artificial Sequence: Synthetic coding sequence
atggagctctttcaggccaaggatcactatatacttcaacaaggcgaaagggcactgtggtgtagccggcgtgacggaggcctgcaactgaggccagctacagacctcctcttggcatggaatcctatctgcctgggtctcgtagaaggtgtgatcggaaaaatacagctgcattcagacttaccatggtggctgattctcattcgccaaaaagctctagtggggaaattgcctggcgaccatgaggtctgcaaagtgacaaaaattgccgtgctctctctttcagagatggagccccaggatctggaactggagctgtgtaaaaagcaccactttggaatcaataaacctgagaagattattccaagtccagacgattcaaagttcctgctcaagacatttactcacatcaaatcaaatgtgtcagcgcctaacaagaagaaagtcaaagagtctaaggaaaaagaaaagctggaaagacgactactggaggagcttcttaaaatgttcatggactcagaaagtttttactactcgctgacttacgacctgacgaatagcgtccagaggcagagtactggcgagagagacggaagaccattatggcagaaggtggatgacagatttttttggaataagtacatgatccaggatcttaccgaaattggcacgcccgacgtggatttctggattattcctatgattcagggctttgtacaaattgaggaactcgtggtgaattacacagaaagctccgatgacgaaaagagtagtcccgagaccccacctcaagagtctacctgcgttgacgatatccacccacgcttcctagtggccctcatcagccgacgcagtcggcaccgcgctggcatgagatataaacgaagaggagttgacaagaatggcaatgtggctaactacgtggaaactgagcaactcatacacgtccacaaccacaccctgagtttcgtccagactcgagggtctgtgcctgtcttttggagccaggtggggtaccggtataatcccaggccaaggctggatcggtccgaaaaggaaactgtcgcctacttttgtgcccacttcgaggagcagctcaatatatataagaaacaggtgataataaaccttgtggatcaggccggaagggagaaaatcataggagacgcctacctcaagcaggtgctcttgttcaacaactcccacttgacatatgtcagcttcgatttccacgagcactgccgcggtatgaaattcgagaatgtccagaccttgacagacgctatctatgatattatcctggatatgaagtggtgctgggttgatgaagccggagtgatatgcaagcaagaaggcatcttcagagttaactgtatggactgcctagaccgtaccaatgtcgtccaggccgcaatagccagggttgtgatggaacaacagctcaagaagcttggagttatgccccctgagcaaccgcttccggtaaaatgcaacaggatttatcagatcatgtgggcaaataacggggacagcatcagccggcaatacgctggaaccgctgcacttaagggcgacttcacccgcacaggggaacggaagttagctggcgtcatgaaagacggagtgaatagcgccaaccgctactaccttaatcgtttcaaggatgcttatagacaagctgtcatcgatttgatgcagggtatccctgtaacagaagatctatactcaatcttcacaaaggagaaagagcacgaagcactccacaaggaaaaccagcgttctcatcaggagcttatttcacagttgctacagagctatatgaagcttttgctgcctgacgatgagaaattccacggtggttgggcactgattgattgcgatccgagtctcatcgatgctacccacagagatgttgatgtgctgctcttgctaagcaatagtgcttattacgtcgcctattacgacgacgaggtggacaaagtgaatcagtaccagcgcctgtctctggagaatcttgagaagattgagatcggccctgaacccactctgttcggaaagcccaaattcagctgcatgcggctacattacaggtataaggaggccagtgggtactttcataccctgagggccgtgatgaggaacccagaagaagatggtaaggacactcttcagtgcattgctgaaatgctccagattacaaaacaagctatgggatcggaccttccgattatcgagaaaaaactcgagcgcaaatcctcaaagccccatgaggatataattggtatccgttcccagaaccaaggatcgttagcacaggggaagaacttcctgatgtctaaattcagcagcttgaaccaaaaggttaaacagacgaagtctaatgtgaacatcggaaacctgaggaagctagggaactttaccaaaccggaaatgaaggtcaacttcctgaagccaaacttgaaagttaacctgtggaagagcgattcctctctggagacaatggagaacaccggtgtgatggataaggtgcaggccgaatccgacggagacatgtccagcgacaacgattcatatcacagcgacgagttcttaactaatagcaaatctgacgaggaccgtcagctggcgaattcactggagagcgtaggaccaatcgactatgtcctcccaagttgtggtattattgctagcgcccctaggttggggtcacgctcccagagcctgtcatctacggattctagtgtccacgctccgtccgagataactgtcgcccacggcagcgggctgggtaagggacaggaatcccccctgaaaaaatctcctagcgcaggggacgtccacatactgacaggctttgccaagccaatggacatttactgccaccgttttgtgcaagatgctcagaacaaagttacccacctgtccgaaacccgcagcgtctctcaacaggcctcccaagaacggaaccagatgacaaaccaagtctctaacgaaacgcagtccgagagtactgaacagacccctagccggccttcacagttggatgtgtccctgtccgcgacaggaccacaattcttatcggtggagcctgcacattctgtggctagtcagaagacacccacctcagcatcttcaatgcttgagttggagactgggctgcatgtcactcctagcccatcagagtcctcctccagcagggccgtgtcaccctttgcaaagatccgatcttcaatggtgcaagtggccagcataactcaagccggactcacccacggcattaactttgccgttagcaaggttcagaagtccccgccagaacccgaaattatcaatcaggtgcagcaaaacgagctaaaaaaaatgttcatccaatgccagacccgtattatacagatctag

SEQ ID NO: 56868 - DNA, 1569 bp, Artificial Sequence
  Description of Artificial Sequence: Synthetic coding sequence
atgtgccatgacgtcatcttcatggcatggttaaaacagcaattctcagaatgcacattgatcgatgcaacgcatagggatgtggatgtgcttttgctcctctcaaattccgcgtactacgtagcctattatgatgacgaggtcgacaaagttaatcaatatcaacgattatccctggagaatttggagaagatcgaaattgggcctgagcccaccctgtttggcaagcccaagttctcatgtatgcgcctccactacaggtacaaggaggcatccgggtacttccatactctgcgcgcagttatgcgcaatccggaggaagacggcaaagatacgcttcagtgtatagctgaaatgctgcagataaccaagcaggctatgggatcggaccttccgatcatcgagaaaaagctcgaacgcaagtcttcaaaaccgcacgaggatatcatcggcatacgaagccagaatcaggggtcactcgcacaaggaaaaaatttcctgatgtccaagttctcctctttgaatcaaaaggtcaagcaaacaaagtctaacgtgaatatcgggaatctgcggaagttaggaaatttcacaaaacctgagatgaaggtgaatttcctgaaaccaaatctgaaggtgaatctctggaagtctgattccagcctggagacaatggaaaacaccggagtcatggataaggtgcaggctgagagcgatggcgacatgagcagcgacaacgactcttaccacagcgatgaatttctcactaacagtaagtcggacgaagatcggcagctcgccaacagtctggaaagcgtgggacccatagactacgtgctcccttcttgtgggattatcgcatcggcccctagattgggctcacgctctcagagcctatcaagtacggactcatcggtgcatgcgccttctgagatcaccgtcgcacatgggtctgggttaggcaagggtcaggagtcccccctgaagaagagtccaagtgccggagacgttcatatactcacgggcttcgccaagcccatggacatatactgtcaccggttcgttcaggacgcccagaacaaggtgactcatttgagcgaaactcgtagtgtctcccagcaagcttcacaggaacgaaatcagatgacaaatcaggtttccaatgagactcagtccgagagtacagagcagaccccctcccgcccatcacagctggatgtcagcctgtccgccaccggcccacaattcctctctgtggagccagcccatagtgtggccagtcaaaagacaccaacatctgcatcatccatgctggagctggagacgggcctccatgtgacaccttccccatctgagagctcaagcagtagagcagtctctcctttcgccaagatacggagctccatggtccaggtggcctcgatcacccaggcaggtctcactcacggaatcaactttgccgtgagcaaggttcagaaatcccctccagaacccgaaatcatcaatcaagtccagcagaatgaactgaagaaaatgttcatacagtgccagacccgcatcattcagatctag

SEQ ID NO: 56869 - DNA, 372 bp, Artificial Sequence
  Description of Artificial Sequence: Synthetic coding sequence
atggaaccacaggatttagagttggagctgtgcaagaaacaccactttggcatcaataagccagaaaaaatcatcccatcacccgacgactccaaatttctcctcaaaacatttacgcacattaaatctaacgtcagcgctcccaataaaaaaaaagttaaggaaagtaaggagaaggagaaattggaacggaggttgttggaggagctgctaaagatgtttatggatagtgaatcgttctactactccctcacatacgatctaaccaattcggtccagagacagagcaccggcgagagagacggcaggcctctgtggcagaaagtgcctttgactgccagacgggctgggtttgctttaggcaaaaaatag

SEQ ID NO: 56870 - DNA, 1128 bp, Artificial Sequence
  Description of Artificial Sequence: Synthetic coding sequence
atggagctgtttcaggcgaaagatcactatatcctgcagcaaggagagagagctttatggtgcagccgaagggatggcggattgcagttaagacctgctaccgacctcctgctggcttggaacccaatctgtttgggcctggttgaaggtgtaatcggcaaaatccagttacattcagacttgccctggtggctcattctaatacggcagaaggcgctcgtgggcaaactccccggtgatcacgaggtgtgtaaggtgacaaagatcgctgtcctatccctctccgagatggagccgcaggatcttgagctggagctctgtaaaaagcaccacttcggtattaacaagcctgaaaagattattcctagcccagatgactccaagtttttgctaaagactttcactcacataaagagcaacgtgtccgcacctaacaaaaagaaggtgaaagagtccaaggagaaagaaaagctggagaggcgtctgctggaggaacttctcaagatgttcatggactccgagtctttctattatagtctgacctacgacctgacaaattccgtgcaaaggcagtctacgggcgaaagggatggacgaccattatggcagaaggttgatgaccgctttttttggaacaaatatatgatccaggacttgacagaaattgggacacctgacgtcgatttctggattattcctatgattcagggtttcgttcaaatcgaagaactggtcgtgaattataccgagtcctctgatgatgagaagtcttcccctgagactccgcctcaggagtcgacctgtgtggatgacatccatccacgcttcttagtcgcactgatttctcgtcgaagccgccaccgggctggtatgcggtacaagaggaggggagtggacaaaaacggtaatgtcgccaactacgtggaaacggaacaactgatacatgtgcataatcatactctgagttttgttcagaccaggggttctgtgccagtgttttggagtcaggtgggatatcgttacaatccaaggccaagactggatcggagtgaaaaggaaacagttgcttacttctgcgcacacttcgaagaacagttaaacatttataaaaaacaacagcaaaaatag

SEQ ID NO: 56871 - DNA, 507 bp, Artificial Sequence
  Description of Artificial Sequence: Synthetic coding sequence
atgagcaaacgaaagtggaggggatttaggggggcacaacaggagagagcccagcccccagctgccagtccccagccctgtcctgcccctcacgccggacttcctggaggctctcgcagacgggcaccggcacccgctggacagcagcagatgagagccgagtcccgtagcggagcacagagacgcagggggtctgccagaaggggggcacatcgggaagccggaggctgtgtgcggggtaggacacgttctagtggcagtgagaggtctaatgccctgtggcaggccgtggatgccgcagaagcacttgctctctctagcccgctacgacgcccatgggatcaggcccagcacttcacaaaccccgctccattctccaaaggacctcagtctgctccaccttcgccccctgccggtcgtcggagaaggggcgctgatcttgccttgactccgctggccggtgaaggtcatactcgatggcgccagccaggaagacctggcaaatag

SEQ ID NO: 56872 - DNA, 3129 bp, Artificial Sequence
  Description of Artificial Sequence: Synthetic coding sequence
atggaactacagaaagggaaaggggcagctgccgctgcagccgctagtggagccgctggaggcggaggagggggagctggagccggtgcccctggtggcggacggcttttgctgagcacctctctggatgccaaagatgagctcgaggagcggctcgaacgttgcatgtcgattgtgacctctatgaccgcgggtgtgagcgaaagggaagccaacgatgccctaaacgcctacgtatgtaaggggctgccgcaacacgaagaaatctgtctgggtttgtttactctcatattaaccgagcccgctcaagcccaaaagtgctatcgcgacctggcgttagtgtctcgggacggcatgaacattgttttgaacaaaatcaatcagatcctgatggagaagtatctgaagctgcaagacacttgcaggacacagctcgtctggctggtccgtgagcttgtgaaaagcggggtactgggagcagatggggtttgtatgacatttatgaaacagatcgccggaggcgacgttaccgccaagaacatctggcttgctgagagtgtcttagacattctcaccgagcaacgggaatgggtgttgaaatccagcatactcattgcgatggccgtgtacacttacctgcggctgattgtagatcaccacggtaccgcgcaactgcaagcactgaggcagaaagaggtggatttttgtatctcacttctgcgcgaacggttcatggagtgcctgatgattggacgagatctcgttagacttctgcagaatgtggccagaataccggaatttgagctcctgtggaaagatattattcacaatccacaggcgctttctccccagtttacaggaattctgcagctgctgcagagccgtacaagtcggaagtttctcgcgtgccgtctgactccagatatggagaccaagctgttattcatgacctctcgtgttcgcttcgggcagcagaagcggtatcaggactggtttcagagacaatatctcagtacacccgattcacagtctctgcggtgtgatctcatccgttatatatgcggtgtggtgcatccttcgaacgaggtgctgtcgtctgacatcctgccgagatgggctataatcgggtggctgctcaccacttgcacgtccaatgttgccgctagcaacgcaaaactcgcccttttctacgactggctattttttagccccgacaaagattccataatgaatatcgagcccgctatcctagtaatgcatcacagcatgaagccacacccagccatcaccgccactttactcgatttcatgtgtaggataatccccaacttctaccccccattggaaggtcacgttcgccagggggtgttttcaagtctgaaccacattgtggaaaagcgggttctggctcacctcgcacctctcttcgacaaccctaagctcgataaggagctccgcgcaatgcttcgggagaagttcccagagttttgcagcagcccgtctccacctgtcgaagttaaaatagaggaacctgtgtctatggagatggataaccacatgtcagataaggatgaaagttgctatgataacgctgaggccgcattcagcgatgacgaggaggatctgaactccaagggcaaaaaacgggaattcaggtttcatcccataaaagagacagtggtggaggaacctgtagatattacaccttacctcgaccaactcgatgagtccctgcgagataaggtgttgcagctccaaaaagggagcgatacagaggctcaatgtgaggtcatgcaggagatagtagaccaggttctggaagaggattttgactccgagcagctgagcgttcttgcatcttgtctgcaggaactgtttaaggctcatttcagaggtgaggtcctgcccgaggagataacagaggagagccttgaagaatccgtcggtaaaccgctttacctcatcttcaggaacctgtgccagatgcaggaagacaattccagcttttctctgctgttagatctgctctcagagctctatcaaaagcagcctaaaataggctaccacttgctgtattatctcagagctagtaaggccgcagcagggaaaatgaatctttacgagtcttttgctcaggcaactcagctgggagacctccacacttgcctgatgatggatatgaaggcatgccaagaggacgacgtgcggctgctgtgccaccttaccccaagcatctacactgaattccccgatgagacattgcgctccggagagctgctgaacatgatcgtcgccgttatcgattccgcgcagttgcaggagttggtgtgccacgtgatgatgggcaacctagttatgtttcgcaaggacagtgtgctgaacatcctcatccagtccttagactgggaaaccttcgaacaatactgtgcttggcagctctttctcgcgcacaatattccactggagacaatcattccgatcttgcagcatcttaagtacaaggaacaccccgaggccctctcctgtctcctgctgcagctacggcgtgagaagcccagcgaagagatggtgaagatggttctttcgcgtccctgtcatccagacgaccaatttactacgagcatcctccgccattggtgtatgaaacatgacgagctgctggctgaacacatcaaatccttgctgatcaagaacaatagcctgccaagaaagagacagtctcttcgaagctctagctccaaactggctcagctcaccctcgagcagatcctggaacacctggacaatcttaggctcaacctgaccaataccaagcaaaacttcttcagtcagacgcctattctgcaagctctacagcacgtgcaggcttcttgcgatgaagcacacaagatgaagttttcggatctgttttcactggcggaggaatatgaagatagtagcaccaaacctcccaagagcagaagaaaggcggctctgtcctcacctcggtcgaggaaaaatgcaacccagccccctaacgctgaagaggaatcaggctcgagctccgcctctgaagaggaagacaccaagcctaaacctacgaaacgcaagcgcaagggtagtagcgctgttggctccgattctgactag

SEQ ID NO: 56873 - DNA, 1224 bp, Artificial Sequence
  Description of Artificial Sequence: Synthetic coding sequence
atggagtcggcaatcaccctctggcagtttcttttgcagctccttttagatcaaaagcatgagcatctgatctgttggacgtctaacgacggagagttcaaattgcttaaagctgaagaagtcgctaagttatggggccttcgaaagaataaaactaacatgaactacgataagctgagccgcgcactgcgttattactacgacaagaacatcatcaaaaaggttatcggccagaagttcgtgtacaaatttgtgtcattcccagagatacttaaaatggacccccacgcagttgaaatcagccgagaatccctgctccttcaagattccgattgtaaagccagccctgaggggagggaggcccataagcatggcctcgccgctttgagaagcacaagccgaaacgagtacatccactcgggcctgtactccagttttactatcaatagtctgcaaaatccacctgatgcatttaaggctatcaaaaccgagaaattagaagagccccctgaagatagcccgcctgttgaggaggtcaggacagtgattcggtttgtcacaaacaaaacagacaagcatgtgaccaggccagtcgtgtcacttcctagcacgagtgaagcggctgccgctagcgccttcctcgcaagcagcgtcagcgccaagatcagttcattgatgctgccaaacgccgcttctatttcgagcgctagccctttttcctcacggtctccttccctgtctcccaacagtcctctaccttccgagcatcgttctctgtttttagaggcagcttgccacgattcagattcacttgagcctttgaatctctccagtggcagtaaaaccaaatccccctctctcccaccaaaggctaagaagccaaagggattggaaattagcgctccgccactggtgctgtccgggaccgacatcggctcaattgccctaaattcgcccgctctaccgagcggaagcctgacccctgcgttctttaccgcgcaaacccccaatgggctgctactcactccctcgcctctgttgtcctcaattcacttctggagctctctcagtcctgtcgctcccctttcacctgctcggctgcaggggccttccaccctctttcagttccccacactgctcaatggtcatatgccggtgccaattccatccttggaccgcgcagccagccctgtcctgctctccagcaactcacagaagtcttag

SEQ ID NO: 56874 - DNA, 813 bp, Artificial Sequence
  Description of Artificial Sequence: Synthetic coding sequence
atgctagagggacaggtggattcccttagcgtgactttgggtcctctggggctgccggaactcatggtcagtcagcccggatgcgcctacgccatcctgttgtgtacatggaagaaagacactggttctccccctgcctctgaagggcctactgacggcagcagggagacacccgctgcccgtgatgtcgtgctacaccagacttcgggccgtatacataacaagaacgtctcaacccatcttattggcaacatcaaacagggccatgggacagaatcgtctggctccggcctgtttgccctgtgtaccctcgatggcactctgaagctgatggaggagatggaggaagccgataaactgctctggtcggtccaggtggaccaccagctttttgctctcgaaaaacttgatgttacaggcaacgggcacgaagaggtcgtggcctgtgcctgggacggccagacctacatcattgatcacaaccgcactgtggtaaggtttcaggttgatgagaatattcgcgcattttgtgccggactgtacgcttgcaaggaaggtcgcaatagtccttgtctcgtgtacgtgacctttaaccagaagatctacgtttactgggaggtgcagctggagagaatggagagcaccaatctcgttaaactgttggagaccaagcccgaatatcatagcctgttgcaggagctgggcgtggaccccgatgacctgcctgtgacacgtgcgcttctccaccagactctatatcacccagatcagccgcctcagtgcgctccgagctctctccaggatcctacatag

SEQ ID NO: 56875 - DNA, 1008 bp, Artificial Sequence
  Description of Artificial Sequence: Synthetic coding sequence
atgcctacttttgccggaagtcaggagagtcgcagtcagtggattctggagcacatccctagagattgggacggagacggatgcagagagcttgtagtcgggtacactgaccgcgtagtaagggccttccggtgggaggagctcggtgaaggaccagaacacctgactggccaactggtgtccctgaagaaatggatgctagaaggacaggttgactctttatcagtgactctgggcccactagggctgccagagctaatggtgtcccagcccggttgcgcttacgccatcttgttatgcacctggaagaaagatactggatctccaccggctagtgaagggccaactgatggctcacgagaaacgcccgcagcacgcgatgtagtgctgcaccaaaccagcggtagaatccataataagaacgtgtcaacacatctcatcggtaacataaaacagggccatggcacagagagctctggaagtggtctcttcgccctctgtacactggacggaactcttaaactgatggaggagatggaagaggccgacaagctgctttggtctgtccaagttgatcatcagctctttgccctagaaaagctagatgtgacaggcaacggccacgaagaggtggttgcatgcgcgtgggatggtcagacttacatcattgatcataaccgtaccgttgtcagatttcaagtcgacgagaatattcgcgctttttgcgccggtttatatgcctgcaaagaaggccgtaatagtccatgccttgtgtacgtgaccttcaatcagaaaatctacgtgtactgggaagtgcagttggagcgaatggagagcacgaacctggtgaaactcctggagacaaagccagaatatcatagtctgttgcaggaactcggtgtggacccagatgatttgcctgtcaccagagctcttctgcatcaaacactgtaccatccagaccagccaccccaatgcgccccttcctcattacaggaccccacatag

SEQ ID NO: 56876 - DNA, 693 bp, Artificial Sequence
  Description of Artificial Sequence: Synthetic coding sequence
atgaaactgattgtcggtattggaggaatgacgaacggcggaaaaaccactcttactaattccctgctccgggctctccccaattgttgcgtcatccaccaggacgatttctttaagccccaagaccagatcgccgtcggggaggatggcttcaaacagtgggatgtattagagtccttagatatggaggctatgttggataccgttcaggcctggttgagttccccccagaaattcgcccgtgcacatggagtatccgtacagccggaagccagcgacacacacattctccttctcgaaggcttccttttgtactcctataaaccactggtggatctgtatagccggaggtattttttgactgtgccgtatgaggagtgtaaatggcgcagaagcacacgaaactatactgtccccgatccacctggcttgttcgacggccatgtctggcctatgtatcagaagtaccgtcaggagatggaagcaaacggcgtcgaggttgtgtatctcgacggaatgaagtcacgagaggagctattcagagaggtgctcgaggatatccagaatagtttactgaatcggtctcaggaaagtgcaccaagtccagctcgacctgcacgcacacagggcccagggagaggctgcggacatcgcacagccaggcctgctgccagtcagcaggattcaatgtag

SEQ ID NO: 56877 - DNA, 561 bp, Artificial Sequence
  Description of Artificial Sequence: Synthetic coding sequence
atgaagttaatcgtgggtatcgggggtatgaccaatggtggcaagacgaccctgactaactcactcttgagggctctacccaattgctgtgtgattcaccaggacgattttttcaaaccccaggatcagattgccgtgggagaggacgggttcaaacagtgggacgtgttggagtcactggatatggaagccatgctcgatacagtacaggcttggctgagttcaccgcaaaagtttgcccgagctcatggtgtgagtgtgcagcctgaggccagtgacactcatatactgctactggaaggtttcctgctgtactcctacaagtaccagaagtaccgccaggaaatggaggccaacggtgtcgaggtagtgtatctggatggaatgaaatctcgggaagaactattccgcgaggtgctcgaagatatccaaaacagcctactcaaccggagtcaggagtctgctccttctcccgctaggccagcccgaacgcaggggcctggaagaggctgtggccatcgcactgctcgcccagcggcttcccaacaggactccatgtag

SEQ ID NO: 56878 - DNA, 1425 bp, Artificial Sequence
  Description of Artificial Sequence: Synthetic coding sequence
atgagtgaggagtctgacggcaaactaatagaggatagcctgatccagttgcggtgtcactttacctggaagctcctgatcgaagcccctgagatccctgatctagagaaccgcatctgggaggagatccaattcctggatacaaagtataatgtgggtattcacaacctcctggcatacgttaagcacctgaaaggccaaaatgaagaagctctggtgagcctcaaaaaagccgaggacctgattcagaaggagcacgccaatcaggcagacatcagaagtctcgtgacctgggggaatttcgcctgggtgtactatcacatgggcagactcgccgaagcgcaaacatacctagataaagtagagaatacatgtaagaaattcgccaacccgagtcgctatagaatggaatgtccggaagtggattgcgaagaggggtgggccctcgccaagtgtggaggcaagaactacgaacgcgctaagacatgctttgagaaagccctggagggcaaccccgagaatccagagttcaacaccggatatgctattacggtgtacagactggataaattcaatactgctagcgggagaaataaggcctttagtctccacgtactaaaacgagcggtacgactaaatcccgatgacgtgtatatccgagtcctgctggccttgaagctccaggacgagggccaggaagctgagggggaaaagtacattgaagaagctctcactagcatttcctcccaggcttatgtcttccaatacgccgctaaattctatcggaggaaggggagtgttgataaggcgctggaactgctcaagatggcgctggaaaccacacccacctcggctttcctgcatcaccagatgggattgtgttaccgggctcagatgatacagataaaagaagccacaaattggcagcccagaggacaggaccgggagaccgttgatcggctggttcagctggcaatctgcaaattcgaaaagactatcatgcttaagaggacattcgagatggcttatgtagacttagctgaaacctatgcagagattgggcatcataggaaagccgaagagcactttcagaagggattaaggatgaaaatcttcgaagaccagctgaaacaagagattcattaccactacggcaggttccaagagcaccacggtaaatctcaggataaagccatcacacactacctcaagggacttaagattgaaaagatgtctcactctcgggagaaacttttaaacgcactggagaaactagcaaaacggtgtatccaccaaaacgtcagagtggtcgaatctgtctccctgctgggacttatccataagctgaagggagaagtctccgatgccctgctttgttacgagagagctcttagactggctgcagatctcaatcctatcttctag

SEQ ID NO: 56879 - DNA, 1449 bp, Artificial Sequence
  Description of Artificial Sequence: Synthetic coding sequence
atgtctgaaatccggaaggatacccttaaagcaattctgctcgaactggaatgccacttcacctggaacctcttaaaagaggatatagatctgtttgaggtggaagacacgatagggcagcagctggagtttctgacaactaagtcacgtctggcattatacaacctgctggcatacgtaaaacatctaaaaggccagaacaaggatgcactcgagtgtctcgagcaagcagaggagatcattcagcaagaacattcagataaggaagaagttaggtccctggtgacttggggcaattatgcatgggtctattatcacatggatcaattagaggaagctcagaaatatacgggcaagattggaaacgtgtgcaaaaagctctcatcaccttctaattacaagctggaatgccccgagactgactgtgagaaaggatgggctttgctgaagttcggcggaaagtattaccaaaaggctaaggctgcttttgagaaagcactagaagttgagccagataatcctgagttcaatatcggctatgccatcacagtctacaggcttgatgattccgatcgtgaggggagtgttaagagtttctccctaggccctttgcgaaaagccgtaaccctaaatccggataacagttatataaaagtgttccttgccctaaagctccaggacgttcacgcggaagctgaaggcgagaagtatattgaagagatcctggaccaaattagctcccagccatatgtcctgcgttacgctgccaagttttacagaagaaagaacagctggaataaggcactggaactcctgaagaaggcgctcgaagtaactcctacaagttccttcctgcatcaccaaatggggctttgttaccgcgctcaaatgatccagattaagaaggccactcacaaccggccaaaggggaaagataagctgaaggtggatgagctgattagttctgcaatctttcattttaaagcggcaatggaaagagattccatgtttgcctttgcatatactgacttggccaacatgtatgccgagggaggccagtattccaacgccgaggatatctttaggaaagctctgaggctggaaaatattacagatgaccacaagcatcagattcattaccactatggcaggtttcaagagttccacaggaaaagtgaaaacaccgccattcaccattatttagaagccctcaaggtgaaagataggagtcccctgcgaacaaagctgacatccgctctaaaaaagctatccacgaaacggctgtgccataatgccctcgacgttcaatcactgtcggcactcggtttcgtgtataagctggaaggtgaaaagcgacaggccgcagagtattatgagaaggcgcaaaagatcgatcctgagaatgctgagtttctcaccgccttgtgcgagctgcgtctgtcaatatag

SEQ ID NO: 56880 - DNA, 1305 bp, Artificial Sequence
  Description of Artificial Sequence: Synthetic coding sequence
atgagcgagatccgcaaggatacgttgaaggccattctgctcgagctcgaatgccacttcacttggaaccttttaaaggaggacattgacctgtttgaggtggaagataccatcgggcaacagctcgaatttctgacaaccaaatctcgacttgctctatacaatctgcttgcctatgtaaagcatctcaaagggcagaataaggatgccctggagtgtctcgagcaagctgaggagattatccagcaagaacactccgataaggaggaagtccggagcttggtgacctggggcaactacgcttgggtatattaccacatggaccagctggaagaagcccaaaaatacacaggcaaaatcgggaacgtatgcaagaagctgtccagcccttctaattataagttggagtgccctgagaccgattgcgaaaaaggctgggcccttctgaaattcgggggaaagtactatcagaaggcggtgactttaaatcctgacaacagttacatcaaggtgttcctagccttgaagctccaagatgtacatgccgaggccgagggcgagaaatacattgaagaaattctggatcaaatcagcagccaaccctacgtgctccgttatgcagcaaagttttaccgccgtaaaaactcatggaataaagcactggaacttcttaaaaaagccctggaagttactccgacgagctcattcctgcatcaccagatgggactctgctacagagcccaaatgattcagataaaaaaagccactcacaaccggccaaagggcaaggataaactgaaagtagacgagctgatttcaagcgcaatttttcatttcaaagcggcaatggaaagggacagcatgtttgcatttgcgtacactgatctggcgaacatgtatgccgagggaggtcaatattctaatgccgaggatatatttcggaaagccctgcgtctggagaacatcacagatgatcacaaacaccagatccactaccactatggacgctttcaggagtttcataggaagagcgaaaacaccgcaatccatcactacttggaagccctcaaggtgaaggaccgaagtccgttgcgcactaaactcacatctgccctcaaaaaactgagtacaaaacgcttgtgccacaacgccctggacgtgcagtctctgtccgccctgggcttcgtctacaagctcgaaggggaaaagcgtcaagccgcagagtactacgagaaggcgcagaagattgaccccgaaaacgcggagtttctgacggccctctgtgagcttcggctttctatatag

SEQ ID NO: 56881 - DNA, 2061 bp, Artificial Sequence
  Description of Artificial Sequence: Synthetic coding sequence
atgaagccaccttttctgcttgctttggttgtttgctcggtggtgtctactaaccttaagatggtctccaaacggaattccgtggatggctgcatcgactggagtgtggatttaaaaacttacatggcactagctggtgagcccgtgagagtaaaatgtgcccttttctactcctacatcaggactaactatagtacagcccagtccacgggactgcggctaatgtggtataagaataaaggcgacttggaggagccaataattttttctgaggtacgaatgagtaaggaagaggattccatctggttccattccgctgaagcccaggattccggattctacacatgtgtgctacgcaattctacttattgcatgaaggtctccatgagtctcaccgtagccgagaatgagtcaggcctttgttataacagcaggatccgttatttggaaaagagcgaggtgaccaaacggaaggaaatttcttgtcctgatatggacgatttcaagaaaagcgaccaggagccggacgtggtttggtataaagaatgtaaacccaaaatgtggagatctataataatacagaaggggaacgcgctcctgatacaggaggtgcaggaagaagatggtggaaattatacctgcgagctgaaatatgaaggcaaactcgttcgcaggaccacagagcttaaggtcactgctctgctgacagacaagccacccaagcccctgtttcccatggagaatcagcctagtgtgatcgacgtgcaattggggaagcccctaaacatcccttgcaaagccttcttcggtttcagcggtgaatccggaccaatgatttattggatgaagggcgagaaattcattgaggagttggcaggccatatccgtgaaggcgagattcgccttcttaaggaacatctgggcgaaaaggaagtggagctggcactaattttcgattctgtcgtggaagctgacttggctaattacacctgccacgtagagaacaggaacgggcgaaagcacgcatccgtgctccttcggaaaaaagatctcatttataagattgaacttgccggtggcctgggagcaatctttctcttgctggtactgctggtagttatatacaagtgttacaacatcgagcttatgctcttttacagacaacactttggtgcggacgaaacgaacgatgataataaagaatatgatgcatacctaagttacaccaaggtagatcaggataccctcgactgcgataaccccgaagaggaacaattcgcattggaagtcttacctgatgtgctggagaagcactatgggtataagctgtttattcctgagcgcgatctgatacctagtgggacctacatggaggaccttacacgatacgtcgagcagtcacgacgtctcataatcgtgctgacacccgattacatcctgagaagaggatggtccatattcgaactcgaaagcaggctccacaacatgttggtgagtggcgaaatcaaagtaattctgatcgaatgcaccgagttgaagggtaaagtgaattgtcaggaagttgaaagcttgaaacggtccatcaagctgctttccttgataaagtggaaggggagcaaatcctccaagttaaacagcaagttctggaagcatctggtgtatgaaatgccaatcaaaaagaaagaaatgttaccacggtgccacgtcctggattctgcagaacagggactgtttggtgagctacaacctattccctctattgccatgacctctaccagtgctaccctggtgagttctcaggctgatctgccagaattccatccttccgatagcatgcaaataaggcattgctgcaggggctataagcacgagatcccagccacaactctgcctgtgccttcacttgggaaccaccacacttactgtaatctgcctctaactctgctgaacggtcagctacctctcaataatactctcaaggacacccaagagtttcacagaaactcatctctcctgccactctcttctaaggagctgtcctttacaagcgatatttggtag

SEQ ID NO: 56882 - DNA, 1143 bp, Artificial Sequence
  Description of Artificial Sequence: Synthetic coding sequence
atggccttcgtgtgcctggcaattgggtgcttatatacctttctgattagtaccaccttcggctgcacctcaagctccgacacagagatcaaggtgaaccctcctcaggatttcgagatcgtagatccgggataccttggctatttgtatttgcaatggcagccaccactgtctttggaccacttcaaggagtgcactgtggagtatgagttgaaatacagaaatatcggttccgagacctggaagacgattatcactaagaatttgcattacaaagacggattcgacctgaacaagggcatcgaagctaaaatacatactctcctgccatggcaatgcaccaacggtagtgaagtgcagtcctcgtgggccgaaactacctactggattagtcctcagggcatacccgaaactaaggttcaggatatggactgtgtgtattataattggcagtacctgctgtgctcttggaagcctgggattggtgtgcttctagatactaattataatctgttttactggtacgagggcctggatcatgcgctgcagtgtgtggattacattaaagcagacggacagaatatcggatgccggttcccctatctggaggctagcgattataaggacttttacatttgtgtcaatggatcttctgagaacaagcctatccgatcatcctacttcactttccaacttcagaatattgtaaagcctctccccccagtctatttaactttcacccgcgagtctagttgcgaaatcaaattaaagtggtccatccccctcggacccatcccagccagatgttttgactatgaaatcgaaatccgcgaagatgatacgactttggtgaccgcaactgtggagaacgaaacctacactctgaaaaccaccaacgagacaagacagctctgttttgtcgtgcggagcaaagtgaatatttactgttcggatgatggaatctggagcgagtggagcgataaacagtgctgggagggagaggacttaagtaagaagaccctgcttagattttggctgcccttcggctttattttgatacttgtcatcttcgtaacggggctgcttttgagaaaacctaacacctaccctaagatgatccccgagttcttttgcgatacatag

SEQ ID NO: 56883 - DNA, 1011 bp, Artificial Sequence
  Description of Artificial Sequence: Synthetic coding sequence
atgagccggtctgtacttgaagccttaaccagtagtactgcaatgcaatgcgtgcctagcgatggctgcgctatgctactaagagtgagagcatcaataacactgcacgaacgtcttagaggactcgaggcctgcgccatgtctttagacacacaggagacccagtgtcagagtgtctgggtggcgagagcgtcccaccgtcagcaggggggtcagcagttacaggtgcacttcggttgttttgccgtgagcgttgcgcagcatctgtatgttaccttgagaacaattccccatttctgcggcgttcagctggaccagaggcatcttgttgaagccggtaaactctcgtattgggtggatagacggaggaaggccatcctggttcaggtgccccgtgcaagcgggtctccagattactaccttaggctatgtctgaaaagattcacgtgtgaagacgccggtgctccagtgagggtgaccgctaattctgtatcccaggctgtttttctcccttacagtcaggaattaccctgtttgtgtttggaaggatggagcgcaactcctgatgccgttagaattcagatatgcccctttgaaaatgatactgaagcccttgaagttttgtgggatacggtctactaccaccccgaatcacagactctctcttgggagccagcgtgccctgtgtcaggccatgtgagcctgtgctggcggccagggcctggcgctggatgcagaaagttacaacagtcttcgcagttggttcatcgcagagtgcagtatcctttggtggacacgcaacctcaactctgcctcaaattcagcacttcatgggggagttgggtcaggtgcccttttgagcaaaggcgattccccacgccacccacctcccgatgtacatgcgtcaccgggggttcccacagtagcctgccagcaaacgcccattcccggccagcccgttctctgcaaccacaggtaacatggcaacccccattgctgctgccttcctag

SEQ ID NO: 56884 - DNA, 1011 bp, Artificial Sequence
  Description of Artificial Sequence: Synthetic coding sequence
atgagtcggtctgtcttagaagcccttacatcatcgactgccatgcagtgcgtaccctccgatggctgcgcaatgctgttaagggtgcgcgcatcaataacacttcacgagaggctgcggggattagaagcctgcgccatgtccctggacacccaggaaacacaatgccaaagtgtttgggtggcacgcgcaagccatcggcaacaaggcggtcagcagctgcaggtgcatttcggctgcttcgccgtttccgtggcacagcacctttatgtgacgctccgcacaataccgcacttctgcggggtgcagttggatcagcggcatctggtggaggccggtaagctgagttactgggtggaccgcagaagaaaggcaatcttggtccaggtccctcgcgcatctgggtcacctgactattacttaaggctgtgtctcaaacgattcacttgcgaagatgccggtgcccctgtgcgtgttactgccaactctgtgagtcaggcggtgtttttgccttacagtcaagaactaccttgtttgtgccttgaggggtggagcgccactcctgacgccgtgagaatccagatctgtccctttgaaaacgatactgaagccttggaagtgctttgggacacagtgtactatcatcctgaatctcagacgctgtcttgggaaccagcttgccccgttagcggacacgtgtccctctgctggcgccctggccctggtgccggatgtagaaagctgcagcagtcatcccagctcgttcacaggcgcgtccagtacccactggtggatacccaaccacagctgtgcctgaagttctccacgagttggggctcatgggtgaggtgtccattcgaacagaggaggttccccacaccccctacttctaggtgcacttgtgtgacagggggaagccactcatcactacctgcaaatgcccactccaggcctgctcgatccctacagccgcaggtcacctggcaaccgccactgctgctgccctcctag

SEQ ID NO: 56885 - DNA, 471 bp, Artificial Sequence
  Description of Artificial Sequence: Synthetic coding sequence
atgcggggaggaggtggagtccccctcattcacttttccctccctgtctgctctccctttctttatctgtccttgcctgaaccccaggcaaagcaccagcggagaccaggttccgaacagggtgcacacgttgcgtctgtggaccaccctcccgcatgtacagcattgggcggaccgagaaacgccagaccatccgcaggtgggtcgctgttcacatctctccagccatctgaggatacatctgagtggggcgcagaacctgcggatggagaaaataagaacgacgacacattatacaccccagacgatctcagtataccaggccatttcgtgcccactgtgtgcccagctgagacgttaggctgctccagactagaattatctgtgatcggctttgaggaggggccaagcatggggactgctgtgtttcaattgcaatatctgctagatcttctgggatctcgactctag

SEQ ID NO: 56886 - DNA, 1386 bp, Artificial Sequence
  Description of Artificial Sequence: Synthetic coding sequence
atggctttggccttcgggtgtccccctggcggtgggggaggagggtgtcctggcggagggggaggaggagggggagccggaccaggccctagtccagtgaccgccgctttgagagatgatcttgggagcaacattcacctgctgaagggcctgaatgtcaggttcaggtgtttccttgctaaggtgcatgagttggagcgcagaaaccggcttctcgagaagcagctcgaacagcagcagtcagaaagagaaaggagattgcgatataaaacattcagccgcgaacaagcagtacagaccggcccagagctactccggcctcccgcaccagggggtggacatggcctatcctcaggtgccgcagccggagctaacgccaacgccgtagctttggggggtcttcctcccggtggcggaagccacccacagcactatggacggctcccgggtacaatttggtcatacacccaggtgcggaggacaggtggaggaggtgtcgagaccgtgcagggtcctggggtgtcatgggtgcatcctgacggtgtaggggttcaaattgacaccatcacccctgaaatacgagcgctctacaacgtgctggccaaagtaaagagggagcgagatgagtacaaaaggcggtgggaggaagagctggccaagcggatgaacctgcagacaatggtcgataccctgcaggaggccgcacaagaggccgatgccattcaggaggagatgaacgagaagattgagaggctgaaagctgaactggtcgttttcaaagggctaatgagtgacgttgtgccgaaaaaaaaagaacgtaaggttgccagtgacgacgatattagtgaacaggacggtgaggtcaatcgattcagcgacgatgaagtcggtagcatgaacatcacagatgagatgaaaaggatgttcaaccaattgcgagagacctttgatttcgacgacgattgcgattctctgacgtgggaggagaatgaggacaccctccttctttgggaagacttcaccaactgcaatcccactatcgaccttcaaggagaacaggaggaaaatctaggcaacctgatccatgagaccgaatcatttttcaagacccgggacaaagaataccaggaaacaattggacagatcgagcttgagctggctactgcgaaatccgacatgaatcggcaccttcacgaatatatggaaatgtgctccatgaagaggggactggatgtgcaaatggagacatgtcggagactgattaagggcagcgccgacaggaattcaccgtctccatcctctgtggcatcaagcgattcggggtctaccgatgaaatacaggatgaatttgaacgggaagccgatgtggaaccaatggtgtcctag

SEQ ID NO: 56887 - DNA, 1554 bp, Artificial Sequence
  Description of Artificial Sequence: Synthetic coding sequence
atggtcaattcgttgctttttggcgagatggcactcgcgtttggctgccccccaggcggaggaggtggagggtgccctggcggagggggtgggggaggcggagcgggtcccggaccaagcccagtgacagcagcactgcgtgacgacctgggctctaatatccacttgctgaaggggcttaatgtgagattcaggtgcttcctggccaaagtacacgaactggagcgacgcaataggctgttggagaagcagctcgaacagcaacaatcagagagagaacggagactacgctacaaaactttttcccgggaacaggctgtgcagactgggcctgagttgctcaggccacccgcaccaggcggagggcacggtctgtcttctggcgctgctgctggcgctaacgcaaacgccgtggccctggggggtctccccccaggtggcggttcacatccacagcactatggcagactgccagggacaatctggagttatactcaggttcgccgtaccggaggagggggtgtcgagaccgttcaaggccctggcgtgagctgggtgcatccagatggtgtgggggtccagattgatacaattacaccagagattagggccctgtacaatgtgctggccaaggtcaagcgtgaaagagacgagtataagagacgttgggaggaagagctggcaaaacgaatgaacttgcagacaatggtggatactctccaagaagctgctcaggaggcggatgcgatccaagaagaaatgaatgaaaaaatagaacggctgaaggcagaattggttgtgttcaagggcttgatgtctgaccctatgacggacctggatacgaaaatacaggaaaaggccatgaaagtggacatggacatatgtcggaggatcgatatcacggccaaactttgcgacgtggcgcagcagagaaattctgaagatgtatcaaaaattttccaagttgtgcccaagaaaaaggagcgcaaggttgcctcagatgacgacatcagtgagcaggatggtgaggttaataggttttccgacgacgaagtgggctcaatgaacattacggatgaaatgaaaaggatgttcaaccaacttcgggaaactttcgactttgatgatgactgtgatagcctgacttgggaggaaaacgaggatactctcctcctgtgggaggatttcacgaattgtaaccctacaatcgatctgcaaggcgagcaggaagagaatttgggtaatctgatacatgagactgaatcttttttcaagactcgcgacaaggaataccaggagacaatcgggcagatcgaactggagctcgccacagccaagtccgatatgaatcggcacctccatgaatacatggagatgtgtagcatgaagagagggcttgatgtgcaaatggaaacctgtcgcaggctcatcaaaggatcagcagatcgtaattctccatctcctagcagtgttgctagctcagattctggcagtaccgacgaaatccaggatgaattcgaacgggaggctgatgttgagccaatggtatcatag

SEQ ID NO: 56888 - DNA, 1971 bp, Artificial Sequence
  Description of Artificial Sequence: Synthetic coding sequence
atggccaggatgtgcgtcaagacacagaggctcgacgtggcgaaggtttgtttgggaaatatgggacacgcacgaggagccagggccttgcgggaagctgaacaggagcccgagctggaggctcgagttgcagtgctcgcaacgcagctcggtatgttggaggatgcagaacagttataccggaagtgtaaacgtcatgacctcctgaataagttttatcaggctgcaggacgttggcaggaggcactacaggtggccgagcaccacgacagagtgcatcttcggtcgacctaccatagatacgccggacacctagaagcttccgccgactgctcccgcgctctttcatattacgagaagtccgatacgcaccgctttgaggtgcctcgaatgctgtctgaagacctcccaagtctcgaactgtacgtgaataagatgaaagataaaacgttatggcggtggtgggcccaatatttggaatcccagggagagatggacgcagccctgcactactacgagctggccagagatcacttctccctcgtaagaattcactgctttcaggggaatgtgcagaaagccgctcagatcgccaatgaaactggaaacctggccgcatcgtatcaccttgcaaggcagtacgagagtcaggaggaggtgggccaggccgtccacttttacaccagagcccaggccttcaagaacgccatcaggttatgcaaagaaaacggcctggacgaccagctcatgaatttggccctactcagctccccagaggatatgatcgaagccgcaaggtactatgaggagaaaggcgtccaaatggaccgagctgtgatgctgtatcacaaggccggacacttttcaaaggcgcttgagctcgctttcgcaactcaacagttcgtggctctgcagctcatcgccgaagaccttgatgagacaagcgaccccgctcttctggctcgatgttccgatttcttcattgaacattctcagtatgagcgggctgtggagttgctgctggcagcacgtaaataccaagaagccctgcagctctgcttaggccagaatatgagcattactgaggaaatggcagagaagatgacagtcgcgaaagattcctcggatcttccagaagagtctagacgggaattactggagcagatcgccgattgctgcatgaggcaggggtcttaccacctggcaactaagaagtatactcaggctgggaacaaactcaaggcaatgagggcccttctgaagagcggggacactgagaagattacgttcttcgccagcgtctctcggcaaaaagagatttacattatggctgccaattaccttcagtcattggattggcggaaggagcccgaaatcatgaaaaatattatcggcttctacacgaaaggaagggctctggatctgcttgcgggattctacgacgcctgcgcccaagttgagattgatgagtaccagaattacgataaagcccacggggctctcaccgaagcctacaagtgtcttgccaaggccaaagctaagagcccactcgaccaggagacacgcctggcacagttgcagagcagaatggctttagttaaaaggttcatccaggccaggcgaacatacactgaagatcctaaagagagtattaagcagtgcgaactgctcctcgaggagcctgacctcgactctaccatccgaatcggggacgtgtatggattccttgtcgaacattatgtgagaaaagaggagtaccagacagcctaccgtttcctggaggagatgaggcggcgattgcccctcgcaaacatgagctattatgtgagccctcaagccgtagatgcggttcatcgcggtctcggtttgcctctcccccgaacggtcccggaacaggtgagacataattctatggaagacgctcgagagttggacgaggaagttgtggaagaggcggacgacgatccgtag

SEQ ID NO: 56889 - DNA, 4389 bp, Artificial Sequence
  Description of Artificial Sequence: Synthetic coding sequence
atggctctctattatgatcaccagatcgaggccccagatgctgcaggaagcccttctttcataagctggcaccccgtgcatcctttcctcgccgtggcatatatttcgacaacctcaactgggagcgtcgatatctacctcgagcaaggagagtgcgtgcccgatacccatgtagaaaggccattccgtgtcgccagcctgtgttggcatccgacacgcctggttcttgcggttgggtgggaaacaggggaggttactgtcttcaataagcaggataaagagcaacacacaatgccattaactcacacggcagacatcacggttctaagatggtcaccttcagggaactgtctgctctccggtgaccgcctgggagtgctgctgctctggcgactcgaccagagaggacgtgtacaaggcacacctctgctgaagcacgaatatggcaaacacctgacccactgtatattcagactccctcctccaggtgaggacctggttcagttggcaaaagctgccgtgtcgggcgacgagaaagcactggatatgtttaactggaaaaagtcctcctcaggctccctgttgaaaatggggtctcatgagggcctacttttctttgtgtccctaatggatggaaccgttcactacgtggacgagaaggggaaaaccacacaggtggtcagcgccgacagtacaattcaaatgctgttttacatggaaaagcgggaggccttggtggttgtgacagagaaccttagacttagtctttatacagtcccaccagagggaaaggccgaagaagtgatgaaagttaaattgtccggcaagactggcaggagagcagatatcgctttaatcgaaggctctttgctcgtgatggctgtgggggaagctgctttgcgcttctgggatatcgagcgtggtgaaaactacatcctatctcccgacgaaaagttcggcttcgagaaaggagagaacatgaattgtgtctgttactgcaaagtgaaaggcctgttggcagccggtacagatagaggtcgggttgctatgtggcgtaaggtcccagactttctcggttcacctggtgccgaggggaaagaccggtgggccctacagacaccgaccgagctgcaaggcaacataacacaaattcaatggggatcaaggaaaaatctactggccgttaacagcgttatctctgtcgctatattgagcgaacgagcaatgtcaagccacttccatcagcaggtggcagcaatgcaagtgtctccctcattgctcaatgtctgctttctgagcaccggcgtcgctcactcactaagaaccgatatgcacatttccggggtgtttgccacgaaggatgccgtggcggtttggaatgggagacaggttgctatatttgagctcagtggcgctgcgatccgtagtgctggcacgttcctctgcgagacacccgtgttggcaatgcatgaagaaaacgtgtacactgtcgagtcgaatcgcgtacaggtaagaacatggcaaggcactgttaagcagctcctactgttttctgagaccgagggaaatccctgcttcctggacatttgtggaaatttcctcgtagttgggactgacctagcccactttaagagcttcgatctgtcacgcagggaggcgaaggcccactgtagctgtaggagcctcgccgagctggttcccggagtgggaggcattgcctcgttgcgttgcagctctagcggcagtactatttcaatcctgcccagcaaggctgataattcccctgactcaaagatctgcttctatgacgtggaaatggacacagtcacagtgtttgacttcaaaaccggccagatcgatcgtcgtgagaccctgtcttttaacgagcaagaaacaaataagtctcatctgttcgtagatgaaggactgaaaaattatgtgcctgtcaatcatttctgggaccagagtgagccccgactgtttgtgtgcgaagcagtgcaggaaactcctcggagtcaaccccagtctgccaacggacagcctcaggatggcagggccggtcccgctgctgacgtgctaatactgtcattctttatcagcgaggaacacggctttcttttgcatgaaagctttccacgaccagcaacctcacacagcttgctcggtatggaagttccttactattattttacaaggaaaccagaggaggcagaccgagaggatgaagtggagcctgggtgtcatcatattccccagatggtcagtaggcggccactacgggactttgtgggtcttgaggattgcgacaaggcaactcgggacgccatgctccactttagctttttcgtaacaatcggggatatggatgaggccttcaaatccatcaaactcattaaaagcgaagcagtgtgggaaaacatggctagaatgtgcgtgaagacacagaggttggacgttgctaaggtgtgcttagggaatatggggcacgcaaggggagctcgggcattgcgtgaagcagagcaggagcctgagcttgaagcacgagtagccgtcctcgctacacaacttggcatgctcgaagatgctgaacagctctatcgtaagtgcaagcggcatgaccttctgaataaattttaccaggcagcaggaaggtggcaagaggcactgcaggtcgccgagcatcacgaccgggttcatttgcgatctacttaccacagatatgccggacatcttgaagcctcagctgactgctcccgagctctgagctactacgagaaatcagatacccaccgcttcgaggtaccacgaatgctctcggaggacctccctagtctcgaactctatgtgaacaagatgaaggacaagactttgtggcgatggtgggcccagtatcttgagtcccaaggtgaaatggacgctgcgctgcactattacgaactggcacgggaccatttctctctggtgaggatccattgttttcaaggcaatgtgcagaaggccgctcagattgctaatgagactggcaatctagccgcttcttaccacttggccaggcagtacgaatcgcaggaggaagtaggacaggcagtgcacttttacacccgcgcacaggcattcaaaaatgcaatccggttgtgcaaagagaacgggctcgatgatcagttgatgaatctcgccctgctgtctagcccagaagacatgattgaggctgcaaggtactatgaagaaaagggagtccagatggatagagctgtgatgttgtaccataaggctggtcacttttcgaaagctctggagctggcatttgccacccagcagtttgtcgctttacagcttatcgccgaggatctggacgaaacaagcgacccggctttgctggctagatgttctgatttctttatcgaacatagtcagtacgaaagagcagtcgaattactgctggccgctcgaaaatatcaagaggctctccagttgtgcctcggtcagaacatgagtattacggaggaaatggctgagaagatgacagtcgccaaagacagttcagacttaccagaggagagccggcgagaattgttagaacagatagccgactgttgtatgagacaggggagctaccatcttgctactaaaaaatacacccaggccggtaacaaattgaaggccatgagggcccttctaaagtcaggggacaccgaaaagataacatttttcgcatcagtgtcccggcagaaagaaatctatatcatggccgctaattacctccagtcgctggactggcgaaaggaaccagaaattatgaagaacattattggattttacacaaagggacgtgcattggatctcctcgctggcttttacgacgcctgcgctcaggtggagattgatgaatatcaaaattacgacaaggctcacggggcacttacagaagcgtacaagtgtcttgccaaggctaaggcaaagagccccctggaccaggaaaccaggttggcccaactgcagagccggatggccctggtgaagagattcattcaggccaggagaacttatacagaagatcctaaggaatcaattaaacaatgcgagctcttgctggaggagcctgacctggatagtacgattagaattggggacgtgtatgggttcctcgtggagcattacgtgagaaaagaggaatatcagaccgcgtacaggtttctggaagaaatgaggagaaggcttcccctggctaatatgtcctattacgttagcccgcaagcagtcgatgcagttcacagaggcttgggacttcctctacccaggacagtccctgaacaggtgaggcataattcaatggaggatgccagggagctggacgaagaagtggtggaggaggcagacgacgacccttag

SEQ ID NO: 56890 - DNA, 4389 bp, Artificial Sequence
  Description of Artificial Sequence: Synthetic coding sequence
atggctctgtattacgaccaccagattgaggcgccagatgccgctggttcaccatctttcataagttggcatcctgtgcacccgttcctggcagtagcttatattagcacgacctccacgggcagtgtggatatctatctagagcaaggggagtgcgttccagacacacatgtggaacgaccttttcgggttgcttccctgtgttggcatcctaccagactggtcctggcagttggctgggagacgggggaagtaactgtattcaataaacaggataaagaacagcacacaatgccactgacacacactgctgacataactgtattgaggtggtcaccttcaggcaactgtctgctgtccggggaccgccttggagtcctgctactttggcgccttgaccagagaggtcgcgtgcagggaacgccattgctgaagcatgaatatgggaagcacttgacacattgtatctttcgcctcccacctccaggcgaagacttggtccagttggctaaggccgctgtgagcggggacgaaaaagcactggatatgtttaactggaaaaagagttcttctggcagtctgctaaagatggggagccacgaggggctgctattctttgtgtcacttatggatggtacagtacactacgtggatgagaaaggtaaaactacccaggtcgtgtccgccgatagcactatccaaatgctcttctacatggaaaaacgcgaagcactggtggtcgtgactgaaaaccttaggttgagcctgtacactgtgccacctgagggaaaggccgaggaggtgatgaaagtgaaactttctggaaaaacaggccgaagggccgacatcgctttaatcgagggctcccttctcgtaatggccgtgggtgaagcggcacttaggttctgggatattgagagaggagaaaattatattctgagccccgacgagaaatttggctttgagaagggagagaatatgaactgcgtgtgctattgtaaagtcaaaggcctgctcgcggcaggcaccgatcgcggtcgtgttgctatgtggaggaaggtgcccgactttctaggcagccctggagccgagggaaaagatcggtgggcccttcagactccgaccgagttgcagggcaacattactcagatccagtgggggtctagaaagaatttgctggccgtgaattcggtcatatccgtggctatcctgtcagagcgggcaatgagctctcatttccaccagcaagttgccgctatgcaagtatctccctccctgctcaatgtatgcttcttgtcaactggtgtggctcattcacttcggactgacatgcatatcagtggggtgtttgctacgaaagacgcagttgcagtatggaacggaagacaggttgcaatcttcgaactgtccggcgctgctatccggtctgccggtactttcctctgtgaaacacccgtcctggcaatgcacgaagagaatgtatacaccgtggaaagcaatagggtgcaggtgagaacctggcagggcacggtgaaacagctgttgctgttctcagagacggaaggcaatccttgctttttggatatttgcggtaacttcctcgtcgtgggcacagacctagctcattttaagagcttcgatctatcccgccgagaagcaaaagcccattgctcctgcaggtcattggcggagttggtgcccggtgtcgggggtatcgcgagcctgagatgttcatcttcgggcagcaccattagcatcctgccctcaaaggccgataatagcccggattccaaaatttgtttctatgacgtggagatggacacagtcaccgtctttgactttaagaccggtcaaatagatagaagggagacactgtcctttaacgagcaggagacgaataaaagccaccttttcgttgacgaagggctgaaaaattatgtcccagttaaccatttttgggatcaaagtgagccaagactgttcgtttgcgaggctgtgcaggaaacaccacggtctcagccccagtcagcaaatggacagcctcaggacgggcgagcagggcctgctgctgatgtattgatactgagcttcttcatctctgaagagcacggctttctactccatgagagttttccaaggcctgctacttcccacagtctgctaggcatggaagtgccttactactatttcacccgtaagccggaggaggcagaccgtgaggatgaggtcgagcccggatgccaccatatcccccagatggtatcgcgtaggccgctgagggatttcgttggcctcgaagattgcgacaaagccactcgcgatgccatgctccacttttcttttttcgtgaccatcggcgatatggacgaagcatttaaatcaattaagctcattaaatccgaggctgtatgggagaacatggcaaggatgtgcgttaagactcagagactcgatgtcgctaaagtctgtctgggcaacatgggccatgccagaggtgcaagagcgttgcgagaggctgaacaagaacccgagctggaagcaagggtggccgtgctggccacacaactcggaatgctcgaagacgctgaacaattgtaccggaagtgtaaacggcacgatctgttgaacaagttctaccaggctgccggtcgctggcaggaagcacttcaggttgccgaacaccacgatcgcgtgcatttgagaagcacctatcaccggtacgccggacacctggaagcttcggcagattgttcaagggctctttcctattacgagaaaagcgatacccaccggttcgaagtccccaggatgctgagcgaggatttaccgagcctggagttgtacgtaaataaaatgaaggacaagactctttggcggtggtgggcccagtatctcgaatcccagggtgagatggacgctgcccttcattattatgaactcgcccgtgatcatttcagcctagtgaggatccactgttttcagggaaacgtgcagaaagccgctcaaatcgctaatgaaacaggcaacctcgccgcaagctaccatttggcacgtcagtatgagtcgcaagaagaagtcggacaagctgttcacttttatacaagggcacaggcttttaaaaatgcaatccgattatgcaaagagaatggcctcgacgaccagctgatgaacttagctctgctgtcgtcacctgaagatatgattgaggcggctaggtactacgaagagaaaggcgtacagatggaccgagcagtaatgttgtaccacaaagccggacactttagcaaggccttggagctagcatttgctactcagcagttcgtggcactccagctaattgcagaggatctggacgagacatccgatcccgctctcctggccagatgctctgattttttcatcgagcactcacagtacgagagggctgtggagctcctgttggcagcacgcaaataccaggaggctctccagctctgtctaggccagaacatgagtataaccgaagaaatggccgaaaagatgaccgtagcaaaggactctagtgatcttcccgaggagtctcggagggagcttttggagcagatcgcggattgttgtatgcgacagggctcctaccacctggccaccaagaagtatacacaggccggtaataagctcaaagctatgcgggcattactgaagagtggagacactgagaagatcaccttcttcgcaagcgtctcaagacagaaggagatctatattatggcagctaattacttacaatccctggactggcgcaaggaaccagagatcatgaagaatataataggattttatactaagggccgagccttggatcttttagccggtttctacgacgcgtgcgcccaagtagagatagatgagtaccagaattatgataaagcccacggggcactcacagaggcgtacaagtgcctcgccaaggcgaaagcgaaaagcccacttgatcaggagacaaggttagcacagctccaaagccggatggcacttgtgaagaggtttattcaggctcgcaggacctatactgaagaccccaaagagagcatcaagcagtgtgaactgcttttagaggaaccggacctcgactccactattaggataggcgatgtctatggtttcttagtcgagcactatgtgcgtaaggaggagtatcagaccgcatataggttcctcgaagagatgcggaggcggttaccccttgctaatatgtcctattatgtttcccctcaagctgttgatgctgtccacaggggattgggattgcctttgccaagaacggttcctgagcaggtccgccacaactccatggaggacgctagggagctggacgaagaagtggtcgaggaagcggacgatgacccgtag

SEQ ID NO: 56891 - DNA, 2406 bp, Artificial Sequence
  Description of Artificial Sequence: Synthetic coding sequence
atggctctctattacgaccatcagatcgaagcccctgacgcggctgggagcccgtccttcataagttggcacccagtccacccttttcttgctgtggcctacatcagcacaaccagtacaggcagcgtggacatctatttggagcagggggagtgtgtgcccgacacacatgtagagaggcccttcagggtggcttccctctgttggcaccctaccagactggttctggctgttgggtgggagaccggtgaggtcaccgtatttaataagcaggacaaagagcagcatacaatgcctctaactcacactgcagacatcacagtgctgcgctggtcgccctccggaaactgtttgttgagcggcgacagactgggagtgttactgctgtggcgattggaccagcgtggtcgtgtccagggtactcccctcttgaagcatgaatacgggaaacatctaactcactgcattttccgtctccctccaccaggggaagacctcgtgcaactcgccaaggctgccgtctcaggtgatgaaaaggccttagatatgttcaactggaagaaaagttccagtgggtcattgcttaaaatgggttcccatgaggggctcctcttcttcgtatcgctgatggatggaaccgtacactacgtggacgagaagggaaagaccacccaagttgtttctgccgacagcacaatacagatgttgttttacatggagaaaagggaagccttggtagtagtcacagaaaatctccggcttagcttgtatacagtacctcccgaggggaaagctgaggaagtgatgaaagtgaaactgagcgggaaaaccggcaggagagccgacatcgccttgattgaaggatccctgctcgtgatggccgtgggagaagccgctctccgtttttgggatattgaaaggggtgaaaactacatcctgtcaccggacgaaaagtttgggttcgagaagggggagaatatgaactgcgtatgttactgcaaggtcaaaggcttgctcgcagctgggacggaccgcggtcgggtcgctatgtggaggaaagtgcccgacttcctgggctctcccggtgctgaagggaaggaccgctgggcacttcagaccccgacagagctgcaggggaacatcacacagatacaatgggggtccagaaaaaatcttttggccgtgaactccgttatatcagtggcaatactgtctgaacgggcaatgagcagtcatttccaccagcaggtcgccgctatgcaggtctctccttctctgctcaatgtgtgttttctgtcaacaggtgtagcccactcactgaggaccgacatgcacatttccggcgttttcgctaccaaggatgccgtggcagtgtggaatggacgccaagtggccatttttgaactctctggcgctgccattcgcagcgccggaacatttctctgtgaaactccagttctggccatgcatgaggagaatgtttataccgttgagagcaaccgggtccaggtcagaacttggcaggggactgtgaagcagctgctgctattctcagagactgaaggtaatccctgcttcctagacatctgcgggaatttcctcgtggtaggcacagatttggcacacttcaagtccttcgatctgagtaggagagaagcgaaagcacactgctcttgcaggagcttagccgaactggtgccgggagtcgggggaatcgctagtctgcgctgctcgagctctggaagcacaattagcattttgcccagtaaggccgataattcccccgactcaaaaatctgcttctacgacgtggagatggacacagttactgtcttcgacttcaagacagggcagattgaccgtcgagagactctgtccttcaacgagcaggagaccaacaagtctcacctgtttgttgacgaaggcctcaagaattacgtacccgtcaatcatttctgggaccagtcagagcccagactcttcgtgtgcgaggcagttcaggaaactcctcgtagccagcctcagtcagccaacggccagccacaggatggtcgggcaggtcctgcggcagacgtgcttatcctgtcgtttttcatttcggaagaacacggtttcctgttacacgagtcattcccccgacccgcaacctcacattccttgctaggtatggaggtcccctattactattttacacggaagccagaagaagctgaccgcgaggacgaagtcgagccagggtgtcaccatatcccacagatggtcagtcggaggccactgcgagactttgtggggcttgaagattgtgataaggctacacgcgatgctatgctgcactttagctttttcgtgaccattggtgatatggacgaagcttttaaatcgattaagttaatcaagagggcctag

SEQ ID NO: 56892 - DNA, 399 bp, Artificial Sequence
  Description of Artificial Sequence: Synthetic coding sequence
atggctaaagatattttgggggaggctggattgcatttcgacgagctgaataaactcagagtgctcgaccctgaggtgacacaacaaacgatcgagctcaaggaggaatgtaaagacttcgtggataaaatagggcagttccagaaaatagtggggggtctgattgaactcgtagaccagctggcaaaggaggccgagaacgagaagatgaaggcaattggggctcgcaatctgttgaagtctattgccaagcagcgcgaagcccagcagcagcaactccaggcgctcattgccgagaaaaagatgcagttggaacgttacagagtagagtacgaggcattatgtaaggtggaggccgagcaaaacgaatttatagaccaattcattttccaaaagtag

SEQ ID NO: 56893 - DNA, 477 bp, Artificial Sequence
  Description of Artificial Sequence: Synthetic coding sequence
atgacacatctgctgctgactgctaccgtcactccttcagaacagaactcctcccgcgagcccggttgggagacagccatggcaaaagacattctgggggaagccggactgcatttcgacgagctcaataagcttagggtactcgatcccgaagtaacacagcagactattgaactaaaggaggagtgcaaggatttcgtggataaaatcgggcagtttcagaaaatagtgggaggcctgatcgaactggtggatcagctagccaaggaggccgaaaatgagaagatgaaggccatcggggctcgaaatctgctaaagtcaattgccaaacagcgggaagcacagcaacagcagctgcaggctctgatagccgagaaaaaaatgcagctggagcgctatcgagtggagtacgaagccctttgtaaggtcgaggcggaacagaacgagtttattgaccagttcattttccagaagtag

SEQ ID NO: 56894 - DNA, 345 bp, Artificial Sequence
  Description of Artificial Sequence: Synthetic coding sequence
atggcaaaggacatcctgggagaggctggcctgcacttcgatgaactgaacaagttgcgcgtgttagatcctgaggttacccaacagaccatcgagctgaaagaggaatgcaaggatttcgtggataaaatcggccaatttcagaaaatagtgggcggacttatcgagttggtggaccagcttgccaaggaggccgagaatgagaaaatgaaggccatcggggctaggaacctattgaagagcattgctaaacagcgggaagctcagcagcagcagctgcaagcgctcattgcggagaagaaaatgcagttggagaggaacgagctcaagatatcactcctctag

SEQ ID NO: 56895 - DNA, 399 bp, Artificial Sequence
  Description of Artificial Sequence: Synthetic coding sequence
atggccaaggatatactcggggaggctggcctccatttcgatgaactgaataagcttagggttctggacccagaggtgactcaacagactatcgagctgaaggaagagtgcaaagactttgtcgataaaatcgggcaattccagaagattgtgggcggacttattgaattggtggaccagctagcgaaagaggccgaaaatgagaagatgaaagccatcggagcgagaaacctcctgaaatccatagccaagcagagggaggcccagcagcagcagttacaggccttgattgcagagaagaagatgcagctggagcggtaccgcgtagaatatgaggccctgtgcaaggtcgaggccgagcagaatgagtttatcgaccaattcatctttcaaaaatag

SEQ ID NO: 56896 - DNA, 216 bp, Artificial Sequence
  Description of Artificial Sequence: Synthetic coding sequence
gacattctcggcgaggctggtctgcattttgatgagctgaacaaactgcgggtgttagatcccgaggttactcagcagactatcgagctcaaggaggagtgcaaggacttcgtggataaaattgggcagtttcaaaaaattgtgggtggcctgatcgaattggttgaccagttagcaaaggaggcggagaacgagaaaatgaaggtgtccggctag

SEQ ID NO: 56897 - DNA, 558 bp, Artificial Sequence
  Description of Artificial Sequence: Synthetic coding sequence
atggtgaagttggccgctaagtgcattcttgctgatcccgctgttggcaaaacagccctcgcccagatttttcgcagcgatggcgcacattttcaaaagtcatacacccttactacaggtatggatttagtggtgaaaacagtgcctgtacctgacacaggcgattccgtggagctgttcatctttgacagcgccggaaaggagttattcagtgaaatgttggataaactctgggagtctccgaacgtgttatgcctggtctatgatgtgactaatgaggaatccttcaataattgctcgaagtggcttgaaaaagccagatcccaggcacccggaattagcttgccaggagtactcgtaggaaataagacggatctggctggaagaagggccgtcgattctgctgaagctagggcttgggccctcggtcaggggctggaatgcttcgagactagcgtcaaagagatggaaaattttgaggcaccctttcactgcctcgctaagcagtttcaccagctctacagagaaaaggtggaagtgtttcgggcactggcctag

SEQ ID NO: 56898 - DNA, 390 bp, Artificial Sequence
  Description of Artificial Sequence: Synthetic coding sequence
tgatccgacggagctcattttcagaaatcctatacattgacgaccggaatggatctggtggtgaagactgtacctgtgcctgacaccggagattcagttgaattgttcatatttgactctgcaggcaaggagttatttagcgagatgctggacaagctctgggagtccccaaacgtgctttgtcttgtctacgatgtcaccaacgaggagtcattcaataactgttctaaatggctcgagaaggctcgtagccaagcgcctgggatctccctccccggtgtcctggttggcaataaaacagacctggctggccgtagggcggtggactcagcagaggctagagcctgggcactgggccagggtctagagtgcttcgagacgtccgtttag

SEQ ID NO: 56899 - DNA, 552 bp, Artificial Sequence
  Description of Artificial Sequence: Synthetic coding sequence
atggtcaaactggcggcaaaatgcattctggccgttcccgtggacaaaagactgtctcgagccgaagtctgctcagggtgctgtgaagtgtgccggtcggtgtcatggacctgtgctctgcccgctgcatctgagcaagtcccggtcagaggagaccctgccgtgggaaagaccgcattggcccagatctttagaagtgacggcgcacattttcagaagtcttatacactgaccacaggaatggacctggtcgttaagactgttcccgtacccgatacaggcgatagcgtggagctgttcatcttcgactccgctggtaaggagttgtttagcgaaatgctcgacaagttgtgggagtcaccgaatgtgttatgcttagtatacgatgtgaccaacgaagagagcttcaacaattgctccaagtggctagagaaggctcggagccaagcccctggcatctcactgcctggcgttctggtgggcaacaaaaccgatctggccggaagacgggcagtggactccgcagaggcacgcgcttgggccctggggtag

SEQ ID NO: 56900 - DNA, 351 bp, Artificial Sequence
  Description of Artificial Sequence: Synthetic coding sequence
atggtaaagctcgcggctaaatgcattttagccgaccctgccgtgggaaagaccgcactggctcagatctttcgctcagacggcgcacacttccagaaatcctacacgttgacgacagggatggatctggtggtgaaaacagtcccagttcccgacaccggagactcggttgagctgtttatctttgactcagctgggaaagagctgttctcggaaatgctggacaaactgtgggaaagcccgaacgttctatgcctggtatatgatgtaacaaatgaggagagctttaacaactgtagcaaatggctggaaaaagccagatctcaggccccagggatctcactgccttag

SEQ ID NO: 56901 - DNA, 561 bp, Artificial Sequence
  Description of Artificial Sequence: Synthetic coding sequence
atggttaaactggccgctaagtgtatactcgccggagaccctgctgtgggaaaaactgcgctggcccagatttttcgcagcgacggggcacacttccagaagtcttacactctcaccacaggaatggacctagtcgtcaagaccgtgccagtgcccgataccggagattccgtcgagctgtttatttttgacagcgcaggcaaagagctgttctccgagatgcttgacaagctctgggaatctccaaacgtgttatgtttagtctatgacgtgacgaatgaggagtcttttaataattgctcaaagtggttagaaaaggcccgtagccaagccccagggatatcattgccaggggtgttggttgggaacaagactgatctagctggcagaagagccgtggattccgccgaggcccgagcatgggcccttggtcagggcctcgagtgcttcgaaacatctgtgaaggagatggaaaattttgaggcgccatttcattgtcttgcaaagcagtttcaccagctttaccgagaaaaagtggaagtcttcagagcactcgcatag

SEQ ID NO: 56902 - DNA, 156 bp, Artificial Sequence
  Description of Artificial Sequence: Synthetic coding sequence
atggacctggtcgttaagaccgtgcctgtacccgatacaggcgactccgtcgagctgtttatcttcgactctgctggaaaggaactattcagtgagatgttggacaagctctgggaatctcctaatgtgctgtgcctcgtgtacgacgtcacctag

SEQ ID NO: 56903 - DNA, 438 bp, Artificial Sequence
  Description of Artificial Sequence: Synthetic coding sequence
atggacctcgttgtaaagacagtccctgtacctgatactggagactcggtcgagttgttcattttcgatagtgcaggaaaggaacttttcagcgagatgctggacaaactctgggagtcccccaatgtcctgtgtcttgtgtacgacgttaccaacgaagagtctttcaataactgtagtaagtggctggagaaggcacgcagtcaggcacctggaatttctcttcctggagttttggtgggcaacaagactgatctggccggtcgccgagctgtagattccgcggaggcaagagcgtgggctctgggccagggcctcgagtgttttgaaacttctgtgaaggagatggagaattttgaagctccttttcactgcctggctaagcaattccaccaactgtacagagaaaaggttgaggtcttcagggcccttgcttag

SEQ ID NO: 56904 - DNA, 1314 bp, Artificial Sequence
  Description of Artificial Sequence: Synthetic coding sequence
atggaaaaagagctgagaagcacgatcttgtttaatgcatataagaaggagatttttacaacaaataatggctataagagcatgcagaaaaaattacgcagtaattggaagattcaatcactcaaggatgagattacctcagagaaattgaacggcgtgaagctgtggatcacagctggaccacgagagaaattcacggccgcagaattcgagatcctgaaaaagtatctggatactggaggggacgtcttcgtaatgttgggtgaaggtggagagtccaggtttgacaccaacataaatttccttctcgaggaatacggcattatggttaacaacgacgccgtggtacggaatgtatatcacaagtactttcaccccaaggaggctttggtttcttctggcgtgctaaatcgggaaatctcccgagccgcaggcaaagccgttcctggaattatcgacgaggagagttcaggaaataatgctcaggcactgacattcgtctacccttttggcgcaactctgagcgttatgaaacccgctgtggcagtcctgtcaaccggcagcgtgtgtttcccactgaacaggcccatactggcgttctatcactccaagaatcaggggggaaaactagcggtactggggagctgccacatgtttagcgaccaatacctggacaaggaggaaaacagcaaaattatggatgttgtgtttcagtggcttactacgggagacatacatttgaaccagattgacgcagaagatcccgaaatcagcgactatatgatgctcccctacaccgcaacattatcaaagaggaatcgggagtgcctccaggaatctgacgagattcccagagatttcacaactttgttcgatctctcaatatttcagttggacactacgtcgtttcactccgtgatcgaggcccacgagcaactgaatgtgaaacatgaacctctccagttaatacagccccagttcgagacacctttgcctacccttcaaccagctgtattccccccttcattccgagagctcccacccccaccccttgagctgttcgacctggatgaaacattctcatccgagaaagccaggctcgctcagattactaacaagtgcaccgaagaagatttggaattctatgtgcgcaagtgtggcgacattctaggagtaacaagtaaactgcccaaagaccaacaagatgcaaaacacattctcgagcacgttttcttccaagtagttgaatttaagaagctcaatcaagagcatgacattgacactagtgaaaccgcatttcaaaacaacttttag

SEQ ID NO: 56905 - DNA, 1314 bp, Artificial Sequence
  Description of Artificial Sequence: Synthetic coding sequence
atggagaaagaattaaggtctacgattttgttcaatgcctacaagaaagaaatctttacaactaataacggatataaatctatgcagaagaaactgagaagcaactggaagattcagtcacttaaggacgaaatcacgagcgaaaaattgaacggagtcaaattatggattacagccggaccaagggagaagtttactgcagcagagttcgagatcctgaagaaatacttagatacaggtggtgacgttttcgtgatgttaggagaaggcggtgagagccgatttgatactaatattaacttcctgctggaggaatacggaatcatggtcaataatgacgcagtagtccgcaatgtttatcataagtacttccaccccaaggaagccctcgtcagtagcggggtcctcaacagggagattagccgcgcagccggaaaggcagtgcccggtatcatcgatgaggagtctagtggtaacaacgcccaagctctgacattcgtataccctttcggtgccacactttccgttatgaaacctgccgtagccgtcttatcaacagggtcggtgtgtttccccttgaataggccaatcctggctttttatcactcaaaaaaccagggcggaaagctcgccgtccttgggtcttgccatatgttctctgaccagtatctcgataaggaggagaattctaaaatcatggacgttgtgttccagtggctgaccacaggggatattcatcttaaccagattgatgcagaagaccctgaaatctctgattatatgatgctgccctacaccgccacattaagcaaacggaatcgcgaatgcctgcaagaatccgatgagatacctagagattttactactcttttcgacctgtcaatttttcaattggacaccacctcctttcactcagtgattgaagcccatgagcaattaaacgttaagcatgaacctctccaactcatccagccacagttcgagactcccctacccaccctccagcccgcagtgtttcctccaagttttagggagctgcctccccctccgctggaattgtttgatctcgacgaaaccttttcaagcgagaaggccaggttggctcagatcacaaataaatgtaccgaggaggacctggagttctatgtgcgaaaatgtggagatatcctgggagtcacctcgaagctccccaaggatcagcaggacgcaaagcacatcctggagcacgtcttttttcaagtggtggaattcaagaagctgaaccaggaacatgacatcgatacatccgagaccgcctttcagaacaacttctag

SEQ ID NO: 56906 - DNA, 1401 bp, Artificial Sequence
  Description of Artificial Sequence: Synthetic coding sequence
atggagccggagctgttggtgcgcaaagtgtcagcccttcaggcttgtgtgcgaggctttctggtgcggaggcagtttcagtcgctgagggcagaatatgaagctatcgtccgggaggtggagggcgatctgggtacactacagtggaccgaaggtcgtatccccaggccccgttttctgcccgagaaggctaagtctcaccagacttggaaagcaggagaccgggtggctaacccagaacaaggcctgtggaaccactttccttgtgaggaatccgagggggaggccacttgggaagaaatggtcctgaagaagtcgggggaaagcagcgccaatcagggctccctgtgccgggatcacagtagctggctgcagatgaaacaaaaccgcaaaccctctcaggagaaaaccagggacactacaagaatggagaatccagaagcaaccgaccagcgcttgccgcactctcagccccagctgcaggagctgcaataccaccgatctcacctggctatggaactcttgtggctccagcaggctatcaacagcaggaaagaatacctgcttcttaagcaaactttgcggtctcccgaagctgggccaataagggaggagccccgagtgttcctggagcacggcgaacaggcatgtgaacgcgaccagagccagcccagcgctccattggaggaccagtcttacagagacagaaccaccggagaactcgagcaggaggatgatagttgccaccgtgtcaaatcacctcatcggagtcccggatcactggccactacccaaaagaacatcgcaggagccaagtgtcgggaaccttgctatagcaagagtggtcccccatcttcaattccctccaatagccaggcacttggggatagattgactaagggccctgatgacggtcgtcagactttcgggggaacatgtcttctgcaaatgaagattctggaggaccagaccccaagaggcttaaagccccgaaaccactgtccgcgtaagtcaagaactcagctatccgccctctatgaagacagtaacataaaagagatgagccccaggaagctcgaccacaaggagcctgactgcaggaccgtcaggacacaagaattaggattgtccgaagaccacatcatctgggacggcactttagggggtcctgagcattcagtgctcgatctttggcgcaccaagcccccaaaaggccaggcccctacagaccgatcctccagagatggcaccagcaatgagccttcacatgaggggcagaaaaagcagcgtaccatcccatggaggagtaagtctccagaaatcctgtccagcacaaaagccggttgtaccggcgaagagcagtggcggggacgtccatggaagacggagcctcctggctag

SEQ ID NO: 56907 - DNA, 1641 bp, Artificial Sequence
  Description of Artificial Sequence: Synthetic coding sequence
atggagccagaactgctggtcagaaaagtttccgcactgcaagtgcgtggccgagcgagaggatcccaggatttttcattccgcgaaattatgggcagcaggacatggactagccagcgtgacgccacgacattttctcctttgaccgcacgccagccccttgagatccctgccgtaccgaatcgagccgaggagtcctgggatccaagaacaccttgtcctgccaggccacactcgcatcacacactggcacctgaccagggtaatggaaagtcccttaaggcatgtgtgcggggttttttagtccgtcggcagttccaatcactgcgagcagaatacgaagccatcgtgcgggaggtggagggcgacctgggcacgctgcagtggacagaaggtcgtatccccagaccccgattcctccccgagaaagccaaaagtcaccagacttggaaggctggagatagggtggctaatcccgagcaggggttatggaatcatttcccgtgcgaggagtccgagggtgaggcaacttgggaagagatggtcctcaagaagtccggcgagtctagcgccaatcaaggttcgctgtgtagggaccattcttcttggctgcagatgaaacaaaatagaaagcctagccaggagaaaacacgcgacaccaccaggatggaaaatcccgaggccacagaccagaggctgccacattctcagccacagctgcaggagctgcagtatcaccggtctcatttagcgatggaactattgtggctccagcaggctatcaattcacgcaaggagtatttgttgttaaagcagacgctcagatcaccagaggccggacccatccgagaggaacctcgggtcttcctggaacacggggaacaggcgtgtgagcgcgatcagtcacagccctctgctcctcttgaagaccaaagttatagagataggactaccggcgagctcgagcaggaggacgatagctgccatagggtcaagtccccccacagaagccctggctcactggccaccactcagaagaacattgcaggggctaagtgtagagaaccgtgctactcaaagtccggacctccttctagcatcccatcaaacagccaggcgcttggagacagattgacgaagggtccagacgacggacggcagacatttggtgggacttgtctgttacagatgaagatcctggaggatcagactcctagaggcctgaagcccagaaatcattgtcctagaaagtcccgcacccagcttagcgctctgtatgaagattccaatatcaaagagatgagtccaaggaagttagaccacaaggagccagattgtcgtactgttagaactcaggaattagggctgtccgaagaccacattatatgggacggaacacttggaggacctgaacactcggtcttagatctgtggcgcactaaaccaccgaagggccaggcacccaccgatcgctcttcgcgcgatgggacaagcaatgaacctagtcatgaagggcaaaagaagcagcgaacaattccttggagatccaaatcacctgagattctcagtagtactaaggctggctgcactggagaagagcagtggcggggacggccttggaagaccgagccgccagggtag

SEQ ID NO: 56908 - DNA, 1044 bp, Artificial Sequence
  Description of Artificial Sequence: Synthetic coding sequence
atggccctggatattttggcaatggccccattatatcaagcccctgccataaatcgcattggccctaagacagacccttccaaacgccctgccgaccctcttaagcctctcgtgctcagccggacgaagcttaccacaatcgaggccaagcgtatcatgagtattctcgacgaagcaatctacaaggtggagcttgtcaccctattgagttacgtggcatcaaatagggaggacatggaggggatgctgggagaggacgtcatgcgagcagtgagagagcacgaagatctttgccaggtactgctggaaaatgtacgttgcttaaaggagaaagagagacagctgcaggaacagaaagaggctgaggaagaaggatggttgcgggaccgcctgctctctatcgaactccaaaagtcctctctgtcacctctgatgcaacaaataaaagattccaccaagaacgtgttgcggctgcttttgtcaaaccctcaagcagctcggctcctgcagatgcagactcagggcaggtccgcagaggcgcagaatttcattgattccctcatcgaattacgaggcttcctcttcgaaaagctcttaacatcaccaatggaagccagggacaaggctcagttcctccaggacatttcgcggcagaatagcaacaaccagcagataatcgacaccctggaaaaggagcttgctgagaggatgaagaacagaaacgccgaggaagaactggaagatttagacgcagtgcacagagaggaaaagatatcattggaagagctgcgcaggcgacataaggtattggtaggggagtttgctcagatcagggaggagagggaaattaattctaagaaaagaatggaggcggaacaggagatggttcgaatggtccgcgctgctactctgatccaggcactctggaaagggtacctagtgcgttctctccttcggagtaagaagaagagaggcaaaggtaaggcaaaggataaagagaaaggaaaacagaaggggaaggagaagggcaagggtaagaagtag

SEQ ID NO: 56909 - DNA, 1110 bp, Artificial Sequence
  Description of Artificial Sequence: Synthetic coding sequence
atggctttggatatacttgcgatggccccactgtatcaagccccagcaattaacagaataggccctaagacagaccccagcaagagacctgccgatccccttaagccgttagtgctgagcaggactaaactgaccaccattgaggcaaagaggatcatgagtattctggatgaggcgatctataaggtcgagctcgtcacgctgctcagctacgtggcaagcaaccgggaggacatggaaggcatgctgggcgaagacgtgatgcgggcagtcagagagcacgaggatctatgccaggttctcctggagaacgtccgctgcttgaaggaaaaggaaaggcagctacaggaacaaaaagaggccgaggaagagggctggcttagggaccggctgctttccatagaacttcaaaagagctctctgtcacctctcatgcagcagattaaggactccacaaaaaacgtcctccgcctcctgttgtccaacccccaggctgctcgcttacttcagatgcagacgcaagggcgatcagcagaagcgcagaattttattgattcgctgatcgagctgcgtggattcctgttcgaaaaattactgacctctccaatggaggcgcgagataaagcccagtttcttcaggacatatctcgccaaaactccaacaatcaacagatcatagacactttggaaaaagaacttgcagagcggatgaagaaccgcaacgccgaagtactgtttcattcgatcgctgagatcaccgaggaagctacccagatcttttgctggcttggcttctccagcatgatagattttttcttcaaaatggaatccaggagcgtggtccagacccgggtgcagtggtgtaacctagatagtctacagccgctgcctcccagatttaagagattctcccaccacagtctcccctcaagttgggactacaggcgtatgccaccacgccctgccaatttctgcatattctcaagggaccgcgtgacgccatttagttgtttgtccctccctagctcttgggattatagatgccccccactgtattccagcctggctgctgaacaggatcccgtgagcaaaaaaaaaggcaagcagtag

SEQ ID NO: 56910 - DNA, 1350 bp, Artificial Sequence
  Description of Artificial Sequence: Synthetic coding sequence
atggccctggacatcctcgcaatggccccactgtaccaagctcctgcaattaacaggatcggcccaaagaccgatccaagcaagaggccagcagaccctctgaaacctttagttctctcccggacgaaactgacaacaatagaagccaaaaggattatgtccatcttggacgaggcgatctacaaggtggaattagtgaccctcctgagttatgttgcctcaaatagagaggacatggaagggatgcttggggaggatgttatgcgagccgtgagagagcacgaggacctatgtcaggtcctgcttgagaatgtgcggtgtcttaaagagaaggagcgccagctccaggaacaaaaggaagccgaggaagaagggtggctgcgcgatagactcctgtcgatcgaattacagaaatcctccttaagccccttaatgcaacaaataaaggactccaccaagaatgtactgcgcctattattaagcaatccgcaggccgcacgcctccttcagatgcagacccagggtcgaagtgcagaagctcaaaacttcatcgattctcttattgagctgcgtgggttcctgtttgaaaaactgcttaccagccctatggaagcgagggacaaggcgcagtttctccaggatatttctcgtcaaaactcgaacaaccagcagattattgatacacttgaaaaggagctggccgaacgtatgaagaacagaaatgccgaggtggaaaaggaaaatttcgtgatccaggagcttaagaaccacctgcatcaggtcttgaagttctcagaaaatagcctggtgcgcacgaagcaggaggccgaaaaacagcagaaggctgacttccgggcttcgcaagcaagagtggcaaaaatccagcaggagatcctacagcttcagagccagttctacaacctggttatggagaatagagaagcggaacaagctcttaggaaaaaaaagtacaaagtcgaaactgagatcgagaattggattcagaagtacgataccgaaatgggggagaaacaggaagaactggaggatttagatgccgtgcacagagaggagaaaattagtctggaggagctgagaaggaggcataaggtactggttggtgaattcgctcaaatccgggaagagagagaaatcaatagcaaaaaaagaatggaagccgaacaggagatggtccgaatggtgcgggctgccactcttatccaggccctgtggaaggggtacttagttaggtccttgctgcgcagtaaaaagaaacgcggaaaaggcaaagcgaaagataaggagaagggaaagcaaaaggggaaggaaaagggtaaaggaaaaaagtag

SEQ ID NO: 56911 - DNA, 618 bp, Artificial Sequence
  Description of Artificial Sequence: Synthetic coding sequence
atggaagagaagcagccccagaagacgaaagagccaagcaaggaagatgaaccccagcagaaagaaatgccaacccatctctcccttggtgctgagtctaaggcggaggctaaaactccagtgctggttgagacccaaaccgtggacaacgccaacgagaagtccgaaaaaccgcctgagaaccagaaaaagctatccgataaagatacagtggctaccaaaatccaggcctggtggagggggaccctcgtgaggcgcgcattgctccatgcagccctctccgcctgcattatccagtgctggtggagacttatcttatccaagattctaaagaagagacggcaagcagcactggaggcattctcgaggaaagaatgggcagccgtgacactgcagagtcaggctcggatgtggcgcataagacgcaggtactgccaggtacttaacgccgtgcggattattcaggcctactggcggtgccggagctgtgcctcacgcggatttattaaaggccaataccgcgtcaccgctaatcagctgcacctgcagcttgagattcttctcgacagtgggccttgcatagtgacagagtgcatacctttctctataaaagagtag

SEQ ID NO: 56912 - DNA, 249 bp, Artificial Sequence
  Description of Artificial Sequence: Synthetic coding sequence
atggaggagaaacaacctcagaaaacgaaggaacctagcaaagaagacgagcctcaacaaaaggaaatgcccacccacctgagtctaggagcagaatcgaaggctgaggccaagacgcccgtgctggtggaaacgcagactgttgacaacgccaacgaaaaatcggagaagagggtttgtcaatggaacatggtgatcgtctcaatggattggaaatcactcgaaagtgaggaccttcgtaatctttag

SEQ ID NO: 56913 - DNA, 495 bp, Artificial Sequence
  Description of Artificial Sequence: Synthetic coding sequence
atgcgggtccggttttgtacgaaaggaaacctgattctggtaattatagaggacgtggaggaaagcatcgaatggaaaactctgcagaagaaaaagcaacagaaaattaaagagaagttgcggattcgaactaaggctgccgtgaagatccaggcttggtggcgcggaacattagtccggaggactctgctgcatgctgctttgagggcttggattattcagtgttggtggcggatgaccctaagtcgcgtactggagaagaaacggcaggcggctctgatcgcttacgctacacgtgagcgcgctgtgattaagttgcagagcctagtgaggatgtggcgggttcgctggagatattgtcaggtgctcaacgccatttacatcatccagggtcactggcagtgtcataactgccagacctgcgctctcctgcagggtcattgcgtcgtaactgcaacccacttgcagttccacattgagattatcaactcttag

SEQ ID NO: 56914 - DNA, 465 bp, Artificial Sequence
  Description of Artificial Sequence: Synthetic coding sequence
atgggttccaagtgctgcaaaggcggtccagacgaggacgcagtggaaaggcagcgaaggcagaaattgttgctggcccagctgcaccaccggaaaagggtaaaagctgctggccagattcaagcttggtggaggggggtcctggtccgcaggacactgctagtggccgcactgcgagcctggatgatacaatgttggtggcgcacactcgtccaaaggcgtatcagacagcgtcgccaggcactcttgcgggtttacgtgattcaagagcaggccacagtgaagttgcagagttgtattagaatgtggcagtgcaggcaatgctatcgccagatgtgcaacgccctctgcctgttccaggtccccgagagctccttggccttccaaactgatggattcctgcaggtccagtacgctattccctctaagcaacctgaatttcatatagagattctgtctatctag

SEQ ID NO: 56915 - DNA, 465 bp, Artificial Sequence
  Description of Artificial Sequence: Synthetic coding sequence
atgggtagcaagtgctgcaaaggtggccctgacgaggatgctgtcgagcgacaaagacggcaaaaactacttcttgcccagctccaccaccgcaagagggtgaaagcagcgggacagattcaggcttggtggcggggagtgcttgtgcggagaacgctgctcgttgccgcactgcgggcttggatgattcaatgctggtggcggaccctcgtgcagcgccgtatccggcagcgtcggcaagctctgctgagggtctatgttattcaggaacaggccaccgtgaaactccagtcctgtataaggatgtggcagtgccggcaatgctatagacagatgtgcaatgcactctgcctcttccaggtgccagaatcaagcctggcttttcagacagacggcttcctccaggtgcagtatgctatcccgtctaagcagcccgaatttcacattgagatcctctccatatag

SEQ ID NO: 56916 - DNA, 465 bp, Artificial Sequence
  Description of Artificial Sequence: Synthetic coding sequence
atgggcagcaaatgttgtaagggcggacctgacgaggatgccgtggagagacagaggaggcaaaaactgctgttagctcagctgcaccaccggaaacgagtcaaagccgcaggccaaatacaggcctggtggaggggcgtcctggtccggaggacgttgctggtcgccgcactgcgagcctggatgatccagtgttggtggcgtaccctagtgcaacggaggatcagacagagaagacaggccctgctgcgagtatatgtgatacaggagcaagccaccgtgaaactccagagctgcataagaatgtggcagtgcagacaatgctataggcagatgtgcaatgcactctgcctctttcaggtaccagagagctcactggcctttcaaaccgacgggtttctccaggtccaatacgccatcccaagcaagcaacccgagtttcatatagaaattctctcaatttag

SEQ ID NO: 56917 - DNA, 465 bp, Artificial Sequence
  Description of Artificial Sequence: Synthetic coding sequence
atgggctccaagtgctgcaaggggggacctgatgaagatgcagtcgagcggcagcgcagacaaaaactcctgttggctcagctccatcaccgaaagagggtaaaggcggctggccagatccaggcatggtggcggggagtgctggttcgcagaactctgttagtggcagccttacgcgcttggatgatccaatgttggtggagaaccctggtgcaaagacgaatccggcagcggcgtcaggccctgctccgggtgtatgtgattcaggagcaggccacagtgaagttgcagtcctgcataagaatgtggcagtgccgccagtgctaccggcagatgtgtaatgccctctgtctatttcaggttcccgaatcttcactagcttttcagacagatggttttctgcaggtgcaatacgccattccctccaagcagcccgaattccatatagaaatattgtccatttag

SEQ ID NO: 56918 - DNA, 366 bp, Artificial Sequence
  Description of Artificial Sequence: Synthetic coding sequence
acgaaaaaaaaaaaaaagaaaaagaagcgaaaagagaagaaactgcgtgaaaggtctgccgcagttttcattcaggcatggtggaggggaatgctagtgcgcaggaccctgctgcacgcagccctgcgagcttggatcatacagtgttggtggaggcaggtcttagagaagctgctggccaagcgccgacggatggttttggagttttacgtacaacaagagtgggctgctgtccggcttcaatcctgggtgcgcatgtggtgcgtgcggcaacgctattgccggcttctgaacgcagtcaggatcatccaggtgtattggcgatggcatagctgtcactctagggtatttattgaaggacactag

SEQ ID NO: 56919 - DNA, 447 bp, Artificial Sequence
  Description of Artificial Sequence: Synthetic coding sequence
atgggacctgaagagaagactataatgacagagcgcagcgcggctgtctttattcaggcgtggtggcggggaatgttggtgagacggaccctcctgcatgccgctctcagggcttggattatccaatgttggtggcgacaagtgctagaaaagcttctggccaaaagaaggaggatggtactggaattctatgtccagcaggagtgggctgctgtgcgattgcagtcatgggtgcggatgtggtgtgtgaggcagagatattgccgcttgctaaatgcagtgagaattattcaagtgtactggcggtggcactcatgtcacagtagagtgttcatcgaggggcattatgagctgaaagaaaaccagttaaatatccagctagaaattagcctgggcctgcaagcttgcaaagtccagcaatgtatcccacttccactaaaagagtag

SEQ ID NO: 56920 - DNA, 324 bp, Artificial Sequence
  Description of Artificial Sequence: Synthetic coding sequence
atggttaggcgcactctactccaggccgcattgcgcgcttgggtgattcaatgttggtggcgctctatgcaagcaaaaatgctcgagcagaggcggcgactcgccctaaggctgtacacctgtcaggagtgggcagtggtaaaagtccaggcgcaagtccggatgtggcaagctcgcagaaggttcctccaggctcgccaggcagcctgtatcattcagagccactggcggtggcacgcatcccagactcggggattaattcgcggacactacgaggtccgcgctagccgcttggaactggatatagagattctgatgacatag

SEQ ID NO: 56921 - DNA, 570 bp, Artificial Sequence
  Description of Artificial Sequence: Synthetic coding sequence
atggcagccccaaggcagatcccaagccatatagtccgtctgaaaccttcctgcagtacagattcatcgttcactcgtacacccgtgcctactgtaagtctggcttcacgggaactgccagtgtctagctggcaggtaacggagcccagctcaaaaaacttgtgggaacagatctgtaaggagtacgaagctgaacagcccccattcccagagggctataaagtgaagcaggagcctgttatcactgttgcaccggttgaggaaatgctgttccatggcttttctgcagaacactactttccagtgagccactttaccatgattagccggaccccttgccctcaggacaaatccgaaactatcaatcccaagacctgtagccccaaggagtatttagagacctttatattccccgtgctgctcccaggtatggcatccctgctccatcaggcaaagaaggagaagtgtttcgagcctaccgctgcaaacccaactttggccccagcggatcgtaggggaagcagccctctgcacagcatcttgcttgagtctctgtgtggtagcctgtag

SEQ ID NO: 56922 - DNA, 864 bp, Artificial Sequence
  Description of Artificial Sequence: Synthetic coding sequence
atggccgcaccccgtcagatcccatcacacatcgtgcgactgaagccaagttgttccacagatagtagctttacccgcacacccgtgcccacagtatcattggcctctcgggagttgccagtctcctcgtggcaagtcactgaaccctcatctaaaaacctttgggagcaaatttgcaaggaatacgaggcagaacagcctccatttcccgaaggatacaaagtgaagcaggaacccgtgataacagtcgcccctgttgaagaaatgctgtttcatggtttttccgctgaacattacttccctgtgagccactttactatgataagcaggactccctgccctcaggacaaaagtgagaccatcaatccgaagacctgcagtccaaaagagtatttagagacattcattttcccagtgttgctaccgggaatggccagcctgctgcatcaggccaaaaaggagaaatgttttgagaggaagcgcacaaagtttatagcatgcgacttcctgaccgagtggctgtataatcagaacccaaagagagcaggtgaaccctttacagagttcttctcgatcccgtttgtggaggagcgcctcaaacagcaccctcgcccaccaattcctttgtctctgttgttgactgaagaggaggctgccttgtacatccagtcattctggagggcctgcgtagtgagatgcgatcccgagatacaggaactgcggcagtggcagaagaaattgcgcgaagctaaacatatccaccagcaggtgaaaattttctgggcaaaacaggaacagaaggtaaaatgtaagatggaggacgacgctgtgcccgctgcgaaaatgaaaattccatcaagttag

SEQ ID NO: 56923 - DNA, 600 bp, Artificial Sequence
  Description of Artificial Sequence: Synthetic coding sequence
atgctcttccacggattttccgctgagcactacttcccagtgtcccactttacaatgattagcagaacaccttgtccacaagacaagagcgaaaccatcaaccccaaaacctgttccccgaaggagtacctcgagacattcatttttcctgtactgctgcccggaatggcctctttgctgcatcaggctaagaaggaaaaatgtttcgagcgaaagaggacaaagtttatcgcttgtgactttttgactgaatggctttacaatcagaatcccaaacgtgcaggcgagcccttcacggaattcttcagcatccccttcgttgaggaaaggctgaaacagcacccccgtccaccgatccctctgtccctgctgcttacggaggaggaagcagccctatacatccagtctttttggagagcctgcgtggttcgctgtgacccagagatccaggagctgcgtcagtggcagaagaaattacgtgaagccaaacatattcaccagcaggtgaagatattctgggcaaaacaagagcagaaggtgaaatgtaaaatggaggacgatgcagttccagccgctaaaatgaaaattccttcatcctag

SEQ ID NO: 56924 - DNA, 720 bp, Artificial Sequence
  Description of Artificial Sequence: Synthetic coding sequence
atggcagcccctcggcaaatacccagtcacatcgtccgtttgaagccctcttgcagcaccgactcgtcttttacaagaactccggtcccaactgtgagcctagcatcccgtgaactcccggtctcgagctggcaagttacagaaccgagcagcaagaacctgtgggagcagatctgtaaagaatatgaggccgaacaaccgccattccccgagggctacaaagtcaaacaggagcctgtgatcacggtcgcccctgtggaggaaatgttattccacggcttcagcgctgagcactatttcccggtgtctcactttaccatgatcagtagaacaccatgtccccaggacaagagtgagaccattaaccccaagacatgcagccctaaggagtacctcgaaacattcatcttccccgtgcttttacctggcatggccagcttgttacatcaggctaagaaggagaaatgtttcgagcgtaagcggactaagtttattgcttgcgacttcctgaccgagtggttatataatcagaaccccaagcgggcaggggaaccttttaccgagtttttctccatcccctttgtcgaagaacgcctcaagcagcagttcgccgtaatccttcgcttcaaaaactgcgtatccggacggcgaaattttgcgaggccaagcacctttacctccaaaagcaagttctcgggcccatcaaagaataagaaatag

SEQ ID NO: 56925 - DNA, 2460 bp, Artificial Sequence
  Description of Artificial Sequence: Synthetic coding sequence
atgtacaataaaatgtggcaccagactcaagaagcgctgggagctctactggacaaggaaccccagaagatgatcgaaccccagagaaaccaggtttttatattccagaccttggctactttctacgtgaagtacgttcagatctttagaaaccttgagaacgtgtacgatcagtttgttcatccccagaagaggatcctcattcgaaaggtgctggacggcgtgatggggcgaatcctggagctgaagaatgaaatggtagagctggagctgactgaatttcactatttcgacgacatcttgcaagatctgaaactggcaccacagcagctggatattccaatccccaagtatttcctgaaggagaaactggaagtgatcaaaggacgggagaagattctggcacagattctggcagactccgggatcgacacatccgatatgaaatacccggttaagtcgattccctttgacgaggccgtaaagctgattcagatcgctgagagagccagacagggtcggctgagggctctattcatgaagcagatttatttgcaggaatatagggccaagcagtccaagatgctgggaaaaaaggtcacagacacctgggctgctgctttgagaatccagaaagtatggcgcaggttccatcagcggaaagagaccgaaaagctacgggaggaagagatgatattcctcggcatgaatcctcctcctctattcaatgaggtctcggccactgttatccaggctgaaaaggttgatagactgcgcaacgaggtccagatcaaacacgaggaggactatcgggaggcccttgtgaccataaaaaacgacctgaaactaatcgaaggcgtggatatcaaggagaaccttcaagatcagatcagacattggtttattgaatgccgtaatttgacaggaactttccctgactatccagatgtcgaggaagggggatctgctataatctttagtgacaaaacaatccaacaagtgatcgaagacatcatcgctaaccaagaggaagaggagaaaaacaaaaagaagaaaaagaagaaagagaagcagcccaagaaagccaagaaacagaagaaaggcactaaggaaaaaaacaaggaggaagatgaaaagtggaaaatgtcgccttcccttttcttacccgctatgaaggaggggtgtaatgcctacaaggaaatttggatgaagaaagatgagagctggaatttcagtcaggactacgacccggagctgattaaggaggagaaacgaaaggagttgcagagtgaaatccgcatacaagtggacgaactcatgcgacaagagctgaaaaacctgaaactggctgtcgaccgagagagggaaaggccagtcaaggcgggtaagaaaaaggataaaaagaaaggcaagaaaggtaagaagaaggaaaagaaagccaagaaggataaggatttgacagccgatagaacgatagagagcctgtacaaggagctggttgaggagggcctgctgattcaggctctgaaagtgaatctgagtgactatattggggaatactcctacctgggcactacgcttcgacaagtgagcatcgagccaatgcctagcttgctggatgtccgccagctaattacactatacgggatttggcccctcggttccgccgcagttcacgagaaggctcccctcgttaagtctcttctgctagcaggcccttccggagtgggtaagaaaatgctcgttcacgccatttgcaccgaaactggggcaaacctttttaacctgtcctcttctaatattgccggtaaatatcctggaaaaaacgggttgcaaatgatgctgcacgccgtgtttaaggttgcgcgtcaactgcagccttccgtggtatggattgaagacaccgagaagacattctataagaaagttccaaacgctgagaagatgaatgagcctaaaaggttaaagaagcacctacctcagatcctgaagctactaaaacccgacgatcgtattctgatcgtaggcactacccggcgacctttcgacgcagagttacagagcttctgcaaggtctaccagaagattatcttggtgcccaggccagactatgcatctcgctacgttttgtggaagcagataatcgagaggaacggaggcgtgctgacatcggcgttaaacgtgtcatgtctggccaaggtcacagatgggttcacacagggccatatcgtcgaggttgtgaaaggggtgttgactgatcagagaattagaaggcaaatccataagcccctgactgccgtggaattcattaccgccataacttctatgaaccccgtgtacaaggaggaggaggaaagtttcaagaactggtatgctaagactcctctaggcaagaagcgcgctctggctattaccggcggtagcactgagaaggccaaggacaagggaaagcggaaatag

SEQ ID NO: 56926 - DNA, 2469 bp, Artificial Sequence
  Description of Artificial Sequence: Synthetic coding sequence
atgtcaaacgctatgtataacaagatgtggcaccagactcaggaggcgctcggagcccttttagacaaagagccacagaagatgattgagcctcagagaaaccaggtattcatctttcaaacgctggctacgttttacgtcaaatacgtacagatattcagaaatcttgagaatgtgtacgaccagttcgtccacccccagaagcgaatcttaatccgaaaggtcctggacggagtgatggggaggatactggaattgaaaaatgagatggttgagctggagctgaccgagttccactatttcgacgatatactacaggacctaaagttggcaccacagcaactggatatccccattcccaagtactttttgaaagagaaattggaagtgataaagggcagagagaaaatcttggcccaaatcctggccgactccgggatagatacgagcgatatgaaatacccagtgaagtctatccctttcgatgaggcagttaaactcatccagattgctgaacgggctaggcagggcaggctcagagccctttttatgaagcagatctatctccaagagtacagagctaagcagtcaaaaatgctcgggaagaaggtcaccgatacctgggctgccgctctgcgcatccaaaaggtgtggaggcgctttcaccagcgcaaggaaacggagaagctgagggaagaggagatgattttcctcggcatgaatccccctccactgttcaacgaggtgtcagcaaccgttattcaggctgaaaaggtcgaccgcctgcgcaacgaggtgcaaatcaagcatgaggaggactatagagaagccttagtaaccataaaaaatgacctcaaactgatagaaggggtggatatcaaagagaacctgcaggaccagatccgacactggtttatcgaatgtcggaacctgaccggtactttccccgattatcccgatgtcgaagaaggaggtagcgccattatttttagcgataaaactattcagcaggtgatagaagatattatcgcaaaccaggaggaggaagaaaagaataagaagaaaaaaaagaaaaaggagaaacagcctaaaaaggccaagaagcagaaaaaaggaaccaaagagaaaaataaggaggaagacgaaaagtggaaaatgtccccatccctcttcctgccggctatgaaggaaggatgcaatgcttataaagaaatctggatgaagaaagatgagtcctggaattttagtcaagattatgacccagagttgatcaaggaggaaaaacgcaaagagctccagtcagagatccgtatccaggtagatgagctgatgagacaggaactgaagaacctcaagctggccgtggatcgagaacgagagagacctgtgaaggccggtaaaaaaaaggataagaagggaaagaaggggaaaaaaaaagagaaaaaagcaaaaaaggacaaagaccttactgccgataggacaatcgaatctctgtataaggagctggtagaagagggtctcttgatccaggctctgaaggtgaacttgtcggactacatcggggaatactcctaccttggaactaccctgcgccaggtgtccatcgaaccaatgccttcactgcttgacgtgcgccagctgatcaccttgtatgggatctggccgctcggcagtgccgctgtccatgagaaggccccactggtgaagagcctgctgcttgctggaccctccggagttgggaagaaaatgctcgttcacgcgatctgtactgaaacaggcgctaacctgtttaacctgagttcttccaacatcgctgggaaatacccagggaaaaacggcctgcagatgatgctgcacgcagttttcaaggtggcgcgtcagcttcagcccagtgtcgtgtggattgaggacactgagaaaactttctacaaaaaggttcccaacgcagagaaaatgaacgagcctaaaagattaaagaagcacctccctcagatcctgaagcttctgaagccagacgaccgaattctgatcgtgggtaccactcgacggccttttgatgccgagctgcaatctttctgcaaagtatatcagaagatcattttagtgcccagacctgattatgctagtaggtacgtgctttggaagcagataatcgaaaggaacggcggagttctgacatctgcgctgaacgtgtcatgtcttgccaaggtgactgatgggttcactcaaggccacatcgtggaggttgttaaaggtgtgctcacggatcagcggatccggaggcaaattcacaagccgctcactgcagttgagttcataaccgccataacctccatgaatcctgtctataaagaggaggaagaaagttttaaaaattggtacgccaaaactcccctcggtaagaagcgggctttggcaatcacaggtggtagcaccgagaaggctaaagacaaagggaagagaaagtag

SEQ ID NO: 56927 - DNA, 2013 bp, Artificial Sequence
  Description of Artificial Sequence: Synthetic coding sequence
atgtacaacaagatgtggcatcagacccaggaggctctcggtgcattgttagacaaagagccccagaaaatgatcgagccacaacggaaccaggtgttcatattccagaccttagcgacgttctacgttaagtacgttcagatctttaggaatttggaaaacgtctatgatcaattcgtgcaccctcaaaaacggatactgattaggaaagtgctcgatggggttatgggaagaatattggaactgaaaaacgagatggtcgaactggagcttactgaatttcattactttgacgatatcctgcaggatctcaagctggctccccaacagctggatatcccaatacctaaatacttcctaaaggagaagctcgaggtcattaaagggagagagaaaatactggcccagattttagcagactcagggattgacaccagtgacatgaaataccctgtgaagagcattcccttcgatgaggcagttaagctgatacagattgctgagagagctcgccaggggagactccgggctttgtttatgaagcagatctatctccaggagtatcgagccaagcagtctaagatgctgggtaagaaggtgaccgacacatgggcagccgctttgcgaatccagaaagtttggcggaggttccaccagcgaaaagagaccgagaagctgcgggaagaagagatgatcttcttgggaatgaacccacccccactgttcaacgaagtgagtgcaacagtgattcaggcagaaaaggtagatagattgaggaacgaagtgcagatcaaacacgaggaggactacagggaggctcttgttacaatcaagaatgatctaaaattgattgagggggtggacattaaagagaatttgcaagatcagatacgccattggttcatcgagtgccgcaatctgacaggaaccttcccagactatcccgacgttgaggaagggggaagcgcaattatcttttccgacaagacaattcagcaagtgatcgaggatattattgccaaccaggaggaggaagaaaaaaataaaaagaaaaagaaaaagaaagaaaagcagcccaaaaaggctaaaaaacagaaaaaagggaccaaggagaagaataaagaggaagatgagaaatggaagatgagtcctagcctttttctccctgcaatgaaggagggctgtaacgcctataaagagatctggatgaagaaagacgagagctggaatttctctcaagactacgaccccgaattgatcaaagaggaaaagagaaaggaactgcagagcgagatccgcatacaggtggacgagcttatgagacaggagctcaaaaacctgaagctagccgtggatcgcgagcgcgagcgacccgtgaaagctggaaagaagaaggataagaaaaaagggaagaagggaaaaaaaaaggagaagaaagcaaagaaggacaaggatctgactgcagacagaacgatcgagagtctgtacaaggaactggttgaggaggggctcctcattcaggccctgaaggtcaatttatccgattacataggagagtattcctatttaggcaccaccctgcgtcaggtgtccatcgaacctatgcccagtctgcttgacgtccgtcagctgatcacgctctatggaatctggccgctcggtagcgctgcagtgcatgagaaagccccattggtcaaatctcttctactcgccggtcccagcggcgttggaaaaaagatgctggtccatgccatctgtacagaaaccggagctaacttgtttaacttgtcgtcttctaatatcgccggtaaataccctggaaagaacggccttcagatgatgctgcacgccgttttcaaggtggctcggcagctgcagccaagcgtggtgtggatcgaagacactgaaaagaccttctataaaaaggtgcccaatgccgagaaaatgtttacaccctccgccggagaggtcgcagctctccagaagaatctgaagcgctccaccagccgctag

SEQ ID NO: 56928 - DNA, 2346 bp, Artificial Sequence
  Description of Artificial Sequence: Synthetic coding sequence
atgtcaaacgctatgtataacaaaatgtggcaccaaacacaggaggcactgggcgctctgttagacaaggaaccccagaagatgattgagcctcaaaggaaccaggtgttcatttttcagaccctggcgacgttttatgtgaagtatgtacagatcttccgcaacttggagaatgtgtacgaccagttcgtgcatcctcagaaaagaattctgattcggaaagtcctggacggcgtcatgggaaggatccttgagctgaaaaacgaaatggtcgagctagagctcactgagtttcactatttcgacgacatcttgcaggatctgaagttggcccctcaacagctggatattcccattcccaagtactttctcaaggagaaactcgaagtgatcaaaggcagggaaaaaattcttgctcaaattctggcagacagtggtattgatacttcggacatgaagtacccagtgaaatccatcccctttgatgaggccgtaaaacttattcagatcgcggaacgcgcaagacaggggaggctgagggccctgtttatgaaacagatttacctccaagagtacagagccaaacaatctaagatgctgggcaagaaagtcactgacacatgggccgcagctcttcggatacaaaaagtgtggcgcaggttccatcagcgaaaggaaacagagaagctcagagaggaggaaatgatattcctgggcatgaaccccccaccgttgttcaatgaagtaagcgcaaccgtaattcaggccgaaaaagttgacaggctgcgcaatgaggtccagataaaacacgaggaagactatcgcgaggcactggtcactatcaaaaacgaccttaaactcatcgagggtgttgatatcaaggaaaacttgcaggatcagattaggcattggttcatcgaatgccgaaacctgacaggcactttccccgactacccagatgtggaggaaggcggttccgcaattattttctctgacaagactattcagcaggaggaggacgagaagtggaaaatgagtccctcactctttttacctgccatgaaagaaggatgtaacgcgtacaaagagatctggatgaagaaagatgaatcttggaacttctcccaggattatgatccggagcttattaaggaagagaagaggaaggaacttcagagcgagatccgtatccaagttgatgaactcatgaggcaggagctgaagaatttgaagctggccgttgacagagagagggaacgccctgtgaaggccggtaaaaagaaggacaagaaaggaaaaaagggcaagaagaaagagaagaaggctaagaaggacaaggatctgaccgctgatagaaccattgaaagtttatacaaagaactggtcgaggaaggacttcttatccaggcccttaaggtgaaccttagtgattatataggggaatattcttatttgggtacaacactgcggcaggtttctattgagcctatgccctcccttctcgacgtaaggcagttgatcaccctgtatgggatctggccgctgggctcagcagctgtgcatgagaaggcaccgttggttaaatccctactgttggctggcccaagtggcgtcgggaagaaaatgttggttcatgccatctgcaccgagacaggagccaatctgttcaacctaagctcgtctaacatcgccggtaagtaccctgggaagaacggattacagatgatgcttcacgctgtatttaaggtagcaaggcaattacagccaagcgtggtgtggatcgaagacactgaaaaaaccttctataaaaaggtacccaatgctgaaaaaatgaacgaacccaaaagactcaaaaagcacctgcctcagatccttaaacttcttaagcctgatgatagaatcctgattgttggtacaacaaggaggccgttcgatgcagaactgcagagcttttgcaaagtttaccaaaaaataatcctggtgcctcggcctgattatgcgtccaggtatgtattgtggaagcagataatcgagagaaatggcggtgtactgacttcggctctcaacgttagctgcttggcaaaggtcaccgacgggtttactcaggggcatatcgttgaggtggtgaaaggggtcctcaccgaccaacggatacgcagacagattcacaaacccttgaccgctgtcgagttcatcactgctattacctcaatgaatccagtgtacaaggaggaagaggagtcattcaaaaattggtacgcaaagactcctctggggaaaaaaagggctctggcaatcacaggcggatctaccgagaaagccaaggacaaaggcaaaagaaagtag

SEQ ID NO: 56929 - DNA, 2493 bp, Artificial Sequence
  Description of Artificial Sequence: Synthetic coding sequence
atgacgccctctttatctgccgaagaaaacaggatgtacaacaagatgtggcaccaaacgcaggaagctcttggcgctctcctagacaaagaacctcagaagatgatcgaacctcagcggaatcaggtatttatcttccaaaccctggcaacattttacgtgaagtacgtccagattttcagaaatctagaaaacgtatatgaccagttcgtgcatccgcagaagagaattctcattcgtaaagtgttagacggtgtgatgggccgaattctcgagcttaagaatgagatggtggagcttgaactgacagagttccactatttcgacgatattctccaagatttgaagctagctccccagcagctggacatcccgattcccaaatatttcctcaaagaaaagcttgaagtcatcaagggcagagagaaaatcctcgctcaaatcctcgcagactcagggatagacacgtcagatatgaaataccccgtgaagtctatccccttcgacgaagccgtgaaactcatacagattgccgaaagagcacgacagggcagattgagggcattgttcatgaagcagatttacctgcaggagtacagagccaagcagtccaaaatgcttgggaagaaggttaccgatacttgggctgctgccctgcgaatacagaaagtttggcgcagatttcaccagcgcaaagagacagaaaaactgcgagaagaagaaatgatattcctgggcatgaaccctccacctttattcaacgaggtctctgccacagtgattcaggcagaaaaggtggacagattacgaaacgaggtccagataaagcacgaggaggattatcgagaggctctagtgacgattaagaacgatcttaagttgattgagggtgttgacatcaaagagaacctgcaggatcagatccgacactggtttattgagtgtagaaacctgaccggcacgttccccgattaccctgatgttgaggagggtggcagtgccatcatcttctcagataaaaccatccagcaggtcatcgaggatattattgccaatcaggaggaagaagaaaaaaacaaaaagaagaagaaaaagaaggaaaaacaacctaaaaaggccaagaagcagaagaagggaactaaggagaaaaacaaagaggaggacgaaaagtggaaaatgagcccatccctgtttctacctgccatgaaggagggctgcaatgcgtataaggaaatctggatgaagaaggatgagagctggaacttctctcaggactacgaccctgaattaatcaaagaagagaaacgcaaagagctgcagtccgaaatccgaatacaggtcgacgagctcatgaggcaagagcttaagaacctcaagcttgctgttgaccgagaaagagaaaggcccgtcaaagctggcaagaaaaaggataaaaagaagggcaagaagggaaaaaaaaaggagaagaaagctaagaaggataaagatcttactgccgaccggacaatcgaatccttgtataaagagctggtggaagaaggactgctcatacaggcccttaaggtgaacttaagcgactacatcggagaatactcttatctcgggacgacactgaggcaggtatccattgaacccatgccatctcttctggacgtgagacaactcatcactctttacggcatttggcctcttggttcagccgctgtccacgaaaaggcgcctctggtaaagtccctgcttctcgctggaccaagcggcgtaggtaaaaaaatgctggttcacgcaatctgcacagaaacaggtgccaacctatttaatctgtcctcctccaatattgccggaaaatatcccggaaagaacggcttgcagatgatgctccatgcagtcttcaaggtggcgcgtcagctgcagcctagcgttgtctggatcgaggataccgaaaaaaccttttacaaaaaagtgcccaatgctgagaaaatgaatgaacctaagcgactgaagaaacatcttccacagatcttgaaactcttgaaacctgatgaccgcatccttatcgttggcacgaccagacgtccctttgacgccgaactacagagtttctgtaaggtgtatcagaagataatcctggttcctcggcctgattacgcctcacggtatgtgctgtggaagcagatcatcgagaggaacgggggagtcttgaccagtgctctcaatgttagttgcttagctaaggtgactgacggattcacacagggtcacattgttgaggtcgtcaagggcgtgctaacagaccagaggatacgaagacagattcacaagcccctaacagcagtcgagttcatcaccgcaataacttcgatgaaccccgtatataaggaagaagaagagagcttcaagaactggtacgccaagaccccactggggaagaaacgtgcactcgccatcactggcggatcgactgagaaggccaaagataagggaaagaggaagtag

SEQ ID NO: 56930 - DNA, 1449 bp, Artificial Sequence
  Description of Artificial Sequence: Synthetic coding sequence
atggattcgttcgggcagccgaggcccgaagacaaccagtctgtcgtacggcgaatgcagaagaaatattggaaaaccaagcaggttttcatcaaggccactggaaagaaagaggatgagcatctggtggccagtgacgcggagctggatgccaaactcgaagtcttccatagcgtacaagagacctgcactgagctgctgaaaatcatcgagaagtatcagctgagacttaacgttatttccgaggaagagaacgaacttgggctctttctcaaattccaggccgaacgcgatgcaactcaggcaggcaagatgatggatgctaccggtaaagcactgtgtagttctgccaaacaaaggctggctttgtgtacgccgttgtccagactcaaacaggaggttgctacattttcacaacgtgctgtgagcgacactctgatgactatcaatagaatggagcaggctagaaccgaataccggggagcacttctctggatgaaggatgtgagtcaggagctagatccggatacactaaaacaaatggagaaattccgcaaggtgcagatgcaggtgaggaattcaaaagcatcattcgacaagctgaagatggatgtttgccagaaggtggatctgcttggcgcttctcgctgcaacatgctttctcatagcttaaccacttaccagcggaccctgctgggattttggaagaagacggccagaatgatgtcacagattcatgaagcttgtattggtttccacccgtatgacttcgtggccctaaaacaactccaggacacccctagcaagatcagcgaggacaataaggacgagcagatcggcggtttcctgaccgagcagctgaacaagctggtgctgtctgacgaagaagccagcttcgagtcagagcaggctaacaaggaccataatgagaagcactctcagatgcgcgagtttggggcaccgcagtttagcaactccgaaaatgtggccaaagacctgcctgttgactccctggaaggagaggatttcgaaaaagaattcagcttcctaaataacctcctctcatccgggtcatcctccacgtccgagttcacacaggagtgccagactgcctttggctcacccagtgcgtccctgacttctcaggaaccttctatggggtctgaaccgctggctcattcttcgcgttttcttccatcgcagctcttcgacctgggatttcacgtggcgggagcatttaacaactgggtgtcacaggaagagtctgaattgtgtttgtctcatacagacaatcagccagtgccttcacagtctccaaaaaaacttactagatctcccaacaacggaaatcaggacatgtcagcttggttcaaccttttcgcggacctagaccctctctcaaaccccgacgcgataggtcacagcgacgacgagttgctgaatgcatag

SEQ ID NO: 56931 - DNA, 1449 bp, Artificial Sequence
  Description of Artificial Sequence: Synthetic coding sequence
atggactcgttcgggcagccaagaccagaagataatcagtccgtagtgcgcagaatgcagaagaagtactggaagactaaacaggtgtttatcaaagccacagggaagaaggaggatgaacatctagtggcgagcgatgcagagctagatgcaaagttggaagtgttccatagcgtccaggaaacctgcaccgaactgctaaagataattgaaaagtaccagctgcgcttaaatgttatttctgaagaagagaatgaactgggcttgttcttgaagttccaggcagagagagacgccacccaggctggaaaaatgatggatgccaccggaaaggctctgtgttcttcggctaaacagcggttagccctgtgcaccccgctgtcacgcttaaaacaggaggtggcaaccttctcacagagggcagtgtccgatactttgatgactatcaatagaatggagcaggcacggacagaatatagaggagcattactatggatgaaggatgttagccaggaactggaccccgacacgttaaagcagatggagaaattcagaaaggtccaaatgcaggtgaggaactccaaagcctcttttgacaagctgaagatggacgtgtgccagaaggtggacttactgggcgcttctcgctgcaacatgttgagccactccctaacgacatatcagagaacactactgggcttctggaagaaaaccgccagaatgatgtctcagatccacgaggcttgtatcggttttcatccctatgactttgtcgctcttaaacagctccaagataccccctcaaaaatcagcgaagataacaaagacgagcagattggaggattcctgaccgaacagctgaataaactggtcctgagcgacgaagaggcctcatttgaaagtgaacaagctaacaaagatcacaacgagaagcactcccagatgcgggaattcggggctccacagttctctaacagcgagaacgttgcaaaggacctacctgtggatagtctggaaggcgaggactttgaaaaggaatttagttttttgaataatctgcttagcagcggatccagctcaacttccgagttcacccaggaatgtcagacggctttcggcagtccgtccgcctccctgacatcccaagagccatctatgggcagtgaaccccttgcgcattcctcacgattcctgccatcacagctgtttgacctgggatttcatgtggccggtgcttttaacaactgggttagtcaggaagagtccgagttgtgcctgagccacacagacaaccaacccgtgccatcacagtccccaaaaaagttgacccgatcccccaataatgggaaccaggatatgtcagcttggttcaacctcttcgcagatctggaccccctcagcaatcccgacgccatcggacattcagacgacgagttgctgaatgcctag

SEQ ID NO: 56932 - DNA, 237 bp, Artificial Sequence
  Description of Artificial Sequence: Synthetic coding sequence
atggactccttcggtcagcctcgccctgaggacaaccagagtgtagtgcggaggatgcaaaaaaaatattggaagactaagcaggttttcataaaagccactggtaagaaagaggacgagcacctcgtggcgagtgacgccgaactggatgcaaagcttgaggttttccattcagttcaggaaacttgtaccgagctgctgaaaatcatcgagaagtaccagttgaggctgaactag

SEQ ID NO: 56933 - DNA, 360 bp, Artificial Sequence
  Description of Artificial Sequence: Synthetic coding sequence
atggattctttcggccagcctcgccctgaggacaaccagagcgtggtgcggagaatgcagaagaaatactggaagacgaaacaagttttcattaaggctaccggcaagaaagaagatgaacatctcgttgcttccgacgcggaactagacgcgaaacttgaggtctttcactctgtgcaggaaacttgcacagagcttctgaaaatcatcgagaagtaccagttacggctaaacgtaatcagcgaggaggagaacgaactgggactgttcttaaaattccaagctgagcgggatgcaacccaggcaggcaaaatgatggatgctaccggaaaagccttatgtagttctgccaagcaatag

SEQ ID NO: 56934 - DNA, 297 bp, Artificial Sequence
  Description of Artificial Sequence: Synthetic coding sequence
atggattcctttgggcagcccagaccggaagacaatcagagcgtagtcaggcggatgcagaagaagtactggaaaacaaagcaggtgtttataaaagccacgggcaagaaggaagatgagcatctagtcgcctctgacgcggagctagacgccaagcttgaggtctttcatagtgtgcaggagacatgcactgagcttctaaaaattatcgagaagtatcaactgaggctgaacgtcatcagcgaagaggagaatgaactcggtctttttctcaaattccaggctgaaagggactag

SEQ ID NO: 56935 - DNA, 375 bp, Artificial Sequence
  Description of Artificial Sequence: Synthetic coding sequence
atggattccttcggacagcctcggccagaagataaccaaagtgtggtccgaagaatgcagaagaagtactggaagaccaagcaggtgtttatcaaggccaccggcaagaaagaagatgagcacttggtagcaagtgacgctgaactcgatgccaagctcgaagtgtttcactccgtccaggagacttgcactgagctgctgaagatcatcgagaaataccaattaaggctgaacgtcatctctgaggaagaaaacgaacttggtttgtttctgaagtttcaggctgaacgcgacgccacccaggccggaaagatgatggacgccacaggaaaagccttgtgttcaagcgccaagcagagactggcgctgtgttag

SEQ ID NO: 56936 - DNA, 129 bp, Artificial Sequence
  Description of Artificial Sequence: Synthetic coding sequence
atggactccttcggccagccccgaccagaagacaatcagagcgtggtgcgccgaatgcagaagaagtattggaagaccaagcaggtctttatcaaagccaccgggaaaaaagaagacgaacatctgtag

SEQ ID NO: 56937 - DNA, 300 bp, Artificial Sequence
  Description of Artificial Sequence: Synthetic coding sequence
atggactctttcggtcagcccaggccggaagataatcaatccgttgtgcgacgaatgcagaagaagtactggaaaactaagcaggtctttattaaagccacgggcaagaaggaggacgaacatctggtggcctccgacgcggagctggacgccaagctggaagtgtttcacagtgtgcaggagacctgtactgagctcctgaaaataattgagaaatatcagctgaggctcaatgttatctcagaagaggagaacgaacttggactgtttctgaaattccaggctgagagagacgcctag

SEQ ID NO: 56938 - DNA, 405 bp, Artificial Sequence
  Description of Artificial Sequence: Synthetic coding sequence
atggattcattcgggcagccacggcctgaagataaccagtctgtcgtgaggcgcatgcagaagaaatattggaagactaagcaagtctttattaaggcgactggtaagaaagaggacgagcatctggttgcttcagatgctgagctggatgccaagttggaagtcttccatagtgtccaggaaacctgtacagaactgctgaagattatcgagaagtatcagttgaggctcaacgttattagtgaagaggagaatgagctgggcctgtttttgaagtttcaggcagaaagagatgcaactcaggctggaaaaatgatggacgccactggcaaggcattgtgttcttcggccaaacaacggctcgccctgtgcacgcccttatcacggctgaagcaggaagtgtag

SEQ ID NO: 56939 - DNA, 360 bp, Artificial Sequence
  Description of Artificial Sequence: Synthetic coding sequence
atggattcattcggccagccacggcctgaggacaatcagagtgtcgttcgaagaatgcagaaaaaatactggaaaacaaagcaggtctttatcaaagcaaccggaaagaaagaggatgaacatctcgtggcctcagatgccgaactggatgccaaactggaagtctttcacagtgtccaggagacctgcacagagttgctgaaaatcatcgaaaagtaccagctcaggctgaacgtaatcagcgaagaagagaacgagctaggcctgttcctaaagttccaggccgagagggatgctactcaggcaggcaaaatgatggacgctactggtaaggctttgtgtagcagtgccaaacaatag

SEQ ID NO: 56940 - DNA, 456 bp, Artificial Sequence
  Description of Artificial Sequence: Synthetic coding sequence
atggacagctttggacagccgagacctgaggataaccagtctgtggtccgacggatgcagaagaagtattggaagaccaaacaggtgttcatcaaggccacaggaaagaaggaggacgaacacctggtcgcgtctgatgcggaactggatgctaaacttgaagtctttcacagtgtgcaagagacgtgtactgaattactgaaaattatagagaagtatcagctgaggctaaatgtgatcagtgaagaagagaatgaactggggttgttcttgaagttccaagccgagcgcgacgctacacaggccggtaaaatgatggacgcaacaggcaaggcactgtgtagcagtgctaagcagagattagccctttgtacaccgcttagtcgcctgaaacaagaggtggctaccttttcccagagagcagtttccgatacattgatgactattaatcggtag

SEQ ID NO: 56941 - DNA, 294 bp, Artificial Sequence
  Description of Artificial Sequence: Synthetic coding sequence
atggattcctttggacagccgaggcctgaagacaatcagtcagtggtcaggcgcatgcagaaaaagtactggaagactaagcaagtgttcattaaagccacaggcaagaaggaggacgaacatctggttgcttccgacgcggaactggacgccaagctggaggtgttccattctgtacaggaaacgtgcaccgagttattgaaaatcatagagaaatatcaactgcgactgaacgttatttcagaagaggaaaatgagttgggactgttcctgaaatttcaggccgagagatag

SEQ ID NO: 56942 - DNA, 303 bp, Artificial Sequence
  Description of Artificial Sequence: Synthetic coding sequence
atggacagcttcggtcaaccacggccagaggacaaccaatcggttgttaggcgcatgcagaaaaaatattggaagacaaagcaggttttcatcaaggccactggcaagaaagaggatgagcatctcgtagcatccgatgccgagcttgatgcgaagttggaggtgtttcactcagtgcaggagacttgcactgaactcctgaaaatcatagagaagtaccagctccggttgaacgtgatttcagaagaggagaatgaactcggactgttcctgaagtttcaggccgagagagacgccacgtag

SEQ ID NO: 56943 - DNA, 408 bp, Artificial Sequence
  Description of Artificial Sequence: Synthetic coding sequence
atggtgcagtacctaaaaagtgtcgacatccccgagaatcgagtcatactgattaccccaactccactctgcgagactgcatgggaagagcagtgcatcatacagggctgcaagctaaaccgccttaacagtgtggtcggtgagtacgccaatgcttgtttgcaagtcgcccaagattgtggcaccgatgttctcgatctgtggacattgatgcaggactcacaggatttctcaagctacctaagtgatggactgcacctctcccctaagggaaatgaatttttgttttctcacctctggccattgatagaaaagaaagtgtcatctctgcctctcctgcttccctactggcgtgacgtggctgaagcgaagcccgaattgtccctgctcggcgacggagatcactag

SEQ ID NO: 56944 - DNA, 747 bp, Artificial Sequence
  Description of Artificial Sequence: Synthetic coding sequence
atggctctgtgtgaggccgctggatgcggcagtgccttgctctggcctaggctccttctctttggcgattcaattacacaatttagcttccaacaaggcggatggggtgccagcttggccgatcggctggtgcgtaagtgtgatgtactcaacaggggcttttccggttacaacactagatgggcaaagattattctcccacgccttatccgcaagggaaatagtcttgacatacccgtcgcagtgaccatcttcttcggggctaatgactcggctttgaaggacgaaaaccccaagcaacatataccgctggaggagtacgctgcaaatctgaagagtatggtgcagtacctgaaaagcgtggacatcccagagaacagggttattctcattactccgacacctctgtgcgagacggcctgggaggaacagtgcattatacaggggtgtaagctgaataggctgaatagtgtggtcggtgaatatgcaaacgcgtgtttgcaagtggctcaggactgtggcactgacgttctggacttgtggactctgatgcaggactctcaggacttcagttcctatctctccgacggattgcatctgagccctaagggaaacgagttcttgttcagccatttgtggcctctgattgagaagaaagtttctagccttccgctcttactgccctactggcgcgacgtggctgaagccaagccagagctttcactgttaggagacggggatcactag

SEQ ID NO: 56945 - DNA, 408 bp, Artificial Sequence
  Description of Artificial Sequence: Synthetic coding sequence
atggtgcaatatctcaagtctgtggatatcccggaaaatcgtgtgatcttaatcacacccactccattgtgcgagactgcttgggaggagcagtgtatcatccagggttgtaaactaaacaggctcaattcggtggtgggcgagtatgcaaatgcgtgcttgcaggtcgctcaagactgcggtaccgacgtgctggatctctggaccctaatgcaggattcccaggacttcagctcctatctgtcggacggcttgcacctcagtccaaaaggaaacgaatttctttttagccacttgtggccactgatagagaaaaaggtcagcagcttgccgctgttgctgccatactggcgcgatgtagctgaggccaaaccagaactaagtcttttaggggacggagatcactag

SEQ ID NO: 56946 - DNA, 1356 bp, Artificial Sequence
  Description of Artificial Sequence: Synthetic coding sequence
atggaggcgggtccacctggctcggccaggcctgccgaacccggaccttgcctgtccggacaaaggggcgctgaccatacagctagcgcaagcctgcaatccgtggctggtactgaacctggcagacaccctcaggccgtagctgcagtgttgcccgctggtgggtgcggagagcgaatgggggtgccgacacccaagcaattctgccccatcctcgagaggccgctgatatcctacaccctccaggcgctggagcgggtctgttggattaaagatatagtcgtcgctgtcactggagaaaacatggaggtaatgaagtcaatcatccagaagtatcagcacaaacgtatttccctggtggaggcaggcgtcaccagacacaggagcatctttaatggactaaaggcactggcggaagaccaaattaactcgaagctttcaaagcccgaggttgtgataattcatgatgcagtgaggccgtttgtcgaggagggtgtgctgttaaaggtggtcacagccgcaaaagagcatggcgctgccggagccatacggccattggtgtctactgtggtaagtccaagcgccgacggatgtcttgattactccttggaaagggcacggcaccgggcaagcgagatgccccaggcttttctgtttgacgtcatttacgaagcctatcagcagtgttccgactacgatctcgaattcggcaccgagtgtcttcagttggccctcaagtattgttgtacgaaagccaaactggtggaggggagccccgacctctggaaggtcacatacaagagagatttgtatgctgctgaaagcattattaaggaacgcatctctcaagagatatgcgtggtgatggacaccgaggaagataacaagcacgtgggccatctgctagaagaagtgttaaaaagcgagctgaaccatgtgaaagtgacttctgaagcactgggacacgcgggtagacatctgcagcagattatcttggatcagtgttataatttcgtctgcgtaaatgtgactacatccgacttccaagagacacagaaactgttgtcaatgctggaggaaagcagcctatgtattctctatccagttgtggtggtgtcggttcactttctggattttaaactggtcccccctagccagaaaatggagaacttaatgcaaatacgcgaattcgcaaaagaagtgaaagagcgcaacatccttctttacgggcttctcatctcgtacccacaggatgatcagaagctgcaggagtctctgcgccaaggagctattataatcgcctctctgatcaaggagaggaacagtggactgattgggcaactgctgattgcctag

SEQ ID NO: 56947 - DNA, 996 bp, Artificial Sequence
  Description of Artificial Sequence: Synthetic coding sequence
atggcacgaaatgcagagaaggcaatgactgctcttgcaagatttcgtcaggctcagctggaagaaggaaaagtgaaggaaagacgcccatttcttgcatccgaatgcaccgagctgcccaaagctgaaaagtggcgcagacagattattggggagattagcaagaaagtggcccagattcagaatgcgggtctgggagagttccggatcagggacttaaatgatgagatcaataagctactgcgcgaaaagggtcactgggaggtgcgtattaaggaattaggaggtccggattacggtaaggttggcccaaaaatgttagatcatgaaggtaaagaagtgccagggaatcggggatacaagtactttggtgctgctaaggacttacccggagttcgggagttatttgagaaggagccactgcctccacctagaaaaacaagagccgaactgatgaaggcaatcgacttcgaatactacggctatttggatgaagatgacggagtcatagtgccattagaacaagagtacgaaaagaagctccgcgcagagctggtggaaaagtggaaggctgagagagaagcacggctggcaagaggggagaaggaagaagaggaggaagaggaggaggagattaacatttacgccgtgacagaagaagagtctgatgaagaaggctcacaggagaaggggggagacgactctcaacagaaatttatcgcccatgtccccgttccttcgcagcaggagattgaggaggccctggttagacgcaagaaaatggaattgctacagaagtatgcttccgagacactccaggctcaaagtgaggaggccaggcggctgctgggatgccgtagcggaacacgtcctgctaggagcgggagtgcgcctagcccaagggccacaacagccgtacctatgggcccatcactccccacaacctccccccgtggagccccaagttgccggtgtctgacagggctgagaatgtag

SEQ ID NO: 56948 - DNA, 1671 bp, Artificial Sequence
  Description of Artificial Sequence: Synthetic coding sequence
atggcctcaaaacctgccgcaggaaagagcagaggtgagaaaaggaagagggtggtgcttacccttaaagagaagatcgatatttgcaccaggcttgaaaagggtgaaagtcggaaagcgctaatgcaggagtacaacgtgggcatgtcaaccttgtacgacatcagagcacacaaggcgcagttactgcggtttttcgcctcatcagactctaacaaggcgttggagcaacgtcgaactctgcacactcccaaattagagcacctggacagggtcctgtatgagtggtttctgggcaaaagatccgagggggtgcctgtgtccggccctatgctaatcgaaaaagcgaaagatttctatgagcagatgcaacttaccgagccctgtgtgttctcaggcggttggctctggcgtttcaaagctcggcacggtattaagaagttggacgcatccagtgaaaagcagagcgcagaccaccaagcggctgaacagttctgtgccttctttcgttcactcgctgctgagcacggtctcagcgcggagcaggtctataacgccgatgaaacagggttgttttggcgctgcttaccgaatccaacccccgaaggaggcgctgtacccggtcctaagcagggaaaggaccgtttgaccgtgcttatgtgcgctaatgcaactgggtcacatcggttgaagcctttggccatcggaaaatgtagtggcccaagggcattcaagggtatccagcatctgccagttgcatataaagcgcagggaaatgcgtgggtagacaaggagatcttctctgactggtttcaccacatcttcgttccgagcgtgagagaacacttcaggacgatcggtcttcccgaagactctaaggccgtgctcttgcttgacagcagccgggcacaccctcaggaggccgagctcgtgtcctcaaatgtgttcaccattttcctcccagcgtccgttgcaagcctagtacagcctatggaacaaggaattcggcgtgatttcatgcggaattttatcaacccccctgtgcccttgcagggtccccatgcaaggtacaacatgaatgatgcaattttcagtgttgcttgcgcgtggaatgcagtaccaagccatgtgtttcgaagagcctggcgaaaactgtggcccagtgtggctttcgccgaggggtctagcagcgaggaggaactcgaagctgaatgtttccccgtcaagccgcataataaatcctttgcccacatactggagctagttaaggagggaagtagttgtcctgggcagttaaggcaacgccaggcggcatcctggggcgtcgccggaagggaagcagagggtggcaggccccctgctgcaacctcacccgcagaggttgtttggtcatctgagaaaactcccaaggcggatcaggatggcaggggtgaccccggagagggtgaggaggtggcctgggaacaagccgctgtggcgttcgacgctgtgttacgctttgccgaaaggcaaccatgcttctccgctcaggaggtgggccagcttcgcgcacttcgtgccgttttccggtcacagcagcaagagactgtgggcctggaggacgtggtggtgacttcaccagaagagttagccatccccaaatgctgcctggaagcctcgaccgaaacatag

SEQ ID NO: 56949 - DNA, 1707 bp, Artificial Sequence
  Description of Artificial Sequence: Synthetic coding sequence
atggcatccaagcccgctgccggaaaatctaggggagagaagagaaagcgggtggtcctcacgctgaaagagaaaattgacatttgcacaaggttggagaagggggagtctcgcaaggcgcttatgcaggaatataatgtgggcatgagcaccctgtatgacatccgagcccacaaggcccagctgctgcgattctttgcatccagtgattctaataaagctctagagcaacgaaggactttgcacaccccaaagctggagcatctagatcgagtcctgtatgagtggtttctgggcaagcggtctgagggagtgcctgtgagcggaccaatgctcattgaaaaagctaaagatttttatgaacaaatgcagctcactgagccctgcgttttcagcggcggatggctgtggaggttcaaggctagacacgggattaagaaactcgatgctagcagtgaaaagcagagcgccgaccaccaagccgctgaacagttttgcgcgttctttagaagcctcgctgctgagcatgggctgtcagctgagcaggtttacaacgcagatgagactggactgttctggcggtgtctgccaaatcccacgcctgagggaggtgctgtgcccggtcccaaacagggtaaagatcggctgacagttctcatgtgcgctaatgcaacaggctcacatcggctgaagcctttggctatcggtaagtgcagcggcccaagggccttcaaaggcatccagcacctgcccgtagcctacaaggcgcagggcaatgcctgggtagacaaggagattttctcagactggttccatcacatatttgtgccatccgttcgcgaacattttagaacaatcggactgcctgaagattccaaagctgtcctactcctggacagttctagagcacacccacaggaagctgagttggtgagttcaaacgtgtttacaattttcttgcctgcaagcgtcgcctccctggttcaacctatggagcagggtattaggagggatttcatgcggaacttcattaaccctcccgtgccactgcagggaccccacgctcgttacaacatgaatgacgccatcttcagcgtggcgtgtgcctggaatgctgttccatcacatgtgttcagaagagcctggcgtaaattgtggccctctgtggcttttgctgaaggatcctcttctgaggaggaactggaggcagagtgctttccagttaaaccgcacaataaaagtttcgcgcacattctcgaactcgtaaaagaaggctcatcctgcccagggcaactaaggcaaaggcaggccgcttcatggggagtcgccggtcgagaggccgaaggtggtcgcccaccagccgctacctcgccggctgaagtggtctggtcaagcgaaaaaacgcctaaggccgatcaagacgggagaggcgacccaggcgagggagaagaggttgcctgggaacaggccgcagtagcttttgacgctgtcctgagattcgcggagcgccaaccttgcttttctgctcaggaggtaggacaactccgcgcactgagagccgtttttaggtcccagcagcaggtgaggcgcagacggggagcacttggcgctgtggtaaaggtggaggcgctacaagaaggccctgggggatgtggcgctaccgcccagtctccactcccgtgttcatccactgccggagacaactag

SEQ ID NO: 56950 - DNA, 960 bp, Artificial Sequence
  Description of Artificial Sequence: Synthetic coding sequence
atgaagggggagatccagcaatcactaggagcgtgggttctgctgacatgcctcgggctctactgtgggaagaccctgctgttcaagaatggatcaactgagatctacggagaatgtggggtgtgtcctcgtggccagcgaaccaatgcacagaaatattgccagccctgcacagagtcccctgagctgtacgattggctatacttaggctttatggctatgctgccattagtcttgcactggttctttatagaatggtacagtggaaaaaaatctagctcggccctttttcagcacatcacagccttattcgaatgttctatggccgctattattacccttctcgtatccgaccctgtgggcgtgttatatatccggtcttgccgagtcctcatgctatccgattggtataccatgctttacaacccaagtccggactacgtcacaacagtgcattgcacgcacgaagcagtctatcccttatatactatcgtgttcatctattatgcattttgcctggtattaatgatgttgctgcgcccattattggtgaaaaagattgcatgcggcctgggtaagagtgaccgttttaaatcaatatatgcggctctttatttcttccccatcctcaccgtcctacaggccgtaggcggtggactactgtattacgcctttccttacataatcctcgtactgtccctggtcaccctcgctgtttatatgtcagccagcgagatagagaattgttatgaccttcttgtaaggaaaaagagactgattgtgctcttctctcactggctcctccacgcgtacggaattatttccatcagtagagtcgacaagctcgagcaagacctgcccctgctagcccttgtccctactcctgctctcttttatctgttcaccgctaagtttaccgaaccaagtagaattctgagtgagggcgctaacggccactag

SEQ ID NO: 56951 - DNA, 936 bp, Artificial Sequence
  Description of Artificial Sequence: Synthetic coding sequence
atggccgtagatatccagcctgcttgcctcggactgtactgcgggaaaacacttctgttcaaaaatggaagcacagagatatacggcgagtgtggtgtctgtccgcgtggccagcggaccaatgcacaaaaatattgccagccgtgcacggaaagccccgagctgtatgactggttatacttaggattcatggccatgttaccccttgtgctgcactggttctttatcgagtggtatagtgggaaaaaatcttccagcgccttgttccagcacattactgccctgttcgagtgttccatggccgctatcatcactcttcttgtgtctgacccagtgggagtgctctatatcaggagttgcagggtgctgatgttgtctgattggtatacgatgctgtataatccttccccagactatgtgacaaccgtgcactgtacccatgaggccgtctatcccctatacaccattgtgtttatctactacgccttctgcctcgttctgatgatgttgctacgccctctcttagtgaagaagatcgcatgcgggcttggcaagagcgaccgattcaaaagcatatatgcagccctgtatttcttccctattctgacggttcttcaggccgtggggggtggcctgctttactacgcctttccttacataatcctggttttgagccttgttacattggccgtttacatgtccgccagcgagatcgaaaattgttacgatctgctcgtccgcaaaaaaagactgatcgtcctgttctcacattggttactacacgcctacggcatcatatcaataagtcgagtggacaagctcgagcaggatctgccattgctggccctcgtccctaccccggcactcttttacctgttcaccgcgaaattcacggagccttcgcgaatcctttccgaaggagccaacggccactag

SEQ ID NO: 56952 - DNA, 918 bp, Artificial Sequence
  Description of Artificial Sequence: Synthetic coding sequence
atggcctgtctcggtctatactgcggcaagactctcttgttcaagaatggtagtaccgagatctatggggaatgtggcgtttgtcccaggggacagagaacaaatgcacaaaagtattgtcagccgtgtactgagtcccccgaactttatgactggctatatctggggtttatggctatgttgcccttagtgcttcattggttctttattgaatggtactcaggtaaaaaatcgtccagcgccctgtttcagcacatcaccgcactcttcgaatgctccatggctgccattattacccttcttgtctcggaccccgtcggagtactgtacatacggtcatgccgcgtcctgatgctgagcgactggtacacgatgctttacaacccgagccctgattacgtaacaactgtgcattgcacccatgaggctgtgtacccactgtacacaattgtgttcatctattatgcattttgtcttgtccttatgatgcttcttcggccactgctggtaaagaagatagcctgcggcctgggaaagtccgatcgttttaagagcatttatgccgcactctatttttttcctattcttacagtactccaggccgtgggcggtggactgctgtattatgcttttccttatattatcctagttttaagtttggtcacactggctgtgtacatgtctgcgagcgaaattgagaactgctatgatttgctggtgaggaaaaagaggcttatcgtgctgttttcccactggctgctacatgcctacggcattatatccattagccgagtggataaactagaacaggatctccccctactcgcactcgtgcctacaccagcattgttctacctgttcaccgccaaattcactgaaccgtcaagaattctgtctgagggcgctaatggccactag

SEQ ID NO: 56953 - DNA, 1518 bp, Artificial Sequence
  Description of Artificial Sequence: Synthetic coding sequence
atgagccgtagttataacgatgagcttcagttcctggaaaaaatcaataagaactgttggagaatcaaaaagggttttgtacccaatatgcaggtagaaggagtgttttacgtcaatgatgcattggagaagttgatgtttgaggagttaagaaatgcatgcagaggcggaggcgtcggagggtttttgcctgctatgaaacaaattgggaacgtggctgcgctgccgggaatagtccacaggagcatcggactgcctgacgttcacagtggctatggattcgcgattgggaatatggctgcttttgacatgaacgatcctgaagctgtggtgtcgccagggggagtgggattcgatattaactgcggagtcaggcttcttcgcaccaatctggacgaaagcgacgttcagcccgtgaaggaacagctcgcccaggcgatgttcgatcacattcccgtgggagtgggctctaaaggggtgatcccaatgaacgctaaggacttagaagaagccctggagatgggagttgactggtcactgcgggaaggttatgcttgggcggaagataaggaacactgtgaggagtatggtaggatgttgcaggcagaccctaataaagtgtcagccagagctaaaaagcgcggacttccccagctgggaaccctcggcgctggaaaccattatgcagaaattcaggtggtagacgagatttttaatgaatacgcggctaagaaaatgggaatcgatcataaaggccaggtgtgtgtgatgatccattccgggtctagaggcctcggtcaccaagtcgccacagatgcccttgtcgccatggaaaaagcaatgaagcgcgataaaatcatcgttaatgacaggcagctggcgtgcgcccgtatagcgtccccagaaggacaggactacttgaagggcatggctgcagctggcaactacgcctgggttaaccgtagtagtatgaccttccttactcgccaggctttcgctaaggttttcaacacaacgccagacgatctcgatctgcatgtaatctatgatgtcagccataacatcgcgaaggtggagcagcatgttgttgacgggaaggagaggaccttgcttgtgcatcgcaaggggtccacgcgtgccttcccaccacaccatcctcttattgctgtcgattaccagctgacaggccagcctgtgctgatcggcggtacgatgggcacttgtagttacgtcctgacagggaccgagcagggcatgacagagacctttggaacaacttgtcatggagccggaagagccttatcccgcgcaaaatcccggaggaatctggatttccaagatgtcttggacaagctggccgatatggggatcgccatacgggtggcttcacccaaactcgtgatggaagaagccccagagagctataaaaatgttacggatgttgtaaacacttgccacgacgctggcatcagcaagaaagccatcaagcttcgtcccatcgcagtgattaagggttag

SEQ ID NO: 56954 - DNA, 315 bp, Artificial Sequence
  Description of Artificial Sequence: Synthetic coding sequence
atgagctgcgtgccatggaagggagataaagcaaagtccgaaagtctagaattaccacaggccgctccccctcagatctaccacgaaaaacaacgcagggagctgtgtgcactccatgctctgaataacgtctttcaagactctaacgcattcacacgagatacattacaggaaatcttccagcggctttcccccaataccatggttactcctcataaaaagtcgatgttaggcaatggcaattacgacgtaaatgttattatggctgccctccaaaccaaaggctacgaggcggtttggtgggacaagcgttag

SEQ ID NO: 56955 - DNA, 189 bp, Artificial Sequence
  Description of Artificial Sequence: Synthetic coding sequence
atgtcttgcgtgccatggaagggagataaggccaagtccgagagcctggaacttccacaggccgcacccccacagatctaccacgagaaacagcggagggaattgtgtgcactgcatgcgttgaataacgtgttccaggatagcaatgccttcacccgagacactctccaggagatcttccagcgttag

SEQ ID NO: 56956 - DNA, 186 bp, Artificial Sequence
  Description of Artificial Sequence: Synthetic coding sequence
atgagctgcgtcccctggaaaggcgacaaggcaaagtccgagtcattggagttgccccaggctgcccctccccagatatatcatgagaagcaacggcgagagctgtgtgctctgcacgcattgaacaacgtgttccaggattccaacgctttcacccgggataccctccaggagatattccaatag

SEQ ID NO: 56957 - DNA, 627 bp, Artificial Sequence
  Description of Artificial Sequence: Synthetic coding sequence
ggggatgcagagactcccggaagcgttgaaagacgcggtagacgcggagctgaagatggtatgagccaagcccctggcgctcaaccaagccccccaacggtctaccatgaacgccagcgactggagctgtgtgccgtgcacgccttgaacaatgtattgcagcagcagttatttagccaggaggcggcagatgaaatatgcaagcgcttggcacccgactctcgtttgaacccacacagatctctcctgggcactggcaactatgatgttaatgttatcatggctgcactgcaggggttggggctagcagccgtgtggtgggaccggaggcgaccgctgtcccagctcgcattacctcaagttctcggacttatcctcaacttgcccagccccgtcagccttgggttgctgagtctcccacttcgacgtaggcactgggttgccctccggcaggtggatggagtgtattataatttggactccaaactgcgggcacccgaggctttaggcgacgaagacggcgtcagagcctttttggcggctgcacttgctcagggactgtgtgaagtgctcctggtggtcacgaaagaggttgaggaaaaagggtcctggctgcgtacagactag

SEQ ID NO: 56958 - DNA, 567 bp, Artificial Sequence
  Description of Artificial Sequence: Synthetic coding sequence
atgagtcaggccccaggcgcacagccatctccaccaacagtctaccacgagcggcaacgcttagaactgtgcgccgtgcatgcactgaataatgtgttgcagcaacagctgttcagtcaggaagctgcggatgaaatctgtaaaaggctggcgccagatagtagattaaacccccatcgctccttactcggcactggaaattatgatgttaatgtgatcatggccgctctgcaggggctgggccttgcagccgtatggtgggacagaagaaggcccctgtctcagctcgcactaccacaagtcctggggctgatactgaacctgcccagccccgtgtctcttggcttgctgtccctgccattaaggagaagacattgggtcgctctgaggcaggtagacggcgtgtattataatcttgactctaagttacgggctcccgaggcacttggagacgaggacggcgtgcgtgcatttcttgccgcagctctggcgcagggtctctgcgaagtgctgctggtggttaccaaggaggtggaggaaaaagggagttggctgcgcacagactag

SEQ ID NO: 56959 - DNA, 441 bp, Artificial Sequence
  Description of Artificial Sequence: Synthetic coding sequence
atgagccaagcaccgggagcacaacctagtccacctacggtgtaccatgagaggcaaaggctggagctgtgcgctgtgcatgctctgaacaacgtgctgcagcagcaactgttctctcaagaagctgctgatgagatatgtaagcgcccactttcccagcttgccctgccacaggtccttggcctgatccttaatctaccgtcgcccgtgtctttgggcctcctctctcttcctctccggagaagacactgggtggccctgcgtcaggttgatggggtgtattacaacctagattctaaattgcgagcaccagaagccctgggtgacgaagacggggttagagcattcctggctgccgctttggcccagggcttgtgtgaagtactgctggttgtgaccaaggaagtcgaagagaagggaagttggcttcggaccgattag

SEQ ID NO: 56960 - DNA, 567 bp, Artificial Sequence
  Description of Artificial Sequence: Synthetic coding sequence
atgagccaagcccctggggctcagcctagtccgccaactgtatatcatgaaagacagagacttgagctttgtgctgtccatgcactcaataatgtcctgcaacaacaactcttctcccaagaggctgccgatgaaatttgcaagcgcctggctcccgactcacggctgaatccccaccggagcctcctgggtaccggtaattacgatgtgaacgtgatcatggcagctcttcagggactcggcctcgcggcagtgtggtgggacagacgcagaccactctctcagttggcactgcctcaagtgctgggacttattttgaacctgccttctccagtgagcctgggcttgctctctctccctcttaggcgtagacattgggtggccctgagacaagtagacggcgtgtactacaatctcgactcaaagttgcgagctccagaggcacttggcgacgaagatggcgtgcgagctttcctagctgcagccttagctcaggggttgtgtgaagtgctgctggttgtaacgaaggaagtcgaggagaaagggtcttggctgcgaaccgactag

SEQ ID NO: 56961 - DNA, 1392 bp, Artificial Sequence
  Description of Artificial Sequence: Synthetic coding sequence
atgagggcgggacctgagccacaggccctggcaggacagaagaggggggcattgcgccttctggtccctcgattagtcctgaccgtttctgctcccgcagaggttcgaaggcgcgtcctgcgaccagtgctttcatggatggatagagagactcgtgctctggccgacagtcatttccgcggtctgggagtggatgtgcctggcgtcggccaagcaccagggcgagtggcatttgtttccgaaccaggagctttttcctacgcagacttcgtgcgaggcttcctcctgccaaatctgccttgcgtattctcctcagcattcacccagggctggggctctcggaggcggtgggtcacaccagccggtagacccgactttgaccatctgcttcgtacatatggcgatgtggttgtgcctgtagcgaattgcggcgttcaggagtataacagtaatcctaaagagcacatgaccttacgcgactacattacctattggaaggagtacatccaggctggctattcctcacccaggggctgtctgtacctgaaagattggcatctgtgccgagattttcccgtcgaagacgtgttcacgctgccagtttatttcagcagcgattggctgaatgagttctgggatgcgctggatgtggatgactacagattcgtgtatgccggtccagccggttcgtggtcgcccttccacgctgacattttccggtccttttcttggagtgttaacgtttgcggcaggaagaagtggcttctttttccccctggtcaagaggaggccctgcgtgacagacacggtaatctgccatacgacgtcacaagccccgcactttgtgacacacatctgcatccgagaaatcagctggccggacctcctctagagattactcaagaggccggtgaaatggtgtttgtgccttcgggctggcaccatcaggtccacaaccttgatgacactatctctatcaaccacaactgggtgaacgggttcaacctggccaatatgtggcggttccttcagcaggagttgtgtgccgtgcaggaagaagttagcgaatggagggactccatgcccgactggcaccatcactgtcaggtcatcatgagatcatgctccggcattaacttcgaggagttctatcactttctcaaggtgatcgccgagaagcgacttctcgtgctcagggaagcagccgcagaggatggcgcaggtttgggcttcgagcaggcagccttcgacgtgggcaggattacggaggtactggcaagtctcgtggcccaccctgactttcagcgggtggacacctcagctttttcccctcagccaaaagagttactgcagcaactgagggaagctgtcgatgctgctgcggcaccctag

SEQ ID NO: 56962 - DNA, 1323 bp, Artificial Sequence
  Description of Artificial Sequence: Synthetic coding sequence
taagctcttgcgggtcaaaagagaggcgctctgcggcttctggtgccccgattggtactaacagtttctgcaccagcggaggtgcgccgacgggttttacggcctgtgctctcttggatggacagggagacacgtgctctagcagatagccattttagaggcttgggcgtggatgttcccggagtcggccaggccccaggccgagtagcgttcgtgtccgaaccaggcgcattctcgtacgcagattttgtgcgcggtttcttgttgcccaacctgccttgcgtgttcagtagtgcctttacccaaggttggggctccagacggagatgggtgaccccagctggtcggcctgatttcgaccatctgctccggacttatggagacgtggttgtgccagtggcaaattgcggagtccaagagtacaatagtaaccccaaagagcacatgactctgagggattacatcacatactggaaagagtatatccaagccggttactctagtccaaggggttgcctttacctgaaagattggcacctctgccgggactttcctgtggaggacgtcttcacattacctgtgtacttcagttccgactggttaaatgagttttgggatgcactagacgtggatgactataggttcgtgtacgcaggtccggctggcagctggtcaccatttcacgcggatatattccggtccttttcttggtctgttaacgtttgcggtagaaaaaagtggctgttatttccgccaggtcaggaggaggctctgagggaccggcatggaaaccttccctatgatgtgactagccccgcactgtgtgatacccatctgcacccaagaaaccagctcgccggaccaccactagagataacccaggaggccggtgagatggtcttcgtgccaagcggctggcaccaccaggtgcacaacctggatgatacaatctctatcaaccacaactgggtgaacggtttcaatctggcgaacatgtggcgctttttacaacaggagctgtgcgcagtccaggaggaagtcatcatgcgttcgtgcagcgggatcaatttcgaagagttctaccactttctgaaagtgattgcggagaaacgacttctggttcttagggaggccgcagctgaagacggcgcaggcctcgggtttgagcaggccgcatttgatgtggggaggatcactgaagtactcgcctctctcgtcgctcacccagactttcagcgagtcgacacttcggcctttagcccccagccgaaagaactgcttcagcagctgcgcgaggctgttgatgccgcagctgccccatag

SEQ ID NO: 56963 - DNA, 951 bp, Artificial Sequence
  Description of Artificial Sequence: Synthetic coding sequence
atggcagaggctgccctggaggcagttcgcagtgagctgagagagttcccagccgcagcgagggagctgtgcgttcccctcgctgtgccctacctggacaaaccaccgacccctctacacttctaccgagactgggtgtgtcctaatcggccttgcatcatcaggaacgctctccagcattggcctgctctccagaaatggagcctaccttactttagggcaacagtaggaagcaccgaagtgtccgtggcggttactcctgatggatatgcagatgcagttcgaggcgatcggttcatgatgcctgccgagcggaggctcccacttagcttcgtgctggacgtcttggaaggcagagctcagcatccgggagtcctgtatgtacagaagcagtgtagtaacctgccctccgaactgcctcagctcctgcccgatctggagagccacgttccatgggcctcagaagctctcggcaaaatgccagacgcagtgaatttctggctaggtgaagctgcagctgtgacttccctccacaaggatcactacgagaatctttattgtgtggtctctggggaaaagcattttctgttccacccaccctccgatcgccctttcatcccttatgaactttacactcctgcaacataccaattgactgaggaaggcactttcaaagtcgttgatgaggaagccatggaaaaggtcccctggattcccctagatccgctggctcccgatctagccagatacccctcctattctcaggctcaggcattgcgttgcacagtccgggctggagagatgctctacctgcctgctctgtggtttcatcatgtccagcagagccaggggtgcattgctgtcaatttctggtacgacatggagtacgatttaaagtacagctacttccagctgctcgactcactgaccaaggccagtggtctggattag

SEQ ID NO: 56964 - DNA, 1005 bp, Artificial Sequence
  Description of Artificial Sequence: Synthetic coding sequence
atggtcacgggcggtgctcattctaggtctagaggcggattgccatctgcttcgagaagagggcttttccggggtggcccaaaggaggtgacatccggggtgcgccctggtagtaggccactgccgcgtcggaggtcctgtcgaccaatggccggaggatgggcacaaggatcaaggcgtgcagctcgcctgccagaaggagggagacttatggctcccgcatcacggctgctggctctgtgggccctggctgctgttgcactcccaggttcaggagccgagggagacggaggttggagacccggagggcctggggcagttgcagaggaagagcgctgcaccgtagagaggcgcgcagacctgacatatgcagagttcgtacagcagtacgcctttgtcaggcccgtcatcttacaggggttgaccgataattcacgattccgcgctctgtgcagtcgtgatcgcttgctggcttcattcggggatagggtggtgcggctgagcactgccaatacttattcttatcacaaggttgatttgcccttccaggagtacgttgagcagctactccacccccaggacccaacctcattgggcaacgatactctttatttcttcggcgacaacaatttcactgaatgggcgtccctgttccgtcactactcaccccctcctttcggacttctcggcactgctcctgcttatagcttcggcatcgctggtgctgggtcgggtgtgccctttcactggcatggaccaggatactcagaggtcatttacggccgtaaacgctggttcctctaccctcccgagaagacgcctgaatttcaccctaataagacaacccttgcctggctgcgtgacacttatcctgccctgcccccaagtgctaggcccctcgagtgtacgattcgcgcaggcgaagtgttgtatttccccgatagatggtggcacgccacactgaatctggatacaagcgtattcatctccacttttctcggctag

SEQ ID NO: 56965 - DNA, 858 bp, Artificial Sequence
  Description of Artificial Sequence: Synthetic coding sequence
atggccggaggctgggcccaaggctccagaagagctgcgaggctccctgagggaggccgtctgatggccccagcctctcgtctgcttgccctgtgggcgctagcggctgtggcgctgcccggtagcggagccgaaggcgatggcggatggcggcctggaggacctggcgctgttgctgaagaggagcgatgtactgttgaacgccgagccgatctgacatacgcagagttcgtgcagcagtatgcatttgtaaggcctgtgatcttgcagggtctgacagataatagcaggtttcgcgcactgtgtagtagggatcgtctgttagcctcttttggagatagggtggtgcgcctgagcacggccaatacctattcctaccacaaagtcgatttgccttttcaggagtacgtggagcagctgctgcatccacaggaccccacaagtctgggaaacgatacgctatatttctttggcgacaataattttacagagtgggcatctctctttcggcattattcgccccctcccttcggcctcctgggcacggccccagcttattctttcggcatagccggagctgggtcaggagtgcccttccactggcatggtcccggatacagcgaagtgatctatgggcgaaagcgttggttcctctatccacctgagaaaactcccgagttccacccaaacaaaacgactcttgcctggcttagagatacataccctgcactgccaccttcagcccgtcccctggaatgcaccattagagcgggagaggtcctgtattttcccgatcgatggtggcatgctaccctgaacttggacacctctgtgttcatctccaccttcttgggttag

SEQ ID NO: 56966 - DNA, 915 bp, Artificial Sequence
  Description of Artificial Sequence: Synthetic coding sequence
atggtgactggtggggctcactctagatcccggggtggactgccctccgccagtaggagaggtctttttagaggtgggccaaaggaagtcacaagcggcgtcaggccaggaagccgcccactgcctcgacgtcggtcctgccgcccaatggcaggtggctgggcccagggatccagacgtgctgccaggctgcccgagggcggacggctgatggccccagcaagtcgtctgcttgctctgtgggctctggctgcagtggctttgccaggatctggggcagagggggatggtggctggtacgcttttgtcaggcccgtaatactccagggcctaacagacaatagtcgttttcgcgctttatgcagtcgggaccgtcttctggcttccttcggagatcgagttgtgcggctgtcaacagccaacacatacagctaccataaagtagatctcccctttcaagagtatgtcgaacagctgctgcacccacaagatcctaccagtctaggcaatgacactttgtatttctttggtgataacaacttcacagagtgggctagcttatttaggcactactctcctccacccttcggtcttctcggcaccgcacccgcatattcatttggcatcgccggtgccggtagcggcgtgccctttcactggcatggtccaggttattctgaggtgatttacggccgaaaacggtggtttctttatcctcccgaaaaaacccctgagttccacccaaataagaccaccctcgcatggttgagggacacttatcccgcactcccccctagtgctcgaccattggagtgcacgatacgagcgggtgaagtgttatacttccctgaccgatggtggcacgcaactttgaaccttgacactagcgtattcattagcacttttcttggatag

SEQ ID NO: 56967 - DNA, 2238 bp, Artificial Sequence
  Description of Artificial Sequence: Synthetic coding sequence
atggaggtcatgaatctaatggaacagcccattaaggttacagagtggcagcagacatatacctacgatagcggaatccatagcggggctaacacctgcgtcccctccgtgagcagcaagggtatcatggaagaagacgaggcctgcggacggcaatacacactgaagaagactacaacctacacccaaggcgtcccacccagtcagggggatctggagtaccagatgtccacaactgccagagccaaacgcgtacgcgaggctatgtgtcctggagtgagtggagaggattccagtttacttctcgccactcaggtagaagggcaagcgactaatctgcagagactcgcggaaccatcacagttgctcaaatctgctattgtgcacctgatcaactatcaggatgacgccgagctagccacaagggcactgcccgagctgaccaagctgctgaacgatgaagatcctgttgtggtgacaaaggccgctatgatagtgaatcagctgtctaaaaaggaggcatcgagacgggcactgatgggcagccctcaactggtcgctgccgtcgttcgcaccatgcagaatactagcgacctagatactgctagatgtacaactagtatccttcataatctcagccaccaccgcgaaggacttctagccatctttaaatcaggaggcataccagctttagtgaggatgttgtcgagccccgtcgagagcgtgcttttctacgctatcaccaccttacataatttgttgctgtatcaggagggggctaagatggcggttcgcctcgcagatggcctacagaagatggtacccctattaaataagaacaacccgaagtttctggccatcaccaccgattgcctgcagctgctggcgtatggaaaccaggaatccaaacttataatacttgcgaatggcggtccacaagcactggtgcagattatgagaaattacagctacgaaaagctgctttggacaactagtagagtgttgaaagtcttgtctgtgtgcccctccaataaaccagccatcgtggaagctggagggatgcaagcgctgggaaagcacttaaccagtaattcccccaggctagttcagaactgtctctggactctgagaaatttgagtgacgtggcaaccaaacaggaaggcctggagagcgtgcttaagatccttgtgaatcagctatcggtggacgacgtaaacgtactgacctgcgccaccgggactctgagcaaccttacctgcaacaactcaaagaacaagactctagtgacccaaaactccggcgtggaggcactgatccatgcaattctccgagccggtgacaaggacgatataacggagccggctgtctgtgccttgcgtcaccttacatctagacaccccgaagccgagatggcacagaactctgtgaggcttaactatgggattcctgccatagttaaactgctaaaccaacctaaccaatggcctcttgttaaagctactatcggattaatcaggaatctcgctctgtgccccgcaaaccacgctcccttacaggaagctgccgttattcccagactggtccagcttctggtgaaggcacaccaggatgcacagaggcatgtggcagctggaactcagcaaccctacacggacggggtgcggatggaggagatcgtggagggatgcactggagcccttcatatcctcgcgagagaccccatgaataggatggagatcttccgcctgaacaccattcctttgttcgtgcagttgctgtactccagcgtcgagaatatccagagagtggctgcaggtgtcctgtgtgaactggcacaggacaaagaagccgcagacgccatagacgcggagggggctagcgccccacttatggagttactgcatagtaggaacgaaggcactgctacttatgccgcagcagtgttgttccgaatttcggaggacaagaatcctgactacaggaagagagtatccgtagagctgacaaattcccttttcaagcatgatccggcagcttgggaggctgcccaatctatgataccaatcaacgaaccctacggggacgacatggatgcgacataccggccaatgtactccagcgatgttccactcgacccactcgaaatgcacatggacatggatggcgattatccaattgacacctatagcgatggcctgcggccaccctacccaacagcagatcatatgttggcctag

SEQ ID NO: 56968 - DNA, 2238 bp, Artificial Sequence
  Description of Artificial Sequence: Synthetic coding sequence
atggaggtgatgaatttaatggaacagccaatcaaagtcactgaatggcagcagacatacacctatgattctggcatccactccggggcaaacacctgtgtgccttctgtgagttcaaagggaataatggaagaagacgaggcctgtggacggcagtataccctcaaaaaaaccacaacttatacacagggtgtgcccccatcacagggtgacctcgaataccaaatgagcacaaccgcaagggcaaagagagtgagggaagccatgtgtccaggcgtctcaggtgaagacagctccctcctgctggctacacaggttgaaggccaggcgaccaacctgcaacggttagcagaaccatctcaacttctcaaatcggcaatcgtgcacctcattaactatcaggacgacgccgaactagccacgcgcgctctccccgagttgaccaagctgctcaatgacgaggacccggtggtcgtgacaaaagctgccatgattgtgaaccaattatccaagaaggaagcttccagaagagcactcatgggatccccccagctggtcgcggctgttgttcgcacgatgcaaaacacctcagacctggatactgcaaggtgtacaacaagcatcttgcacaatcttagtcatcaccgggagggactgctcgctattttcaagagcggaggcatacccgctctagtcagaatgttatcttcccctgtggaaagcgttttgttctacgctataactacactgcacaacttgctgctatatcaagagggagcaaaaatggcggtgcggctcgccgatggcctgcagaagatggtgcctctgctgaataagaacaatcctaaattcctagcaatcaccactgattgcctccaactgcttgcttacggcaaccaagagtccaaacttattattcttgccaatggaggccctcaagccctggttcagatcatgcgaaattactcatatgagaaactgctttggaccacatctagggtgctgaaggttctctctgtatgtccttctaacaaaccggcaattgtggaggccggaggtatgcaggccctgggcaagcatttgacctctaattctcccagattagtgcaaaactgcctttggacgctcaggaatctgagcgatgtggcaacgaaacaagaggggctggagagtgttttgaaaatcctcgtcaatcagctgagcgtcgacgatgtaaacgtgttgacctgcgcaacaggtaccctgtcgaaccttacatgtaataacagcaaaaataaaacactggtgactcagaactctggtgtagaggcactcatccacgctattctgagagctggggacaaagatgacatcaccgagcctgccgtatgtgctttgcggcacctgacatcccgacatcctgaagccgagatggcacagaactccgtgcgactcaactacggcatccctgcaatcgtaaagctgctgaatcagcccaatcagtggcctttagtgaaggccacaattggactgatccggaacctggcgctatgtcctgccaatcacgctcccctgcaggaggctgccgtaataccgagacttgtccagctcctcgtgaaagcacaccaggacgcacaacggcatgtcgccgctgggactcagcagccgtacacggacggcgtcaggatggaagagattgtcgagggatgcaccggcgcactccacatacttgcgagggaccctatgaatagaatggagattttccgcctgaacactattccactgttcgtgcaattactatattcaagcgtggaaaacattcagagagtcgccgcaggcgtcctgtgcgagctggcccaggacaaggaggcggcagacgccatcgatgcggagggcgcttccgctccactgatggagctactgcattcacgaaacgagggtacagctacctacgccgcagctgtcttattcaggatcagcgaagacaagaaccccgactacaggaaaagagtaagcgttgaacttaccaactctctatttaagcacgatccagcagcttgggaggctgcccaatcgatgatccccatcaatgaaccctacggggacgacatggacgcaacctatcgccctatgtactcttcagacgtgcccctcgaccctctcgagatgcacatggacatggacggggattatccaatagacacatactcagacggactccgccctccttacccaaccgctgatcatatgctagcctag

SEQ ID NO: 56969 - DNA, 1890 bp, Artificial Sequence
  Description of Artificial Sequence: Synthetic coding sequence
atgcacgtgcctggaggcaaatttgactttgatgacgggggttgctacgtggggggttgggaagcgggacgggctcacgggtacggtgtgtgcactggccctggggctcagggcgagtactccggctgttgggctcatgggttcgagtccctcggggtgttcacggggccaggagggcacagctaccagggtcactggcagcaggggaagagagaggggctgggagtggagcgaaagagcaggtggacctacaggggcgagtggctcggcggtttgaagggtcgcagcggcgtgtgggagtcagtttcaggattacggtatgcaggtctatggaaagacggatttcaggacggctatgggacagagacctacagcgacggaggtacctatcagggccagtggcaagcagggaagcggcacgggtacggagtgaggcagagcgtgccctaccaccaagccgcactgctcaggagcccacggcgtaccagtctagactcaggtcacagcgaccctccgactccaccccctccgctgcctctcccgggtgacgagggcggatcacctgcatctggatcgcgagggggatttgtactggccggacctggcgatgctgacggggcatcatctaggaagcgtacacctgccgcaggcggatttttccggagatccctgctcttgagtggactgcgcgctggtggccgaagatcatcactcggcagtaaaagaggtagcctgagaagcgaagtgagctccgaagtcggctccacaggacccccagggtctgaggcgtcaggtccgccagcggctgctcctccagcgctgatcgaggggagcgcgaccgaggtttatgctggtgaatggcgcgcagacagacgcagcggcttcggcgtctctcagcgctcaaatggtctgagatatgagggtgaatggctagggaataggaggcacggctacggccgtacaacccggccagatggctcacgcgaggagggcaagtacaagcgtaacaggctcgttcacggcggaagggttagaagcctactccctcttgcgcttcgcagaggcaaagtgaaggagaaagttgatcgggctgtggaaggggctcgacgggctgtgagcgcagcacggcagagacaggaaattgcagctgcgagggcagccgacgccttgctgaaggccgtcgcagccagctcagtcgcagagaaggcagtggaggcagcacgcatggccaagcttattgcccaagatttgcagcctatgttggaagcgcctggccgaaggccacgccaagactcagaggggtcagacacagaacccttagacgaggattccccaggcgtttacgaaaatggccttactccaagcgaagggtctccggagttaccctcctcacccgcttcctccagacagccttggagacctccggcttgcagaagtcccctgcctcccggaggggatcagggcccattctcttcccctaaagcatggcctgaagaatgggggggtgccggagctcaagccgaagagctggcgggttacgaggcggaggacgaggccggaatgcagggcccaggtccgagagatggatcccctttgctgggaggctgctctgattcctcaggatccttacgcgaggaggagggcgaagatgaggagccacttccacctttacgagcacccgcaggtaccgagcctgagccgattgcaatgttagtccttcgcggttcgtcttcccgcggtccagatgccggatgcttgaccgaggaactgggggagcctgcggctactgaacgacccgcacaacccggtgcagctaatccacttgtggtgggagccgtagccctgctcgacctgtcactggctttcctattctcacagctgctgacatag

SEQ ID NO: 56970 - DNA, 1590 bp, Artificial Sequence
  Description of Artificial Sequence: Synthetic coding sequence
atgtctacaaatgagaatgccaatacacccgctgcaaggctccaccgcttcaagaacaagggaaaggacagcaccgaaatgaggcggcgtagaatcgaagttaacgtcgaactccgaaaggccaaaaaagacgatcaaatgttgaaacggagaaacgtgagctcattccctgatgatgcaacttcaccattgcaagagaacaggaataatcagggcacagtgaattggtccgtggatgacattgtgaaaggaatcaattcttccaatgtagaaaaccaactgcaagcaacccaggcagcgagaaaactcctatcccgcgagaagcaaccacctatcgacaatataatccgggctgggctaataccaaaattcgtatctttcctggggagaaccgattgttcccctattcagtttgagagcgcatgggccttaacaaatatcgcctcagggactagtgagcagacaaaggctgtggtggacggtggggcaatacctgccttcattagcctgctagcgagtccacacgcccacatatcagagcaagcagtgtgggccctgggcaatatcgccggagatggaagcgtgttcagagatctggtgatcaaatacggcgctgtagaccctctccttgcattgctagctgttcctgatatgtctagcctggcatgcggatacctacggaacctgacctggactctgtccaatctgtgccgcaacaaaaacccagccccacccattgacgctgtagagcaaatactccctactcttgttaggctgttacaccatgacgatccggaggtgctggctgacacctgctgggcaatctcttacctcaccgatgggccaaatgagcggatcggcatggttgtaaaaaccggtgtggttccccagttggtgaagctactcggcgcaagtgaactcccgatcgtgacaccagccttgcgagcgatcggtaacatcgttaccgggacagacgagcagacccaggtagtcattgacgcaggagctctggccgtgttcccttcattgctgactaatccaaagacaaatatccaaaaggaggcaacgtggacgatgtccaatatcactgctggaagacaagatcaaatccagcaggttgttaaccacggtctggtccctttcctcgtgtctgtgttgtctaaggccgatttcaagacccagaaagaggccgtttgggcggtgacaaactacacaagcggaggcacggttgagcagatagtgtacttagtgcactgtggcataattgaacctctgatgaacctcctgacagcaaaggacaccaagattattctggtgattctcgacgccatttccaacatcttccaggcagctgaaaaacttggggagactgagaagttatctattatgatagaagaatgtggagggctggacaaaatcgaggctttgcagaaccatgagaacgaatcagtttacaaggccagcctgtccctcattgaaaaatactttagtgtcgaagaggaggaagaccagaatgtggtgccagaaactacatcggaaggatacacgttccaggtgcaggacggcgctccaggcacatttaatttctag

SEQ ID NO: 56971 - DNA, 459 bp, Artificial Sequence
  Description of Artificial Sequence: Synthetic coding sequence
atgcgagagaaattaatccgtcttcagtctctctacatcgaccaatttaagcggctgcaacacctgcttaaggagaagaaaagacggtacctccataaccgcaaggtggagcacgaagctctgggatcctccctgctgacaggacctgagggtcttctggcaaaggaaagagagaacctcaaaagattgaagtgtctgagaagatacagacagcgctacggcgttgaagccctgctccatcgacaactgaaggagcgaaggatgcttgctaccgatggtgccgcacagcaagcacacactacacgctcatcccaacgttgtctggcctttgtggatgatgttcgttgttccaaccaatcactgcccatgacccgacactgccttacacagaaagacgccaccgctattggcgatctacttactttgtattgtggcctaatggagactgccctggattag

SEQ ID NO: 56972 - DNA, 1479 bp, Artificial Sequence
  Description of Artificial Sequence: Synthetic coding sequence
atgaatagaattcggatccatgttctacccaccaatcgcggtcggattaccccagtacccagaagccaggagccgctatcctgcgccttcactcataggccctgttcacacccaagactggaagggcaagagttttgtatcaagcatattcttgaagataaaaacgcaccttttaagcaatgttcatacatctccacaaaaaatggcaagaggtgccccaatgcggcacccaagccggaaaaaaaggatggtgtctccttctgtgccgagcacgtgagacgtaacgcactggctctgcacgctcagatgaaaaagactaatccaggcccagtcggcgaaacactgctctgtcagttaagctcatacgctaagacggagctgggctcccaaactcccgaatcaagccgatctgaggcctctcgcatcttagacgaagactcttggagtgacggggagcaggagcccatcactgttgaccagacctggagaggggacccagattcggaagccgattccatcgactctgaccaggaagaccctctgaaacacgctggggtttatactgcagaagaggtggctctcatcatgcgcgaaaaacttatcaggctgcagagtctgtacatcgaccaattcaaacgactccagcatttgctgaaggaaaaaaagcgcaggtacctgcacaacaggaaagttgagcacgaggctcttggttctagtctcctgaccggaccagagggactattggcaaaggaacgagagaacttgaagagactgaagtgcctaagaaggtatagacagagatacggcgtggaggctcttctgcaccgccagcttaaggaaagacgtatgctggccacagacggggcagcccagcaggcgcacaccacccgatctagccagagatgtctggctttcgtcgacgatgtccgttgcagtaaccagagtttaccaatgactaggcattgccttacccacatctgccaggacaccaatcaggtgttatttaagtgctgccaaggttctgaggaagtgccgtgcaataagcccgtgccggtatcactttcagaggatccatgttgtcctctacacttccaattgccaccacaaatgtacaagcctgagcaagtgctgagcgttcccgacgacctcgaagcagggcctatggatctgtatttgtctgctgctgaattgcaaccaacagaatccctcccactggagttttccgacgatctagatgtagttggggacggaatgcagtgtccaccttccccgcttctgttcgacccaagcctcacactcgaggaccacctggtgaaggagattgccgaagaccccgtagacattctcgggcagatgcaaatggcaggcgacggttgtcggtcgcaggggtcccgaaactcagagaaggcctcagcgccactgtctcagagcggcctggccactgccaacggaaagcccgaaccaacatcaatcagctag

SEQ ID NO: 56973 - DNA, 210 bp, Artificial Sequence
  Description of Artificial Sequence: Synthetic coding sequence
atgaaccggatcagaattcacgtgcttcccactaaccgaggcagaattacccctgttccaagatcgcaagagccactgagctgtgccttcacgcatcggccatgctcacacccacgcctggaaggacaagagttctgtattaaacacatcttagaggataaaaatgccccttttaagcagtgtagctatatcagcacaaagaatgggtag

SEQ ID NO: 56974 - DNA, 2376 bp, Artificial Sequence
  Description of Artificial Sequence: Synthetic coding sequence
atgccgctttacgataatcaaaaagcacgttctgtcatgaatgagtgtgagcgccatgtcatttttgctcgaacagacgccgacgctcccccacctcctgaagactgggaggagcatgtgaatagaacaggatggacaatggcccagaacaaacttttcaataagatcctcaaagcattgcaaagcgatcggttggctcgacttgccaatgaaggagcttgcaatgaaccggtccttcgtagagtggcagtcgacaagtgcgcacgcagagtgcgccaggctctggccagtgtgtcatgggacaccaagctcatccaatggctacacactaccttggtggaaacactgagtctgcccatgttggcagcctacctggacgccctacagaccctcaagggcaagattcccacgctcattgacagaatgttagtgtccagcaacacaaagactggcgctgcaggggctgaggcactgagcctcttgctcaaacgcccttgggatccggcagttggagtcctgagccataacaaaccgtccaaactcccaggatcgcctttgattctgatcgcctcaagtgggccatcatctagcgtcttcccaactagtagacggcaccgtttttggcagtcacagctctcttgtctcggaaaagtgatccctgtcgccacccaccttctcaacaacgggtccggagtgggggttctgcagtgtctggagcacatgattggcgctgtacgctctaaagtgctggagattcacagtcacttccctcacaaacctattatcctcataggttggaatacgggagctctggtcgcttgtcacgtgagcgtaatggaatatgtcactgccgtagtctgtctaggctttcctctcctcacggtggatggcccacggggagacgtggatgatcccctgctcgacatgaagacccctgtcctttttgtcattgggcagaacagcctacaatgtcaccctgaggcaatggaagactttcgcgaaaaaataagggccgagaacagcctcgtagtggtcggcggagcagatgacaatcttcgaatttcaaaggctaaaaagaagagcgaaggtctaacgcagtcaatggtggaccggtgcatccaggacgagatcgtggacttcctgaccggcgttctgacgagggccgagggtcatatgggcagcgagccacgggatcaagatgctgagaagaaaaagaagccacgggacgtggcacggagggacctcgcctttgaggtcccggaacggggttcgcggcctgctagccccgcagctaaactcccggcaagtccttctggtagcgaagacctcagctcggtcagctcatcaccgacatcgagtcccaagaccaaggtgactaccgtgacctcggcccagaaaagcagccagattgggtcctcgcaactgctgaaaaggcatgtgcaaaggaccgaggcagtgctgacccacaagcaggcccaagtgccgatctcctctgaacctcccgaagagggagaaaaggaagaccttcgcgtacagctaaaaagacaccacccctccagtccactgccaggtagcaaaacgtccaagcgcccaaagatcaaagtgagtttaatatcacagggcgacacggccggtggcccttgcgcgccttctcaaggcagtgctccagaggccgcaggcggaaaacctatcaccatgacacttggacaagcttctgccggagctaaggaactcaccggactcctgacaaccgctaagagctcttcaagtgaaggcggagtatccgcgagcccggtgcctagcgtggtgagctcttctacagctccatctgctctccacacactgcagtctcggctcgttgctactagtcctgggtctagtctgcccggagctacgtcagcttcttcacttctgcagggactcagtttttccttgcaggacatttcaagcaagacaagtggcttacccgcaaacccatcccctggtcctgccccacaggccactagtgtaaaactcccaacacctatgcagagtttaggtgctataacaaccgggacatctaccatagttaggactattcctgttgcaactactctttccagtctgggcgctacgcccggaggcaagcccaccgcaattcaccagctgctaacaaatggcggacttgcgaagctcgccagctctttgcccggtttggctcaaatttctaaccaggcctcaggcctcaaggtacccaccacaatcaccttaacgctcagagggcaaccgtctcggattaccacactatcccctatgggctcaggcgctgccccttctgaagaaagcagtagccaagtgttaccaagtagctcacaacgattaccacctgccccttag

SEQ ID NO: 56975 - DNA, 2637 bp, Artificial Sequence
  Description of Artificial Sequence: Synthetic coding sequence
atggcacaccggggaggggaacgcgattttcaaacgtcagctagacgtatgggcacttccttgctgtttcagctctccgtgcacgaaagggagcttgatctggtatttctcgaccactcttacgcgaagccctggtcagcccatcccgacgcgtcctccgcgaggcccacgaggatgttgtttgtgactccaaggagacagcacgagtccacaattgaatctgatgtgccaattgatgtcgaaactgtaaccagcacacccatgccgttgtacgacaaccagaaggccaggtccgtgatgaacgaatgtgagcgccacgtaatctttgcccgtacggatgcagatgctcccccaccgcctgaggactgggaagagcacgtaaaccgcaccggctggactatggcccagaacaagctcttcaataagatcctgaaggccctccaaagtgataggttggcacggcttgctaacgagggcgcttgcaatgaacccgtccttcgccgagttgctgtcgataagtgtgcaaggagagtgcggcaggcactcgcttctgtgtcgtgggataccaagctgatccagtggctgcataccactctcgtcgaaactctatccctgccaatgctggccgcttatcttgacgctttgcagactcttaagggcaaaatccctacgctcattgatcgcatgctagtgtcctctaacaccaagaccggtgctgctggcgcagaagctctttcactgctgcttaagcggccatgggatcccgctgtcggcgttctgtctcacaacaagccatcaaagctaccaggatcccccttgatcctgatcgctagttctgggccatcgagctccgtgttcccaacttcccggcgtcatagattttggcagtctcaattgagctgcctgggtaaggtgatacccgtcgcaacacaccttctgaacaacggcagtggtgtgggtgtgttgcagtgcttagaacatatgatcggggctgtcaggagcaaggtgctcgagatccattcacacttcccacacaagccaataatactcatcggctggaatacgggcgctctggtggcctgccacgtatcagtgatggaatatgttaccgcagttgtgtgcctgggatttccactcctgaccgtagatggaccccgaggagatgtggatgaccctctactcgatatgaaaactcctgtgcttttcgtcatcgggcagaactctctccagtgccaccctgaagctatggaggacttccgagaaaagattcgcgcagagaattccctcgtagtggtgggaggcgcagacgacaacctccgaatttcaaaggctaaaaagaagagtgaaggtttgacccaatcaatggttgaccgatgcatacaagacgagattgtggatttccttacaggtgtgctcacccgagcagagggtcacatgggctccgagcctagggatcaggacgcagagaagaagaaaaagcccagggacgtggcacggagagatctggcttttgaggtgccggaaagaggcagtagaccagccagtccagctgctaaattacccgcatccccttccgggagcgaggatctgtccagcgtgagctcaagtccaaccagcagccccaagactaaggtgacgaccgtcacctccgctcagaagtcctctcagatagggtccagccagcttctcaagcgccatgtccaacgaactgaggctgtgctcacccacaaacaggcccaggtcccaatttcttctgagcccccagaagagggggagaaagaggatttacgtgtgcagctgaagagacaccatccaagcagcccattgcctgggtcaaagacatcaaagcggccaaagatcaaagtctcccttatatcccagggcgacacagcgggagggccttgcgcaccgagccaaggtagcgctccggaggctgccggagggaagcctatcacaatgacactgggtcaggcctcagctggcgctaaagagctgaccggtttgttgacaaccgccaaatcttcatccagcgaaggtggtgtttcagcctctccggtgcccagcgtggtgagctccagcactgcccctagtgctctacacactttgcagagtcgcctggtggccacctcccccggttcttctttgcctggcgcaacttctgcgtcttccctgctgcagggtttgagtttttcgctccaagacatcagcagtaaaactagcgggctgcccgctaacccatccccgggtccagctccgcaagctacgtcggtaaagctgcccactcctatgcagtccttgggcgcaatcactacaggcaccagtaccatagttaggacaatcccagtggccacaaccctctccagccttggagccaccccagggggaaagcccacagcgatccatcagttactgaccaatggaggtctggctaagctggcctccagtctgcccggactcgcccagatcagcaatcaggctagcggactgaaggtccctacaacaatcactctcaccttgagaggccagccctcccgaataactacgctctccccgatggggtctggagccgcaccatccgaggagtcgtcctcccaggtgctgccttcgtcctctcaacgactgccacccgctccatag

SEQ ID NO: 56976 - DNA, 426 bp, Artificial Sequence
  Description of Artificial Sequence: Synthetic coding sequence
atgcccttatacgataaccaaaaggccaggagcgtcatgaacgaatgtgaacgtcatgtgatcttcgccaggaccgacgccgatgctccccctcctcccgaagactgggaggagcatgttaaccgtacaggttggacaatggcccagaataagttgttcaataagatcctgaaagctcttcagagcgatcggctggcaaggctagccaacgagggagcatgtaacgagccagttcttcggagggtcgccgtcgataaatgcgctcgaagagtcaggcaggctctggcatcagtaagctgggacaccaagctcatccagtggctgcacacaactctggtggagacactgagtctccctatgctggctgcatacctggatgcactccagacactcaaaggtaaagtaatcctgacgttttgtgggtag

SEQ ID NO: 56977 - DNA, 1593 bp, Artificial Sequence
  Description of Artificial Sequence: Synthetic coding sequence
atgcctctatacgacaaccagaaagctaggtccgtgatgaacgagtgtgagcgccatgtcattttcgcgcgtactgacgccgatgcccctcctcccccagaagactgggaagaacatgttaatagaaccggctggactatggcgcagaataagctctttaacaagatcctgaaagctctccagagcgataggctggctcgcctggctaacgagggcgcatgtaacgagcctgttctgaggcgggtggctgtagataagtgtgcaaggcgtgtgagacaggccctggcttctgtgagctgggacactaaactgattcagtggctacacactacgttggtggagaccctcagtcttccaatgcttgctgcctaccttgatgcgctccagaccctaaaggggaagatccccaccctcattgatcgtatgctcgtgtcctccaacacaaagactggtgctgccggagctgaggctctaagtttgctgcttaagcgaccctgggacccagccgtaggggtgctgtctcataacaagccttcaaagcttcccggttcacctctgatcttgatcgctagctcagggccttcttcctctgtgttcccaacgtctcgcagacacaggttctggcagagccaactcagctgtttgggcaaggtgatcccagttgccacccatttgctgaataacgggtccggggtgggcgttctgcagtgcctggagcacatgataggcgctgtgcgctctaaagtgcttgagattcactcacacttcccccacaaaccaatcatcctcattggatggaacacaggggcactcgtggcctgtcacgtgtccgtaatggaatacgtgactgccgtagtttgcctgggattcccgcttttgacggttgacgggccacggggtgatgttgatgaccctcttctggatatgaaaacccccgtacttttcgttatcggacagaattccctacaatgccacccagaggccatggaagacttccgggagaagatccgcgctgagaattcactggtcgtggtgggcggagccgacgataatctgcgaattagcaaggcgaaaaaaaagtcagaaggtctgacacagtcaatggtggatcgatgcatccaggatgagatcgtggattttttgaccggggtactcacacgcgctgaggggcacatgggatcagagcctagagaccaagatgccgaaaagaaaaagaaacccagggacgtggcccgaagggatctcgcctttgaggtccctgaaagaggaagtagacctgccagcccagccgctaagctccccgcttccccttcgggcagcgaggatttgagtagcgtcagctcctctcctacttcttctccaaagaccaaggtaacaacagtgacttcagctcagaagtctagtcagattggcagctcacagctattgaagaggcatgttcagcggactgaagcagtactcacccacaaacaggcccaggtcccaatctctagtgaaccccctgaagaaggagagaaggaggacctgagagtgcaattaaaaagacaccacccatccacaccactccctgtgtacagttggtttcaccactag

SEQ ID NO: 56978 - DNA, 2295 bp, Artificial Sequence
  Description of Artificial Sequence: Synthetic coding sequence
atgacgctgccacattgccataggctgatgctgacccatcacctgttctggacagggtggaccatggcgcagaacaagctctttaataagattctcaaggcccttcagtcagatcgcctggctagactcgctaacgaaggcgcatgcaacgagccagtcctccgcagggtcgcagtagataaatgcgcgaggagagttcgacaggctctcgcctccgtatcatgggatacgaagctgatccaatggctgcatacaacattagtggagaccctgtctctgccaatgttggccgcatatctggacgcgctccagacgctcaaaggcaagatccccaccctgatagacaggatgctggtcagttctaatacgaaaaccggagcagctggggcagaggcgctctcattgctcctgaaacgcccatgggatcccgcagtgggagttctatcgcataataagccctcaaaattgccaggctcgcctctgatcctgattgcctccagcggaccatcctctagcgtgttccctacaagccgaagacataggttctggcagagccagctcagctgcttaggaaaagtaatcccggtagctacgcacctattaaataacggctcaggcgtcggcgtgctgcagtgtctggagcacatgatcggcgctgtgcggtcaaaggtgcttgagattcattcccattttcctcacaagcctattattttgattggatggaatactggggctctggtggcatgccatgtcagtgtgatggaatacgtgaccgctgtggtctgcctggggtttccattactgaccgtcgatggtccaaggggcgacgtcgatgatccactgctggatatgaaaacgcctgtgctttttgtgatagggcaaaacagcctgcagtgtcacccagaagccatggaagattttcgcgaaaagattcgcgcagaaaattctctggtagttgtcggaggtgccgacgacaatctgaggataagcaaagccaagaaaaagagcgagggtttaacacagtccatggttgatcgctgtatacaggatgagatcgttgacttcttgaccggcgtgctgacacgggctgaagggcacatgggctccgagccccgagatcaggacgccgagaagaagaagaagcctcgcgacgtcgctcgcagggacctcgcatttgaggtgcccgagaggggcagccgtccagctagccccgctgccaagttgcccgctagtccgagcggatcggaagacctgtcttcagttagctccagccccactagttccccgaagaccaaggtgactaccgtcacgtcggctcagaaaagttcgcaaatcggaagctcgcagctgctgaagaggcacgtgcagcgtaccgaagctgtactgactcacaaacaggcccaggtgcctatcagctccgaaccccctgaggagggcgaaaaggaggatctgagggtacagctgaagagacatcacccgagctctccactccctggctcaaaaacctccaagcgcccaaagataaaagtgagtctcatatcccaaggcgataccgccggtggtccctgcgccccatcccagggctctgctccagaaggcggaaaacccatcaccatgaccctgggtcaagcaagcgccggagctaaagagctgaccggcctgttgacgaccgcaaaatcatcttcctccgagggaggcgtgagcgcgtcaccggttccaagcgtcgtgtcatcttccaccgcgccatcagcgcttcacactctacagtccaggctcgtggccacttctcctgggtccagcctgcctggcgcaacatctgctagttccctcttgcaagggctttcttttagcctacaggatatttcaagcaagactagtggcctcccagcgaacccttctccaggaccagctcctcaagcgacgtctgtgaagcttccaacccccatgcagtccctcggtgcgatcaccaccggaacctccaccatcgttcgtaccatccccgttgcaacaacactgtcctcgttgggggctactccgggagggaagcccacggctattcaccaactgctcactaatgggggactggcaaaacttgcctcttccctgcccggactagcccagatcagcaatcaagcatccggcctgaaagtccccacaaccattacacttacactgagagggcagccaagccgtatcacaactctttcgcccatgggaagcggggcagcaccttcggaggagagctcatcccaggtgctgccgagctcttcacagagactgcccccagcaccatag

SEQ ID NO: 56979 - DNA, 1059 bp, Artificial Sequence
  Description of Artificial Sequence: Synthetic coding sequence
atgcccctctacgacaaccagaaggcacgctcagtaatgaatgagtgcgaaagacacgtaatattcgctcgaaccgatgccgatgcccctccccctccagaagactgggaagaacacgtgaaccgtaccggttggacgatggcccaaaataaactgtttaacaaaattcttaaagctctgcagagcgaccggcttgctcgcctcgccaacgagggggcatgtaacgagccggtgctgcggcgtgtagccgtcgacaagtgcgcccgtcgggtaaggcaagccctcgccagcgttagctgggacaccaagctgattcaatggctgcacacaaccctggtcgaaaccttgtcactgcctatgttagctgcatacttggatgctttgcagactctcaagggcaagatacctacgctgatcgaccggatgctagttagcagcaataccaagacaggggctgctggagccgaagccctttcactgctgctcaaacgaccatgggatccagcagtgggcgtcctgagtcataataagccttccaaattgcccggatccccactaatcctcatcgcctcgagcgggccaagcagctctgtctttcccacatcccggcgtcatagattctggcagagtcagcttagctgcctgggtaaggtgattccagtggccacccacttgctgaacaacggctcaggtgtgggggtactgcagtgcctggaacacatgatcggcgctgtgcgcagcaaggtgctggagatccattcgcatttccctcacaaaccaatcatcctcattggctggaataccggcgctctggtcgcttgtcatgtgtcagtgatggaatatgttactgcagtggtgtgccttgggtttcctctacttactgtcgatgggccacgaggcgacgtagatgaccctttactagatatgaagacacctgtgctgtttgtgatcggacaaaactccctccagtgccaccccgaggctatggaggattttcgagagaaaatccgggcagagaattcgctggtggtcgtaggaggagcggatgacaatctgtag

SEQ ID NO: 56980 - DNA, 1329 bp, Artificial Sequence
  Description of Artificial Sequence: Synthetic coding sequence
atgtctgccgcacagggctgggatagaaatagaagacgagggggaggggcagctggggcaggagggggaggcagcggcgcaggtggcggatccgggggatccgggggacgtgggactgggcagctgaataggtttgttcaactgtctggcagacctcatctcccaggtaaaaagaagatcagatgggatcccgtccgacgacgcttcattcagtcatgccctattatacgtattcccaacagatttctaaggggtcacaggccacctcctgcgagaagcggacaccggtgcgtggctgataatacaaatctgtacgtttttgggggttataaccctgattacgacgagtctgggggtcctgataatgaggattatccactctttcgcgagttgtggagataccacttcgccaccggcgtgtggcatcaaatgggaactgatgggtacatgccgagagaactggcatcaatgagcttggtgcttcatggcaataacctgctcgtgttcggtggcacgggaatcccctttggcgagtctaacggaaacgacgtgcacgtctgtaacgtgaaatacaaacgctgggctttgctgagttgtcgtggcaagaaaccctcgcgcatctacggccaggcaatggcaattatcaatggctccctttacgttttcggaggcacaaccggctacatctatagtaccgatttgcataaacttgacctgaacactagagaatggacccaactgaagcccaataatctgtcttgcgacctgcccgaggaacgctaccgacacgaaatcgcccatgacggccagcggatctacatcctcggaggaggcacctcctggaccgcatatagtctgaacaagattcacgcttataatcttgagaccaatgcctgggaggagatcgccacaaagcctcatgaaaaaatcggctttcccgcagcgcgtaggtgccatagttgtgtccaaattaagaatgatgtatttatttgcggcggttataacggcgaggttatcctcggtgatatctggaaactcaatctgcagacgttccagtgggtgaagctgcccgcaactatgcccgaaccagtctatttccactgtgccgctgtaacccctgctggatgcatgtacatacatggcggagtagtgaatatccacgaaaacaaacggacaggatcccttttcaagatttggctggtggtgccatccttgttagagttagcctgggagaagctgctcgcagcttttccaaatcttgccaatctgtctcgaacgcagttgctccatttagggctgactcaaggcttaattgaacggcttaaatag

SEQ ID NO: 56981 - DNA, 1563 bp, Artificial Sequence
  Description of Artificial Sequence: Synthetic coding sequence
atgggaaagaaaggaaagaaggagaagaagggacggggtgccgagaaaacagcagctaagatggaaaagaaagtgagcaaaagaagccggaaggaggaggaggacctcgaagccctcatcgcccactttcaaaccctcgatgccaaacgtactcagacagtagagctaccctgcccgccacccagtcctagactgaacgcttccttaagcgtgcaccctgagaaagacgaattgatcctgtttggaggagagtatttcaatggccagaagacattcctctacaatgagctgtatgtgtataacactcgaaaagacacatggacgaaagtggacatcccctctccccctcccaggcgatgtgcccatcaggcagtggtggtcccccaggggggagggcagctctgggtctttggcggtgagtttgctagccctaatggagagcaattctaccactataaggacctctgggtgctgcacctcgccacgaaaacctgggagcaggtgaaatccactggtgggccaagcggacggtcaggtcatcgtatggttgcatggaagaggcagctaatattgttcggcggttttcacgaatctacaagagattatatatactataacgacgtgtacgcatttaacttggacacttttacctggagtaagctgtctcccagcggcacggggcctacgccgcgaagcgggtgccagatgtcagtgaccccacaagggggtatcgtggtgtacggcggatattcaaaacagcgggtgaaaaaggacgtggataaaggcacgcgccactctgacatgttccttctcaagcctgaagatgggagagaagataaatgggtgtggaccaggatgaacccaagcggggtgaaacctacgcctaggtccggctttagcgtggcaatggctcctaatcatcagacactcttctttggaggggtatgcgatgaagaagaggaggagagcctgtctggcgagttttttaacgacctctatttctatgatgccacacgtaatcggtggtttgagggacagctgaagggacctaagagcgaaaaaaaaaagcgtcgccgtgggcgaaaagaagagccagaagggggttccagaccagcatgcggaggcgctggcacccagggcccagttcagctagttaaggaagttgtggctgaagacgggacagtggtaaccattaagcaagtgctcacggcaccaggctcagctgggcagccaagatctgaggacgaggactcactcgaagaagccggatcgccagctccaggcccatgcccacgctcaaacgcaatgctagccgtaaagcatggagtcctctacgtctatggtgggatgtttgaggctggggacagacaagtaactctttctgacctacactgcctggatctgcatcgtatggaggcgtggaaagctcttgtggagatggatcccgagacacaagagtggctcgaagaaaccgacagtgaggaagacagtgaggaggtggaaggggcagagggaggtgttgatgacgaggactcaggggaagaatccggagccgaggactag

SEQ ID NO: 56982 - DNA, 777 bp, Artificial Sequence
  Description of Artificial Sequence: Synthetic coding sequence
atggtagcttggaagagacaactcatcttgttcgggggttttcacgaatccactcgagattacatttattacaatgacgtgtatgcattcaaccttgacacattcacttggtccaaactttcacccagcggtactgggccaacacccagaagtgggtgtcagatgtcagtaacgccccaagggggaatcgtcgtctacggaggctatagtaagcaaagagtcaaaaaggacgtcgacaaggggacaaggcacagcgacatgttcctcctgaaacctgaggacggtagagaggataaatgggtatggactcggatgaacccatctggcgtcaaaccaacacccagatccggtttctctgtagcaatggcaccaaaccatcagactctttttttcggtggcgtgtgtgacgaagaagaagaggagtcgcttagcggagaattcttcaatgacctttatttttatgatgcgacccggaataggtggttcgaaggacagctgaagaagctgcgctccggatggcgaagacgtactcggaagcgcacggtcagaagactgcgggctcccagagtcggaagtaccactaagaccgcggaaaggcgcgcagtacggaggactgagagcccgtgtcagggccgtctggcttctgccgtgcccaccagtgctcaggatcctgcagtactctctgaggcattaggcgctagtgtcaggcccgatgcccaggagcgagcagaggggggatggcctcggccaggttgtgagctgtcccccatggtttag

SEQ ID NO: 56983 - DNA, 1470 bp, Artificial Sequence
  Description of Artificial Sequence: Synthetic coding sequence
atggggaagaaaggaaaaaaggaaaaaaagggcaggggggcagagaaaaccgcagctaaaatggagaagaaagtttcgaagcgttcgcgcaaagaggaagaagacctagaggccctcattgcacacttccaaacattagatgcgaagaggacacaaaccgtcgagttaccctgtccgccaccgagccccagactgaatgcttctttgtctgtgcatcccgaaaaggatgagttgattttattcggtggagagtacttcaatgggcagaagacattcttgtacaacgaattatacgtctacaacactagaaaggacacttggacaaaggtggatatcccatcaccccctcccagacgttgcgcccaccaggccgtggttgtcccacagggaggcggacagttgtgggtgttcggtggagaattcgcctctcccaatggcgaacagttttaccactataaggatctctgggtcctccatctggccactaagacctgggaacaggtgaaagattacatttactataatgacgtgtacgccttcaatctcgatacttttacgtggagcaagctttccccgtctggcaccggccctactccccgaagtggatgtcagatgtctgtgaccccccagggcggaattgtcgtttacggagggtacagtaaacagagagtcaagaaggatgtggataaaggcacccgtcactccgacatgttccttctcaagcccgaggacgggagagaagataaatgggtatggacaagaatgaatccaagtggtgtgaagcccacccctcgtagcggattctccgtcgcgatggctcccaatcaccagaccctttttttcggtggagtgtgcgatgaagaagaggaggagagcctgagcggcgaattttttaacgatttgtatttctacgatgccacccggaatcgctggtttgagggacagttgaagggccctaaatccgaaaaaaaaaagagacgacgtggccgaaaagaggaacctgagggaggctctcgccctgcgtgtgggggagctggtacccaaggacccgtgcaattggtgaaagaagtggttgcagaagatggcaccgtagtcaccatcaaacaagtgcttactgccccagggagtgccggacagcctcgtagtgaggacgaagacagccttgaagaagccggatcacccgctcccggtccttgcccccgtagcaatgcaatgctcgccgtcaagcacggcgtgttgtacgtgtacggcggaatgtttgaggccggtgacagacaagtcacactctccgatctgcactgtctggatctccataggatggaagcatggaaggccttagtggagatggacccagagacacaggagtggttggaggagacagacagtgaggaggatagcgaggaggtcgagggtgctgagggtggggtggatgatgaagactctggcgaagaatccggcgcagaggactag

SEQ ID NO: 56984 - DNA, 1392 bp, Artificial Sequence
  Description of Artificial Sequence: Synthetic coding sequence
atgggaaagaagggaaagaaggagaagaagggtcgcggtgctgaaaagacagccgctaaaatggaaaagaaggttagcaagagaagtagaaaagaggaaacatttctgtacaacgaattatacgtatataatacccgcaaggacacctggacaaaggtcgacatccctagcccacctcccagacgatgtgcccatcaggccgtcgtggtcccacagggcggtggacagctctgggtttttggaggcgagttcgcctcccccaacggtgaacaattttatcattacaaagacctgtgggtattgcatctggcgacgaagacctgggagcaggtaaaaagcaccggcggaccctcaggcagatctggacaccggatggtagcctggaagcggcagttgattcttttcggtggttttcacgaatcaacccgggactatatctactacaacgacgtctacgcttttaacttggatacgtttacctggtcgaaactgagcccctcggggaccgggcctactcctagaagtgggtgtcaaatgtcagtgacgccgcagggtgggatcgtcgtttacggcggttactccaaacagagagtgaaaaaagacgtcgataaggggacgcggcacagtgacatgttcctgctcaagccggaggacggcagggaagacaaatgggtatggactcgcatgaacccctcaggagttaagcctacacctcgatctggcttttctgtcgccatggctcctaatcaccagacgcttttcttcgggggagtttgtgacgaagaggaggaggagtcattatccggcgagttttttaatgatctgtacttctacgatgcaacacggaatcgctggttcgagggacagctcaaggggcctaaatccgagaaaaaaaagagacggagagggcgaaaagaggaacctgagggaggctctcgacctgcatgtggcggagcaggaacccagggtccagtccaactcgtcaaggaagttgtggccgaggacggaacagtggtgacaatcaagcaagtgctcactgcacctgggagtgcgggacagcccagatcggaggatgaagactctctggaagaagctgggtcaccagcacccggtccatgtcccaggtcaaatgccatgctcgcggtgaagcatggcgtgctctatgtctatggaggcatgttcgaagctggggatagacaggtgaccttgtcagacctccactgtctagacctgcaccgcatggaggcctggaaagccctggtagaaatggaccctgaaacgcaggagtggttggaggaaactgacagtgaggaagatagcgaggaagtggagggcgcagagggtggagtggatgatgaggactccggcgaagaatctggcgcagaggattag

SEQ ID NO: 56985 - DNA, 1518 bp, Artificial Sequence
  Description of Artificial Sequence: Synthetic coding sequence
atgtccgccgaggaaatggtgcagatcagactggaggacagatgctatccagtctctaagcgaaaactgatagaacagagtgattactttcgcgcactgtatcgctccggaatgcgggaggcccttagtcaggaggctggaggacctgaagtgcagcagttgaggggcctgagcgcccctggcttgaggttggtactggacttcattaatgccggtggcgctcgagaaggctggttgttgggccctcggggagagaaggggggtggcgtcgatgaggatgaggaaatggacgaagtcagcctcctcagtgaattggtggaagcagcctccttcctgcaagtgacctccctgctccagctgttgctctcccaagtaagactaaacaattgtctcgagatgtacagactggcacaagtgtatggcctgcctgacctccaggaggcttgtttgaggtttatggttgttcacttccacgaagtgctgtgtaaaccacagttccaccttctcggctctcccccacaagctccaggcgatgtgtcactcaaacagcgcctgagggaggccaggatgacagggacccccgtgctggtggctctaggtgatttcttagggggtccattagcccctcacccttaccagggagagcccccaagtatgcttaggtacgaagagatgaccgagcggtggttccctctcgcaaacaacctgccgccagatctggttaacgtgagagggtacggctcggccattctcgataattatctgttcatcgtcggcggatatcgaataacgagccaggaaatttcagcggcacactcctacaatcctagcacgaacgagtggctccaagtcgctagtatgaaccaaaaacggtcgaactttaaactggttgccgtgaatagcaaactgtacgccataggcggacaagctgtgtcaaatgtcgaatgctacaacccagagcaggacgcctggaactttgttgccccacttcccaacccattggcagaattcagcgcctgtgaatgtaagggtaagatctacgtcattggtggatacaccactcgggacaggaatatgaacatcctccagtactgccccagctccgacatgtggactcttttcgaaacctgcgacgtgcatataagaaaacagcagatggtgtccgtcgaggaaaccatctacatagtaggagggtgcttgcacgaactggggccaaatcgacgttccagtcagtccgaagacatgctgaccgtgcaatcttataatacggtgacacgacaatggctgtacctgaaggagaacacgtctaaatcgggtctaaatctgacatgcgccctgcacaacgacgggatctacataatgtcccgggacgtaaccctgtcaacttcactagaacaccgtgtatttttaaaatataatatattctctgactcttgggaggcttttagacgctttcctgcctttggccacaatttgctcgttagctctctctatttgcctaacaaagcagagacatag

SEQ ID NO: 56986 - DNA, 1785 bp, Artificial Sequence
  Description of Artificial Sequence: Synthetic coding sequence
atggtcctgagaagccacccatttcctaggcaggataggccgcaagggagtgtgccccgtgcagtgcccggtagtcccgtcggaccgtccacctcgacccattccgaagatagacacgggcctagctcttccgtgggaacagttatagggaccggtaccgggggtctagtcgaagcgggaggacagccccagcctcgtagttctgaaaccaacggcagtcccagcccagatcctccaccaggcctacgcggagaaggaacccgagagaagtcgttagatccactgcctcaggccgctatgcctcgtgggcctgcacaaccgcctgcacagcggcctccaggcccagctgcctccagctccgcaaggaggagtcagccagtcccccagctgagaaagaggtcccgatgcgagattgctccaagctccgaacaagaggtgcgcccagctgctagcggcgaccctcaaggcgaggcgcctggggaaggtggatctcctgctggtcggagtggcgctttgacagagaagcaagaggaagctcgaaaattaatggtttttctacagcggcctgggggatggggggttgtggagggacccagaaagccctcgtctcgggcactggagcctgcaaccgccgctgcactgcgaagacgcttagatctgggaagttgcctggacgtcctcgccttcgcccaacagcacggagagccaggattggctcaagaaacctatgccctgatgtctgacaacctgctccgagtgctgggcgatccatgtctgtatcggcgtctgtcagctgcggatcgagagcgcattctgtctctgcgcaccggcagggggagagccgtgcttggtgtgctcgtccttccttccctatatcaaggaggtcgatcgggactcccaaggggaccccgaggagaagaaccacctgccgctgcacctgttagcctcccacttccagcccatctccacgtctttaatccgagggagaatacttggcgccctctcactcaggtcccagaagaggcgccattacgcggatgcggcctgtgtactatgcacaactacctctttctggcaggtggaatcagggggagcggtgctaaggctgtttgctcaaatgaagtgttctgctataatccactgacgaatatctggtcccaggtcagacccatgcagcaggcaagagcgcagctgaaattggtggccctcgacgggttgttatatgctattggaggcgagtgtctgtacagcatggaatgctacgacccgaggacagatgcctggaccccacgcgcacctcttcccgctggtacatttccagtcgcacatgaggctgtagcctgcagaggagatatctacgtcacagggggacacctgttttatcggttgttgcggtattctccggtcaaggatgcttgggacgaatgcccgtactccgcaagccatagaagaagctccgacatcgtcgccctgggaggcttcctatataggtttgatctgctgagaggtgtgggcgctgccgtgatgcgctacaacacggtgaccggctcttggtcacgcgctgctagtcttcccttacctgctcctgctcccctgcattgcactactctgggaaacactatctactgtttgaacccccaggtcaccgcaacctttaccgtgtccggtggaaccgcgcagttccaggccaaggagcttcagcccttcccacttggcagtacaggggtcctgtctccctttattctcacgcttcctccagaggatagactgcaaacttccctgtag

SEQ ID NO: 56987 - DNA, 1053 bp, Artificial Sequence
  Description of Artificial Sequence: Synthetic coding sequence
atggaagtgcccaacgtgaaggactttcaatggaagcgcctggccccactgccgtcacgccgtgtttattgttctctgctggagactggcggacaggtctatgcaattggcggatgcgatgataatggcgtgccaatggattgtttcgaggtttatagtcctgaggcagaccagtggacagcacttccaagactgcccacggcgcgtgctggggtcgctgtgacagctcttggcaaacggattatggttattgggggagtgggcactaaccagctcccgcttaaggttgtggagatgtacaacatagacgaagggaagtggaagaaacggtctatgttgcgcgaggctgctatgggcatatcggtgacagctaaggattatagagtttatgccgcaggcggaatgggtctagatctgcggccacataatcacctgcaacattacgatatgctgaaggatatgtgggtgagcctcgccccaatgccaacgcctcgatatgctgccacgagtttcctcaggggatccaagatttatgtgctgggtggaagacaatccaagtatgcagtcaacgcatttgaggtgtttgatatcgaaacccgctcctggacaaagtttccaaacatcccctataaaagggcgttctcctcgttcgtgactctggataatcacctgtatagcctgggcggactgaggcagggccgactgtacaggcaaccaaagtttctacgtactatggacgtctttgatatggaacagggaggttggctgaaaatggaaaggtccttttttctaaaaaagagacgggctgacttcgtagccggttcactgagcggccgagtcatcgtggccggaggtctaggcaatcaaccaacagtcctcgagacagccgaagcttttcatcctggaaagaacaaatgggaaattctgccggcaatgccaactcctagatgcgcctgtagctctattgtcgtgaagaactgtctcttggccgtcggcggagtaaaccagggactcagtgatgcggtcgaggccttatgcgtcagcgactcttag

SEQ ID NO: 56988 - DNA, 1053 bp, Artificial Sequence
  Description of Artificial Sequence: Synthetic coding sequence
atggaagtccctaatgttaaagatttccagtggaagcgtttggcccctcttccatcgcgccgagtctattgtagtctgcttgaaacggggggacaagtctatgctattggcggatgcgatgataatggagttccaatggattgctttgaggtctacagtccagaagcagaccagtggaccgccctacctcggctgccaacagccagagcaggtgttgctgtaacggcacttgggaagcgcattatggtgattggaggagtgggaacaaaccagctccctctgaaagttgtggaaatgtacaacatcgacgagggtaaatggaagaagcgtagcatgcttagggaggcggctatggggattagcgtgaccgctaaagattaccgtgtctatgcagcagggggaatgggtctggacctgcgaccgcacaaccacctgcagcactacgacatgttgaaagatatgtgggtgtcactggcccctatgcctacaccccgatacgccgcaacttcatttcttaggggcagcaaaatctacgttctcggcggaaggcagtcgaagtacgcggttaacgcatttgaggtcttcgacattgagacccgctcttggacaaaattccctaacatcccgtacaaaagagcctttagctctttcgtgacgctcgacaatcacctttactctttggggggtctgagacaaggtcgcctgtatcgacagccaaagtttttgcggacgatggatgtcttcgacatggagcagggtgggtggctcaagatggaacgctctttctttctgaagaagagacgggcagattttgtcgccggtagccttagcggcagagtcatcgtggccggtggtcttgggaatcaacctacagtacttgaaaccgcggaggcattccacccaggtaaaaacaagtgggagatcctgccagccatgccgacaccgagatgtgcatgctcttcaattgtggtcaaaaattgcttgctcgcggttggaggggtgaaccagggcctgtctgatgccgtggaagcgttgtgtgtgtctgactcctag

SEQ ID NO: 56989 - DNA, 714 bp, Artificial Sequence
  Description of Artificial Sequence: Synthetic coding sequence
atgatcgctgggtgtaggtcttttagcctgcagagcgattacagagtttacgcagccggaggcatgggacttgatctgaggccccataatcacttgcagcactacgacatgctgaaagacatgtgggtgagccttgccccaatgcctacgccaaggtacgctgcaacctcattcctgcggggatccaagatctatgtgctgggcggaagacagtctaaatatgccgtaaatgcctttgaggtgtttgacattgaaaccaggtcatggacaaaattcccaaatatcccatataaaagagcattttccagctttgtcactttggacaatcacctctattcattggggggactgcggcagggtaggctgtacagacaacccaagttccttagaaccatggacgtgttcgacatggagcaagggggttggcttaagatggaaagaagctttttcctgaagaagagacgcgcagactttgtggctggctctctctccggtcgcgtcatcgtagctggagggctcggcaaccagcccacagtgctggaaaccgccgaagccttccatcccggaaaaaataagtgggaaattctaccagctatgcccacaccacgatgcgcatgctcctcgatcgtggtcaaaaactgcctacttgcagttgggggtgttaatcaggggttatcggacgcagtggaagcactctgcgtctctgactcctag

SEQ ID NO: 56990 - DNA, 1053 bp, Artificial Sequence
  Description of Artificial Sequence: Synthetic coding sequence
atggaagtgcccaacgtgaaagactttcaatggaaacgcctcgcccctttgccatctcgtagagtgtattgttccctccttgagactggcggacaggtgtacgcaatcggcggttgcgatgataacggggtgcccatggattgttttgaggtgtactctcctgaggctgatcagtggacagctctgcctcgccttcctaccgcgagagcaggggtggccgtgaccgcactgggtaaaagaattatggtaataggaggggtagggactaaccagctgcctttgaaagtggtcgaaatgtacaacatcgatgagggtaaatggaagaagcgttccatgctgagggaagccgctatgggcatatctgtgactgccaaagactatagagtgtatgcagcagggggtatggggctcgacttgagaccacacaatcaccttcaacattatgatatgttgaaagatatgtgggtcagcctggccccaatgcccacccctaggtatgcagcaacaagttttctgaggggctctaaaatctatgtgctcgggggtcgacagtctaaatacgccgtcaatgcgtttgaggtgttcgacatcgagacccgcagttggactaagtttcccaacattccttacaagagagcatttagctctttcgtgacactagataaccatctgtactccctcggtggtttgcggcagggcagactgtatcgtcagccaaagttcctgaggaccatggacgtgtttgatatggagcagggcggttggctcaagatggaacggtccttctttttgaaaaaacgacgggcagattttgtggccggtagcctgtctggcagggtgattgtggcaggcggattgggcaaccagccaacagttttggaaacggcagaagcctttcacccaggaaagaacaaatgggagatcctgcccgctatgccaactccacgctgtgcttgcagttcaatcgtggtgaagaattgccttttggccgtcggaggcgtgaaccaaggattgtcagatgccgttgaagccctgtgtgtcagcgacagttag

SEQ ID NO: 56991 - DNA, 1050 bp, Artificial Sequence
  Description of Artificial Sequence: Synthetic coding sequence
atggccgtggctgtgcctccaggccgagctgccggatccggttgggcttggagaccagtcgctcgagatgcactgctcgcacgggcttttcactcctgcacagagcttagaggccgtttttacctggtcgggggattattagccggtggcgctcgcgagccatcttccgacacggtcgtctttgatccagccaggggccaggccgtgagactcggggctcgaggtagcccgcctcgcagccaccacgatgccgctccagttgacggtagatggctgtgcgtggtgggagggtgggacgggagtaggcgattggcaacagtgacagccctagacacagagagaggggtctgggaggcctggacaggcacgccaggagattgccctccagccggtctcagctcccacacctgcaccagaatttcagatagggaactacaagtggctggacgagagggtggcattcatacccaaaggcgctacggatcaatctacacacttcggctggatccttctgcacgcacatattgctataaacaagaggggtgtcacacagcaagtaggagtggtcactgcgccgcactcctacaaacgccaggaccacacccaggacaccagctgctactgttcgggggttgcaacctggcggagcctgaggttgctgggcattggtctcacggaaagattaaggaggaaccgccagtggcccctcacctgatggagcagcttgccagactggtgtcatcaggccagggctctcaaaaaggacctcacggtctgcgccatcactcttgttccgtggttggcccatttgcagtgctatttggcggagaaactttaaccagagctagggacacaatctgtaatgacctttatatctatgacacacggacctcacctcccttatggttccattttccctgcgcagatcgcggtatgaagcgcatgggccataggacttgcctgtggaatgatcagctttacctggtggggggattcggggaagatggcagaacagcttcccctcaggtatgcatcctggacttcatttag

SEQ ID NO: 56992 - DNA, 867 bp, Artificial Sequence
  Description of Artificial Sequence: Synthetic coding sequence
atggcagtggcagtcccaccagggcgagcagccggatcggggtgggcatggcgcccagtcgctcgcgatgcgcttttagccagggctttccactcttgcaccgaattgcggggtcgtttctatcttgtgggcggattgctggctggtggcgctagagagccatccagtgataccgttgtgttcgatcctgcacggggacaggccgtgcgtctgggagccaggggctcccccccaagatctcatcatgatgctgcacctgttgatggcaggtggctctgcgtggtgggcggatgggatggcagccgaagattggctacagtgacagccttagatacggagcgcggtgtatgggaagcgtggacaggcactccaggggattgtccacctgccggactttccagccatacatgtacccgcataagcgaccgggagctccaggtggctggccgagaggggggaatccacactcagcgtcggtatggttccatctatactttgaggcttgaccccagcgcacggacctactgctataagcaagaagggtgtcatactgcgtcgcggtccggacattgcgcagccttgcttcagacccccggtccacaccctggtcatcagctcctcctgtttggaggctgcaacctcgccgagcctgaggtcgccggacactggtcccacgggaaaattaaatcttttctgagccctcaggggggaacgacatgttgctcatccttcgacggtaccgcctgcaaagcctgtgagcagtgggccggagtgccagaaggtgccccatggaccacagctagtctgatgttctgcggccgagcgttgtgctgtgcggtctggtggaggaactccgatcagagttag

SEQ ID NO: 56993 - DNA, 1872 bp, Artificial Sequence
  Description of Artificial Sequence: Synthetic coding sequence
atggagcacgctgtggccccatgtgtcttgtaccctggcaccgagccaggtgccgctggcgagtctgaaagtgagggtgctgcaagccccgcacagaccccgtgtagtcttggggcttcgctgtgcttctcatctggggaagaatcccccccacagtcactcgcttccgcagctgaaggggctgccactagcccgccatcatctggaggtcctcgggtcgtagagcggcagtgggaggccggatcagccggagccgcaagcccagaagagttggcgtctcccgaggagcgtgcgtgtcctgaggaacctgcggctccttcaccagaacctcgcgtctggttggaagatcccgcttcgcccgaagagcccggtgaaccagcgcctgtaccccctggttttggcgctgtttatggagaaccagatttggttctggaggtctccggcaggagactgagagcgcacaaggccgtcctcgctgcacggtcagattatttccgggctagagcatcacgcgatgttttgcgcgtccaaggagtgtctttgaccgctctgcggctcctccttgccgacgcctacagcgggagaatggccggtgtacgtcccgacaacgtagccgaagtggtggccggagcgagaagattgcagttgcccggagctgcccagcgggctacggacgccgtcgggcctcagctaagcctcgcaaattgctatgaggtcctgtctgctgccaagaggcagcgtcttaacgagctccgggacgcagcctattgcttcatgtccgaccactatctggaagtcttgagggagccggcagtgtttggacgtttgagcggggcagagcgggatctcctactcaggcggagactcagagcgggaagagctcatctgctcgcggcagctttggggccagccggagagagagctggctctagacctcaatctccctccggggatgccgatgcacggggtgatgccgcagtgtattgtttccacgcggctgccggtgagtggcgcgagctaacccggctgcctgagggagcccctgctcgcggatgcggactgtgcgtgctttacaactacctcttcgttgccggaggggtggctccggctgggcctgatggcagggcacggcctagtgatcaagtgttttgctacaatcccgcaaccgactcttggagcgcagtccgtcctctgcggcaggccaggtcccagctccgcttgctcgcactggatggtcacctgtacgctgttggcggtgaatgcttattgtccgtggaaaggtatgacccacgcgctgaccgttgggccccagtcgctccgctgcccaggggagcatttgctgtggctcacgaagccacaacttgtcacggagagatctatgtcagtggtggatccttattctaccgcctgctgaaatacgatcccaggagggacgagtggcaggagtgcccatgctcaagtagcagggagcgctctgccgacatggtcgctttggatgggtttatttacaggttcgacctttccggctcccgaggtgaggctcaggccgctggtccttccggggtctctgttagccgataccattgcctggcaaaacaatggagcccctgtgtggcacccttgcgtttaccgggtgggcctactggcctccaaccttttcgctgtgcagcgctggatggcgctatttattgcgtatcccgtgccggaacgtggcgttttcagcctgctcgggagggggaggcaggtggtgacgccggtcaaggcggaggctttgaagccctgggggcacctctcgatgtacgcggtgtgcttatccccttcgctctgtccttgcctgagaagccacctcgcggagagcagggagccccatag

SEQ ID NO: 56994 - DNA, 1872 bp, Artificial Sequence
  Description of Artificial Sequence: Synthetic coding sequence
atggagtgcaagattgaggggaaagaaaagtaccagcattcacttaatttactgaataagatccagaacatgaaggagcttgccgaaatgatcgatgtggtgctgactgccgaaggggaaaaattcccatgccatagactggtgttggcagccttttctccttattttaaagccatgttcacctgcggcctgctcgagtgtaatcagcgcgaagtgattctctacgatattaccgccgagagcgtgagtgttctcctgaactacatgtataatgccgctctggagatcaataacgccaacgtgcagaccgtcgccatggcagcctacttcatgcagatggaggaggtgtttagtgtgtgtcaaaagtatatgatggaccacatggacgctagcaactgccttggtatttactattttgctaaacagatcggtgcggaggaccttagtgaccgcagcaaaaagtacctgtatcagcactttgccgaagtaagtctccatgaggaaatactggagatcgaggttcatcagttcttgacattgatcaaaagtgatgacctcaatatctccagggaggagagcatattagatctcgttcttaggtgggttaaccataacaaagagcttcgcacggtacatttggtggaactgctgaagcaggttcgcttggagctcgtgaaccctagctttcttcgacaggcactgcggaggaacacaatgttgctgtgtgatgccgactgcgtcgacataatccagaatgcgttcaaggccattaagactccccagcagcattccttaaacttgcggtacggaatggaaaccacaagcttgttgctttgcatcggaaacaactcctctgggatcaggagccgccatcggagctacggagacgcatctttctgctacgatccagtgtcccggaagacctacttcattagcagtccaaagtacggcgaagggctggggacagtttgtaccggggtagtcatggaaaacaacaccatcatcgtggccggtgaggccagcgcctctaagctttctcgacagaagaacaaaaatgtggaaatttatagataccatgaccgcggaaaccagttttgggaaaaactttgcaccgcagaattcagagagctgtacgccctcggtagtattcacaatgacctgtatgttataggcggtcaaatgaagataaagaaccagtatttgattaccaactgtgttgataagtattctgttgagagggataattggaagagagtctctcccctgcccctgcagttagcctgtcatgcggtcgtcacagtcaacaacaaactctacgtgataggaggttggaccccccagatggacctgcccgatgaggaaccggacagactctccaacaaactcttgcagtatgacccctctcaagaccagtggtctgttcgggcacctatgaagtattcgaagtatcgttttagcaccgccgtggtgaactccgagatatacgtgctcggaggaattgggtgtgttgggcaagataagggccaagtgaggaagtgtcttgatgttgtagagatttacaacccggatggcgacttttggagggagggccctccaatgccctccccgctgctgtccctgcggaccaattcaactaatgctggagcagtggacggaaaattgtacgtgtgcggcggtttccatggcgcagatcgacacgaagttatctccaaggaaatcctggaattggatccgtgggaaaatcagtggaacgtcgttgcaatcaacgtcttgatgcatgactcttacgacgtttgtctggtcgcgagaatgaacccacgggatctgattccaccaccatccgacttggtggaggagggcaatgagcattag

SEQ ID NO: 56995 - DNA, 1872 bp, Artificial Sequence
  Description of Artificial Sequence: Synthetic coding sequence
atggagtgcaagattgagggcaaagagaagtaccagcatagcctaaacctgctgaacaaaattcaaaatatgaaagaactggccgagatgatcgacgtggtcctaaccgccgagggagaaaagttcccctgccaccggctcgtgctagcagcctttagtccttacttcaaggccatgttcacttgtggactgctggagtgtaaccagagggaagtaattctttacgatataactgctgagtcagtgtccgtgctgttaaactacatgtataacgccgctctggaaatcaataatgctaacgtgcagaccgtagccatggcagcctattttatgcaaatggaggaagtcttttctgtctgccagaaatatatgatggatcacatggatgcaagtaactgccttgggatatactatttcgctaagcagatcggtgcggaagacctctcggacagaagcaaaaaatacctgtaccagcactttgctgaggtctcactccacgaggagatactggaaatagaagttcatcagttcctaacgctgatcaaaagcgatgacctgaatatttctcgcgaggagagcatccttgatcttgtcctgaggtgggttaaccacaataaggagttgcggactgtgcatctcgttgagctgctgaagcaagtgcgcctggagctcgttaatcctagttttctcagacaagcactgcgccgaaacacaatgttgttgtgcgatgccgattgtgtggatatcatccaaaacgcttttaaggcaataaagaccccccagcagcactccctgaatctgaggtacggcatggagacaaccagcctcctgctgtgcattgggaacaattcgtccggcatcaggtctagacaccggagctacggagatgcctcattctgctatgacccagtgtctcggaaaacgtattttattagctcccctaagtacggggaggggcttggtaccgtctgcactggagtggtgatggaaaataacaccattattgtggccggtgaagccagcgccagtaagctcagccggcaaaagaacaagaatgtcgaaatctacaggtaccatgatcggggaaatcagttctgggagaagctgtgcacggcagagtttcgcgaactctacgccttgggtagtatccacaacgacctgtacgtaattggagggcagatgaaaattaaaaaccagtatcttattacaaactgcgtcgataaatactctgtcgaacgagataattggaaacgagttagtcctctacccctgcagctagcgtgccacgccgtggtcacagtgaataataaactttacgtgatcgggggatggacacctcagatggatctccccgacgaagaaccggacagactgtctaacaaactgcttcagtacgatccctctcaggatcagtggtcagtccgggctccaatgaagtatagcaagtatagattctccaccgctgtggttaacagtgaaatttacgtgttgggcggtattggctgcgtcgggcaggacaaagggcaggttagaaagtgcctggatgtcgtggaaatctacaaccccgatggggatttctggagggaagggccacctatgccatcaccactcctgtctctgaggaccaactccacgaacgccggagccgttgacggaaagctttatgtgtgtggtgggtttcacggtgctgaccgccatgaggtgatttccaaggagatactcgaactggatccctgggaaaatcagtggaatgttgtggctatcaacgttctcatgcatgactcctacgatgtttgccttgttgcacgcatgaaccctagagacctgattccaccaccttccgatttggtggaagaggggaacgaacactag

SEQ ID NO: 56996 - DNA, 1872 bp, Artificial Sequence
  Description of Artificial Sequence: Synthetic coding sequence
atgagtacccaagacgagcgtcagattaacactgaatacgccgtcagtttgttggaacagcttaaattattctatgagcaacagctctttaccgacatcgtacttattgtggaggggacagaattcccttgtcacaagatggtcctagctacttgctctagttatttccgggcaatgtttatgtctggactttcggagagtaagcagacacatgtgcatttgcgcaatgtagatgcagccacgctgcagattatcattacatacgcctacacaggaaacctggcgatgaacgacagcaccgttgagcagttgtacgaaacagcctgtttcttacaggtagaggacgtgttacagcgctgtcgggagtatctaattaaaaaaataaacgccgagaactgcgttcgccttctgtcctttgcggaccttttctcatgtgaggagctgaaacagtcggctaagcgtatggtcgaacacaagtttaccgccgtctaccatcaggatgcttttatgcagctgtcccacgacctgctaattgatattctgtcctccgataacctgaacgtggaaaaagaagagaccgttagagaggccgcaatgttgtggctcgaatacaataccgagtcaaggagccaatatctttcctcggtgctgtcccagatcagaatcgacgccctcagcgaggtgacgcagcgggcatggtttcagggactcccacctaatgacaagtctgttgtggtccagggtctctacaagtccatgcccaagttcttcaagcccagactgggcatgacgaaagaagaaatgatgatcttcatcgaggccagcagcgaaaacccttgttctctctactctagtgtgtgctactctcctcaggccgagaaggtgtacaaactctgtagcccaccagcagacctacataaggtcgggaccgtggttacaccagataatgacatctacattgccggtggacaggtgcctctaaaaaacacgaagactaaccattcgaagactagcaaactccagacagcctttcgaactgtgaactgtttttattggttcgacgcccagcaaaatacatggttcccaaaaactccaatgctcttcgtacgtatcaagccctcactggtgtgctgtgaaggatatatatatgccataggcggtgactccgtcggcggagaactaaataggagaaccgtggagcgttacgacacagagaaggacgagtggacaatggtgtcacctctgccatgtgcatggcagtggtccgcagctgtggttgtgcacgactgcatctatgtgatgacccttaatctgatgtactgttatttcccacgctcagacagctgggtggaaatggcgatgcgacaaacatccagaagctttgcctccgcagccgcttttggcgataagatcttctatatcggagggctccatatcgcaactaattcaggaattcgcctcccaagcggcactgtagacgggagttcggttactgtggagatctacgatgtgaacaagaatgagtggaagatggccgctaacattccagcgaagaggtattccgacccttgcgtcagagcagtcgtgattagcaactcgctttgcgtctttatgcgagaaacccatctgaacgagagagcaaagtacgttacctatcagtacgaccttgagttagatcgttggagcctgcgccagcacatatctgaaagagtgctttgggatttgggtagggatttccgatgcacggtggggaagctctatccttcttgtctggaagaaagcccgtggaagcctcccacgtacttattcagtaccgacggcaccgaggaattcgagctggatggggagatggttgctctccctcctgtctag

SEQ ID NO: 56997 - DNA, 45 bp, Artificial Sequence
  Description of Artificial Sequence: Synthetic coding sequence
atgtccacgcaggacgagcgacagattaataccgaatatgcctag

SEQ ID NO: 56998 - DNA, 15 bp, Artificial Sequence
  Description of Artificial Sequence: Synthetic coding sequence
atgagtacccagtag

SEQ ID NO: 56999 - DNA, 147 bp, Artificial Sequence
  Description of Artificial Sequence: Synthetic coding sequence
atgtctactcaggacgaacgccagataaacaccgagtacgctgtttcgctgctcgagcagctcaaactgttctatgagcagcaactgttcactgatattgtgctcattgtcgagggcactgaattcccctgccacaaaatggtgtag

SEQ ID NO: 57000 - DNA, 90 bp, Artificial Sequence
  Description of Artificial Sequence: Synthetic coding sequence
atgtcgacacaggacgagaggcaaataaacacagaatatgcagtcagcctgctagagcagctaaaacttttttacgaacagcagctctag

SEQ ID NO: 57001 - DNA, 1050 bp, Artificial Sequence
  Description of Artificial Sequence: Synthetic coding sequence
gtgcgggaggcagccatgttgtggctcgagtacaatacagaatctcgttcccagtacctttcgtcagtgctcagccaaattagaatcgacgcactgagtgaggtcacacaaagggcctggttccagggtttgccacccaatgacaagtcagtagtggtgcagggcctgtacaaaagtatgcctaaattcttcaagcctcgactgggtatgaccaaggaggaaatgatgatctttatcgaagccagttccgaaaacccatgctccttgtacagtagtgtgtgctacagtcctcaggctgaaaaagtctacaaactgtgcagccccccagctgatcttcataaagttggcaccgtcgttaccccagataacgacatctacatcgctgggggacaagttcctctgaaaaacactaaaacaaaccactcgaaaacctcaaagttgcagacactgcagaattgcgagctgctgctgctggacgcacagcagaacacaagtaaggaccccaatgccttctgcccccacaaggcgattttttgttgcgaggggtacatctacgctattggcggagatagcgtcggaggggagctgaatcgcagaaccgtggagcgttacgacactgagaaagatgaatggaccatggtgtctcccctaccatgtgcctggcagtggtctgctgctgtagttgtccatgactgtatatacgtgatgacactcaatttgatgtactgctacttcccccgtagcgacagctgggtcgagatggctatgcggcagacctcccgcagctttgcctctgctgcagccttcggggacaaaattttctatatcggagggctgcatatagccactaattcaggcatcagacttccaagcggtactgtggatggctctagtgtgacagtcgagatctacgacgtcaacaagaatgaatggaagatggcggctaacatccctgctaaaagatatagtgatccctgtgtcagagctgtggttatctccaatagcttgtgcgtttttatgcgcgagacacacctcaacgaaagagcctag

SEQ ID NO: 57002 - DNA, 1839 bp, Artificial Sequence
  Description of Artificial Sequence: Synthetic coding sequence
atggagttggctatggacaatagctacgctttcaaccaaagatctacctgtaacggcatacctagtgagaagaagaacaacttcttggtgagcgaagatcatggtcagaaaatactgtcggtgctgcagaattttcgtgaacagaatgtgttttatgactttaaaattatcatgaaggatgaaatcatcccatgtcatcggtgcgtactggcagcatgttcagactttttccgtgccatgtttgaagtcaacatgaaggaacgagatgacggttctgtgaccattacaaatctctctagcaaggctgtgaaggcttttctggattacgcctacaccggcaagactaagatcacggatgacaatgtggaaatgttcttccagctgagtagcttccttcaggtttcctttctgtctaaggcttgctccgatttcttgattaaaagtattaatctggttaattgcctgcagctgctgtcaatatctgattcctatgggtcaacctcactttttgatcacgcccttcactttgtgcaacatcacttttctcttctattcaagagctcggacttccttgaaatgaatttcggcgtcctgcaaaaatgtctcgagtccgacgaacttaacgttcccgaagaggagatggtgctcaaggtcgtgttgagctggacaaaacacaatctggaatctcgccagaagtatctcccccacttaatcgaaaaggtcagactgcaccaactgagtgaagaaactctgcaggattgcctttttaatgaagaaagcttgctcaaatcaaccaattgctttgatattattatggatgcaattaagtgtgtgcaggggtctgggggtctctttcctgatgcgagaccatcgacaacagaaaagtacattttcattcataagaccgaggagaatggggagaatcagtacaccttctgctataacatcaaaagcgattcgtggaaaatcctcccgcagagccatctgattgacctgcctgggagctccttaagctcgtacggcgaaaaaatttttctaacagggggatgcaaagggaaatgctgccggacggtgcgcttacacattgccgagtcataccacgacgccaccgaccagacttggtgctactgccctgtgaagaatgattttttcctagtgtccacaatgaagacgccacgcaccatgcatacatctgtgatggccctggaccgcctctttgtgatcgggggtaagacgcggggttcgagagacattaaaagtttgttggatgttgagtcgtacaaccccctctctaaggaatggatcagcgtcagcccgctgcctagaggaatctactatccagaagccagtacatgtcagaatgtcatttacgtgcttggttccgaggtggagatcactgacgcctttaacccctctctcgactgctttttcaaatacaatgccaccactgatcaatggagcgaactcgtggcagagttcgggcaattcttccacgctactctgattaaggccgttccggtcaactgcactctatatatctgcgatctaagtacgtacaaagtttactcattttgccccgacacctgtgtctggaagggggaaggctctttcgaatgcgctgggtttaacgctggagctatcgggatagaggataagatctatatcctggggggagactacgcaccggatgagataaccgacgaagtacaggtctatcactccaaccgttcagaatgggaagaggtatcacccatgcctagagcactgacagagttctactgccaggttatccagtttaacaagtaccgagacccgtggttcagcaacctgtgtgcgtag

SEQ ID NO: 57003 - DNA, 1839 bp, Artificial Sequence
  Description of Artificial Sequence: Synthetic coding sequence
atggagctggctatggataacagttacgcattcaaccagagatcgacatgtaatggcataccatccgagaagaaaaataattttctcgtgtcggaagatcacggacagaaaatcctatcagtgctgcaaaactttcgagaacaaaacgtgttctatgactttaagattattatgaaggacgagattataccatgtcatcggtgtgtgctcgccgcttgcagcgacttttttcgtgccatgttcgaagtgaacatgaaggaaagggatgatggatccgtgaccatcaccaatctgagcagcaaggctgtcaaggctttcttggattacgcctatacgggtaaaacgaagattacagatgacaacgtggagatgttctttcagctgtctagctttctacaggtgagcttcctaagtaaggcatgttccgatttcttaataaagagcattaatctcgtcaactgtctgcagctgcttagcatcagtgactcttatggaagtacctcattgtttgaccacgcactgcacttcgtgcagcaccattttagcctgttgttcaagagctccgactttttggagatgaatttcggcgttctccagaaatgtttggagagtgatgagctgaacgttccagaagaggaaatggtgctcaaggtggtattgtcatggactaaacacaacttagaaagtcgacaaaagtacctcccccatctgatagagaaagtgcggctccatcaactgtccgaagagaccctgcaggattgtctatttaatgaagagtccctgctgaaatccacgaactgttttgacattatcatggacgccatcaaatgtgtccagggctccggaggtctgttcccagacgccaggcctagtaccactgagaagtatatctttatacacaagaccgaggaaaacggtgaaaatcagtatacattctgctacaatattaagtccgatagttggaagattctgcctcagagtcacctgatcgacctccccggttcaagcctgagctcctatggtgaaaaaattttcttaacaggcggatgcaagggcaaatgttgtcggacagtgcgtctgcacattgcagagtcttaccacgacgccacagaccagacctggtgttattgccctgtcaagaatgatttctttctggttagcactatgaaaacgccacgcactatgcacacttccgtgatggcactggaccgcctgttcgtcattggcggaaaaaccaggggcagtcgggacattaaaagcctgcttgatgtcgaaagctataaccctctatctaaagagtggattagcgtgagcccccttccaaggggaatttactatccagaggcctctacatgtcagaatgttatttacgtgctcgggagcgaggttgagatcacagatgcctttaaccctagcctggactgctttttcaagtacaatgctactaccgaccagtggtcggaattggtcgccgagttcgggcagttcttccatgcaacattaataaaggccgttcccgtcaactgcacgctgtacatttgtgatctgagcacatacaaagtttactcgttctgtcccgacacctgcgtgtggaagggagagggaagtttcgagtgtgcagggtttaacgctggagccataggcattgaggacaagatctatatcctgggcggtgattacgccccagacgagatcactgacgaggtgcaggtgtaccatagcaacagatcagaatgggaagaagtgagcccaatgccaagagccttgaccgagttttattgtcaggtcattcaatttaataagtacagggatccgtggttcagtaatctgtgtgcctag

SEQ ID NO: 57004 - DNA, 957 bp, Artificial Sequence
  Description of Artificial Sequence: Synthetic coding sequence
atgaagggcggaaacgctgatagttggcagcgcgagaaactcgcctctatggaaagccctgaggaaccaggagcgtccatggatgagaactatttcgtgaattatacattcaaggatcggagccattcgggtagggtcgctcaagggatcatgaagctttgcctcgaggaggagctctttgcggacgtgacaatatccgtggaggggcgagagtttcagctgcaccggctcgtattgtccgcacagagctgttttttcagatccatgttcacaagtaacctgaaagaagcccacaatcgcgtcatcgtcctccaggatgtcagtgaatcagtcttccaattgcttgtcgactacatctaccacggtactgtcaagctgcgcgcagaggagctgcaggagatctacgaggtttctgatatgtatcaactcacctctttgttcaatgcacttggattctggcccgcacagtgtaaatgggaaacagcattcagagcagatagacacagcgatagcagcatccgcctcccttcatgcgcaaagacacatctggcacagctgcagaacaccgaagagttcctccatctgccccatagattgctcaccgatatcataagcgatggagtaccatgtagtcagaatccaactgaagcaatagaagcctggattaacttcaataaagaagagcgtgaggctttcgcggagtctttaaggacttccctcaaggagatcggagagaacgtgcacatttacctcattggaaaagagagcagcagaacacacagcctggctgtgagtctgcattgcgctgaagacgacagcatttctgtgtctggtcagaatagtctgtgccatcagatcactgccgcttgtaagcacggaggagatttatatgtggtgggaggcagtatccctagaagaatgtggaagtgcaataacgcgaccgtcgattgggagtag

SEQ ID NO: 57005 - DNA, 1557 bp, Artificial Sequence
  Description of Artificial Sequence: Synthetic coding sequence
atggagagccccgaggagcccggtgcaagcatggatgagaactacttcgttaactacaccttcaaagaccgtagccactccggtagagtggcacagggcatcatgaagttgtgtttggaggaagaactgttcgcagatgtgacaataagcgtggaaggccgagagttccagctccaccgcctggtcctttctgcgcaatcttgcttttttcggtcaatgttcaccagtaatttgaaggaggctcataatcgggtaatcgtgctccaggacgtgtccgagagcgtgtttcagttgctggtagactacatctatcatggcaccgtcaaactcagggcggaagaactgcaggaaatttatgaagtgagtgacatgtaccagttgaccagcctgttcgaggaatgctcccgtttcttggcgagaaccgtacaggtgggaaactgtctccaagtcatgtggttggccgaccgacacagcgatccggaactatacactgccgcaaagcactgcgctaaaacccacctggcccagcttcaaaacacagaggagtttctgcatttgccccatagattgctaacagatatcataagcgatggagtcccctgctcccagaatcctacggaggcaattgaggcctggatcaacttcaataaagaggagcgcgaagcatttgccgagtctttgagaacatctctcaaggagatcggtgagaacgtgcacatctatctgattggtaaggaatctagccgaacacacagtttggctgtcagcttacactgtgccgaggacgatagcatttcagtgagtggccagaactccctctgtcaccagatcaccgccgcttgtaaacacggcggagatctctacgtcgtcggcggttctatcccacggagaatgtggaagtgcaataatgccacagtagattgggaatggtgtgctcctctccctcgagatcgcctccagcacactctcgtgtccgtgcccggaaaagatgcaatctatagcctgggaggcaaaaccttgcaagacaccttaagtaacgcggtaatctattatcgggtgggcgataatgtctggacagagacaactcagctggaagtggccgtttctggcgctgctggtgccaacctcaacggaatcatctatttactgggaggcgaggaaaacgacttggactttttcacaaagccatcaaggctaatacagtgttttgatacggagactgacaagtgtcacgttaaaccatatgtcctgcccttcgccggacgcatgcatgccgcagtacacaaggacttggtatttattgtcgccgaaggggacagcttagtgtgttataatccattactggacagcttcacccgactgtgtctgcctgaggcttggagctcagctcctagcctgtggaagattgcgtcctgcaatggctctatctacgtctttcgagacaggtacaagaagggggacgccaatacctacaagctcgaccctgccacaagcgctgtgacagtcaccaggggcattaaggtcctgttgactaatctgcagttcgtgcttgcatag

SEQ ID NO: 57006 - DNA, 1605 bp, Artificial Sequence
  Description of Artificial Sequence: Synthetic coding sequence
atgaaaggtggcaacgccgatagttggcaacgggaaaaactggcatcgatggaatcccccgaggagcccggagcctctatggatgaaaactactttgtaaattatacctttaaggaccgctcccattctggcagagtggcccagggcatcatgaagctttgccttgaggaggagttatttgctgatgtgacaatttccgtcgaaggtagagagttccagctccatagattggtcctcagtgctcagagttgcttcttccggtcaatgttcacctccaacctgaaggaggcacataacagggtgatagtcttgcaggatgtttcagaaagcgtgttccagctattggtggactacatttatcatggaacagtgaagctcagagcggaggaattacaggagatctatgaggtgagtgacatgtaccagctgactagcctgttcgaggaatgctctcggttcctcgccaggacagtgcaagtcggcaattgtctgcaggtgatgtggcttgctgaccgacactccgatcccgagctctataccgccgcaaagcactgcgccaagacacatttggcacagctgcagaacactgaggaattccttcacctcccccaccgcctgttaaccgatatcatcagtgacggcgtgccatgcagtcagaatccaaccgaggccattgaagcttggatcaactttaacaaggaggaacgcgaagccttcgcggagagcttgaggactagcctgaaggaaattggggaaaacgtccatatttatctgattgggaaagaatcctcaaggacacactcactggctgtgtctctgcattgtgcagaagacgatagcatttctgtgtcaggacaaaattccttatgccatcagatcactgccgcttgcaaacatggaggcgacctgtacgtcgtgggcggatccatcccccgtaggatgtggaaatgtaataatgcgactgtcgattgggaatggtgtgcccctctgccccgagacaggttgcagcacacacttgtaagtgttcccggaaaagacgctatttacagtctgggcggaaagaccttgcaggacacgctttccaatgcagtgatttattatagggtcggagataatgtatggacggaaaccacgcagttggaagttgctgtgtccggagcagctggagctaatttgaacggaatcatctatctcctaggcggtgaggaaaatgatctcgatttcttcaccaagccgagcagactgattcagtgcttcgacaccgagaccgataaatgtcacgtgaagccttatgtgctaccattcgcaggaagaatgcacgccgctgtgcataaggacctcgtgttcatcgttgcagaaggcgacagcctggtgtgttacaatccactactggacagcttcacgaggctatgtctgcccgaggcctggtctagcgcccctagcttgtggaaaatcgcctcctgcaatgggtcaatttatgtattccgtgaccgctataagaaaggggacgccaatacatataagcttgaccctgctaccagcgcggtgaccgttacaaggggaattaaagtgctactgaccaacctgcagttcgtcctggcttag

SEQ ID NO: 57007 - DNA, 1866 bp, Artificial Sequence
  Description of Artificial Sequence: Synthetic coding sequence
atggccctgggtctggagcaagctgaggagcagcggctatatcaacaaacccttctgcaggacggcttgaaggatatgttggaccatgggaagtttttggattgtgtcgtacgtgcaggcgaacgggagttcccttgccaccggttagtgctggcggcatgcagtccatactttcgtgctagattcctggctgaaccggagcgcgcaggggagctgcacttggaagaggtttctcccgatgtggtggctcaggtgttgcattacttgtatacctcagagattgctctcgacgaggcttcagttcaagaccttttcgcagctgcccacaggtttcagattcccagcattttcaccatatgtgtcagtttcctccagaagagattgtgtttatcaaattgcctagctgtcttccgtctgggcctcctccttgactgtgccagactggcggttgcggcacgcgatttcatttgcgcccatttcaccctcgttgctcgcgatgccgacttcctcggacttagtgcggatgaactgattgccattatctcctccgacggattgaacgtagaaaaggaagaggccgttttcgaggctgtgatgagatgggcgggatccggggatgccgaggcccaggccgaaaggcagagagctctgcctacagtctttgagagcgttaggtgtaggctcctgccacgggctttcttagagagcagggttgaacggcaccctttggtaagggcacagcccgaattattgcgcaaagtccagatggtcaaagatgctcacgaagggaggatcactacattaaggaagaagaaaaagggcaaggacggggctggggctaaagaggcagacaagggtacttcgaaggccaaagccgaggaggacgaggaagccgaacggatcctgcctggcatcctgaatgataccctgaggttcggcatgtttctgcaggatttgatttttatgattagcgaagagggagcagttgcatatgatccagccgcaaacgagtgttattgtgcctccctgtccaatcaagtaccgaagaatcacgtttccttggttacaaaagagaatcaggtattcgtcgcagggggactgttctataacgaggataataaggaagacccaatgtccgcttactttctgcaattcgaccatttggatagcgagtggctggggatgcctcctctgccctcccccagatgcctatttggactgggcgaagccctaaacagtatctacgtcgtgggcggacgggaaatcaaggatggagagcgctgtttggacagtgtgatgtgctatgaccgcctttcgtttaaatggggcgagtctgaccctctgccatacgtggtttacggacacacggtactgtcccacatggatctggtgtacgtgattggcggaaaggggagcgatagaaagtgtttgaataagatgtgtgtttacgaccccaagaaattcgagtggaaggagctggcacctatgcaaacagctagatcacttttcggcgctacagtccatgacggtagaatcatcgttgcagctggggttactgatactggccttactagtagtgctgaagtatactctataacagataacaagtgggctcctttcgaggccttcccacaagagcgtagttccctcagtctggtgtcgctggtgggaacactgtatgccattgggggattcgccacactggagactgaatccggggaactggtaccgacggaacttaacgacatctggcggtataatgaagaggaaaagaagtgggaaggagtacttcgggaaatcgcctacgcagccggtgctacattcctgccagtgcgcctgaatgtgctgtgtctgactaaaatgtag

SEQ ID NO: 57008 - DNA, 1101 bp, Artificial Sequence
  Description of Artificial Sequence: Synthetic coding sequence
atggtgaaggatgctcatgaaggtaggatcaccacactccggaagaagaagaagggtaaggacggcgcaggggctaaggaggctgacaaaggtactagcaaagcaaaggccgaagaagatgaggaggcagaaagaatcttgccagggattctaaacgacactctgaggttcggtatgtttctgcaggatctaatcttcatgattagtgaggagggggctgtggcatacgaccctgctgcaaacgaatgttactgtgcctctttgagtaaccaggtgcccaaaaaccacgtgagtttggttactaaagaaaaccaggtgtttgtcgcaggcggtctgttctataatgaggacaacaaagaggatccaatgtccgcctacttcctgcagtttgaccacctggactctgagtggctggggatgcctccactgccctcccctcgatgtctgttcggactgggtgaggctctcaatagcatctacgtggtgggtggacgggagatcaaagacggagaacgatgcctcgattcggtcatgtgctatgaccgactgagtttcaaatggggcgagtcggaccccctgccttacgtcgtgtacggtcataccgtcctttcccacatggatctggtctatgtgatcggcggaaaaggctctgacaggaagtgtctaaacaaaatgtgtgtgtatgatcccaaaaaattcgaatggaaggaactggcaccaatgcagactgctagaagcctgtttggagccactgtacatgacggcaggatcatcgttgcagccggtgttactgacactggactcaccagcagtgctgaggtctattcaatcaccgacaacaagtgggcgccatttgaagcgttccctcaagagcgctcttcccttagtcttgtctcactggtggggacactgtacgcaatcggcggtttcgccactctggagactgaatcaggagaattagtgccgactgagctcaatgatatctggcgatacaacgaggaagagaagaaatgggaaggcgttctgagggagatcgcctacgccgcaggtgcgactttcctgcccgtgcgtcttaacgtactttgccttacaaaaatgtag

SEQ ID NO: 57009 - DNA, 2025 bp, Artificial Sequence
  Description of Artificial Sequence: Synthetic coding sequence
atgcagtcaagagaagacgcacctaggtcacgcagacttgcctccccgagaggcggaaaaaggccaaaaaaaatccacaagccaactgtctccgccttttttaccggcccagaggagttaaaagacaccgcgcacagcgctgctctgctggctcagctcaaatccttctatgacgccagactcttgtgcgatgtcaccattgaggtagtgacaccagggtccggacccggaacaggccgattgtttccgtgtaaccgcaacgtgctggctgctgcttgtccttacttcaagtctatgtttaccgggggaatgtacgagtcccagcaggccagcgtgacaatgcacgacgtggatgccgagtcatttgaggtcctcgtggactactgctacaccggaagggtttcgctgagtgaggctaatgtcgagcgcctgtatgccgcatctgacatgctccagctcgaatacgtaagagaggcctgcgcatcctttctggcaagacgtttagacctgaccaactgcaccgcaattctgaagtttgccgacgccttcggtcataggaagctccgcagccaggctcagagctacatcgcccagaatttcaagcagctctcacatatgggaagcattcgggaggaaacattggccgacctgaccctggcccaattgttagctgtgctgcggctcgactctctggatgtggaatcagaacagacggtttgtcacgtggccgtccagtggcttgaggcggctccaaaggaaaggggtccaagcgcagctgaggtcttcaagtgcgtgaggtggatgcattttacagaggaagatcaggactacctcgaaggcctgcttactaagcccattgtgaaaaaatactgccttgatgtaattgagggcgctttacagatgcgttacggtgacctgttgtataagagcttggtaccggtaccgaactcatcatcctcctcttcctccagcaattctctcgtgagcgcagcggagaacccaccccagcgcctggggatgtgtgccaaggagatggtgatatttttcggccaccctagagatccgttcctgtgctgcgatccatactccggtgacctttacaaggttccatcgccgctgacttgtttagctcacacgaggacagtcacgacccttgcagtatgtattagccccgatcatgacatttatctcgcagctcagcctcgaactgacctttgggtctacaaaccagctcagaatagctggcagcagctagcagatagattattatgtagagaggggatggacgttgcatacctcaacggctatatttatattctcggcggtagggatccgatcaccggcgtgaagctgaaggaggtcgagtgctataatgtcaaacggaatcagtgggcactcgtagcacccctgccgcacagtttcttaagcttcgatcttatggtgatacgcgattatctgtacgcgcttaatagtaagcgcatgttttgctacgacccttcacataacatgtggctgaagtgtgtctctttaaagcgcaatgacttccaggaggcttgcgtatttaatgaggagatctactgcatctgcgacatccccgtaatgaaggtttataaccccgtgagggctgagtggcgtcaaatgaataacatcccactcgtatcagagaccaacaattaccgaattatcaaacacgggcaaaaactgctgttaatcacctcaagaacaccacagtggaaaaagaatcgcgtgactgtctacgaatatgacattcgtggcgaccagtggattaatatcgggactaccctcgggctgctgcagttcgacagcaactttttctgtctatccgcaagggtttacccatcgtgtctggaacccggtcaatcctttctgaccgaggaggaagaaatcccaagcgagtccagcaccgagtgggatcttggcggattttctgagccagactctgagagtgggtcgagcagctctttgagcgacgacgatttctgggtaagggttgcgcctcagtag

SEQ ID NO: 57010 - DNA, 1827 bp, Artificial Sequence
  Description of Artificial Sequence: Synthetic coding sequence
atgcaatccagggaagatgctccgagatctaggcgtctcgccagtccccgaggcggtaaacgtcctaaaaaaatccataagccaactgtgagtgctttcttcaccggacccgaagagttgaaggatacagcaagcgtcaccatgcacgatgtggacgctgagtcttttgaagtcctcgttgactattgctatacgggtagagtatctctgagtgaggcaaatgtggaaaggctttatgccgctagcgacatgctacagttggaatatgttcgcgaggcctgcgccagcttcctggctaggcgcctggacctgaccaactgcaccgcaatcttgaagttcgccgatgcttttgggcacagaaagctccgctcacaagcccagtcgtacatcgctcaaaatttcaagcaactaagtcatatgggaagcatccgggaggagaccctcgctgaccttactctggcccaactccttgctgttttgcgacttgacagcctcgatgtggaaagcgagcagactgtctgccacgtcgcagtacagtggttggaagcggcaccaaaggaaagagggccttcggcagccgaagtgttcaagtgtgtccgttggatgcatttcaccgaagaggatcaggactatctggaggggctgttgactaaacctatcgtcaagaagtactgcctcgatgtcatcgagggagcactccagatgagatatggtgatctgttgtacaaatccctggtacccgtgcccaactccagcagttcgtcctcctcctccaacagcttggtgtccgcagcggaaaatccacctcagcgactggggatgtgcgccaaggagatggtgatattcttcggccatcctagagatcctttcttgtgttgtgacccttattccggagatctttacaaggtcccatctccactgacctgtctcgcacacactcggactgttactacactggccgtttgcatcagtcccgatcatgacatttaccttgcggctcagccaaggaccgatctgtgggtgtataagcccgctcagaattcctggcagcagttagctgataggcttctctgtcgggaaggcatggacgtcgcctacttgaacggctatatctatattttgggaggccgagaccccatcacaggcgtgaagctaaaggaagtggagtgctataatgtcaagaggaatcagtgggccctggtagccccactgccacattccttcctatcattcgatctgatggtgatccgggactatttgtacgctctgaactctaaaagaatgttctgctacgatccctctcataacatgtggcttaagtgcgtgtcgctaaagaggaacgatttccaggaggcctgcgtttttaacgaagagatatactgtatttgtgacatcccagttatgaaggtctataatccagtgagggccgagtggcgccagatgaataatatacccttggtgagcgaaaccaataactataggatcattaaacacgggcagaagttacttctgattacttctcgaaccccccagtggaagaaaaaccgcgttaccgtgtatgagtacgacattaggggcgaccaatggattaatataggaacaaccctaggcttactgcaatttgacagcaactttttctgcctatctgcaagagtgtatccttcctgccttgagccgggacagagcttcttgacagaagaagaggagatcccctctgagagcagcacagaatgggacctcggaggcttctccgagccagactctgagtccgggagctctagttctctgtccgacgacgatttttgggtgcgcgtcgcccctcagtag

SEQ ID NO: 57011 - DNA, 2055 bp, Artificial Sequence
  Description of Artificial Sequence: Synthetic coding sequence
atgcagagtcgggaagacgtgccgcgatctcgtagactggcgtcaccacgaggcggaagacggccaaagagaatcagcaagccttcagtcagtgcctttttcaccggtcctgaagaactcaaggacaccgcccacagcgctgcattacttgctcaactgaagagtttctatgacgcgagactcttgtgcgatgtgacgatcgaggtggtgaccccgggtagcggacccggaacagggagactgttctcgtgcaaccgaaatgttctagccgctgcctgtccatattttaaaagcatgttcaccggcggtatgtatgagtcccagcaagccagtgtaactatgcatgacgtggatgccgagagcttcgaggtgctcgtggattactgttatacaggaagggtcagcctgtcagaagcaaatgtccaacgcttgtatgccgcttctgatatgctccaactcgaatacgtgcgagaagcctgcgccagtttcctggctagacgtttagacctcacaaattgtacagcaattcttaagttcgccgacgcatttgaccatcacaaactgagatctcaggcccagagttacattgctcataactttaagcagctgtccaggatgggctctatcagggaggagacactggcggacttgaccctggcccagctgctggccgtgctcagacttgactcgctcgacattgaaagcgagcggacagtgtgtcacgtggctgttcagtggctagaggccgctgcaaaggagcgtggcccatcggctgccgaggttttcaaatgtgtccgctggatgcatttcaccgaggaggaccaggactatctcgagggactgctgactaagcccatcgttaagaagtactgcctggacgtcattgagggggcactgcagatgaggtacggcgatctactctataaatctctggtcccagtgccaaattcttctagttcctcatcctctagcaactctctggtgagtgccgctgaaaatcccccacagcgcttgggcatgtgcgctaaagaaatggtcattttcttcggtcatcctcgggaccccttcctgtgttatgatccctattcaggcgatatttataccatgccatcccctctcacgtctttcgcccacaccaaaacagtaaccagttctgcagtatgcgtatcacctgaccacgatatctatctcgccgcacagccacggaaggacttatgggtgtataagccagcccagaattcttggcaacagcttgccgaccgcctcttgtgccgggaaggaatggatgtggcctacctaaatggatacatttacatccttggtggcagagacccaattactggggttaagctgaaggaagtcgagtgctactccgtgcagaggaatcaatgggcgctggtcgcaccagtcccacacagtttttattcatttgagctcatcgttgttcagaactacctatacgcagttaactcaaagcggatgctgtgttatgaccccagccacaatatgtggctgaactgtgctagcctcaagaggagtgacttccaggaggcctgcgtgttcaatgacgagatctactgcatctgtgatataccggtcatgaaggtatacaaccccgctagaggtgagtggcgtagaatttcgaacatccctttggattcagaaacacacaattatcagattgtgaatcacgatcagaaactcttgttgatcaccagcaccacaccacagtggaaaaaaaatagggtgactgtgtacgagtacgacactagagaggatcagtggataaacatcggcacgatgctgggactcctgcagtttgacagtggctttatttgcctttgtgctcgggtttacccatcctgcttggaaccaggtcagtcttttataacggaggaggatgatgccaggagcgaatccagcacagagtgggaccttgacggatttagcgagctggattctgaatctggctcgagttccagctttagtgacgacgaagtgtgggtgcaagtggctcctcagaggaatgcccaggatcaacagggtagcctgtag

SEQ ID NO: 57012 - DNA, 1761 bp, Artificial Sequence
  Description of Artificial Sequence: Synthetic coding sequence
atgttcactgggggtatgtacgaatcacagcaggcctctgtcaccatgcatgacgtggatgccgaaagcttcgaggtcctcgtggattactgctataccggacgcgtcagtctgtccgaggcaaacgtgcagcgcttgtatgctgccagtgatatgctgcagctcgaatacgtgagggaagcctgtgccagtttcttagctcggcgactagacctgaccaactgcacagccatccttaagtttgccgatgccttcgatcatcacaagctgcggtctcaggctcaaagctatatcgcgcataacttcaaacaactgtccaggatggggagtatccgtgaggagaccttggcagacctgactctggcacagttgctggctgtgttacggctggattcactagacattgaatcagagcgcacagtttgccacgttgcggtccagtggcttgaggcggcagccaaagagaggggtccgtccgctgccgaggtgtttaagtgcgttcggtggatgcactttactgaagaggaccaagactatctcgaaggcctgctgactaaaccaattgttaaaaagtattgcctggacgttatcgagggggcattgcaaatgcgctacggcgatctcctctacaaaagcctcgtgcctgtccccaactcctcttcttccagttcctcttcaaactccttggtgtccgcggctgagaaccctccgcaaagactcggaatgtgcgccaaagaaatggtgattttctttggccatccgcgagaccccttcctgtgctacgatccctattccggtgacatctacaccatgccttctccgttaaccagttttgcccacactaagaccgttacatcttccgcggtctgtgtgtcaccggatcatgacatctatctggcggctcagccacgaaaagacctctgggtctataagcctgctcagaattcttggcagcagcttgcggatcgcctgctgtgtcgagagggaatggacgtcgcctatctaaacggatacatctacatacttgggggacgcgaccccatcacgggggtcaagttgaaggaggtcgaatgttatagcgtccagcgcaaccaatgggccttggttgctcccgtgcctcacagcttttactccttcgaactgattgtggtgcaaaactatctgtatgctgtcaatagcaaaagaatgctctgctatgatccgtcccacaacatgtggctgaactgcgcttccctcaaaagaagcgatttccaggaggcgtgcgtttttaatgacgagatctattgtatctgtgatatccctgtgatgaaggtttacaatccggctcgaggggagtggaggagaatctctaatatccctctcgattccgagacccacaattatcagatcgttaaccatgaccagaagttgctgctgatcacctccacaaccccccaatggaagaaaaacagagtcacagtgtatgaatatgacactagagaggaccagtggataaacatcggaaccatgctgggcctgctccagtttgatagtggttttatatgtctttgcgccagggtttacccatcttgccttgaacctggtcagtcattcatcaccgaggaggacgacgccaggagcgagtcttcaactgaatgggatctggatggcttcagtgagcttgacagtgaaagcggctccagctcttccttctcagacgacgaagtgtgggtccaagtggccccacagagaaacgcccaggaccagcagggcagcctgtag

SEQ ID NO: 57013 - DNA, 1728 bp, Artificial Sequence
  Description of Artificial Sequence: Synthetic coding sequence
atggaccccttccatgcctgttccattctgaaacagctgaaaaccatgtatgacgagggtcagctgaccgatatcgtcgttgaggtcgatcatggcaaaacgtttagctgtcacaggaatgtgctggctgctatcagcccttacttcagatccatgtttacgtcgggcctgacagaatccacccagaaagaagtgaggatcgtgggcgtggaagccgagtctatggacctggtcttgaattatgcttacacttcccgggttatacttacggaggccaacgttcaggctctgttcaccgccgcttctattttccagattccctcgatacaggaccagtgtgccaagtacatgatcagccacctggatccccagaacagtattggtgttttcattttcgctgaccactatggacaccaggaactcggcgatagatccaaggagtacatcagaaagaaatttctttgcgtaaccaaggagcaggagttcctgcagctaaccaaggaccaactgattagtattttggactcggatgacctcaacgttgatcgtgaagaacacgtctatgagtctatcatccggtggtttgagcacgaacagaatgaaagagaggtgcacctgccagagatatttgcaaagtgcattcgattcccacttatggaagacacattcatcgaaaagattcctccacagttcgctcaagcaattgccaaatcgtgtgtggaaaaaggtcccagtaacacaaacggatgcacacagcgattagggatgaccgccagcgagatgattatttgctttgacgccgctcacaagcacagcggaaaaaagcaaacagtcccgtgcctggacatagtgaccgggcgagtattcaagctttgtaaaccccctaacgatctcagagaagtgggcattctggtaagtccagataacgatatatatatcgctggtggttaccgaccatctagttcggaagtgtctatcgatcacaaggctgagaacgacttctggatgtacgatcactcaacgaacagatggctctcgaagccctcgttacttagggccaggattggctgtaagctggtctactgctgcgggaagatgtatgccataggaggcagagtctacgaaggagacggtaggaactcgctgaaatctgtggaatgctacgactcaagagagaactgctggacaaccgtgtgcgccatgccagtggccatggaatttcataatgcagttgagtataaagagaagatttacgtgctacagggtgaattttttctattctacgagccccagaaggattactggggattcctcacacccatgacggttcctagaattcaggggttggcagccgtgtataaagactccatatattacatagccggaacctgtgggaaccaccagaggatgtttactgttgaggcatatgacatagagctgaataagtggaccaggaaaaaggacttcccttgcgatcaaagcattaacccctatctgaaactggtgctattccagaataaactccacttgttcgtgcgcgcaacacaggttaccgtcgaggagcatgtttttcgcacgtctcgcaagaattcactttaccagtatgacgacatcgccgaccagtggatgaaggtttacgaaactcccgataggctctgggatttgggacgacacttcgagtgcgctgtggcgaagttataccctcagtgccttcagaaggttctctag

SEQ ID NO: 57014 - DNA, 1806 bp, Artificial Sequence
  Description of Artificial Sequence: Synthetic coding sequence
atggctgcctccgctgacctctccaagtccagcccgactccaaatgggattccctctagtgatccagcaagcgacgccatggacccttttcacgcctgctctatattgaagcagctaaaaactatgtacgatgaaggacagcttacagatatcgtggtggaggtggaccacggaaagacctttagctgccataggaatgtcctcgctgctatctctccttattttaggtccatgtttacaagcggactgacagaatctacccagaaggaggtccggatcgtaggcgttgaagcagagtctatggacctggttctcaactacgcctacacctcacgagttatcctgacagaagccaatgtacaggccctctttacagcagcgagcatttttcagattccttccatccaggaccagtgcgcgaagtacatgatttcgcacctcgacccccagaactctattggcgtgttcatttttgccgatcattacggccatcaggaactgggggaccggtccaaggaatatattaggaaaaaattcctgtgtgtcacaaaagagcaggagtttctccagcttacgaaagaccagctgatcagtatactcgactctgacgatttgaatgtagaccgcgaggagcatgtgtatgaatcaatcattagatggttcgagcatgaacagaatgaaagagaggtgcacctccctgagatctttgccaagtgtatccgcttccctctcatggaagacacatttatcgaaaagataccccctcagtttgctcaggccattgctaaatcatgtgttgaaaagggcccttcaaataccaatggttgtacacagagattaggtatgacggcctctgagatgattatctgttttgacgcggcacacaaacactccgggaaaaagcagactgttccgtgcttggatatcgtgactggtagggttttcaaactatgcaagcctcccaatgacctcagagaggttggaatcctggttagccccgacaacgatatatatatcgcgggaggatacagacccagtagctcagaagtgagcatcgatcacaaggccgagaacgacttctggatgtatgatcattccaccaataggtggctatcaaagccaagtctcctgagagcgagaatcggatgcaaactggtgtattgttgcggcaaaatgtacgctatcgggggacgagtttatgagggagatggcagaaattcccttaagtctgtggagtgctatgactcccgcgagaattgttggactacggtgtgcgctatgccagttgctatggagttccacaatgcagtggagtacaaggagaaaatctacgtactgcagggcgaattcttcctgttttacgagcctcagaaggattactggggctttcttaccccaatgacagtgccgaggatccagggcctggctgccgtttacaaagattcgatctactatattgccggaacatgcggaaaccatcaaagaatgttcacagtggaggcctacgacatagagctgaataagtggacccgtaaaaaagacttcccttgcgaccagtcgatcaatccttacctgaagctggtactcttccagaataaattgcatctgtttgtgagggccacccaggtcacggtcgaagagcacgtttttcgtacttcacggaagaacagcctatatcaatatgatgacattgctgatcagtggatgaaggtttacgagacacccgaccggctgtgggatctgggcagacattttgagtgtgcagtggctaagctgtacccgcaatgcctccagaaggtgctgtag

SEQ ID NO: 57015 - DNA, 948 bp, Artificial Sequence
  Description of Artificial Sequence: Synthetic coding sequence
atggacgtgaacaagtttgaagcgtcggtcggatttctggacgttaaaaagttcctttccacttggaagctgcagaatcccaggacacactttgttttgtccccccattgtttcatggggggtatcatggccccaaaggatatcatgactaacacgcacgccaagagtattctgaatagcatgaactcgctgaggaagagcaatactttgtgtgacgtaacgttgagagtagagcaaaaggacttccccgcacacagaatagttctcgctgcctgttctgactatttctgtgccatgttcacttcagaactgtctgagaagggaaagccatacgtcgatatccaaggtctaactgcgagtaccatggaaatattgctggactttgtctataccgaaaccgttcacgttacggtggagaatgtgcaggaattgctgccagcagcctgcctgctacagctgaaaggcgtaaagcaggcatgttgtgaattcctggagtcccaacttgacccctctaactgtctgggtatcagagatttcgctgaaactcacaattgcgttgatctcatgcaggccgcagaggtgttcagtcagaaacatttccccgaagtcgtgcagcatgaggagtttattctcctctctcagggagaggtggagaaactcatcaagtgtgacgaaattcaggtagactcagaagagcctgtatttgaggcagttatcaattgggtgaagcacgctaagaaggaaagagaagagtcattgccaaacctgcttcagtacgttcggatgccactcctgacaccgcgttacatcactgacgtcatcgacgctgaaccgttcattcgctgtagcctgcagtgccgcgaccttgttgatgaagctaaaaaattccacctccgcccagaactccgcagccagatgcagggccctaggactagggcacggttgtag

SEQ ID NO: 57016 - DNA, 615 bp, Artificial Sequence
  Description of Artificial Sequence: Synthetic coding sequence
atgcagggaccacggacgcgggctcggctcggcgcaaatgaggttctgttggtagtcggtggctttggcagccagcaatcaccgatcgatgtcgtggaaaaatacgatcctaagactcaggaatggtccttcctgccatcaattaccaggaagaggagatacgtcgcctctgtgagccttcacgatcggatttacgtgattgggggttacgacggacgctcaagattgtcatcagtcgagtgtctggattacacggccgatgaggatggggtctggtacagcgtggcacccatgaatgtacggaggggactggccggagccactaccctgggggatatgatatatgtctcagggggattcgatggaagtcgaaggcatacttccatggagagatacgaccccaacatcgatcagtggagtatgttgggcgacatgcagactgcccgagagggggcaggcttggtggttgcctcgggggtcatctactgtcttgggggatacgatggactcaatatcctgaactccgtggagaaatatgatcctcacactggtcactggacaaacgtcacacccatggccacaaaaaggagtgatatgatggtgataccatgctag

SEQ ID NO: 57017 - DNA, 1707 bp, Artificial Sequence
  Description of Artificial Sequence: Synthetic coding sequence
atgggcggaattatggccccaaaagacataatgaccaacacacacgccaagagcattttgaactctatgaactccctgaggaagtccaacacactttgtgatgtgaccttgagggtcgaacagaaggacttcccagctcataggattgtactcgccgcttgcagtgattatttctgtgccatgttcacgtcagaactgagcgaaaagggcaagccttatgtggacattcagggtcttacggcttctacaatggaaatattgctggatttcgtgtataccgagactgtgcatgtgaccgttgaaaacgtccaggagcttttgccggctgcttgtctgttacaactgaagggagtgaaacaggcatgttgcgaattcctcgagagtcaactggatccctctaactgcctgggcatcagagacttcgcggaaacacacaactgcgtcgatcttatgcaggctgctgaagtgttcagtcaaaaacactttccagaggtggtgcagcacgaagagtttatactgctgtctcaaggagaagtcgagaagctgattaaatgtgacgagatccaggtggatagtgaggagcccgtttttgaggccgtgattaactgggtgaaacatgctaaaaaagaacgagaggagagtctgcctaatctgctgcagtacgtgcggatgcccttactgacccctcggtacatcacagatgtcattgacgcggagccgttcattaggtgcagtttgcaatgccgggacctggtggacgaagctaagaagtttcatctgaggcccgaactgcgcagtcagatgcagggcccaaggaccagggcaagacttggagctaatgaagtgctgctggtggtcgggggttttggctcacagcaatccccaattgacgtcgttgaaaagtacgaccctaagactcaagagtggagctttctccctagcatcactaggaagaggcgttacgtcgcaagtgtgagtctgcatgaccgaatttatgtgattgggggttacgatggtcgctcccgcctttcttctgttgagtgcctggactatacggctgacgaggatggcgtctggtattccgtggccccaatgaatgtgagacgtggtctggccggtgctacaactctcggcgacatgatttatgtctccggaggcttcgatggaagtaggagacacacaagcatggagaggtatgaccctaacattgatcagtggtcaatgctcggtgacatgcagaccgctcgtgagggcgctggtctggtggtggccagtggtgtgatttattgtttgggaggatacgatgggctgaatatcctaaatagcgtcgaaaaatatgacccccacacgggtcattggaccaacgtcactccgatggccacaaagcggtcaggggcaggcgtggccctgctgaatgaccatatatatgttgtcgggggtttcgatggcacagctcacctctcatcagtcgaagcgtacaatatcaggaccgactcatggacaactgtgacctccatgaccactcccagatgctacgttggtgcaactgtgctgcgcggtcgcctctatgcaattgctggatatgacggcaattccctgttaagttccatcgagtgctacgatccaatcatcgactcgtgggaagtggtgacgagtatggggacccaaaggtgtgacgccggtgtttgcgtcctccgcgaaaagtag

SEQ ID NO: 57018 - DNA, 1821 bp, Artificial Sequence
  Description of Artificial Sequence: Synthetic coding sequence
atggacgtgaataaatttgaggcttctgttggattcctcgacgtaaagaagtttctgtccacctggaagctgcaaaacccccgaacacactttgtgctgtccccgcactgtttcatgggaggaattatggcccctaaagatataatgacaaacacccacgccaaaagtattctcaactctatgaactcgctccgaaaatccaacaccctgtgcgacgtgacacttcgggtagaacaaaaggattttccagcccacaggatcgtccttgccgcttgttctgactatttctgcgcgatgttcacatctgaattatcagagaagggcaagccctatgtcgatatccaaggactgactgcatctacaatggaaatacttcttgattttgtatatacggaaactgtacacgtgaccgtggaaaacgtccaggaattgctgccagccgcatgtctgctccagctgaaaggagtgaagcaggcatgttgcgaattcctggagtctcaactcgatccttctaattgtctgggcatccgggatttcgcggaaacccacaactgcgtggatctcatgcaggctgcagaagtcttctcccaaaaacattttcccgaggtggtccagcacgaagaattcattctgctgtctcagggagaggttgaaaagttaattaagtgcgatgaaatccaggtcgactctgaggaacccgtttttgaagctgttatcaactgggtcaaacacgccaagaaggaaagagaggaatctctgcccaatctgttgcagtacgtgaggatgcctttgctgacaccaagatatatcaccgatgtgatcgacgccgagcctttcattaggtgttctttgcagtgcagagatttagtcgatgaagcaaaaaagtttcatctccgccctgaactgcggagtcagatgcaggggcctcgtactcgcgctagactgggagctaatgaagttctgcttgtcgtcgggggttttggctcacagcagtcccccatcgacgttgtcgagaagtacgaccctaagacacaagaatggagcttcctgccatccattactcggaagaggagatacgtcgcctctgtctcgctgcatgatcggatctatgtgattggcggatacgacggccgatcaaggctgtcgtccgtggagtgtctggactacactgctgacgaggacggcgtgtggtacagcgtggctcctatgaacgtaagaagaggcctggctggggctacaactttgggcgatatgatttacgtttccgggggtttcgatgggtcgaggaggcatacatccatggaaaggtacgatcctaacattgaccaatggagcatgctgggggatatgcagaccgctagagagggagcgggtttggtggtcgcctctggggtcatatactgcctgggcggatatgacggtttaaatatccttaattccgtcgagaagtatgacccacatacaggacattggacaaacgttactcctatggctacaaagcgatctggggctggagtagctctgcttaatgaccacatttatgtggtgggcggattcgacggcactgcccatttgtcaagcgtcgaagcctacaatatcaggaccgactcttggaccacagtcacgagcatgactacacctagatgctatgttggcgcaaccgttcttcgaggaagactttacgctatcgctggatatgacgggaacagtcttctgtcttccattgaatgctacgatccaatcatagacagctgggaggttgtgaccagcatgggcacacaacggtgtgacgcaggagtatgcgtgttgcgcgagaagtag

SEQ ID NO: 57019 - DNA, 1815 bp, Artificial Sequence
  Description of Artificial Sequence: Synthetic coding sequence
atggccggagatgtcgagggcttttgttcaagcatccatgacacgagtgtgtcggcaggctttcgcgctctgtatgaagaaggactgctgttggatgttacgttagtgattgaggaccaccagttccaggcacacaaagccctcctggcaactcagtccgactattttaggattatgtttaccgccgatatgagagaacgcgatcaggacaaaatccatctcaaagggcttacagccaccggcttctctcatgtgctgcagttcatgtactacggtactatcgagctgagcatgaacactgtccatgaaattcttcaggctgcaatgtacgtacagctgatcgaagtggtgaaattttgttgctcctttctcctagccaagatatgtctagaaaactgtgctgagataatgcggctgctggacgattttggagtaaatattgagggcgtgcgtgagaaactggacactttcctcttggacaattttgtgcccctcatgtcaaggcctgattttctgtcttacctcagttttgaaaagttgatgtcatatttggacaatgaccacctgagcaggttccctgaaatcgaattatacgaagccgtgcagtcttggctgagacacgacagacggcgttggcggcacaccgatacaatcatccagaatataaggttctgtctcatgactccaacaagtgtctttgagaaggtcaagactagcgagttttatagatattccaggcaactgaggtacgaagtcgatcaagccctgaactactttcagaacgtgcatcagcagcccctgctcgacatgaaatcaagccgaatcaggtcagccaaacctcaaactaccgtgtttagaggcatgatcggtcatagtatggtgaactctaagatcctgttattgaagaaaccaagagtttggtgggaattggagggccctcaggtccccttaaggccggattgtctggcaattgtcaataactttgtgtttctgctcggcggagaggagctgggaccagatggagagttccacgcttcgagtaaagtattccggtatgacccccgtcagaatagttggctgcagatggcagatatgtccgtgccacggagtgagttcgcggtcggcgtgattggcaagttcatctacgctgttgcgggtcgaactcgggatgagaccttttactcaactgaaaggtacgatattaccaatgataaatgggagtttgtagatccataccctgttaacaaatatggacatgagggcacagttttaaataataaactctttattaccgggggtattacgtcctcttcgacaagtaaacaagtgtgcgtgtttgaccccagcaaagagggaactattgagcagcggaccaggcgcacccaagtggtgaccaactgctgggaaaataaatccaaaatgaattatgccaggtgtttccataagatgattagctataacggcaagttgtacgtcttcggaggtgtgtgcgtcatcttaagagcatcctttgagtcacaggggtgtcctagtacagaggtttacaaccccgaaacggatcagtggactatcctcgcttctatgcccattggtcggtcgggccacggtgtaacggtgttagacaagcagatcatggttctgggaggactgtgttataatggccactacagcgacagtatcttgaccttcgacccagatgaaaataagtggaaagaagatgagtaccccagaatgccatgcaaactggacggactccaggtgtgcaacctccacttcccagactacgtgctggacgaggtgagacgatgcaactag

SEQ ID NO: 57020 - DNA, 1437 bp, Artificial Sequence
  Description of Artificial Sequence: Synthetic coding sequence
atggatacaagtgacctcttcgcctcctgcaggaaaggagacgtgggcagagtgcggtatcttctcgaacagagagacgtggaagtgaatgtgagggataagtgggacagcactccactctattacgcatgtctttgcggacacgaggagctggtgctttacctgctggccaacggggcacggtgtgaagccaatacctttgacggcgaaagatgtctgtacggcgcactctctgaccccattcgtcgggcattacgcgattacaagcaagtcactgccagctgcaggcggcgtgactactacgatgatttcctgcagcgtctgctggaacagggaatacacagcgacgtcgtctttgttgtccacggaaagccatttagggtgcatcggtgcgttttaggggcacgctccgcctactttgcaaatatgctggacacaaagtggaaggggaaatcagtggtggtcttacgccacccactgatcaaccctgttgcctttggagctcttctccagtacctctataccggcaggttggacattggagtcgaacacgtgagcgattgcgagcggctggctaaacagtgccagttgtgggacctattgtctgacctggaagctaaatgcgagaaggtgagtgaatttgtggcatcaaagcccggtacctgtgtcaaggttcttacaatagaacccccaccagctgatcctagactgcgtgaggatatggccctccttgctgactgcgcactccccccagagcttaggggtgacttatgggaactcccgttcccctgccccgacggcttcaattcctgtccagacatctgttttagagtggcaggctgctcttttctctgccacaaagctttcttctgtggaagatctgactacttccgcgcactgctggacgatcatttccgtgagagcgaggagcccgcaacaagtggaggcccacccgcagtcacactgcatgggattagtcctgacgtgttcacacacgttctgtattatatgtactcagaccataccgagttatcccccgaggctgcatatgatgtgctgtctgtggctgatatgtatctgttgccaggcctgaagcgattgtgtgggagatcactggctcagatgctcgatgaggacaccgtggtgggcgtatggagggtggcgaagctattccgtcttgcgcgactcgaagaccaatgtaccgagtatatggctaaagtgattgagaaactggtcgagagagaagactttgttgaagccgtcaaagaggaagcggctgccgtggctgctaggcaggaaaccgactccattcccctggtggatgatattcggttccacgtcgcatccacggttcagacatactctgccatagaagaggcgcaacaaaggttgagggctcttgaggatctcctggtttctatcggactggactgttag

SEQ ID NO: 57021 - DNA, 1389 bp, Artificial Sequence
  Description of Artificial Sequence: Synthetic coding sequence
atgggtgcgtctttcttacaactgcagtccataaaagacgcgtgctgcacatttctgcgcgagagattgcaccctaagaactgtctgggagtgagacagtttgctgagactatgatgtgtgcggtgctgtacgacgcagcgaatagcttcatacaccagcactttgttgaggtctcaatgagcgaagaatttcttgccctgccactagaagatgtgttagagctggtgtcccgagacgagctcaacgtgaagagtgaggagcaggtgtttgaggctgccttggcctgggtgcgatatgatcgcgaacagcgcggaccttatctgcccgagcttctctctaacataaggctccccctatgtcggcctcagtttctgagcgaccgtgttcagcaggacgacctggtgcgctgctgccacaaatgtcgagacttagtggacgaggccaaagactatcacctgatgccggaaagacggcctcacttgccagccttcaggactaggcccagatgttgcacctctatcgccggtctgatctatgctgtgggcggtctgaactctgcaggcgatagcctgaatgtggttgaagtgttcgatcccatagccaactgttgggaacgctgccgcccaatgactactgccagatccagggtgggagtggcggtggtaaacggactgctgtatgcaattgggggatacgatgggcagctcagactgagtactgtggaggcctacaaccctgaaaccgatacctggacacgagttggaagtatgaacagcaaacgttcagccatgggcactgtggttctggacggacaaatttatgtatgcggcggttacgacgggaactccagcctgagctctgtggagacttactcacccgagactgacaaatggaccgtggtgaccagtatgtcctctaatcgctctgctgccggagttacagtgtttgaggggcgtatttacgtgagcggcggtcatgacggattacaaatattctccagcgtcgagcattacaaccaccatacggctacgtggcaccctgccgctgggatgctgaataaacgctgtcgacacggcgcagcctcactcggctccaaaatgtttgtgtgtggcggatacgatggctctggcttcctcagtattgctgaaatgtattcatccgttgccgaccaatggtgtctgattgtgcctatgcatacgcgtcggtcgcgggttagcctggtggcttcctgcggtaggctgtacgccgttggtggatacgatggccaatctaacctctccagtgtggagatgtatgacccagagacagactgctggacctttatggcccctatggcctgccatgaaggaggtgtgggggtgggctgtattccattactaacaatatag

SEQ ID NO: 57022 - DNA, 1905 bp, Artificial Sequence
  Description of Artificial Sequence: Synthetic coding sequence
atggccgaggaacaagagtttacccagctttgtaagcttccagcgcagccaagtcacccacattgcgtgaataacacatatcgcagtgcccagcactcgcaagctctcttgcggggtcttctcgcgctcagagattccggaatcttgttcgacgtggtgctagtggtcgaaggtaggcacatcgaggcacacaggattctgttagctgcatcctgcgactatttcagggggatgttcgcaggcggtttaaaggagatggagcaggaggaagttttgattcacggagtgtcttacaatgcaatgtgtcagattctgcatttcatctacacatcagagctcgagttgtcattaagcaatgtccaggagaccttggtggctgcatgccagctgcagatccccgagattattcacttctgctgcgatttcctgatgagctgggtggatgaggagaatatcctagacgtttacagattggcagagctatttgacctgtctcgtctgacagaacagctagatacatacatactcaaaaactttgtagcattctccaggactgacaagtatcggcaattgcccttagagaaagtgtatagcctgttatcgtcaaatcgcctcgaagtctcttgcgaaacggaagtttacgagggagcactcctatatcattattcgctggagcaagtccaggccgaccagatcagcctgcatgagccccctaaattgctcgaaaccgtcaggttccctctcatggaagcggaggtgctgcagagactccatgataaactcgatccttcccctctccgggataccgtcgcttcagcgctaatgtatcacaggaacgagagtcttcagccttcgctacagtcccctcaaactgaactgcggtctgatttccagtgcgtggtaggcttcggtggcatacactccacccccagcaccgttctatccgaccaggccaagtatctgaatcctctgctgggcgaatggaagcattttactgcgtctctggcccctcgaatgtcgaaccaaggaattgcggtgctgaataactttgtgtatctcatcggcggagataataacgtgcagggcttccgcgcagagagccgctgctggaggtatgaccccagacacaatagatggtttcagattcagtctctacagcaggagcatgcagacttatccgtctgcgtcgtcgggcgatatatttacgccgtcgcagggagggactatcataatgacctgaacgccgtcgagcgttacgacccggcaactaattcatgggcatacgtggcgccactgaagcgcgaggtatatgcacatgccggtgctacactggagggtaaaatgtacatcacatgtgggaggaggggagaagattacttaaaggaaacacattgctacgaccctgggagcaatacatggcacacgctggccgatggccctgtacgaagagcatggcacgggatggctacattattaaataagctgtacgttattggagggtctaataatgatgcagggtacagaagagatgttcatcaggttgcgtgctatagttgtacatcaggccaatggagcagcgtctgcccactgccagcaggtcatggcgagcctgggatcgctgtgctggacaatcgcatctacgtactgggcggaaggtcacacaatagggggtcacgcacgggctacgtccatatttatgacgtggagaaagactgctgggaggaggggccacaactggacaactctatcagtggccttgccgcatgcgtccttaccctgcctcggtcactattgctcgaacctccccgaggcactccagatcggagccaggctgatcccgacttcgcatctgaagtaatgtctgtgtcagattgggaagagttcgacaattcatctgaagattag

SEQ ID NO: 57023 - DNA, 1476 bp, Artificial Sequence
  Description of Artificial Sequence: Synthetic coding sequence
atgtcttgggtcgatgaagagaacatcctggatgtgtatcgcctcgctgagttgttcgacctgtctagattaacagagcagctggacacctacatactgaagaacttcgtagcattttccagaactgacaaataccgtcagcttcccttagagaaagtttatagcttactgagctccaaccgactggaggttagttgcgaaaccgaagtttatgagggagccctgctgtaccactattcattggagcaggtgcaagctgatcaaatcagtctgcatgagcctccaaagctcctggagaccgtgcgctttcccctcatggaagctgaagtattgcaacggttacacgacaagttagaccctagtcccctgagggatactgtggcatccgccctgatgtaccacaggaatgagtctctgcaaccatcattacagtcaccgcaaactgaattaagatctgatttccaatgcgtggtcggattcggcggaatccacagtacgccaagcactgtcttgtccgaccaagctaagtacctgaaccctctgctgggtgagtggaagcattttaccgcgtcccttgcccctcgaatgagcaatcagggcatagcggtgttgaataattttgtgtatctcatcggcggtgacaacaacgtccaagggtttcgagctgaaagtcgatgctggcggtatgatccaaggcataacaggtggtttcaaatacagtctttgcagcaggagcatgctgatctcagtgtgtgcgtcgtgggaaggtatatctacgccgttgccggaagagattaccacaatgacctgaatgctgtggaaaggtatgaccccgcaaccaacagctgggcatatgttgcacctctgaagagagaagtgtacgcccatgccggagctaccctggaaggaaagatgtacattacctgcggcagaagaggcgaagattacctgaaagaaactcactgctatgaccctggcagcaatacatggcacactctagccgacggacctgtgaggcgcgcatggcatgggatggctacactcctgaataaactctacgttatcggcggaagtaataacgatgccggttacaggcgagatgttcaccaagttgcttgttacagttgcacatcaggtcagtggagttctgtctgcccgctgccagctggccatggtgagcctggcattgccgtgttggacaaccgcatctatgttctagggggtcgatcccataaccgcggttcaaggacagggtacgttcatatttatgatgttgaaaaggattgttgggaagagggcccacagctggacaattcaatcagcggactggcggcttgtgtactgactctgcccagaagcttgttgttagagcccccacgcggaaccccagacaggtcacaggccgaccctgactttgcaagtgaggttatgagcgtgagcgattgggaggaatttgataacagctccgaggattag

SEQ ID NO: 57024 - DNA, 708 bp, Artificial Sequence
  Description of Artificial Sequence: Synthetic coding sequence
atggcagaagaacaggagtttacccagctttgtaagctccccgcacaaccaagccaccctcactgcgtgaataacacatatcggtcagcccagcacagccaggcccttttacggggactgttagctctacgcgactccggcatactgttcgatgtggtcctagtggtcgaaggcaggcacatcgaagcccacaggatcttactggcagcctcctgcgattattttaggggtatgttcgctggtggcctcaaggagatggagcaggaagaagtcttgatccacggagtgagttacaacgccatgtgtcagatccttcacttcatctacacttctgagcttgagctatctctgagcaatgttcaggaaacactggtcgccgcatgccagctgcagattcccgaaattattcatttctgttgtgatttcctgatgtcctgggtggacgaagaaaacatcctcgatgtttacagactggccgagctgtttgatctctcaagactcactgaacagttggacacttatattttgaagaattttgtggcctttagcaggacagacaaatacaggcagctgccacttgagaaagtgtattctttgctcagctctaataggcttgaggtgtcctgcgagaccgaagtctatgagggggcactgctatatcactacagcctcgagcaggtccaggctgaccaaatctctctgcactag

SEQ ID NO: 57025 - DNA, 1677 bp, Artificial Sequence
  Description of Artificial Sequence: Synthetic coding sequence
atggcgctgaaaggtcaggaagattatatatacctgtttaaggactccactcacccagtcgacttcttggatgcatttagaactttctacctggacggcctgttcacagacattacattacagtgtccctcgggaataattttccattgtcatcgggcagtccttgcggcatgctccaattactttaaagccatgttcacggccgatatgaaagaaaaatttaaaaacaaaataaaactgtcaggcatccaccacgacattctggagggcctggttaactacgcatatacaagtcagattgaaattacaaagaggaatgtacagtccctgttggaggccgcagatctgctgcagtttctgtctgtgaagaaagcttgcgagagattcctggtgcgccatcttgatatagataactgcataggtatgcacagcttcgctgagttccacgtctgtccagaacttgagaaggagagtcgacggattctctgctcgaagtttaaagaggtgtggcagcaggaggaattcctcgagatctctttggagaaattcctgtttattttgagtcgaaagaacctgtctgtgtggaaggaagaagcgattatagagcccgtgatcaagtggacagcccatgacgtggagaaccggattgagtgtctctacaatctcctgagctacatcaatattgacatagatcccgtttatctgaaaactgctcttggactgcagcggagctgcctgctgaccgaaaacaaaatccgaagccttatctacaatgccctgaaccccatgcataaggagatctctcagagatccaccgcaacaatgtacatcatagggggttactactggcacccactgtctgaggtgcacatttgggacccattgacaaacgtttggattcagggagctgagattcccgactacaccagagagtcctatggcgtgacatgcctcggacctaatatctacgtcactggcggataccggactgataacattgaagcgctggataccgtttggatctacaacagtgagtcggacgagtggacggaagggctgcccatgttgaatgccagatactaccactgcgccgtgaccctgggcggttgtgtatatgccctgggtggctatcgcaagggcgctcctgctgaggaagcagagttttatgacccattgaaagagaagtggatcccaatagccaatatgatcaagggcgttggaaacgccactgcctgtgttctccacgacgtgatctatgtgattggtggccactgcggataccgcggatcctgcacctacgataaagtccagagctacaattccgatatcaatgagtggagcctgataacgagttcaccccacccagaatacggactttgctccgtgccattcgagaacaagctgtatctggtcggcggacagacgacaataactgagtgttacgatccagagcagaatgaatggcgcgaaattgctcctatgatggagcggcgaatggaatgtggcgcagttatcatgaatggatgtatctatgtgactgggggatatagctattccaagggaacatatctccagtctattgagaaatatgaccctgacctcaataaatgggagatcgttggaaacctcccttctgctatgcgatcccacggatgcgtgtgcgtctataacgtgtag

SEQ ID NO: 57026 - DNA, 1677 bp, Artificial Sequence
  Description of Artificial Sequence: Synthetic coding sequence
atggctctgaagggccaggaagattacatttacttgttcaaggacagtacacacccagtcgatttcctggatgcctttagaaccttctacctcgatgggctgttcaccgatatcacactgcaatgcccatcagggatcattttccattgtcacagagctgtcttggctgcgtgcagcaattattttaaagcaatgtttactgccgacatgaaagagaaatttaagaataagattaagttgtcaggcatccaccacgatatcttagagggtctggtcaactatgcatacacttcacagatagagatcactaaacgcaacgtgcaaagcctcctagaggcagccgacctcctgcaattcctgagcgtcaaaaaagcctgcgagaggttccttgtgagacatctggatattgacaattgcattgggatgcatagctttgctgagtttcacgtatgtccagagctggagaaagagtcccgtcgcatattgtgtagcaaattcaaagaggtgtggcaacaggaagagttcctggaaatctcactcgagaagtttcttttcatactcagccgcaaaaatctgtccgtgtggaaagaggaagccattatcgagcccgtgattaagtggaccgcccatgatgtcgaaaacaggatcgagtgtctctataatctgctttcctacatcaacatcgacatcgatccggtgtacttgaagactgctctcggccttcagcgcagctgtctccttacagagaacaaaataaggtctctgatatacaacgccctgaatcctatgcacaaagagatttctcaacgcagcacggccactatgtatattatcggcggatactactggcatcctctctctgaagtccacatttgggaccccctaacaaatgtgtggatccagggagccgaaatcccagactatacaagagagtcctatggcgtcacttgtttgggacccaacatctacgtcactggaggatatcggactgacaacatcgaagctctagacactgtctggatatataactccgagtccgatgagtggaccgagggcctacctatgttaaacgcgagatactaccattgcgccgtgacactgggcggatgcgtgtatgccttgggcggttatagaaaaggggctccagcagaggaagcagagttttacgaccctctgaaggagaagtggatccccatcgccaacatgatcaagggggtgggaaacgctacggcatgtgtgctacacgatgttatctatgtgattggcggacattgcggctataggggatcttgtacttatgacaaggtgcagtcatataattcagatattaatgaatggagcctgatcactagctctccccatccagagtacgggctgtgcagtgtacctttcgaaaacaaattgtatttggtcggtgggcaaaccacaattaccgaatgctatgatccagagcagaatgaatggagggaaatcgctcccatgatggagcggcgaatggaatgcggcgcagtgattatgaatgggtgtatctacgtgacagggggatattcatattcaaagggtacatacttgcagtcgatcgagaagtacgatcccgatctgaacaaatgggagatagtcggaaatctaccatcggcaatgcggtcgcacggctgcgtttgtgtttacaacgtgtag

SEQ ID NO: 57027 - DNA, 1848 bp, Artificial Sequence
  Description of Artificial Sequence: Synthetic coding sequence
atggcagagagcggaggatcttccggaggtgctggcggaggcggagccttcggagccggtcctggccctgaaaggccaaatagcacggctgacaaaaacggggctctgaaatgtaccttttccgcaccctcccattcaacgtccctgctgcagggtctggccacactccgcgcacaaggccagctcctggatgtggtactcacgatcaatcgcgaagcctttcctgcgcataaggttgtgctcgccgcttgttccgattatttccgtgcgatgtttaccggaggtatgcgtgaagcatcacaggatgtgattgagcttaagggcgtgagtgctcgcggtttgcgccatatcatagatttcgcatactccgccgaagtaacactggatttagattgcgtgcaagacgtgctgggagccgctgtcttcctgcagatgcttcctgtggtggaactctgcgaagagtttctgaaggcagcaatgagcgtggagacgtgcctcaatataggtcagatggccacaactttctcgcttgctagcttgagggagtctgtggacgcgttcacattcagacacttcctccagatcgcagaagaggaagacttccttagattaccactggaaaggctggtgttttttctccagtcaaatagattgcagagttgcgcagaaatagatctattcagagctgccgtgcgatggttgcagcacgaccccgctcgtcggcctcgggctagccacgtcctctgccatattagattcccactgatgcaatcctccgagctggtagattcagtacagactctggatatcatggtggaagatgttctgtgtagacagtacctcctagaggcctttaactaccaggtcttaccttttagacaacacgagatgcagagcccccgaaccgccgtgcgcagtgacgtaccgtccctggtgacgttcggcggaacaccctacaccgatagtgaccgcagtgtgagtagcaaggtataccaactgccagaacccggagccagacacttccgagagcttaccgaaatggaggtgggctgcagtcatacgtgcgtggcagtgttggacaacttcgtgtatgtggcaggcggacagcacctgcagtataggagcggagagggcgctgtcgacgcttgttacagatacgaccctcacctgaatcggtggcttaggctgcaagctatgcaagagtcacgtatacaatttcaactgaatgtgctatgcgggatggtgtacgcaaccggcggaagaaatagagccggtagccttgccagtgttgagagatactgtcctcggaggaatgaatggggctatgcgtgctctctgaagagaagaacctggggtcatgccggagccgcaagcgggggaagactgtatatcagtggcggatatggcatttcagtcgaggataaaaaggccctgcattgttacgaccccgtagccgaccaatgggagtttaaagccccaatgagtgagccgagagttctccatgctatggtgggcgcaggtggcagaatctacgctctcgggggtcgaatggaccatgtcgataggtgctttgacgtgctcgctgttgaatactatgtgcccgaaaccgaccagtggacctcggtttcccctatgcgcgcagggcagagcgaagctggatgttgtctgcttgagaggaaaatctatatagtcgggggatacaactggagactaaacaatgtaacaggcattgtgcaggtctacaacacagacactgatgagtgggagcgcgatctgcatttccccgagtcttttgcagggatcgcctgtgctcccgtgctcctgcccagagccggtactcgccgttag

SEQ ID NO: 57028 - DNA, 438 bp, Artificial Sequence
  Description of Artificial Sequence: Synthetic coding sequence
atggccgagtccgggggatcttctggcggagcaggcggtggtggggcttttggagcaggcccaggtcctgaacgaccgaactccacagctgacaaaaatggtgcgctcaaatgcactttttctgccccttctcactctacctcacttctccagggtcttgcaactctaagagcacagggtcaactgttggacgtcgtgttgaccatcaaccgcgaggccttccctgctcacaaggtcgtcctggccgcatgttccgactactttagggctatgtttactggcggaatgcgcgaggccagtcaagatgtgatcgaacttaagggggtcagcgcccgtgggctgcggcatattattgacttcgcgtattcggccgaggtgaccctggacttggactgcgtgcaggaggtggctcccaagacacctgggaccctcgcatag

SEQ ID NO: 57029 - DNA, 1716 bp, Artificial Sequence
  Description of Artificial Sequence: Synthetic coding sequence
atggatcatacctcacctacatatatgctggccaacttgacacatctgcactcagaacagttgttacaggggttgaacctgctgaggcagcaccatgagctgtgtgatattattctgcgcgtcggcgacgtgaagatccatgctcacaaagtggtgctggcctccgtcagcccgtattttaaggctatgtttaccggtaatctcagcgagaaggagaactcggaagtggaattccagtgtatagatgaaaccgccttgcaagcgatcgtggaatatgcctacaccgggaccgtcttcatttcccaggacaccgtggaatcactcctgcccgcagcaaacttgctccagatcaagctagtcctcaaagagtgctgtgccttcctggagtctcagctggaccctggcaactgtattggcatttccagatttgcagaaacttacgggtgccgcgacctgtaccttgcggctacaaagtacatttgccaaaacttcgaggccgtctgccagaccgaagagtttttcgagctgactcacgccgatttggacgagatcgtgtcaaacgactgtctgaatgtagcgacagaagaaactgtgttctacgcccttgaatcatggatcaaatacgatgttcaggagagacagaagtatctggctcagctgctgaattctgtacgcctgcccctcctgagtgtcaagttcctcactcgactgtatgaggcgaatcatcttataagagatgataggacttgcaaacatctgcttaacgaggctctcaaatatcacttcatgccggaacaccggctcagccatcagaccgttctcatgacccggcctaggtgcgcacccaaagtactctgtgcagtgggcggaaagtcaggtcttttcgcatgcctagattccgttgagatgtattttccccagaatgactcctggattggactggccccactcaacattccccgttacgagttcgggatttgtgtgctcgaccagaaagtatacgtgatcggagggattgccaccaacgtgcggcctggagtgactattaggaagcacgagaattcagtcgagtgctggaaccctgatacaaacacctggacttcactagaaaggatgaacgagtccaggagcactctgggagttgtggtgttggccggagagttgtatgccctcggtgggtatgacggccagtcttatttgcaatcagtagaaaaatacattccaaaaatccggaaatggcagcccgtcgccccaatgactacaaccagaagctgtttcgccgctgctgttctcgatggtatgatctacgccattggcggatatgggcctgctcatatgaactctgtggagaggtacgaccctagtaaggacagctgggagatggtcgcctcgatggctgacaagagaattcacttcggagtcggggtgatgctgggttttatcttcgttgtaggaggccacaacggagtcagtcacctgtcatctattgagcgctatgatccccaccagaatcagtggaccgtttgtagaccaatgaaggaaccaaggaccggtgtaggagcggctgtcatcgacaactatctgtatgtggtcggtgggcatagtgggtcctcttacctcaataccgttcagaaatacgaccccatctcagacacttggctcgatagtgcagggatgatttactgtagatgcaattttggactgactgcattatag

SEQ ID NO: 57030 - DNA, 255 bp, Artificial Sequence
  Description of Artificial Sequence: Synthetic coding sequence
atggatcacacatcacctacttatatgctcgcaaaccttactcatctccactctgagcagctgctccaaggcctcaaccttctccgacagcatcatgaactctgtgacatcatcctgcgagttggagacgttaaaattcacgcccataaggtggtgctcgccagtgttagcccttatttcaaggccatgttcacagggaatctgtccgaaaaagagaactccgaagtcgagttccagtgcatcgatgagacgtag

SEQ ID NO: 57031 - DNA, 489 bp, Artificial Sequence
  Description of Artificial Sequence: Synthetic coding sequence
atggaccatacctctcccacatatatgctagctaacctgacgcacttgcatagcgagcagctgctccagggactgaatttgcttcgccagcatcatgaattgtgtgacattatcctgagagtcggagacgtgaaaatccatgcacacaaagtagtgctagcctcagtgtccccctatttcaaggcaatgtttacgggaaaccttagcgaaaaggaaaatagtgaagtggagtttcagtgtatcgatgaaactgccctgcaggcgatcgtggaatatgcctatactggtactgtttttatttcacaggacaccgtggagtctcttctccctgcggcaaacttgctgcagatcaagctcgtgctcaaagagtgttgcgcctttctggagtcacagctggacccgggtaactgcattgggatttcgcggttcgctgaaacatatggatgccgtgacctctacctagcagctaccaagtatatatgccaatag

SEQ ID NO: 57032 - DNA, 138 bp, Artificial Sequence
  Description of Artificial Sequence: Synthetic coding sequence
atggatcacacctcacctacatacatgctggccaacctcacacatctacatagtgagcagctcctgcagggccttaacctcctccggcagcatcatgagctttgtgacatcattctgagagtgggggacgtgaagtag

SEQ ID NO: 57033 - DNA, 2628 bp, Artificial Sequence
  Description of Artificial Sequence: Synthetic coding sequence
atgtctcgacaccactcccgctttgaacgcgactacagggttggttgggacaggcgcgagtggtcagtgaatggcacccatggcactacatccatctgcagcgtgacatcaggtgctggcggtgggaccgcctcatccctatctgtacgcccaggtctgctgcccctcccggttgtaccgtccaggctgcctactcccgctaccgcaccagcaccttgcactaccggtagttcagaagcgattacatctctggtagcgtctagtgcttcggccgtcacaactaaggcgccagggataagtaagggagattcccaaagccagggcctggcaacttccatacgttggggtcaaacacccatcaaccagtctactccttgggataccgatgaacctcctagcaaacagatgcgagaatctgataaccccggaaccggaccctgggttacgacagtcgctgcgggtaaccagccaacattaatcgcccattcatatggcgtcgctcagcccccaacctttagccctgctgtgaatgtccaggcaccggtcatcggggtgacacctagtctgccaccccacgtgggaccccaactgccacttatgcctggccactatagtctcccacagccaccatcacaacccctgtccagcgtagtagtgaacatgcccgcacaagctctttacgcatccccccagccgctagccgtgagcaccctacctggcgttggacaggtggctaggcccggtccgaccgccgtgggcaatggccatatggctggaccacttctcccgcctccaccgcctgctcagccctctgccaccctgccatccggcgcacctgcaaccaacggccctcctactacagattccgcccacgggctgcagatgctcaggaccattggggtcggcaagtatgagtttaccgaccccggtcatccacgcgaaatgctcaaagaactgaaccaacagaggcgcgcaaaagcatttaccgacttgaaaatcgtggttgagggccgagaattcgaggtgcaccagaacgtgttagcctcttgtagtctttattttaaggatttgattcagagatccgtgcaggacagcggccagggcggacgagagaagctggagcttgtgctttcgaacttacaggcggacgtattggaacttctgctcgagttcgtatacaccggaagtctggtcattgacagcgctaacgctaagacactgctcgaggccgcatccaagttccaattccacaccttttgcaaggtctgtgtcagctttcttgaaaagcagctcactgccagtaattgcctaggtgtgctcgctatggcagaggcaatgcagtgcagcgaactgtatcacatggctaaagccttcgccctgcaaattttcccggaagtagctgcacaagaggagatcctctctatcagtaaggatgacttcattgcatacgtctccaatgatagcctgaacacaaaggctgaggaactcgtttacgagactgttattaagtggatcaaaaaagacccagctacgaggacacaatatgcagcagagctcctggctgttgtgcgcctgcccttcatccatccctcttacctgctgaatgtcgttgataatgaagaactgatcaaatctagtgaggcatgtagggatcttgtcaacgaagccaaacgctatcacatgcttcctcatgcccgacaggagatgcagactcctagaaccagacccagattgagcgctggagtagcagaagtgatcgtgctcgtggggggacgccaaatggttggtatgacccagcgaagcctcgttgccgtcacctgctggaacccccaaaataacaagtggtatccactcgcttccctccccttctatgatagagagtttttctctgtcgtgagtgctggagacaacatctacctctccggcggtatggagtccggggttactctcgctgatgtctggtgctacatgtctctcctcgacaattggaatttggtttcaagaatgaccgtgcctagatgcaggcacaacagcctagtgtacgacggcaaaatctatactctgggcggactaggggtggccggaaacgttgaccatgtggaaaggtacgacaccattacaaaccagtgggaagcagtagccccactaccaaaagcagtgcatagtgctgctgctactgtgtgtggcggtaaaatctacgtgttcgggggagtgaatgaggccggaagggcagccggagtgttgcaaagttacgttcctcagactaacacatggagcttcattgagtcaccaatgatcgataataagtacgcacctgctgtgactctgaacggatttgtttttatcttggggggtgcctatgctagggcaactaccatttatgacccagagaaaggtaatattaaggctggcccaaacatgaatcactctcggcagttttgctcagctgttgtcctcgacgggaagatatacgcaacaggagggatagtatcttccgaggggcctgcactgggcaacatggaagcttatgaacctacgacaaacacatggaccctcctgccccatatgccatgccccgtattccggcacggctgcgttgtgataaaaaaatatatacagagcggttag

SEQ ID NO: 57034 - DNA, 1683 bp, Artificial Sequence
  Description of Artificial Sequence: Synthetic coding sequence
atgctcgatggactgcaaagattgaggtcgcagcccaaactcgctgacgtgacgctactagtgggaggacgggaactgccctgtcatcgcggtcttcttgccctgtcctctccatattttcatgccatgtttgccggtgattttgccgagtcatttagcgccagggttgagttgagggacgttgagccagcagtcgtcggccaactcgtggacttcgtgtatactggcaggctgactattacgcaaggcaatgtggaagccctgacgaggacagcagctcgattgcatttcccgtccgtgcagaaggtctgtggcagatacttgcagcagcagcttgacgcagccaactgcctcggaatctgtgaatttggagagcagcagggactgttgggcgtggctgccaaagcatgggcatttctgcgggagaactttgaggcagtggccagggaagatgaatttcttcagctaccacgggagagactagttacgtgcttggcaggagatttactgcaggttcagccagagcagtctagacttgaggcactcatgcgttgggtgagacatgacccacaggctagggcagcccaccttcctgaactgctcagcctggttcacctggacgcggttcctcgaccctgcgttcagcagcttctggcttccgagcccttgattcaagagtctgaagcatgccgcgctgctctctctcaggggcacgatggagcgccacttgcactccagcaaaaactggaggaggtgcttgtggtcgtcggcggtcaggccctggaagaagaggaggccggagaggaacccacacccggactcggtaacttcgccttttataattctaaggccaagaggtggatggctctccctgatttccccgactatcataagtggggattttccctcgccgctctaaataataacatttacgtcacaggcggatcacgcggtactaaaactgacacatggtcaacgacgcaggcatggtgtttccccctgaaggaggccagctggaaaccagttgccccaatgctgaagccacgcaccaaccatgctagcgctgccctcaatggagagatttatgttatcggtgggaccactctcgacgtggtggaggtggaaagctacgacccatacaccgactcttggacccctgtgtctcctgctctgaagtacgttagcaattttagcgcagccggatgccgtggcaggctctacctggtaggcagctccgcttgcaaatataatgccttggcccttcagtgttacaaccctgttaccgacgcatggagtgtgatcgcatcccccttcctgccaaaatacctctcctccccacggtgcgccgctttgcatggcgagctatatctgataggcgacaatacgaaaaaggtgtacgtctacgaccccggagctaatctttggcagaaggttcaaagccagcatagcctccatgagaatggggctcttgtccccctcggggatgccttatatgtaactggtggacgatggcaaggcatggagggagactatcacgtcgaaatggaggcctacgacaccgttcgggacacatggactcggcacggggctctccctcgactttggctttaccatggagccagtacggtgttcctggacgtcagcaaatggactcagccatcgggtcctacacaagagcactag

SEQ ID NO: 57035 - DNA, 1737 bp, Artificial Sequence
  Description of Artificial Sequence: Synthetic coding sequence
atggtacgtaacgtggacgacttggatttccaccttccttctcacgcccaggacatgctggacgggttgcaacgcttacgttctcaacctaagctggcagatgttaccttgctcgtcgggggtcgggagctgccttgccaccgcggacttctggcactgtcatcgccttacttccacgcaatgttcgctggcgactttgctgaatctttcagcgctagagtagagttacgggatgtggaacctgctgtggtgggacagctggtggactttgtttacacggggaggctcactatcacacaggggaacgtggaggcccttacccgtaccgctgctcgactccacttcccaagcgtgcagaaggtttgcggccgttacctgcagcaacagttggacgccgctaattgcctgggcatttgtgagttcggcgagcagcaggggctcctgggtgttgcggctaaggcgtgggcatttctgcgcgagaattttgaagccgtcgctcgtgaagatgagtttctccagctgcctagggagcggttggttacatgtcttgcaggcgacttgctacaggtgcaacctgagcagtcaaggctggaagcattaatgagatgggttcgccacgatccacaggctagagccgcacacctgcccgaattgttgagccttgtccatctggatgccgtgccacgcccatgtgttcaacaactgctggcatccgagccattaattcaggaatcagaggcatgcagggccgcactgtctcagggccacgatggagctcccctggccctgcaacagaaactggaggaggtgctggttgtggttggtggacaggcactagaagaggaggaagccggtgaagagcccacgcctgggttgggaaactttgccttttataacagcaaagccaaaagatggatggccctccccgatttccccgattatcataagtggggtttcagcttagccgcattgaacaataacatctatgtgaccgggggatcacgcggtacaaagacagatacttggagcacaacacaggcctggtgttttcctctaaaggaagcatcgtggaaacccgtcgctccaatgttaaaacctcggaccaaccatgccagcgccgcactcaacggcgagatttacgttatcgggggtaccactctagatgtggtcgaggtggagtcctacgatccgtataccgattcttggacccctgtgagcccggctttgaagtacgtgtccaatttctcagccgctggatgccgcggtcgcctgtatctggtcggcagctctgcttgcaaatacaacgcgttggcactacagtgttacaaccccgtcacagacgcttggagcgttattgccagccccttcttacctaagtaccttagcagcccccgttgcgccgcacttcatggcgagctgtacctgatcggtgacaacacaaaaaaagtgtacgtctatgacccgggagctaatctgtggcagaaggtgcagtcccagcatagtctgcatgaaaatggggcactggtgccccttggagatgctctgtacgttacaggcggacgctggcagggcatggaaggggactatcatgtcgagatggaggcatacgacactgtgcgcgatacttggacccgccacggcgctctgcctagattgtggctttatcatggcgcatctaccgtgttcctggatgtgtccaagtggacacagccctctgggcctacacaagagcactag

SEQ ID NO: 57036 - DNA, 420 bp, Artificial Sequence
  Description of Artificial Sequence: Synthetic coding sequence
atgccaagcgaacggtgcttgtctatacaggagatgctaacgggtcagcggttgtgtcacagtgaaagccacaacgatagtgttctcgccgctctgaatcagcagcgaagcgatggcatactttgtgacataacactgatagccgaggagcaaaagtttcacgcccacaaagccgtgctggcggcttgtagtgactacttccgcgcaatgtttagtctatgtatggtcgagagcggcgctgatgaggtgaacctgcacggcgttaccagcctgggcttgaagcaggcactcgaattcgcttacacaggacagattctgctggagccaggcgtaattcaggatgtgctggccgctgggtcccacctccaactactcgagcttctcaacttatgctcccactatcttatccaagtggaatag

SEQ ID NO: 57037 - DNA, 621 bp, Artificial Sequence
  Description of Artificial Sequence: Synthetic coding sequence
atggtcgaaagtggagcagacgaggtgaacctccacggagtgacctctctggggctgaaacaggccctagagttcgcatacacaggccaaatcttgctggaacccggagttatacaagatgtcctggcagccggatcacacctccagctgctcgaactcctcaatctctgtagtcattacctaatacaggaactcaactccttcaattacctggacctgtatagactggcggacctctttaacctcaccctgctggagaaagccgtaattgattttcttgttaagcacctgagcgagctccttaagagtcgccctgaggaggtgcttacgttgccctactgtctgctgcaggaggtgctcaagtctgacagactgacatccctgtctgaggagcagatctggcagaaatgtggaatttgtgctgccttctgcgctctgcgtggagattggtgcccgggattgccccagtgggatgacaagactgcctcatgcgaagtcgtggggacacagctccctctgcctgtccatggaagggctccagccattcaccctttatggccaaatggatgcggctactccccttattcttgtcccgtgccaccaccctgtccatccaagtag

SEQ ID NO: 57038 - DNA, 1863 bp, Artificial Sequence
  Description of Artificial Sequence: Synthetic coding sequence
atgccatccgagcgctgtctgtcaattcaggagatgctgacaggacagagattgtgccattctgagtctcacaatgatagcgttttggctgctcttaaccagcagcgtagtgacggaatcctgtgtgacataacgcttattgctgaagaacagaagttccacgctcacaaagctgtcttagcagcctgcagcgattactttagggctatgttctctctctgtatggtagaatccggagccgatgaggtcaacctgcacggagtgacaagcctgggtctcaaacaggcactcgaatttgcatatacaggccagattcttctagagcctggcgtgattcaagacgtgctggccgctggcagccatcttcaactgcttgagctcctgaacctgtgttctcactacctaatacaagagctaaattcatttaactacttagacctgtaccgcttagctgacctattcaacctaacgctgctggagaaagctgtcatcgatttccttgtgaaacacctaagtgagctgctgaagtctcgacccgaagaggttctgacactaccttactgcctgctgcaggaggtcctcaagtctgataggctcacaagtctatccgaggagcagatctggcagctggcagtccgctggctggagcataactgtcactatcagtatatggatgaattgctgcaatatatccgctttggcttaatggacgtggataccttacatacggtcgcattgagccatccactagtccaggccagcgagaccgcaactgctctggtcaatgaagccctggaatatcaccagtctatctatgctcagcccgtatggcaaactcgacggaccaagcccagattccagtcagacacgctatatataatcgggggaaaaaagagagaagtttgcaaagttaaagaattgcggtatttcaatccagtggaccaggagaatgcccttattgcggctattgctaactggtctgaactggccccaatgccggtgggtcggtcccaccactgtgtggccgtcatgggggattttctgtttgttgcaggcggtgaggtcgagcatgcctcaggcaggacctgcgcggtgcggaccgcctgcaggtatgacccaagaagcaacagctgggcagagatagctccaatgaaaaattgtcgggaacacttcgtgcttggtgccatggaggagtatttatatgctgtgggtggcagaaatgagctaagacaagtcctgccgaccgttgagcgctactgtcccaagaaaaacaaatggacgtttgttcagagtttcgatagaagtctcagttgtcacgctggctacgttgcagacgggcttctctggatttctggcggtgtgaccaacaccgctcaatatcaaaacagactcatggtatacgaaccaaaccagaataagtggatttcacggtcgcccatgctgcaacgtcgagtataccactccatggctgcagttcagaggaagctgtacgttcttgggggaaatgaccttgactataataacgaccgtattctggtgagacacatcgactcctacaatatcgacaccgaccagtggacaaggtgcaattttaaccttttaaccgggcagaacgagtctggagtcgctgtccataacggcagaatctatctggtgggcggatattccatatggactaacgagcccctggcctgcatccaagttttagacgtgtccagagaagggaaggaggaggtattctacggcccaacacttcctttcgcctccaatggaattgctgcttgttttctgccagccccttacttcacatgtccgaatctgcagactctccaggtcccgcatcatcgcatcggtacgatttag

SEQ ID NO: 57039 - DNA, 531 bp, Artificial Sequence
  Description of Artificial Sequence: Synthetic coding sequence
atcctattggagccaggagtgattcaagacgtactggccgcaggatcccatctacagttgttggagctgctgaatctgtgcagccactaccttatccaggagctgaattcattcaactatctcgacctatatcgactggccgacctatttaatcttacgctcctagagaaagctgtgattgacttcctggtgaaacacttaagtgaactgctcaagagccgacctgaggaggtgctgaccttaccatattgtctcctgcaagaagtattgaagtctgaccgtctgacctccttgtcggaggagcagatttggcagaagtgcgggatttgcgcggctttttgcgcactccggggagactggtgtccaggcctgccgcaatgggatgacaagacagccagctgcgaggtagtgggcacgcaactgcctctccccgttcacggcagagctcctgccattcaccccctgtggccaaacgggtgtggctacagcccgtactcttgccccgtgccacctccctgcccttcaaaatag

SEQ ID NO: 57040 - DNA, 1755 bp, Artificial Sequence
  Description of Artificial Sequence: Synthetic coding sequence
atgcctagcgagaggtgcctcagcatccaggagatgctgacagggcagcggttatgccactccgagagccataatgactccgtgctggcagcacttaatcaacaaaggtccgacggtatattgtgcgatatcaccctcatcgccgaggagcagaagtttcatgcccacaaagctgtccttgctgcatgctccgactattttcgcatcctgctcgagcccggtgtaatccaggatgttcttgccgctggctcgcatctgcagctcctggaattgctgaatttgtgctcccattaccttatacaggaactgaatagtttcaattacctggacttgtacagactcgcagacctgtttaacctcaccctgctggaaaaggcagtgatagactttctggttaagcatctgagcgagcttctgaagtctagaccagaggaagtcctcaccctcccatattgtttgttgcaagaggttttgaaaagcgaccgcctcacttcactttccgaagagcagatatggcagctagcagtgcggtggttggagcacaattgtcactatcagtatatggacgaactgctacaatatatccggttcggactaatggacgtcgatacgttacacaccgtggcattgagccacccattggtccaggcttcagagacagctacagctctcgtgaacgaagccttggaatatcaccagtctatctacgcacagcctgtttggcaaacgcggcgaactaaaccccgatttcaatctgacacgctgtacatcataggtggtaagaaaagagaagtgtgtaaggtcaaggagctcagatactttaacccagttgatcaggaaaatgccttaatcgccgctattgctaattggagcgaactcgctccaatgcccgtggggagatctcaccattgtgtggctgttatgggcgactttttgttcgtcgctggaggggaggttgaacacgcttcagggagaacctgtgcggttaggacagcctgtaggtatgacccgagatccaactcttgggctgagattgcacccatgaaaaactgccgggagcactttgtcctcggagcgatggaggaatacctgtatgcggtggggggtcggaatgaactccgtcaggttttgcctacagtagaacgatactgccccaagaaaaataagtggaccttcgttcagagctttgacagatccctatcatgtcacgctgggtatgttgccgacggtttactgtggatctccggcggtgtcacaaacactgctcagtatcagaacagactgatggtttacgagcccaatcagaataagtggatctcccgttccccgatgctgcagcgcagggtgtatcacagtatggctgccgtacagcgcaagttgtatgtcctcgggggaaacgacctcgattacaataatgataggattcttgtgcggcacatcgattcatacaatattgatactgaccagtggaccagatgcaatttcaacttgcttaccggccagaacgagtccggagtcgcagtccataatggccgaatttatctggtaggcggatactctatttggactaatgaacccttggcatgcattcaagtgctcgacgtgagcagagaagggaaagaggaagtattttatggccctactttgccatttgctagcaatgggatagccgcttgctttctgcctgctccctacttcacttgcccaaacttacagacactgcaagtgccgcatcacagaatcggcactatttag

SEQ ID NO: 57041 - DNA, 1656 bp, Artificial Sequence
  Description of Artificial Sequence: Synthetic coding sequence
atgcctagcgaaaggtgtttgagcatccaggaaatgttgacaggccagaggctgtgccactcagagagtcacaacgatagcgtgcttgctgcgcttaatcagcagcggagcgatggcatcttatgtgacatcacactgatcgccgaggagcagaaattccacgcacacaaagctgtgctggctgcttgtagtgattactttcgtgaactgaactcattcaactacctcgacctgtaccgtctggctgatctatttaatctgaccctgttagagaaagccgtgatcgatttcctggtcaagcatctcagtgaattgcttaaatctcgcccagaagaggttctgaccctgccctactgcctgctgcaagaagttctgaaatctgaccgcctaacatcactcagcgaggaacagatctggcagctggccgtgaggtggctggagcacaactgtcactaccagtatatggatgaactcttacagtacattaggttcgggctgatggacgtggacacactacataccgtagcactgagccatcccctggtgcaggctagcgaaactgcaacagccctggttaatgaagcactggaatatcatcagagtatatatgcacagccggtgtggcagactcgtcgcactaaacctcggttccagtccgatactctgtatatcattggagggaaaaaacgcgaggtttgtaaagtcaaggaactccgttactttaacccggtggatcaggagaacgccctcatcgccgctattgccaattggagcgagttggcccctatgccggtcggccgatcccatcattgtgttgcagtcatgggagactttttgttcgtggccggtggtgaggtagagcatgcctctggtcgaacttgtgctgtgaggacggcctgtaggtatgatcccagaagcaacagctgggccgagatcgcacccatgaaaaattgccgcgagcattttgttctaggagcaatggaggagtatctgtacgcagtggggggtcggaacgaattgcgtcaggtcctgcctaccgtggagaggtactgtccgaagaagaacaaatggacttttgtgcagagctttgatcgctctcttagctgtcatgccggatacgttgccgatgggctcttgtggatatcagggggtgtcaccaacacagcccagtatcagaacaggctgatggtctacgaaccgaaccagaacaagtggattagtcgttctcctatgctgcagcgacgtgtgtatcatagtatggccgctgtccagagaaaattgtatgtgcttggaggcaacgatctggattacaataacgatcggatccttgtgaggcatattgacagctataacattgatacagatcagtggactcgctgcaatttcaacctgctcactggtcagaatgagtccggagtggcggtgcacaacggcaggatttacctggttggagggtattccatctggacaaacgaaccactggcttgtattcaggtcctggacgttagcagagagggcaaagaagaagtgttctatggaccaacactccctttcgccagtaatggaattgcagcttgctttctcccagccccttatttcacatgtccaaatctgcagacactgcaggtgccacaccaccggattggtaccatctag

SEQ ID NO: 57042 - DNA, 531 bp, Artificial Sequence
  Description of Artificial Sequence: Synthetic coding sequence
atgttgcccctcagtcaccccggaggggtgaccaatacagcccagtatcagaacagacttatggtatatgagccaaaccagaacaaatggatctccaggtcgcccatgttacagcgtagagtatatcatagtatggctgctgttcagcggaagttgtatgttctcggagggaatgaccttgactacaacaacgacagaatcttggtgcgccacattgattcatacaatattgacacagatcagtggactcgctgcaatttcaatttactgaccgggcaaaatgagagtggagtggctgtgcataacggcagaatctacctcgtgggaggctattccatttggacaaacgaaccacttgcttgtattcaggttttggatgtctctcgggagggcaaagaggaggtgttttatgggcctacactaccttttgcatctaacgggatagcggcttgctttctgcccgctccgtatttcacttgcccaaacctccagactctccaagttccccatcaccgcatcggcactatttag

SEQ ID NO: 57043 - DNA, 1602 bp, Artificial Sequence
  Description of Artificial Sequence: Synthetic coding sequence
atgttactttcagggatgcgcgagagtcaaggtaccgaggtgtctctcaggacgatttcaacacaagacctgcgtcttctggtgagctttgcgtattccggagtggtgagggccaggtggccgggtttgctgcgggctgcccaggcagcactgcagtatcagagttcctcatgcctggacctctgtcagaaaggactggctcgaggcttgtctcctgctaggtgcctcgccctatttcccatggctgaagcacccggactggagcgactgtggtccaaggctagacattacctgctcactcatctccctgcagtggctctgtgccctgccttcccctcactcccagctgcatgtctggctgagctgctggattcagatgaacttcacgtgcaagaggagtttgaggcgttcgtagctgctcgctgttggctggctgccaatccagaaacccaggagagcgaggccaaagcgcttctccgctgtgtgcggttcggtcggatgtccacacgcgaactgcgaagagtgagggccgctggtctccttccccctctcaccccagacctcttacaccagctcatggtcgaagcagatgtaccaggtcaagagcggaggcgggagcccgaccgggcactggtagttatcgggggagacggtctccgcccagacatggcactgcggcagcccagtagggctgtttggtgggccagggccttccggtgcggcgtgggccttgttcggaccgtagaatgggggcagctgccggctttacctgccccaggcagatttagacacggcgcagctagtttagcaggctccgagctctacgtctgcgggggtcaggacttctacagtcatagtaatacacttgcatcgacgcttagatgggagcctagccaagaagattgggaggaaatggcaccactgagccaggctcgctccctcttttccctggtcgccctggacggcaaactctatgctctggggggaaggcacaacgacgtggcactcgacagcgttgaaacctacaatcctgaactgaacgtgtggcgccctgccccagccctcccagccccatgtttcgcacacgctgctgccatcttagagggccaactgtacgtctcaggaggttgtggcggaacagggcagtatctcgcttccttgatgcattatgatccaaaacttgagaagccaggaacgttcctgtcccccatgggtgttccacgggctgggcacgtaatggccgctctgggcggaaggctgtatgtagctggcggactcggcgagacagaagatctgctcagctttgaggcctacgaattacgaacagactcatggacccatttggcccctttgcctagccctcatgtgggcgctgcctcggcggtcttacagggggagctgctggttctcggtggctacagccatcgcacttacgctctgagccacctgatccacgcatactgtcccggtctggggaggtggttatgcttgggaacattgccgagaccgcgtgcggagatgcctgcatgtatccttaccctgcccgctgtacagcatattgccctggtgccgaccccacaccagactaagcctgctggttag

SEQ ID NO: 57044 - DNA, 1935 bp, Artificial Sequence
  Description of Artificial Sequence: Synthetic coding sequence
atgtcctacttcctgtcctactgcaaggcccatggaggcgctctgctgactgggtatcaagccctacgcgcagaaggttttctttgcgatgtgacactggagacagagggctcagaatttcccgcacacagatccctacttgcctgtagttccgattacttcagagccctgtttaagagccacacacaggagtcaagggctcgtgtgatccatctgcacgtgccttcagcagcaggactccagaggttgttggatttcatttacaccgcttggctctcactctccatggataccgtggaagatactttggaggccgcttcttatctgcaggtgacggaagccctgggcctctgcgggagatacctggaaaggcagctcgcacctgaaaactgctgttttgctgccaatgtggccgctaggttcggtctcgctcataccctggatgctgctgaacgttgtattgtgagccacctccaagaactgctggcgcgtggggctggcccagccggactgctcgaattgaaccctacttcattgagggcagttctgggtgcgccagatgtcgccagagtgccagaagccaggctcctgggccttgcgctcgcttggctgaggcaagagcccacaactgaaagactggcccactgtaccgagctgttagagagggtccggtttggcctagtgcctgccgatgtgctacggcgtgtctactctggaagtggactggtgttgcccgcaagagtgaaaggacttatcattcaggcgctcaattaccacactaccccctcccgtcagcccctgatgcagggagagcagacctccatccggtcaccacagactagaatcttactcgtggggggacggagagccagggaggtggtaatcgaagaggtggcggctccgcagcgggctgcgaggggacaggtagcagcacctgagcctgaggaggaggaagaagagttggaagaggaagaggaggaggaggagtgggagttaacccagaatgtggttgccttcgacgtgtacaatcatagatggcggtctttgacccagctgcccacgccgctcctcggccatagcgtttgcactgccggtaatttcctcttcgtacttggtggcgaaagcccatctggcagcgcttcgtctccgctggctgatgattcccgcgtggtgaccgctcaggtgcatcggtacgatcccaggtttcacgcctggactgaagtgcccgcaatgcgggaagccagggcacatttttggtgtggagcagtcggcgaaaggttactggccgttggagggcttggagctggaggggaggtccttgcctccgtggaaatgtatgacttaagacgtgaccgatggaccgctgccggtgcgctcccacgcgcactgcatggccacgccggtgctgtcggcgaccggggagtggtgtacatctctggcggtaaagccggtcggggtgagggaggtgctagtagtttaagggacctgtacgttctgggtccagaggagcaggtatggtctaagaaggctccaatggggactgcaaggtttggccatcacatggccgtgctgcgtggtgccgtgttcgcgtttttgggtcgatatgaaccgtttagtgaaattgaacgctacgaccccggagcagatcagtggacacgactgcgcccattgccctacgatcgcttttgttacggcctggccgtcgttgaggagactgcccttctcctgggaggcctcaagtggcgggattcaagacaggtgcctaccagaaatgtggtcggctacgacctcgatttagatcgatgggaagatatcggatgcgcactgccatgggcctggagcgggctcaggtgtgcggtacttcagttggctgaaggcggagacgatgagcgggaaggggaggtgggcgaagccctggacctggtattgggatag

SEQ ID NO: 57045 - DNA, 1092 bp, Artificial Sequence
  Description of Artificial Sequence: Synthetic coding sequence
atgcgatgggtccggcacgacgcaccggctagacgaggacagctgagacgactgttggagcacgttcgcttgcccctgctcgcgcctgcatactttcttgaaaaggtggaagccgacgagctgttacaggcttgtggcgagtgtagacccctgctgcttgaggcacgagcttgttttatcctgggacgcgaggccggagccttgcggactcgtcctaggcgattcatggatttggccgaagtgattgttgtcatcggaggttgtgataggaaggggctactgaagctgcccttcgctgacgcttaccatcccgaaagccagagatggactcccctgcccagcctgccaggatatactagaagtgagttcgcagcgtgtgctctcaggaatgacgtctacgtctctggcggacacatcaatagccacgatgtgtggatgtttagctcacacttacacacctggataaaggtggctagcctccataaaggtaggtggaggcataagatggccgttgtgcagggacaactcttcgcggttggaggattcgatggtttaagaagactgcatagcgtggaaaggtacgatcccttctccaacacctgggctgccgctgcccctcttcccgaggcagttagttccgctgcagtggctagttgtgcaggcaagctgtttgtcatcgggggtgccagacagggaggtgtgaacaccgataaggttcaatgcttcgatcctaaggaagacaggtggtcactcagatcccccgctccattctctcaaaggtgtctcgaggccgtgtccctggaggatactatatatgtgatggggggactgatgagcaaaattttcacatatgatccaggtacagacgtttggggggaagccgcagtgctcccttcacctgtggaatcttgtggcgttacagtgtgtgacgggaaggtgcacatcctgggcggacgcgatgaccggggtgagtcaactgacaaggtgttcacattcgatcccagctcaggacaggtagaagtccaaccatccttgcagcgctgcacctccagccacgggtgtgtcacgatcattcaatccctgggtcgatag

SEQ ID NO: 57046 - DNA, 1752 bp, Artificial Sequence
  Description of Artificial Sequence: Synthetic coding sequence
atgcgccagggccatgcacccgaggagtccgaacctggatgcgaggcaccctgcgctggcccttgccatgcacagcgtgtgctgcaggccctgaatgcttaccgcaggagcggcactctgacagacgtggtgctgagggctgggggtagggattttccctgtcaccgagcagctttgtcggcaggcagcgcctatttccgctctctgttcgccgcagggagaccagaaaggggccctgcagtggtcccagtggtgcccgttgcacccgaggctccagggacaagcccagcaggtgctgcggcagcattggctgtggttctggattatgtgtatggtgctggggtcagactgcgcgctgaggatgaggccgctgctgtgctggccttagcagagaggctcggtgtggccggacttcgcgaagcctgtgtgcggtttctcgagggcaggctgcgcgctgctaattctctggctctgcgccgagtggctgcagcatttagtttagcacctcttgcagagaggtgcggacgtgttcttaggcaggcctttgcagaggtagccaggcatgcggatttcctcgaactggcacccgatgaggtagtggcgctgctggcggaccctgccctcggtgtcgcaagagaggaggcagtctttgaagctgccatgcgctgggttaggcacgatgcacctgctcgtaggggacagctccggaggttgttagagcacgtgcggctccctctccttgcccctgcctattttctggagaaagtcgaggctgacgagctcctgcaagcatgcggggaatgcagacctcttctcctcgaggcacgcgcatgctttatccttgggagggaagcgggagccctgcgcacgcgtccccgtaggttcatggacctggcggaggtgatcgtcgtgatcggagggtgtgaccgaaagggactgcttaaactgccctttgcagacgcgtatcacccagaatcccagaggtggacacccctcccctctctccctgggtatactcggagcgaatttgcggcttgcgcgttgaggaatgatgtttacgtatctggcggtcatattaacagtcacgacgtttggatgttctcttctcacctccacacatggatcaaggtggcatccttacacaaaggtcggtggcgacataagatggcagttgtacaaggccagctcttcgccgtgggcggatttgacggtctgcggcgactacactccgtagagcggtacgacccctttagcaacacctgggcggctgccgctcctctacctgaggcagtaagcagcgcagccgtcgcgtcatgcgctggcaagctgttcgttatcgggggagcgcgacagggtggtgtgaatacagataaagtacagtgtttcgaccccaaggaagaccgatggtctttgcgcagccccgctcccttcagccagcgctgtctcgaagctgtcagccttgaggacaccatatatgtaatgggaggattaatgagtaagatctttacctatgatccaggcactgatgtgtggggcgaggctgccgttctcccatctcccgtggagtcttgtggagtgacagtgtgcgatggtaaggtgcatattctgggcggtcgcgacgacagaggtgagtccaccgataaagtgtttaccttcgatccaagcagcggccaggtggaggttcagccatctctccagcgctgcacatcttctcacgggtgtgtgacaatcatccagtccctagggcgatag

SEQ ID NO: 57047 - DNA, 1662 bp, Artificial Sequence
  Description of Artificial Sequence: Synthetic coding sequence
atgatggaaggttctcgccaaacacgtgtaagtagaccatacaagatttccgagagctctaaggtatacaggtgggcggaccattcttccacagtgctccagcgcctgaacgagcaaaggctgagaggcctcttctgtgatgtggtcctagtcgcggacgagcaacgggtgccagcgcaccgcaacctgctggcagtatgctctgactatttcaacagtatgtttaccatcggcatgagggaggcattccaaaaagaagttgagctcataggtgccagctatatcggacttaaggccgtcgtcgattttctctatggaggcgagctcgtcctggatggaggtaacattgattatgtgcttgagaccgcccacctgctccagatatggaccgtggtggatttctgttgcgagtaccttgagcaggaagtctctgaggacaactatctgtaccttcaggaactcgctagcatctactcgctgaaaaggctggacgcctttattgacgggtttatcttgaatcattttgggacacttagctttacaccagactttctgcagaatgtatccatgcagaagctctgcgtgtatctgtcgtcatctgaagtccagagagaatgtgaacatgatctcctgcaggccgctctgcagtggctgactcagcagcccgagcgcgaggcccacgccagacaggtgctggaaaatattcattttcctcttattcctaagaacgacttgcttcaccgagttaagccagccgtgtgttctctgttaccaaaagaagccaactgcgaaggctttattgaggaagcagtgagataccacaataatcttgctgcccaacctgtgatgcaaacaaagcgtactgccttgaggactaatcaggaacgactcctctttgtgggcggagaggtgtccgagcgatgcctggagctcagcgacgatacgtgctatcttgatgccaagagtgagcaatgggtgaaggagacacctttaccagcgagacgctctcatcactgcgtggccgtgttggggggttttatcttcatcgctggcggatcattttccagggacaacgggggagacgccgcttcaaacctgctttacagattcacctatgggcacgccggtacaatctacaaggacttcgtatatatctcaggtggacacgactaccagattggcccttaccgcaaaaatcttctttgttatgatcacagaactgatgtgtgggaggagcgacgtccaatgaccacagcccgtgggtggcatagcatgtgttcacttggagactccatatactctattggtgggtcagatgacaacattgagagcatggaaagattcgacgtcctaggagttgaggcctatagcccacaatgtaaccagtggacgagggtggctcctctcctccacgcaaattcagagagcggagttgccgtttgggagggcagaatctatatcctcgggggatacagctgggaaaacaccgctttttctaaaacggtccaggtgtacgatcgagaggccgacaaatggagtaggggagtggatctgcctaaagcaatcgcgggagggtccgcctgtgtgtgtgctctggaaccacgtcctgaagataaaaaaaagaaggggaagggaaaacggcatcaagaccgaggacaatag

SEQ ID NO: 57048 - DNA, 1851 bp, Artificial Sequence
  Description of Artificial Sequence: Synthetic coding sequence
atgatggagggcagcaggcagacgagggtttcacgcccttacaaaatctcggaatcttctaaggtctataggtgggcagatcattcatcaaccgttctgcagaggctgaacgagcagagattgagggggctgttctgtgacgtcgtgctcgtggctgatgaacaacgtgtgcctgcgcataggaacttgttggcggtgtgcagcgattattttaactccatgttcacaatcggcatgcgcgaggccttccagaaagaggtggaattgatcggcgcaagctatataggcctcaaggctgtagtggacttcctatacggaggggaactggtgcttgatggcggaaatatcgattacgtgctggaaactgctcatttactccagatctggaccgtggtggacttctgctgcgagtatctggagcaggaagtctccgaggacaattacctttacctccaggaactggcatctatctactccctaaagaggctcgatgcatttatagacggtttcattctcaaccactttggcactttatcctttacccccgactttctgcagaacgtcagtatgcagaaactctgcgtttatctgtcaagctcagaggttcagagggaatgtgagcatgatcttttgcaggcagcccttcagtggctgacacagcagccagaaagagaagctcacgctcgccaggtgctcgaaaatatccacttcccactcatcccaaaaaacgatctgttacatagggttaagcccgcagtatgctccctccttcctaaagaggctaattgtgagggctttatcgaagaggccgttagatatcacaataatctggccgcacagcccgtgatgcagacgaagcggacagcgctgcgcacaaaccaggaacgcttgttgtttgtgggtggtgaagtgtccgagcggtgcctggagctatccgatgacacttgttacttagatgccaaaagcgagcagtgggtgaaggagacccccttgccagccaggcgtagccaccactgcgtcgccgtgcttggtggttttatctttattgcaggaggatcctttagtagggacaatgggggagatgccgcaagcaacctgctgtacaggtacgatcctagatgtaagcaatggatcaaggttgcctcaatgaatcagaggcgggtggacttttatttggcctcaatcgaggatatgctggttgctatagggggacgaaacgagaacggcgctctgagcagcgtagagacatattcccctaagactgactcttggagttatgtggcagggctccccaggtttacgtacggccatgctgggaccatctataaggactttgtttatataagcggcggtcatgactaccaaatcggcccatatcggaaaaaccttctgtgttatgaccacaggacagatgtgtgggaggagagacgcccaatgaccacagccagaggttggcactcaatgtgttctttaggagatagcatctactcgataggaggatccgacgataatattgagagcatggagagattcgatgttttaggagtagaggcatactccccccagtgcaaccagtggacaagagtggcccctcttctgcatgcaaacagtgaatcaggcgtggcggtttgggagggacgcatttacattctggggggttactcttgggaaaatacagccttttccaaaacagtgcaggtctatgatagagaagctgataaatggtcccgtggtgtcgacttacctaaggcaatagcaggcggaagtgcctgcgtttgtgcgctggagccacgacccgaggataagaagaaaaaaggcaaaggcaaacgacatcaagacaggggccagtag

SEQ ID NO: 57049 - DNA, 1851 bp, Artificial Sequence
  Description of Artificial Sequence: Synthetic coding sequence
atgatggaggggagccgtcagacccgggtgtctaggccgtacaaaatttccgagagttctaaagtttaccggtgggccgatcactccagtaccgttcttcagcggctgaacgaacagcgactgcgcggtctgttctgtgatgtagtgctggtcgccgacgagcagagagtgccagcacaccgcaaccttctggctgtttgctcagactattttaactcaatgttcaccatcggcatgcgcgaggccttccagaaggaagttgaactaatcggcgcatcctacatagggctcaaggcggtggtcgatttcctatacgggggtgagctcgtactagacgggggaaacatcgactacgttctggagaccgcccacttactgcagatctggactgtggttgacttttgctgcgaatacctcgaacaggaggtttccgaggacaattacctttatctgcaggagcttgctagtatctatagtttgaaaaggctggacgcatttatagacggttttatcctaaaccactttggtactttaagcttcacacctgacttcttgcagaacgtgtcaatgcaaaaactgtgcgtatatctgagttcctccgaggtgcaaagggaatgtgagcacgacctcctccaggcagctctccagtggctgactcaacagcccgaaagagaggctcacgcacgccaggtcttggagaacatacacttccctttgatccccaagaacgatctccttcacagggtgaagcctgccgtgtgtagtctgctcccaaaggaggcaaactgcgaggggttcatcgaagaagctgtgcggtaccataacaacctcgccgctcagccagtaatgcagaccaagcggactgctctgaggaccaatcaggagcggctcctgttcgtggggggagaggtgtctgaaagatgccttgaactgtcggacgatacatgttatttggatgcaaaatcagagcaatgggtcaaggaaacccctttgcccgctcgacggtcccatcactgcgtcgccgtactggggggatttatctttatcgcagggggatcattcagcagagacaatggtggggacgccgcaagcaaccttttgtatagatatgaccctcgctgtaaacaatggatcaaggttgcctccatgaaccagaggagggttgatttttacctggcctcaattgaggatatgctagtggcgattggaggcagaaacgaaaacggtgccttatcaagcgtggagacatattctcctaagacagactcctggtcttacgtggctgggttgcccaggttcacatacggtcatgctgggaccatttataaggatttcgtgtacatctcaggcggacacgattatcagatcgggccataccggaaaaatcttctgtgttacgatcaccgcaccgacgtgtgggaggaacggagaccaatgacgactgcacggggatggcactctatgtgcagcttgggggattccatttactctatcggtggatcagatgataatatcgagagcatggagcgcttcgacgtgctaggagtcgaagcttattcccctcagtgcaaccagtggacccgcgtcgcccctcttctacacgctaactctgagtctggcgtcgccgtgtgggaggggagaatatatatccttggcggatactcatgggaaaatacagcctttagcaagaccgtgcaggtttatgatcgcgaagctgataaatggtctcgcggagtagacctcccaaaagctatagctggcggatcggcttgtgtgtgtgctttggaaccacgccctgaagataagaagaagaaaggtaagggcaagcgccaccaagacagagggcagtag

SEQ ID NO: 57050 - DNA, 1746 bp, Artificial Sequence
  Description of Artificial Sequence: Synthetic coding sequence
atggacgaagaaagtttggacgggcttcttttcaaagatcacgatttctctagcgacctgttgaggcagctgaacagcctgcggcagagccggattttaacagacgtaagcatctgtgccggagccagggaaattccatgtcatcggaacgtcctggccagttcgagcccgtacttccgggcaatgttctgttcatccttccgtgagaagtctgaagctaaagtccagcttaaggggatagatccacctaccctggatcaaattgttagctatgtgtacacgggagaagcccacatcgccacagacaacgtgcttcctgtcatggaggctgcctcaatgctgcagtttccgaaactattcgaagcttgtagttcctatctgcagagccagttagcaccgtctaattgcctgggtatgatccgcctatccgagattctgagttgtgaaactctgaagaagaaagccagggaggttgcactgacatcttttcctgaggtcgccgcaagcgccgacctcaaggaactgtgtgcgctggaacttagggattacttgggagatgacgggctgtgcggtgaagaggagaaagtgtttgaggccctgatggtgtggatcaagcatgacctccaggcacgaaagagatacatgcaggaattgtttaaacaggtccgcctccagtacatccaccctgccttttttcaccatttcatcgcaaacgacgcgttattacagagtagccccgcttgccaaataattctggagacagctaagaggcagatgttctctttgtgtggcacaactgttcctgattgtaaactgctgttgcatgtgcctccccgtaactcctaccaggactttttaattctgctggggggaaggaaggactctcagcagacgaccagggatgtcttgttgtacagcaaacaaaccggacaatggcagtctctggctaaactgccaacccgcctttacaaggcgtctgctattaccctgcacagatccatctacgtgctgggcggtatggcagtaagctcaggacgcagcctggtgtcacacaacgtttacatcttttccttaaaactaaatcagtggcgtcttggtgagccaatgctcgtggccagatactcccatcggtcaactgcacacaagaacttcatatttagcattggcggtattggagagggtcaagagctgatggggtcgatggagcggtacgattccatttgcaatgtttgggagagtatggcgagcatgcccgtcggtgttctgcatcctgcggtggcagtcaaagatcagcggctgtacctgtttggcggagaggatatcatgcagaatcccgtgcgtctgattcaagtctatcacatctctaggaactcttggtttaaaatggaaactagaatgataaaaaacgtgtgcgctcctgccgtggtccttggagaacgcattgttatcgtgggaggatacactagacggatcctagcatacgaccctcagagcaataagttcgttaaatgtgcagacatgaaagatcgccgaatgcatcacggggctactgtcatgggtaataagctatacgtcactggcggtcgcaggctgacaactgattgcaatattgaagactcagctagctttgattgctatgatcccgaaaccgacacttggacctcgcagggacagcttccccataagttattcgatcatgcctgtctgactctgcaatgcattcccaggacctcaggactcccgtag

SEQ ID NO: 57051 - DNA, 1854 bp, Artificial Sequence
  Description of Artificial Sequence: Synthetic coding sequence
atgaaggtgagcctggggaatggagagatgggagtgtccgctcacttgcagccctgcaaagccggaacaactagattcttcacgagtaatacccatagctctgtcgttctgcaggggttcgatcagctgcgcatcgaggggctgctctgtgatgtgaccctcgtgcccggtgatggagacgagatctttccagtgcatagggctatgatggcaagtgcgtcggactactttaaagcaatgttcaccggcggtatgaaggagcaggatctgatgtgtataaagctgcatggtgtcaataaagtcgggcttaaaaagatcattgactttatatatactgcaaagctgagcctcaacatggataacctgcaagacaccctcgaggccgcttcattcttgcagatccttcccgttttggacttttgtaaggttttcctgatctctggcgtctcactggataactgtgtggaggtaggtagaattgcaaatacttacaatttaattgaggtggataagtacgttaataacttcatcttaaaaaacttccctgccttactgtccaccggcgagttcctcaagttaccatttgaaaggcttgctttcgtgctgagcagcaattctttaaagcactgcactgagctggagctgtttaaggccgcttgccgatggcttagattggaggatccgaggatggactacgctgctaaactcatgaaaaacatccgcttcccgctgatgacaccccaggacctgatcaactacgtccagacggtagatttcatgagaacagacaatacgtgtgtcaacctgctgctcgaggcaagcaactaccaaatgatgccttatatgcagccagtgatgcagagtgatcgtacagcaatcaggtccgactccacccacctcgtaactcttggcggagttctgagacagcagctggtggtgagtaaggagctgaggatgtacgacgagcgtgcccaggagtggcgctcacttgcccctatggatgcaccccgttaccagcatggaatcgccgtaatcgggaactttttgtacgtggtgggcggacagtcgaactatgatactaaggggaaaacagccgttgacaccgtttttaggttcgatccgagatacaataagtggatgcaggtcgcttccttgaacgagaagcggactttcttccatctctcagccctcaaaggccatctatacgcagtgggtggcagaagtgctgctggagaattggccacagtggagtgttacaaccctcgaatgaacgagtggtcttatgtagctaagatgagcgagcctcattatggacacgccggtacggtgtacgggggactgatgtacatttccgggggaattacacatgatacttttcagaacgagcttatgtgcttcgacccagacacggacaagtggatgcagaaagccccaatgaccaccgtcagaggcctgcactgcatgtgtactgtgggggacaagctatatgtgataggcggaaatcactttcggggaaccagtgattacgacgatgtcctttcttgtgaatactatagccctacgctggaccagtggacaccaattgccgctatgttgcggggacagtctgatgtgggcgtcgcagtgttcgaaaataagatatacgtggtcggtggttatagctggaacaatcggtgtatggtggagattgtgcagaagtacgacccggagaaagatgagtggcacaaagtgttcgatttacctgaaagcttagggggtattagggcatgcactcttacagtgttccctccagaagagaaccctgggtctcctagtcgcgaatcccccctgagcgcccctagcgatcattcttag

SEQ ID NO: 57052 - DNA, 1650 bp, Artificial Sequence
  Description of Artificial Sequence: Synthetic coding sequence
atgatggctagcgcatccgactacttcaaggccatgtttacaggaggtatgaaggagcaagaccttatgtgtatcaaattgcatggcgtgaacaaggtaggactaaagaagattatcgattttatatacacagcaaagctcagcctaaatatggataacctgcaggacacgttggaagcagcctcttttcttcagatcctcccagtgcttgatttctgcaaggtatttctgattagcggggtgagtctcgacaactgtgtggaggttggccgtattgccaatacatacaatctcattgaggtggataaatacgtcaataactttattctgaagaattttcctgccttgctctccacgggagagtttctcaagctgcccttcgagcgcctggctttcgtgttaagctctaacagtctgaagcattgtaccgagctggaactgtttaaggcagcttgcagatggctgaggctggaagatccacgtatggactacgccgctaaacttatgaagaatatccgctttcctttgatgaccccccaagatctgatcaactatgtccagacagtggatttcatgcgaacagataacacttgtgtcaatttgttgctagaggcctccaactatcagatgatgccttacatgcaaccggtaatgcagagcgacaggactgccatccggtccgacagtacccatttggtgactttaggaggcgtgctccggcagcagctggtcgtttcaaaagagctgaggatgtatgatgagcgagctcaggaatggcgctcgttagctcccatggacgctcctcgctaccaacacggtatcgccgttattggtaacttcctgtatgttgtgggtggccaatccaactacgacaccaagggcaagacagctgtagacaccgtttttcgctttgacccccgatataacaagtggatgcaggtggcatctttgaatgagaagcgaacttttttccatttgtccgctttaaaggggcatctctacgctgtagggggtcgatcagcagcgggtgaactagctaccgtggaatgttacaaccctaggatgaacgagtggtcatacgtcgccaagatgagtgagcctcactatggccacgccggaaccgtgtatggtggcctgatgtatatatccggagggattacccacgatactttccaaaatgaactgatgtgcttcgatccagataccgacaagtggatgcagaaagcgcctatgaccaccgtaagaggcctgcactgtatgtgcaccgttggagacaagctgtatgtgattggaggaaatcattttcgcggtacctccgactacgacgatgtgctgagttgcgaatactacagccccaccctggatcaatggactcccattgccgctatgttacgaggacaatcagacgtcggagtggctgttttcgaaaacaaaatttatgttgtggggggatatagttggaataacagatgcatggtggagatcgtccagaaatacgacccagagaaagacgaatggcataaggtcttcgacttaccagaaagtctgggcggaattagggcgtgtacgctgaccgtgttccctccggaggaaaatcccggtagcccatctagggagagtcccttgtctgcaccgtccgaccattcttag

SEQ ID NO: 57053 - DNA, 534 bp, Artificial Sequence
  Description of Artificial Sequence: Synthetic coding sequence
atgactactagcatacgccagtttactagctcatccagcataaagggttcatccgggttaggcggtggatccagcaggacctcttgccagctctccggcggtctgggagctggatcctgtaggcctggtagcgccggaggcctcggctcggccctcgggggatcttcatactcctcatgctactcgtttgggtccggaggaggctacggttccagctccttcgaaggagtggatggcttactcgtcggaggagaaaaggcgaccatgcagaatctaaatgatcgattggccagctacttagacaaagtgagggctctggaagaggcagatacagagcttgaggtcaagataagagactggtatcagaggcaagcaccaggtcctgcaagagattatagtcaatactaccggattattgaagagcttcagaacaagccaccatggaccatgcctacatcctgctatattctgacaatgcctatctggctgctgctcacttcggcacccaagtcttggcagaacgagggccgatag

SEQ ID NO: 57054 - DNA, 1326 bp, Artificial Sequence
  Description of Artificial Sequence: Synthetic coding sequence
atgaccacatccatacgccagtttaccagtagcagctctatcaagggatcatcaggtctgggaggcggttctagtcgcacgagttgccagttatctgggggactgggggctggaagctgtcgacccggatccgcgggaggtctaggttctgccttgggagggtcctcttattcctcttgttattctttcggttcaggcggaggctatggcagttcctcttttgagggcgtggatgggttgttggtagggggagaaaaggccactatgcagaatttgaacgatcggctggcgtcataccttgacaaagtcagggccctcgaggaggctgacaccgaactcgaagttaagatccgcgattggtaccagaggcaagcccctgggccagcacgcgactattcccaatactatcgaattatcgaggaactgcagaacaaaatccttaccgccaccgtggacaacgccaacatcctcctccatattgacaatgcacacctcgcggctgccgacttcaggacaaagttcgagacggaacaggccctgtgtctcagtgtcgaggctgacataaacgggccttgccgcgtgcttgatgagctcacactggctcgcgcagacctggagatgcatatcgagaacctcaaagaggagctggcctacctcaagaagaatcatgaagagatgaatgcaccccgaggtcaggtgggcggagagatcaatgtcgaaatgggcgcagcacctggcgttgacctttcgcgtattttgaatgaaatgcgtgagcagtatgaaaagatggccgaaaaaaacagaaaagatgcagaggactggtttttttccaaaactgaagagcttaacagggaggtggcaaccaatagcgagctggtccagtcaggcaaatctgaaatttccgagttacgttgcactatgcaggccctggaaatcgaacttcagtcccaactgagcatgaaggccagcctggagggcaatctggctgagacagagaacagatattgcatgcagctctctcagattcagggcctcatcggcagtgttgaggagcgccttgcccaattgctttgtgagatggagcagcaaaaccaggaatacaagatcctgctagacatgaagatgagactggaactggagatcaccacctatcatcgactgctcgaaggcgaggatgcccatgagggtctgttagctccaactcacttcaagctccctgcgtcaccggcagccgtgacgacgtgtcaggtgccgaccattgtcgaggaagtccaggacggcaaggtgatctcatctcgcgaacaggtgcggcagacaactcggtag

SEQ ID NO: 57055 - DNA, 366 bp, Artificial Sequence
  Description of Artificial Sequence: Synthetic coding sequence
atggcctcttgctctacttcaggcacttgcggatctagctgttgccagccgtcttgttgcgagacttcttgttgccagccttcatgttgtcagacctcctcctgcggcactggttgcgggatcggaggcggaattggatatgggcaggagggcagcgggggatcagtttctacgaggatccggtggtgccatccagattgccacgtcgaaggaacttgcttacctccctgttaccttgttagttgcacaccaccgtcctgttgtcaactgcaccatgccgaggcgagctgctgtaggccgagttactgtggccaaagctgctgcagaccagcatgctgctgccactgttgtgaaccaacatgctag

SEQ ID NO: 57056 - DNA, 372 bp, Artificial Sequence
  Description of Artificial Sequence: Synthetic coding sequence
atgaccggatcctgctgtggatctacatttagctctctgtcctatggaggcggttgctgtcaaccatgctgttgcagagatccttgctgctgccggccagtgacctgtcagaccacagtttgccgtccagttacttgcgtgcccaggtgtactaggccgatttgtgaaccttgcagacggccagtgtgctgcgatccctgttccctgcaagagggctgttgtaggcccatcacttgttgtccaagctcgtgcactgccgtggtgtgccgaccatgctgctgggcaacaacatgctgccagcccgtctcagtgcaatctccttgtggtcagccaactccgtgttccaccacttgcagaacaagcagctgttag

SEQ ID NO: 57057 - DNA, 390 bp, Artificial Sequence
  Description of Artificial Sequence: Synthetic coding sequence
atgacggggagttgttgcggctccactttcagttctctgagttatggcggagggtgctgccagccatgttgctgtagggatccctgttgctgccgacccgttacctgccagactactgtttgtcgcccagtgacctgtgttccacgctgtactcgtcctatctgtgagccatgccgaaggcccgtctgttgtgatccctgctccctgcaggagggatgctgtcgcccaataacatgctgtccatccagctgtaccgccgttgtatgcagaccttgttgctgggcaactacttgctgccagcctgtgtccgttcaaagtccatgtggtcagccatccccttgcggccagccgacaccctgttcaacgacatgtagaactagtagctgctag

SEQ ID NO: 57058 - DNA, 468 bp, Artificial Sequence
  Description of Artificial Sequence: Synthetic coding sequence
atggtgtcatcgtgctgcggatctgtctgcagcgaccagggttgtagccaggatctctgtcaggaaacatgctgcagaccttcctgctgccagaccacttgttgcagaacgacatgttaccgtccctcatgctgcgtatcgagctgttgtcgaccacagtgctgtcaatcggtttgttgtcaacccacctgctgccgacctacgtgttgtgagacaacatgctgtcaccccagatgctgtatcagttcctgctgcaggcccagctgttgtatgtcgtcctgttgcaaaccccagtgctgccagagcgtctgctgccagccgacgtgctgccgaccatcatgctgtagaccttgctgttgtctgcgacccgtttgcgggagagtgtcttgtcatacaacttgttaccggccaacatgcgtgatttccacttgcccacggccactctgttgtgcttccagctgttgctag

SEQ ID NO: 57059 - DNA, 660 bp, Artificial Sequence
  Description of Artificial Sequence: Synthetic coding sequence
atgggctgttgcgggtgttcaggcggttgcggttcaggttgtggcggatgtgggagcgggtgcggagggtgtggatccgggtgcggcggttgtggctcagggtgcgggggatgcggcagcggctgcggtggatgtggcagttcctgttgcgtccctatatgctgttgtaaacccgtttgttgttgtgtgccggcttgtagctgttccagctgcggcagctgtggaggttccaagggtgggtatgggagctgtggcggaagtaaaggaggatgtgtatcttgtgggggaagtaagggcggttgcggcagctgtggaggtagtaagggagggtgcggtagctgcggtggtagcaaggggggttgtggatcctgtgggggtagcaaagggggatgtgggtcctgtggttgctctcagtgttcctgctgtaaaccttgttgttttagctcagggtgcgggtcaagttgttgccagagcagttgttgcaagccctcctgctgtcagtcctcttgttgtaagccctactgctgtcaatcttcttgttgcaaaccatgttgcagcagcagcggatgcggttcatcatgttgccagtcctcctgctgtaacccgtgttgttctcagagttcatgctgcgtgcccgtctgctgccagtgcaagatttag

SEQ ID NO: 57060 - DNA, 687 bp, Artificial Sequence
  Description of Artificial Sequence: Synthetic coding sequence
atgggctgctgtggctgcagcgggggttgtggatctggatgtggcggatgcgggtcgggatgcggcggttgtggttctggttgtgggggttgtgggtccggctgcgggggatgcggatctggatgtggcggatgcggctcgagttgctgtgttcctatctgctgttgcaagcccgtgtgttgttgcgtgccggcttgtagctgctctagctgcggctcctgcggaggttctaaaggcggttatggatcttgtgggggaagcaagggcggatgtgtgtcttgtggcggatctaaagggggatgcggatcgtgcggaggttccaagggcggatgtgggtcctgcgggggaagtaagggcggatgcggaagctgcggcggatcaaaaggcggatgtggatcatgtgggtgctcccagtgctcttgctgcaaaccttgctgcttcagcagtggatgcgggagctcttgctgccagtcaagctgttgcaagccatgctgttcctccagcgggtgcggatcgagttgttgccagtcaagctgttgtaaaccatactgctgtcagtcaagttgctgcaagccctgctgctcttcctctggctgcggatcctcttgctgccagtcctcttgttgcaacccttgctgttcgcagtcctcctgttgtgtgcctgtctgctgccagtgtaaaatctag

SEQ ID NO: 57061 - DNA, 351 bp, Artificial Sequence
  Description of Artificial Sequence: Synthetic coding sequence
tgctgtcaccctacttgttgccagaacacttgttgccggaccacgtgctgccagcctacgtgcgtggctagctgctgtcagccttcctgctgctcaaccccttgttgtcaaccgacgtgctgcggcagctcctgctgcgggactacctgctgccagccaacatgctgccagccgacttgttgccgtaacaccagttgtcaacctacctgctgtgggtcttcatgttgtcaaccaccatgctgccgcccaacatgctgtcagacaacgtgttaccggacaacttgctgtcgccctagctgttgttgctcaccatgctgtgtgtccagttgttgccagcctagctgctgttag

SEQ ID NO: 57062 - DNA, 306 bp, Artificial Sequence
  Description of Artificial Sequence: Synthetic coding sequence
cggccattctgctgtcacacaccttgctgtcaaccctcatgttgtgtaccaagctgttgccagccatgctgccatcccacctgttgtcagaacacctgttgcagaactacttgctgtcagccaacctgcgtggcgtcatgctgccagccctcctgttgcagcaccccgtgctgccagcctacctgttgcgggcagacctgtaacgaaagttcctactgtctgccctgttgccgtcccacatgctgtcaaacaacatgctacaggaccacttgttgtagaccatcttgttgttgctctccatgttag

SEQ ID NO: 57063 - DNA, 753 bp, Artificial Sequence
  Description of Artificial Sequence: Synthetic coding sequence
atgacgcactgttgctccccatgctgccagcccacctgttgcaggacgacttgctgccgcactacatgttggaagccaaccacagtgaccacatgctcaagtactccttgctgtcagccatcctgctgcgtgccgtcatgctgtcagccttgttgccaccctacatgttgtcagaacacttgctgtcgaaccacttgctgccagcccacttgcgtggccagttgctgtcaaccgagctgctgttctaccccctgctgtcagcctacctgttgcggctcgtcttgctgcggacaaacaagttgcggatccagctgttgtcagcccatttgcggttcaagttgctgtcagccttgctgtcatccaacctgttatcagactatctgcttccgcacaacttgctgtcagcccacttgctgtcaacctacctgctgtagaaacacttcatgccagcccacttgctgtggcagttcttgctgtcagccatgctgtcaccccacctgctgtcagaccatctgtagatccacttgttgtcagcccagttgcgtgactaggtgctgctccaccccctgctgtcagcccacatgcggaggaagctcatgttgttctcagacttgcaatgaatcttcctattgtctaccctgttgccgacccacctgctgtcagacaacatgttatcgaactacctgctgcagacccagttgctgctgttctccatgctgcgtgagctcctgctgccagcctagttgttgttag

SEQ ID NO: 57064 - DNA, 483 bp, Artificial Sequence
  Description of Artificial Sequence: Synthetic coding sequence
atgactcattgctgtagtcccggatgtcaacccacctgctgtagaactacgtgctgccggacaacctgctggcaacccactatcgtcaccacctgctcttcaaccccctgttgccagccatcctgttgtgttagtagctgttgccagccgtactgtcaccccacatgctgccagaacacctgctgcagaaccacctgttgtcagcccacttgtgtcacctcatgttgtcagccttcatgttgtagcacaccatgctaccagcctatctgctgtggtagtagttgctgcggacagacgtcatgcggttccagctgtggtcagagttctagctgtgcgcctgtgtactgccggaggacctgttaccacccaaccaccgtttgcttaccaggatgcctgaatcaatcttgtggcagcagctgttgtcagccttgctactgtcctgcctgctgcgttagctcatgctgccagcactcatgctgttag

SEQ ID NO: 57065 - DNA, 510 bp, Artificial Sequence
  Description of Artificial Sequence: Synthetic coding sequence
atgacccattgctgtagcccttgctgtcaacctacttgctgtaggactacgtgctggaagccaacaactgtgaccacttgctcttcaacaccatgctgccaaccctcatgttgcgtgtccagttgttgtcagccctgctgccatccaacctgctgccagaatacttgctgtaggaccacatgctgccagccgacatgcgtcactagttgctgtcagccgtcatgctgttctacaccatgttgccagccaatttgttgtggctcatcgtgctgtggccagacgagctgcggctcatcttgctgtcagccatctagctgtgccccaatttactgtcgacggacctgctatcacccaacttcagtttaccttcctggatgcttgaaccagtcctgtggcagtagctgctgccagccttgctgccgccctgcttgttgcgagactacgtgctgccggaccacctgctttcaacctacttgtgtgacctcatgttgccagcccgcatgctgttag

SEQ ID NO: 57066 - DNA, 510 bp, Artificial Sequence
  Description of Artificial Sequence: Synthetic coding sequence
atgacacactgttgctctccatgttgtcaacctacctgctgtagaacgacttgctggaagccgacaaccgtcacaacatgcagctccacaccatgttgtcagcctagttgttgcgtgtcctcttgctgtcagccttgctgccggccagcctgttgtcagaatacgtgctgtaggaccacttgctgccagcctacgtgtctgacaagctgctgtcagccttcttgctgttcgactacctgctgtcaaccaatttgttgcggatccagctgttgtggtcagacttcctgtggatcaagctgtgggcagtccagttcttgcgccccagtgtactgcagacgaacctgctattatcccacaacagtctgtttgcctggctgtcttaaccaatcatgcggatcctcctgctgtcagccatgctgcagaccggcttgttgtgaaaccacttgctgtagaacgacctgcttccaacccacctgtgttagctcttgttgccagccttcttgctgttag

SEQ ID NO: 57067 - DNA, 528 bp, Artificial Sequence
  Description of Artificial Sequence: Synthetic coding sequence
atgactcattgttgctctccctgttgccagcctacctgttgccgaacgacttgctgtagaactacttgttggaagcccaccactgtgactacttgcagttcaactccctgctgtcaaccttcgtgctgcgtgagttcctgctgtcagccaccatgctgtcggccagcgtgctgccagaacacctgctgccgcaccacctgttgtcagcccacctgccttacatcctgttgtcaaccttcgtgctgctcaacaacatgttgtcagccaatatgttgcgggtcgagctgctgtggtcagacttcatgcggctccagttgcggacagtccagttcatgtgcccctgtctattgcagaaggacatgctattacccaaccacagtttgccttcccggttgtctgaatcagtcatgtggatcatcttgttgtcagccctgctgtcgccctgcctgttgcgaaacaacgtgctgcaggaccacttgtttccagccaacctgtgtgtcatcttgttgccagccctcatgctgctag

SEQ ID NO: 57068 - DNA, 2037 bp, Artificial Sequence
  Description of Artificial Sequence: Synthetic coding sequence
atgcctacttggggcgcaaggcccgctagccccgacaggtttgctgtgtctgctgaggctgagaataaggtgagagaacagcaaccccacgtggaacgcatctttagcgtgggcgtgagcgtactgccaaaggactgtccggacaaccctcacatatggctgcaactggaagggcctaaggagaacgcctcccgcgcaaaggagtacctgaagggactttgtagtcccgaactgcaggacgagatccactatccccctaagctccactgcatttttctaggagcccaaggcttttttctcgattgcctagcttggtctacttccgctcatctggtgcctagagcccctggatccctaatgataagcggcctgaccgaggctttcgtcatggcccagtcccgtgttgaggaattggccgagaggttgagttgggatttcactcctgggccatcctcaggcgcaagtcagtgtactggcgtcctcagagacttcagtgccctgctccagagtccaggcgacgctcatcgagaggcactcctgcagctacctctagcagtgcaggaggagttgctgtccttagtgcaggaagctagctcaggacagggacccggagcactcgcgagctgggaaggaagaagctcggctctgctgggggctcaatgccagggagtccgcgcacccccatcggacggacgcgagtcgcttgacaccggctcaatgggacctggtgactgcaggggggcacgtggtgacacttacgcagtggaaaaggaaggcggtaagcagggcggacccagagagatggactggggctggaaagagctgcccggtgaagaagcatgggagcgtgaggtggcgctcagacctcagtcagtgggtggcggagcacgagagagtgccccactcaagggcaaagctctcggcaaggaagaaatcgcactagggggagggggattttgtgttcaccgcgaacccccaggtgcccatgggtcctgccaccgcgctgctcaatcacggggagcaagcctgcttcagcgccttcataacgggaacgcctcccccccacgtgtgcctagccccccacccgcacccgagccaccgtggcactgtggcgaccgaggcgactgcggcgatcgtggggacgtgggagataggggtgacaaacaacagggaatggctagaggtcgcggaccgcagtggaagaggggggctaggggcggtaatctcgtgaccggaactcagaggtttaaggaagcattgcaagaccctttcaccctgtgtctggccaatgtccccggacagccggatctgaggcacatcgttatagatggctctaacgtggccatggtccatggactccagcactacttttcttctagaggcatagctatcgccgtgcagtacttctgggataggggtcaccgggatattacagtattcgttccgcagtggaggttctcaaaggatgcaaaggtgcgcgagagccacttcctgcagaagctgtatagcttgtccttgctctctctcactccatcccgggtgatggatggcaagaggatctcctcctatgacgatcgattcatggttaaactcgcagaggagaccgacggtatcatcgtgtctaacgatcagtttagagacctggctgaggaaagcgagaaatggatggccattatcagagagcgcctgctgccgtttacatttgttggcaacctgttcatggttccagacgatcctttgggacgaaacggccctactctggacgagtttctcaagaagccggcacgcacccagggcagcagtaaggcccagcatccaagccgcggatttgccgaacatggcaaacagcaacagggacgcgaggaagagaaaggcagtggtgggatcagaaaaacccgcgagactgagcgcttacgacgacaactcctggaagttttttggggacaggaccacaaggtcgacttcattttacagagggaaccctattgtagggacattaatcagttgtcagaggcgctactgtcactaaacttttag

SEQ ID NO: 57069 - DNA, 2037 bp, Artificial Sequence
  Description of Artificial Sequence: Synthetic coding sequence
atgcctacttggggcgctcgtcctgcatcaccagaccgtttcgctgtgtcagcagaggctgagaacaaagtccgggaacagcagccccacgtagaaagaatcttcagcgtgggcgtatctgttctcccaaaggattgccccgacaacccacatatctggttacagctggagggacccaaggagaacgcctctagggccaaagagtacctaaaagggttgtgctcccctgaactccaggatgagatacactatcctccaaaactacactgcattttccttggcgctcagggcttctttttggactgccttgcctggagcaccagtgcccatctggttccaagggccccaggaagcctgatgatatcaggcctgacggaggcctttgtgatggcgcagtctcgcgtagaggaactggccgaaaggctaagctgggatttcacgcccggtcccagcagtggtgccagtcaatgcactggggtgctgcgggacttttccgccctgctgcagtcacctggtgatgcccatagagaagccctgctgcaactcccccttgcagtgcaggaggaacttctctctttggtgcaggaggccagctctggacaggggccaggcgcattagcttcctgggaaggtaggtcgtccgcactgctcggcgcacaatgtcagggggtgcgcgctccccctagcgacggtcgagaatctcttgacactggctcaatggggcctggcgattgtcgtggcgcaaggggtgatacctacgcggttgagaaagagggaggcaagcagggaggccctcgtgagatggattggggttggaaggagttaccaggcgaggaagcctgggagcgtgaagtggctctgcgccctcaaagtgtgggtggcggagccagagagtccgctcctcttaaaggtaaagctttgggtaaggaagagattgctctcggcggtgggggattctgcgtccaccgcgagcccccaggagcccacgggagctgccacagggccgcacagagtagaggagccagccttctgcaaagactccataacggtaatgcatccccacctcgggtaccatcaccaccacctgctcctgaacctccatggcattgcggtgatcgcggtgactgtggtgatagaggggatgtgggtgaccgcggtgataaacagcagggcatggcaagaggaagaggcccacagtggaaacgtggggcaagagggggaaatctcgtgaccggcacacagaggtttaaggaagcactgcaggaccccttcactctgtgcctcgcgaacgtgccaggacagcccgatctccgccatatcgtcatcgacggttcgaatgtagctatggttcatggtctgcagcattacttttctagccgcggaatcgccattgcggtgcagtacttttgggacagagggcatcgcgacattaccgtgtttgttccgcaatggagattctctaaagatgccaaggtgagggagagccatttcttacagaagttgtattcacttagtctgttatccttaacgccctcccgggtgatggacgggaagcggatctcatcttacgacgaccgctttatggtgaaactcgcggaagagaccgatggcattattgtatccaatgatcaattccgcgatctcgccgaagagagcgagaagtggatggccatcattcgggagcgcctactgccctttacatttgtcggtaacttatttatggtgcccgatgaccctctgggtcggaatgggccaacactcgacgaattcctgaaaaaaccggctcgaacgcagggttcttctaaggctcaacatcccagccgcggattcgccgagcacggcaaacagcagcaaggcagagaggaggaaaaaggctcgggcggtatccggaagactcgagaaactgagcgcctgaggagacaactgcttgaagttttttgggggcaggaccacaaggtggattttatacttcaacgtgagccctactgcagggacattaatcagctgtcagaggctttgttgtccctgaacttctag

SEQ ID NO: 57070 - DNA, 408 bp, Artificial Sequence
  Description of Artificial Sequence: Synthetic coding sequence
atgcctacttggggggcacggcctgcttctccggatagattcgccgtgagcgctgaggccgaaaataaggtcagggagcagcagccccatgttgaacgtatcttttctgtgggggtaagcgttttgcctaaggattgccctgataatccgcatatttggttgcagctagagggccctaaagaaaacgcctctcgagccaaagagtatctgaaaggcttgtgctcacccgaactacaggacgaaattcattatcctcccaaacttcattgtatatttctgggggcacagggtttcttccttgactgcctcgcttggtccacttccgcccatctcgttccacgggctcccggaagccttatgatcagtggcctgaccgaagcctttgtaatggcacagtcccgcgtttag

SEQ ID NO: 57071 - DNA, 2037 bp, Artificial Sequence
  Description of Artificial Sequence: Synthetic coding sequence
atgcccacatggggggcaagaccagcctcccctgaccggtttgcagttagcgccgaggcagagaataaagtgagggagcaacagccacatgtcgaacgaatattttcagtcggcgtgagcgtgcttcctaaggattgtccagacaaccctcacatctggctccagctggagggacctaaggagaatgcctcacgcgcaaaagagtatctcaagggtctgtgctcccctgagctacaggatgaaatccactaccctcctaaactgcattgcatttttctgggggctcaggggttcttcctagattgcctggcctggtctacgagcgctcacttggtgcccagagctccaggctcacttatgatttccggcctgactgaagccttcgttatggcacagtctcgggtggaagagttagccgaaaggctgagttgggatttcacccccggacccagcagcggcgcatcacagtgtacaggagtgcttcgcgatttcagtgcactgctgcaatctcctggcgatgcacaccgtgaggccttgctgcaattgcctctcgctgttcaagaagagctgctgtccctggtgcaagaagccagttcgggacaaggacccggtgccctagcctcttgggagggcaggagctctgcgcttctcggggcacagtgccagggagtgcgagcaccaccttctgatggtcgcgagtcgttggataccggctcaatgggccctggtgattgtcgtggtgccaggggagatacctacgcagtggagaaggaagggggaaagcagggaggacctagggaaatggactggggatggaaagagctgccaggcgaagaggcctgggagcgtgaggtagctcttcggcctcagtcagtcgggggtggggctagagaaagcgccccactgaaaggaaaggccttagggaaggaggaaatagctctgggaggcggtggcttctgcgtgcatagagagccacccggagcccacggttcctgccacagggctgctcagagtaggggtgcgtctctgctgcagcgactgcacaacggtaacgcatccccccctcgggttccgtctcctccccctgcccctgagcccccttggcactgcggcgacagaggcgattgcggggatcgtggagacgtgggggacaggggagataaacagcagggcatggcaagaggacgtggaccccagtggaagcggggtgcccgtggcggaaacctggtcaccggcactcaaaggtttaaggaagccctgcaagatccgttcaccttgtgcttggcaaacgttcccggacaaccagacctcagacatatcgtcattgacggttcgaacgtggctatggtgcatgggttacaacactacttcagcagcagaggtattgccatcgcagtgcagtatttttgggacagaggccacagggatatcaccgtgttcgtgcctcagtggagattcagtaaagacgccaaagtcagggagtcacactttctgcagaaactttacagcttaagcttacttagcctgaccccctctcgtgttatggatggaaagcgcatctcctcgtatgatgatcgttttatggttaaacttgctgaagaaactgatggaatcatagtcagtaatgatcaattccgcgacctggccgaggagtccgagaagtggatggcgatcatcagagaacggcttctcccgttcacatttgtcggcaacctcttcatggtacctgatgaccccttgggaagaaacgggccaaccctggacgagtttttaaagaagccagcccgaacacagggatcctcgaaggctcagcatccatcgaggggattcgccgagcatgggaagcaacagcaagggagggaagaagaaaagggctctgggggtattagaaaaacgagagaaactgagcgcctccggagacagctgctggaggtgttttggggacaagatcacaaagtggacttcatcctgcagagagagccttactgccgggatatcaaccagttgtccgaagcactcttgtctctcaatttctag

SEQ ID NO: 57072 - DNA, 387 bp, Artificial Sequence
  Description of Artificial Sequence: Synthetic coding sequence
atggcggtgggcaccagtgcactgtctaaagagccctggtggaccctcccagaaaacttccacagccctatggttttccatatggaagaggaccaagaggagctcatatttgggctcgatgatacgtacctccggtgtatcgaacttcacagccatactctgatccaactggaaagatgctttactgcgactggtcaaactcgcgtcactgtggttgggccacctatggctaagcagtggctgctgctgatgttccactgcgtcggaagccaggacagtaagtgccatgctagaggcctgaagatgcttgaacgggtccgcagccagcctctcacaaacgacgaccttgtgactagcgtctctttgccaccttataccggtgactag

SEQ ID NO: 57073 - DNA, 1251 bp, Artificial Sequence
  Description of Artificial Sequence: Synthetic coding sequence
atgtcaccctctcacgtagtggtaaacgtgtccaccgctaggagcggcccactgacaacaagctctgctccagttagccgggcagaatcactgcggcctgggagtagaagctgtactatgtctatgtcgcctacagtaattatcctcgcctgtctaggattttttctggatcaaagcgtgtgggcacatgttggtggccaagataagcctttttgctcagcatggccctccgcagtagtgcctcagggaggacacgtgacccttcggtgccactgtagaagaggatttaatatatttactttgtacaaaaaagacggagtccccgtgcccgagctgtataaccgaatcttttggaactccttcctgattagtccagtaacccctgcacacgctggaacctataggtgtcggggatttcacccacattccccaacggagtggagcgccccaagtaaccccctggtcataatggtgactggattatacgagaagcccagccttacggctaggccgggtccaaccgtgcgcgcaggcgagaatgtgactttatcttgcagcagccagtcaagtttcgacatctaccacctgagcagagagggtgaagcccacgagttaaggctgcctgcagttccctccattaatggcactttccaggcagacttcccactcggaccagccactcacggagaaacgtacagatgtttcggatccttccacggctctccctatgagtggagcgacccctcagaccccctacctgtcagcgttaccggaaacccatcttcttcatggcctagtcccaccgaacccagcttcaagaccggtattgctaggcacctacatgccgtgataagatatagtgtggccattatccttttcacaatcctgcctttctttttgttgcatcgttggtgtagcaagaaaaaaaacgcagctgtgatgaatcaggagcccgctggacaccggaccgtcaatcgcgaggattcagacgagcaggacccccaggaggtgacctacgcacaactcgaccattgtattttcacgcaacggaagatcacggggccttctcaacggagcaagcgcccaagtactgatactagtgtttgtattgagctgcctaatgccgaaccacgcgcactgtcgccagcccacgagcatcattctcaggctcttatgggctctagccgagaaaccaccgccttatctcagacccagctagcctcctcaaatgtgccggctgcaggaatctag

SEQ ID NO: 57074 - DNA, 915 bp, Artificial Sequence
  Description of Artificial Sequence: Synthetic coding sequence
atgtctctgatggtagtatcaatggcatgcgtaggcttctttctacttcagggcgcttggccacatgagggagtgcacaggaaaccctcactgctggcccacccaggacctttagttaaatctgaggaaacggtcattcttcagtgctggtccgacgtaaggtttgagcactttctcctccacagggaaggcaagtacaaagacacccttcatttgatcggggagcaccatgatggagtcagtaaagctaatttttctatcgggccaatgatgcaggacctggccggtacgtaccgttgctatgggtccgtaacacactccccatatcagctttcggcaccgagcgatcccctcgacattgtgattacaggtctgtacgagaagccaagcctgtccgcacagccaggtcccactgtcttagctggcgaaagtgtaacgctctcttgcagttcacgttctagctatgacatgtatcacttgtctcgagaaggggaagcccatgagagacggttttccgccggacctaaggtcaacggcacatttcaggcagatttcccactgggcccagctactcacggcggtacgtatagatgtttcggatcattccgtgatagtccttatgagtggagcaactctagtgaccccctgttggtatcagttaccggcaatccctcaaactcatggccatcgccgacagagcctagctcaaaaacaggcaatcctaggcatctgcacgtgctaataggcacgagcgtggtgaagataccttttacgatcttactcttttttctgctgcaccggtggtgctccaataagaagaacgcagctgttatggaccaggagccagcgggtaaccggacagtcaattctgaagactctgatgagcaggatcatcaggaagtgtcttatgcttag

SEQ ID NO: 57075 - DNA, 915 bp, Artificial Sequence
  Description of Artificial Sequence: Synthetic coding sequence
atgtccctcatggtcgttagcatggcatgcgtgggcttcttcttattgcagggtgcttggccacacgagggggtgcaccggaagccctctcttctggcacatcctggtcccctggtgaagtcagaggagacggtgatattgcagtgttggtctgatgtgaggttcgaacacttcctgctgcaccgcgaaggaaaatacaaggacactcttcacctaattggcgagcaccacgacggagtctcaaaggcgaatttttcaatcggtcctatgatgcaagatctggctggcacatacagatgctatgggagtgtaacccacagcccataccagctgtctgctccttctgatccactggatatcgtgatcactgggctctatgaaaaaccctctctgtctgcacagccgggtcccaccgtgctggccggtgagagcgtgacgctgtcctgctcctccagaagtagctacgatatgtaccacctctccagagagggggaagcgcacgagaggcgcttctcggctggccctaaagtcaatggcacgttccaagcagacttccctctggggcctgctacccacggtggcacttatcgttgcttcggaagttttcgggactccccctatgaatggtccaactcttccgatcccctgctcgtgtcagtgaccggcaacccctccaattcttggcccagtcccacagagccctcaagcaagacggggaatccacggcaccttcacgtgcttatcggcactagcgtggtgaagattccttttactatcctcttatttttcctcctgcaccggtggtgctctaacaagaagaatgcagccgtcatggatcaggaacccgctggcaacaggaccgtcaattctgaggactctgatgagcaggaccatcaggaagtctcctatgcatag

SEQ ID NO: 57076 - DNA, 867 bp, Artificial Sequence
  Description of Artificial Sequence: Synthetic coding sequence
atggcttgcgtcgctttctttctcctccaaggagcctggccccatgagggctttcgcaggaagccgagcctgctggctcaccccggaccattagtgaagagtgaggagacagtaatcctccaatgctggagcgatgtcatgtttgaacactttctgctgcacagagaaggaacatttaaccatacgctgaggctgatcggcgaacacattgatggagtctccaagggcaatttttccataggtagaatgacccaggacttagccggtacctaccggtgttacgggtccgtgacacactccccttaccagttatcagccccttctgaccccctggacatagtgattacaggactctacgaaaaaccatccctgtctgctcaacccggacccacagtgctggctggtgagtcggtgacgctatcatgctcttcacgaagttcttacgacatgtaccacctctcaagggagggggaggcacatgagcgtcgtctgccggcagggcctaaagtgaatcgaaccttccaggctgactttcccctggaccctgcaacacatggaggcacatatagatgtttcggaagcttccgagactccccttatgagtggtcaaagtcgtcggaccctctgctcgtgtccgtgacgggcaactcttcgaacagctggccatcaccaacggagccctccagcgagaccggcaaccccaggcatctgcacgtcctgatcggcacctctgtggtgaaactgccttttacaatcttgttattttttctgctccaccgctggtgcagtaacaagaagaacgcatctgttatggaccagggcccagctggaaacagaactgtgaatcgggaggattccgatgagtag

SEQ ID NO: 57077 - DNA, 666 bp, Artificial Sequence
  Description of Artificial Sequence: Synthetic coding sequence
atgtctctgactgtggtgtcgatggcttgcgtgggtttcttcctgctgcagggcgcttggcccctcatggggaaccacagaaagccctccctgcttgctcacccgggaccattgctgaagagcggcgagacagtcattttacagtgttggtctgacgtgatgtttgagcatttctttcttcacagggagggcatcagcgaggaccctagcagattggtggggcagatacacgatggcgtcagtaaagctaacttttccattggaccactgatgccggttctggccggtacctatcgctgctacggtagcgtgccacatagtccctaccagctttcagctccatcagatccactggacattgtcataacggggctctacgaaaagccttccttatctgcacagccaggacctaccgtccaagctggcgaaaacgttaccttgagttgtagctcatggtcaagctatgatatttatcatctcagccgcgagggagaggcacacgaacgcaggctgcgggcagttcctaaggttaataggacattccaagccgacttccctctcgggccagctactcatggtggcacttatcggtgctttggttcctttagagcccttccttgcgtatggtccaatagctcggatcctctgttagtgtctgtgacatag

SEQ ID NO: 57078 - DNA, 1002 bp, Artificial Sequence
  Description of Artificial Sequence: Synthetic coding sequence
atgagcctcacagtcgtgagtatggcatgcgtcgggtttttcttgctgcaaggagcctggcccttaatgggaggccaggacaagccattcctttcagccaggccatcaaccgtggtgcctcgcggtggacatgtggctctgcaatgtcattaccgtcgtggatttaataatttcatgctgtacaaggaagatcggtcacatgtcccaatctttcacggccgaatctttcaggagagtttcatcatgggtcccgtgactcccgctcacgcgggtacctaccgatgtcgcggaagtcgccctcactcactgacgggatggagcacccctagcaatcccttggtgattatggttaccggaaaccacaggaaaccaagcctacttgcccaccctggacccttgctgaaaagcggcgaaaccgttatcctccaatgctggagcgacgtgatgttcgaacatttcttcttgcacagagaagggatatcggaagatccatcccgcctggtgggacaaatccacgatggggtcagtaaggccaattttagcatagggcctcttatgcctgttctagccggaacctaccgctgctatggctccgtgcctcacagcccctatcaactctctgcccctagcgatccgttagacatcgttatcactggcttgtacgagaagccgtccctttcagcccagccaggcccaactgtacaggcaggggaaaacgtgacgctgtcatgctcctcatggtcatcgtacgacatttatcacctgtcacgagagggggaagcccacgagagacgactgagggcggttccaaaggtgaaccggacattccaggctgacttcccactcgggccagctacccacggagggacatacaggtgcttcggctctttcagggccctgccttgcgtgtggtcaaatagttcagatcccttgttggtgagcgttacaggcaacccgtcctccagctggcccagccccaccgaacctagcagcaagtcctag

SEQ ID NO: 57079 - DNA, 5249 bp, Artificial Sequence
  Description of Artificial Sequence: Synthetic coding sequence
atgcaggcgatggatccagccgctgcagatctatacgaagaagacggaaaagatctggacttttacgacttcgaacctctccctactctccccgaagatgaggaaaacgtgtcactggcagacatactttccctgcgcgacagaggtctgagcgagcaggaggcctgggctgtatgcctggagtgcagtctctctatgcgctccgtagcccatgctgccatattccagtcactgtgcattacaccagataccctggctttcaatacaagcggaaatgtttgtttcatggagcaactcagtgacgaccccgagggagcttttgtccccccagagtttgacgtgacaggaaacaccttcgaagctcacatatactcattaggcgcaactttaaaggccgcactggaatacgtggccgagcccacattagagcccagattgtcccaggacctagaagctctcctatcgcggatgcaggcggaggaccctggcgaccggccagatctggaatccattattgcactgtgtgaggagaaattacaattgactagctcatgccgggtatgccgtagccttagtgccgtagggaggcgcgtccttagtatcgagagcttcggcgctctgcaggacgtctccgagtccagctggagggagaggcccgcaccaggtaatgccggaccccgacgtcccccaggcgacccaagcacggaccctgaggtgttgccaactcccgaggggccagagtcagaaacaagcagaggaccgcgtgccagtcccactaaagctctccttagcacaccagtgagaaacggcgagtctcattcaagagaggggctcgctggcctcgtgctggacgccgaacgtacattgggggagctggacagggatgcccttaggcgttctcgcctgcgtaaagtgcaaacatttccaagattactctcagacagtccagaggctactttgtgcctcccactcacccgcggaaaaagccagctcccaatcagtgagctgttcagcccagatcctcgaaaagcatttctcgatcggaagaatggcctttctagttttcaggcacagcccaaatgtcgtctgtggcccgagcaagagccagaacatcaactgggcagggtcccttgtgcgggtcgtagcactgatcggggtcccggagtgcccggaagtcccggacagcctgagacatctcatccgtcccagggaccagcggaggcgccagctgatcccagggacgcgagtggagaggcacagactccacgggacgacgagagaattcccgaaggcgcacggcaacttgagtctgccgctgcagaacagtgggtgagtctgcaggatcttcttagtcagctagggcgacccttccgcgagtatgaactttgggccctatgcctggcttgcctgcgagctctccagacaagaccagagcacccagcttacctgtgtctcgatagtgtattggttgccgaggatggtgccgtcctgttccagccacctcctgcgaatggtagctacgattcgttctttctggcacccgagctagcagaagaacggttggtgactgaaaaggctagcgtttattgcgtggcagcagtgctttggacagcagccaaattctcagtgcccagaaaccataagctcgctcttccaagacggttaaagacacttctgctggacatggccagaaggtccgcgcctgaacggcctagcgccgctgaggctattaaagtgtgcggctcttacttgttacagcgcggaatggatagtcgaaaaattctcgctcacttaagggcctctatctgccaggtgtaccaggaggaggagacgatctcattgcagaatgccttttcagtggttgagctgaagccaagtgttgctccagccccagaaccctcccccggattcctgcctgttaatagcgacactggtttggtggcagttcctgggcctgttccagggcagcatccctgtggcgaggaggctacccagctacctgcagcattcacctctgaagcaacccacttcaagccaattgttctggctcagaacgccagcgtggctcgggatcagccagcgctggcccaggaggaatctgaggagagaggtggccagcgtgaaggcgaaggcgaagagaaactcagtctggaggcccatgccggatcccctagtctcaagacccctgatggaccggtgccaggaccgggaccacaaggagcagcacccgaaccacttggtgctagcgtgcaaagagattccgcacaaggtaggccctgtcctcctcctcaggctcctgccaatcagccagaaggagcgtcaagcgcagcacccggttcacctgtcccagcaccaccaacgaaagcaagcgcccttcctgtagagcagggtcccgcagagccaattcctccaggagtcgcttccggtgggctcaggcccgatgcattggggcctactacggcccaccacggccctagacaccccccaaagccaccaagaagtaaggccacggagcgaccaggacaggagcctgaaggccctggcgctacgccagcaggagagagggacgatcaatccccagactctgtgccagaaaggcccagacccgctgaccgaagactttgtctgccatgcgtcgatgcatcaccacttccaggaagaaccgcatgtcccagtctgcaagaagcaactcggcttattcaggaggagtttgccttcgacgggtacttagataacggcttggaagcactgataatgggggaatatattttcgccctgaaggacttgacgttcgcaacgttctgtggcgcaatttctgagaagttttgcgatctgtattgggacgagaaattactgcagaacctcttcaaggttgtgaatggccaggcttctcctagcccttccaccgcggaagaagcaggaagccagctagaaggatcacagagtcctagatcccccagctccaaacggccttcactgcaccgcttaggcaaagaaaaacccgcaatggcaaggaccagtagtcgggctccctgctcccctacttccgtgagtgatgtggatagcgatgcattgtctcggggtaacttcgaggtcggctttcgaccacaaaggagcgtcaaagctgagcgcgctcagcagcctgaggccggtgaagaccgccgtcctgccggtggcgcatccgatgtagaggccgtgacccggctggcccgtagcaaaggagttggacctgccctgtctcctgggcctgccggatttcagtcctgttcgcctggatggtgcagtgcattctacgaggcagactgctttggagcagacgtgcacaattatgtcaaagatctggggcgacagcaggcagatggggcattgcctgacgcgcagtcccccgaactggagcaacagctcatgatggaaaaaaggaattacaggaagacacttaagttctatcagaagctacttcagaaagagaagcggaacaaaggtagcgacgttaaaacaatgttgtccaaacttaagggtcaactggaagagatgaagtcgagggtgcagtttctctcattagtaaagaaatatttgcaggtcatgtatgccgaacggtggggcctagagccatgcacattgcctgtgatagttaatattgcagccgctccctgcgatacactggacttctcaccgctggatgagtcttcttccctgattttctacaatgtgaacaaacatccaggcggtcgccagaaagctcgaattctacaggctggcactcctctgggactgatggcctatctctacagctctgatgctttcctggaaggttacgtgcagcagtttctgtacactttccgttacttctgtaccccgcacgacttcctgcatttcctgttagaccgaatcaattctactctcactcgtgctcatcaggaccccacatccacctttactaaaatctatcgccgatccttgtgcgtcttgcaggcatgggtggaggactgctatgcagtggatttcccgcgtaactccggcctgttagggaagcttgaggattttattagctcaaaaatccttccccttgatgggagcgcgaaacacttacttggactgcttgaagtggggatggatagacgggcagaaggcaatcctcgtgggactgaccttgaaaatccccgagaagccgaagaggacgctcgcccatttaatgcactttgtaagcggctctcagaggatggaatctctaggaagtctttcccctggagacttcccagggggaatggtctcgtcctgcctccccacaaggagagaccttatactatcgccgctgctttaccaaaaccatgcttccttgaagatttttatgggccatgtgctaagacgtccgaaaagggaccttactttctgacagagtactctactcatcagcttttcagccagttgaccctactgcagcaggaactgttccagaagtgccaccccgtgcatttcctgaactcgcgggcacttggagtcatggacaagtcgactgccatccccaaagccagctcatctgaatcgctgtctgccaagacgtgctccctatttttgcccaactacgtgcaggataaatacctgctgcagctccttagaaacgcagacgacgtgtcaacttgggtggcagcagagatcgtcaccagccacacatctaagcttcaggtgaacttgctgtcaaaatttctacttatcgctaaatcatgctacgagcagaggaatttcgctaccgccatgcaaatcctgtctggcctcgaacatcttgccgtgcgccagtctcccgcttggcgcattctacccgcaaagattgccgaggtgatggaggagctcaaagccgtagaagtgttcttgaagtccgacagcctgtgcctcatggaaggccgtcgtttccgcgcacagcccacattgccttccgctcacctgcttgctatgcacatacagcagcttgaaacaggcggttttactatgacaaacggggcacatagatggagcaagctgcgaaacatcgctaaagttgtgtctcaggtccacgcctttcaggaaaatccctacacattctcacctgatcccaagttgcaatcctatttgaagcagaggattgcgagattttcaggagccgatatttctacactcgccgcagactctcgggctaactttcatcaggtctcttcggaaaaacatagtagaaaaatccaagacaaactgagaaggatgaaggcgacattccagta

SEQ ID NO: 57080 - DNA, 5255 bp, Artificial Sequence
  Description of Artificial Sequence: Synthetic coding sequence
atgcaagccatggaccccgctgctgctgacctgtatgaggaggatggcaaggatctagatttctacgacttcgagcccctacctacacttcccgaagacgaggagaatgtaagcttggccgacatcctgtctttgagggaccggggtctaagtgagcaggaggcatgggcggtctgcctcgaatgttccctgtccatgagaagcgtggcccatgcagccatcttccagagcctctgtattacgcctgacactctcgcgtttaatacaagcggaaatgtgtgtttcatggagcagttaagcgacgatcctgagggtgccttcgttcctcctgaatttgacgtgacagggaacactttcgaggcccacatttatagcttgggagccacccttaaggcagccctggaatacgttgctgagcccaccctggaaccgagattatcccaagacttggaagcattattgagcaggatgcaggccgaggaccccggagatcgtcctgacctcgaatccatcatcgccctctgcgaggaaaaattgcaattaacgtcatcctgcagggtctgtcgaagcctcagcgccgttggacggagagtacttagcatcgagtctttcggagccctccaggatgtgtcggagtcgtcttggagggaaagaccggcacccggaaatgccggtcccagacggccacctggggacccctccacagaccccgaagtgctcccaacgccggagggacccgaatctgagacaagcagaggccctcgcgcttccccgactaaggcccttctttccacacccgtcaggaatggcgagagccattctcgagaaggtcttgctgggctggtgctcgatgccgagcgcacactcggagaactcgatcgagatgccctccggaggagtagattgagaaaggtgcagaccttcccccgtctgctcagcgattcgcccgaggctaccctgtgcctacctctgactagaggaaaaagccagctccccatttccgagttgttcagtccagaccccaggaaggctttcctcgatcgaaagaatggcctaagcagttttcaggcccagccaaaatgccggctgtggcccgagcaggagcccgagcaccagcttgggagggtcccctgcgctggccgatctactgaccgaggtcccggagtccccggtagtccagggcagcctgaaacaagccatccgagccaagggcctgctgaggctcctgccgatcctcgcgatgcttcaggcgaggcccagacacctcgcgatgatgaaaggatcccagagggtgcccgtcagctggagtctgctgcggctgagcagtgggtgagcctccaagacttactttcccaactaggtaggccttttcgggagtacgagctctgggctctctgccttgcctgcctgagagctctccaaactcggcctgagcacccagcgtacttgtgccttgattccgtcctcgttgccgaggacggagccgttctgttccagccgccacccgcaaatgggagctacgactcatttttcctggcacccgaattggctgaagagcggctcgtcacggagaaggctagcgtttactgtgtggcagccgtactgtggactgcagccaagttttccgtaccccgaaaccacaaactggcattgcctagaagacttaagacactcttgttggatatggcaaggaggtctgcaccagagcggcctagcgccgctgaggcaattaaagtgtgcggatcatacttactgcagcggggtatggacagcaggaaaatcttagctcacctccgtgcttcaatttgccaggtataccaggaggaggaaacaatttcactgcagaacgccttcagcgtggtggagctgaaaccatcagtggctcccgcaccagaaccctcacctggatttctgccagtgaatagtgatacaggacttgttgctgtaccaggaccggtgcccggtcagcatccttgtggggaggaggctacccagctgccggcagcattcactagcgaagccacacacttcaagccaatagtgttagcccagaatgcatcagtagcgcgagatcagcccgctctggctcaagaggagagtgaagagcgcggaggccagcgcgaaggcgagggagaagagaaactaagcctggaagcccatgccggatctccgagtctgaagacccccgacggccctgttccaggccctggcccacagggcgctgcccctgaacccctcggggcatccgtacaacgcgactcagcccagggtagaccctgtcctccgcctcaggcaccagctaatcagcccgagggcgcttcaagcgccgctcccggttcccccgttcctgctccgcctacaaaagcctcagctctgccagtagaacaagggcctgccgagcccatccccccaggcgtggcgtcaggcggattacggccagatgcactgggccctaccacagctcatcacgggcctagacatccacccaagccacctaggagtaaggctacagaacggccaggccaggagcccgagggcccaggagcgacgcccgcaggagagcgggacgaccagtcacctgatagcgttcccgagagacccagacctgcagatagacgactgtgcctgccttgcgttgacgcctcgccactgccaggaagaacggcatgtcctagcctccaggaggcgacccgcctcatacaagaggagttcgcattcgacggctatcttgataatggtttagaggcactgataatggaaccaggcgagtacatctttgctctcaaagaccttacctttgccacattttgtggggcaatcagtgaaaaattctgtgatctttattgggacgagaagcttctacagaatttgttcaaggtggtcaatggacaggcaagtccaagccccagcactgcggaggaggctggttcacaactagaaggcagccagtcaccgagatcccctagcagtaagagaccgagtttgcaccgactggggaaagaaaaacccgcaatggccaggaccagctccagagctccctgtagcccgacctccgtgtccgatgtcgactccgatgctctaagccgagggaacttcgaggtcggatttaggccacagcgttccgtaaaagctgaacgcgctcagcaacccgaggcgggtgaggaccggcgaccagctgggggtgcatcggatgttgaagcagtgacacgcctggctcggagtaaaggtgtgggccctgccctttcacctggtcctgccggattccaatcatgctctcccggttggtgttcagccttttatgaggcggactgctttggtgccgatgttcataattacgtgaaggaccttgggcgtcaacaggccgatggcgctttgccagacgctcagagtcccgaactggaacagcaattaatgatggaaaagagaaattacagaaagacattgaagttttaccagaagttgttacagaaggaaaaacggaataaaggaagtgacgtaaagactatgctgtccaaactgaaaggacaactggaggagatgaagtccagagtccagtttctgagcttagtcaagaaatacttgcaggtgatgtacgcagagcggtggggcctcgaaccttgcactctgccggtcattgtgaatattgccgctgctccctgcgacacgctggacttttcccctctggacgaatcaagttcacttatcttttacaatgtgaataaacatcctggaggtcgtcagaaagccaggattcttcaggccggaactcccttgggactcatggcctatctgtattcctcagatgcctttctggaaggctacgtccaacagttcctgtatacctttaggtacttctgtaccccccacgactttcttcacttcctcctagatcggattaactcaacgcttaccagggctcatcaggatccaacctcaacttttaccaagatctatagaagaagtctctgtgtgctgcaggcctgggtggaggactgttatgccgtggattttccgaggaatagcggactcctgggcaagctggaagacttcatatcctccaaaatactgcctcttgacgggtccgcaaagcacttacttggcctgctggaggtgggcatggataggcgtgcagaaggcaatccacgtggcacagacttggagaatccaagggaggccgaggaagacgcccgtccatttaacgccttgtgtaagcggctctctgaagacggaatatcccggaagagctttccatggcggctgcccagaggaaacggcctggtgctgccccctcacaaagagaggccttacacaatcgccgcagcgctacctaagccctgcttccttgaggatttctacgggccatgcgccaagactagtgaaaagggcccatatttcctcactgaatatagcacccaccaactcttcagccaattaactctactgcagcaggaactctttcagaaatgccatcctgtgcactttctaaatagccgggctctaggcgttatggataaatccaccgctatccctaaggcatcttcctccgaatctttatctgctaagacctgtagcttgtttctgccaaattatgtccaggacaagtatctccttcagctacttcgaaacgccgatgacgtgagtacttgggtggccgcagaaatcgtaacctcccacactagtaagctccaagtcaatctcttgagcaagtttttgctgattgcgaaatcgtgttacgagcagcgtaacttcgctacggccatgcagattttgtctggactggaacaccttgctgtacgacaaagcccggcatggcgcattctgccagccaaaatcgctgaggtgatggaagagcttaaagctgtcgaagtctttttaaagagcgactctctttgcctcatggaaggcaggcgattccgggcacagccgactctacctagtgcccatctacttgccatgcatattcagcagcttgagacagggggatttaccatgaccaacggtgcccaccgctggtctaaattgcggaacattgctaaggtagtgtcccaggtgcatgcttttcaggagaacccctacacattttcacctgaccctaagcttcaatcctatttgaaacaacgcatagcgagattttccggcgcagatatttcaacattggcagccgactccagagcgaacttccatcaggtttccagcgagaaacacagccgcaaaatccaagacaagttgcgccgaatgaaagctactttccagta

SEQ ID NO: 57081 - DNA, 561 bp, Artificial Sequence
  Description of Artificial Sequence: Synthetic coding sequence
tgagacctgtccaagtcccgagaaaatctttcagccgtcatgctgtataatccgggactatttcccattaaaggcccaatttgcctgcgactagagttcgaacgccagcaaagggaagaactggaaaaacttgagtccaaacgcaaattaatcgaggaaatggaggaaaaacaaaagagcgataaagcagaactcgaacgtatgcagcaggaggtggagacccaaagaaaggagacggaaatcgtgcagcttcagattcgcaaacaggaggaatccctgaaaaggagatccttccacatcgaaaacaagctgaaggatttgctcgccgagaaggagaaattcgaggaggagagactgagggagcagcaggagatagaactccaaaagaagagacaggaagaggagacctttcttagagttcaggaagaactccagaggcttaaggagctcaacaataatgagaaagcagagaagtttcagatattccaggaattggatcagctgcagaaagagaaagacgaacaatacgccaagctcgaactggaaaagaagagactgtag

SEQ ID NO: 57082 - DNA, 2874 bp, Artificial Sequence
  Description of Artificial Sequence: Synthetic coding sequence
atggcagaccccgctgagtgcagtatcaaggtaatgtgtagatttcggcctctgaacgaagccgagattctgcgaggtgacaagttcattcctaagttcaaaggagatgaaacagtcgtgattgggcagggtaaaccctacgtgttcgacagggttctgccccctaataccacccaagagcaggtgtacaatgcctgcgctaaacagatcgtaaaggacgttctagaagggtacaacgggaccattttcgcctatggccaaacttccagtggcaagactcacacaatggagggtaaattgcacgacccccagctcatgggaatcatcccccgaatcgcccatgacatattcgaccacatttacagcatggatgaaaacctcgagttccacatcaaggtgtcttatttcgaaatttacctggacaagatacgagatcttctggatgtgtctaagacgaatctggcagttcatgaggataagaaccgagtgccctatgttaagggctgtactgaaagatttgtaagtagcccagaagaagtgatggacgttatcgacgaaggcaaagccaatcgccacgtggctgtgactaatatgaacgagcactcatcccggagccacagtatctttctgataaatattaagcaggagaatgtggagactgaaaaaaagcttagcggtaaactatatcttgttgatctggcagggtcagagaaagtctccaagaccggcgctgagggtgccgtgttggacgaagctaaaaatattaacaagtccctgagtgctctaggaaatgttattagtgcgctggctgaaggaaccaagactcatgttccttatcgggattctaagatgacccgcatcctgcaggactccttagggggaaattgccgaaccacaatagtgatttgttgttcgccttcggtatttaatgaagcagagacgaaatcgaccctgatgttcggtcagagggccaagaccataaaaaacactgttagcgtcaatctggaattgaccgccgaggagtggaaaaagaagtacgaaaaagaaaaggaaaagaataagactctgaaaaacgtgattcagcacctggagatggaactgaacaggtggcggaatggcgaggccgtgccggaggacgagcaaatatctgccaaagatcaaaagaaccttgagccttgcgataacacacccatcatcgataacattgcgccagtggtcgcgggaatctccaccgaagagaaagagaagtacgatgaggaaatttcctccctgtataggcagctcgatgacaaggacgacgagattaatcagcagtctcagctcgccgaaaagctgaaacagcagatgctggaccaggacgagctacttgcttccactcgccgtgactatgagaagatccaggaggaattgactcggttacagattgagaacgaagcggctaaagatgaggtgaaggaggtcctccaagcactggaagaactcgccgtaaattatgatcagaaaagccaggaagtcgaagataagaccagagcaaacgagcagcttacagacgagctagcccagaaaaccaccacactgaccaccacccagcgggagttgtcccaactgcaggagcttagtaaccatcaaaaaaagcgagctaccgaaatccttaatttacttctaaaggatctaggggaaataggagggataatcgggaccaacgatgtgaaaactcttgctgatgtgaacggggtgattgaagaagagttcaccatggcgaggctttatataagcaaaatgaagagcgaggtcaaaagtctggtgaataggtccaagcagctcgagtccgcacaaatggattcaaaccgtaagatgaacgccagcgaacgagaactggcagcgtgtcagcttttgatatcccagcatgaagctaagataaaatcgttaaccgactacatgcagaatatggagcagaaacgcaggcagcttgaggagtcccaggattctctgagcgaggaattggctaagctgcgcgcacaagaaaaaatgcatgaagtgagtttccaggacaaagagaaagaacacttaacacgcctccaggacgccgaggaaatgaaaaaagctctcgagcagcagatggagtcccatcgggaagcccaccagaagcagctctctaggcttagagacgaaattgaagagaagcagaagattattgacgaaatccgcgatctcaaccaaaaactccagctagaacaagagaaactgtcatctgattacaataagctgaagatcgaagatcaggaaagggagatgaaactcgaaaaattgctactgcttaacgacaagcgcgagcaggctagagaggacctgaagggactggaagaaacggtgagtcgggagttgcaaacgttgcataacctgcggaaactattcgttcaggatctgacgacgagggtgaagaagagtgtggagctggataatgacgatggtggcggtagcgccgctcagaaacagaagatcagttttctggagaataatcttgagcaactaacaaaggtgcataagcagctggttagagataacgccgatctgcggtgcgaactcccaaagctggaaaaaagacttagggccaccgccgagcgagtgaaagcgctggagtctgcactaaaagaggcaaaggagaacgcaatgcgggacaggaaacgataccaacaagaggtggacagaatcaaagaggccgttcgtgctaaaaacatggccagaagagcccattctgcacagattgccaagccaattcgccctggacactacccagcaagttctcccaccgctgtgcacgccattcgtggtggaggaggcagttcttcaaactcaacgcattaccaaaaatag

SEQ ID NO: 57083 - DNA, 2064 bp, Artificial Sequence
  Description of Artificial Sequence: Synthetic coding sequence
atggtggagaatgagaggctgcgacaggagatgcgaagatgcgaggctgaattgcaggaactgagaacaaagccagcaggcccatgccctggatgcgagcattcacaagaatcagcccaattgcgcgataagctatcccagctccagttggaaatggcagaaagtaaggggatgttaagcgaactaaatctcgaagtacagcagaagacagatcgtctagccgaggtcgagctgcgactgaaggattgtttggccgagaaggcccaggaggaggagcgcctgtcccgccgtctcagagactcacatgaaacaatcgccagtctgagagcccagtctccccctgtgaagtacgttatcaaaaccgtggaggtcgaatcttctaagacaaagcaggccctttcagaaagccaggcaaggaaccaacatttgcaggaacaggtggcaatgcagcgtcaggtactcaaagagatggagcagcagctccagagttcccatcagctaacagctaggctgagagcgcagatcgccatgtatgagagcgagctcgagcgggctcacggtcagatgttagaagaaatgcagtcactggaagaagataagaaccgcgcaatcgaggaagcatttgccagagcgcaggtggagatgaaggcagtccacgagaaccttgccggagtacggaccaatctgctgacacttcaaccagcattgcgaacgctgacgaacgactataatggattgaagaggcaggttagggggttccctctgttactgcaggaagccctgcgaagcgtgaaggccgagatcggccaggcgatcgaggaagtgaacagcaacaaccaggaactgctccggaaatacaggcgggaactgcagctgaggaagaagtgtcataacgagctggtgcggttaaagggcaacatacgcgtgattgcacgggtaaggccagtgacgaaggaggacggggaagggccagaggcaacaaacgccgtgaccttcgatgctgacgacgacagtattattcatctgctgcataaaggaaagccggtgagctttgaactggacaaagtgttttcaccgcaggccagccagcaagacgttttccaggaagtgcaggctttggtcacttcatgtatagacgggtttaacgtgtgtatttttgcctatggacagaccggggctggcaaaacatatactatggaaggcacagccgagaatccagggattaatcaacgcgcacttcagctactgttttcagaggtgcaggagaaagccagcgactgggagtacaccatcacagtgagtgccgctgagatttacaatgaggtgctccgggacctactggggaaggaaccacaagagaaacttgaaattagactatgtcccgatggatccggccaactctatgtcccaggcttgacagagtttcaggtccagtcagttgatgacatcaacaaagttttcgagttcggtcatacaaacaggaccactgaatttacaaatctgaatgaacacagttcacggtcccacgctctgctgattgtcaccgtgcggggagtggactgctcaactgggctgcggacaacagggaagttgaatctggtcgaccttgccggttctgagcgtgttgggaagtcaggggctgaggggtctcggctcagggaggcacagcacattaataagtcactgtccgcccttggcgacgtcattgcagctctgcggtccagacaaggccatgtcccatttcgcaacagtaaactgacatatctgctgcaggatagtctgagcggagactccaaaaccctgatggtcgtgcaggtgtctcccgtagagaaaaacacctctgaaaccctgtacagcctcaaattcgccgaaagagtccgcagcgtggaactgggcccaggactccggagagcagagttaggcagctggagctctcaggaacaccttgagtgggaacctgcctgtcagaccccccaaccaagcgcacgggcacatagcgctccttctagtggcactagcagtaggccaggctccattagacggaaattacaaccttctgcctag

SEQ ID NO: 57084 - DNA, 2556 bp, Artificial Sequence
  Description of Artificial Sequence: Synthetic coding sequence
atggctcaggtgctgcacgtaccagccccatttcctgggacacccggtccggctagcccaccagccttccctgctaaggaccctgacccgccatactccgtcgaaacaccctacggctataggctcgatctggactttctgaagtatgtcgacgatattgaaaaggggcatacactgcgaagggtggccgtgcagcgcagacccagactttctagcttgccacgcggtcctggatcctggtggacctcaaccgagagcctgtgttctaatgcctctggcgattcccgacactccgcttactcctactgcggacggggattctacccgcagtacggagcacttgaaacacgaggcggtttcaaccccagggtagaaaggactctcctcgatgcccgtaggagactcgaggaccaagccgctacgccgactggtctcggatcactgacaccgagcgctgctggctcaaccgcgtctctggtgggcgttggactcccacctccgaccccgagatcttccggactcagcacccccgtgccacccagcgctgggcatctggcccatgttagagaacagatggccggagccctccgtaagttgaggcaactggaggaacaggtgaagctgattccggtcctgcaggtcaagttatctgtattgcaggaagaaaaacgccagttgactgttcagctgaagagccagaagtttctggggcatccaacagccggaagaggcagatccgaactgtgcctcgacctgcctgaccccccagaggacccagttgcactggaaacaagatccgtgggtacctgggtccgagagcgcgacttaggcatgcccgacggggaagccgctctcgccgctaaggtggccgttctggaaacccagctcaagaaagctctgcaggagctgcaggcagcccaggcacggcaggcggaccctcagccccaagcctggccgcctcctgattcacctgtgcgggtcgacacagtgcgcgtggtagaggggcctcgggaagtcgaggttgtggcctcgacagctgcaggcgctcctgctcagcgggctcagtctctggagccttatgggacggggctgcgggcattagctatgcccggtaggcccgagtcaccccctgtgtttcgcagccaggaggtagtcgagacaatgtgcccagtacccgctgcagccacatcaaacgtgcatatggtgaaaaaaatcagtattaccgagcggtcttgtgatggggcagccggattacctgaagtgcctgccgaatcttcttcttccccgcctgggtccgaggtagcctcgctgacccagccagagaaatcaactggacgggtgcctacacaggaacccactcaccgcgagcccacacgacaagccgcaagccaagaatcagaggaggccggagggactggaggacctcccgctggtgtgaggagcattatgaagcggaaagaagaagtagcagaccccaccgctcacaggaggtctctgcagtttgtgggggttaatggtgggtacgaatcctcgagtgaagacagctccactgccgagaacatcagcgataatgactctacagaaaatgaagcacccgagccacgggaacgggtcccctctgtggccgaggccccacagttgaggcctgcgggaaccgccgcagctaaaacttccagacaggaatgccagctgtcccgcgaaagccaacacattcccacagccgagggagcttccggatccaacacagaagaagagattaggatggagctgtcacctgatctgataagtgcatgtctggctctggagaaatatctagacaatccaaacgctctgactgaacgggagctgaaggtggcgtatactacagtgctgcaggaatggctgagattggcatgtaggagcgatgcacatccggagctggttcggagacacctcgttaccttccgtgccatgtctgctcggctcctggattatgtggtcaatatcgccgacagcaacgggaatacagctctgcactatagtgttagtcacgctaattttcccgttgttcagcagttactggattcaggagtgtgtaaggtggacaaacagaaccgcgcaggctactcccctataatgctgaccgcgctggccaccctcaagacacaggatgacatcgagactgtgctccaattattccgcttgggaaacattaatgcaaaagcttctcaagctggccagaccgccctcatgctggccgtgagccacggtcgggtggacgtagtgaaggcccttctggcctgcgaggccgatgtcaatgtgcaggacgacgatgggtcaacagctttgatgtgtgcttgtgaacatgggcataaagagatagcgggactcttgctcgccgttccatcatgcgatattagcctgactgatcgggacggctccacagccctgatggtggcactggatgctggtcagtctgagatcgccagtatgttatacagtcgaatgaatatcaaatgcagtttcgccccaatgtctgatgatgaaagcccgacgagttctagtgctgaggaatag

SEQ ID NO: 57085 - DNA, 2580 bp, Artificial Sequence
  Description of Artificial Sequence: Synthetic coding sequence
atggcccaagttctgcacgttcctgcgccttttcccggaactcctggaccggcaagccctccggcattccctgccaaggaccctgacccaccgtactccgtggagacaccatatggctataggcttgatctggactttctgaaatatgtcgacgacattgaaaaaggtcacactttgagacgggtggctgtccagagaagaccccgtctgtcatctcttccaagagggcctggctcatggtggacttccacggaatccctgtgttctaatgcttcaggggattcgcgacatagcgcatactcttattgtggtcggggattttatccccaatacggagccttagagactcgcggagggtttaatccgagagtggagaggactctactcgatgctaggagacgcctcgaggaccaagctgctacccctacagggctgggctctctcaccccatcagcagccggaagcaccgcctcgctcgtgggggtgggtttgccccctcctacccccaggagcagtggcctctctacgcctgttcctccatctgctggccatcttgcccacgtaagagagcagatggccggtgccctgcggaaactccggcaactcgaggagcaggtcaaactgattccagtcctgcaggtcaagctgagtgtgctccaagaagagaagcggcagctgactgtgcaactcaaatctcagaagttcctcggccatcccacagccggaagaggcagatccgagttatgcctggacctgccggaccccccagaagatccagttgcattggaaacccgctccgtgggaacatgggtacgcgaacgcgacttaggcatgcccgacggagaagccgctctggccgcaaaagtggccgtgttagaaacacagctcaaaaaggccctgcaggaacttcaggcagcccaggctaggcaggctgacccacagccgcaggcctggcccccacccgactcgcctgtgcgagtggatacggtgagagtggtggaagggcctcgcgaggtcgaggtagtggccagcaccgctgccggagcccctgcccagagggcacagtcactcgaaccgtatgggaccgggctgcgagctttagccatgcctggtcgaccggagtcgcctcctgtgtttcgatcccaagaagtggttgaaactatgtgccccgttccggctgccgcaacctcaaatgtgcatatggtgaaaaaaatatccattaccgagagatcatgcgatggagctgctggactccccgaggttcccgctgaatctagctcaagcccacctggcagtgaagtggcctccctgacacagccagagaagtctacgggaagagttcctacacaggagccaacccaccgcgagcccacgaggcaggccgcatcacaggagtcagaagaggccggtggcacagcgccacccctgagctcgccccctggaggaccccctgcgggagttcgctctatcatgaagaggaaagaagaggtggcagaccccaccgcccatcgcaggtctctgcagttcgttggcgtgaatggcggatacgagtcatcatccgaagattcctctacagccgaaaacatctctgataacgactctactgaaaatgaagctccagagcctcgcgaaagggtccctagcgttgcagaggcgccacaactccgaccagcaggcactgctgcagctaaaaccagtcggcaagagtgccagctgagtagggaatcccagcacatccccactgccgagggtgccagtggatctaacaccgaggaggagattcgcatggagctgtctccagacctgatctccgcatgtctcgcacttgagaaatatctagacaatcccaacgcgctgaccgagagggagctgaaggtggcctacaccactgtgctgcaggaatggctacggctggcatgccgatcggacgctcacccagagctcgtgcgccgtcatctggtaactttccgcgcaatgtcggcacgtctgctggactacgtcgtcaacattgccgactccaacggcaacactgcactccactacagtgtgtcccatgccaattttccagtagtgcagcagctccttgatagcggcgtgtgtaaggttgataagcagaatagagcaggatactctccaataatgctgaccgctctggcaacactgaaaacacaggatgatattgagaccgtgctgcagctctttcggctaggcaatatcaatgccaaggccagtcaggctgggcagacggcccttatgctggcggtttctcacggacgcgtcgatgtggttaaggcactccttgcatgtgaagccgatgtcaatgtgcaggatgatgatggctctacagccttgatgtgtgcgtgcgagcacggacataaggaaatagcaggactcctcctcgcggtaccgagctgtgatatttctctgactgacagggatggcagcacagccctaatggtcgctctggatgctggacagagcgaaatcgcttcaatgctatactcaagaatgaacatcaagtgtagcttcgcacctatgtctgatgacgaaagtccaacttcgagcagcgctgaggagtag

SEQ ID NO: 57086 - DNA, 2556 bp, Artificial Sequence
  Description of Artificial Sequence: Synthetic coding sequence
atggcccaggtgctgcacgttcctgcccctttcccgggaactcctggcccagctagccccccagcttttccggcaaaagatcccgatcctccttactcggttgagaccccttatggatatcgattggacctggactttctgaagtacgttgatgatatcgaaaagggccataccttgcgtagagtggctgtgcagcggagaccacgtctgtcctcactgcccagaggtccagggtcttggtggacatctactgagtccttatgtagcaacgcctcaggtgacagcagacatagtgcctatagttactgcgggagaggcttttaccctcaatatggcgctctcgagacaaggggtgggtttaatcccagagtggaacgcaccctgctggatgcacgacggaggcttgaagatcaggccgctacacccactggcttgggttccttaacaccatccgctgcaggcagcaccgcctcccttgtaggggtgggactacccccacctactcccagatccagtggcctgtccactcccgtgcctccatctgccggacatttggcccacgtccgggaacagatggctggagctctgcgcaaacttcggcagctggaagaacaggtcaagctgatcccagtcctgcaggtgaagctgtccgtgctccaggaagagaaacgtcaactgacagtccaactaaaatcccaaaagttcctggggcacccaacagcaggcagagggaggagcgagctttgtctcgatttgcctgatccccctgaggatcccgtcgcactcgagactcggtccgtgggaacttgggtgcgggagcgcgatctcgggatgcccgacggcgaggctgctctcgcagcgaaggtggccgtgttggaaacacagctcaagaaagccctgcaggagttgcaagccgctcaggcaagacaagcagaccctcagccccaggcttggccccctcccgatagcccggtgagagtggataccgtcagggtagtagagggcccaagggaggtagaggtggtggcttcgactgcggctggtgcccctgcgcaacgggcacaatcactggaaccatatggtacaggcctgagggctctcgctatgcccggtcgccctgagagtcccccagtgtttcgttcccaggaggtcgttgaaactatgtgccccgtgcctgccgctgcgacctctaacgtccatatggtgaagaaaatcagcattacagagcgttcctgcgacggcgctgcaggtttacctgaagtacctgccgagtcaagcagcagtcctcccggttccgaggttgcttcactgacgcagcccgagaagtctactggcagggtgcctacgcaggagccgacacatagagagccgacccgccaggctgcatcacaggaatccgaggaagccggaggaactgggggtccacctgccggtgtgagatctataatgaaacggaaagaagaggtagccgacccaaccgcccatcgaagaagcttacagtttgtcggagttaacgggggatacgagagtagttccgaagacagcagcacagccgagaacataagcgacaacgactctaccgagaacgaggcacctgagccaagggagcgtgtgccatcagtcgcagaggcacctcagctgcggcctgcgggaacagccgctgccaagacatccaggcaagaatgccagctgagtagagaaagccagcacatcccgacggctgagggggcatctggaagtaatactgaggaggagattcggatggagctgtccccggacttaatcagcgcatgtctggccctggagaaatatctagataacccaaacgcccttacagagcgggaactgaaggttgcttacacaactgtactgcaggagtggctcaggctcgcatgtagatccgatgcccatcctgaactcgtcagaaggcatttggtcacatttagagccatgagtgcgcgattgcttgattatgtagtaaacattgctgacagcaacggcaatacagcactgcactattccgtgtctcatgcgaattttcccgtcgtacagcaattgctggactccggagtgtgtaaggtcgataaacagaaccgtgccggttacagcccaattatgttaacggccctggctacgctcaaaacacaagatgatattgagacagtgttgcaattgttccgccttgggaacattaacgccaaagcgtcacaggcaggtcagactgcattaatgctggctgtaagccacgggcgagtcgacgtcgtgaaggccctgctggcgtgcgaagccgacgtgaacgtccaagatgatgatgggtcaacggccctgatgtgtgcgtgtgaacacggccacaaagagattgcgggattactcctagctgtgccatcttgtgacatctcactgacagacagagacggctctactgccctgatggtggctttggacgcaggacagagcgagatcgcctctatgctctacagccgtatgaacataaagtgcagttttgccccaatgagcgatgatgagtcgcccacttcgagcagcgctgaggaatag

SEQ ID NO: 57087 - DNA, 2466 bp, Artificial Sequence
  Description of Artificial Sequence: Synthetic coding sequence
atggctaagtttgcgctcaatcagaacctccccgatcttgggggaccaaggctgtgccccgttccagcagccggtggggcacgctcccctagttccccgtactcagtggagactccatatgggtttcacctggacctcgactttctgaagtacatcgaagagttagaaagaggtcctgcagcacggagagctcccggacctccgacatcccgtagaccaagagccccacggcctggcctggcaggtgccaggtcccccggtgcctggacgagctctgaaagccttgcttcagatgacggcggtgccccaggaatactgagccagggcgctcccagtggactcttaatgcagcccctttctccaagggctcccgtcagaaatcccagagttgagcacacactgcgggaaacatcaaggagactggagttggctcagactcatgagagagcaccttcacccggtcgtggagttcccagaagccccaggggcagcggcagatcgtccccagctccaaacctcgcgccagcttccccgggacctgcacagctccagttagtccgggaacaaatggctgccgcacttcgcagacttcgcgaattggaggaccaggccagaaccctccctgaactgcaggaacaagtcagagccttaagagccgaaaaggctaggttgctagccggacgggctcaaccagaaccagacggagaagcagaaactcggcctgacaagctggctcagctccggaggctgaccgagcgtctcgccacatctgaacgcggaggaagggctcgcgcttcccctcgtgccgatagtccagatgggctggcagccggaaggagcgaaggggctctgcaggtgttggacggagaagtgggctcgctggacggtacccctcagacaagagaggtcgcagcagaggccgtgcctgaaacgagagaggccggtgcacaagccgtccccgaaacgagagaagccggtgttgaagcagcacccgaaaccgtggaggctgacgcatgggtcactgaggccctgcttggactcccagctgccgctgaacgggagctggaactcctgagagcgagtcttgagcaccagcgtggtgtgagcgaattgctgagggggagactcagagagttagaggaagctcgcgaagccgcagaagaagcagccgcaggcgctcgggctcagctccgggaggccacaactcagaccccttggtcatgcgccgagaaagccgcacaaacggagtcgcctgcagaggcaccatccctcacacaagagtcctctcccggttccatggacggagaccgcgctgtggcccctgcagggatccttaagtctatcatgaagaaacgggacggcactcctggcgctcagccgtcgtctgggcctaagtcacttcagttcgtgggcgtgttgaacggggagtacgagagctcatcaagtgaagacgcatctgattcagacggggatagtgagaacgggggtgcggagcctcccggttccagctcgggatcaggcgacgacagcggcggtggctctgactcgggcacacctggcccaccgtcaggcggtgatatcagagaccccgagccagaggccgaagctgagccccagcaggtggctcaggggcgttgcgaactctcacctcggcttagagaagcatgcgtggccctgcagaggcagcttagtaggccgaggggcgtcgcgtctgatgggggagcagtaagactcgtggcgcaagaatggtttagagtctcaagtcagcggaggtcccaggcagagccagtcgcacgcatgctggagggggttaggcgtctgggcccagagctgttagctcatgtggtaaacctggcagatggaaacggcaacacagcactacattatagcgtgtcacatggcaatcttgctattgcttcccttctcctggacactggcgcttgcgaagttaacaggcaaaatagggccggttattctgccttaatgctcgccgctcttactagcgtgcggcaagaagaagaggacatggccgtagttcaaaggctgttttgtatgggtgatgtgaacgccaaggcatctcaaactggccagaccgccctgatgctcgctatcagtcatggccgacaagacatggttgcaaccttgctggcgtgcggcgctgacgttaacgcccaagacgccgacggagcaacagcgctgatgtgtgccagcgagtatggcagattggatacagtgaggctcttgctgacccaacccggatgcgacccggctatcctggacaacgaggggacctcagccctggccattgcgctggaggctgagcaagacgaggtggcagcattactccatgctcatctgtccagcggccaacctgacactcagagcgagtctccgccaggatctcagactgctactcctggggagggagagtgcggcgacaatggagagaacccgcaggtccaatag

SEQ ID NO: 57088 - DNA, 633 bp, Artificial Sequence
  Description of Artificial Sequence: Synthetic coding sequence
atggctaccgcaaggaccgtagcccctagtcccagagtcgcccctagggcacccggaatgacagctgctggagacccgacacgtgcaccactcgccctccccgctgctggcacctccggaactttaagcccacggcgtagacaatcccttagcaggtggcatagggggggagagcgaaggagcttggtggtctggaggggcggtgggtgtccaccccctgggaggcggtgcccacgctccattctgtctctgagctggccaccactccaggtgcgcgcagagcccgcttctgagggcggtgtcaggagtgccgctgccgcagccgagcccgctcctcgctccagtgatggcggagctgtacggctggtggctcaggaatggtttagagtcagctctcagcgaaggagccaggcagagcccgtcgctagaatgctcgagggggtgcgccgtttggggcctgagcttctggcccacgtagtgaacctggctgacgggaacggcaataccgctctccactattctgtgagccacgggaatctggctattgcttcattactcctcgatactggccaaagccagggcagagtcggtcatcaagaaatgggagggggacggggtcaggggcttacctag

SEQ ID NO: 57089 - DNA, 402 bp, Artificial Sequence
  Description of Artificial Sequence: Synthetic coding sequence
atgattacccctctcgcctcggccgaaacaaacgaggatatggcagtggtttggaagctgcttcgcgaaggaaacgtgaatatccaggccactcagggtggccagacagcgctaatgctcggggtgagtcacgatagggaggacatggtgcaggccctgctaagttgccaggccgacgtcaacctgcaggatcacgatggtagctctgcccttatggttgcttgtcaccacgggaacgtcgacctggtgcgcttgctgctggctcacccagcatgtgactccagccttacggacaaggccggacgtacagccttgagtattgcacttaagagtcccactcatatggaaattgccggtttgttgagagcccacgccgaacagggcagatccctgggcctctag

SEQ ID NO: 57090 - DNA, 1104 bp, Artificial Sequence
  Description of Artificial Sequence: Synthetic coding sequence
atggaaaaaacagacgaaatctccccgagcacctcactgaagagcatcatgaaaaaaaaggattacggttttcgcgcaggtgggaatggtaccaagaaaaaccttcaattcgtaggcgttaatggaggatatgagaccaccagtagtgaggagacatctggcgaggattccaccccagaggatctttcagattctgaggccgagaaaaagtgcgacgggcctgaccacaaacacgtaaaggacgcgcatctgacttgcgaggctggtcagggtattccggagggcacatgccatgccgctcaggaaagcggccctggtgaggaagtgccccacagcaaggccgagcggtacaagccctccgaagagtttctcaatgcttgcagagctctctctcaacacctgccagagacagggactacaacggaccaactgttgagacaaagcctgaacacaattagtcaagagtggttcagagtttccagcagaaaaagttcctccccagccgtggtcgcctcttatctgcacgaagtacaaccccattccccccatttcctcaaactgttagtgaacctggcagaccacaatggaaatactgccttacactatagcgtttcacactccaacttctccattgtcaagcttctgctggagaccggagtatgtaacgtggaccaccagaacaaggcgggatacactgccgttatgatcactccgctcgcatccgctgagaccaatgaggacatggccgtcgtgtggaaacttctcagggagggcaacgtgaacattcaggcgacccaagggggacaaacagcccttatgctgggcgtttctcacgaccgcgaagatatggttcaggccctgctgagctgccaagccgacgtgaaccttcaggatcacgacggaagttctgctctgatggtggcttgccatcacggcaacgtggatctagtcaggcttctgctggcccacccagcctgcgattcttcactcaccgacaaagctggtcgaaccgcactatctatagctctgaaatctcccacacacatggagattgctggtctcctgagggcccacgccgaacagggtagatctctagggctgtag

SEQ ID NO: 57091 - DNA, 1056 bp, Artificial Sequence
  Description of Artificial Sequence: Synthetic coding sequence
atgaagaaaaaagactacggatttagagctgggggaaacgggaccaagaaaaacctgcagtttgtaggagtcaacggaggctatgagacgacttctagtgaagagacgtcaggggaggacagcacacctgaagatctttcagactcagaagcagagaaaaaatgtgatggcccagatcataaacacgtgaaagatgctcaccttacgtgtgaagctgggcaaggcatccctgaaggaacatgccatgctgcccaggaatcaggtcctggagaggaagtgcctcactcaaaggccgagagatacaagccaagcgaagagtttttgaacgcctgcagggcactctctcagcacctgcctgagaccggaactaccacagaccagttgctgaggcagtcgttaaatactatctcccaagagtggtttcgcgtgagtagtcgcaagagcagctcccccgctgtagtcgcctcataccttcacgaggtgcagccccactctccacattttctgaaactgttggtcaatttagcagatcacaatggcaacacggccctgcactattcagtgtcccactccaatttctcgatcgtcaagctgttgctcgaaaccggagtttgtaatgtcgatcatcagaataaggcaggatataccgccgtcatgataacccccttggcctcagcagaaacaaacgaagacatggcggtggtctggaaactactccgggaaggcaatgtcaatattcaggcgacccagggaggccaaaccgccctgatgctcggagtctctcatgatcgagaggacatggtgcaggcactgttgtcttgccaggccgatgtgaacttgcaagatcatgacgggtcatctgcactgatggtggcctgccaccacggaaacgtcgatttagttagactcctattagcccacccagcttgtgattctagccttactgataaggcaggtcgaactgcactgagtattgctctaaagtcgccaacccatatggagattgccggactccttagggcccacgcagaacaggggaggtcactagggctgtag

SEQ ID NO: 57092 - DNA, 2988 bp, Artificial Sequence
  Description of Artificial Sequence: Synthetic coding sequence
atggaaaagacagacgctaaggatcagagttcacagggtgatgaggaaaaagatcctccaaagtcccacccctactctgtggagacaccatatgggttccaccttgacctagacttcttaaagtacgttgatgatatcgagaaggggaacacgatcaaacggatcccaattcatcggcgtgccaagcaggcgaagttctcaacgctgcctcgtaatttctcactccccgactctggggctagacccccagccgctccccctttgcagaactggtctcccgtggttccacgggaagcatccttaggtacccaggaacaaaatcagtcccctccattaggcaatgccccacaggcttccacatctcggagcgaggtctcttaccacaggaaggcacttctggccgaggccacaaggcagttagaggcagcagaacccgaggacgccgagctgacattcggaagcggtcgtccccagctgctaagggccagcagcatgcctgccaccttgctacacagccgggctagcgaggaacccggactcagcttgggcccacccgcaccaccagccttgccccctttgcagggcgagggtagcgtgtgtgacggtaccttcgaaccggcagagggcctggcgggatttcactcctcaagtccgagagccagcacacgaattcccgaactagtgcaggagggcgcagagcctcccgagggagtggtgaaagtgcctaatcatttacccctgccaggacctccgttttcctttcagaatgttctggtggtgctggaagataaagaggacgagcataatgccagggaggccgaggtgttgtttactcctggctcccctaccccatcaccaccaccactgcccagtcccattccagaaaacgagctcctcctggaagagatcgagctcaacatttcagagataccaccccctccgcctgtggaggtggatatgagaagcatcggaatccgagttacagaggaaagcttgggactcgctcgggtggatcccggaagtatttctagtctgaaacagcaagtcagcgcgttggagggagaattaagcgggcgaactgaagaattagctcaggtgcggactgctctgcagcagcaggaggaagaaatcaaagccagagagcagcgaattcgtgagctcgagtttaccgtagcacagctggaagggcagtttcaccaggagaacgcaaaggatacacaggggcaaaccgatgtgatggtcaacaccgaccctgtccacggactgcttactcgcgagtcttgcgataaaggaattgaggtgaacctgctggggagtatggaaagtgagtcctggggacatagaggcgaggagaacgggcttctgtggggacctgatgggcacaagcagggcaatcagtcaccagccgagcgtgtgctgctcccacagttgtctctgcctcaggggcctgagcaggtgcttacctcatccgtccatagcttccttagcactgagcttagaattgaagaggcaggaaccgagcaggagggcggaccacagggagggactcggggagccggtggttttctttggggctctgataggaaaacgcctccggcaggaagggaggagaccagtagcaatctccccggaaaggaacacccaggacgaccccctagcagtcccacagatgccacaattggtcaatatgtgaaaaagatccaggagctgctccaagagcagtggaattgtttggaacacggttacccggagcttgcaagtgcaatcaagcagcccgctagcaagctgagctcaatccaatcacagcttctatcctccttaaatctattactgagtgcctatagtgcccaggcccacccgccaaaggaaccgcctgcaagttcttccagcccacccgtggagatctcaccttcgaccagcctgaagtctatcatgaagaaaaaggattatggcttccgagcgggaggaaatggcactaagaaaaacctgcagtttgtgggggtgaatggtggttatgagactacgtcttccgaagaaactagtggcgaggactcaacacccgaggatctgagcgactctgaggctgaaaaaaagtgtgacggccctgatcacaaacacgtcaaggacgcccacctgacctgtgaggccggtcagggcatacccgaagggacttgtcacgccgcacaggaatccggaccgggtgaagaggtaccccactctaaggctgaaagatacaaaccctccgaggaattcctgaatgcctgtagggcactctctcagcacctgcctgagacaggaacaactaccgatcagctgctgcgtcagtccctgaacacgataagccaggagtggtttcgtgtcagtagccgcaagagctcaagtcctgccgtggttgccagctatttacacgaggtgcagccgcatagtccccacttcttgaagctactggtcaacctggctgaccataacgggaatacagctctgcattacagcgttagccatagcaatttctcgattgtgaagctgctcttggagacaggggtttgtaacgtcgaccatcaaaacaaagctggctatactgccgtgatgatcacaccactggccagcgcagaaacgaatgaggacatggcagtggtatggaaactgctgcgggaaggtaatgtgaatattcaggcaacccagggcggacaaactgccttgatgctcggggtcagtcacgaccgcgaagatatggttcaggctcttctcagctgccaggctgacgtgaatctgcaggaccacgatgggtcctcagctctgatggtggcgtgccaccacgggaacgtagaccttgtaaggctcttgctggcacacccagcttgtgactccagcctcaccgataaggcgggtaggaccgcactttccatcgcacttaagtcccccacccacatggagatcgcaggccttctgcgcgctcacgctgaacaaggtcggtcccttgggctgtag

SEQ ID NO: 57093 - DNA, 387 bp, Artificial Sequence
  Description of Artificial Sequence: Synthetic coding sequence
atgatgaccgctgtgtcacttacaacccgtccacaagagtcagttgcattcgaggatgtcgctgtatacttcacaacaaaagagtgggcgataatggtgcccgctgagagagcgttgtatcgggatgtgatgttagagaactacgaggcggtggccttcgtcgtgcctccaacctccaaaccagcgctcgtcagccatctagagcagggtaaggagagctgcttcacccagcctcagggcgtgctcagtagaaacgactggagagctggatggattggttatctcgaattacggaggtacacctatctagcaaaagccgtgctgcgccgaattgtttcgaaaatttttcgcaacaggcagtgctgggaagatcggaggaaggcctag

SEQ ID NO: 57094 - DNA, 387 bp, Artificial Sequence
  Description of Artificial Sequence: Synthetic coding sequence
atgatgacagcggtttctttgactacccgtccccaggaatctgtggcttttgaggacgtggctgtctactttaccaccaaggagtgggccatcatggtgccagcagaacgcgctttgtatcgggatgttatgctcgagaattacgaggccgtcgcttttgtggtcccgccaactagcaagcctgctctggtcagtcatctggaacaggggaaagaaagctgctttacccaaccccagggcgttctctcaaggaatgattggcgggcaggctggatagggtacctggaattgagaagatacacctatttggctaaagcagtgctccggagaattgtgagtaagattttccggaaccgccagtgctgggaggaccggcgaaaggcgtag

SEQ ID NO: 57095 - DNA, 387 bp, Artificial Sequence
  Description of Artificial Sequence: Synthetic coding sequence
atgatgacagccgtgtccttgactactcgacctcaggagtccgtcgcttttgaggacgtggccgtgtactttaccactaaggaatgggctatcatggtcccagccgagcgggcattgtacagggacgttatgctcgaaaactatgaggctgtggcctttgtggtgccccctaccagtaagcctgcattggtgtctcacctggaacagggaaaagagtcttgctttacacagccgcagggtgtcttgtctcgaaacgattggcgggcaggctggattggatacttggagctgagacggtacacctatctggctaaggcagtgcttagaaggatcgtctcgaaaattttcagaaacaggcaatgttgggaagaccggaggaaagcctag

SEQ ID NO: 57096 - DNA, 3090 bp, Artificial Sequence
  Description of Artificial Sequence: Synthetic coding sequence
atgcgcgagaattacgaaaccctagtatccgtgggtaccgctgaacttctgcctttgagcgcttttctttcaccatcagagcctggcagagcagtgggcggaggatcccacgctgatgaaggccaggagccagccggatgtggcgatcctcaggggggacagccgcgacacagcctccatttgactgctcttgttcagctggtcaaggagatcccggagttcctgttcggcgaagtcaaaggggctatggattcacccgaatctgagtcgaggggtgcatccctggatggcgagcgggcttccccggaggcagcagcagctagagagccatgtccgttgagaggactcctgagctgcttgcccgatggtccgacttcccaaccccacctcgccaccacccccactgactcctcatgcagctccgggccaacgggtgatggagtgcaggggtccccactgcccatcaagactgcggacaagccttggcctaccaggaaggaagggcctggggctctcggaggggaaccttcaccccctacgcatagtccatcaagaagaaagagtcacagaggtcaagagcggggaactagcgaggcgggtattagccctgggaactccccactgcagggacttattaactgcctcaaggaaatcctcgttcccggaccgaggcacccggaaacatcgccaagttttctgccaccccttccctccctcggtacaagtcgcctaacacgcgctgacctggggccagggtctccgccatgggccgtcaaaaccgaggccgtcagcggcgattgtccactgcaaggtttactgcattgcctaaaagaactgcccgaggcgcaggacagacacccatcccctagcggcgtcggtaatcgacgactccaggagaatcctggtgcttggaagagaggctcaggcggacccggttatctgctgactccacctccacatcctgacttaggagctggtgggctcctgagtgtgaagatggagaactcttgggtgcaatcaccgcctggacctgcctcttgtcagcctggcagacagcctttgtctccatctgcgactggagacacgaggggtgttccgcaacctagttggggcccagaagcccaggcagccagtgcgagttcttctcccctggaggcgctggaagcgtgtttaaagggcatcccaccgaacgggtcatctccttcacagctgcctcccacaagttgctctcagaatccccagccaggagattcaagaagccagaaaccagaactgcagcctcatcgtagtcatagcgaggaagccactagagagcccgtcttgccattgggattacagtcatgtgtgagggacgggccatcacgacccctcgctccccgtgggacaccaacatccttcagctcctcctcgagcactgactgggatcttgacttcggatccccagtgggcaatcagggacaacatcctggcaagggcagcccaccgggatcctcgccactgcaggggctcgagaactgcttgaaagaaatcccggtcccagtcttgcgtcccgcatggccgtgctccagcgcagctgacaggggacccaggagggccgaaccacgcaactggacagctgataaggagggcttgcgtgctgaggcatgcgaaagccgcctgggtcagggacgaggcgaggctccaactcggtcactccatctggtgagccctcaggtgttcacctcatcctgcgtgcctgcatgccaccaaagaggcttcaaggatcccggagcgacaagacccggagtttggcgatggcttcctgagggatcagcccctaagccatctcccctgcattgcctggagagtgctctgcgtggaatcctccctgtacgcccactccgcttcgcctgcgtgggaggccctagcccctcgcctagccccggaagttccagcagctttagcggttccgaaggtgaggaccccagacccgaacctgatctctggaaaccactgcctcaagaaagggaccgcctgccaagctgcaaacccccagtgcccctatccccatgccccggaggcacgcccgcaggatctagcggcggatcccccggagaggaccctcgaagaaccgaacccaggtattgttccgggctcggggctggcactgcccaggacccatgccccgtcagccagctagaaaaaaggcctcgcgtgagcgaagcgtctcgtggcctggagctcggtcacggccgacccagggttgccgctaagacacatgaaagactcttgcctcagggccctcccgaactacccagcgaatctcctccccctgagctcccgccacctgaggccgctccaccagttctccctgcaagcagcctccaacctccatgccactgcgggaagccacttcagcaggagttgcacagcttgggggcagcattggcagaaaagctggaccgactggccacggcactcgctggcttggcgcaggaggtggcaacgatgcgaactcaggtgaatcgccttggacgacgacctcaaggcccagggcctatgggccaggcctcgtggatgtggacactccccaggggccctagatgggcgcacggccctggccatagacacctcccttattggaggcagaaaggacccactaggccaaagcctaaaattcttcggggacagggagagagttgccgcgctggggaccttcaggggttatcccggggaaccgcaagacgggctcggccactaccccctgatgcccctcccgcagagccacctggcctacactgttcaagttcccagcagctgctgagctctacccccagctgccacgcagctccccctgctcacccactgcttgcccatactggtggacaccagtcccctctgccgccactcgtccccgctgccttacccctgcagggtgcgtcgccccctgccgctagtgctgacgctgacgtgccaacttccggtgtcgctccagacgggattccagaaaggcctaaggagcccagctctctactcggcggagtgcaacgggctttacaggaggagctgtgggggggtgagcacagagacccacggtggggggcacactag

SEQ ID NO: 57097 - DNA, 2910 bp, Artificial Sequence
  Description of Artificial Sequence: Synthetic coding sequence
atgagggaaaattacgaaacattggttagcgtgggcacagcggagctcctgcccctcagcgccttcctttccccatccgaaccagggagggcagtcggcggtgggagccatgccgacgaggggcaggagcccgctggctgtggggaccctcagggaggacaaccgagacattcgttacacctgaccgccttagtccaacttgtcaaagaaatccccgaatttctgttcggcgaggtgaagggagctatggactcgcccgaatccgaatctcggggtgcctccttggacggcgaaagagccagtcccgaagctgcagccgctcgggaaccgtgtccgctccgcggattactgtcttgccttcccgacgggccaactagccagccacatctagctacaactcctacagattcgtcttgcagcagcggccctaccggagacggtgtgcagggtagtccacttcccataaagaccgctgataaaccatggcctacccggaaggagggccctggcgctctcggtggggagccttcaccccctactcactcacctagtagacgaaaatctcatcggggacaggagcgcggtaccagcgaggccggaatcagcccgggtaattccccactccaaggcctgatcaactgcttgaaagaaatcctcgtaccaggccctaggcatcccgaaacctcccccagttttctgccaccactcccaagcctcgggaccagcagactgacaagggccgatctcggaccagggagccccccatgggctgtaaagaccgaagccgtctctggggattgccctctacagggactgttgcactgtctcaaggagcttcctgaggcccaggaccggcacccgtccccctctggggtgggcaatagaaggctccaagagaaccccggagcttggaaaaggggctcggggggtcctggatatctcctgacccccccacctcaccccgacctaggcgctggtggtctgctctcagtaaagatggaaaacagctgggtgcagagtccacccggtccagctagttgccagcccggacgccagcctctctctccaagcgcgacaggagacacaaggggggtgccccagccctcatggggcccagaggcgcaggccgcttccgcatcatcaagccccttggaggccctcgaagcatgtctgaaaggcattcccccaaacggcagttcaccttcccagttgccacctacatcatgcagccaaaatccgcagccaggggacagccgctcgcagaaacccgagcttcagccccaccgctcccactctgaagaggctacccgggaacccgtgctgccactgggactccaatcgtgtgtccgggatggcccttcccggccactggcacctaggggcactcccacttccttttcaagttcatcctctacggactgggacctcgattttggcagcccggtcggtaaccaggggcagcaccctggcaaggggtcacctcccggttcctcaccacttcagggcctagagaattgccttaaggaaatcccggtgccagttttgcgtccggcatggccttgttcttccgcagccgatagaggtccccgaagagctgagccaagaaactggacagccgataaagaagggtctgctcctaagccaagtccgcttcattgcctggaaagcgccctacgcggtattctccccgtgaggcccttgcggtttgcctgcgtgggcggtccttccccctctccttccccaggctcatcctcctcattcagcggtagtgagggcgaagacccaagacccgaacctgatttatggaaacctttgccacaggagcgcgatagattgccttcctgtaaacctccggttccactatcgccctgtcctggcggaacccctgccggttcgagcggcggatcacccggagaagaccctcggaggactgagccacggtattgttctggacttggtgctggcacggcccaggatccctgtccagtgtctcagctggaaaaacgtcctagagtctcagaagcctccagagggctggagcttggccacggcaggccacgggtggccgcaaagacacacgagaggctacttccccaggggcctcctgaactgccttcagagtcaccccctcctgaactgccgcctcctgaggctgcgcctcctgtccttccggctagcagcctgcaaccaccctgccactgcggaaagcctctgcagcaggagctccactccctcggtgccgcattggccgaaaagctggatcggcttgcaaccgccctagccggacttgcgcaagaggtggctaccatgcgtactcaggttaatcgattgggcaggagaccccagggacccggtcccatgggacaggcctcttggatgtggacactgcctagaggtcccagatgggcacatggccctggacaccgacacctgccttactggcggcagaagggacccacccgccctaagcctaaaatcctgagaggtcagggcgagtcatgcagggccggagatctgcagggtctgagcagaggaactgctagacgggctagaccccttccgccagatgccccacccgctgaacctcccggactccattgctcatctagccagcagttactgtcttccactccgtcctgtcacgcagccccacctgctcatcctctgctggctcacactgggggtcaccaaagcccgctgccacccttagtccccgctgctcttcctctgcagggggcttcccctccggctgcatctgccgatgccgacgtcccaaccagtggagtggcacccgatggtattcccgaaagacctaaagaacctagtagcctgctaggaggagtccagcgtgcactccaagaagagctttggggcggagaacacagagaccctaggtggggcgcacattag

SEQ ID NO: 57098 - DNA, 312 bp, Artificial Sequence
  Description of Artificial Sequence: Synthetic coding sequence
atgcgtgaaaattatgagacacttgtgagtgtgggaacagcagaattgctccctttatcggcttttctgagccctagtgaacctggccgtgctgtggggggagggagccacgctgatgagggccaggaacctgcgggttgcggcgatcctcaggggggacagcccaggcattctctgcacctgacagctctggtccaactggtgaaagagattcctgagttcctgtttggggaggtgaagggcgcaatggactctccagagagcgagagtcgtggcgcatcactggacggggagcgagcatcccccgaatag

SEQ ID NO: 57099 - DNA, 1479 bp, Artificial Sequence
  Description of Artificial Sequence: Synthetic coding sequence
atgccctcatttctggtgccttctctggtgagcagccctgtgctattaaagcttctttttagcccaggtcctaagaccatatggagcttgtggcaacagcccatgttgttccaagaagccacagcatttgaaaacatgaccaaggactggaattatttagagggctcgcagaaagactgctaccgagataccatgcttgatagctacgaaaacacagtcccgcaggggagcttcttacagcttagtatgatgccacaacgagccggaaatgatcctccaggggtgtccaacgcatccgaaatggaaatggaaatctcgaacatgcgggaaaagtttctcatgagtgtcacaaaactagttgagtccaagagctacaatagcaaagtgttctcgaaggagaagtactttcagaccattaaggaggtgaaagaagcgaaagagaaggggaaaaagtcctccagagattatcggagggccgctaagtacgacgtcattagcgtgcagggtacagaaaagctgatcgaggctacacacggggagcgcgaccgcatccggtattacgtgcacaaggaagaactgttcgacatcctgcacgacactcacctttctatcgggcatggcggacgtactcgtatgctcaaggagctgcagggaaaatatggaaacgtgaccaaggaggtgattgtgctttacctgactctctgcaagcaatgccaccaaaaaaaccctgtgccgaaaagaggacttgcgccaaagcccatgacgttcaaggatatcgactccacttgtcaagtggagatactggatatgcaatctagcgcggacggggaattcaagtttatactgtattaccaggaccatagcaccaaatttataatcctaagaccactgcgaactaagcaggcccacgaggtggtgtcagtgctgcttgacatatttacaattctcgggacaccgagcgttctcgactccgactccggagtggagttcacaaaccaggtcgtgcacgagctgaacgagctgtggcctgacctaaagatagtgagtggtaaatatcaccccggtcagagccagggatccctcgaaggggcttctagagacgtaaaaaatatgatatcaacatggatgcagtccaatcacagctgccactgggccaaaggattgaggtttatgcaaatggtccgaaatcaggccttcgacgttagccttcagcagtcccccttcgaggctatgttcgggtataaggcgaagtttggtttgtattcttctaacctcccacgcgaaacagttgccacactgcagaccgaggaggagctcgagattgccgaagagcaactcgagaattctctctggataagacaggaggagcgggcagaaataggggcagataggtctgacatggatgacgatatggatcccacgcctgaggcgagcgaaccatctacgagccagggcacatccggactgttgtgttggtag

SEQ ID NO: 57100 - DNA, 1233 bp, Artificial Sequence
  Description of Artificial Sequence: Synthetic coding sequence
atgatgccgcaacgagctgggaatgatccaccgggagtttctaatgcctcagagatggagatggagatatcaaacatgagagaaaaattcttgatgagcgttacaaagctcgtcgaatctaaatcttacaatagcaaagtgtttagcaaagaaaaatactttcaaactatcaaagaagtcaaggaggccaaggagaagggaaagaaaagttcccgagattatagaagagcagctaaatatgatgtgatcagcgtccagggtactgagaagctcattgaagccacccacggagagcgagatagaatcaggtactatgtccataaggaggagttgttcgatattcttcatgacacacatttgtcaatcggccacggcggacgcacaagaatgctgaaagaactacaaggcaaatatggcaatgttactaaagaagtcatcgtgctctaccttacactgtgtaagcagtgccaccagaaaaaccccgttccgaagaggggacttgccccaaagcccatgacatttaaagacatagatagtacatgtcaagtggagatcctcgacatgcaatcatctgccgacggtgaattcaagtttatcctatattatcaagatcacagtacaaaatttattatcctgagacctttgagaacaaagcaggcacatgaggtggtaagtgttctcctcgatattttcacaattctggggacccccagtgtattagacagcgatagcggggtggaattcacaaatcaggtggtccacgagcttaacgagctgtggcctgacctgaaaatcgtgtcaggtaaatatcatccaggacaatcacaagggagcttagagggcgcttcgcgagatgtgaagaacatgatctccacttggatgcaatcaaatcacagctgccactgggccaagggcttgaggttcatgcagatggtgcgcaaccaggcattcgatgtaagcttgcagcagagcccgtttgaggcgatgttcgggtataaggctaaattcgggctttactcctcaaacctccccagagagacggtcgctacgctccaaactgaagaggagctcgaaatcgccgaggaacagcttgagaattccctgtggatcagacaggaggaaagggccgagataggggcagatcggagcgacatggacgacgacatggacccaacccccgaggctagtgagccatccacaagccaggggacatccggacttctgtgctggtag

SEQ ID NO: 57101 - DNA, 2130 bp, Artificial Sequence
  Description of Artificial Sequence: Synthetic coding sequence
atgggtcataggacagcgatgcctgaacctcgtggatcctcacagttacgagtgaatgccgcattcgccgctcggtataatcggtatagggagcgtgaggaactgcagaggctaaaggatagatatggagacagagatagtagtagtgatagttcaagtgaaagcgactctagtgacgaacgcgtggaatttgatccacaacaggaaagagacttctacaagacgctaagcctgttgaagaagaaagaccctagaatctaccagaaggatgccacattttacaataggacggcctcaagcagtgacagtgaagaggatccagaagccctcgaaaagcagaaaaaagtgaggcccatgtatctcaaggattacgagaggaaggttatcctggagaaagccggaaaatacgttgacgaggagaactcagacggcgagacgtcaaaccatagactgcaggagactagcagtcagtcctacgtcgaggagcagaaacagttaaaggagtcttttagggcgtttgtagaggacagtgaagatgaagacggtgcaggtgaggggggaagtagtctgttacaaaaacgtgctaagacacggcaggagaaggcccaggaggaggccgattacatcgagtggcttaagggccagaaagagatccgaaacccagattctttgaaagaactgacccacctgaaggaatattggaatgatcctgagctggatgagggtgagagattcctacgcgactacatcttaaacaaaagatacgaagaggaggaagaagaggaagaagatgaggaggagatggaggaagaggaaggcgtgcacggccctccagtgcagctggctgtcgacgatagctcagatgaaggtgagctttttctcaaaaaacaggaggacttcgagcaaaagtacaactttcgttttgaggagccggatagtgcttcagtaaaaacttatccacgtagtattgcttcctctgtgcgcagaaaggacgagcggagaaaagagaagagggaagaaacaagagagcgcaagaaacgggaaaaagctaagaaacaggaggaactgaaacagctcaagaatctgaaacgtaaggaaattctggctaagctcgaaaaacttagaaaggtgactggcaatgagatgctcgggctggaggaaggtgatctcgaggatgacttcgacccagcccaacacgatcagctcatgcagaaatgttttggagatgaatactacggtgccgtagaggaagaaaagccacagtttgaggaggaagaagggctggaagacgactggaattgggatacctgggacgggcctgaacaggagggcgactggtctcagcaggaactccactgcgaggaccccaacttcaacatggacgcggactacgatccatcacagcctcgtaaaaagaagcgggaagctccccttacaggaaaaaagaaacgcaagtccccgttcgcagctgctgtgggacaggagaaacccgtgtttgagcctggagacaagacatttgaagagtatctggacgaatactatcggttagactacgaggatattattgatgacctaccatgccggtttaagtaccggactgtcgtgccatgcgacttcggcctctctactgaggagattctggcagctgatgataaagaacttaacaggtggtgcagcctcaagaagacctgcatgtatagatctgaacaggaggagttacgagacaaacgcgcatactcacaaaaggctcagaactcttggaagaagcgccaggtcttcaaatcactttgtagagaggaggccgagacgccagccgaagctacgggaaagccgcagagagatgaggctggccctcagagacagctcccggcactggatggatctctgatgggacccgaaagcccaccagcccaagaagaggaggcaccagtgtctccacataagaagcctgccccacagaagcggagacgagcaaagaaggctcggctgctgggcccaacggtcatgcttggcggttgtgaattttctagacaacgcctccaggcgtttggcctgaatcctaagcgtttacacttccgacagctcgggcgacagcggcgtaagcaacagggacctaagaatagttcttag

SEQ ID NO: 57102 - DNA, 1749 bp, Artificial Sequence
  Description of Artificial Sequence: Synthetic coding sequence
atggggcataggacggctatgcccgaacctcgaggatcttctcagctgcgggtgaatgcggcatttgccgctaggtacaaccgctatagggagagggaggagctgcagcgattaaaggacaggtacggagatcgagactcctcaagcgattcttcatctgaaagtgactcttcagacgagagagtcgaattcgaccctcagcaggagagggatttctataaaacattatcattattaaagaaaaaggaccctaggatctaccagaaggacgccactttttacaatcgcacggcctctagttcggactctgaagaggaccctgaggcgcttgagaagcagaaaaaggtacgccctatgtaccttaaagactacgagagaaaagtgattttagaaaaagcaggcaagtatgtcgacgaagagaactccgacggtgaaacctctaaccaccgcctacaggagacctcttcccaatcttacgtcgaagaacaaaagcagctcaaagagtcattccgggctttcgtggaggatagcgaggatgaggacggtgccggagaggggggttcatctttgttgcagaaaagagctaaaacccgccaggaaaaggcacaggaggaagccgattatatcgagtggctgaaaggccaaaaggagatccgcaacccggacagccttaaagaactcacccacctgaaggagtattggaatgatcccgagttagatgaaggagagagatttttacgcgactatatcctgaataagaggtatgaggaagaggaggaggaggaggaagacgaggaagagatggaggaggaagaaggagtgcacggtccacccgttcaactcgctgtagacgatagttctgacgagggagagctgtttctcaaaaaacaagaggatttcgagcaaaaatataattttcggttcgaggagcccgatagcgcaagtgttaaaacataccctcgatcaatagcatcttcagtcaggcggaaagacgaacggaggaaagagaagcgagaagagacaagggagcgcaagaaacgggagaaggccaaaaagcaagaggagctgaaacagctcaagaacctgaagagaaaagagattttggcaaaactggagaaactccggaaggtaactggcaatgagatgcttgggctggaagagggcgatcttgaagatgatttcgaccccgctcagcacgatcagctgatgcagaagtgtttcggagatgaatattacggagctgtcgaggaggaaaagcctcagtttgaggaggaagagggattggaggatgactggaactgggacacttgggatgggcctgagcaagagggcgactggtcacaacaagaacttcactgcgaggacccaaatttcaacatggatgctgattacgacccatctcagccacgcaagaaaaagagagaggccccattaaccggcaagaagaagagaaaatccccctttgcagctgctgtgggacaggagaagcctgtgtttgagcctggagaggcccaggttgggcgaccatgggtcggaagaggacacaggggcgcatggcactcaccggcagcgtggttatgcctggagcagggcaccagacggagtagatcaacctggatgtccatcacaggctggaccactcgaacctcctccaccacttgtcctgtcgcgagctctaccgctcagtggtgccccgtcactctcgcgagtgcactgcggcgtagctccctgctaacaataaggtcctag

SEQ ID NO: 57103 - DNA, 1065 bp, Artificial Sequence
  Description of Artificial Sequence: Synthetic coding sequence
atgcccctggtcgtgttttgcggactaccatatagcggaaaaagtaggagggccgaagaactccgggtcgcccttgccgctgaaggtcgggctgtgtacgtggtcgatgacgccgctgtactgggcgcagaggaccccgcagtctatggcgactccgcccgtgagaaagcgcttagaggcgcactcagggcatcagttgagcgaaggctgtctcggcacgacgtcgtgattctggactccttaaactatataaagggcttcaggtatgaactgtactgtctggcacgtgctgctaggactccattgtgtctggtctattgtgtgaggcctggcggacccattgcgggaccacaagtggcaggcgcaaatgaaaatcccggtcgtaatgtctcggtgtcatggcgccctcgggctgaggaggacggccgagcccaggcagccggatcgagtgtcctgcgtgaactccacacggcagattctgtggtcaatggttctgcccaggctgacgtgccaaaggagttggagagagaggaaagtggagccgcagagtccccagccctagttacccctgatagtgagaaaagtgccaaacacggatctggggcattttatagccccgagctattagaggccctgaccctgagattcgaggcacccgactcacgaaatcggtgggaccggccattgtttactctcgtcgggttggaggagccactgcccctggccggaatcaggtctgccttgttcgaaaatcgtgctccccctcctcatcagtctacccagagccagccgctcgccagtggatcctttctgcatcagctagaccaagtcacaagtcaggtactggctggccttatggaagcccagaagtctgctgtgcctggcgatctgctgactctgcccggtaccacagaacatctccggttcaccagaccccttactatggcggagctgagtcgcctgcggaggcaatttatcagttatacaaaaatgcaccccaataacgagaacctgccccagctagctaatatgtttctccaatacctatctcaaagccttcattag

SEQ ID NO: 57104 - DNA, 162 bp, Artificial Sequence
  Description of Artificial Sequence: Synthetic coding sequence
atggaggcagcgggaggctttcaagtgcattttcacccaagcaatggcgatggtcgatttattgaaacgagcagcgctgccgatctcgaagtcatttcctattcctccaaggtctcagtcactgagaggtgctttattaaagtgtgcacagtgctgttctag

SEQ ID NO: 57105 - DNA, 162 bp, Artificial Sequence
  Description of Artificial Sequence: Synthetic coding sequence
atggaggcagcgggaggctttcaggtgcattttcacccctccaacggagacggacggtttattgaaacctcctccgcagccgatctggaggttataagttatagcagcaaagtcagcgtgaccgagcggtgcttcattaaagtgtgcacagtactcttttag

SEQ ID NO: 57106 - DNA, 1041 bp, Artificial Sequence
  Description of Artificial Sequence: Synthetic coding sequence
atggacatgctggaccccggattggaccctgccgctagcgccactgcggcagccgcagcaagccatgataagggaccggaggctgaagagggggtggagttgcaggagggcggagacgggcctggggctgaggagcagacggccgtcgccattaccagcgtccagcaagctgcatttggggatcataatatccaataccaattccgcacagaaaccaacggcggtcaggtgacttatagagtggttcaagttaccgacggtcagttagacggccagggagacaccgctggcgcagtgtccgtggtgtccactgcagcgttcgccggagggcagcaagccgtgacacaagtcggggtcgacggcgcagctcagcggccaggacccgctgccgcttccgtgccccctggtccggctgccccatttccgctggctgttattcagaatccgttttccaatggaggtagccctgcagctgaggccgtatcaggcgaggccagatttgcgtattttcctgcctcatccgtgggtgatacaaccgccgttagcgtgcagaccaccgaccagagccttcaggcgggaggtcagttttacgtgatgatgaccccacaagatgtccttcagaccggcacacagcgaaccatcgcgcctagaactcatccttacagtcctaagatcgatggtacccgcactccaagggatgagagacgccgagcccaacacaatgaggtggagaggcggaggcgggataagatcaacaactggattgtgcagctgagcaaaatcatccctgattgcaacgccgacaactcaaagacaggcgcaagcaaaggaggaatcctgagcaaggcatgcgattacattagagaactgcggcagaccaatcagcgaatgcaagaaacatttaaagaagccgagcgactgcagatggataatgaattgctgcgacagcagattgaggagttaaagaacgagaacgccctcctgagggctcagcttcagcagcacaatctggaaatggtaggcgagggcactcggcagtag

SEQ ID NO: 57107 - DNA, 531 bp, Artificial Sequence
  Description of Artificial Sequence: Synthetic coding sequence
atggacctacccgactctgcatcacgggtgttctgcggacgcattctgtccatggtgaacactgatgacgtcaatgccatcatccttgctcagaagaatatgcttgaccgattcgaaaagaccaatgagatgctgctaaacttcaataatctgtctagtgcacgcctgcagcagatgagtgaacgcttcctgcaccatacaaggactctggtggaaatgaagagagacctggattccatcttccgtcgcatcaggaccctgaagggtaagctggcaagacagcacccagaggcattttcccacattcccgaggcctcctttctcgaagaggaggatgaagaccccataccgccatccaccacaaccaccattgcaacctcggaacagagcaccggatcctgtgacactagtccggacaccgttagccccagtctgtcccctgggttcgaagacctgagccacgttcagccgggttctccagcaatcaacgggagaagccagactgatgacgaggagatgacgggcgaatag

SEQ ID NO: 57108 - DNA, 531 bp, Artificial Sequence
  Description of Artificial Sequence: Synthetic coding sequence
atggatctgcctgattccgcaagccgagtgttttgtggaaggatcctctccatggttaacaccgacgacgtaaatgcaattatcctggctcaaaagaatatgttagatcgcttcgaaaaaacgaacgagatgttgctcaactttaataatctgagctccgcccgactgcagcagatgagtgagcggttcttgcatcatacaagaacactcgtcgagatgaaaagagatcttgatagcatttttcgccgtatccgaacacttaaggggaaattggccaggcagcatccagaggcattctctcacattcctgaagcatctttcttggaggaggaggatgaagatccgataccaccgtctacaaccacaacaatcgccacgagcgaacagagtacaggcagttgtgatacttcccccgacactgtctcaccctctctgtccccaggctttgaagacttatcccacgttcagccaggctcgcccgcaattaatggacggagtcagaccgacgatgaagagatgacaggtgaatag

SEQ ID NO: 57109 - DNA, 432 bp, Artificial Sequence
  Description of Artificial Sequence: Synthetic coding sequence
atgagggatgcagatgctgacgccggaggcggtgctgacggcggagacggacgcggtgggcatagttgcaggggcggtgtcgataccgctgccgctcccgctggtggagccccaccagcacacgcccctgggccagggagggatgccgctagtgccgctcggggatctaggatgcggccacacatctttaccctcagcgtcccttttcccacccccctggaagcagaaattgcccatggctctttggctccagacgcagaaccccatcaaagggtagtcggtaaggatctgactgtatccggacgcattctcgtggttcgttggaaggccgaagactgtcggctgctgaggattagtgtgatcaatttccttgatcagctgtcgttggtggtgaggacgatgcagcgcttcggcccacccgtctcaagatag

SEQ ID NO: 57110 - DNA, 3747 bp, Artificial Sequence
  Description of Artificial Sequence: Synthetic coding sequence
atggtggtagcattgcgctatgtgtggcctctgttactctgctcgccttgcctgctgattcaaatccccgaagaactgatggaacccccagttattactgagcaaagtcctcgcaggttagtagtctttccaaccgacgacatctccctgaaatgtgaagcttccggtaagcctgaagttcagttcagatggacaagggacggagtccacttcaagcccaaggaagagctcggcgtaacagtgtaccagtcaccgcacagcggctccttcaccataaccggcaataacagtaatttcgcacaacggtttcaggggatctaccgctgttttgcgtcgaacaaattaggtactgcaatgtctcatgaaattcggctcatggccgagggcgcacccaagtggccaaaggaaacagtgaaacctgttgaagtggaagagggcgaaagtgtcgtactgccatgcaatcccccaccgtcggcagagcctctgcggatttactggatgaatagcaagatcttgcatattaaacaagatgagcgtgtgacaatgggacagaacggtaacctgtacttcgctaatgttctgaccagcgacaaccattcagattacatctgccatgcccactttccagggactcggaccattatccagaaagagccaatagacctgcgcgtgaaggccactaattccatgattgatagaaagcctcggcttctgttccctacaaactccagcagtcatcttgttgctctccaagggcagccccttgtactggagtgtattgcggaagggtttcctactccgaccataaaatggctgcgcccaagtggacccatgccggctgatagagtaacgtatcaaaatcacaataagacactacagttattgaaagtcggggaagaggacgacggtgaatacagatgccttgccgagaacagtctggggtctgcgagacacgcgtattacgtgaccgtcgaagccgcaccatattggttgcacaagccccagagccacttatatggtcctggcgaaactgccagactggactgtcaggtgcagggtcggccacagccagaggtgacatggcggatcaacgggattccagtggaagaactggcgaaggatcagaaatatcggattcagcgcggtgctcttatactgtcaaacgtccagcccagcgacactatggtcacacagtgcgaggcccgtaaccggcacgggctgctgttggccaatgcttatatatatgttgtccagctgcccgcaaagatactaacagccgataaccagacttacatggccgtgcaaggctccacagcataccttctctgcaaggcctttggtgctcccgttccgtctgtacagtggcttgacgaggatgggactaccgtgttacaggatgagcgcttctttccatatgccaacggcacccttggcatacgggacttgcaagccaatgatacgggacgatacttctgcctcgcagcgaacgatcagaacaatgtaacaatcatggcaaacctgaaagtgaaggacgccactcagatcacccagggacctcggagtacgattgagaaaaagggttcaagagttacgtttacctgccaggcgagttttgatccgtccctgcagccctccatcacttggcgcggagatggccgtgacctacaagaactgggcgattcagacaagtacttcattgaagacggacgcctggtgatacacagcttagactatagcgaccaaggtaactactcttgcgtggccagcacagagctcgacgtggtcgaatcaagagctcaactgcttgtagtcggaagccctggacccgtgcctagattagttctgagcgaccttcacttgttaacgcagagccaggtgagagttagttggtctcccgcagaagaccacaatgcccctatcgaaaagtatgacatcgaatttgaggacaaagaaatggctcccgagaaatggtattcactcgggaaagtgccgggaaatcagacctcaacaaccctcaagctgtcaccttacgttcactataccttccgggttacagcaattaataaatatggcccaggtgaaccatctcctgtgtcagaaacagtcgtgacgcccgaagctgcaccagaaaagaatccggttgacgtgaaaggggaaggcaacgagactactaatatggttatcacctggaagccacttagatggatggactggaatgcccctcaggtccagtacagagtgcagtggcgtccccagggcaccagagggccatggcaggaacagattgtgtcagacccattcctggtcgtatcaaacactagcacctttgtgccatacgaaataaaggtgcaggccgttaattcgcaggggaaaggacccgagccgcaggtgaccatcggatatagtggtgaagactacccccaggccatccctgaactagaggggattgagattctgaactctagcgctgttttagtgaagtggcggcctgtcgacctggcccaggtcaagggccacctccgaggatataacgtcacatattggcgggagggcagccagcggaaacattcgaaacgccatatccataaggaccatgtggtcgttccggcaaacacaacctcagtgatattgtctggtctacggccttactcatcgtaccacctggaggttcaggcctttaatggcagggggtcggggccagcttctgagtttaccttttctactccagaaggggttcctggccacccagaggctcttcatctggaatgtcagtccaataccagcttgcttctgaggtggcagccgcctctgtctcacaatggagtgttgactgggtacgtgctcagctaccacccactcgacgagggtgggaaggggcagctaagttttaatctgcgcgacccagaactaaggactcataacctcaccgacttgagtccgcacctgcgctacaggtttcagttgcaggccactaccaaggaagggccaggggaagccatagtcagggaggggggaacaatggccttaagcgggatatcggacttcggcaatattagcgctacggcgggagaaaactactccgttgtatcctgggtcccaaaggagggtcagtgtaattttcggttccacatcctctttaaagccctgggcgaggaaaaaggcggagcttccttgtcaccacagtacgtgtcttacaaccagtccagttacacccagtgggacctccagccagatacagattatgaaatccacttatttaaggaaaggatgttcaggcatcagatggcggttaaaacgaatggcaccgggagggtgcgccttccgcctgctggattcgcgaccgagggatggttcattgggttcgtatcagccattatactcttgctgctggtgcttctgattctctgtttcatcaagagaagcaagggaggtaagtattctgtcaaggataaagaagatactcaggtcgattcagaagcgaggcctatgaaagacgagacttttggggagtatagtgataacgaagaaaaggcattcggctcgtcacagccaagcctgaacggggacatcaaaccactcggttccgatgactctctggccgattatgggggatctgtggatgtccagtttaacgaagatggatcgtttatcgggcagtactccggcaaaaaagagaaagaggctgcagggggtaacgacagctctggagccacgagtcctattaacccagcagtcgccctggaatag

SEQ ID NO: 57111 - DNA, 3774 bp, Artificial Sequence
  Description of Artificial Sequence: Synthetic coding sequence
atggtggttgcgttaagatacgtgtggcctctactattatgttctccttgtcttctgatacagatccctgaagaatatgagggccatcacgttatggaaccgccagtgatcacagaacagtcaccaaggagactggttgtattccccactgacgacatttccctcaaatgcgaggctagcggaaagccagaggtccagtttcgatggacccgcgacggagtccacttcaagccaaaggaagaactcggggtcaccgtgtaccagtcaccacatagcggttcatttaccattacaggaaataattctaacttcgcccagcgattccagggaatctaccggtgctttgcgtcaaataagctgggaactgccatgagtcacgaaatcaggctaatggccgaaggtgcacccaaatggcccaaggagacagtcaaacctgtcgaggtggaagaaggggagtccgtcgtccttccatgcaatcccccaccatcagccgaacctctgagaatctactggatgaactctaaaatcctgcatattaagcaggacgaaagagtgacaatgggacagaacggcaacttgtatttcgccaatgtcttgaccagcgataaccacagcgactacatttgccacgcccacttcccagggacccggaccataattcagaaagagccaatcgatcttagggtaaaagccaccaacagtatgatcgatcgcaagccccgactcctcttccccaccaacagttcctcccatctagtggccctccaagggcagcccttggtgctggaatgtatcgccgaggggttccccacaccaaccattaagtggctgagaccctccggacctatgcctgccgacagggtcacttaccagaatcataataagaccttacagctactgaaggttggagaggaggacgacggtgaatacaggtgtctggccgagaactccctgggatccgccagacacgcgtactatgtaaccgttgaggcggcaccttactggctgcacaagccacagtcccacctctacgggcctggggaaaccgcacgactcgattgccaggttcaagggagaccgcagccggaagtgacatggcgaattaacggaattccagtcgaggaactggctaaggaccagaagtacaggattcagcgaggggctctcatattgtctaacgttcagccgagcgacactatggtgacgcagtgtgaagccagaaaccgacatgggctcctgttggctaacgcctacatttatgtggtgcagctccccgcaaaaatcttgacagccgacaatcagacatacatggcagtccaaggctccacagcatacctgttatgtaaggcttttggcgctcccgtgccctcagtccagtggctggatgaagacggtaccaccgtgctgcaagatgaacgcttcttcccttacgctaatggtaccttaggaatacgagatcttcaagctaacgatacaggtcggtacttttgcctggccgcaaacgatcagaataatgtgacaattatggcgaacttaaaggtgaaggacgctacccagatcacccagggccctcggtcaactattgagaaaaaaggctcacgggtgaccttcacatgtcaggcttcgtttgacccatctctccagccaagtatcacgtggcgtggagacggaagggatctgcaggaactgggtgactccgataagtactttatcgaggacggcagactggtcattcattcgttggactactccgaccaagggaactactcatgtgtcgcaagcaccgaactggatgtcgtagaaagtcgcgctcagctgttagtggtgggaagccctgggcctgtcccacgcctcgtgctgagcgacctccacctgcttacccagtcccaggtacgcgtcagctggagcccagccgaggaccacaacgcgccaatagagaaatacgatatcgagttcgaagacaaggagatggcccctgaaaaatggtactcactagggaaagtacccggaaaccagaccagcactactttaaagctctccccttacgttcactacacattccgagtcactgccattaataaatacggccctggggaaccaagccctgttagcgagaccgtggtgacaccggaagcagctcccgaaaaaaaccccgtcgatgtgaagggggagggcaatgagaccacaaatatggttatcacctggaaacctttacgttggatggactggaatgccccacaggtgcagtaccgcgtccagtggcgcccacagggcacgaggggcccatggcaggagcagatcgtttctgatccttttttagtagtttccaacacctcgacattcgttccttacgagattaaggtccaggcagttaatagccaagggaagggacctgagccacaagttaccattggttattcaggggaggattaccctcaggccatacccgagctggaaggcatagagatcttgaattctagtgctgtgctggtgaaatggagaccggtagacctggcccaggtgaagggacacctgcggggttacaatgttacgtactggcgcgaggggtctcaaagaaagcactctaagcgacacattcataaggaccatgtcgtcgtacccgctaatactacctccgtgatcctgagcgggcttagaccgtattcttcataccatcttgaggtgcaggcattcaacggacgaggaagtggaccggctagcgaattcactttctcaactcccgaaggcgtcccagggcatcctgaggctctccatctcgagtgccagagtaacacgtctcttctgctacgctggcagccccctctctctcataacggcgtgctgaccggatacgtgcttagctatcatcctctcgacgaggggggtaagggacagctctcattcaacctccgcgaccccgagcttcggacccacaatttgacagacctttccccacacctgcgataccgcttccagctgcaggcgaccacaaaggagggtcccggagaagccatcgtgagggaaggcggaactatggccctaagcggcatatcagacttcgggaacatttccgctactgctggggaaaactactctgtcgtctcatgggtgcccaaagaagggcagtgcaacttccggttccatatcctttttaaagccctgggggaggagaaaggaggcgctagcctgagccctcagtacgtgtcctacaatcagtcgagctacacccagtgggatctccaacctgataccgactacgagatccatctatttaaagaaaggatgttcagacaccagatggcagtgaagactaacggcactgggcgtgtcaggctgccgcctgccggtttcgccaccgaggggtggtttattggctttgtgagtgctattattttgctcttgcttgtgctcctgatactttgcttcattaaacggtcaaagggcggaaagtattcagtgaaagacaaggaagacacccaggtcgatagcgaagcacggccaatgaaggacgagacgttcggagaatatcggagcctggagagtgacaacgaggagaaggcctttggctcctctcaaccgtctctcaatggcgacattaagccattaggctctgatgacagcctggccgactacggcggtagcgtcgacgttcagtttaacgaggacggctcgttcatagggcagtattccggaaagaaagagaaggaagctgcaggaggaaatgatagctcaggagctacttctcctattaaccccgctgtggctctggagtag

SEQ ID NO: 57112 - DNA, 1338 bp, Artificial Sequence
  Description of Artificial Sequence: Synthetic coding sequence
atgttgctgttcgtggagcaggtggcctcaaaggggacgggcctgaaccccaacgccaaggtctggcaggaaatcgccccaggcaacacagacgccacccctgtgacccacggcactgagtcctcatggcacgaaattgccgctaccagcggcgctcatcctgaagggaatgccgagctgagtgaagacatctgcaaagagtacgaggtgatgtattcgtctagttgcgagaccacaagaaatacaaccgggatagaggagagcactgatggtatgattcttggcccagaggacctgtcttatcagatatacgacgttagtggtgaatccaactccgccgtctccaccgaagacctgaaagagtgtctgaagaagcagctagagttttgcttctcaagggagaacctgtccaaggacctgtatctgatcagtcagatggactctgatcagttcattccgatttggaccgttgcaaatatggaggagatcaagaagctgactactgaccccgacctgatcctggaagtcctccgtagcagccctatggtccaggtggatgaaaagggcgagaaggtcaggccttcccacaagcgatgtatcgttatacttcgggaaatccccgagaccactcctatcgaagaggtgaagggattgttcaaatccgagaactgtccaaaagtaatctcatgcgagttcgcccataattcaaactggtacataacatttcagagcgatactgacgcccaacaagcattcaagtatctgagagaggaggtcaaaacctttcagggaaagcctatcatggcacgcataaaagccatcaacacatttttcgcgaaaaacggatacaggctgatggactcttcaatctactcgcaccccatccagacccaagctcagtatgcctcccctgtgttcatgcagcccgtttacaacccccatcagcaatatagcgtgtattcgattgtgccacagtcctggtcgccaaaccccacaccatatttcgaaacccccctggcgccattccctaatggttccttcgttaacggctttaactctccaggcagctacaagactaatgctgctgcgatgaatatgggacgacctttccaaaagaatcgagtcaagccacagttccggagctctgggggatccgaacacagtactgaaggtagcgtgtctcttggcgacggccaattgaaccgctacagctcccggaattttccggctgagcgacacaacccaacagtgaccggacatcaggaacagacatatttgcagaaggagactagcaccttacaggtggagcagaacggagattatggtcgaggtaggtag

SEQ ID NO: 57113 - DNA, 2568 bp, Artificial Sequence
  Description of Artificial Sequence: Synthetic coding sequence
atggagaattggcctactccttccgaactggttaacaccggctttcagtctgtcttgtcccaggggaacaagaaaccccagaacaggaaggagaaagaggaaaaagtggagaagagatcgaactccgactcaaaagagaaccgggagacaaaactcaacggaccaggggagaacgtatctgaggacgaagctcagtcctctaatcaacgtaagcggggttggaaaagggaccgcgagaagagggacgaccaggatgacgtgtcaagtgttcgatcagagggagggaacattaggggcagtttcaggggcagaggcaggggcagggggcgtggtcgcggtaggggtcgtggaaacccacggctaaatttcgactatagctatggctatcaggagcacggggaaaggaccgaccaaccatttcagacagagctgaatacctctatgatgtattactacgacgacggcacgggcgtgcaggtctatccggttgaagaagccctcctgaaggagtacatcaaacgccaaatcgagtactacttctctgttgaaaacctagagagggacttctttctccggggaaagatggatgagcaaggtttcctgccaatttccctcatcgctggcttccagagagtacaggctctcaccaccaatctcaacctcatcctggaggctctgaaagacagtaccgaagtcgagatcgtggatgaaaagatgcgaaaaaaaattgaacccgaaaagtggcctattccgggaccccctcctcgcagcgtccctccaaccgatttctctcagctgatcgactgtccggaatttgtgcctggccaggccttctgctctcatacagaatccgctccaaattctccacggatcggctccccgctttcgccaaaaaagaattcagagacgagtatacttcaggccatgtctcggggtctgtccactagcctgccagatctcgactctgagccatggatcgaggtgaaaaagcgccaccagccggcacctgtcaagctgcgagagtcagttagcgtacccgaggggagcctgaaccagttgtgtagttccgaggagcccgagcaagaggaactggattttctgtttgacgaagaaatcgagcagatcggtcgaaagaatacttttacagactggagtgacaatgatagcgattacgaaatcgacgaccaggacctgaataagattcttatagtgacgcaaacacctccatatgtgaagaagcatccagggggagaccgcactggaacacacatgtctcgagccaagatcacgtcggagcttgccaaagtcattaatgacgggctgtattactacgaacaggatctttggatggaagaggatgaaaataaacataccgccataaagcaagaggtcgagaacttcaagaagctgaacctgatctccaaagagcagtttgaaaatcttacccccgaactgcccttcgaacccaaccaagaggtgcccgtggcccctagtcagtcacggcaagacctgaccgacgaattggcacagaagctctttgacgtcagtgagattactagcgctgcaatggtccatagcctcccaacagctgtcccagaatcacccagaattcaccccaccaggacccccaaaaccccgcgaacgccacgcctacaggatcccaacaagacccccaggttttacccggtcgtgaaggagccaaaggccatcgatgtgaagtctcctagaaaacgaaagaccaggcattctacgaaccctccactggaatgtcatgtgggttgggtcatggatagcagggatagggggcctggcacttcaagtgtctccacttccaatgcatccccctccgagggggcaccactcgctggatcgtacggctgtacaccacactccttccccaagtttcaacatccgtcgcacgaactactgaaggagaacggtttcactcagcaggtctaccacaagtaccgccgtcggtgcctcagcgagcgcaagagactcggtatcggtcagagccaggagatgaacactctattcagattctggagcttctttctgagggaccattttaacaaaaagatgtatgaagaattcagacagttagcctgggaggatgcgaaagaaaattacaggtatgggcttgagtgcctttttagattctattcctacggcctcgagaagaaatttaggcgcgaaatttttcaggactttcaagaggaaactaagaaggactacgaaagcgggcagctctatgggctcgagaagttctgggcttacctcaagtactcacagagtaaaactcagtctattgacccaaaactgcaggaatatctgtgctcctttaagaggcttgaagatttcagagtagatcctcccatatccgatgaatttggcaggaaacgacattcatcaacctcaggagaagagtccaatcgacaccgcctgccccctaactcatcaaccaagccccctaatgccgctaaaccaacctctacttctgagctgcaagtgccaatcaactcccccaggcgaaacatctcacctgagagctcagataattctcactag

SEQ ID NO: 57114 - DNA, 2745 bp, Artificial Sequence
  Description of Artificial Sequence: Synthetic coding sequence
atggagaattggcccactccaagtgagctagtgaacaccggtttccagtccgtgctgtcccaaggcaacaagaagccgcagaaccgcaaagagaaagaggaaaaggttgagaagaggtctaattccgacagcaaagagaacagggagaccaagttaaacgggccaggcgagaatgttagcgaggacgaggcacaaagcagtaatcagcgcaagcgcgctaataagcataaatgggtacctttacatctggacgtggtgaggagcgagtcacaggaacggccaggaagtaggaactcatccagatgtcagcctgaagccaataagccaacccacaataaccgacgcaacgataccagatcttggaagagagaccgcgaaaagagggatgaccaggatgatgtgtcttccgtgcgtagcgagggtggcaacatacgcggttcctttcgcggacggggacgcggtagaggaagaggcagggggcgaggaagagggaatcctcgcttaaacttcgactactcatatggataccaggagcatggcgagcgaactgatcagcctttccagacagagctgaatactagtatgatgtactattatgatgatgggaccggagtgcaagtgtaccctgtggaggaagccctgcttaaggagtatatcaaacggcagattgaatattacttcagcgtggagaatctggagcgggactttttcctccgcggtaagatggacgaacaaggattccttccgataagtctgatcgccggttttcaaagagtccaggctctcactacgaacctgaatctcattttagaagccttgaaggactctacagaggtggaaattgtcgatgaaaaaatgaggaagaagattgaacctgagaagtggcccattccagggccaccacctcgtagcgtacctcccactgatttttcccagcttattgattgcccagagttcgtccccggacaggcattctgcagccatacggagagcgctcccaattcgcctcgcatcggctctccactgtcgcccaaaaagaactctgaaacctcaatactccaagcaatgtctaggggactttctacttctttacccgatttggacagcgagccttggattgaggtcaaaaagcgccaccaacctgcgcctgttaagttacgcgagagcgtgtccgtacccgaaggcagtctgaaccagctctgttcgagtgaagagccagagcaggaggagctggacttcttattcgacgaagaaatcgagcagatcggaagaaaaaatacctttacggattggtccgacaacgattctgactatgagattgatgatcaggacttaaataagattctgatcgtcacacagactcctccttatgtcaaaaaacatcccggaggcgatagaacggggacccatatgagccgggctaagattacctcagaactcgccaaggtcataaatgatggtctatactactatgaacaggacctatggatggaagaggacgagaataaacacaccgctattaagcaggaagtagaaaactttaaaaagctcaatctgatttctaaggaacagttcgagaacctcaccccggagctgccctttgaacctaaccaggaggtgcctgtagctccgtcacagtctcgccaggggggtgtacagggcgttctgcacattccaaaaaaggatttgactgacgaattggcacagaaattgtttgatgtgagcgagatcacatcagccgctatggtccactcattacccacagcagttcccgagtctccccgaatccacccaacgaggacgccaaagactcctcgaactcctagacttcaggatcctaataaaaccccgcgtttttaccccgtggtcaaggaaccaaaagcaattgacgtgaaatcccctcggaagagaaagactagacacagtacaaatccgcctttggaatgtcatgtgggatgggttatggacagtcgggataggggccctgggactagtagcgttagtacctctaacgccagcccttccgaaggggctccactggccggatcttacgggtgcaccccccacagcttccccaaatttcagcacccttcacatgagttactcaaagagaacggctttacccagcaggtgtaccacaagtaccggagacggtgcctgagcgagcggaagagactcggaattgggcagagtcaggaaatgaatactctgttccgtttctggtccttctttctgcgtgaccacttcaacaagaaaatgtacgaagaattcaggcaattagcatgggaggacgctaaggagaactaccgttatgggctggagtgtctgttccgcttctacagctacggcctcgaaaagaaatttaggcgggagatctttcaggattttcaagaggagaccaaaaaggattacgaatctgggcagctctacggtctggaaaaattctgggcatatctaaagtactctcaatctaagacacagagcattgacccaaagctacaggagtatctttgcagtttcaagcgccttgaagattttcgcgtggatcccccaatttccgacgagttcggaaggaaaaggcactccagcaccagtggagaggaatccaacaggcataggctaccaccaaacagctccacaaagccccctaacgccgcaaagcccacaagtacaagcgaactgcaggttcctattaactctccacgtaggaatatctcgcccgaaagcagtgataatagccattag

SEQ ID NO: 57115 - DNA, 846 bp, Artificial Sequence
  Description of Artificial Sequence: Synthetic coding sequence
atggtgcacagtctgcctaccgctgttcccgagagcccaagaatacacccgacacgaactcctaagactccaaggaccccgaggttgcaggaccctaacaaaacgcccaggttttatcccgtggtaaaggagccgaaagctattgatgtcaaaagcccacgtaagcgcaagactcgtcactccacgaacccacccctcgaatgccacgtggggtgggttatggatagtcgggaccggggaccagggacatcctccgtgtcaactagcaacgccagtccatctgaaggcgcacctctggctgggtcgtacggttgcacaccgcatagcttccccaagttccagcatccttctcatgagctgctgaaagagaatggcttcactcagcaggtttaccataagtacaggagacgttgcttaagtgagcggaagcgactcggtataggtcagagtcaggagatgaacacacttttccggttctggtcattctttctgagggaccatttcaacaaaaagatgtacgaagaatttcggcagttggcttgggaggacgcgaaagaaaactatagatacggcttggagtgccttttccggttctactcctacgggcttgagaagaaattcagacgcgagatctttcaggactttcaggaagaaacaaagaaagactacgagagcggtcagctctatggactcgagaagttttgggcatacttgaagtattcccagtccaagacccagtcaatagatcccaagctgcaggagtatctttgttcattcaagcgactcgaagatttccgggtggataaccaccacgatagactgctgttactgatcatcaacatttag

SEQ ID NO: 57116 - DNA, 1008 bp, Artificial Sequence
  Description of Artificial Sequence: Synthetic coding sequence
atggagaactggcccacaccctctgagcttgtgaacactggatttcagtccgttctgtcccagggcaacaagaaaccccagaatcggaaagagaaggaagagaaagtggagaaacgctcaaattcagactccaaagagaacagggagaccaaactcaatggtccaggcgagaatgtctccgaggatgaagctcagagttctaatcagagaaagagagctaacaaacataaatgggtcccgctacatttggacgtagttcggtcggagtctcaggaacgacccggaagccgaaatagtagccgctgccagcctgaggctaacaaaccaactcataataaccggaggaacgacactagaagttggaaaagggacagagagaaacgagacgaccaggatgacgtgtcctccgttcgctccgagggcggaaacatccgaggaagtttccggggtaggggcagaggacgcggaagaggccgagggcgtggaagagggaacccgagactcaatttcgactactcttatggctatcaggagcacggcgagcgcacggatcagccgttccagaccgagttgaatacctccatgatgtactattatgatgatggcaccggcgtgcaggtgtatcctgtggaggaggccctgttgaaagagtatatcaaacggcagattgagtactacttcagcgttgagaacctggaaagggactttttcttgaggggcaagatggatgaacaggggttcctgcccatcagtcttattgcgggattccagagggttcaggcgcttactaccaacttgaacctgattttggaagccctgaaagatagcaccgaggtggagatagtggacgaaaagatgcgcaaaaagattgagccagaaaagtggcctatccctggaccccctcccagatcagtgcctcccacagatttttctcaactgatagattgccccgagtttgtcccgggacaagccttctgctcccacactgtgcgcgtcatgattttctag

SEQ ID NO: 57117 - DNA, 1569 bp, Artificial Sequence
  Description of Artificial Sequence: Synthetic coding sequence
atggagaactggcctaccccatctgaactggttaataccggtttccagtccgtgctgagtcaggggaacaaaaaaccgcaaaaccgtaaagaaaaggaggaaaaggtcgagaagaggtctaattcagactcaaaggagaacagagagaccaaactgaacggaccaggcgaaaacgttagtgaagatgaggctcagagcagcaaccagcggaagagagccaataagcataagtgggtacctttgcatctggacgtcgtcagatctgaatcccaggagcgcccagggtccagaaactctagtagatgccagcctgaagccaataagcccacccacaacaaccgccgaaatgacacacggtcttggaagcgtgatcgtgagaagagggacgatcaggatgacgtaagctctgttcggtctgaggggggaaatattcgagggtcatttcgcggtcggggacggggtcggggtcgaggtcgcggacgaggacggggtaatccacgattgaactttgactacagttacggctaccaagaacatggagagaggacagatcagcctttccagacagaactaaatacctcaatgatgtactactatgatgacggaacaggggtgcaagtgtaccccgtggaggaggccttgctgaaggagtacatcaagagacagatcgaatactatttttctgtcgagaacttggaaagggacttctttttaaggggcaagatggacgaacagggcttcctgccaatctctctgattgcgggattccaacgcgtgcaggccctgaccacaaatttgaacctgatcttagaggcccttaaggactctacagaggtggaaattgtggatgaaaagatgagaaagaaaattgaacctgaaaagtggccaatacccggtcccccacccagatctgtgcctcccaccgatttttcccagctgattgactgtcccgaattcgtgcccggtcaagctttttgctcacacaccgagagcgccccaaactctcctaggatcggcagtcccctgagccccaaaaagaacagcgagacctcaatcctccaggccatgtccagagggctgagcacttctctgccagatctcgactccgaaccgtggatcgaagtgaaaaagaggcatcagcccgctcccgtcaagctgagggaatctgtgtcagtgcccgaaggctctctgaatcagctctgctcctcagaagagcccgaacaagaggaattagacttcctctttgatgaggagatagagcagataggcagaaaaaataccttcactgattggtccgataatgactccgactacgagattgacgaccaggacctgaacaagatcctcatcgtgacccaaacgcctccctacgtcaagaagcatcctggcggagataggaccggtactcacatgagcagggcaaaaatcacgtccgaacttgctaaagtgattaatgacggcctatactattatgagcaggacctgtggatggaagaagacgagaataaacacaccgctatcaaggtgatagtgtctggacagcacctttccacagacgctctcttctag

SEQ ID NO: 57118 - DNA, 1077 bp, Artificial Sequence
  Description of Artificial Sequence: Synthetic coding sequence
atggaaaattggccaactccgagtgaactggtcaataccgggttccagagcgtgctaagccaaggaaacaaaaaaccacaaaatcgtaaggaaaaggaggagaaagtagaaaaacggagcaactctgattccaaagaaaatcgggaaactaagctgaatgggcctggagaaaatgtctctgaggatgaagcccaaagctccaaccagcgtaagcgcgcaaacaagcataagtgggtacctcttcatcttgacgtagtgagaagcgaatcccaggagcggcctggctctagaaactccagccggtgccaaccggaggctaacaaacccacccacaataaccgccgtaacgacacacgcagctggaaacgcgatagagaaaaacgcgacgaccaggacgacgtcagcagtgtgcgctctgagggcggtaacatcagaggctcgttccggggtcgaggacgcggacggggtcggggacgagggaggggccgaggaaacccccgtctgaactttgattattcgtacggctaccaggaacacggtgagcggaccgaccagccattccaaaccgagctcaacacatctatgatgtactactatgatgatggtacgggagtacaggtctatcctgtcgaagaggctctcctcaaggaatatataaagcggcagatcgaatactacttttctgtggaaaatcttgaacgggacttcttcctccgcggtaaaatggatgagcagggcttcctgcccatctcattgatagccggattccagagggtgcaggctctgactactaatctcaacctaattctggaagctttgaaagacagcactgaagtcgaaatcgtagatgagaaaatgcgaaaaaagatcgagcctgaaaagtggcccattccgggaccccctccccgttctgtgccacctaccgactttagccaacttattgactgccctgagttcgttcctggtcaggccttttgtagccatacaggtaatattttttcgtcccgcgctaatgacgttaccgtggggtatttagttcaattcacgtacctgtttatctacttccaattcatatag

SEQ ID NO: 57119 - DNA, 2364 bp, Artificial Sequence
  Description of Artificial Sequence: Synthetic coding sequence
atggaaaattggccaactcctagcgagcttgtcaacacaggatttcagtctgtgctgtctcaaggaaataagaaaccacaaaaccggaaagaaaaagaagaaaaggtcgagaaaaggagtaattccgattccaaagagaacagggagacaaagctgaacgggccaggtgaaaatgtgtctgaagacgaggcccagagctccaatcagaggaagagagcaaacaaacacaaatgggtgccactccatctggatgtggtccggtctgaaagccaggagaggccgggatcaagaaattcttctcgatgccagccagaagctaacaaacccacgcataacaaccgcaggaatgacactagaagctggaagcgcgaccgcgaaaagcgcgacgatcaggatgatgtctctagtgttcgctctgagggcggaaatatacgcggatcatttagaggcagaggcaggggcagaggtcgtggcaggggaagaggccgagggaatcctaggctcaactttgattactcctatgggtatcaagaacatggagagagaacagaccaaccatttcagaccgaactcaacactagcatgatgtactattacgatgacgggacaggtgtccaggtatacccagtggaggaagctctcctgaaagagtatatcaagaggcaaatcgagtattatttctccgtcgaaaatctggagcgagacttctttctccggggaaaaatggatgaacagggctttctgccaatctcgctcatcgccggttttcagagagtgcaggcactgactacaaatcttaaccttatcctcgaggccttgaaagacagcaccgaagttgaaatcgtagacgagaagatgaggaagaaaatcgaacctgagaagtggccaatccccggacctccgcctcggagcgtcccgcctacggacttctcccagctaatcgattgccctgagtttgtgcctggccaggctttttgcagccataccgaaagcgcaccaaatagccctcgcatcggatcgccgctgtcccccaagaagaattccgaaacctctattctccaggctatgtctcggggactgagcacttccctgcccgacttggattccgaaccctggatcgaagtgaagaaacggcaccaacccgcaccagtgaaactgcgcgagagcgtgtctgtgccagagggatctctgaaccagctgtgttcttcagaggagcctgagcaagaggagctggactttctgttcgacgaggaaatcgaacaaattggcagaaagaatactttcacagattggtccgacaatgatagcgattacgaaatcgatgaccaagatctcaataagattttaatcgtcacacagacgcctccctatgtgaagaaacacccaggtggggatcggacaggaacacacatgtcgagagctaagattacttctgagcttgcgaaagtgattaacgatggtctgtattattacgaacaggacctgtggatggaggaggatgaaaataagcacactgctattaagcaggaagtcgagaatttcaaaaaactgaatctgatctcaaaagaacagtttgagaacctgaccccggaattacccttcgagcctaaccaggaagtacctgtggcaccgtctcaaagcaggcaaggaggtgttcagggagtacttcacattcccaaaaaagatctgacggatgagcttgcccaaaaactgtttgatgtttccgagattacctccgcggcaatggtccactccttacctactgccgtgcccgaatctccgagaatacaccctactaggactccaaaaacgcccaggaccccgaggctccaagatccaaataagactcccaggttctaccctgtggtgaaggaaccaaaggccatcgatgtcaagtcccctcgaaagaggaaaacaaggcacagcacaaaccctccactggagtgccacgtggggtgggtcatggactctcgggacagaggcccagggaccagctccgtaagcacatccaatgcttcccctagcgagggagccccactggcagggtcttatgggtgtacgcctcatagcttccccaagtttcagcaccctagtcatgaacttctcaaagaaaatggatttactcagcaagtctaccataagtacagaaggagatgcctgagtgaaaggaaacgactgggaatcggacaatcacaagaaatgaacactttatttcgtttttggtcattctttctacgagaccattttaataagaagatgtatgaggagtttaggcagctggcctgggaggacgccaaggaaaactatcgttcagccgtgtggacacggaaggtgctcggactcttcgaaatcttttctatatag

SEQ ID NO: 57120 - DNA, 1476 bp, Artificial Sequence
  Description of Artificial Sequence: Synthetic coding sequence
taggaagagaaagtggagaaacggagcaactctgactctaaagaaaatcgcgaaacaaagctgaatggtccaggcgagaatgttagcgaagacgaggctcaatcctccaaccagagaaagcgagcaaacaagcataagtgggttccactgcatctcgatgttgtgcgcagtgagtcacaggaaaggccaggctcccggaacagttcaaggtgccagcccgaggccaacaaacctacccataacaaccgtcgaaacgacactagatcgtggaaaagagaccgcgaaaaacgggatgaccaggatgacgtctcgtccgtgagaagcgaagggggaaatatccggggttcttttcgcggtaggggcaggggcagaggacgcggacggggtcggggaaggggaaaccctcgactgaactttgactattcctatggataccaggagcatggcgagaggactgatcaaccattccagacagagcttaacaccagcatgatgtattactacgatgatggaacgggtgtgcaggtgtatcccgtagaagaggccctgctgaaagaatacattaaaaggcagatcgagtactacttttccgtcgaaaacctggaacgtgacttctttctcagggggaaaatggacgagcaaggtttccttcctatcagtctgattgctggtttccagagagtccaggctctgacaacaaacctcaatctcatcttggaggccctaaaagactctaccgaagtcgagatagtggacgagaagatgaggaagaaaatagagccagaaaaatggccaattcccggtccacctccaaggtccgtcccccctaccgattttagtcagctaatcgattgtcctgaattcgttcccggtcaagctttttgctcacataccgagtcagccccaaattcccctagaatcggttcacccttgtcgcccaagaagaactcggagactagtatcttgcaggcaatgagtcggggacttagcacgtcactgcctgacctcgactccgagccatggattgaagtcaagaagcgccaccagccagcacctgttaaactgcgcgagtcagtttcagtgcccgaaggttctttaaaccagctctgttcctcggaggagcctgaacaggaggaattggatttccttttcgacgaggagatcgagcagattggtcggaaaaacacattcaccgattggtccgacaacgacagcgattacgaaatcgatgaccaggatctgaataaaatcttgattgtaacccaaactccgccatatgtgaaaaaacatccagggggtgatcgaacgggtacacatatgtctcgcgcaaagatcacctccgagctggccaaggtaatcaatgatggactatattactacgaacaggacttgtggatggaagaggacgaaaacaagcacacagctatcaaagtgatcgtctctggtcagcacctcagcaccgacgctctcttttag

SEQ ID NO: 57121 - DNA, 1962 bp, Artificial Sequence
  Description of Artificial Sequence: Synthetic coding sequence
atgttgctgtttgtggaacaggttgctagtaaaggaacaggcctgaacccgaatgccaaagtctggcaagagattgccccagggaatacggatgccactccagtcacacatggaaccgaaagctcctggcatgagatcgccgctacctccggcgcacatcctgaggggaatgccgaattgagtgaagacatatgtaaggagtatgaggtgatgtattcgtcatcatgtgaaaccaccaggaatacaactggcattgaagaatctaccgacggaatgatccttgggccagaggatctgtcctaccaaatctacgacgtgtccggtgaaagcaattccgccgtcagtaccgaggacttgaaagaatgcctgaagaaacagctcgagttctgtttttcacgggaaaatctctcaaaggacctgtatctgatcagccaaatggatagcgaccagttcatcccaatttggaccgttgcaaatatggaagagattaagaagttgaccaccgacccagacctaatccttgaagtgctgaggtccagtcctatggtccaggtcgacgagaaaggggaaaaggtaaggccatcccataaaagatgcattgtcatactgagagaaattcccgagactaccccaattgaagaagtcaagggcctgtttaaaagcgagaactgtccgaaggtgatttcctgtgaatttgcacacaattctaattggtatatcacatttcagagcgatacagacgctcagcaggcctttaagtatctgcgagaagaggttaagacctttcagggtaaacccatcatggcaaggattaaggccataaacacttttttcgctaaaaacggatacaggttgatggacagcagcatttactctcaccccatccagacccaagctcaatacgcgagccctgtatttatgcagcctgtctataatccacatcagcaatattccgtgtacagtattgtgccgcagagttggagtccaaaccctacaccctacttcgagacccccctggccccttttccaaatgggtcattcgtcaatggattcaactcccccggatcttacaagactaatgccgcagccatgaacatgggcagaccctttcagaaaaatagacgcaccctgttccggggaaggcgcagaagggaggatgatcggatttctcgtcctcatccgagcactgccgaaagcaaggcccctacccccaagtttgatctccttgccagcaacttcccgcctctgcccggttcaagtagcaggatgccaggggagctggttttagaaaaccggatgtcagacgtcgtgaaaggtgtgtataaagagaaggacaatgaggagctgactatctcatgtccagtgcctgccgatgagcaaacggagtgtacttctgcacagcagctgaatatgagtacgtcaagcccgtgcgcagcagagctgacggccctgtccactacacagcaggaaaaagatctgatcgaggatagttccgtgcagaaagatggtttgaaccagaccacaatccccgtgagccccccttcgaccacaaagccctcccgcgcttcaacggcctccccctgcaacaataacattaacgccgctactgcagttgccctacaggaaccacgaaagttatcgtacgccgaagtgtgtcagaaaccaccaaaagaaccttctagcgttcttgtacagcctcttcgagaactacgatctaatgtggtttctccaacaaaaaatgaggataacggggcacctgaaaacagcgtggagaagcctcacgagaagcccgaagctcgtgcttccaaggattatagcggattcagggggaacatcattcctcggggtgctgccggtaagattcgagagcagaggcggcagttctcccatcgggcaattccccagggggtaaccaggcggaacggaaaggagcagtacgttcctcccaggtctcctaagtag

SEQ ID NO: 57122 - DNA, 1962 bp, Artificial Sequence
  Description of Artificial Sequence: Synthetic coding sequence
atgttactctttgtggaacaagtggccagtaagggaacaggactgaaccctaatgccaaagtatggcaggaaatcgcccctggaaacacagacgctacccctgtcactcacggcacagagagtagttggcacgagatcgctgcaacttcaggtgcccaccctgagggtaacgcagagctgtccgaagacatatgcaaggaatatgaagtaatgtactcttcgagttgcgagaccaccagaaatacgaccggaattgaggaaagtaccgatgggatgatcctcggcccagaagacctctcttatcagatatacgatgtgagtggggagtccaacagcgccgtttctaccgaagacttgaaagagtgcctcaagaaacaattagaattctgtttttcccgggagaacctcagcaaagatctgtatttgatatcacagatggattcagaccagttcatcccaatctggaccgtggcgaacatggaagaaattaaaaaactgaccactgacccagatttgatcctagaggtgcttcggtcttctccaatggtgcaggtagatgaaaaaggagaaaaagtacgcccatctcataaacggtgtattgtcattctaagagaaattcccgagacaacacccatcgaggaggttaaggggctattcaaaagcgaaaattgtcccaaagtaattagctgcgagtttgcgcacaacagtaactggtacatcacgttccagtctgataccgatgcccagcaggccttcaagtatctcagagaggaggttaagacatttcagggaaagcctataatggcgccttttccgaacggtagcttcgtcaacggtttcaacagtcccggttcgtacaagactaatgccgcagccatgaatatggggaggccgttccagaagaatcgagtgaaacctcagttcagatcttccggaggctccgagcatagtacagaaggctctgtaagcctgggtgacggccagctcaatcgctacagcagccgtaacttcccagctgaaagacataatccaacagtgacaggccaccaggagcagacttacctccagaaggaaacttctaccttgcaggtggaacagaatggggattacgggaggggccgacgtactcttttccgtggaaggcgtcgccgagaagatgacaggatttccagaccacacccctcaactgctgagagcaaagctcctactccaaagtttgatctgttagcgagcaatttccccccactccccggatccagctcccgaatgcctggtgagctcgtactggaaaaccggatgtcagatgtggtgaagggtgtctacaaggaaaaagacaatgaggagctgactatcagctgcccagtgcccgcagatgagcagactgagtgtactagtgcccaacagctaaacatgagtacctcgtctccttgtgcagccgaactaactgctttgtcaaccactcagcaagagaaagacctgattgaggactccagcgtccagaaagacggcttaaaccagaccacaataccagtgtccccaccctccactacaaagccctctcgggcatctacagccagtccttgcaacaacaacattaatgcagccacagccgtggccttgcaagagccgagaaagctgtcttacgctgaggtgtgtcagaagccacctaaagagccgtccagcgtgcttgtccagcctctcagggagcttcgttcgaatgttgtaagccccacaaagaacgaagacaacggagcacccgaaaactccgtggagaaaccccatgagaaaccagaagcccgagcaagtaaagattattccggatttagaggcaatataatccctaggggggcagcgggtaaaattagagagcagcggagacagttctcccaccgcgcaatccctcagggcgtcacccgtcggaacggcaaagaacagtacgttccacccagaagccctaagtag

SEQ ID NO: 57123 - DNA, 1125 bp, Artificial Sequence
  Description of Artificial Sequence: Synthetic coding sequence
atgctcctatttgtagaacaggtggcatctaagggcacggggctaaaccccaacgccaaagtttggcaggaaatcgctcccggtaataccgacgccacgcctgtcactcacggcaccgaaagtagctggcatgagattgcagccacctcgggggcacatcctgagggaaatgctgaactgagcgaggacatctgcaaggaatatgaagtcatgtatagcagctcctgcgaaaccacgaggaacaccactggaatcgaggagtcaaccgacggaatgatcctcggaccggaggacttatcataccagatttacgatgtctccggcgagtccaattctgccgtgtccaccgaggacctcaaagagtgcctgaagaagcagctagaattttgctttagtcgcgagaacttatccaaggacctgtatcttatctcacagatggactccgatcaatttatccccatctggacggtcgccaatatggaggagatcaagaagctgaccactgaccccgaccttatcctggaagttctgaggtctagccctatggttcaggttgacgagaaaggagagaaagtgcgcccttcccataaacgctgcatagttattctgcgagagatccccgaaacaacccctatagaagaggtaaaaggtctgttcaagagcgagaactgcccaaaagtgatttcctgtgagtttgcacataattccaattggtacatcactttccagagtgacaccgacgcacagcaagcgtttaagtacctgcgcgaggaggtgaagacatttcaaggcaagcccatcatggcaaggattaaggcaatcaatacgttttttgctaaaaatggctaccgactgatggatagttcaatctacagccatccgatccagacccaggctcagtatgcgtcccctgtctttatgcagcccgtctacaatccgcaccagcagtactcagtctactcaatcgttccacaaagctggagcccaaatccaactccctattttgagacccctttggcaccgttccctaacgggtccttcgtgaacggtttcaatagccctgggtcctacaagactaacgctgccgcaatgaacatgggcaggcctttccagaaaattgtttag

SEQ ID NO: 57124 - DNA, 2175 bp, Artificial Sequence
  Description of Artificial Sequence: Synthetic coding sequence
atgctcttatttgtagaacaggtagcgtctaaaggcaccggactgaatccgaatgcaaaagtgtggcaggagatcgccccagggaacaccgacgccacccctgttactcatggcacagaaagctcttggcacgagattgccgcaacctccggcgctcatccagaaggcaacgcagagctgtctgaggatatttgtaaagagtatgaagtgatgtacagttcttcctgtgaaaccactcggaacactactggaatcgaggaaagcaccgatgggatgattctgggaccggaggacctctcataccaaatctacgatgtgtccggagagtcaaactccgcagttagtacagaagacctgaaggaatgcttgaaaaagcagctcgagttttgctttagcagagagaatctgagtaaagatctttacctgatctcccagatggattctgatcaattcattcccatctggactgtagcgaatatggaagaaattaaaaagctgaccacagaccctgacctcattctcgaagttctcagatccagtcctatggtgcaggtcgacgagaaaggcgaaaaggtgagaccctctcacaaaaggtgtatcgtcatattaagggagattcccgagaccacccctatagaggaggtgaagggtctgtttaagtctgagaactgtcctaaggtgatctcctgcgaatttgcgcacaatagcaactggtatataacctttcaaagtgatactgacgcccagcaggcattcaaatacctccgagaggaggttaaaactttccagggcaagcccatcatggctcgcatcaaggctattaacaccttcttcgccaagaacggctatcgcttgatggatagctcaatttactcacacccaatccagactcaagctcaatacgcctcaccggtttttatgcagccagtttacaatccgcaccagcagtactctgtgtactctattgtgccacagtcctggtctcccaatcctactccctacttcgaaacccctctggcgcctttccctaacggcagctttgtcaatgggtttaacagtccaggtagctacaaaacaaatgccgcagcaatgaatatggggcgacctttccagaaaaatcgggttaaacctcagttcaggagctctgggggaagtgaacacagtacagagggcagtgtgagtttaggcgatggacaactgaaccgctattcatctaggaacttccccgcagagcggcacaaccccaccgttaccggacaccaggagcaaacgtacctgcaaaaggaaacctcaaccctgcaggtggagcagaatggggattacgggagggggagaagaactctttttcggggaagacggaggcgggaggacgaccgaatctccaggccccaccccagtaccgccgagtctaaggccccaacaccgaaattcgacttgctcgcttctaattttccgcctctccccggatctagctctcgtatgcccggagagcttgtactggagaacagaatgagtgacgtggttaagggcgtgtacaaagaaaaggataacgaggagctgaccataagctgtcccgtgccagccgacgaacagaccgagtgtacatcagctcagcagctgaatatgtccacgagctccccatgtgcggcagaactcaccgctctgagcacaacccagcaggaaaaggatctgatcgaagacagctccgttcaaaaagacggactcaatcagacgacaatcccagtcagcccaccatcaaccaccaagcctagccgtgcctccacggcgtcaccttgtaacaacaacatcaacgcagctaccgcagtggccttacaagagccaaggaagttgagctatgctgaggtttgtcaaaaaccgccaaaagaaccatcttcggtcctcgtgcagcctctgcgagaattgcgatccaatgtagtcagtcccaccaagaatgaggacaacggggcacctgaaaattcagtagagaaaccccacgaaaagcccgaagcgagagcatcaaaagattattcagggtttcggggaaatatcattcctcggggagcagcgggaaaaatccgagagcagcgccgtcagttcagccatcgtgcaatcccacaaggggtgactagacgcaatgggaaggaacagtatgtgccgcctcgctctccgaaatag

SEQ ID NO: 57125 - DNA, 2193 bp, Artificial Sequence
  Description of Artificial Sequence: Synthetic coding sequence
atgctgctcttcgtggaacaggttgcaagcaaggggactggcctgaacccaaatgccaaggtgtggcaggaaatagcacccggtaataccgatgcaacacctgttacacatgggacagaatcgtcttggcacgagatcgccgctacatcaggagcccaccccgaggtctccgtcttcaatacaggaaacgctgaactgagcgaggacatttgtaaggaatatgaggtcatgtactctagttcttgtgaaaccacaaggaatactacaggaattgaagaaagcaccgatggaatgatccttggcccagaggacttgtcatatcagatctacgacgtgtcaggagaaagtaattcagccgttagcaccgaagaccttaaggagtgtctgaagaagcagttggaattctgttttagccgagagaacctgtccaaggacctttatctcatctcacaaatggattcagaccagttcatacccatctggacagttgcaaatatggaggaaatcaaaaagctgaccaccgatcccgatctgattctggaggtgctacggtcaagccccatggtgcaagtcgacgagaaaggagagaaggtccgcccatcgcacaagcgatgcattgtcatcctgcgggagattcccgagaccacacccattgaggaggtaaagggcttattcaaaagcgagaattgcccaaaagtgatctcttgcgaatttgcccataactcaaactggtacattacctttcagtccgataccgacgcccaacaggcctttaaatatttgcgagaggaggtaaaaacgttccaggggaaacccattatggcgcgaattaaagcaatcaatactttcttcgcaaagaacggctacagattgatggacagctccatttacagccatcccatacaaacccaggcccaatatgccagcccagtgttcatgcaaccagtatacaatcctcatcagcagtatagtgtgtactccatcgtgccccagagttggtcacccaatcccacgccctacttcgaaacgccgctggcaccattccctaatggcagcttcgttaatggattcaatagccccggaagctacaaaaccaacgctgccgcaatgaatatgggaagaccatttcagaagaatcgagttaagccccagttcagaagctccggaggaagcgagcacagcacagagggttccgtgtctctcggggatggccaactaaatagatactcttcccgtaactttcccgctgagcgccacaacccgacagtaaccgggcaccaagagcaaacatacctgcagaaggagacttcgactttgcaggtcgaacagaatggggactacgggcgaggaagacgaactttgttcagaggcagacgcagacgcgaggatgacagaatcagcagacctcacccaagtaccgcggagtcaaaggctcctacccctaaatttgatctcctggcgagtaacttcccccctctgccagggagctcctcacgcatgcctggagagcttgtactggaaaaccgaatgtctgacgttgtcaagggggtctataaggagaaggacaatgaagagctgacaatatcctgtcctgtcccagcagacgagcagaccgaatgcaccagcgctcagcagttaaatatgtctacctccagcccctgtgcagctgagttaaccgccttatctacgactcagcaggagaaggaccttattgaagattcatctgttcagaaggatgggttaaaccagacaacaatccctgtttcaccgcctagcacaactaaaccaagcagagctagcacagccagcccatgtaacaataacataaatgcagccaccgcggtagctttgcaggaaccacggaagctttcctatgcggaagtgtgtcagaaaccacccaaggaaccttcgagtgtcctagttcagcctctgagagaactgaggtcaaatgttgtgtctcccacgaagaatgaagataatggcgcacctgagaacagtgtggaaaagccccatgaaaagccggaggcccgagcctccaaggattactcaggtttccgcggtaacattattcccaggggtgccgcaggcaaaatccgcgagcagagacgccagttctcccacagagccatcccccagggcgtgacccggaggaatgggaaggaacagtacgtgcccccacgatcgcctaaatag

SEQ ID NO: 57126 - DNA, 567 bp, Artificial Sequence
  Description of Artificial Sequence: Synthetic coding sequence
atgtacagctcatcttgtgaaaccacccgaaacactactggtatcgaggagagtaccgatggtatgatcttggggcctgaagatctgtcttatcagatctacgacgttagcggagagtctaatagcgctgtctctaccgaggacctcaaggaatgcctcaagaagcagctagaattctgtttctcccgcgaaaacctgtccaaggatctctatctcatctcgcaaatggattccgatcagttcatccctatctggaccgtggccaacatggaagagataaagaaactcactactgatcctgaccttatcctcgaggtactgcgctcatcgcccatggtacaggttgatgaaaagggcgagaaagtaaggcctagccacaagaggtgcattgttatactgcgtgagatacccgaaactacacccattgaagaggtgaagggactgttcaagagcgaaaactgtccgaaagtgatcagttgcgagttcgcacacaactctaattggtatattacattccagtccgacaccgatgcccaacaggcctttatattaaagcggaggtcatag

SEQ ID NO: 57127 - DNA, 2172 bp, Artificial Sequence
  Description of Artificial Sequence: Synthetic coding sequence
atgctactttttgtcgaggtggcatccaagggcacgggtcttaatcccaacgcaaaagtgtggcaagagatcgccccaggcaatactgacgccacgcctgtgacgcacggtaccgagtcttcatggcacgagatcgccgctacaagtggggcacaccctgaaggaaatgccgagttgtctgaggacatatgcaaggaatatgaagtgatgtatagctcttcatgcgagaccacccgcaatactactggaattgaggagagtactgatggaatgattctcggccctgaggacctttcctaccagatttatgacgtaagcggtgagtcaaactcagctgttagcactgaagatctgaaggaatgcctgaagaaacaactggaattctgttttagcagggagaacctgtcaaaagacctctatttgattagtcagatggattccgaccagttcattcccatttggaccgtcgctaatatggaggaaatcaagaagttgacaaccgaccctgacctgatcctcgaggttctcaggagctcccctatggtccaggtagatgagaaaggggaaaaagtccgaccaagccacaagcggtgtatcgttatcttgagagagattcctgaaactactccaattgaggaagtgaaaggactattcaagtcagagaactgtcccaaagtcatttcctgcgagttcgctcataacagtaactggtacataaccttccaatcagacactgacgcacagcaggcatttaaatatctacgagaagaggtgaagacattccaaggcaagcctataatggcacgcataaaggcgattaatacctttttcgccaagaatggctatcgtttgatggactcttcaatatactcccaccccattcagactcaggcccagtacgcttcccctgtgttcatgcagcccgtgtataatcctcaccagcagtactcagtgtattccattgtccctcagtcctggagtcctaaccctactccgtactttgaaacgcccctggccccttttcctaatggctcctttgtgaatgggttcaattccccaggtagctataagaccaatgcggcagccatgaatatggggcgtccctttcagaagaaccgggtcaaacctcagttccgtagcagcgggggaagtgaacattcgacggagggaagcgtgtccctgggcgatggacagctgaatagatattcgtcccggaacttccctgctgagcgtcataaccctacagtaactggccatcaggaacagacgtatctgcaaaaagaaacctcaaccctgcaagtggaacagaacggagattatgggagagggcgacgcaccctgttcaggggaaggaggaggagagaagatgacaggatcagtagaccccacccatctaccgctgaaagtaaagctcccacccccaagtttgacttactcgctagcaacttcccgcctttacctggatcctcatcacggatgcctggcgagctagtgcttgagaatagaatgtccgatgtcgtgaagggggtatacaaagaaaaggataatgaagaattaaccatatcgtgccctgtaccggctgatgaacagacagagtgcacctcagcccagcagcttaatatgtctacgtccagcccgtgtgccgcagaactgactgcgttaagtacaacgcaacaggagaaggatctcattgaggactcgagtgtgcagaaggacggcctgaatcagaccacgataccagtttctcctcccagcacgacaaaaccctctagggcttctacggcgtctccttgcaacaataatatcaacgccgcaaccgcggtcgcgctgcaagagcccaggaaactctcatacgctgaagtgtgccaaaaacctccgaaggaaccaagttccgtcttagtccagcccctaagagaactgagatcaaatgtggtcagccctactaagaacgaggataacggggcaccggagaattctgtggagaagcctcacgagaagcctgaagctcgcgcatctaaagactattcgggcttccgcggtaacatcattccacggggtgcagccggaaaaatacgagaacagcggagacagttttcgcacagggctatcccccagggtgtaaccagacgcaacggcaaagaacagtacgtccctcccagatcccctaagtag

SEQ ID NO: 57128 - DNA, 2217 bp, Artificial Sequence
  Description of Artificial Sequence: Synthetic coding sequence
atgacaagtgatcaagatgccaaagtggtcgctgaaccccaaacccagcgagtccaggaaggcaaagatagtgcccacttgatgaatggaccaatcagccagacgacgtcgcagactagcagcattccccctctatcacaagtacccgctactaaagtcagtgagcttaatcccaatgcagaggtgtggggcgctccagtactccatctggaggcgtcaagtgctgccgacggtgtctctgcggcatgggaggaggttgcgggtcaccacgccgatcgcggtccccaaggctctgatgctaatggtgatggagatcaaggccacgaaaatgccgctctgcccgacccccaggagagtgaccccgctgacatgaatgctctcgccctcggcccttccgagtatgattcactcccggaaaacagcgaaacggggggtaacgaatcccaaccagactctcaggaagatccaagggaagttctcaagaaaaccctggaattttgtctctctcgcgaaaacctggcaagcgatatgtatctcatcagccaaatggatagcgaccagtatgtccccattactacggtggcgaatctagaccatatcaagaagttaagcactgatgtggatctgattgtcgaggtgctgaggtctcttccgctggtgcaggtcgatgaaaaaggggaaaaagttagacccaatcaaaacaggtgtattgtgatcctccgagaaattagtgagagtaccccagtagaggaggtcgaagcactgtttaagggcgataacttacccaaattcatcaactgcgagttcgcatacaacgataactggttcatcacctttgaaactgaagctgatgcccagcaggcatataagtacctccgagaggaggttaagactttccaggggaaacccatcaaggccagaataaaggctaaggccatcgcaattaacacatttctgccaaaaaacgggtttcgacccttggatgtgtccctgtacgcccagcaaaggtacgccacctctttttatttcccgccaatgtactcaccccaacagcagtttccactttactcattgattaccccccagacgtggtctgctacccactcttacctggaccctcctctggtgaccccctttccaaatacaggattcatcaatgggtttacaagccccgcatttaagcctgctgcatcccctctgacttcattgaggcaatacccccctcgcagccgaaatccatctaagtcacatcttcggcacgcaattccctcagcagaaaggggccctggtcttctggaatctccatccatattcaattttacagctgaccgcctcattaacggggtcaggtccccacagactcgccaagctggccagacacggacgagaattcaaaacccctcagcatatgccaagcgcgaagccggtcctggccgagtggaaccagggtctctggaaagcagcccagggctgggcagaggacgaaagaactccttcggctatagaaaaaagcgggaagaaaagttcacatcttctcagactcagtcaccaactcccccaaagcctccatcgcctagttttgaactgggcctttcatcctttcctccgctgcctggagccgcagggaacctgaagactgaggacctctttgaaaatagactctcctcactcatcattggtcctagtaaggagagaacactctcggccgacgccagtgtaaacaccctccctgtggtggtgtcacgggagccgtccgttcctgcaagctgcgcagtatcagccacctacgagcggagtccttctcccgctcacctgccagatgatccaaaagtggcggagaaacagcgcgagacccactccgttgatcgcctgccctcagctttaactgctaccgcctgcaaatctgtgcaggtgaacggggctgcaaccgagctgcgaaaaccttcatatgccgagatatgtcagcgaacatccaaggaacccccaagtagtcctctccagcctcagaaggaacagaagcctaataccgtgggctgtggcaaagaggagaagaaacttgccgagcctgcagaacgataccgtgagcccccagccctaaagtcaacgcctggtgcccctcgtgaccagaggaggcctgcaggaggcaggccatctcctagcgcgatgggaaagagactgtctagagaacagagcaccccacccaagagccctcaatag

SEQ ID NO: 57129 - DNA, 396 bp, Artificial Sequence
  Description of Artificial Sequence: Synthetic coding sequence
atgaccagtgatcaagatgcaaaggttgtggccgagccacagacccagcgtgttcaggaaggcaaggactcagcccacttaatgaacggcccaataagccaaacaacaagccaaacttccagcattcctcccctgtcgcaagtcccagctacaaaggtgtctgaactgaacccaaacgccgaggtctggggggcaccagtgttgcatctggaggcttcctcagcagccgacggagttagcgctgcttgggaagaggtggcagggcatcatgcagaccgcggaccacaaggttccgacgctaatggggacggagaccaggggcacgagaacgctgccctcccggacccacaagagtccgatccagctgatatgaatgccttggccttggggccttag

SEQ ID NO: 57130 - DNA, 174 bp, Artificial Sequence
  Description of Artificial Sequence: Synthetic coding sequence
atgacttcggatcaagacgcaaaagtagttgccgaaccacagactcagagggtacaggaagggaaggacagcgctcatctgatgaacgggccaattagccagaccactagccagaccagttctatccctccgctgagccaggtgccagctaccaaggttagtgagctaaattag

SEQ ID NO: 57131 - DNA, 552 bp, Artificial Sequence
  Description of Artificial Sequence: Synthetic coding sequence
taatcatttgagctaggcctttcaagcttccccccactcccaggggctgccggtaacttgaagacagaggatctcttcgagaaccgtctcagtagcctcatcatcggtccttccaaggaacggaccctgtcggctgacgctagcgttaataccttgcctgtagtcgtgagtcgcgagccatcagtccccgctagctgtgccgtttccgccacttacgagcggagcccctctccagcccacttacctgatgatccaaaagtagctgagaaacaaagggaaacccattccgttgacaggctgcccagtgccctgactgccactgcctgcaagtcagttcaggtcaatggcgctgccactgtcagaacttcatgtttgccgagttgcacgacggcagccaggttatggtgtgagcagaccttacgcactcctgccccagccaggtttcttataacctccaacctggtcggtttttacctccggctgtcagtcctgtgtttcctatataagatccccctgatcttcgccaacaattttccattgaccaccctgtag

SEQ ID NO: 57132 - DNA, 1020 bp, Artificial Sequence
  Description of Artificial Sequence: Synthetic coding sequence
tagtcaatatttaatttcactgcagatagacttatcaatggcgtgagatcaccacagacacgacaggctggccaaaccaggactcgtatacagaatccctcagcctacgccaagcgtgaggctgggcctgggagagtggagcctggatccctggagagctcgcccggattaggacgaggccgaaagaacagcttcggataccgtaaaaaaagagaagagaaattcacatccagccaaacccagtcaccaacaccacccaagccgcctagcccctcgttcgaattaggcctgagcagctttccccctctgcctggcgcagcaggtaacctgaaaacagaagacctttttgaaaacagattatctagcttaatcatcggcccatcaaaagaacggactctatctgccgacgccagtgtgaatacactgcctgtggtcgtgtcacgggaaccttcagttccggcttcctgcgctgtatccgcaacatatgagagatccccctcacctgcacacctcccagacgacccaaaggtagccgaaaagcagagggaaacacattccgtagataggcttccgagcgccctgaccgcaaccgcatgcaagagcgtgcaggtgaatggcgctgctaccgtccgcacttcctgcctgccctcttgcaccactgcagctcggttgtggtgtgagcagaccttgcgcacgcccgcaccggcaagattcctgatcacttccaacctggagctccggaaaccctcctacgcagagatttgccagcgaacctcaaaggaacctccttcgtctccactccaaccccaaaaagagcagaagccgaatactgtgggctgcggtaaagaagagaagaaactcgccgaaccagcggagcgttatagggagcctcccgctctgaaatctactcccggagctccccgtgaccagcggagacccgctggtgggagaccgtccccaagtgcaatggggaaaagattaagtcgcgaacaatcaactccaccaaagagtccccaatag

SEQ ID NO: 57133 - DNA, 1293 bp, Artificial Sequence
  Description of Artificial Sequence: Synthetic coding sequence
atggccgaagcagtgctgattgacctgttcggactgaagcttaactcccaaaagaattgccatcagactcttctgaagaccttgaacgccgtacaataccatcacgctgcaaaggccaaatttctctgtatcatgtgctgtagcaacatcagctacgagagagacggcgagcaagataattgtgaaatcgaaactagcaacggactgtccgccctgctggaagagttcgagatcgtgtcttgcccctcgatggcagcaaccctgtataccatcaagcagaaaatagacgaaaaaaacctttctagcattaaagtgatagtccctcgccacaggaagacgctgatgaaagcctttatcgaccaacttttcacagatgtgtataattttgaatttgaggatctgcaagtgaccttcagagggggacttttcaaacagtcaatcgagatcaacgtgattactgcccaggagttgaggggtatacagaacgagatcgagacttttctcagatcattaccagcattacgagggaagctgacaataatcacatcatcactgatccctgacatttttattcacgggttcacgaccaggacagggggaatctcgtatatccctaccttgtcatcgttcaatctgttcagctcatctaaacggagagaccctaaggtcgtggtgcaggagaatctgcgtagactcgctaatgctgctggctttaacgttgaaaaattctatagaatcaaaacgcaccactcaaacgacatttggatcatgggtcgcaaggagccggatagctacgacgggattacaacaaatcagcgaggagtgacgatcgccgctctgggcgctgactgcatacccatcgtattcgctgatcccgtaaaaaaggcctgtggcgtggcccacgccggatggaaagggactctgctcggcgtcgctatggcaacggtaaacgccatgattgcggagtacggatgcagcctggaggatatcgtcgtggtcttgggaccctctgtgggaccctgctgttttaccctaccacgagagagtgcggaagccttccacaatctccaccctgcctgcgtccagctctttgacagccctaatccttgcatagacatcaggaaagccaccagaatcttattggagcaggggggaattctgcctcagaatatacaggaccaaaaccaggatcttaatctgtgcacatcatgccatcctgacaagtttttttcacatgtcagggacggcctcaactttggcacacagatcgggttcatttccataaaagaatag

SEQ ID NO: 57134 - DNA, 495 bp, Artificial Sequence
  Description of Artificial Sequence: Synthetic coding sequence
atggcagaagcagttctcatcgatttgttcggtcttaagctcaattcacaaaagaattgtcaccagaccttattaaagacactgaacgcagtgcaatatcaccatgccgctaaagccaagttcctttgcattatgtgttgcagtaacatcagttacgagagagacggggaacaggacaactgtgagatcgagacaagcaatgggttgtctgcactgttagaagaattcgagatcgtcagttgcccaagtatggccgcaacactctatactatcaagcaaaaaattgacgagaagaacttgtctagcatcaaggtgattgtccctcgtcatcgaaaaacgctcatgaaagctttcatcgaccagcttttcactgacgtttataattttgagtttgaagacttgcaggtgaccttccggggaggattgtttaagcagagtattgaaattaatgtaattacagcacaagagttgcgcggaatccagaacgaaatctag

SEQ ID NO: 57135 - DNA, 1293 bp, Artificial Sequence
  Description of Artificial Sequence: Synthetic coding sequence
atggcggaggccgtgctgatcgatttgtttggtcttaagctcaactcccagaagaactgtcaccaaaccctgctcaaaactctcaacgctgtccagtaccatcacgccgcaaaagccaagtttctgtgcattatgtgctgttccaatataagttatgagagggatggcgagcaggacaactgtgaaatagagaccagtaacggcctaagtgcgctcttggaggagttcgagattgtgtcctgtcccagtatggccgctacactttacacaatcaagcagaaaatcgacgaaaagaacctatcgtccatcaaggtcatagttccacgacaccggaagaccttgatgaaggccttcatagaccagttgtttacggatgtttacaattttgagttcgaggatctccaggtgacgtttaggggaggcctgttcaagcagagtattgagatcaatgttataacagctcaggaattacgcggtatacagaatgagatcgaaacattcctgcgaagcttgccggctctgcgcggaaaattgactatcatcacatcctccttaatcccagacattttcatccacggcttcacaactagaaccggtggtatttcctacatcccgacgctgtccagttttaacctcttctctagtagtaaaagacgggaccccaaagtggtcgttcaggaaaacctgcgtcgccttgccaatgcagcaggcttcaatgtcgaaaaattctaccgaatcaagacacatcatagtaacgacatctggattatggggaggaaggagcccgattcctacgatggcatcaccacaaatcagcggggagttaccatcgctgctctgggcgcagactgcatcccgatcgttttcgcggacccagtgaaaaaggcatgcggagtagcccatgccggatggaaaggcaccttacttggtgtagccatggccacagtgaacgctatgatcgctgaatacgggtgcagcctggaggatatagtcgttgtgctggggccttccgtcggtccctgttgtttcaccctgcctcgggaatctgctgaagcattccacaatctgcatcccgcatgcgtgcagttgtttgattctcccaacccgtgtatagatatcagaaaggcaacccgcattcttctggagcaaggcggtatcttgccccagaatatccaggaccagaaccaggacctcaatctgtgcacttcttgccatccagataaattcttttcacacgtgagagacggactgaatttcggcacacagattgggtttatttccataaaggaatag

SEQ ID NO: 57136 - DNA, 5471 bp, Artificial Sequence
  Description of Artificial Sequence: Synthetic coding sequence
atggcgctgtcatctgcttggaggtctgtgctgccactttggctgctctggtccgctgcttgttcccgcgctgcaagcggagatgataatgccttccccttcgacattgaggggagcagtgccgtggggcgacaagaccctcccgagacatcagagcccagagttgccctgggtagattgccccctgctgccgaaaagtgcaacgctggattttttcatactctcagcggagaatgcgtgccatgtgactgcaacgggaattccaatgaatgtttggacggcagcggatattgtgttcactgtcagaggaacacaactggtgagcattgtgaaaagtgcttggacggttacatcggcgattccatccggggagcccctcagttttgccaaccctgtccttgccctcttcctcatctggcgaactttgctgagtcctgctacagaaaaaatggcgctgtgaggtgcatctgcaatgagaactacgccggaccgaactgcgagcgatgcgcccctggctactatggcaatcccctgctgataggaagcacctgcaagaaatgtgattgctcgggaaacagtgaccccaatctgatcttcgaagactgtgatgaggttacagggcaatgccgaaactgcctgcgtaacaccactggcttcaagtgcgaaagatgcgctccaggctactacggcgatgcacgcatcgccaaaaactgcgctgtatgcaactgcggaggcggtccttgcgatagcgtaacaggagagtgcttggaagaagggtttgaacccccaactggtatggactgtccgacaatcagctgtgacaaatgcgtgtgggacctgactgacgatctgcgcctggccgcattgagtatagaagaagggaaaagcggagtactgtcagttagctcaggcgcagctgcccacaggcatgtgaacgagattaacgcaacaatatatctgcttaaaactaagctgagtgagcgggagaaccagtatgcactgaggaagatacaaataaataatgcggaaaataccatgaaaagtctcctttctgatgtcgaggaattagtggaaaaggaaaatcaggcgtcacggaaagggcagctggtgcagaaggagagcatggacacaatcaatcatgcttctcagctagtcgaacaggcgcatgacatgcgagataagatccaagaaattaacaacaaaatgctgtactacggggaggaacatgagctctctccaaaggagatttccgagaagctggtcttggcgcaaaagatgctcgaggagattaggtctcggcagccattctttacccagcgtgagctcgtggatgaagaggctgatgaagcctacgaactcttatcacaggcagaatcgtggcaaaggctgcacaacgaaacccgcacattattccctgtggtgctggagcagctggacgactataacgctaagctgagtgacttgcaggaagccctggaccaggctctcaattacgtccgtgacgctgaggatatgaatagggctactgccgcacgccagcgcgatcatgagaaacagcaagaaagagtgcgcgaacagatggaggtagtcaacatgtctctctccacctccgcagattccctgacgactccacggctcactttaagtgagctggacgatattataaaaaacgcctccgggatctacgccgaaatcgacggcgcaaagtccgaactgcaggtcaagctgagcaatctgtctaacctcagccacgacctcgtgcaggaggctattgatcacgcccaagacctgcaacaagaggcgaacgaacttagcagaaaactgcattcatcggacatgaacggcttagtacagaaggctctagatgcatccaatgtctacgaaaacatcgtgaattacgtatccgaagcgaatgaaaccgctgagttcgcgctgaataccacggatcgcatatatgatgctgtttcgggaattgatacacaaattatataccacaaggatgagagtgaaaacctgctgaatcaggcccgagagctgcaagctaaggcagaatcctccagcgacgaagccgttgccgacacttcccgacgcgtggggggagctttagcgagaaagagcgccttgaaaacaagactcagcgacgcagtgaaacaactgcaggcggctgaacgcggtgatgcccaacagagactcggccagtctagactgattactgaagaggccaatagaacaacaatggaggtccagcaggccacagcgcctatggctaataacttgactaactggtcacagaatctccagcacttcgattcgtccgcctataacaccgccgtaaattccgctagagacgccgttcgaaacctaactgaagttgtgccccagctcctcgatcagctgagaacagtcgaacagaaacgcccagcttccaatgtgtccgccagcattcagcgtatccgtgagctgatagcacaaacaagaagcgtggcttcaaagattcaagtgtcaatgatgttcgatggacaatcagccgtggaggtgcactctaggacctctatggatgaccttaaggccttcacttcactgtccctctatatgaaaccaccagtcaagaggcctgaactaaccgaaacagccgaccagttcattttgtacctgggcagtaagaacgccaaaaaggagtatatgggacttgccatcaaaaacgacaacctcgtttacgtctataacttggggaccaaggacgtggaaattcctcttgactccaaacctgtatcttcctggcccgcttacttttccatcgtaaagatcgagcgagtaggtaagcacggcaaagtctttctgactgtgccatctctgtcaagcaccgctgaggaaaagtttatcaagaagggtgagttttctggtgacgactcccttctcgacctggatcctgaagacactgtgttctatgtcggaggggtgccttcaaactttaaattgcccacatccttgaatctgccgggatttgtgggatgcttggagctggccacacttaacaatgatgtaatcagcttatacaatttcaagcacatctacaacatggacccgagcacatcagtgccctgtgccagagacaagctggcgtttacacaatctcgagccgcaagttactttttcgacggctctggatatgccgtggtgagggacatcacccgcaggggtaagttcggtcaggtcacacggttcgacatcgaggtcagaactccagccgacaacgggttaatcctgctcatggtcaacggctccatgttcttccggctcgaaatgcggaatgggtatttgcacgtcttttatgattttggcttcagtggcggacctgttcacctcgaagacacactgaaaaaagctcaaattaacgacgccaaataccatgaaatttccataatctatcataatgataaaaagatgattttggtggtggacagacggcatgtaaagagcatggacaacgaaaagatgaagattccatttacagatatctacataggtggcgcacccccagaaatcctgcagtctcgagccctgagggctcacctgcctctggacatcaacttccgtggctgtatgaaaggattccagtttcaaaaaaaggacttcaacttactggaacagacagagacactgggagtgggctatgggtgtcccgaggacagtctgatcagcaggcgcgcttacttcaacggccaaagctttatagcatctatccaaaaaatatcttttttcgacgggttcgaaggaggtttcaactttagaactctgcaacctaacgggttactgttctattatgctagcgggagcgatgtgttctcaattagtcttgacaacggaactgtcataatggacgttaaaggcattaaggttcagagcgtagacaaacaatataatgacgggctgtctcactttgtgattagctccgtctctccaactcgttatgaactgatcgttgacaagtcgcgggtgggatcaaagaatccaactaagggtaagattgaacagactcaagcctctgagaagaaattctactttgggggaagtccgatctccgctcagtatgcaaatttcactggctgcatctctaatgcctactttacgcgcgtggatcgagacgtggaagtagaggacttccagcggtacaccgaaaaagtccacacttccctgtacgagtgccccatcgaaagtagtcctctttttctgctccataaaaagggcaagaatctgtccaaaccgaaagcgagccaaaacaaaaaagggggaaaaagtaaggatgcaccatcttgggatccagtggccttgaagttaccagagaggaacaccccacgtaatagccattgccacttgtccaattcacctagagccatcgagcatgcctatcaatatgggggaactgctaatagccggcaggagttcgaacatctgaagggagacttcggggctaagtcgcaatttagtatccgcttaaggacacgctcttcacacggaatgattttctacgtttcggaccaggaagagaatgatttcatgactctcttcctggctcatggcaggttagtttacatgttcaacgtgggccacaagaaactgaaaatccgcagtcaagagaagtataacgacgggctctggcatgatgtgattttcatcagagaaaggagtagtggccgattggtgatcgacggtctccgcgttctggaggaaagtctaccccctactgaggccacatggaaaattaagggaccgatctaccttggaggcgttgctcctggcaaggctgtgaaaaatgtgcagatcaacagtatctactccttctctggttgcctcagcaatctgcagctgaatggagcctctataacctccgcctcacagacttttagcgtcaccccgtgtttcgaaggccctatggaaaccggtacctacttctctaccgaaggcggttacgtcgtgctggatgaaagttttaatattggactgaagtttgagattgcgtttgaagtgcgcccaagatctagcagcgggacacttgtgcatgggcactcagttaacggcgaatacctgaacgtccatatgaagaatggacaggtgatcgtcaaagtgaataatggtattagagacttctcgacaagtgtcactcctaaacaatccttatgtgacggtcggtggcatcgcattactgtgattcgagattcgaacgtggtacagctggacgtggattccgaagttaaccacgtggtgggcccactgaacccaaagcccatcgaccacagggaacccgtctttgttgggggagtgcccgagagcctgctgaccccacgattggctccctctaagccatttacgggatgcatccgacatttcgtgatcgatggacatcccgtgtcgttctccaaggccgctctggtgagtggggctgtgagcattaattcctgtcctgctgccta

SEQ ID NO: 57137 - DNA, 363 bp, Artificial Sequence
  Description of Artificial Sequence: Synthetic coding sequence
atggcccttagctctgcgtggcggtctgttctgcccctttggctcttgtggagtgccgcatgcagcagagcagcgtccggcgatgacaatgccttcccgttcgatatagaggggagctcggctgtggggcgtcaggaccccccagaaacgtctgagcccagggtagctcttggaaggttgcccccagccgcagaggtccagtgcccatgtcactgccacccagcaggcgctccagcccctccgcgtgctgttccccacagctcattctctttgtccccaccattgtctagcccccaatgcctcgagtcatttacatgggctcgctcagtgcgcaagctggaaattaaaagcttcccattgtag

SEQ ID NO: 57138 - DNA, 1263 bp, Artificial Sequence
  Description of Artificial Sequence: Synthetic coding sequence
atggatacgaagcgatgtttcgcaaaccgcttcgatgattaccagggaagccttttggccggtcagtgcgaggaggctgtggcccctctggtcacagcaacaattgagagaatcctccaggagctgcccccattgggaggaggtgctgaggcaaggggtgcgaccgccggtgcctcagcgtgtcaaggaggattgtacgggggtgttgccggtgtcgcgtatatgctctatcacgtatcacagtccccgctctttgcgaccgctagagagcgctatttaaggagtgctaaaaggttgattgacgcctgcgcacgcgctgaagagtggggggaacccgatgctgatacgcgagctgcatttctcctgggaggggcaggcgtttacgccgtagccaccttggtttaccacgccctgggcaggtctgattatgttcagccgcttggcaagttcagggcactctgcgccgtgtgcgcccctgtaagtttcctcgagtgcggcagcgacgagctctttgtgggtcgagcaggttacctctgtgccgcactggttttgaagcagaaactggcccaggaagttctcacacccgctcagattaaaagtatttgtcaggccatcctagacagcggcaaacagtatgccatcaagaaacggaagccgttcccattgatgtattcatattacggaactgagtatctcggcgctgctcacggtctgagtagtatcctccagatgctgctctcctatcacgagcacctcaagcctagcgaccgcgagctggtctggcagtctgtggatttcctcatggaacaggaacagaattgtaattggccgccagaattgggagaaactatagagcgggaaaatgaattggtgcattggtgccacggtgcgccagggattgcctatctgttcgctaaggcgtacctagtctcaaagaagccccaatacctggatacctgcattagatgtggtgagctcacatggcaaaaaggtctgctgaagaagggacctggtatttgccacggggtcgccggaagcgcttacgtcttcctgcttctctaccgcttgactggcaattcaaagtacatttatcgtgcgcaacggttcgcacaattcctgttcaccgaggagttcaaggcaggatctcgagtgctcgagtccatttactctctttacgaaggcttttccggaactgtatgctttctgatagatctgctccagcccaatcaggccgagttccccttgttttccgtcttcgtttag

SEQ ID NO: 57139 - DNA, 1167 bp, Artificial Sequence
  Description of Artificial Sequence: Synthetic coding sequence
atggatacaaaacgctgctttgccaatcgctttgacgattaccagggttctctgttggcgggacaatgcgaggaggccgtggctccactcgtgaccgccactattgagaggatactccaggaactgccccctttaggaggcggagccgaggcccgtggcgcaacagcgggagcctccgcttgccagggcggattgtacggaggagttgccggagtcgcatacatgctctaccatgtctcccagagcccgctcttcgctaccgcaagggagcgctatctgaggtccgccaaaagactgattgatgcctgtgctagggctgaagaatggggtgaaccggatgccgataccagagcggcattcttgttgggaggggctggggtgtatgccgtcgctacgctcgtctaccacgcccttggccgatccgactacgtgcagcctttgggaaaatttcgcgcattgtgcgccgtttgcgccccagtttctttcctggaatgcgggagcgatgaactgtttgtgggaagagccggttacctgtgcgcagctctggttcttaaacagaagcttgctcaagaggtgttaactcctgcgcaaatcaaatctatctgccaagccattctggattccgggaagcagtatgccataaaaaagagaaaacctttccctctgatgtatagctattacggcactgaatacctgggcgctgcccatggtctctcatcaatcttgcaaatgctgctcagctaccatgagcacttgaagcctagcgaccgcgagctcgtttggcagagcgtggatttccttatggagcaggagcagaactgcaactggcccccagagctgggcgaaacgatcgagagggagaacgagttagtgcactggtgccacggggctcccggaattgcctacctttttgccaaagcatacttggtgagtaagaaaccacagtacctggatacctgtatcaggtgcggagaactgacttggcagaaaggtctcctgaagaagggacccggtatatgccacggcgttgccggaagcgcttacgtgtttctgctcctgtacagactgacaggcaattcaaagtatatctatcgggctcaatcctcttttccagttaatctgataaaaatggagcacttactatacactcgacaacattgcttctag

SEQ ID NO: 57140 - DNA, 243 bp, Artificial Sequence
  Description of Artificial Sequence: Synthetic coding sequence
atgagtcagcagaagcagcaatcatggaaacctccaaacgtccccaagtgttccccacctcagcgcagtaatccgtgcctagcgccttactccactccctgcggcgcacctcattcagagggttgccactcaagcagccagcgtcccgaagttcagaaacctagaagggctcgccaaaaactgcgatgtctgtctagagggactacatatcactgtaaggaagaggagtgtgaaggagattag

SEQ ID NO: 57141 - DNA, 4410 bp, Artificial Sequence
  Description of Artificial Sequence: Synthetic coding sequence
atgtggccctcgcagctccttatattcatgatgcttttggcaccgataattcatgccttcagcagggcaccaataccaatggcagtagtgagaagagagctgtcctgtgagtcatatccaattgagttaaggtgtcccggtactgacgtgataatgattgagtctgctaactacggtaggacagatgacaagatttgtgacagtgatccagcgcagatggagaacatccgttgctatttacccgacgcatacaagattatgagccaacgctgtaataaccgcacccagtgcgccgtcgtagcagggcctgacgtgtttcccgacccctgcccgggtacatataaataccttgaggtccagtacgagtgcgtgccctacaaggttgagcagaaggtgtttctttgtccgggtttattaaaaggagtctaccagtctgagcatctttttgagagcgatcaccagtcaggtgcatggtgcaaagaccccctgcaagcctctgataagatctactacatgccatggacgccctacaggaccgatacgctgaccgaatattcaagcaaagacgatttcatcgccggtcggccaacaaccacgtataagctcccacatcgcgtagacggtaccggctttgtggtctacgatggggcactgttctttaacaaagaaaggacaaggaacatcgtgaagttcgacctcagaactaggatcaagtccggcgaggccattattgccaatgctaactaccacgatacttctccctaccggtggggcggtaagagtgatatcgatctggcagttgacgagaatggcctctgggtgatctacgccacagaacagaataacggaaagatcgtgatcagccaactgaacccttacaccctgagaattgagggaacttgggacaccgcttacgacaaacggagcgcgtccaatgcttttatgatatgtggaatcctgtatgtagtaaaatcagtttacgaagacgatgacaacgaggccactggcaataagatagactacatttacaatacagaccagagtaaagattctctggtcgacgtcccatttcctaatagctaccaatacattgcagcggtggattataacccccgtgacaacctgttatacgtgtggaataattaccacgtggtgaagtatagcttagacttcggtcctctagattcgcggtccggccaggcccaccacgggcaggtgagttatatttcccctccaattcaccttgatagcgagttagagagaccaagcgtaaaagatatcagtaccactggaccccttggtatgggatctacaaccacctcaacaactcttaggaccacaaccctgagcccgggaagatccaccactcctagcgtgtccggaaggcgaaataggtccactagtaccccgtcgccggctgtggaggtccttgacgatatgaccactcatctacctagcgcttcatcccagattccagcattagaagaatcttgcgaggctgtcgaggcgcgtgaaatcatgtggtttaaaacccggcagggtcagatcgccaaacagccctgtcctgccggaacgatcggcgtgtccacatatctgtgtctggctcctgacgggatttgggatccccaaggccctgatttaagcaactgttcttcaccatgggtgaaccacataacgcagaaattaaaaagcggggagaccgccgcaaacattgcccgtgagctggctgagcagacgaggaatcaccttaatgcgggtgacataacttatagcgttagagctatggaccagctggtgggacttctggatgttcaactgcggaatcttacaccgggtggaaaagatagtgccgcacgctctctgaacaagttgcaaaagcgggagcgctcatgccgcgcttatgtgcaggccatggtcgagaccgtgaataacctcctgcaaccacaggcccttaatgcttggagagatctgaccacctctgatcagctgcgcgctgccactatgctgctgcacaccgtcgaggaatccgcatttgtgctcgcagataatttactcaagacagatatcgtaagggaaaacactgataatattaaactcgaggtggcaaggttgagtacagaagggaatttagaggatttgaagtttcccgagaatatgggccacggatctaccatccagctatcggcaaatacactcaagcagaatgggaggaatggggagatacgggtggcattcgtcctttacaataacctgggaccctatctgagtacagagaacgcgtctatgaagttgggaaccgaagcactctccaccaaccatagcgtgatcgtaaactcaccagtgattacagctgctataaacaaggagttctcaaataaggtttacctagcggatcctgttgtcttcacggtgaaacacatcaagcagtcagaagaaaacttcaatcccaactgttccttttggtcctattcaaagcggacaatgactggctactggagcacacagggatgtcgcctcctgacaacgaataaaactcatacaacttgcagttgcaaccacctgaccaacttcgccgtgctgatggcccatgttgaggtcaagcattccgacgccgttcacgacctgctgttagacgttattacgtgggttggcattctgttgtccctagtttgcctgctgatttgtatcttcacattctgcttctttaggggattgcaatctgaccggaatactatccataagaacctgtgtatctccctatttgttgccgaactgctgtttcttattggaattaatcgaaccgaccagcccattgcttgcgcagtgtttgccgcactattgcacttcttctttcttgccgcatttacgtggatgttcctcgaaggagtacagctttacatcatgcttgtggaggtgttcgagagtgagcattcccggcgtaagtacttctatttggtcgggtacggcatgcctgccttgattgtagccgtgtcagctgctgtggattaccgctcatacggcacagataaggtgtgctggctccggctggacacttattttatctggtcctttatcggccctgccacgctgatcattatgcttaacgttatctttttgggcattgcactatacaagatgttccatcacactgctattctgaagccagagtctgggtgtctggataacatcaattatgaggacaataggccctttatcaagtcatgggttatcggcgctatcgctcttctgtgtctgctagggctcacgtgggcatttggcctgatgtatatcaatgaaagcaccgttatcatggcctaccttttcactatttttaacagcctgcagggtatgttcatattcatcttccattgtgtactacagaaaaaggtccgaaaggagtacggtaaatgtctgcggacacattgctgctcaggcaagtcaaccgaatcctctatagggtcagggaagacatcgggaagccggacccccggacggtacagcaccgggtctcagagtcgaatccgcaggatgtggaacgatactgtgcggaagcagtctgagtcatcattcatcacaggagatatcaactcctccgccagccttaatagagaaggcctgcttaacaatgctagagatacctctgtgatggataccttaccgttgaacggtaatcacgggaacagctattctattgcatcgggagagtatctctccaactgcgtacagataattgatagggggtacaatcacaacgagacagctctagagaagaagatcctgaaggaactgacctctaactatatacctagctacctgaataaccatgaacgttcttctgagcagaacaggaacctgatgaacaagctggtcaataatctgggcagtggcagggaagacgatgccatcgtgttagacgatgccacaagctttaaccacgaggaatcactgggactcgaactgatccacgaagagtcggatgcacccctattgcccccacgggtttactctaccgagaatcaccagccgcatcactacacacgccgtcgtatccctcaagaccactcagagtctttttttcccctcctgacaaatgaacacaccgaggatctgcagagcccacacagggattcgttatacaccagcatgccaactctggcaggcgtggccgcaacagagtcagtgacaacctcaacacaaactgagcctccccctgccaagtgcggcgacgccgaagacgtctattacaagtctatgccaaatctcggctctaggaatcatgtccaccagctccacacgtactaccaactgggccgaggctcttccgatgggttcattgtgccaccaaataaggatggcacacccccagagggctctagcaaaggtcctgcacatctcgtcacctcactgtag

SEQ ID NO: 57142 - DNA, 2013 bp, Artificial Sequence
  Description of Artificial Sequence: Synthetic coding sequence
atgtccttggcggacctgaccaaaaccaatatagatgaacatttcttcggggtggcattggagaataatagacggtcggccgcatgtaagaggtcccctggcacaggcgacttctctcgaaactccaatgcctctaataagtccgtcgattactctaggtcccagtgttcatgtggatccctgagttcccaatatgattacagcgaagatttcctgtgcgactgtagcgaaaaagctatcaatagaaactatctcaagcaaccagttgtgaaggagaaggagaagaaaaagtataacgtttctaagatcagccagagtaagggacagaaggaaatttctgtggagaagaaacatacctggaatgcatctttgttcaatagccagatccacatgatcgcccagagaagggatgccatggctcatagaattctaagtgccaggttgcacaagatcaaaggactaaagaacgagctggctgatatgcatcataagctggaggccatcttaacagaaaaccagtttctgaaacaactgcagctgcgtcacctgaaagccattggaaagtatgagaactcccagaacaaccttccccagataatggccaaacatcagaacgaggtcaaaaacctgcgccaactgctccgtaaaagccaggagaaagaacgtacacttagcaggaagttacgagaaactgacagtcagcttctgaagactaaggacatactccaggcgcttcagaagctcagtgaggataaaaacctggcagagcgcgaagagctgactcataaactgagtattattacgaccaagatggatgcaaacgataaaaaaattcagtcccttgagaagcagctgagactcaactgccgcgctttctccagacagcttgccattgagacccgaaagaccctcgctgcacagacagccaccaagaccctccaagtggaggttaagcacctgcagcaaaagctgaaggaaaaggaccgggagctggagatcaagaacatctactctcatcggattctgaagaatctgcatgatacagaagactatcctaaggttagttctacaaaatcagtgcaggctgaccgaaagatcttgccctttactagcatgcgccaccagggcacacagaaatctgacgtgcccccattaaccactaagggcaagaaggccaccgggaacatcgatcataaagagaagtctacagaaatcaatcacgagattccacactgcgtgaataaactgcctaagcaggaggactctaagagaaaatacgaagacctatcaggggaggaaaagcatctggaagttcaaattctgctggagaacacaggcagacagaaggacaaaaaggaggatcaagagaagaagaatatttttgtgaaagaagagcaggaactccctccaaagattatcgaggtcattcatcccgagcgtgagtctaatcaggaggacgtcttagtgcgcgaaaaattcaaaagaagcatgcagaggaacggagtggacgatacccttggaaaagggacggccccttacaccaagggccctctaaggcaaagacgccactattcttttacagaggcaacggaaaatctgcaccatggactgccggcatccgggggtccggctaatgccggtaatatgaggtatagtcacagtacagggaagcaccttagtaatagagaggagatggagttggagcacagcgattcagggtatgagcctagctttggcaagagtagtagaataaaggtgaaagacaccaccttcagggataagaaaagctcattaatggaggaactattcggctccgggtatgtgcttaagacagatcagtcctccccaggagtggcaaaagggtctgaagagcccctgcagtcaaaagagtcccaccctctgcccccaagtcaggccagcaccagtcatgcctttggtgactctaaggttacagttgtaaattccatcaaacccagctctcccactgaaggcaaacgcaagatcattatttag

SEQ ID NO: 57143 - DNA, 2013 bp, Artificial Sequence
  Description of Artificial Sequence: Synthetic coding sequence
atgagtctggcagatctcaccaagacaaatatcgatgagcattttttcggcgttgccctcgaaaataaccgccgatctgccgcttgtaagaggtccccaggcactggggatttttcccgaaattctaatgcctccaataaatctgtagattatagcagatcacaatgttcatgtggtagtctaagttcacaatatgactacagtgaggactttctgtgtgactgctccgagaaagcaatcaatagaaattatctgaagcagccagtagtgaaggagaaagaaaaaaaaaaatacaatgtatccaagatatcccaaagtaagggtcaaaaagagattagcgttgaaaagaagcacacatggaacgctagtctcttcaatagtcagatccatatgattgcccagagaagagacgcgatggcacacaggattctatcagccagacttcacaaaatcaaagggctaaagaacgaacttgctgacatgcaccacaaactagaagccatcctgacggagaaccagtttctgaaacaactgcaactcaggcacctcaaagcaatcggtaagtacgagaattctcaaaacaacttgccccagattatggccaaacaccagaatgaggttaagaacctcagacagctgcttcgtaaatcgcaagaaaaagagcgcacactttctcggaagctcagggagaccgactcccagcttttgaagactaaagatatcctgcaagcgttgcagaaattgtccgaggacaagaatttggcagagcgcgaggagcttacccataagctgagtattattactacaaagatggatgcgaatgacaaaaagatccagagtctggagaagcaactgaggctgaactgtcgagccttctcgcgacagttagctatcgaaactcggaaaaccctcgctgcccagaccgccacgaaaaccttgcaggtcgaagttaagcacttgcaacagaagctgaaggaaaaggaccgcgaattggagatcaaaaatatttatagccatcggatcttaaagaatctacacgatacagaagattatccaaaggtgtcatcaactaaaagcgttcaggccgataggaagattttgccctttacaagtatgcggcaccagggtacacagaagtccgacgtgccacccctgactaccaagggtaagaaagctaccggcaatatagaccacaaagaaaaaagtacagagatcaaccacgagatcccacactgcgtgaacaaactccccaagcaggaagactctaagcgtaaatacgaagacttatctggagaggaaaaacacctcgaagtgcagatcctgctcgagaatactggcaggcagaaagataaaaaagaagaccaggagaagaagaatatcttcgttaaggaggagcaggagctgccccctaagatcattgaagtgattcaccctgagagggaatcaaatcaggaagacgtcctggtgagagagaagttcaagcggtcgatgcaaaggaacggagtggacgataccttgggaaagggaaccgcaccatacaccaaggggccactgcgccagaggcggcattattcctttaccgaggccacggagaacctgcatcatggtcttccagctagcggaggccctgctaatgccggtaatatgagatattctcacagcacaggcaagcatctgtcgaacagagaagaaatggagctagaacattccgactctggctacgaaccttcgttcggcaaatcctcacgcatcaaggtgaaggatacgacgttccgcgacaagaagtctagcctgatggaggaactgttcggtagcggctatgtactgaaaaccgaccaatcatcacctggcgtggctaaaggttccgaagagcccttgcagtctaaagagagccatccgttacctcctagtcaggctagcaccagccacgctttcggcgactcaaaggttactgtcgtaaactctattaaacctagttccccgaccgaggggaaaagaaaaatcatcatttag

SEQ ID NO: 57144 - DNA, 2013 bp, Artificial Sequence
  Description of Artificial Sequence: Synthetic coding sequence
atgagcctcgctgatctgaccaagaccaacattgacgaacacttctttggtgtcgcactcgaaaacaaccggagaagtgccgcatgtaagcgtagtccaggaaccggagatttctctcgcaactctaatgcttctaacaaaagcgtggattacagtaggagtcagtgttcatgtggcagtctctcctcccaatatgattacagtgaggacttcttgtgtgactgtagcgaaaaggccattaaccggaattacctcaaacagccagtggtgaaggaaaaggagaagaaaaagtataacgtcagcaagatcagtcagtctaaggggcagaaggagatatctgtggaaaagaagcatacttggaacgcttcacttttcaactcccaaatccacatgatcgctcagaggagagacgcaatggcccaccggatccttagcgctcgactgcataaaattaaagggcttaaaaacgaactggccgatatgcaccacaagctggaggctatcctgaccgagaaccagtttctgaaacagttgcagttaagacatttgaaggctattggaaaatacgagaatagtcagaataatctcccacagatcatggctaaacaccagaacgaagtgaagaatctccgccaactcctgagaaaaagccaagagaaagaaaggacgctctcgaggaagctgcgggagactgacagtcagttactcaaaaccaaagacatattgcaggcattacagaagctgtctgaagataaaaacctcgcggagcgcgaggagctgacacacaagttaagtattattactactaaaatggacgctaatgataaaaaaattcagtctctggagaagcagctgcgccttaattgcagagccttcagccgacaactagcaatcgagacccggaagacactggccgctcagacagccacgaaaaccctgcaggttgaagttaaacatttacaacagaagttaaaagaaaaagatagggagctggaaataaagaacatatactcgcaccggattctgaaaaacctgcatgacacagaagactatcctaaggtaagcagcactaaatccgtccaggctgacaggaaaatcctcccgtttacatcaatgcgccatcaagggacacagaaaagtgacgtccctcctctcacaacgaaaggtaaaaaggcgacaggcaacattgatcacaaggaaaaaagcaccgagataaaccatgaaatcccacattgcgtgaataagttgccaaaacaagaagacagcaaacgcaaatatgaagacctgtccggtgaggagaaacatctagaggtgcagatcctgctggaaaatactggccgtcagaaagataagaaagaagaccaggaaaagaaaaacattttcgtcaaggaagagcaggaactaccaccgaagattatcgaggttattcacccggaacgcgagagcaaccaggaagacgtcttggtccgcgagaagttcaagagatccatgcagcgaaacggcgtggacgacacccttggcaaaggcacggccccatacactaaaggccctctacggcaacgacgccactactcctttaccgaagcaaccgagaacttgcaccatggtttaccggcaagcggaggtcctgcaaacgcgggaaacatgagatactctcattcaactggaaagcacctcagcaatagggaagagatggagcttgaacactccgactctggctacgagcccagcttcggcaaaagctcaaggattaaggttaaagatactactttccgtgataaaaagtcctcattgatggaagagctgttcggctcaggctatgtgctgaagactgatcagtcatcgcctggcgtcgctaagggaagtgaggagccactgcagagcaaggagtcccatcctctccccccttcccaggcgtcaacaagccatgcatttggcgactccaaggtcacggtggtcaactccataaaaccttcttcccctacagagggaaagagaaagataattatctag

SEQ ID NO: 57145 - DNA, 282 bp, Artificial Sequence
  Description of Artificial Sequence: Synthetic coding sequence
atgagtctcgccgatctgacgaaaaccaatatcgacgaacacttcttcggggtcgcgctggaaaacaataggaggagcgctgcatgtaagcggtcacccggtacaggcgacttctctcgtaactccaatgctagtaacaaatcagtggactactcccgcagccagtgtagttgcggaagtctgagttcacaatacgactacagcgaagacttcctctgtgactgcagtgagaaagcgatcaatcgtaactacctgaagcagcccgttgtgaaggaaaagtag

SEQ ID NO: 57146 - DNA, 210 bp, Artificial Sequence
  Description of Artificial Sequence: Synthetic coding sequence
atgtcactcgccgatttgaccaaaaccaacattgacgagcattttttcggcgtcgctcttgagaataatagacgttctgcagcttgcaagagatctcccggaaccggagacttcagccgcaatagcaacgcttccaataaatccgtcgactatagccgttcccagtgtagctgtggcagcctgtcttcccaatacgactatagcgagtag

SEQ ID NO: 57147 - DNA, 570 bp, Artificial Sequence
  Description of Artificial Sequence: Synthetic coding sequence
atgtccctcgctgacctcacaaaaaccaacattgacgaacactttttcggcgttgcactggaaaacaaccgtcgttccgccgcttgcaagcgctcacctggcaccggagacttctctcgcaatagcaacgcgtctaataagtccgttgactactctcgttcgcagtgttcctgtggttccctgagttcccaatatgattacagcgaagacttcctgtgcgactgctccgagaaagctattaatagaaactacctgaagcagcccgtggttaaagagaaagagaaaaaaaaatacaacgtgagcaaaatttcgcagtcaaaaggccagaaagagattagcgtggaaaaaaaacacacctggaacgccagtttgttcaattcacagatacatatgatcgcccaacgaagagacgccatggcccataggatactgtccgcaaggctgcacaagatcaaggggttgaaaaacgaactcgccgacatgcaccacaaactcgaggcgattctcacagaaaaccagttcctgaagcaactgcaattacgtcatctgaaagctatcggcaaatattag

SEQ ID NO: 57148 - DNA, 192 bp, Artificial Sequence
  Description of Artificial Sequence: Synthetic coding sequence
atgtcccttgcagatttaaccaaaacaaatatcgacgaacactttttcggcgtcgcccttgaaaacaatagacgtagcgccgcttgtaaaagaagtcctggtaccggtgacttttctagaaattctaacgcgtcaaacaagagtgttgactattctaggagccagtgcagctgcgggtccttgtcatcttag

SEQ ID NO: 57149 - DNA, 288 bp, Artificial Sequence
  Description of Artificial Sequence: Synthetic coding sequence
atgagtctcgccgatctgactaagaccaatatcgacgagcatttcttcggcgtggcactggagaataatagaaggagtgctgcatgtaagcgaagccccggaacgggcgattttagccgcaattctaacgccagtaacaaaagcgtcgattacagcagatcccagtgttcctgcggctcgctgtctagccagtacgactatagcgaagatttcttgtgcgactgctctgagaaagccatcaacagaaattacctcaagcagccagtcgtgaaggaaaaagagaagtag

SEQ ID NO: 57150 - DNA, 285 bp, Artificial Sequence
  Description of Artificial Sequence: Synthetic coding sequence
atgagcctggctgacctcacaaaaactaacatcgatgaacatttcttcggagtcgccctggagaacaatcgaagatcagcggcttgcaaacgctccccaggtacgggtgatttttctcggaattcgaatgcctccaataaatccgtggactacagtcgttcccagtgtagttgcggatccttgagttcacagtacgattattcagaagattttttgtgcgactgtagcgaaaaggcgatcaacaggaattacctgaaacagcccgttgtcaaggagaaagagtag

SEQ ID NO: 57151 - DNA, 327 bp, Artificial Sequence
  Description of Artificial Sequence: Synthetic coding sequence
atgagtctggcagatctcactaagactaacattgatgaacacttcttcggagttgcattggagaacaacagaagatccgcggcatgtaagagatcccccggtactggcgacttctcaaggaatagcaatgctagtaacaagagcgtggattactcccgaagtcagtgtagctgcggttccctgtcttctcaatatgattactccgaagatttcctgtgtgattgctcggagaaggccattaaccgtaattacctgaagcagcctgtcgtgaaagaaaaggagaaaaagaagtacaatgtgtccaagatatcccagtccaagggttag

SEQ ID NO: 57152 - DNA, 33 bp, Artificial Sequence
  Description of Artificial Sequence: Synthetic coding sequence
atgagcctggcagacctgacgaagaccaactag

SEQ ID NO: 57153 - DNA, 93 bp, Artificial Sequence
  Description of Artificial Sequence: Synthetic coding sequence
atgagtttggccgacctgaccaaaaccaatatagacgaacacttcttcggcgtcgccctcgagaataatcgcagatccgcagcgtgcaagtag

SEQ ID NO: 57154 - DNA, 429 bp, Artificial Sequence
  Description of Artificial Sequence: Synthetic coding sequence
atgtcttttttgactgtaccgtacaaactacctgtttctttgtccgttggttcctgtgtgataattaaaggtacactgatcgattcttccatcaatgagcctcaactgcaggtggacttctacaccgagatgaatgaggactctgagatcgcattccatctgagggtgcacctcggacgaagagtggtgatgaattcacgcgagttcggaatctggatgctcgaggaaaatctgcattatgtcccatttgaagacggaaaacccttcgatctgcgtatatacgtgtgccttaacgagtatgaagttaaggttaatggcgagtacatatatgcgttcgtgcatagaattcctcccagttatgtcaagatgatacaagtgtggcgcgacgtgtccttagattcagtcctggtgaacaatggcagacgatag

SEQ ID NO: 57155 - DNA, 1071 bp, Artificial Sequence
  Description of Artificial Sequence: Synthetic coding sequence
atggcattttcgggaagccaggcgccttatctatcccccgctgtgccattttcggggactattcaaggaggactccaggatggtttccaaatcaccgtgaatggcgcagtgctgtccagctcaggaacacgttttgcggtcgacttccagacaggattctcgggcaacgatatagcgtttcactttaacccgaggtttgaagacggtggttacgtggtttgtaatacccggcagaaagggcgatggggtcccgaggaacgcaagatgcacatgccatttcagaaggggatgccatttgacctctgctttttggtgcaatccagcgatttcaaagtgatggtgaacggctctctctttgttcagtactttcaccgcgttccatttcatcgtgttgatactatctccgtcaacggctcagtgcagttgagctatatcagcttccagaatccaaggacggttccagttcagcccgcattcagtacagtccctttcagtcaacccgtttgtttccccccacgacctcgcggaagaaggcaaaaaccgccatcagtgcggccagcaaaccccgctccgattactcaaacggtaatccacaccgtgcagtctgcctctgggcaaatgtttagccagacacccgctatacctcctatgatgtatccccatccggcttatccaatgcccttcataaccactattccaggaggactctacccgtctaaaagcatcatcctatcgggcaccgtcctgcccagtgctcagaggttccacatcaatctctgcagtggaagtcatattgccttccacatgaatcccaggttcgatgagaacgccgtcgttagaaatactcagatcaacaactcgtggggatccgaagagcgcagtctgcctcgtaagatgccttttgtcagaggacagtctttttccgtttggatcctctgtgaggctcattgtctgaaagtagctgttgatggccaacacgtgtttgagtattatcataggctccgcaatcttccaaccatcaacaaattggaggtgggaggcgacatccagttaacgcacgtgcagacgtag

SEQ ID NO: 57156 - DNA, 1068 bp, Artificial Sequence
  Description of Artificial Sequence: Synthetic coding sequence
atggcattctcaggaagtcaggccccataccttagccccgctgtgccattcagtgggacgatccaaggcggtcttcaggatggcttccagattacagtaaatggggctgtcctgtcttccagcggtacacgctttgctgtcgacttccagaccggattcagcggcaacgatatcgctttccatttcaacccaaggtttgaggatggtggctatgtggtttgtaacacacggcagaaagggcgatggggcccagaggaacgcaagatgcacatgccttttcaaaagggcatgccattcgacctgtgctttcttgtccaatcgtccgatttcaaggttatggtgaacggctccctgtttgtccagtattttcacagggttccattccatcgggtggacacaatctctgtcaacggaagcgtccagctgtcctacataagctttcaaaaccctagaactgtgcctgtacagccagcgttctctactgtgccctttagtcagccagtttgtttcccacctcgacccagaggcaggagacagaagccacccagtgtgagacccgctaaccctgcaccgatcacccaaacagtgatccacaccgtccaatcggccagcggccagatgtttagcaccccagctattccgccaatgatgtacccccatcccgcttatccaatgcccttcattacaaccatcccgggaggactgtacccgtcaaagagcatcatactttcgggcaccgtgctcccctccgctcagcgctttcatattaatctgtgttcagggagccacattgcctttcacatgaaccccagatttgacgagaacgcggttgttcgcaacactcaaatcaataactcctggggcagcgaggagaggtccttgccccgaaagatgccatttgtccgtggccagtcatttagcgtgtggattttgtgcgaggctcactgcttgaaggtcgccgtagatggccagcacgtctttgagtattatcatcggttgcggaacctaccaaccattaataagctcgaggtgggtggagacatacaacttacccacgtgcaaacttag

SEQ ID NO: 57157 - DNA, 1071 bp, Artificial Sequence
  Description of Artificial Sequence: Synthetic coding sequence
atggctttttccgggtgtcaagccccttaccttagtcccgcagtgccgttcagtggaaccattcagggcggtctgcaagacggattccagataaccgtgaacggcgcagtcttgtcatgttccggcacccggttcgcggtagatttccaaacaggcttctctgggaatgacatagcctttcatttcaatcctcgattcgaagacggtggatacgtcgtctgcaataccaggcagaaagggacttggggacctgaggagcgcaagatgcatatgccattccagaagggcatgccattcgatctgtgcttcctggttcaatccagcgactttaaagttatggtcaacgggagcttgtttgtgcagtatttccatcgcgtgccttttcacagagtagataccattagcgtgaacggcagtgtacagcttagttacatttcgtttcaaaatccacgcgctgtacccgtacagccagcgttctccacagtccctttctcccaacccgtttgcttcccccctagaccacgcggtaggcgacagaagcctccctcagtcaggcccgcaaacccagcacctattacacagactgtcatacatactgtgcaatccgctagcggtcagatgttttcccaaacgccagctatcccgcctatgatgtatccccaccccgcataccccatgccgttcattaccacaataccaggaggcctgtatccctcgaagtctatcatactgagtggaaccgtgttgccatctgcgcaacgctttcatatcaacctctgttctgggtcacacattgccttccatatgaatcctcggttcgacgaaaacgcagttgtgcgaaacactcagataaataattcctggggaagcgaggagagaagtctacccaggaaaatgcctttcgtgcgcggacagagtttttcagtttggattctatgtgaagcgcactgcttaaaggtcgccgtcgacgggcaacacgtcttcgagtattaccaccgcctccggaacttgcccaccatcaataaactggaggtagggggagatattcagctcactcacgtgcagacttag

SEQ ID NO: 57158 - DNA, 807 bp, Artificial Sequence
  Description of Artificial Sequence: Synthetic coding sequence
atgcacatgccctttcagaaggggatgccatttgatctgtgtttcctggtgcagtccagcgatttcaaggtcatggtgaatggctcactctttgttcagtattttcacagagtcccgttccacagagtggacaccattagtgtgaatgggtcggttcagctgtcgtatattagtttccagaaccctagggccgtgcctgtccagcctgcattcagcacagtgcctttctcacagcccgtgtgttttcccccacgaccccgtggtaggagacagaagcccccttcagttcgaccggctaacccagcccctataacccagacagtaatccacactgtgcagtctgccagcggccaaatgttttcacaaacccccgcaataccgccaatgatgtacccccatcctgcctacccaatgccctttatcacgactatccccggtgggctttatccttccaagagcattatactttctggcaccgttttgccctccgctcaacgattccacattaacctgtgcagcggttcccacatagcctttcacatgaaccccagatttgacgagaacgccgtcgtaagaaatacccagatcaataactcctggggaagtgaggaaagatcactccctcgaaaaatgcctttcgtccggggacagagtttttcagtgtggatcctctgcgaagcacactgcttgaaggtggcagtggacggccagcatgtgttcgagtattaccataggttgcgaaatctcccaactattaataagctcgaagtgggaggggacatccagctaacacatgtgcagacttag

SEQ ID NO: 57159 - DNA, 519 bp, Artificial Sequence
  Description of Artificial Sequence: Synthetic coding sequence
atggctggctccgttgccgattctgatgctgttgtgaagctcgacgacggacacttgaacaattccctctcctcacccgtccaggccgatgtgtatttccctcggttgattgtgcccttttgcgggcacataaagggtggcatgaggcccggaaaaaaggtgctggtgatgggcatcgtggacctgaatcctgagtcttttgcaatctcactcacatgtggagatagcgaggacccccctgctgatgtggcgattgagttaaaggctgtcttcactgataggcaacttctgcgtaactcatgcatctctggagagcgaggagaagagcagtccgcaataccttatttcccttttattcctgatcagccctttagggttgagattctatgcgagcacccgcgattccgtgtgttcgtagacggccatcagctcttcgatttctaccaccgaattcaaaccctctccgccatcgatacaattaagatcaatggtgaccttcagattacaaagctgggttag

SEQ ID NO: 57160 - DNA, 1497 bp, Artificial Sequence
  Description of Artificial Sequence: Synthetic coding sequence
atgagcacttttgggtatcggagaggcctgtctaaatacgaatctatcgatgaagacgagctgcttgcatcactaagcgctgaagaattgaaggagctggagagggagctcgaggacatcgaaccagaccgtaatctccctgtgggacttagacagaaatcattaacggaaaagactccaactggaacgttctcccgcgaggccttgatggcctactgggagaaagaatctcagaaactgctggagaaagagcgcttgggagagtgtgggaaagtggcagaggacaaagaggagtctgaggaagaagaggactccgacgaggaggaacggaccatcgaaacagcaaagggcatcaatggcactgtgaactatgatagtgtcaatagcgacaacagtaaaccgaaaatctttaagtcccaaatcgaaaacataaatttgaccaacggatctaatggtcggaacactgagtctcccgcagccatccacccctgcggaaatcctaccgttatcgaagacgctctggacaagattaagtccaatgaccctgatactacagaagtgaatttgaacaatattgagaatatcacgacccagacgcttactaggttcgcagaagcgctgaaggacaacaccgtggtcaagacattttcactcgccaacactcacgcagatgattctgccgcaatggctatcgctgagatgctcaaggttaacgagcatataactaatgtgaacgttgagagtaactttataacaggcaagggaatcttggcaataatgcgggcactgcaacataatacagtcctcacagagcttaggttccataaccagcgccacataatggggtctcaggtcgagatggagatagtcaagctgctgaaagagaacacaaccctacttcgactggggtatcatttcgagctgcctgggccaagaatgtccatgaccagtatactgacgcgcaatatggataaacagcgccagaagcgacttcaagagcaaaaacagcaagaaggttacgatgggggtcccaacctgcggactaaagtgtggcagaggggtacgccttcgtcttccccttacgttagtcctcggcactccccttggtcttcccctaaactgcctaaaaaagtgcagaccgtgagatcacgcccactaagcccagtcgcaacaccaccaccaccacctcctcccccactgcccgagaagaagctgatcacaagaaatatagcggaagttatcaagcagcaggagtccgcccagagagctctgcagaacggacagaagaagaagaaagggaagaaagtaaagaagcaaccaaattctatcctgaaggaaatcaaaaactcattgaggagtgttcaggagaagaaaatggaagacagctctagacccagcacaccccagcggtcagcacacgaaaacctgatggaagctattcggggatcgagtataaagcagctcaagagggtggaagtccctgaagctctgaggtag

SEQ ID NO: 57161 - DNA, 1524 bp, Artificial Sequence
  Description of Artificial Sequence: Synthetic coding sequence
atgtctactttcggttatcggcgaggcctgagcaaatatgagtccattgatgaagatgagctgttggctagcttgtctgcggaggagctgaaggagctggagcgcgaactcgaagatatcgagcccgacaggaacctgcctgtagggctgagacagaaaagcctcactgagaaaaccccaacaggcaccttctcacgagaagcactgatggcctattgggagaaggaatctcaaaagctgctggaaaaggagcgactcggggaatgtggtaaagttgccgaggacaaagaggagagaaccatcgagaccgctaagggaatcaatggtacggtgaattacgactccgtaaattccgacaacagcaaaccaaagatttttaaatcacagattgaaaatattaaccttactaacggttctaacgggcgtaataccgaatcacctgccgctatccacccatgtggcaacccaactgtgattgaggacgccctagacaagattaagtctaatgatccagataccactgaagttaacttgaataatatcgaaaatattacaacccagaccttgactcgctttgctgaagccttgaaggataatacggtggtcaagacattctctcttgccaacactcatgccgatgattccgctgccatggcaatagctgagatgttaaaggtcaacgagcacataactaacgtgaacgtcgaatcgaactttattacagggaaagggattctagctataatgcgcgctctgcagcacaacactgtcctaacagagctaaggttccacaatcaacgccatatcatgggctcccaggtggagatggagatcgtgaagctgctgaaagaaaacacaacactcctgagactgggttatcactttgagttgcccggacccaggatgtctatgacaagcatcctgactaggaacatggataagcaacgacagaagcgactacaggagcagaaacaacaggagggatatgacggcggaccaaacctgcggactaaagtgtggcagcgcggaaccccgtcatcttccccctacgtgagtcccaggcactccccttggtcctcacctaagttgcccaagaaagttcagaccgttagaagccggcctctctcgcccgtcgcgacaccaccacccccacccccaccaccccctcctcctccaccatctagccagagactccctccaccgcctccgccaccccctcctcccctgccggagaagaagctcattacgcgcaacattgccgaggtgatcaaacagcaggaatctgcgcagcgagcactccagaatggtcaaaagaagaagaaagggaagaaggtgaagaagcaaccaaatagtatactgaaagagatcaaaaacagcctacggagcgtgcaggagaagaagatggaagactcctcacgaccctcaactcctcaacgttccgcccatgagaatttgatggaagctatccggggttctagcataaagcagctgaagcgcgtagaagtgccagaggcactcaggtag

SEQ ID NO: 57162 - DNA, 1644 bp, Artificial Sequence
  Description of Artificial Sequence: Synthetic coding sequence
atgtccacattcggataccgtagagggctgagtaaatatgagagcattgatgaagatgaactgctcgctagtctgagcgccgaagagttgaaggaactcgagagggagctggaggacatcgagcctgacagaaatctgcctgtgggactgagacagaagtcgctgaccgagaagacaccaactgggactttctctagagaagcactgatggcctattgggaaaaggagagccagaagttacttgagaaggaaaggctaggggagtgcggcaaggtggctgaagacaaggaggagagtgaggaagaattaatctttaccgaatctaacagcgaggtgagtgaggaggtgtacaccgaagaggaggaagaggaatctcaggaagaggaggaagaagaggattcagacgaagaggaacgtactatcgagaccgcaaaggggattaatgggactgttaactatgactctgttaattccgacaacagtaaacccaagatattcaaatcacagatcgagaacatcaatcttactaatggctcaaacggaaggaacactgagagtcctgcagctatacacccctgtggcaatccgacagtcattgaggatgccttagacaaaatcaagagcaacgacccggataccacagaagtgaatcttaataacatcgaaaatatcacaacacagacactcactcgtttcgctgaggctctgaaggataacactgttgtgaaaaccttctcgcttgcgaacactcacgcggatgacagcgctgcaatggcgatcgctgagatgctcaaggtgaacgagcatattacaaacgtcaatgttgagtcaaactttattaccggcaaaggcatcttggctatcatgcgcgcactgcagcataataccgttctgactgaactgagattccataatcagcggcacattatgggttcccaggtcgaaatggagattgtgaagctgctaaaagaaaatacgacattgttgagacttggttatcattttgagttgccaggtcctcgaatgagtatgacaagtatcctaactaggaacatggataagcaaagacagaagcggctgcaagaacagaaacaacaagagggctacgatggcggacctaatcttaggaccaaagtctggcagagggggacgccctcttcctctccctacgtaagccccaggcactcaccgtggtccagccctaaattgcctaagaaggtgcagacagtgagatcacggcctctgagccctgttgcaaccccaccccctccaccccctcctcctccccctcctccaccaagcagccagcggctgcctccaccgccacccccaccaccgcctcctctccccgagaagaaacttatcacaagaaatattgctgaagtgatcaaacagcaagaatcagctcagcgggcattacagaatggccagaagaagaagaaaggcaagaaggtaaaaaaacagcccaactccatcctcaaagaaataaagaatagcctgcgatccgttcaagaaaaaaagatggaggatagctcccgtccaagcactccgcagcgcagtgctcatgaaaacttaatggaagccattcggggatcatccatcaagcaactaaaacgtgttgaggtgcctgaggctttgcggtag

SEQ ID NO: 57163 - DNA, 2208 bp, Artificial Sequence
  Description of Artificial Sequence: Synthetic coding sequence
atgcttaggctgttacggcctctcctgttgctgctcttgctgcctcccccaggctccccagagcccccaggcctgacccaattaagccctggggctccgcctcaggcacccgatctcttgtacgcagatggcttaagagcatacgctgctggtgcctgggctcccgctgttgctttgctgcgggaggcgctcagaagccaggctgcactggggagagttcggctggattgcggcgctagttgcgctgcggacccgggtgctgctcttccagccgtgttgctgggggcacccgagcccgatagtggacctggcccaacccaaggctcgtgggagcgacagcttctgcgcgctgccctcagaagggccgattgcctcacacagtgtgccgcaagacgtctcggaccaggaggagccgctaggagagtggggtcagccctgcgcgatgctttccgtcgacgagaaccatataactaccttcagagagcctactaccagctgaagaaactggatctcgcagccgctgcagctcataccttcttcgtcgctaaccctatgcatcttcagatgcgcgaagacatggctaaataccggaggatgtctggtgtgcggccacaatcattcagggacctggaaactccccctcactgggcagcttatgacacagggctggagctcttaggaagacaggaggccggtctcgctctcccacggctggaagaggctcttcagggctcattagctcagatggaatcttgtcgtgcagactgtgaagggccagaagagcagcagggagcagaggaggaggaggatggagccgcatcacaggggggattgtatgaagccattgccggacactggatccaggtacttcaatgtcggcaaaggtgtgtcggggaaactgcaacgagacctggtcgaagttttcctgttcccgactttctccctaaccagttgcgccgtttacacgaggcccatgcccaggtcgggaatttatcacaggcgatcgagaacgtactcagtgtcttactgttctatccggaagacgaagctgccaagagagcgttgaaccaataccaggcacaattgggcgaaccccgtccaggcctcggcccaagagaagacatccagagattcattcttagaagcctgggggagaaacgccaactttactacgccatggagcaccttgggacgagttttaaagatcccgatccttggacacctgctgctctcatcccggaggccttgcgcgagaaactgcgggaggaccaagagaagaggccctgggatcacgaacccgtgaagccaaagcctctgacttattggaaagatgtgctgctgctggagggcgtgacgctgactcaggactcgaggcaactcaacgggtcagagcgagccgtcctggacggtctcctgactcccgcagagtgtggagtgttactacagcttgcaaaggatgcagctggagccggtgctagaagtggatacaggggtcgcaggagccctcacaccccgcatgagagatttgaggggctcactgtgttgaaagctgcgcaactggcaagagctggaacagttggctcccagggggctaaattgctgctggaggtttccgagagagtgcggaccctcacgcaggcctatttcagccccgaacgacccctgcacttgtcctttacacacttagtctgccgtagcgccatcgagggagagcaagaacagaggatggatttaagccatcccgtgcatgccgataactgtgtgcttgacccggacactggcgagtgttggcgagaaccccctgcatatacctatcgtgattattcaggcctactgtacctcaatgacgacttccagggcggagacttattctttaccgaacccaatgccctgaccgtgacagccagggtccggcctcggtgcggtcgactagttgcctttagctccggcgtcgagaacccacatggcgtgtgggcggtgacccgaggccgaagatgtgcccttgccctgtggcacacctgggctcctgaacacagggaacaggagtggattgaagctaaggagttgcttcaggagtcccaggaagaggaagaggaagaggaagaggagatgccctccaaggacccgagtcctgagccacccagccgcaggcatcagagagtgcaggataagacagggagagcgccacgagtacgcgaggagctgtag

SEQ ID NO: 57164 - DNA, 3015 bp, Artificial Sequence
  Description of Artificial Sequence: Synthetic coding sequence
atgcatggaagctgctgcttaggtggaggccagcccttaagcgtgttcgcatcattacatatgggacccgaagggctcgcacttaaggctggcagaggctggtgccccacatttcagagtttccctgaacctaccccgtcttacggcgcaccaggagtcgagtttatgggactgcaccaagagaataacgccgtgacccagatacacttgcttcccggacaatgtcagctggtgactctgctggacgacaactcattgcacctgtggagcttgaaagtcaagggaggcgcatcagaacttcaagaggacgagagtttcacccttaggggcccaccgggagccgctccgtcggctacccagattactgtagtgctcccacattctagctgcgagctcttgtacctgggtacagagtcaggaaacgtattcgtggtgcaactacccgcttttcgggcactagaagaccgaaccatatcttcagatgcagtcttgcagcgcctccccgaggaggcgagacatcggagagtgttcgaaatggttgaagctctacaggaacaccccagagaccctaatcaaatcctgattggctacagccgcggtcttgtcgtcatttgggacttgcagggcagcagagtcctctaccatttcctgagcagccaacagctggagaatatctggtggcagcgagacggacggttgctggtgtcatgccattcggacgggagctattgccagtggccagtgagctctgaagcacagcagcctgaaccactccggagcctggtaccatacggcccattcccttgcaaagccattacacgcatactatggctcacaactcggcaggggctcccgtttaccatcttccagggtggcatgcctcgcgcaagctatggagaccggcactgcataagtgtgattcatgatggccagcagactgcattcgatttcacatcgcgggtgatcggtttcacagtgctgaccgaggcggacccggcagcaacttttgacgatccctatgccttagtggtgctggctgaagaagaactggtggtcatcgacttacaaactgctggttggccaccggtccaactgccctacctcgcgtccctgcattgctccgccatcacttgctctcaccacgtgagcaatattccactcaagctgtgggagcgcataattgccgcaggaagtcggcagaacgctcacttctccacgatggagtggcccatcgatggcggaacatcgctcacccctgctccaccacagcgtgacctgctgctcaccggacacgaagacggcacagtgaggttttgggatgccagcggagtctgtctgaggctgctttacaagctgtctacagtccgtgtattcctaacggacacagaccctaatgagaacttctctgctcagggagaggacgaatggccacccctgcgcaaagtgggctcttttgacccatactctgacgatcctaggctgggcattcagaaaattttcctgtgcaaatactctgggtatcttgcagtggccggtacggcagggcaggtgcttgttctcgagttgaatgacgaagcagccgaacaggccgtggaacaggtggaggccgaccttctacaggaccaggaaggctaccggtggaagggccatgaaaggttggccgctagatccggaccagttagatttgagcccggatttcagcccttcgtattggttcagtgtcagccccctgctgtcgtaacatcattagctctccacagtgaatggagattggtggcttttgggacatcccatggattcggcttgtttgatcatcagcagcgaaggcaggtgttcgtaaaatgtaccttacatccttcggaccagctagctttagagggccctctctcgcgcgtaaagtccctgaagaaaagtctgcggcagagctttaggagaatgagacggtcgcgagtcagtagtcgaaagaggcacccagctggccctcccggagaagcgcaagaaggaagtgccaaagctgagcgcccagggttgcaaaatatggagctggcgcctgtccaacggaaaatcgaggcaagaagtgcggaagattcatttacgggatttgtgcggaccctctatttcgctgacacttatctcaaggattcctctcgtcattgtccctcgctctgggctgggaccaatggtggaaccatctatgctttctctctccgcgtccctcccgctgaacgccgaatggatgaaccggtccgtgcggaacaggccaaggaaatccagctcatgcaccgcgcacctgtcgtgggaatcctggtcttggatggtcattcggtccctctgcccgaaccattggaagtggcacacgatctcagtaaatctcctgatatgcagggctctcatcagctactggtggtgagcgaggaacaatttaaagtgtttacactgcccaaagtgtctgccaagctgaagctgaagttaactgctttagaaggtagcagagtaaggagagttagtgtggcacacttcggttcaagacgcgcagaagactacggcgagcaccacctggccgtacttacaaatttgggcgatatacaagtggtctcgctccccttgctcaagcctcaggtcaggtactcgtgcatcagaagggaagacgtgagtggcattgctagctgtgtctttacaaaatacggtcagggcttttacctgatctcaccttcagagtttgaacgatttagcctctcgaccaagtggctggtggagccccgttgtctggtggatagcgctgaaacaaaaaaccaccggcctggcaacggcgctggcccaaaaaaggcacccagtcgcgcaaggaacagcggcacacagtctgacggagaagagaagcagccaggtctggtgatggaaagagcccttctgtctgatgaacgggctgctactggcgtgcatattgaaccaccttggggcgcagcctccgctatggccgaacaatccgaatggttaagcgttcaggccgctagatag

SEQ ID NO: 57165 - DNA, 2061 bp, Artificial Sequence
  Description of Artificial Sequence: Synthetic coding sequence
atggggcctcggagtcgagagaggcgggctggcgcagtacaaaacaccaacgacagttccgcactttccaaacggtctctcgcggctcggggatacgtacaggacccttttgcagccctgctggttcccggtgcagctcggagagccccattgattcaccggggttattacgtgcgtgccagagctgtcagacattgcgtgagggcattcctcgagcagataggggctccacaggctgccctgcgggcacaaattctgagcctgggggctggttttgactctctatatttcaggctcaaaacggcaggaagactggccagggccgctgtttgggaggtagacttccctgatgtggcacgtcgtaaggcagagaggataggcgagacccccgagctgtgcgctttaacaggaccctttgaacgcggagagcccgctagcgcactgtgctttgagagtgctgactactgcatacttggactggacctgcggcaacttcagagggttgaagaagcactgggtgccgctgggctggatgcagcatcaccgacgcttcttctcgcagaagcagtgctaacttacctggagccagagtctgctgctgcgctgatcgcgtgggctgcccagagatttccaaacgccctctttgtggtgtatgagcagatgcggccacaggacgcctttgggcagtttatgttgcaacactttagacaactaaattcacccctccatggcctggaaagatttcctgatgtcgaagcacagcgcagaagatttttacaggcgggatggaccgcatgcggcgctgtagacatgaatgagttttaccactgtttcctgcccgctgaggaaagaaggcgcgtggagaacattgaaccatttgatgaatttgaagaatggcaccttaaatgcgcccattattttatcctcgccgcatcaagaggggatactctgtcacatactctagtgtttccctcatcagaggcctttcctcgcgtcaaccccgctagcccgagcggcgtcttcccggctagtgtggtctcatccgaaggacaggtgcccaatttaaagcggtacggacacgctagcgtgtttcttagccccgacgtcatcctgtctgcaggtgggtttggagaacaagaggggaggcactgccgggtgtcccaattccatctactgagtcgcgattgcgactctgaatggaagggaagccagatcggatcttgcggaactggtgtccagtgggacggcagactctaccataccatgacccgcttgtcagaatctcgcgtgctcgtcctgggtgggaggttatctcctgtcagccctgccctgggcgttctgcaactgcactttttcaagtccgaggataataatactgaggacttgaaggtcactattaccaaggccggtcgaaaagacgattccacgctgtgctgttggcgccactcaactactgaggtgagttgtcagaaccaggagtatctttttgtgtatgggggacgatctgttgtggagcctgtgctgagtgattggcactttctccatgtgggtacaatggcgtgggttagaatccccgtggaaggcgaggttcccgaggctcggcactcccattccgcctgcacctggcaaggtggtgcccttattgctggtggtctcggcgcatcggaagagcccctgaattctgtcctgtttctgagacccattagctgcggctttctgtgggagtctgtggatatacagccgccaatcactccaagatattctcacactgctcacgtcctgaacggcaagctgctgctagtggggggtatatggatccacagttcctcatttcctggcgtgaccgttataaacctgactaccggacttagcagtgaataccagatcgacacgacttacgtgccgtggccactgatgttgcacaatcatacgtctattctgctcccggaggagcagcagctgctcttgctgggcggtggcggtaattgcttctcttttggtacctacttcaacccgcacaccgtgacacttgatctgagctcattgagtgctggtcagtag

SEQ ID NO: 57166 - DNA, 798 bp, Artificial Sequence
  Description of Artificial Sequence: Synthetic coding sequence
atgacccgactcagcgaaagtcgtgtgctagtcttaggcggaaggctgtcccctgttagccctgctctgggcgttctgcagctgcattttttcaaatccgaggataataacacagaagatctgaaggtaacaatcaccaaagctggtagaaaggacgactctaccctatgctgttggcgccacagtacaaccgaggtatcatgtcagaaccaagaatacttgtttgtgtatgggggacggtctgtagtcgagccagtccttagtgactggcactttctgcatgtcggtaccatggcatgggtaagaatacccgtggaaggcgaggttcccgaggctagacactcccactcagcctgtacatggcaaggtggcgcactcatagctggaggcctgggggcatctgaagaaccgctgaactcagtgttgtttctccgaccgatttcctgtggtttcctctgggagtcagtggacatacaaccccctattaccccacggtactcccacaccgcacatgtgctgaatgggaagctccttctcgttgggggaatttggatccactcaagctcatttcccggtgttaccgtgatcaacctcactactgggctgtcatcagagtatcagattgatactacttacgtaccatggccacttatgctccacaaccatacatccatcctgctgccagaggaacagcaattgcttctcctggggggagggggaaactgcttcagctttggcacatattttaatcctcacactgtgaccctagatttatccagtctctctgctggacagtag

SEQ ID NO: 57167 - DNA, 399 bp, Artificial Sequence
  Description of Artificial Sequence: Synthetic coding sequence
atggatcatcatatcccaatgcacgcgttacccgaagagatccagaaaatgctgccggaagagaaagtatgcaagtattgcggggtttcttacttgatcctccatgagtttaaggccatggaggaaaaggtcaaagccatggagaaagaaatgaaattttaccaaggcagcgttgacagagaaaagcgtcttcaagagaaactgcactcactctcccaagaactggagcaatacaagatcgataataaatccaagactgaaagaatctatgacgtgggcatgcaattgaagagccagcagaatgaattccagaaggtgaagaagcagctttcacacctgcaggacgaacttaaaatcaaatataggcaatcttacatctttaggctgtgcttctgctag

SEQ ID NO: 57168 - DNA, 879 bp, Artificial Sequence
  Description of Artificial Sequence: Synthetic coding sequence
atggggattgccgagtcaacaccagatgaactgcccagcgacgcagaggaacagttgagatctggggaccagcagctcgagttaagcggaaggagactgcgcaggctcccatccgcggtgtgtgccctgagtagacttcaaaagctctatgtgagcggcacaggattgcgggaactgccagaagaaatcgaggaacttagagagttgagaatactcgcactggacttcaataagctggaaagacttccagatggcctttgtcgcttacccagactcactcggctgtacctcgggggaaaccgattgttagctcttccggctgattttgctcagctgcagagcttgcgatgtctttggatcgagggcaattttttgagaaggttcccacgacctctcctgagactggtggcactgcagagcctgcagatgggggataatagacttcgggctctccctgctgaacttccccgtatgaccgggctgagggggctctggctgtatggcaatagatttgaagaattccctccagcgctgctccggatggggagacttcatatactggacttagatcggaatcggctcggtggctttcctgacttacaccctctaagggccttgcgcgtgttcagctacgatcacaatcctgtaaccggccctcctcgagtggcagacaccgtctttttggtgggtgaaggcgcagtggagaggatggcagagcgggatgagccaacgcctcggcctcccccacgtcgccctgcaagggccttcgaagatgaggaggaggaagacctcctcataggaggagcgggatcaagagcactgggggctccgggtggctccttccgcgctctggaggccgctcctggactcgggacctag

SEQ ID NO: 57169 - DNA, 1482 bp, Artificial Sequence
  Description of Artificial Sequence: Synthetic coding sequence
atgcacactctcgtttttctctccactcggcaggtcctccaatgtcagcccgctgcatgtcaagctcttccgctgctcccccgagagttgttccctctgctgttcaaagtggcgttcatggataaaaaaactgttgtgctgagagagttggttcatacatggccctttccacttcttagcttccagcagctgctgcaggaatgtgcccactgttctagagccctgcttcaggagagaccgtcaacagagtcaatgcaggcagttatcctgggcttgaccgctcgacttcacaccagcgaacccggtgctagtacacaaccactctgtagaaagcacgctctgcgagttttggacatgaccgggcttctggacgatggtgtcgaacaagatcctggcaccatgtcaatgtgggattgcaccgccgctgtggctcgaacctgcattgcccagcagcaggggggagcagccgagcctggacccgcacccattcctgtggaggtaagggttgaccttcgggtcaacagggctagctacgcttttcttagggaagcacttaggtccagcgttggaagtcctctcagactatgttgccgggaccttcgggcagaagacctgcccatgcgaaatacggttgctttactgcagctcctcgatgcagggtgcttgcgaagagtagacctaagattcaacaatctcggcctcagaggactcagtgtcattatcccacatgtcgctaggttccagcatcttgcttctctgagactccactatgttcacggagatagtagacagccatccgtggacggggaggacaactttcggtacttcctggctcagatgggacggttcacctgcctgcgagagttatccatgggctcttccctgctcagtggcagactggaccagttgctgagtaccctgcagagtcctctggaatcccttgaactggctttctgcgccctgctaccagaggatctgaggtttttggcgaggtcccctcatgcggcacacctgaaaaagttggacctgagcggcaatgatttgtcaggcagccagttagcccctttccagggacttctgcaggcgtcagctgctacacttttgcatctggaattgacagaatgccagctcgcagacacccagctcttagctactcttccgattctgacccagtgcgcatcccttagatatctgggcctatacgggaacccgttaagcatggccggattgaaagagttgctgcgggactccgtcgctcaggcagagttacggaccgtcgtgcacccatttcccgtagattgttatgaaggcctgccttggccccctcctgcatctgtactgctggaggccagtattaacgaagagaaatttgctcgtgtcgaagccgagttacatcagcttttgcttgccagtgggcgtgctcacgtgttgtggaccacggacatttacggacgcctcgcagccgattattttagcctgtag

SEQ ID NO: 57170 - DNA, 1545 bp, Artificial Sequence
  Description of Artificial Sequence: Synthetic coding sequence
atggatacgatgcgttcccttcgcttcatttccgcggaagctctggttagtcaccctcaagtggccaggcagtcactggactccgtggctcataatctgtatcccctgttgtttaaggcaagctacctgctggagcaggcggaggttacgcgggcagtgctcggcagatggccgcttgaagaattcagacttggtgcactactcggtcccggagccgatcacccccaggatttaagagacagaacctgtcgggcttgtctggaggcattagtgagggggttagcagaccatgtcctccaggaccggagtagacggaggctgagggttgctgatctgacagggattagggatgtgcaggttcagcgctgtccctgtggacgtgctctcggaagatggggaagaacccagctactggcgagaacctgttgcgaattacaagcggagcccttggccgctggacgaccagtggaggtccttgctgacctgttcgtcaccgaagggaattttgaggccgtggtgcaggccctccgaccagccggaccggctcccctaagagtgcattgcccgtcttttcgcgctgactcactgtccccctcacagcttcttcatgtgctccgcctagccggacccggtgctttgagaaagctggaagttgtccacaatgtgaggctgcatgcgggacatgtacagcaactgttagcccaagtgggcttcccccgactcgcttcactgacgctccccacaaaggctttcgatgcacctcctacatacgcaagtacacccgatggagaagatcctctactggcgtccattgcccgagaactgtccaaaatggctcagttgactgagcttagtgttgccttcagtaccctgacaggcaagatcccaacactcctcggcccactgcagacaccccttcgcgtgctagacttggccaactgcgctctcaatcacaccgatatggcgttcttagccgactgcgcacacgctgcacatctggaagtgctggacctctcggggcacaatctggtgtccctctacccctctaccttcttcagactgctgtcacaggcgagcaggaccctccggatactgaccctcgaggagtgtgggatcgttgactcacacgtggggatgctgatcctggggctgtcgccttgccatcgattgcggcagctcaaatttctcggtaaccctttgagtgcccgagccctcagaagattgtttacagcgctctgtgagctgccagagctgcgatgcatcgagttcccagttccaaaagactgctacccagaaggggctgcatacccacaggacgagctcgccatgagcaaattcaaccagcagaaatacgacgaaattgctgaggagctgagagccgtgctactgagggccgatagggaagacattcaagtgagtactccgctttttgggtcttttgacccagatatccaggagacgtcaaacgagttgggggcattcctgctccaggcgttcaaaacagccctagaaaacttttcccgagctctgaagcaaattgagtag

SEQ ID NO: 57171 - DNA, 1278 bp, Artificial Sequence
  Description of Artificial Sequence: Synthetic coding sequence
atggcaattaaaaaacagaaacgatgtcgcaagatacggccagtgtccgcttttatatctggcagcccacaggatatggagagccagctggggaacctggggattccccctggctggttctccggactggggggtagtcagcctaccgcctctggcagctgggaagggctgagcgagttgcccacccacggatacaaattgagacaccagacacagggaaggccgaggccacccaggaccaccccccctgggccaggcaggcctagtatgcctgctccagggacccggcaagaaaacgggatggctactagactggatgaagggctcgaagacttcttcagcaggcgggtgcttgaggaatcctctagctatcctcggacccttcgcaccgtgaggccagggctgagtgaggcccctttacccccactgcagaagaagcgtcgcagaggtctattccatttccgcagaccgagatcgttcaaaggcgatagaggccctggatcccctaccactggtctgttgctgccaccccctccacctccaccaccgactcaagagtcacctccatctcccgaccctccaagtcttgggaacaactctagcccatgttggagccctgaggaggagagctcacttttgcctggcttcgggggaggtcgcggacctagctttcgtagaaaaatgggtccgggtccggaccaggagggaagtacccaggcatggcagaagcggagatcctccgatgatgctggacctgggtcttggaagccacctcctcctccgcaaagtaccaaaccctcatttagcgccatgagaagagcggaggcaacctggcatatcgctgaggagtcagcgcctaaccactcgtgccagagtcctagccctgcttctcaagacggagaggaagaaaaggagggtaccctcttccccgaaaggacacttcccgcacgaaacgcaaagcttcaggaccccgcattggccccatggccacctaagcctgttgccgtgcctaggggtcggcagcctcctcaggagcccggtgttcgtgaggaggctgaggccggagatgctgccccaggcgtgaacaagcctcggctccgactatcttcccagcaggatcaagaggagcctgaagtgcagggtccgccagatccaggtagaaggacggcaccattgaaaccaaaaaggactcgccgagcccagagctgtgataaacttgagcctgaccggagacgcccacctgaccctacgggaacaagtgagccaggcacagattag

SEQ ID NO: 57172 - DNA, 4119 bp, Artificial Sequence
  Description of Artificial Sequence: Synthetic coding sequence
atggctaaaccctcagtcgagttgaccagggaattgcaggactccatcaggagatgcttatcacagggcgcagttctccagcagcaccacgtgaagttagagaccaaacctaaaaagttcgaggacagggtgttagcattaaccagttggcggcttcatctctttctgctcaaggtcccagcaaaagtggaatcatcattcaacgtactggagattcgcgctttcaacacactcagccaaaatcagattctggtggagacagagcgcggaatggtgtctatgaggctgccttccgctgaatccgtcgaccaagtcactagacacgtgagcagcgcgctttcgaaagtttgcccgggacctggctgtctgatccggagagggaacgctgatacccccgaaggtcctagggataccagtcctaacagtgagacttctaccagtaccacccactctgtttgcggagggttctcagagacatatgcggctctgtgcgattataatggtctccactgtagagaagaagtgcagtgggacgtcgacaccatatatcacgccgaggataaccgtgagtttaatctgctcgacttttcacatcttgaatctcgggatcttgcccttatggtggcggctctggcctataatcagtggtttaccaagctatattgtaaagatctgcggctgggttctgaagttttggagcaggtgttgcatacactttctaagtccgggtcgctggaggaactcgtcctcgacaacgcaggattgaaaactgatttcgtccagaaactagctggggtttttggcgagaacgggtcttgtgtgttgcatgcactcaccctctcacacaatcccatcgaggataagggctttctaagcctgagtcagcagctgctctgttttccctcaggactcacaaaactgtgtcttgccaaaactgctatcagccctagggggcttcaggctctcggccagacattcggcgctaatcccgctttcgcctcgagccttcgctatctggatctgtcaaaaaaccccggtctgctcgccactgatgaagccaatgctttgtacagcttcctggcgcagcctaatgcgttagtccacctggatctgtcgggaacggactgtgttatcgacctactcctgggagctttgctgcatggatgttgctctcacctcacctaccttaacttagcacggaacagctgcagccatagaaaaggccgagaggcgccaccagccttcaaacagttctttagtagtgcatatactttgtcacatgtcaatttaagcgctaccaagctcccccttgaggcactccgggctctgctccaggggttgtccctgaattcccatctaagcgaccttcacctggatttgtctagctgtgagctgagaagtgcaggcgctcaagctttacaagagcagctcggagctgtcacatgtgtgggaagcctggacttgtcagataacggcttcgacagcgatcttctaaccttggtacccgcactgggaaagaacaagtcactgaagcacctcttcctcggaaagaatttcaacgtcaaagcaaagaccctcgaggaaattctccacaaactcgttcaactgattcaggaggaggattgtagcctgcagtcactgtccgtcgcagattctaggttaaagctgaggacctcgatacttatcaacgccctgggttccaatacgtgcttggccaaagtggacctgtccggaaacggcatggaagacataggtgctaagatgctgtcaaaagctctccagatcaacagtagcttgaggaccatcctgtgggacaggaataacacgtctgccctggggttcttggatatcgcccgtgctctggagtcaaaccacaccctgcggtttatgtcatttccagtctccgacatttcccaagcgtatcgctccgctcccgaacgaacagaagacgtctggcagaagatccagtggtgtcttgtgaggaataaccattctcaaacatgccctcaggagcaggcgttccgactgcagcaagggctggtgactagctccgctgagcagatgctgcaacggctctgcggtagagtgcaagaagaagtgagagctctgcggttgtgcccccttgagcctgtgcaggatgagttactttacgcaagagatcttattaaggacgctaagaactctagagcgctgttcccctcattgtatgagcttggtcacgttctggctaatgacggtccagttaggcagaggctcgaaagtgtggcgtctgaggtgtccaaggctgttgataaagaactgcaggtgattcttgagtccatggtatccttgacgcaggagctttgtcctgtcgccatgagggtcgccgaaggacataacaagatgctcagtaacgtggcggagagagtgactgttccacggaatttcattcgcggtgctctgctcgaacaagccggtcaggatattcagaataagctggacgaggtgaaactaagcgtggtgacctaccttacaagctccatagtggacgaaattttgcaagagctgtatcacagccataaaagtctggcccgtcacctgacccagctgcgtacattgtctgacccaccaggttgtccgggacagggccaggatctcagcagtaggggaagaggccgaaatcatgaccatgaggaaacaaccgacgacgaactcggaaccaacattgatactatggctatcaagaagcaaaaaaggtgtaggaagattagacctgttagcgcatttataagtgggtcgcctcaggacatggagagccagctgggtaaccttggcattccccctgggtggttctctggcttgggaggaagtcaaccgacagcgtcagggtcttgggagggattaagcgagttgcctacacacggctataaactgcgccatcagacacaggggagaccaagaccgccaaggacgactcctccaggaccaggaaggcccagcatgcccgcacctggcacccggcaagagaacggcatggcaacgcgcctagatgaaggcctggaagactttttcagccgaagagtcttggaagagtccagttcctatccccgtaccctccggacagtgcggccaggtctgagcgaggcacctttgccccctctgcagaaaaaacgccgaaggggactttttcattttcgcagaccgaggagctttaagggagacagaggcccaggatctccaactactggactgctgctacccccacccccaccgccaccccctacacaagagtcgccgccatcgcccgacccaccgagcctgggcaacaattcaagtccctgctggtctcccgaagaggagtcctccttgctgcctgggttcggcggtggacgaggccctagctttagacggaagatgggaaccgaaggatcagagcccggtgagggaggccctgcgcctggcacagcccagcagcctcgcgtgcacggcgtggctctccccggattggagagggcaaaggggtggagctttgacggtaagagagagggcccagggcctgaccaggagggttcaacccaggcatggcagaaacggagaagtagcgatgacgcaggaccaggcagctggaagcctccacctccaccccagtcaactaaacctagcttcagcgctatgaggcgagccgaggctacctggcatatcgccgaagagtctgcccctaaccactcatgccaatcaccatccccagccagtcaggacggggaggaagagaaggaaggcacactgtttcccgaaaggacactcccggcacggaacgccaagctgcaggatccagctctggcaccatggcctcctaagcctgttgccgttccacggggtcgacagcctcctcaagaaccgggagttcgggaggaagccgaggctggtgacgccgcacccggagtcaacaagccaagactgcgcctctcttctcagcaggatcaagaggagcctgaagtgcaggggcctcccgacccaggccgtcggaccgcacctcttaagccaaagaggactcgacgcgctcagtcgtgcgacaagctcgagccggataggaggcgccctcctgacccaacagggacttccgaacccggtacagactag

SEQ ID NO: 57173 - DNA, 555 bp, Artificial Sequence
  Description of Artificial Sequence: Synthetic coding sequence
atgctaaaaaagatgggggaagccgttgcccgtgtggccagaaaagtcaacgaaactgtcgagtccgggtcagatactctcgatcttgccgagtgtaaactagtctcatttccgataggcatctacaaggtgttaagaaacgtcagtgggcaaatacacctgatcacgcttgctaacaacgaactaaaatctttgacttctaaattcatgacaactttctcacaactgagggagcttcacttagagggaaattttttacaccgcttgccctccgaagtgtctgctctgcagcatttaaaagccattgacctctcccgtaatcagttccaggattttccggaacaactgacggccttgcccgctctagagaccattaatctggaggaaaacgaaattgttgatgtccccgtcgagaagcttgcggcaatgcccgcactcagatctataaatttgcggttcaaccctttgaatgccgaagtgcgggtgattgcccctcccttgatcaaattcgatatgctgatgagccccgaaggggctagagctcccttgccttag

SEQ ID NO: 57174 - DNA, 387 bp, Artificial Sequence
  Description of Artificial Sequence: Synthetic coding sequence
atgctgaaaaaaatgggtgaggccgtcgcacgcgtggctagaaaagtaaacgagactgtggagtctggctccgacactcttgatctggccgagtgcaagctcgtgagcttcccgatcgggatctacaaagtgctgcgaaacgttagcgggcagatacacctgattacgcttgctaataatgaattgaagagcctcacgtctaagttcatgaccaccttctcccagctgcgagacgtgcccgtcgaaaagctggcagccatgcctgctctgcgctctatcaacctccggttcaacccactcaacgcggaagtgcgcgtcattgcacccccactcattaaatttgacatgctcatgagtcctgaaggggcacgggcaccccttccttag

SEQ ID NO: 57175 - DNA, 405 bp, Artificial Sequence
  Description of Artificial Sequence: Synthetic coding sequence
atgcttaagaagatgggggaggcggtggcaagagtggcgcgaaaggttaatgaaacagtggaatccggctccgataccctggagctgcatcttgagggaaacttccttcacagactgccctctgaagtgtccgccctccagcatctcaaggccattgatctcagtcggaaccagttccaagactttcctgaacagctcaccgcgctgcctgccctggaaacaatcaatctggaggaaaatgaaatcgtggacgtgccagtagagaagcttgctgctatgcccgctttgcgatctattaacctgagattcaatccactgaatgccgaggtgagggtgattgctcctcctctgattaagtttgacatgttaatgtccccggaaggcgcacgagcgcctctcccatag

SEQ ID NO: 57176 - DNA, 555 bp, Artificial Sequence
  Description of Artificial Sequence: Synthetic coding sequence
atgttgaaaaaaatgggggaagcagtcgccagggtggcgaggaaggttaacgagacggtcgaatctggttctgacacactggacttagccgagtgcaagctcgtgtccttccccataggtatctacaaagtcctccgcaatgtctccgggcagattcatctcatcactctcgctaacaacgaactgaagtctctcacctcaaaatttatgactactttttcacagctgagggaattgcacttagaaggaaacttcctccataggctgccatcagaggtgagcgccttgcagcacctcaaggctattgacctgagccggaaccaattccaggatttcccagagcagctgacggccctgcccgctctggaaactattaacctcgaagagaacgagatcgtcgatgttcccgtcgagaagctagcagctatgcctgctcttagatctatcaatctgagattcaacccgttgaatgcagaagttcgagtcatcgcgcctcccctgatcaaatttgacatgttgatgtcaccggagggtgctcgggctccgctgccatag

SEQ ID NO: 57177 - DNA, 387 bp, Artificial Sequence
  Description of Artificial Sequence: Synthetic coding sequence
atgctcaaaaaaatgggcgaagctgtggcccgagtcgccagaaaggtgaatgagaccgtggaatcgggaagtgataccctcgatttggctgagtgcaaactcgtgtccttccccataggcatctacaaagtgctccgaaacgtctccgggcaaattcacctcattactttagcaaataatgagctgaagtccctgactagcaaattcatgacgacattcagtcagcttcgagacgtgcctgtggagaaattagccgctatgccggcactcaggagcataaatctcaggtttaacccgctgaatgcagaggtcagggtgatcgccccaccactgatcaagtttgatatgcttatgtcccctgaaggtgctcgggctcccctcccatag

SEQ ID NO: 57178 - DNA, 405 bp, Artificial Sequence
  Description of Artificial Sequence: Synthetic coding sequence
atgctgaagaaaatgggcgaagccgttgcacgcgttgcaagaaaggtgaatgaaacagtggaatccggatccgacactcttgagttgcacctggaaggaaattttctgcacagattgcctagcgaagtcagtgccttacagcacttgaaggcgatagacctgtcccgaaatcaattccaggattttcccgagcagcttaccgccctgcccgcattggaaactataaatctggaagaaaacgagattgtcgatgtgcccgttgaaaagcttgcggcaatgcctgccctgcggtcaattaaccttagattcaaccccctgaacgcagaggtgcgcgtgattgcgccacccctgattaaatttgacatgctaatgtcacctgaaggtgcaagagcccctctgccttag

SEQ ID NO: 57179 - DNA, 528 bp, Artificial Sequence
  Description of Artificial Sequence: Synthetic coding sequence
atgctgaaaaaaatgggggaagcagtcgctagggtggctcgaaaagtgaacgaaacagtcgagtcaggctcagatacattggacctggcagagtgtaaacttgtgtcattcccaattggcatctataaagtgcttcgcaacgttagcggtcaaattcacctgataacactagccaacaatgagctgaaatctctgaccagcaagttcatgaccaccttctcacaattgcgggagttacacctggagggtaattttctgcaccgcctcccatcggaagtctccgccctgcagcatctgaaagcgatcgacttgagccggaatcagtttcaggacttcccagaacaactcactgcgctaccagcccttgaaactataaatctggaggaaaatgagatcgttgatgtgcctgtggaaaagcttgcagccatgcccgctctaaggtccattaatctccgctttaatccactcaacgctgaggtgagggttatcgctccacccctgattaagttcgacatgcttatgagctag

SEQ ID NO: 57180 - DNA, 1032 bp, Artificial Sequence
  Description of Artificial Sequence: Synthetic coding sequence
atgagtgacgaggacgatctggaggactcagagccggaccaagatgacagcgagaaggaggaggatgagaaagagaccgaagagggtgaggactacagaaaggagggagaggaatttccagaggaatggctgccaactccgttgactgaggatatgatgaaggaagggctgagtcttctgtgcaaaaccggtaacggactcgcgcatgcatatgttaagcttgaagtaaaggagcgagatttgaccgatatatacctccttaggtcttatatccacctgcggtatgtggatatttccgaaaaccacttgactgacctaagtcccctgaattacctgacccacctcttgtggcttaaggcggatggaaacaggttgcgcagtgcccagatgaacgagctcccctatctgcagatcgcctctttcgcatataatcagataacagacacagaaggcatctcacaccctagacttgagaccttgaacctgaaaggcaatagcatccacatggtgaccgggttggaccccgagaagttgatctctcttcatactgtcgaattacgagggaatcagctcgagtccaccctcggcattaacctgccaaagctgaagaacttatatttagcccaaaatatgttaaaaaaggtggagggcctggaagacctctccaatttaactaccctgcatctccgagacaatcagattgatacactgagcgggttcagccgcgaaatgaaaagtctccaatatcttaaccttaggggaaacatggttgctaacctgggcgaattggctaaactgagagacctccccaaactgcgggctttggtgttgttagacaacccatgcaccgatgagacctcctacaggcaggaagctctggtgcagatgccctacctggaacggctcgacaaggaattctacgaagaggaggagcgtgcagaagccgatgtgatcaggcagcggcttaaggaggaaaaggaacaagagcctgaaccgcaacgagatcttgagccagaacagagcctgatctag

SEQ ID NO: 57181 - DNA, 939 bp, Artificial Sequence
  Description of Artificial Sequence: Synthetic coding sequence
atgtcagatgaagacgacctggaagattccgaacctgaccaggatgatagcgaaaaggaagaggatgagaaagaaactgaagaaggcgaggactatcgaaaggagggcgaagagttcccagaagagtggctgcccacccctcttactgaagacatgatgaaggaaggactgtccctcctctgcaaaacagggaacgggctggcacacgcatacgtgaaacttgaagtaaaggagcgagacctgacagacatttacctccttcggagttacatacacttacggtacgttgacatttcagagaaccaccttacagatttgtcaccattgaactatctgacccacctcctctggctgaaggcggacgggaaccgcctccggtccgcccagatgaacgaactgccatacctgcagattgcttcctttgcatataatcagatcaccgacactgaaggcatttctcatccaagactagagacactgaacttaaaaggaaattcgatacacatggttaccggcctggatcctgagaagttgatctctctgcatacggtggaactgagaggcaatcagttagaaagcacactggggattaatctgccaaagctgaagaatctgtacctcgcccaaaatatgctaaagaaggttgaaggtctggaggacctgagtaacctgacaacacttcatttgcgagacaaccaaattgacacactcagtggatttagcagagaaatgaagagcttacagtatctgaatctgagaagaagcaagacactagccttccgtcccgatcagactcctcggggaagtcaccatatgtacgaccgcgagcagcgcatgcccgtattcgctcccaaattggagatccaccacaacctccggcctagaatctgctctgtgccggttctgtgggccgtgtggggcgcagaatggggcgcatag

SEQ ID NO: 57182 - DNA, 285 bp, Artificial Sequence
  Description of Artificial Sequence: Synthetic coding sequence
atgtccgatgaggacgatctggaggattcagagcctgatcaggatgatagcgagaaagaggaggatgaaaaagagacggaagaaggagaagactatcgtaaagaaggggaggagtttcccgaagaatggcttcccactccactgacggaggacatgatgaaggaggggttatcccttctgtgcaaaacgggcaacgggcttgctcacgcctatgtaaaactggaagtgaaggagcgggacctgactgatatttacctgttgcgatcgtacatccatctgagatag

SEQ ID NO: 57183 - DNA, 1032 bp, Artificial Sequence
  Description of Artificial Sequence: Synthetic coding sequence
atgtcagatgaagatgaccttgaagacagcgaaccagaccaggatgattccgagaaggaagaagacgaaaaggaaactgaggaaggcgaagactaccgaaaggaaggagaggagttccctgaggagtggcttccaaccccgcttaccgaggatatgatgaaggaaggactgagcctgctgtgtaaaacgggcaacgggctggcccacgcctacgtaaaattggaagttaaagaacgcgacttgactgacatctacctgctccggagctacattcatctcagatatgtggacatctccgagaaccacctgacagacctgagccctctgaattacttgacacatctgctgtggttgaaggccgatggaaacagattgcgctctgcgcagatgaacgagttgccttatctgcaaatcgccagttttgcctataaccagatcaccgatactgaaggaattagccacccacgccttgaaacgttgaacctgaaggggaacagcatccatatggtgaccggactggacccagaaaagctgatatccctacacacggtggagctgaggggtaatcagcttgagagcacgctggggatcaatctgccaaagttgaaaaacctgtacctagcgcagaacatgcttaaaaaggtggaagggttagaagaccttagcaacctgacaacactccacctgcgggataaccagattgacacactgtctgggttcagtcgggaaatgaaaagtctgcagtacctcaatctgcggggaaacatggtagcaaacctgggcgagctggctaagctcagggatctgcccaagttgcgcgctctggtccttctcgacaacccctgcactgatgaaacgtcctatcgacaagaggccctggtccaaatgccttacctcgaaagactggataaagaattttacgaggaggaagaacgcgcagaggcggatgtgattcgccaacgtctgaaggaagagaaagaacaggagccagagcctcagcgggatctggagcctgagcagtccctgatatag

SEQ ID NO: 57184 - DNA, 1032 bp, Artificial Sequence
  Description of Artificial Sequence: Synthetic coding sequence
atgagcgacgaagatgacctggaggactcagaacctgaccaggacgactccgagaaggaagaggacgaaaaagaaaccgaagagggcgaggactaccgaaaagagggagaagagttccccgaggagtggctgcccacacctctgactgaggacatgatgaaggaaggattatccctgctgtgtaaaacgggtaatggactcgcacacgcgtacgtgaagctcgaggttaaagaacgtgacttgaccgacatctatcttctacggtcctacattcacctgaggtatgtcgacatctctgagaaccatctgacagacctgtccccgctcaactacctcacccacctgctgtggctgaaagcagacgggaacaggctgcggtcggcacaaatgaatgagctgccctatctgcagatcgcatccttcgcatacaaccagatcaccgataccgagggaatttctcatcctcggctggagactctaaatctgaaaggcaactccatccacatggtaacaggcctggatcctgagaagctgatctctctgcacactgttgaactccggggaaaccagctcgaaagtaccctgggaatcaatcttcctaaactaaagaacttatatctcgctcagaacatgctaaagaaggtggaggggctagaggatctgtccaacctgaccaccctgcacctgcgcgataatcaaatagacactctgtccgggttttcccgtgaaatgaagagtctgcagtatctgaacctgcgcggtaatatggtggccaatctcggagagctggccaagctcagggatcttcccaagctgcgggctcttgttctgctggataacccgtgcaccgatgaaacatcgtacagacaagaggctttagttcagatgccataccttgaacgcctggataaagaattttatgaagaggaagaacgggcagaagctgatgtaattcggcagcggctaaaggaggagaaagagcaggaacctgagcctcaacgtgatttagaacctgaacaatcgctgatatag

SEQ ID NO: 57185 - DNA, 1032 bp, Artificial Sequence
  Description of Artificial Sequence: Synthetic coding sequence
atgagcgacgaagacgatctagaggatagcgaaccagatcaagacgacagtgaaaaggaagaagatgagaaggagacagaggagggcgaggattaccgcaaagaaggagaggaatttcccgaagagtggctcccaacacccttgaccgaagatatgatgaaagagggactgtcgctgctttgcaaaacgggcaatggcctggctcatgcttatgtaaaactcgaagttaaagagcgggatctgactgacatctatctgttacgaagctacatccacctaaggtacgtggacatatcagaaaatcacttaacagacctgtctcccctgaattatttgactcatttattatggctcaaggccgacgggaaccggctgcgctctgcccagatgaatgagctgccttacctgcagattgccagctttgcctataatcagattaccgatactgaaggcatcagccatccaagattggagaccctgaatctaaagggcaactctatccatatggtcaccggcctggaccccgaaaaattgatcagcttgcatacagttgagctcagagggaaccagctagagagcaccctcgggattaacctccccaagttgaaaaacctttacttagcacagaacatgctaaaaaaggtcgaggggttggaggatctgtccaacctgacaaccctgcacctgcgcgacaatcaaattgatacgttatccgggttcagtcgcgaaatgaagtcgttgcagtacttgaatctcagaggcaacatggtggcgaatttgggggagttggctaagctcagggatctgcctaagttaagggcactggtcctgctggacaacccttgcacagatgagactagctatcgacaggaggccctggtacagatgccctacctagaacggttagataaggaattctacgaagaggaggagagagccgaagcagacgttatccggcagaggctgaaagaggagaaggagcaagagcctgagccacagcgagaccttgagcccgagcagtccctcatttag

SEQ ID NO: 57186 - DNA, 1152 bp, Artificial Sequence
  Description of Artificial Sequence: Synthetic coding sequence
atggagggctcctcatcatacgaggtaccatcagtggctgctgccgatttagaggagggggcaggccagactaggtccctgcccgcaacaccgtccaaagacgtgcacaaaggtgtgggcggtatcatcttttcctcttcaccaatcttagacctgtcggagtcaggcctgtgtcgtctggaggaggtcttcaggatcccaagcttacaacagttacacttacagagaaatgcgctgtgcgttattcctcaggacttttttcagctgctgcccaacctgacatggcttgatctccggtacaacaggataaaggccctcccatctggcatcggggcacatcagcacctgaagaccctgttactcgaaagaaatccgattaagatgcttccagtggaactggggagcgtgactaccctcaaggccctgaatctccgccactgtccacttgagttccccccacaacttgttgtacagaaggggttggtcgcaatccagcgattcttaaggatgtgggccgtggagcactcgctacccaggaaccctacatcacaagaggcccctcccgtccgcgaaatgacacttcgtgatctgccatcccctgggctggagctcagcggcgatcatgcgagcaaccaaggcgcagtcaatgcgcaggatcctgagggggctgtcatgaaagagaaggcatctttcctgccaccagtagagaagccagatctctccgagcttcggaaatctgccgactctagtgagaactggccgagcgaggaggagatcaggcgtttctggaagttgcgacaagagatcgtggagcacgtaaaagccgacgtgctgggagaccagctgctgacccgcgaacttccacccaatctcaaggcagcactgaacatagaaaaggaactgcctaaaccgagacacgtcttcagaactcgcgtaccaagaaagcaggctctgcagagactgcacgagcggaagacgaggatcatgggtgtggtagggcgtgcgcctacgcatatgggcgaaggcagacaacctccgcctggcgcatcctatccaacctcttgtcataggacaaaatggcggtcagaacagaaggactggaagagagcagagcggagaagatccgaatcgagtcgtcgaagtaggctctag

SEQ ID NO: 57187 - DNA, 510 bp, Artificial Sequence
  Description of Artificial Sequence: Synthetic coding sequence
atggagggtagctcaagctacgaggtgccatctgtcgcagcagccgatctcgaggaaggcgctgggcaaaccagaagcttacccgctaccccctccaaagatgtacacaagggggtcggaggaataatcttcagcagttctcccatacttgacctgtccgagtccggtttatgtaggcttgaagaggtatttcggataccttccctccagcagctccatcttcagcggaatgccctgtgcgtgatcccccaggacttcttccaactactgcccaaccttacctggctggacctcaggtataaccggatcaaggcccttccaagtggtattggggcacaccaggaaagaaaccatgctgagtccaccgagcccaagacgctgccaagtggaatccccagttcagctaggtgcgccgaaggtataggtggttatccagctttgcccgcagatgtcggctctagaactctcagcccccagaagtcaaacttttcacggggtagcactggatag

SEQ ID NO: 57188 - DNA, 1407 bp, Artificial Sequence
  Description of Artificial Sequence: Synthetic coding sequence
atggatataaacacctataacaaccagctgcacctccagaggaacgcactctgtgtgatccctcaggacttcttccagctactgcctaacttgacatggctggatctccgctacaatagaattaaggcacttcccagtgggatcggcgctcatcagcacctcaaaacgcttctgctagaacgaaaccccattaaaatgctcccggtagagctgggcagcgtcacaacattaaaggctctcaatctcagacactgcccgctggagttccccccacagctcgtcgtgcagaaaggactggtggcaatacagagattcttgcgcatgtgggctgtggaacactctctgccacgtaatccgacatcccaggaagcccctcccgttcgggagatgactttacgcgacttacctagccctggcctcgaactaagcggcgatcacgcatctaatcagggcgcagtcaatgcccaagatcccgagggtgccgtcatgaaggagaaagcctccttcctcccaccagtagaaaagcctgatttaagtgaactccgaaagtccgccgacagcagcgaaaattggcctagcgaggaggaaatcagacgattttggaagctgcgccaggagatcgtggagcacgtgaaggcggatgtgcttggggatcaactcttgactcgcgagctcccccctaatctgaaggcagcgctcaacatcgaaaaagaacttccgaaacccaggcacgtgttcagaaggaagaccgcgagttctagatcgattctgccggatctcttgagtccatatcaaatggccatcagagccaaacgactcgaagagagtcgggctgccgcactcagggagcttcaggaaaaacaggcactgatggagcaacagcgacgggaaaagagagcactgcaggaatggagggagcgggctcagcggatgcggaagagaaaagaggaacttagtaagctactgcctccacgaagatctatggtagctagcaaaattccgagtgccacagatctgatcgataaccggaaagttcccctcaacccgcctggtaagatgaagcctagcaaagaaaaatctccccaggcaagcaaagaaatgagtgctctacaggagagaaatctagaagagaagatcaaacaacacgtgctgcaaatgagggagcaaaggagatttcacgggcaagcaccactggaggagatgcgcaaagccgctgaagatctggaaatcgcaacggagcttcaggatgaagtgctcaagctgaaattgggcctaactttgaataaagaccggcgaagggcagcacttactggaaacttaagtctgggcttgccagcggctcagccgcagaataccttttttaacacaaaatacggcgagtccggcaacgtacggcgataccaatag

SEQ ID NO: 57189 - DNA, 1407 bp, Artificial Sequence
  Description of Artificial Sequence: Synthetic coding sequence
atggatatcaacacctacaataaccaactacatctgcagcggaacgcactctgtgttattccccaggacttcttccagttgcttcccaatcttacctggctcgacctgagatacaatagaattaaagctttgccatccggaattggagcccaccagcatcttaaaacattactgctcgagcgtaacccaattaagatgttgccagtggagttagggtccgtaaccacgttaaaggccctgaacctgcgacactgtccattagagttcccacctcaattagtggtgcagaaagggctggtggcaatccagagatttctcagaatgtgggccgtggagcactccctccccagaaacccaacaagtcaggaagccccacccgttcgcgagatgaccctgcgagaccttccttctccaggtctggaattatccggcgatcatgcgtccaaccagggcgctgtgaacgcacaggatccagaaggcgcagtgatgaaagaaaaggccagtttcctgcctccggtggagaaacccgatttgtccgagcttcggaaaagtgcagacagcagtgaaaactggcccagcgaggaggagattcgcaggttttggaagctgcgccaggagatagtcgaacacgtgaaggccgatgtactaggtgaccagctgctgacaagagagctgccccctaatctgaaggctgcgcttaatatcgagaaggagctgcccaagcctcgacatgtttttcgccgaaagaccgcctcgagccggagcatactccccgacctgctgagcccctaccagatggccataagggccaagcgcctcgaggaatcacgggctgccgctctgagggaactgcaggagaaacaggctctgatggaacagcaaagacgagagaagagggccctccaagaatggcgggaacgcgcacagcgaatgaggaaacgaaaggaggaattatctaaacttctccctccccgacggtccatggtcgcctccaaaattcccagcgcaacggacttaatcgataaccgcaaagtccccctgaaccccccaggtaagatgaaaccgtccaaggagaagtctcctcaggcttccaaagagatgtccgcacttcaggagcggaacctcgaggaaaagattaagcaacacgtcctacagatgagggagcaacggaggttccacggacaggccccacttgaggagatgcgaaaagctgccgaagatctggagattgccactgaactgcaggacgaggtgctaaagctaaagctggggctgacgctgaataaggataggcggcgagccgctcttaccggcaacttaagtttaggcctgcctgccgcacagcctcagaacacattctttaacaccaaatacggagagagcgggaatgtacgcagatatcagtag

SEQ ID NO: 57190 - DNA, 1593 bp, Artificial Sequence
  Description of Artificial Sequence: Synthetic coding sequence
atggaaggatcttcaagctatgaagtgcccagtgtggctgccgcagacctggaggaaggggctggtcaaacacgcagcctgcccgctactccttccaaggatgttcacaaaggggtcggtggaattatattttcgagcagtcctatcttagatctgtctgaaagtgggctttgccggcttgaggaagtcttcagaatcccctccctccagcaactacatctccaaagaaacgccttatgcgtgatcccgcaggattttttccagctgctgccaaaccttacctggctcgatctgcggtataacagaatcaaggctctgccttccgggatcggggcacaccagcacctcaaaacccttctgttggagaggaatcccatcaaaatgctgcccgtggagctcggctctgtgactaccctgaaagctctgaacctgagacactgccctctggagttcccacctcaattagttgttcagaaggggttagttgcaattcaacgctttctgcgaatgtgggctgtagaacattctttgccccgtaacccaaccagtcaggaagccccaccagttagggagatgacactcagagaccttccgtcccccggtctggagttaagcggcgaccacgcctcgaatcagggtgcagttaacgcccaggatcccgagggtgctgtcatgaaagaaaaggccagctttctgccgccagttgagaaacctgacctctcagaactcaggaaaagcgccgactcgtcggagaattggccttctgaagaagagatcaggcggttttggaagctcaggcaagagatcgtggagcacgtcaaagcagacgtgttaggagaccaactgttaacaagggaactgcctccgaacctgaaggccgcattgaacattgaaaaagaactgccaaagcccagacatgtctttcgcagaaagacagcatccagtagatccatccttcccgatcttctctctccctaccagatggctatcagagctaaaagactggaagagtcaagagccgctgccctgcgagagctgcaggaaaagcaagccctgatggaacagcagaggagagagaagcgcgcactgcaagaatggcgcgagagagcacaacgaatgaggaaaaggaaagaagagttaagcaagctgctgccccctaggagatcaatggttgccagcaagattccctcggccacagatctgatagataacaggaaagtccccctaaaccctccaggcaagatgaaacccagcaaggaaaagtcacctcaggcttctaaagaaatgagcgccctccaggaacgtaacttggaggaaaagataaagcagcatgttctacaaatgagggaacagcgtagattccatgggcaggctccccttgaggaaatgcgcaaagccgcagaggacttagagatcgccacggagctgcaggatgaggttttgaagctaaaactggggttaacattaaacaaagacagaaggcgggctgccctcaccgggaacctcagcctaggactgccagccgctcagccacagaacacattcttcaacaccaaatacggcgagagtggaaacgtcaggcgctaccaatag

SEQ ID NO: 57191 - DNA, 1593 bp, Artificial Sequence
  Description of Artificial Sequence: Synthetic coding sequence
atggagggctcctctagttacgaagtgcctagtgtggccgctgccgacctggaggaaggcgctggccagacacgctcactgccggctacaccctccaaagatgtgcacaagggggtcggaggtattatttttagttcttccccaatcctggatcttagtgagtccggcctgtgccggttggaggaggtgttcaggatcccttccctgcagcaactgcatcttcagagaaacgccttatgtgtgattccacaagactttttccagctgcttcctaatctcacatggctcgatctgaggtacaatcgcatcaaggcactcccttctgggatcggcgctcatcaacacctcaagaccctgttactcgagagaaatcccatcaaaatgctgcctgtcgaactcgggtccgttacaactctgaaagcactgaatttgcgtcattgtcctctggaatttccaccacaactcgtggtccagaagggcttggtagccatccagcggttcctcaggatgtgggccgtcgaacattcgttgcctaggaaccctacatcccaggaggccccaccagtacgagagatgactctgcgagatctacctagtcccggactggagctgtccggggatcacgccagtaatcagggtgccgtgaatgcacaggaccctgagggcgctgtgatgaaggagaaagcgtcttttcttccacctgtcgagaaaccagatttgtctgaactgcggaagagtgcggatagtagcgaaaattggccttcagaagaagagattagacgtttctggaaactcaggcaggagattgtggagcatgttaaagcagacgttctgggtgaccagctgttaacaagagagttaccccctaatctcaaggcagcgcttaacatcgagaaagaattgcccaaaccacgtcatgtgttccgtcgaaagactgccagtagtcgctccattctgcccgacctgctatctccctaccagatggcaattcgggctaagcgattagaggaatcccgtgcagctgctcttagggagctgcaggaaaaacaggcccttatggaacagcaaagacgcgaaaagcgggctctgcaggagtggagagaaagagcgcagcgcatgcgtaaacgtaaggaagaactgtccaaactgctgccgcctagacggagcatggttgcaagtaagattcctagcgccactgatctcattgacaaccggaaggtgccactaaacccccctgggaaaatgaaaccttccaaggaaaagagtccccaggcaagcaaagaaatgtctgcactccaagaaagaaatctagaagagaagatcaaacagcacgtgctgcaaatgagagagcagagaagatttcacggccaagctccactggaggagatgcgtaaagcagctgaagacctggagatagccacagagctgcaagatgaggttttaaagttgaaacttggcttgacccttaataaggaccgccgtagggccgctctgacggggaacctgagtcttgggctgcctgcagcgcagccacagaacacgttcttcaacacaaaatacggagagagtggcaacgtgcgccgttaccagtag

SEQ ID NO: 57192 - DNA, 1152 bp, Artificial Sequence
  Description of Artificial Sequence: Synthetic coding sequence
atggagggctctagttcatacgaggttccaagcgtggccgctgccgatcttgaggaaggtgcaggccagacgagatcacttcccgctacaccgagtaaagatgtgcacaagggcgtgggcggaattattttcagctcttccccaatcctggatctgagcgagtcgggattgtgccggcttgaggaagtgttcagaatcccttccctccagcagcttcatcttcaacggaacgcactgtgcgttatcccacaggactttttccagttacttccaaatctgacctggttagatctgaggtataacagaatcaaggctttgccctccgggataggggcacaccagcatctcaaaaccctgcttctggagcgaaaccccattaaaatgctcccggtggaacttgggtccgtcaccacactgaaagccctaaacctaaggcactgtccactagaattcccgccacagttggtggttcaaaagggcctggttgctattcagcgatttctcagaatgtgggcagttgagcatagtctgccaagaaatccaacttctcaggaggcgccacccgtgcgagaaatgacgctgcgggaccttccgagtccgggtctggaacttagtggggatcacgcctctaaccagggggcagtgaatgcccaggacccagagggcgctgtcatgaaagagaaggcgtccttcctaccacccgtcgagaagcccgacctgtctgagctgcgcaaatctgccgactcatccgagaattggccttctgaagaagagatacgacgtttctggaaattgcggcaggagatcgttgagcatgttaaggccgacgttcttggggatcagttgctgacccgcgaactcccacctaacctgaaagctgcgctgaatatcgagaaagaattacctaaacccagacatgtgttccgacgaaaaacggcctccagtagaagcattcttccagacttattgtctccctaccagatggccatcagagcgaaaaggttggaggagagtagagcggctgctctgagagaactgcaagagaagcaggcgctgatggagcagcagaggaggccattcctcctcatctttccccgagtgttccaggccttgactcgaagttccggcaggttcatcctggttttgctttag

SEQ ID NO: 57193 - DNA, 1152 bp, Artificial Sequence
  Description of Artificial Sequence: Synthetic coding sequence
atggaaggttcctcttcatacgaggtcccaagtgtggcagcagccgacttggaagaaggggctgggcagacacgctcccttccagcgactccttccaaggacgtacacaaaggtgtgggcggtatcatcttttcttcgagccccattctcgatctgtcggagtccggcctctgccgtctggaggaggtgttccggataccatcactgcagcagctgcatttgcagcgcaacgccctatgcgtcatcccacaggacttcttccaactgctcccgaatctgacctggttagaccttcgctacaatcggataaaggccctcccgtctgggatcggcgcacaccagcacctaaaaacactgcttttggagagaaaccccattaagatgctgcccgtggagctgggcagcgtgaccacactgaaagcgctgaacctgcggcattgccctcttgagttccctcctcagctggttgtacagaagggtctcgtggccattcaaaggtttctgaggatgtgggcagtcgaacactccctgcctcgaaatccaacgtcacaggaagcaccgcctgtgcgggagatgacgctccgcgacttgccatcgcctggcctcgaattaagcggtgatcacgcctcaaatcagggggctgtcaatgcccaagatcctgagggcgcagtcatgaaggagaaggctagtttcttgccccctgtggagaagcctgacctgagcgaactccgcaagtctgccgatagtagtgagaattggccatccgaggaagaaatcagaaggttctggaagctacggcaagaaatcgtggagcatgtgaaggccgatgtccttggcgatcagctgcttaccagggagttaccgccaaatctgaaagccgctttgaacatagaaaaagaactccccaagccccgtcacgtgtttcgcacgcgggtgccaagaaagcaggctcttcagaggctgcacgagcgtaaaactaggatcatgggggtagtcggtcgagctcccacacacatgggcgagggcagacaaccgcctcccggtgccagctacccgacgtcctgtcacaggacaaagtggcggagcgagcagaaagattggaaacgagcagagcgccgaaggagtgagtctagtaggcgctcccggctgtag

SEQ ID NO: 57194 - DNA, 1107 bp, Artificial Sequence
  Description of Artificial Sequence: Synthetic coding sequence
atgctgcctgtggagttaggctctgttaccactctgaaagccctcaatttgagacactgccctctggagttccctcctcagttggttgtgcagaaagggcttgtggcgatccaacgctttctgaggatgtgggccgtggagcattccctgccaaggaacccaacttcacaggaggccccacctgtgcgggagatgacccttagagacctgccttctcctggcctggaattgtctggagaccatgcttccaaccaaggcgctgtcaatgcacaggatccagagggcgcagtcatgaaggagaaggcctcatttctgccacccgtggagaagcctgatctgtcggaattgagaaagagtgctgactctagcgagaactggccctctgaagaggagattagacgtttttggaaattgagacaagaaatcgttgagcacgtgaaggcggatgtgttaggagaccagctactaactcgagaactgccacctaatctgaaggctgcgctgaacatcgaaaaagagctccctaagcctcgccacgtgttccgacggaaaaccgcgtcgtcacggtccatcctgcccgatcttctgtccccttaccaaatggcgatacgcgcaaagcgcctcgaggaatccagggcggcagcacttagggagttgcaggagaagcaggcgctgatggaacagcagaggcgagaaaagagagcattacaggaatggcgcgaaagagctcagcgcatgcgtaagcggaaggaggagctttccaagttgctgcctcccaggaggtccatggttgcatctaaaatcccttcagctacggatctgattgacaatcggaaggtgccactgaacccacctggtaagatgaaaccatcaaaggaaaaaagcccccaggcgagcaaagagatgagtgccttgcaggaaaggaaccttgaagagaagatcaaacagcacgtgctgcaaatgcgggagcagcggagatttcatggccaagcaccactggaagaaatgagaaaggctgccgaagatctggagattagtaggcgatgggaacgcggaggcatgcgggctggttgcggcgcaacctcctggcgcccacatccaacatag

SEQ ID NO: 57195 - DNA, 777 bp, Artificial Sequence
  Description of Artificial Sequence: Synthetic coding sequence
tagtttcgcacgtccgtgtccacaccatccggcaacacagatatggacattaacacttataataaccaacttcatctgcagagaaacgctctctgtgtgatcccccaggactttttccaattactgcccaacctgacttggcttgacctccggtataatcgtataaaggcactgcccagcgggatcggagctcatcagcatctgaaaaccctactgctagaacggaacccgatcaagatgctgcccgtggagttaggatccgtgacaaccctcaaagccttgaacctgcggcactgcccattggaatttccaccacagttggttgtgcagaagggtctggtggcaatccaacgcttcctgcgaatgtgggcggtggagcacagcttgcctagaaatccaacgtcacaggaggccccacccgtgagagagatgaccctgagagacttgcccagtccaggcttagaacttagtggagaccatgctagcaatcaaggtgcagttaatgcgcaggacccagagggtgcagtcatgaaggagaaggccagtttcctaccccctgtggaaaagcctgacctgtccgagctgcgcaaaagcgccgactctagcgaaaattggccatccgaggaagagatcagacggttctggaagttacgccaggagatagttgaacacgtaaaggctgatgttctcggcgaccagctactgacccgagagctgccccctaaccttaaggcagctctgaacatcgagaaagagctgcctaagcctaggcactag

SEQ ID NO: 57196 - DNA, 1104 bp, Artificial Sequence
  Description of Artificial Sequence: Synthetic coding sequence
atggcgtctgagctgtgcaaaacaatttctgtggcccgattggagaagcacaaaaacctattcctaaattataggaatttgcatcacttccctctcgagctgttaaaggacgaaggcctgcagtacttagagcgactgtacatgaagagaaacagtttaacttcgttacctgagaacctcgcacagaaactaccaaacctggtggaactctacctgcactctaataatatcgtggttgtccctgaagctatcgggtccttagtaaaactccagtgcctggacctgtcagacaacgccttggaaatcgtctgtcctgagatcggcaggctacgagcccttagacatctgcggctcgccaacaatcagcttcagttcctgcctcccgaagtaggggatttaaaagagctgcagacactagatattagcaccaatcggttgctcactctcccagagagattgcacatgtgcctctcactccaatatctaacagtcgaccgcaaccgtctatggtacgtaccaaggcatttatgccaattgccttccctgaatgaactcagcatggctggaaaccgactcgcttttttacctctcgacttaggtagatctcgcgagttacaatacgtctacgtagacaacaatatccacctgaagggcctgccttcatacctttataataaggtgattggctgtagtggatgtggcgctcctatacaggtgtctgaggtaaaactgttgtcattctcaagcggccagaggactgtgttcctccctgccgaggtgaaagccattgggacagaacacgatcacgtccttcctttgcaggagctggcaatgagaggcttgtatcatacctatcactccctgttgaaagacctgaatttcctttcacctatcagccttccgcgtagtcttcttgaactccttcactgcccactgggacactgccacaggtgctcggagccgatgttcacaatcgtgtaccccaaactgttccccctcagggagactccaatggccggtctacaccaatggaagactaccgtctcatttgtcgcgtactgctgcagcacccagtgtctgcagaccttcgacctgttatcatag

SEQ ID NO: 57197 - DNA, 897 bp, Artificial Sequence
  Description of Artificial Sequence: Synthetic coding sequence
atggccagcgaactctgtaagacaatctcagtggccaggctagagaaacacaagaacctgttcctgaactaccggaatttgcatcacttccccctcgaattgctgaaggacgaaggcctgcaatacctagaacgtctgtacatgaaaaggaactcattgacctctctccctgaaaatctcgcacagaagctgcctaacttggtggagctgtacctccacagtaacaatatcgtggtggtacccgaggccattggatcactggtgaaactccaatgtctggatctgtccgacaacgctctggagatcgtctgccccgaaatcgggcgattgcgggcactaagacacctccggcttgctaacaaccagctacaattcctgccacccgaccttggccgaagccgggaactgcaatatgtatacgtggacaataacatccacctgaaggggcttccgagttatctctacaataaagtcatagggtgttcggggtgtggtgccccaattcaggtgtccgaagtcaaattactctctttttcatcaggacagagaacggtcttcctgcctgctgaggtcaaggccatcggcacagagcacgaccatgtccttccattgcaagaactcgcaatgcgcggtctgtaccatacgtaccacagcctgctgaaggacctgaactttctgtcaccaatctctctacccaggagtctattagaactccttcactgccctctcgggcactgccaccgctgttctgagcccatgttcactatagtttatcctaagttgtttcccttgagggaaacccctatggccggactacaccagtggaaaaccactgtttcgtttgtggcgtactgttgcagcacgcagtgcttgcaaacattcgatttgctgtcatag

SEQ ID NO: 57198 - DNA, 456 bp, Artificial Sequence
  Description of Artificial Sequence: Synthetic coding sequence
atggctagcgagttgtgtaaaaccatctctgtggctaggctagagaaacataagaatctcttcctaaattatcggaacctccatcatttccccctggaattgctgaaggacgaaggccttcaatatctcgaacgactgtatatgaaacgcaatagcctcacgtctctgccggagaatcttgcccagaaactgccaaacttagtggagctatacttgcattctaacaacattgtggtcgtgcctgaggccatcggcagtcttgtgaagcttcagtgcctggatctgtcggacaatgctttggagattgtgtgccctgagataggccgtttgcgggcactgagacatctcagactcgcgaataaccagctgcagtttctgccccctgtcccacattgtggtccaaaatcttcgatggtctgtgccgcacccagcctgcccgctgcgcagcctcagtag

SEQ ID NO: 57199 - DNA, 939 bp, Artificial Sequence
  Description of Artificial Sequence: Synthetic coding sequence
atggcatctgaactgtgtaaaaccataagcgtggccagactagagaagcataaaaacctgtttctgaattatcgcaatttacaccactttcccctggagctgctgaaggacgaggggcttcagtacttggaaagattatacatgaagcgcaacagcctgaccagtctgcctgagaacctagcacagaagcttcccaacctggtcgagttgtacctgcacagcaataatattgttgtggtgccggaggccatcggcagcttggtgaaactccagtgtctggacctcagtgacaacgcgctcgaaatagtatgtcccgagatcggtcggctgagggcactgcgccatcttcgacttgccaacaaccagcttcagtttctgcccccagaagtcggcgacctcaaggaactgcagaccctggatatctccacaaatagactattaactctgcccgaaagactccatatgtgtctgtccttacagtatctgacagtcgaccggaatagactatggtatgttccaaggcacttgtgccaattgcctagcctcaatgagctgagcatggccggtaaccgtctcgccttcttgcctctggatctgggtagatctcgcgaacttcagtacgtgtacgtcgacaataatatacacctgaaagggctgccgtcctacttgtataataaagtgatcggatgttccggatgcggcgctcctatccaggttagtgaggtgaagcttctgagctttagcagcggccaaagaactgtgttcctgccggcagaggtgaaagccattgggacggagcacgatcacgtgctgccactccaggaactggcaatgagggggctgtaccacacgtaccattcactcctgaaagggcgtcaactgttggtgctgtggctaactgcagcacctccttcagtgtgccgcctgctgacttgctag

SEQ ID NO: 57200 - DNA, 513 bp, Artificial Sequence
  Description of Artificial Sequence: Synthetic coding sequence
atggcctcagaactatgtaagactatatcagtggcccgactggaaaaacacaaaaacttatttctcaactaccgaaatctccaccactttccactggagctgttaaaggatgagggcctccagtacctggaacgactgtatatgaagcgaaactccctcaccagcctccctgagaacctggcgcagaagctgccgaatctggtggagttgtaccttcacagcaataatattgtggtcgttccagaagccattggatccctggtaaagttgcagtgcttggacctgtcagataatgcattagaaatcgtgtgccctgagatcggtcgacttcgcgctctacgacacctgagactggcgaacaatcaactgcagtttctgcccccagaggtaggggatctgaaggagctgcagacattagacatctctaccaatcggctgcttactttgccggagcgccttcatatgtgtctatccctgcaataccttaccgtcgacaggaatcggctatggtag

SEQ ID NO: 57201 - DNA, 672 bp, Artificial Sequence
  Description of Artificial Sequence: Synthetic coding sequence
atgtactcatccggctggccagccggtgccgcagagcccagacatgggcgaggcagggagttggcccaggcactgggctgtatgcatggtgcaccttctcaactggcgagtttgagcctggcccactgttcttcccttaagagccggcctgaacttgaacatcaagcctctggaacaaaagacgcttgtcccgagcctcagggcccatctctgttgacacttcgagccctccaggaactggacctcaccgcatgttccaaattaacggatgcaagcctggccaaggtgctgcagttcctccaactcaggcagctgagccttagcctcctgccagagctgactgataacgggctggtggctgtcgctcgcggatgtcctagtctggagcatcttgctttgagtcattgcagcagactctccgataaaggctgggcccaagccgcatcctcatggccaagactgcagcacctgaatctttcttcttgttctcagctcattgagcagacactggacgccattggccaagcctgccgccagctgagggtactcgatgttgcaacctgccccggaataaatatggccgcagttagaagatttcaagcccaactgccacaggtgagttgtgtgcagtcaagatttgtgggtggggcagacctgaccctaacgctctag

SEQ ID NO: 57202 - DNA, 672 bp, Artificial Sequence
  Description of Artificial Sequence: Synthetic coding sequence
atgtattcgagtgggtggcctgccggtgccgcagaaccgcgacatgggagaggtagagagctcgctcaggcactgggatgcatgcatggcgctccctctcagcttgcatccttatctctcgcccactgctcatccctcaaatcaaggccggagctagagcatcaggcctccggtaccaaggacgcatgccctgagccacaaggcccatcactgctcaccttacgggcactgcaggaactggatttaaccgcatgctccaagctgaccgacgcgtcactggcaaaggtgttgcagttcctgcagctccgccagcttagcttaagcctgttgccagaactcacggataatgggctagttgcagtggcacgcggttgcccttctctcgaacatcttgctctgtctcactgttcccgcctgagtgacaaaggttgggcccaagccgcttcttcatggccaaggctccagcaccttaatctcagcagctgcagccaactgatcgagcaaaccctggatgcaattggccaggcttgccgccagttaagggttctggacgtcgcaacttgccctgggataaacatggctgccgttaggaggtttcaggcacaattaccccaggtgtcttgcgtacaaagccgtttcgtgggcggtgccgatctcacacttacactttag

SEQ ID NO: 57203 - DNA, 672 bp, Artificial Sequence
  Description of Artificial Sequence: Synthetic coding sequence
atgtattcatccggttggccggctggtgcggctgagcctagacacggtcggggaagggaactagcacaggctctcggttgcatgcacggggcaccaagccagctagcatcgctctcactcgctcattgtagcagccttaaaagccggccagagcttgaacatcaggcctcaggaacaaaagacgcgtgtccagagcctcagggcccttccctcttgactctgcgcgcactgcaggagttggatttaactgcttgttcaaaacttacggacgctagcttggcaaaagtgctacaatttctgcagttgcgccagctctctctgtctctgctgccagaactcacggacaatgggttggtggcggtcgcgagggggtgcccgagtctggaacacttagccctttctcactgctccagactgtccgacaagggttgggctcaagccgcttcatcttggcctaggttgcagcacttaaacctgtcatcctgctctcagcttattgaacagaccctcgatgcgatcggccaggcatgcaggcaactccgggtcctcgacgttgccacttgtcctggaattaacatggcagccgtacggagattccaggctcaattaccacaggtgtcttgcgtgcagtcaagattcgtgggaggagctgacctcaccttgacgctctag

SEQ ID NO: 57204 - DNA, 672 bp, Artificial Sequence
  Description of Artificial Sequence: Synthetic coding sequence
atgtacagtagcggatggccggcaggggctgcagaacctaggcacggcagaggtagagagctggcccaggccctggggtgcatgcacggcgctccatcccagctcgccagcctgtctctagctcattgctctagcctgaaaagccgaccggagcttgagcatcaggcttctggaaccaaggacgcatgcccagaaccacaaggcccttctctgctgacccttagagctttacaggagttagacctaacagcctgttctaaattaacagacgcctcccttgctaaagtactccagttcctgcagcttcgccaattgtccttgtccctgcttcctgagctgactgataacggcctggtcgccgttgctcggggatgcccttcgctggagcatcttgctctttcacactgcagtcgcctttctgacaagggatgggcacaagccgcaagcagttggccgaggctccagcaccttaacctgtcaagctgtagccagctcatagagcagacacttgatgctataggtcaggcgtgtcgccagctgagagtgttggacgtggctacctgtcccggtataaacatggccgctgttcggaggttccaggcccagctcccacaagtatcttgtgtgcaatctagattcgttggtggcgctgacctcactctgacactgtag

SEQ ID NO: 57205 - DNA, 498 bp, Artificial Sequence
  Description of Artificial Sequence: Synthetic coding sequence
atgtactcatccggatggccggcaggcgcagccgaacctaggcacgggaggggccgagaactggcccaggccctagggtgtatgcacggggcaccatctcaattggctagccttagtctggctcactgttcatccctgaaatcccggccagagctggagcaccaggcttccgggaccaaggacgcttgtcctgaaccacagggaccaagtctactgacccttcgcgcacttcaggaacttgacctgacagcatgctccaagttgacagacgcctccttggctaaggttcttcaatttctacaacttagacagctcagcctctccctcttacccgagctgacagataatgggctggtggcagtggcaagaggatgcccgtcgcttgaacatcttgccctttcacactgtagcaggctctccgataagggctgggctcaggcagcctctagctggcccaggctccaacatctcaacctgtcctcttgttcacagctctag

SEQ ID NO: 57206 - DNA, 906 bp, Artificial Sequence
  Description of Artificial Sequence: Synthetic coding sequence
atgggggctcggcagagtcgcgcttcctcaaaagataagggacccaaacggatgcttttcaccgggagacgacaaaagttcagcccttgggacgacgccctcctgtccggaagagaccctcgctctctgcttaagcggggaatgcaccatgtgtctttctccctcgttacccgtggaatgactgacattcccgattttctctggggactgagtgaagtgcagaagttaaacctgtcacacaaccaacttagggtgctgccaccggaggtgggcaaattgaccagaattgtggtactgaatctgtgtgggaatcgcctaaagtctctgccgagagaggtgtcgctcttacagtgccttaaggtgctctttgtgaacatgaactgcctaacagaagtgcctgctgaactgagtctctgtagaaaactcgaggtgcttagtctgtctcataactgtctgagccagctgcctgcctgtttcgcggacctgagtcgtctcaggaagctcaacttgagtaataacttcttcgctcacatccctatgtgtgtgttctctctgaaagagttaatcttcctgcacgtgggatctaatagactggaaaatatagcagaatctatacagcacctcgcatcattacaaatttttattgccgaagggaacaacattcacagttttcccaggagtctgtgtctggtcacttcactcgaacttcttaatctgaacaacaacgatattcagacactaccatctgagttacatcttctgtgtcgactcgtccggatcgcctggaacccaatggataagggacttcacatctcccacaaccccctcagcaagccgctgcccgagttagtggagggtggcctcgagatgctttttggatacctcaaagacaagaagcatacatag

SEQ ID NO: 57207 - DNA, 1491 bp, Artificial Sequence
  Description of Artificial Sequence: Synthetic coding sequence
atgtcacagacccgcaaaaagacgagttctgagggtgagacgaagccacaaacctcgacggtgaacaagttcctgagggggagtaacgccgagtctagaaaagaggacaacgatttgaagacaagtgacagccagccatccgactggatacaaaaaactgcgacgtctgaaaccgccaagcctttgtcgtctgagatggaatggcgaagttctatggagaagaatgagcattttctgcaaaagctcggtaagaaagccgtcaataaatgccttgatctgaataactgtggtctaaccactgcagatatgaaagaaatgggtgaagcatttgagatgatccctgagctggaggagcttaatctgagttggaacagcaaagtgggaggaaacctccctctcatcttacaaaagtttcagaaaggtagcaaaattcagatgatcgaactcgtagactgtagcctgacatcggaagacgggacctttttagggcagttgctgccaatgctccaatccttagaagtgttagatctttcaattaatcgcgacatcgtgggtagccttaattcgatcgcccagggactcaaaagtactagcaacctgaaagtgctgaaactgcactcctgcgggctgtctcagaagtccgtcaagattttggacgcagccttccggtacctgggggagctgaggaagctggacctgtcttgtaacaaggatctaggaggagggttcgaggatagcccggcacagttggttatgctaaagcaccttcaggtgttggatctacatcagtgttccctaacggccgacgacgtgatgagcttgacacaggtcatacccttgctaagtaatctccaggagttggatctgagcgccaataaaaagatggggtcgagctcagaaaacctgctgtctagattgagattcctgccagcattgaagtccctcgtgattaacaactgtgccctagagtccgaaaccttcactgccttggcagaggcttcagttcatttatctgctctcgaggtcttcaacctttcgtggaacaaatgtgtgggtggaaatcttaaactactcctggaaacactgaaactgagtatgtccttgcaggtacttagattatcgagctgctcattggttacggaagatgtagccctcttggcctccgtgatccagaccggccacctcgctaagctgcagaagctggacctcagttacaatgactccatctgcgatgcgggttggaccatgttttgccagaacgtcaggttcctgaaagagcttatcgaactggatatatctctgaggccttctaatttccgggactgcggacagtggttcaggcacctcctatatgcggtgaccaaactgccacagatcaccgagataggtatgaaacgttggatcctacctgcctcgcaggaggaggagctcgaatgttttgaccaagacaaaaagcgaagcatacatttcgatcacggagggttccaatag

SEQ ID NO: 57208 - DNA, 1659 bp, Artificial Sequence
  Description of Artificial Sequence: Synthetic coding sequence
atgtctcagacacggaagaaaacaagcagtgaaggtgaaaccaaaccccagacctcgaccgtgaataagttcctcagaggctctaatgccgagagtaggaaggaagataacgatttgaaaacaagtgatagtcagccgtctgactggatccagaagacagcaacatccgagacggcgaagcccctgtcgtcagagatggagtggaggagcagtatggaaaagaacgaacacttccttcagaaattggggaagaaagcagttaacaagtgtttggacctgaacaattgtggactgacaactgccgacatgaaagaaatggtggcccttctcccattcctgccagacttggaggagctagatatctcatggaacggatttgtggggggaaccctgctgtcaatcacccaacagatgcatttagtgtctaagttgaagatcttgcggctgggctcctgccggctgactacagatgacgtccaggctctcggcgaagctttcgagatgatcccagagctggaggagctgaacctgagctggaatagcaaggtaggaggaaaccttccactgatactccaaaaattccagaagggaagcaaaatacagatgattgagctggtcgactgttcactcacctctgaggatggcaccttcctgggacagctgctgcccatgctccagtctctcgaggtgttagatctttcaatcaatcgggacatagtcggctcgctcaactctattgcccaagggcttaaaagcacctccaatctgaaagttttaaaactgcattcctgtggactgagccagaagtcagtgaaaatcttggatgctgcattccggtatctcggagaacttcggaaattagacctgtcgtgcaacaaggatttaggtggtgggttcgaagactctcccgctcagctggtcatgctcaagcacctgcaggtgctcgatttgcatcagtgttctcttacggctgatgacgtcatgagcttgactcaagttatccccctactgtcaaatctgcaagagctggatctctccgccaacaaaaaaatggggagtagctcggagaacctcctcagccgtctgcggttccttccagccctcaaaagtctcgtaatcaataactgtgcgttggaatccgaaacattcacagctctcgctgaggcttctgttcatttaagtgctcttgaggtgtttaacttaagctggaataagtgcgtagggggtaatttaaagctcctgcttgagacactgaagttaagcatgtctttgcaggtgctgcgactgtcatcctgtagcctggtcaccgaggatgtggcgttattggcaagtgtgattcagacaggccatctggctaagctccagaagctggatttgtcatacaatgatagcatctgcgacgccggatggaccatgttttgtcagaatgtgagatttctgaaggaactgattgaattggacatttccctgagaccatcaaacttccgcgactgtggacagtggttcaggcatttactgtacgctgttacgaagcttcctcagataaccgagattgggatgaaaagatggatcctgccggcaagtcaagaggaggagctggagtgcttcgaccaggacaagaagcgctccatacattttgatcatggcggttttcagtag

SEQ ID NO: 57209 - DNA, 1260 bp, Artificial Sequence
  Description of Artificial Sequence: Synthetic coding sequence
atgggcagttcgcgcgaggctgcacgggcaccagccaggagccctgcatgggcctccactcaagcatccactcctggagccgcacttgcagtgcagcgagaatcaccagagtcgggcctgcagaaacattatagcaacctgtgcatggaaaagtcacagaaaatcaatccattcatcctgcacattctccaggaagtggatgaggagatcaagaaaggcttagcggcaggaattacgcttaacatcgcagggaataacaggcttgtcccggtcgagagagtaacgggagaggatttttggatcctctccaaaattctgaaaaactgtctgtacatcaatggcctcgacgtggggtataacttactctgtgacgtgggagcctattacgccgctaaactgctgcaaaaacagttaaacctgatctacctgaacctgatgttcaacgatattgggcctgagggcggtgagctaatcgccaaagtgctgcataaaaatagaaccctgaagtaccttcgtatgactgggaacaagatagaaaacaagggcggtatgtttttcgcggctatgcttcaaatcaacagttccttggagaaactggacctgggcgactgtgatctagaggaatcaacggtgcacgtcggaagaatgctcaaagaaaatcactgtctggtcgctctgcacatgtgtaaacacgacatcaaaaacagcggcatccagcaattgtgtgacgccctttacttgaatagttctctccgctacctagacgtcagctgtaataaaatcactcatgacggaatggtctacctggctgacgttctgaaatccaacacgacacttgaggttatcgacctgtctttcaataggattgagaacgcaggcgctaactatctgagtgagactctgacgtcccacaaccggagcctcaaagccctcagcgttgtaagcaataacattgagggggaaggcctggttgcgctctcacagtccatgaaaacaaatctcacattctcccatatttatatttggggaaacaagttcgacgaggctacgtgtattgcctacagtgatctcatacaaatgggctgcctgaaaccagacaacactgacgtagagcccttcgtagttgacgggagagtgtacctagcagaggtgtctaacggtcttaaaaagcactactattggacaagcacttatggggagagttacgatcattcttccaacgcaggatttgcattagtccctgttggccaacaaccctag

SEQ ID NO: 57210 - DNA, 1395 bp, Artificial Sequence
  Description of Artificial Sequence: Synthetic coding sequence
atggcagctcagccgcctcgaccagtgggcgaaagaagtatgggatcctcccgtgaagcagcccgagccccagcacgatccccagcctgggcatctactcaggcctctactcccggagctgctctggccgtacagagggagtcccccgaaagtgggctgcaaaagcactacagtaatctttgtatggaaaaatcccagaagatcaatccatttatcctgcatattctccaggaggtcgatgaggagatcaagaaaggcttggctgctggtattacactgaatatagccggtaacaacaggctagtgccggttgagagggtgacaggtgaggacttctggatcttgtcgaaaattctgaagaactgtctgtacatcaacggtctcgacgtgggttataacctattatgtgatgtgggcgcttattatgccgctaaactgctgcaaaagcagctgaatctgatttacctgaacctgatgttcaatgacatcggacccgaggggggtgaactgatcgccaaagtgctgcacaagaacaggaccctgaagtacttacgcatgaccggcaataaaatcgagaataagggcggaatgtttttcgccgcaatgctgcagattaacagttcactggagaaactggacttaggcgactgtgaccttgggatgcaaagtgtaattgccttcgccaccgttctgacacagaaccaggcaatcaaggccattaacctgaatcgacccattctttactcggaacaggaggagtctaccgttcatgtgggtagaatgctgaaggagaatcactgccttgttgcattgcacatgtgcaagcatgacattaagaacagtgggattcaacagctgtgcgatgccctctacctaaattcatccctacgctatctggacgtctcctgcaacaaaattactcacgatgggatggtataccttgccgacgtgctaaaatctaacactacactagaagtgatagatctcagtttcaatagaatcgaaaacgcaggagcgaattatctgagcgaaaccttgacttcccacaacaggtctctgaaggcactcagtgttgtgagtaacaatatcgagggagaaggcctcgtggccctttctcagagtatgaaaaccaatttaacattctcccatatctatatctggggcaataagtttgacgaggcaacctgcatcgcgtactctgatttgattcaaatgggttgcctgaaacctgataatacagatgtggaaccttttgttgtggatggacgcgtttatttagccgaagtgtccaatggattaaaaaagcactactattggacctctacctacggggagtcctacgatcactcttcaaacgccggtttcgcgttggtacctgtcgggcaacaaccatag

SEQ ID NO: 57211 - DNA, 1299 bp, Artificial Sequence
  Description of Artificial Sequence: Synthetic coding sequence
atggccgcacaaccaccgagaccggtcggcgagcgctcaatgggctcttcgagggaagcagcccgagcccctgcgcgatccccagcctgggcgtccacccaggcctccacacctggagccgcactagcagtgcaaagagagtcaccagaaagcggtctgcagaagcactacagcaacctgtgcatggaaaaatctcagaagattaatcctttcatcctgcacattctgcaagaggtcgatgaagagatcaagaaaggactcgctgcgggtattaccctgaacattgccggaaacaataggcttgttcctgtcgagagagttaccggagaagacttctggatcttgagcaaaatactgaagaactgcttgtacattaacggccttgacgttgggtacaatctcctttgcgatgtcggtgcatattatgccgctaagttgctacagaagcagttaaacctgatatacctcaaccttatgtttaatgatattgggccagaagggggtgagcttatcgctaaagtgctgcacaaaaaccgaaccctgaagtatctgagaatgaccgggaacaagatcgagaataagggcggtatgttcttcgctgccatgctgcaaattaacagtagcttagagaagcttgacctgggcgattgcgatctagaagagagcacagtgcatgtcggcaggatgctcaaggagaatcactgcctggtggctttgcacatgtgtaagcacgatatcaagaatagtggaatccaacaactctgtgatgctctttatctcaatagcagcctccgatatctggacgtctcatgtaataaaatcactcatgatggtatggtctatttggccgatgtgctgaaaagtaacacaaccctggaagtgatcgacctgtccttcaatagaatcgaaaacgccggagctaactatctgtcagagaccctgactagtcacaatagaagtctgaaggctcttagcgttgtgtcgaataatatcgaaggcgaggggctagtggccctttctcagagcatgaagactaacctgacgttttcccatatctatatctgggggaacaaattcgatgaagcaacttgcatcgcgtactccgaccttattcagatgggttgtttgaaacctgacaataccgacgttgaacccttcgtggtggacggccgagtttatctggctgaagtatctaacggtttgaagaagcattattattggaccagcacctacggcgagtcatacgaccacagctccaacgccggatttgccttggttcctgtaggccagcagccctag

SEQ ID NO: 57212 - DNA, 981 bp, Artificial Sequence
  Description of Artificial Sequence: Synthetic coding sequence
atgacccgcgagggataccaggttagcttcctggacaacaagtcttctggcagttcacctgaaaaagaactgattcctaagccagatacctttcacctaactcatgacgcttccctgtcaaaatgcctggatgttggcgacagctctcaaattcatccctatcagctgccatcggatgtcgggcttgagaactacgatagttgttactcccagacgctttcattgcacggcagcctggggaaaaggccgcagcgaagcaagaactatcaggagtacagcatcaagccatcaaacgatattaagaccaccgcctctcactcctgcggcgatcttctgacctcactctctaacccagatagctccactggaaggttactgaagttgagctccgatctgtacgccacaacacactttaactccgaccccgctgtgctggtcaacgtggagcaacagttgtccaccagcctggatgacctcacacccgctcatggatcggttcctaacaacgccgtgcttgggaataggacaactccccttcgcacgttgttgctctctccaggaaccagtgagcatcgtaagattttcaccaagagaagtttgagcccatctaagcggggattcaaatggaaggataacatactggcaaatcttaacctgaagcatgggttccaggatgctaccggatctgagccgctttcaagcgacctggggtccctgcacggcctggcagggaaccacagcccccctatttcggcgcgtacacctcacgtcgccacagtcctgagacaactgctcgagctcgtggacaaacactggaacggcagtgggtctcttctgctgaataagaagtttctgggaaagttcgaagccaagaccggacaatccgcaggcggaaagcctcatttcgtgagaaagaactcgacagtagggggtcgttgctgccacttaaattgtgagtgggctactgtcacctacctctag

SEQ ID NO: 57213 - DNA, 2265 bp, Artificial Sequence
  Description of Artificial Sequence: Synthetic coding sequence
atggccgaacagtgggaactggacgaggagggtattcgccgactgggagctctaacgcttgaacagccagaactcgtggagtcacttagtctccagggaagctacgcgggaaagatccacagtatcggagacgctttccgaaactttaaaaacctcaggtcactcgacctgtccagaaaccttataacaagcctgaaggggattcaatacctgtgcagtctgcaggatctaaacctatactataacaacattcctagtctcgtggaagtaagcagactgcagcccttacctttccttaaggagttggacctgcgcttgaatccagtggtgaggaaggacaccgactaccggctgtttgccgtgtacacactgcaaaccctggaaaaacttgacgaccggactgtgcgagaaggggaacggaaggctgccaagctgcacttttctcagctgggcaacagtgagaatttcttgctggaggtggagaaaagctcccgcgaaaaaacgatgaagaattgcgttacaggagagtcctccgcctctaaggtaagcgccaacgtggatagtcggatcgagatggactcaaataagggcctgttcattcctttccctaacagggagatcaaagattccctgtcaacaagtgcgacccaggggaacggaaccagggatcagaagctcgatactttcccactcggcacccagacacaggaggtggcgagaagagaaatgcctagcgacaaccaccaggaggatgagttcaggcattattcacccagacaaagtacagttcgttctcctgagaagatgacccgggaggggtaccaagtgtcattcctcgacaacaagagcagtgggtcttctcccgagaaggagctgattcctaagcctgacaccttccacctgactcacgacgcttccctatctaagtgcttagatgtgggcgattcaagccaaattcatccttatcagctgcctagtgatgtaggactggaaaattatgactcgtgctattctcagaccctctcactccacgggagtttgggtaagagaccccagaggtccaaaaactaccaggagtatagcatcaagccaagtaacgatatcaagactacagcctctcacagctgcggcgacctactgacatcgctcagcaacccggactcctccactgggcgtctactgaaactgagtagcgatctatacgctaccacacatttcaatagtgatccagcagttttggtgaacgtggaacaacagctgtcaacaagtctggacgatctgacacccgcacatggatcagttcccaataatgccgtgctcggaaaccggactacgcctcttcgcaccctgttactgtcccccggaacgtcagaacacagaaagatttttactaagcgctcacttagccccagcaagcgaggcttcaaatggaaggataacattctggccaacctgaatctgaaacacggatttcaggacgctaccggaagtgaacccctgtctagcgacttgggctccttgcacgggctagcaggtaatcattcccctcctatctcggctcggaccccacacgtggccacagtgctgcgtcagcttctggaactcgtggacaagcactggaatgggagcggatcccttctgctgaacaaaaagttcttgggacctgcccgtgacctgctgttgagtctcgtcgtgcctgccccttcccagcctcgctgttgctcccatccagaggataccatgaaggccttctgtcgcagggagctcgaactcaaagaggctgcacagctcgtccctaatgacatggagtccttgaagcaaaagctcgtcagagtgttggaagaaaacctcatcctttcagagaaaattcagcaattagaggagggtgcagcaatatctatcgttagcgggcaacagagtcatacttacgacgacctgttgcataagaatcagcagcttactatgcaagtggcttgtctgaatcaggaactcgcccagctgaagaagctggagaaaacagtagccatcttgcacgaatcacagcgatcactggtcgtcacgaacgaatatcttctccaacaactcaataaggagccaaaaggatattctggcaaggcattgctgcccccagagaaggggcaccatttggggagaagctcaccattcggcaagagtacgctcagctcttcttccccagtggcacacgaaaccggccaatatcttatccaatctgtactggacgccgcaccagaaccaggtctctag

SEQ ID NO: 57214 - DNA, 1590 bp, Artificial Sequence
  Description of Artificial Sequence: Synthetic coding sequence
atgctaagaccacgatttttgcctcctgacgatagaactgtgagggagggcgaacggaaggcagcaaagctgcacttttcacaactgggcaacagtgagaactttctcctcgaggtggagaaaagtagtcgggagaagaccatgaagaactgtgtaactggcgagtctagtgcaagtaaggtctcagcgaatgtcgacagtaggatcgagatggacagtaacaagggacttttcattccttttccgaacagggaaattaaggactccctgtctacgtctgcaacacagggcaacggcacgcgggaccagaaactggacacttttcctctcggcacgcagacccaggaagtggcccgtagggaaatgcctagtgacaatcaccaagaggacgaattccggcactatagtcctcgacagtctacggtcagaagtcctgaaaagatgacgcgtgagggataccaggtttctttcctagataacaagtcgtcaggcagtagccctgagaaggagctaatcccaaaacccgatacctttcatcttacccacgatgcgtctctctcaaagtgcctggatgtgggagactccagtcagatacatccataccagttgccttctgacgtgggcctcgaaaactacgactcgtgttattcccaaacactatcactccatggatcactgggcaaacgcccacagcgaagcaaaaactaccaggaatatagcatcaagcctagcaatgacattaaaaccaccgcgagtcattcctgtggcgatctattaacatccttgtccaatccagactcctctactggacgcctgctcaagttgtcatctgatctttacgccactacgcactttaattcagacccagcagtgctggtgaatgttgagcaacagctgtcaacctctctcgacgacctaacccccgctcacgggagtgtgcccaacaacgctgtgctgggcaatcggacgacccccctgcgcactttacttctcagccctggcacgtccgaacacagaaagatcttcaccaaaagatcgctaagcccctccaagcgcggatttaagtggaaagataacatattggccaatctgaatcttaagcatggttttcaggacgctactggctctgaagagtctctaaagcagaaactggtacgagtgcttgaagagaatctcatcctgagtgagaagattcagcagttggaagaaggtgctgcgatcagcatcgtaagcggccagcaatcccacacatatgatgacttgcttcacaaaaatcagcagctgacaatgcaagtggcctgcctgaaccaagaactggcccagcttaagaagctagaaaagactgtggctattctgcacgaaagccagagatctctggtagtcacaaatgagtacctcctccagcagctaaataaagagcctaaggggtattctggaaaagccctcttaccaccggaaaagggacatcacctgggtcgttcttccccgtttggtaaaagcacactgtccagttcgagccccgtagcgcatgagaccgggcagtaccttatccagagcgtgctggacgcagccccagagcccggactgtag

SEQ ID NO: 57215 - DNA, 681 bp, Artificial Sequence
  Description of Artificial Sequence: Synthetic coding sequence
atggaaggacaatacccctgccagcctgaatccaaagcttggttccctaggtgttataggcagcgagtgacctgggtggtgtgcactgtgtggctggagactaccgtaccccctagcttaccggagcctccaatgtggcccctcagctccgacagttcctggagtctctggatctccaccggcatggcgcctgctccttcgtcgtccactcgctctttctctgagtccctgaagcagaaactggtgcgcgtccttgaggagaatttgatcctgagtgagaagatccagcagcttgaggagggagccgcaatctccatcgtgagcggccagcagtcccacacttatgatgatctactccacaagaatcaacaattaacaatgcaggtggcctgcctcaaccaggagctcgcgcagcttaaaaagctcgaaaaaacggtcgctattcttcatgagtcgcagagatccttagtggtcaccaacgaatacctgttgcagcagcttaacaaagaacccaaaggatactcgggtaaagccctgctgcctccggagaaagggcaccacctcgggaggagtagcccattcggaaagtcaactctaagttcaagcagtcccgtcgcccatgagacaggtcagtatctgatccaatccgtccttgacgctgcacctgagcctggattgtag

SEQ ID NO: 57216 - DNA, 1902 bp, Artificial Sequence
  Description of Artificial Sequence: Synthetic coding sequence
atgctcaggcccaggttcctgcccccagacgatcggacggtgagggagggtgagcgcaaggcagccaagctgcactttagtcagctgggtaacagcgagaacttcctgctggaggtggagaagtccagcagggaaaagacaatgaaaaactgcgtcacaggagaatcctccgcgagtaaggtgagcgcaaacgttgactcacgtatcgagatggattctaacaaggggctctttattcctttcccaaaccgcgaaatcaaagattcattgagtacatccgccacacagggaaacggcactagagatcagaagctcgacacatttcctctcggaacgcagactcaggaggtggcgaggagagagatgcccagcgataatcaccaggaggatgagttccgccactactcccccagacagagtaccgtgagatcacccgagaagatgacccgcgagggctaccaggtcagcttcctcgataataaatcatcgggcagtagccctgagaaagagttgatcccaaagcccgacacattccacctcactcacgacgcctcattatccaagtgcctagatgtaggggatagttcccagatacatccctatcagctaccatcggacgtgggcctggagaattacgattcatgttacagccagactctgtcgttgcatggcagcctggggaagcgccctcagcgatccaagaactatcaggagtattctattaaaccctcaaacgatattaaaacgaccgccagtcacagttgcggggacctgctcactagcctatctaaccctgatagctccacaggtagactgcttaagctgtcctctgatctctacgccaccacgcatttcaatagcgacccagctgtgctggttaacgtggagcagcagcttagcaccagcctagatgacctaacccctgctcacgggtcggtccccaataacgcagttcttggtaacagaactacccctctgcgcacgctgctgcttagtccaggcacatccgagcatcgcaagattttcacaaagcggtcattgtctccatcaaagcgcggtttcaagtggaaagataatattcttgctaatctaaatctgaagcacggcttccaggacgccaccggaagtgagcccctcagctctgatttaggcagcctgcatgggctggcagggaaccacagccctcctataagtgcaagaactccccacgtggcaacagtgctgcggcaactgctggaattagtggacaaacactggaacggctcaggttccctccttttaaacaaaaagtttctgggtcctgctagagacctcttgctgtccctcgtcgtccccgctccatctcagcccagatgttgttcccatcctgaagacaccatgaaggccttctgcagacgcgaattagaactgaaagaggccgcacagctggtgcctaacgacatggagtctctaaagcagaagcttgtacgcgttctggaggagaatctgatattatccgagaaaatccagcagctggaagagggtgctgccataagcatcgtgtctggtcagcagtcccacacttacgatgatttgctccacaaaaatcagcaactgaccatgcaggtcgcttgtctaaaccaggaactggctcaacttaagaagctggagaaaacagtcgctatcttacatgagtcccagagaagcctcgttgtcacaaatgaatacctgctgcagcagctgaacaaggaaccaaagggatattctggcaaggcactgctcccccctgagaagggtcaccacctcggacggtctagccccttcggcaaatcaactctgagcagcagttcaccagtggcgcatgagaccgggcagtacctgatccagagcgtgctggacgctgcccctgaacccggactctag

SEQ ID NO: 57217 - DNA, 5102 bp, Artificial Sequence
  Description of Artificial Sequence: Synthetic coding sequence
atgtcatctgcccagtgtcctgctctagtgtgtgtcatgtctaggttgcgattctggggcccatggcctctactcatgtggcagctcttgtggttattggttaaagaggcccagcctttggagtgggtgaaggaccccctccagttaacctctaaccctctcggcccacctgattcatggtccagccactcgtcccatttcccacgcgaaagtccacacgcgccaacactgcccgcagatccttgggactttgaccatctgggcccaagcgccagctctgagatgccagcaccgccacaagaatccacggagaatttagtgccatttctggatacatgggactctgcaggagagcagcccctggagcccgagcagtttttggctagtcaacaagacctaaaagacaagctatcccctcaggaacggctgcctgtgtccccgaagaaactgaagaaagacccagcccaacgttggagcctggcggagatcatcggaattacccgccagctctccacgccacagagccaaaagcaaacactccagaacgagtattcctctaccgatacaccttatccaggatctctgccaccagaactacgggtgaagagcgacgagccaccgggacccagcgaacaggtggggccttcacagtttcacctggaaccagagacccagaatccagaaacactcgaagatatacagtcctcaagcctgcaacaagaagcccctgcacagctgccacagctcttagaggaggagccatcatcaatgcagcaggaggcacccgcattgcctcctgaatcaagtatggaaagcttaactcttcccaaccacgaagtcagtgtgcagccacctggggaagatcaagcttattaccatctgcccaatattacagttaagcctgcagatgtggaggtaaccatcacctccgagccgactaatgagacagagtcgtcacaggcacagcaggaaaccccgatacagttcccggaagaggtggagccctctgccactcagcaggaagctcctatagagccaccagtgcctcccatggagcacgaactgtccatcagcgaacaacaacaacctgtgcagccctctgaatcccctagggaggtggaatcgtctcctacccagcaggagactcccggacaacctcctgaacaccacgaggtgaccgtgtcccctcccggtcaccatcaaacgcatcacctcgcttccccctcagtgtcagtgaagcccccagatgtacagttgactatagccgcagagccctcagctgaggttggcacaagtctggtgcaccaagaggctaccacccgattaagcggaagtggcaacgatgtcgagcctcccgctatccagcatggtgggcctcccctgttgcccgagagctctgaggaggccggaccattagctgtgcagcaagagacctcatttcagagtcccgaacccattaacaatgaaaacccctctcctacgcagcaggaggcagccgctgagcatccgcagaccgcggaagagggggagagctccctaactcaccaggaagctcctgcacagacgccggaatttccaaacgtggtggtggcacagccaccagagcattctcatctgacacaagctacggtgcagcctctggacctgggctttacgatcactccggaatctaagacagaggtggaactgtctcccaccatgaaagagacccctactcaaccccctaagaaagtcgtgccgcagctgcgagtttatcagggagtgacaaacccgacccccggacaggatcaggctcaacacccagtttcgccgagcgtgacagtgcagcttctagacctaggtctcactattacaccggaacccacaactgaggtgggccactctacaccaccaaagagaaccattgtgagcccaaagcatccagaggtgacccttccccaccccgatcaggtccagacgcagcacagtcatcttactcgtgctactgtgcagccattggacctgggcttcacaattacacccaaatctatgacagaagtggagccatcaaccgcattgatgactacagccccacctcccggacaccccgaagtcaccttgcccccatcagataaagggcaggcacagcattcccacctgacacaggcaacggtacagcctctggacctggagctcaccatcacaacaaaacccacaaccgaggtgaagccctcccccaccaccgaggagactagcacacagccaccagacctaggcctggcaattattcccgaacccacgaccgagacccgccacagtacagctctggagaaaaccacagctccacgtcccgacagagtccagacgctgcaccgctccttaaccgaggtgacaggaccgccaactgagctcgaaccggcacaggacagtctcgtccagtccgagtcttacacccagaacaaagcccttactgcccctgaagagcacaaggcctccacttccacaaacatttgcgagttatgcacctgcggtgacgaaatgctttcctgtatcgacctcaaccccgagcagcgattacgccaggtcccggtcccagagcctaacacgcataatggaacgtttaccattcttaactttcaggggaattacatcagctacatcgacggcaatgtatggaaggcatatagttggaccgaaaagctgatcctgagggaaaacaacctgactgaactccataaggactcattcgagggcctgctgagcctccagtatcttgacctgtcctgcaacaaaatacagtccattgagagacacaccttcgagcctttgccatttttaaagttcataaatctgtcctgtaacgttataactgaactgagtttcggcacatttcaagcgtggcatggcatgcagttcttacacaaactgattctgaatcacaaccctttgaccaccgtcgaggacccctacctgtttaaactgcccgcattaaagtacctagacatgggcactacactggtgccgttgactactctgaaaaacattttgatgatgaccgtggagctggaaaaattgatcctcccctcccacatggcttgctgtctgtgccagttcaaaaattcgatcgaggccgtgtgcaaaacggtgaaattgcactgtaactctgcctgtctgacaaacaccacacattgtcctgaggaggcctcagtcggaaaccctgagggagcgttcatgaaagtcttgcaggctcgcaaaaattatacatccactgaattaatagtggagcccgaggaaccatctgactcttccggaatcaacctctctggattcgggagcgaacagctggatactaatgacgaatcagacttcatttctaccttgtcatacattctgccctatttttcagctgtcaatctggacgtaaaaagccttctccttccttttatcaagctacctacgacgggcaacagccttgccaaaatccagactgtgggacagaatcggcagagggtgaaaagagtactgatgggacctaggagcattcaaaagcggcacttcaaagaggtggggaggcagagcattcgacgcgagcagggcgcacaggcctccgtcgaaaacgcagctgaagaaaaacgacttggaagtcctgcgcctagagaggtagagcaaccacacacacagcagggccctgagaaactggctggtaatgctgtgtataccaagccttcgtttacccaggaacacaaggctgctgtgtctgtgctgaaacccttctctaaaggagcgccaagcaccagtagccccgctaaggctttaccccaggttcgcgacagatggaaagacttgacccacgcgatttctattctggaaagcgcaaaggccagggtgactaataccaagacttccaaacctatcgtgcacgctagaaagaaatatcgattccacaaaacccgtagccacgtaactcaccgaacccccaaagtcaagaagtcacccaaggtgaggaaaaagagctacctgagccggttaatgctcgccaacagacttcctttttctgcagctaagtccctgattaatagcccaagtcagggtgcattctccagcctcggagacctgtcaccccaggaaaatcctttcttagaggtttctgcgccttccgaacacttcattgaaaacaataatacaaagcacactacagcaaggaacgccttcgaggagaatgactttatggaaaacactaacatgcccgagggcaccatctctgagaatacgaattataaccacccccacgaggccgatagcgccggaacagcatttaaccttggtcctactgtcaagcagacggagactaaatgggaatataataatgtcggaaccgatctcagcccggagccgaaatctttcaactatccgctgttgagctcccctggcgaccaatttgagattcagctgactcagcaactacaaagtctaattcctaacaacaatgtacggaggctaatcgctcatgtgatccggacactgaaaatggactgttccggggctcacgttcaggtaacctgcgctaagcttattagcagaactggccacctgatgaaattacttagcggtcaacaggaagtgaaggcttccaagattgaatgggatacggaccagtggaagattgagaattatatcaatgaatcaaccgaagcccagtccgaacagaaggaaaaaagcttggaactgaagaaagaggtcccgggttacggctacaccgacaagctaatcctggccctgattgtgactggcattcttaccattcttatcatcctcttttgcctgattgtaatttgttgtcacagaaggtccctgcaagaagatgaagagggatttagtaggggaatattcaggttcctgccctggcggggatgcagttctcgccgagagagtcaggatggactctccagttttggacagcctctgtggtttaaagacatgtacaagcccctttccgcaacgcgtatcaataaccacgcatggaagttgcacaagaaatcatccaacgaggataaaatccttaatagggaccccggagactccgaggcgccaacagaggaagaggagtctgaggcgctcccata

SEQ ID NO: 57218 - DNA, 5103 bp, Artificial Sequence
  Description of Artificial Sequence: Synthetic coding sequence
atgtcttctgcccagtgccctgccttggtgtgtgtgatgagcagattgcgattttggggaccctggccactcttaatgtggcagctcctgtggctgttggtgaaagaggcccaacccctcgaatgggtaaaagatccgctccaattaactagcaatcccttgggtccccctgacagttggtcttcacatagcagtcattttccgagggagtctcctcacgccccaacccttcccgcagatccctgggatttcgatcacctggggccttcagcgagtagcgaaatgcccgctccgcctcaagagagcacggagaatctggttccctttctggacacttgggactcagccggtgagcaacctctggaaccagaacagtttctagcctctcaacaagacttgaaagacaagctgagccctcaagagagacttcctgtttccccaaaaaaactgaaaaaggaccccgctcaaagatggtccctggctgagataattgggattacccgccagttgtctaccccgcagagccagaaacagactctgcaaaacgagtattcctcaacggatactccttatccaggatcactgcctccggaattgagggtgaagagcgacgaacctccaggcccatctgaacaagttggaccatcgcagttccatctcgaaccagagacgcaaaaccctgagactctagaggatattcagagctctagtcttcaacaggaggcccctgcccagctgcctcagctgttggaggaggagccctcctcaatgcagcaagaggcccctgccctcccacccgagagctcaatggaatcgttaacactgcctaaccatgaagtgtcagtgcaacctcccggagaagaccaggcctattaccacctgcctaacattacggtaaaacccgctgacgtcgaggtgaccatcacctctgagccgactaatgaaaccgagtcctcccaggctcagcaggagacccccattcaatttcccgaggaggtggagcctagcgccacccagcaggaagctccaattgagccaccagtacctccaatggagcacgagctgtctatctccgagcaacaacagcccgtgcaaccatctgaatcaccaagagaggtggaaagcagcccaacacagcaggaaactccgggtcagcctcccgaacatcatgaagtcaccgtgtctcctcctgggcaccaccagacacaccatctggcgtcaccatcagtctctgtcaaaccccctgacgtgcaactgaccatcgctgccgaaccatctgccgaagtgggaactagcctcgttcaccaggaagctaccacccgcctgagcggttcagggaacgacgtggagcctcccgctatccagcacgggggtccccctctgttgcctgagagctcagaagaagctggacccctggccgtgcagcaagaaacctcctttcagtccccagagccaatcaataacgaaaatcctagcccaacacagcaggaagccgctgcagaacaccctcagacagcggaggaaggagaaagctccctgactcatcaggaggccccagctcaaacacctgagtttcccaacgtagtcgtggctcagccaccagaacacagccaccttacccaggcaacagtacaaccgctagatctcggctttaccatcaccccggagagcaaaacggaggtggaattgagcccgacgatgaaggaaactcccactcagcccccaaaaaaggtggtgccccaacttagggtttatcagggggttacaaaccctacacccggacaggatcaggcccagcatcctgtaagcccatcagtcaccgtgcagctgcttgaccttggcctaactattacccccgaaccaacaacagaggtcggtcactccacccctcccaagagaacaattgtcagccctaaacaccccgaggtcaccctcccacatcccgaccaagtacagacacagcactcccacctcacacgggctaccgtgcagcccctggacttgggatttacaatcaccccaaagagtatgacagaagtagagccgtcaaccgctctgatgacgaccgcacctccccctggtcaccctgaggtgacactcccccctagtgataaaggccaagcacagcatagtcacctcactcaagcgacagtacagcccctggatctcgagctgaccattacaactaaacctactactgaggtgaaacccagcccaaccaccgaggaaacttcgacccagcctcccgacctgggcctggctatcatacccgagccaaccactgagacccgtcattcaaccgctctggagaagacaacggcacctcgcccagaccgcgtccaaactctgcaccgtagcctcacagaagttacaggacctcccaccgagctggagcctgcacaggattctttggtgcagagcgagtcatacacacaaaataaagccctgacagcccctgaggagcacaaggcctccacctccaccaacatatgtgagctgtgtacctgtggcgacgagatgctgtcatgtatcgatctgaaccctgagcagagactacgacaggtccctgttcccgaacccaacacccacaacggcacgtttaccatactgaatttccagggtaactacatcagctacattgacggcaacgtgtggaaggcctactcatggacggagaagctgatcctccgggagaacaatttaacggaattacacaaggactctttcgaagggttgttatcgcttcagtatctggacctatcttgcaacaagattcagagcatcgaacggcacacatttgagcctctgcctttcttgaagttcatcaatctttcatgcaatgtgattacagaattgagcttcggtacttttcaagcttggcacggaatgcagttcctgcataaactgattctcaatcacaaccctttgaccaccgtagaagacccctacctttttaagttaccagcactcaaatacctggatatggggacaactctcgtgcctttgaccaccctcaagaatatcctgatgatgaccgttgagcttgaaaagcttatactgccttctcacatggcctgctgtctgtgccagttcaaaaacagcattgaagccgtgtgcaagactgtaaaactgcattgtaactcagcatgcctgaccaatactacacactgtccagaagaagcctccgttgggaatccagaaggcgctttcatgaaagtcttgcaagccagaaagaactacacctccacagaactcatcgtggagccagaggaaccttccgattcctccggcattaacctgtccggcttcggttcagagcagttggacaccaatgatgaatctgatttcattagtaccctgtcctatatcctgccctactttagtgcagtcaacctagacgtcaagtctcttctgctgcctttcatcaagctgcccaccacaggcaatagcctcgctaaaatccaaacggttgggcagaataggcaacgcgtgaagcgtgttctgatgggacccaggagcatccagaaacgccattttaaggaggtaggcaggcaatcaatcagacgggagcaaggagcccaggctagtgtggagaacgcggcagaggaaaagcggcttggttcgccagctccccgagaagtagagcaaccccatacccagcagggaccagagaagctggccggaaacgccgtatataccaaaccctcctttacccaagagcataaggcggcagtgagcgtgctcaagcccttttcgaaaggggcaccgagcacttccagcccagcaaaagctttgccacaagtcagagatcgctggaaagacctgacacatgcaatctcaattctggagagtgcaaaggctcgtgtgacaaacactaaaactagcaagccgatagttcatgcacggaagaagtatcggttccataagacccggtcacacgtcacacaccgaaccccaaaggtgaaaaaaagtccaaaggttcgcaaaaaaagttatctcagccggctgatgctcgctaatcggctgcccttctccgctgccaagagcctgatcaactccccaagccagggggctttcagtagcctgggagacctcagcccacaagagaacccattcctggaagtatccgctccttcagaacactttatcgagaacaataacactaaacatacaaccgcacgaaacgccttcgaggagaacgacttcatggagaacaccaacatgcctgagggcactataagcgaaaacaccaattataatcacccacatgaggccgattccgccggaacagctttcaatctgggacccactgtgaaacagaccgagactaaatgggaatataataacgtcggcacggatctgtcccccgaacctaagagcttcaactatccgctactgtcgagtcctggcgaccagtttgagattcaattaacccagcagctgcagtcattaatccctaacaataacgtacgtcgattaatcgctcatgtgattaggacacttaagatggactgttcaggcgcacacgtccaagtaacttgtgccaagctcatttcgagaacagggcatcttatgaagctcctttctggacagcaggaggtgaaagcctctaagatcgaatgggataccgaccaatggaagatcgaaaattacattaacgagagtactgaggcccagtccgaacaaaaggaaaaatccctggaactgaaaaaggaagtccccggatacggctacaccgataagcttatcctggcccttatcgtgaccggaatccttactattcttatcattctcttctgtctgattgtgatctgttgtcatcgccgatccctccaggaggacgaggaaggatttagcaggggcattttcagattcctcccatggaggggctgttcctctcgcagagagagccaagacggcctgtcctcttttggacagcccctctggttcaaagatatgtataagccgctgagcgcaactcggattaacaatcatgcatggaaactgcataaaaagagctcaaatgaagacaaaatattgaaccgggacccaggcgattcagaggccccaactgaggaggaggagtccgaggcccttccctag

SEQ ID NO: 57219 - DNA, 1008 bp, Artificial Sequence
  Description of Artificial Sequence: Synthetic coding sequence
atgaccgagaatgtggtctgcaccggcgctgtgaacgccgtaaaggaggtgtgggaaaagagaatcaagaagcttaacgaggacctgaaacgggagaaggaatttcagcacaagctggtccgcatatgggaagagagggtcagcctaaccaaattgagggagaaagtgacacgagaagacggaagagtgatccttaaaattgaaaaagaagagtggaagactcttccaagttccctattaaagctgaatcagctgcaggaatggcagctgcataggactgggttgcttaagatccctgagttcattggtaggtttcaaaacctgattgtgctggatctaagcagaaacacaatatccgagattcctcctggcatagggctgctgacgcgcctccaggaactgattctgagctataataaaatcaaaacagtgccgaaggagctgtcgaattgcgccagcttggaaaagcttgagcttgccgtgaacagagatatttgcgacttgccccaggaactgagtaacctgcttaagctgacccacttagacctgtctatgaatgactttacaacaattccactcgctgtcctgaacatgccggcacttgagtggcttgacatgggttccaataagctggagcagctccctgacactattgaaagaatgcagaatctccataccttgtggcttcagagaaatgagattacttgcttaccacagactattagcaatatgaagaatttagggacgctggtcctcagcaataataaattgcaggatattcctgtgtgcatggaagaaatggctaatctacggtttgttaattttcgcgataatccactgaagctcaaagtgtctttgcctccttctgagggaactgatgaggaagaagagcgggagttgttcgggctacagtttatgcacacgtacattcaggaatccagaagacgcgctgaccaccaggtgaacggctccacgaccttacccattagcatcaacactgatggatag

SEQ ID NO: 57220 - DNA, 1020 bp, Artificial Sequence
  Description of Artificial Sequence: Synthetic coding sequence
atgaccgagaatgtagtatgcaccggagccgttaatgcggtcaaggaggtttgggaaaaacgcataaaaaaactgaacgaggaccttaaacgtgaaaaagagtttcaacacaagctggtcagaatctgggaggaacgggtgtcactcaccaagctgcgcgaaaaggtgacaagggaggatgggagggtgatcctgaaaatagagaaagaggaatggaaaacacttccttcaagcttgctcaagctcaaccaactgcaagagtggcagctgcatcggacaggcctgctaaaaattcccgagtttattggcagatttcagaaccttatagtactcgacctgtcacgtaatacaattagtgaaatccccccagggatcgggcttctgacacgcctgcaggagcttatactgagctacaacaagatcaagactgtacccaaggaactgagtaattgtgcttcgctggaaaagttggaacttgccgtgaacagggacatctgtgacctcccacaggaactctcaaatctgctcaaacttacccaccttgacctatctatgaacgacttcacaacaatccctctggctgtacttaacatgccagcattagaatggctggatatgggcagcaacaagctcgagcagctccctgatacaattgaaaggatgcaaaacctgcacacactgtggttacagcggaatgaaattacgtgcttgcctcagaccatttccaacatgaagaaccttgggacgctcgtactgagtaacaataagttgcaggacattcccgtgtgcatggaggaaatggcaaatttgaggtttgtcaactttcgggacaaccccctgaagcttaaagtgagcttacccccatccgagggtacagatgaagaagaggagagggagttatttggactgcaatttatgcacacttacattcaggaatctcgtaggagagctgcccttcagttttgcgtctgtcatggccagattctgacgatctatacttgcatggccctcgagatttag

SEQ ID NO: 57221 - DNA, 1008 bp, Artificial Sequence
  Description of Artificial Sequence: Synthetic coding sequence
atgactgagaacgtagtctgcacaggcgcagtgaatgccgtcaaagaagtttgggagaaacggattaaaaaactgaacgaggacctgaagcgggagaaggagttccagcataaattagttaggatttgggaagagagagtatccctgaccaagttgagagaaaaagtgacccgtgaggatggccgagtgattcttaaaattgagaaggaggagtggaaaaccctgccctcgtcactgctgaagctgaaccagctgcaggagtggcaattgcatcgaactgggctgctgaagatcccagaatttatcggcaggttccagaacctaatagtactggacctgtccagaaatacaatcagtgaaataccccctggcatcggcctccttactcggctccaggaattaatcctgtcgtataacaaaattaagacagtacccaaagagttgtcaaactgcgcttctcttgagaaattggagctggccgtgaatcgcgacatctgcgacctacctcaggaactgagtaatctgttaaagttgactcatttagacctcagcatgaacgacttcaccaccataccgctagcagtgttgaatatgccagccctcgagtggctagacatgggcagtaacaagctggagcagctccctgacactattgagcggatgcagaatctgcacacattatggttgcagcgcaacgaaatcacttgtctgccgcagaccatcagcaatatgaagaacctaggaacccttgttctctccaataataagttgcaggatattccagtgtgcatggaggagatggcaaaccttcggtttgtcaatttcagggataaccctcttaaactcaaggtgtctcttcccccttctgaaggcacggatgaagaagaagagagggaactgtttggcctgcagtttatgcacacatacatccaggagtctaggcggagggccgaccaccaagtgaacggatcgaccacattgcctatcagtatcaacactgatggctag

SEQ ID NO: 57222 - DNA, 1020 bp, Artificial Sequence
  Description of Artificial Sequence: Synthetic coding sequence
atgacagagaacgttgtttgcacaggcgcagtgaacgccgtgaaggaagtttgggagaagcgcatcaagaagcttaacgaagacctcaaacgagagaaagaatttcagcacaagctcgttaggatttgggaagaacgcgtttccctcacaaagttgagggaaaaagtaacccgtgaggacggccgagtcattctcaagatcgagaaggaggagtggaagaccctcccttctagcttgcttaagttgaaccagctgcaggagtggcagctgcaccgtacaggcctgctgaagatccctgagtttattgggaggtttcaaaacctcatcgttctagatctgagtcgaaataccatctcagagatccccccaggtatcggcctcctgacaagactacaagagctcatactgtcttataacaagatcaagaccgtcccgaaagagctgagcaactgcgcctcactagaaaaactggagttggctgtaaatcgagacatatgcgaccttccccaagagcttagcaacctgctgaagctgacgcacctagacctgagtatgaatgacttcaccaccatcccactggcagtgctgaacatgcctgcgttggagtggttggacatggggtctaataaactggagcagctgcctgacacaatcgaaagaatgcagaaccttcatacgttatggttgcaacgtaatgaaattacatgcttgccccagaccatcagtaacatgaaaaatctcggtaccctggttttgtccaacaacaagttacaggacattcctgtgtgcatggaggaaatggccaatctgagatttgtgaattttagagataatcctcttaaattaaaggtgagcctgcccccatctgagggaaccgacgaggaagaggagcgtgaattattcggactgcagttcatgcatacctacattcaagagtctcgccgaagagccgctttacagttttgtgtgtgccatggccaaatcctcactatatatacctgtatggccttggagatctag

SEQ ID NO: 57223 - DNA, 1809 bp, Artificial Sequence
  Description of Artificial Sequence: Synthetic coding sequence
atgtctcgcctaaaacggatcgcaggccaggacttgcgtgcgggtttcaaagccggagggagagactgtggcacctctgtgccccagggcctattaaaggcagctcgtaagtctggccaactgaatctgtcaggcagaaatctgagtgaggtcccccaatgcgtatggagaatcaatgttgacatcccagaagaagctaaccagaacctgagcttcggggcaactgaacggtggtgggaacaaactgacctgacaaagctgatcatttctaacaacaagctgcagagcctcaccgatgatctcagactcttaccggctctgacagttctagatattcatgacaaccagttgacttcacttccttccgccatccgggagctggaaaatctgcaaaaactgaatgtctctcataataaactcaagattttgcctgaagagataaccaatctgagaaaccttaagtgcctttacctccagcacaacgagttgacatgcatcagcgagggctttgagcagctcagtaatctggaggatttggacctgtccaacaatcacctcactactgtgccagcctcgttctcaagcttgagctctttagtgcggctaaatctgtcttctaacgagctgaagtctctcccggctgagatcaatagaatgaagcggctaaaacacctggactgcaactccaatctgttggagacgatccctcccgagctggctggcatggaaagcctagaactgctctatctgcgcaggaacaagctgagattcctgccagagttccccagctgttctcttctaaaggagttacacgtgggtgaaaatcagatcgagatgttagaggcggaacacttgaagcatctcaacagtattttagtgctcgatctgcgagacaacaagctgaaatcagtgccagacgagatcatccttctccgctcactggaacggctggacttaagcaataatgacattagttccttgccatacagcttaggcaatttgcacctgaaattcttggctctcgaaggtaacccactccgcacaatcagaagggaaattatctctaaaggaactcaggaagtgcttaagtatctcagatctaagatcaaagacgatggccctagtcagagcgagtctgccaccgagaccgcaatgaccctcccgtccgagagtcgcgttaacatccacgcaattatcaccctcaaaattttggattacagcgataagcaagctacccttattccagatgaagtatttgacgcagtaaagtctaatattgtgacttcaatcaatttctctaagaatcagctgtgcgaaatccccaagaggatggtagagttgaaagaaatggtatcagatgtggacctcagcttcaacaagctgtcttttatctcactagagttgtgtgtgctgcagaagttaacatttctcgacttgcgcaataatttcttgaatagcctccccgaggaaatggaatctttagtgagactgcagactatcaacctgagtttcaatcggttcaagatgctgcccgaggtgttataccgcatcttcacactggagaccatcctgattagcaacaaccaggtgggcagcgtggacccacaaaagatgaagatgatggaaaacctaacgacactggatctgcaaaacaatgacctcctgcagatacctccagaactaggaaattgtgtgaacctgcggaccctcctcctagacgggaatcccttccgcgttccccgtgctgccatcttgatgaaaggcacagccgctatactggaatacctgcgagataggatccccacatag

SEQ ID NO: 57224 - DNA, 651 bp, Artificial Sequence
  Description of Artificial Sequence: Synthetic coding sequence
atgcttcagggggcaactgaactcgtagcagaaccgaatcgtcgagtgctcgagactttggccagctcactgcacaccctgaaatttcgacacctgctgttctccgatgtggctgcacaacagtcattgaggcagctgctgcatcagctgatacaccatggcgcagtgagtcaggtcagcttatactcatggcctgtgcctgagtccgccctgtttatccttatcctgacaatgagcgccggtttttggcagcccggacctgggggtcccccatgtcgtttatgcggagaggctagtaggggtcgagctccttccagagacgagggttccttgctgctgggttcgcggcgaccgaggcgggacgccgcagaaagatgtgccgcagccctgatggccagcaggagaaagtccgaggccaaacaaatgccccgagcagcaccggcaaccagggtgactcggcgttctacacaggagagtttaaccgcaggcggaacggatcttaaacgtgagttgcatccccaaccccctccaatgcgattactggctccttccggccacctgttgttgcagcagcctcctccacttcctctcctactccacccccacacaaacggccaccagcttgcccagccacattccctgtccccatag

SEQ ID NO: 57225 - DNA, 2439 bp, Artificial Sequence
  Description of Artificial Sequence: Synthetic coding sequence
atggcggctcccgaagcctggcgggctcggagctgttggttttgcgaagtagccgcagcaacgacaatggaggcgaccagccgcgaagccgcacccgctaagtcaagcgcttctggaccaaatgcgcctcctgcactgtttgaattgtgtggcagggcggtttctgcgcacatgggggtgcttgagagcggtgtgtgggccctgcctgggcctattctacagtcaattttgcctctgctgaatatttattatctggagcggatagaagagacagcgctgaagaaaggacttagcacgcaggctatttggcggcgactgtgggacgagttgatgaaaacacgtccctcgtctctggagagcgttacttgctggcgcgctaaatttatggaggcctttttctcacatgttctgagggggactatcgacgtatctagtgaccgcaggctctgcgatcagaggttcagccctctcctgcacagctctcgtcacgtgcggcagcttaccatctgtaatatgctgcagggcgctactgaacttgtggccgagcccaatcgcagagtgctcgaaacgctggcgagtagtctccacacactgaagttccgccacctactgttcagcgacgttgctgctcagcagtccctgcgccaattacttcaccagctcatccaccacggtgctgtgtcccaggtcagcctgtactcatggcccgtgccagaaagcgcacttttcatactgatactgacaatgtccgcgggtttctggcagcccggacccggaggtcccccttgtcgactgtgtggcgaggccagtagaggacgggcaccaagccgcgacgaaggatccctcctactcggaagcaggcggccacgacgggacgccgcagagaggtgtgccgctgccctgatggcttccaggaggaagtcggaggcaaagcagatgccacgggcagcacccgctacacgggtcacaaggcggagcacccaggagtcactgaccgccggtggaactgatctaaaacgcgagcttcaccctcccgctacaagtcatgaagctccaggaaccaagcgcagcccatctgcgccagctgccacgtcatctgcgtcgagcagcacgtcctcctacaaaagagctcctgcttctagcgctccacagccgaagcctctgaaaaggttcaagcgtgccgcaggcaagaagggggcacgcacccgccagggacccggtgcagagtcagaggacttgtacgattttgtgttcattgtggccggtgaaaaggaagacggagaggagatggaaattggagaggttgcatgcggggctcttgatgggagtgacccctcctgcctggggcttcctgcccttgaggcaagccagcgatttcgcagtatctctacgctggagctctttacggtgccactcagtactgaggcagctctgactctgtgccacttgctttcaagctgggtgtctctcgagtcacttactcttagttataatggtctggggagcaatatattccggcttctggattcattgagggccctttctgggcaagctgggtgccgtctccgcgcactccatctaagcgatctgttcagcccgcttcctatcctggagctgacacgggcaatagtgcgcgcactgcccctcctaagggtgctttcaatacgtgtcgaccacccatcccagcgtgacaatccaggagtgcccggaaacgcagggcctccctcccatattattggcgacgaagagattcccgaaaactgcctggaacagttagaaatgggattccccagaggagctcagccagctcctctgttatgctccgtcctgaaagcttccgggtccttgcaacagctcagtctggactctgctaccttcgcgagtcctcaggattttggccttgtacttcaaaccttgaaagagtataacctagcactgaagcgtctgtcctttcacgatatgaacctcgctgactgtcagagcgaagtcttgttcctcctccagaatctgacgctgcaagagatcactttcagcttttgccgtttgttcgaaaaaagacccgctcagttcctccccgagatggtggccgctatgaagggaaacagtactctcaaaggccttcgtctcccagggaataggctcggtaatgctggcctgcttgccctggcggacgtcttcagcgaggacagtagcagctcactttgccagcttgatatctcaagtaattgtataaaacctgacggtctcctggaatttgccaagaggctggaaagatgggggagaggggcatttggccatctccggctgttccagaactggttggaccaggatgcagtgaccgcgagagaagccattaggcggctaagagcaacctgccatgtcgtgtccgattcttgggacagctctcaggcctttgctgattacgtgtctaccatgtag

SEQ ID NO: 57226 - DNA, 2088 bp, Artificial Sequence
  Description of Artificial Sequence: Synthetic coding sequence
atggaagccacctctagagaagccgcaccagccaaatcctccgcctccggcccaaacgccccaccagcccttttcgagttgtgtgggcgtgcagtatctgcacacatgggcgtgttggaatccggtgtttgggccctccccggtcctattctccagtcaattttacctctccttaacatctattatttggaacgaattgaggaaaccgccctaaagaagggactgagtacacaggccatatggcgtagactatgggacgaacttatgaagaccaggccgagttctctcgaatcagtcacctgttggcgtgcgaagttcatggaggcgtttttttcccacgtgctaagaggcacaattgacgttagctctgatcggagactgtgcgaccagcgattttcgccactgctgcatagcagcaggcacgtacggcagctgactatctgtaacatgctgcagggagctacagaactggttgccgagcctaatcgtcgagtgttggaaactttggccagctccttgcacacactaaagtttcgccaccttctcttttcagacgtcgccgcacagcagtccctgcgccagctgctccatcagcttatccaccatggcgcagtctcacaagtttcgctatattcctggcctgtgccagaatctgccctttttatactgatcctaaccatgagcgccggattctggcaaccaggcccagggggacctccttgtaggttgtgtggcgaagccagtcgagggcgtgccccaagcagggacgagggttcattattgctagggtcgagaagaccaaggcgcgacgccgctgaaaggtgtgctgccgctctcatggcttctagaaggaaatccgaagctaagcagatgcctagggccgctcccgcaactcgtgtgacgaggaggtcaactcaggagagcctcaccgccggagggactgacttgaagcgtgagctgcatccaccggcaacctcacatgaagctcctggaacaaagcggagccccagcgccccagctgccaccagttcggcttctagctcaacatcctcttacaagcgcgctcccgctagctccgcaccgcagcccaagccactaaaacggttcaagcgggcagctggcaaaaaaggggctagaactaggcaggggcctggcgctgagtctgaggatctgtacgattttgttttcatcgtggctggcgagaaggaggatggtgaggagatggagattggagaagttgcatgtggggcactggatggtagcgatccatcctgcttgggcctgcccgctctggaggcttctcaacgctttcggagcatctcaacacttgagttgttcactgttccgttaagtactgaagctgctttaaccctgtgccacctgctcagttcttgggtttctctagaaagtctgaccttgagttataatggactgggctctaacattttccggctcttggattctctgcgagctctctcaggtcaggcaggttgtcggttgcgggcactccatctgtcagacctcttcagccccttgcccattctggagctgacccgggctatcgtgcgcgctttacccctgctgagggtcttaagtatccgggtcgaccaccccagtcaaagacactcatgggggatgctggcttgctggccatggcagatgttctcccagcggattcacccaccactttctgtgtcttggaccagtgtgcctaccgcgtcaagtcagatgggcttttggtccagtccaagcgggtggtccgccggagctgtggaacctctggtgacctgcgccagctctaagactgggtggacaaggatgcaaagccagcccggaaaacctagcggtgggtccggactaccagccatgtggcttgcaacccatggcactcatcccagaccaagccaaatcatgcttgcaccatgtgatggagcacgcacctcccaaagccatgcacgctatcatcagctcgccggagccgaggcctgggccgctcagaatccaaaccatcagttctatttgtcacttagcgttactttcttcctcttctttccctcatctctggccctgaggtcatggaggccctag

SEQ ID NO: 57227 - DNA, 1287 bp, Artificial Sequence
  Description of Artificial Sequence: Synthetic coding sequence
atgagctactacctaagctctgagaaccatctggatcccggaccgatctatatgcgagaaaacggccagctccacatggtcaatttggctttagatggtgtccggagctcactgcagaagcctcgacccttccgtctcttcccaaagggattttctgtcgagctctgcatgaaccgcgaagacgacacagcgaggaaggagaaaaccgaccatttcatcttcacttataccagagagggaaatctcaggtacagtgccaagtccctgttctctcttgtcctgggctttattagcgataatgtggatcacatcgactccctgattggctttcccgagcagattgccgaaaagctcttctctgctgcagaggctaggcaaaaattcactgagcctggcgcagggctcagggcgttgcagaagttcaccgaggcttatgggtctctcgtgttgtgttccctctgtctgcgcaaccgctacctagttatttccgagaagctggaagaaatcaagtcctttcgtgaactgacctgcttggacctgagctgctgcaaactgggcgacgaacacgagctccttgagcatttaacgaacgaggccttgtcaagcgtgactcaactccacctgaaggacaactgcctatccgatgcaggtgtgagaaagatgaccgccccagttcgagtaatgaagcggggattggagaacctcacattgctggacttgagttgtaaccccgagattaccgacgccggaatcggttaccttttctcttttagaaagcttaactgcttggacatatccggaactgggttaaaagatatcaagaccgtcaaacataagttgcagacccacatcgggttggtccattcaaaagtacccctgaaggaatttgaccactccaattgcaagacagagggctgggctgaccagatcgtgctgcagtgggaacgggtgacggccgaggcagtcaagcccagggagacctctgagccccgagccgcagcgcagcgcttctacggaaagaggtcccgggctgaagcacccctgaaatgcccactagcggatacccacatgaactccagcgaaaagctacagttttataaggagaaggccccagattgccatggaccggtcttaaaacatgaggcaatttcctcccaggagtctaaaaagtccaaaaagcgtccctttgaagagagcgagactgagcagaacaatagctctcaacctagtaagcagaaatacgtgtgtctagctgtggaagactgggacctcctgaattcatactag

SEQ ID NO: 57228 - DNA, 579 bp, Artificial Sequence
  Description of Artificial Sequence: Synthetic coding sequence
atgtcgtattacctatctagcgagaaccacttggatcctggacccatttacatgagggaaaatggccagctgcatatggtaaatctcgctttagatggtgtgaggagcagcctgcagaagccacgtccattcagactgtttcccaaaggattctccgtggagctctgcatgaatcgggaagacgatacggccagaaaagagaagactgatcactttatttttacatacactcgcgaggggaacctgagatactcagctaagtctctcttctctctggtgctgggattcattagcgacaatgtggaccatattgacagcctcattgggttcccagaacagattgccgagaagctcttcagtgctgccgaggctcggcagaaattcactgaaccaggcgcaggactccgggcactgcaaaaattcacagaagcttacggctccttagttctttgctccttgtgcctgaggaaccgctatctcgtgatctcagagaagcttgaggaaataaaatctttcagggagctgacctgtctggatctgagctgttgtaagctaggagacgaacacgaactgttatag

SEQ ID NO: 57229 - DNA, 1287 bp, Artificial Sequence
  Description of Artificial Sequence: Synthetic coding sequence
atgtcttattacctgtccagcgaaaatcacctggatcccggtccgatctatatgcgcgaaaatggacagctgcacatggtcaaccttgctctggacggcgtgaggtcatcactccagaagccacggccttttaggctattcccaaagggcttctccgttgaactgtgcatgaacagggaggacgacaccgcccgtaaagaaaaaaccgatcacttcatcttcacatataccagggagggaaatttgcgttatagtgctaagtcactattcagcctcgtgctcggatttattagcgataatgttgaccacattgacagcttgataggctttccagaacagatcgctgaaaaattgttttcggccgctgaagctcgacaaaagtttaccgagcctggcgctgggctccgcgctctgcagaagtttaccgaggcctatgggtccctcgtgctctgcagcctctgcctgcgcaatagatacttggtgatctcagaaaaactggaagaaattaagtcctttcgcgaactcacttgccttgacctctcctgctgtaaacttggagatgaacacgagctcctagaacacctcaccaatgaagctctgagttccgtcactcagttgcacctcaaggataactgcctctccgatgcgggtgtgcgtaaaatgacggcgccagtcagggtcatgaaacggggtctcgagaacctgacgctcctggatctctcatgcaaccccgagattactgatgcagggattggttatctgttttctttcaggaagttaaattgtcttgatatctccggcacaggcctgaaagatattaagacagtgaagcataagctacagactcatattggactggtacattcaaaggtccccctgaaagagttcgaccacagtaattgtaaaacagaaggatgggcggaccagatcgtgctccaatgggaacgggtgaccgccgaagcggttaaacctagggaaacttccgagcctagggcggctgctcaaaggttttatggaaagcgttccagggcagaagcccctctgaaatgccccctggccgacacacacatgaacagctctgagaagcttcagttctataaagaaaaagcaccggactgccacggccctgttcttaagcacgaagctattagctcgcaggagtctaagaaatcaaagaaacgaccgttcgaagagtctgagactgaacaaaacaattcatcacagccctccaaacaaaagtacgtgtgtttagcggtggaggactgggatctgctgaactcgtactag

SEQ ID NO: 57230 - DNA, 720 bp, Artificial Sequence
  Description of Artificial Sequence: Synthetic coding sequence
atgagctattacctgtccagcgagaaccacctcgacccgggacccatctacatgcgagagaacggtcagttacatatggtaaacttagccttagatggagtccgctccagtcttcaaaaacctagaccctttaggctgtttccgaagggattttctgtggagttgtgcatgaaccgggaggatgataccgcccgaaaggagaagaccgaccattttatatttacatacacacgcgagggcaatttacggtatagcgcaaagtccctcttctccctggtgctgggttttataagcgataatgtagatcatattgattccctaatcgggttcccagaacaaattgccgaaaaattattctcggctgcggaagccaggcagaagtttaccgagcctggagcagggttacgggcactgcagaaattcacagaagcctacggttcgctcgtgctgtgctccctgtgcttgcgtaataggtacctggtaatcagcgagaaattagaggagatcaagtccttccgcgaacttacatgtctcgaccttagctgctgcaagctgggggacgagcatgagttactggaacatcttaccaacgaggccctgtcaagtgtgacacagttgcacctcaaagacaactgtctctccgacgctggagtgcgaaagatgaccgctccggtgagagtgatgaaacggggtctggagaatctcacattgctcgattag

SEQ ID NO: 57231 - DNA, 1584 bp, Artificial Sequence
  Description of Artificial Sequence: Synthetic coding sequence
atggagtgtctgtgtgctcacccaccagccggtttgcagcatctgggactcggccacaacaagctactgggaccactggaatcactgtatgtgacagcgaaccactggggccgtgtgcggctagggcttggtgacgcagtgttaacagcagccgcttgtgttttcctgctgttctcggagccacggtcaatctgctttttggtatgtggctccagactccttgccccatgttcgcccggattcctgactcccagaagaagttgctcacctagcagaccaaatcttgtgtctctagatttgggcttcaatgatctcacggatttacaatctatggtgaccagcctcaggaccctccgtcacttaaggctgctggtgttacaagggaaccctctggcgctggttccttactataggggtctgaccatcgattccctggcacaactgtgcgttctagacgacattactgtgtcacccaatgagaaacatctgtttagaggcctctctcttaatggtgatctcctcgcccaggaggcccagttcgtcgtgaccatcggcaacatacgcggagtgctggacaccagcgtactggaccccgagcctcgtccagaaggcccttttattacctacaattactatgtcacttatgattttgtaaaggacgaagaaggggaaatgaatgagagtgctggcgttttggctgaaattgtcaagccatctcctagcctggaactgcttgttgaagagagcccagaggaagtagtggaagatgtaattgaagacatcgttgaggaggtgacagaagaagttgaaggttccctcgagtcagaagtggaggaaagcggggagagtgaactctcagttatctccggtccatcaaccattctgcaaatgcccagagcaagtgctgaggaattggcaaaactgagacttcgaattgatcctcggctctgtccctctcccggaaccgtgctgtttagcactgctcacaagccttgggcagaagttatcccgtgttcatacgaaatgcagcattcactcagagacctagttcccctgaaagcctttctgctggcagggaccaccgtgaccatcgtggaagaaaagattctgtcttggcccgtcgtattgcctgcagtggactccccactgtcagctaagaaggggaaaggcgagaaagacaagaagggcaaagagaaagaccgcactggtaagggggagaaggagccagccaaagaatggaaggtgctgaaaaagaagaaggaacctccgaaggagttgcggcaggatcctcccattttacaggtgcttggtcgcggtttggtgattttggaaccgctcctggccggagaaccattggtctccactgtatgcaatttcggggtcgtgcggacactcacatcagaccgactgactctcgcacgagattcaaagaagattaaaaaggtggccaaaaaagaaaaaccaaaggcggtgatcccgatctacgagggggactaccacccagagccgctcacggtggaggtgcagatccagcttaatcagtgtcgcagcgcagaggaagctctgagaatgttcgccgtgtag

SEQ ID NO: 57232 - DNA, 1971 bp, Artificial Sequence
  Description of Artificial Sequence: Synthetic coding sequence
atggaggcctcctatgagagcgagtcagagagcgagtcagaggctggaccgggaactcagcgccctggcacaggtactgtaagtgccgcagtaagggagcacctgagaaaattgtgtcttagagagtttccgtgcggagcgggttcttggaataaaagcaggttcttacctcagacctggaggacttggcgcgaactggtgccgagggaggaagacgtggtgagtcccggagaagagacagtagaggcgctgctgggcctggtcaggtcacggcactctccttgggctcttctgaacaactcaaatgccgaggactccttcctgcgtgagctggctattcggaacccccttaccattacagatacatttttctatagctattttcggtcactgcgggtcattgacaagaaagtcacattggtggacaaggacctgctgaaatttctaaagttggaagaactggtgctcagtgcgaatagaataaaggaggtcgacgctacaaaccttccacctaccttaaaagtgcttgagctttacgggaacgaaatctccagtatggagtgtctttgcgctcacccccctgcagggcttcagcacctggggttgggccataataagttgcttgggccactggaatctctctatgtcacagcaaaccattggccgaatttggtgagtctggacctgggcttcaatgatcttacagatctgcagtctatggttacatctctcaggacgctgaggcatttaaggttactggtgctgcagggcaatccgctggctctcgtcccttattatcgaggattgaccatagatagccttgcccagctttgcgtgcttgatgacataacggtgtcgccaaatgaaaagcacttgttcaggggcctctcactgaatggtgatctgcttgcgcaggaggcacagttcgttgttacgattggtaatattaggggtgtcctggatacaagtgtgttagacccggagcctcgcccagaaggaccgttcatcacatataattactatgtgacgtacgattttgttaaggatgaggaaggggagatgaatgaatcagcaggagtacttgctgagatcgtcaaaccctccccttccctggaactactggttgaagaaagtcctgaagaggtcgttgaagatgtcattgaggacatagtggaggaggtgacagaagaggtggaaggaagcttggagagcgaggtggaggagagtggagaatcagagctgtctgtcatctctgggcctagcaccattctacagatgcccagggcaagtgcagaagaattagccaagcttagactgagaatcgaccccagactgtgcccgagcccaggtaccgtgctgttctcaacagcccacaagccgtgggccgaggtcatcccttgcagctatgagatgcaacatagtctacgggatttagtgccattgaaagcattcttgctggccggaaccactgtgaccattgtagaggaaaagattctgagctggccggttgtgcttcctgcagtggatagcccactaagtgccaagaagggaaaaggagaaaaggacaaaaagggcaaggagaaggaccgaactgggaagggggagaaggaacctgctaaggagtggaaggtactgaaaaagaagaaggaaccacctaaggaactgaggcaggacccaccaatactgcaagttctgggacggggactggtgatcttggaacctctcctagctggggagcccctggtctccaccgtgtgcaatttcggggtagtcagaaccctgacttctgaccggctgaccctggcacgggactctaaaaaaattaaaaaggtggcaaaaaaagagaagcctaaggctgtgattccaatctacgagggggactaccaccccgagcccttaacagtggaggtacagattcaactcaaccaatgcagatccgccgaagaggccctacgcatgtttgccgtgtag

SEQ ID NO: 57233 - DNA, 1416 bp, Artificial Sequence
  Description of Artificial Sequence: Synthetic coding sequence
atggagtgtctgtgcgcacatccccctgccggattgcaacacctgggtctcggacataataagttactgggaccccttgagtccctatacgtgacagctaatcactggcccaacttggtgagtctagacctgggtttcaacgatctgactgacctacagagtatggtcactagccttcggactctacgacacctgcgactgttagtgctgcaaggcaacccacttgctcttgttccatattatagggggttgaccattgattctttggcgcagctctgtgtcctcgacgatattacggtctctcccaatgagaagcacctattcagagggctgtcacttaacggggacctgttggcccaggaagctcagtttgtagtgaccatcggaaatattagaggcgtccttgatacgtcagtgcttgacccagaaccacgcccagagggacccttcattacttataactattatgtgacttacgactttgtaaaagacgaagagggcgaaatgaacgagagtgccggagtgctggccgagattgtcaagccttcaccctcccttgagctgctcgtcgaggagagtcccgaggaagtggtagaggacgtcatcgaggacatagtggaagaagttacggaggaagtggagggttctctcgaaagtgaggttgaagaaagtggcgagagcgaactgtcagtcatctctggcccatccactattttgcaaatgcctcgcgcttccgctgaggagctagctaagctgcggctccggattgaccctcgtttgtgcccaagtccagggacggtcctgttttctaccgcacacaaaccttgggctgaagtcatcccatgcagctacgagatgcagcatagcctccgcgatctcgtgccgctaaaggcatttcttctcgctgggaccacggtgacaatcgtagaggaaaaaatcttgtcctggcccgtggtcctgcccgcagttgatagtcccctgtctgctaagaagggtaaaggagaaaaagacaaaaaaggcaaggagaaggacagaaccggcaagggggagaaggagcccgcaaaggagtggaaggtgcttaaaaagaaaaaagagcccccaaaggagcttcgccaggatcccccaattctgcaggtactcggacggggactggtcattctggagccattgctggcgggagagcctttggtgtcaactgtttgtaacttcggcgtggttcggaccctcacctctgatcgcctgacactggcgagagattccaagaaaatcaaaaaggtcgcgaagaaagaaaagcccaaagctgttatcccgatttatgaaggagattaccatccggagccgctcaccgtggaggtccaaattcagttaaatcagtgccggagcgcggaagaagcattgcggatgttcgcagtatag

SEQ ID NO: 57234 - DNA, 966 bp, Artificial Sequence
  Description of Artificial Sequence: Synthetic coding sequence
atgtctggcggaaagtctgcacagggccctgaggaaggtggagtatgtataacggaggccctgatcaccaaaagaaatctcaccttcccagaggacggagagctgtccgaaaaaatgttccataccttggacgaacttcagaccgtgaggctcgatcgagaaggtattacaaccatccggaacctggagggcctgcagaaccttcattccctttatctgcagggaaacaagatacagcagatcgaaaatttggcatgtattcctagtctccggttcctgtcgctagccggtaaccagatcaggcaagtggaaaacctccttgacctgccctgcctgcagtttctcgacctatcagaaaatctgattgagactttgaagctagatgagttccctcagagcttactgattcttaacctcagcggcaattcttgtaccaatcaagatggataccgtgagctggtgaccgaggctctccctctgctcctcgacctcgacgggcaacctgtcgtcgagcgttggatctcagacgaggaagacgaggcatcatctgacgaggagtttcccgagctgagcggccctttttgctcagagcgcggattcctaaaggagctagagcaggaactatcccgacatcgcgaacaccggcagcaaactgctctcacagagcatttattaagaatggagatgcaacctacacttacagatctcccactattgccaggcgtcccaatggctggagatagcagcccgagcgccactcccgcacagggggaggaaacagtccctgaggccgttagctcgccacaggctagctccccaacgaaaaagccatgcagtctgatcccccgaggacatcagtccagcttttggggtcgcaagggcgcacgtgctgccacagccccaaaagcctccgtggctgaggccccaagcaccaccaaaaccacagcaaagagatctaaaaaatag

SEQ ID NO: 57235 - DNA, 1752 bp, Artificial Sequence
  Description of Artificial Sequence: Synthetic coding sequence
atggcggcagccgcagtttctgaaagttggccggagctggaacttgcggaaagagaaaggagaagagagctccttttgactggcccaggtctggaagaacgggtccgtgcagctggtggccagctgcctcccagactgtttactctgccccttctgcactacttggaggtctctgggtgcgggagccttcgggcacctggccctggccttgctcagggcctgcctcagttgcactcattggttctacgacggaatgccctgggtccaggactctcccccgaattgggcccacttccagccctcagggttcttgacctatcaggaaacgcattagaggcactacccccaggccagggcctcggccctgcagaacccccaggtctgccccagttacaaagcttgaacctttcgggaaatcgtctccgcgagcttcccgcagacttggcacgttgtgcacccaggctccagtccctaaatctgactggaaattgcttggacagcttccctgctgagctgttccgccctggagctttaccgttgctgtcagagctagccgctgcggacaattgtttgagggagctgtcacctgacatcgcccacctggcaagcttaaaaaccctagacctctccaacaaccagcttagcgagatcccagccgaattagccgactgtccaaagcttaaagagatcaacttccgcggtaataagcttcgagacaagagattggagaaaatggttagtggctgccaaacacggtctattctggaatacttaagggtaggcggaagaggcggagggaaaggaaaaggccgagcagagggctccgagaaagaagaaagccgcagaaagcgccgagagagaaagcagcgaagggaaggtggggacggtgaagaacaagatgtgggagatgccggaagactgttactccgagtgctgcatgtctccgagaatcctgtccctctgaccgtacgcgtgtctcccgaggtgcgcgacgtcaggccatacatagtgggggcagtggtacggggaatggaccttcagcccggtaacgcgcttaagagatttctgacttcacagacgaagctccatgaagacctctgtgagaagaggaccgcagccaccctcgccacacacgaactgcgggctgtgaaaggtccactactgtattgtgccaggcccccacaggatctgaagatagtacctctgggacggaaagaggctaaagctaaggagctcgtgaggcagctccagctcgaagccgaggagcaaagaaagcagaagaaacggcagtctgtgtccgggttgcaccggtacctccacctgttggatggcaacgagaactacccttgtcttgtggatgctgacggggacgtgatcagcttcccgccaattacaaattcagagaaaacaaaagtgaagaagacaacaagcgatttattcctagaagtgacaagcgcaacaagtctgcaaatctgcaaggacgttatggacgcactcattttgaaaatggcggagatgaagaagtataccttagaaaataaggaggagggctcactgtctgataccgaggcggacgccgtgtcaggacagctgcctgaccccacgactaatccatcagcaggcaaagatggtccctctctgttggtagtggagcaggtacgcgtcgttgatctagagggttctcttaaggtcgtctatcctagcaaggccgatctggccacagcacccccacacgtgaccgtcgtccgctag

SEQ ID NO: 57236 - DNA, 1515 bp, Artificial Sequence
  Description of Artificial Sequence: Synthetic coding sequence
atgctgcgtctcgttgctgcgtgcccagaaagttgcgtggtgtgtaccaaggatgtgactctctgccatcagctcacctacatcgttgcggcacctatgacaacacgagtccttatcatcaccgacggatacttgagttccatagaatcaaccaaccttagcctcttatttaatctggccctgctgtctttgtcccggaacggaatcgaagatgtgcaggaagacgcgctgcacggcctgaccatgctgaggacgctgctgctcgaacacaatcagatatcctcaagttctctgacagatcatacattctccaaactgcattccctgcaagttctcgttctctccaataacgccctcaggactctgcgaggctcctggtttaggaatactagcggcttgacaagacttcagctggacgggaaccagattaccaacctaacagacagctcttttgggggtaccaacctgcattccttgaggtatctcgatttgagcaataacttcatttcttacataggcaaggacgctttccgcccactgccgcagcttcaggaggtggaccttagtcggaaccggcttgctcacatgccggatgtgttcacacctctgaagcagttgattttgctatctctggacaaaaaccagtggagctgtacatgcgacctccacccgttagcaagatttctgaggaattacattaaatcgagcgcacataccctacgaaatgccaaagatctgaattgtcagccaagcaccgctgccgtggccgctgcacaatcagttctgaggctcagtgaaaccaactgcgattccaaggccccaaatttcacactcgtgctcaaggatcgtagtccactcctgcctgggccagatgtcgcgctgctgaccgtgttgggcttcgccggtgccgttggcctaacatgtttgggacttgttgtctttaactggaagctccaccagggtaaagcaaatgagcataccagtgagaatctttgctgccgcactttcgacgagcctctgtgtgcccacgaagctcgtaactaccacactaagggatactgtaattgccacctgactcaggaaaatgaaatcaaggtgatgtccaccgttgggtctcgaaaggaaatgccactccttcaggaaaactcgcaccaagccacttctgccagtgagtccgcgaccctggatgggtccttcagaaacctgaaaaagaaggatcgcggagttggctcaactctattctgtcaagatggcaggctcttgcactcagaatgtagtgagcctcccggtaacatgcgtgcatttaacgaggcaggactgcttacaacttacaacccaaggaaagtgcagaaactttggaatctcgagcccggtgaagtacagcctcaaacactccagcaccacattattcgcacggaagacatcagcagcgacatttttcgacgtcgctacgcgactccagcctctgcacttgcaggagagagcctcgaaaagagacttacaaatgaatcatag

SEQ ID NO: 57237 - DNA, 1533 bp, Artificial Sequence
  Description of Artificial Sequence: Synthetic coding sequence
atgctcaggctggtcgctgcgtgccctgagagctgtgttgtgtgtacaaaggatgtcactctctgccatcagctgacttacatcgttgcagccccaatgacaaccagggtgctgatcataaccgatggctatctctctagcatagaatccaccaaccttagtttactgttcaatctggcactgctcagcttgtccaggaacgggatcgaggacgtacaagaagacgctttacatggactgactatgttgcgtacactgctgctcgagcataaccaaatttcctcatcttcactgaccgatcacacctttagtaagctgcactcgcttcaggtcctggtcctttcaaacaatgctctacggacactgagaggatcatggttccgcaacacttccgggctcacccggctacagttggacggtaatcagatcacaaacttgactgactctagttttgggggaaccaatctgcattctctaagatatttggacttatccaacaactttatctcctatatcggcaaggatgccttccgtcccctcccacagctgcaggaggtggatctttctcgcaatcggctggcccacatgcccgatgtgtttactccactcaagcagttaatcctgctgagcttggacaagaatcaatggtcatgtacttgcgacctgcatcctctggccaggttcctgcgaaactacatcaaaagttcagctcacaccctgcggaacgccaaggacctcaattgtcagccttctacggctgctgtagcagccgcacaatccgtgttacgactgtcagaaacgaactgcgacagtaaggcccctaatttcaccttagttctaaaggaccggtcacctctgttgcctggacccgatgttgctctgttgactgtgctcgggttcgcaggtgcggtgggactgacatgtctgggcctggtcgtgtttaactggaaactgcaccagggaaaggccaatgaacacactagtgaaaacctctgttgtcgaacattcgacgaacccctctgcgctcatgaggctcggaattatcacacaaagggctactgcaactgccatcttacccaagagaatgagatcaaagtgatgagtaccgtcggaagtcggaaggagatgccccttctgcaggaaaatagccatcaggcgacttctgcctctgagtccgcaacacttgatgggagcttcagaaaccttaaaaagaaagaccgcggtgtgggtagtacacttttctgccaggacgggaggctgctacacagtgagtgtagcgaacccccaggcaatatgcgcgcttttaatgaggccggacttctaacaacttataatccccgaaaggtgcaaaaactctggaatctggaacctggtgaggtccagcctcaaactctccaacaccacatcatcaggactgaagatatctccagcgatatattcagaagaaggtatgccactcccgcaagcgccttggccggagaatctctcgagaaaagattaacaaatgagtcttggcagccacctatcgagtag

SEQ ID NO: 57238 - DNA, 1629 bp, Artificial Sequence
  Description of Artificial Sequence: Synthetic coding sequence
atggatctgggttgggatcgctctcgcggacctcgacgtagcacaagctctgtgagagtccgggagctgtcttggcaggggctgcataatccttgtccccaatccaaaggcccagggtcccagagggaccggctgggggaacagctggtcgaagaatacctaagccccgcaagactccaagcactcgctcgcgtggatgatcttcggcttgtccgcaccctggagatgtgtgttgatacccgggagggaagcttagggaactttggcgtgcacctgccaaatttggaccagctgaaactgaatggttctcaccttggctccctaagggacttggggaccagtctgggccacctccaggttctgtggctagcccgttgtggcctggcagacctggatggcatcgcctcacttccagcgttaaaagagctctatgctagctataacaacatcagcgatctgtcacctttatgccttctggagcagctcgaggtcctcgatctggaaggtaattctgtggaggatcttggccaggttcgctacttacaactgtgtccccgtctggccatgttgactctcgagggaaatctggtgtgcttgcagcctgctcccggtccaaccaacaaagtgccgagggggtacaactatagagccgaggttcgcaagttgattccacaattgcaggtgttagacgaagtacctgcggctcacaccgggcctcccgcacccccacgtctgagccaggactggctggccgtcaaggaggccataaagaagggcaacggcttgcctcccctggactgtcccagaggagcccctattaggcggctcgatcccgaattgtctttgcccgaaactcagtccagagcttcacgaccttggccattttcactgctggtcaggggtggaccgctaccagaggggctgctgagcgaggacttggcccctgaggacaacacgtcatcccttacccacggcgcaggacaggtgctttgcggtaaccctactaagggactgagggaacggcgacatcaatgtcaggccagagagccgcctgaacaactgccccagcaccggccaggtgatccagccgcaagcacatcaacacccgagccagacccagccgattcttcagactttctggcactggctgggctgagggcctggagagagcacggggtgaggccactgccttaccgtcaccccgagtctcagcaggaaggagccgtggcgccatgggggccaagaagggtgccagaagagcaggttcatcaggccgagccgaaaacccccagtagtccccctagtctggcctctgagccaagtggcacctcttctcagcacttagtgccttcccccccaaaacacccaaggccacgggacagcggaagctcttctccacgatggtcgaccgatctgcagtccagagggaggaggttgagggtcctaggctcttggggccctggtcttggcgacggagtcgctgccgtgcctgtgctgcgtgcacttgaggttgcatcacgattgtcacctcgcgcacaagggtgcccgggtccgaagcccgctcccgacgctgccgcacgacctccaagggctgcagaactgagccatccatcccctgtgccgacatag

SEQ ID NO: 57239 - DNA, 720 bp, Artificial Sequence
  Description of Artificial Sequence: Synthetic coding sequence
atgggaaactcagcactgcgagctcatgttgagaccgcccaaaaaacaggggtttttcagctgaaagaccgcggtctgactgagttcccggctgacctacagaaactgacgtctaatctccgtacaatcgacctttcaaacaataaaattgaatcgctccctcccctcttaataggaaaatttactctcctaaagagtctgtccttaaataataacaagcttaccgtgctacccgatgagatctgcaacctgaaaaagttggaaacactgagccttaataacaatcatctgcgggagttaccttctaccttcggtcagctctccgccttaaaaacattgagcctgagtggtaaccagctgggcgcacttccccctcaactgtgctccctgaggcatttggacgttatggacctgtcaaagaatcaaatcaggtctattcccgactcagtgggcgagctccaggtcatcgagctaaacctgaaccaaaaccagatctctcagatctctgtcaagatttcctgttgccccaggctgaaaatcttacgccttgaggaaaattgcctcgagctgagcatgctccctcaatctattctttccgattctcagatctgcctgttggccgtcgagggcaacctgttcgaaatcaagaagttaagagagctggaagggtacgacaagtacatggagagattcactgcaaccaaaaaaaagtttgcctag

SEQ ID NO: 57240 - DNA, 720 bp, Artificial Sequence
  Description of Artificial Sequence: Synthetic coding sequence
atggggaactctgcgctgcgcgctcatgtagaaaccgctcagaaaaccggcgtgttccagctcaaggaccgcggactcactgagtttccggcagatttacaaaaattaacctctaacctgaggaccattgatctgagcaacaataagattgaatctctcccaccactgcttatcggtaagttcaccctcctgaagtccttgagcctgaacaacaacaagctgactgtgctgcctgatgaaatatgtaatctgaagaagctggaaacgctgtccctgaacaataatcatcttagagagctgccatctaccttcggccagctatccgcactgaagaccctgtccttgagcgggaaccagctcggagctttacctccacaactgtgctctctgcgtcatttggacgtgatggacttgagcaagaatcagattcgatcaatacctgattctgtaggcgagctgcaagtcatagagcttaacttaaaccagaaccaaatctcacaaatctcggtgaagataagctgttgtcccaggcttaagattctccggctggaggaaaactgccttgagctcagcatgttgccccaaagcattctctccgattctcagatctgcttgctcgcggtcgagggcaacctctttgagataaagaagctgcgcgaactggaggggtatgacaaatatatggaacgattcaccgccactaaaaagaagtttgcctag

SEQ ID NO: 57241 - DNA, 1116 bp, Artificial Sequence
  Description of Artificial Sequence: Synthetic coding sequence
atggaggaggccggtgcagccgtggtaactgcaggggaggcagaactgaactggagccgcctctcagtgtcaactgaaacactggaaagcgaactcgaggcccgtggtgaggaacgcagaggggctagggaagccttgcttcgcttactgctgccccacaatcggcttgtatctctccctcgcgctctggggtcgggctttccccatctccagcttctggacgtatcagggaacgccctgacagccctgggccctgagcttctagccctcaggggccttcggacattacttgctaagaacaatcggttggggggacctagcgcactgccgaaagggcttgcccagtcaccactgtgcagatccctgcaagttctcaatctcagtggcaattgttttcaggaggtgcccgcaagtctcctggagctccgcgctctgcagaccctttctcttggcggaaaccagctccagagcatccccgctgaaatcgagaatctccagagtctggaatgtctgtatctggggggaaacttcattaaggagataccaccagagcttggaaatcttccgagcctgaattatctcgttttgtgtgataataagatccagagtattccaccacagttaagtcaattacattcgctgcgaagtctttcattacacaacaacctccttacatatctccctcgggagattttaaacctgatccacctagaggaactgtctttaagagggaaccccctcgtggtgagattcgtgcgggacctcacgtacgatccccctaccctcctcgagctggcggcaaggaccataaagatcaggaatatctcctacacgccttacgacctcccgggaaatctactgagatacctgggctctgcctccaattgtccaaacccaaagtgcggaggcgtttacttcgactgctgtgtgcgccagatcaagtttgtcgacttctgcggcaaatacagactgccacttatgcattacctttgctcccccgagtgtagctccccttgctcgtcagcttctcacagctcaacatctcagtccgaaagcgattccgaggatgaggcaagtgtagccgcaagaagaatgcagaaggtgctcctgggctag

SEQ ID NO: 57242 - DNA, 780 bp, Artificial Sequence
  Description of Artificial Sequence: Synthetic coding sequence
atggaccccccagcggagaagcccggagaggccggagggctccaaatcaccccacagttactcaaaagtcgaacaggggaattctcactggaatctattctccttctcaagctgcgaggcctcggcttagctgaccttgggtgcttaggcgaatgtctcggtctcgagtggctcgatctgtccggcaacgccctgacccacctgggcccacttgcaagcctgagacagctagcagtgctgaacgtgtccaataacagactcactggcctcgaacccctagcaacatgtgagaatctccagtccctaaacgctgcagggaatctgctcgcaacccccggacaattgcaatgcctcgccggactcccatgtctggagtatctgcgactgcgtgaccccctggcaagactgtcaaaccccctctgtgcaaatcctagttattgggccgcagtgcgcgagttgctgcccggattgaaggtcatcgatggggagcgggtcatcggtcggggtagtgaattttatcagctctgcagggatctggatagttctctgaggcctagctcgtccccagggcctcgagccaccgaggcccaaccttgggttgaacccggatactgggagagttggcccagcaggtctagttcgatactggaggaggcgtgcagacagttccaggataccctgcaggaatgctgggatctggatcgccaggccagcgacagcctcgctcaggccgagcaggttctaagctcagcaggtcccacttctagctttgtcttttag

SEQ ID NO: 57243 - DNA, 780 bp, Artificial Sequence
  Description of Artificial Sequence: Synthetic coding sequence
atggaccccccagcagaaaaaccgggtgaagcgggtggcttacaaatcacaccacagctgctcaagagtcgaacaggagaattctccctcgagagcattctgctcctcaaattacgcggtctgggcctggcagatctcgggtgcctgggcgagtgtttgggattggagtggcttgatttgagtggtaatgctctgactcacctgggaccactcgccagtctgcgacagctggctgttcttaatgttagtaacaatcgattgactggattggaaccgctcgccacctgcgagaatttgcagtcactgaatgccgctggaaatcttctcgcaacacctgggcaattgcaatgcctcgctgggttgccttgcctggaatatctacgccttagagaccctctggccagattgtcaaacccgctttgtgcaaatccatcatactgggcggcagtacgcgaactgttaccaggtctgaaggtgattgatggagagagagtcatcggccgaggatccgaattctatcagctctgtcgggatctggattcctctctgagaccttcaagtagcccaggaccaagggccacagaggcccagccctgggtggagccagggtactgggagagctggccatcccgttcttcctccattctggaggaagcttgcagacagttccaggacaccctgcaggaatgctgggacctggacaggcaggcatcagattccttggcccaggcagagcaagtgttgtcttctgcgggtcccacctcttcatttgtgttttag

SEQ ID NO: 57244 - DNA, 780 bp, Artificial Sequence
  Description of Artificial Sequence: Synthetic coding sequence
atggatcctccggcagaaaaacctggcgaggcgggtggcctccagataactccacagctgctgaagagccggaccggtgaattttcgcttgagtctatcctgctgctaaagctgcggggtcttggattggccgacttaggctgccttggagagtgcctaggtctcgagtggctcgatctgtctggaaacgctctgacccaccttggacctctcgcctctttaaggcagttagcagtacttaatgtctccaataacagactcacgggattggagcctcttgccacatgtgagaatttgcaaagcctgaacgcggctggcaacctgcttgcgacccctggccagctccagtgtcttgctggactgccgtgcctggaatatttgagactgcgcgaccccttagcaaggctgagcaacccgctgtgcgccaatccaagctattgggccgcagtaagggaacttttgccagggctcaaggtgatagatggcgaacgggtcatcggcaggggcagcgagttctaccagctgtgcagggacctagatagttctctgcgcccaagcagcagccctggaccgagggctactgaggcacagccttgggtggagccaggctattgggagagctggccctccaggagctcttccatcctggaggaggcctgccgtcagttccaggacacgcttcaggaatgctgggacctggataggcaagcaagtgacagcctggcacaggcggaacaggtgttgtcatcagccggtccaacctcttcctttgtgttctag

SEQ ID NO: 57245 - DNA, 1746 bp, Artificial Sequence
  Description of Artificial Sequence: Synthetic coding sequence
atgcagaagccacccctcttgctacgcagaccgttgccgcctaaattcacgaaactgtccctgcatgagaagaaaactcacacagccaagaccgggaagattgaatcactgcatgttgcctttaccgaagacgagaccacgtctataaagatggacagaactaggttccccgacgttctgaggaatcagagcctcaccccaattaacatccagaacatatttttggatcactgcgtccaagaacgtgtgaccgctattagcagtcctcagaagagtaccaaacacgtacgcgaacagataccagacacggccaccggcagcatcttttttccccactgcaattccgcctctaccaggattttcgggaaacaaactaataaaatggagtcttctcggaagttcaagacaatgaaggatgtttacaccgagaagagactcgagaatatcctaatactttcctccaaattctccaaacccaagtccaccccaggcagcgtgatcgcacagaagctggagaagatgcacccaaaacatcagccccttcctgagtctccaggctatacctaccagcatatatccagagatctatcagccacggtgccaagtccaccgcctatgaccgtctcaatgaagcccgaaggccagtggccagagcacttcaagtcaacagccacattgacgctccgggtgaccgagtttcctgggttcgtctccttacccaccccagttctaccacgaaagccacaccgacaatctgtgattgaaacacttgtgaccgaaaacgggaatatcgaatcagtcccaaaacagataccccctagacctcccgagggcctgacaaagactgaaaaaattgagagcgagatccacgtggtgaggggtgaagggtttaaaactgtggccgctacacggtacgagactatcactgccatgacaaacctggccattgtcaactgtcaggtttacggacgcaacgcgctgaacttaaaaggatttttcatcttgaattgccctgacttgactcctttggccttccagcttatttacttaaacctgtcctttaacgacctgcattactttcccacagagatcctttgtcttaaaaatttgcagatcctcaagctgcgcaataacccaatcaaggagatacccagcgagattcagcaactggagtttctgcgaatttttactatcgcttttaatctcattactgtactgccaatcggcctgttctctctgtcctacttagaagaactcgatgtatcatataatgagctcacattcattcctaacgagatacagaagctccggtcactagaaaaactaacagttgacgggaatgagctgtcattcttcccccacggtatccttaaactcaacctgactaaaatccagtttgagaataacttcactcacccttgtttctggagggacaattaccttaataacccacaacagttaactcaaatcatcagtcttttcatcgtccagaacaagctgcacaagttttacgataagatccctgtcgaggtgcagaaactgctgaagtggtggggagcccagtttctcacagagctggctccactgagcatctattcgtcaagaaaggccattactgagggttacatcgccgttgaactcccaaaattcgaggaatccaagaacatcactgaggggctcttgacacaaaagagatacgaggaagtcatggtgaaatgtatcaacgccactaccgtcacaagctag

SEQ ID NO: 57246 - DNA, 576 bp, Artificial Sequence
  Description of Artificial Sequence: Synthetic coding sequence
atgaccgagcggctgctgattaaagccctgtcaggtggcaaaaacacaaagatcattacactgaatgggaaaaaaatgaccaagatgccttccgctttggggaagttgcccggtttaaagaccctggtcctccagaataatcttatccccaaagtctgccccgaactgtgtaatctcacgcagttccaagacttaaagctgagagagttctattgcgaaggaaacccactcttccttcagcagcctgtgatctccacccaacaagagaatgtatggtcactccaagagatcacctcgcgctttgtaatgaatcaactggcagagaataacccatttctgatggacgatatcgagcgctacccacaggtcagaagcatgatctcacagggaaaaacatgtgcgatttgcggccaatacttcataaccgtttggctggagtgcgttaggttcgttccaccccctaaagattggaagatatctaaaaatcttaaactagtgcctctacaggtcctgatttgcagttataagtgcttcacacaaagagaccccaacttgtttggcatcgcccaggtctag

SEQ ID NO: 57247 - DNA, 153 bp, Artificial Sequence
  Description of Artificial Sequence: Synthetic coding sequence
atgaccgagcgcctcctaatcaaggcattatccggaggaaagaacaccaaaattataactctgaatggtaaaaagatgaccaagatgcctagcgctttgggaaagctgcctgggttaaagacgctggtgttacagaacaatctaattccatag

SEQ ID NO: 57248 - DNA, 1044 bp, Artificial Sequence
  Description of Artificial Sequence: Synthetic coding sequence
atgacagaaagattgctgattaaagccctgtcaggcggaaaaaacacaaaaattataacgctaaatggcaagaaaatgactaagatgccaagcgccttggggaagcttcccggactcaagacactggttctgcagaacaacctgatcccgaaagtgtgtcctgagctctgtaacctgactcagctcacaactctgaacctgggcaacaatctactggaagaggtaccggaggaaatgaagtatctcacatccctaaagaatttacacctgagtggcaatcggatctgtaggttcgccccaggggcttgcgatggcttgcagaatctgattctgctcaatttaaacaacaaccacctgacccagcttcctcaggaggtctcccggctcaagagcctgacctatatgagcataaattataatcagttggcctccatccctcgggagctgtgtttccttgagaacttggtggaactgcagctgaactacaaccaattaatctgtatacccgaggaaatcaagtttctcaagaaattacagaagcttttactcgctcgcaacaacatcggcgtgctccctgaggagctgtgcgatctcaagaagctccgcattttggatattgcaggaaatatcatccagatcttcccatctggatttcaggatctgaagctgagagagttctactgcgagggcaatcctctgttcttgcagcaacccgtaatcagtactcaacaggagaatgtgtggtcattacaggagattacgagcagatttgtcatgaaccagctggcggagaataatccattccttatggatgacattgagcgttacccgcaggtccgcagcatgatctcacaggggaagacttgtgccatatgtggccagtacttcataacagtatggctagaatgtgtgcggttcgtccccccaccgaaagattggaaaatcagtaagaatctcaaactggtacccctccaggtgttaatctgcagttacaagtgcttcactcagcgcgatcctaatctttttgggatcgcccaggtgtag

SEQ ID NO: 57249 - DNA, 1680 bp, Artificial Sequence
  Description of Artificial Sequence: Synthetic coding sequence
atgtctagcgagcagtccgcccctggggcatctcccagagcccctaggcctgggacccagaaatcctctggggcagttactaagaagggagaaagagcggctaaagagaagcctgctacagtgctcccgcctgtcggcgaagaggaaccaaaatcccctgaggagtatcagtgttcaggcgttctggagaccgatttcgccgaattatgtacacgatggggttacacagactttcccaaagtggtgaacaggcccaggccgcaccctccgttcgtcccctctgcttccctaagtgaaaaagccaccctagatgatcccaggttgtcgggcagctgctctctgaatagcttggagagcaagtatgtgttctttcggcctacaatccaagtggaactggagcaggaagactcgaagtcagtcaaagaaatatacatccggggatggaaggtggaggagaggatcctgggagtgttttccaagtgccttccacccctgacccaactgcaggcgatcaatctttggaaggtgggactgaccgacaaaacgctgactaccttcattgagctgctccccctgtgtagtagcaccctgcgtaaagtaagcttagagggtaatccactccctgaacagtcctaccataagctgatggctctggactctacgattgcccacctgagtctgcggaacaataacatcgacgataggggcgctcaattgctgggtcaggctctgagcacgctacactcatgcaacagaactttggtgtccctgaacctcgggttcaaccatatcggcgacgagggtgctggatacattgccgatggactcagactgaacaggtctctactgtggctaagcctggctcacaatagaatccaggacaaaggcgctctgaagctcgccgaagtgttacgggctttcgagcttacccatactgaggtcgtcgagaggcgacgtttactgctggagaaggggactcaggagaggtcccgcagcccttccagctctagacacggggatagtaaaactgacagggagaagagccagatggttggcatcagtaacagcgctttagtggacaagaccgacaagactcagacaatgaagacacccaaaggcctagggaaaaaaaaagagaagtcttgggagctggcaaaaaaagaggagaagttggggtcagggcagagccctacgcaaggcacgccgaagaaggaagatgctaccaaggccggaaaggggaaggtaactatccccgaacagaagccttctagggccaaaggcattaagatcgggtcgagggagaagaggtcgatactgcttgaaagcgaactcgtggtagaagccactgaggtcgtgaatcctttgttagagccggtcgaacatcgcgacgggaaggtgttcatgcccggaaataaagttcttctgcatctgaatttgattagaaacagaatcactgaggtgggcctggaggggtttctagctactgtccaataccagatgcagttcagtaaggccaaaagcgcttcaaagggaccagtgggactactctggctttcccttgccaagaattgcttcgcccctcagtgcccagcatacgcgattatccaggagttaatgcttcctcgggaccccattaaggctaaactccgagaagacgaggctatggcgttttttccctag

SEQ ID NO: 57250 - DNA, 864 bp, Artificial Sequence
  Description of Artificial Sequence: Synthetic coding sequence
atgagctgggatcctaatcctgtgccaagaacgctgcgttgttggaggttgaggcgtgccagcgagaccgctctgcaatcctcccgtcgcgctgtggaggaccaactcaagatatgcggccatcgaagagacgccgatgtcttcgaactgtttttgagtaagaaggaactgacagaagttattgacctgagccgctttaagaagttgaaatacctctggctgcaccataacaaattgcatgggataaccttcctcacccgaaactactgtctgaccgaactctacctaaacaataacgctatcttcgagattgaaggcttacactacctacctagcctccatatcctgctactccatcacaatgaactcactaacatcgatgctaccgtgaaagagctgaagggtatgctaaacctgaagattctatctctttaccaaaatccactctgccaatataacctgtacaggctgtacattatctaccatctgccaggtgttgaactgttggaccgaaaccaggtgacagagaaagagagacgatctatgattacgatattcaaccacaagaaggcacacatcgtgcaaagcatagcctttggcggaaaggtcgatgccagctgggaccccaagtcacccttcaagcagaagccagcccaacgcgtgccctccgacttcgctttcgcgaataacgtagacaagaccgtcctagatgaccccgaggatgccgtatttgttcgcagtatgaaacgatctgtgatgacactcacttcaatgaactgggacaccgtacccaccagagaagagaggtacttggaagaagaagggacagagacagcacaaatgctgacagtgaccctgagatag

SEQ ID NO: 57251 - DNA, 951 bp, Artificial Sequence
  Description of Artificial Sequence: Synthetic coding sequence
atgttaccctcttcaattcagatctcaggcgaaccattgtccggcgcagaagtgagggacatttgtcgcggacttagggacaacgccgtgcgactgttatctctgaggggatgccgattatgcgacagggatttcggccgaatctgcagagcactggccggtgcgacctctttagctcagttgaatctgaacttaggagtagtgagctcgccctcacggattaaacagctggccgaagcactaagaaccaatagaagcattcagagcctattcttgcatggctctccactcacagatgcgggtttagcgttgcttaatcctgctctggcccttcaccccgctctggttgccctcgatcttggcgattgtatgctgggagacgaggccataaacctgatttgtggcctgctcccccctgatggggcaaaatcaggcctgaaggaactcaccctgtcggcaaacccaggtattacccccaaaggctggtcaaggttggcgatcgcagtggctcacagctctcaggtgagggtgttgaacctggattacaatcccctgggcgatcacgttgcaggaatgttggccgtagccgtcgcctccagtaggacactggaggtgctcgacttagagggcacagggcttactaaccagtccgcccagacgctccttgacatggtcgaaaattaccccaccgcccttaggtctctcgtcctcgccgagaacagcatctcccctgagctccaacagcaaatatgcgacctgctgagtgagggagaggaggaggaagaggtggctggtggagccggtgacacccaggagtgggaaaggggcagagaacccgcagcgcaccagcggggatcatcctcttggatgtgccctagcgaccccagcagccagatggtgcttatgaccagcgggctcggcgattctctgctggcggagacagaaatgtag

SEQ ID NO: 57252 - DNA, 1245 bp, Artificial Sequence
  Description of Artificial Sequence: Synthetic coding sequence
atgaagctgcattgcgaagttgaggtcattagtaggcacctccccgcattggggctccgcaaccgcggaaaaggcgttagagcagtcctctctctgtgccagcagacaagtcgctcccagcctcctgtgcgggcattcctcctgatcagtaccctgaaggacaagaggggcactaggtacgagttgcgtgaaaacatcgaacagttttttacgaaattcgtagatgaaggtaaggctacagtgagactcaaagaaccacccgtggatatttgcctgtccaaggctatcagctcttccctgaaagggttcctgtctgccatgcgcctcgcccaccggggatgcaacgtggacactccagtgagcaccctcacaccggtgaagacaagcgagtttgaaaattttaaaacaaaaatggttataacaagcaagaaagattatccgctgtcgaaaaatttcccttactccttagagcacttgcaaacctcttactgtgggctcgtcagagtagatatgaggatgctgtgtttaaaatccctcagaaaactcgacctcagtcacaaccatatcaagaaactcccagccactatcggcgacttgattcatcttcaggagcttaatctgaacgataatcacttagaatcgttctcagttgctctgtgtcacagcaccctgcagaagagcctgcgaagtctggacctgtccaagaataagattaaggccctgcccgtgcagttctgtcagcttcaagagcttaagaatctgaaactggatgacaacgaacttatacagtttccttgcaagattggccagctgatcaacctccgcttcctttccgcagccaggaacaagcttcctttcctccccagtgagttcaggaacctctcactagaatatctggatctgttcgggaatacgtttgaacagccaaaagtccttcctgttattaagctacaggcacctctcaccctgctggagagcagtgcccgaaccattctccacaatcgaatcccttacggttcccacataattccctttcatctttgtcaggacttggacactgccaagatatgcgtctgtggccgattctgtctgaactcattcatccaggggacaaccaccatgaacttacatagtgtggcacacaccgtggtgctggtggacaacctgggtgggaccgaggcaccgatcatcagttatttttgttccctgggatgctatgtgaattccagtgacatgctgaaatag

SEQ ID NO: 57253 - DNA, 441 bp, Artificial Sequence
  Description of Artificial Sequence: Synthetic coding sequence
atgaagttgcattgtgaggtcgaagttatctcccggcacctgccggcactgggtttgagaaaccggggaaaaggcgtgcgggcagtgttgagcctgtgccagcagacatctagaagccaaccgccagttagggcatttctgttgatttcaactctgaaagacaagaggggcactaggtatgaacttagggagaacatcgagcagttttttacaaaattcgtggacgaagggaaagctactgtgcgactgaaagaaccacctgtggacatttgcctctccaaggactccatctggctgtcctatcacagtatcccttcactcccccgattcggctatcggaagaacctatgcttatggaaaatccttagcgagctatttcactccaggaactattaccatgaatctgccttttgctgtcctcattgtggcctgtccagatag

SEQ ID NO: 57254 - DNA, 1269 bp, Artificial Sequence
  Description of Artificial Sequence: Synthetic coding sequence
atgaagttgcactgtgaggttgaagtgattagccgacatctccctgccctgggcctgcggaaccggggaaaaggggtccgggctgtgttatctctgtgccagcagacgagcagaagtcaaccacccgtgcgcgcatttcttcttatctctacacttaaagataagcgaggcactaggtatgagttgagagaaaatatcgaacaattttttacaaagttcgttgatgaaggaaaggcgaccgttcgcctgaaagagcctcccgtggatatctgtctgtccaagatggaaagtcatagcgtaacgcaggtgggagtacaatgggaagaactgggctcactacagccaaccgggcatttccagcagtttaaaagatttccgtttagctatgagactggccacaggggctgcaatgtagatactcccgtgagcactctgacccctgtgaagacgtccgagtttgaaaattttaagaccaaaatggttatcacttctaaaaaggactacccattgagtaagaattttccttattccctagaacacctgcagactagttattgtggcctagtgagagtcgatatgcggatgctgtgcctgaaatccctgagaaagctcgacctgtcccataatcatataaagaagctcccagccaccatcggtgatctcattcatttgcaagagctgaatcttaacgacaatcatctggagtccttcagcgtcgccctgtgtcactctaccttgcagaaaagcctgagatcacttgatctgagtaaaaacaaaatcaaggctctcccggtccagttctgccagctgcaggaattgaaaaacctgaaactcgacgataatgagctcatacagtttccatgtaagattggccagctgatcaacctgagatttttatcagcggctaggaataaacttccattcttgccgagcgagttccgtaacctttccctcgagtatctcgatctgttcggaaataccttcgaacagcctaaagtgcttccagtcattaagctgcaggctcccctgacgttgcttgaaagctccgcgagaactatcctgcataaccgtaccatatatcctaaagaaataaatgtgaacatgtgggagacattgcctggaaggatttcacttggctgcatgtatgactttgctgctagtaattggagcaaaggtcgttttctgtatacctgttggcggggaggaatgtgcatcgtgacgcaccttgatgatagcaagacgtttataaagacaaacttctctttttag

SEQ ID NO: 57255 - DNA, 507 bp, Artificial Sequence
  Description of Artificial Sequence: Synthetic coding sequence
atgcaccccagtttggccacaatgggcaaactggcctctaaacttcagctggacctgtccgtggtgaaaatctggtttaaaaatcagcgcgctaaatggaaaaggcaacagcgacaacaaatgcagactcgcccttctcttggcccagccaatcagacaacttctgttaaaaaggaggagaccccttctgcaataacaactgccaacattcgaccagtcagtcccggaatctccgatgctaatgaccatgacctgcgggaaccctctgggattaaaaaccccggtggtgccagtgcctcagcacgggtttctagctgggatagtcaatcttacgacatcgagcaaatttgcctgggcgcaagtaatccaccctgggctagcacactgttcgagattgacgagtttgtgaaaatctacgatcttccaggtgaagacgacacgagctctctgaaccagtatttgttccccgtgtgccttgagtacgatcagcttcaatcatcggtgtag

SEQ ID NO: 57256 - DNA, 549 bp, Artificial Sequence
  Description of Artificial Sequence: Synthetic coding sequence
tgagcacacgggttccagccccatgctagcgtggaacccgcatgccaagcaggaacctggaacctcaagcagctgtctcaggaaggccctagacgttacagacgccctcgtactcgtttcttaagcaagcagctaacagctttgagggagctgctggagaagaccatgcatccatcccttgctactatggggaaactcgcaagtaagctacagctcgacctttcggtagttaaaatctggtttaaaaatcaaagggcaaaatggaaaaggcagcagaggcagcagatgcagacccggccatctctgggcccagccaatcagaccacctcggtgaagaaagaggagacaccaagcgctataacaaccgccaacattagacccgtgtcgcccggaatttcagatgccaatgaccatgatctcagagaacccagcggaatcaagaatcctggaggcgcaagcgcctccgctagagtgtcttcatgggattcccaatcatacgatatcgagcagatctgtctgggagccagcaacccaccatgggccagctag

SEQ ID NO: 57257 - DNA, 573 bp, Artificial Sequence
  Description of Artificial Sequence: Synthetic coding sequence
atggcctctcgcggtaaaaccgagacaagtaaactcaagcaaaacctggaagagcagctggatagactgatgcagcagctgcaggatctggaggagtgccgcgaagaattggacaccgacgagtacgaagaaactaaaaaggagactctagagcagttaagcgagttcaacgactctctgaaaaaaattatgtccggcaacatgaccctggtcgatgagctctcaggaatgcagctcgctatccaagctgccatatcccaggcattcaagacacccgaggtgatccgtctgttcgctaagaaacaacctgggcaactgagaaccaggttggccgaaatggatcgggacctcatggtgggaaagctcgaaagagatctctatactcagcagaaagtagagatcctcactgccctccggaagttaggggagaagttgacagcagacgatgaggcttttctttctgcgaatgctggagccattcttagccaattcgaaaaagtcagcacagatctcggaagtggagacaagatattggcactagctagcttcgaagtggaaaaaactaagaagtag

SEQ ID NO: 57258 - DNA, 573 bp, Artificial Sequence
  Description of Artificial Sequence: Synthetic coding sequence
atggcaagtcgaggcaagaccgagacgagcaagttaaagcagaatcttgaggaacaactcgataggctcatgcagcagcttcaggatctggaggaatgtcgggaagagctcgacactgacgagtacgaggagacgaagaaggaaacactggaacaactgtcagagtttaacgactcattgaagaaaattatgtctggcaacatgacactagtggacgaactatctggcatgcagctggctatccaagccgctatttcacaggcatttaaaacacccgaggtcattcgcttgtttgccaagaaacagcccggacagctgcgcacccggctggcagagatggaccgggaccttatggtgggaaagttggagcgggacttatatacccagcagaaagtagaaatactgaccgctctgaggaaactgggggagaagctcactgctgacgacgaagccttcttaagcgctaacgccggtgccatcctctcccagtttgaaaaagtgtccaccgacctgggtagcggcgacaagatactggccttggccagtttcgaggttgaaaagacaaagaaatag

SEQ ID NO: 57259 - DNA, 573 bp, Artificial Sequence
  Description of Artificial Sequence: Synthetic coding sequence
atggcctctagaggcaagaccgagaccagcaagttgaaacaaaacctggaggagcagctggacaggttgatgcagcaactacaggatctggaggaatgtagagaagagctggacactgacgagtacgaagagactaagaaggagacactggaacagctttctgagttcaatgattcgctgaaaaaaatcatgtccggcaacatgacattggtcgacgagttgtctggtatgcagcttgcaatccaggccgctatttctcaggcattcaagacgcccgaggtgattaggctcttcgcgaagaaacagcccggtcagctgcgcacacgactagcagaaatggatcgcgacctgatggtcggcaaactcgaaagagacctatatacccaacaaaaggtagagatcctgacagctcttcgcaaactgggagagaagctgaccgccgatgatgaggcctttctgtctgcaaatgccggagccatattgagccaattcgaaaaagtctctaccgacctggggagcggtgataagatccttgccctcgcctcattcgaagtcgagaagaccaaaaaatag

SEQ ID NO: 57260 - DNA, 636 bp, Artificial Sequence
  Description of Artificial Sequence: Synthetic coding sequence
atgaacaatttcatctttcttaagttcatgacactgggtacctctcggacgggcgagatcaagatggcaagcagggggaagaccgaaacctcaaaacttaagcagaatctggaggagcagctcgacagactgatgcaacagcttcaagaccttgaggaatgtagggaggagctagacacagacgagtatgaggaaaccaaaaaggagaccctggagcagctttccgagtttaacgatagcctgaagaagatcatgagtggcaacatgacactggtggacgagctgtccggaatgcagctggccattcaagcagcgatcagccaggccttcaaaacccccgaggtcattaggttgtttgccaaaaagcagccagggcagttgaggacccgtctggcggaaatggacagggacttgatggtgggtaagctggaacgcgacctctacacgcagcagaaggtggaaattctgaccgctctccgcaaactcggcgagaagttgacagccgatgacgaggctttcctgtccgcaaatgccggagcgattctttctcagtttgagaaagtgtctactgacctgggctccggggacaaaattctcgcgctcgcatctttcgaggtagaaaaaacaaaaaagtag

SEQ ID NO: 57261 - DNA, 720 bp, Artificial Sequence
  Description of Artificial Sequence: Synthetic coding sequence
atggtccagccccagaccagcaaagcagagagtcctgcgctggcggcaagccccaatgcccagatggacgacgttatcgatacgctcacctcccttcggctgaccaacagcgcgctgcgcagagaggccagcacattgcgggctgaaaaggccaaccttaccaatatgctcgaaagtgtgatggcagagctcactctcctgcggacccgtgcgaggattccaggagccctgcagatcaccccacctatttcttctatcactagcaatggcactaggccaatgaccacacctccaacatcactccctgaacccttttccggcgatcccggacgtcttgcgggttttcttatgcagatggaccgttttatgatcttccaggcctctcggtttccaggggaggcggaacgcgttgctttcctggtctctaggctgactggggaggcggaaaaatgggccatcccccatatgcagcccgactctccactgcgtaacaactatcaggggtttcttgccgaactcagaaggacctataaaagccctctccgacacgctcgccgagctcagattcggaagacctccgctagcaaccgtgccgtacgcgagagacagatgctgtgccggcaactggcaagcgcagggacgggaccatgccccgtgcatccagccagtaatgggacctcgcccgctcccgctctgcctgcgagggctcggaatctatag

SEQ ID NO: 57262 - DNA, 2079 bp, Artificial Sequence
  Description of Artificial Sequence: Synthetic coding sequence
atggaccaccacatcccaatgcacgctctccccgaggagatacagaagatgctccctgaggagaaagtctgcaagtactgtggggtcagctatctcatattgcacgaattcaaagcaatggaggagaaggtgaaggccatggagaaggagatgaagttctatcaggggtctgtggatcgggaaaagaggctccaggaaaagttgcacagtttaagccaggaactcgagcagtacaagattgataataaatccaagactgagcgaatctatgatgtcggcatgcaactgaagtctcagcaaaacgaatttcaaaaagttaagaaacagctcagtcacctgcaggatgaactgaaaataaagtacagacagagttatatcttcagccagaggctgagcgaatacaagtacttctggaacaagacccttagcctactgactttcacgaagcgggagctaacttcaattaagaatgaagtctacgataattaccagaattggactagtctgaaaggagccgtgttcctgcagattaagtcaatctctgaaaccgccctcaccgaaatcgacattctgaataaatcactgacagtgtcacagcgcaacaaggtatgtctagaaaaggagatgaaaaatttgaaactgttgtcagatgcagctattctgcgatcacagcagatcaggacttcccgtcaacaggaggtaaaccttcagaccagatgctacgatctgcagaaagaagtcttagatctccagtgtcttgtggaggctctcggattgaaactccaaaaggccgtgacagagatggacaattataaagagatgctaatgaataagtccaacgaggccgacgattgtcaacgagagttgaagaagttaaaatttgagtccattatctctgaaagccagcacacaatgctgctgaaagaaaaagaagacagccttatgacttgccagcaaatatataaagccctgcaggaggagctgacggtcaaggagaagcaggaggaggatataaaacggagaataaacctggcggaaaatgaactcgagattacaaagacattgctgaaccaaaccagagaagaagtgctgactctgaagaatgagagggaactgatgctaatttcccatcagaaaagcattgagcaactccaggaaactctccgtcaaaagctgctgtccgacgataattggaaggagaagattgaggcagaacttgctaaagaacgtgctcagcaccttgtagagtttgaggagcaggctctgctgtttaaagaagagaccaaactgcaacttgatatagagaaggaaaaacatcaggatgtgatccagaaatacaaaaaagaacaggaggagctccaaatgaagatttctgatctgataacaggggcaacccgcgacctcagacaagaagtgaccacactgaaggagaagcttcataagtcacatataaggtacacagaggagtcaaacagcaaagagaaggaaatcgaaaatctgaaaaacttggttgccgagtttgaatctaggctcaaaaaggaaatcgactctaacgactcggtatcggaaaatctacgcaaggaaatggaacagaagtctgacgagctgaagcgcgtgatgctggcgcagacacagctgatcgaacagttcaaccagtctcaggaggaaaacacctttcttcaagaaactgtgagaagagaatgcgaggagcgcttcgaattgaccgaggctctcagccaggctcgagaacagctgctagagcttagcaagctccggggatcgctgcctttttcaccatgttccctatcaaaaggaagtttgactagtcccgcagctgcggtcagcaatcacggagagcgtagcctggcacgactgaattcagaaaagggaattcagatcccaaaccttagaggggtaagtaaacctacgacctttcccacaagcgacaaacccaaaagagtgcgctccggggtccctatcctgccacagccgcacccacccagaggcggtgcttctagtgccaacgagacccgccagcggttagctgccatccttcggaggcggagaagccagcagtag

SEQ ID NO: 57263 - DNA, 1167 bp, Artificial Sequence
  Description of Artificial Sequence: Synthetic coding sequence
atgctcctgaaggaaaaagaggactccctcatgacatgtcagcagatctacaaagcgctccaggaggaactgaccgtaaaagagaagcaggaggaggacatcaaaagacggattaatctggcagagaacgaactcgagatcaccaagacccttctgaatcaaactcgcgaagaggttctgactctcaagaacgaacgggaacttatgttgatttcccatcaaaagagcattgagcaactgcaggagacactgagacaaaagttattgtctgatgacaactggaaggaaaagattgaagccgaactcgccaaagagagggcacagcacctcgttgagtttgaagagcaggctctattgttcaaagaggagacaaagctgcagttggacattgagaaggagaaacaccaggacgtgattcagaaatacaaaaaagagcaggaggagttgcaaatgaaaatttccgacctgataacgggggctacccgtgaccttcgccaagaggttacaaccctgaaggagaaacttcataagagccatatccgttatactgaagaatctaattctaaagaaaaggaaattgagaatcttaagaacttagtagcggagtttgaatctaggttaaagaaagagatcgactcgaacgattcagtgtccgagaacctccgcaaggaaatggagcagaagagcgacgagcttaagcgagtgatgctggcgcaaacgcagctgattgaacaattcaaccagtcacaggaggagaatacattcttgcaggagactgtccgtagggaatgtgaggaaaggtttgagttgacagaagccctgtcccaggccagagaacagcttcttgaactgtcgaaactgagggggagcttgcctttctcgccatgctcactgagcaaagggtccttaacctcccccgcagccgctgtcagcaatcatggagagcgctccctggccaggttgaactctgaaaaagggattcaaatcccgaacctccggggtgtatctaaacctacaacgttccccacttctgataaacctaagcgcgtgaggtccggggttccaatcctgcctcagccccacccccctaggggcggtgcttcgagtgcaaatgagactcggcagagattagccgcaatcctgcgacgtaggaggtcccagcagtag

SEQ ID NO: 57264 - DNA, 1653 bp, Artificial Sequence
  Description of Artificial Sequence: Synthetic coding sequence
atggctagtgtgttccattactttcttctggtgctggtgttccttgatactcacgccgctcagcctttttgtcttcctggatgcacatgctctgaggaatccttcggcaggacgctgcaatgtactagcgtctcactcggcaaaattcctggtaacctgagtgaagaatttaaacaggtgcggatcgaaaacagtccattgtttgagatgccccagggctctttcatcaacatgtctaccctagagtacctgtggctaaatttcaataacataagcgtcatacacctgggcgcactggagcatcttcctgagttgcgggagctccgactggaaggtaacaagctttgcagcgttccatggacagcctttcgcgcaacacccctgttgcgcgtgctggatctcaaaagaaacaagattgacgccttgccggaacttgctctccaattcttagtttcattgacctatctcgatctgtctagcaatcggctgaccgtggtgtcaaaaagtgtgtttctcaactggcccgcttaccaaaaatgccgccagccagactgcggagcagaaatcctttcctccctggttgttgctttgcatgataacccctgggtatgcgactgccgcctgcgcggattagtgcagtttgtgaaaagtattacacttcctgtcatcttggtgaatagctacctaatttgccagggcccattgtctaaggctgggcaactcttccacgaaacggagctcagtgcatgtatgaagccccagatctcgaccccctcagcgaacataacaatcagggcaggccagaatgttaccctacggtgcctggcccaagcctcgccctccccaagtattgcatggacgtaccccctgtccatgtggcgtgaattcgacgtcctcacttcaagcacgggcgaggataccgcattgtctgaattggccattcccgcagcacacctggtggacagtggaaactacacctgtatggcgagtaactccattggcaagtcaaaccttgttatcagcctgcacgtgcagccagctcaggcattacacgcacccgacagcctctcaatacctagcgaaggtaacgcctatattgacttacgagttgtgaagcaaactgtccatggtatactgctagagtggcttgccgtagccgacacgtcaaaagaggaatggtttacactgtacattgctagcgatgaggctttcagaaaggaggtcgtgcatatcggcccaggtataaacacgtacgcagtagacgacttgctgcccggaaccaagtacgaagcttgccttagcctggagggacaaccccctcaccaaggccagtgtgtcgcattcgtgaccggacgggatgccggagggctggaagcccgtgaacacctgctgcatgtgacggtcgtcctgtgcgtggtattactggccgtcccagttggggcttatgcatgggccgctcaggggccttgctcttgctcgaagtgggtcctgcggggatgtctgcacagaagaaaagctccaagctgcacaccggctgctccccagtcaaaagacggatccttccgagagcatccagcggtgtgcgacgatggcgaggggcacatagatacagaaggagataaggagaaaggcggaaccgaagataactcctag

SEQ ID NO: 57265 - DNA, 1683 bp, Artificial Sequence
  Description of Artificial Sequence: Synthetic coding sequence
atggcgtcagtgtttcactatttcttactagtcctcgtcttcctggatactcacgctgctcagcctttttgtctgcccggatgcacgtgctcggaagagtcatttggcagaactttacagtgcacttcagtatctctgggaaaaatccccggtaacctgagcgaggaatttaagcaggtgcggatcgaaaactcacctctcttcgaaatgccacaggggtctttcataaatatgtcaaccctcgagtatctgtggctgaacttcaacaatattagtgtgattcatcttggcgcattggaacatctgcccgaactccgggaactgcgactggaaggcaacaaattatgctccgtgccctggaccgcctttagggccaccccactgctccgagtgctcgacttaaaaagaaacaaaatagacgccctccccgaactggccctgcagttcctcgtctctctgacctatctggacctgtcaagcaaccggttaaccgtcgttagcaaatctgtcttcctgaactggcctgcataccaaaagtgtcgacagcccgactgtggtgctgaaatactgtctagcctggtggtggccctacatgacaacccttgggtgtgtgattgccgcctgcggggactcgtacaattcgtgaagagtatcaccctgccagtcatcctggtcaattcctatctcatctgtcagggcccactctctaaagctggtcaactgtttcacgagaccgagctcagtgcctgtatgaaaccgcagattagtacgccaagtgcgaacattaccattagagcaggccaaaacgttactctgcgctgtttggcacaagcgagccccagtcctagcatcgcatggacttatccactcagcatgtggcgcgagttcgacggcttgctgggaggtaaacaccttacaccagttttgaccagtagcaccggcgaagacacagccctctccgagctcgcaattccagctgcccacctggttgattccgggaactatacctgtatggcaagcaacagcattgggaagtctaaccttgttatctctctgcacgtccagcccgctcaggccctgcacgctccagattctctgagcatacctagcgagggtaacgcctatatagatctcagagtcgtcaagcagactgtgcacggtattctgctggaatggctggctgttgctgatacctcgaaagaagagtggttcaccctgtacattgcttcagacgaggcattccgcaaggaggtggtgcatatcggtcccggtatcaacacttatgcagtcgacgatttgttgccgggaactaagtacgaggcctgtctatccctggaagggcaacctcctcaccagggacagtgcgtggcattcgtgacagggagggacgccggtggactggaggctcgcgaacatcttctccatgtgacggtggttctctgtgttgtgctgttggctgtgcccgtgggcgcatacgcctgggctgcccagggcccttgttcatgttcaaagtgggtgctgagaggctgcctgcacagacgtaaggcaccgtcttgtactcctgctgcaccacagagcaaagacggcagcttccgcgaacatccagcagtttgtgacgatggggaagggcatatcgatacggaaggcgacaaagagaagggtgggacagaggacaatagttag

SEQ ID NO: 57266 - DNA, 1176 bp, Artificial Sequence
  Description of Artificial Sequence: Synthetic coding sequence
atgcgtggtagctgcgagaggagcggggaagatgaagaacagaaagaggaggccatggtggcttgcggaaggctgtcaggggtgcctgaggctgagcaagggccagaagccaactgggacagtgatctggagactgagggtactgacggcctaggtgaactcgtgagagacacgctctatctccgatcgtgtcgcgcacactctgtcgttccgattagctgttttctcaggcagggcagcgcgcaggagctgaatttaaggcatcgcggtcttggaccccagggagccagagctcttgcgtcttcattgtcttcaaatccatacgtaaaacggctggacctgagggataatggcctctgcggtgcaggcgcagaagcccttgctggagccctctccaagtctagcagtatccacgatgtagatctgagtgaaaaccagctcggagtggcaggagcacaggccctgtgcgctgcactgaccgtgaaccaggctatgcgtaagatgcagctctctgggaatgggttggaagagcaagctgcccagcatcttgccgagctgctgctggcacacacggatcttaagagtctggacctgagttataaccaactgaatgatcaggccggtgagaccctgggcccagccctagcagagaacacgggcttaaccgaactgaacgtgtcctggaatcacctgaggggaccaggtgctgtcgctttcgccagaggcctggaggcgaatatcttcctgaaagttctggacatctcttataacggattcggcgacccaggagcttctgccgtgggtgaagcgctgaaggctaacaacgtgttggaggaattgaatatgtcgaacaatcgcatatcagctatgggagctttatccctgggcttggggctcagggtcaatcagacgctaagaatactggtttctcggaatccaatgcgtagcgagggctgctttggcttacttaagtccgtgcaggataatcccgctagcgccctcgagcttctagacttttctgatattcaagtgaacgcagagttcgatgggttggcctcctctgttcgcggtattctaccagaactgtgcatcaagacaggtgcctgcagggtcgagtataaaaaggagctactgccagtgttccgctccgccttgcctgcctccgttcccaagtag

SEQ ID NO: 57267 - DNA, 486 bp, Artificial Sequence
  Description of Artificial Sequence: Synthetic coding sequence
atgaggggatcttgcgaaaggtccggagaggacgaggagcaaaaggaggaggctatggtggcctgtgggagactgtccggtgttcccgaagctgagcagggcccagaggcaaactgggactcagatctggagaccgaaggcactgacgggctgggcgagttggtacgagataccttataccttcggtcctgcagggcacactctgtggttcccatttcctgctttctccgacaaggtagtgcacaggaactgaacctgaggcaccgcggactggggcctcagggagccagggcacttgctagctctttaagcagtaacccatatgttaaaagactggatctgagagacaacgggttgtgcggagctggggcagaggccctggcaggcgcactgagtaagtccagctccatccacggccgatgttgggtatgggggagatgggccggtgtgagttcattttcatccggcatgtgtttgcatagatag

SEQ ID NO: 57268 - DNA, 2298 bp, Artificial Sequence
  Description of Artificial Sequence: Synthetic coding sequence
atggccgcaagccagggcggtggtgggaattcaggcggaggcggttgtggcggagggggatcatccggaggatgtgggaccgcgggtggcggagggggtggagcgggaggcggtggcggaggcggtgggggaaccctggtggttccaatccccgtccctaccctgttcgggcagccttttccaaacgggcctccatggaatcctgggtccctgcaaccccagcatactgtgcgcagcctagacagggcactggaagaggcaggatcatctgggatactttccctaagcgggcgaaaactgcgggatttccccggtagtggctatgatctaacggataccacacaggctgacctttcaagaaatcgttttacagaaattccttctgacgtttggttgtttgccccactggaaacactgaatctgtatcataattgcatcaaaaccataccagaagccatcaaaaatctgcaaatgcttacatacctgaacatctctaggaatcttctcagcaccttgcccaaatatttgtttgacttgcccctgaaggtgctggtggtgagcaataacaagctcgtgtcaatcccagaggagatcggcaagctgaaagacctgatggagctagatatatcatgcaatgaaatacaagtgttacctcaacagatgggcaagcttcacagtctgagagaactgaatatccggagaaacaacttgcatgtgctcccagatgaattaggggacctgcctctggttaagttggatttttcctgcaataaggttacagagatccctgtgtgctatagaaagctgcaccacctccaagtgataattctggacaacaaccccttgcaggtgccccctgcgcagatctgcttgaaaggaaaggtgcacatcttcaaatatttgaacatccaggcgtgttgtagaatggataagaagccagactccctggatctaccaagcctgtcaaaacgcatgccttcccagccccttacagacagtatggaagacttttatccgaacaagaaccatggtcctgacagcggcattggctccgacaacggcgaaaagagactcagtaccacagagccaagcgatgatgacacagttagcctgcacagtcaggttagtgaaagtaaccgcgagcagacgtcccggaacgacagccacattataggttcaaaaacagatagccagaaagaccaagaggtgtacgatttcgtcgacccaaatactgaagatgtggccgtgcccgaacaggggaacgctcacataggttcctttgtttcttttttcaagggtaaggagaagtgtagtgagaagtcgagaaagaatgaagaattgggcgatgaaaaacggttggaaaaggagcagttgttagcggaggaggaagatgacgatctgaaagaggttaccgacctcagaaagatcgctgcccaactgttgcagcaagagcaaaagaataggattttaaatcacagcacctccgtcatgcggaataaaccaaaacagactgtggagtgcgaaaaatccgtgtctgccgacgaagttaatagcccactgagccctctgacctggcagcctctcgagaaccaaaaagaccagatcgacgagcaaccctggcccgagagccaccccataatctggcaatctgaggaacgaagacgctccaagcagatcagaaaggagtatttcaagtacaaatctatgcggaaatcctctagcggcaatgagaacgacgaacaagattccgataatgctaatatgtccacccagtctccagtgagtagtgaggagtatgatcgaaccgatggcttctctcattcacctttcggactcaagccccgatctgccttctcgagaagtagcaggcaggagtacggcgctgccgatcccggattcaccatgaggaggaaaatggaacacctgcgggaggaaagggaacagatacgacagttgagaaataatttggagtcccgactcaaagtgatcctacctgatgacataggcgcagctctcatggatggcgttgttttgtgtcacttagctaaccacatccgccctcgctcggtggcatccatccacgtcccatctcctgcggtacctaagttgagcatggccaagtgtaggagaaatgtggaaaatttccttgatgcatgcaagaagctgggggtttcccaggaacgtctgtgtcttcctcaccacattctggaggaaagaggtctcgtgaaagtgggagtgacagtgcaagcccttctggaacttcccaccaccaaggcttcccagctgtcagtggcgtag

SEQ ID NO: 57269 - DNA, 735 bp, Artificial Sequence
  Description of Artificial Sequence: Synthetic coding sequence
ggcctgttttcattaccaggcacatggcggcgtgtgcgcgaggaggcagtgactgtcggcgagtctcatcctatcatttggcagagcgaagagcgcaggcgcagcaaacagatcagaaaggaatacttcaagtataaatccatgcggaaaagctcttccgggaacgagaacgacgagcaagacagcgataacgctaatatgagtacacagtctcctgtttctagtgaggaatacgatagaaccgacggtttttcccattcacccttcggcctgaagcctcggagcgcttttagccgcagctcgagacaggagtacggagcagccgatcccggatttactatgcggcgaaaaatggaacatctgcgggaagaaagggagcagatccgacagctgcggaacaacctggagtccaggttaaaagttatcctccccgacgacatcggagcagctttaatggatggcgtggtgctatgccacttagccaaccatatccgcccacgatccgtagcctccatccacgtgccttcccccgcagtgccaaaactaagtatggccaagtgccggaggaacgtcgaaaactttctcgacgcttgtaagaagttgggcgtgtctcaggaaagattatgcttacctcatcacattctcgaggaaaggggactcgtgaaggtcggggtgacagtgcaggcactgctggaactccccacgacaaaagcatcccaactgagtgtagcatag

SEQ ID NO: 57270 - DNA, 2247 bp, Artificial Sequence
  Description of Artificial Sequence: Synthetic coding sequence
atggctgcctctcagggcggtggcggaaattccgggggtggtggatgcggcggtgggggatccagcggcggttgcggtactgcagggggagggggaggtggagccggtgggggaggtggtggtgggggaggcacgctggtggtgcctattcctgtgcccactctgtttggccaaccattccctaacggcccaccatggaatcctggtagcttacagcctcagcacacagtccgaagcctcgacagagccttagaagaagcaggttcttcaggaatcctttcgttatccggacgaaagctcagggactttccaggcagcgggtatgacctgacagatacaacgcaagctgacctgtcccggaatcgattcaccgaaataccttcggacgtgtggctttttgccccattagagacattaaacctgtaccacaactgtatcaaaaccatcccggaggccattaagaacctgcaaatgctaacatacctgaacatcagtcgcaatctgctgagtacattgcccaagtacctgttcgatctccctctcaaggttctagttgtcagcaataataagctggtgtctattcccgaggagatcggaaagctgaaggatttaatggagcttgacatcagttgcaacgaaatccaggtgctcccccaacagatggggaagcttcatagtctacgggagctgaacatacgtaggaacaacctccacgtccttccagatgagcttggtgacctgcctctggtgaaactggacttctcatgcaataaagtgactgaaatccctgtttgttatcggaaacttcaccatctccaggtgatcatcctggacaataatccgctccaggtcccacctgcacagatctgtttaaaggggaaggtgcatatatttaaatacctgaatatccaggcctgctgtcgaatggacaaaaaacctgacagtctggacctgcctagcctttctaaacgaatgccctcccaaccacttactgactcgatggaggacttttaccctaacaagaaccatggcccagatagtgggatcggcagcgacaacggagaaaaaaggctgtcgactaccgagccgagtgacgacgataccgtgtccctccattcccaggttagcgagtcaaatagggaacaaacgtcacggaatgattcccacatcattggcagcaagacagacagccagaaggatcaggaggtttacgattttgtggatcctaatactgaggacgttgccgtccccgaacagggcaatgctcacatagggtcctttgttagcttttttaagggaaaagagaaatgtagtgaaaagtctagaaagaacgaggaacttggcgatgaaaagcgcctggagaaggagcagcttttggctgaggaggaggacgatgatctcaaagaggtcaccgatttgcggaagattgcggcacaactgctgcagcaagaacaaaaaaaccgcattttaaaccactccaccagtgtgatgcgcaataaaccaaaacagaccgttgagtgtgagaagtccgtctcggccgacgaggttaatagccccttgtcccctctgacctggcaaccgctcgagaatcagaaggatcagatcgatgaacaaccgtggccagagtctcaccctataatttggcagtctgaagagcggaggcggagtaagcagattaggaaggaatactttaagtacaagtctatgcgaaagtcatcatctgggaatgagaatgacgaagagtatgatagaaccgatggcttttcccattctccgtttggtctgaaacccaggtctgcctttagccggtcttctagacaagaatatggggctgccgatccaggttttaccatgcgcagaaaaatggagcaccttagggaagaacgcgagcagattcgacagcttcgtaacaacctcgagtctcggctgaaggtaatcctaccggacgatataggagctgctttgatggatggggtcgtgctctgccacttggccaaccacattcggccaagaagtgtggctagtattcacgtgccctcccctgctgttccaaagctctcaatggctaagtgccgaagaaacgtagaaaattttctggacgcgtgcaaaaaactcggggtttcccaggaacggctgtgtttgccccatcatattctggaagaacgcggactcgttaaagtgggcgtgaccgttcaggccttgcttgaactgccaacaactaaggcgagccagttgagcgtggcgtag

SEQ ID NO: 57271 - DNA, 2247 bp, Artificial Sequence
  Description of Artificial Sequence: Synthetic coding sequence
atggcagcgtcccagggaggagggggtaatagtggcggtggtggatgtgggggaggaggcagttccgggggatgcgggaccgcaggcggaggcggagggggtgcgggtggagggggtggcggaggagggggaactctggtggttccgattcccgtgcccaccttattcgggcaaccctttcctaatgggccaccatggaaccctggttccctccagcctcagcatacggtccgctcacttgacagggcactggaagaggctggctcgtccggcatcctatctctaagcggccgtaaactgcgggacttccccggtagcggatacgacctcaccgatactacgcaagcagatcttagtagaaaccggtttaccgagattccaagcgatgtatggctattcgcaccactggaaacactgaatctgtatcacaactgcatcaaaactatccccgaggctattaagaatctgcagatgcttacttacctgaacattagccgtaacttgctgagtacgctgcctaagtacctgttcgatctgcctttgaaagtactggttgtcagtaataacaagcttgtgagcattcccgaggaaattggaaagttgaaagacctgatggagttggacatcagttgtaatgaaattcaggtgctgcctcagcagatggggaaactgcattcgttgcgcgagctgaacattcgcaggaataacctccatgtgctgcctgatgaattgggcgatctgcccttggtgaagctcgatttcagctgcaataaggtgactgaaatccctgtgtgctaccggaagctccaccacctgcaggttataattctggacaacaacccactgcaggtgccgcctgcacagatatgcctcaaagggaaagtgcatatcttcaaatacctgaacatccaggcctgctgcaggatggacaaaaaacctgactccctcgacctgccttcccttagtaaaaggatgccttctcagccactcaccgattccatggaggacttttatccaaacaagaaccacggtccagatagcggcattggcagtgataacggagagaaacgtctatccacaactgaacctagtgatgatgatacagtgagtctgcatagccaggtgtcggaaagcaatagagagcagactagcaggaatgattcgcatattatcggttccaaaactgactcacagaaagaccaggaggtgtatgacttcgtcgacccaaataccgaggatgtagctgtcccagagcagggcaatgctcacatcgggtcattcgtctcattttttaaaggcaaagagaaatgctccgaaaagtcaaggaagaacgaggagctcggggacgaaaaacggctggagaaagagcagcttctcgcggaagaagaggacgacgacttaaaggaagtgaccgacctcaggaaaatcgcagctcagctgctgcagcaggagcaaaagaatcgaattctgaaccatagcacttcagttatgaggaataaacccaagcagaccgtcgaatgcgagaagagtgtctctgctgacgaagtgaatagcccactgtcccccctcacatggcaacccttagagaatcagaaagatcagatagacgagcagccctggcctgagtctcacccaattatttggcaatctgaggagagaaggcggagcaagcaaatcaggaaggagtacttcaagtataaatctatgcgtaagtccagtagcgggaacgaaaacgacgaggaatacgatcgcacggacggatttagccatagcccatttggcctgaagcccaggtccgcgttctctagaagttctcggcaggagtacggggctgccgatcctggcttcaccatgagacgaaagatggaacacctccgggaggagagggaacaaataaggcagttgcggaataatctcgagtcccgccttaaagtgatactgccagatgatatcggagcagcccttatggatggggtggtgctgtgccacttagcaaaccatatccgcccacggtccgtagcatcaatacacgtcccttcccccgctgttcctaaactgtccatggccaagtgtcgtcggaatgtcgagaacttcctcgacgcctgcaagaagctcggagtttctcaagagcgcctttgccttccccaccatattctggaggaaagagggctagtaaaggtaggggtcaccgttcaagctctgctggaattaccaacgacaaaggcttctcaactgtctgtggcctag

SEQ ID NO: 57272 - DNA, 351 bp, Artificial Sequence
  Description of Artificial Sequence: Synthetic coding sequence
atgacccagctcaaggaactggatatatctaataatgctatacgcgagatcccaaggaatatcggtgagttacgcaatctggtctccttgcacgcgtacaataatcagatctcatatctgcctccctcacttctatccctcaatgacctccaacagctgaatctgtccggtaataacttgaccgccctgccatctgctatctacaacatattttctcttaaagaaattaatttcgacgacaatcctctcctgcgccctccagtcgagatctgtaagggtaaacagctgtatacaatcgcccgatatctccagagggcagacgagagggatggcttgcaattgcactcctag

SEQ ID NO: 57273 - DNA, 2583 bp, Artificial Sequence
  Description of Artificial Sequence: Synthetic coding sequence
atgagtgagaaagagggaatgtcggaggttctagaggatactatcagccaattccggaaggaatcgcgaagccagtctatgaaggagcccggttttataaaggagacctccaacctgataaacgaagcctcggactaccttgaaggcaaatccagcaaccaaatttatgagactcacccacgccagaacacattagaatccacgtctagcagtgggaggaagtcgaagaggaacgaggaacagaagaagaatctacagttctccgagacctctacccgcaccggtacatcacagagcctatcatcactcacaggcaggactgcagaataccaagccctcgtgaacttcctttcccacgaaactgtaggggaagtgtcgccccaggtctccgaggagaaccagaagcaactgggcctcggtgcagataacttcaccgtgaacttggaagccaaaggcttgcaggagtttcctaaggacatcctaaaaataaagtacgtgaaatacctgtatctggacaagaatcagataaagaccttccagggcgctgactctggagacttactaggcctggagattttgtcactccaggagaacggattgagttcccttccctcagagattcagctgctgcataacctgcggatactgaatgtttcccataatcacatctcgcacattcccaaggagatcagtcagctgggcaacatcaggcagcttttcttctacaacaactatatcgagaactttccctcagatctagaatgcctgggaaatcttgagatcctgagcctcggaaagaataagcttcggcatatccccgatacccttccatccctgaagaccctgcgtgtgcttaatctggaatacaatcagcttaccaccttccctaaagctctgtgttttctcccaaaactgatttccctagatctaaccggcaatttaattagtagcttgcccaaggaaatccgtgagctaaaaaatttggagacgttacttatggaccataacaaactcaccttcctagcagtggaaattttccagctgctcaaaatcaaagagctgcagcttgctgataacaaactggaagtcataagtcacaagatcgagaatttcagagagttgaggatactgatcctggataagaatctgttaaagaatattccggagaaaatcagctgttgcgcaatgcttgagtgtcttagtctctccgacaacaagttgacagagctgcctaagtatatacacaagctaaacaatctgaggaaacttcacgtgaacagaaacaatatggttaaaataactgactgcatcagccatttgaataacatctgctcacttgaattcagcgggaatatcatcacagacgtacctatcgaaataaagaactgccagaagatcattaagatcgagctctcatataacaagattatgtattttcctttaggtctgtgtgctctggatagcctctattatctatctgtgaacggtaactatatctccgagatccccgttgatataagcttttccaagcagctccttcacctggagctctcagagaataaactccttatcttcagcgaacacttttgttctctcattaaccttaagtatctcgatctgggcaaaaaccagatcaagaaaatccccgcaagtattagcaatatgatttctctccatgtgctaattctctgttgcaataagtttgagacgttccccagagagctgtgcactttggagaatcttcaggtactcgacttgagcgaaaatcagctacagaaaatctcaagcgacatttgcaatctgaaggggatccaaaagttgaacttttcctcaaaccagtttattcatttccccatcgaactgtgtcagctgcagagtctggaacagcttaacattagccagatcaaagggaggaaactgacacgtttgccaggcgaactcagcaatatgactcagctgaaggaacttgatatcagcaataatgccattcgagagatccccaggaacatcggtgagctcaggaacctggtttcactgcatgcatacaataatcagatcagttacctgccgccaagtcttctttcccttaatgatctgcagcagttgaatctgtctggaaacaatctgaccgctttgccatccgctatttataatatcttttccctgaaggagatcaatttcgatgataatccactgctgcggcctcccgttgaaatttgtaaaggcaaacagctttacactatcgctcgctaccttcaacgcgcagacgagcgggatgagaaaattttggagaagatattcaagatagttgcgaacaacataaccgagaccaatttcgagttcctctgccagaagctcaaccttgctaacagcgagactgacatgcctaccaaaagcacagtgtccttgagcgaacgcgctcatcaggctctcgtgatctggaagacccagtccaataaactcagcctgacagcggcagcgttgcgggaccaattgatcagagccctgacaatgattggcgcatatgagataatggacaagatcaccgccctgaatctgtttacaagggccatcaagttctag

SEQ ID NO: 57274 - DNA, 180 bp, Artificial Sequence
  Description of Artificial Sequence: Synthetic coding sequence
atgagtgaaaaggagggcatgtcagaggtgttagaggatacaatatcccagtttagaaaggagtcccggtcacagagcatgaaagaacccggatttatcaaggagacctctaacctcatcaatgaggcctccgactacctcgagggaaagtcatcaaatcagatctacgagacgcactag

SEQ ID NO: 57275 - DNA, 354 bp, Artificial Sequence
  Description of Artificial Sequence: Synthetic coding sequence
atgactcaacttaaagagctcgacatttctaataatgcaatccgtgagattccgcgtaacattggggaacttcgcaatctggtgagcctccatgcatacaacaaccagatctcttatctgcccccatcgttgctgtctctcaatgatttacaacagttaaacctttcaggtaataacctgaccgcccttccttccgccatctacaatatcttctcactgaaagagattaactttgatgacaatccactgctgaggccccctgtggagatttgcaagggcaagcagttgtatactatcgctagatacctgcagcgggctgacgaaagagatggcaggcttaagattcacacgtag

SEQ ID NO: 57276 - DNA, 2583 bp, Artificial Sequence
  Description of Artificial Sequence: Synthetic coding sequence
atgagtgaaaaggagggcatgtctgaggttctcgaggacaccattagccaatttcgaaaagagtcccggagtcagtccatgaaagagcccggtttcatcaaagaaacaagcaatttgatcaacgaggctagtgattatctggaagggaaatcgtctaaccaaatttatgagacccaccccagacagaacacactggaatccaccagttccagcgggagaaaaagcaaacgaaacgaggagcagaagaaaaatctgcagtttagcgagaccagtaccagaactggtactagccaatccctctcctctctgacgggacggacggccgagtatcaggctctcgtgaattttttgagtcatgagactgttggcgaggtctctccccaggtaagcgaagagaatcagaagcagttgggtctgggagctgacaacttcaccgtcaacttggaggcaaaggggctccaagagttcccaaaagacatcctcaaaataaagtacgttaaatacctgtatttagacaaaaatcagatcaagaccttccagggtgccgattctggggatctcctgggactcgagatactgagtcttcaagagaacggactttccagtctgccatctgagattcagttgttgcataacctgcgcattctcaatgtttcccacaatcacatatctcacattccgaaagagataagtcaacttggaaacattcgacagctgttcttctataataactacatcgaaaatttccctagcgatctggaatgcttgggtaacctggaaatcctgtcattgggaaagaacaaactcaggcacatcccagataccctcccatccctgaagacactgagagtgctcaacttggagtacaaccagctcacaacttttccgaaggctctgtgttttctgccaaaactcatcagtcttgatcttacaggtaacctcataagcagcttgcctaaagagatccgcgagctaaaaaacttggaaaccctcttaatggaccataacaagctcactttcttggctgtggagatctttcagctgctcaagatcaaagagttacagcttgcagacaataaactggaggttatcagtcacaagattgaaaacttcagggagcttcgaatactcatcctagacaagaatctgctaaaaaacatcccggaaaaaattagttgttgtgccatgcttgagtgcctgtccctgagtgacaacaagctgaccgagctgccaaagtacatccacaaattgaataacctgagaaagttgcatgtgaacagaaacaatatggtgaaaatcaccgactgcattagccaccttaacaatatctgttccctggaattctctggcaacatcattacagatgttcctatcgagattaaaaactgtcagaagatcatcaagatcgagttgtcttataacaaaatcatgtatttccctctcggcctgtgtgcgctggattccttatactacctgagtgtcaacggaaactacatctcggagattcctgtggatatttcattttcaaaacaacttcttcacctcgagctgtcagagaacaagcttctgatcttctctgagcacttctgcagcctcatcaatcttaagtatctggatctgggaaagaatcagattaagaagatccctgcatcaatttctaacatgatctctctgcatgtactcatactgtgttgcaataagttcgagacattccctagggaattgtgcaccctcgaaaaccttcaagtgctggacctgagcgagaatcaactacagaaaatttcttctgacatatgtaatctgaaagggatccagaagttgaacttttctagcaatcaattcattcatttcccaatcgaactctgccagctgcagagcttggaacagctcaacatctcccagattaaggggagaaagctgacacgcctgcccggagagctctccaatatgacccaactaaaagaacttgatatcagtaataacgcaatcagggaaattcctcgcaatatcggagaactgaggaatttagttagtctgcatgcgtacaacaaccagatctcctacctgccaccaagtctgctcagcctgaacgatctacagcagcttaatctgagcggcaataatctgaccgctctgccatctgcgatctataatatcttctctttgaaggaaatcaattttgacgacaacccactgcttcgcccacctgttgagatttgtaaaggcaagcaactgtatactatagcacgctacctgcaaagagctgacgaacgcgatgagaaaatcctcgaaaagatctttaaaattgttgccaataatatcacagaaacaaactttgaattcctgtgtcagaagctgaatctggctaattctgagacagacatgccaactaaatcaacagtcagcctctccgagagggctcatcaggctctggttatctggaagactcagtccaacaagttgtcactaacagctgcggcactacgagatcagttgatcagagctctgactatgatcggcgcatacgagattatggataaaataaccgccctgaatctgttcacccgggctatcaagttttag

SEQ ID NO: 57277 - DNA, 2478 bp, Artificial Sequence
  Description of Artificial Sequence: Synthetic coding sequence
atggcaacatctgagagggcactgcttcggaccagagccgcttcactgctccgcggtctgggcagatcccgcactggtgcacgctctcttcagttccgggcagaaaaggaaaggcaaccctgctggtctttcccaatgggccagaaaacaaagggttcttctaacatcgcctcctcatacctgctccagcagctaatgcaccggtaccaagaactcgatagtgacggggacgaagatcagggcgaaggagaggccggatcagaggagtctagcgaatcggaaatgttaaacctggaagaagagtttgacggagtgctgcgagaagaagccgttgccaaagccttgcatcacctaggcagatccggaagcggaaccgagcaggtgtacctcaatttgaccctgagcggctgtaaccttattgatgtttccattctatgtggctacgtccacctgcagaaattggatttatcagcaaataagattgaggatctctcctgtgtgtcttgtatgccgtatttactggagcttaatgcttcacaaaataacctgaccacatttttcaatttcaaacccccaaagaacctcaaaaaagccgacttctcccacaatcagatctcagagatatgtgatctaagcgcttatcacgctctaacaaagctcattctggatggcaatgaaatcgaggagatatcagggctggaaatgtgcaacaatctgatccacctcagcctcgccaataataagatcacaacaataaacggcctgaacaagctgcccattaagattctgtgcttatcaaacaaccagatagaaatgatcaccgggctggaggacctgaaagcgctccagaacctcgacttgtcacacaatcagatcagctctcttcaggggctggaaaaccacgacctgctggaggtaatcaacctggaggataataaaatcgcagagctgagagagatcgagtacattaaaaacctgccgattcttcgcgtgttgaacttgctggagaaccccatccaggaaaagtcagaatactggttctttgtcatcttcatgctgcttagactcaccgaattggaccagaagaagataaaagtggaggagaaagtttcagcggtgaataagtacgatccaccccctgaagtggtcgctgcacaggaccacctcacccacgttgtgaacagcgtcatgcagccgcagcgaatcttcgacagcactcttccctcacttgacgctccatacccaatgcttatcttagccggacctgaagcctgtggcaagcgcgaattagctcatagactgtgtcggcaattttccacatatttccgctacggagcttgccatactacaaggccgccatatttcggagagggcgatcgggtcgactaccactttatctcccaggatgtgttcgatgagatggtgaatatgggcaagtttatcttaactttctcttacggcaatcacaagtatggattgaatcgcgatactgttgaaggcattgcccgagacggtttggcttcatgtatacatatggagatcgagggggtccgctcactcaagtactcatattttgagcctcgttacatcctggtcgtgcccatgaataaggagaagtatgaaggttatttgcggaggaagggcctcttctcaagggcagagatcgagtttgccgtttcaagggtcgatctgtatatcaaaattaaccagaactttcctggctattttgatgaagtgattaacgcagacgatctcgacgtggcctaccaaaagctgagccaactgataagggaatatctgggactcaccgaggagcccgcaaaatcactggccactacagccgatgtgaagactagccacctaaagcctgaggctcaccctaccaaatacatctcgagcaacatgggcgactttctccacagtacagacaggaactacctcataaaattttgggccaagttgtcagctaagaaaacccccgctgaacgagattccattcacaggcagcatgaagccgctcgccaggccctgatgggccgtatcagaccagaccacactctgctgtttcaaaggggcccagtgcccgcacctcttacgagcggcctgcattactacacaacattagaagagctgtggaagtcctttgacctgtgtgaagattacttcaaacccccttttgggccatatccggagaagagcggtaaagactctctggtgtcaatgaagtgctccctcttccgcttctgcccctggagcaaagagctcccttttcagccacctgagggatctatatcttcacatttagggtctggagcatctgactcagagacggaagaaactcgaaaggctttaccaatacagtcgttttctcacgaaaaagagagccaccaacatagacagcacagtgtgcccgtaatctctagacctgggtccaacgtaaagcccaccctgccccctatcccgcagggtagaagatag

SEQ ID NO: 57278 - DNA, 3933 bp, Artificial Sequence
  Description of Artificial Sequence: Synthetic coding sequence
atggatgatgatgatgccaagctaaaagctgagattgaggccgagctggataagctctcaatcagttctcttgaaaaagaggacatagaatctgatgcaaagtccgagacccaaagcgacgacagtgatacggattctgtggagctgccagagagtgttctccattgtattaatattatcaagaatagatctaaagccgtggaggagcttattcttcaagacctggaagacactgacatcctatcctgttcctacggggctgtctcaaataaccatatgcacctgcgaaccggcctcagcacagagtacgaagagtcctctgaacagctcattaagatcctgagtgaaattgaaaaggaagagtttatgagatcaaaaacagattgtgcgacacccgacttcgttccggagccttcaccacacgatctgcctatggatgaacatgttcttcctgatgatgctgatatcaacttcggatattgtgaagtggaagagaagtgccggcagtccttcgaagcatggcaagaaaaacaaaaggagctggaagacaaggaaaagcaaacactcaaggcccagagggacagggaagaaaagcagttccaggaggaggaagagaagcgccactgctggatgaagcagtttaaagtagagaagaagaaactagagaatattcagaaggagtacatacgcaaccttcacctgcagatggaagaggaaaggacgcgttttaaagatcagcaagagaaggaaaaaaattccctcttgaagcagcagaataatgcagctgtgaaaatccaagcaaagtataaggcgtttgtggcttaccagaaatacgggcctatcatcaaggagcaaattgagagcaaaaaacgaaaggcgcaggagtggaaggaaaaagaggcaaaaatccggcagaaagaggaagagaatcgcaagcgtctggaagaggaacagaggatcaaagaggaaagaaagaagcagaaggaggaagagcggaaaaggagagaaaaagagtacgaggagaagaagaacatcgtgaagcaggaaagagagcaactgatctcgaaggaaaaaatcatccttcgggaggacgcatcacagcagctcatcattagtagtgcgctcaagaaatctggctataataacaagcacctttctttggaagacatttccaatgacaagggggacatagctaaaaacttagtcgatgagaacagcaagaagcaggaggacgtgttgttatggttggtcgaagaatcaaatatgaaagaaaacgtcgatcgacaaacaatcctcaaggagagcattcaggtgaagcttaaggaatcaatatcttcccaaactatcttggccgattttaaaatggaagagaagaatgagaatctggccaagaagagatgttccgaggagctagttaagcaagagcggaaatacgaaaataccgataataaaacagagctcgggaactcagacctcaaggggaacttaaaggagcagttcccattgcaggagctgaaatccgatgcacagaaggaagagaaaatcatgaaacatgtgattaatgagaacactggtcaaaagacgcagatcatcttggggcataaccaggagatttccgaggtgaaaacaaacgaagagcagaaaatcataaaagacaaccagcagaagaagatccagaaagtggagaaggaggagatccaagagcagaacggcctcctatacaaggataaagacacactggtgatctcagtgaagcagcggtccctctccctaacaagcgagaactcaaaagatgtgcgggaaaacgtcatcctgcaggagaaggaaatctacagtaagtcgaaagagatagaggagaatcctaaagataatgcatggaatagtggaatagtgattttcaataccacggatacgatgatcaatattgagggtaaaaggaatgatcaggactatgtgctgggcagacatgcaccttgtgagggattgagcaattacaacgccgagtccagtatggtgagcaaagaggtgaattccctaaaatccgagatccggaacatttccgagaaatgccatgagaatgccccagagcccgacagcatgacatgctgcgtatccgagtcaactctcctgtattctattgaagaacgcagactcgcgtggattaagagtttcaaaccctggctggaaatttttaagcagaaccagcagaaaaagattgtccgacgcaagaggcccgtgaagtgcccagcaaatatgactccagctctggacaaactggaaatcctgcgctgtgggccttgggataccctacagcaagtgaccacagtcacattccaagaccttccaggctgtgtgctcagcaccttggctgagtgtactaacctccaattcctgagcctgcgtcgctgcggccttacgtcactgcactccctgtcgaattgcaaaaagttgaaatacatcgacgcacaggagaatcacatcgaagccatcgagtgtgagaatctggagaacctgtgtgttgtgctgctcaataaaaaccaactgaccagtctgcacggactggatggttgcaccaacatacagtgcttggagctctcttataataagataacccgcattggttactctttcttcctggaggagaaactcgtagacaacgctggattttgtcatcacttgggaacatccacaagctacctttctctcgcccaggtatggattcccactggtctttgttggtcttggatccctatcacatcccttaccaaaaactctgactgcaactttctcatctctcacttgtattggaactgcggactcgaaagtctgaaaaacctgcaacagctaattcttgatcacaaccagctgatcaatactaaggggctgtgcgacactcccacaatagtctacctggactgtagccataatcatttgacagacgttgagggtgtggaaaattgtggtctgctccagatccttaaactccaggggaattatttgtcagagctcccctccctagagaacctagtgctccttcgagaactacacttggatgataatagtattagtactgtggaggccttctccagttattggcttcctctgctccagaacatcacaatctcccagaattccctcacaaagattgtgcccctgtttcattttgtgagtctggagaagctcgacgtctcccataactgtctgagcgatctgaaaagcgccattaagtggtttgacgcttgctacagcctacatgaactgagccttaccggcaaccctttgctacaggaaaccaattggagagactcgttgctaaaggtcctcccagccctgcgaatcctgaacggcaatattcttaactctaatagcgagtccaggaccgaagaacacaaccagcttggcagcgctggtttcctggctctgtgtcagagccagatcagggaattcaacctgctcattgagaactacatcacaggcaagggagacgtatttacactggacactgctgagaacctctgtcactatttcaagaagctcatgattctcagcaccgagtaccggcatgcccacgagaggggggacgtgaccattacaaagaaggacgaaagtgaagctcaaaagaaccacctggctcccaccaactccgacagcactctgcaaaacggcgtgttttactcctgtgctagagagggagagccagattcacctgatattccggaaaaatggatggacagcgtgtcctcccattccccattaagtaaaagcgctacctgcgagaatatggagggacgtcatcaggagatacttgtctgtcagaaaagggaggattctaaggcttccagcatacccacaatccggattccttttaaagaagtggttatgactaactctctcttaagaaatcaccagaacattgaaccaagtgagaaatag

SEQ ID NO: 57279 - DNA, 495 bp, Artificial Sequence
  Description of Artificial Sequence: Synthetic coding sequence
atggacgatgatgacgcgaagctgaaagccgagattgaagccgaacttgacaagctgtctatcagtagcctggaaaaggaagacatcgagtcggatgcgaaaagtgaaacgcaatcggatgatagtgacaccgactccgtggaacttccggagtcggtgctacactgcatcaatatcattaaaaatagaagtaaagctgttgaggagctgatcctgcaggatctagaagataccgatattttgtcctgctcctacggcgcagtatcgaacaatcacatgcatctgcggacaggattatcgacagagtacgaagaatcctcagagcagttaattaagatcttgtccgagattgagaaggaagagtttatgcggagtaaaactgattgtgccactcctgactttgtgcccgagccttcgcctcatgatttgcccatggatgaacatgtactgccggacgatgcagatatcaactttggctactgcgaggtcgagtag

SEQ ID NO: 57280 - DNA, 5168 bp, Artificial Sequence
  Description of Artificial Sequence: Synthetic coding sequence
atggacgacgacgacgcaaagctgaaagccgaaattgaggccgagctggacaagctgtcaatttcgagcctggaaaaggaagacatcgagagcgacgctaaatccgaaactcaatctgatgatagtgacacagactcagttgagcttcctgaatccgtactacactgtatcaacattattaaaaaccgatcgaaagccgtggaggagcttatcctgcaagatctggaagatactgatatcctaagttgctcctatggcgcagtgtccaacaatcatatgcacctccgtaccggcctgtccacagagtacgaggagagctctgagcagctgatcaagatcctttcggagattgaaaaagaggaattcatgcgaagtaagacagattgtgccaccccagattttgtgcctgagccttcaccacacgatctcccgatggacgaacacgtcttacctgatgacgccgacattaactttggctattgtgaggtggaggaaaaatgtcgacagagtttcgaggcttggcaggagaagcagaaggagttggaagataaggaaaaacagaccctaaaagctcagagggatagagaggaaaaacagttccaggaggaggaagaaaagcgtcactgttggatgaaacaattcaaggttgagaaaaagaagctggaaaatattcagaagcaagaacaggataagatgaacgacgagctctacaaagaagagaaaatctggaaggaaaagtttaagcaacacgaggaatatatcaggaaccttcatcttcaaatggaggaggagaggactcgattcaaggatcagcaggagaaggagaaaaactcccttctcaagcagcagaacaacgctgctgtcaagatccaagccaagtataaggccttcgtagcctaccagaaatatggaccaatcatcaaagagcagatcgagtccaaaaaaagaaaggctcaagaatggaaagaaaaagaggccaagattcggcaaaaagaggaggagaataggaagcgccttgaagaagagcagagaatcaaagaagagcggaaaaagcaaaaggaggaggagcgtaagagaagggagaaagagtatgaagaaaagaagaatatcgtgaagcaggagagggagcagctaataagcaaggagaaaatcatactgagagaggatgcctctcaacagttgatcatcagctctgcattaaagaaatccggctacaacaataagcacctctctttggaggacatttccaatgataagggcgacattgcaaagaacttggtggatgaaaactctaaaaaacaggaagatgtgctactgtggctggtggaggaatcaaacatgaaggagaacgtcgaccggcagacaatcctcaaagagagcattcaggtgaagttgaaggagtctatttcatcccagaccatcctcgctgattttaaaatggaggagaagaacgaaaatctcgcaaagaagcgttgcagcgaggaactcgtgaaacaggaaaggaagtatgaaaacacagacaacaaaactgagcttggaaactctgacctcaaaggaaacctaaaggaacaattccctcttcaggagctcaaaagtgatgcccagaaagaagagaagattatgaagcacgtgattaacgagaacaccggtcagaagacccaaatcattctcgggcataaccaggagatatcggaggtcaagaccaacgaagagcagaaaatcatcaaggataaccagcagaagaaaattcagaaagtcgagaaagaggagattcaggagcagaacggtcttctgtacaaggacaaggacacactggtgatctctgtcaaacaacgttcactcagcctgactagtgaaaactccaaggacgtgcgtgagaacgtgattctgcaagagaaagagatctacagcaagagcaaagagatagaggagaatccgaaagacaatgcttggaacagtggaatcgtgatttttaatacaacggatacaatgattaacattgaggggaagaggaatgatcaagattacgtgcttggcaggcacgccccttgcgagggactgtccaattacaacgccgagtcttccatggtaagcaaagaggtgaatagcctgaagtctgagatccggaatatttccgagaagtgtcacgaaaatgctcctgagcccgattctatgacctgctgtgtatctgagagcactctgctctactccattgaggagaggcgcctggcatggatcaaatcatttaagccgtggctggagatcttcaaacagaaccagcagaaaaagattgtgaggaggaagcgccctgttaagtgtcccgcaaacatgaccccagccctggacaagctggaaattctccggtgtggcccatgggacacattacaacaggtgacaaccgtaacgttccaagatcttccaggatgtgttctgagcacacttgctgagtgcaccaacctccaattcttgtccctacgcaggtgcggattaacgtctttgcacagcctgtctaactgtaagaagctcaaatatattgatgcccaggagaaccatatcgaggctatcgagtgtgagaacctggaaaatttgtgcgtggtactgctgaataagaaccaacttacatcactccacggcctagacggatgcaccaacatacagtgtctggagttgtcatacaacaaaattacaaggattgggtacagcttcttcctggaagagaaactggtcgataatgccggtttctgtcaccacttggggacctcaacctcctatctttctctggcacaggtttggattcctaccggcctctgctggagctggataccgattacgtccttgactaagaacagtgattgtaattttctgattagccacctctattggaattgcggcttagaatcactgaaaaatctccaacagctgattctggatcataaccagctgattaacacgaagggcttatgtgatacacctactatcgtgtatctggattgcagtcataatcacctgacagacgtcgagggggtcgaaaattgcggactcctgcagatcctgaaacttcagggtaattacttatcagagttgccaagcctcgaaaacctagtacttttgagagagctccacttggacgacaatagtatctcaacggtcgaggccttcagcagttattggcttccgctcctccagaacatcacaatcagtcagaactccctgacgaaaattgtccctttgttccatttcgtgtccctggagaagttggatgttagtcacaactgcctctcggatctcaagtctgccatcaagtggtttgacgcttgctacagccttcacgagttgtccctcaccggcaaccccctgcttcaggagacaaattggcgagacagcctgctgaaggtgctccccgctctgcggatcctgaacggaaacatcctgaactcaaactcagaaagcaggacagaggaacacaatcagttggggtccgcagggttcctggccctctgtcagtcacagattagagagttcaatctgctgatcgaaaactacattaccgggaagggggatgtctttaccttggatactgctgaaaatctctgccattacttcaagaaactgatgatcctcagcacggagtacaggcacgcccacgaacgtggcgacgtaacgatcacaaagaaggacgaaagcgaagcccagaagaatcatttggcgcctaccaatagtgacagtacactgcagaacggcgtcttttacagttgcgccagggagggcgaacccgacagtcctgatattcccgaaaaatggatggattcggtgtcctctcattcccctctaagtaagagcgctacatgcgagaatatggaaggtagacaccaggaaattctggtgtgccagaagcgcgaggactccaaagcttctagtatcccaacaatcagaataccctttaaagaagtagtgatgacgaacagtctgctgaggaaccatcagaatatagagcctagcgagaagattatggcagctgtcgtgatccagagttattggagagggtacctgatgcgccgtcaaacccatttctcaaccagattgcatactgccgcaactgaaggtctgcccaatagctccatcaagaatcagacaattcttaaaaagggtaaacgtgagaacattgtaaacatccgtaagcagcgggaaaaggctgccatcctgattcaggctgtgtggaagggcttcattttgaggaagaagctgactactgctctcgaagccatcaagaatgaggagtccgatgaagagtatcgggaaatagatttggaagactttatctttgatgaagcagccctcgaggaggaatggttggcccttgattccacacgtttccccagtcaaacactcttactgagtaaccaattacactggcctaaaatcccaggaaacctaaagtgggatgatacatctttcaacctaccgtccaatccagcacaagcgtggctgtgcaacgataaagagaatctcagctccagtgaacacacgcagttcaactctagaagcgaaaacaaaactagctcatggacccccgaaagcaagacctcgcgcaagtcgttgctcaagtctgaaaaagagaagaagatcagcgaggagtggggcttcaaagatatctcaaccgcccaacagatgctgaaacgggctcagaaaatgaaatcaaaaaaactgaagaaaaaaattgactcgaccgtaaggctggcactatttaagaacaacgaaaacaaggtctcccttcccaagtctccaaaaatggtccaaccacgacgggatgggtactttgaagggatcgaagaagatccgatccacaaagacactaccgctaacgagaaacttgaacggaatcgggagtatacctatcaatggctccatactcaggtcggagtgcatgaaacgacctccagtcgaaatatgaaatgtaaccactttctgcccgagctggacccagatgtgctgaacggcggtagggtgcagttggtggcgaggctcgtaagccgagaagataccgacctagacctgtttagcatgactaacggctctgccctgagcgttaatcgtgaaaaaaagaatcaggcacaccgccactcggccggatcctcatccaagctttggttccccagcaaactcatcta

SEQ ID NO: 57281 - DNA, 1875 bp, Artificial Sequence
  Description of Artificial Sequence: Synthetic coding sequence
atgttccacggcaccgtgacagaggagcttacttcacacgaggaatggtcacattacaatgaaaacatcagagaagggcaaaaggacttcgttttcgttaaattcaacgggttgcatctcaagtcaatggaaaatctccagtcttgcatctccctgcgtgtgtgtattttttctaacaattttattactgacatccatcccctgcagagttgcattaaattgatcaagcttgacctgcatgggaaccagattaagtccctgcccaatactaagttctggaatggcctgaaaaatctaaagctactgtatctgcatgataacggattcgccaagctgaagaacatttgtgtgctgtctgcctgtcccacgctaatagctctgacaatgttcgactgtccagtgtccctaaaaaagggctaccgccacgtactcgtgaattccatttggccactcaaagctctggatcatcacgtaatctccgatgaagaaatcatccagaactggcatctacctgagagatttaaggcgtgcaaccatcggctgttttttaatttctgcccagcattaaggaagggaacaacctatgaggaggagatcaataacataaagcacattaccagtaaaattaacgccatattggctcataattctccagttctgatagtccaacggtggatccggggattcctagttcggaaaaatctgtcacccgttttcttccacaagaagaagcagcaggaaaaaataatcagagggtacgaggccaagtggatttatattactaagggctatgaggataagctgctgaaggatctctttttcaaaccagagacaaacataaaaggcaagttggcttactggaaacacaatatttattacccagtagatctgaagaattctagcgagcaccgaaagcacgtcagttcaatcctatgcgaacttaagcccaaagacctggggatgaagagcaaaacatccagacacctcatccaaaagggacaggaaagtgaagatgagatcgttgatgagaagttggacacatcttttaggataagcgtgttcaaactgccgatctacacttcaggctctctaaagaacaatgccgtcctgcgagaaaagaaacagcatttcttcccagcctaccctcaacctatctatactactcacccaaaacccatcatcaaaaaggatatcagactagaacggtcaatgaaggaattctttgcaccacaacgtgccggaatgaagttgcgaactttctctgatatcgataagtattatacagagcagaaaaaacaggagtatcacaaggaaaaagttcgagtggttgccatggcacaggtagcccgagaacgggttcgagtcgccgttaatgagcatctgaaccagaagaagtatgctacccagaagcttatcgaagagaacaaagaaacgatccagaactcactgagacaggtgtggcaaaataggtttaactacctggaaaaggctcgagagcgaaaagccctgttcctgaaggagaagagccagaaggctagtgagcgactgttggttcagaacctgaataatgaaagaacgctcctgaccaggggcttactgaaaatagatcgtttagagaaaaatgaggccgttttgaaggagaagtcactaatcgtcaaacagaagctaaaggcagagaagtatagaaagaacctcttgaaggagatgaagaaggtgaggtcacaggagatttacaaaagacattgcgaagaaaagttcgtgatggacatgatcgcttttgagaaagcgtgcgagaggttgcaggatgcaaagaccaaagtggctatagtgaaaacaaacctggacttcaaagtgcctaatggtctgatcaaatag

SEQ ID NO: 57282 - DNA, 900 bp, Artificial Sequence
  Description of Artificial Sequence: Synthetic coding sequence
atgtttcatggaactgtgacggaagagctgacctcacacgaagaatggagccattataatgagaacatccgagaggggcagaaagacttcgtgttcgtaaagttcaatggcctacatctcaagtccatggagaatctacagtcctgtataagtctgagggtatgtattttcagtaacaacttcattaccgacatccaccccctccagtcgtgcatcaagcttattaaactcgacttgcacggcaaccagatcaagagcttgcccaacaccaagttttggaacgggctgaagaacctgaaactgctgtaccttcacgacaatggttttgctaagttgaaaaacatctgcgttctctctgcttgcccaactttgatcgccctgacaatgttcgactgtccagttagcttgaagaaagggtacaggcacgttctagttaactctatctggcccttgaaagccctggatcatcacgtcatctcagacgaagaaatcatccagaactggcacctgcctgagagatttaaggcctgcaatcacaggcttttcttcaatttctgccctgcactcagaaaggggactacttacgaagaggaaattaacaacattaagcacattacctcaaaaatcaatgccatactggcccacaactcgcctgttcttatcgtgcaacggtggatccgtgggtttctagtcagaaaaaatctctctcccgtgttcttccacaagaagaaacagcaagagaagattattaggggatacgaagcgaagtggatttatattacaaagggctatgaggacaaactcctgaaggacctgttcttcaagccagaaaccaatatcaaggggaagctcgcctactggaaacacgatataaagaagctgtactctaatcatcactag

SEQ ID NO: 57283 - DNA, 1683 bp, Artificial Sequence
  Description of Artificial Sequence: Synthetic coding sequence
atgagcaaagacattaaatccgttgaacatagccctaaaattcatcagcgcaacgatcctcagcatgtgaatgaccgaacatttttcatagacgcgtccaatcaatcactgaccgcaataccactcgaaatatttactttcaccgagctcgaggaagttcacctagaaaacaatcaaattgaagagattcctcaggagatacagcgcttaaagaacatcagggtactataccttgacaagaataaccttcggtccttatgtcccgctcttggactcctttcttctctcgagtctctagacctatcctacaaccccatcttttcttctagtctggtggtggtttctttcctacacgctctgcgcgagctgagactgtatcaaactgatttaaaggagattcctgtagtcatcttcaaaaatctgcaccatctggagctactaggcctgaccggtaaccatctaaagtgtctgccgaaggagatcgttaatcagacaaagcttagggaaatatacctgaaacgaaatcagtttgaagtttttcctcaggaactctgcgtgctgtacacccttgagattatcgatctggacgaaaataaaatcggagccatccctgaggagattggacatcttaccggtttgcagaaattttacatggcctctaacaacctgccagttttgccggcaagcctgtgccaatgttctcaactgtctgttctggacctgtcccacaacttattgcatagcatccccaagtcatttgctgagctaagaaagatgaccgagatcggcctgtccggtaaccgtctggagaaggtccctcgcctgatctgcaggtggacttcgctgcacttactgtacctaggaaatactgggcttcaccggctcagaggctctttccgttgtctagtgaacctgcgttttttagacctttctcagaaccatctccatcattgtcccctgcagatctgcgccctcaaaaacctggaggtgctggggctggacgacaacaaaatcggccagctgccaagcgaattggggtctctctcaaagttaaagatcctcggacttaccggaaacgagttcttaagtttccccgaagaagtcctgtctctcgcgagcctggagaaactctatataggtcaggaccagggctttaagctgacttatgttcctgaacatatacgaaagctacagtcactgaaggagttatacattgagaacaaccatcttgaatatctgcctgttagcctggggtccatgccaaacttggaggttctggattgccgccataacctgctgaagcaactccctgacgctatatgccaggcccaggccctaaaggagctgagacttgaggacaatctcctgacccatctccccgaaaatctggattccctggtgaaccttaaggtgctaactctgatggataaccccatggaagagcctcccaaggaggtatgcgccgaggggaacgaagccatctggaagtacctgaaggagaatagaaatcggaacatcatggcaaccaaaatacaagcatggtggcggggtaccatggtgcagcgaggattcggtaaattcggagagctcctcaaaccgcagaaaaagggcaagacaagtccaaaggacaagaagggaaagaaggatgtgaaggggaaacctggcaaaggaaaaaaaaaatag

SEQ ID NO: 57284 - DNA, 537 bp, Artificial Sequence
  Description of Artificial Sequence: Synthetic coding sequence
atggagcacaaggacgatgacgatgacgacgtgtccttcgccaagtggatgtcttctttttggggccactcctggcgtgaggaggatcagcgcggactgagagagcgacaccggctgcaggcaaccagtcaccggaaaacaagcttgccctgcccccttcccgtcctgcccagaattccaagctctgactgccaccccaggcgacactctcacgaggaccaggagttcaggtgcaggtctcacgtgcgtgattacagaaagtactccgaagacggaagtttcaaagagccattggagtctaaaggacggtcacatagcaaaattgagaagttcagcgaatcctttgagcgacagttatgcttcagaacaaagcgatccgctagcctggggcctgaatcccggaaagagcgcaatgagcgtgagtgccttaggatggaaatcaaatcaaggaagaaagtggaggaagaaaggtcaagtcgaaaggaagagcacggggaagcccacatggcccctctgtttgagaaaggaccggaatag

SEQ ID NO: 57285 - DNA, 1446 bp, Artificial Sequence
  Description of Artificial Sequence: Synthetic coding sequence
atgacacctgcactcacagctttactgtgccttggactaagcctgggcccacgcacaagggtgcaagccggtcccttccctaagcctacattgtgggccgagcccggtagtgtgatttcctggggtagtccagtgactatctggtgccagggcagcctggaagctcaggaataccagttagacaaagagggctcgcccgagccattagacaggaataatcctctggagccgaagaataaggcgaggttcagcataccctctatgactcagcatcacgccggacggtacaggtgtcactattactccagcgctggttggagcgagccatcagatcctctggaactggtgatgactggattctataacaaacctaccctgagtgctctgccctcccctgtggtggctagcggcggaaatatgactctgcggtgcggaagccagaagggctaccatcactttgtgctgatgaaagagggggagcaccagctgccaaggaccctggattcacaacaactgcatagtgggggatttcaggcccttttcccggttggccctgtgacccctagtcatcgatggagatttacctgttactattactacactaatactccacgcgtgtggtcacaccctagcgatccccttgaaatcctccccagcggcgtgtccaggaagcccagtctgctcactttacagggccctgtattagcaccaggacaatccctgacactgcaatgcggcagcgatgtcggctatgatcgcttcgtcctgtacaaagaaggagaaagagatttcctgcagagacctggccagcaacctcaggccggattgtctcaggccaactttaccctggggcctgtcagtcctagtcacggcggacagtataggtgttatggggctcataacctgtcttcggaatggagcgcaccaagtgatcctctcaacattctcatggccggacaaatttacgataccgtctcgttgtctgctcaaccaggccctaccgtagcaagcggcgagaatgttacgctcctgtgccagagccgcggatatttcgacaccttcctgctgacaaaggagggggctgctcaccccccactgagactgcggtctatgtatggggctcacaagtatcaggcagagtttcccatgagtcctgttaccagtgcccatgccggaacataccgatgttacggtagttactcaagcaatccccacctgctgtcatttccatcggagccactcgaactgatggtctcagggcattctggcggttcttccctgccaccgaccgggcctcctagtacacccgctagccacgctaaagattacactgtggagaatctaattcgcatggggatggccggattggtactggtctttttgggaatccttctgttcgaggcccagcatagccaacgcaacccacaggacgcagcaggacgatag

SEQ ID NO: 57286 - DNA, 1395 bp, Artificial Sequence
  Description of Artificial Sequence: Synthetic coding sequence
atgaccccagcactcaccgcgttgctttgcctgggcttatcactggggcctcggactcgtgttcaagctggaccctttcccaagcctaccctgtgggccgagcctggatcggtgatctcgtggggaagtccagttaccatatggtgtcaaggctcacttgaggcacaggagtatcagctggacaaggaaggctctcccgagcctttagacagaaacaatcctctggagccaaaaaataaagctcggtttagcatccccagcatgactcagcaccacgccggaaggtatcgatgtcactattacagtagcgcgggatggtccgagccatccgatcccctcgaacttgtaatgaccggattctacaacaaaccaactctttcagccttgccgagccccgtagtcgccagcggcggaaatatgacgctaaggtgtggcagccagaaggggtatcaccacttcgtccttatgaaggaaggtgagcaccagctgccaaggactctagattcacagcagctccacagcgggggattccaggccctttttcccgtgggacccgtcacaccatcccacaggtggaggtttacctgctattactattacactaacactcctagggtctggtcccatccgtcggacccactggaaatcctccccagtggagtgtcacgaaaaccttccttgctgactttgcaggggcctgttttagccccagggcagtccctgaccctgcagtgcggttctgatgtaggatacgaccgcttcgtgttgtataaggagggcgagagggacttcctgcaacgtcccggtcagcagccacaggctgggctgtctcaggccaatttcaccctggggccagtatccccgtcccatgggggacagtatcgatgctatggggcacacaacctgagttcggagtggagcgccccatccgatccgctgaacatactaatggcaggacagatctacgataccgtatcactcagcgcccagcctggaccaaccgtggcttcaggagaaaatgttactctgctgtgtcagtccagagggtatttcgacacatttcttctgacaaaggaaggcgcagcccacccccctctgagactgcgttcaatgtatggagcacataagtaccaggcagagtttcccatgtctcctgttactagcgcacacgctggcacttaccgttgttatggatcctatagctccaaccctcatcttctttcctttccgagtgagcctctggagttgatggtatccgcctcccatgccaaggattacaccgttgaaaatctcattcggatgggaatggccggtctggtgctggtatttctcggaatcctgctttttgaagcccagcatagccaacgcaatcctcaggatgcagctggtcggtag

SEQ ID NO: 57287 - DNA, 1899 bp, Artificial Sequence
  Description of Artificial Sequence: Synthetic coding sequence
atgacacctgctctgaccgccctgttatgcctgggccttagtctgggtcctcgaacaagagtgcaggcgggaccttttcccaagcctacactttgggccgaacccggatcagtgatctcttggggtagccctgttacaatctggtgtcagggatcactagaggcgcaggagtatcagctcgacaaggaaggctcccccgagccgctggatcgtaataaccctttagagcccaagaataaggcccgattttcgataccctcaatgactcaacaccacgctggcaggtatagatgccactattattcatcagcgggatggtccgaaccgagcgacccactggagctggtgatgaccggcttttacaataagcctacactgtcagcacttcccagtccagtagttgcctccgggggtaatatgactttgcgctgcggaagccagaagggctatcaccacttcgtgctgatgaaggaaggagagcaccagcttccgagaaccctcgatagtcagcagttgcacagcgggggtttccaggccctcttcccagttggtcccgtcactcctagccacaggtggaggtttacctgctattattactacaccaatactccacgggtgtggtcgcaccccagcgacccactggagatccttccaagcggcgtgtcacgaaagccttctctgttaacactgcaggggcctgttcttgctccgggacaatcattgaccttgcaatgtgggagcgatgttgggtacaatagattcgtgttatataaagagggtgaacgggacttcttgcagaggcccggacaacagccccaggctggcctaagccaagcaaactttacactgggcccagtgtctccatcaaacggcggacagtatcgctgctacggggcacacaatctttcctccgagtggagtgcaccctcggatcctctgaacattctgatggccggtcagatttacgataccgtttctttatccgcacagccaggacctaccgtagcatcaggtgagaacgtgacgttactgtgtcagagttggtggcaatttgatacctttctgctgacaaaagagggagctgcccacccacctcttcgtttgcgctcaatgtatggggctcataaatatcaagcagagttccccatgagcccagtgactagcgctcatgctggcacttatagatgctacggttcatacagctcgaatcctcacctcctgtctcatccatccgaacctctagaattagtggtgtcaggacactctggagggagcagtctgcctcccacgggacccccatccactcctggcttaggtagatacctagaagtcctgattggggtttccgtcgcattcgtgctcctgctgttcctgctgttattcctcttgctgaggcgacaacgtcactccaagcatcgcacatcagatcagaggaaaaccgactttcagagaccagctggggcagccgaaacagagcctaaggaccgtggtctcctaagaagatcatcccccgctgctgacgttcaggaagaaaatctttacgcagcagtgaaggatacccagagtgaggacagggtcgagctggactcccagcagtcgccacacgatgaagacccacaggccgtgacatacgcccctgtgaagcacagttccccaaggcgcgagatggcctcccctcccagtagtctcagtggcgagttccttgacaccaaagacagacaggtagaggaggacagacagatggatactgaagccgcagcgagcgaagcctctcaagacgttacgtacgctcagctccactctctcacactcaggagaaaagcaactgagccacctccgtcccaggagggagagccgccagccgagccatcaatatatgctaccttggcaatacactag

SEQ ID NO: 57288 - DNA, 582 bp, Artificial Sequence
  Description of Artificial Sequence: Synthetic coding sequence
atgactcctgcgctgactgccctgctttgtctgggcctatcactgggcccaagaacccgagtgcaagccggaccttttccaaaacctacactgtgggctgagcccggatctgttataagttggggaagcccagtgaccatctggtgtcagggatcacttgaagcccaggagtatcagctggacaaagagggctcccctgagcctctggatagaaataaccctttagagcccaagaataaagctcgattttctattccatcgatgacgcagcatcacgctggtcgttacaggtgtcactactatagtagcgctggttggagcgagccaagtgatccacttgagttggtcatgaccggattctacaataaacctacgctttcagcattgccaagccccgttgttgcgtccggagggaacatgacactgcgctgcgggtcacagaagggctatcaccatttcgtgctaatgaaagagggggagcaccagttgccgcgaaccctagactcccagcaactgcatagcggaggatttcaggcgctgttcccggtcggcccagttacgcctagccacaggcgggtttag

SEQ ID NO: 57289 - DNA, 1899 bp, Artificial Sequence
  Description of Artificial Sequence: Synthetic coding sequence
atgacccctgcactcacggctctgctttgccttgggttgtccctcggacctcgtacacgcgtgcaggccggaccgtttcctaaaccaactctctgggctgaaccaggaagcgtaataagctggggttcgcccgtcaccatctggtgccagggctcgcttgaggcacaggagtaccagctcgacaaggaaggaagtccagagcctttggatagaaacaaccctcttgagccaaagaataaggcccgattttcaatccctagcatgacacagcatcatgcaggcagataccgctgccattactattctagcgcgggatggagtgaaccatccgatccactggagttagtgatgaccggattctacaacaagcccaccctcagtgccctccccagccccgtggtggcttccggcggtaatatgacactgagatgtggatctcagaaaggttatcatcacttcgtgttgatgaaggaaggtgagcatcagctacctagaaccctggattcacagcagttacatagtgggggttttcaggctctcttcccagttggacctgtgacgccatcgcaccggtggcggttcacttgctactattattacacaaatacccctagggtttggagtcatcccagcgaccctttagaaatcctgccgagtggggtctctaggaagccatccctgcttacactgcagggacctgtgctcgcccctgggcagtcgctcacacttcagtgtggttctgacgttggctacgaccgcttcgtgctgtacaaggagggcgagagggactttcttcagcggcctggtcagcagccgcaggcaggcctatcccaggccaactttacactgggccctgtgtctccttcacacggcggacagtatcggtgctatggtgcccataatctttctagcgagtggtccgccccttccgatccacttaatattctgatggccggacagatctatgacactgtgagcctgagcgcacagcctgggccaacagttgcctctggggaaaacgtcactctcctgtgccaatcacgcggttacttcgataccttccttttaacgaaggaaggcgctgcgcatcccccactcaggttacggtccatgtacggggcacataagtaccaggcagaatttcccatgagtccagtaacctccgctcatgccggaacgtataggtgctacgggagctactcttccaacccccatctactttcctttccatccgaacctttggaactcatggtgagcggtcactccggaggaagttcgctgccaccaaccgggcctccatccacgccaggtcttggccgatacctggaagttctgataggtgtgtcagtggctttcgtgttgctgttgtttctgctgttattcctccttctccggaggcaaaggcatagcaagcacagaaccagcgatcaacgcaaaaccgatttccagaggcctgctggggcagctgaaactgagcctaaggacagaggattgctccgacgttcatcccccgcagccgacgttcaggaggagaatctctacgccgctgtgaaggacacccagagtgaggatcgggtcgagctggatagtcagcaaagtccccatgatgaagatccacaggccgtgacatacgctcctgtgaaacattccagcccgaggagggagatggctagccccccttctagcctttccggagagttcctggataccaaagaccgccaggtggaagaagaccgacagatggatactgaggccgctgcttctgaggcttctcaagacgtgacatacgcccaacttcactccctgacattgaggaggaaagctactgagccgcctccctcccaggagggcgagccaccggctgaaccttctatatatgcaaccctggctatccattag

SEQ ID NO: 57290 - DNA, 1368 bp, Artificial Sequence
  Description of Artificial Sequence: Synthetic coding sequence
atgacacccgcacttacagcactcttgtgtctgggcctgtcactggggcctagaactagagtccaggcaggacccttccctaaacccacgctgtgggccgaacctggatcagtaatcagctgggggtcccccgtcaccatatggtgccagggcagccttgaagcccaggagtatcagctcgacaaagaagggagcccggaacccctcgaccggaataatccgttggaaccaaagaacaaagccagattcagcatcccgtcaatgacccaacatcacgccggtcgctacagatgccattactattcaagtgccggatggagcgaaccctctgacccgctggagctcgttatgacaggcttctacaacaagcccaccctctccgccttgcctagccctgtggtagccagcggtggcaatatgaccctgaggtgcggatcccagaaggggtaccatcacttcgtcctgatgaaggagggagagcatcagctgccaagaacactggactctcaacaactacactcgggcggatttcaggccctattccccgtgggcccagtgacaccatcccaccgctggcgcttcacttgctactattactacactaacacgcccagggtttggagccaccccagtgatccacttgagattctgccttccggcgtgagcaggaagccgtcactcctcaccctacagggtcccgtcctcgctcccggacagagtctgacacttcagtgcggttcggatgtaggctatgatcgctttgtgctgtacaaggaaggcgaacgcgatttcctccagaggcctggccagcagccacaggctggactcagtcaggcaaattttacccttggacccgtctcgccaagccatggagggcagtaccgctgttacggggcacacaacctgagtagcgaatggtccgcgccttccgatcccctgaacattttgatggctggacagatctacgacaccgtctccctgagcgcccaacccggacccaccgtggccagtggagagaatgtgacactactgtgccagtcccgtggctattttgatacgtttttgctcactaaggaaggcgcagcgcatcccccactgcgactgcgttccatgtacggtgcccataagtaccaggccgagttcccaatgtcacctgtgacctcagctcacgcaggcacgtacaggtgttatgggagctacagctcaaacccacacctgctgagtttccccagtgagccgctggagctcatggtgtcgggtgagggtgctgatcctgtgctcagcgaacttaagggctccgctcaggcgcaggctccaagacgggctctgggctgggatggcccacgggaggcggtccgtgaggcttag

SEQ ID NO: 57291 - DNA, 1896 bp, Artificial Sequence
  Description of Artificial Sequence: Synthetic coding sequence
atgacgcctgcacttacggccctgctgtgcctgggcttaagcctgggtcccagaacgcgggtacaagccggaccctttcctaaacccactctgtgggcggaacccggatctgttatatcgtggggatcacctgtgacaatctggtgtcaaggctccctagaggctcaggagtaccagctggacaaagagggctcgcccgagccactcgatcggaataatcctttggaacccaagaacaaggctcgtttctccatcccctctatgactcagcatcacgccggacgctaccgatgccactactacagttccgctggatggagcgagccctcagaccccctggagttggtcatgaccggtttctacaataagccaactttgtccgccctgccttcaccagtggtcgcatcagggggaaacatgacgttacggtgcgggagtcaaaagggatatcaccattttgtccttatgaaggagggcgagcaccagctgcccaggaccctggactcccagcagcttcattcgggtggctttcaggccctctttcccgtgggtccggtgacaccctcccacagatggaggttcacctgctattactactataccaatactcctagagtgtggtcgcacccatccgaccctctcgagattctgcccagtggcgtgtccaggaagccctccctgctgacattgcaggggccagtcctcgcaccaggccagagtctgaccctccagtgtggctcagacgtcggctacgataggtttgtcctttataaggaaggtgagcgagacttcctgcaaaggccaggccaacagccacaggctggcctgtcccaagcaaacttcaccctgggccctgtgtccccctcccacgggggacagtatcgctgctacggagcccataatctgagtagcgagtggagcgccccttctgaccccttgaatatcctcatggctgggcagatctatgatactgtctcactttctgcacagccgggaccaactgtggcatccggtgagaacgtgactctcttatgccaatcttggtggcagttcgataccttcttactgacaaaggagggcgctgcccacccccctttgcgccttcggagtatgtacggggcacataagtaccaggccgaattcccaatgtcccctgtcacatccgcacatgctggcacttatagatgctatggtagttattcctccaacccccacctgctctcacaccctagcgagccgcttgaactcgtggtgtctgggcactcaggcggttcttctttgccgcctacgggccctccgagtacacccggactggggaggtatctcgaggtgctcatcggcgtctctgtggccttcgttttactcttgttccttttgctatttttgctattgcgacgacagagacactcaaagcacagaactagcgatcaacggaagacagacttccagagacccgcaggagccgctgaaacagaacccaaggaccggggactcctgcgcagatctagccctgccgcagatgtacaagaggaaaatctctatgctgcggtgaaggacacccagtcggaggatagggttgaattagactcgcagtccccacacgacgaagacccacaagccgtgacatatgcacccgtcaagcacagttctccgagacgggaaatggctagccctccttcatctctcagtggtgagttcctggatacaaaggatagacaggtggaggaagatcgtcagatggacactgaagccgctgcttcagaggcatcccaggacgtgacctacgctcaactacactcattgactctgagaaggaaggctactgagccaccccctagccaggaaggggagcccccagctgaaccgagtatctatgcgacactcgccatccattag

SEQ ID NO: 57292 - DNA, 1083 bp, Artificial Sequence
  Description of Artificial Sequence: Synthetic coding sequence
atgatacccttactgctagctgccctgctttgtgttccggctggggcactgacctgctatggggattctgggcagcccgtcgactggttcgtcgtttataaacttcctgccctcagaggatctggcgaagcagcacagcgaggtctgcaatataaatacctggatgagtctagtggcggttggcgcgatggtcgtgcattaatcaactctccagaaggcgcagtgggtagatcgctgcagcctctatatagatcgaacacttctcaactggctttcctgctgtacaacgatcagccacctcagccgtcaaaggcacaagacagctcaatgcgaggccatactaagggagtcctcctcctggatcacgacggagggttctggttggtgcacagcgtccccaattttccacccccagcttcgagtgctgcctactcgtggccccattctgcctgtacttatgggcaaaccctcctctgcgtaagcttccctttcgcgcaattcagtaaaatgggcaagcagctgacgtacacatacccgtgggtgtataactaccagctggagggtattttcgctcaggagtttcctgacttagagaatgtggtcaagggccaccacgtaagccaggaaccatggaattcaagcattaccttaacctctcaggcgggtgcagtgttccagagcttcgcgaagttttctaagttcggagatgacttatactccgggtggctcgcagcagccttgggaactaacctgcaagttcaattttggcacaagaccgtcggaatcttacctagcaattgttccgacatatggcaggttcttaacgtcaatcagatcgcttttcctggaccagccggacccagcttcaactccaccgaggatcattcaaagtggtgcgtttcaccaaagggcccttggacctgcgtcggggacatgaacagaaatcagggcgaggagcaaagaggtggaggcaccctgtgcgcccagctgccggctctgtggaaggcttttcaacccttggtgaagaattaccaaccctgcaatgggatggctcgcaagccctctcgtgcctataaaatctag

SEQ ID NO: 57293 - DNA, 2346 bp, Artificial Sequence
  Description of Artificial Sequence: Synthetic coding sequence
atggctgctaacgtgggtgatcagagatctaccgactggtcgtcgcagtactcaatggtagctggtgcgggaagagagaacgggatggagacacccatgcacgagaatccagagtgggaaaaagccagacaggcacttgcttcgattagtaagtccggcgcagcaggaggttctgctaagtcttcatccaatgggcctgtggctagtgcacagtacgtaagccaggcagaggcctctgcactccagcagcaacagtattaccagtggtaccagcagtacaactacgcttatccttactcatactactatcctatgcctcctgtgcccggaatggacgagtccatgtcttatcaggccccaccccaacagctgccaagcgcccagccgccacaaccttctaatccaccccatggggctcacacacttaactccgggcctcagccaggtacagctccggctacacagcactcgcaggccggacctgctacaggacaggcttatggaccacacacatacactgagcctgctaaaccaaaaaaaggccagcaactgtggaaccgcatgaaacctgcccctgggacgggaggactgaagttcaacattcagaagagaccttttgccgtgactacgcagtcatttggaagtaacgctgagggccagcattccggctttggccctcagccaaacccagaaaaagtgcaaaatcattctggatcaagcgccaggggaaatctgagtggcaaacccgatgactggccgcaggacatgaaggagtatgtcgagcggtgcttcacagcatgcgagtcagaggaggataaggaccgtacggagaagctgctgaaggaggtcctccaggctcggctgcaggatgggtctgcatacaccatagactggagtagggagccgctgcccggactgacaagggagcccgtcgcggaaagccccaagaagaagcgatgggaagctgcaagtagcttgcatcctccgaggggggctggatctgccactcggggagggggtgcgccaagtcagaggggaacacctggagcaggaggagccggacgcgcacgcggtaattccttcaccaaatttggaaatcgcaacgtttttatgaaagacaacagctcctcgtcctctactgactcaagatcacggagttcctctcgctcccccacacggcactttaggcgctcggatagtcacagcgattcagattcctcttactctggcaacgagtgccaccctgtggggaggcgcaatccaccccctaagggtcggggaggaagaggcgctcacatggacaggggacgcggacgagctcagagagggaagaggcacgatttagctcctacgaaacggtcgaggaaaaaaatggcggctctcgagtgtgaggaccctgagcgagagttaaaaaaacagaagcgcgctgctagatttcagcacggccatagtcgtagactgcggttggaaccactcgtcctgcagatgagttctctggaatcttctggggctgatccggactggcaagagctccaaattgtggggacatgtcctgacattacaaaacattatttgcgcctgacttgcgccccagacccaagcaccgtgagacccgttgccgtcctgaaaaagtctctgtgtatggtcaaatgccactggaaggaaaaacaggactatgcctttgcctgtgagcagatgaaatctattcggcaggacctgacagtccaggggatccgtactgagttcactgttgaggtgtacgagactcacgccagaattgccctcgagaagggagatcacgaggagtttaatcagtgccagacgcagttaaagtcactgtacgccgaaaatctgccgggtaacgtgggtgaatttactgcataccggatcttgtattatatttttacaaagaactccggcgatatcactaccgagttggcatatcttacacgcgaactgaaggcagacccttgcgtagcacacgctcttgccctgaggacagcctgggcccttggcaactaccacaggttctttcgcctttattgccacgcaccatgcatgtccggctacctagttgacaagtttgcagatcgggagcgaaaggtggctcttaaggctatgatcaagacttacgtcgtccccagctcacttctgcctttgctctttcctagtttccggcttgtcagcagttgtataaagctctctccgtgccctctgctgccattgccacctgtgttcctcctgatctttttctcacctttccccccttctcttagcgccttctttccatggttcagcaccgggaaaactgtacccccatctctgcctccatcatcagccatgtag

SEQ ID NO: 57294 - DNA, 2403 bp, Artificial Sequence
  Description of Artificial Sequence: Synthetic coding sequence
atggcagccaatgtgggcgaccagcggtcaactgattggtccagtcagtattccatggtagcaggggctggcagagagaacggcatggaaacacctatgcatgaaaaccccgagtgggagaaagcacggcaggccctggcaagcattagtaagagcggggctgccggaggcagcgccaagtctagcagcaatggcccagtggcttcagcccagtacgtgagccaagctgaggcgtctgccttacagcaacagcagtattaccaatggtatcagcagtacaattatgcatacccgtattcctattattatccgatgtctatgtatcaatcatacggcagtccgtcacaatatggtatggccggttcttatgggtcagccactcctcaacaaccctctgctccgcagcaccaggggaccttaaaccagccaccagtacccggtatggacgagagtatgtcctaccaggcccctccacagcagctgccctctgcccagcccccacagccaagcaatccacctcatggagcacacacacttaactccggaccacaacctggcacagccccagccactcagcattcacaggccggtcctgccaccgggcaagcttatggtccacatacttacaccgagcctgcgaagcccaaaaaggggcaacaactgtggaatagaatgaaacccgcacctggaaccggtggactgaaattcaatattcagaagcgcccattcgctgtcactactcaatccttcggttctaatgctgaaggccaacactctggctttggcccacaacctaaccctgagaaggtgcagaaccacagtggatcatccgccagaggcaatctgagcggaaaacccgatgattggcctcaggacatgaaggaatatgtggaacgctgcttcacagcatgcgagtccgaggaggacaaggatcgtactgaaaagctcctcaaggaggtgctccaggcgaggctacaggatggttccgcctatacgatagattggagccgggaaccactgcctggcctcactcgcgagcctgtcgccgagtccccgaaaaagaagaggtgggaggccgcaagtagtctccaccccccacggggagcagggtcagcaacacggggaggcggagctccctcacaacgcggtacacccggtgccggaggcgcaggtagagccaggggtaacagcttcaccaagttcggtaatagaaacgtattcatgaaggataattcaagcagtagctctacagacagtcggtccaggtctagttcgcgcagtcctacccgacatttcagacggtccgactctcattcagacagcgattcctcttactctggaaacgaatgccaccctgtggggagaaggaacccacccccaaaggggagaggaggacgaggggcacacatggatcggggacggggaagagcacaaagaggtaaaagacatgatttagcaccaacgaagcgtagtaggaaaaagatggctgccctggagtgtgaggaccccgagagggaactcaaaaagcagaaacgagcagcaaggttccagcatggacactctcggagactgaggctcgagccactcgtgctacagatgagcagtcttgagagctcaggagccgaccctgactggcaagagctacagattgtaggcacatgcccagacatcaccaagcactacctccgcttaacttgcgcgccagacccctccactgtgagacccgtcgccgtgctcaaaaaaagcctgtgcatggttaagtgccattggaaggagaagcaagactatgcttttgcctgtgagcagatgaagtccatcaggcaggacctgaccgttcagggcattcgcaccgagtttacggtcgaggtgtacgaaacacacgcgaggatcgccttagagaagggagatcacgaagaattcaaccagtgtcagacccagctgaagagcctctatgccgagaacctgccagggaacgtgggggagtttaccgcctaccgcatcctttattacatttttacaaaaaactctggtgacatcactacagagctcgcttatctcacccgagaactgaaggccgacccttgtgtggcccacgcgcttgcattacgcacagcctgggccctgggcaactatcatcgcttttttcggctttattgccacgcaccatgcatgtctggctatttggtggataaattcgcagaccgggagagaaaggtcgccttgaaggcgatgatcaagaccttccggcctgcactgcccgtctcctacctccaggccgagttggcttttgagggagaagccgcttgccgcgcatttctagaaccgttgggcctggcttacaccggtccagacaactcaagcattgattgtcgtctgagtctggcacaattgtcagccttctag

SEQ ID NO: 57295 - DNA, 165 bp, Artificial Sequence
  Description of Artificial Sequence: Synthetic coding sequence
atggctgccaacgtgggagaccagaggtctacagattggagcagccagtactctatggtggcgggagccggacgagagaacgggatggagacccctatgcacgagaatcctgatagaagcggcatagactgtcggctctccctcgcgcagctctcggctttttag

SEQ ID NO: 57296 - DNA, 903 bp, Artificial Sequence
  Description of Artificial Sequence: Synthetic coding sequence
atggcagctaacgtgggcgatcagcgctccactgattggtcaagccagtactccatggttgccggtgctggtcgggagaatggtatggagaccccgatgcacgaaaaccctgaatgggaaaaagcgagacaagccctagcttccatctcaaaatctggggctgcgggtggatcagccaagagtagctcaaacggcccagtcgcatcagctcagtatgtatctcaggccgaagcaagcgctttacagcagcaacaatattaccagtggtaccaacagtataactatgcctacccctatagttattactaccctatgtcaatgtatcagagttatgggtctccatcccagtatggaatggccggatcatatggtagtgcaaccccccagcagcccagtgcaccccagcaccagggtactttgaatcagccgccagtgccaggcatggacgaatccatgtcctatcaggcgcctccccaacagctgccatctgcccagccacctcagcctagcaacccgccacatggggcacacacactcaattcagggcctcagccaggaactgcaccggcaacccaacatagccaggcagggccagctacgggtcaggcttacggtccccacacctatacagaaccagccaaaccaaaaaagggccagcaactttggaaccgtatgaagcccgcaccaggcactgggggattgaagttcaacatccagaaacggccattcgctgtcactacccagagctttgggtcaaacgcagagggccagcacagcggcttcggcccacaacccaatcctgaaaaagtacagaaccatagtggtagctctgcccgagggaacctaagcggaaagcctgacgattggccccaggacatgaaagaatatgtggaaaggtgttag

SEQ ID NO: 57297 - DNA, 276 bp, Artificial Sequence
  Description of Artificial Sequence: Synthetic coding sequence
atggctgccaatgtcggcgaccagagaagcaccgactggtcctctcagtactctatggtagctggcgcaggtagggaaaatggcatggaaactcccatgcatgaaaatccagaatgggagaaagcccgacaggcgctagcttctataagcaagagcggtgccgctggcggaagcgctaaaagctccagcaatgggcctgtggcaagtgcgcaatacgtgtcacaggctgaggctagcgccctgcagcaacagcagtattaccagtggtaccagtag

SEQ ID NO: 57298 - DNA, 591 bp, Artificial Sequence
  Description of Artificial Sequence: Synthetic coding sequence
atggtctgccgccttatctgtgtcttccactcaacaaatgccgttagcgttttctctttgtcccttttccgcgcatgcacacctgttcccgaccccgctccttggccgatcccctgtcggggagcttcaggtaagaagaccggcagacctgccagggccagacttcgacgaggccaccctgcctcaccaccgacagcccgatgtttaacatgcttcgccactgatagctgcagccagccactaggagcttcggttttcggagtgggagaacttctgcgggattgcgccaggccacggccaccgaccctgaagtgtcagcatcatcagcaccagatacttcgtaggcatacagctttgcgaacaagaagacccggacgtctggtctcttcctgcatcaaactgagtccctgtcctctgctgcccctgcctcctgtgttcctgttgatctttttcagccccttcccacctagcttgtcagctttttttccttggttctccactggcaaaacggtcccgctgcctccttgcctgcatggttcccctgcccacgtaatgcttccgagtttattctttgtgtgcgttttcatctag

SEQ ID NO: 57299 - DNA, 1506 bp, Artificial Sequence
  Description of Artificial Sequence: Synthetic coding sequence
atgggctctcggccaccctgcggagcaacgtcatccgctcgcagagcctgccaatttccagccccaatggcggcagcccgagaacccgaattgccgcaagaggcccctgctaccgaaccggcaccccctccggcatgccgtttttttctggaggggaggtgccgtttcggagccaggtgtcgacaaccgcacccaggtgccccagctcctcccggacgggaagcccagccagaggcaggcgcaaagaaaccacccttgcgcactgcagctgatgtaattcagcgaatcaggtgggaccctcggctcgacccagcagacttttcggttgggtacgttgatcgattccttggggttcgagaagaacccttctccgctttttgttgggaccagcctcttgccgcactcggcccaggagttcttgcagtaccacaacatagagtcaggttctttcgtttccacgggagactggtgtgggaccgagcctctagaactgacttagtgtttgggtcaggatcagccgctggcaggggcccaaccattctggatgcacccaacaccgaaggcgcacatggggctgaaggtgctgagtggacacttgccggaaccggccaggaagcccaggccgcaccaaagcgtggcagcacacggccactctgtactgggcaccaggagccaggcgttgaggagcccggagaattggaggccgctcaagaaagagccctgggtacagcagccgaccttggtactctcgcccctcgaggaagactggcaggggtgaccgaagaggctctgaagcctactgccgcaaccagaacgacattactgggcggtaaagaggcacaagccttgggcgtccccggaggaagtgccgaaacaaccgaagctgagtggggtcctgccgcatggccagaggacaaacgggcacggctctcagttgctgctccatgccagccgcgtcccacgcattttgttgccctgatggtcaccgagcccggattacaagcggaggtgacaaaggctcaagagtatctcgtacacgtggcaccacattgtgctaactttctggttccaagtcagaacctgcacttaacactggctctcctgcgactcgctggggctggcgaagaggccgctgctatcggggctctgagaagggcactgctggcaccaggattgaatgccccacctcgcctgagtttccggaaactggttctcctcggtccacacgtcctatgcgctccaccctcacctactcttgaatccatggcacaagtgttgagtcaacggttagaagctgaagggctgagcacgctccagagtccagggcagctgcaccctcacctgaccgtggctaaagtaccccacggcagccaggtgcatcttcctaagttggagtttactctctctcaggaggtagggtgtcagccactgcagaccctttggctttgcagaatcggtagaaccggtggcccttttcagccccttgcagagattcgtttagaatag

SEQ ID NO: 57300 - DNA, 3252 bp, Artificial Sequence
  Description of Artificial Sequence: Synthetic coding sequence
atggcctgcccagccctgggacttgaagctctccagcctctgcagccagaaccccctcccgaaccggctttcagtgaggcccagaagtggattgagcaggtgacaggacgttccttcggggataaagacttcagaacggggctggagaacggtatcctcttgtgcgaactactaaacgctattaaacccggactagtaaagaagatcaaccggctcccaaccccaattgctggcctagacaacataattttgtttctgcgcggatgtaaggagctgggcctcaaggagtcacagctattcgacccgtctgatttgcaagatactagcaaccgggttactgtgaaaagcctcgactattcgcgcaaactcaaaaatgtcctcgtgacaatctactggctgggaaaagccgctaacagctgtacgtcgtattcggggactaccctgaaccttaaggagtttgaaggcctcttagcccaaatgcgcaaggataccgatgatattgagtcgcctaagcgttctatccgggactcagggtatattgattgctgggactcagagcgaagtgacagcctgtccccacctaggcatggaagagacgattccttcgactcgctcgatagtttcgggagccgttctcggcaaacaccctcccccgatgtcgtgttgcgcggaagtagcgatggaagggggtctgatagcgaatccgacctccctcataggaagctgcccgacgtgaagaaggatgacatgtccgccaggcgcacttcccatggtgagcctaaaagcgcagtgcccttcaatcagtacttacccaacaaaagcaatcagactgcatatgttcctgctccactccggaaaaagaaagcggagagagaagagtaccggaagagctggtcaacagcaaccagcccattgggaggagaacgtccctttagatacggacccaggacgcccgttagcgacgatgctgagagcacttccatgtttgacatgaggtgcgaggaggaagctgccgttcagcctcactcccgggcaaggcaggagcaactgcagctcatcaataatcagcttcgggaagaagacgacaaatggcaggacgatctagcaaggtggaaatccagacggagatcggtctctcaggacctgataaaaaaggaggaggagaggaaaaaaatggagaaacttctggccggagaagacggaacatctgagagacgaaaatcaataaaaacatatcgtgaaatagtacaggagaaggagagaagagagagagagctgcacgaagcttataagaacgctcggagccaggaagaagccgagggtatattgcaacaatacattgaacgcttcactatttccgaggccgtattggagagattggagatgcccaaaattctggagcgatctcacagtactgagccaaacctgtcctctttcttaaatgaccccaaccccatgaagtacttgaggcagcagagtctgccaccccctaagttcaccgcgactgtcgagacaacaattgctcgcgcttctgtcctggatactagtatgagcgcgggaagcgggagtccctccaagactgttacccccaaagctgtgcccatgctcaccccaaagccctatagtcagcctaagaatagtcaggacgtccttaaaaccttcaaggtagatgggaaggttagcgtgaacggggaaaccgttcaccgcgaagaggagaaagaacgcgaatgcccaaccgttgcccctgctcactctctgacaaagtcccaaatgttcgagggggttgcacgggtgcacggtagtccgctggaactcaagcaagacaatggctctatcgagattaacattaagaagccaaactctgtgccccaggagctcgccgcaacaaccgagaagaccgaacccaacagccaagaggacaagaacgatggaggtaaaagcagaaaaggaaacatagaactggcctctagcgagccccaacacttcacaacaaccgtgaccaggtgcagccctaccgttgccttcgtggagttccctagttcacctcaactgaagaacgatgtgagtgaagagaaagatcagaagaagcccgagaatgagatgtccggtaaggttgaactggtgctttcccagaaagtggtgaaacctaagtcccctgagcccgaagccacacttaccttcccgttcctcgacaaaatgccagaagctaaccagcttcacctgccaaatctgaacagccaagtggactctccgtcctccgagaaatctccagtgatgacgcctcaatttaaattctgggcttgggatcccgaagaggaacgcagacgacaggagaagtggcagcaggaacaagaaagacttctacaggagaggtatcagaaagaacaggacaagctaaaagaagagtgggagaaagcacaaaaggaagtagaggaagaagaacgaagatattacgaggaggagaggaagattattgaggataccgtcgtcccttttacagtgtcttcgtctagtgccgatcagctctccaccagttcttcgatgaccgaaggttcaggcactatgaataagattgacctgggcaattgtcaggatgagaagcaggaccgcaggtggaagaaatctttccagggagatgatagcgacctcctgctgaagacgcgggagagtgaccgcctggaagaaaaagggtcattgactgaaggggcattagctcatagcgggaacccagtgagcaaaggcgtacatgaagaccatcagctggataccgaagctggggcaccccactgcggcaccaacccccagctagcccaggacccgagtcaaaaccaacagacaagtaaccccacgcactccagcgaagacgtgaagcctaaaactctcccactcgacaagtccattaatcatcagatcgagtccccttctgaacgcaggaaaaagagtcccagagaacatttccaggccggtccatttagtccatgctcccctactccacctgggcagagtcccaatcgctcaatcagcgggaagaagctgtgctccagctgtggacttcccctggggaaaggtgcagctatgataatagaaaccttgaatctatactttcacatacaatgctttagatgcggaatttgcaagggtcagctcggggacgctgtaagcggcaccgacgtgcgcatccgtaacggattgctgaactgtaacgactgttatatgcgatctagatccgctggccagccaacaaccctttag

SEQ ID NO: 57301 - DNA, 4401 bp, Artificial Sequence
  Description of Artificial Sequence: Synthetic coding sequence
cggaaagacaccgatgacatcgagtccccaaagcggagcattcgagactccggatatattgactgctgggacagtgagcgatccgacagcctatcccccccaagacatggcagagatgatagttttgactcattagatagttttggaagccgatctcgccaaactcctagtcccgatgtagtcctgcgcggtagttcagatgggagaggtagtgactcagagtcagatcttccgcaccgaaagttgcctgacgtaaaaaaagacgacatgtccgcgagaaggactagtcacggagaaccaaaatcagccgtaccgtttaatcagtatctccctaacaagtcaaatcagacggcatacgttccagctccactgaggaaaaagaaagccgagagagaagagtatcgcaagtcctggtcaacagccacttcaccattgggcggagagagacctttcagctttccagagaccattgaagaagaagggagcgaagtcggctccgccggtgaagataacccagctggacaaatgaatccaggatggaagccatctgacggaggctgtgaattgccggacgggtccggaaaagagcacccttcgagcgacggggcagttgtggcccctgcaccgaagagcgaggagaaagatgctgctgagatccagaagcgtaagcggctcgagcaggcaggaattaaagtaatgcccgcagcgcagagattcgcaagtcagaagcagctgtctgaggagaaagaagctatccgagatattgtgttacgcaaagaaaactcgttcctcacgcaccagcatggcaacgacagcgaagccgagggggaagtggtgtgtcggcttccagacctcgaaaaagatgatttcgctgctagaagagctcgcatgaaccagaccaagcctatggttcccctcaaccagctcttgtacggtccgtaccccaagaagggcgcagagaaaagcgacggaagtaaacagctttctaaggggatttccaagaagcgatccctggagtacaagagaaatcaaggccacactgaggaagtgaaactcatcgtcacctgcaatatgagagctcaggagagcgagcccgtcgaagggggactgaggaaggtgccggatctgcataaagatgacttggcacagcagcgtattcaaggctcgctggctcctcacagggagcccccaagcttcatcactctctctaatattaccgaagccgacctggagacctgggagcggcttaaagtgtcagagaaggcccgagatggagacgtccagcacatctgcgcgtccgaaccgagtccagagattaaagccgagaccgctatcagagacgacttcgcaaatagaaaggccagagcgtctaaaaaggcttccagcccgagacaaaagttcgtgcacttcggcccagtgaccgagttagaccagcagaaatggaagcgcctttccattggaaaagccggaccaagagaagacgaggaggaagtcatctgccatggtagcaagattcagatggatagtgtaagtcctgtctccgcagccacaagctctctcaagggccaccagatcttcaataggcaaaatgattgccgcaccatgaactgtggtcgcggagattactgcaggagggcctcctggttagcccctgtgccagaaagccaggaagagtgggtctgctctctgggcgagtgccctcgcggaacggaggaggtgacttcgaagcaactccctcaagacggaaaggaggagacagaatcggctcctagggattcagagcgactgtcaaaagcagagcggtcagaggatagcagccagcccctggtgtgcccattagcatcagagtgtgaggcatctggtaccgaagagaagctggagaagatgacggctccagcgtggtctgggagtggactcaaggggcagcggaagctggacgactcccgcaaggatgacatgatggcccgaaggaccggtatgagcctacgacacaccggttccaaccctaaccaattcctcccagtgccattcgctaagcaacaggatgttgaggagtccagcaaaggcctgccaatgaaggatcagcgctacggtcctcgcacaccggtcagtgacgatgctgagagtacgtcgatgttcgatatgcggtgtgaggaagaagctgccgtgcagccccatagtcgggcaaggcaggaacagttgcagcttatcaacaatcagctaagagaggaagatgataagtggcaggatgacttagctcgttggaagagtaggcgaagaagcgtgtctcaagatctgatcaaaaaggaagaggagcgcaagaaaatggaaaaactgttggcaggcgaagacggaacgtctgaacgcaggaagtccatcaaaacctaccgcgagattgtgcaggagaaggaacgacgcgaacgtgagctccacgaggcttataaaaatgccaggtcccaggaagaagccgaaggtatcctgcagcagtacatagaacgttttaccatctccgaggcagtattggagagactagaaatgcctaagattctggagagaagtcactctaccgagcccaacctcagttcctttttgaatgatccaaaccccatgaagtatctgaggcagcagagccttccccctccaaaattcaccgcgaccgttgaaaccactattgcccgagcctcagtgcttgatacctccatgagcgcaggtagtggctccccaagcaagacggtgacacccaaagccgtgcctatgctgacgccgaagccttactctcagcctaagaacagccaggatgtgttgaagacatttaaggtcgacggaaaggtgtcagttaatggggaaaccgtccatcgggaggaggagaaggagagggagtgcccgaccgtagccccagcacactcactgacaaagagccagatgtttgagggcgtggctcgtgtgcatggttcacccctggaactgaagcaggataacggatccatcgaaattaatataaagaagccaaactccgtgccacaggaactagcggctacgaccgagaagaccgagcctaattcacaggaggacaagaacgatgggggaaagtcccgtaaggggaacattgaattggctagctctgaaccccagcacttcactacaactgtcacgagatgctcccctacggtcgcattcgtggagttccctagcagcccccagctcaaaaacgacgtgtcagaagagaaggaccagaaaaagccggagaacgagatgtcaggaaaggtagaactagtgctgtctcagaaagttgtgaaaccaaagtcgccagagccggaggccacgttgaccttcccattcctggacaagatgccggaggctaaccaactgcacctcccaaacctgaattcccaggtggactcaccctcttcagagaagagtcctgttatgaccccatttaagttctgggcctgggatcctgaagaagagagacgcaggcaagaaaaatggcaacaggagcaagagaggctgttacaagagcgttaccagaaggagcaggataaacttaaagaggagtgggagaaagcgcaaaaggaagtggaggaagaggagaggagatactacgaagaggagcgtaaaatcattgaggacacagtggttccattcaccgtatcgagtagtagcgctgaccagctctccactagctccagcatgactgagggctccggtaccatgaacaagatcgacctgggaaactgtcaggacgaaaagcaggataggcgctggaaaaagtctttccagggtgacgacagtgatctgttgcttaagacaagggagtctgatagactggaggaaaagggatccctcaccgagggggctcttgcacattctgggaaccctgtgtcgaagggggtccacgaggatcatcagctggacaccgaggctggtgcacctcactgtggtaccaacccgcagctggcccaggacccaagccaaaatcaacagaccagtaatcccactcacagctccgaagatgtgaaacctaaaacgctgcctctggataagtccatcaatcaccagatagaaagcccttctgagcggcgaaaaaagagccccagggaacactttcaggccggacccttctcgccatgctcaccaacaccccctggccagagtcccaatcgttccattagcggcaaaaaactttgcagttcgtgcgggctccctctgggaaagggcgcagccatgatcatagagaccttgaacctgtatttccacattcagtgctttcgttgcggcatttgcaagggtcagctgggtgacgcggtgtcggggacagacgtgcggatcagaaatggactcctgaattgcaatgactgctacatgagatcacgttcggccggacagcccaccactctgtag

SEQ ID NO: 57302 - DNA, 2673 bp, Artificial Sequence
  Description of Artificial Sequence: Synthetic coding sequence
atggacagtgagcgccaggtgaaggataccgacgacatcgaatctcctaagagaagtattagagactccggctatatagactgttgggattctgaacgctctgattccctgtccccccctcgccacgggagagacgattcctttgactccctcgatagttttggatctcggtcacgccaaacccccagtcccgatgtggtgctccgcggttcatctgatggccgaggatctgactccgaatctgatttaccccaccgtaagctccccgatgtgaagaaggatgatatgtctgccagacggaccagccacggagagccaaaatcggctgtgccgtttaatcagtatttgccaaataagagcaaccaaactgcctacgtgccagctcctctacggaaaaagaaggccgaacgtgaagagtaccgcaaatcttggtctaccgcaacaagccccctcggaggcgaaaggcctttcagaagtacatcaatgtttgacatgcgttgtgaagaagaggcagcagtgcaaccgcactcccgggcaagacaggaacagctccagttaattaacaaccagctgcgagaagaggacgacaagtggcaggacgacctggctagatggaagtccagacgcaggtcagtgtctcaggacctcatcaagaaggaggaggaacggaaaaaaatggagaaactgcttgccggtgaagatggtacctctgagaggagaaagtccattaagacctatcgcgaaatcgtgcaagagaaagaaagaagggagcgggagctccacgaggcgtataagaatgctcggtcccaagaagaagccgaaggaatcctccagcagtacatagagcgtttcaccatcagtgaagctgttctagagcggctggaaatgcccaaaattctggagagatcacactccacagaacccaaccttagttcatttctgaacgaccctaaccccatgaagtatctgagacagcaatccctccctcctcctaagtttaccgccaccgtggagacaactattgccagagcatcagtactggacacctctatgagcgctgggagtgggagccccagcaagactgtgaccccgaaggccgtccctatgttgactcccaagccctacagtcaaccgaaaaactcccaggacgtcttgaaaaccttcaaagtggacggaaaggtctccgttaatggcgagacagtacatagagaggaagagaaggagagagagtgccccacggtcgccccagcccattctttaactaagagccagatgttcgagggagtagcccgagtgcatgggagccccctcgagctcaagcaggataatgggagcatcgaaataaacattaagaagcccaatagcgtgccgcaggagctggcggcaaccacagagaaaacagagcccaatagtcaggaagataaaaatgacggcggaaagagtaggaaagggaacattgaactggcctcctcagaaccacagcattttacaaccaccgtaacccggtgctcgcctaccgttgcctttgtggagttcccttcgagcccccagctgaaaaacgatgtgagcgaggaaaaggaccagaaaaaaccagaaaacgagatgagcggtaaggttgagctcgtgctcagccaaaaggtcgtgaagcctaagtctccagagcccgaagcaaccctcacgttccctttcctcgacaaaatgcccgaggcaaatcaacttcacttgccaaacctgaattcccaggtggatagtccttcctccgagaaatcacctgtcatgacaccctttaaattctgggcttgggacccagaggaagagagaaggcggcaggaaaaatggcagcaggagcaggaacggctcctacaggaacgatatcagaaagagcaggataaactgaaggaagaatgggagaaagctcagaaagaggtcgaagaagaagagcgccgatactacgaagaggaacgtaagattatcgaagacacagtcgtacctttcaccgtctcctctagcagcgccgaccaactatctacttcaagcagtatgacggagggttctgggaccatgaacaaaatagatctcggcaattgtcaggatgaaaagcaggatcgacgatggaagaaatcttttcagggggacgattctgacctcctcctaaaaactcgggagtccgatcgcctggaagagaaggggagtctcacggagggcgctttggctcactccggaaacccagtcagtaagggggtgcatgaagaccatcagctggacacagaagcgggagctccgcactgcgggacgaatccccaactggcacaggacccctcccagaaccaacaaacctccaacccaactcacagtagcgaggatgttaaacctaagactttaccgctggataaaagcatcaaccaccagatcgagtcaccctccgaaaggcggaagtctatatcaggcaagaagctatgctcttcatgtggccttcctctgggcaagggggctgccatgatcatagagacacttaatctgtactttcatatccagtgcttccggtgcggcatctgcaagggccaacttggagatgccgttagcggaactgacgttcgcattcgcaacggactcctgaattgcaacgattgctacatgcgttctcgctctgccggtcagcctacaaccctgtag

SEQ ID NO: 57303 - DNA, 2709 bp, Artificial Sequence
  Description of Artificial Sequence: Synthetic coding sequence
atggattctgagcgtcaggtaaaggacactgacgacatcgagtcacccaagcgctcaatccgagatagcggatatatagactgctgggacagcgaacgaagcgacagtctcagccccccacggcacggcagagatgactccttcgattccctggactcattcggcagccggtctcgtcagacaccatctcccgatgtggtcttaagggggtccagtgacggcaggggttcggactccgaatctgatttgccgcaccgcaagctgcccgacgtgaagaaagacgacatgagtgcaaggagaacgtcacacggggagcccaagtctgccgtccctttcaatcagtacctccctaacaagtctaaccaaactgcttatgtccccgcaccattgcggaagaaaaaggctgaaagggaagagtatcgcaaaagctggtcaaccgcaacgagtccacttgggggagaaaggccattccgctacggacccagaacacctgtgagtgacgacgctgagagtactagtatgtttgatatgcggtgcgaggaagaagccgcagtccagcctcacagcagggctcgccaagaacagctgcagctaatcaataaccagctgcgtgaggaggatgataaatggcaggacgacttagcaagatggaaatccagacgtagatcagtgtctcaggatctcattaagaaagaggaggaaagaaaaaaaatggagaagcttctggccggagaagatggaacctctgagcgacggaaatctattaagacttaccgagagatagttcaggagaaagagcgacgcgagagggagcttcatgaggcttacaagaacgcgcgttcacaggaggaagcggaagggatcctgcagcagtacatcgaacggttcactatcagtgaggcggtgcttgaaaggctggagatgccgaaaatccttgaacgctctcattccaccgagcctaacctgagtagcttcctgaacgaccctaatccgatgaagtatctgagacaacaatctctgcctccgccaaaattcaccgcgaccgtcgaaaccaccatagctcgtgcgtccgttctggatacatccatgtcagctggatctggctccccgagcaagaccgtgacccctaaagccgtccctatgctaacgccaaaaccatattctcagccgaaaaattcacaggacgtgctgaagacatttaaggtcgacggaaaggtatctgtgaacggagagactgtgcatagggaggaggaaaaagaaagagagtgtcctactgtggcgcctgcccattccctgactaagtctcagatgtttgaaggtgtcgccagagtccacggatcccctcttgaactgaaacaggataatgggtctatcgagatcaatatcaagaagcctaattccgtgccccaggagcttgccgcaacgacagaaaaaactgaaccaaattctcaagaagataagaatgacgggggtaaatcgcggaaaggcaacatcgaactcgcctcctcagaaccacagcatttcacgacgacagtaacgcgatgcagccccacagtggcctttgtagaattcccgtcatctccacaactgaagaatgacgtgagcgaggagaaggaccagaagaagcctgagaatgagatgtcgggtaaggtcgagctagtcctgtcgcaaaaggtcgtgaagccgaagtcccccgaacccgaggccacgctcacttttccctttcttgacaagatgccagaagccaatcagctgcatcttccgaacctcaacagtcaggtggatagcccctcctccgaaaagagcccagttatgactccattcaaattctgggcctgggacccagaggaagaacgccgtcggcaggaaaaatggcagcaggagcaggagcgtctactccaggaaaggtatcagaaagagcaggacaaactcaaagaggaatgggagaaggcccaaaaagaagtcgaagaagaggaaagaagatactacgaagaggagcgtaagattatcgaggacacagtcgtgccctttacagtatcgtcctctagtgccgaccagttgagcaccagttcatccatgaccgagggaagtgggaccatgaataagatcgacctcggcaactgtcaggatgagaaacaggacaggcggtggaagaaaagctttcagggagacgactctgatctccttttgaagacgagggaatctgacagactagaagagaaaggatcactgaccgaaggggctctcgcccactcaggtaaccctgtgtcaaaaggagtgcatgaagatcaccaactggatactgaagctggcgctccccactgcggtaccaatccgcagctggcacaggatccatctcagaaccagcagacctcaaatccaacccatagttcagaggatgtaaagcctaagactctcccgctagataagtccatcaaccaccagatcgagagcccttcggagagaagaaagtctattagtggcaaaaaactctgtagcagttgtggcctgcctctcggcaagggagctgctatgatcattgaaaccctgaacctgtatttccacatccagtgctttcgctgcggaatctgcaagggtcaactgggtgacgctgtctcgggtactgacgtgagaattcgaaatggcttgttgaactgcaacgactgttacatgcgctctcgctctgcaggtcaaccgacaaccctctag

SEQ ID NO: 57304 - DNA, 4404 bp, Artificial Sequence
  Description of Artificial Sequence: Synthetic coding sequence
atgcggaaagacactgacgacatcgagtcccctaagagaagtattagggatagcggatacatcgactgctgggactccgagcgttccgacagcttgagtccaccgcgtcacggcagggatgactcctttgactctctcgatagtttcggcagtaggtctcgccagactcccagccctgatgtggtcctaaggggctcctccgacggaaggggatccgatagcgaatcagatctgccgcataggaagttgcccgacgtcaaaaaggatgatatgtctgcgagacgcaccagccacggcgaacccaagtctgctgtgccctttaatcagtacctccctaacaagtctaatcagactgcatacgtccctgcccctctacgcaaaaagaaagccgagagagaggagtaccgtaagtcctggtccacagcaacgtctccactcgggggagagcggcctttctcctttcccgagaccattgaggaagagggaagtgaagttggatccgccggagaggataaccctgccggacagatgaatcccggttggaagccaagcgacggtggttgtgagctgccagatggtagtggtaaagaacatccttcatccgatggagctgttgtcgcccctgccccaaaatccgaggaaaaagatgccgctgagatacaaaagaggaaaagactggaacaggccggaatcaaagtgatgcctgcggctcagagattcgcctcccagaagcaactgagcgaagagaaggaggctatcagggacatcgtcctgagaaaggaaaatagctttctcactcatcagcacggcaatgactcagaagccgagggggaggtggtgtgtcggctacccgatttggaaaaggatgacttcgccgctagaagggcaaggatgaatcagaccaagcccatggtgccccttaatcagctgctgtacggaccctaccccaaaaagggcgctgagaaatccgatgggtctaagcagttgtccaagggcatcagcaaaaaacgcagtctggagtacaagagaaaccaaggtcacactgaagaggttaaactcattgtgacatgtaacatgcgcgctcaggagagcgaaccagttgagggagggctgcgcaaggttcctgatttgcacaaggatgacctggctcaacaacgcatccaaggctctctggcccctcaccgggagcctccatcattcatcacactgtccaatatcacagaagccgatcttgaaacttgggaacgtctgaaggtcagcgaaaaggctcgggatggagatgttcaacatatatgtgcctctgagccttcaccggagataaaggccgagacagcaataagagatgactttgcaaatcgaaaagctagggctagtaagaaagcatcaagtcccaggcagaagttcgtccattttggtcctgtaaccgagcttgaccaacagaagtggaaaagattgtctatcggcaaagccggtccccgagaggacgaggaggaggttatctgccacgggtcaaaaatccagatggacagtgtgtcccctgtgtcagcagctacctcatccctgaaaggtcaccagatcttcaatagacagaacgactgccggacaatgaattgcggccgtggcgattactgtagacgtgcctcctggctcgcacccgtccctgaatcgcaggaagaatgggtttgcagcctaggcgagtgccctaggggcacagaggaggtcacctccaaacagctgccccaggacggtaaagaggagaccgagagtgcccctagggactctgagcgccttagcaaggctgagcggtctgaggatagctcccaacctctggtgtgcccactggcttctgagtgtgaggcctccggcaccgaagaaaagctcgagaagatgacagccccagcttggagcggtagcggactgaagggacagaggaaacttgatgacagtcgaaaagacgacatgatggccaggcgcaccgggatgagcctgcgtcatacaggatctaaccctaatcagtttctgcccgtgccatttgcgaaacagcaggatgtggaggaatccagcaaagggctccctatgaaggatcaacggtacggccctaggacccctgtgagtgatgatgcggagagcacctcaatgttcgatatgaggtgtgaggaagaggcagccgtacagcctcactcccgggctagacaagaacaactgcagctcattaataaccagcttagagaagaagatgacaagtggcaagacgatcttgcgcgttggaagagccggagacgatctgtttcacaggacttgattaaaaaggaggaggagaggaaaaagatggaaaaattgttggcgggagaggacgggacttccgagcggagaaagagtattaagacttacagagaaatagtccaggaaaaggagagaagagagcgagagcttcatgaggcatataaaaacgctagatcacaggaagaggcagaggggatactccagcagtacatagagcgctttaccatatccgaggccgttctcgaaaggctcgagatgcctaagattttggagaggtctcattccacagagcctaacctgagtagcttcctgaatgatcctaaccctatgaagtacttacgccagcaatcgctcccaccacccaagtttacagctactgtggaaacaaccatcgccagggcgtctgttcttgatacttctatgtctgctggcagcggctccccctctaagaccgtgacccctaaggcagttccaatgctgacgccaaagccttacagtcagcccaaaaattcccaagatgttcttaaaacgtttaaagtggacggcaaggttagtgtgaacggagagacagtgcaccgtgaagaggagaaggaacgggagtgtcctactgttgcacccgcacatagcctaaccaagtcacaaatgttcgagggggtcgcaagagtccacggaagcccacttgaacttaaacaggataatggatcaatcgagatcaatataaagaagccgaactcagtcccgcaggagctcgccgcaactacagagaagactgagcccaactcacaggaagacaaaaatgatggaggtaagtcgcgcaagggaaatatcgagctcgccagcagcgagcctcagcacttcacaaccaccgttacgcgatgttcccccacagtcgcctttgtcgagttcccatcttccccacaactgaaaaatgatgtgtcggaagagaaagatcagaaaaagcctgagaatgagatgtctggaaaggtggagttggtgctcagccagaaagttgtgaagcccaaatccccagaaccagaagcaaccctgacctttcccttccttgataaaatgccagaagcgaaccaactccacctgcccaatctgaactcccaggtcgacagtccgagctccgaaaagtcccccgttatgaccccattcaaattttgggcttgggaccccgaggaggagaggcgacgacaggagaaatggcagcaggaacaggaaagactgctgcaggaacgctaccagaaagaacaagacaagttaaaggaggaatgggagaaagcccagaaggaagtggaggaggaggagagacgctactacgaagaggagaggaagatcatagaggacacggtcgtccctttcacagtatcctcaagttccgccgaccagctttccacatcttcttctatgaccgagggcagcggaaccatgaataagatcgatctgggcaactgccaggacgagaagcaggataggaggtggaagaaaagcttccagggcgacgacagcgacttgttactgaagaccagagaatctgaccgtctcgaggagaagggctccttgactgaaggagcactggcccatagtggcaacccggtttctaagggcgtccacgaggatcaccagttggacacagaggccggagccccacattgcggaaccaatccccagttggcgcaagatccttcccaaaaccagcagaccagtaaccccactcattcatccgaggatgtgaagcctaagaccctccctctggataaaagcattaaccaccaaatagaatctcccagcgaaagacgcaaaaaatctccacgcgagcactttcaggctggtccgttctccccctgctctccaaccccccctggacaatcacctaacagatcgatttccgggaagaagctctgttcatcgtgtggtctgccattggggaaaggagcagctatgatcatcgaaacactgaacctttatttccacatccagtgcttccgttgcggaatctgcaaagggcagctcggtgacgctgtgtcagggacggatgtaaggatacggaatggcctgctgaattgcaatgactgttatatgcgctcaagaagcgcaggacagcctactactctatag

SEQ ID NO: 57305 - DNA, 2694 bp, Artificial Sequence
  Description of Artificial Sequence: Synthetic coding sequence
atgagaaaggacaccgatgacattgagtctccgaaaagatcaataagagattccggctatatcgactgttgggatagtgagcgtagcgattcactgtcgcctccgaggcacggccgtgacgattcatttgattcactagattccttcgggtcaagatctagacagaccccctcgccagatgttgtgctgcgcggatcatctgacggcaggggcagcgattccgagagcgacctgccacaccgaaagctccccgatgttaaaaaagatgatatgagcgcacggagaactagtcacggagaacccaagtccgctgtgcccttcaatcagtacctgcccaacaaaagcaaccagactgcgtacgttcccgctcccctaagaaagaaaaaggcggagcgcgaggaatatcgaaagagttggagtactgcgacgtctcccttgggcggtgagcgaccctttcggtacggtcccagaaccccggtctctgacgatgctgaaagtacctccatgttcgacatgcggtgtgaagaggaagctgccgtgcagcctcactccagagcccgtcaggaacagcttcaactcattaacaaccagttgagggaggaggatgataagtggcaggatgatctcgctagatggaagtcccgcaggaggtcagtttcccaagatttgatcaaaaaagaggaagagaggaagaagatggagaagcttctggccggagaagacggcacaagtgagcggagaaagtccatcaaaacctaccgagagattgttcaggaaaaagagagacgcgaaagggaacttcacgaggcttacaagaatgctcgtagccaagaagaagcggaggggatactccagcaatatatcgagcgctttaccatctcagaagcagtcttggaaagactggaaatgcccaaaatcctcgagagatctcacagtacagaacctaatctgtcatcatttcttaatgaccctaacccaatgaagtacctcagacaacaatcactgccgccacctaagtttacagcgaccgtggagaccaccatcgccagagcctcggttctggacacttctatgtctgccggttctgggagcccaagtaaaacagtaacacccaaggccgtccctatgttaacacccaaaccatactcacagccaaaaaattcccaggatgtgctgaagacttttaaggtggacggcaaggtgtccgtcaacggggaaacagtccacagggaggaagaaaaggagagagagtgcccgacagtggctcccgcacactctctcaccaagtcccagatgttcgaaggcgtggcgcgagtgcacggctcacccctggaactgaaacaggacaacggctcaattgagattaatattaagaagcccaactctgtccctcaagaactggcggctacaacggagaagaccgaacccaatagccaggaggacaagaacgatggaggaaagagtcggaaggggaacatagaactggcctctagcgagccccaacactttactactacagtgaccaggtgcagcccaaccgtggcttttgtggaattccccagcagccctcagcttaaaaatgatgtgtcagaagaaaaagaccagaaaaagccggaaaatgaaatgagcgggaaggttgaattagtccttagccagaaggttgtgaagccaaagagccccgagcccgaagccaccctcacttttccatttctggacaaaatgcccgaagccaaccagctccacctccccaacctgaattcacaggtggatagcccatcatctgagaaatcccccgtgatgaccccctttaaattttgggcgtgggaccccgaagaggagaggcggcgacaggaaaagtggcagcaggagcaggagaggcttctgcaggagcgctatcagaaggagcaggacaagcttaaggaagagtgggaaaaagcccagaaggaagtggaggaggaagagcgcaggtactatgaggaagagaggaaaataattgaggatacggtggtccctttcaccgtgtcctcctcctctgccgaccagctatcgacgtcttcaagtatgacagaagggtccggcaccatgaacaagattgaccttgggaactgccaggatgaaaagcaagatcgcaggtggaagaagagcttccaaggggacgatagcgatcttcttttgaagacgagggagtcggatagactcgaggagaaaggcagcctgacggaaggagcactggctcactccggaaatcccgtgtcaaagggggtgcatgaagaccatcagctcgacacggaagccggtgcccctcactgcggaacgaatccgcagctcgcccaagatcccagccagaatcagcagaccagcaatccaactcacagctctgaggacgtgaagcctaagactttaccactcgataaatccattaaccaccaaatcgaatccccaagcgagagacgtaagtctatctctggcaaaaaactatgttctagctgcggtctgccgttgggaaagggtgccgcaatgatcattgagactctgaacctctacttccacattcaatgctttagatgtggtatatgtaagggacagctgggcgatgccgtgagcggcaccgacgtgagaatccgcaatggcctactgaattgtaacgattgctatatgagaagtaggtcagccggacaacccaccacactgtag

SEQ ID NO: 57306 - DNA, 3210 bp, Artificial Sequence
  Description of Artificial Sequence: Synthetic coding sequence
atggcttgcccagctcttggattggaagcattgcaacctctccagccagaacctccacccgagccggctttttctgaggctcagaagtggatagaacaggtgactgggaggagctttggtgataaggattttcgaacaggcctggagaacgggatcctgctgtgtgagctcctgaacgcaataaagcctggactggtgaagaagatcaatcggctgcccaccccaatcgccggtctagacaacattatcctattcctaaggggatgcaaagagctaggccttaaggagtcacagctgttcgaccctagcgatctgcaggatacatcaaatagggtgaccgtcaaaagcctcgattactctaggaagctgaagaacgtcctggtaaccatttactggctagggaaagctgcaaacagttgcacgtcgtattccgggactaccttaaatctgaaggaatttgagggactgctggcacaaatgagaaaggacacagacgatatcgagtctcccaagaggagcatccgcgattccgggtacattgattgttgggactccgaacgcagcgattccctgagcccgcctcgccacggtcgagacgactcttttgattctctcgattctttcggatccagatctagacagacaccatctcccgacgtggtcttgcggggatcctctgacggacgcggtagtgattcggaatccgacctgccgcaccggaaattgcccgacgtcaagaaggatgacatgtccgccaggcggacttctcatggagagcctaagagtgcggtcccctttaaccagtacttgccaaacaaatctaaccagacggcatatgtgccagctcctctccggaagaagaaagcagagcgagaagagtatcggaaatcatggtcaactgccacatcccctctcggcggtgaaaggcccttcagaagcaccagcatgtttgatatgcgttgcgaagaagaggcagcagtccaaccacattcacgtgcccgtcaggagcaactgcaacttatcaataatcagctgcgagaggaagacgacaaatggcaggatgatctggctcgatggaagagccgacggcgaagtgtctctcaggacctaatcaagaaggaagaagagagaaagaaaatggaaaagctgcttgctggagaggatgggacctcagagcggagaaagtcaataaagacgtatagggaaatcgtgcaagaaaaggagagacgggagcgagagctgcacgaggcttataagaatgcaagatcgcaagaggaagccgagggtattctacagcagtacattgagcgattcactatttcagaagctgtgctggaacgcctagagatgcccaagatcctggaacgcagtcactctaccgaacctaatctcagctcgttcctgaatgaccccaatcccatgaaatacctgcggcagcagagtctaccaccccctaagttcaccgccaccgtggagacaactattgcccgagcaagcgtgctggacactagtatgtcggcaggttctggctccccatcaaaaacagtaaccccaaaagctgtacccatgcttacgcccaaaccatattcacagcccaagaattcgcaggatgtcctcaagacattcaaagtggacggtaaagtgagcgtgaacggtgaaacggtgcaccgcgaagaagagaaagagcgtgagtgtcctaccgttgccccagcccactccctgactaaatcacagatgttcgagggcgtggcacgggtccatggctcgccactggaactgaagcaggacaatggatcaatcgagatcaacatcaagaagccgaactctgtgcctcaggagctggcggcaacaacagaaaagaccgagcccaattcccaagaggataagaatgacggaggcaaatcgaggaaaggcaatatcgagttggcttcttccgaaccccagcactttactacgacagtgacccggtgctccccgaccgttgcctttgtcgagttcccatccagcccccagctgaaaaacgatgtgagtgaagagaaggaccagaagaaaccggaaaacgagatgagtggtaaagtcgaactggtgcttagccagaaagtggtcaagcctaagagccccgaaccggaagcaaccctgacgtttccttttctggataagatgccggaggcaaatcagctgcatcttcccaatctcaacagtcaagagtctcccggtacggcctctgtcccccttcgggtgcagaactcttggaggcggtcacagttcttcagtcaatccgtggattcccctagctccgaaaaatccccagtgatgactccctttaagttttgggcctgggatcccgaggaagaaagaagaagacaggagaagtggcagcaagagcaggagaggctgctgcaggaaagataccagaaggaacaggataagcttaaagaggagtgggaaaaagctcagaaggaggttgaggaggaggaacgcagatactatgaggaagaacgcaaaataatagaagacaccgtggtccctttcaccgtgagttccagctctgcggatcaattaagcacctccagctcaatgacagaaggcagcgggaccatgaataagatcgacctgggaaattgccaggatgagaaacaggatcgcaggtggaagaagagttttcaaggcgatgactccgatctgttgttgaagacacgggagtccgatcggctggaggaaaaaggatctcttactgaaggcgctctggcacattctggaaatcccgtgagtaagggcgttcacgaggaccaccagctggataccgaggctggggctccgcactgtgggacaaacccacagctcgcccaggatccgagccagaaccagcagacaagtaaccctacccattcttccgaggacgtgaagccaaagaccctccctctcgacaaatctatcaaccatcagatcgaaagccccagcgagagaagaaaatctatttcaggcaagaagctctgctcatcctgcggactccctctgggaaaaggagccgcaatgattatcgagaccctcaatctttacttccacattcagtgctttcgctgtggtatctgcaaagggcaactaggcgatgccgtcagcggcaccgacgtacgcattcgtaatgggctacttaattgcaacgattgctacatgcggtctcgctctgctggccagcccaccaccctgtag

SEQ ID NO: 57307 - DNA, 3174 bp, Artificial Sequence
  Description of Artificial Sequence: Synthetic coding sequence
atggcttgtcccgcactcggattggaggcgctccagcctctccagccggagcctccccctgaaccagcattttcggaggctcagaagtggattgaacaggttactggtagaagcttcggagacaaggactttcgcacgggactggaaaacggcattctgctatgcgaactcctgaacgctatcaagccaggactggtaaaaaagatcaaccgattgccgacccctatagccggactagacaatataatcttgtttctgagagggtgcaaagaactgggcctcaaggagagccagttatttgacccttccgatctgcaagatacgagcaatcgtgtcacagttaaaagcctggactacagtcggaagctgaaaaacgttctggtgaccatatattggctgggcaaggcagccaacagttgcaccagttattctgggaccacattgaatctgaaggaattcgaggggctgctggcgcagatgaggaaggataccgacgacatagagtccccaaaaaggtccattagagacagtgggtacatcgattgttgggatagcgaacgatcagatagcctgtcgcccccacgtcacgggagagatgactcattcgactccctcgattctttcggcagtagatcaagacagaccccatctcccgacgtggtccttaggggctcttcagacggtcgcggaagtgattcagaatccgatctacctcacaggaaactccccgacgtaaagaaagacgacatgagtgccaggaggacctctcacggagagcccaagagcgcagtccccttcaaccagtacctgccaaataagtccaatcagaccgcttacgtaccggctcctctgagaaagaagaaggccgagagagaggagtacagaaaaagctggtccacagccacgtccccacttggtggggaaagacctttccggtatggaccaagaactcctgttagtgatgacgctgaatccaccagcatgttcgatatgcggtgtgaggaagaagccgcagtccagccccattcccgggcacggcaggaacagctgcagctgatcaacaatcagttgcgggaagaagacgacaaatggcaagatgatctcgctaggtggaaatctagacgtcgcagcgtctcgcaggacctgataaagaaagaagaggagcggaagaaaatggagaaactgcttgctggtgaggacggcacttctgagaggcggaagagcattaaaacttacagggaaatagtccaggaaaaagaacggagagagcgtgagctgcacgaggcctacaaaaatgcccgttcccaggaggaagcagaaggcattcttcaacagtatattgagcggttcaccatcagcgaagcagtgcttgaaagattagaaatgccaaaaatccttgaaagaagccattccaccgaaccgaatttgagcagctttcttaatgatcctaacccaatgaaataccttagacagcaatctctgccaccaccaaagttcacggctacagtcgagaccacaattgccagggctagcgtgttagacacatcaatgtctgccggaagcgggtctcccagcaagaccgtgactcctaaggccgtgcccatgctgacgcctaagccatattcacagccaaagaactctcaggatgtgctaaaaacttttaaagttgacggcaaggtgagcgttaatggagagactgtacaccgggaggaggagaaagagcgtgaatgtcccactgtggcccctgcacactctttaaccaaatcccagatgtttgaaggagttgccagagttcacggttcacctctcgaactcaaacaggacaacgggagcattgaaatcaatatcaagaagcctaatagcgtgccgcaggagctggccgctacaaccgagaaaaccgagcccaacagtcaggaggacaagaacgatggcggaaagtcacgcaaagggaatattgagctggcctcctcagaaccgcagcacttcactacaacggttacaagatgcagcccgacagtagcatttgtggagttcccgtctagccctcagctgaagaacgacgtctcagaagagaaggaccagaagaaacctgagaacgaaatgtcgggtaaagtggaactggtactgagtcagaaagtggtgaaaccaaagtctcccgagcctgaggcgacactgacatttccatttctggacaaaatgccggaggccaatcaattgcatctgcccaatctcaactcacaggtggattcaccttcaagcgagaagtccccagtcatgaccccccaattcaagttctgggcatgggaccccgaggaggaaaggcgcaggcaagaaaaatggcaacaggaacaggagcggctgcttcaggaacggtatcagaaagaacaggacaaactaaaagaggaatgggagaaggctcagaaagaggtcgaggaggaggaaaggcgctattatgaagaggagcgcaaaatcattgaagacactgtcgtgccattcactgttagctcatcctctgctgaccaactgtccacatccagctctatgaccgagggtagcgggacaatgaataagatcgaccttggaaactgtcaagatgaaaaacaggaccgccgttggaaaaagtcttttcagggcgacgattctgacctgttgttaaaaacacgagagtcggatcggctagaagagaaggggtcattgaccgagggagcactggctcattcaggtaatcccgtgtctaaaggggtccacgaggaccaccagctcgatactgaggccggtgcacctcactgtggtactaatccacagctcgcgcaggatccatctcaaaatcagcagacctccaacccaacacactcctctgaggatgttaagcccaagactctgccccttgacaaatcaattaatcaccagatcgaatcaccgtctgaaaggcggaagagcatcagcggtaaaaagctttgctcgagttgtggcctgccgctcggcaagggagccgctatgattattgaaactctgaacttgtattttcatatccagtgttttagatgcggaatttgcaagggccagctgggagatgccgtctccggaacagacgtacgtattcgtaatggcctgctaaattgcaacgactgctatatgcgctctaggtccgcaggccagcctacgactttatag

SEQ ID NO: 57308 - DNA, 1230 bp, Artificial Sequence
  Description of Artificial Sequence: Synthetic coding sequence
atgaatctcgatcggtgcaactcaatagcggagcctcaacattttacgacaactgtgaccaggtgcagtcctaccgttgccttcgtggagttcccatcttcgcctcagttgaaaaacgacgtgtcagaagagaaggaccagaagaaaccagaaaatgagatgagtggaaaggtagaattggtactctcgcagaaggtcgtgaagcctaagtcccccgagcccgaggcgactctcaccttcccattcttagataaaatgcctgaggccaatcagctgcacctgcccaatctgaatagtcaggtcgattcaccgagtagtgagaaatcacccgtcatgacaccattcaagttctgggcatgggaccctgaggaggaaagacgcaggcaggagaagtggcagcaggagcaggagcggctgctgcaggagagataccaaaaagagcaagataagttgaaagaggaatgggagaaggctcagaaggaggttgaggaagaagagagaagatactacgaggaagagagaaaaattattgaagatacagtggttcctttcaccgtatcctccagcagcgcagatcaactgtccaccagttcctcgatgactgaaggttctgggactatgaacaaaattgacctcgggaattgtcaagacgagaagcaggatagaaggtggaagaaatcctttcagggggacgactcagacctgctgttgaagaccagggagtccgaccgccttgaagaaaagggcagcctgaccgaaggggctctcgcccactctgggaacccagtttctaaaggtgtgcacgaagaccaccagctggataccgaggccggagcgccacactgtggcaccaatccgcagctggcccaggatccaagccagaaccaacagacctccaatcccacacattcctccgaagacgttaagccgaagacactcccacttgataagtctattaatcaccagatcgagtcaccctccgaacgccgtaagtctatcagtggcaaaaagttatgctctagttgcggcttgccgctcgggaagggcgctgcgatgataattgagactctgaatctttatttccacatccaatgcttcaggtgcggcatatgtaaggggcaattgggcgatgcggtgagcggaaccgacgtgaggattcgaaacggcttgctcaactgcaacgattgctacatgagaagcagaagcgcgggacagccaactactttgtag

SEQ ID NO: 57309 - DNA, 3171 bp, Artificial Sequence
  Description of Artificial Sequence: Synthetic coding sequence
atggcatgtcccgctctcggcctggaagcactacaacccttgcagcctgaaccaccgccagaacccgctttttcggaggcacagaagtggattgagcaagttaccggtcggagctttggagataaggattttcgaacggggctggagaatgggatcctcctgtgtgagctgctgaatgccattaagcccggtcttgtgaagaagattaaccgccttcccactcccattgccggtctcgacaacatcatactattcttacggggatgcaaagaacttggcctgaaggagagccaactgttcgatccttctgatcttcaggacacatctaatagagtcaccgtgaagtcgctagactactctcggaaactaaagaacgttctggtgaccatctactggctaggtaaggccgctaactcatgcacgtcctacagtgggacaactctgaatctcaaggaattcgaaggactgttagcccagatgagaaaagacactgacgacatcgagtctcccaagaggtctatacgggattcagggtatattgactgctgggacagcgaaagatcagatagcctaagtccgcctcgccacggtcgcgatgatagctttgacagtctcgacagctttgggagcaggtctagacagacgccatcaccggacgtcgtgctgcgcggatcttctgacggacgagggtccgactctgagagcgacctgcctcaccggaagctaccagacgtgaaaaaagatgatatgagtgccaggagaacatctcacggcgagccaaagagcgccgtcccttttaaccagtacttgcccaacaagtccaatcagaccgcatacgttccagcaccccttcgaaagaaaaaggcggagcgggaggaatacagaaagtcctggtctaccgccacatcaccactaggaggggagcgcccatttcggtatgggcctcgtacccctgtctccgatgacgccgagtccacatcaatgttcgacatgaggtgtgaagaggaggctgcagtgcagccacactcaagagcaagacaggagcagttgcagctgatcaacaaccagctccgggaagaggatgataagtggcaggatgatctcgcccgttggaagtctaggcggcgaagcgtctcacaagacctgatcaaaaaggaggaggagcggaaaaagatggagaagcttctcgcaggcgaggatggaacctcagagaggcgtaagtcaatcaaaacctaccgcgagatcgttcaggaaaaggaacgcagagagagagaactgcatgaagcgtataagaacgccagatcacaggaggaggcggaaggtatactgcagcagtacatcgaacggttcactatttcagaagccgtcctggaaaggctagaaatgcccaagatactggagaggtctcacagcacggaacccaatctcagcagcttcctaaacgaccctaatccaatgaaatatctgcggcaacagtcattaccgcctccgaagtttacagccacagtggagaccacaatcgcccgagcatccgtcttggatacctcgatgtcagccggaagcggctccccgtccaagacggttactcctaaggcagttccaatgctgacacctaaaccttacagtcagccaaagaacagtcaggacgtgctgaagacctttaaagtcgacgggaaagtgtccgtcaatggtgaaacagtgcatcgagaggaggaaaaagaaagggagtgtcctaccgtcgctccagctcacagtctcactaagagtcagatgttcgagggcgtagctcgcgtgcatgggagtccccttgagctgaaacaggataacggctctattgaaatcaacatcaaaaaacccaacagcgtaccacaagagcttgcagccaccaccgagaaaacagagcccaattctcaggaggataagaacgacgggggtaagtctaggaaggggaacatcgaactagcatcgtcagagccccaacacttcaccacgacggtcaccagatgctcccccacagtcgcgtttgttgaatttccctctagtccccaacttaagaatgacgtgagcgaagaaaaggatcagaagaagccagagaacgaaatgtcgggcaaagtggagttggtgctgtcacaaaaggtggtcaagcccaagagtccggagccggaagcaactttaacctttcctttcctcgataaaatgccagaagctaaccagcttcatctaccaaatttgaattcccaggtcgatagcccgagctccgagaaatcccccgtgatgacgcctttcaagttctgggcttgggacccagaagaagagagacggagacaagaaaaatggcagcaagaacaggaacgccttctgcaggagcgctatcagaaggaacaagacaaattgaaggaggagtgggaaaaggcccaaaaagaggtcgaagaggaagaacgtcgttactatgaggaggagcgaaagataatcgaggatactgtggtgccgttcaccgttagtagtagcagtgccgaccagctctccacctcaagttctatgaccgaaggaagtggaacgatgaataaaatcgacttgggcaactgtcaggatgaaaaacaggatcgacggtggaaaaagtcttttcagggggacgactcagatctgctattgaagacacgcgagtccgaccgtctggaagagaaaggaagcctgactgaaggggctctagcgcattccggtaaccctgtgagcaagggggtgcacgaagaccaccaacttgataccgaagctggagccccacactgcgggaccaacccgcaacttgcccaggacccttctcagaatcagcagacctccaatcccactcatagtagcgaagatgtcaaacccaagaccctgcccttggacaaaagcatcaaccatcagatcgagtcaccctcagagcgacgcaagtccatcagcggcaagaagctgtgctccagctgcggcctcccgctgggcaaaggggcagcaatgatcatagaaactttgaatctatattttcacatccagtgcttccggtgcggtatatgtaaggggcagctgggggatgccgtgtctgggacagatgtgcggatccgaaatggccttctcaactgcaacgattgctacatgagatcgcgcagcgcgggtcagcctacaaccctctag

SEQ ID NO: 57310 - DNA, 384 bp, Artificial Sequence
  Description of Artificial Sequence: Synthetic coding sequence
atgttccaagccgcaggcgctgcccaggcaactccttctcatgatgctaagggcggtggtagttccaccgttcaaaggtcaaagtccttctcgctgcgtgcgcaagtgaaggaaacatgtgccgcatgtcagaagacagtgtaccctatggaaaggctcgtagctgataaattaatcttccataattcttgcttttgctgcaagcattgccatacgaagctgtccctcggctcttatgccgctctccatggagagttttactgcaaaccacactttcagcagctgttcaaaagtaagggcaattacgacgaaggcttcggccgtaaacagcataaggagctctgggcccacaaagaagtcgaccccggaaccaagaccgcatag

SEQ ID NO: 57311 - DNA, 1944 bp, Artificial Sequence
  Description of Artificial Sequence: Synthetic coding sequence
atgaggcttactctgctctgttgcacgtggcgggaagagcgcatgggcgaggaagggagtgagctgcctgtctgtgcttcttgtggccagcgaatctacgacggccagtatcttcaggcccttaacgccgattggcatgcagactgcttccggtgctgtgactgttccgctagtttgagccatcaatattacgagaaagacggccagcttttttgtaaaaaggattattgggccagatacggggagtcttgtcatggctgcagcgagcagattaccaaagggctggttatggtggcgggtgagctgaagtaccaccctgaatgtttcatatgcctcacatgtgggacctttatcggcgacggagatacttatacactggttgagcattcgaagttgtattgtgggcactgttattatcagactgtagttacacccgtcattgaacaaatactgccagatagcccaggaagtcatctgccacacaccgtgacacttgtctctattccagcttccagccatggcaagcggggactctcagtgagtattgatccaccccacggaccgcctggatgtgggactgaacacagtcatacagtccgcgtgcaaggggtagaccctggctgtatgagccctgatgtcaagaactccatccacgtgggtgatcgcatcctcgaaattaacgggacgcccatccgaaatgtccccctggacgaaattgacctcctgatacaggaaacctcccgccttctgcaattgaccctggaacatgacccacacgatacactggggcatggcctgggacctgaaacgagccctctctctagccccgcatatacaccctctggcgaggctggctccagtgctaggcaaaagccagtcctgcgtagctgttccattgataggtcacccggagccggatccctgggaagccccgctagtcagcgcaaagatctgggcagatccgaatccctgagggtcgtctgtcgacctcatcggatcttccggccatcagatctcatccacggtgaggtgctgggcaaaggttgtttcggccaagcgataaaggtgacccaccgggagaccggcgaagtcatggtcatgaaggagctcatacgctttgacgaagaaacccaacgtaccttcctgaaagaggtgaaagtgatgcgttgcctggagcatcctaacgtcctcaaattcatcggggttctctataaagataagagactgaactttattaccgagtatataaaaggcggaaccctcagaggaatcattaagtctatggactcccaatacccatggagccagagagtatctttcgccaaagatatagcatctggtatggcctatctacacagtatgaacatcattcatcgagacctgaactctcacaattgcctggtgagagaaaataaaaacgtagttgttgccgacttcggtcttgcccgactgatggtggacgagaaaacacagcccgaaggcctccggagcctaaagaagccagaccgcaagaaaaggtacacagtggtaggcaatccctactggatggctcccgaaatgattaacggtaggagttacgatgaaaaagtagatgtcttcagctttggcatcgttctatgcgagattatcgggagagttaatgctgacccagactatctgccgcgaactatggactttgggctcaatgtcaggggcttcctggatcgttactgtcctcctaattgccctccctctttctttcctattacagtcaggtgctgtgacttagacccagagaagaggccctcctttgtgaaactggaacattggcttgaaactctccgaatgcatttggccggacatctgcccttgggacctcaattggagcagcttgatagggggttctgggaaacgtacagaagaggggagagtggtcttccagcccacccggaagttcctgattag

SEQ ID NO: 57312 - DNA, 741 bp, Artificial Sequence
  Description of Artificial Sequence: Synthetic coding sequence
atgtttcccgttaaagtgaaagtggaaaagtccgagttggaaatggttaaagcacggaatcagcttgacgccgtgttgcagtgcctgctggagaaatcccacatggatcgggagaggctggacgaggaagccggtaagaccccttctgatactcacaacaaggattgctctatcgctgcaactggtaaacgccctagcgcacggtttccccatcaacgcagaaagaagcgaagagaaatggatgatggactggctgaaggtgggcctcagcgctcaaacacatacgtgataaaactatttgatagaagcgtggatctcgctcaattttccgagaacactcccctttaccctatctgtcgcgcttggatgcgtaacagccccagcgtgagggaaagggaatgctcccccagttctcctttgccacctttgcccgaggacgaagaaggaagcgaggttacgaacagcaagtcacgggacgtctacaagctccctccgccaactccccctgggcctcccggtgacgcctgcagaagccggatccccagccctttgcaaccagaaatgcaagggacaccagatgatgaaccttcagaaccagaacccagcccctcgactcttatctatagaaacatgcaacggtggaaacgtatacggcaacgttggaaagaggcgtcgcaccggaaccagctacggtactccgaaagcatgaaaattcttcgcgaaatgtacgagcggcagtag

SEQ ID NO: 57313 - DNA, 351 bp, Artificial Sequence
  Description of Artificial Sequence: Synthetic coding sequence
atgggctggaaaatggcaagccccactgacggcactgatctggaagctagcctactctcattcgaaaagcttgaccgcgcttcccctgatctgtggccagagcagctgcctggagtcgccgaattcgctgcatccttcaaatctcctataacgtcttcaccgccaaagtggatggccgagatagagcgggatgatatcgacatgctgaaagagttggggtcccttacaactgccaacctcatggagaaagtccgcggtttgcagaatttagcctaccagctcggcctagacgagagccgcgaaatgacaagggggaagttcctgaatatcctggaaaagccaaagaagtag

SEQ ID NO: 57314 - DNA, 447 bp, Artificial Sequence
  Description of Artificial Sequence: Synthetic coding sequence
atgagactaggatgtgagttggggatcggctttcttttcggcggtgtggcctatgggacctcattctcccgccgaagactggcgacctcccgtgatatgggatggaagatggcttcccccactgacggcacagaccttgaagcgtcgctcctgtcctttgagaagcttgatcgcgcttccccagacctgtggccagaacagctgccaggagtggccgagtttgcagcttcatttaaatcacctatcacatcaagccctcccaaatggatggcagaaatcgagagggatgacatagacatgctaaaggaactgggaagcttgaccaccgcgaatctgatggagaaggtaagaggattgcagaatctggcataccaactcggcttagatgagtctcgcgaaatgaccagaggaaaatttcttaacatactcgagaagcccaaaaagtag

SEQ ID NO: 57315 - DNA, 2598 bp, Artificial Sequence
  Description of Artificial Sequence: Synthetic coding sequence
atgtctgacgtgtcaaccagtgtgcagtccaagttcgcgagacttgcaaagaaaaaggagaacataacctatatgaagcgtgagcagctaactgagacggataaggatatagccccagtcctcgacctcaaatgcaaagatgtgtctgctattatgaacaagttcaaagtgctcatggagattcaggatctgatgtttgaggaaatgagggaaacgctcaaaaatgacttaaaagctgtgctgggagggaaggccacaatacccgaagtgaagaattctgagaactcttctagtaggaccgagttccaacagataatcaacctggcgctccagaaaacgggaatggtgggtaagattgagggtgagaactcaaagattggcgacgacaatgaaaatctcaccttcaagttggaagttaacgaactgagtggaaagctcgataatactaacgagtataacagcaacgacggcaaaaaactgccccagggagagtcacggtcatacgaggttatgggaagtatggaggagaccctctgtaatatcgacgacagggacggcaatagaaatgtgcaccttgagttcaccgagcgggagagccggaaggatggggaggacgaattcgttaaggagatgcgggaagagaggaaatttcagaagctgaaaaacaaggaagaagtgctgaaagcaagtagggaagagaaggtactgatggatgagggtgctgtccttaccctggttgcagacctatcatcagctaccctcgatatttccaagcagtggagtaatgtgtttaatattttacgcgaaaatgacttcgaacctaaatttctgtgtgaggtgaagctggcttttaagtgcgacggcgagatcaaaacattctcagatttgcaatccctccgcaagttcgccagtcagaaaagttccgtgaaagaactcttgaaggatgttctcccacagaaggaggagatcaatcaaggcggaaggaagtatgggatccaggagaaacgtgacaaaaccttaatcgacagtaagcatcgggcaggtgagataacctcagacggcctttctttcttgttcctaaaggaagtcaaggtcgctaagcctgaggagatgaagaatttggagacccaggaggaagaattcagcgagctcgaggagctggacgaggaggcctctggcatggaggacgatgaggatacaagtggcttggaggaagaggaagaggagccatctggactggaggaggaagaggaggaagaggccagcgggcttgaagaggatgaggcctccggcctggaggaggaggaggagcaaacctctgagcaggactcaaccttccaaggccataccctggttgacgcaaaacacgaggtggagattactagcgatggcatggagaccacttttattgatagcgtcgaagactctgagagcgaggaggaggaggaggggaaatcctctgaaactggtaaggtgaaaacgacctcactcacagagaagaaagcaagtcggaggcagaaggaaatcccgttctcttacctggtaggtgacagcggtaagaaaaagcttgtgaaacaccaggtcgtacacaagacccaggaggaagaagaaaccgccgtccctacctcccaggggaccggaactccatgcttaaccctgtgtctcgcatctccctcgaaatctctggaaatgtcccacgatgaacataagaaacatagtcacacgaatttatcaattagcacaggcgtaaccaaacttaaaaagacggaagagaagaaacaccgaacgcttcatacggaggagctaactagtaaagaagccgacctaacagaggagactgaagagaacctccgcagcagtgtgatcaatagtattagggagatcaaggaggagatcggcaacctcaagtctagccacagcggagtcttggaaatcgagaattcagtggatgacttatcgtcacgcatggacatcctggaagaaaggatagactctctcgaagaccaaatcgaagaattcagtaaggatacaatgcagatgactaaacagatcatatccaaggaacgacaacgcgacattgaagaaaggagtcggtcgtgcaatatccgactgatcgggatacccgagaaggaatcctacgagaaccgggctgaggatatcataaaggagatcattgatgagaacttcgcagagctcaaaaaaggctcatctcttgagatagtcagtgcttgccgtgttcccagtaaaatcgacgagaaacgtcttactccccgacatatccttgtcaaattttggaatagctccgataaggagaaaattattcgagcaagccgcgaacggagagaaattacgtatcaggggactcggattagactcaccgctgacttatctctggacactctggatgcacggagcaagtggagtaatgtgtttaaggtgctcctggaaaaggggttcaatcccagaattttgtacccggcaaaaatggcctttgacttccgaggcaaaactaaggtcttcctgtccatcgaggaatttcgggattatgtgctgcatatgcccacgctccgggaattattgggaaataatatcccttag

SEQ ID NO: 57316 - DNA, 2274 bp, Artificial Sequence
  Description of Artificial Sequence: Synthetic coding sequence
atgaaggtgttttgtgaggtcttggaggaactgtataaaaaggtgctgctgggggcaactctggagaacgatagccatgattacatattctacctgaaccccgctgtctctgaccaagactgcagcacagccacttcactggagtgggctaacacttgcggcatccaagggcgacaccagccaatatccgtaggcgtggcacctatcgccgtagcccctgtgtgcctcaagaccaactcccagatgtcagggagccgcgaggtcatgttattgcagctaacggtcattaaagtgatgacaacaaggatcctcagcgtgaagacagagtttcatgcaaaagagcagtatcgggacgtcatcaagatcttgttggaatctgcaaaggtggactcaaaattgatttgtatgttccagaatagcgacaaactcctaagccacatggccgctcaatgtttggctttactcctatactttcagctgcgtgagaagattacactctcaaatagttggatagctttctgtcagaaaaacctcagcgagtactcagaatctaacaaagcaatctactgcttgtggaccctgaccgctataataaaggagatttttaaggatagctgcagccagaaaacagagatcctgaaacagtttctgactcatttcgataccatctttgaggtcttctacaactcgcttttttctcaacattttgagaactgtcgcgacacaagcaagatcgtgaatatccttatgtgcttcctggatctgctcgagctgctcattgccagtagaattcatctgaaacttcactttacgtgtcagagaatcctcttcctgaaacccagctgcatgctggaggtgataacatggccaatccaggcattcgtgaagaggaaagtcattatcttcctaaagaagtgtttgctatgcaaggtgggcgaggacctctgcagagggagcgtaccagcactgatgccaccagatcatcatgtagctgtggacatgttggctctggctaatgccgtgctgcaagcagtaaatagtgggcttttgaaaacgctgagtgtctatgaaaagcactcattcttcggaggcgatgaagttcaacctgaatgcgaactcatcacttcccctgaccacgtcatcttgcgtgctgcctcccttgtgattatgaagtctttagagattaagtttcagaattacagttcggcatctgaagtgaaagtggacctgcagcgttttatgtctgagctgctgacatttctgaaaccacatctgcagcctagcctccagctgcacaatccctgtaagtggctgtcgcgagtgtttatcgagcaggacgatgatatgctcgaagccgctaaggcttcattgggaatttacctcactcttacccgcggttgcgaggctactgagagtctgactcaggggaaggagatgtgggaccaccacactcacgaaaacggatacaacccacattgcatatttctgtttttcttaaaaaatatcggcttcgattcgacagtactgttagactttctgatcagttctgagacctgcttcctggagtacttcgtccggtatttgaagctgctccagaaggattgggacaacttctttactatctgcaacaacttcgacgccaccgagtccaaatacgatatcagcatttgcgggtgcgtgccttcactggttcaggaccagtcatctaaccagacaattccgcaccggctgactgcccctcactcccacagagatgtgtgtgctcgccactcttgggcttcggacgcccctagcgaacctcttaaagctgtcatgagtaagggtgcccacaccatgtgcgcaagttcactaagtagccccagagcttctcaatctcttgtggattatgattcctcggatgattctgacgtcgaatcaacggagcagtgcctggcgaactccaaacagaccagcttgcaccagcaagcaaccaaggaaatccaggatgcagcagggacctcacgcgataaaaaagagtttagcttagaacctccctctcgccctctagtactgaaggagttcgacacagcctttagtttcgactgcgaagttgccccaaatgatgtggtttctgaggtagggattttctacaggatagtgaagtgttttcaggaacttcaggacgcaatctgtagactgcaaaagaaaaacttattcccctacaatccgacagctctgctgaagcttttaaagtatattgaggtcatatctaacaaaaccatgaacacattgtag

SEQ ID NO: 57317 - DNA, 576 bp, Artificial Sequence
  Description of Artificial Sequence: Synthetic coding sequence
atgaaagtgttctgcgaggtgttggaggaactatataagaaggtcttattgggcgcaactctcgaaaacgactcccatgactatattttttatctgaatccggcagtttctgatcaagactgctctaccgcaaccagtctcgaatgggctaacacctgcgggatccagggaagacatcaacctatctctgtgggagtggccccaatcgcagttgctcccgtttgccttaagacaaacagccaaatgtcagggagtcgagaggtgatgttactgcaactgaccgtaatcaaggtcatgactacgaggatccttagcgttaaaacggaattccacgccaaagagcaatatagagatgtcataaaaattttgctggaatccgcgaaggtggatagcaagctgatctgcatgtttcaaaactctgataagctcttaagtcacatggctgcacaatgtcttgcgttgctgttatacttccagctgagggagaagattactctatccaatagttggatagcattttgtcagaagaatctgtcagagtactcagagtcaaacaaagctatttactgcttatag

SEQ ID NO: 57318 - DNA, 597 bp, Artificial Sequence
  Description of Artificial Sequence: Synthetic coding sequence
atgaaggtcttctgcgaagtcctagaagagctgtataaaaaggtcctattaggagctaccttggagaacgacagccatgattacatattttatttaaacccagcagtttcagaccaggactgttctacagcaacctccctggaatgggcaaacacatgcggaattcagggaaggcatcagccaatttctgttggcgtggcccctatcgcagtggctcctgtgtgcctcaaaactaattcacagatgagcggcagtcgggaggtgatgctgttgcagctgacagtcatcaaagtaatgacgacccggatcctctcagttaagactgaattccacgccaaggagcagtaccgcgacgtgattaagatcttactggaatccgccaaggtcgattcaaaactcatctgcatgttccagaatagtgacaagcttttaagccacatggcagctcagtgcttggccctcctgctctatttccagcttagagagaagatcactcttagcaacagctggattgccttctgccagaaaaatcttagcgagtattctgagtccaacaaggcaatctattgcttatggacactaacagccataatctag

SEQ ID NO: 57319 - DNA, 390 bp, Artificial Sequence
  Description of Artificial Sequence: Synthetic coding sequence
atgaaggtcttttgcgaggtgctggaggagctgtataaaaaagtgctgttaggtgccaccctggagaacgactctcacgactacatattttacctgaaccctgcagtcagtgaccaggactgttctaccgccacctccctcgagtgggctaacacgtgcggaatccaaggccgacaccagcctatcagcgtcggtgtcgcccctattgccgtggccccagtttgtctaaaaactaacagtcagatgagtggctccagggaggtaatgctgctgcagctaacagtgataaaagttatgacaactaggatcctttcggttaagacagagttccatgccaaggagcagtatagagatgtcatcaaaatcttactggaatcagccaaagtttag

SEQ ID NO: 57320 - DNA, 435 bp, Artificial Sequence
  Description of Artificial Sequence: Synthetic coding sequence
atgaaagtgttctgcgaggtgctggaggaactgtacaaaaaagtgcttctcggggctactctggaaaacgacagtcatgattacattttttacctgaatcctgctgtatctgaccaagactgttctacagccactagcttggaatgggccaacacttgtgggatccagggacgccaccagcccatatctgtgggcgtcgcaccaatcgccgttgctccagtatgcctgaagacaaactcacagatgagcggttctcgtgaagtaatgctgctgcagcttacggttattaaggttatgaccactaggatcctcagcgtgaaaacggagttccatgcaaaagagcagtaccgcgacgtcatcaagattcttctggaaagcgccaaagttgattccaaactgatttgcatgttccagaatagtgataaactgctgtag

SEQ ID NO: 57321 - DNA, 1311 bp, Artificial Sequence
  Description of Artificial Sequence: Synthetic coding sequence
atgaaagtgttctgtgaggtgttggaggaactgtacaagaaggtgttgctcggagccaccctagaaaacgattcccacgattacatcttctacctgaatcctgccgtgagcgaccaagattgctctactgcaaccagcctggagtgggctaatacttgcgggatccaggggcgtcaccagcccatttctgtgggtgtggcaccaatagcagtggccccagtttgcctgaaaacaaacagtcaaatgtcgggttccagagaggtgatgctgctccaactgactgtgattaaggttatgaccactcggatcttgagcgtcaagaccgagttccatgcaaaggaacagtaccgcgatgtgatcaagattcttctggaaagcgctaaggtggattccaagctcatttgcatgttccaaaattctgataagctgctgagccacatggcagctcaatgccttgccctactactgtatttccagttgagagagaaaattacactgtcaaatagttggatcgcgttttgtcagaagaacttatctgagtacagcgagagcaataaagccatttactgcttgtggactcttaccgccatcatcaaggaaatctttaaggattcatgcagccagaagaccgaaattctgaaacagttcctcacgcatttcgatactatctttgaggtcttctacaactctctgtttagtcaacacttcgagaattgtcgcgacacatcaaaaatcgtgaacatactcatgtgtttcctggacctgctggagctcctgatcgcctcaaggattcacctgaaactgcatttcacgtgtcaacgaatcttattccttaaacctagctgcatgctggaggtgatcacctggccgatccaggcctttgtgaaacgcaaggtgatcattttcctaaaaaagtgcctgctgtgtaaggttggcgaagacctgtgcagaggttccgtgcctgccctcatgccaccagaccaccatgtggccgtagatatgctcgccctagccaacgcggttttacaggctgtgaattctggcctcctcaaaactctgtccgtctacgaaaaacactctttttttggaggggacgaagtacagcccgaatgcgaactgattacctctcctgatcacgttatcctgcgcgctgcaagcctggtcatcatgaagtcccttgagattaagtttcaaaattactcctctgcaagcgaggttaaagggaactcccccaactccttctgcatgcagtgtgtgataatttacttgagcactgtgatccataattatcagatttccggcctcgtctag

SEQ ID NO: 57322 - DNA, 732 bp, Artificial Sequence
  Description of Artificial Sequence: Synthetic coding sequence
atgtctagtggaaccgagcttctgtggcccggagccgctctgctcgtgttgttaggcgtagccgcaagcttgtgtgtccggtgttcccggccaggggcaaaaaggtctgagaaaatctaccagcaacggtctctccgggaagatcagcagagtttcacaggttctcgcacgtatagcctggtcgggcaagcctggcccggacccttagcggatatggctcccacccggaaggacaaactactacagttctatccatcactcgaggatccagcctcatctagatatcaaaacttcagcaagggatcccgccacggctctgaagaggcctacatcgatcctattgcgatggaatattataactggggaaggttttcaaaaccaccggaggacgacgacgcaaacagttatgagaatgtgttaatctgcaagcagaagaccacagaaaccggagcgcagcaggaagggattgggggactatgcagaggtgacctgagtctgtctcttgcactgaaaactggccctacaagcggcttgtgtcctagcgcgtcccctgaagaagatgaggagagtgaggactaccagaatagtgcatctatccaccaatggcgcgaaagccgaaaggtgatgggacaactgcagcgcgaggcatccccaggccctgtaggatctcccgatgaggaggacggcgaacccgattatgtcaacggggaagtggcagctactgaagcttag

SEQ ID NO: 57323 - DNA, 732 bp, Artificial Sequence
  Description of Artificial Sequence: Synthetic coding sequence
atgagctctggcacagaacttctatggcccggagccgctctgctagtcttgctgggagtggcagccagcctctgtgtccgttgtagccggcctggggctaagcggtccgaaaaaatttaccagcagcgttctctgagagaggatcaacagagctttaccggttcccggacctacagcctggtgggacaggcctggccgggacctctcgcggacatggcccctacacggaaggacaagttgctgcagttctacccgtccttggaggacccagccagttctagataccaaaatttcagtaaagggagcaggcacggaagcgaagaggcctatatagacccgatcgcaatggagtattacaactggggccgttttagcaaaccacccgaagatgacgacgctaacagttatgagaatgtgcttatttgcaagcaaaagacaacagagacaggcgctcaacaggagggcatcggtgggctgtgtcggggagatctgagcctgtctttggctcttaagaccggacctacctctggcctttgcccctcagcgtcccccgaagaggacgaggaatccgaggattaccagaacagtgccagcatccatcagtggagagagagccgaaaggtcatgggccagttacagcgtgaagccagtcctggtccagtgggttccccagacgaggaagatggcgagcccgactatgtgaacggggaggttgcagccacggaggcatag

SEQ ID NO: 57324 - DNA, 732 bp, Artificial Sequence
  Description of Artificial Sequence: Synthetic coding sequence
atgagtagtggaacggaactgctgtggcccggagccgctttactggttttgctcggggtggctgcttccttatgcgttaggtgctctaggccaggcgcaaagagaagcgaaaaaatctatcaacagcgctctctaagagaagatcagcagtctttcacaggatcacggacctacagtcttgtcggccaggcctggccagggccattggctgatatggctcctactcgaaaggacaagctacttcagttctacccctcactagaggacccagcttcgtcccggtatcagaacttttcaaagggcagcagacacggctccgaagaggcatacatcgatccgatcgccatggaatattacaattggggacgtttttcaaagcctcccgaggatgatgatgccaattcctatgagaatgtcctgatttgtaagcagaagaccaccgaaacaggtgctcaacaggaaggaatcggaggactgtgcagaggcgacctttccttgagcttggccctgaagacgggtcctacaagcgggctgtgccctagtgcaagtcctgaggaggatgaagaatccgaggactaccagaactctgcttcgatccaccaatggcgcgagtcccgcaaagtgatgggacagctccagagggaagccagccctggtccagtcgggtctcccgacgaggaagatggcgaacctgactatgtcaacggagaggtcgctgctacagaggcctag

SEQ ID NO: 57325 - DNA, 495 bp, Artificial Sequence
  Description of Artificial Sequence: Synthetic coding sequence
atggtcggcgttgtgagcgacgaccaggatttcctggacagcaaggacacaatgaaaatggctgtcgtcctggtgacgccccttggtaatggtgatcttgcactcaaattcggctatcccacaccccacggaggctgtcaaaagatggataccacattcacagaaggggcagtacctggccagttcagcaacccagccatggccctctcggatatccgggtggccttttccgactatcagcattttgccttgctttacttagagatgcggaaaggagggctgagaaaccagtggctccagctgtacggaggcagagccgcaggaagacgcccaaggcacccaagatttggaagcggcatgagcccactctgcttgcatcagcccttcttgcatgcagagggaggcacagctgggagctggtgcttatggcccagggttcccgcacctccgtgtcctagtctgcccctgttcgcccctcccgcacccagcctctag

SEQ ID NO: 57326 - DNA, 696 bp, Artificial Sequence
  Description of Artificial Sequence: Synthetic coding sequence
atgagacaaccggctgttcggctggtgagactaggacgggttccatacgccgaactgctcgggttgcaggacaggtggttgagaaggctgcaggctgagccaggtatcgaagctccttcgggcactgaagcgggagcgctcctgctctgtgaaccagctggacctgtatacaccgcaggactaagaggtggactgaccccagaggaaacagccaggctacgtgccctcggcgctgaggttcgtgtgacgggaaggggcggactggctactttccacggacccggtcagcttctgtgtcacccggtcctggatttgagacgtctcggcctgcgacttcggatgcatgtggcatctctcgaggcctgtgctgtacggctctgtgagttacaaggactccaggatgccagggccaggccaccaccatacactggggtttggctggacgataggaagatctgcgccattggagtgcggtgcggtaggcacattacatctcacgggctggcacttaactgcagcaccgatttgacgtggttcgagcacattgtgccctgcggtctggtggggactggagtgacaagcctctcaaaagaactacagcgccatgtgactgtggaggaggtcatgcccccttttctggtagctttcaaggagatttacaagtgcactttgataagtgaggacagtcctaactag

SEQ ID NO: 57327 - DNA, 849 bp, Artificial Sequence
  Description of Artificial Sequence: Synthetic coding sequence
atggaccggaccctcgagtctctccgccacattatagctcaggttctgccgcatagagacccagccctggttttcaaggacttaaacgtggtaagcatgttacaggaattttgggagtccaaacagcagcaaaaagcggctttcccatcagaaggcgtagttgtctatgaaagtctccccgctcccggacctccgtttgtgtcatatgtaacgctgcctggcggttcatgctttgggaacttccagtgttgtctgagtcgggcagaagctcgaagggatgccgcaaaagtagccttgatcaactcgttatttaacgagctgcctagccgcaggatcaccaaggaattcatcatggaatcggtccaggaagccgttgcgtcgacctctgggaccttagacgacgcagatgacccgagtacatctgtgggggcatatcactatatgctggagagcaacatgggaaaaaccatgctcgagtttcaggagctgatgactattttccagcttctgcactggaacggttcactcaaggccctccgagaaacaaaatgtagccggcaggaggtgatctcttactatagtcagtactccctggatgagaaaatgagatcccacatggcactggactggatcatgaaggagagagactccccagggatagtgtctcaagaattgagaatggcgctgcgccaactggaggaagctcggaaagcaggccaggaattgagattttacaaggagaagaaagagatccttagtctggctctgacgcaaatttgctctgaccctgacacatcaagcccatctgacgatcagctaagcctgaccgctctctgtggttaccactag

SEQ ID NO: 57328 - DNA, 1014 bp, Artificial Sequence
  Description of Artificial Sequence: Synthetic coding sequence
atggaaaccatgcgcgcacagcggttgcagcctggggtgggcacatctggtcgcggaactttgcgggcactgagaccaggggtgaccggcgctgcggcagcaaccgccacccccccagccggaccgccaccggctccccctccaccggctccaccacccccaccactgctcctttctggcgctcccggattaccgcttcccccaggtgcagctgggtcgcccgcagtgctgcgcgaggccgtggaagctgtggtgcgctcatttgccaaacacacacagggctacggcagagtgaatgtagttgaggcgcttcaagagttttggcagatgaaacagagcaggggcgctgacctgaaaaacggcgctctcgtggtctacgagatggtacccagtaatagccccccatacgtgtgttacgttacacttcccggaggatcctgcttcgggagctttcagttttgccccactaaggctgaggcacggagatctgctgccaaaatcgctctgatgaatagtgtgttcaatgagcacccaagtcgcaggatcacggacgaatttatagaaaaaagtgtatctgaggccttagcttccttcaatggaaaccgggaggaggcagacaatccaaatacaggcattggcgcatttcgatttatgctcgagagcaacaaaggaaaatccatgcttgaattccaggagctcatgaccgtgttccagctcctacactggaacggttcactgaaggccatgcgcgaaagacagtgctctcgccaggaagttcttgcccattactcccacagggccctcgacgacgatattcggcatcaaatggcacttgattgggtgagccgggagcagtccgtgcccggagcactctcgcgagaactggcctccactgagcgggagctggatgaagccagattggccggtaaggaactgcgattccacaaagaaaagaaggacattctggtcttggcagcagggcagctgggaaatatgcattcctctaattgctag

SEQ ID NO: 57329 - DNA, 855 bp, Artificial Sequence
  Description of Artificial Sequence: Synthetic coding sequence
atggagactatgagggcccagagacttcaacctggggttggtacatctggaagaggcaccctgagggctttgcggcctggcgttaccggagcggctgcggcaaccgctactcacactcagggttacggaagagtcaatgtggttgaggccttacaggagttttggcagatgaagcagtcacggggagccgacctcaagaacggcgctctggttgtgtacgagatggtcccctcaaacagccctccttacgtttgttacgtgactcttccaggaggcagttgttttgggtcgtttcagttttgccccacaaaggcagaggctcggagatccgccgctaagatagccctcatgaattcagtcttcaatgaacacccctccagaaggattacagatgaattcattgaaaagagcgtgagcgaagctttagcttcttttaacggcaacagggaagaggcagataatccaaacaccgggatcggggcttttaggtttatgcttgaaagcaataaggggaagtctatgctagaattccaggaactaatgacggtgtttcaactgcttcattggaacgggagcctgaaagcaatgagagagcggcaatgctcccggcaggaagtgctggcccactacagccacagagccttggatgacgacatccgccaccaaatggcacttgattgggtgagtagggaacaatcagtccctggtgctctctcccgagaacttgcttccacagagagagagttggatgaagctaggctggccggaaaggagctaagattccacaaagaaaaaaaggacatcctcgtgctggccgcaggacaattaggaaatatgcacagctcaaattgttag

SEQ ID NO: 57330 - DNA, 390 bp, Artificial Sequence
  Description of Artificial Sequence: Synthetic coding sequence
atggccaaatcactgaggtcaaagtggaagagaaagatgagagccgagaaacgtaaaaaaaacgcacccaaagaggctagtaggttgaagagcatcctgaagttggatggcgatgtcctcatgaaggacgttcaggaaatagccaccgtcgtggtccccaagccaaagcattgccaggaaaagatgcagtgcgaagtgaaggacgagaaggatgacatgaagatggagacagatattaaaagaaataaaaagaccctgctggaccaacatgggcagtacccaatttggatgaaccagcgacagcgcaagcggctgaaagcaaagcgcgaaaaacgtaaaggaaaatctaaagcaaaagccgtgaaggttgctaagggcctggcctggtag

SEQ ID NO: 57331 - DNA, 390 bp, Artificial Sequence
  Description of Artificial Sequence: Synthetic coding sequence
atggccaaatccctgcgatctaaatggaaaagaaagatgcgtgccgaaaaacggaaaaagaatgccccaaaagaggcctcccgcctcaaatccatcctcaagctggacggcgacgtgttgatgaaggatgtacaggagattgcaaccgtggtggtgcctaagccaaaacactgccaggagaagatgcagtgcgaggtgaaagatgagaaagacgacatgaaaatggaaacagatattaaaaggaacaaaaaaacactactggatcagcacggccaatatcctatctggatgaaccaaagacaacgcaagagactgaaagctaagcgtgagaagagaaagggcaagtcaaaagcgaaggccgtcaaagtggccaaagggctggcttggtag

SEQ ID NO: 57332 - DNA, 414 bp, Artificial Sequence
  Description of Artificial Sequence: Synthetic coding sequence
atgtctcagtttcaaggtaaaggcccacgatggacagtactgatcatgtccaaggttgggctgagaggcggtctgtcagaccagatggctatgaaagtgctggatcccctgaggcaggccttggatagttcaatgcaatcaaataatctgtgtcagcaccctcagcccctggcactccacgtgtcagccgcagtggcctccgccggagcccaagcctcttctctgctaggtccactcccgcacctcagctcttttgcctttcaaccagcccactcgctcttatccctcctggggtcccacggagccgaggtgagcaaaaaaatggcactgctggcccgagagcggtcccccgcacatctggtcgcatttcccggtcggctcacggcaacccctcccggactccctactttttag

SEQ ID NO: 57333 - DNA, 198 bp, Artificial Sequence
  Description of Artificial Sequence: Synthetic coding sequence
atgaagaaagattcccagggcgcattctccggcttttgtcacggcggagacgcgttacacgagggtcgggtaaggcgtcccctctggctgaaagacatgtacaaaccactgtccgccacacgggtcaacaaccatgcctggaaactgcacaaaaagtcaagtaatgaagatgaaatcctgaatcgggatccaggctag

SEQ ID NO: 57334 - DNA, 1818 bp, Artificial Sequence
  Description of Artificial Sequence: Synthetic coding sequence
atgtctagcgtgtctccaattcagatcccgtctcgcctgccactgctgcttactcatgaaggagtgctgcttccaggaagcacaatgaggaccagtgtcgactctgctagaaatttgcaactcgtgcggagccggctgctcaaggggacaagcctgcagagcacaatcctgggcgttattccaaacacgcctgaccctgccagtgatgcccaggatctgccacctttgcacagaattggtacagcggctctggcggtgcaagttgtcggatccaactggcccaaaccgcattatacgctgctaattacaggtctgtgccgcttccagatcgttcaggttttaaaggaaaagccatatcccattgctgaagttgagcagctcgatcgtcttgaggagttccctaatacatgcaagatgagagaggaactgggcgaactctctgagcagttctataaatatgctgtacagatcctggatgcagtttcattggaggagcgttttaagatgacaatcccattactcgtgaggcagattgaaggcctcaagttgttgcagaagacccgcaagcctaagcaagatgatgataagcgggtcatcgcaatccgcccaatcagaaggatcacccacataagcgggaccctggaagacgaggacgaggatgaggacaacgacgacatagtgatgttggagaagaagatccgtacgtcaagtatgcctgaacaagcacataaggtctgtgtgaaggagattaagcgattgaaaaagatgccccagagcatgcctgagtacgcactgacgcgaaattatcttgaactcatggtcgaactgccatggaacaaaagtactaccgaccgcctcgatattagagccgctcgcatcctgttagataatgaccactatgctatggaaaagcttaaaaaacgcgtgctggaatacctggcagttcgacagcttaagaacaacctgaaaggcccaatcctctgtttcgtcggaccaccaggcgttgggaaaactagcgtgggccgaagcgtagctaagaccctggggcgtgagtttcaccgcatcgccctggggggagtctgtgatcagtccgacattaggggccatcgccgtacctacgtcgggagtatgcctgggagaatcataaacggattaaagaccgtcggagtcaacaatccggtcttcctgttggatgaggtggacaagctgggaaaaagcctccaaggggacccggcagccgctctgttagaagtacttgacccagagcaaaatcataacttcacggatcattatctcaatgttgcgttcgacttgtctcaggtgctatttatcgcgacagcgaatacgacagctacaattcccgcagctctgcttgaccgtatggaaatcatccaagtccctggctacacccaggaggaaaaaatcgagattgcgcatagacacctaattccgaaacagcttgagcagcacgggttgacccctcaacagatccagataccacaggtcacaaccctcgatatcattacgagatatacaagagaggcaggtgtgaggtctctggatcgaaaacttggcgctatctgtagggctgtcgcagtcaaagtggcagaagggcaacacaaggaggcaaagctcgacaggtctgacgtgacagagagggagggttgtagagagcacatcctggaagacgaaaaacctgaatccatctcagatacaacagacctggccttgccgccagagatgccaatattgattgactttcatgcgttaaaggatattctgggtccgccaatgtatgagatggaaatagcctcttag

SEQ ID NO: 57335 - DNA, 2427 bp, Artificial Sequence
  Description of Artificial Sequence: Synthetic coding sequence
atgagctctgtgagtcctatccagatcccatccagattaccactgctgcttacccacgagggcgtgctgcttcccggttcaaccatgaggacctctgtggattctgcacggaatctgcagcttgtcaggtcacggttattgaaagggacctcactgcagtccacgatattgggcgtcatacctaataccccagatcctgctagtgacgcccaagatttgccgcctctgcaccggatcggcaccgccgctcttgctgtccaggtcgtcggttccaactggcctaagccacattacacactcctcattacaggcctgtgccggttccagattgttcaggtgctgaaagaaaaaccgtatcctattgctgaagtggaacaactcgatcggctggaggaattcccgaacacctgtaagatgagggaggagctgggagaactgtcagagcagttttataagtacgccgtccagatacttgacgccgtgtctctggaggaacgcttcaagatgaccattccgctcctggttcggcaaattgaaggcctgaagctacttcagaagacgcggaaacccaaacaggatgatgacaagcgggttatcgctattagacccatccgcaggattacacacatttcggggacactggaagacgaagatgaagacgaggacaacgacgatatcgttatgttggagaaaaagattcggacctcctctatgcctgagcaggctcacaaggtttgtgttaaggagataaagcggctcaagaaaatgcctcagagcatgcctgaatatgctttaaccagaaattacctcgaactgatggtcgaactgccttggaacaagtcaacaacggatcgactcgacatccgcgctgccagaatacttctagataacgatcactatgccatggaaaaactgaagaagcgggtcctcgaatacctggcagtcaggcaactgaagaacaacctcaaggggcctattctgtgctttgtgggccctcccggtgttggcaaaacttcagtggggagatccgtcgccaagaccctggggagggagtttcataggattgccctgggcggagtttgtgaccaatccgatattaggggacatagacgtacgtacgttggctccatgcctgggaggatcataaacggcttaaaaaccgttggcgtaaataatcctgttttcctactcgacgaggtcgataagctgggaaagtctcttcagggtgatcccgctgctgcactcctggaagtccttgacccagagcaaaaccataattttactgatcactatttgaatgtcgcctttgaccttagtcaagtgctgtttatagccactgccaatactacggcaaccattcctgcagcattactggaccggatggagatcatccaagtaccaggctatacccaagaagaaaagatagaaatcgctcaccgccatcttatcccaaaacagctggagcagcatgggttgactccacaacagatccagatacctcaggtgaccaccctagacatcattactagatatacacgcgaggcaggcgttcggtcactcgaccgcaagcttggcgctatctgtagggccgtggctgtcaaggtggcagaaggtcagcataaagaggcaaaactcgacaggagtgacgttaccgagagggagggttgtcgcgagcacattcttgaagacgagaagcctgagagtatcagcgatacaactgacttggctctgccacccgagatgccgatactcattgacttccatgccttgaaagatattctcggaccaccaatgtacgagatggaggtctcacagagattatcacagccaggagtggcgattggcctggcctggaccccattggggggagagattatgtttgttgaggcgagccgaatggacggcgaaggtcaactcactttaactggccagttgggcgacgttatgaaagagtctgcccatttggctattagctggttgcgatcaaatgcgaagaaataccagctgacaaacgctttcggctcattcgaccttttggataacactgacatccatctgcatttccccgctggcgcagtcactaaagatggaccctctgcgggtgtaaccatagttacctgcctcgcctccttgttttcaggacgccttgtccgctcagacgtggctatgacaggcgagatcactttgagaggtctggtcctgcctgttggcggaattaaagataaagtgctagcagctcatcgtgctggcctgaagcaggttatcattcctagaaggaacgagaaggatctcgagggcatccccggaaatgtccgccaagacctgagcttcgttaccgccagttgtctcgatgaagtgctcaatgctgccttcgatggcggtttcactgtaaaaacaagacccggactactgaactccaagctctag

SEQ ID NO: 57336 - DNA, 1746 bp, Artificial Sequence
  Description of Artificial Sequence: Synthetic coding sequence
atgcttgaaaaaaagatccgcacatcctctatgccggagcaggcccacaaggtgtgcgtgaaagaaatcaaaaggcttaagaaaatgccccaaagcatgcctgaatatgctttgaccaggaactacttagagctgatggtagaactgccgtggaacaagtctaccacagaccgcttggatatccgggcagctaggattctcctggacaacgaccattacgcgatggagaagctcaagaaacgcgtactggagtatctggcagtgcgacagctcaagaacaatctgaagggtcctatcttgtgttttgtggggccacccggagtgggcaagacaagcgtgggcagaagcgtcgcgaaaactctcggcagggagtttcataggattgccctcggtggggtttgtgatcagagcgatattcggggtcataggagaacgtacgttggaagcatgcccggaagaatcataaacggtctgaagactgtcggggtaaacaatccggtgtttctgttagacgaagtcgacaaattgggtaagagcttgcaaggggatcccgctgcagcactcctcgaagtgctcgatcccgagcagaatcataattttactgatcactacctgaacgtagcatttgatctaagtcaggtgcttttcatcgctaccgccaacacaactgctaccattcccgctgctctgttagacaggatggagataatacaagttccaggatatacgcaggaggaaaaaattgagatcgcccacaggcatctgattccgaagcagctggagcagcatggattaacaccacagcagatccagatcccgcaagtaacaacattagatattataacccggtacactagagaggcaggcgttcgatctttggatcgcaagctgggggctatttgtagggccgtggcggtgaaggttgcagagggtcagcataaggaggcgaagctagatcgtagtgacgtgacagagcgagaggggtgtagagagcacattctggaagatgaaaaaccggagtcaatttccgacacaacagacctggcattaccacccgaaatgcccattctgatcgatttccatgccctgaaggatattctaggcccacccatgtacgaaatggaggtttcacagagactgtctcagcctggagtggcgattgggcttgcttggacacctctcggcggagaaatcatgtttgtcgaggcaagtcggatggatggagagggccagctcacgctcaccggccagcttggcgacgtaatgaaggaaagcgcccacctggcaattagctggctcagatccaatgccaagaagtaccagctcacaaatgccttcgggtcattcgacctgctcgataacacagacatacatctgcattttcccgctggcgcagtaacaaaggatggtccatctgctggggtgacaattgtgacttgcctggcttcgctcttttctgggaggctggtgagatccgacgttgccatgacaggtgagatcactcttaggggtcttgttctaccggtaggcggaatcaaagataaggtgttggccgctcatcgggctggccttaaacaagtgatcattccaaggcgaaacgaaaaggaccttgaaggtataccagggaatgtcaggcaagacttgagtttcgtgaccgcgtcctgcctggacgaagtgctgaacgccgcatttgacggcggtttcaccgtcaaaacgcgacctggactcctcaactctaagctgtag

SEQ ID NO: 57337 - DNA, 2322 bp, Artificial Sequence
  Description of Artificial Sequence: Synthetic coding sequence
atgtcttcaccagcagtagctaggacttcacctgggggatcacgggagatggcccctgcaccccagggtagaggcaggttctgggaagtcggaggaggatctgggcataggcttgagcgtgccgcagctgaaagcgagcggtgggaactcctcctcagacggggagaacttctggctctggggggacaccttaaaggggcactcgaggcattcgccgcagctctcaggagaggtgcgcctgcccgtcctgagtgccttggcgcactagtcgattgcctcgtgtttaattatcgtctccgtcacggcctcggatggtctgcagcgcctgtcgccggtgccgatggcggtgccggtggcttactcagatgtttaggatgtagaggctttctctccgagccggtgaccgtcccctgcggtcattcatactgtcggaggtgcttgcgtagggagctgagggccaggtgtcgactctgccgcgaccggctgccaccggctaccgcctccgcaacagatgccgaggggactgcaccaagacccccaccactggcagccgctatcgccgcatccgacttccggacgtctgtcgtcctgaaccacctggctgagaagtggttcccaggacaacgagagagggccagagccgctgggcgactcggagaactgctccatcagggtagataccgagaggccctggccgcagcatgtgaagccctacgcgcagaaccaagtgacctcattgtgaaaatttatcgagcagagagctatgccggtcttcaggagtttaaagccgctatagaggacctgaacgccgtgctgtttcagcttcctgactggcctgaggtttacttcaggaagggcaaagtgctctgtgatgccggattcctgggcgacgccctccagctgtttttacaatgcctggcccttgacgaggattttgccccagctaagcttcaggttcagaaaatcctttgtgatctgctgttacccgagaacctaaaagaagggctcaaagagtcatcctggtcctccttaccctgtacaaagaaccgcccatttgatttccacagcgtaatggaggagtctcagagtcttaacgaacccagcccgaaacagagtgaggaaattccagaagtaacttctgagccggtcaaaggctcactgaatagagctcagtcagcgcaaagcatcaactctaccgagatgcccgctcgtgaagattgtcttaagagagtgagcagtgaaccagtactttcggtccaggagaagggcgtgttgctgaagcgcaagctcagcctgctggagcaggatgtcattgtaaacgaagacggcaggaacaaattaaagaaacagggagaaacgccgaacgaagtctgtatgttcagtctggcttacggtgacatccccgaggagttgatcgacgtgagcgacttcgagtgtagcttatgtatgaggctattctttgagcctgtgaccaccccatgtggccacagcttttgtaaaaactgtcttgaaagatgtctggaccacgctccgtactgcccactctgtaaagaaagcctcaaagagtatctcgcagatcgtaggtactgtgtcacccaattgctggaagagctgattgtgaagtacctcccagacgagctgtctgagaggaagaaaatatacgacgaagaaacagctgagttgtctcacttaaccaagaacgtccctatctttgtgtgcacaatggcttacccgaccgtgccttgccctctgcacgtttttgagcccaggtaccgcctgatgattcggagaagtattcagaccggaacgaaacagttcggcatgtgtgtttccgatactcaaaattctttcgccgactacggttgtatgcttcaaatccgcaatgtacactttctgccggatggtaggagcgtcgtggacaccgtagggggaaaaaggtttagagtgctgaagaggggtatgaaggacggctattgtacagccgacattgagtacttggaggatgtcaaggtcgagaacgaggacgagatcaagaatctgcgagaactccacgatctagtgtacagccaggcctgttcatggttccaaaacttgagggatcgattcaggagtcaaatcctgcagcacttcggctcgatgcctgaacgcgaggaaaacctgcaggcggcacctaatggacccgcttggtgctggtggctcctggctgtgctgccggttgaccctcgataccagctgagcgtgctctctatgaagagcctgaaggagcgcctaaccaagatccagcatatcctgacgtacttttcccgggaccagtctaagtag

SEQ ID NO: 57338 - DNA, 2265 bp, Artificial Sequence
  Description of Artificial Sequence: Synthetic coding sequence
atgtcccccgaaccagtgccaccaccacccccaccacagtgtccgggatgtgatcgcgcagaacccattgcacagcgtcttgaggaaggggacgaggcgttcagggctggcgattatgaaatggctgctgagctattcagatcgatgctcgccggtttggcacagcctgacaggggcctgtgcctgcgcctgggcgatgctctggccagggccggacgcctccctgaggcactcggcgctttccgcggagcggcacgcctgggagccttgcgacctgaggaactcgaggaattagcgggaggactggtgcgcgcagtcggattgagagaccggcctctgtccgcggagaatcctgggggagagccagaagcacctggtgaggggggtcccgctccagagccacgggctcccagagatcttctcgggtgccccagatgcaggcgcttactccacaaaccagtaacactaccctgcggacttactgtgtgcaagcgatgtgtagagccgggacccgctcggccacaggtgaggagagttaatgtggttcttagtggcctgctcgagaagtgttttcccgcagaatgccgactcagacgccttgctggtcaggcgcgaagcctgcagcgacagcaacagccagaggccgcactcctgcgatgtgaccaagccctagaactcgcaccagatgataactctctcttacttcttagggccgaattatatctcactatgaagaattatgagcaggcactccaagatgcctcagcggcttgtcagaatgagccactcttgattaaaggacatcaggtcaaggctcaggcgttgtccggtttaggtcggtccaaagaagttttgaaggaattcctgtattgtttagcactgaaccctgaatgcaattccgttaagaaagaggcccagaaggttatgtgcgaggtgctattcagtgcaaccgcaaacgttcacgagaatctcacctcttccattcaaagtaggctgaaggcccagggccacagccacatgaacgcgcaagctctgctggaagagggtgacgccggatcaagtgagaactcgtccgaaaaaagtgacatgctggggaacaccaatagctctgttctctacttcatcctcgggcttcattttgaagaagacaaaaaggcgctggaatcaatactgccaacagccccatctgccggactgaagcggcaattccccgatgatgttgaggatgctccggacctgaatgcaccaggaaagatccccaaaaaagatttatctctgcaaagatctccaaattctgagaccgaggagagccagggcctcagcctggacgtgactgacttcgagtgtgccctgtgcatgcgcctgctgtttgaacccgtcacaacaccatgtgggcacaccttttgtctgaagtgcctggagagatgccttgatcacgctcctcattgccccctttgcaaagacaaactgtctgaactgctggcttcacgtaattttaacatcaccgtcctggccgaagagctgattttccgatacttgccagacgagctctccgacagaaaacgaatctatgacgaggagatgagcgaattatcaaacctgacccgggacgtcccaatttttgtctgcgcaatggcatttcctaccgttccttgccctctccatgtgttcgaaccaagataccgtttgatgatccgccgatgcatggagactggaacaaagcgttttggcatgtgtttgagtgctgagcatgcgggactttctgaatacggttgtatgttggagatcaaggacgtgagaactttccccgatggctcgtcagtagtcgatgcaatcggaatttcccgctttcgcgttctgagccatcggcatcgggatggatataatactgccgatatcgagtacctggaagacgagaaggtagaaggtcctgagtatgaagagcttgctgccttgcatgactcagttcatcagcagagcgtgtcgtggtttgcaagcctccaggaccgaatgaaagaacaaatactctcccatttcggtgttatgcccgaccgagagcctgagcctcagtccaacccctccggtcccgcttggagttggtggatcttggccgtattgcctctggaacggaaggcacaactggcgatcctgggaatgacatcactgaaggaacgcctgctggctatacgacgcatactggttatcataaccaggaagatgaacagcagacaggaactggcgaacgcgagggagcggaacaactag

SEQ ID NO: 57339 - DNA, 1536 bp, Artificial Sequence
  Description of Artificial Sequence: Synthetic coding sequence
atgaagaattatgagcaagcactgcaagacgcctccgccgcatgtcagaatgagcccttgttaatcaaggggcatcaagtgaaggctcaggccctgtccggcctgggaagatctaaagaggtcctgaaggaattcctgtattgcctcgccctgaacccagaatgcaattccgttaagaaggaggcccagaaagtaatgtgcgaggttttgttttccgccacagcaaatgttcatgagaatctgacctcatctatacagtcaagactgaaggcccagggccactcacatatgaatgcccaggcacttttagaagaaggagacgctggatcttcggagaacagttctgagaagtccgatatgctcggcaatactaatagctcagtgctgtattttattctggggttgcattttgaggaagataagaaggctctcgagtcgatcctccccacagccccaagtgcaggcctgaaaagacagtttcctgacgatgtggaagacgctcccgatttaaacgccccaggtaagatcccaaaaaaggatctgtccctgcaaagaagcccaaatagtgagacagaggagtcgcagggactgtcattggatgtaactgattttgagtgcgccctgtgcatgagactgctgtttgagccggtcacaaccccatgtggacatacattctgcctgaaatgcctcgaacgatgtctcgaccacgctccccactgcccactttgtaaggacaaactgagtgaactactggcgagtaggaatttcaatatcactgtactggcagaggaactgatcttccggtatttgccagacgaactctcagacaggaagcgcatctacgatgaagagatgtcagagttgtccaatttgactagagacgtacccatcttcgtatgtgctatggcattccctactgtcccttgtcccttacatgtgtttgaaccacggtaccggctgatgattaggaggtgtatggaaaccgggacaaagcggtttggaatgtgcttgagcgccgaacatgcaggcttgtctgagtatggttgtatgttggagattaaggacgttcgtacctttccagatggtagcagcgtggtggatgccattgggatcagcaggttcagggtgctgagtcatcgccatagagacggatacaacacagcagatatcgaataccttgaagacgaaaaagtggagggcccagagtatgaagaactggcggcattacatgatagcgttcatcaacagtctgtgtcttggttcgcgagtctgcaggatcgcatgaaggagcagatactgtcacattttggggtgatgccagaccgcgagcctgaaccacagtctaacccttccggccctgcctggtcatggtggattcttgctgtactccccctggaaaggaaggcccagttggccattctcgggatgactagcctgaaggagcgccttctggccataaggaggatactggtgattattacacgaaagatgaactcaagacaggaactggctaacgcccgtgagagaaacaactag

SEQ ID NO: 57340 - DNA, 2157 bp, Artificial Sequence
  Description of Artificial Sequence: Synthetic coding sequence
atggagtccgtaaggattgaacagatgctgtcactcccagcagaagttagctctgacaatctcgaatctgccgaacgcggtgcctcagccgctcaggtggatatgggccctcatccaaaagtggccgctgagggccctgccccactgccaacaagggagcccgagcaggaacaatctcccggaacctcaacccccgagtcaaaagtgctcctgacccaggccgacgccctggcttcccggggacgcattcgcgaagcacttgaagtctaccgtcagttgagtgagagacaacagctagtggccgagcagctggaacagctcgtgcggtgccttgccgagaaggtcccccagggtgaagccctggcaccagcgccacccgacgagggcagcaccgccagcggaacagttgccgctgaagagactggagcagccgcagccgcagcagccacggaggtgtgggatggatttaagtgtcgcaagtgccacggctttttaagcgatcccgtatcgctaagttgtgggcacaccttctgtaaactctgtctggagaggggaagggccgcagatcggagatgtgcactgtgtggcgtgaaacttagtgctctgatggtcgctaccggccgtgctcggggagcacgcagggctgggcagcagccaccccctcctctccgtgttaatgtcgtgttatcaggacttctggggaagttgttccccggtcccgcacgcgcttcccagctcagacatgaaggcaatcggctgtaccgtgagagacaggtcgaggccgctctgctaaagtacaacgaggctgttaagttggctcctaatgatcacttgctttattctaaccgctcgcagatttatttcaccctggaatcgcacgagaatgccctccacgacgccgaaattgcatgtaagctgcgtcctatggggttcaaggacaatcttgaattgccacactgttccagccaggaggaagccgcagcccgtggggatggatcgtcgctgatggaccctgcgaaggtgaagggagacgggcagcaacaccacatgaaggatcaggaggaagaagaggagaaatgggacgctacatcccctaaagccgctagctcaaagacggggaaatgtcaggaaaaaaaacggaaacactgccaaatcgagtctcaggaggaaactgggatgcccaacaaagcatccaaacaggatccgccaaccgaccagggggacaaacctgcactcagcctgcctctggcaagtttcgacgcctccgacctggaatgcgccttgtgcatgcgcttgttctatgaaccagttactaccccgtgcggtcatactttctgtctgaaatgcctcgagcgatgccttgatcacaatgctaaatgccccctgtgcaaagatgggctgagtcagtgcctggcttcccggaaatactcaaaaaatgtgattatggaggagctgattgccaaattcctgcccgaggagctcaaggaacgtagaaagctttacgaggaagagatggaggagttgtccaatttgaataagaatgtgccaatcttcgtgtgcacaatggcttatcccaccgtgccttgcccactccacatattcgaaccatgctatcgcctaatgatcaggaggtgcatagagacagggaccagacaattcggtatgtgcttgggggacccggtcaaggggttcgcagaatatggctgtatcctcgagatcagaaatgtacagtttttcgccgatgggagaagcgttgtcgactcaattggcaaacggaggttccgcgtgctgcatcagagccagcgggacgggtacaatacagctgatattgaatacatagaggatcagaaggtccagggggaggattgcgccgagctgatgggcctccataactgcgtctaccagcaagcatccctgtggttccattctctgaaactgtcccttaagaaccgcatactgaaccatttcggacccatgccagagaaggatgccgacccacaaatgaatcccaacgggcctgcttggtgttggtggatgctggctgttctcccactcgagagccgggcacaactacccttcctcgctatgagaagtcttaaagatagactcaatggaatcagaagggtgctggcatttatcagccgaaatcagaattag

SEQ ID NO: 57341 - DNA, 2157 bp, Artificial Sequence
  Description of Artificial Sequence: Synthetic coding sequence
atggaatccgttcggattgaacagatgttgagccttcctgccgaggtgtcctctgacaacctggaatccgccgaacggggagcatcagcagctcaggtggatatgggtcctcatccgaaagtagccgctgaaggacccgcaccactacccacgcgagagcctgagcaggagcagagcccaggaaccagtactccagaaagcaaggtactactcacgcaggcggatgccctcgcctcccgcggaaggatcagggaggctctcgaggtttatcgccagctttcggagcggcagcagcttgtggccgagcaattggaacaactcgtgcggtgtctcgctgagaaggtcccacagggcgaagcactggctccagccccaccagacgaaggcagtacagcgagcggaaccgtcgcagccgaagagactggagcagccgcagcagcggcagctacagaagtgtgggatggtttcaaatgccggaaatgccatggtttcctctcagaccctgtatccctctcgtgcggacatacattctgcaagctctgcctggaacgcggtcgggctgcagacaggcgatgtgctctgtgtggcgttaagctctctgcactcatggtcgctaccggccgagcgaggggggctcgacgcgcaggccaacaacccccaccacctctccgcgtgaatgtagtgctcagcgggttgctggggaagttattccctgggcctgccagagccagccaattgcgacatgaaggcaaccgcctctatcgtgaacggcaagtggaggctgctctactcaagtacaacgaggccgtgaagctggcacccaacgatcatcttctgtactccaatagaagccagatttactttacgctcgagtcccacgagaatgccttgcacgatgccgagatcgcttgcaagctgaggccgatgggcttcaaggacaatctcgagctgccacactgttccagccaggaagaagctgctgcgagaggtgatggatcttctctgatggacccagccaaggtcaagggcgacggacagcagcaccacatgaaggaccaggaggaggaagaggagaaatgggatgcaacttccccgaaagcggcttcctcaaagaccggaaaatgccaggagaagaagcgcaagcattgccagatagaatctcaggaagagaccggcatgcccaataaggcctccaaacaggatccccctaccgatcagggagataagccagccctgtcattaccactggcgtcattcgacgcttccgacctggaatgtgccctatgtatgagactgttttacgaaccagtgaccacaccatgtgggcacactttttgtctcaaatgtctagaacgatgtctcgaccacaacgccaaatgcccactgtgcaaggatgggttgagccaatgtctggcgagcagaaagtacagtaaaaatgttatcatggaggaactaatcgccaaattcttgcccgaggagctcaaagagcgacggaaactgtatgaagaggagatggaggagctgagtaatctgaacaagaatgtgccgatcttcgtttgtacaatggcatacccgactgtgccctgtccactgcacatctttgagccgtgctacagacttatgatccgacgatgcatagagaccggcactagacagtttggaatgtgtctgggcgacccagtgaaaggctttgccgaatacgggtgtattctcgaaatccgcaacgtccagttctttgcagacggtcgatccgttgtggatagtatcgggaaacgcaggttcagagttttacaccaatcacaaagagatggatacaatacagctgatatcgaatacattgaagaccagaaagtgcagggagaagactgtgcggaactcatgggattgcacaactgtgtttatcaacaggccagcttatggttccactctctcaagctttctctgaagaatcgcatactgaatcatttcggccctatgccagagaaggacgccgaccctcagatgaaccctaacggccctgcctggtgttggtggatgctggctgtgctgcccctggagtcacgtgcgcagctcccattcctcgccatgcgatctctcaaagataggctcaacggcataagaagggttcttgcgtttatatctcgaaatcaaaactag

SEQ ID NO: 57342 - DNA, 2280 bp, Artificial Sequence
  Description of Artificial Sequence: Synthetic coding sequence
atggagtccgtacgtatcgaacagatgctgagcctacctgctgaggtttctagcgacaatctggaatctgcagaacgcggagccagcgccgctcaggtggatatgggcccacaccccaaagtggccgcagaaggacctgcacccctcccaacccgggagcctgagcaagagcaaagtcctggcactagtacccccgaatctaaggtactgctgacacaggccgacgctttggcttcccggggtaggatccgggaggccttagaggtttatagacagctaagcgaaaggcaacagctggtggctgagcagctggagcagctagtgaggtgtttggctgaaaaggtgcctcagggagaagcacttgctcccgcacctcccgacgaaggtagcactgcctcgggcaccgtcgctgccgaggagaccggggcagctgcagcagccgcagcaaccgaagtctgggacggcttcaaatgccggaagtgtcatggcttccttagcgatcccgtgtctttgtcttgcggtcacactttctgtaagttatgcttggagagaggccgagccgctgatagacggtgcgccctgtgtggtgttaaactgtcagccttaatggtcgcaaccggcagggccagaggcgcaagacgagccggacagcagccaccacccccacttagggtcaatgtggtgctgtcgggcctcctaggcaaactctttcccggaccggctagagcaagtcagctgagacatgaagggaaccgactctaccgtgaacggcaggtcgaggctgccttactaaagtacaacgaggccgtcaagctggcgccaaacgatcatctgctctactctaatcgatcccagatatactttactttggagagccatgagaacgccttgcatgacgccgaaatcgcctgtaagctgaggccaatgggtttcaaagcacactttaggaaagcccaggccttagcgaccctggggaaagttgaagaggctctacgggagtttctgtattgcgtctcacttgatggaaagaacaagcgagcaaggtgtgaagcacagagagataacttagaactgccacactgctcttcccaggaggaagccgctgcaagaggcgatggcagctccctcatggaccccgctaaagttaagggagacgggcagcagcaccatatgaaagaccaggaagaggaagaggagaagtgggatgctacctccccgaaggctgcatcttccaagactggaaagtgccaggagaaaaaaagaaagcattgccagatcgaaagtcaggaggagacggggatgcccaacaaagcatctaaacaggatccacctactgatcagggagataagccagctctgagcttacctttggcatcctttgacgccagtgatctggaatgtgcactctgtatgcggctgttttacgaaccggtgacaactccctgcggccacacattttgcctgaaatgcctcgaacgatgcctggaccataacgccaagtgtcccctgtgtaaggacggcttaagccaatgtctggcatctcgcaaatactccaaaaacgtgataatggaggaacttatagctaagttccttccagaggagctgaaagagcggcgaaagctgtatgaagaagagatggaggagctctccaacctcaacaagaacgtgccaatcttcgtttgtacaatggcctaccctacagttccatgccctctccacattttcgaaccgtgctacaggctgatgatcagaagatgtatcgaaacaggaactcggcagtttggcatgtgcctgggggatcctgtgaagggtttcgcagaatatggttgcattctcgagattaggaatgtccagtttttcgcagacggtcggagcgttgtcgattctattgggaaaaggaggttcagggttttgcaccagtcacaaagagatggatacaacacggctgacatcgagtacatcgaggaccagaaagtgcagggtgaggactgcgctgagctcatgggactgcataattgtgtgtaccagcaggcatctctctggtttcactccctaaagctctccctcaagaaccgtatcttgaatcactttggtccaatgcctgaaaaggatgctgatccccaaatgaatcccaatggccctgcctggtgttggtggatgttagccgtgctaccccttgagagtcgagcacaactgccttttctcgctatgcgatccctgaaagatagactcaacggtattcgtcgcgtcctggcctttatcagccggaaccaaaattag

SEQ ID NO: 57343 - DNA, 1512 bp, Artificial Sequence
  Description of Artificial Sequence: Synthetic coding sequence
atgggttttaaggcccattttcgcaaagcccaggcattagctaccctcgggaaggtcgaagaagcgctcagagaatttctgtactgcgtgagcctcgacggcaagaacaaaagggccaggtgcgaggcccagcgactcctgctctccttttttagcccaagcgtacccggagatagtcaagagcattccccagatattctcaaactgctcgcccctcatccaaggctgaaggagaacgtggagagcatgaccaccgaggttacaagccacaatctgcccaggctgctgcaggacaacctcgagcttccccactgctcaagccaggaggaagccgctgcacgcggtgatgggtctagtctgatggacccagcgaaagtgaaaggcgatggtcagcagcaccacatgaaggatcaagaagaggaggaagagaagtgggatgctactagccctaaggctgcgtctagcaagacagggaaatgtcaggaaaaaaaacgcaagcactgccagatcgagtcccaggaggaaaccggtatgccaaacaaggcctccaaacaggatccccctaccgatcagggcgataaacccgctctctcgcttcctctggcgtctttcgacgccagtgatcttgagtgcgcgctttgtatgaggctgttctatgaacctgtcaccactccttgtgggcacaccttctgcctaaaatgtctggaacggtgtcttgaccacaacgccaagtgccccttgtgtaaggacggcctgtcccagtgcctcgcatcaagaaagtactccaaaaacgtaatcatggaagagctcattgcaaagtttttgcctgaggagcttaaggagcgcagaaagctgtacgaggaggaaatggaagaactgtccaacctcaataagaatgtacccatttttgtatgtactatggcatatccgactgtcccctgccccctgcacatctttgagccctgttatagactcatgatccggagatgtatcgagaccggcacccggcagtttgggatgtgtctgggagacccggttaaagggtttgcagagtacggatgtatcctggagattcgaaacgtgcagtttttcgccgatggcagatcagtggtcgatagcattggaaaacggagatttagagtattgcatcaatcccaacgggatggctataataccgcagacattgaatatattgaggatcaaaaggttcagggcgaggattgtgccgagctcatgggtctccacaactgcgtgtatcaacaggcatctttatggtttcacagtcttaagctgtcactgaagaacagaattctgaatcactttggcccaatgcctgagaaggacgccgacccacagatgaatcccaacggcccagcatggtgttggtggatgctagcagtgcttccgctggaatcaagggcccagctgcctttcctggccatgaggtcactcaaggacaggttaaacggaatcagacgcgtgctggcttttatctcccgcaatcagaattag

SEQ ID NO: 57344 - DNA, 1578 bp, Artificial Sequence
  Description of Artificial Sequence: Synthetic coding sequence
taatgcggcgtaaagctatcagcgctgatggtcgccaccggtagagcacgtggcgcacgtagagccggtcaacaacccccaccacccctgcgtgttaatgtcgtactgagcgggttgctgggcaagctctttccaggccctgctagagcctcccagctgcggcatgagggcaaccggttatatcgggagcgccaggtggaggcagcgttgctgaagtacaacgaggcagtcaaactggctcccaatgatcacctgctgtattccaacaggtctcagatttattttacgttggaatcccatgaaaacgccctgcacgatgcggagattgcctgtaagctgaggccaatgggattcaaagataatttagagctgcctcactgttcttcccaggaggaggcggcagccagaggagatgggtcaagcttaatggacccagccaaggtcaaaggagatggacagcagcaccacatgaaggaccaggaggaagaagaggaaaagtgggacgcaacttcccccaaggccgcttcaagcaagacaggaaaatgtcaagaaaagaagcgcaagcattgccaaattgagagtcaggaggaaactggcatgccaaataaagcctcaaagcaagatccaccaacagatcaaggtgacaaacccgcactttctctccctctggcctccttcgacgctagcgatctggaatgcgctctttgtatgcggctcttctacgagcccgtgacgacgccatgcggtcatactttttgtcttaagtgtctagagcgctgtctggaccataacgccaaatgtcccctttgcaaggacgggctctcccaatgtctcgctagtagaaagtatagtaaaaacgtcataatggaagaacttatagctaagtttctgcccgaggaactcaaagagcgaagaaaattgtacgaagaggagatggaggagctgagtaacctaaacaaaaatgttccaattttcgtctgcactatggcttatcccaccgtgccctgtcctctccacatttttgaaccctgttaccggttgatgattcgcaggtgcattgaaaccggaacgcgccaattcggaatgtgtttgggtgacccagtgaagggttttgctgagtatggctgcatcttggagataagaaacgtacagttctttgctgacggtaggtccgttgtcgactcaattggcaagcgacggtttagagtgctccaccagagccagcgggacggatacaataccgctgatatagagtacatcgaagaccagaaagtgcaaggagaggattgtgctgagcttatggggcttcacaattgtgtgtatcagcaagcaagtttatggtttcattctctgaagctgtccctaaaaaacaggatcctgaatcatttcgggccaatgccggaaaaggacgcagatccacagatgaatcccaacggaccagcttggtgctggtggatgctagcagtactgccactggagtctcgcgcacaactgccttttctggccatgcggagcctgaaggatcgactcaatggaatccgacgggtgcttgctttcatcagtcgcaatcagaattag

SEQ ID NO: 57345 - DNA, 1389 bp, Artificial Sequence
  Description of Artificial Sequence: Synthetic coding sequence
atgggcgctgccggacgcgctacccgtctggtcgggggtcgagaacaacggggtgccgtgggtggcggatggtgggggggtgagcccgatattccctacacccataccacagaacacccgccaatgggatcaccgcttccgaacctgcgcgctcatgttagaacgggacgcccacctgacccatgtactgctgcggcacgcgaccgcagaccacttggccgaggcggacggggagccgcacagacctttggacaacggacacggggaggccctcggtgccctggctctcaccggcagagacctccgtctatgaaggcggcaccccgactcccacacagactccgacacagaggccaacctcctgagcctagctctctgagagcactgcacgccgatccgattccgtccgggctttccccaggcccttgcggcgctcccccaacgtggagtggaaggcgcgcaccaggcgatcgggacaatcgtccaacgtctggcccttggcagcgccatacgagacgttctcgggtctggagtcagcgaggtccccctcagccaaagctcgtcagcaggagcggtcgagaagatacgcgtgcaggtcgtggggctcagaccggaaaagccagagaccgcaagggtaagggcactagggagcccgcagagggcaggcttggcaaaaaaccacaggctaaacccggacatcaggagaacaccgcaaccgggtctcatcgacaccggtatgaggggggtccagccgctcccaggctcggaagtagaacagcccctgggacccatcgggacccaccccacgaacctgggtctcgccaccgggatccagaagcaacctcagccaccaatccaactccgggtcctagatgctggttcttggtacaccccccaaccctctcttcctcggggaggcccgctcgtccacccctgggtatgctgccaatggcaaggcaccccaatccagtgccaagaaaacgaggatgccgccaccgcagtctactgttgagaggcgcaggaggtgaaccagcaaggtctggagccggtcacgcgcctgatggtacacccggaactgccaccgcaagagccgcttctcagccattgggtaggcggcctgggcctgcgggatcctcgcctgacagtgaaggtgggggtgccggacacaccgtaggggacgagccgccttcagtgcccactgccgaagacagcctgaaaagggagtcagtgcgcgacagctcgttttcccccgaaagcagtgaagtggacggaggcctgtgctcagaacttctttggtttcagctggcggcaaggaggagagagatctccaacgttagccgggaggcccgagccactgtgatagagcccaggaaatggagacttcagtag

SEQ ID NO: 57346 - DNA, 495 bp, Artificial Sequence
  Description of Artificial Sequence: Synthetic coding sequence
atgaggcctcaaccaaggggagggtcagggaggaaggaaaatacaggggaagaaagagaaggtcgggctgagagatatcacgcaatctccgctgacggcgaacgcaggttgcagcccggaactgccgttttaacacgccacgtgtccttcctttttggaggcagggaggcggaggagcacgtgatggagaccgacagagtggaaggtgcacgggacggggacaaacggaaagaagtttgtttcgtaccaattcaagggtctttctgcttcatgcgtctgacttgtgccagacttgtggctgcattggatattcacgggctgtccttcagcctccggttttgtggctcgcgagatactaaacacgaggacattaccgggagagaaggccaagttacccccctgcccaggggtactccccagctctgtactgctcgggttggattgtcttctccgaggacgaggggacaaggggtccctatcagctgtaagacatag

SEQ ID NO: 57347 - DNA, 261 bp, Artificial Sequence
  Description of Artificial Sequence: Synthetic coding sequence
atggtcagacacccgtatagcgttcagacacagctgtccacagaggcgaaagccatttggcggtcgatgcagcagcaggaaactaatcttctagccaatttaacaacaaatgacgctagggataactctaaagactttcaaaattctaaggtaggcgcagccgcaacctctcgtgacgaaggttgtaattgtccaatcataggtgagatcgtcatctcctgctactggttgtttgagatccctcctttgattagcaggtag

SEQ ID NO: 57348 - DNA, 192 bp, Artificial Sequence
  Description of Artificial Sequence: Synthetic coding sequence
caacaacaggagaccaacctcctagccaacctgacaactaacgatgcacgagataactctaaggatttccagaattcaaaggtcggtgccgcagccacatcccgggatgagggttgcaattgcccaatcataggcgaaattgtcatctcgtgctactggctgttcgagatccctcctctcattagtgaatag

SEQ ID NO: 57349 - DNA, 249 bp, Artificial Sequence
  Description of Artificial Sequence: Synthetic coding sequence
atgcagtgcctttactttattctgattctgaagggctatttccaccagcagcaccatactctgcttattactattgcgctctgtttcttacagcaacagcaagagaccaatctactggcaaacctcacgacgaatgatgcaagagacaactcaaaagattttcagaacagcaaagtgggagctgcggcaacaagccgggacgaaggagagacacagaaatgtatccagaagcccctccacgagaaatag

SEQ ID NO: 57350 - DNA, 795 bp, Artificial Sequence
  Description of Artificial Sequence: Synthetic coding sequence
atgccaaggagcctgaagcgcgctcaactgaggtcccttttgcccagaccgccagccgtctcacatacgcagccatggtaccgtgccgctcatcccacaactagccccaccgcagccagccgggacgtgcatccagcttctggcgctgtccccggtccatggctggtggaggggactgcagtcagggagggtccacagctgcaggacgcagtgcctcagaggccaaccagacctagcaaggctctttggcccgcacagatgagcgcggctccggctatccgattggggcaaatggtccctggtgacactcggggactgtggggcccacagggaacccttctcacatggacatatcgcggtggtcagggaggcagatggacacggagagctgaaggaccacgggaagggaccttcgccgaacaacggcctcactttcagagttctggtgcgcagcaggagagccgtttagccatggggcctccacctctcgggctcggcgacgccgctggcgatggcaggggccagaccgggcaggaaaaaggccgagcagagggcagacaggcacggaagtccgcctgtaaatgccccaggaagggtccaaacccgggaccttggaccagagcggctgcttggtggggaagactagagggggcaaaagctagcgccaagggcgaacaggtcagagacccgggagggcacctgtgggaacagggtcatgtctctccctgtgctcgatttaaccagggtcactcatgtggcagcccaaaagtctctcacactacttgggttagctag

SEQ ID NO: 57351 - DNA, 447 bp, Artificial Sequence
  Description of Artificial Sequence: Synthetic coding sequence
atggggtcagaacagtctagcgaggccgagtccaggccaaacgacctgaactcctctggcctcttgagcggtcaaacctcccccactaacgctaagctggagaagcttgactcccaacaggtactgcaactatgtctaaggtaccaagatcacctccaccagtgcgcagaggccgtggcttttgaccaaaatgctctagtgaaacgcattaaggagatggatctttccgtggagacattgttttcatttatgcaggagcggcaaaaacggtatgccaaatacgctgagcagattcagaaagtcaatgaaatgtcagccatcctccgcagaatccaaatggggatagaccagacagttccattattagaccggctcaatagcatgctcccggaaggggagcggctcgagccatttagtatgaaacccgatcgagagctgcggttgtag

SEQ ID NO: 57352 - DNA, 591 bp, Artificial Sequence
  Description of Artificial Sequence: Synthetic coding sequence
atgggaagtgaacagagctctgaggcagagagccgccctaacgatttgaatagcagtgtaactccttcacccgcaaagcacagagctaagatggacgatattgtagtggtcgctcaaggcagtcaagcgtcccggaatgtgtccaacgatcctgacgttatcaagctgcaggaaatccccactttccaacccctccttaaaggcttattgagcggacagacttccccaaccaatgcaaaactggaaaagctggatagtcaacaggtactgcaactgtgtctgagataccaggaccacctacaccagtgtgcagaggcagtggctttcgatcaaaacgctttggttaagaggatcaaggaaatggatcttagtgtcgaaactcttttttcttttatgcaggagagacagaaaagatatgccaagtacgctgagcaaattcagaaggttaacgagatgtctgctatcctgcgtaggatacaaatgggaattgatcaaacagtgcccctcctcgaccgcctcaactccatgctcccggagggggagcgcctagagccattctcgatgaagcctgaccgtgaactgagattgtag

SEQ ID NO: 57353 - DNA, 501 bp, Artificial Sequence
  Description of Artificial Sequence: Synthetic coding sequence
atgcagggtactagagcggaattgtcagcccactctccatccagggccgcaggcaaccggagacacgagcagggcctgcctcccggagcacaggcctgtatcaccctcactaatcgaaccgggtttttgtgccacgaccagcgctcttgtatccctgcatccggcgtgtgtgacggcgttcgcacttgcacccatggcgaagatgaggacgaaagtctatgccgagatgtgccacagtcccttccacactttctagttgcccactgtggggatcctgcttcctggatctacagtgatcagaagtgtgatggcactaataattgcggagattgtagcgatgagctctccccagtgaccgtttgccctccctgtggccctggatggtggaggtgcccgtctaccttctttaaatactgtgattgtatcccacgccatctgtgccgtgatcacgtgcagcactgctccgattggtctgatgaatatgcgtgccctggcccatag

SEQ ID NO: 57354 - DNA, 489 bp, Artificial Sequence
  Description of Artificial Sequence: Synthetic coding sequence
atgaataaggtgtttccccagggcgaaaatgggtacacggcagcagagtctaaggcgcaccctggcggagagggcgcacaggcctgcataacccttaccaataggactggcttcctctgccacgatcagcgctcctgtatacctgcatctggagtatgcgacggtgtgagaacttgtacacatggagaggatgaggatgaatctctctgtcgggatgttccacagtcattgccccacttcctagtcgcgcactgcggggatccagcatcctggatctacagcgatcagaaatgcgatggcacgaacaattgcggggattgctctgacgagctctctccagtgactgtgtgtcctccatgcggcccagggtggtggaggtgtccttccacgttctttaagtactgcgactgcatccctcggcacctctgtcgggatcatgtacagcactgcagtgattggtccgatgagtatgcatgtcccggtccttag

SEQ ID NO: 57355 - DNA, 759 bp, Artificial Sequence
  Description of Artificial Sequence: Synthetic coding sequence
atggagggtcacgtctattggacggatgacgaagtgtgggcaattaggcgagcctatcttgacggtagcggcgcacagacattaatcaatactaagattaatgacccagacgatattgctgtgaactgggtagctagaagtctgtattggactcacaccggcacagagcacattgaggttacatgtctcaattccacaagccataaaatcctggtgagcgaggacatggacgaaccacgcgcaatcgccttgcatcccgaaatgggattaacctattggatcgactggggtgagaaccctgaaatcaaaagggccaatctggaccgccaagaactgagagtgctcgtgaatgcatcgctggggtggcctaacggtctggctcttgacctgcaggaaggtaaactgtattggggagacgctaagacagacaaaatcgaggcaatctccgtggatgaaaccaagaggcagacattgttgaaagataaactgccacacatttttagatttacacttttgggcgatttcatatattggaccgcttggcagcaccacagtatcaagcgagtgcacaaggtgaaagcaaatagggatgttatcattgatcaactccctgatctaatgggattaaaggccgtgaatgtggacaaggtggtgggcacgaacccccatgccgaccgcaatgggggtgcagcaacatgtgcgtctagccggccaactcagccaggcttagcggctccatccagagcatggaactgctag

SEQ ID NO: 57356 - DNA, 759 bp, Artificial Sequence
  Description of Artificial Sequence: Synthetic coding sequence
atggagggccatgtctactggacagacgacgaggtttgggccataagaagggcatatctagacgggagcggggcacagaccttgatcaatacaaagatcaacgacccagatgacattgccgtgaattgggtcgccagatctctctactggacccatacgggcacagagcatattgaggtgacatgtctgaacagcaccagtcataagatcctcgtctcagaagatatggacgaacccagggcaattgccctccacccggaaatggggctcacttattggatcgactggggcgagaacccagagatcaaacgggcaaacttggaccgccaggagctgagagtgctggtaaacgcttcccttgggtggcctaacggattggccctggatctccaagaaggcaaactgtattggggcgacgcaaagacggacaaaatagaggccatctcagtggatgaaaccaagcggcagacactccttaaggacaagctcccacacattttccgtttcactctgctgggggattttatctactggaccgcctggcagcaccacagtatcaagagggtgcataaggtaaaggcgaaccgagacgttatcatcgatcaacttccagacttgatgggcctgaaggcagttaatgttgataaagtggtcggtaccaatccccatgctgatagaaacggcggagccgctacatgcgcgtcatccagacccacccagcctggcctggccgcaccatcgcgagcttggaattgttag

SEQ ID NO: 57357 - DNA, 675 bp, Artificial Sequence
  Description of Artificial Sequence: Synthetic coding sequence
atggaagggcatgtctactggaccgacgatgaagtttgggccatccgcagggcttatctcgatggatccggcgctcagacactgatcaacaccaagattaatgatccagacgacatcgccgtcaattgggtggccaggagtttgtactggacacacaccggcaccgaacacatcgaagtgacttgcctgaattcaactagccacaaaatccttgtgtctgaggatatggatgagccaagggccattgcgttacaccccgagatgggattaacttactggatcgattggggggagaacccagaaattaaacgcgctaatctggataggcaggagcttagggtgctggtgaacgccagccttggctggccaaatggacttgccttggatcttcaagagggcaagctttattggggagacgcaaagaccgacaagatcgaggccatatccgtggacgaaaccaaaagacagacgctccttaaagataagctcccccatatctttcggttcacactccttggtgactttatatactggaccgcctggcaacaccatagcatcaagcgtgtgcacaaagtgaaagccaacagggatgtgattatcgaccagttgcctgatcttatgggactgaaggcggtgaatgttgataaggtggtcgggccaggtacggctgagtag

SEQ ID NO: 57358 - DNA, 12 bp, Artificial Sequence
  Description of Artificial Sequence: Synthetic coding sequence
atggagggctag

SEQ ID NO: 57359 - DNA, 1158 bp, Artificial Sequence
  Description of Artificial Sequence: Synthetic coding sequence
atgagtggctcgtccgggactccatacctgggctcaaaaatttctctgatctcaaaggcacaaatcagatatgagggcatcctttatactatagacaccgataattccactgtggccttggcaaaagtgcggtccttcggtactgaagacagacctacggatagaccagccccacccagggaagagatttatgagtacatcatctttcgtggcagcgacataaaagatatcacagtgtgtgaaccccctaaagcacagcacacactgcctcaggatcccgcaattgtgcagagttcacttggcagcgccagtgcatctcctttccagccccacgttccatactctccattccggggaatggcaccttacggaccgctggcagccagcagccttctgtcccaacagtacgccgctagtctgggcctggaaaagttggtttcaccgcctgcctccgcagcggcttcatccccatctagtagtcctagtcctcagcctgtgtcagagctcgatttgtcatcagaaccacagcaactgacagccaagggtaactcatctctgggcgagctccatgctgtactgcagacaatcctgcgcgcacggggtaaggccgctgatagaatgaccgtcgccgtggcagaccatctgccaagtccatgtagccggcgaaggtccggcaaccgccgaacacgcaatcgaagcagagggcagaacaggcctaccaacgtaaaggagaacaccattaagtttgagggagacttcgacttcgagtccgccaacgcccagttcaatcgggaggaattagataaagaattcaagaaaaaactgaacttcaaggacgataaggcagagaagggggaagaaaaagacctagcggtcgtgacacagagtgccgaggcgcctgcagaggaagatctgctgggacctaattgctactatgataagagcaaaagcttttttgataacataagcagcgagctgaagacgtctagccgacgaacaacctgggctgaggagcgaaaactcaatacagaaacgttcggagtgtctggcagattcctccgtggtcgttcctcaaggggaggatttaggggcggacgtggcaatggcaccacgcggaggaaccccacgtctcatagagccggtacagggagagtctag

SEQ ID NO: 57360 - DNA, 1158 bp, Artificial Sequence
  Description of Artificial Sequence: Synthetic coding sequence
atgagcggtagcagcggcactccctaccttggatccaagatttcgctgatatcaaaggcacaaattcgatatgaaggtatcctctacaccattgacactgacaatagtacagtggccttggcaaaagtgcggtcttttggcacagaggaccgtcctacagatagacccgctcccccacgggaggagatatacgaatatatcatatttcgaggctcagatataaaggacataacggtatgtgaacccccaaaggcacaacacactctcccccaggatccagcaatcgtgcaatccagtttgggatccgcttctgcatcccccttccagccccatgtcccttatagcccgtttaggggaatggctccgtatgggccattggcagcttcttcgctgttaagtcagcagtacgcagcttcactgggtctgggtgcaggcttcccttcaatccctgtagggaagagccccatggttgagcaggccgtacagacaggcagcgctgataacttgaacgccaaaaaattactgccaggtaaggggacaaccggcacccagctgaacggtcgtcaagcccagccatcctccaaaacagcctctgatgtcgtccagccagccgctgtccaggcccaggggcaggtgaatgacgagaaccgacggcctcagagacggagaagcgggaatcggaggacgaggaaccggagccggggacagaatcgccctactaatgtgaaggagaatacgataaaatttgagggcgactttgatttcgagtccgccaatgcccagtttaatcgtgaggagctcgataaggagttcaagaagaaactcaactttaaagatgataaggccgagaaaggtgaagaaaaagatttagccgtagtaacacagtcggccgaggccccagctgaggaggatctactcggccctaattgctattatgacaagtctaagtcattcttcgataacattagttccgagctcaaaacgagctctagacggaccacttgggcggaggagaggaagctgaacactgagacctttggcgtatctggccgttttctccgcggacgctcaagccgcggtggctttcgaggcggacggggtaatggaacgactcgcaggaatcctacttctcacagagcgggtactggccgagtttag

SEQ ID NO: 57361 - DNA, 672 bp, Artificial Sequence
  Description of Artificial Sequence: Synthetic coding sequence
atgtctgggtcctctggaacaccttaccttggatccaagatttctctcatctccaaggcacaaatacgatacgagggtatcctctacaccatcgataccgataatagtactgtcgctttggccaaggttagatccttcggtactgaggaccgcccaacagaccggccagcccctccaagagaggagatatacgagtacattatctttcgcggatccgatatcaaagacatcaccgtgtgtgaacctcctaaagcgcagcacacgctccctcaggatccggctatcgtgcagagttccttaggatcggcttcggccagcccctttcagccgcatgtgccttatagcccattcaggggaatggccccatacgggcctttggctgcttctagtctcctttcgcagcagtacgctgcaagtctggggctgggggcaggttttccctccattcctgtgggaaaaagcccaatggttgagcaggcggtacagactgggtcagccgacaatctgaacgccaagaaactcctacccggaaaaggaacaacaggaacacagctgaacggaagacaagcccaacccagctcaaaaactgcctctggtaacaggagaacccggaataggagtaggggacagaatcggcctactaacgtcaaagaaaacacaattaagttctag

SEQ ID NO: 57362 - DNA, 747 bp, Artificial Sequence
  Description of Artificial Sequence: Synthetic coding sequence
atggcaccttatggtccccttgcggcatcgagtctcctgtctcagcagtatgccgcatccctgggtctagagaaattggtttctccacccgcttcggctgcagcttcctcaccgtcctcttctccatctccacagcctgtatccgaactggatctgagcagcgaaccacaacagctgaccgccaagggagctggctttccaagtatacctgtcggcaaatcccctatggtagaacaggctgtacaaacaggatccgctgacaacctgaatgccaagaaactgttgccaggtaagggtaccacagggacacagctaaacgggcgacaggcccagccctcatcgaagacagcctcagacgttgtccaaccagccgcagtccaggcccaaggacaggtcaatgatgagaaccgccgtcctcagcgaagacggagcggaaaccgtaggacgaggaataggtctcggggacagaacagacctaccaacgtgaaggagaacactatcaaatttgagggggatttcgacttcgagagtgcaaacgcacaattcaacagggaggaactggataaagagttcaaaaaaaagctgaattttaaagacgataaggcggaaaagggtgaggagaaggatcttgctgtggtgactcagtccgctgaggcaccagccgaggaggaccttttgggccctaattgttactacgacaaatccaagtctttcttcgacaatatcagcagcgagctgaaaacctag

SEQ ID NO: 57363 - DNA, 720 bp, Artificial Sequence
  Description of Artificial Sequence: Synthetic coding sequence
atggcaccctatgggccactggcagcctcctctctcctcagccagcaatacgccgcttctctaggtctcgaaaagctggtttctccacccgcatccgctgcagcctccagtccctccagctctcccagcccccaacctgtgagcgagctggatttgagtagcgaaccacaacaactcaccgcaaagggttgcttgttctgttttaggtcactgtttacgtacacgcagtctcacattgtgctgtttagggtgccaacaggtcctggcaccttggaaagggaggagatggaaaggggggctggtttccctagtattcctgttgggaaatccccaatggttgagcaggcagtgcagactggtagtgccgacaatctaaacgctaagaaactgctcccaggcaaaggaacaaccgggactcagctgaacggaaggcaagcgcaaccctctagtaagaccgcctcagatgttgttcagcccgctgccgtccaggcccagggccaagtgaatgatgaaaatcggaggcctcagcgaaggagaagtggtaaccgcaggacaaggaaccgcagtcgcggacagaatagaccaactaatgtcaaggaaaatactatcaagttcgagggggattttgatttcgaatccgctaacgctcaattcaacagagaggagctggacaaagaattcaaaaaaaggccaatcttgctgcttgtgttctggacttag

SEQ ID NO: 57364 - DNA, 666 bp, Artificial Sequence
  Description of Artificial Sequence: Synthetic coding sequence
atgtccgggagttccggcacaccttacctcgggagcaagattagtcttatctcaaaggcacagatccgatacgagggtatactgtacacaatcgacacagacaattccacagtggcactagccaaagtccgctcctttgggaccgaggatcgccctaccgatcgtcctgctcccccacgagaagagatttatgaatacattatctttcgaggtagtgatatcaaggatattactgtgtgcgagcctcccaaagcccagcacacactcccacaagaccctgccattgtacagagttccctgggttccgcctccgcgtcaccattccagcctcatgtgccatactcaccatttaggggcatggccccttacggcccattggccgcttcaagcctgttgtcacagcagtatgccgcttcactggggctggaaaagctggtgagtccaccagcgtctgcagctgccagttcaccctcaagtagccccagtccacagccggtgagtgagcttgacctaagcagcgagccccagcagctaaccgccaaagggaatagttctttgggagagttacatgcagtactccagactattctgagggcccgtggaaaggctgctgacagaatgaccgttgcggtcgccgaccatctgccttcgccatgctccagatag

SEQ ID NO: 57365 - DNA, 891 bp, Artificial Sequence
  Description of Artificial Sequence: Synthetic coding sequence
atgtctgggtccagtgggaccccgtatctagggtccaagattagcctgatctcaaaggcacagatcaggtacgagggtatactgtacacaatcgacactgacaactcaactgttgcgctggctaaggtccggtcttttggaactgaagaccgccctacagatcgaccggctccccctcgggaagaaatctacgagtatatcatattccgtgggagcgacatcaaagacatcaccgtatgcgaaccccctaaggcccaacatactctgccccaagaccctgccatcgttcagctgaacaagaggccagacgagggtgtgaggggggatggaatggcgtttgcagtactgacccggtgtctggttgtacagagcagcttgggaagcgcatctgcttctcccttccaaccacatgtgccatattcaccgtttcgcggaatggctccatacggtcccctggccgcttcttcccttctgtctcagcagtacgcagcaagcctgggtctgggtgccggattcccaagtatacctgtcggcaagtccccaatggttgagcaagctgtacagacgggaagtgccgacaatctgaatgccaagaagctgttgcctggcaagggcaccactggaacccagctgaatgggaggcaggcacagcccagctccaagacagcctctgacgttgtccaaccagccgcagtacaagcacagggacaggtgaacgacgagaatagacgacctcagcgtcgtcgcagcgggaataggcgcacacgtaatcgctctcggggacaaaacaggcccaccaatgtcaaagagaacaccattaagtttgaaggggacttcgactttgaatctgccaacgcacagttcaacagggaagagctggacaaagagtag

SEQ ID NO: 57366 - DNA, 693 bp, Artificial Sequence
  Description of Artificial Sequence: Synthetic coding sequence
atggccccttacggccctttagctgcatcctccctactcagtcagcagtacgctgcgagccttgggctggagaaactggtgagtccgcctgcctctgcagccgcatcttcgccctcttcctccccaagtccccagccagtgtccgagctggacctctcttctgagccgcaacagttgacagcaaaaggttgtctgttctgttttaggtccttgttcacgtatactcagagtcacatcgtcctgttccgggtgccaaccggacccggaactctggagcgggaggagatggagcgaggtgccggtttccccagcatccccgttggcaaaagccccatggtggaacaggccgtacagaccggctctgcagataatctgaatgccaaaaaactgctccccggaaaaggcactaccggcactcagctgaacggtaggcaggcccagcccagcagcaagacggctagcgacgtggtgcagcccgcagcagtgcaggcacaaggacaagtgaacgatgaaaatcgcaggcctcagagaaggagatcagggaatcgcagaacccggaatcggtccagaggacaaaatagacctacgaatgtgaaggaaaatactattaaattcgaaggggacttcgattttgagagtgccaacgcccagtttaaccgggaagaacttgataaggagttcaaaaaaaaatag

SEQ ID NO: 57367 - DNA, 1158 bp, Artificial Sequence
  Description of Artificial Sequence: Synthetic coding sequence
atgagtggaagttctggaaccccgtaccttggttccaagatttctttaatttcaaaggcacagattcggtacgaaggcatactgtacaccattgacactgacaacagcaccgtggcccttgcgaaggtccgctcatttggcacagaagaccggccaactgatcgcccagctccccctcgcgaggagatctacgagtacataatatttcggggttcggatattaaggacattaccgtgtgcgagcccccaaaagcccaacataccctgcctcaggacccggctattgttcagtcaagtctgggctcagcttctgcgtctccattccaacctcatgttccctacagccccttccgagggatggcgccttacgggcctctggctgcaagctcgctccttagccagcaatacgcagcctcacttggactaggggcaggttttccgtccattccagtagggaaatctccaatggtcgagcaagctgtgcaaactggatccgcagataatctgaatgctaaaaagctactaccagggaagggcacgactggcacacaacttaatggaagacaggctcagcctagctccaagactgccagtgacgtggttcaacccgctgcagttcaggcccagggccaggtaaatgatgagaataggaggccgcagcgcagacggtccggcaacagacgaacaagaaacagatctcggggacaaaaccgtccaacgaacgtcaaggaaaatacgatcaagttcgagggtgactttgattttgagtctgctaacgcccaatttaaccgcgaggagctggataaagaattcaagaaaaaactgaacttcaaggatgataaagctgagaaaggcgaagagaaagacttagccgtggttactcagtccgccgaagctcctgcagaagaggatctgctcggacccaattgttattacgacaagtctaagagtttcttcgacaatatcagcagcgaacttaaaacatctagccggcgaacgacctgggccgaagagcggaaactaaatactgagaccttcggggtgtcaggacgattcttacgcggacgctcaagtaggggtggcttccgtgggggtaggggcaatggcactacccggaggaaccctacaagtcacagagctggtacaggcagagtctag

SEQ ID NO: 57368 - DNA, 1428 bp, Artificial Sequence
  Description of Artificial Sequence: Synthetic coding sequence
atgccacaccgtaagaagaagcctttcattgaaaaaaagaaggccgtgtcctttcatctggtccaccggtcccagcgggatcccctcgccgctgacgaatctgcccctcagcgtgtgctattaccaacccagaagatcgataatgaggagcgacgagccgagcaaaggaagtatggagtctttttcgacgatgattacgattacctgcagcatctgaaggagccctccggtccttcggagctgattccctcctcaaccttctctgcacataatcggcgtgaggagaaagaagagaccctggttattccgagcactgggattaagcttccaagttcggtctttgcgagcgagtttgaagaagatgtgggtttactcaacaaagccgctcccgtcagcgggccacggttggacttcgaccctgatatcgtagcagcactggacgacgactttgatttcgacgaccccgacaacctcttagaggatgattttattctccaggctaataaggcaaccggggaagaagaaggcatggacattcaaaagagtgaaaatgaggacgactccgagtgggaggacgtggatgatgaaaaaggcgacagcaatgacgattacgactcagccggactactgtccgacgaggactgtatgtcagtcccaggaaagacacatagggcgattgccgatcatctgttctggtctgaggaaaccaagagccgtttcactgaatatagcatgacatcttccgtaatgcggagaaacgaacagctaacactgcacgacgaacgcttcgaaaaattttatgaacagtacgatgacgacgagataggggctctcgacaacgcggagttagaggggtcaattcaggttgactcaaatagactccaagaagtgctcaatgattactataaggaaaaggcggagaactgtgtgaaactgaacactttggagccactagaagatcaggacctcccaatgaatgaactggacgagtccgaagaagaagagatgatcacagttgtacttgaagaagcaaaagaaaagtgggactgcgaatccatatgttctacctattctaacctgtataaccacccgcagctcataaagtaccagccaaaaccaaaacagattaggatatctagtaagacggggattcccctgaatgtgctgccgaagaagggcctaacagcaaaacagaccgaacgaattcaaatgattaatgggtctgatcttccaaaggtgtcaacacaaccacgatcaaaaaatgaatctaaagaggacaagcgggctaggaagcaggccatcaaggaagagcggaaagagcgcagggttgagaagaaagccaacaaattagcctttaaactggagaaacgacgacaggagaaagagctactcaacctcaagaaaaacgtagagggccttaagctttag

SEQ ID NO: 57369 - DNA, 714 bp, Artificial Sequence
  Description of Artificial Sequence: Synthetic coding sequence
atgaaaggcattctggtcgctggcatcactgccgtgctcgttgcagcagttgagtctctttcctgtgttcaatgtaactcatgggagaagtcctgtgtgaatagcatagcctctgagtgtccctctcatgccaacaccagctgcatctcctcttcagctagctctagcctggagacacccgtccggctttaccagaacatgttctgctctgctgagaattgtagcgaggagacccacataactgcctttactgtgcatgtgagcgcagaggagcactttcatttcgtgtcccaatgctgccaggggaaggaatgtagtaacacaagcgatgctctggatccacccctgaaaaacgtgagttcgaacgctgaatgcccagcctgctatgagtctaatgggactagttgccacggtaagccctggaagtgttacgaggaagagcaatgtgtttttctggttgcggagctgaaaaacgacatcgagagcaaatccctggttctaaaagggtgctcgaacgtgagtaatgccacctgtcagtttctttctggagaaaacaagacacttggtggtgtgatcttcagaaaatttgagtgcgcaaatgtcaatagcctgacacccaccagcgcgcctaccactagtcataatgtgggtagtaaggcttctctgtatttgctggctctagcatctttactattaagaggcctcctgccatag

SEQ ID NO: 57370 - DNA, 5621 bp, Artificial Sequence
  Description of Artificial Sequence: Synthetic coding sequence
atgcgcactgggtgggccactccacgcagacccgctggcctgttgatgcttttgttctggtttttcgatcttgccgaaccttctggaagagccgctaacgaccccttcacgatcgttcacggcaatactggaaaatgtattaaaccagtatacggctggattgttgctgatgactgtgacgagaccgaagacaagttgtggaagtgggtgtctcagcaccggctttttcacctccattctcagaagtgtctgggactcgatattacaaagagcgtcaacgagctcagaatgtttagctgtgactcgtccgccatgttgtggtggaaatgcgagcaccactcactgtacggggctgctaggtaccgactcgctctaaaagatgggcatgggacggcgatcagcaacgcctctgacgtgtggaagaagggaggctctgaggaatcactgtgtgaccagccttatcacgaaatttatacacgggacggaaacagttacggcagaccctgtgagtttcccttcctaattgatggtacttggcatcatgactgcatactggatgaagaccactcaggaccctggtgtgcgactaccctgaactatgagtacgatagaaagtggggtatctgcttaaaaccggaaaacggatgcgaggataattgggagaagaatgagcagtttgggagctgctaccagttcaatactcagacagccctgtcttggaaggaagcttacgtgtcttgccagaatcagggggctgacctcctaagtattaattcagccgcagagctgacctacttgaaagagaaggaggggattgccaaaatcttttggatcggcttgaatcagctgtactccgcccgtggatgggagtggtctgatcataaacctctcaattttttgaattgggacccagaccggcctagcgcacctaccattgggggatctagctgcgccaggatggacgccgaaagcggcttgtggcagtcgttcagctgcgaggctcagttgccctacgtttgtcggaagccacttaacaatactgtggagctaaccgatgtctggacttacagcgatacccgctgtgacgccggatggctgcccaacaatggattctgctatctgctagtgaatgagtccaattcatgggataaagcacatgcaaaatgcaaggcgttcagttctgatctcatcagtatacatagtctggctgatgttgaggtggttgtcaccaagctgcataatgaagacatcaaagaggaggtctggatcggacttaaaaatattaatatcccaacactgttccagtggagcgacggtaccgaggtgacactgacttactgggatgagaatgagcctaacgttccctacaacaaaacccctaactgcgtgtcatacctgggcgaactgggccagtggaaggttcaatcctgcgaggagaagcttaagtatgtgtgcaagcgaaaaggcgagaagctgaatgatgccagcagcgataaaatgtgtcccccagatgagggctggaaaaggcatggcgagacctgctacaaaatctacgaggatgaggtgcccttcggaacgaattgtaatctcactataacctccagatttgagcaggagtacctgaacgatcttatgaaaaaatatgataagtctcttaggaaatacttctggaccgggctgcgggatgtcgatagctgcggggagtacaactgggctactgtgggaggacgccgtcgcgctgtcacgttctctaattggaacttcttggaacccgcatccccaggtggatgcgtggccatgtcaacaggcaaaagcgtaggcaagtgggaagtcaaagactgcaggagttttaaggctctcagcatctgtaaaaagatgagcggacccttgggaccggaggaagcaagccctaaaccagacgacccttgccctgaggggtggcagtctttccccgctagcctctcttgctacaaggttttccatgccgaacgtatcgttcggaaacgcaattgggaggaagcggaacggttttgccaggcgttgggggcacacctgtcttcattctctcacgtggatgagatcaaggaatttttgcatttccttactgatcagttctccggacagcattggctgtggattggccttaataagcgctctcctgaccttcaggggagctggcagtggagcgaccgcacgccggttagtaccattattatgcctaatgagttccaacaggactatgatatccgtgactgtgcggcagtcaaagtgttccatcggccatggaggagagggtggcatttttatgacgaccgggagttcatctatcttcgtccatttgcatgtgataccaaactggaatgggtatgtcagatccctaagggaagaactcctaagaccccagactggtataacccagatagagccggaattcacggccctcccctgattattgaggggtctgaatattggtttgttgctgatctacacctgaattacgaggaggctgtgctgtattgtgcttcaaaccactcatttctggctaccatcaccagctttgtgggcctgaaagctattaagaataaaatcgccaatatctctggggacggccagaagtggtggattcgtatatccgaatggccaatagacgaccatttcacatactctagatatccttggcaccgatttccagtaacattcggtgaggagtgtctgtacatgtcagcaaagacctggctgatcgatctgggcaagccaaccgactgctcgacaaaactccctttcatttgcgaaaaatataacgtatcctccctggaaaaatactcacccgatagcgctgccaaggtccagtgctcagagcagtggatcccatttcaaaacaagtgctttttaaagataaaacctgtgagcctgaccttttcacaggcttcagacacctgccacagctacgggggtaccctccctagtgtcctgagccagatcgagcaggactttattacctctttgcttcccgacatggaagcgacactatggataggactcaggtggactgcctatgagaagatcaataaatggactgataatagggaactgacctactctaacttccacccactcctggtaagcggccgactgagaattcccgaaaacttttttgaagaagagagcaggtaccactgcgccctgatcctgaatctgcagaagtccccattcactgggacgtggaacttcactagttgtagcgagcggcatttcgtaagcctctgccagaagtattcggaggtgaaatcgaggcagacgctccagaatgcctccgaaaccgtgaaatatctgaacaatctctacaagatcatcccgaaaactctgacatggcactctgccaagcgggaatgtttaaaaagcaatatgcagcttgtgtccattaccgatccctatcaacaggcgtttctgtccgtacaggccctgttgcataattcctccttgtggattggactgttcagccaggacgacgagctcaactttggctggagtgatgggaaacgcctccacttttcaagatgggccgagacgaacggacaactggaggattgcgtcgtgctcgataccgacggtttttggaagaccgttgactgtaacgacaatcagcctggcgctatttgctactactctgggaatgaaaccgagaaggaggtcaagccggtcgactctgtgaaatgcccctcccccgtactgaatacaccatggataccattccagaactgctgttacaacttcattattaccaaaaatcgccacatggccaccacacaagacgaggtccacaccaagtgtcagaaactcaatcctaaatcccacatcctgagcatcagggacgagaaagaaaataatttcgtgcttgagcagcttctgtattttaactatatggcttcgtgggtcatgctgggtatcacctacagaaataagtctcttatgtggttcgacaaaacccccctgtcctacactcattggcgagccggaaggccaaccattaagaacgaaaagttcctggcaggactctccactgatggcttctgggacatccagacatttaaagtcattgaggaggcagtctatttccaccaacactccatcctggcttgtaagatcgagatggtggattataaggaggagtataacactaccttacctcagtttatgccctacgaggacggtatctacagcgtgatccagaagaaggtcacctggtacgaggccctcaacatgtgtagccaaagcggcggacaccttgcaagcgtccacaaccagaacggtcaattgtttcttgaggatattgtgaaaagagacgggtttcccctatgggtaggactatccagtcatgacggatcggagtcctcattcgaatggtccgatggtagcaccttcgactacattccctggaagggccagacctccccaggtaactgcgtgctgctagacccaaagggcacgtggaaacacgagaaatgcaactccgtgaaggacggggctatatgctataagccgaccaagtccaaaaagctatcccgactgacatactcaagtcggtgcccggcagctaaggaaaacgggagtcgctggatccagtataaggggcactgttataagtccgaccaggccttacattccttttcagaagccaagaaactttgtagtaaacacgaccactcggctacaatcgtgagcataaaagacgaagatgagaacaagttcgtgtcccggttaatgcgagaaaacaacaatatcacaatgcgggtgtggctcgggttgtcccaacattccgtggaccagtcctggagctggctggatggctcagaggttaccttcgttaaatgggaaaacaagagcaagtccggcgtgggcaggtgtagcatgctgattgcatccaatgagacctggaaaaaggtggagtgcgagcatggctttggccgtgtagtttgtaaagtccccctcgattgtccttcttccacttggatccagtttcaggactcatgttatattttcctgcaggaggctatcaaggtcgaaagtatcgaagacgttcgaaaccagtgcacagatcatggtgccgacatgattagcattcacaatgaggaggagaatgcgttcatattggacactttaaaaaagcagtggaagggcccagacgatatactgctgggcatgttttacgataccgatgacgcctcctttaagtggttcgataacagtaacatgacgtttgataagtggaccgatcaggatgacgatgaggatctggtggatacctgtgcattcctccacatcaaaactggcgaatggaaaaaaggcaattgcgaagtcagtagcgttgagggaactctttgtaaaacagctatcccgtacaagagaaaatatctctcagataaccacattttgatatctgccctggtaattgcaagtactgttatcctgaccgtcttgggcgcaatcatctggtttttgtacaaaaagcactctgattcccggttcaccaccgtgttcagcaccgcccctcagagtccgtataacgaagattgtgtccttgtggttggggaggaaaatgagtacccagtccagtttgacta

SEQ ID NO: 57371 - DNA, 5453 bp, Artificial Sequence
  Description of Artificial Sequence: Synthetic coding sequence
atgaggacggggtgggccaccccccgacgcccagccggtcttctcatgctgttgttttggtttttcgatctggccgagccctcggggagagccgctaatgaccctttcaccatagtgcacggtaacactgggaagtgtattaagcctgtgtacggttggattgtcgctgacgattgcgacgaaactgaagataagctttggaagtgggtatcacagcaccgtcttttccacctgcatagccagaagtgcctcgggctcgatattactaagtctgttaatgagctaaggatgttttcctgcgactctagcgccatgttatggtggaaatgtgaacatcattcgttgtacggtgcagcgaggtatcgtctggctcttaaggacggtcatggaactgcaatcagcaatgcaagcgatgtgtggaagaaggggggatcagaggagagcctctgtgaccaaccttaccacgagatttacacccgggacgggaatagttatggtagaccttgcgagtttccctttctgattgatggtacctggcatcacgattgcatcctcgacgaggaccacagcggcccatggtgtgctacgacgcttaattatgagtacgataggaaatggggtatctgcctcaagcctgagaacggatgcgaggataattgggaaaagaatgaacaatttggaagctgctatcaatttaacactcagaccgctctgtcctggaaagaagcttacgtgagctgccaaaatcagggcgcagatcttctgtccattaattctgcagcagaactcacatatttaaaagaaaaggagggaatcgccaagatcttttggattgggttgaatcagctttactccgccagagggtgggaatggtccgatcacaagcccctgaactttcttaattgggaccctgatcgtccaagtgctcccaccattgggggaagttcatgcgctaggatggatgcggaaagcgggctctggcaaagcttttcgtgtgaggcacagttaccttatgtgtgtcgtaaaccactgaacaatacagtcgagctgactgatgtgtggacctattccgacacacgctgcgacgcagggtggctacctaataatgggttctgctatctcttggtaaacgaaagtaactcatgggacaaagctcacgccaaatgtaaagccttctcctctgaccttattagtattcacagcttggccgacgtcgaagtagtggtgacaaaattgcacaacgaagacattaaagaagaagtgtggatcgggctgaaaaacattaacatccccaccttgttccagtggtccgatgggaccgaggttacactgacgtactgggatgaaaacgaaccgaatgtcccgtataataagacccccaattgtgttagctacctgggcgaactgggtcagtggaaggtccaaagttgtgaggaaaaactcaagtacgtatgtaagcgtaagggcgagaaattgaacgatgccagcagcgataagatgtgcccgcctgacgagggatggaaacggcacggtgaaacatgttataaaatatacgaggatgaggtgccgttcggtacaaattgtaacttgacaattacgtctaggttcgagcaggaatatctgaatgatctaatgaagaaatatgataagagtctccgcaagtacttttggactggcttaagggacgtggattcatgtggtgagtataactgggctacggtgggcggacggcgaagggctgtcacattctccaactggaacttccttgagccagcatctcctgggggttgtgttgccatgtccacaggtaagagcgtgggcaagtgggaggtgaaagattgtaggtcattcaaagccctgtcaatctgcaagaagatgtctggccctttagggcctgaggaagctagcccaaaaccagacgacccttgtccggagggttggcagtcatttccggcttccctgtcctgctacaaagtgttccacgctgagcgcatcgtccgaaagcggaattgggaagaggccgaacgcttttgccaggctctgggtgcccacctctctagtttcagccacgtcgacgaaattaaggaatttttgcactttctgaccgaccaattctcaggacagcattggctctggatcggtttaaacaagagatccccagacttacaaggaagttggcagtggtcggatcgcacccctgtgtcaaccataatcatgcccaatgagtttcaacaagactacgatatcagagactgtgccgctgtaaaggtgttccatagaccctggagacggggatggcatttctacgacgatcgcgaatttatctacctgcgaccctttgcctgtgataccaaactggagtgggtttgtcagatcccgaagggcaggacccccaaaaccccagactggtacaatccagatagggcaggaattcacggacctcccctgatcatcgagggttccgagtactggttcgttgccgatcttcatctgaactacgaagaagctgtgttatactgtgccagcaaccacagcttcctcgctacaattacaagctttgttggactcaaagctataaagaataaaatagccaatataagcggagatggacagaaatggtggataaggatcagcgaatggcctattgacgaccacttcacctatagcagatatccatggcaccggttcccagtcactttcggggaggaatgcctgtatatgtctgccaaaacatggctcattgacttggggaagcccacagattgctccacaaagctcccgttcatatgcgagaaatacaatgtctcgtcactcgagaagtacagccccgatagcgctgcgaaggtccaatgctccgaacagtggatcccgtttcagaacaagtgttttcttaaaattaaacctgtgtctcttacgttctcgcaagctagcgacacatgtcacagctacggcggaacacttccgtcagttctcagccagatcgagcaggactttataacaagcctcttgccggatatggaagcaacactgtggataggtcttagatggacagcctatgagaagattaacaagtggacagacaatcgcgagttgacttattctaattttcatccattgcttgtatcagggagactcaggattcccgagaactttttcgaagaagagtcccgttaccactgtgctctgattcttaacctccagaagagccccttcacaggcacttggaattttaccagctgctctgagcgccacttcgtctccttgtgtcagaagtactccgaagtgaaatcgaggcagaccctgcaaaacgctagcgagactgttaagtacctgaataatctctataagattataccgaaaactctgacctggcacagcgctaagagggaatgcctgaaatccaacatgcaactcgttagtatcacagacccctatcagcaggccttcctgagcgtccaggccttgcttcacaatagttctctttggattggcctcttttctcaggacgacgagctcaacttcggatggagcgacggcaaacgactgcatttctcaagatgggccgaaaccaacgggcagctcgaggactgtgtggttctggacactgacggtttctggaaaactgtggactgtaacgacaaccagccaggcgcaatttgttattatagtggaaatgagaccgagaaggaggtcaaaccagtagatagtgtgaagtgcccctctccagttctaaacactccttggatcccctttcagaactgttgttataacttcatcattacgaagaaccgacacatggccacgacacaggacgaggtccacacaaagtgccagaagctcaaccctaaatctcacatactcagtatccgcgatgagaaggaaaataatttcgtccttgagcaactgctgtacttcaattacatggcctcttgggttatgttagggattacttatcggaataaaagcctaatgtggttcgataaaactccactgtcctacacccattggcgggcaggtaggcccacaatcaagaatgaaaaattcctggccggtttgtctacagacggtttttgggatattcaaacttttaaagtcattgaagaggccgtctattttcatcagcactcaatcctcgcgtgcaagatagaaatggttgactataaagaagaatataatactaccctcccacagtttatgccgtacgaggacggaatttactctgttattcagaagaaagtcacttggtatgaggcactgaacatgtgttcgcaaagtggaggacatctggcaagtgttcacaatcagaacggccagctttttctggaggatatagtcaagagagatggattcccgctgtgggtcggcctgtccagtcatgacggatctgagtcatcctttgagtggtccgatggatctacttttgattatatcccttggaaggggcaaacctcccccggtaattgtgtactcctcgatcccaaggggacctggaaacacgagaagtgcaatagtgttaaggatggagctatctgctacaaacctactaagagtaaaaaactatccaggttgacgtactcttcccggtgtcctgctgcaaaggagaacggatctcggtggattcagtataaaggccattgttataagtctgaccaggctctgcatagtttctctgaagcaaaaaagctctgctctaaacatgaccactcagccaccatagtaagcatcaaggacgaagatgagaacaaattcgtgagccgcctgatgcgtgaaaataacaacataaccatgagagtatggctagggcttagtcagcactcagtagattgtccttcctcaacttggatacagttccaggacagctgttacatattcctgcaggaagcgatcaaggtagaaagtatcgaggatgtgcggaatcagtgtacggatcacggggctgacatgatatcaatccacaatgaagaggaaaacgcgttcatcctggacaccctgaagaaacagtggaaaggtccggacgatatattgttgggcatgttttacgataccgacgacgccagcttcaagtggtttgataactcgaacatgacatttgacaagtggaccgaccaggatgacgacgaggatctggtcgacacctgcgcatttttacacatcaaaaccggtgagtggaaaaagggaaattgtgaggtgagcagcgttgagggaacactatgcaagaccgcaatcccttacaagcggaaatacctgtctgacaaccacatcttaatcagtgcgcttgtcattgcctctacggtgattctgaccgtactgggggctattatctggttcctctacaagaagcactctgacagcaggtttaccaccgtgttctctaccgctccccaaagcccatataatgaggattgcgtgctggttgtgggggaggagaacgagtaccctgtccagttcgatta

SEQ ID NO: 57372 - DNA, 498 bp, Artificial Sequence
  Description of Artificial Sequence: Synthetic coding sequence
atggccctcctggctctcctgctcgttgtggcactgccaagagtgtggactgacgcgaacctaactgcacggcagcgggatcccgaggactcacaaagaacggatgagggggataatagagtttggtgccacgtgtgcgagcgagagaacacattcgaatgtcagaatcccaggagatgcaagtggacagaaccctattgtgtgattgccgctgtcaagatcttcccacgtttctttatggtggccaagcagtgctccgccggttgtgccgcaatggagagaccaaagccagaggagaaacgttttctgctggaggagccaatgccatttttttatttaaagtgttgcaaaattcgttactgtaacctggagggaccacctataaattcgtctgtctttaaagagtacgccggatcaatgggcgagtcttgtgggggtctctggctcgcaattctgttactactggccagcattgccgctggactttccctgtcttag

SEQ ID NO: 57373 - DNA, 639 bp, Artificial Sequence
  Description of Artificial Sequence: Synthetic coding sequence
gactttggttactgcccaagagtgtactgcgagaaccagcctatgttaccaatcggtgttctggtaatggtgggatttacagttggaaaagtgccagtccccgacatccgtacctgccatttttgcctggtcgaggacccaagtgtgggctgcattagtggaagcgagaaatgcacaatctcctcctcaagcttatgcatggtgatcacgatctactacgacgttaaggtcagattcatagtcaggggctgtggtcagtatatctcgtataggtgtcaggagaaacggaacacttattttgccgagtactggtatcaggcccagtgttgccagtatgattactgcaattcttggagcagcccccagcttcagtctagtctacctgagcctcatgacaggccgctggccctgccattatccgatagccaaatccagtggttctatcaggccctaaatttatcattaccactcccaaacttccacgcaggcactgagcctgacgggctcgatcctatggtaacccttagtctcaatctggggctgagctttgccgaactctgcagaatgtacctgttcctgaacagtagtgggctcttagtgctcccacaggccggattattgactccccacccctcctag

SEQ ID NO: 57374 - DNA, 639 bp, Artificial Sequence
  Description of Artificial Sequence: Synthetic coding sequence
gattttgggtattgtcccagggtgtattgcgaaaaccagcctatgttgcctatcggcgtactggtgatggtgggttttacagtggggaaggtgccagtaccggacatacgcacatgccatttttgtctggtggaggatccctcggtagggtgtataagtggaagcgaaaaatgtacaataagctcttcctctctgtgcatggtcatcacaatttattatgacgtgaaggtgcgattcattgtgcggggatgcggacagtacatttcttaccgctgccaagagaagcgcaacacttactttgctgagtattggtatcaggctcagtgttgccagtatgactactgcaactcatggtcctccccacagttgcagagctcccttccggagcctcatgaccggccactcgctctaccactctctgatagccagatccaatggttctaccaggcactcaacctgtccctgccgttacctaacttccatgcgggaacagagccagatggcttggaccccatggtgaccctgtccttgaacttggggctgtcatttgccgaactgcgacggatgtatttgtttctgaattctagtggcctcctcgtactgccacaggcgggtctgttgacacctcacccttcctag

SEQ ID NO: 57375 - DNA, 687 bp, Artificial Sequence
  Description of Artificial Sequence: Synthetic coding sequence
atgagctcatctgaggaggtatcttggatcagttggttttgcgggttgcggggtaacgaattcttctgcgaagtcgacgaggactatatccaggataagtttaaccttactggattgaacgagcaggtgcctcactaccgacaggctctcgacatgatcctcgacttggaacccgatgaggagctggaggacaacccaaatcaatcagacctgatcgaacaagctgctgaaatgctgtacgggttgatacatgctcggtatattttgacaaaccgcggtatcgcacagatgctcgagaaatatcaacagggggatttcggctactgccctagagtgtactgcgaaaatcagccgatgctcccaattggcctctctgatatcccaggggaagccatggtgaaactgtattgccccaaatgcatggatgtgtatacaccaaagagctctcgccatcatcacaccgacggagcttattttggcacgggcttcccacacatgctgtttatggtgcaccccgaataccggccaaagaggccagccaatcagttcgtgccatcgtcctgctcgaggcaccccgatgtcccgttgctgccacgaaggcggccattttgccgcatgcactttagattacgtgaggtgtaccaccagcagctgattcccgtgcacggcgaccaccacctcctatag

SEQ ID NO: 57376 - DNA, 639 bp, Artificial Sequence
  Description of Artificial Sequence: Synthetic coding sequence
gattttggctactgcccaagggtgtattgtgaaaatcaaccaatgttgcctatcggagttctcgtcatggtcgggttcacagtgggtaaagtcccagtccccgacattagaacctgccacttctgcctggttgaggatccctccgtgggctgcatttctgggtccgaaaaatgcacaatctcttcttccagtttgtgcatggtgatcacaatatattacgacgtcaaagtgagattcatcgttcgtggatgcggacaatatattagctaccgctgtcaagagaagcgcaacacgtactttgcggaatattggtaccaggcccaatgttgccaatacgattactgtaattcttggtctagcccccaacttcagtcttcgttacccgagcctcacgacaggcctctcgctctcccactgtcagacagtcagattcagtggttttaccaggccctgaatctatccctcccactgcccaactttcacgccggtaccgaaccagacggacttgaccccatggtgactttaagcctcaatctgggcctgagtttcgcggaactgcggcgaatgtatttgttcctcaactcttcaggactgttggttctgccccaggctgggctgttgacccctcaccctagctag

SEQ ID NO: 57377 - DNA, 639 bp, Artificial Sequence
  Description of Artificial Sequence: Synthetic coding sequence
gacttcggatactgtccaagggtgtattgcgagaaccagccgatgctgccaatcggcgtgctcgtgatggtgggtttcacggtcggtaaagtccccgtccccgatattagaacgtgtcacttttgtcttgttgaggacccctccgtgggctgcattagcggatcggagaaatgcacaatatcatcctctagcctgtgtatggtcatcactatatactacgacgtgaaagtgcgctttatagtcagaggctgcgggcagtacatttcctacagatgtcaggaaaagcgtaatacttatttcgctgagtattggtaccaggcccagtgctgtcagtatgactattgcaatagctggtcatcgccacagttgcagagttctctcccagagccacatgacaggcctctggcactgccattgagtgattcacaaattcaatggttctaccaggccctgaatctgagtctgcctctgcctaactttcacgctgggaccgaaccagatggactcgatccaatggtgacccttagcctcaacttgggcctgtcattcgccgaactttgcagaatgtacctgtttctgaatagctcaggcctcctggtgctgccacaggctggactcttgaccccacaccctagctag

SEQ ID NO: 57378 - DNA, 687 bp, Artificial Sequence
  Description of Artificial Sequence: Synthetic coding sequence
atgtcctcctccgaagaagtctcatggatctcctggttctgcggtctgaggggtaatgagttcttctgcgaagtcgatgaagactatatacaggacaaattcaatctgacaggcttgaatgagcaggtaccacactatcgacaggctctagacatgattttggacctagaacctgacgaagagttggaagacaacccaaatcagagtgatctgattgaacaggccgcagaaatgttgtatggtctgatccacgcacgctatatcttaacaaatcgcggaatagcccagatgctcgagaagtaccagcaaggagatttcggctattgtccacgagtatactgtgagaaccaacctatgctgcccattggtctatcagatattcctggagaagccatggtgaagttgtattgtcccaagtgtatggacgtctacacaccaaagagttcccggcaccaccataccgacggggcatattttgggacaggctttcctcacatgcttttcatggtgcacccggaataccgtcccaaaaggccagccaatcagtttgtgcctagctcatgtagccgacacccggacgtccctttactgccacgtaggcgcccattttgtcgaatgcattttagacttcgggaagtttaccaccagcagttgatcccagtccacggagatcaccatctgttatag

SEQ ID NO: 57379 - DNA, 606 bp, Artificial Sequence
  Description of Artificial Sequence: Synthetic coding sequence
atgaaggttcacatgctggtcggggttctcgttatggtggggttcacggtggggaaggtgcccgtgccggatatcagaacttgccatttctgtctcgtcgaggacccaagcgttggttgtatctctggaagtgagaaatgtacaatcagttcgagcagtctatgtatggttattacgatctactacgatgtaaaggtccgcttcatcgttcgcggttgtggccagtacatcagctacagatgtcaggagaaacgtaatacatattttgccgaatattggtatcaggcacaatgctgccagtacgattactgcaacagctggtcctccccacagctgcagagttctctgcctgagccccacgatcgcccactcgccctccctctgtccgatagccagatccagtggttctaccaagcacttaatctctcattgcctctcccaaacttccacgcgggtactgaacctgatggcttggatcctatggtcactctgagcctaaatctcggtctttccttcgccgaactctgccgaatgtatctattcctcaactcaagcggcctgctcgtgctgccgcaggccggactgctaacccctcacccttcctag

SEQ ID NO: 57380 - DNA, 606 bp, Artificial Sequence
  Description of Artificial Sequence: Synthetic coding sequence
atgaaagtgcacatgttggttggcgtcctcgtgatggttggcttcacagtgggaaaagtcccggtcccagatattcggacatgccatttttgcctggtggaagatccatccgtcggatgtatctcaggttctgagaagtgtacaatcagcagctcatctctgtgtatggtaatcaccatttactatgacgtgaaagtgcggtttatcgtccgcggatgcggccagtacatttcctataggtgccaggagaaaaggaatacatattttgcagaatattggtaccaggcccagtgctgtcagtacgattactgcaacagttggagctcaccacagctgcagagctccttgcccgagccccacgacaggcctctcgctttacccctgagtgactcacagatccagtggttttatcaggcccttaacttgtccctgcctcttccgaattttcacgctggtaccgaacccgatggactggacccaatggttaccctcagtttgaacctcggtctcagttttgctgagctgtgtcggatgtatctcttcctaaactcatcgggtctgttagtgctcccccaggccggtctcctgacacctcatcccagctag

SEQ ID NO: 57381 - DNA, 303 bp, Artificial Sequence
  Description of Artificial Sequence: Synthetic coding sequence
atggggacttcatcaattttcctgtgcgtcctcttcttatgtggcgcattgggactgaccatgagccccgctcgcggacggctgagatgctacatctgcggatttaccaaaccctgtcaccctgtcccaactgagtgccgggatgacgaggcttgtgggatatcgataggaacctctggcaggactctagtgcaatggccattttcacgaaggctccccacaagcattcatcctgcgttccctgtggcgccagcgagcgcttgccttttccaccccactgatcagtcagagatcacagaatag

SEQ ID NO: 57382 - DNA, 378 bp, Artificial Sequence
  Description of Artificial Sequence: Synthetic coding sequence
atgggtacaagcagcatctttctgtgtgtgttgttcctttgtggggctttaggcctcacgatgagccccgctagaggcaggttgcgctgctacatttgcggatttacgaaaccatgccatcccgtcccgaccgagtgtcgcgatgacgaggcttgcggcatctcgattgggacatcgggtaagtcttgcctttccagggcccagtgtccacttccgggatacgccacatattggctgcacagctacacattatggcaccactgttgtgagcaagatctttgtaacattgctgcaagcccacagcagctgacctcactgctggccagtttgccactatttgtggcttccttcgccggtcgcggacatttgctgcattag

SEQ ID NO: 57383 - DNA, 303 bp, Artificial Sequence
  Description of Artificial Sequence: Synthetic coding sequence
atgggtacatctagcatcttcttgtgcgtcctcttcttatgcggggcactcgggctgactatgtctcccgctcgcggtcggcttcgctgctatatttgtggttttacaaaaccctgccacccagtgccgacagagtgcagagatgatgaggcctgtggaatcagcataggaacatcgggacgcacccttgtccaatggcctttcagtcggagactccccacttccatccatccggctttccccgtcgcgccagcctccgcgtgtctgttccatcctaccgatcagagtgaaatcaccgagtag

SEQ ID NO: 57384 - DNA, 201 bp, Artificial Sequence
  Description of Artificial Sequence: Synthetic coding sequence
atggggacatccagcattttcctttgtgttctgttcctttgcggtgctctaggtttgaccatgagcccagcacggggaagattgcgttgctacatctgtgggttcactaagccgtgtcaccccgtccctaccgaatgcagggacgatgaggcatgtgggatatcaattgggacttcagaccagtcagagataaccgagtag

SEQ ID NO: 57385 - DNA, 201 bp, Artificial Sequence
  Description of Artificial Sequence: Synthetic coding sequence
atgggaacatcatcgattttcctgtgcgtcttgttcctctgtggagctctgggcctaactatgtcaccagcacgagggagactgaggtgctacatttgcggcttcactaagccctgccatcccgttcctacggagtgtcgcgacgatgaggcatgcggtatcagtattgggacaagcgatcagtctgaaattactgaatag

SEQ ID NO: 57386 - DNA, 201 bp, Artificial Sequence
  Description of Artificial Sequence: Synthetic coding sequence
atgggaacatcatcaatctttctgtgtgtgttattcctatgtggtgcacttggcttgaccatgagtccagccagagggagattacgttgctatatctgcggctttacaaaaccatgccaccctgtgcctacggagtgcagggacgatgaggcttgcggcatttccatcggcacatccgaccaatcagaaatcacagagtag

SEQ ID NO: 57387 - DNA, 303 bp, Artificial Sequence
  Description of Artificial Sequence: Synthetic coding sequence
atggggacaagctctattttcctgtgcgtcctgttcctttgcggcgcactgggcctgactatgagtcctgccaggggaagactgaggtgttacatttgtggcttcaccaagccgtgtcacccggtaccaacagagtgtagagacgatgaagcctgcggaatcagcattggaaccagcgggaggacccttgtccaatggccctttagccgacgtcttccaacttcgatccatcccgctttccccgtcgctcccgcaagtgcttgcctgttccatcccactgaccagtctgagatcactgaatag

SEQ ID NO: 57388 - DNA, 303 bp, Artificial Sequence
  Description of Artificial Sequence: Synthetic coding sequence
atgggaacctccagcatctttctgtgcgtgctattcttatgcggggcactgggactcaccatgagtccggcacgcggacggctgcgctgttatatctgtggctttaccaagccttgtcatcccgtccctaccgagtgtagggatgatgaggcctgcggaatctcaatcggaacaagtgggaggactttagttcagtggccgttcagccggagacttcctacttccattcacccggcttttcctgtggctccagcttctgcctgcttgtttcacccaaccgaccagagtgagatcaccgagtag

SEQ ID NO: 57389 - DNA, 201 bp, Artificial Sequence
  Description of Artificial Sequence: Synthetic coding sequence
atggggacatcatccattttcctgtgcgtgctttttctttgtggggctctggggttgacaatgagtcccgcaaggggaagactacgatgttacatttgcggctttactaaaccctgccacccagtgccaacagagtgcagggatgatgaggcctgcggaatttcaatcggaacatccgaccagagcgagataactgagtag

SEQ ID NO: 57390 - DNA, 201 bp, Artificial Sequence
  Description of Artificial Sequence: Synthetic coding sequence
atgggaaccagcagtatatttctatgcgtactctttttatgcggagcacttggactgacgatgagcccggctaggggcaggctgagatgttacatctgcggctttactaagccctgtcacccagttccaaccgagtgtcgcgacgatgaagcttgtggcatttccattggaacctctgatcagtctgagatcacggaatag

SEQ ID NO: 57391 - DNA, 303 bp, Artificial Sequence
  Description of Artificial Sequence: Synthetic coding sequence
atgggaacatcttcaattttcttatgtgtactatttctttgcggagccctgggactgactatgtcccccgcacgtggacgcttgcgctgctacatctgcggatttacaaaaccctgccacccggtgccaacagaatgccgtgatgatgaggcctgtggtatcagtatcggaacctcaggccgtactctagtccagtggcccttcagtagaaggcttcctaccagcatacatccagcttttcctgtcgcacccgcttctgcttgtctcttccatcctacagatcagagtgaaattacggagtag

SEQ ID NO: 57392 - DNA, 201 bp, Artificial Sequence
  Description of Artificial Sequence: Synthetic coding sequence
atggggacttccagcatcttcctgtgtgtgctgttcctctgcggggctttggggctgaccatgtctcctgctaggggccgactgagatgttacatctgcgggtttactaagccatgccaccccgtgcccaccgagtgccgggacgatgaggcgtgtggcatttccatagggacttcagaccagtctgagattacggagtag

SEQ ID NO: 57393 - DNA, 303 bp, Artificial Sequence
  Description of Artificial Sequence: Synthetic coding sequence
atgggcacgtctagcattttcctatgtgttctgttcctatgcggagccctgggtctgaccatgtcaccagccaggggccgactacgatgttacatttgtggcttcaccaaaccctgtcatccggtgcccacggagtgccgcgacgatgaggcatgtggtatttccattggtacatctggccgaaccttagtgcaatggccgttctcacgccgactgcccacttcaatccatcccgctttcccagttgcgccagccagcgcgtgcttatttcacccaaccgatcagtccgagattaccgagtag

SEQ ID NO: 57394 - DNA, 387 bp, Artificial Sequence
  Description of Artificial Sequence: Synthetic coding sequence
atggggaccagtagcatctttctgtgcgtgctgtttctttgcggcgcacttgggctgacaatgtcccccgctagaggccgactacgatgttacatatgcggtttcaccaagccttgccaccccgtcccgactgagtgtcgtgacgacgaggcgtgtgggatcagcattggcactagtgtcaagaagcttcccctaaaggggcctgttccctctgcaagactgtgccaccttttagcagccctgcttcattccgtggcccctctcctccgcgctggacccgtccaacattcccggttcccaactgctgcccaccagccccctagactccccgcacctctttgcggccaactgcgatgggagcgcacaccaccacctctggcttcctag

SEQ ID NO: 57395 - DNA, 378 bp, Artificial Sequence
  Description of Artificial Sequence: Synthetic coding sequence
atggggaccagctcaatcttcctctgcgtcctgttcctgtgcggcgctctgggcctcaccatgtcgcccgctaggggccgtttacgctgctatatctgcggatttacaaaaccatgtcatccggttcccaccgaatgccgcgacgatgaggcatgcggcattagtatcgggacatccggcaaatcttgcctgagcagagcccagtgccctctgccgggatacgccacctactggctgcactcatatacgctctggcaccactgctgcgagcaggacttatgtaacatcgcagcctcccctcagcaactgacctctctgctggcatctttaccactcttcgttgcttccttcgccggacggggtcacctgctgcattag

SEQ ID NO: 57396 - DNA, 378 bp, Artificial Sequence
  Description of Artificial Sequence: Synthetic coding sequence
atgggcacctctagtatctttctctgcgtgctctttctctgtggcgcattgggtctgaccatgtctccagccagaggtcggctccggtgctatatctgtgggtttaccaaaccatgtcatcccgttcctaccgaatgcagagacgatgaggcatgcgggatttcaattgggacaagcggcaaatcttgcctgtcccgggctcagtgtcctctgccagggtacgccacctactggctgcacagctacaccctatggcatcactgttgtgagcaggatctttgtaacatcgccgcaagtcctcagcagttgacttccttgctggccagcctgcccttgtttgtcgcaagttttgctggacgaggccatcttctccactag

SEQ ID NO: 57397 - DNA, 378 bp, Artificial Sequence
  Description of Artificial Sequence: Synthetic coding sequence
atgggaacgtcttccatttttttgtgcgtcctctttctttgcggggcattgggcctcacaatgtcaccggctagaggtcgactgcgatgctacatctgcggtttcacaaagccatgccaccctgttccgacagagtgtcgtgacgatgaggcttgtgggatttcaattggcacttctggaaagagctgtttgagccgcgctcaatgtcctctgcccggatacgccacctattggcttcatagttacacactctggcatcactgctgcgaacaggacttatgcaacattgcagcctcaccccaacagctgacttctctcctcgccagcctgcccctgtttgtggcctcgtttgcgggtcgtgggcatctgctgcactag

SEQ ID NO: 57398 - DNA, 378 bp, Artificial Sequence
  Description of Artificial Sequence: Synthetic coding sequence
atgggcacatccagcatttttctctgcgtcctttttctctgcggggctctgggtctcactatgagccctgccagaggtcgattaaggtgctacatatgcggcttcacaaagccctgtcatccagtacccacggaatgtagggacgatgaagcctgcgggattagtattggtacctcaggaaagtcatgcctctcacgtgcccagtgtcctctgcccggatatgcaacctattggctccactcttacactctctggcaccactgctgtgagcaggatttgtgtaatatagcagctagcccacaacaactaacatcactcctggcgagcctccccttgttcgtcgcctctttcgccggaagggggcacctgttgcactag

SEQ ID NO: 57399 - DNA, 378 bp, Artificial Sequence
  Description of Artificial Sequence: Synthetic coding sequence
atgggcacaagctctatctttctgtgtgtcctctttctgtgcggggcactaggcctcacaatgagccccgcaagaggtcgcctgagatgctatatatgcggatttaccaagccttgtcacccagtacctacagaatgcagggacgacgaagcatgtgggatctctatcggcacctcaggcaagtcatgtctgtctagggcccagtgccctctgccaggctacgcgacctactggttgcattcatacaccctgtggcaccattgctgtgagcaagacctatgcaatattgccgcatcaccccagcagctgaccagtctgctggcgagtttaccactttttgtggcctccttcgctggacgtggccatctgcttcactag

SEQ ID NO: 57400 - DNA, 378 bp, Artificial Sequence
  Description of Artificial Sequence: Synthetic coding sequence
atgggcacttcatccatctttctctgcgtcctcttcttatgcggcgcactgggtctaacaatgagccccgcacgcggacgcctgcggtgctatatctgcgggtttacaaagccatgtcacccagttccaacagagtgccgggatgatgaagcctgcggcatttctatcgggaccagcggcaaaagctgcttatctcgggcacaatgtccactgccaggatacgccacctattggttgcactcctataccctgtggcaccattgttgtgaacaggatttgtgtaacatagccgcaagtcctcagcagctcacatctctgctcgcatccctgcctctatttgtggcctcattcgcgggaagaggtcacctactgcactag

SEQ ID NO: 57401 - DNA, 894 bp, Artificial Sequence
  Description of Artificial Sequence: Synthetic coding sequence
atggcagtgttgttcctgcttctattcctttgtggcacgccacaggctgccgacaacatgcaggccatctatgtggccctcggagaagccgtggaactgccctgtcccagccctcccacgctgcacggagatgaacacctatcatggttttgcagccccgctgccggatcatttaccactttggtggcccaggtgcaggtgggcaggcccgctccagaccctggaaagccgggaagggaatctcggttacggctgctgggtaattactcactgtggctggaaggtagtaaggaggaagacgccggacgttactggtgcaccgtgttggggcagcaccataattatcagaactggcgggtttacgatgtcctggtcctgaaaggtagccagctgtcggccagggcagccgacggctctccatgtaacgttctcctgtgttccgtggtgccatctcgccgtatggactcggtgacctggcaggagggcaaagggccagtcaggggccgtgtgcagagcttctggggtagcgaggccgctctgctgcttgtgtgtcccggtgaaggccttagtgaaccccgttcccggcgtcctcgaataatacggtgtctcatgactcacaataagggagtgtcattttcattggccgcaagcattgatgcatccccagcgctgtgcgccccaagcacagggtgggacatgccttggatactgatgctgctgctcacaatggggcaaggcgtggtaattctggcactgtctatcgtcttatggaggcagagagtacgcggtgcccctgggcgagacgcctcgatcccacagttcaagcctgagatccaggtatacgagaatatccacctggctagattaggacccccagctcacaagcctcgatag

SEQ ID NO: 57402 - DNA, 894 bp, Artificial Sequence
  Description of Artificial Sequence: Synthetic coding sequence
atggcagtgttgtttctgctcctgtttctgtgcggcacgcctcaggccgctgacaacatgcaagctatctatgtcgccctgggggaggccgtagagctcccatgtcccagccccccaacgcttcatggggacgagcatctttcctggttttgcagcccagccgcaggctctttcacgacgctggtggcccaggtgcaggtaggtcgtcctgccccagaccccggaaaacccggtagggaaagcagactcaggcttctcgggaattacagtctttggcttgaggggtcaaaggaagaagatgccggacggtattggtgtactgttctcgggcagcatcacaactatcagaattggcgggtgtacgacgtccttgtgctgaaaggttcgcagttatccgccagggccgcagatgggtccccctgcaatgtgttgctctgttccgtagtgccgtccaggcgcatggactctgttacctggcaggaggggaaaggccctgtaagagggcgagtgcagtcattttgggggagtgaagccgctttactgctcgtgtgcccaggggaaggcctgagcgaacctcgatcgagacggccaaggattattcggtgcctgatgacacacaacaaaggggtgagcttttccctggcagcctccatcgatgcctctccggctctgtgcgccccttctacaggttgggatatgccttggatactgatgttactgctgacaatgggacagggtgtggtgatactcgctctgagtattgttctgtggcgacagagagtccgtggggcacctgggagggatgcctccataccccaatttaagccggaaatccaggtttatgaaaatatacatcttgcaaggctggggccacccgcacacaaaccacggtag

SEQ ID NO: 57403 - DNA, 1149 bp, Artificial Sequence
  Description of Artificial Sequence: Synthetic coding sequence
atggccgtgctgttcctattactgttcttatgtggcacccctcaggccgctgacaacatgcaggcaatctacgtagccttgggggaggccgtcgaactcccctgcccatctccaccgaccctgcacggagacgagcatttaagctggttctgctccccagctgcgggtagctttactacccttgtagcccaggtacaggtggggaggccggctcctgaccccggaaagccgggtcgcgaatctagactacggctcctcgggaattattctttgtggctggaggggagtaaggaggaagacgccggtaggtactggtgcaccgtcctcggccagcaccataactaccagaactggcgggtgtacgacgtgttggtgcttaaaggcagccagctgtccgcaagagccgctgatggatccccctgcaacgttctcttatgcagtgttgtgccttcgcggaggatggattctgtgacttggcaggagggtaaggggccagttagaggtagagtccagagcttctgggggtctgaggcggcactgctgcttgtgtgcccaggggaaggcctgtcggagcctagatccagaaggccacgcatcataagatgtctgatgacccacaacaagggtgtgagcttttcgttggcggcatccatcgacgcatcccctgctctttgtgccccatcgacagggtgggatatgccgtggatactgatgctgctgctaactatgggccaaggcgtcgtgatactggctttgtcaatcgtcttatggcggcaacgcgttcggggtgcacccggtcgcggtaataggatgaggtgttataattgcggcggttccccctcttcaacgtgcaaggaagccgtcacgacatgtggggagggccgaccccagcccggtctggaacaaattaaactgccaggaaacccacccgtgactctgatccatcagcatcctgcgtgtgttgcagcacatcactgtaatcaggtggagaccgaatccgtaggagacgtcacctaccccgcacaccgcgattgctacctgggggacctgtgcaattctgccgtggcaagtcacgtggccccagccggtatccttgccgcagccgcaaccgctttgacctgtcttcttcccggactgtggagcgggtag

SEQ ID NO: 57404 - DNA, 237 bp, Artificial Sequence
  Description of Artificial Sequence: Synthetic coding sequence
atggcccctctccctggggctgaactggtacggaggcccttgcagctttaccggtatctcctgcggtgctgtcaacagctccccacaaaggggatacagcagcattacaagcatgcagtacggcagtcattcagggtgcattcagatgaggacaacccggagcgcattcagcagattattaagcgtgccattgaggatgccgattggattatgaacaaatacaaaaagcagaattag

SEQ ID NO: 57405 - DNA, 1572 bp, Artificial Sequence
  Description of Artificial Sequence: Synthetic coding sequence
atggaaaccatgaagagtaaagcgaattgcgctcagaatccaaactgtaatataatgatctttcatcctactaaggaggagtttaatgatttcgataagtatattgcatatatggaatctcagggcgcacatcgggcaggcctcgccaaaataatcccgcctaaggaatggaaagcacgtgaaacatacgataatatttcagagatcttaatagcaaccccgcttcagcaagtggcaagtggcagagctggcgttttcacgcagtatcataagaaaaagaaagcgatgaccgtcggcgagtacaggcacctcgctaattcaaaaaagtatcagacaccaccacaccagaatttcgaagacctggaacgcaaatattggaaaaacagaatctacaacagtcccatctacggggcagatatctctggaagcttatttgacgagaataccaaacaatggaatttaggccacttggggactattcaggatcttctggagaaggaatgcggcgtggttatcgaaggtgtcaacactccttatctgtattttggcatgtggaaaacgacgtttgcctggcacactgaggatatggacctgtacagtatcaattatctccatttgggcgagccaaagacatggtacgtggtgccaccagaacacggtcagaggctggagcgactggccagggagttatttcccggttcatcacggggttgtggggcttttctgcgccacaaggttgcactgatctccccaacagtactgaaggagaatggtataccctttaatcgcatcacgcaggaggctggcgagtttatggtgaccttcccgtatggctatcacgctggctttaaccatggttttaattgtgctgaggctatcaacttcgccacgcctcgatggatcgattatggcaagatggccagccagtgcagctgtggcgaggccagagtaacattctccatggatgccttcgtacggatcctgcaacccgagcgctatgacctgtggaagagaggacaggaccgggcagtggtcgatcacatggaacccagagtcccagccagtcaagagctatctacacagaaggaggtccagttgccccgacgagccgctctaggactccgccagctgccgagtcactgggcccgacacagtccctggccaatggccgctcgcagcggcaccagatgtcatactcttgtctgtagttccctgccgagaagatccgccgtgtcgggcacagccacccaaccccgtgcggctgccgttcacagcagcaaaaaacctagcagcaccccttcatctacaccaggaccctctgctcaaatcattcatcctagtaacggaagacgtggccgaggcaggccaccacagaagctgcgggctcaagagttaacacttcagaccccagccaagcgtccccttctagccggaacgacatgtacagcctctggtccagaacccgaaccgttgcctgaagacggcgctctcatggataagcctgttccactgagccctggactgcagcacccagtgaaggctagcggctgttcttgggcccctgtgccctag

SEQ ID NO: 57406 - DNA, 780 bp, Artificial Sequence
  Description of Artificial Sequence: Synthetic coding sequence
atgaagcacagtaaaaagacatacgacagcttccaggacgaactggaagattatattaaggtgcaaaaagcccgtgggctggagcctaaaacatgctttagaaagatgaagggagactatctggagacctgtggctacaaaggggaggtgaactccagaccaacatatcgcatgtttgaccagagactaccctcagaaacgatccaaacgtaccccaggtcctgtaatattcctcagaccgtggaaaacagactcccccagtggttgcccgcacacgatagtcggctgcggcttgactcactctcttactgtcaatttacccgagactgcttctcagagaagcctgtgcctctgaactttaaccaacaggagtacatctgcggatcgcacggcgtcgagcaccgcgtgtacaagcacttctccagcgataacagcacatccacacatcaggctagtcataagcagatccatcagaaacgtaagcggcatccagaagaaggaagagaaaaaagcgaagaagagaggagtaagcacaagcggaagaagagctgcgaagagatcgacctggataagcataagagcatccagagaaaaaaaacagaggtggagatcgagacagtgcacgtcagcaccgaaaaactgaagaacaggaaagagaagaagtctagagacgtagtatccaagaaggaggagcggaaaaggaccaagaagaaaaaagagcaggggcaggagaggactgaggaggaaatgttgtgggatcaaagcattcttggcttttag

SEQ ID NO: 57407 - DNA, 684 bp, Artificial Sequence
  Description of Artificial Sequence: Synthetic coding sequence
atggcatcaccatctcgacagccgcctcccggaggatccggcctacttcagggtagccgggctaggtcttacgggtccctggtgcagagcgcttgctcgcccgttcgcgaacgcagactcgaacatcagctcgaacctggcgatactctggcaggtctggctctcaagtacggcgttaccatggaacaaatcaaacgagcaaaccggttgtatactaacgacagtattttccttaaaaagactctgtatatacccatcctgaccgagcccagggacttatttaatgggttggattctgaggaagaaaaagatggcgaggagaaggtgcacccctcgaattcggaggtctggccacacagcactgagcggaaaaagcaggagacgggtgctggacgtgctaatggcgaggtcctccccactccgggacaggaaactccgactccaatccatgatctgagtgcatcagacttcttgaagaagcttgacagccaaattagcctctcaaaaaaagccgctgcacagaagttaaagaaaggagagaacggagtgcccggagaggatgccggtctgcatctcagtagcccatggatgcagcagagggctgtcctggggccagttcccctcaccagaacctctaggacccggactcttagagaccaagaggacgaaatctttaaactctag

SEQ ID NO: 57408 - DNA, 540 bp, Artificial Sequence
  Description of Artificial Sequence: Synthetic coding sequence
atgagatcagggccactccgaatcagcgagtggaaaatggaacagatcaagcgcgcaaatcggctctatactaacgacagcattttcctgaagaagaccctctacatcccaatcttaacagagcccagggacctttttaacggtttggatagtgaagaggagaaggatggggaagaaaaggtacacccctccaatagcgaggtgtggccccactcaactgagcgaaaaaagcaggagactggggctggcagagctaacggcgaggtcctgccaaccccaggccaggaaacgcccactcccattcacgatctgagtgccagcgactttcttaagaagctggattcgcaaataagcctgtctaagaaagccgcagcacagaagcttaagaagggggagaatggggttcctggagaggatgctggactgcacctgtccagcccctggatgcaacagcgggctgttcttgggccagtgccattaacacggacgagccggacccgcaccctgagggaccaggaagatgagatttttaaactgtag

SEQ ID NO: 57409 - DNA, 648 bp, Artificial Sequence
  Description of Artificial Sequence: Synthetic coding sequence
atggcagactcctcccctgccttgtctctgagagagggcggaccacgtgccccacggccttccgctccaagcccaccacctagatctcgctccggatcagagagtgaggaggcggagcttagcctttcactggccaggactaagacaaggagctatggctccaccgctagcgtgcgcgctcctctcggagccggagtgatagagagacacgtcgagcaccgagtgagagcaggggatactctgcagggcatcgcgctgaagtacggcgtgaccatggagcagattaagcgggctaataaactgttcacaaacgactgtattttccttaagaagaccctgaacattcctgtgatctctgagaagccgttgttgtttaatggccttaattccatagattcccctgagaatgagactgccgacaacagcttttcccaggaggaagagccagtggtcgccggagaagacctgccaccacccagccctcaggaatccgacgttcagccagtgcagccagaagaggtgtcggccagggactttcttcagaggctggaccttcaaattaaactcagtacccaggccgcaaaaaaattgaaagaggagagccgggatgaggagtccccttatgctacctccctgtaccatagttag

SEQ ID NO: 57410 - DNA, 375 bp, Artificial Sequence
  Description of Artificial Sequence: Synthetic coding sequence
atggagcagatcaagcgagctaacaagcttttcacaaacgactgcatcttcttgaaaaaaaccctaaacatccccgtgatcagcgagaagcccctcctctttaacggcttaaatagcatagactctcctgaaaacgagaccgcagataactctttcagccaggaagaggagcccgttgtggccggagaagatcttccccctccttctccccaggagtcagacgtgcagccagtgcagccggaggaggtttctgctcgtgattttttgcagcgactggacctgcagatcaagctgtccacgcaggccgcaaagaaacttaaagaagagagccgcgacgaagagtctccatacgccacttccctgtaccattcttag

SEQ ID NO: 57411 - DNA, 375 bp, Artificial Sequence
  Description of Artificial Sequence: Synthetic coding sequence
atggaacagatcaaacgcgcaaataaactatttactaacgactgcatctttttgaagaagactttgaatattcccgtcattagcgagaagccgcttctgttcaatggtttgaactccattgattcacctgagaatgaaactgccgataattccttcagccaagaagaagaacctgtcgtggccggagaagatctccccccacctagcccacaagagtctgatgtccagccagtgcagcctgaggaggtgtccgccagggattttttgcagaggctcgacctgcagataaaactctccacacaggccgctaaaaagcttaaggaagagagccgtgacgaggagtcgccttatgcaacgtcgctgtatcactcctag

SEQ ID NO: 57412 - DNA, 495 bp, Artificial Sequence
  Description of Artificial Sequence: Synthetic coding sequence
atgaagatggtcatgccttcatggttcgacctgatgggcctaagtcctgatgcacccgaagatgaagctggaattaaaaaggccgcagagaatattaaggcactgatagagcacgagatgaaaaatggaattcccgcaaatagaatcgtgctgggcggtttcagccaaggcggtgccctgtctctgtacacagcccttacctgcccgcaccctttagccggaatcgtggccctgagctgttggttacctctgcatagggccttccctcaggccgcaaatggctccgctaaagatctagcaatcctgcagtgccatggggaactggacccaatggtgccagttcggtttggcgctttgactgcggaaaagttaagatctgtggtgactccggcaagagtgcagttcaagacctaccctggcgttatgcatagcagttgtcctcaggagatggcagctgttaaggagttccttgagaagttactgccaccagtctag

SEQ ID NO: 57413 - DNA, 543 bp, Artificial Sequence
  Description of Artificial Sequence: Synthetic coding sequence
atgtgtggcaacaccatgtctgttcccttgcttactgatgccgctacggtgagcggggctgagagggagacagcagccgtcattttcctgcacggtttgggcgatacaggtcacagctgggccgacgccctttccaccatccgcctaccacatgtgaaatacatctgccctcacgcccctagaatccccgtaacgctgaatatgaagatggtgatgccttcttggttcgatctcatgggtctgtcccctgatgctcccgaggatgaagcgggtattaagaaagcggcagaaaacattaaggcccttatcgaacacgagatgaaaaacggaatacccgcaaaccgcatcgttttggggggtttttctcagggaggcgcactgagcttgtacactgcactgacgtgtccccaccctcttgccggtatagtagccctttcatgttggctccccctgcaccgagccttcccacaggtgaacgtccccacagacccacccgcactgtgcgtgtgcattctcgtggcctgggggcttctgcagcactag

SEQ ID NO: 57414 - DNA, 549 bp, Artificial Sequence
  Description of Artificial Sequence: Synthetic coding sequence
atgtgcggaaataccatgtctgtgccactgctgactgatgctgctacagtatccggggcagagcgagaaaccgctgccgtgatcttccttcacggattgggggacaccggccattcctgggccgacgctttgtccacaattcgacttccgcacgtgaaatacatttgcccccatgctccccgaattcccgtcactctgaatatgaaaatggtgatgccctcttggtttgacctgatggggctttcaccggatgcccctgaagatgaggcaggaatcaaaaaggctgctgaaaatattaaggcactgatcgagcacgaaatgaagaacggtattcccgctaataggatagtgctcggaggcttctcccaaggtggagccctctctctctacactgccctcacatgtccgcatcccctcgcaggcattgtcgctctaagctgctggctgccccttcacagagctttcccccagggcccagtacaggatatccccggttgccatgcgcaactgctctctagtggcgacggcagttgtgagggtatctcttag

SEQ ID NO: 57415 - DNA, 414 bp, Artificial Sequence
  Description of Artificial Sequence: Synthetic coding sequence
atgtgcgggaacaccatgtctgtgcctcttcttacggacgctgcaaccgtaagcggagccgagagagagacagctgccgtgatcttcttgcacggcctgggtgacacggggcattcttgggccgacgcactgagcacgattaggctgccccacgttaaatacatctgtccccacgctccgaggataccagtgacgctgaatatgaaaatggtcatgccgtcgtggtttgatctgatgggtctgtctccggatgcccctgaggacgaagccggaatcaaaaaagccgctgagaacagacgcggacccgtccccctgcatggtccccatctccccccaccatctggctggcatcggggagttgaacttctcgccgctagtgcccctgggctgccgccaggcgagtgtccacattag

SEQ ID NO: 57416 - DNA, 627 bp, Artificial Sequence
  Description of Artificial Sequence: Synthetic coding sequence
atgctgcctccctgtctggagctttcaggaaagcggcctagacacagctgggccgacgccttgtccacaatccggctgcctcacgtgaagtacatctgcccacacgccccaaggataccagtgactctaaacatgaagatggtcatgccctcatggtttgacttaatgggcttgagcccggacgctccagaggatgaagccggtatcaagaaggctgcagaaaacattaaggcgttaatagaacacgagatgaaaaacggtatcccggcaaatcgcatcgtgctgggagggttttcccaagggggagcgctctctttatacacagcccttacctgtccacatccactggccggaattgtggcccttagctgttggttgccgttgcacagagcattcccgcaggctgccaatgggtcggctaaagacctggctatccttcagtgtcacggggaactcgacccgatggtgccggtccgtttcggagctctgacagccgagaagctgaggtctgtggtgacgcctgcgagggttcagtttaaaacctacccgggagtgatgcattcaagttgtcctcaggaaatggctgctgtaaaggagtttctggaaaaactcctgccacccgtctag

SEQ ID NO: 57417 - DNA, 696 bp, Artificial Sequence
  Description of Artificial Sequence: Synthetic coding sequence
atgtgtggcaacaccatgtcagtgccactcctgaccgacgccgctaccgtcagtggcgctgagcgcgagactgcagcggtgattttcctgcacggactgggtgatacaggccattcctgggcggatgccctgtccacaattcgtctgcctcatgtcaagtacatctgtcctcacgccccacgaattccagtcacactcaatatgaaaatggttatgccttcctggtttgacctcatggggctctcccccgatgcaccagaggatgaagccggaattaaaaaggcagcagagaacatcaaggccctgatcgaacatgagatgaagaatggcattccagcaaatagaatcgtgctgggaggtttttcccagggaggcgcactctccctctacactgccctgacctgccctcaccctctagcaggcattgtggccctgagttgctggcttcccctccacagagctttcccgcaggccgctaacggcagtgcgaaggacctcgctattctccagtgtcatggggagctggatcccatggtcccggttcgtttcggagcgctgacagcagagaagcttagatctgtagtgacacccgctcgagtacagttcaaaacttaccctggggtgatgcactccagttgcccccaagaaatggccgctgtgaaagaattcctggagaagttgctccctccggtttag

SEQ ID NO: 57418 - DNA, 405 bp, Artificial Sequence
  Description of Artificial Sequence: Synthetic coding sequence
atgtgtggcaatacgatgtcggtacctctgctgaccgacgcagctaccgtctcaggggcagagcgggaaaccgctgcagttattttcctgcacggtctaggtgacacaggccactcctgggctgatgctttgtcaacgattaggttgccccacgtgaaatatatctgtccacacgcacctagaatccccgtgacgttaaacatgaaaatggtgatgccgagttggtttgatctgatgggactgtcacccgatgcccctgaggacgaagccggaatcaaaaaggccgcagaaaatcgaaggggcccagtccctcttcacggaccacacctgccacccccttctggatggcaccgcggtgtggagttgctcgccgctagtgctcccggactgcctccaggaagctag

SEQ ID NO: 57419 - DNA, 489 bp, Artificial Sequence
  Description of Artificial Sequence: Synthetic coding sequence
atgctgcctccatgcctggagctcagcggaaaacggcctaggcacagttgggccgacgcccttagcacaatcaggctaccccacgtcaagtacatctgcccacacgcccctagaattcccgtcaccctgaacatgaagatggttatgcccagctggttcgatttgatggggctcagtcctgatgctcccgaggatgaagccggaataaaaaaggcggctgaaaatattaaagccctgattgaacatgagatgaagaatggcattcctgccaataggatagtgctaggaggattctcacaggggggagcgctgtcactgtataccgcccttacctgtcctcacccgctggcgggaattgtggccctctcctgttggctccccttgcatagagccttcccacaggccgcaaatggttccgctaaggatttggccatccttcagtgtcacggggagctggaccccatggtgcccgttcgatttggcgcttag

SEQ ID NO: 57420 - DNA, 276 bp, Artificial Sequence
  Description of Artificial Sequence: Synthetic coding sequence
atgtgcggcaacactatgtctgtgcccttgctcactgacgccgctacagtttcgggggcagaacgcgaaaccgccgcagttatcttcctccacggcttgggggatacggggcattcctgggccgatgctctgagcacaatcagactcccccacgtgaaatatatttgcccgcacgcgccaaggattcccgtcacattaaatatgaaaatggtgatgcctagttggtttgacctcatgggactgtcccctgacgcgccagaggatgaggcaggatag

SEQ ID NO: 57421 - DNA, 1476 bp, Artificial Sequence
  Description of Artificial Sequence: Synthetic coding sequence
atgaagatggccgctccaaccgccaacaaggcagcctccctgggttgtaacaacaagccagcatttcccgagcttgattttcggtctggtgcacgtgtagaagagctgaacaaactcattcaagaatttaccaagcacgatcagcgcgaatacgacgaccaacgcgctctggaaatacacaccgccaaagactttatattttctatgttaggcatggtccagaagctcgaccagaaactgccagttgcaaatgagtatctgctgctttccggcggagtcagagagggggttgttgacctagatctggatgagctgaatgtgtacgccaggggcacagactacgacatggatttcacccttctcgttcccgcattgaaattgcatgaccgcaaccaacctgtgactctagacatgcggcactccgccctgtgtcacagctggctgtccttgcggctgtttgacgaggggacgatatcaaagtggaaagactgttgcacaatcgtggatcacattaatggtgccactaactatttcttcagtccaacaaaagtcgcagactggttttatgatagcatctccatcgtcctgtccgagatccagaaaaaaccccaaagaggcatgccaaaagtcgaaaaggtggaaaaaaacgggaccatcatctctatcattctgggggtcggatcaagcagaatgttgtacgacatcgtgcccgtggtgtcctttaaagggtggccggcagtggcccaaagttggctgatggagaaccacttctgggacggaaaaattactgaagaggaggtgatttccggcttttatctggtaccagcttgctcctacaagggcaaaaaagacaacgagtggaggctgtcatttgctagaagtgaggtgcagttgaagaaatgcatctccagcagcctcatgcaggcataccaggcctgcaaggccatcattataaagctcctttctcgcccaaaggccataagcccatatcatctgaggtccatgatgctgtgggcctgcgatcggctgccggctaattatctggctcaggaagactacgcagctcatttcctcctcggactgatcgatgacttgcaacactgccttgttaataaaatgtgccctaactactttattcctcagtgcaatatgcttgagcatctgtccgaggaaacggtcatgttgcacgcacgaaagctctcgtctgttaggtccgatcctgccgaacacctaagaactgctatcgaacatgtaaaggccgcaaaccggctaacattggaactgcagcgcaggggcagcactacgagcatccccagcccccagagcgacggcggtgacccaaaccaacctgacgaccgtctggccaagaaattgcagcagctggttaccgagaatcccggaaagagtatctcggtgtttatcaacccggatgatgtgactaggcctcactttagaattgatgacaaatttttctag

SEQ ID NO: 57422 - DNA, 1089 bp, Artificial Sequence
  Description of Artificial Sequence: Synthetic coding sequence
atgaagtacctcaccgttggcgacttggaggattgcctgctgaacaaagttgacctccgcagacagcagataagccaggcagtagaggaagtccagaaagtagtgcatcacctgactaccaatatctcaaatcaggatattaggtttcaagcagtgccgtattccgatacttacaacgagaatattaaggtgttagcaccttcccaatttctcgtcacagtccctataaagggtctcgccggatatagggaggcaagagagcaacattggcgatattatactctgcaaggcactcggctcccatgtcccctcagagacccagagggtttgcagcagtggttggaggtcgaacagttcatgaagtcgctgtggcaatggcacgagacagatgtgaatattgacggggacattgtgcccgctaaggtgcttttagtgtttcggaaactagttgagaatgcggtgcgaacctgtcacctgagtggcaaggtatcgcttctgggcaacaggagtgccgtgtgggtcgctgtggaaacctcagcctaccaggtcgagttagaactagtgcctgccgttgagatcccaacgacttggagcaagaaagcaagatggcctcgttgcctgcagcggtggcctagccaggaacgagtggaatgcataaagtcttttggatttaatctgctggcctgttctaattatcactggcagctgtcatttctgcgagcagagcaggtgctcctggaacaacttgacgaagatgggggttgcaggcgaaaatgcttccaggtcatgcggcacctcaaagaggacatttggtgcccaggtaatcgccctgtgataacatctcatcacctgcaaaccgttttgttttggacctgcgagaaatatcctcattttaaggattggcaggtcttctctaaggcattcctccggcttgtgcggaagctacataaatgtgtgtcccaacattttctgaaacattactttgtgcgtaactctaatctcttccagtgtaccaatcccaccgaactggacaccgtggcccagaagctagcgacctttctgaagaatccccagatcggccctccttag

SEQ ID NO: 57423 - DNA, 4371 bp, Artificial Sequence
  Description of Artificial Sequence: Synthetic coding sequence
atgcgactgcctctattgctcgtgttcgcgtccgttatccccggagcggtactgctcctcgacactaggcaattcctgatatataacgaggatcacaaaagatgcgtggatgccgtgtcaccatccgccgtgcagaccgccgcttgtaaccaggatgccgagtcgcagaagttccggtgggtgagtgagagccaaattatgagcgttgcctttaaactgtgcctgggcgtcccatctaagaccgactgggttgccatcaccctatatgcttgtgactccaaaagtgagtttcagaagtgggagtgcaagaatgacaccctcttaggcataaaaggagaagatttgtttttcaattacggcaaccgtcaggaaaagaatataatgttgtataagggctcaggactatggtctcgctggaagatttacggcacaactgataatctgtgttcccggggttatgaagctatgtacacccttctcggtaatgctaacggtgccacatgcgcgttcccgttcaagtttgagaataagtggtatgctgactgcacctcagcaggaaggtcagatgggtggctgtggtgcggcactacgaccgactatgatacagataaactgtttggctattgtccgttgaaattcgaaggatccgagagcttgtggaacaaagatccgcttacatccgttagttatcagatcaatagcaaaagcgcgctgacatggcatcaagctaggaaatcctgccagcaacaaaatgccgaactgctgtccatcacggagatccatgagcaaacatatctcactggcctgacaagttctctgacatcagggctgtggattgggttgaatagccttagcttcaatagcggctggcaatggagtgataggtccccattcagatatctgaattggctcccaggatccccttccgccgaacccggaaagtcctgtgtctccttgaaccccggaaaaaacgcgaagtgggaaaatctggagtgtgtgcagaagctgggctatatatgtaagaagggaaacacaacactcaattccttcgtgatcccaagcgaatcagatgtccctacccattgcccatcccagtggtggccttacgccggacactgttacaagattcatagggacgagaaaaagattcagcgagatgccctgaccacgtgtcgcaaagagggcagtgaccttgcatcaattcacacgatcgaggagtttgattttatcatctcacagctgggttatgagccaaacgatgaactctggattggattgaacgacatcaagatccagatgtactttgagtggagtgacggtaccccagttacttttacaaagtggctgaggggcgagccctcacatgaaaacaataggcaagaggattgcgtggtgatgaaaggcaaagatgggtactgggccgatcggggttgcgaatggccactcggttatatttgcaagatgaaatcccggtcacaggggcctgaaattgtggaagtcgaaaaggggtgccgaaaaggttggaagaaacaccacttctattgctacatgatcggacacaccctgtctacattcgcagaggccaatcagacttgtaacaatgagaatgcatacttaacaacaatagaagaccggtatgagcaggcgtttttgacgagcttcgttggactccggccagaaaaatatttctggaccggactctccgacatccaaacaaaaggtacattccaatggaccattgaggaagaggtgcgttttactcactggaattcagacatgcccggacgcaagcccggttgcgtcgccatgcgcaccggcatagcgggagggctctgggatgttctgaaatgtgacgagaaagccaaatttgtgtgtaagcactgggctgagggagtgactcatcctcccaaacctaccactactcctgaaccaaaatgcccagaagactggggcgcatcctctcggaccagcctttgttttaaactgtatgccaagggcaagcacgaaaaaaagacgtggttcgaatcacgagacttttgccgtgcactgggcggagatctcgcctccatcaataataaggaagagcagcagactatatggcggctgatcacggccagcggaagctaccacaagctgttttggctcggactgacctatggaagcccatctgaaggattcacttggtccgacggtagtccagtgagctacgagaattgggcttatggcgaacctaataactaccagaatgtggagtattgtggtgagctgaaaggcgatccaacgatgtcttggaatgatattaattgcgaacacttgaacaactggatttgccaaatccagaaggggcagacaccaaaacccgagcccacccccgctcctcaggataaccctcctgtaacagaagatggctgggtcatctacaaagactaccagtactacttttctaaggaaaaagagacgatggacaacgcccgtgccttctgcaaacgcaactttggggacctggtgtccattcagtccgaatccgagaaaaaattcttgtggaagtatgtgaatcgcaatgacgcccagagtgcatacttcatcgggctgctcatctcactggataaaaagtttgcatggatggatggctcaaaagtggattacgttagctgggctacgggggagcccaatttcgccaatgaggacgaaaattgcgtcacaatgtattctaacagtgggttttggaacgacatcaattgcggttacccgaatgccttcatttgtcagcggcataactcgtcaataaacgccacaacagttatgcctactatgccgtccgttcccagtggttgtaaggaagggtggaatttttacagtaataagtgttttaaaatcttcggatttatggaagaagaacgcaaaaattggcaagaggctagaaaggcatgcattggttttgggggaaacttagtgtcgatccaaaatgaaaaggagcaagcctttctaacgtaccacatgaaagactccacattcagcgcctggacgggtcttaatgacgtcaatagcgagcacactttcttgtggaccgatggaaggggggtccattacactaattggggaaagggctatcctggcggaagaaggagcagcctgagctacgaagacgccgactgcgtcgtaatcattggaggagctagtaacgaggcagggaaatggatggacgacacatgcgacagtaagcggggatacatctgccaaaccaggtccgatcccagcctcaccaaccccccagctacgattcagacagatggcttcgtaaagtatggtaaaagctcctacagtttgatgagacaaaagttccaatggcatgaggctgagacgtattgtaagctccataactctctcatagcgagcatcttggacccctatagtaacgcatttgcctggctccagatggaaacaagcaacgagagggtctggatcgccctcaatagcaacctgaccgataatcagtatacctggaccgacaagtggcgcgtccggtatactaattgggccgcagacgaacctaaactcaaatccgcttgtgtctatctggacttggatgggtattggaagaccgcgcattgtaatgagtctttctacttcctgtgcaaacgatctgacgagataccagctacagaacctccccagcttcctggcagatgtcctgaatcagatcacaccgcctggattccgttccacgggcactgctattatattgagtccagttacacaagaaactggggtcaggcgagtctcgagtgcctccgcatgggctcctcactggtgagtatcgaaagcgccgctgagtcctctttcttgagctatcgggtggagcctctgaagtcaaaaacaaacttttggataggactgtttcggaatgtcgaaggtacatggctgtggataaacaactcgccagttagttttgtgaattggaacactggcgatccttcaggggagcgcaacgactgtgtggctctgcacgcctcatccggattctggagcaacatccactgctcttcttataaagggtacatctgtaagaggcccaaaatcattgatgcaaagcctacccacgagttgctcacaacaaaggctgacactaggaagatggacccatcaaaaccctcgagtaacgtcgccggtgtggttatcattgttatcctgctaatcctgaccggagctggtctggcagcctactttttttacaagaagagacgggtgcacctgcctcaggaaggtgcctttgaaaatactctgtattttaacagccagtccagccccggaactagcgacatgaaggacctggtaggcaatattgagcaaaatgaacattcagtaatttag

SEQ ID NO: 57424 - DNA, 1497 bp, Artificial Sequence
  Description of Artificial Sequence: Synthetic coding sequence
atgcgccttccgctgctcctggtatttgccagtgtgatacccggtgccgttttgttactagatacccgccagtttctgatatataacgaagaccataagagatgtgtcgatgctgtttcaccatccgctgtacagactgccgcttgcaaccaagatgccgagtcccagaaatttaggtgggtgagtgagagccaaatcatgtccgtcgcctttaagctctgtctgggggttccctctaagaccgactgggtggcaatcacactgtacgcatgcgactctaaatctgagtttcaaaaatgggaatgcaagaatgacacactccttggcatcaagggggaagatctatttttcaactacggcaatcggcaggaaaagaacattatgctctacaaagggtctgggctgtggagtcgatggaagatttatggtactactgacaatctgtgctctcggggttatgaggcgatgtataccctgctggggaatgccaacggagctacctgcgcctttcctttcaagttcgaaaacaagtggtatgcagactgcacatctgcagggcgtagcgacggctggctctggtgcgggactacaactgactacgacactgataagctgtttggatactgccctcttaaattcgaaggctccgaatcactttggaacaaggaccctttaacctctgtttcctaccagataaatagcaaaagcgccctgacatggcatcaggcgagaaaaagctgtcagcagcaaaacgctgagctgctgtctattactgagatccatgaacagacttatctgacagggctaacctcgtccttgacttctggtctgtggattggactgaattctctgtccttcaacagtggctggcagtggagtgaccgctcacctttcagatatttgaactggttgccaggaagcccatccgccgaacctggcaaatcgtgtgtgtccctcaatcccggtaaaaatgccaagtgggagaatctcgagtgtgttcagaagttgggatatatttgcaaaaaggggaatacaaccctcaacagtttcgtcatcccatccgagagcgatgttccgacacactgcccctctcagtggtggccatacgcagggcactgttacaagatccatagagacgaaaagaagatccagcgcgacgctctcactacctgtcgcaaagagggctccgatctagctagtatccacactattgaggaatttgactttattatttcccagttgggatacgaaccaaatgatgaattgtggatcggcttaaacgatatcaaaattcagatgtactttgaatggtctgacggcacacccgtgacttttacaaaatggctgcgcggtgagccgagccacgagaataacaggcaggaagactgtgtcgtgatgaaaggaaaggccggtgttcagtggcacaatctcggatccatgcagcccttgcctagggagttcaaaaggttcagctgcctatctctccccagttcctag

SEQ ID NO: 57425 - DNA, 507 bp, Artificial Sequence
  Description of Artificial Sequence: Synthetic coding sequence
accgggcagggcggagttaggtccgctccaggcacaggcagaatcgcttttcccccaaaggcctctcggggatccacaaacacagcccatttgtctatcgcaaatagctggcctcgtagtgctagtacaccggaaacaagaaccaaatttacccaggacaacctgtgtcatgcccagcgcgaaaggctggactcggcaaacctatgggttctcgtcgattgcattctgcgtgacaccagcgaagaccttggtctgcaatgcgacgcagtcaatctggcctttgggcgaagatgtgaggaattagaagacgccagacacaagttacaacatcaccttcacaaggtcgggcacccagagcccaggagaagactgagacgcctaccgacgacgcttccacctctgataacttggcccggtccgtctactcctttctcctccgtccctctcatccctagagacccaagaagcaaatgccacctctccgtgaacctgtgcaagacacgctag

SEQ ID NO: 57426 - DNA, 1941 bp, Artificial Sequence
  Description of Artificial Sequence: Synthetic coding sequence
atggaattccaggaagtacagcagacacaagctctggcatggcaggctcagaaggctcccacacatatttggcagcccttgccagctcaagaagcgcagcggcaggctccacctcttgttcagctggagcaaccttttcaaggcgcaccccctagccagaaagcggtgcagattcagctgccacctcaacaggcccaagcttcaggcccacaagcggaagttcctacactgcctttgcagccaagctggcaagcgcctcctgctgtcttgcaggcgcaacccggaccgccagtggctgcggcaaacttccccctcggttccgcaaagtcacttatgacacccagcggcgaatgccgggcaagcagtatcgacagacggggaagctcgaaggagagacgaacatcgtctaaggaacgacgcgcaccctccaaggataggatgatctttgccgcaacgttctgcgcaccaaaagcagtcagtgctgccagagcgcatctccctgcggcatggaaaaacctgcccgctacccccgaaactttcgcaccttctagctctgtgtttccagccaccagtcagttccagcctgcaagcctcaacgcttttaagggcccttccgctgcgtctgagacccccaaatcgcttccttatgcactccaggatccgttcgcatgtgttgaagctcttccagcggtcccctgggtgcctcagcctaatatgaatgcttccaaagcctctcaggctgtgccaacctttcttatggcaaccgcggcagcccctcaggcaacagccacaacacaggaggcttcgaagacttcagtagaacccccacgcaggagcggcaaagcgactaggaaaaagaaacacctggaggctcaagaagatagccgcggtcacacgctggccttccatgactggcagggcccacggccatgggagaacctgaacctctccgactgggaagtgcagtcccctatacaagtcagtggagattgggagcatccaaacacaccgagaggcctgtctgggtgggagggcccatccacctctaggatcctcagcggctgggaaggtccctctgctagttgggctctgtcagcctgggaaggcccttccaccagcagagctcttggcttgtctgaaagccctgggtcttccctgcctgtggtcgtctcagaagtggcttccgtgagcccaggaagctcagcaacacaagataacagcaaggtggaagctcagcccctgtctccgctggatgagcgtgcgaatgcgttggtgcagtttctcttggttaaggaccaagcgaaggtccccgttcagcgtagcgagatggtgaaagtgattctccgagaatataaggatgagtgccttgatattatcaatagagcaaacaacaagctggaatgtgcgttcggctatcagttgaaagaaatagacacaaagaatcatgcctatatcatcatcaataagctgggttatcacaccgggaatctggtcgccagttaccttgatagacctaaattcgggctcctcatggttgtcctgagtttaatatttatgaagggaaattgcgtcagagaagacctcatatttaattttttgtttaagctggggttggacgtacgggagactaacggtctgttcggaaacactaagaagttgatcacagaggtattcgttcgccagaagtaccttgaataccggaggatcccctacacggaacccgcagaatacgaattcttatggggaccgcgtgcgtttcttgaaactagtaaaatgctggtactgcgtttcctggcaaagcttcacaagaaggacccgcaaagctggccattccactaccttgaagccctcgcagaatgtgagtgggaggataccgacgaggatgaacctgatactggcgactcggcccacggtcctactagcagacctccccctcgttag

SEQ ID NO: 57427 - DNA, 828 bp, Artificial Sequence
  Description of Artificial Sequence: Synthetic coding sequence
atgccacttctttggataacaggtcctcgctaccatctgatcctgctgtcagaggctagctgtttgcgggctaactatgtccacctgtgtccgctgtttcagcatcgctggctggagacttgcaatgcccctccccagctcatccagggaaaggcacattctgcgcctaagccttcccaggcatctggtcacttctctgttgaattagtccgaggttacgccggattcggactcacgctagggggagggcgtgatgtcgctggggacaccccactcgcggtgagaggacttctcaaggatggtcctgcccagcggtgcgggaggctggaagtgggagatgtagtgctgcacatcaatggagagtccacccagggattaacccacgcccaagccgtcgagcggatacgggcaggtggccctcaactgcacctcgtgatccgccgtcccctcgaaacgcaccctggcaagcctcgcggagtgggcgagcctcgtaagggcgtggtccctagttggccagatcgtagccctgaccccggtggccctgaggtgacggggagtcgaagctcgagcacgagcctggtccagcaccctccgtcacggaccaccctgaagaagacaagaggatcgcctgagccctctccagaagcagccgctgatgggcctacagttagtcccccagagaggcgggctgaagacccgaatgaccagatccctggtagtcctgggccatggctagtaccatctgaagaacggttgtcacgcgctctgggagtgcgtggggcagcacagtttgcacaggaaatggccgcagggcgtcgacggcactag

SEQ ID NO: 57428 - DNA, 813 bp, Artificial Sequence
  Description of Artificial Sequence: Synthetic coding sequence
atgccccttctgtggattacaggccctaggtatcatctcatcttgttgtcggaggcaagctgcctccgtgccaactatgttcacctttgtcccctgtttcagcacaggtggctggagacctgtaatgcccctcctcaactgattcagggtaaggcccattcagctcctaagccttcccaagctagcggccacttttctgtggaactggttcgcggttatgccggtttcgggctaactttagggggaggtcgtgatgttgctggcgacacccccctcgcagtgagaggtcttctcaaggatggacctgcgcaacggtgcggacgcttagaggtcggagacgtggtgctgcacatcaacggggagtctacacaggggttaacacatgcccaagccgtcgaaaggattagagccggaggaccacaactccacctcgttatcaggagacccctggaaactcatccagggaaaccgagaggagtgggggaacctcggaaaggtgtagataggtcaccagacccagggggtcctgaggtgaccggttctcgctccagcagcacttccctggtgcagcatcccccaagccgtaccactctgaagaaaacaagaggctctcctgagccttcacctgaggcagccgcagacggccctacggtgtctcccccagaacggagggctgaggatcccaacgaccagatccctggctcacccggtccttggttggttccctccgaggagcgcttaagtcgcgctctgggagtccggggtgcggcacagtttgcgcaagagatggccgcaggcagaagacgccattag

SEQ ID NO: 57429 - DNA, 1005 bp, Artificial Sequence
  Description of Artificial Sequence: Synthetic coding sequence
atggagccgagaaccggtggagctgcaaaccccaaaggctcacgcggaagccgaggcccatcccctctggccggaccttctgctcgccagttgctggctcgccttgacgccaggccccttgccgctcgcgctgccgtggacgtagcggctttggtgaggcgcgcaggagccactctgcggttaaggaggaaggaggctgtgtcagttttggattcagcagatatcgaagtgaccgattcacggcttccccatgccaccattgtggatcaccgccctcagcaccgatggctcgaaacctgcaacgctcctccccaactgatccagggaaaggcgcattccgcccctaagccttcccaggcttctggtcatttttcagtggaattagtgagaggatacgcaggcttcggcctgacattaggaggaggcagagacgtggccggagacacaccactggctgttaggggcctgctgaaagacggccctgcacagcggtgtggaaggctggaggttggtgacgtggtgctccacatcaacggggaaagcacccagggtctgactcatgcccaggcagtggaacgtatcagggctgggggacctcagctgcatctggtgatcagacgccctctggagacgcatccgggaaagccccgaggagtcggtgaacctcgcaagggggtagtgccttcatggcccgatcggtcacccgacccagggggaccagaggttacggggagtaggtctagttcaacctctctcgtccaacaccctccctcccgcacaaccctgaaaaagactagagggtcccctgagccatcgcccgaagctgcagcagacggcccaacagtgtccccacccgaacggagggctgaggatccaaatgaccaaatcccaggtagtcccggaccctggctggtgccctctgaggaacggctttcaagggccctcggagtgaggggcgctgcacagttcgcgcaagaaatggcggctggaagacggaggcattag

SEQ ID NO: 57430 - DNA, 714 bp, Artificial Sequence
  Description of Artificial Sequence: Synthetic coding sequence
tagagggggccatcacccttggccggaccaagtgcgaggcagctgctggccagacttgacgcgaggcctctggccgctagagctgctgtagatgttgccgctctggtgcggagggcgggtgccacactcaggctccggaggaaagaggccgtaagtgtgctcgattcagccgacattgaggtgacggactcacggcttccccacgcaacaattgtggaccatcgtccgcaaggaaaggcgcattcggctcccaaacccagtcaagcctcaggccacttttctgtggaactagtcagaggttatgctggtttcggcctgaccctgggagggggtcgagacgttgcaggcgacactcctctggcagtgcggggtcttctcaaggatggtcccgctcaaaggtgcgggcgattagaggtgggcgacgtcgttctgcacattaacggggagagtacgcaggggcttacacacgcccaagctgtcgaacgaattcgcgctgggggtccacagctccacctggttatccggagacccctcgagacacatcccggtaagcccaggggagtcggagaaccaaggaaaggagttgacaggtcaccggacccaggaggacctgaggtaactgggagccgatccagcagtacttccctcgtgcagcacccaccttctagaactacactaaagaaaaccagagggtcccctgagccctccccctag

SEQ ID NO: 57431 - DNA, 645 bp, Artificial Sequence
  Description of Artificial Sequence: Synthetic coding sequence
gcttggggggtgtcatcgtactgcccggtgctggcggtgtctgtgctggacagtgcagatattgaggtgacggactctagactgcctcacgccactattgttgatcacagaccccagcacagatggctagaaacctgcaatgcccctccacagctcatccaaggcaaagctcactctgccccaaaaccttctcaggcatcgggtcatttcagtgtcgagctggttagaggatatgctggtttcggcctgactttgggagggggacgtgatgtggccggagatactcccttggccgttcgagggctcttgaaggatggacctgcacagagatgtggacgcctggaagtgggggacgtggtgctacacataaacggagaatccacccaggggctgacccacgctcaggcagtggaacggattcgtgcaggcggtccccagctgcacctggtgatcagacggcctctggaaactcacccgggaaagcccaggggggttggagagccgaggaagggggtggatcgttctcctgaccctggcggtccagaggttaccggtagcaggtccagttccacaagcctggttcaacaccctccaagtagaaccaccctcaagaagaccaggggatcccccgagccgagcccctag

SEQ ID NO: 57432 - DNA, 777 bp, Artificial Sequence
  Description of Artificial Sequence: Synthetic coding sequence
atggaaccaagaacaggcggagccgctaaccccaaggggtcccgtggaagccgcggtcccagtccgctggccggaccctccgccaggcagctcctggctcgccttgatgcaaggccactggccgctcgggctgccgttgatgtggccgcactggtgcgtagagccggagcgacacttaggctacggaggaaggaagccgtgagtgttctggattctgccgacatcgaggtgaccgattcccggctcccccacgcaacaatcgttgaccacagacctcaagtgggagacgtcgttcttcacattaacggggagtctacacagggtctcactcatgctcaggccgtggaacggatccgcgcaggaggcccacaactccacctggtaatccgccgacccctggaaacccatccaggtaaacctcggggtgtgggcgagccgagaaagggagtagtcccctcttggccagaccgatcccccgatcctggtggacccgaggtgactggcagccggtctagctcgacctccctagtgcagcatccacctagtcggacaacactgaagaagactagggggtcccctgagcctagcccagaagctgcagcagacggtcccaccgtctcaccgccagagcgacgcgctgaagacccaaatgaccagatccccggatcacccggtccatggctcgtaccgtctgaggagcgtctgtctagggcactcggggtgaggggcgctgcccaattcgctcaggaaatggccgctgggcgtcgtagacactag

SEQ ID NO: 57433 - DNA, 432 bp, Artificial Sequence
  Description of Artificial Sequence: Synthetic coding sequence
atgtcgccaaacagtcctctgcactgtttttacctgcctgccgtctccgtcctggacagcgcagacatagaggtgacagactcaagattgcctcatgccacaatcgtcgaccacaggccccaagttggagacgttgtgcttcatatcaatggggagagtactcaggggttgactcacgcacaggccgtggagcgtatcagagctggtgggcctcagttgcatcttgtcattcggcgacctttggagacacaccctgggaagccaaggggagtgggggaacccaggaagggggtggatcgctctcctgaccctggcggtccagaggtgacaggttctaggagctccagcacttcattggtacaacatccacccagcaggacaacgctcaagaaaaccagaggcagccccgaaccaagccctgaggctgcatag

SEQ ID NO: 57434 - DNA, 606 bp, Artificial Sequence
  Description of Artificial Sequence: Synthetic coding sequence
tgaggtcgcttgctggctatggagccacgcacagggggagccgctaatcccaagggatcgagagggagccggggaccgagcccactcgctgggcctagcgcacgtcagctcttggccagactggatgccagaccactggcagcacgcgctgcggtcgacgtcgccgctctcgtcagacgggctggagcaacattgaggcttaggagaaaggaggcagtgagcgttctggacagtgcagatatagaagtcacagattctcgcctccctcatgccactatcgtagaccatcgcccacaggttggagatgtggtcctacatatcaacggggaatcgacacaggggctcacccatgcccaggccgtggagcggattagggctgggggtccgcagctgcacctggtcatccggaggcctttagagactcaccctggcaagccaagaggcgtgggagagcccagaaagggcgtggataggagcccagatcccggtgggccagaagttacgggctctaggtctagcagtacaagtctcgtgcagcaccctccaagcaggaccactctcaagaagacacgcggttcgcccgaaccgagcccagaagccgcttag

SEQ ID NO: 57435 - DNA, 531 bp, Artificial Sequence
  Description of Artificial Sequence: Synthetic coding sequence
atggccaggctgccaaagctagcagtcttcgacctggactatactctatggcctttttgggtagatactcacgttgacccaccattccacaaatcctccgatggcactgtgcgcgatagaaggggccaggatgtcagattatatccagaagtgccagaggttctgaaacgacttcagtcattaggcgtgcctggggcagccgcttctaggacttctgagatcgaaggagccaatcagctgctagagctgtttgacctcttccgctacttcgttcacagggagatatacccaggctctaaaatcacacatttcgaaaggctgcagcagaagaccggcattcccttctcacagatgatctttttcgatgacgagaggcgaaatattgtcgatgtgtcgaagctaggcgttacatgtattcacatacagaacgggatgaacctgcagacattgtctcagggcctggagacatttgctaaggcgcagaccggtcctcttcgtagctcattagaggagtcaccttttgaggcatag

SEQ ID NO: 57436 - DNA, 369 bp, Artificial Sequence
  Description of Artificial Sequence: Synthetic coding sequence
atggcgcgactgccgaaacttgccgttttcgatctggactacactctctggccattttgggtggacacccacgtggaccccccttttcacaaatcctcagatggtaccgtccgcgatcgaagggggcaggatgtgagactgtaccctgaagtaccagaggtgctgaagcgcctgcagtccctcggggttccgggtgctgctgccagcagaactagtgaaattgaaggagctaatcagctgctcgagcttttcgacctgtttcggtgctatctgcactcgcaccccgagtggaatgagtcttctaattctaaatctcgggtgagggacatctgtgagggccctaattgggcttttgaagtgcagccttag

SEQ ID NO: 57437 - DNA, 1515 bp, Artificial Sequence
  Description of Artificial Sequence: Synthetic coding sequence
atggctgcccctccagctccagcagccaaaggatccccacagccagaaccacacgcccctgaacccggacctggcagtgctaaaaggggtagagaagatagtcgggctggtcggttgtctttttgtaccaaggtgtgttatggaataggaggtgttcctaatcaaatcgcaagctccgcaaccgctttttatctccagctgttcttgttggacattgcacaaattccagctgcccaggtgtcgttggtgctgttcgggggaaaagttagtggcgcagctgcagacccagtggctgggttttttattaatcgcagtcaacggacggggagcggaaggttgatgccctgggttttaggctgtaccccctttatcgcattggcttatttttttctgtggttcctgccaccattcacgtccctcagaggtctgtggtacacaaccttttactgcctctttcaggcgctggcgactttctttcaagtaccctatactgctttgaccatgctgctgactccttgtccacgcgagagagactcagcgaccgcctataggatgaccgtcgaaatggcagggacccttatgggcgcaacagttcacggcctcattgtttctggcgctcatcgcccacaccggtgtgaggcaactgccacccccggtcctgtgaccgtttctccaaatgcagcccatctctattgcattgcagcggctgtggtcgtggttacctatcctgtctgcatctccctgctgtgcctgggcgttaaagaacggcctgaccccagtgcaccagcctcgggacctggcctgagcttcctggctggcctgagcctcacaacacgccatccaccgtatttaaaactggtgatctcctttttgttcattagtgccgcagtccaggtggagcagtcttatctggtcctgttctgtactcacgctagccagcttcatgaccacgttcagggcctggtgttaactgtccttgtgagtgccgtgctgtcgaccccattatgggaatgggtgttacagcgctttggcaaaaaaacatccgcttttggcatttttgctatggtcccatttgcgatcctgctggcagcggtgcccacagccccagtggcctacgtggtggctttcgtctcaggtgtaagcattgccgtgagccttctgcttccctggtccatgctcccagatgtagtggatgattttcagctgcagcatcgccacggacctgggctggaaacaatcttctactcttcctacgtcttttttaccaagctgtccggtgcctgcgcactgggaatctctactttgtcattggagttttccggatataaggcgggtgtctgtaagcaggcagaggaggtggtcgtcaccctgaaagtgcttatcggcgcagtacccacttgcatgatcctcgctggtttatgtatcctgatggtgggctccaccccaaagactccaagccgggacgcatcatcccggctgagtctcaggcgacgcacatcttactctctggcatag

SEQ ID NO: 57438 - DNA, 1494 bp, Artificial Sequence
  Description of Artificial Sequence: Synthetic coding sequence
atggcggctccgcctgcaccagcagctaaaggctctcctcaaccagaacctcacgctcctgaaccgggtcccggatcagcaaagagaggcagggaagactcacgagccggacggctgagtttttgtactaaagtgtgctatgggatcggtggcgtgccgaaccagattgcatcttcggcaactgctttctacctccaactcttcctgctggacatcgctcagatcccagccgcacaggtgagcttggtgctcttcgggggaaaagtctccggagcagccgcagatccagtagccggattctttatcaaccggtcacagcgcacagggagcggaagattgatgccctgggttctgggatgcacaccctttatcgctctggcatacttcttcctctggtttctgccaccatttacgtctctgagaggcctatggtacacaaccttctattgcctgtttcaggcactggctactttctttcaggtgccctatacggccctgaccatgctcttgacaccctgtccacgcgaacgcgactcagcgactgcctatcggatgacggtggagatggcagggacactgatgggtgcaactgtccacggcctgattgtaagcggtgcacacagacctcataggtgcgaagctacggctactcccggaccagtgaccgtgtcgcccaacgctgcccacttatattgtatagcggcagctgtggtcgtggtgacttacccagtatgcatctctcttctctgcctcggagttaaggagaggccagatcccagtgcacccgcatccggccctgggttgagcttcctggccggactgagcctcacgacacggcaccctccctatctgaagttagtgatctctttcttgtttatttctgccgcagtccaggtggaacagagttatttagtcttgttctgtacccatgcctcccagctgcacgatcatgttcagggacttgtgttgaccgtgttagtcagtgctgtgctgtccaccccactttgggaatgggtgctgcagcgctttggaaaaaaaactagtgcttttgggatcttcgcaatggtccctttcgccatcctgctcgcggctgtcccaaccgcacctgttgcctacgtcgtggccttcgtctcgggtgtgtcaattgcggtgagtttattgctaccctggagtatgttgcctgacgtggttgacgactttcaactccagcacaggcacggtcccggattggagaccatcttctacagcagctacgttttctttacaaagttatccggtgcttgcgcgttgggaattagtacgctcagccttgagtttagcggctacaaggctggtgtctgcaagcaggccgaggaagtggtagtgactctgaaggttctgattggggctgtcccgacatgtatgattcttgctgggctctgtatactgatggttggcagtactccgaagactcctagcagagatgccagttcccggttgagccttcgcagatag

SEQ ID NO: 57439 - DNA, 1449 bp, Artificial Sequence
  Description of Artificial Sequence: Synthetic coding sequence
atggccgaggccgctactcctggcacaactgcaaccacctccggtgctggggcagctgccgcaacggctgcagcagcctcccctacacccatccctacagtcaccgcaccatctctgggggctggtggaggtggcggaggtagcgatggaagcgggggaggttggacaaagcaggtcacctgtcgatactttatgcacggggtgtgcaaagaaggagataattgcaggtactcacatgacttatcagattccccatacagcgttgtgtgtaagtacttccaaaggggatattgcatctatggggatcgctgcaggtacgaacattctaaacccttaaagcaggaagaggctacagccaccgaactgactaccaagagcagtctcgctgcaagcagtagcctcagcagcatagtcgggccactcgtcgagatgaataccggggaggccgaaagtcggaattccaattttgcaacggtgggcgcaggttcagaggattgggtcaatgcaatagagttcgtacccggtcagccctattgcgggagaacggctccttcctgtacagaagctcccttgcagggaagtgtaaccaaggaagaaagtgaaaaggagcagaccgccgtggaaacaaagaaacagctttgcccgtatgctgctgtgggagagtgcagatatggcgaaaattgtgtgtatctccacggagactcatgtgatatgtgcggcctccaggtactacatcctatggatgcagctcagcgatctcagcacataaagtcctgtatagaggcacatgaaaaagacatggagttgagtttcgcggtccagcgatccaaggacatggtatgcggaatatgcatggaggttgtctacgagaaggctaatccatcagagagacgttttggcatcctctcaaactgcaaccatacttattgcctcaaatgcatccggaaatggaggagcgcaaagcagttcgaaagtaagatcatcaaatcctgtccggagtgtaggattacctctaacttcgtgattccatcagagtactgggtggaagagaaggaggagaagcagaaactgattctcaaatacaaagaggccatgtctaataaagcatgtcggtattttgacgaagggcgaggatcttgccccttcggcggtaattgcttttacaaacacgcctaccccgatggcagacgcgaggaaccccagagacagaaagtggggacctccagtaggtatagggcgcagagaaggaaccacttttgggaactcatcgaagagcgtgaaaacagcaacccatttgacaatgacgaagaagaggttgtgacctttgaactgggcgagatgctgctgatgcttctggcagctggtggcgacgacgaattgaccgacagcgaagatgaatgggatctatttcatgatgaactggaagatttttatgatctagatctatag

SEQ ID NO: 57440 - DNA, 651 bp, Artificial Sequence
  Description of Artificial Sequence: Synthetic coding sequence
atggagctgagctttgccgtccagcgctctaaagacatggtttgtggcatttgcatggaggtggtgtacgagaaggcaaatcctagcgagagaaggttcggcatcctgtccaattgtaatcacacatactgcctaaaatgcatcaggaagtggcgatccgccaagcaattcgagtccaagatcattaagagttgcccagagtgcaggataacaagcaatttcgtgattccttcggaatattgggtcgaggagaaggaggaaaagcagaagctcattctcaaatacaaagaggcaatgtccaacaaggcctgtcgatactttgacgagggaagggggtcatgtccctttgggggtaactgtttctacaagcacgcataccctgacggcagaagggaagagccacagagacaaaaagtggggacaagttctcgataccgggcacagcgcagaaaccatttttgggaactcatcgaggaaagagagaactcaaatccatttgataacgatgaggaagaagtggtcacttttgaattgggcgaaatgctgcttatgttactcgccgctggtggggatgacgagctaacagactcggaagacgagtgggaccttttccacgatgaactcgaagacttttatgatcttgacctctag

SEQ ID NO: 57441 - DNA, 1257 bp, Artificial Sequence
  Description of Artificial Sequence: Synthetic coding sequence
atgcacggcgtgtgcaaggagggtgataattgtcggtacagtcacgacctttcagattcaccgtactctgtcgtgtgcaaatacttccagcgaggctattgcatatacggtgatcggtgcagatacgagcacagcaaacctttgaaacaggaggaggccaccgctaccgagcttacgactaagagtagcttggctgcatcttctagtctctcatccatcgtggggccattggtggaaatgaatacaggagaagcagagtcgcgcaatagcaacttcgccacggtgggagcgggaagcgaagactgggtgaatgctattgaattcgtgcccggtcagccctactgtgggcgaaccgcacctagttgcaccgaggctccgctgcaggggagtgtgaccaaggaagagtccgagaaggagcagaccgcagtggagactaagaaacaattatgcccatacgccgctgtgggagaatgtcggtatggcgaaaactgcgtgtaccttcatggggactcctgtgacatgtgcggtctgcaggtactgcaccccatggatgccgcacagagatcgcagcatatcaaaagttgtattgaggcacacgaaaaggatatggaattatcctttgcggtacagcggagtaaggacatggtgtgcggcatctgtatggaggtagtctatgaaaaagccaacccctcggagcggaggtttggcattctctcaaactgtaatcatacgtattgtctcaagtgcatccggaagtggcgaagtgctaagcagttcgagagcaaaattataaaaagttgcccggaatgtcgtatcaccagcaatttcgtaattccctccgaatactgggtagaagaaaaggaggaaaagcagaagctgatcttaaagtataaagaagccatgtcaaataaagcatgtcgttacttcgatgaagggaggggttcatgtccattcggcggaaactgtttctacaagcacgcatatcccgatggacgcagagaagagcctcaacggcagaaagtggggacaagtagccggtaccgggcacagcgtcggaaccacttctgggaactcatagaggaaagggagaacagtaatccttttgacaatgacgaggaggaggtcgtaacattcgagcttggggaaatgctgctcatgcttctggcggcaggaggggatgacgaactgactgattcggaagacgaatgggatctcttccacgatgaattggaggatttttacgacctggatctgtag

SEQ ID NO: 57442 - DNA, 990 bp, Artificial Sequence
  Description of Artificial Sequence: Synthetic coding sequence
atggctgaagctgcgactccaggcactactgcaacaacgagtggcgctggggctgccgcagcaaccgctgcagcagcgagcccgaccccaattcccactgttacagccccaagtctgggtgctggcggtggcggaggaggctcagacggctctgggggaggctggaccaaacaggttacttgccgttactttatgcatggggtgtgtaaggagggagacaattgccgatactctcatgatttatctgactccccttattccgttgtctgcaaatatttccaacgcggatactgtatatacggcgacaggtgccgctacgagcatagcaaacccctgaaacaggaggaggctaccgcaactgaactgacaaccaaaagtagcctggctgcctcttcttccctgagttcgattgtgggcccattggtggaaatgaacaccggggaggccgagtctcggaattcaaatttcgccactgtcggtgccggttccgaagattgggtgaacgccatagagttcgtgccagggcagccctattgtggaagaacggctcccagttgtaccgaggcacctttacaggggagcgtcactaaggaagaatccgaaaaggagcagacagcagtggaaactaagaaacagctgtgcccctacgcagcagtgggagaatgcagatacggtgaaaattgtgtatatctgcacggtgattcctgtgacatgtgcggcttacaggtgcttcatcctatggacgccgcacaaagatcacagcacatcaagagttgcattgaggcacacgaaaaggacatggaactgtcattcgctgttcaaagatcaaaagacatggtgtgtgggatctgtatggaagttgtgtatgagaaggcgaacccctctgaacgccgattcggaatcctgagcaactgcaaccacacctactgcttgaaatgcatcagaaagtggaggagcgctaagcagtttgagagtaaaatcataaaatag

SEQ ID NO: 57443 - DNA, 1557 bp, Artificial Sequence
  Description of Artificial Sequence: Synthetic coding sequence
atggctaaattcgttattgccggacgtgccgattgcccttattacgcgaaaacggagttggtggccgactatctccaaaagaacttaccggattttaggattcacaagattacccaaagaccagaggtctgggaagactggttgaaggacgtttgcgaaaagaacaagtggagccacaagaacagcccaatcatctggcgggaattgctggaccgcggaggcaaaggcctcttacttggaggctataacgaatttctggagcatgcacagctgtactatgacgtcacgtcttcgatgacaacggagctgatgatggtgatagctcaggagaaccttggagcccacatagagaaagagcaggaagaggaggctttgaagacatgcatcaatcccctgcaggtgtggatcaccagcgccagcgcacctgcttgttataacctgattcccattctgacctccggagaggtcttcggcatgcacacggagatctccatcacactgtttgacaacaaacaggcagaagagcacctgaaatccttggtggtggaaacacaagacctcgccagcccagttcttcgctccgtgtcgatctgcacgaaagtggaagaagctttccgtcaagcacacgttattgtggtacttgatgactctaccaataaggaagtgttcactcttgaagactgcctacggagccgcgtgccgctgtgtaggctgtacggctatctgattgagaaaaacgcccacgagtcagtgagagtgatcgtgggcggtcgtacttttgtgaacctgaaaaccgtgctgttgatgcgctacgctccccgtattgctcataatattatcgccgtcgctctgggtgtagagggcgaagccaaggctatcctggccagaaagctcaaaaccgcgccttcttatatcaaggacgtgattatctgggggaacatctcaggcaacaactacgtagacctccggaaaactagggtgtacaggtatgaatccgccatttgggggccactccactacagcaggcctgtcctcaatctgatttttgattctgaatgggtcaaacgcgagtttgtagcaatcctcaagaatctcactaccacagggcgtcaattcggcggtattctcgctgctcactcgattgccaccactttgaaatattggtaccatggttctccacccggtgagatagtgagtttagggattctcagcgaaggtcagtttggcatacccaaaggaattgtgttctctatgccggtcaagttcgaaaacggtacttgggtggtgcttacggatttgaaggatgtggaaatctccgaacaaatcatgactcggatgactagtgacctcatccaagaaaagctcgtggccctcggggacaagatacacttccagccctatcaatctggacacaaggatcttgtccccgacgaagagaaaaatctagccatgtctgacgcggcagagttccccaaccagatccctcagactacgttcgagaaaccccaatctcttgagtttctaaatgagtttgaaggcaagacagtggagagctag

SEQ ID NO: 57444 - DNA, 852 bp, Artificial Sequence
  Description of Artificial Sequence: Synthetic coding sequence
atggccaaatttgtgatcgcaggtcgagcagactgtccatattacgccaagactgaactcgtggccgactacctgcagaaaaacctgccagatttccgcatccacaaaatcacgcagcgcccagaagtgtgggaggattggctgaaagatgtgtgcgagaagaacaagtggtctcacaagaattccccaattatctggagggagctactggatcgaggcggaaaagggctgttactgggcggttataacgagtttctggagcacgcccagctgtactacgacgtcaccagtagcatgaccactgagctgatgatggtaattgcccaggagaacctgggagcccacatagaaaaagaacaggaagaggaagccctgaaaacctgtatcaaccccctgcaggtctggataactagtgaatgggtcaagagggaatttgtggcgattctgaaaaacctgacgaccacaggcaggcagttcggaggtattcttgctgcccactccatcgcgacaactctgaagtattggtaccacggcagtccgcctggcgagatcgtcagccttgggattttgtcagagggacagttcggtatcccaaaaggcatcgtgtttagcatgcctgtgaagtttgaaaacggtacttgggtggtcctcaccgacctgaaggatgttgagattagcgagcagatcatgacaaggatgactagtgacctgatccaggagaagctagtcgccctgggcgataaaatacactttcaaccctaccagtctgatacccccagaattaataccttacaccccagcatccagtccagctggcattcggtgcttactataactattagaaaacgctag

SEQ ID NO: 57445 - DNA, 1554 bp, Artificial Sequence
  Description of Artificial Sequence: Synthetic coding sequence
atggcaaagttcgtcatcgctgggcgagccgactgcccttattacgcgaagacagaacttgtcgcagactacctgcagaagaacttgcctgactttagaatacataagatcacccagagacctgaagtttgggaagattggttgaaggacgtgtgtgagaagaacaagtggtctcataaaaactcacccattatctggcgtgagttgttggatagagggggaaaggggctgttactagggggttacaacgagtttttagagcatgcccaactgtactacgatgtcacttcatccatgaccactgaactgatgatggtgatcgcccaggagaaccttggtgcacacattgaaaaagaacaagaagaagaagccctgaagacgtgtatcaaccctctccaggtctggatcactagcgctagcgcccctgcatgttacaaccttatacccatcctcacgtctggggaagtttttggaatgcatactgagatttcgatcaccttattcgacaacaagcaggccgaagagcacctgaaaagcttggtggtggagacccaagacctggcttctccagttttgagaagtgtcagtatttgtacaaaagtggaggaggcttttcgccaggcccatgtcattgtggttctggacgacagtacaaacaaagaagtctttactcttgaggattgcctgaggagtcgggtccctttgtgtcgcctttacggctatttaatagagaaaaatgctcatgaaagtgtacgagtgattgtaggagggcgtaccttcgtcaatcttaagaccgtattgctcatgcgttacgcaccccgaatcgcacataacattatcgcagtggctctaggggttgagggggaagctaaggcaatattggctcggaagctgaagaccgccccatcctacattaaagacgtgatcatttggggcaacatatctggtaataactatgtggatttgcggaaaacacgggtgtatagatacgagagcgccatatggggccctctgcattatagcaggccagtgctgaatctgatcttcgactccgagtgggtaaagcgtgagtttgtagctatcctgaaaaacctcaccaccacagggcgacagttcggtgggattctcgctgcacattccatcgcaacaaccctgaagtactggtatcatggtagccccccaggagagatcgtaagtctggggatactgtctgaaggtcagttcggaattcctaaggggatcgtgtttagtatgccggtcaaatttgagaatggtacttgggtggtcctgactgatcttaaggacgtcgagatcagcgagcaaataatgactaggatgacctcagacctgattcaggaaaagttagtggcattgggggacaaaattcacttccaaccttaccaatcaggccacaaagacctcgtacctgatgaggaaaaaaatctagctatgagcgacgccgaattccccaatcagatcccacagacaacttttgaaaagcctcaatctctggagttcctgaatgaattcgaaggcaaaacagtagaatcatag

SEQ ID NO: 57446 - DNA, 705 bp, Artificial Sequence
  Description of Artificial Sequence: Synthetic coding sequence
atggagcggggagggggaggaagtgggaccgggagtaggcccgagggcactgccaggggaacatctcttccagggaagattgctgaaccaggagctgtcaggacctcccagcctaactacagaccacaagggatggagggtttcctcaagagtgacgagcgccagcgtctggcaaaagaaagacgggaggaaagagaaaaatgtttggcagcacgggaacagcagatcctagaaaagcagaaaagagctagactgcagtatgagaaacagatggaggaacggtggcgaaagctggaggagcagcgccaaagggaggaccagaaaagagcagctgttgaagagaagaggaagcagaagctgagggaagaggaggagaggctggaagcgatgatgcgtcgtagcctagagcgcactcagcagctggagctgaagaagaagtatagttggggtgcacctctggccataggccctggaggtcacgatggcgagtcagagaatacacctcccccacccttaggcctggccgctagtactctgccgccagacgcaggcacgactgcagctgcggcagaatcaaccaacgcctgcgacaaattaagcacatccaccatgtccctccccaaaccaacagagcccccaatgaacaagcggctatcatcctccaccgtggcaatctcatactcccctgaccgcgacgaaaagtag

SEQ ID NO: 57447 - DNA, 2322 bp, Artificial Sequence
  Description of Artificial Sequence: Synthetic coding sequence
atggagagaggaggcggagggtcaggcactgggtcccggccagagggaactgcaagaggcacttccttgcctggtaagatagctgagcccggagccgtgagaacgtctcagccgaactataggcctcaagggatggagggattcctaaagagcgacgagcgacaacggctggcaaaggagcgacgagaggagagagagaagtgtctggccgcacgagaacagcagatcttagagaagcagaagcgcgctcggcttcagtacgagaagcagatggaagagcgatggaggaagctggaggagcagcgccagagagaagaccagaaacgagccgcagtggaggagaagcgcaagcagaagctcagggaagaagaagaacgtttggaggctatgatgaggcgaagcctcgaaaggacgcagcagctggaactcaaaaaaaaatattcatggggagcgcctcttgctattggccctggcggtcatgatgcctgcgacaaacttagcacgtcaacgatgagtctgcctaagccaaccgaaccgcctatgaataaaaggctctcctcttcaacagttgcgatctcatacagtccagatagagcccatcacatgcacctgagcccgatggaggctatccttgtgagtcgcctgttaacaccaacacaatcgagtctggcccgatcaagggcaagcgtgatgctctcggggcaggcaaatgactcagtgttccacgtgtgccctagactggcaccactgggccctcttaaccccagctacaagtcttctccaacaaggaatatcgagaagaaaaaagctacaagcacatcaactagcggggctggtgatgtgggtaaggaagccctaagcggaggtgaagcatcccttgtcgaaaaagttaagaggggtcaaaggactgcaacatctctacctgtcgttaacttcgggtctcccctccgcaggtgcgaattctccggcggaatcccaaaacggcctagcagcccagtgatttcaaagaccgcaactaaagcctatcctcagagtcccaaaaccactaagccaccttatcctgggtccccggttaaatatcggctgccggcattatctggccaggatatgcctaagcgcaaagcggaaaaagagaagtcaaacaaagagagagagggaacactcgctcagcaggcagctggccctcaaggagaagaagctcttgagaaacacgtggtcgataagcatgcatccgaaaagcacgcagccgctgccggtggcaaggcggaaaatagcgccgcattgggcaaacccactgccggaactaccgacgccggtgaagccgctaagatcctggccgaaaaacggcgtcaagcacgcctgcaaaaggaacaagaggagcaggagcggctcgaaaaggaagagcaagaccgtctggaacgcgaggaactcaaaaggaaggctgaggaagagcgcttaaggctggaggaggaagcacggaaacaggaagaggaaaggaaaagacaggaagaagagaaaaagaagcaagaaggagaggagaaaagaaaagcgggagaagaagcgaagagaaaagccgaagaggagctcctgcttaaagagaaacaggaacaggaaaagcaggagaaagccatgatagaaaagcagaaggaggctgctgagactaaagcccgtgaagtcgctgaacagatgaggcttgaaagggagcagatcatgctgcagatcgagcaggagaggctggagcgtaagaagaggatcgatgagataatgaagcgaacacgtaaaagtgatgtatcacctcaggtcaaaaaggaggacccgaaggtgggagtccaaccagcggtgtgtgttgagaaaaagactaagctggtcgttcctaataagatggagatcaatggcctgaatacttgccaggaggtgaatggagtcgatcacgccgctcctgaaacatatccacaagatatcttctcaaatggactaaagcccgcaggcggactgatacacttggatgcactggacggtaagtcaaattcattggacgactccacggaagaagtccagagcatggacgtgtcaccagtcagcaaggaagaactcatctccatcccagagttcagccccgtgtccgaaatgatccccggtgtgtcgcttgaccagaacggcactggcaatgcgagggcactgcaagacctgctggattttaccggcccaccaaccttccctaagaggtcatctgagaatcttagtcttgacgactgcaacaagaacctgattgaggggttcaattctcctgggcaagaaacccctctgaatacattttgctag

SEQ ID NO: 57448 - DNA, 2199 bp, Artificial Sequence
  Description of Artificial Sequence: Synthetic coding sequence
atggaaaggggcggtgggggatctggtactggtagtcgtccagagggcaccgcaagaggaacttctcttcctggaaaaatcgcagagccaggggctgtgcggacgtcgcagcccaattacaggcctcaaggcatggaagggtttctgaagtcggatgaaagacaaaggctggccaaagagcgtcgagaggagcgagaaaagtgtttagctgcccgtgagcagcagatcctggaaaaacaaaagagggcacgactgcagtacgaaaagcagatggaggaacgctggcggaaactcgaagaacaacggcaaagggaggatcagaaacgcgcagcggtagaagaaaagagaaagcagaagttaagagaagaagaagaacgcttagaagctatgatgcggcgatcactcgagagaactcagcagctcgagctgaaaaaaaaatatagctggggcgctcctttggctatcggccctggagggcatgatgcctgcgacaagttgtcaacatctacaatgtctctcccaaaacctactgaacctcccatgaataaacggctctcctcgtcaacagttgctatctcatattctcctgacagggtgttccatgtctgtcctaggctggcgcctttaggccctttgaacccttcatacaaatctagtcctacgcgtaatatcgagaagaagaaagccacctcaacaagcacctcaggagctggcgatgttggcaaagaggcccttagtggtggcgaagcgtctcttgtcgaaaaagttaagcgcggtcagcgaaccgctacctctctgcccgtagtgaattttggctcacctctgcggagatgcgagttttctggcggaattcctaagagaccatcctcacctgtcatctcgaaaaccgctacaaaggcctatccacagagcccaaaaacaaccaagcctccctatcccggatctccagtgaaatatcggttgccagccctttctggtcaagacatgcctaaacggaaagcggaaaaagagaaaagcaataaggaacgcgaggggactctcgcccagcaggctgccggaccccagggcgaggaagccctagaaaagcacgtcgtggacaagcacgcttccgaaaaacatgctgccgctgcaggaggtaaagcagagaactccgctgctcttggaaaaccaaccgccggtactactgacgcaggagaagcggcaaaaattttagccgagaagcggaggcaggcaaggttgcagaaggaacaggaggagcaggaacgccttgagaaggaggaacaggatcgtctcgagcgtgaagaactgaagagaaaagccgaagaggagcgattgagactggaagaggaggctaggaagcaggaagaagagagaaagcgtcaggaggaggagaaaaagaagcaggagggcgaagagaaacgaaaggctggagaggaggctaagagaaaagccgaggaagagctgcttctgaaggagaaacaggagcaagaaaagcaggaaaaggccatgattgaaaaacaaaaggaagccgcagagactaaagctcgcgaggtcgctgagcagatgcgccttgaaagagagcagataatgctgcagatcgagcaagagcggctggagcgcaagaaacgcatagacgagatcatgaagcgtaccaggaagagcgatgtgtcaccccaagtgaaaaaggaagaccctaaggtaggggtgcagcctgctgtgtgcgtggagaaaaagactaagcttgtggtccccaacaagatggagatcaacggactgaatacttgtcaggaagttaatggcgtggatcacgctgccccagagacctatcctcaggatattttctcaaatggccttaagcccgcagggggactaatccacctcgacgctctcgacggcaagtctaatagccttgacgattccacagaagaggtgcaatccatggatgtatcacctgtctcaaaggaagagctgatttccattcctgaatttagccccgtgagcgaaatgatcccgggtgtgagcctggatcagaacggcaccggtaatgcacgagccctacaggacttactggatttcacaggaccacctaccttcccaaagagatcgtctgaaaacctgtcacttgacgattgcaataagaatctgatcgaaggcttcaattctcccggacaggagacccctctgaatactttttgttag

SEQ ID NO: 57449 - DNA, 2064 bp, Artificial Sequence
  Description of Artificial Sequence: Synthetic coding sequence
atggagcgcggaggtggaggctctggcaccgggtcaagaccggagggcaccgcccgtggaacctctcttcccggaaagattgcggagcctggagccgtgagaacatcacagcccaactaccgcccacaggggatggagggattcctcaaatccgacgagagacaacggctggccaaggagcgaagggaggaaagagaaaagtgcctggctgccagagaacaacagattctggagaagcaaaagagagcacgcctgcaatatgaaaagcaaatggaggaacgatggcgtaagcttgaggaacaaaggcagcgggaggatcagaagcgtgctgcggtagaggaaaagagaaagcagaaactgcgggaggaagaagagagactggaagccatgatgagaagatccctggagcgcactcagcagctcgagctaaagaagaagtatagctggggcgcaccgctggcaattggcccaggaggccacgacgctccattgggcccactgaacccatcctataaatcgagccccactcggaacattgagaaaaagaaggcaacctcaacatctacgagcggcgctggcgatgtggggaaagaggcccttagcggtggtgaggccagcctggtagaaaaggttaaacgcggacaacgcaccgctacatctcttcccgtcgtgaattttggatccccactgcggcgatgcgagttctcagggggtatccccaagcggcctagcagtcccgtgattagtaagaccgccacaaaagcttacccgcagtctccgaagacaacaaagcctccataccctggcagcccagttaaatatagactgccagcattgagtggccaggatatgccaaaacgcaaggccgaaaaagagaaatcaaataaagaacgcgaagggactttagctcagcaggccgctggaccccaaggagaggaggctttggagaaacatgtggtggacaagcatgcctcggaaaaacatgcagccgcagccggaggcaaggctgagaactccgccgcacttggcaaacccaccgccggaaccactgatgccggagaggctgccaaaattttagccgagaagagaaggcaggcccgactccagaaggaacaggaagaacaagagcgattagaaaaggaggagcaggataggctcgaaagggaagagctcaagcggaaggccgaggaggagcggctgcgtcttgaagaagaagcgaggaaacaagaagaagaaagaaaaagacaggaagaagagaagaaaaaacaggaaggtgaggaaaagaggaaagccggagaagaggctaagaggaaagccgaagaggagctcctgctgaaggagaagcaggaacaggagaagcaagagaaagctatgatagaaaagcaaaaagaagccgcagaaactaaggctagagaagttgctgagcagatgcgactagaaagagaacagattatgctgcaaattgaacaggagcggctggaacgcaagaagaggattgatgagattatgaaacggacacgaaagagcgacgtgagtccccaggtgaagaaagaggaccctaaggtgggagtgcagcccgcagtgtgtgtggagaagaaaacaaagctggtcgtcccaaacaaaatggaaattaacgggttgaatacttgccaagaggtgaacggagtcgaccatgccgctcccgaaacctatcctcaggacatattcagtaatggcctgaaaccagcaggagggctaatacatctcgatgccttggacggtaaaagtaattcgcttgacgatagcacggaagaagtccagtcaatggatgtgtcccccgtgtccaaggaggagttaatcagcattcccgagttctcacctgtttcagagatgatccccggagtgtcgctcgaccaaaacggaactggcaatgcgcgagctctgcaggacctgctggatttcacgggccctcctacctttcccaagagatccagcgagaacctcagtctggacgattgtaataaaaacctgatagagggcttcaactctccaggccaggagactccgttgaatacattttgctag

SEQ ID NO: 57450 - DNA, 2043 bp, Artificial Sequence
  Description of Artificial Sequence: Synthetic coding sequence
atggagggattcctgaaatctgacgagcggcaacggttagctaaggagcgcagagaagagcgggaaaagtgcctcgccgctcgcgagcaacaaatactagaaaaacaaaagagggcaaggctacagtacgaaaaacagatggaggagcggtggaggaaactagaggagcagagacagagagaggaccagaaaagagccgctgtcgaggaaaagcggaaacaaaaactcagggaagaggaagaaaggcttgaggccatgatgcgcaggagtttagaacggacacagcagttagagctcaaaaaaaagtactcatggggcgcacctctggcaataggcccaggaggccacgatgcctgtgacaaactttcaacatccactatgtccctgcccaagcctactgagcctccaatgaataaacgcctgtcttccagtactgtggcaataagttactcaccggatagagctccattagggccactgaacccctcatacaaatctagtcccacacgaaacattgaaaaaaaaaaggcaacctctacctctacatctggagccggtgacgtgggcaaggaggccctgtctggaggagaggcttccctggttgagaaagtcaaaagaggacagcgaaccgccacaagcctcccagtggtgaattttggcagcccactccgaagatgcgagtttagcggcggaattccgaagcgcccttcaagtcccgttatctcaaaaaccgccaccaaggcgtacccgcagtcgccgaagactactaaaccgccataccccggtagcccagtcaaatacagactgccggcactgagcggacaagacatgcctaagagaaaggccgaaaaggagaagtcaaacaaagaacgcgaggggacactggcacaacaggctgccggaccacagggagaagaggccctggagaaacacgtggttgataagcatgcttctgagaaacacgcagcagcagccggaggcaaggcagagaacagtgccgctctgggaaagcctacggcaggcacaaccgacgctggggaggcggcaaagattcttgccgaaaagagacgccaggctaggctccaaaaggaacaggaagagcaggaaaggctggaaaaggaagaacaagatagactggagagggaagaacttaagcggaaggcggaagaggaacggttgcgactggaggaggaagcccgtaagcaggaggaagaacgcaagcgccaggaagaagagaagaaaaaacaggagggagaagaaaagcgaaaagccggagaggaagctaagcgcaaggccgaagaagaactcttacttaaggagaagcaggagcaggaaaagcaggagaaagctatgatcgaaaagcagaaagaggctgccgagaccaaggcgagggaggtggcagaacagatgcgactggagagagagcagattatgctgcaaattgagcaggagcggctggagcgcaaaaagaggatagatgaaataatgaaacgaacgcgcaagagcgatgtcagtcctcaggtgaagaaagaggatccaaaagtaggcgtacagccagcagtttgtgtggagaaaaaaaccaagctggttgtcccaaacaagatggaaatcaatggtctaaacacctgtcaggaggttaacggcgtggatcacgcggctcccgagacctatcctcaggatatcttcagcaatggtctaaagccggcaggcggattgatccacctggacgccctggacggcaaaagcaactctctcgatgattccaccgaggaagtgcagtctatggacgtttctcctgtatcaaaggaggagctgatcagcatccccgaattcagcccggtgtcagaaatgatccccggtgtcagtctggaccagaatggtacagggaacgcaagagccctgcaggacctgctggattttaccggccctcccacttttcccaaaagatctagtgaaaatctctctctggatgactgcaataagaatcttatcgagggctttaacagccctggtcaagaaactccgctcaatacgttttgctag

SEQ ID NO: 57451 - DNA, 1854 bp, Artificial Sequence
  Description of Artificial Sequence: Synthetic coding sequence
atgatgcgccgttctctggagaggacccaacagttggaactgaagaagaaatattcatggggtgccccattggcaatcggcccaggtgggcacgacggtctggccgcatctacattgccaccagatgccggaacaaccgccgcagccgctgaatccacaaacgcttgcgataaactgtccacctcgactatgtctctgcctaaacccacagagcccccaatgaacaaaagattgtccagctctaccgtggctatatcttatagtcccgacagagcgcctctggggccacttaatccttcctacaagagttcccccactaggaacatcgagaagaaaaaagctacgagcaccagtacatctggcgcaggcgatgtgggcaaggaggccctgtcgggtggagaggcttcactggtcgagaaagtcaagcgaggacaaagaaccgctaccagccttcccgtcgtcaacttcggcagtcccctgaggcgctgtgagttctccggcggtattcctaagcggccaagcagccctgttatatccaagaccgcaacgaaggcatatcctcagtcccccaagactaccaagccaccctatccaggaagccctgtgaagtatagacttcctgccctaagtggccaggacatgcctaaaagaaaggccgagaaagagaagtccaacaaagagcgggaaggaacccttgcacagcaggccgctgggcctcaaggcgaagaggcgcttgagaaacatgtggtggacaagcatgcttctgaaaaacatgcagctgcggctggtgggaaggcagaaaacagcgcagcacttggcaagccgactgccggtacaaccgacgccggagaggcagcgaagatattagctgaaaagcggcgacaggccagattgcaaaaagagcaggaggaacaggagcgcctagagaaagaagagcaggatcggcttgaaagggaagagctcaaacgcaaggctgaggaagaaaggttacgcctcgaggaagaggctcgaaagcaggaggaggagcggaagcgtcaggaagaagagaagaagaagcaagaaggcgaagagaagcggaaggccggagaagaggctaagcgcaaggccgaagaagagctcttgctcaaagagaagcaagagcaggagaaacaggagaaggcaatgattgagaaacagaaggaggcagccgagaccaaggccagggaggttgctgagcagatgcgactcgaaagagagcagattatgctgcagatagaacaggaaaggttagaacggaagaagcggattgacgaaatcatgaaacgcacacggaagtccgacgtaagcccccaggtcaaaaaagaggaccctaaagtgggggtgcagcccgcagtgtgtgtggaaaagaagacgaagctggtcgtacccaataagatggagatcaatggtctgaatacatgccaagaagtgaatggtgtcgaccacgctgcaccagaaacctacccgcaggatattttttctaatgggctgaagccagctggaggattgatccacctggacgccctagacggaaaatctaactcattagatgattctacagaggaagtgcagagcatggatgtgtctccagtgagcaaagaggagctgatcagtatcccggagttctctcctgtgtccgagatgattcccggagtgtcacttgaccagaacgggaccggaaatgccagggccctacaggacctgttggactttaccgggccacctacctttcccaaaagaagctctgaaaacctctccttggacgactgtaacaagaaccttatagagggtttcaattctcccggtcaagagacccccctgaataccttctgctag

SEQ ID NO: 57452 - DNA, 1248 bp, Artificial Sequence
  Description of Artificial Sequence: Synthetic coding sequence
atgcgcggaagagactggccaaaaaaggacgaaaagaaggaaaaaaatgtgtggctcctgggctccaatcggtcatggagaaatcggaaggagcccggatgctccaccaagtctaagtggaggtctgacggggagaactggaaatcctcaggatcaggcagaacaaagcgagagctgttgtggaaaagaaaggggaactccgcggcattgggaaagcctaccgccggtaccaccgacgcgggagaggccgctaagattctcgccgagaaacgacggcaggccagattgcaaaaagagcaggaagaacaggaacggctggagaaggaggagcaggatagactggagcgggaggaattgaaacggaaagcagaggaggagcgactacgactagaggaggaagcacgaaagcaggaagaggagaggaaaaggcaggaggaggagaaaaaaaagcaagagggggaggaaaaacgaaaggctggagaggaagccaaacgcaaagccgaggaggagttgctgctcaaggagaaacaggagcaggagaagcaggagaaagctatgatcgaaaaacaaaaggaggcagccgagacaaaggctcgcgaagtcgccgagcagatgcgactcgagagggaacaaatcatgcttcagattgagcaggagagactggagaggaagaagcggattgacgagattatgaaaaggactagaaaatctgatgtttctcctcaagtgaagaaagaggaccccaaagtcggcgtccagcctgccgtgtgcgtggagaagaaaacaaaacttgtcgtaccaaacaaaatggaaatcaatggactaaacacctgtcaggaagtgaatggtgtggaccatgctgcccctgagacctaccctcaggacatcttcagtaatggtctgaagccagcaggagggcttatacacctcgatgctctggacgggaaatcaaattcactggacgactccacagaagaggttcaaagtatggacgttagtcccgtttcaaaagaagagctaatatccattcccgaattcagccctgtgtctgaaatgatccccggtgtctcgcttgatcagaatggtaccggcaacgccagggctctgcaggatctgttggattttactggacctcccacatttcctaagcgatcttcagagaacctcagtctggacgattgtaataaaaatttgatagaagggttcaactctccaggccaggaaacacccctgaacaccttctgttag

SEQ ID NO: 57453 - DNA, 522 bp, Artificial Sequence
  Description of Artificial Sequence: Synthetic coding sequence
atgctgccaccacctcccaggcaacccccaccgcaggctagagccgctcgtggggctgtccgcctccagcgacccttcttgcgcagcccattgggtgtgctgagactacttcagctcctggctggagccgctttttggattacaattgcaaccagtaagtaccagggccctgttcattttgctcttttcgtgagcgttcttttttggctgctcactctcggcttgtactttcttacccttctcggcaagcacgaattggtgccggtactgggctcgagatggctcatggtgaacgtggcccacgatgtgcttgccgcagcgctgtatggagctgctaccggaattatgtctgaccagatgcagcgccactcatactgtaatctaaaagactatcccctgccgtgcgcctaccatgcctttctggccgcagctgtctgcggaggagtgtgtcatgggttgtacctgttatccgccctctatggctgcggcaggcgatgtcagggaaaacaggaagtggcctag

SEQ ID NO: 57454 - DNA, 1158 bp, Artificial Sequence
  Description of Artificial Sequence: Synthetic coding sequence
atgcagacgtcttcaaaaccttcagattttttgaacctggctaaaaagaaacgcaagttcagtgaacttcttacaacagttgtgctactctgtctactgactcctagctggacttccacaggcaggatgtggagccaccttaatcggctcctcttctggagtatcttctcaagcgtcacgtgtaggaaggcagttcttgattgtgaagccatgaagaccaacgaattccccagtccttgcctcgactctaaaacgaaggttgtcatgaagggacagaatgtcagtatgttttgctcccataaaaacaagagcctacagattacttactctctgttccggaggaagacccatctcggcacacaggatggcaagggcgagcccgcaatctttaatctttccatcaccgaggcacacgagagcggtccttataagtgcaaagctcaggtgacatcctgttctaaatactcaagggacttttcgtttacaatcgtggatcctgtgactagtcctgtgctgaacatcatggtaatccagaccgagaccgacagacacatcacactccactgtctctcagtcaacgggtctctccctatcaattacacattctttgagaatcatgtggccattagccccgctatttcgaagtatgacagagagcccgctgaatttaatttgactaagaaaaaccctggagaagaggaagaataccggtgcgaggcaaagaatcgcttaccaaattatgcaacgtattcccacccagttaccatgccctctacaggcggtgattcatgcccattttgcttgaaattgctgctcccaggactcttgcttctgttggtcgtgataatcctcattctggctttttgggttctcccaaagtacaaaacccgcaaggccatgaggaataatgtgcccagggacaggggggacacagccatggaggtcggaatctatgcaaacatccttgaaaaacaagcaaaggaggagtcagttccagaggttgggtcccggccatgtgtctctaccgcccaggacgaggcaaagcacagtcaggagctgcagtatgctacacctgtgttccaggaagtggctccacgcgaacaagaggcctgtgactcatataaatctggatatgtgtattcagagctgaatttttag

SEQ ID NO: 57455 - DNA, 1413 bp, Artificial Sequence
  Description of Artificial Sequence: Synthetic coding sequence
atgaaatttctgctgatattgctgttgcaagctaccgcaagcggagctttgccccttaactcctctacgtctctcgagaagaacaatgtgctctttggcgagcggtatttagagaagttctatggcctggagatcaacaagctccccgtgacaaagatgaagtatagtggcaacctcatgaaggagaaaattcaggagatgcagcacttcctgggcctcaaggtcacaggacagttggacaccagcactctggaaatgatgcacgccccaaggtgtggagttccggatgttcaccacttcagagaaatgccaggaggaccagtgtggaggaaacactatattacatatcgcatcaataactacacccccgacatgaatagggaggatgtagactacgccatcagaaaggcttttcaggtctggtctaacgtgaccccgctaaagttctctaagattaacaccgggatggctgatatcctcgtcgtcttcgcgcgaggtgcccacggagacttccacgccttcgacggtaaaggaggaattctcgcccacgcattcggcccaggcagcggcatcgggggtgatgcgcacttcgatgaagatgaattttggactacacatagcggcggaactaatctctttcttaccgccgtacatgaaattgggcactctctaggcctgggacactctagtgacccgaaggccgtgatgttccctacgtataaatacgttgacattaatacctttcgcctgtccgccgacgatatcagagggattcagtctctgtatggggaccccaaagaaaaccagagactaccgaacccggataactccgagcccgctctctgcgatccaaacctcagcttcgacgcggtgacaacagtcggtaataagatcttcttctttaaggacagattcttctggctcaaggtgtcggagagaccgaagaccagtgtgaatttaatctcttccctctggccgacactgccttcaggcattgaggccgcttacgaaatcgaggcacggaaccaggtttttttgtttaaggatgataaatattggctgatttctaacctgaggcccgagcctaactatcccaagtctatccactctttcggttttcctaacttcgttaaaaaaattgacgccgcagtgtttaaccctcggttttacagaacttacttttttgtggacaatcaatattggcgctacgatgagaggcggcaaatgatggatcccggatacccaaaactgatcactaaaaactttcagggaatcgggccaaagatcgacgctgtattctactctaaaaacaaatactactacttcttccagggatcaaaccagttcgagtatgatttcctgttacaaagaatcacaaaaacccttaagtccaacagctggtttggatgttag

SEQ ID NO: 57456 - DNA, 324 bp, Artificial Sequence
  Description of Artificial Sequence: Synthetic coding sequence
atggctggggaggacgtaggggcacctcctgaccacctttgggtccatcaggagggaatctatcgggacgaataccaaagaacatgggtagcagtggtcgaagaggagacctcctttctgcgagcccgtgtccagcagatacaagtccccctgggggatgcagccaggccttctcatctgcttaccagccagctcccattaatgtggcagctgtatcccgaagagaggtacatggataacaactccagattgtggcaaatccagcaccacctcatggtaaggggcgttcaggaattactgctcaaacttctacccgacgactag

SEQ ID NO: 57457 - DNA, 3345 bp, Artificial Sequence
  Description of Artificial Sequence: Synthetic coding sequence
atgctttcgtgcctgaaagaagaaatgcctccccaggagctgaccaggagattggctacagtgatcacccacgtcgatgaaatcatgcagcaggaagttcgaccgctcatggctgttgagatcatcgagcagttgcatcgccagttcgcaatcttgtctggcggacgcggtgaagatggggctcccattattacgttcccagaattttccggctttaagcacatcccagacgaggattttctcaatgtcatgacctacctgacctccataccgtcagttgaggcagcttctattggctttatcgtggtgatcgacaggcgacgcgataagtggagcagtgtcaaggcctccttgactagaatcgcagtggcgtttcccggtaaccttcagctgatcttcatcctccgaccttccaggttcattcaaagaacatttacagatatcgggatcaagtattacaggaacgagtttaagaccaaagtgcccatcatcatggttaatagcgttagtgacctgcacggttacattgataagtcccagttgaccagggagcttggtggtaccctcgaatacaggcacgggcagtgggtgaaccacagaactgcgatcgagaactttgcgctcacactaaagacgacggcacagatgctccagactttcggtagctgcctggccacagccgaactccctcgcagcatgctgagtaccgaggatctgctgatgtctcacacgcggcaacgcgataagctgcaggacgagctgaagctactcgggaagcaggggacaaccctcctgtcttgtatccaggaaccagctactaaatgccctaattccaaactgaaccttaaccagctggagaatgtgactactatggagaggctcctcgtgcagctcgatgagaccgagaaagctttcagccacttctggtccgagcaccacctaaaactaaaccagtgcctgcaacttcagcatttcgagcacgacttctgcaaggctaagctcgccctcgacaacctgctggaggagcaggccgaattcaccggtattggagactcagtcatgcacgtggagcagatactgaaggaacacaagaaactcgaagaaaagtcccaggagccgctcgaaaaagcgcaactcctggctctggtgggggaccagctgatccagagccaccattacgccgcagatgctatcagacctcgatgtgtcgaactccggcatttatgcgatgacttcatcaacggcaacaagaagaagtgggatatactgggtaaaagcttggaatttcatagacagctcgacaaggtaagtcagtggtgtgaggccggaatttatctgcttgcgtcccaagcagttgacaagtgtcaaagcagagaaggtgtagacatcgctcttaatgatattgcaacgttcctgggaactgtgaaagagtacccccttctaagccccaaagaattttacaacgagttcgagctgttgctaactctagatgctaaggcaaaggcgcaaaaagtccttcagcggctggacgacgtgcaggaaatcttccacaaaagacaggtgagcctaatgaagcttgccgctaagcagacccggccagttcagcctgttgccccacaccccgagagcagcccaaagtgggtatccagcaaaacgagtcaaccaagcacaagcgttccattggcccgaccccttcggacgtccgaggagccttatactgaaactgaactaaatagccggggtaaggaggatgatgagacaaagtttgaggtcaaatctgaggagatatttgagtcccatcacgagaggggaaacccagaactggaacagcaagccagactcggcgacctgagccccaggaggagaattatcagggatctgctggagacagaggagatttatattaaagagataaagagtatcatagacggctatattaccccaatggatttcatttggctcaagcatctgatacctgatgtgctccagaataataaggattttttgttcggcaacatccgggagttatacgagttccacaatagaaccttcttgaaggaactggagaagtgtgctgagaaccccgagctccttgcccattgctttctcaagagaaaagaagacctgcagatctattttaagtaccacaaaaatcttccgcgagcccgagcgatctggcaggaatgccaagattgtgcgtacttcggggtctgccagcgacagttggaccataacctgccgctgtttaaatacctaaaaggtcctagtcagcgcctgataaagtatcagatgctgctgaaaggactgttagacttcgagtcacctgaggacatggagatcgaccccggtgaactgggtgggtccgccaaagacggcccaaaaaggacgaaggacagcgcctttagcacagaactgcagcaagccctggcagtaattgaggacctgatcaagtcatgcgaacttgccgtggatctcgctgctgtaaccgagtgccccgacgatattggaaagctggggaaactgctgttacacggacctttttccgtgtggacaatccacaaggatcgttacaaaatgaaggatctgatcaggttcaaacctagccaacgccaaatttatctgttcgaacgaggaattgtattttgtaaaatccgcatggagcccggagatcagggactaagcccccattattcatttaagaaaaccatgaagctgatgaccttgtccattaggcagcttgggagggggtctcatcgtaagtttgaaatcgccagccgcaacggacttgagaaatacatcctccaagcggctagtaaggaaatcagagactgttggttttctgaaatttctaagttgctcatggagcaacaaaacaatattaaggatcagggaaatccccagttcgagatgtcaaccagcaagggaagtggagccggatctggtccatggataaagaatatggagcgcgcaactacatcgaaggaagatcccgcaagttcgacaggagggatcaaaggttgctcttcaagagagttctcgtccatggacacctttgaggactgtgagggagctgaagatatggaaaaagagtcatcagccctaagtttggcaggcttgttccagtcagacgacagccatgaaacatgctcatctaaatctgcttttcttgagagaggagagtcttcacagggagagaaagaggaacgggatgaggaagaaaccgctacacgatcaacagaggaggaacgggcaggggcatcaaccggtcgactcgcccctgccggagccacagcgggttttcaggccagggcgctccgcccacgaaccagtgctcaggaatcgtag

SEQ ID NO: 57458 - DNA, 1887 bp, Artificial Sequence
  Description of Artificial Sequence: Synthetic coding sequence
atgcttagctgtctcaaggaagagatgccacctcaggagcttactaggcgtcttgctactgtgattacccacgtcgatgagataatgcagcaggaggtccggccactgatggcagtggaaataattgagcaactgcatcggcaatttgcaatcctgtctggcggtcggggtgaagacggcgcacccatcatcacctttccagagttctctggtttcaagcacatcccagacgaggatttcctgaacgtgatgacatatctgacttcaataccttccgtggaagccgcaagtattggatttatcgtggtgatcgaccgcagacgtgacaagtggagtagtgttaaggctagtctgaccagaatcgctgtcgcctttcccggaaatctgcaactgattttcattctccgtccttcacgctttatccagaggactttcacggatatcggcatcaagtactatagaaatgaattcaaaactaaggtgccgatcataatggtaaattccgtctccgaccttcatggctatattgacaaatctcagctgacgagggagctggggggaaccctcgaatacagacacggccagtgggtgaaccaccggaccgccatcgagaactttgctctcacgctcaaaactacggcccaaatgttgcagacctttgggtcttgtcttgccaccgccgaactcccaagatctatgctgagtacggaagacttgctgatgagtcacactagacagcgcgataagctgcaggatgagctgaaactgttaggaaagcagggtacgaccctgcttagctgcatccaagagcccgctaccaaatgccctaacagtaagttgaacttgaatcagttggagaatgtaactacaatggagcgccttttggtccagcttgatgaaactgaaaaggctttcagccacttttggagcgagcaccacctcaaactgaaccagtgcctacagctgcagcacttcgaacatgatttttgtaaggcaaaactggctctcgataatttactagaagagcaggcagagtttaccgggatcggtgactctgtaatgcacgtggagcagatactgaaggagcataagaaacttgaagagaagagccaggagcccttggagaaggcccaattactagctctcgtgggcgaccagcttatccagtctcatcactacgccgcagatgcaatccgacccaggtgtgtggagctccgccacctctgtgacgatttcattaacgggaataaaaaaaaatgggatattctaggtaaatccctggaatttcatcgccagctagacaaagtctcccagtggtgcgaggccggaatttacctcttggcctcccaggcggtggacaagtgtcagtctagagaaggggtggatatcgctctgaatgatatcgctacctttctgggaaccgtgaaagagtacccgctcctatctcccaaagagttctataacgagtttgaattgctgttgacactggatgccaaggctaaggctcagaaggtgctgcagcgcctggacgacgtgcaggaaatcttccataaacgccaggtgagcctcatgaagcttgcagctaaacagacgagacccgtccagccggtggctccccaccccgagagctctcccaaatgggtgtctagtaaaacttcccaaccttctacttccgttcctctagctcgaccactgagaacatcagaggaaccttacaccgagacagagctaaactctcgcggtaaggaagacgacgagaccaagtttgaagttaaaagtgaagagatattcgaatcccaccacgaaaggggcaatcccgaacttgagcagcaggccaggctgggggacctctctccgcgacgctatagctctcagtacttcaagtag

SEQ ID NO: 57459 - DNA, 519 bp, Artificial Sequence
  Description of Artificial Sequence: Synthetic coding sequence
atgcacgtcgaactacgtcacttatgcgacgattttattaatggcaataaaaaaaaatgggacattctcggcaagagtcttgaattccatagacagctcgataaggcgaaagcccagaaagtgctccaacgcctcgatgatgtccaggaaatcttccacaagagacaagtgtcactgatgaagctggcggcaaaacagacaagacctgttcaaccagtggcccctcaccccgaatcttcaccaaaatgggtcagcagcaaaacttcacagccttccaccagcgtgccgctggcacggccactcagaacttccgaggagccctacacggagactgaactcaactctagaggcaaagaggatgatgaaacaaagttcgaggtaaaatccgaggagatcttcgaatcccaccacgagagaggtaaccccgagttggagcaacaggcccgtctgggagacctgtcccctcggagtgtgattactgtgtgcgtttgcgaaatgctgaccctaggcgtccagtag

SEQ ID NO: 57460 - DNA, 2136 bp, Artificial Sequence
  Description of Artificial Sequence: Synthetic coding sequence
atgctgagctgcttaaaagaggagatgcctccacaagagctgacacgcaggttagcaacagtcattacccatgtcgacgaaatcatgcaacaggaagtcagacctctgatggccgtggagatcatcgaacagctgcatcgtcagttcgctatcttatctgggggaagaggcgaagacggcgctccaatcattaccttcccagagttctcagggttcaagcatattccagatgaggactttttgaatgtcatgacttatctgacgtcgattccgagcgtagaagctgcgagtataggctttatcgtcgtgattgaccgacgaagggataagtggtcctcagtcaaggctagcttgactcggatcgccgtggccttccctggaaacctgcagctcatatttatcttgcggccaagtcgcttcatccaacgcaccttcacggatattgggatcaagtattatagaaatgagtttaaaaccaaggtccctatcattatggtcaattccgtgagcgacttacacggttatatagacaagtcacagctgactcgtgaactcggtggaaccctggaatacagacatgggcagtgggttaatcatagaaccgctatcgagaacttcgctctcacgctaaagacaactgcccaaatgcttcagacattcggtagctgcttagctacagctgagcttccacggtctatgctctccacggaggacctgttgatgtcacacacacgccaacgcgataagttgcaagatgagctaaaactcctgggcaaacaggggaccacgcttctgagctgcatacaggagcccgctactaagtgtccaaatagcaaactaaatttgaatcagctcgaaaacgtgactacgatggagcgcctcttagtgcaactggatgaaacagagaaagcattcagccacttttggtcagagcaccatcttaaactcaatcagtgtttgcagctgcagcactttgaacatgatttctgtaaagctaaactcgccttggacaacctgttggaagagcaggccgagttcactggcatcggggacagtgtgatgcatgtcgagcagatcctgaaagaacacaaaaaactggaggaaaagtctcaagaacccctcgagaaggcccaactcctggccctcgtgggtgaccagctgatccagagtcaccactacgcagcggatgctattagacccagatgtgttgagttgaggcatctttgcgatgattttattaacggcaacaagaaaaagtgggatattctaggtaagagcttggagttccatcggcagttagataaggtgtctcaatggtgtgaggccggaatctacctgctcgccagccaagccgtcgacaaatgtcagagccgggaaggggtggacattgcactaaatgatattgctacgtttctggggactgtgaaagagtacccactgttgtctcccaaggaattttacaacgagtttgagctcttactgaccctggatgctaaggctaaagctcagaaagtgctgcagcgcctcgacgatgtgcaggaaattttccataaacgccaggtctctctgatgaagctggcagcgaagcagacccgccctgttcagcccgtggcccctcaccccgaatcttccccaaagtgggtcagttcgaagacttcacagcccagtacttcagtccccttggccaggcccctgagaacctccgaggagccatacacagaaacggagctgaattcccggggaaaagaggatgatgagaccaaatttgaggtgaagagtgaagagatcttcgagagccatcacgagaggggcaacccagaactggagcaacaagccagactgggcgacctttcacctcgcaggagaatcatacgggacctcctcgagactgaggagatttacattaaggagatcaaaagcattatcgatggatacattacgcccatggactttatttggctcaagcatttgatacctgatgtgctacagaacaacaaggacttcctcttcgggaacatccgcgagttgtacgagttccataaccggacattcttgaaggagctcgagaagtgcgcagagaaccccgagttgctggcacattgtttcctgaaaagggtctccctctattctcagtag

SEQ ID NO: 57461 - DNA, 3225 bp, Artificial Sequence
  Description of Artificial Sequence: Synthetic coding sequence
atgctgtcttgtctcaaagaggagatgcctccacaagagctgacccggagattagcgactgtgatcactcacgtggatgaaattatgcagcaggaggttaggccattgatggccgtggaaatcattgagcaactgcaccggcaattcgccatcctgtctggaggacgcggagaggatggggctccaatcatcacattccctgaattttcaggattcaagcatatacctgatgaggatttcctgaacgttatgacatatctgacctcaatccccagcgtggaagccgcttccatcggcttcattgttgtaatcgaccgtaggagagataagtggtcatctgtgaaagctagcctgactcgaatagccgtggccttcccaggaaacctccagcttattttcatactaaggcccagccgcttcatccaaagaactttcacagacatcggaatcaagtactatcgtaacgagttcaaaacgaaggtgcccataatcatggtgaatagcgtgagcgacctgcacgggtacattgataaaagccaattaacgagggagctgggtgggaccttagagtaccggcacggccaatgggtgaatcacagaaccgctatcgagaatttcgcactgaccctgaagacaaccgctcagatgctgcagacgtttggatcttgccttgcaaccgctgaactgccgagatccatgctctctaccgaggatctgttgatgagtcatactcggcagcgcgataagcttcaggacgagctgaaactcctgggcaagcagggtaccactttactgtcctgtattcaggagcccgcaacaaagtgcccaaatagcaagctgaatctgaatcagttagaaaacgtgaccacaatggaaaggctcttagtgcagctggacgagactgagaaggccttttcacatttctggtcagaacatcatcttaagctgaatcagtgcttgcagctgcaacacttcgagcatgatttctgcaaagccaaacttgccctggacaatctgctcgaggagcaggcagaatttacaggcatcggcgactctgtgatgcatgtggagcaaatactgaaggaacataagaaactggaggagaaaagtcaggagcctttagagaaggcccagctgctcgcactggtgggcgaccagctaatacagtcccaccactacgctgcggacgcaattaggcctcggtgtgtcgaactgagacacttatgcgacgacttcattaacggcaacaagaaaaagtgggatatcctgggcaagagcttagagttccacaggcagctggacaaggtctctcagtggtgcgaggcgggtatctacctgcttgcctcacaggcggtggataagtgccaatcccgcgaaggggttgacattgctctgaatgatattgcaaccttcttgggtacagttaaggagtatccgcttctgtcaccaaaggagttttataatgaattcgagttgctgctgacgctcgacgcaaaagcaaaggcccagaaagtacttcagcggcttgacgatgtgcaggaaatattccataaacgccaggtctctttgatgaagctagcagcaaagcagactagacccgttcagcccgtggctcctcaccctgagtcaagtccaaagtgggtgagtagtaaaacttcccagccaagtactagcgtgcccttagccaggcctctgaggacctccgaggagccttacaccgaaaccgagttgaactcacgcggtaaggaagacgatgaaaccaagttcgaggtgaagtctgaagagatattcgagtcccaccatgaaagaggtaatcctgagctggagcagcaggctcgtctcggtgacctttcaccacgacggaggataattcgagacctccttgagaccgaagagatctacattaaagagataaagagtatcattgatggttacattacaccaatggatttcatttggctaaagcatcttatacctgatgtcctacaaaacaataaagactttctctttggcaacataagagaattatatgaatttcacaacaggacttttctgaaggaactcgaaaaatgtgccgaaaacccagagctactcgctcactgcttcctgaagaggaaggaagacttacaaatttattttaaataccataagaatttgcccagagctagggccatttggcaggagtgccaggattgcgcctatttcggtgtttgccagagacaactggatcataatcttccgttatttaagtatctgaagggtccatctcagaggctgatcaaataccaaatgctcttaaagggcttacttgactttgagtctcctgaggatatggaaatcgaccccggtgaactcgggggatctgccaaggatgggccaaaacggaccaaggactccgcgtttagtacagagttgcagcaagctctagcagtcatagaggacctgataaagtcctgcgaacttgcggtggacctggccgcagtgactgagtgccccgacgatattggcaaactgggaaagctcctgcttcacggcccattctcggtgtggacaatacataaggatcggtataagatgaaggatctcatacgttttaagcccagccaacgacagatttacctcttcgaacgcggaattgttttttgcaagattagaatggaacctggcgatcaaggactttcacctcactatagcttcaaaaaaaccatgaaactaatgaccctgtctatccggcagctgggtcgtgggtcacaccgcaagttcgagatcgcctcccgcaatggcctagaaaagtacatactccaggctgcgagtaaggaaattagagattgctggttctcagagatctccaagctcctcatggagcagcagaacaacatcaaagaccagggcaacccccagttcgaaatgagcactagtaaggggtcaggtgctggctccgggccttggatcaagaacatggagagggcaaccacttcgaaagaagatcctgcctcctcaaccgggggaataaaagggtgctccagcagggagtttagttctatggatacttttgaagattgcgagggtgcagaggatatggagaaagagagttctgccctgtccctagcaggcttgtttcagagtgatgatagccatgagacttgcagctctaaaagcgccttcctcgagagaggggagagcagccagggagagaaggaagagagggacgaagaagaaacatag

SEQ ID NO: 57462 - DNA, 360 bp, Artificial Sequence
  Description of Artificial Sequence: Synthetic coding sequence
atggaggagccagaaatgcaacttaaagggaagaaggtgaccgacaaatttactgagagtgtctacgtgctggcaaatgagccgtcggtggctctataccgccttcaggagcacgtccgcagaagccttcctgagctggcacaacataaagccgacatgcagcgctgggaagagcagtcccaaggggctatttatacagtagagtacgcttgcagtgccgtcaaaaacctagtggattcgtcagtttacttccgctcagtagaaggcctgctgaaacaagctattagcatcagggaccatatgaatgcgtctgcccagggacactcaccagaagaaccccctccaccttcttccgcgtag

SEQ ID NO: 57463 - DNA, 330 bp, Artificial Sequence
  Description of Artificial Sequence: Synthetic coding sequence
atggaggagccagaaatgcaattgaaaggaaaaaaagttaccgacaaatttacagaatctgtgtacgtgctcgcaaatgaaccgtcagtagctctctatcgcctgcaggagcacgtacggagatctctccccgaactggctcagcacaaggcggatatgcagagatgggaagagcagagccagggtgccatttatactgtggagtatgcatgcagtgcagtgaagaatctggtagattctagtgtttacttcaggagtgtggaaggcttactaaagcaggcaatctcaatcagggatcacatgaacgcctctgcccagggccaccgttag

SEQ ID NO: 57464 - DNA, 717 bp, Artificial Sequence
  Description of Artificial Sequence: Synthetic coding sequence
atgctggccttaactctggctaaagccgactcccctagaacagccttgctgtgttctgcatggctgctaaccgccagcttctctgctcagcagcacaaaggaagcctccaggttcaccagaccctgtctgtggagatggaccaggtgctgaaggccctgtcgttcccaaaaaaaaaggcggctctgctctctgcagccatcctgtgttttttaagaaccgccttgcgccagagcttttcctccgcactggtggccctggttccttctggagctcagccactgcctgccacaaaggacacagtcctggctccactgcggatgagccaagtgaggtccctggtcatcggcctccagaacttgctggtccagaaggacccactgctaagccaggcatgtgtgggatgtctggaggcactcttagactacctcgacgcacgaagccctgatatcgccctccacgtcgcatcgcagccgtggaaccggtttctcttgtttacacttctggacgcgggagagaactctttcctgaggcccgagattctgaggctgatgacactcctccagtcgatgggtcacctggcagaccattcaatggcgcaaactttacaggcctctctcgaaggcctgcctccttctaccagtagcggacaacctcccctccaggacatgctctgtctagggggagtcgcagtatccctgagccatattcggaattag

SEQ ID NO: 57465 - DNA, 1824 bp, Artificial Sequence
  Description of Artificial Sequence: Synthetic coding sequence
atgtgccttaacctcctttcagcccctgaaaaaacagggcctcccagtaaggaggagttgtctgcggtctccgaactgctgcaacacgggctcccacagattagctctagatctccggagtccctggctttcctctccgatcgccagtatatggaaggcgctgccagacagcgtcagtactgcattctccttttgttttacctggcatatatacacgaagatcggttcgtctcagaagccgagctattcgaggcagtccaatcatttcttctgtctttacaggaccagggggagaggcctcctctagtcgtgttcaaggcttcgatatacctgttggcaatttgtcaagataaggataacactttgagggaaacgatggtttcagccattcgaaaatttctggaaggcatcccagacttgcagctggtctacactcatcacccactgctcttgcgctttttcttgctctatcctgaactgatgtcccggtacgggcaccgggtgctggaactttggttcttttgggaggaatcatcttacgaagagcttgatgatgtgacctcagccggacaaccagctctgcccgctagcctggttgtcctgtttcaacttcttaggagcatccccagtattctgttgattctgttagatttgatttacagttccccagtcgacaccgcccataaagtactcattagtttgagaaccttcttacgtagaaatgaggacatccaggtcggaggcctgataagagggcatttcctgttaatcttgcaacgcctgctcgtcgaacatggggctagcccttccggtgtatccaagctctgcggtaagtgctcacccacagacgtcgatattcttcagcccagtttcaatttcttatattggtctctgcaccaaacgacaccctcatcccagaagagggctgctgctgtgctgcttagtagcactggacttatggaactgcttgaaaaaatgctcgctcttacactggcgaaggctgatagtccacgcaccgcgctgttgtgctcggcatggctgctcacggccagcttcagcgctcagcagcacaagggctcattgcaggtccaccagacactgtccgtggagatggatcaagtgctcaaagcactctcatttcccaagaagaaagccgcattgctgagtgctgccattctgtgttttctcagaaccgcactgcgccaaagcttcagtagcgccttggtggccctggtcccatccggagcccagcccctgcccgcaaccaaggatacggtgttagctccgttgcggatgtctcaagttaggtcactcgtgatcgggttacaaaacctgctcgtgcaaaaggatccactacttagccaagcctgcgtaggctgcctggaggctctgttggattatcttgatgccaggtcccctgatatagctcttcacgtggcttcacagccttggaatcgctttctgctgtttaccctgttagacgccggtgaaaacagttttctgcgccctgagattcttaggctaatgacattgtttatgagatacagaagcagctccgtgctctctcacgaagaggtcggagatgttttacagggcgtcgcgctcgctgatctctctacactgagcaatacgaccttacaggctctccatgggttttttcagcagcttcaaagcatgggacacttggccgatcacagcatggctcagacacttcaggctagccttgaggggcttccacctagcacctcttctggccagccacctctacaagatatgctatgcttgggcggagtggccgtctctttatcccacattcgtaactag

SEQ ID NO: 57466 - DNA, 3825 bp, Artificial Sequence
  Description of Artificial Sequence: Synthetic coding sequence
atggcagttcgccaggctgccactgctggtacaccagggcctcggagagaagaggaagctgccctactcttcgaacgggcacactaccgccacgacccgcgttggttactgcctgtgacccccagactttgcctggcctgtgccctggagctgctgcccgaccctggggtctcgcttgttaggaaaaagcatatgctctcttgttttcaggatgcgctggtgcggcatacctctcttgtaacccaactggtgtcccaggaccagcgtgtttgtattcactttattagcgttctctttggactgctatgtagtatggaggatggaagtgtaaccgatctttgcatcgaagtcctcatccagatcaccacgcagctgaagctggagcagacaatcaggtgtctgctggacgagtgccacaaagaattgtgtaacatgcccagcatgagaggcagccttgcaactttaacactgctagggaagcttgtggatgccattcctgccctcgctgatgaactcgtgatggagcatgggaatttgatggagcacttgcttagagggctagtgtacccctctgaaggtatccaggccagtgtatgctacctttacggtaaattgtattcctctcctgtggctgcggagatgctaagcgggcacttcagagaaaaactctttcccctttttctgagcatcctggacggagcacagactaaggaattgcagatcaactgtctggggctactgcgccagctcctaaagtacgatctttttgtgtcaatgatcatgaatcaggatgggctgggtgagagcgcaaaaaacatagagggttccagcgggaacactagcctgcccctggtcctcaaaaagctgctgctttccagggatgagaccctgcaggttgcatctgcccattgcattacagcagtactggtccactcaccagcaaagcacgcatctgcgttcattcacgcagatatccccgaatttctcttcgagcatctgtctagctcctcagaagtactagtttggagcagttgtaattgtctgactttattggttgaggagccgctgtttttctcaaagtgccacaccgtgtatggcattgaagccgtcgtacgcagcctgcaaggcagtctgaagatgaacaacatcgagctgcacaagcagggccttctcttgttcgccgaaatcttaacaaggcaacctgaagagatcaagttattcacctcaagtgccatgtgcagggatgccggacgcgcactgcaggaagcagtgagttccccagttctcgaagtagccgctgaggctctgaaagccacctccgcctttcttagaaaagaccaccaatcaacgccgcctgtacaatacggagagttgcaagcacttctggaggcgatgctcaacagatgtgcagaattttcccagacccttctatctcgcaggccgctgggccacgccagtagccgggatagcgaaaaagcaattctgcagaggggtaagtttctactgagtactctggaaggattccgcagcgcctgcaggctcgcaattgagtttcaaagcgaacctagcgctcaggagaatcctttcacagcaccatccgctaaaaaagaagacactctcgaagcgttttccgagtttctgctgagcgcttgcgattccctctgcatacctatggtaatgcgacacctggaacagactacccaccctgcacttatggaggtatttttgtcaatcttgcataatctgttcgttatcgttcctcacatgaaggaaaaatttagcaaaaagcttgcctctagttctttcattcgcctgacgctggaacttaaggctcgtttctgctctgggctgtctcatagtgctctaaaccaggtgtgcagtaattttctgtactatatgtgcttgaatctgttgagcgccccagagaaaaccggcccaccttccaaagaggaattaagcgccgtaagtgagcttctacagcatggcctgccacagatatcttcaaggtcaccggagtcattggcttttctcagcgacagacagtacatggagggcgcagctcgacagcggcaatactgcatcttactgttattttatctagcttatatacatgaagaccggttcgtgtctgaagctgagctgttcgaggcagtgcaatcctttctcttgtccttgcaggaccagggtgagcgccctccactggtcgtctttaaggctagtatctatcttctcgccatatgtcaagataaggacaacaccctgcgcgagacaatggtcagcgctattcgcaagttcctcgagggaatacccgatcttcagttagtttatacccatcatcccctcctcttgcgcttcttcctgctgtatccggagctgatgtctaggtatggacacagggttctggagctgtggttcttttgggaagagtcctcatatgaggaattggacgatgtgacttcagccggacaacctgctctgcccgcttcacttgttgtcttgtttcagcttcttaggagtattccatctatcctcttaattctcctcgacctgatctacagtagccctgtggatactgctcataaggttcttataagtctgcggacttttctgaggaggaatgaggatatacaggtcggcggactgattcgaggccacttcttgttgatattacaaaggctgcttgtcgagcacggggcttcaccttctggtgccagcggcaatctgccactgctgctgagcctgctcagtctgatgcagctgaggaatgtctctgagcaggaactcgattcggtggccatgaaactgctgcaccaggttagcaagctttgcggaaaatgttcccctaccgatgttgatatcctgcagcctagctttaacttcctttattggagcctgcaccagactaccccatcatctcaaaaacgagcagccgctgtgctgttgtcctccaccggattgatggagctattggaaaaaatgctcgccttgacactcgccaaagccgatagccctagaaccgcgttgttgtgctctgcttggttgctcaccgcttcctttagcgcccagcaacataaggggagcctccaggtgcatcagactctttccgtggagatggaccaggtgctcaaggccctctcattcccgaaaaagaaagccgctctgctgagcgctgcaatcctgtgtttccttagaaccgctctaagacaatctttctcctcagccctcgttgccctggttcctagtggagcacagccattgcccgcaacaaaggatactgtgctcgccccattacggatgagccaggtgcggtcactggtgatcgggctgcagaaccttctggttcagaaggatccattacttagccaagcatgtgtcggatgcctggaagccctgttggattacctagatgcaaggagcccagacatcgccctacacgtcgcatcacagccttggaacaggttccttcttttcaccctgctagatgcaggcgaaaactcttttcttagacccgagatcctccgtctaatgacccttttcatgcggtaccgctcttcctcagtactctctcacgaggaggtgggcgacgtgttgcagggcgtcgccctagcggatctatcaactctgtccaatactacattgcaagctcttcacggctttttccagcagctgcagtcgatgggccacctcgcagaccactcgatggctcagactctgcaggcctcactggaaggcttgcccccttccacttcatccggccaaccccctcttcaggacatgttatgtctagggggtgttgccgtatccctctctcacatcaggaactag

SEQ ID NO: 57467 - DNA, 1155 bp, Artificial Sequence
  Description of Artificial Sequence: Synthetic coding sequence
atgggtcaccctcatcaggaatctagtctgtttttcaccgcctccggtaatctaccactgctcctatccctcctgtccctcatgcagctgcggaacgtcagcgagcaggagcttgactccgtggcaatgaaattgctgcatcaggtgtccaagctgtgcggaaagtgcagcccaactgacgtcgacatcctacagccatcatttaattttctgtactggagcctgcaccagaccaccccttcttctcagaaacgcgctgccgctgtgctgctaagcagcacgggcttgatggaattactcgagaagatgctggctttaactctggcaaaagccgatagccctaggacggctctactgtgctccgcttggcttctgacagcctccttttcagctcaacaacataaaggctcgcttcaggtacaccagaccctgtccgtagagatggatcaggtgctaaaagctttgtcctttccaaaaaagaaggcagcactcctctccgctgctatcctttgctttctccgcacagccttgcgacagtccttttcgtcagccctcgtggccctggtgccaagcggggcacaaccactgccagctactaaagacacagttctagcacccctgcgcatgtcccaagtgcgaagccttgtgatcggactgcagaacttgttagttcagaaggacccactcctttcccaggcatgcgtggggtgcttggaagccttgctcgattacttggatgctcgttcccccgatattgctttgcatgttgccagccagccctggaatcgcttcctgttgttcactctgctagacgcgggtgaaaattccttccttcggccagaaatcctccgactgatgactttatttatgagatataggtcaagttccgtactgagccatgaagaggtcggcgatgtgctccagggggtcgcactggccgacctgtctaccctttctaatacaacactccaggccctacacggcttcttccagcagctccagagcatggggcacctggcagatcactcaatggcgcagacgttgcaggcctctctcgagggcctgcctccctcgacatccagcggacagccccctcttcaggacatgctgtgtctcgggggtgtggccgtttctctgtcacacattcgcaactag

SEQ ID NO: 57468 - DNA, 1521 bp, Artificial Sequence
  Description of Artificial Sequence: Synthetic coding sequence
atgaatcaggatggccttggcgaaagcgccaaaaacatcgaaggatccagcggtaatacttcccttccccttgtgctcaaaaaactgctcctctcccgagacgagacactgcaggtcgctagcgcacactgcatcaccgccgtgttggtgcacagtcccgcaaaacacgcctcggcctttatccacgcggatattcccgagtttctgtttgagcatttgagcagctcgtccgaagtgttggtctggagttcgtgcaactgtctgaccctccttgtcgaagagccgctctttttctcgaagtgccacacagtatacgggattgaggcagtggtgagatctctgcaggggtccctcaagatgaataacattgaactgcacaaacaaggacttctcctgtttgctgagatcttgacccggcaacctgaagaaatcaagctgttcacatcgagtgccatgtgccgggacgctggccgtgccttacaagaggctgtgagctctccggtgcttgaagtcgcagccgaagcactaaaagccacaagcgctttcctgcggaaagaccatcagtccacccctcccgtccagtatggcgagcttcaggcactcctcgaggccatgctgaatcgctgcgccgagttttctcagacccttctgtcccgtagacccttgggacacgcctcttctagagactctgaaaaagccatacttcagcgagggaaatttctgctctcgaccttagaaggtttcaggtcagcttgcagactggctattgagttccagtcagagccatccgcacaagaaaatccattcaccgccccttcggccaaaaaggaggacaccctggaagcattcagtgaattcttgctgtccgcatgcgacagcctttgcatccccatggtgatgcggcacctggagcagaccacccatccagccttaatggaggtgttcctgtccatcctacacaatctgtttgtgatagtgcctcatatgaaggaaaagtttagcaagaaactggcctccagcagcttcattaggctgacactggagctaaaggcaaggttttgcagcggcctgtctcacagcgctcttaaccaggtgtgtagtaatttcttgtactatatgtgcctgaacctgttgagcgctccagagaagacaggtccgccatccaaagaagaactctcagctgtgtccgaactgctccagcatggtctcccccagatctcatctcggagccctgaaagcttggcctttctgagcgatcgtcagtatatggaaggcgcagctaggcagaggcagtactgcatcctgctgctcttctacctggcatatatccatgaggacagatttgtatcggaggcagagctgttcgaggcagtccagtcctttctcttatcactacaggaccagggggagcgcccacccttagtagtctttaaggcttccatatatctgctggcaatctgtcaggataaggacaacacactaagagagcagctccactgttctctgatttccataagttag

SEQ ID NO: 57469 - DNA, 810 bp, Artificial Sequence
  Description of Artificial Sequence: Synthetic coding sequence
atggagggggctgcaaggcaacgccagtattgtatccttctgcttttctaccttgcatacattcatgaggaccgatttgtgagtgaggctgaactcttcgaagcggttcaaagtttccttctgagtctacaagaccaaggcgagcgaccgccactagtcgtgtttaaagcatcaatttatctcttggcaatctgtcaggataaagacaacaccctgagggagaccatggtctcagccattagaaagttcctggaaggcatccctgacctgcaactcgtctacactcatcacccgttgttgctgcggtttttcttactgtacccagagttgatgagtcgctacggacaccgcgtgctcgagctgtggttcttctgggaggagagcagctacgaggagcttgacgatgtcacctcggccggacagccggctctgcccgcatccttggtggtgcttttccagctgctgcggtccattccttccatcctcctgatactgttagacctgatctactcatctcccgtggacaccgcccataaagtactcatcagtcttcgaacatttttgagacggaatgaggatatacaggtgggcggacttatcagggggcactttctgttgatcttgcagagacttctcgtggagcacggagcctcaccctcgggtgtcttgcttgtgctgcacagcctaggcgagcccaccatagcagcggaacctcccctaccagacgccgcacaggagtgcgtcagggcccgaaccggtcaaagggggcacgaagccccttctccccgatgccccggttgtctcggttag

SEQ ID NO: 57470 - DNA, 1203 bp, Artificial Sequence
  Description of Artificial Sequence: Synthetic coding sequence
atgagtaaagtgagcacaatgttcagtgaggatgacttccagagcacagagcgcgctccctacggccctcagctgcaatggtcccaggatctcccacgcgtgcaagtgtttcgtgaacaggcaaacctggaggaccgcagtcccagaaggactcagcgaatcactggaggggaacaggttctgtggggccctatcactcaaatctttccaacagtaagacctgccgacttaacccgcgtaattatgccactcgagcagagaagccagcactgcaagcccgaagaagggctgcaggctcaggaagaagaccttgggctggtcggcgcacaggccctgcaggccgaggagcaggaggccgcatttttttcttcaactctcaatgtgggcactctagaggaactcccagccgcagagagccctagcccaccacagtctcctcaggaggaatctttttccccgaccgctatggatgccatctttggttctctctcagacgaaggctctggaagccaggagaaagaaggaccttccacctccccagacctgatagaccctgagagcttcagccaggacattctgcatgataagatcatcgatcttgtccatcttctgcttaggaagtatcgcgtcaaagggctgatcacaaaagccgaaatgctcgggagtgtcattaagaactacgaagactacttccctgaaatcttccgcgaagccagcgtgtgtatgcagctccttttcggaattgacgtaaaggaggtggaccccacaagtcattcctatgtacttgtgacaagtctgaacctgtcttacgacgggatacagtgtaacgagcaatctatgcctaagagcgggttgcttattatcgtcctgggagttatttttatggaggggaactgtatcccagaggaagtgatgtgggaggtcttgtccattatgggagtgtatgccggacgtgaacacttcttgtttggtgaacctaaaagactgctgacccaaaactgggtgcaggaaaagtacttggtctatcgtcaagtgccagggacagaccccgcttgctacgaattcctgtggggccctagagcacacgcagaaacttccaagatgaaggtactggagtacattgcaaacgccaatggacgagatccaaccagttatcccagcctatacgaagatgccctgagagaggagggagagggtgtttag

SEQ ID NO: 57471 - DNA, 957 bp, Artificial Sequence
  Description of Artificial Sequence: Synthetic coding sequence
atgctgcttggccagaaatcccagcgttacaaggccgaggagggcctgcaagcacagggtgaggctccgggactaatggacgtacagatacccacagctgaggaacagaaggctgcttcctcctcatctacattgatcatgggaacactggaagaagtgaccgactccggctctcccagccccccacagtccccggaaggcgcttcctcttccctaactgtgacagatagcacgctctggtcccagagtgacgaaggatcttcctccaacgaagaggaagggcctagtacgagtccagatccggcacatttagaaagcttgttccgggaggccctagacgagaaggttgctgaactcgtccggtttttgctgcgtaaatatcagattaaagaacccgtcacaaaggcagaaatgctggagtcagtgattaaaaactacaaaaatcacttcccggacatcttctctaaggcctccgagtgcatgcaggtcattttcggcattgacgtaaaggaagtggatccagccggacactcttatattcttgtaacctgtcttggcctgtcctatgatggcctacttggagatgaccagtctaccccgaaaactggacttctgatcattgtgcttggcatgattttgatggaggggtcaagggccccagaagaagccatatgggaggctctgtcagtgatgggactgtatgatggaagggagcactcagtctattggaagcttcggaaacttttgactcaggagtgggtccaggagaactatctagaataccggcaggccccaggatctgatccagtccgatacgaattcctttggggcccaagggccctggctgagacctcatacgttaaagtgcttgagcacgtggtgcgtgtgaacgccagggtcagaattagttacccaagcctgcacgaggaagccctaggtgaagagaaaggggtttag

SEQ ID NO: 57472 - DNA, 957 bp, Artificial Sequence
  Description of Artificial Sequence: Synthetic coding sequence
atgctgctgggtcagaagtcacagagatacaaagcagaagagggtctgcaagcacagggggaagctccgggtctaatggatgtccagattcccactgctgaggaacagaaagcagcctcatcaagcagcacactgattatgggtacgttagaagaggtgactgactccggaagtccatcgccccctcagtctcccgaaggcgcaagctcctccctgacagtgaccgactcaacgctgtggtctcaaagtgacgaagggtcgtccagtaacgaagaagaggggcctagcacttcgcctgacccagctcatttggagagcttgtttagggaggcacttgacgaaaaagtcgccgagctcgtgcggtttcttctgaggaagtaccagatcaaggagcctgtcaccaaagccgagatgctggagtctgtaatcaaaaattataagaatcacttcccagacattttcagcaaagcatctgagtgtatgcaggtgatcttcgggatagacgtaaaagaagtggaccctgccggacatagttacattctagttacctgtctgggtcttagctacgacggactgcttggcgacgatcagagtactccgaagactggtttactgataatagtcctcgggatgattcttatggagggctcccgggctcccgaggaagcgatttgggaagccctgtccgtgatgggactgtacgatggacgcgagcacagcgtgtactggaagctccggaaactcctgacacaggagtgggtgcaggaaaattacctggaataccgccaagccccaggctccgatcccgttagatatgagttcctgtggggacctagagccctggcagagacctcttatgtgaaggtcttggagcatgtggtacgggtcaacgcgagagtgaggatcagttacccatcactccacgaagaagctcttggcgaagagaagggcgtgtag

SEQ ID NO: 57473 - DNA, 957 bp, Artificial Sequence
  Description of Artificial Sequence: Synthetic coding sequence
atgctcttggggcaaaagtcccaacggtacaaggccgaagagggcctgcaggcccagggggaggctcccggactgatggatgtgcaaattcctactgctgaggagcaaaaagcagcatctagttcgtcaacattgatcatgggaactctggaagaggtcaccgactcgggaagtccgagcccgccacaaagcccagagggtgccagttcttcattgaccgtgacggactcgaccctgtggtcccagtcagatgagggttcttcatctaacgaggaggaaggacctagcacttccccagacccagcgcacttggaaagtctctttcgagaagccctcgacgaaaaggtcgcagaactagttcgtttcctgttacggaaatatcagattaaggaaccagtcactaaggctgaaatgcttgagtctgtgattaagaactacaagaaccacttccccgacatctttagtaaggcgtcggaatgtatgcaggtcatcttcgggattgacgtcaaagaagtggaccctgctgggcatagctatatcctggtcacatgcctcggattatcttatgacggccttctgggggacgatcaatctactcccaagaccggactcctgattatcgtcttgggaatgatcctgatggagggaagtcgagccccagaggaggccatttgggaggccctgagcgtgatgggcctgtacgatggtcgagagcattcagtgtactggaagctgcgtaaattgttgactcaggaatgggtgcaagagaattacctggagtaccggcaggcgccagggagtgaccccgtgaggtatgaattcctgtgggggcctcgcgctcttgcggagacctcttacgttaaagtgctcgaacatgtggtcagagtcaatgcgagggtgcgcattagctacccctctctgcatgaggaagctctgggggaggaaaaaggagtgtag

SEQ ID NO: 57474 - DNA, 945 bp, Artificial Sequence
  Description of Artificial Sequence: Synthetic coding sequence
atgcctctggagcagcggagtcaacactgtaaaccagaggagggcttggaggctaggggcgaggcgctgggacttgtcggggctcaggctccagcaacagaagagcaacagactgctagctctagtagcacattggtggaagtaacactgggagaggttcctgccgctgatagtccgtctcccccacacagtcctcaaggggcttcgtctttcagtaccaccattaactataccctatggcgtcagtccgatgaaggttcaagtaatcaggaagaggaggggcctcgcatgttcccagacctcgagagtgaatttcaagcggctatcagccgcaagatggtcgagctcgtgcactttcttcttcttaaataccgggcacgggagcctgttactaaggcagaaatgctggagtctgtgttgcgcaactgccaggattttttccctgtgattttttcgaaggccagcgagtacctccaactcgtgttcggaatagaggtagtagaagtggttcccatttcacatctctatatccttgtaacctgcctcgggctgagctatgacggactcttaggtgacaaccaggtaatgccaaaaacggggctgctgatcatcgtgctcgcgataattgcaattgaaggggattgtgctcctgaggagaaaatctgggaggagctgtcaatgttggaggttttcgagggcagggaagatagcgtgttcgcccatccaagaaaacttctcatgcaggacctcgtccaggaaaattacctcgagtatcgccaggtaccgggaagcgatccggcttgctatgagttcctctggggcccaagagccttgattgaaacttcgtacgtgaaggtgctccatcacactcttaaaattgggggagaacctcacatctcttatcctccacttcatgaacgtgcgctgcgcgaaggggaggagtag

SEQ ID NO: 57475 - DNA, 945 bp, Artificial Sequence
  Description of Artificial Sequence: Synthetic coding sequence
atgccgttggaacaacgttcgcagcactgcaagccggaggaaggcctcgaggcgaggggagaagcgctcggcctggttggcgctcaggccccagcaaccgaagaacagcagacagcaagctccagtagtaccctcgtggaagttacccttggcgaagtccccgctgctgattcccccagtccacctcatagcccccagggagcctcatccttttctaccactatcaactatacattatggagacagagtgatgaggggagttctaaccaggaggaagaaggccctaggatgttcccggatctggaaagcgaatttcaggcagccatttcccgaaaaatggtggagctggtacacttccttctgctcaagtaccgtgctagggagcctgtgaccaaagcggagatgctagaaagcgtgctgagaaactgccaggactttttccccgttatatttagcaaggcaagcgaatatctgcagcttgttttcggcatagaagtcgttgaggtcgtccctatctcgcacttgtacatactggttacatgcttgggcctgtcatacgacgggttgctcggtgataatcaggtcatgccaaaaaccgggctgctcataatcgtgctggcaatcattgccattgaaggggattgcgccccagaggaaaaaatatgggaagaattatcgatgctcgaagtctttgagggtcgcgaggatagcgtcttcgcccatcccagaaagcttctgatgcaagacctcgtccaagagaactacttagaatataggcaggttcccggatcagacccagcctgttatgagtttttgtggggtccccgtgcacttattgagaccagttatgtcaaagtgttacatcatacactcaagattgggggagaaccccacatctcgtacccacccctgcacgagagggcattaagagagggggaggagtag

SEQ ID NO: 57476 - DNA, 102 bp, Artificial Sequence
  Description of Artificial Sequence: Synthetic coding sequence
atgccactcgagcaaaggagtcagcactgtaagccagaggagggcctggaagctaggggagaggcacttggactggtgggcgcacaagcccctgctacctag

SEQ ID NO: 57477 - DNA, 363 bp, Artificial Sequence
  Description of Artificial Sequence: Synthetic coding sequence
atgccacttgagcagcggagccagcactgtaagcctgaggagggactggaagcgaggggcgaggccctgggccttgtgggagcacaggcccctgcaacagaagagcaacagacagcctcttctagctcaacccttgtggaagtcactcttggagaggtgcccgcagcggattccccgagcccacctcactcaccccagggggcttccagtttctccactaccatcaactatactctgtggcgccagagcgacgaaggctcatcaaaccaggaggaggaaggccctcgaatgtttcccgacctggagagcgagtttcaggcagctataagccgcaagatggtggagctggtccactttctgtag

SEQ ID NO: 57478 - DNA, 459 bp, Artificial Sequence
  Description of Artificial Sequence: Synthetic coding sequence
atgcctctggaacagcgctctcagcactgcaagccagaagaaggattggaggctcgcggtgaggcgctgggactggtcggagcacaggcacctgcaactgaagaacaacagacagcgtcatccagttcgacactggtcgaggtcactctcggcgaagtgccagccgctgatagcccctcacctccacactcccctcagggtgcctcttcatttagcacaaccatcaactatactctgtggagacagagcgatgaaggctccagcaatcaggaggaagaggggcctaggatgtttcccgatcttgagtctgagttccaggctgcaatcagcaggaaaatggtggaactagtgcacttcttactgcttaagtatagagcgagggaacctgtcaccaaagctgagatgctggagagtgtcctgcggaattgtcaggattttttccccgtcatcttctcatag

SEQ ID NO: 57479 - DNA, 270 bp, Artificial Sequence
  Description of Artificial Sequence: Synthetic coding sequence
atgcccttagagcaacgatcccaacattgtaaacctgaggaggggctcgaagccaggggagaggcactcggtctggttggggcacaggcgcctgctacagaggaacagcagaccgcctcttcatcaagtaccctcgtcgaggtgacattaggggaggtgcctgcagccgactctcccagccctccccactctccccaaggagcctcttccttctccacaacgattaactatactctatggcgccagtctgatgaagggtctagcaattag

SEQ ID NO: 57480 - DNA, 447 bp, Artificial Sequence
  Description of Artificial Sequence: Synthetic coding sequence
atgcctctagaacagcggtcccagcattgtaagcccgaggagggactggaagcacgcggtgaggcacttggcttggtaggcgcacaagcgccagctacggaagagcagcagacagcctccagcagtagtaccctcgtcgaagtgaccctcggcgaggtgccggctgctgactcaccatcacccccacattcccctcagggggctagttctttctccacaactataaactacacgctatggagacagtcagatgaggggtcaagcaaccaggaagaggagggaccgagaatgttccctgacctcgagtccgaatttcaggccgctattagccgaaagatggtggagttggtgcacttcctgctgcttaagtacagggcaagggagcccgtcactaaagcagaaatgttggagagtgttctgcggaattgccaggatttcttcccatag

SEQ ID NO: 57481 - DNA, 114 bp, Artificial Sequence
  Description of Artificial Sequence: Synthetic coding sequence
atgcccctggaacagcgaagccaacactgtaaaccagaagaagggctggaagccaggggtgaggccctgggcctggttggagctcaagctccggcaaccgaggagcagcagtag

SEQ ID NO: 57482 - DNA, 1032 bp, Artificial Sequence
  Description of Artificial Sequence: Synthetic coding sequence
atgccaagaggccagaaaagcaaactgagagctagggaaaaacgccaccaggccaggtgcgagaatcaggacctgggtgctactcaggccacagtagcagaaggagaatccccgagtcctgcataccttttatttggtgatagaccacagaatttgcctgccgctgagacacctagtattcctgaggcccttcagggcgcacccagcacgacgaacgccatcgccccagttagttgctcttcgaatgagggggcaagctctcaggacgagaagtctttaggctcctctagggaagcggaaggatggaaagaggatccccttaataagaaagtcgtgagcttggtgcacttcctgcttcagaaatacgaaaccaaggagccgatcacgaagggcgacatgatcaaatttgtaattcggaaggataagtgtcactttaacgaaattcttaaacgggcatctgaacacatggaacttgccctgggcgtagatctcaaggaagtcgacccaataagacattactacgcgttctttagtaagctcgacctcacttatgacgagaccactagcgatgaagaaaagattccaaagactgggcttctcatgattgcccttggcgttatttttctgaatgggaatcgtgcgccagaggaagctgtgtgggagattatgaacatgatgggcgtgtacgctgacagaaagcattttctctatggagaccccagaaaggtgatgaccaaagaccttgtacagctgaagtacctcgagtaccaacaggtgcctaattccgatcctcccaggtatgagttcctgtggggaccccgagctcatgctgagacaagcaagatgaaagtgctcgagtttgtggctaagatacacgataccgtgcctagtgcattcccttcttgctacgaggaggccctgagggatgaagagcagcgtacccaggcgagggcagcggctcgcgctcacacagctgctatggccaacgcaagatccagaacaacctcctcctcattctcccacgctaagtag

SEQ ID NO: 57483 - DNA, 2337 bp, Artificial Sequence
  Description of Artificial Sequence: Synthetic coding sequence
atggcgcaaaagatggactgtggggctgggctcctgggctttcaggcggaagctagcgtagaggattctgctttactcatgcagaccttaatggaggccatacagatcagcgaggcacccccaacgaaccaagcaacagccgcagcctcaccccaatcctcgcagccacctacggcaaacgaaatggccgacattcaggtctctgcggctgcagccaggcctaaatctgccttcaaagtgcagaatgccaccaccaagggcccaaacggggtgtacgacttctcccaggctcataacgctaaggacgtgcccaatactcaacccaaggccgcattcaagagccagaatgctactccaaaaggtcctaatgccgcttacgacttcagccaggcagctaccaccggagaacttgctgctaataaaagcgagatggccttcaaagctcagaacgccactaccaaggtgggccctaacgctacctacaactttagccagtccctaaacgctaacgacctggcaaacagcaggcccaaaacccccttcaaagcatggaacgacacgacgaaggccccaaccgccgatacccagactcagaacgtcaatcaggctaagatggcaactagccaggccgacatcgagacggaccctggaatttcagagccagacggggcaactgcccagacgagtgctgacgggtcccaagcccagaatctggagagtcgaaccatcatacggggaaagaggaccagaaaaattaacaatttgaacgtggaagagaacagctccggggatcagaggcgcgctcccctggccgcaggcacatggagaagtgcccctgtgcccgtcaccacacaaaatcctcctggggcacctcctaacgtcctctggcaaacgcccctagcgtggcagaatccctcaggttggcagaaccaaacggcccgtcagactccgcctgcccgtcagagccctccagcccgacagacccccccagcctggcagaaccccgtggcctggcagaaccccgtgatctggcccaaccccgtgatttggcaaaatcctgtaatttggcctaaccctatcgtttggcccggaccagtcgtttggcctaaccctctggcgtggcagaacccgcctggctggcagactccccctggttggcagacaccccctggctggcagggcccaccagactggcagggtccccctgattggcctctgccgccagattggccgcttcctcctgattggccgctcccaacggactggcctctccctcctgattggattccagccgactggccaattcccccagattggcagaacttgcgtccatccccgaacctgagacccagccctaattccagggcttcccaaaatccaggtgctgctcagcctagggacgtggctctcctgcaggagagggccaataaactggtgaagtacctcatgctcaaggactacaccaaagtgcccattaagcgctcagagatgctgcgggacatcataagggagtacaccgacgtgtaccctgagatcatagagcgggcttgctttgtgctggaaaagaagttcggaatccagcttaaagagattgacaaagaggaacacctgtatatattgatctccacgcccgagtccttagccggtatcttggggactaccaaggacacacctaaattagggttacttttagtcatcttgggcgtcattttcatgaacggaaaccgggcatccgaggccgttctgtgggaggcactgcggaagatgggcttacgcccaggcgtccgacacccactgctgggagacctgcgcaagttactgacttacgagtttgtaaagcaaaagtatttagactatcgcagagttccaaattctaacccacctgagtacgaatttttgtggggtcttcgatcgtatcacgaaacttccaagatgaaggtgttacgtttcattgcggaggtccagaaaagagaccccagggactggactgcccagttcatggaagcagccgatgaggcattggatgccctcgacgcagccgcagccgaggccgaggcaagagctgaggctagaacccgcatggggattggcgatgaggccgtctccggcccttggagctgggatgatatcgaatttgagctgctcacatgggacgaggaaggcgatttcggggatccttggtctcgcatcccgttcacgttttgggccagatatcaccagaacgcaagatccaggttcccccaaacctttgccggtccaattatcggtcccggaggtacagccagcgcaaactttgctgcaaacttcggggcaatcggttttttctgggtcgagtag

SEQ ID NO: 57484 - DNA, 2337 bp, Artificial Sequence
  Description of Artificial Sequence: Synthetic coding sequence
atggctcagaagatggattgcggagcaggtctgctgggctttcaagccgaggccagcgtcgaagactcggccctgctgatgcagacgctcatggaagccattcagattagtgaagcccctccaaccaaccaagccacagccgcagcatcaccacaatccagtcagccaccgaccgcgaatgagatggccgatatccaggtttccgcggcagctgcaagacccaaatccgcttttaaagtgcagaacgctactacaaaaggacctaacggtgtctacgacttcagtcaggcccataacgccaaagacgtgccgaatacccaacctaaggcggcatttaaatcccagaatgcaacccccaagggacccaatgccgcatacgatttctcccaggctgccactactggcgagttagctgctaacaagtctgaaatggctttcaaagctcagaatgccacgactaaggtggggcctaacgccacgtataatttcagtcagtccctgaatgccaacgacctggcgaacagccggccaaaaactccctttaaagcatggaacgacactacaaaggctcccactgccgatactcagactcagaatgtcaaccaggccaagatggcaacctcacaggcagacattgaaaccgacccaggaatttccgaacccgatggcgcaactgctcagacatctgcggacgggtcgcaggcacagaatttagaaagccgcactatcattcggggtaagagaacccgaaaaattaacaatcttaacgtcgaagagaattcatcaggtgatcagcggagagctcccctggccgctgggacctggcggagtgcgccagtcccggttaccacgcaaaatccccctggcgctccgccaaacgttctgtggcagacccccttggcgtggcagaaccctagcggatggcagaaccagacagcacgccaaacaccacctgctagacagtcccctcccgcaaggcaaactccgccagcttggcaaaacccagtggcctggcaaaatcccgttatctggcccaatcctgttatatggcagaatcccgtaatctggcccaaccctatcgtgtggcccggtcccgtcgtgtggcccaacccactggcctggcaaaaccctcctgggtggcagaccccaccaggttggcaaacacctcctgggtggcaaggcccaccagactggcagggccctcctgactggcccctgccgccagactggcctctgccacctgactggccccttccaacggactggcccctaccacccgattggattcccgcagattggccaatcccccctgactggcaaaacctccgacctagtcccaacctgcgaccctctccaaattctcgagcttcccagaatccgggagctgcccagccaagggatgtagctttgcttcaggaacgcgctaacaaactggtgaaatatctaatgctgaaggactataccaaggtgcctatcaagagatctgaaatgctgagagatatcataagggagtacaccgatgtttatccggaaatcatcgagcgcgcatgtttcgtgctcgaaaaaaaatttggcattcaactgaaggaaattgacaaagaggaacacctatatattctgatttcaaccccggagtctcttgcgggaattcttggaactacaaaggatactccgaaacttggcctgctgcttgttatcttgggagtgatcttcatgaatggaaatagggcctcagaagccgtactctgggaagcactgagaaagatgggcttacggccaggggtgcggcaccccctcctgggtgacctccgaaaactgttgacttacgagtttgtgaaacagaagtacttggattataggcgggtccccaattctaaccctccagagtacgagttcctgtggggtttgaggagctatcatgagacttctaagatgaaagtgttaaggtttattgccgaggttcaaaaaagagatcctagagactggacagctcagttcatggaagcggctgacgaagctctggacgcacttgacgccgctgccgcagaggctgaagctcgggctgaggccagaactcggatgggcataggggacgaggctgttagtggcccttggtcatgggacgatattgagtttgaactgctcacatgggatgaggaaggcgactttggcgatccatggtctcggattcccttcaccttttgggccaggtaccaccaaaacgccaggtctaggttccctcagacctttgccggaccgatcattggacctggcggaaccgcaagcgctaattttgctgccaatttcggtgcaatcggcttcttctgggtcgagtag

SEQ ID NO: 57485 - DNA, 2220 bp, Artificial Sequence
  Description of Artificial Sequence: Synthetic coding sequence
atggctgaagggtcctttagtgtgcagtccgaatcctactctgtcgaggacatggatgaggggagcgacgaggttggcgaagaggagatggtagaaggaaatgactatgaagaatttggggcttttggcggttatggcaccctgacatctttcgacatccatatcttacgcgcattcggcagtttgggtcctgggttgcggatactaagcaacgagccatgggaactggagaaccctgttctggcccagaccctggtggaggctttacagttagatcctgagaccctggcgaacgaaactgctgctagggccgctaacgtggcccgagccgcagcctctaaccgtgctgctcgggcagccgctgctgccgcaaggactgccttcagccaggtcgtggcatcacacagggtcgcaacccctcaggtttctggtgaggatacccaacctacaacatacgctgctgaggcgcaagggccaactcccgagccacccctagccagtcctcagacttcccaaatgctcgttacatcaaagatggccgctccagaagcgcctgccacctctgcccaatcacagaccggatcccccgcacaggaagcggctacagagggtccttcatcagcctgtgccttctcccaagccccatgtgcccgagaagtggacgctaataggcctagcacggcattcctggggcagaatgatgtattcgactttacacaaccagccggagtatcagggatggcttttccacgcccaaaaagaccagccccagcccaggaagctgccacagagggcccaagtgctgctagcggagttccccagacaggaccaggacgcgaggtggccgctactagacctaagacaacgaagtccggaaaggccctggctaagacgcgctgggttgagccacaaaatgtggtcgcagccgctgcggcaaaggccaagatggccacctctataccagagccagagggcgcagctgcagctaccgcccagcattcggctgagccatgggctcgaatgggtggcaaacggacaaagaaatccaagcacctcgacgatgaatatgagtccagtgaggaggaaagggagacccctgccgtgccacctacgtggcgggcttcgcaaccttccttgaccgtgagagcacagcttgcccctagacccccaatggctcccaggagccaaattccatctcggcatgtgctctgcctccccccacgcaatgtgactttactgcaagagagggctaataaattggtaaagtatctcatgattaaggactacaagaagatacctattaagcgcgcagacatgctcaaggacgtgatccgcgaatacgatgagcactttcctgaaatcattgagagagctacatatacactcgaaaagaaattcggcattcatttgaaggaaatcgataaagaagagcatctgtacattttggtgtgcactcgggactccagcgcgaggctgctgggaaagacgaaggacacgcctagactgtccctattgttggtcatcctcggcgtgatcttcatgaacggcaatagagcgtccgaagccgtgttgtgggaggcactccgcaagatgggattacgaccaggggtgagacacccttttctcggagatcttagaaaactgatcaccgatgactttgtcaagcagaaatatctcgaatataagaaaattccgaacagcaacccgcctgagtatgaattcctctggggactaagagctcgtcacgagacctccaaaatgagggtgctgaggttcattgcccagaaccagaacagggatcccagagaatggaaagcccattttcttgaggccgtggatgacgcctttaagacgatggacgtggacatggcggaagaacacgcgcgtgcccaaatgagagctcaaatgaatataggcgacgaggcactaatcggcagatggagctgggacgacatacaggttgagttactgacttgggatgaggatggtgattttggagacgcatgggccagaatacctttcgccttttgggccagataccaccagtacattttaaattccaaccgtgccaaccgaagggcgacatggagagcaggcgtttcatccggcactaacggaggtgcgagcactagcgtgctagatggcccaagcacgtccagtactataagaactagaaacgccgctcgcgctggggcttccttcttcagctggattcaatag

SEQ ID NO: 57486 - DNA, 2274 bp, Artificial Sequence
  Description of Artificial Sequence: Synthetic coding sequence
atggctgagggaagcttcagcgtccagagtgagagctactcagtggaggacatggatgagggtagtgacgaggtgggggaagaggaaatggtggaaggcaacgattatgaagaattcggcgctttcggcggatatggcaccttgacatcctttgacattcacatcctgcgtgctttcggtagcctggggccaggactgagaatcctgagcaacgagccatgggaacttgagaatcccgtgttggcacagacactcgttgaagcccttcagctagatcctgaaacactggccaacgagaccgccgctagagcagcaaacgtggcccgagccgctgccagcaatcgtgccgctcgggctgcagctgctgctgcacgaactgcgtttagccaggtggtggctagtcatagagttgcaacaccgcaggtctctggcgaggatacccagccaactacctatgcagcagaagcccagggccctactccagagccacccctcgccagtccacagacgagtcagatgctagtgacaagtaagatggccgctcccgaagcaccggctacatctgcacagtcccagactggatcccccgctcaggaagctgcaacagagggcccttcctccgcctgtgcattctcgcaagcaccatgtgcaagggaagtagacgccaaccggccatctaccgcttttttgggccaaaacgacgtcttcgacttcacccaacctgccggagtgagtggaatggccttccccaggcctaaaaggcccgctcccgcacaggaggccgctactgaggggccttcagccgcatcaggagtcccccaaactggcccagggagagaggttgcagccactcggcctaaaacgaccaaatcaggcaaggctctagcaaagactcgctgggtggagcctcagaacgtggtggcggctgccgcagccaaagcgaagatggcaacaagcattcccgagccggaaggcgctgctgccgcaactgcgcagcatagcgccgaaccgtgggccaggatgggcggtaagcggactaagaagtcaaaacatctggacgatgaatacgagtctagtgaagaggagcgcgagactcctgctgtgccacctacatggagagcttctcagccgtctctgacggtcagggcccaactggcccctcgaccgccaatggcccctagatcccagattcccagcagacacgtgctgtgcctgcccccaaggaacgttacgctgttgcaagaacgcgctaacaagcttgttaagtatctgatgataaaagattataagaagatcccaatcaaacgggcagacatgctgaaggacgtgataagagagtatgatgagcactttcccgagattattgagcgagctacatacactctggaaaagaaattcgggattcacttgaaggaaattgacaaggaagagcacctgtacatactcgtgtgtacccgggatagcagtgccagactcctgggaaaaaccaaggataccccacgcttgtccctgttgctcgtgatcctgggcgtgatattcatgaatggaaaccgagcctccgaggccgtgttatgggaggctttgagaaaaatggggctgaggcccggtgtaagacacccattcctgggggacctgcgtaagctgatcaccgatgactttgtcaagcagaagaaccctgagctgcgggaagagacccccctgtccatggcaccatcttggtacttggaatataagaaaattccgaatagcaatcctccagagtacgaatttctctgggggttaagagccaggcacgagacaagtaaaatgcgggttctcaggtttatcgcccaaaatcagaatcgtgaccccagggagtggaaggcccactttctggaagcggtagacgacgcctttaagacaatggacgtggatatggctgaggagcatgcaagggcacaaatgcgggctcagatgaatatcggcgacgaggctcttataggtcgctggtcatgggacgatatccaggtcgaactgttgacatgggacgaggacggtgatttcggggacgcctgggccaggatccctttcgctttctgggccagatatcaccagtacatcctgaacagcaacagagcgaaccggagagccacctggagggcgggtgtgagctcaggtacaaacggcggtgctagcacatctgtgctggacggaccctccaccagcagcacaattagaacccgcaatgcagcacgtgcaggtgcgtcttttttttcttggattcaacaccggtag

SEQ ID NO: 57487 - DNA, 2091 bp, Artificial Sequence
  Description of Artificial Sequence: Synthetic coding sequence
atggagagcgaatacgtcctgtgcaattggaaggaccagctgtggccggctaaagtgctgagccggtctgaaacgagttctaattcaaagcggaaaaaggccttctcattagaggtccagatcttgagcctggacgagaaaatcaaactcgatagtactgaaacaaaaatcctgaacaagtcacagatcgaagctatcgccgcttccctgggactccagtcggaagactctgccccacctacagaggagactgcctacggcagatccctgaaggtggcactcggcatcctgaacgaacggacgaacttaagccaggcttctacgtcggatgaagaagaaattacaatgttgagtcagaacgtcccccaaaaacagagcgattcaccgccacataaaaagtatcgaaaggacgagggagacttgcccggttgcctggaggagcgcgagaactcagcatgcttattggccagctcagagagtgacgatagcctgtatgatgataaatcgcaggcaccaacgatggtcgatacgatcccatcggaagtggaaactaagtctttacagaattcttcatggtgtgagacattcccttctctgagcgaggacaatgacgaaaaggagaacaaaaataaaatcgatatcagtgcggtgatgtcagtgcactcagcggtcaaggaggagagcgcctgcgtcaaggatgagaaatttgccccacctctgagcccgttatcatcggacatgttgatcatgccaaaagcgctcaaagaagaatccgaggacacatgtttggagaccctcgcggtgccatctgagtgttcagcattttcagagaatatcgaggatcctggggaaggtccctcaaacccttgtttggacaccagccagaaccagccttcaatggagtccgaaatgggagcagcagcctgtccaggttcctgttccagggagtgtgaagtgtccttcagcgcgtccaatcctgtctgggattatagccatcttatgagctctgagaggaactttcagagattagactttgaagagctggaggaagaaggacaagcatctgacaaatctctactccccagcaggattaatctgtcgctgctggatgatgacgaggaggatgaggagctccctcgcttcattctgcattatgagacacaccctttcgaaaccggcatgatcgtctggttcaagtatcagaagtatccattttggccagccgtcattaaaagcatccgcaggaaggagagaaaggcaagcgtgttgtttgttgaggccaatatgaactcagaaaaaaaaggcattagagtgaactttcgacgactgaagaaattcgattgcaaagagaaacagatgctcgttgacaaagcaagagaggactactccgagagcattgactggtgcatttcattgatttgcgactatagggtgagaattggctgcggctcctttactgggtctctgctggaatactacgcggcagatatctcctaccccgtgcggaaagagaccaagcaagatacttttagaaataaattccccaaactgcataatgaagacgcgagggaacctatggccgtcactagccaaaccaagaaaatgagctttcagaaaattctgccagaccggatgaaggccgcaagagacagagcgaacaaaaacctcgtcgacttcatcgtgaatgctaaggggacggagaatcaccttctggctatcgttaacggcaccaagggcagtcgctggctgaaatcctttctcaacgcgaataggtttaccccatgcattgaaacctactttgaggatgaggatcaactggacgaggttgttaagtatttgcaggaagtttgcaatcagatcgatcagattatgcccacatggataaaagacgacaaaatcaaattcattctggaggttcttttgccagaagccattatttgcagtatctctgctgtggatggcttggactatgaggcagcagaggcgaaatacttgaaaggcccatgtctcgggtatcgagaaagagaattgtttgacgctaaaatcatctacgaaaagcggcgtaaggctcccactaatgaggcccactag

SEQ ID NO: 57488 - DNA, 2091 bp, Artificial Sequence
  Description of Artificial Sequence: Synthetic coding sequence
atggaaagtgaatacgtgctgtgcaactggaaggaccaactgtggccagcaaaggtgttgtcacggagtgaaactagtagcaactcaaagcgcaagaaagccttttcactggaggtccagatccttagcttagacgagaaaatcaagctcgactccactgagacaaagattctgaataagagccagatcgaagctatcgcagcgtccctcgggttacaatctgaagattctgcccctccaacggaggagacagcctacggccgatcccttaaggtggctttgggtattctgaacgaacggacaaacctctcccaagcctcaacatcggatgaagaagagattaccatgctgagtcagaacgtgcctcaaaagcagtccgacagccccccacacaagaagtatcggaaagacgaaggagatcttcccggatgcctggaggagagggaaaattccgcctgtctcctcgcctcatctgaatcggatgattccctgtacgatgacaaatcccaggcccctaccatggttgacaccattccgtccgaggtcgaaacaaagtccctgcagaactcttcctggtgcgagaccttcccctccctaagcgaggataatgacgaaaaagaaaacaaaaacaagatcgatataagcgcagttatgagtgtgcattccgcagtgaaagaggagtccgcctgcgtcaaagatgaaaagtttgcaccccctctttctcctcttagttccgacatgctaattatgccgaaagctctgaaggaggagtccgaagatacatgtttagaaactctcgcggtaccctcagagtgcagcgcgttctccgagaatattgaggaccccggtgaaggaccgagtaacccttgtttagacacttcacagaaccaaccgtcaatggaatcagaaatgggagccgcagcatgtcccggaagctgtagccgcgagtgcgaagtctccttcagcgcgagcaacccggtttgggactattctcacctgatgagctcggagcgcaattttcaaaggttagatttcgaagaactggaggaagaaggccaagcaagtgataagtccttgctgcccagtcgaatcaatctttcacttctcgatgacgatgaggaagatgaggagttgccacgattcatcctccactacgaaactcaccccttcgagaccgggatgatagtgtggttcaaataccagaaatatccgttctggcccgctgttataaagtctattcggcgtaaggagagaaaagcctcagttctctttgttgaggccaatatgaacagtgagaagaaaggcatacgggtgaattttagaagactgaagaaattcgactgcaaggagaagcagatgctggtcgataaggccagggaagactattccgagtcaattgactggtgtatctcccttatctgcgattatcgcgtgcgcattggctgcggcagctttaccggatctctgctcgagtactatgcggctgatatcagttatccagtccggaaggagaccaagcaggatacctttagaaacaagttccccaaattgcacaatgaggatgccagggaacctatggctgtgacatcacagaccaaaaagatgtccttccagaagattctgccagacagaatgaaggccgctagggaccgggctaacaaaaatttggtggacttcatagtaaatgcgaaagggacggaaaaccatctcctcgctatcgtgaatggtacgaaggggtctcgttggctgaagtctttcctgaacgcaaaccgtttcaccccgtgtatagaaacgtacttcgaggacgaggatcagctcgatgaggtggttaagtatttgcaggaagtctgtaaccagattgatcagataatgcctacttggatcaaggacgataagattaagttcatccttgaagttcttcttcctgaggccatcatctgctctattagcgcagtggatggccttgattatgaagccgctgaagctaaatatttgaaaggcccttgccttggctacagagaacgagagctctttgacgcaaaaattatctatgaaaaaagacgaaaggcgcctaccaatgaggctcactag

SEQ ID NO: 57489 - DNA, 2091 bp, Artificial Sequence
  Description of Artificial Sequence: Synthetic coding sequence
atggaatctgagtatgtcctgtgcaactggaaagaccaactctggcccgcaaaagtgttaagtcggtctgagacgtccagcaactctaagcgtaagaaggcatttagccttgaggttcagatcttgtctctggacgagaagattaagctggactcgacagagacgaagattctgaacaagagccagattgaggccatagccgcttctctcggccttcaatccgaagactccgcccctcctaccgaagagacagcgtatggacggagcttaaaagtggcactgggaatactgaatgaacgaaccaacctaagccaggcgtccacatcagatgaagaagagatcactatgctctcccagaacgtgcctcagaagcagtccgatagccctccccataagaagtaccggaaggacgagggtgacctgccaggctgtctggaagaacgggagaatagtgcttgccttttagcctcttcggagtccgatgactccctgtatgacgataaaagccaggctcccacaatggtcgatacaattccatcagaagtagagacaaagtcgttgcaaaattcttcatggtgcgaaacctttccaagcctgagcgaggataacgacgagaaggagaacaaaaacaagatcgatatatcagccgtgatgagtgtccattctgctgttaaggaggagtccgcttgtgtaaaggatgagaagttcgccccacccctgagtccgctgtcatctgatatgttgataatgccaaaggctctaaaggaagaatctgaggatacctgtcttgagacactggctgtcccttccgagtgtagcgccttttcagagaacattgaggatcccggtgaggggccatctaacccctgcctggacacgtcccaaaatcaaccgagcatggaaagtgagatgggagctgccgcatgcccgggtagttgttcgcgcgagtgtgaggttagcttttccgcctctaacccggtgtgggactactctcacctgatgtcaagcgagaggaatttccagagattagattttgaggaattggaagaggaggggcaggcatcagataagagtctgttaccaagcagaataaatctgagcctgctggatgatgatgaggaagatgaggagctcccaaggtttattctccactacgagacccatcccttcgagaccgggatgatcgtgtggtttaaatatcagaagtaccccttttggccagcggtcattaaaagcatccggagaaaagagaggaaagccagcgttctctttgtcgaggctaacatgaactccgagaagaaaggcatccgggtcaattttcgaaggctgaagaagttcgactgcaaagaaaaacaaatgctggtggataaagctcgggaagattattcagaatctattgactggtgcatctctctgatctgtgactatcgagtgcgcatcggctgcggcagcttcactggaagccttctggagtactacgcagccgacatcagttatccagtgaggaaagagacaaagcaggacacatttcgcaataagttcccgaagctccacaacgaagatgccagagagcccatggctgtgaccagccaaaccaaaaagatgtctttccagaaaatccttcccgacagaatgaaggctgctcgcgatcgagctaacaagaatctggttgacttcatcgtcaatgccaaagggacagaaaaccatctgctggccatcgtaaacgggaccaaagggtcccgttggctcaaatcctttctgaacgcaaatcggtttacaccctgcattgaaacttacttcgaggacgaagaccagctagacgaagttgttaagtaccttcaggaggtgtgtaaccagatcgaccagatcatgccaacatggatcaaagatgataaaatcaagttcatcctggaggtgttgctgccggaggccatcatctgtagcatttctgcagtagacggtctagattacgaggccgcagaggctaaatacctgaagggcccttgtctggggtatcgtgagcgtgaactcttcgacgccaaaattatttacgaaaagcggaggaaggccccaacaaacgaagctcactag

SEQ ID NO: 57490 - DNA, 396 bp, Artificial Sequence
  Description of Artificial Sequence: Synthetic coding sequence
atggccaggtctctggtgtgcctgggagtgattatccttttgtctgccttctctgggccaggtgtgcgaggaggtccaatgcctaagctcgccgaccggaagctgtgtgcagaccaggaatgtagccaccccatctcgatggcagtggcccttcaggactacatggcgcctgactgcaggtttctgacaatacaccgtggtcaggtagtgtatgtgttttcaaaactcaaagggcgtgggagactgttttggggagggagtgttcagggggactactacggtgacctcgctgccaggctgggctattttccttccagcatcgtgcgggaggaccaaacgctgaaaccgggaaaagtggatgttaaaacagacaaatgggatttctattgccagtag

SEQ ID NO: 57491 - DNA, 2226 bp, Artificial Sequence
  Description of Artificial Sequence: Synthetic coding sequence
atggctgaaggcagcttctccgtgcagtcagagagctattctgttgaggacatggacgagggtagtgatgaggtgggtgaagaggaaatggttgaggggaatgactatgaggaattcggagctttcggtggatatggaaccctgacctcttttgacatacacattttacgagcgttcggctccctggggcctggcctcagaatccttagcaacgaaccctgggaactggagaatcctgtcctggcccagacactcgtcgaagcgcttcagttggacccagaaacccttgctaatgagaccgccgctcgggctgccaacgtcgcgagagctgcagcttcaaatcgggctgctagagcggcagccgctgccgctcgtactgccttctctcaggtcgtggctagccatagagttgcaactcctcaagtcagcggtgaggatacccagcctaccacctacgccgctgaggcgcaggggcctacccccgaaccaccactagccagcccccaaacctctcagatgttagtgacaagcaagatggcagctccagaagcccctgctacctcagcacagagccagacgggcagtcctgcccaggaagcggctacggagggcccatcgtcagcctgtgcgttctctcaggcaccatgtgccagagaagtcgatgccaaccggcctagtacagcgttcctggggcaaaacgatgtattcgattttacccaacccgcaggcgtctcgggcatggcttttccaagaccaaaacggcctgcacccgcacaagaagccgctaccgagggcccttctgcagcatccggggtgccccaaaccggccctggcagagaagtggcggcaacgaggccaaaaactaccaaatccggtaaagctctggccaagacccgatgggttgaaccccaaaatgtggtggccgcagctgccgcaaaagccaagatggccacatctatcccagagcccgagggggctgctgcagcaacagcgcagcactcagccgagccttgggccagaatgggcggtaagagaactaaaaagtcgaaacatttggacgacgaatatgagtcctccgaagaggagagagagacccctgccgttccccctacctggagggcttctcagccctccctcactgtaagagcacagttggcccctcgtcctccgatggcacctcgaagccagatccccagccgacatgtgctatgcctgcctcccagaaacgtcacactcctgcaggaaagagccaacaagcttgtgaagtacctgatgattaaggactacaagaagatacctattaagagggcggacatgcttaaggatgtcattagggagtacgacgagcattttcccgagatcatcgagagagctacttatactctggaaaagaagttcgggatacatcttaaagaaatcgataaagaggagcacctttatattctggtgtgcacccgggattcttctgcacgcctgcttggcaaaacaaaggacacaccgagactttctcttctgctagtcatcctgggggtaatcttcatgaacggtaaccgcgcatcagaggcagtgctctgggaagcattgagaaaaatgggcctccgaccaggtgttcggcacccttttttgggagatctccggaagctgatcactgatgactttgtgaaacagaagtacctggagtataaaaaaattccgaactccaatcctccagaatacgagttcctctggggcctgagagctcgtcacgaaaccagtaagatgagggtgctgcgctttattgcccagaaccaaaacagggacccacgggaatggaaagctcacttcctggaggcagttgatgacgccttcaagacgatggacgttgacatggcagaagaacacgcccgagcccaaatgagagcgcaaatgaatattggcgacgaggctctcattggccgttggtcctgggacgacatccaggtggagctcttaacgtgggacgaggatggagattttggcgacgcttgggctcggatccctttcgcattctgggcaaggtatcaccagtatatccttaattcgaacagagctaacaggagagccacgtggcgggctggtgtgtcttctggcacaaacggtggcgcatcaacaagcgtgttggacggaccctccacatcaagcacaatcaggacgcgcaatgcggctcgggcaggagcctcattcttttcctggatccagcacagatag

SEQ ID NO: 57492 - DNA, 4446 bp, Artificial Sequence
  Description of Artificial Sequence: Synthetic coding sequence
atgagtaagacactgaagaaaaagaagcactggttgtctaaagtacaggaatgtgccgtaagctgggccggtcctccaggcgattttggcgctgagattcgcggaggcgctgagcgcggagaattcccatatctggggaggttgagggaggagccaggcggtggtacctgctgtgttgttagtggtaaagcccctagtcctggagacgtcttgctggaggtcaacgggacccccgtatcgggcttaaccaaccgagacacacttgcagtaatcagacattttcgcgagcccattcgcctgaagaccgttaaaccaggcaaagtcatcaataaggacctgcgccattacttgtccctgcagtttcagaaaggctctatagatcacaagcttcagcaagtcataagggacaacctatatcttaggacgataccgtgcaccacccgagctccgagggacggagaggtgccgggtgtggactacaacttcattagcgttgaacaatttaaggcccttgaagagagcggggctctgctggaaagcggcacctatgacggcaacttctacgggactccaaaaccccctgctgaaccctctccatttcaaccagacccagtagaccaggtgctgtttgacaatgaattcgacgctgagtctcagagaaaacgaaccacgtctgtgtccaaaatggagagaatggatagctccctgccggaggaggaagaggatgaggacaaggaagcaattaatggctctggaaacgcggaaaaccgggagaggcactcagaatctagcgattggatgaaaaccgttccaagctataaccagacaaattcctcaatggattttaggaactacatgatgcgggatgagactcttgaaccgcttccgaagaactgggaaatggcctacacagatacgggcatgatttactttatcgaccataacacaaagactactacttggctcgacccccgactgtgcaagaaggccaaggcccctgaggactgtgaagatggcgaactaccatatggttgggaaaagatagaggatccccagtatggaacctattacgtggaccatctcaatcagaagactcagttcgagaaccccgtcgaagaggccaaacgcaaaaagcaactgggccaggtcgagattggcagcagcaaaccagacatggaaaaaagccattttactagggacccctctcagctcaaaggagttcttgtcagagcgagcctcaagaaatccacaatgggcttcggatttacaataataggcggtgatcgtcctgacgagtttcttcaggtgaaaaacgtcttaaaagatggacctgcggcacaagacggtaaaattgcgccaggcgatgttattgtggatatcaacggtaactgcgtcctcggtcatacacacgcggacgtggttcagatgttccagctggtcccggtcaatcaatatgtgaacttgaccttatgtcgaggctacccccttcccgacgattcggaggatcccgtggtggatatagttgcggcaacacccgtcatcaatggtcaaagcctgacgaaaggtgagacctgcatgaatccccaggattttaagcctggcgcaatggtcttggagcagaatgggaaaagtggccacactctcacgggagacggcctgaacggcccatcagacgcttcagaacagagggtttctatggcatcatctggatcttcccagccagagctagtaacgattcctctgatcaaaggacccaagggattcgggttcgccatagcagattcacccaccggccagaaggttaaaatgatacttgattcccagtggtgtcagggactccaaaaaggggatatcataaaggaaatttatcatcagaatgtgcaaaacctgacccatctgcaggtggtggaggtcctcaagcagttcccagtcggcgcagacgtaccactcttaatcctgcgcggaggtccgccaagtcccacaaagaccgcaaagatgaagactgataaaaaagagaacgcgggttccctcgaggctatcaacgaaccgatcccccagccaatgccatttccaccgagcataatcagatctggcagtccaaagttagacccctccgaagtgtatctaaagagtaagacactatacgaagataaaccaccaaatacaaaggacctggacgtgtttctgagaaaacaagagtcaggttttgggttccgagtgctgggaggagacgggccagaccagtctatttacattggggcaatcatcccactgggagctgctgagaaggatggacgactgagggctgctgatgagctgatgtgcattgacgggataccggttaaaggtaagtctcacaagcaggtgctagatctgatgactacagcagctcggaatgggcacgtcttacttacagttcgccgaaagatcttctacggtgagaaacagcctgaagatgactccagtcaagctttcattagcacccagaacggttctcctagactgaatcgtgctgaggtccctgcccgtcccgctccacaggagccttatgacgtggttctgcaaaggaaagagaatgaggggttcggttttgtgatcctgacctcgaaaaataaaccccctcctggggtgattccacataagatcggcagggtcatcgaagggtcccctgccgacagatgcggaaagctgaaagttggggaccacataagtgccgtgaacggccagagcatcgtggagttgtcacacgacaatatcgtgcagctgattaaagacgctggggtcaccgtcacactgactgtaattgcggaggaggaacaccacggacctccgtcagggaccaactccgctaggcaaagtccagctctgcaacaccgcccaatgggccagtctcaggcgaatcacattcctggagatcgctcagccctggagggcgagattggcaaggatgtttcaacctcttatcgccactcttggtcagaccataaacacctagctcagcccgacacggcagttatttctgttgtcgggtctcgccataaccaaaaccttggttgttacccggtggagctggaacggggtcccaggggttttggattttccctcaggggtggaaaagaatacaacatgggactctttatccttcgcttggcagaggacggacctgcaattaaggacggaagaattcacgtgggtgatcagatcgtagagataaacggagaacccacccagggcataacccatacacgagcgatcgaactaatccaagctgggggtaataaggtactgctactcctccgcccaggaacaggattaattcccgaccacggtgattgggacatcaataatccttcctcctcaaacgtcatttacgacgagcagagcccgctgccgccttccagccatttcgcatcaatatttgaggagtcacacgtgcccgtcatcgaggaatccctccgggttcagatttgcgagaaggcagaggaactcaaagatatcgtcccagagaagaaatcgacactgaacgagaatcagcccgagattaaacatcagagcttgctgcaaaaaaacgtgtctaagcgggatcccccttcttctcacggacactcaaacaaaaaaaatctactgaaagtagagaacggtgtcactcggcgtggcagatcggtatccccaaagaagccagccagtcagcacagtgaggaacatttggataagatcccctcgcccttgaagaacaatcctaagaggcgtccaagagaccagagcctcagcccctcaaagggtgagaacaaatcctgccaagtaagcacacgggcaggatccggtcaagaccagtgccgtaaatcccgaggacgatccgcatcccctaaaaagcagcaaaaaatcgaaggctcaaaggccccttccaatgccgaggccaagctgttagaagggaagtccagaaggatagcaggttatacaggtagtaatgcggagcagatacccgacggcaaggagaaaagcgatgtgattagaaaggacgccaaacagaaccagttggaaaagagcaggaccaggtctcctgagaagaaaataaaacgtatggtggagaaaagtttgcccagcaaaatgactaacaaaactacatctaaagaggtgagtgaaaacgaaaagggcaaaaaagtcacaaccggcgaaactagtagcagcaatgataaaataggagagaacgtgcaattatccgagaagcgactcaaacaggagcctgaagaaaaggttgtcagcaacaaaacagaagatcacaaggggaaagagttagaagctgccgataagaataaggaaacaggtcgattcaagcctgagtcatccagcccagtcaaaaagaccctgattaccccgggaccctggaaagtgccctcaggcaacaaagtgaccggaaccatcggaatggcggagaaaaggcaatag

SEQ ID NO: 57493 - DNA, 3378 bp, Artificial Sequence
  Description of Artificial Sequence: Synthetic coding sequence
atgagcaagaccttgaaaaagaaaaaacattggctcagcaaagtccaagagtgcgcagtgagttgggccggtccgcctggagactttggagccgaaataagagggggtgccgagcggggtgaattcccgtacctggggagactgagagaggagccaggtgggggaacctgttgcgtggtcagcggcaaggcaccatccccaggcgacgtactgctcgaggtgaacgggactccagtcagtggtttgaccaatagagatacgctggcggtcattcgccacttccgggaacccatccgtctgaagaccgtcaaaccaggcaaggtgataaacaaggatctacgtcattacttatcccttcaattccagaagggcagcatcgatcataagctgcagcaggtgatcagggacaacctgtatctaagaacgatcccctgcactacaagagccccaagagatggtgaagttcctggtgtggattacaatttcattagcgtggagcagtttaaggccctagaggaaagtggcgcattgctagaatctggaacctacgacgggaatttttatgggactccaaaaccaccagccgagccctccccatttcaacccgatccggtggaccaggtcctgttcgacaatgagtttgacgctgaatcacagcgaaagaggaccacaagcgtgtccaaaatggagcgtatggacagttcattgcccgaggaagaggaggacgaagacaaggaggccatcaacggcagtggaaacgcggaaaaccgagagagacactccgaatccagtgattggatgaaaaccgtgccttcctacaatcaaactaattcctccatggacttcaggaattacatgatgcgggatgagacccttgagcccctgcccaagaattgggaaatggcctatacagataccgggatgatttatttcatcgatcacaacaccaagaccacaacttggcttgatcctcggttgtgtaagaaggcaaaggccccagaggattgtgaggacggtgaattgccttatgggtgggagaagatcgaagatccccaatatggcacgtactacgtcgaccatctgaaccaaaagacgcaattcgaaaatcccgttgaagaagcgaagcgaaagaagcaattaggacaggtcgagattggcagcagtaaacccgatatggagaaaagccatttcaccagagatcccagccaacttaagggagttctggtgcgcgcaagcctgaaaaaatcaactatgggattcggttttaccatcattggcggagatagaccagatgaattcctccaggtgaagaatgtgctgaaagacgggcctgccgctcaggacgggaaaattgcccctggcgacgtcatcgtggacatcaatggaaattgtgttctggggcatacccatgcagatgtggttcagatgtttcagttggtccccgtgaaccagtatgtaaacctaacactgtgccggggttatcctctgcctgacgattctgaggaccctgtcgttgacatcgttgccgctacgcctgtgattaacggtcagagcctcactaaaggtgaaacctgcatgaacccgcaggactttaagcctggagcgatggtacttgagcagaacggcaaatctgggcataccctaactggagatgggttgaacggaccaagtgatgcatccgaacaaagagtttccatggcttcaagtggctcctcgcagcctgaactagtgaccattccactgattaagggtcccaaggggttcgggtttgctatcgccgactctcccacgggccagaaggtgaagatgattctggattcccagtggtgtcaggggctgcagaagggtgacattataaaagaaatctaccaccagaacgtccaaaatctgacacatctccaggtggttgaagtgcttaaacaattccccgtgggcgcagatgtaccattacttatcctgagaggtgggccacccagcccaactaagactgcaaaaatgaaaaccgacaaaaaggagaacgccggatctctagaggccataaatgagccgataccacagccaatgccctttcctcccagcatcatacgcagcgggtctcctaagctcgatccaagcgaggtatacttaaagtcgaagactctatacgaggataaacctccaaatacaaaggatctcgatgttttcctcaggaaacaggagtcagggttcgggttccgggtgctggggggtgacggcccagatcagtctatctatatcggagccatcatcccactgggggctgcagagaaagatggacgactcagagcagccgatgaactcatgtgtatcgatggaatcccagttaaaggtaagtcccacaagcaggtcctggacctgatgacaacagctgcacgtaacgggcacgttttgctcactgtccggcgtaaaatcttctatggcgaaaagcagccagaagatgactcaagtcaggcattcatcagcacccaaaacggaagccccaggttaaatcgtgctgaggtgccagctcggccagctccccaagagccatacgacgtcgttttgcaacgcaaagagaatgaaggttttgggtttgttattttgaccagcaagaataagccaccccctggggttatccctcataagattggacgggtgatagagggctcacctgctgatcggtgtggaaaactgaaggtaggagaccatatctccgctgtaaacggtcagagtatagtggagctttctcatgataatatcgtgcagctaatcaaagatgcaggcgttaccgtgactttaactgtaattgctgaggaggagcatcacggaccgccaagcggtacaaatagtgccaggcagtctcctgccttacaacaccgtcctatgggacagtctcaggccaaccacattcccggagacagatccgctctcgagggggagattgggaaggatgtcagcacctcgtatcgccattcgtggtctgatcacaagcacctggcacagcccgataccgcggtcatctccgtcgtgggatcccgccacaaccaaaatctggggtgttaccccgtggaattggaaagaggccctaggggtttcggcttcagtttgagggggggaaaagagtacaatatgggcctgtttatattgagactcgccgaggatggccctgcaattaaggatggcaggatccacgtgggtgatcagatcgtggaaatcaatggagagccgacgcagggaatcacccacacacgtgcgattgagctgattcaggccggagggaataaggttctgctactgctgcgcccaggtactggtctgatacccgaccatgggctcgcaccatcgggcttgtgcagctacgttaagcctgagcaacactag

SEQ ID NO: 57494 - DNA, 3378 bp, Artificial Sequence
  Description of Artificial Sequence: Synthetic coding sequence
atgagtaaaactctcaagaaaaagaaacactggctttccaaagtccaggaatgcgcagtgtcttgggcagggccacccggagattttggggctgaaatacggggtggcgctgaacgaggtgagtttccctacctcggacgattgagggaggagcccggaggcggaacttgttgtgtggtcagtggcaaggctccatctccaggcgacgtactgttggaggtaaatgggacacctgtaagcggactgaccaatcgagataccttagcagtgattaggcactttcgcgaacctatccgactgaaaaccgtgaagccaggcaaagtcattaacaaggatctgcgtcattacctgtcactgcaatttcagaaaggttcaatcgatcacaagttgcagcaagtcataagggataatctatatctcaggaccattccctgcaccacgcgtgctccgagggatggcgaggttccgggagtcgactacaattttattagtgtcgagcagtttaaagccctggaggaatcaggagcgttgcttgagagcggaacatacgacgggaacttttatgggactcccaagccacccgctgaaccttcccccttccaacccgaccctgtggaccaagtgctgtttgataatgagtttgatgccgagtcccagaggaaacgaacaacctctgtatcaaagatggagaggatggatagcagcctgccggaagaggaagaggatgaggacaaggaggccattaatggctctggaaatgcagaaaaccgggaacgtcactccgagtcttctgactggatgaagacagttcccagctacaaccagaccaatagtagtatggatttcaggaactatatgatgcgcgacgaaaccctggaaccactccctaaaaattgggagatggcttacaccgacaccggcatgatctattttattgaccacaacaccaaaactacaacctggctcgacccacgtctttgcaagaaggccaaggctcctgaggactgcgaggatggcgagctgccctacggatgggagaaaatagaagaccctcagtatggtacatattacgttgaccacctgaatcagaagacacagtttgagaatccggtcgaagaagcaaaacgtaaaaaacagcttgggcaggtggagataggctcctccaaaccagacatggaaaaatcccactttacccgcgatcccagccagttgaaaggggtgctggtccgcgctagcctgaaaaaatccacgatgggcttcggattcacaattatcggtggagatagaccagacgaatttttgcaggtaaaaaatgtcctcaaagatggccctgctgcccaagacgggaaaatcgcacctggtgatgtaatcgtcgacataaacggtaattgcgttctcgggcatacacatgcagacgtggttcagatgtttcagctggttccagttaaccagtatgtgaacctaacactctgtagaggatacccgctgccagatgattctgaggatcccgtggtggatatcgttgctgccactccggtcattaacgggcagagcctgacgaagggagagacgtgcatgaatccccaggacttcaagccaggagcaatggtgctcgagcaaaacggaaagtcaggccacacgctcaccggagatggcctaaatggtccatctgacgcaagcgaacaaagagtgagcatggcaagtagtggttcatcacagccggaattagtcaccatccctctaataaaaggtcctaaaggctttggctttgctatcgcagactcaccaactggccagaaagttaaaatgatattagatagccagtggtgccagggattacaaaagggtgatattataaaggagatttaccaccagaatgtacagaatctcactcacttgcaggtcgtagaagtcttaaagcaattccccgtgggtgcggatgtgccactgctgatccttagaggaggacctcccagtcccaccaagacagctaagatgaaaaccgacaaaaaagagaacgccggatcattagaggctatcaatgagcctattccccagccaatgccatttccgccatccattattcggagcggctcccctaagctggacccatctgaggtgtatttgaagtcaaagactttgtatgaggataaaccgccaaacactaaggatctggatgttttccttaggaagcaggaatccggtttcggcttccgagtcctgggtggggacggacccgaccagagcatttacattggggcaattattcctctcggcgctgccgagaaagacggcaggcttcgcgctgcagacgagctgatgtgtattgatggcatacctgtgaaggggaagtctcacaagcaggttcttgacctgatgacaaccgccgcacgaaacggtcacgtgctgctgaccgtgcgcagaaagatattctatggggagaagcagcctgaagacgacagcagccaggccttcattagcacccagaacggctctccgagactgaatagagctgaggtgccagcaaggccagcgcctcaagagccttacgatgttgttctccagcgaaaggagaacgaaggcttcggttttgtaatcctcacctctaagaacaaaccaccaccgggagtgatccctcataaaatagggcgagtcatcgagggatcccctgcggatcgctgcggtaaactgaaagtaggcgatcacatttccgctgtgaacggccaaagtattgtggagctgagccatgacaatattgtccagcttataaaggatgcgggtgtgactgttacacttacagttattgccgaggaggagcatcacgggcctccttccgggaccaattctgctcgtcaaagccccgctctgcagcacagacctatgggccagtctcaagccaaccacatacccggagacagaagcgcgcttgaaggcgagattggaaaggatgtgtcaaccagctatcgccattcctggtctgatcataaacaccttgctcagcctgataccgctgtgattagtgtcgtcgggtctcgacacaaccaaaacctcgggtgctatcctgtcgagctagaacggggaccaaggggcttcggtttcagccttaggggagggaaagagtacaacatgggtctgtttatcctaaggttggcagaggacggcccagcgatcaaagacggccgaattcacgtaggagaccagatcgtggagattaatggggagccaactcaaggtatcactcacactagggccattgaactgatccaggcgggtgggaataaagttttgctgttgctaaggccagggaccggacttatccctgatcacggtctggcgccatctggcctgtgttcttacgtgaaacctgaacagcactag

SEQ ID NO: 57495 - DNA, 1230 bp, Artificial Sequence
  Description of Artificial Sequence: Synthetic coding sequence
atgggacagagtcaggccaaccatattcctggcgataggtcagctctggaaggcgagataggaaaggacgttagtacatcctataggcatagctggagcgatcataagcacttggcgcagcctgatacagcggtgatatcagtggtgggaagccgccacaatcagaacttgggttgttatccagtggagctcgagcggggtcccagaggcttcggattctccctccggggaggaaaagagtacaacatggggctgtttattctacgcttggccgaagacggcccagccataaaggatggaagaatacacgtgggagatcagatcgtcgaaattaatggcgaaccgacccaagggattactcacaccagagccatcgaactgatacaggccggaggcaataaggtgcttctcctattaagacctgggactggactgatacccgatcacggtgactgggatattaacaatccatcttcatccaacgttatttacgacgagcagagtcccctgcctccgtccagccacttcgcttcaatcttcgaagaatcccacgtacccgtgattgaggagagtctcagggtgcagatctgcgaaaaggccgaagaactgaaggacatcgtaccagagaagaaatctactctcaatgagaaccagccagaaattaagcaccaaagtctgctgcaaaagaatgtaagcaagagggatccccctagctcacacggacatagtaataagaaaaatttgcttaaggttgaaaacggtgtaacgcggaggggccgtagcgtgtctcctaaaaagcctgcttcacagcacagtgaggagcacttagataagatccccagccccctaaagaataatccaaaaaggcgccctcgcgatcagtctctttctccttccaagggcgaaaataagtcgtgtcaagtaagcactcgggcaggctcgggacaggatcaatgccgaaagagtcggggtcgttccgcctctccaaaaaagcagcagaagatcgaggggtcaaaggcgccttccaatgccgaagccaaactgcttgaaggcaagtccagaagaatagcagggtacacaggatccaacgctgaacaaatccccgacggcaaggaaaagagtgatgtaattaggaaggatgcaaaacagaaccaacttgagaaggctgagcaggggctccagagaaagaagtccaaagaatggctcaggaatttattccaccccaagtag

SEQ ID NO: 57496 - DNA, 1200 bp, Artificial Sequence
  Description of Artificial Sequence: Synthetic coding sequence
atgggtagtagtaggtgcgggccaggcgctcatcctgtgcacttgtggccccctcatttcgccttttctggacaccacccacgtgatctagggcctcacagcggcccagcactactcgtgagcctggccagtgaagtgcaagatctgcacctggcccagaggaaggaaatggcgtctggcttctccaaaggcccaacactgggcctgctaccggacgtgccttcgctgatggaaactctgtcatactcgtattgctatgtgggaattatgacaggtccgtttttcagataccggacatacctggactggctggaacagcctttccccggagcggtcccatccctcagacccctcctgcggcgtgcctggccggcaccgctgtttgggctgctgtttctgttgagtagccacctgttccccctcgaagccgtgcgagaagacgcattttacgctaggcctcttccggctaggctgttttatatgatccctgtttttttcgcctttcgtatgcggttttacgtagcatggatagctgctgagtgcgggtgcatcgcggcaggcttcggtgcctaccctgttgcggcaaaagcaagagcaggtggtgggcctaccttgcagtgtccaccgcctagttcccctgaaaaagctgcatctctcgaatatgactacgaaactattcggaatatcgattgctacagcaccgacttctgcgtacgcgtcagggatggcatgcgctattggaacatgactgtgcaatggtggctcgcccaatatatatataaatctgccccagccaggagctacgtcctgaggagtgcatggacaatgctgttaagcgcgtattggcacggactgcatcctgggtactacttgagttttctaactatacctctctgtctggcagcggagggcaggctggagtccgcacttagggggcgactgtctcccggaggacagaaagcctgggattgggtgcattggttcctgaagatgcgcgcttatgactatatgtgcatgggatttgtcctgctgtccttggcggataccctccggtactgggcctccatctacttttgcattcactttctggctctggccgcactgggcctgggtttagccttagggggtggttcgccgtccaggcggaaggctgcgtcccagcccacatcactcgcaccagagaagctgcgtgaggagtag

SEQ ID NO: 57497 - DNA, 1200 bp, Artificial Sequence
  Description of Artificial Sequence: Synthetic coding sequence
atggggtcctcacgatgcggtcccggagctcaccccgtccacctgtggccccctcactttgctttttctggacaccacccacgcgatttggggccacactctggacctgcgcttttggtttcgctggctagcgaggtgcaggacctgcacctggcccagcgtaaggaaatggcttccggctttagtaaaggacctacgctgggccttcttccggacgttccctcactgatggagacactcagctatagttattgctacgtgggcattatgactgggcctttcttccgttatcggacctatcttgactggctcgaacagccgttcccgggtgcagttccctcactccgccctctgctgcgcagagcgtggcccgctcctttgttcgggctgctgtttctactgagctcacatctctttccgctagaagccgtccgtgaggatgccttctatgccagacctctccctgccaggctgttttacatgattcctgtcttcttcgctttccgaatgagattctatgtggcctggatcgcagcagagtgcgggtgcattgcggcagggttcggtgcctatcctgtcgccgcaaaggcacgggctgggggaggacccaccctgcagtgcccacctccttcctcccccgagaaagctgcgtctctggagtacgactacgagaccattcggaatattgattgttacagtaccgatttctgcgtccgggtcagggacggcatgaggtactggaacatgactgttcaatggtggctcgcacagtatatttacaagagcgccccagctagatcctatgtactccgcagcgcctggacaatgctgttgagcgcatactggcacggcctccatcctggttactatctttcctttttgaccatcccactgtgcctggcagctgagggtcgcttggagagcgcactgcgagggaggctgtccccaggcggtcagaaggcatgggactgggttcattggttccttaaaatgagggcctatgactatatgtgcatgggcttcgtacttctgtctctcgctgatacactacggtactgggcctccatatatttttgtatccacttcctggctcttgctgccctgggtttaggtctggccctggggggaggctctcccagtcggagaaaggccgctagtcaacccacctccctggccccagagaagctgcgcgaagagtag

SEQ ID NO: 57498 - DNA, 1200 bp, Artificial Sequence
  Description of Artificial Sequence: Synthetic coding sequence
atgggctccagccgctgtgggccaggcgctcatcctgtgcatctgtggcccccacattttgccttcagcggtcaccaccctcgcgacctgggcccacactctggaccggctctgctggtgtccttagccagtgaggtccaggacctgcacctcgctcagaggaaggagatggcatcgggctttagcaaaggacccaccttggggctcttgcctgacgtaccttcgctgatggaaacgctgtcatattcgtactgctacgttggtatcatgacaggcccatttttccgatatagaacttatctggattggctggaacaacccttccctggtgcggtgcctagtcttagaccgctccttcggagggcctggcctgcccctctgtttggtcttctttttctgctgtcctcacacctgtttcccctcgaggcagtccgtgaagacgcgttttacgccagacctctcccagccaggctgttttatatgatacccgtcttcttcgcattccggatgcggttttacgtggcctggatcgccgctgagtgcggatgcatcgctgcaggtttcggcgcttatcccgtggccgctaaagcacgcgctgggggaggccctactctgcagtgcccgccaccttcctcacccgagaaagccgctagcttggaatacgactatgagacaattagaaacatcgactgctacagcaccgatttttgtgtgagagtacgggacggcatgcgttattggaacatgacagtgcagtggtggttggcccagtacatttacaaatcagcccctgcccgatcgtatgtgttaagaagcgcttggaccatgctgctcagtgcttattggcatggcctccatcctggttactatctctcctttcttacaatccccctctgcttggccgctgagggaagactagagtccgctctccggggtcgactgtccccgggagggcagaaagcttgggactgggtgcactggttcctaaagatgagagcatacgattatatgtgcatgggctttgtcctcctgtcccttgcagatacacttcgctactgggcatccatatatttctgcatccactttttggctctagccgcattgggattgggcttggcactcgggggagggagcccatctaggaggaaggcagcctcccagccaacctccctcgcccctgaaaaactacgggaagaatag

SEQ ID NO: 57499 - DNA, 1200 bp, Artificial Sequence
  Description of Artificial Sequence: Synthetic coding sequence
atgggcagttctagatgtggccctggagctcacccagttcacttgtggcccccacatttcgcattcagcggccaccacccccgtgatctgggtcctcattcagggcctgccctgctggtgagtttagccagcgaggtgcaggatttacatctggcccagaggaaggagatggcttcgggcttcagtaagggtcccaccctcggcctcctccccgatgtaccctcacttatggagaccctgagctactcttactgttatgtgggtattatgacaggccctttctttagatatcgcacctacctggattggctcgagcagccattccctggagccgtgccatccctacgtcccttgctcaggagagcttggcctgctcctcttttcggccttctttttttattatcatctcatctcttccctttggaagctgtgcgggaggatgccttttatgctaggcccctgcccgctagactgttttacatgatccccgtcttctttgctttcagaatgaggttttacgttgcctggatcgcagcggaatgtggctgtatagccgcagggttcggcgcttacccggtggcagccaaggcgcgagctggcggtggccctactctgcagtgtccacctccttcttcacccgaaaaagccgcaagcttggagtacgactacgagaccatcaggaacattgactgctactccacagatttttgcgtaagagtgcgcgacgggatgcggtactggaatatgaccgtgcaatggtggcttgctcaatatatctataagtcagctcctgccagaagttacgtactgcgctccgcttggaccatgctactgtcagcctattggcacggcttacacccaggatattatctgagctttctcaccatccctctctgtttggcagcagaaggcaggctggaatctgcactgaggggcaggctgtcgcctggcggacagaaggcatgggactgggtgcattggttcctaaaaatgcgggcttacgactatatgtgcatgggattcgtgctcctctctctcgccgacactctcagatattgggcgagtatctacttttgtatccattttctggcgctggccgctttagggttgggcctggctctgggcggaggatctccatctcggaggaaagccgcaagtcagccaacctctctggctcctgaaaagctccgggaggagtag

SEQ ID NO: 57500 - DNA, 1200 bp, Artificial Sequence
  Description of Artificial Sequence: Synthetic coding sequence
atgggctcctctaggtgcgggcctggagcccaccctgttcatttatggcctcctcacttcgcttttagcggtcatcatccgagagatctagggccacactctggccctgcccttttagtctcactggcctctgaggtgcaggacctgcacttggcccagcgaaaggaaatggccagcgggttctcgaaaggacccacgcttggcctactcccagacgtgccaagcttgatggagaccctcagctactcatactgctatgtcggcataatgacaggaccctttttccgttatcgaacctatctggattggctggagcagccctttccaggagccgtaccttcactgagaccccttctccgacgggcatggcctgccccattattcggactgctatttttgttgtcgtcccacctctttcccttagaagcagtcagggaggatgcgttctatgctcgtcccctccccgctaggctgttttatatgatccctgtctttttcgcgtttcggatgcgcttctatgtggcctggatcgcagctgaatgtggctgcattgcagccggttttggcgcatatcctgtggctgccaaagcccgagctgggggaggacccactctccagtgtcctccgcctagctcaccggaaaaggctgctagcctcgagtatgactacgagacaattcgcaatatcgactgttactccactgacttctgcgtccgcgtcagggatggtatgcgttactggaacatgaccgttcagtggtggctggcccagtacatttacaaatccgctcctgcacgtagttacgttttaaggtctgcgtggactatgctgctgtccgcctactggcacggtctgcacccgggttattatctgtcctttctgaccatcccactgtgtctggccgctgaagggagactagaatctgctcttagaggtcgtctgtccccgggaggtcaaaaggcttgggattgggtacactggttcctcaaaatgagggcatatgattatatgtgtatgggctttgtgctgctctctcttgcagatacactgaggtactgggcttccatctacttttgtatccattttctggctctggctgctctaggtctgggtctggccttgggaggcggatccccttcccgccgtaaagctgctagtcagcctacatcgttagcgcctgagaaactccgagaggaatag

SEQ ID NO: 57501 - DNA, 1200 bp, Artificial Sequence
  Description of Artificial Sequence: Synthetic coding sequence
atgggcagcagcaggtgcggtcctggcgctcatccagtccatctctggccaccacattttgctttctccggtcatcatcccagggacctcggaccacacagcgggcctgctctgctcgtgtcgctggcatctgaggtgcaggacctgcatctcgcccagcggaaggagatggccagcggcttcagcaaaggaccaacgctgggactactgccggacgtcccttctttaatggagacactgtcgtactcttactgttatgtaggtatcatgaccgggccatttttccgatataggacttatctggattggttggaacagccgttccccggtgccgtgccgtcgctacgccctctgctgaggagggcgtggcctgcacctctcttcggcctgctattcttgctgagctcccacctgtttcccctggaggcagtccgggaagacgctttctatgcacggcctttgcctgcaagacttttttatatgattcctgtattcttcgctttccgcatgcgtttttacgtagcctggattgcagctgaatgtgggtgcattgccgctggttttggcgcatacccagtggcagcaaaggcccgtgccggtgggggtcctactctccagtgtccccctccatcgagccccgaaaaggccgctagcctagagtacgattatgagaccattagaaacattgattgttatagcactgatttctgcgttagggtacgcgacgggatgcgctactggaacatgactgttcagtggtggctggctcaatacatatataagtccgcacctgctaggagttatgtgttacggtctgcctggactatgctcttgtcagcctattggcatgggctacatcctgggtactatttgtcttttctaactatacctctttgtttagcggcagaaggacggctggagtctgccctaagagggagactcagtccgggaggacagaaagcgtgggactgggtgcattggttcctcaaaatgcgagcctacgactacatgtgtatggggttcgtacttctctctctcgctgataccctaagatattgggcgagcatctacttttgcatccattttcttgctctggctgcactagggctcgggctagcgctcgggggtggttcaccctcaaggcgcaaagcagcttcgcaacccaccagcttagcgcctgaaaagctgcgggaggagtag

SEQ ID NO: 57502 - DNA, 1200 bp, Artificial Sequence
  Description of Artificial Sequence: Synthetic coding sequence
atgggatcctcacgatgcggtcccggtgcacaccctgtgcacctttggccacctcacttcgcttttagcgggcatcaccctcgtgatctgggaccccacagcggccctgccctcctggttagtctcgctagtgaagttcaagacctgcatctggcacagcgcaaggagatggcatcaggcttcagcaagggacccacactcggtctgctcccagatgtcccttctctcatggaaacgctgtcatacagctattgctatgtgggcattatgaccggacccttcttcagataccggacctacctggactggctggaacagccctttccaggggctgtgccgtctctgaggccgctgctaaggagggcctggcctgcacctctatttggcctgctcttcctcctgagttctcaccttttcccactcgaagcagtaagggaagatgctttctacgcacgaccgttacccgctaggcttttttacatgataccagtgttcttcgcctttaggatgagattctatgttgcttggattgctgccgaatgtggttgcatagccgctgggttcggggcttacccagttgctgccaaggccagggccggtgggggaccaacgctccagtgccccccaccgtcaagccccgagaaagctgcttcactggagtatgattacgagaccatccgaaacatcgactgctattccaccgacttctgtgtgcgtgttcgcgatgggatgagatattggaatatgacggttcagtggtggctggcccaatatatttacaaaagtgcgcctgccaggtcctacgtgcttcggtcggcctggactatgcttttaagcgcctactggcacggcctgcatcctggctactacctatcattcctcaccattccactgtgcctggcagccgagggcagactcgaatcagcattaagaggaaggctcagtcccggtggacagaaagcttgggactgggtgcattggttcctcaaaatgcgggcttatgactatatgtgcatgggatttgtcctcctatcattagccgacactttgagatactgggcctctatctacttctgcatccacttcctggctttggcagcactggggttgggactggctctggggggtggatccccctcacgcagaaaggccgcttcccagcccacctccctagctcccgagaagctacgggaggagtag

SEQ ID NO: 57503 - DNA, 1200 bp, Artificial Sequence
  Description of Artificial Sequence: Synthetic coding sequence
atgggatccagcaggtgtggccctggggcacatcccgtccacttatggccgccacatttcgcgttcagcggacatcatcctcgagaccttggtccacactctgggcctgccctgctggtctctctggccagcgaagtgcaggatcttcatttggcccaacgtaaggaaatggccagcggcttttccaaagggccaaccctgggcctgctaccagacgtgcctagcttaatggaaactctgtcctactcctattgttacgttgggataatgacgggcccattcttccgctatagaacttatcttgactggctggagcagcctttcccaggcgctgtcccatctctgcggcctctgctgagacgtgcttggcccgctcccctcttcggccttctgttcctgctctcttcgcacctgtttccccttgaagccgttcgggaagacgccttttatgctaggcctcttcccgcacgtctcttttatatgatcccagttttcttcgcttttcgcatgagattttacgtggcttggattgctgccgagtgcggttgcattgcagccggtttcggcgcttatcccgtggctgctaaggcgagagcaggagggggtccaactctgcagtgtcctcccccatcaagccccgagaaggcagcttctctcgaatatgactatgaaactatacggaacattgattgttactctacagatttttgcgtgagagtccgggacggaatgcgttactggaacatgaccgtgcaatggtggttggcccagtatatctacaaaagcgcccctgccaggagctacgtactgcggagcgcctggacaatgctcctgtctgcttactggcatggactgcaccctggctactatctgagttttctgaccatccccctgtgtctagctgctgaaggccgtctcgagtcggcactacgaggcaggctctctcctggaggccaaaaggcatgggactgggtgcattggtttctgaagatgcgggcatacgactatatgtgtatgggctttgtgctgctgtccctggctgataccctgcggtattgggcttcgatctacttctgtattcactttttggcactggctgccttagggcttggtcttgctctgggcggtggctctcccagccggagaaaagctgccagtcagcccacgtcgctggcaccggaaaaactcagagaggagtag

SEQ ID NO: 57504 - DNA, 1200 bp, Artificial Sequence
  Description of Artificial Sequence: Synthetic coding sequence
atgggttcatcccggtgcggtcccggagcgcatccagtacatctgtggccccctcacttcgccttctccggccatcacccacgcgatttgggtcctcacagcgggccagcactgctcgtgtccctggcatctgaagtgcaggatctgcatctggcacaaaggaaagagatggcatccggttttagtaagggaccgacactaggattgctccccgatgttccatctctcatggaaacattatcctactcctattgttatgtcggaattatgactggaccattctttcgctatagaacttacctggattggctggaacagcccttccctggcgcagtgcctagcttgaggcccctgttgcggagagcatggccagccccactgtttgggcttttattcctgttgtcttcacatctattcccattggaggccgtgcgcgaagacgcattctatgccagacctttaccggctagattattctacatgattccagtttttttcgcattcagaatgcggttctatgtcgcgtggatagccgcagaatgcgggtgcatagcggcaggttttggggcttatcctgttgctgcgaaggcccgagctgggggtggcccaactctacagtgcccccctccctcctcaccggagaaggcggctagcctcgagtatgattacgaaacaatcagaaacatcgattgttattctactgatttctgtgtaagggttcgcgacggcatgagatactggaacatgaccgttcagtggtggctcgcacagtacatttacaagtctgctcctgctcgcagctacgtccttcgaagcgcctggacgatgttactgagtgcctactggcatggattgcatcccggttattacttatcgttcttaacgatacctctgtgtcttgccgctgagggacgccttgaatctgctcttagaggccgattatccccaggaggacagaaagcctgggattgggtgcactggtttttgaagatgcgtgcctacgattacatgtgcatggggtttgtgttactttctctggccgacacacttaggtattgggcatctatctatttctgcatccacttcctggcgttggctgccctaggtctgggactggcattgggaggaggaagccccagtcggcgaaaggcagcctcccaacccacttcccttgctcccgagaagctgcgagaggagtag

SEQ ID NO: 57505 - DNA, 1200 bp, Artificial Sequence
  Description of Artificial Sequence: Synthetic coding sequence
atggggtcctcccgctgcggacccggagctcatcctgttcacctctggccaccacattttgccttcagcgggcaccatcctcgtgatctaggaccgcatagtgggccagctcttctggtttccctcgcctcggaagttcaagatctccacctagcccaacgcaaagagatggccagcggcttctcaaagggcccaaccctgggcctgttgccagacgtgcccagtctcatggaaactctctcatacagctattgttacgttggtattatgactggtcctttctttcgctaccgaacttacctggactggctggaacaaccttttcctggagccgtgcccagcctgagacctctcctcagacgagcctggcccgcacccctctttggcctgctcttcctcctgtctagtcacttattcccccttgaggctgtgcgggaagatgcgttctacgctaggcccttgccggctcgcctcttctacatgataccagtttttttcgccttcagaatgagattctacgtggcctggattgccgcagagtgtgggtgtatcgctgctggattcggcgcttatccggtggcagcgaaagcaagagccggaggcggaccaactcttcaatgtcctccaccctcctctcccgagaaagcggcttcccttgaatatgactatgaaactataagaaatatagactgttactctaccgacttctgcgtccgtgtgcgcgatggtatgaggtattggaatatgacagtacagtggtggctcgcccagtatatatacaaaagcgctccagcccgttcctacgtactccgttctgcgtggacaatgctgctgagcgcatactggcacggcctacatccagggtattacctgagctttctgaccatccccctttgtctcgcagctgaaggcagactggagtctgctctccggggacgcctatctccaggcggtcaaaaggcctgggactgggttcactggttcttaaagatgagggcatacgattacatgtgtatggggttcgtgctgctctcactggctgacacactccgatactgggccagcatttacttttgcatacacttcctcgcccttgccgctttggggctgggattggccttgggcggagggagcccatcaagacggaaggcagctagccaaccaacttcgctcgcaccagagaaactgagagaggagtag

SEQ ID NO: 57506 - DNA, 1200 bp, Artificial Sequence
  Description of Artificial Sequence: Synthetic coding sequence
atggggtccagccgttgtgggccaggggcacaccctgttcatctttggccaccacacttcgcctttagcgggcatcaccccagagacctggggcctcatagtggacctgcattgctggtcagcctggccagtgaggtgcaggaccttcatctggcccagcggaaggagatggcctcaggcttttctaagggaccaacactcggtctcctaccagacgttccctcactgatggagacactgagctactcctattgttatgttggcataatgactgggccattttttcgctaccggacatacctcgattggttggagcagcctttcccaggtgcagtgcccagcctccgcccacttctgcgccgtgcctggcccgctcccctctttggcctactctttctgctgtcctctcacctgtttccactggaggcagtgagagaagacgcattttacgctaggcccttgcctgcaagactgttctacatgattcccgtgtttttcgcgtttcggatgaggttctatgtggcttggatcgctgctgagtgtggctgcattgccgctgggtttggcgcttaccccgtggccgctaaagcgcgagctggaggaggcccaaccctccagtgcccgccaccatcttctcccgaaaaagcagcctcactggagtacgactatgaaaccatcagaaacatcgattgctattccacagatttctgtgtgcgcgtccgtgacgggatgcgctactggaacatgactgtccaatggtggcttgcacagtacatctataagagcgcgccagccaggagctatgttctgcgcagcgcttggacgatgctgttgagtgcctactggcacggcctccaccctgggtactacctgtccttcctgaccatacccctgtgcctggccgctgaaggtaggctggagtcggctctgcggggtcgcttatcccccggaggccaaaaagcttgggattgggtgcactggtttctgaagatgcgggcatatgattatatgtgtatgggattcgttttgttgtccctcgcagacactcttcggtattgggcatcaatctacttctgcattcatttcctcgctctcgccgctcttggactgggtctggccctgggaggaggcagcccatctaggcggaaagccgctagtcagccaaccagcctcgccccagagaagctccgtgaggaatag

SEQ ID NO: 57507 - DNA, 1200 bp, Artificial Sequence
  Description of Artificial Sequence: Synthetic coding sequence
atgggaagtagtcgatgcggtcccggagcccatccggtgcacctatggcccccacacttcgctttctcggggcaccacccacgagacctaggccctcactcaggaccagctctccttgtgagcctggcatccgaagttcaggacctgcatttggcacagaggaaggaaatggcatcgggcttttctaaagggccaaccctggggctgttaccggacgtgcccagtctcatggagacactgtcttactcctactgctacgtgggaattatgactggtccctttttccggtatcgaacttatttagactggctggaacaacctttcccaggagcggtgccaagtttgcggcctctcctgaggagagcctggcccgctcctctgtttggtctactgttcctgctatccagtcatctgttcccactggaggctgtccgggaggacgccttctacgccaggccactgcccgctagattgttctacatgatccccgttttcttcgctttcagaatgcgcttctatgtggcctggattgcagctgagtgtggctgtatcgcggctggattcggtgcctatccagtagcggcaaaagctcgcgcaggtggagggccaacacttcaatgcccacctcctagtagcccggagaaggccgctagccttgagtacgattatgaaactatccgcaacatcgactgttactcgacagacttttgcgtaagggttagagatgggatgcgatattggaacatgaccgtgcagtggtggctggcacagtatatctacaagagcgccccagcacgcagctacgttcttcgatctgcgtggaccatgctgttatccgcgtattggcatgggctgcaccctggttattacttgtccttcttgaccatccccctgtgcctcgccgcagagggccgtctcgaatctgcacttaggggcaggctgtcacctggtggccagaaggcatgggactgggtgcactggttcctcaaaatgcgcgcatatgattacatgtgcatgggcttcgtactgctgagtctggctgacaccctgcgttactgggcctccatctatttttgcattcatttcctagctctcgccgcattgggattgggcttagcccttggcggtggcagtccatccagacggaaggccgcttcccagccaacctccttggcccctgagaagctgagagaagagtag

SEQ ID NO: 57508 - DNA, 876 bp, Artificial Sequence
  Description of Artificial Sequence: Synthetic coding sequence
atgtcaatgcctttgcaccagatttcagccatcccttcccaagacgcgatttcagccagggtgtaccgtagtaaaactaaggagaaagaacgcgaagagcagaacgaaaagacgctgggccatttcatgtcccacagctccaatatctccaaggcgggatctcccccttcggccagcgccccagccccagtgtcctcattctctcgaacttctattactccatcatcccaagatatctgcagaatctgtcattgtgaaggcgatgacgagtccccactgatcacgccgtgccactgcacaggatcattgcattttgtccaccaggcttgcctccaacagtggattaaaagcagcgacacgcgctgctgcgaactgtgcaagtatgaatttatcatggagaccaaattgaaaccactccggaaatgggaaaagctgcaaatgacgagctctgagcgtcgtaaaatcatgtgttccgtgacattccacgtgattgctatcacctgcgtggtatggtcactgtatgtccttattgatcggactgccgaggagatcaaacagggacaggccaccgggatcttggagtggcctttttggacgaaactcgtcgtcgttgccatcggttttaccgggggtctgctctttatgtatgtgcagtgcaaggtctatgttcagttgtggaagcggctgaaagcctacaacagggttatttatgtgcaaaattgtccagaaacctccaaaaaaaatattttcgaaaagtcccctctgaccgaaccaaattttgaaaataagcatggatatggaatctgccactctgataccaactcttcctgttgtactgagccggaagatactggtgccgaaatcattcatgtctag

SEQ ID NO: 57509 - DNA, 1089 bp, Artificial Sequence
  Description of Artificial Sequence: Synthetic coding sequence
atggccagcggctcagctggaaagcccacgggggaagctgctagtcctgcccctgcgtccgcgatcggaggcgcaagtagccagccgagaaagagactagtctctgtctgcgaccattgcaagggcaaaatgcaattggttgccgacctcttgctgcttagcagcgaggcccgaccagtgttatttgaaggtccagcctcctccggggcaggcgcagagagttttgagcagtgcagggacacgattatcgctcgcacaaaaggtcttagcattctgacgcacgatgtacagagccagttgaacatgggtaggttcggcgaagctggggacagcctagtcgagttgggtgatctggtggtgagcctcactgagtgctcagctcatgccgcttacttggcagccgtggctacccctggcgctcagccagctcagcccggacttgtagatcggtaccgcgtcacccgttgtcgacatgaggtggagcaaggttgtgccgtcttaagagcaacccccctagccgatatgacacctcagttgctcctagaggtttcacaaggcttaagcaggaatctgaagtttctaacagatgcgtgtgcgctggcatccgacaaaagcagagatcgcttctctcgcgaacagtttaaactgggtgtgaagtgtatgagcacctctgcatccgctctcctggcctgcgtgcgggaggtaaaggtggcaccttccgagttggcccgatcacgctgcgcactgttcagcgggcctcttgtccaggccgtgagcgccttggtgggttttgctactgaacctcagttcctgggcagggctgccgctgtgtccgcagagggcaaggctgtgcagaccgcaattcttggcggagctatgtctgttgtgtcagcgtgcgtcttactcacccagtgtctgagagatctcgcacagcatcctgatggaggagccaaaatgagtgatcaccgggaacggttaagaaatagtgcctgcgctgtctcagagggatgtacgctcctgtctcaggcactccgggagcgctcatcgccacgtactcttcctcccgtcaactcaaattcggtgaactag

SEQ ID NO: 57510 - DNA, 879 bp, Artificial Sequence
  Description of Artificial Sequence: Synthetic coding sequence
atgagggagtggtgggttcaggtcgggttattggcggtgcccttgctggccgcatatctccacatccccccaccccagcttagccctgccctccactcctggaaatcctcaggaaagttcttcacctataaagggctgagaattttttatcaggatagcgtgggcgtagtcgggtctcccgagatagtggtgctgcttcatggatttcctaccagttcctacgattggtacaaaatttgggaagggttgacactgcgattccaccgggtcattgcactagacttccttgggttcggattctctgataaaccaagaccacatcattactctatcttcgaacaggcttcgatagtcgaggccctgttacgccacctaggcttgcagaatagaaggatcaatttgctctctcacgactatggcgacatcgtggcccaggaactgctgtacaggtataagcagaaccgcagtggcaggctgaccataaagtctctttgtctttcaaacggaggaattttcccggagactcatagaccactgctgctccagaagctcctcaaagacggaggagtgctgtctccaatactgactaggctgatgaattttttcgtgttcagtagggggctcctacagtatatcaatcagagaaagaagtttaggagacggtgggtaggtgcccttgcctccgtcactattccaatccacttcatctacgggccactggatccagtaaatccctacccagaattccttgaactgtatcgtaagacactgcccaggtccactgtcagcattctcgacgaccatatttcacattaccctcagctggaggacccaatgggctttctgaatgcctatatgggctttattaatagcttttag

SEQ ID NO: 57511 - DNA, 981 bp, Artificial Sequence
  Description of Artificial Sequence: Synthetic coding sequence
atgcgcgagtggtgggtgcaggtggggctcctagctgtaccccttctggcagcctacctccacattcccccaccccagttatctccggcactccatagctggaagtcttccggaaagttttttacttacaaaggcctgcgaatcttctaccaggacagcgtgggtgtagttggatctccagaaatagtggtgcttctacacgggtttccaacatcttcctacgactggtacaaaatctgggaaggcttaacactgagatttcacagagtgatcgctcttgacttcctagggttcggtttttctgataaacccagacctcatcactacagcatctttgaacaggcctccattgtggaggctcttcttcgacacctgggtctgcaaaacaggagaattaatctgcttagccacgactacggcgacatcgtggcccaagaacttctctacaggtataaacagaacaggtcaggcagattaactataaagtctctgtgcctctccaacggcggtatatttccggaaactcacaggcctctgctgctacagaaactcttaaaagacggcggtgtgcttagccccattttgactaggcttatgaatttctttgtctttagtcgcggactgactccggtattcggaccctataccagacccagcgaatccgagctgtgggatatgtgggcaggcatacgaaacaacgatggcaacctggtcatagacagcctgcttcagtacatcaatcagcgaaagaaatttcgtcgtaggtgggtcggagccctggcctcagtcacaatccctattcattttatctatggaccactcgaccctgtgaacccttatcccgagttcctagaactttacaggaagacactgcccagatccacagtgagcatccttgatgaccatatcagccattaccctcaactggaggatcctatgggcttcctgaatgcctatatgggttttatcaattcattttag

SEQ ID NO: 57512 - DNA, 879 bp, Artificial Sequence
  Description of Artificial Sequence: Synthetic coding sequence
atgagagaatggtgggtacaagtggggcttttagccgtccctcttttggcagcttatctgcacatcccgccaccacagctaagccctgccctccactcttggaaatcctcgggcaaattcttcacctataagggactacgcatattttaccaggattcagtgggagttgttggaagccctgagatcgtggtgttgctacatggcttccccacatcttcgtacgactggtacaagatatgggagggactaacacttagatttcatcgagttatcgccttggactttctggggttcggcttttcggacaaacccagaccacatcattacagcatattcgaacaagcttctatcgtggaagctttgttgcgacatctcggcctccagaacaggagaatcaatttattgagccatgactacggtgacattgtggcccaggagctcctctaccgatacaagcagaataggtccggaagactgaccattaagtccctctgtctgagcaacgggggtattttccctgagacccaccgtcccctgctgctccaaaaactactgaaagacgggggagttcttagcccaattttaacccgactaatgaattttttcgtctttagtcgcggactgttgcagtatataaaccagaggaagaagttccgaagaagatgggtgggagccctggcaagcgtgactattccaatccacttcatctatgggcctttagatcccgtgaatccgtacccagaattcctcgagttgtatagaaagaccctgccccgtagtacagtgtcaattttggacgaccacatttcacattacccgcagttagaagatcccatgggttttctgaatgcatacatgggctttatcaacagtttttag

SEQ ID NO: 57513 - DNA, 981 bp, Artificial Sequence
  Description of Artificial Sequence: Synthetic coding sequence
atgcgagagtggtgggtccaggtgggactcttagccgtgccactgcttgccgcatacctccacatcccccctccgcagctgagcccagcattgcattcatggaaatctagtggcaaattttttacatataagggcttgagaatcttttatcaggactcagttggcgtagtgggaagcccggagatcgtcgtactgctccacggcttcccaacatccagttatgactggtacaagatttgggaggggttgacccttcgatttcacagggttatcgctctagactttctggggttcggattctcagataaacccagaccacaccactactccatattcgagcaggcatccatcgtggaagcactgctcaggcacctcgggctgcagaatcgtcggattaacctcctgtctcacgattacggggatatcgtggcccaggagctgttataccgttataaacagaacaggagtggtcggctcaccataaaatccctttgtctctcaaatggagggatctttcccgaaactcacagacctcttctgctacagaaacttctgaaggacggcggtgtgctgtctccgatcctaactcgtcttatgaacttcttcgtgttcagcagggggcttacacccgtgttcggtccctataccaggccctcggagtccgagctgtgggacatgtgggccggaatccgtaacaatgacggaaacctggtgattgattcccttcttcagtatatcaatcaaagaaagaagtttcgaagacgctgggtgggagcgctggcatctgtgacaatcccgattcatttcatttacggaccgttggaccctgtcaatccatatccagagttcctcgaattgtacagaaagaccctgcctcggtcaaccgtgagtatactcgatgaccatatttcccactatcctcagctggaagatcctatgggcttcctgaatgcttacatgggctttataaattctttttag

SEQ ID NO: 57514 - DNA, 801 bp, Artificial Sequence
  Description of Artificial Sequence: Synthetic coding sequence
atgaggaccgagcctctgtgcggtgcttcacccttgctggttcccggtgacccttacagtgtggtggttttactgcagggatatgccgaaccggagggagtgggcgacgcggttcgggctgatgggtccgttaccctcgtcctgccccagacacgcggacctgctagctcacaccgcgagagcccacggggatccgggggtgctgaagccgcactcgaagaggcagctaggggcccaatcctggttgacaccggcggtccttgggcaagggaggccttgcttggagcgctggcaggccagggcgtggcccctggcgatgtcaccctcgtggtgggtacccacggacacagcgatcacatcggaaatcttgggttgttcccaggggctgctctgctggtgtctcacgatttttgtctcccaggaggcagatatctgccacatgggctcggagaggggcaacccctgcgactcgggcctggcttagaagtgtgggctacaccgggtcatggcggacagcgcgatgtcagtgttgtggtggccggtaccgcgcttggaactgtggttgtcgctggggatgtgtttgagcgggacggagacgaggattcatggcaggctctatctgaagatcctgccgctcaggaacggtcgagaaagagagtacttgtggtggccgatgtagttgtcccaggacatggccctccttttcgggtcttgcgggaagccagccaacctgagaccgaagggggaggtaacagccagcaagagcccgtcgtaggtgacgaagaaccggctctgcactag

SEQ ID NO: 57515 - DNA, 342 bp, Artificial Sequence
  Description of Artificial Sequence: Synthetic coding sequence
atgaggacggaacctctgtgtggtgcaagccccctcctggtaccgggtgacccatatagcgtggttgtgctacttcagggatatgctgaaccagagggtgttggcgatgctgtgagggctgacggctcagtcaccttggtgctgcctcagactcgagggccagctagctcacaccgggaaagcccccgtggctctggaggcgctgaagctgcacttgaggaggcagctcggggacccatcctggttgacacaggtggcccttgggctagggaggccctgctgggtgcgcttgccggtcagggcgtagcaccgggtgacgtaaccctcgtggtgggaacatag

SEQ ID NO: 57516 - DNA, 840 bp, Artificial Sequence
  Description of Artificial Sequence: Synthetic coding sequence
atgtcagccctggagtggtatgcccacaaaagcctgggagacggtattttttggattcaggagcgcttctacgaaagtggtaatcgggctaacatctggttggtccgtggaagcgaacaggatgtggtgatcgacacaggcctcgggctgcgctcgctgccagaatacttgtatagttcgggtctcttacaggatcgtgaagccaaagaagatgctgccaggcggcctctgctggcagtggccacccatgtacacttcgatcacagtggcggtctgtatcagtttgatagagtagctgttcatcatgcagaagccgaggcccttgccaggggcgataattttgagaccgtaacctggctttcggatagcgaggtggtgcgaacaccttccccaggctggcgggctcgtcagtttcgtgtgcaggctgtccagccaacactgattctccaagatggagacgtgatcaacttgggggacaggcagctgaccgtgatgcacatgccagggcattccagaggcagtatatgcctgcacgacaaggataggaaaatcctgttcagcggagatgtggtgtatgacggctcactcatcgactggctgccgtactcaaggatcagcgactatgttggcacatgtgagcggcttattgagctcgtggaccgcggactggtggagaaagtgctgcccggacacttcaacacttttggggctgagcgtcttttccgactcgcatctaactatatctccaaagcagggatttgccacaaggtgagtaccttcgctatgaggtcgctggcctcattggcccttcgggtcactaattcccggaccagtccttag

SEQ ID NO: 57517 - DNA, 600 bp, Artificial Sequence
  Description of Artificial Sequence: Synthetic coding sequence
atgagcgctcttgaatggtacgcccataagtcactgggtgacgggatattttggattcaagagagattttacgagtctggcaatcgggctaatatttggctggtgagaggctctgagcaggacgtcgtgatcgacactggtttaggtctcaggtcgctcccagagtatctttattcaagcgggctgttgcaagatcgtgaagccaaagaggatgccgctagacgcccactgttggcagtcgccacacacgtccacttcgaccactcaggcggactgtaccagttcgacagagtcgctgtgcatcacgccgaggccgaagccttagccaggggcgacaacttcgagactgtaacgtggcttagtgatagcgaggtggtgaggactccgtctcccggttggcgggctcggcagtttcgagttcaggcggtgcaacctacgcttatcctgcaggatggcaatggccctccccgtgctagagcacttgtgaaggggggttactgggaagaaaccgtgagggttccccacgttgcggacttgcgtggacataagggcgactatttcggaacctcacagagtcacttttgcttcacgctgccttag

SEQ ID NO: 57518 - DNA, 630 bp, Artificial Sequence
  Description of Artificial Sequence: Synthetic coding sequence
atggccgctaggaggcctctgctggctgtggctactcatgtccactttgaccatagtgggggtttgtaccagttcgatcgggtcgccgtccaccacgcagaggcagaggcattggccagaggtgacaatttcgaaacagtcacatggttgtccgatagcgaagtcgtcagaacacccagtcccggatggagagctagacagttccgtgtccaagccgtgcaaccgacccttatcctccaagatggcgacgttattaatctgggtgaccggcaattgaccgtgatgcacatgcccggtcactccagagggagtatctgtctgcacgacaaagatagaaaaattctctttagcggtgatgtggtgtacgacggcagtctgatagactggctgccatacagccgcatctcagattacgtgggtacttgcgagcgcctcatcgaactcgtggacaggggtttggttgagaaagtgttgcccggtcactttaacacgttcggagctgagaggctgttccgactagccagcaattacatctctaaggctggaatctgccataaagtgagcaccttcgctatgcgctccctggccagcctggcattacgtgtgacaaattcccgcacaagcccgtag

SEQ ID NO: 57519 - DNA, 840 bp, Artificial Sequence
  Description of Artificial Sequence: Synthetic coding sequence
atgtcagctctggaatggtatgcccataaatcgctgggcgatggaattttctggatacaggagagattttacgagtccggaaaccgagccaacatctggttagttagaggctcggagcaggacgtcgtgattgatacagggctcggccttcgctccctgccggagtatttatactcatccgggcttctgcaggatagggaggcaaaggaggatgcagctagaaggcccctgcttgcggtagctactcacgtccacttcgatcattctgggggattgtaccaattcgaccgcgtggcagttcaccacgccgaggccgaggcactggcgcgtggcgataatttcgaaacggtgacctggttaagcgatagtgaagttgtccgcacccccagtcctggctggcgcgctaggcagttccgcgtgcaagcagtgcagcccacattaattttgcaggacggtgacgttatcaacctgggagacagacagctgactgtgatgcacatgcctggtcacagccgtggatccatctgcttgcatgataaggaccgcaagatattgtttagcggagacgtcgtttatgatggcagtctaattgactggcttccatattctcgaatatcagactacgtgggaacgtgtgaaagattgatcgaactggttgacaggggcctggtcgaaaaagtgctgccgggtcatttcaacaccttcggcgctgagcggctcttcaggctcgctagcaactatatcagtaaggccggtatttgtcacaaagtcagcacctttgcgatgaggagcttggcatctttggcgctgagggtgactaatagtcgaacgagcccctag

SEQ ID NO: 57520 - DNA, 153 bp, Artificial Sequence
  Description of Artificial Sequence: Synthetic coding sequence
agctgcacatacgcttccttttgtaagtgcaaggagtacaagtgcacctcttgtaaaaagaattgttgtagctgctatcccgtcggttgcgctaagtgcgcccagggctgtatctgcaaaggagctagcgacaagtgttcatgctgtgcttag

SEQ ID NO: 57521 - DNA, 123 bp, Artificial Sequence
  Description of Artificial Sequence: Synthetic coding sequence
atggaccctaactattcatgcactacaggtggaagttgtacatgtgcaggcagctgcaaatgtaaagaatgcaaatgcacaagctgtaagaaatcctgctgtttctgctgtccaatgggctag

SEQ ID NO: 57522 - DNA, 186 bp, Artificial Sequence
  Description of Artificial Sequence: Synthetic coding sequence
atggatcctaattgcagctgcactaccggggtgagctgcgcatgtaccgggtcttgtacatgtaaagagtgcaaatgtaccagctgcaaaaagtcttgctgttcctgctgtccagtggggtgcgcaaagtgcgcacatggctgcgtctgcaaggggaccctggagaactgctcttgttgtgcttag

SEQ ID NO: 57523 - DNA, 879 bp, Artificial Sequence
  Description of Artificial Sequence: Synthetic coding sequence
atggagacagcagagaaagaatgtggcgcactcgggggactgtttcaggccatcgtgaatgacatgaaaagctcttaccccatttgggaggacttcaatagcaaggccacaaaactacactcccagctgaggaccaccgtgctcgccgctgttgccttcctagacgccttccagaaagtggccgacatggcaaccaacacacgcggtgccaccagggacatcggctccgccttgaccagaatgtgtatgagacatcggtccatagagactaaactccgccagttcactaacgctttgctggagtcacttataaaccccctgcaggaacgtatcgaagactggaagaaggccgctaatcagctggacaaagaccacgcaaaggaatacaagagagcgaggcacgaaatcaaaaagaaatcttcagacactctgaagcttcaaaagaaggcccgaaagggaaagggtgatctgcaaccccaactggatagtgccctccaggacgttaatgatatgtatctcttgctagaggagaccgagaagcaggcagtgagacgggctctgatcgaagagaggggacgtttctgtacctttattacattcctgcaacccgtggttaacggcgagctgaccatgctcggcgagatcacccatctgcagggaatcattgacgacctcgtcgtgctaaccgccgagccgcataagctgccccctgcctcagaacaagtgatcaaagatctaaagggctcagattattcatggagctaccaaacaccacccccttctgtacccagcgagccatttgtctcctttctgtctgttcgcttttggaagaactcacccctccttcccgctccttctaccccatctagtccaatatag

SEQ ID NO: 57524 - DNA, 2244 bp, Artificial Sequence
  Description of Artificial Sequence: Synthetic coding sequence
atggagactgccgagaaagaatgcggggctctcggtggcttgtttcaggcaatcgttaatgacatgaagtcaagctatccaatctgggaggacttcaattcaaaagcgacaaagttgcattcacagctccggacaacggttttagctgcggtggcgttcctggatgcatttcagaaagtcgctgacatggccactaataccaggggcgctacccgggacatcggatccgcgctgacccgcatgtgtatgaggcataggagcattgagactaaactgagacagtttactaacgctctgctggagagtttgattaatcctctccaggaaaggattgaggactggaagaaagctgcgaaccagctggacaaggatcacgctaaagaatataagcgggcacggcacgagatcaagaagaagtctagtgatacacttaaactgcagaaaaaagcgcgaaaggaactgctgggtaagggagatcttcagccccagctggacagcgctctgcaagatgttaacgacatgtacttgctcctggaggaaacagaaaaacaggctgttaggcgcgctctcattgaagagagagggagattctgcacgttcattactttcttgcaaccagtcgtgaacggggagctgaccatgctgggcgagatcacgcatctacagggaattatcgatgacttagtggtactcacagcagagcctcacaagctgccccctgcatctgagcaggtgataaaggacctcaaggggagcgactactcctggagttaccaaacacccccatcctccccaagctcctcctctagccgcaagtcatccatgtgcagtgcacccagctcgtctagctctgcgaagggtggaggagctccatggcccggtggcgctcagacttacagcccctcatccacctgtcgctatagatctcttgcgcaacccgcaaccactacggccaggctgagttccgtcagtagccacgacagcgggtttgtcagccaggacgctacctattctaaaccaccctcccctatgccctccgacatcaccagccagaaaagctcgtccagcgccagttccgaggcctccgagacttgccaaagcgtctcggaatgctcttcccccacctcagactggtcaaaggttggtagccacgaacagccttctggagcaactctgcaacggcgaaaggatcgcgttgagcttctgcgcgacactgaaccaggacccgcttcagggggtactctggggcctagcggggaggaggcccctagaccacgaatgtcacctgctaccatcgccgctaagcatggggaggaggtgtctcccgctgcgtctgatctggctatggttctcactcggggactctctctggaacaccagaagagttctcgcgactccctgcagtactcgtccggttattctactcagacaacgaccccaagttgcagtgaagataccatcccgtcacagggaagtgactatgactgctattccgtgaacggggatgcagactctgaggggcctccagagtttgataagtcctctaccattccacgtaatagcaacattgcccaaaactaccggcgtctgattcagactaagcggcctgcatcaaccgccggtcttccgactgcaggtctgcctaccgctaccggactacctagcggtgcccctcccggagttgctacgataaggcgtacgcccagcactaagcccactgtacgtagagccctgtcttccgccggtcccattcctatcagacctcctatcgttcctgtaaagacaccaactgtaccggattcccctggctatatgggccctacccgcgctggaagcgaggaatgtgttttttacacggatgagacagcatcccctctggccccagatttagccaaagcctcaccaaagagactgtccctgccgaatacggcatgggggtccccctctccagaagccgcaggctaccctggtgccggagcagaagatgagcagcagcagctggctgctaaccgtcattccctggtggaaaaacttggggagttagtcgctggcgctcacgccctgggggagggccagtttcccttcccaaccgccctgtctgcaacccctaccgaagaaacccctactccccctcccgctgcgacatctgatccgccagcagaggatatgctggttgctattaggcgtggggtgcggctccgaaggaccgtgactaatgatcgttccgctcctagaatcctatag

SEQ ID NO: 57525 - DNA, 1149 bp, Artificial Sequence
  Description of Artificial Sequence: Synthetic coding sequence
atggaacccagagccggagtgtctaagcaggatatcagggaacagatttgggggtatatggagtctcagaacctcgccgactttcctcgccctgtgcatcaccggatccccaacttcaagggatcgtacctggcgtgccagaacatcaaggatctcgatgtgtttgccagaacccaagaggtgaaggtggaccctgataaacctttggaaggggtgcggctcctcgtgttgcagagtaaaaaaactctgcttgtgccgacccccaggcttcggaccggcctgtttaacaagatcactccacccccaggagcaacaaaagacattctgcggaaatgcgcaacttctcaaggcgtgcgcaactactctgtgccaatcgggctcgactccagagtgctggtcgatctggtagtggtgggctccgttgccgtgagcgaaaagggatggcgtattggcaagggagagggatacgcagatctggagtatgcgatgatggtgtcaatgggtgccgtgagcaaggagacacctgtggtgaccatagtccatgactgccaggtcgtggatattcccgaagaactcgtggaggaacacgatattactgtggactatatccttaccccaactcgggtgatcgccaccggttgtaagaggcccaagcccatgggcatcacttggttcaaaatctccctcgaaatgatggagaagataccaattctgagatctttacgcgcacgtgagcagcaggccggtaaggacgttacccttcaaggagaacaccaacaccttcctgaacctgggtgccagcagacagtgcctttgtcagtggggaggcggcctcctgacacaccgggtccagaaacaaattccatggaggccgctcccggatctccaccaggcgagggagcacccctcgctgcagacgtgtacgtagggaatctgccgggagacgccagagttagcgatctgaaaagagctctcagggagttgggatccgtcccattacgcttgacctggcaggggccacgcagaagggctttcttacactatcctgattccgctgccgcacagcaggccgtatcttgcctgcagggcctgagattgggcaccgacacattaagggttgccctggcccgacagcaacgggacaagtag

SEQ ID NO: 57526 - DNA, 1152 bp, Artificial Sequence
  Description of Artificial Sequence: Synthetic coding sequence
atggagcctagggccgtgggggtgtcaaagcaagatattagagagcagatttggggatatatggagtcacagaacttggccgactttcctcgcccagttcatcacagaataccaaacttcaaagggagttatctggcatgccaaaacattaaagaccttgatgtctttgctcggacacaggaggtaaaggtggatcctgacaaacctctcgagggagtccggttactagtcctgcagtctaagaaaactttactggtgcccactccgaggctcaggacgggtctttttaataagatcaccccacctccgggagccaccaaagacatcctccggaagtgtgctacctcgcagggtgtacggaattactctgttccaataggattagatagcagagtgctggtcgatctcgtcgtggtggggagtgttgcagttagcgaaaaggggtggagaatcggcaagggagagggctatgcagacttggagtacgccatgatggtgtccatgggtgcggtctccaaggaaacgccagtagttaccatagtccatgactgccaggtggttgacatccccgaggagctggttgaagagcacgacatcacagttgactacattctgacgccaacccgggtgatcgcgaccggctgcaaaaggccaaaacctatgggtatcacctggttcaaaattagccttgagatgatggagaagatcccaatcctgaggagccttagggctcgtgaacagcaggctggcaaggatgtaacacttcaaggtgaacaccagcatctcccagagccgggttgccaacagaccgtgccattaagtgtcggacgacggcctcccgatacccccggaccagagaccaacagtatggaggctgccccaggctccccccctggcgaaggggcaccactggctgccgacgtgtatgttggcaatctgcctggggacgcgagggtgagtgacctcaaaagggctctgcgggagctggggtccgtcccccttcgcctcacttggcaggggccaagacggcgagcatttctccactaccccgatagcgcagccgctcagcaggccgtgtcctgcctgcagggcctcaggctgggaaccgatactctccgggttgccctcgctcgacagcagagggacaagtag

SEQ ID NO: 57527 - DNA, 1152 bp, Artificial Sequence
  Description of Artificial Sequence: Synthetic coding sequence
atggagcccagggccgtgggcgtgagtaagcaggatatcagggagcagatctggggctacatggaatcccagaacttggcagatttcccaaggcccgttcaccatagaattcccaactttaaaggggcttcccacgccgctgaacagctgcctcggctgcaggcattcaagactgctcgtacgatcaaggttaacccagatgcccctcagaagagtgccaggttctttgttctggaatccaaaaagacacttctggtgcctacacccaggctgcggactggactcttcaataagattaccccgccacccggtgccacaaaagacatcctccgtaaatgtgcgactagtcaaggcgtgcgcaactattccgtccctattgggctggactcacgtgttctggtggatctagttgtcgtgggatcggtggctgtatccgagaagggctggcggattggcaagggcgaaggatacgctgacctcgagtatgcaatgatggtgtccatgggggctgtgtcaaaagagactccagtggtgacaatcgtccatgactgccaagtggtcgacatccctgaggagctggtagaagaacatgatatcaccgtagactacatccttacacctacccgcgtaatcgccacaggttgtaaacgcccaaaaccaatgggcattacctggttcaagattagtctggaaatgatggagaagattcctattctccgaagcctgagggctagagaacagcaggccggtaaggacgtcaccctccagggtgaacaccagcacctacccgaacctggatgtcagcaaacagtgcccctcagtgtgggacgccgtcccccagacacccctggcccagagacaaattcaatggaggctgccccagggagccccccaggagagggcgcaccactggccgcagacgtctatgtgggcaacctccctggcgacgcacgggtctctgaccttaaacgcgcactgagggagctgggttctgtacctctgcgcctgacatggcaggggcctcgtcggagggcttttctgcactatccagattctgcagcagcacagcaggctgtgagttgcttacagggcttgcggctgggaaccgacacacttcgagttgcgctggcgcgtcagcagcgagataagtag

SEQ ID NO: 57528 - DNA, 1146 bp, Artificial Sequence
  Description of Artificial Sequence: Synthetic coding sequence
gggccacgtctgggtgtgtctaaacaagatattcgtgaacaaatctggggctatatggagagccaaaacctggctgactttcccaggccagtgcaccacaggataccgaatttcaagggtagctacctagcctgccagaatatcaaggatttggatgtcttcgcccgaacacaggaggtgaaagttgaccccgacaagcccctagaaggggtgaggctgctcgttctgcagtccaagaagactcttctggttcccacacctcggttacgaacagggctatttaacaagatcaccccacctccgggtgcaactaaggatattctgcggaaatgcgcaacatctcaaggagtgcgtaattactctgtcccaattggactagactccagggtgctcgttgatctcgtcgtggtcggttcagtagcagtgagtgagaaaggttggcgcattggcaagggtgaggggtatgctgatctcgagtacgccatgatggtatccatgggagctgtctctaaggagacaccagtagtcacaatcgtacacgattgtcaagtggtggacattcccgaagagctcgtggaggaacatgacattactgtggattatatcctcactccaacccgggttatcgctacagggtgcaaacggccaaaacccatgggaataacatggttcaaaatttccctggaaatgatggaaaaaataccaattctgcgctcattgagagctcgcgagcagcaagcgggtaaagatgtaaccctgcaaggagagcaccagcacctacctgagcccggttgtcaacagactgtgcctctgtcggttggccgtaggccgccagacactcctggaccagaaaccaattccatggaggctgcgccaggctcgcctccgggtgagggcgcacccctggccgctgatgtgtacgttgggaatcttcccggagatgctcgggtgtccgacctgaagcgtgctctgcgcgagctgggatctgtgccactccgtctgacctggcaaggaccgagacgtagagccttcttgcactatcccgatagtgcggctgcccagcaagcagtttcttgtcttcagggactgcgcctgggcactgatacactgagagtggctcttgctagacaacaaagggataaatag

SEQ ID NO: 57529 - DNA, 663 bp, Artificial Sequence
  Description of Artificial Sequence: Synthetic coding sequence
atgatggtttcaatgggcgctgtctccaaggagacacccgtcgttacaatcgtgcatgattgccaggtcgttgatattccagaagaattggtggaggagcacgacatcacagtggactacatcttgactcccacacgagtcatcgctaccgggtgtaagcgacccaagccgatggggataacttggttcaaaatcagcctcgaaatgatggagaagatccctattttgcgtagtctgagggctagagagcagcaggcagggaaggatgtgacccttcagggggaacatcagcatctccccgagcctggctgccagcagaccgtgccgctttcagtcgggagaagacctcctgacacacctggcccagagaccaacagcatggaggcagcacctggatcccctccgggagagggggctccattggccgcagacgtgtacgtgggtaatttacccggtgatgccagagtgtcagatctgaagcgtgcgctcagagagctgggatcagtgccactcagactaacatggcagggtccaaggcgcagagcctttctgcactatcccgatagtgcagccgcacaacaggcagtttcctgcctgcagggccttcggctgggtaccgacacattgcgagtcgccctggcgagacaacagcgagataagtag

SEQ ID NO: 57530 - DNA, 579 bp, Artificial Sequence
  Description of Artificial Sequence: Synthetic coding sequence
atgtgtagtgaacctaagcaccacgtgaatggcaatagaactgtggaacccttccccgagggcacacagatggccgtctttggtatgggctgtttttggggcgctgagagaaagttttgggtgctcaaaggagtgtatagcactcaagtaggttttgcagggggttacacatcaaatccaacttacaaggaggtgtgctccgaaaagacaggacacgctgaggtagtgcgagttgtctatcaacccgaacacatgtcttttgaagaactattgaaggtgttttgggagaaccatgacccaactcaaggaatgcgtcagggcaatgatcatgggacacagtaccggagcgctatataccctacatccgccaaacagatggaggccgctctgagttctaaggaaaattatcagaaggtgcttagcgaacatggatttggccctatcactaccgatatccgcgagggccagacattctattacgcggaggattaccaccagcagtatctgagcaaaaatccgaatgggtactgtggccttggcggtaccggggtctcttgtccagttggcatcaaaaagtag

SEQ ID NO: 57531 - DNA, 588 bp, Artificial Sequence
  Description of Artificial Sequence: Synthetic coding sequence
atgcttagcgccaccagaagagcttgccagctgctccttctgcattccctgttccccgttccacgtatgggcaattctgcttccaacatcgtctcacctcaggaggcacttccaggcagaaaagaacagacccctgtggccgctaagcaccacgttaatggcaaccggactgtggaaccgttccccgagggcacgcagatggccgtttttgaaaagaccggccacgccgaggttgttagagttgtgtaccagcctgagcacatgtcttttgaagagctgctgaaagttttctgggaaaatcacgatcccacccagggaatgcgacaaggcaacgatcacgggacccaataccgctcagccatttacccaacgagcgccaagcagatggaagcagccttgtccagcaaggaaaactaccagaaagtgttatccgaacatggtttcggacctataaccacagacatccgggagggacagaccttctattacgcagaggactaccaccaacagtatctcagcaagaatcccaatggatattgtgggctggggggtacgggtgtaagctgcccggtgggcatcaagaagtag

SEQ ID NO: 57532 - DNA, 510 bp, Artificial Sequence
  Description of Artificial Sequence: Synthetic coding sequence
atggccgttttcggtatgggttgcttctggggcgcagaacgtaagttttgggtgcttaagggcgtttattccactcaagtggggtttgctgggggttacacttccaatcccacctataaagaggtgtgttctgagaagactggccatgctgaggtcgtgcgtgtggtgtaccaaccagaacacatgagttttgaagagctgctcaaagtgttctgggagaatcatgaccccactcaagggatgagacaaggcaacgatcacgggactcaatatcgcagcgccatatatccgacctcggctaagcagatggaggccgcactgtcgtctaaagaaaactatcaaaaagtgcttagcgagcacgggtttggaccaatcacaacagatattcgtgaaggccagacattctactacgctgaggactaccatcagcaatacttaagcaaaaatccaaacggatattgtggtctgggagggacaggtgtcagctgccctgtgggaatcaagaagtag

SEQ ID NO: 57533 - DNA, 627 bp, Artificial Sequence
  Description of Artificial Sequence: Synthetic coding sequence
atgggcgagcctgcctttacctccttccctagccttcccgtcctgggcaaattgaagcgcaacatgatgccctgggccctgcagaaaaagcgcgagattcacatggccaaggctcatcgcagaagggcagctagaagcgccctgccaatgcggttgacatcttgtatatttagacggcctgtcaccagaataagatcacacccagacaaccaggtaaggaggcgtaaaggagacgagcaccttgagaagcctcagcagttgtgtgcctacaggaggctccaagccctccagccttgctcttcccaaggcgagggaagctctcccctccacttagagagtgttctaagtattctggctccaggtacggctggcgagagcctggacagggcgggagccgagagggtccggagtcccctggaacccacccctggaagattccccgctgtggcaggcggacccactccaggaatgggttgccagctgccaccccctctctccggacaattagtgacacctgccgacatcaggagacaggctagaagagtgaagaaggcacgtgaacggctcgcaaaggctttgcaggccgatcggctagcaagaagagcagagatgctcaccgggggatag

SEQ ID NO: 57534 - DNA, 627 bp, Artificial Sequence
  Description of Artificial Sequence: Synthetic coding sequence
atgggagaaccggctttcacgtctttccccagcctgcccgttctcggcaagttgaaacgaaacatgatgccttgggccctacaaaagaaacgggagatccatatggccaaggcacacaggagacgcgctgcgcgttctgcccttcccatgagactaacctcctgtatattccgcagaccggtgacgaggatcaggagtcaccccgacaatcaggtgcggaggcgcaagggagatgagcatttggaaaagccacagcagctttgcgcttacaggcgtctccaggcactccagccctgctcgagccaaggcgaaggtagttccccactccatctggagagcgtgctatctatattagccccaggcacagcaggtgagtcactggaccgagcgggtgccgaacgggttaggagccccttggagcctactccaggcagattcccggcagtcgcaggcggacccacgcccggaatgggctgtcagctcccaccgccattaagcgggcagctagtcactcccgcagatataaggcgtcaggcccgtcgtgtgaaaaaggcccgtgaacgcctggccaaggctttacaggcggatcggctggcccgaagagcagagatgctgacagtgcgctag

SEQ ID NO: 57535 - DNA, 627 bp, Artificial Sequence
  Description of Artificial Sequence: Synthetic coding sequence
atgggtgaacccgcatttacttccttccccagtcccccagtactcggcaagctcaagcgtaacatgatgccgtgggccctgcagaaaaagcgcgagatccatatggccaaggcacacaggcgtcgagccgcacgctccgcccttccaatgaggctgactagctgtatttttcgtcggccagttactaggatcagaagtcacccggataaccaggtgcggagacgcaagggggatgagcacctcgagaaaccacagcaactctgcgcatacagacgactgcaggccctgcagccatgtagcagtcagggtgaagggagcagcccactgcacctggaatctgttctgagcatcctcgccccaggaaccgccggagaaagcctagatcgcgcaggggcagagagggtgagaagccctctagagccgacaccaggcagattcccggcagttgctggcggacctacccctggcatgggctgccagttacctcccccattatctggccagctcgtgacacccgcagatattcggagacaggccagaagagtgaagaaggccagggagagattagccaaggcactgcaagccgacaggcttgcccgacaagcagaaatgctcacgtgccgctag

SEQ ID NO: 57536 - DNA, 627 bp, Artificial Sequence
  Description of Artificial Sequence: Synthetic coding sequence
atgggcgagccagctttcacttcatttccttcaccacccgttttgggcaagttgaagcggaatatgatgccttgggcccttcagaagaagcgggaaattcacatggctaaagcacacaggaggagggccgctcgttcagcgctgcccatgcgcctgacatcctgcatttttcgtcgacccgtcacaagaattaggtcccatccagataaccaggtcagacggaggaaaggggacgagcacctggaaaaaccccaacagctatgtgcttatcgacggttacaggcactgcagccttgtagcagtcagggcgaagggagctcacccctgcatctagagagtgtgctgtctatcctagctcccggaaccgctggcgaatcacttgacagggccggagccgaaagggtcaggatcccacttgagccaacacctggccgttttccagctgttgctgggggacccacgcctggtatggggtgtcagctaccgccacccttgtctgggcagctggttaccccggcagatataagacggcaagcccgtcgggtaaagaaggcccgagaaagactggcgaaggctctccaggcagatcgcctggccaggcaggccgagatgctaacttgtaggtag

SEQ ID NO: 57537 - DNA, 627 bp, Artificial Sequence
  Description of Artificial Sequence: Synthetic coding sequence
atgggagagcccgcatttacctcatttccctctcccccagtcctagggaaactgaagcgcaacatgatgccctgggccctccagaaaaagagagaaatccacatggctaaggcccaccggagaagggccgcaaggtccgccctgccgatgcgcctaaccagctgcattttcaggcgacctgttacaagaatccgcagtcacccagacaaccaggtgaggcggcgtaagggagatgaacatctggagaaaccgcaacagctctgtgcctacaggaggttgcaagccctgcagccgtgctcatcccagggggaagggtcatctcccctccacttagaatccgtcctgtcaattctggcaccaggcacagcaggggaatcactggatagagctggtgcggaaagggttagaattccccttgagccaactcctggtcgttttcccgcagtggcaggtgggccaacccccggtatggggtgtcagctgcccccacccctgagcggccagctggtgaccccagctgacattcggcgtcaggccagacgtgtgaaaaaagccagagagcgcttagctaaagcactccaggctgatcgactcgcacggcaggcagaaatgctcaccggcggttag

SEQ ID NO: 57538 - DNA, 627 bp, Artificial Sequence
  Description of Artificial Sequence: Synthetic coding sequence
atgggcgagcctgcttttacaagcttcccatccccacctgtgctggggaagctcaaaaggaacatgatgccgtgggctctacagaaaaagagggaaattcatatggccaaggctcaccgcaggcgcgctgcccgtagcgccttgcctatgaggctcacctcttgcatattccggcgaccggtaactcgcattaggtcacatcctgacaatcaggtgagaaggcggaaaggcgacgaacacttggaaaaacctcagcagttgtgcgcatacagacgtttgcaggcactgcagccctgctcaagtcagggagaggggagcagtcccttgcatctggaaagtgtgctgtctattttggctccaggaactgctggggagtctctggaccgagcaggagctgaaagggtgcgtatcccgctggagccgacgcccggacgcttcccagcagtcgcgggaggaccaaccccaggtatgggctgtcagttgccccctcccctcagcgggcagctcgtaacaccagctgacattcggagacaagctagaagagtcaagaaagcccgtgagagactggcaaaggccctgcaggccgaccggctggctagacaggccgagatgctcactgttcgctag

SEQ ID NO: 57539 - DNA, 615 bp, Artificial Sequence
  Description of Artificial Sequence: Synthetic coding sequence
atgggtgagccagcatttacatccttcccttccctacccgttttaggcaaacttaagcgtaacatgatgccttgggctcttcagaagaaacgtgaaatccatatggccaaggctcacaggcgcagagcagcaaggtcagcgttgcctatgcgactgactagttgtattttcagacggccagtgacccgcattcgcagtcaccccgataatcaagtcagacgcaggaaaggtgacgaacatctggagaagccccagcagttatgcgcatacaggcggttgcaagctctccagccctgctcaagccagggcgaggggagcagcccacttcatctggaaagcgtgttatccatcctggctcccggtactgctggcgagtcgttggaccgggctggggctgaaagggtgcggtcgccgttagagcccacacccggtagattcccggctgttgctggtgggcctacaccagggatggggtgccagctgccaccacctttgagcggtcaattagtgactccagccgatattaggcgccaggccaggagggtgaagaaggccagagagcgcctggctaaggctctgcaggctgatcgccttgctcggagggctgagatgtag

SEQ ID NO: 57540 - DNA, 759 bp, Artificial Sequence
  Description of Artificial Sequence: Synthetic coding sequence
atgtcatcggaggtttcggccagacgggatgcaaagaagttggtgcggtcccccagcggcctaaggatggttcctgaacacagggcctttggcagcccttttggtcttgaggagccccagtgggtgcctgacaaggagtgtcggaggtgcatgcaatgcgatgccaaattcgattttctaacccgtaaacatcactgtcgccgttgcggcaagtgcttctgcgacaggtgctgctcacagaaagtacccttgcggaggatgtgctttgtggaccctgtccgccagtgtgcagaatgcgccctcgtatcactgaaggaggcagagttttatgataaacagttaaaagttttactctcaggggcaacttttctggtaaccttcggcaattccgaaaaacccgaaacgatgacctgtagactcagcaacaaccagagatatctctttttggacggagattcccattatgaaatcgaaattgtgcacatttccaccgtacagattctgacagagggcttcccgccaggagaaaaggacatccacgcttacacaagcttacgcggtagtcaacccgcttccgagggcggaaacgcaagggccaccgggatgttcctccagtatacagtccccggtacagagggcgttacgcagctgaagctgactgtcgtcgaagatgtgaccgtgggtagacggcaagcggtcgcctggctggtcgccatgcacaaggcagccaagttgctatacgagagccgggatcagtag

SEQ ID NO: 57541 - DNA, 2808 bp, Artificial Sequence
  Description of Artificial Sequence: Synthetic coding sequence
atggcgccagcagagatcctgaatggaaaggagatttcagcgcagatcagggccaggctgaagaatcaagtcacccagctgaaggaacaagtcccgggatttacgcctcggcttgctatactgcaggtaggtaacagggatgacagtaatctatacattaatgtcaaactgaaggctgccgaggagatcggaattaaggccacacacatcaaactacccaggaccacaacagagtccgaggtgatgaagtacatcacatctctgaacgaggattcaacagtgcacggctttctggtccaactcccactggactccgagaacagcatcaatacggaggaagtcattaacgccatcgcacccgaaaaagacgtcgatgggcttacttccatcaacgccggaaagctggccaggggggaccttaacgactgcttcatcccatgtaccccaaaagggtgtctggagctgatcaaggagacaggggtacccattgctggtcggcacgccgtcgtggttggacggagcaaaatagtgggcgcacccatgcatgaccttttgctttggaataacgcaaccgtgacgacctgtcattcgaagaccgcacatctggatgaagaggtaaataagggggatatcctcgtcgtggccacagggcagcccgagatggtgaagggagagtggattaaacctggtgctatcgtgattgactgcgggataaactatgttccggatgataagaaaccaaacggacggaaagtagtcggggacgtcgcctacgacgaagctaaggaaagagcatcttttattacccccgtgccaggaggtgtgggcccaatgacggtagcgatgctgatgcagagcactgtggagagcgccaagcgattcctggagaagtttaagcccggaaagtggatgatacagtacaataacctgaacttaaagacacctgttccttccgatatcgacatttccaggtcatgcaaaccaaagcccattggcaagttggcacgagaaatcggtcttttgagcgaagaggtggaactttacggggaaacgaaggccaaagttctcttaagtgctctggaaagactgaagcaccggcctgacggcaagtatgtggtggtgacgggcattacacctacccccttgggggagggtaaaagcacgacaaccataggactagttcaggcactgggggcacacctctaccaaaatgtctttgcgtgtgtcagacagccaagccaaggccctacattcggaatcaaaggaggcgctgccggtgggggatacagccaggtaattcctatggaggagtttaatctgcatcttactggagacattcacgctatcaccgccgctaataatctcgtcgccgcagcgattgacgcccgaatctttcacgaactgacccaaaccgataaagccctgttcaaccgcttggtgcccagcgtgaacggcgttagaaggttttctgatatccaaatccggagactcaaacgcctggggatcgagaagacagatcctacaaccttaaccgatgaagagattaatcggttcgcacggttggatattgatcccgagaccatcacctggcagcgggtccttgacacgaacgaccgctttctgcgcaaaattaccatcgggcaggcacctacggagaagggacacaccagaactgcgcagttcgatatctctgtggcatctgagatcatggctgtgctggccctcaccacctcactggaggacatgagagagcgtcttggcaaaatggttgtcgctagcagtaaaaagggcgagcctgtgagtgcggaagatcttggcgtttccggggcattaacagtcctgatgaaagatgcgattaagccgaatctcatgcagacactggagggtaccccggtcttcgtgcatgcaggcccattcgcaaacatcgctcatggcaactctagtatcatcgcagataggattgcacttaagctcgtgggacctgaagggtttgttgtcaccgaggccggattcggtgccgatatcgggatggagaagttctttaatataaagtgtcgttactcagggctttgccctcacgtggtcgtgctggtcgcaaccgtgagggccctgaagatgcacggcggtgggccaacagtgaccgctggtcttcctctgcctaaggcatacatccaggagaatctcgagctggtggagaaaggcttcagtaatcttaagaagcagattgagaatgcccgaatgttcggaattcccgtggtggtagcggttaacgcgtttaagaccgataccgaatcagagcttgatctcatctcccggctgtctcgggagcacggggcattcgatgccgtcaaatgtacccattgggccgagggcggtaaaggcgctctggctctggcccaggccgttcagcgggcagctcaagctccaagtagcttccaactcctgtacgatctgaaacttcctgtggaagacaaaattcgcatcattgcccagaagatatacggtgcagatgatatcgagctgctgcctgaagctcaacacaaggcggaagtttatacaaaacagggttttgggaatctccccatctgcatggctaagacccatttatccttgtcacataatccagagcagaaaggcgtgccgaccgggttcatccttcccattcgtgatatccgcgctagcgttggcgctggttttctgtatcctctagtgggcactatgtccacaatgccaggcctgcccacacgcccttgtttttatgacatcgacctggatccagaaacagagcaggtgaatggcctgttctag

SEQ ID NO: 57542 - DNA, 852 bp, Artificial Sequence
  Description of Artificial Sequence: Synthetic coding sequence
atggcccaccgcggagcccattttgctttccgatccagatggcagaaaacagatgatgaactctgcaggcactcaatgtcgtttatcttgcataaagcgatcagaaacgacttctttcagtcctacctttatcttttagagaaaattccccttgtcaagctctacgcactgacctcccaggttatcaatggcgagatgcagttttacgcccgtgcgaagctgttttatcaggaggtccctgcgacagaggagggcatgatgggcaacttcatcgaattgtccagccccgatatccaggcctcccagaaattccttcgtaagttcgttggagggcctggaagggcaggcaccgactgcgctttggattgcggatcaggtattgggagagtttctaagcacgtgctgcttccagtgttcaactcggtggaacttgtggatatgatggaaagcttcctactggaagcccagaactatctgcaagtcaagggcgataaggtggaaagttaccattgttactcacttcaagagtttacaccgccattccggaggtatgacgtcatttggatccagtgggtatccgggcatctgacggacaaagatctactcgcttttctcagccgatgccgtgatggactgaaagagaatggaattatcattctaaaagataacgtcgctcgcgagggatgcattctggacctaagcgactccagcgtcaccagagacatggatatcttgcgcagtttgatccgcaagtccgggttggttgtgttgggacaggaaaagcaggatggattccccgaacagtgcatcccagtctggatgtttgcactccactccgataggcattcttag

SEQ ID NO: 57543 - DNA, 1191 bp, Artificial Sequence
  Description of Artificial Sequence: Synthetic coding sequence
atgaaggagtgcaacgccacacggcgtccgcagatgtccttcctgaagatggatatgacacagatggagttcccggacgctagctttcaagttgtactggacaagggcaccctggacgcggtactcactgatgaggaggagaaaacactgcaacaggttgatcgcatgttagccgaagtaggtcgggtgctccaggtgggaggaaggtatctttgcataagcctagcccaggctcatatcctgaaaaaggcagtgggacactttagccgcgagggctggatggtgagggtgcatcaggttgctaattcccaagaccaggttctggaagccgagcctcagttttcacttcccgtttttgcatttataatgaccaaattcagaccagttccgggttcagcactgcagattttcgaactgtgcgctcaggaacagagaaaacctgtgaggttagagagtgctgaaaggctggccgaggcagtgcaggagcggcaacagtatgcctggctctgttctcagctccgcaggaaggcaagacttgggagcgtcagcctcgatttgtgcgatggagatacaggcgagccacgctacactctgcatgtggtagacagtctgcctctgttcgttcacgaccactttcctaagtcatgtatcgacgcagtagaaatagacccaagtatgttagaagttgcaacacaatggtttggattctctcagtccgaccggatgaaagtgcatatcgcagacggactggactacatcgcatccctggcgggaggcggagaggcacgaccctgctacgacgtaattatgtttgacgtggattcgaaggatcctaccctggggatgtcttgtccccctccggcatttgtcgagcagtccttcttgcagaaggtcaagagtatattgactcctgaaggcgtcttcattctgaacctggtctgccgagatctgggcctgaaggacagcgtgttggctggcctgaaggcggttttcccactcctatatgtgcgccgtatcgagggagaggtcaatgagatcctcttttgccagctgcacccagaacagaaattggctacacccgagttgctcgaaactgcacaggctcttgagaggaccctgcgaaaaccgggaagaggttgggacgatacctacgtgttgagtgacatgctgaagacagtaaagatagtgtag

SEQ ID NO: 57544 - DNA, 2100 bp, Artificial Sequence
  Description of Artificial Sequence: Synthetic coding sequence
atgaatctgcttccgaaatcctctagagagtttggaagcgtggattattgggaaaaatttttccaacagcggggtaagaaggctttcgagtggtacggcacctacctcgagttgtgtggcgtgctgcacaaatacattaagccacgcgaaaaggtgcttgtaatcggctgtggcaattccgagttatccgaacagctgtacgacgtcggttaccgggacatcgtcaacatcgacatctccgaagtggtcattaagcagatgaaggagtgcaatgctacaagacggccacagatgtcgttccttaaaatggacatgacacagatggaatttcctgatgcaagctttcaggtcgtgctcgataagggaactctagatgctgtcttaactgatgaagaagaaaaaaccctccagcaggtggatcggatgctggcggaagttggcagagtcttacaggttggaggtagatacctgtgcatctctctggcccaggctcacatacttaaaaaggccgtgggacatttcagccgggaaggctggatggtgcgggtacaccaggtcgccaatagccaggaccaagttctagaagcagaaccccagttctcgctccctgtcttcgccttcattatgacaaagtttaggccggtacctggatctgctttgcaaatttttgagttgtgtgcccaggaacagaggaagcctgtgcggctcgagtctgctgagagactcgccgaagccgtgcaagaacggcagcagtatgcatggctgtgcagccagcttcgcagaaaggctcgcttgggctcagtctccctggacttatgcgatggggacactggagaaccgcgttacacacttcacgtggtagacagtcctactgttaagccctcccgggacaaccacttcgcgattttcatcataccacagggcagggagacagaatggctgtttggcatggacgaggggaggaagcaactcgcagcttctgctggttttcgaagactgatcacggtggccttgcataggggccagcagtacgaaagcatggatcacattcaggcggaactctcagcccgtgtgatggaactggcccctgctggcatgccgacccagcagcaggtgcctttcttatctgtcggcggagatatcggggtgaggactgtccagcatcaggattgttcaccactctccggtgactacgttattgaagatgtccagggagatgacaagcgctactttcggaggctgatattcttgagcaacagaaatgttgttcagtccgaggcccgactgctaaaggacgtcagccacaaagcgcagaaaaagcgcaaaaaggaccggaagaaacagcgtcctgccgacgctgaggatctgcctgccgcacctggacagagtatagacaaatcctatctatgttgtgagcaccataaagccatgattgccggactagcactgttgagaaacccagagctactgctcgagatccctctcgcactactagtggtggggcttgggggagggtcactccctctgttcgtccacgatcacttccctaagtcttgtatcgacgctgttgagatcgatccttctatgttggaggtggccacccaatggtttggattttctcaaagtgacaggatgaaggtgcacatcgcagatggccttgactacattgcctcactcgcaggtgggggtgaggctaggccatgctacgacgtgattatgtttgacgttgactccaaagaccctactctgggcatgagctgtcccccacccgcattcgtggaacaatctttcctgcagaaggtgaaatctattctgactccagagggggttttcattctgaacctcgtttgtcgcgatttaggtctgaaggactccgtcctcgccggtttaaaagccgtgtttccacttttgtacgttcgcaggatcgaaggagaagttaatgagatcctgttttgccagctgcacccagagcagaagctcgccaccccagaactgcttgaaaccgcccaggccctcgagagaaccctgaggaagcccggtcgcggatgggacgacacatacgtgctttccgacatgctgaaaacggtgaagatcgtttag

SEQ ID NO: 57545 - DNA, 1842 bp, Artificial Sequence
  Description of Artificial Sequence: Synthetic coding sequence
atgaaggagtgcaatgcaaccaggagaccccaaatgagtttcttgaagatggatatgacgcagatggaattccctgacgcttcttttcaggtcgtgctggacaaagggacccttgacgctgttctgacagatgaggaagagaaaactctgcagcaggtcgaccgcatgctggcagaagtggggcgtgtacttcaggtgggcggaagatatctgtgtatcagtcttgcacaggcccatattctaaagaaagccgtgggccacttttcacgggaagggtggatggttagggtgcaccaggtggccaacagccaggatcaggtcttggaggctgagcctcagttcagccttccggtgttcgcgtttatcatgactaaatttcggcctgtgcctggcagcgccctacagatattcgagttatgtgcacaggaacaacgcaagcctgttcgtctcgaaagcgccgaacggcttgctgaggctgtgcaggaaagacagcagtacgcctggctgtgttcccagctccggagaaaggcccgattggggagtgtcagcctggatctgtgcgacggagacaccggggaacctcgctataccctacatgtggtcgattcacccactgtgaagccttcacgggataaccattttgctatctttattataccccaggggagagaaactgaatggctcttcggcatggacgaaggccgaaaacagctggcggcttcagccggattccggagactgattaccgtagctcttcaccgcggacaacagtatgagagcatggatcacattcaggctgaactctcagcaagggtgatggaactggcacctgctggcatgcccactcagcaacaggtgccttttctctccgttgggggtgacataggagtgaggacagtccagcaccaagactgttctcccctgtctggcgactatgtgattgaagacgttcagggggatgataagcgctacttccgaagattaattttcttgtctaataggaatgtggttcagtctgaggcgagactcctgaaggatgtgagccataaagcccaaaaaaagaggaagaaggatcgcaaaaagcagcgtcctgccgatgccgaagatttgcccgctgctccagggcagtccatcgacaagtcttatctgtgttgtgagcatcataaggccatgattgcaggcctggctttattgagaaatcctgagctgttattggaaattccgctggccttattggtcgttgggctcggtgggggatcactcccactttttgtgcacgaccatttccccaaatcctgtatcgacgccgtggagattgatccctctatgctagaggtcgctacccaatggttcggcttcagccagtcagatcggatgaaggttcatatcgctgacggcctggactacattgccagtctcgccggagggggtgaggcacggccatgctacgatgttatcatgttcgacgttgatagtaaggaccccactctaggcatgagttgtccgcctccggcatttgtggagcagtctttcctgcagaaggtgaagtctatactgaccccagagggcgttttcattctgaatctggtttgcagagacttggggctgaaggatagtgttcttgctggcctcaaggctgttttccccttgctgtacgttcgtcggatcgagggggaggtcaacgagattctgttctgtcagctacaccccgagcagaaactcgcaacaccagaactgctcgagacagcccaagcccttgagagaaccctgaggaagccaggccgaggctgggatgacacatatgtattgtctgatatgcttaagaccgtgaaaattgtgtag

SEQ ID NO: 57546 - DNA, 1632 bp, Artificial Sequence
  Description of Artificial Sequence: Synthetic coding sequence
atgaacctgctcccaaagtccagtcgggaattcggttctgtggactattgggagaagttctttcaacaaaggggtaaaaaagcctttgagtggtacgggacataccttgagctttgcggcgttctccataaatacattaaacccagagaaaaggtgttagttattggatgtggcaacagtgagctaagcgagcagctgtatgatgtaggctatagggacattgttaacattgacatatccgaggtggtcatcaaacagatgaaagagtgcaatgctacacgaaggccccagatgtccttcctcaaaatggatatgactcagatggagtttcctgacgccagctttcaggtggtgctggacaaaggcaccttagacgccgtgctgactgacgaggaagaaaagaccctccaacaggtcgatagaatgctcgcggaagtgggccgagtgctccagggcagggaaaccgaatggctgttcggaatggacgagggacgtaagcagctcgcggctagcgccggatttcggaggttaatcaccgtggccttgcatcggggacaacagtatgagagcatggatcacattcaggcagaacttagcgcaagagttatggagctcgcccctgcaggcatgcctactcagcagcaggtgccatttctctcggttggaggcgacatcggagttcggactgtgcagcaccaggactgttcaccattatcaggagattacgtgatcgaggatgtgcagggggacgataaacggtactttcggaggcttatttttttgtcaaataggaatgtcgtacagtccgaagctcggctcctgaaggatgtgagccacaaagctcagaaaaagcggaagaaagatcgaaagaagcagaggcctgccgacgccgaagatctgcccgctgcccctgggcaatccatcgacaagagctatctttgctgtgaacaccataaagcgatgatcgcgggactcgctttgttaagaaaccctgaactgctgctggaaatcccgctcgcactgctggtggttggcctgggtggaggtagcttacccctcttcgtgcatgaccatttccctaaatcttgtatagacgccgtcgaaattgaccctagcatgcttgaagttgccacgcagtggttcgggttttctcagtccgatcgcatgaaagtgcacatcgctgatggcctcgattatatcgccagtctcgccggagggggtgaagccagaccctgctacgacgttatcatgtttgatgtcgatagcaaagaccctactctgggtatgagttgcccccctcctgccttcgtggagcagtcttttctccaaaaagtaaagagcatcctgacccctgaaggcgttttcatactcaacttggtctgccgggatctgggcctgaaagactctgtgctggccggtctgaaggccgtcttccctttactgtacgtgcgccgaattgaaggggaagtgaacgagattctgttctgccagctgcacccggagcagaaactagccacaccggaactgcttgaaaccgcccaagcacttgagcggaccctgagaaagcctggcagaggatgggatgacacttatgtgctgtctgacatgctgaagacagtgaaaattgtctag

SEQ ID NO: 57547 - DNA, 2097 bp, Artificial Sequence
  Description of Artificial Sequence: Synthetic coding sequence
atgcgagcatttgtggtgagcagagagttcggaagcgttgattactgggagaaattcttccagcagaggggaaaaaaggcctttgaatggtatggtacatatcttgaactttgtggcgttttacacaaatacatcaaacccagagaaaaagtcctggtcatcggttgtggaaattccgagctttctgaacagctgtatgatgtgggctacagagacattgtgaacattgacatttctgaggttgtaataaagcagatgaaggagtgtaatgcaacaaggagaccacagatgtcctttctaaagatggacatgacgcaaatggagtttccggacgcttcctttcaggtagttctggacaaggggaccctggacgccgttctcacagacgaggaggagaaaaccctgcagcaggtggatcgcatgctcgccgaggtcggcagagttttacaggttgggggtagatacctttgcatctcccttgcacaggcccacatattgaagaaggcggtgggccatttcagtcgggaggggtggatggtccgggtacaccaagtggcaaacagccaggatcaggtcttggaggcggaaccccaattctctcttccagtgttcgcctttatcatgacaaagtttcgcccagtgcccggatccgcactccagatcttcgagctgtgcgcccaagaacagaggaagcctgtgagattagaatctgctgaacggctcgcagaagccgtgcaagagcggcagcagtacgcatggctgtgcagtcaactcagacgtaaggcacgcctgggctcggtatctctggacctgtgtgatggggatacaggcgaacctagatacaccctacacgttgtcgactctcccacagtcaagccctcacgcgataatcacttcgccatatttattatccctcaaggacgggaaaccgaatggctttttggaatggacgagggcaggaagcaactggctgcttcagctggttttcgcagacttattaccgtcgccttacaccgcggacagcaatatgaatctatggatcacatccaagccgaacttagcgctcgcgtgatggagttggcgcctgcaggcatgcctacacagcaacaggtgccctttctaagcgtcgggggagacatcggagtgcgtacagtgcagcaccaagattgttcccccttgtcgggagactacgtcattgaggatgtacaaggggacgataaaagatactttagacgcctgatcttcctgagcaatagaaacgtggtgcagagcgaggcgaggttactaaaggatgtgtcccacaaagctcagaaaaaacggaagaaagacaggaagaagcagagacccgctgatgccgaagatctaccagccgcacccggacagagtattgataagagttatttgtgctgcgaacaccacaaggctatgatcgccggtctggcacttctccgcaatccagagcttctgctagaaatcccactagcgttgttagtggtggggctcggaggcggatccttgcctctgtttgtgcacgaccacttcccaaagtcctgtatcgatgccgtcgagatcgatccaagcatgctggaagttgcgacccagtggtttgggttttcacagtctgataggatgaaggtgcacatcgctgacggactcgattatatcgcctcgctcgcaggaggtggtgaagctaggccttgttatgatgtcattatgttcgatgtcgattcgaaggatcccacactgggtatgagctgtccccctcccgcattcgttgagcagagcttcctgcagaaggtcaagagcatactgacaccggaaggcgttttcatcctgaatcttgtctgtcgcgacctgggactaaaggattcggtgttggctggactgaaagcagtcttcccccttctgtacgtgcggagaattgaaggcgaggtaaacgagatcctattttgtcaactgcacccggagcagaagttagccactcccgaattgctcgaaactgctcaggccctagagcgcacgttgcggaagcccggacgcggatgggatgacacctacgttctgagcgatatgttgaaaacagtgaaaattgtgtag

SEQ ID NO: 57548 - DNA, 822 bp, Artificial Sequence
  Description of Artificial Sequence: Synthetic coding sequence
atgttacgctacccatatttttgtcgcatgtataaagagtgcctgtcttgctggctcgagtccggaattccaaacttgggagtgtggcccaatcgcattcacacgactgctgagaaatacagggaatacgaggcccgagagcaaaccgaccagacacaggcccaagaactgcatcgcagtcaggatagagattttgagacaatggcaaagttgcacattccagtaatggttgatgaagtggttcactgcctctccccccagaagggtcagattttcctcgatatgacctttggttctggagggcacaccaaagcgattttacagaaggagagcgacatcgtgctgtacgccctcgatagggatcctacagcatacgctctggcagaacacctgtctgaactgtatcccaagcaaattcgtgcaatgcttggccagtttagccaggctgaagctctgctgatgaaggctggcgtccagcctggtacctttgacggcgtcctgatggatttgggttgctcctccatgcagttggacactccagagcggggttttagccttcgcaaagatggtccattagacatgcggatggacgggggacggtacccggacatgccaaccgccgcagacgttgtaaatgcgttggatcagcaggctctggcttctattctgagaacgtacggagaagagaagcatgcaaaaaaaattgcaagtgctattgtccaagcaaggagcatatacccgatcaccaggacccaacagctggcttctatcgtggccgaatattccgaaacttacttcccggtggctcagaccttgtactag

SEQ ID NO: 57549 - DNA, 822 bp, Artificial Sequence
  Description of Artificial Sequence: Synthetic coding sequence
atgcttcgatacccttacttttgccgaatgtataaggaatgtttgtcatgctggctagaaagcggtattccaaatcttggggtgtggccgaatagaatacacacgacagcagagaagtatcgcgaatacgaagctagggaacagaccgatcagactcaagcccaagaactgcacagatcgcaggaccgggactttgagaccatggccaagctacacattcctgtcatggtggacgaagtcgtgcactgcctaagtccacagaaggggcaaatctttctcgacatgacattcggctcgggcggacataccaaagccattcttcaaaaagaaagcgacattgtattgtacgcattagaccgagacccaactgcctacgccctagctgaacacctgtctgagttgtaccctaaacaaattcgggctatgcttgggcaattttcgcaggcagaggccctcctgatgaaggccggagtgcagcccggaacgttcgacggcgtcctgatggaccttggctgctcttccatgcagcttgacacacctgaacgcggattttcactccgcaaagatggcccattggacatgcggatggatgggggtcgctatcccgatatgcctaccgcggcagacgtggtaaacgcactggaccagcaagccctcgctagcatactgcggacctatggggaggagaagcacgctaaaaagatcgctagcgcaattgttcaggccagatctatatacccaattacccggactcaacagctagcctcgatcgtcgccgagtattcggagacctattttccagtggcacaaacactgtactag

SEQ ID NO: 57550 - DNA, 300 bp, Artificial Sequence
  Description of Artificial Sequence: Synthetic coding sequence
atgctaagatatccctatttttgccgcatgtacaaggaatgcttatcctgctggctcgagtctggaattcctaacctcggtgtgtggccgaacaggatccacaccacagcagagaaataccgagaatacgaagctcgcgaacagactgaccaaacacaggcccaggagctgcataggagccaggatagagattttgagactatggctaaactccacattcccgttatggtcgacgaagtggtccattgtctgtcaccccagaagggccagtctctcggtgtgagaagtgtagggatctag

SEQ ID NO: 57551 - DNA, 1224 bp, Artificial Sequence
  Description of Artificial Sequence: Synthetic coding sequence
atgctcaggtatccatacttctgcaggatgtacaaagagtgtctgagctgttggctggagagcggtatcccgaacttgggcgtttggcccaaccgcatacataccacagctgaaaaatatagggagtatgaggcgcgagaacagacagaccagacccaagcccaggagctacaccgaagccaagatcgtgacttcgaaaccatggccaagctccacatcccagtcatggtcgacgaggtggtccactgcttatcccctcagaagggacaaatttttctcgacatgacatttggatctggaggccatacaaaggctatcctccagaaagagtccgacatcgtactttacgccctggaccgagatcctaccgcctatgcactggctgaacatctgtctgagctgtaccctaaacagatcagggcgatgcttggtcagttttcacaagcagaagccctcttaatgaaagcgggagtccaacccggaaccttcgatggagtcctgatggacttgggctgctcaagcatgcagctcgataccccagaaaggggcttctccctgcgcaaggatggacccttggacatgcgcatggacggaggcaggtaccccgatatgccaaccgctgcagacgtagtcaacgcactcgatcagcaggccctcgcctccattttgcgcacctatggagaagagaaacacgcgaaaaagattgcaagtgctattgttcaggccagatctatttaccctattacccggacccagcagctggcttccattgtcgccggagcattccccccatcggcaatctacacaaggaaagatctgctgcaacgtagcacgcatattgcaaccaagacgttccaggccctcagaattttcgttaacaacgagctcaatgagctgtacacagggttgaagacagcacagaaattcctgcggccaggcggaaggctcgtagccctctccttccactcactggaagatcggattgttaagcgatttcttttagggatcagcatgacagaacgattcaatctcagcgtcaggcagcaggtgatgaaaacaagccagctgggaagcgaccatgaaaacaccgaggaggtttcgatgagacgcgcacctctcatgtgggaactgatccataagaaggtcttgtcccctcaagaccaagatgtgcaggataatcctcgcggacgatccgccaaactgagggcagccattaagctctag

SEQ ID NO: 57552 - DNA, 1689 bp, Artificial Sequence
  Description of Artificial Sequence: Synthetic coding sequence
atggctctgtccaagagcatgcatgctcggaatcgatataaagacaagccacccgacttcgcttacctagcctctaaataccccgatttcaaacagcacgtccagataaatctgaatggcagagtgagtcttaatttcaaagaccccgaggccgtgcgggctctgacctgcacccttctccgcgaggacttcggattatcgatcgacattccactggagagactgatccccacagtgccactcaggcttaactatattcactgggtcgaagatctaattggacaccaagatagtgacaaatcaacattgaggagaggtatcgatattgggaccggggctagttgtatctaccctcttcttggcgctacccttaacggttggtacttcctggcaacggaagtggacgatatgtgcttcaactacgctaaaaaaaatgtagagcagaacaacctctctgatcttattaaagttgtaaaggtaccccagaagacactcctgatggacgcacttaaagaagagtcggagatcatctacgacttctgtatgtgtaaccccccttttttcgctaatcagcttgaagccaagggtgtcaattcaagaaaccccaggcggcctcctccgagctctgttaataccggtggaattaccgagattatggctgagggcggtgagcttgaatttgtcaagaggattattcacgactccttgcagctgaaaaagcgcctgagatggtactcctgtatgctcggcaagaaatgtagcctcgctcccctgaaggaagaactccggattcagggggttccaaaagtcacatatacagaattttgccaaggacggaccatgcgatgggcattagcctggagcttttacgacgacgtaactgtcccctctcccccatcgaagcggaggaagctggagaagcccagaaaacccataacttttgtggtgctcgccagcgtcatgaaggagctgtccttaaaggctagtcccctccggtccgagacggccgaggggattgtggtcgtaactacctggatcgagaaaatcctgaccgatctgaaggttcagcacaagagggtgccatgcgggaaggaggaggtatcattgtttctgacagccatcgaaaactcgtggatacacctgcggagaaagaaaagagagcgggtccgccagctccgcgaggttccacgtgcacccgaggatgtgatccaggcactggaggagaaaaaacctacccctaaagagagcggtaacagccaagagctggctaggggaccccaggagaggacaccatgcggtccagctctacgagagggcgaggccgcagccgtggaagggccatgtccatctcaggaatccttgtctcaggaggagaacccagaaccaactgaagacgaaagatctgaggagaaaggtggggtggaagttctggaatcctgtcagggcagcagtaacggagcgcaggatcaagaggcctctgaacagtttggctcccctgtggctgaacgcggaaagcgactcccgggagtcgcgggacagtatctgttcaagtgtcttataaacgtaaaaaaagaagtagatgacgctctcgtggaaatgcactgggtggagggccaaaacagggacttgatgaatcagctatgcacatatatcaggaatcagatttttagactggtggccgtgaactag

SEQ ID NO: 57553 - DNA, 675 bp, Artificial Sequence
  Description of Artificial Sequence: Synthetic coding sequence
atggcactgtctaaatccatgcatgcgcgtaacagatacaaagataagccaccagactttgcctatttggcatcaaagtaccccgactttaagcagcacgtgcaaatcaatctgaatggacgtgtatcacttaacttcaaggaccctgaagcagtacgggcactcacgtgcacactcctgcgcgaagatttcggcctgtctatagacatccccctggagcggcttattcctactgttcctctgaggctgaattatattcactgggtcgaagacctgataggacaccaggacagcgataaatctacgcttcggaggggcattgatattgggacgggcgcatcctgcatttacccgctactcggtgccacattgaacggctggtattttctcgccaccgaggtcgacgacatgtgcttcaattatgctaaaaagaacgtggagcaaaataatctttctgacttgatcaaagttgttaaggtcccccagaagactctgctaatggacgccctgaaggaagaatccgagattatctatgatttttgcatgtgtaatccccctttctttgctaaccagctcgaagcaaagggcgttaacagcagaaatccaaggcggccaccgccatccagtgtaaacacaggcgagagtctggaaccaggtcgcaggcggctccagtag

SEQ ID NO: 57554 - DNA, 606 bp, Artificial Sequence
  Description of Artificial Sequence: Synthetic coding sequence
atgaaagagttgtctctgaaggcaagccccctgcgctcagagaccgccgaggggatcgtcgttgttactacttggattgagaagatcctcaccgacctcaaagtccagcacaaaagagtgccatgtggaaaagaggaggtgtcactgttcttgactgctatagaaaactcctggattcacctgaggagaaagaaacgtgaacgtgttaggcagcttagggaggtgccacgtgcacccgaagacgtaatacaagccctggaagaaaagaagccgaccccaaaagagtctggcaactcccaggaactggctagagggcctcaagaacgtacgccatgcggtcctgctctgcgtgagggagaggcagcagcagtagaaggaccctgcccctcccaagaatccctttctcaggaggagaaccccgaacccactgaggacgaacgctcagaagagaagggtggcgtggaggttctagagtcttgccagggctcatcgaacggtgcacaagaccaagaagcctgttggttaaagctcgcccctcaactttggaccgcttctgctcgcagcgaaggcttgttcgtggagtctgggctgggtagcaccgcctag

SEQ ID NO: 57555 - DNA, 1035 bp, Artificial Sequence
  Description of Artificial Sequence: Synthetic coding sequence
atggctgagggcggtgagctcgaattcgtgaagagaattatccacgatagcctccagttgaagaagcgtctgcgatggtattcctgtatgcttggtaaaaagtgctccctggcccctttgaaagaagaactgcggattcagggcgttcccaaggttacctacaccgagttttgccaaggacgtacaatgagatgggccttagcttggagcttctatgacgacgtaacagtcccaagccctccgtccaaaagacggaaactagagaaaccgagaaagcctatcacattcgttgtgttggccagtgtgatgaaggagcttagccttaaagcatctcctctgcggtcagagactgctgaaggcatcgtcgtggtgacaacttggatcgagaagatactcacagacctgaaggtgcagcataagagggttccttgtggcaaagaggaagtgagcctgtttctcactgctatagaaaattcctggatccatttgcgacgcaagaagcgagagcgggtgcggcagcttagagaagtccctcgagctcctgaggacgtgattcaagcccttgaggagaagaaacctactcccaaagagtcggggaatagtcaggaattggcacggggtccccaggaacgcacgccatgtggaccggcattaagagaaggagaagctgctgctgttgaaggaccctgcccaagtcaagaaagcctctcccaggaggagaaccctgaacccacggaggatgaaagaagcgaggagaagggaggagtcgaagtgttagagtcatgtcagggttccagtaatggtgctcaggatcaagaggccagtgagcagttcggatctcctgtggccgagcgaggtaagcgtctccccggagtggcgggacagtacctttttaaatgtttaatcaacgtaaagaaggaggtagacgacgctcttgtcgagatgcactgggtggaggggcagaaccgggacctaatgaaccagctgtgcacctacatacgcaaccagatattccgtctcgtagctgtgaactag

SEQ ID NO: 57556 - DNA, 795 bp, Artificial Sequence
  Description of Artificial Sequence: Synthetic coding sequence
atggacgtgtgtctgtcgagtgcccaacaaccaggaaggcgcggtgaagggttaagctcaccaggaggctggctggaggctgagaagaagggagcacctcagaaagactctacaggcggtgttttggaggagtcaaacaagatcgagccgtcactacattcccttcagaagttcgttccaacggattacgcctcttatacccaggagcattaccgcttcgccggaaaagagattgttatccaggaatccattgagagttatggcgctgttgtctggcccggtgccatggctttgtgtcagtacctggaggagcatgccgaagagctgaactttcaagacgcaaaaatcctggaaatcggagcaggtcctggtctggtgagcattgtggcgagcatcctaggcgcacaagtcaccgctaccgatctacctgacgttctcggtaatctgcaatacaatttactcaagaataccctgcagtgcaccgctcatctgcctgaagtgaaggaattggtctggggcgaagacttggacaagaacttccctaaatcggccttttattacgactatgtgcttgcgagcgatgtggtataccaccattactttttagataaactcctgactacaatggtgtatctgtctcaacccggtacagttcttctgtgggccaataaatttcgattcagtacggactatgagtttctagataagtttaagcaagttttcgacaccaccctcttggccgaataccccgaatcgtccgtgaagctattcaaggggattctgaagtgggactag

SEQ ID NO: 57557 - DNA, 489 bp, Artificial Sequence
  Description of Artificial Sequence: Synthetic coding sequence
atgtggggtcggctactggcagcgttcccaccggtgccaacaccacagtccaccctgttctaccgtgccgacgtagttgtgacagacctcgaggaactccaagatctcctgaagatgaacataaacatgaataagcacctggtgactggttctgttcaggccaaagtgctcaagtggggggaggagatcgagggctttccttccccgccagatttcatactgatggcggactgtatttactacgaggagagtctggagccactgctgaaaaccctgaaggatatctccgggtttgagacatgcatcatctgttgctatgagcagagaacaatgggtaaaaacccagagatcgagaaaaagtattttgaactgctgcagctcgactttgacttcgaaaagataccactggagaagcacgatgaagaataccggagtgaagacattcacatcatctatatacgaaagaagaaatctaaattcccgtcttag

SEQ ID NO: 57558 - DNA, 585 bp, Artificial Sequence
  Description of Artificial Sequence: Synthetic coding sequence
atggccgatactctggagagctccttggaagatccactgcggagcttcgtgagggtgctagaaaagcgggatggcaccgttctgaggcttcagcaatactcttcggggggagtgggctgcgtcgtttgggatgccgcaatcgtccttagcaagtacctcgagacccctgagttctccggggacggcgcacacgctctgagccgtaggtcagtgttggagctcggaagcggcacaggggctgtgggcctgatggccgctactttgggtgccgatgtagtcgtgaccgacctggaagagttgcaagatctactaaaaatgaacattaacatgaacaagcacctggttaccggctctgtgcaggccaaggtgttgaaatggggcgaggagatcgagggattcccgagccctcccgactttatcctgatggccgactgtatttactacgaagagtcactagaacccctgcttaagacactgaaagacatcagcggtttcgagacgtgcatcatatgctgctacgagcagcggaccatgggtaagaacccagagatcgagaagaaatattttgagaaattccctagttag

SEQ ID NO: 57559 - DNA, 690 bp, Artificial Sequence
  Description of Artificial Sequence: Synthetic coding sequence
atggccgataccctggaaagttcgttggaggacccattgagatcatttgtgagagtgctcgaaaagcgcgacggaaccgtgctgagactccagcagtactcaagcggcggagttggatgcgtggtgtgggatgctgccattgtcctgagcaagtatctggagacaccagaattttccggagatggcgcacacgccctgtcccgaaggtccgtgctggaattagggtccggcacgggggctgttgggttaatggccgctaccttaggagccgatgtcgtggtaacagaccttgaagagctgcaggatttactgaagatgaacataaacatgaacaagcatctggtgaccggctccgtgcaggccaaagtactcaagtggggggaggagatcgagggctttccttcaccgccagattttattctgatggccgattgcatctactatgaggaaagtttggagcccctactcaaaacgttgaaggacataagtggcttcgagacctgcattatatgttgttatgaacagcgaactatggggaagaaccccgagatcgagaagaagtacttcgaactgttacagctggatttcgatttcgagaagattcctctggagaagcatgatgaagagtatcgctccgaggacattcatatcatttatatcagaaaaaaaaaaagtaagttcccttcctag

SEQ ID NO: 57560 - DNA, 618 bp, Artificial Sequence
  Description of Artificial Sequence: Synthetic coding sequence
atggtgcagctggctccagccgctgccatggacgaagtgacatttaggagcgataccgtcttgtccgacgtacacctgtatactcccaaccacagacacctgatggtccggctcaactcagtgggccagcccgtgtttctgtcccagtttaagctgttatggtctcaagattcttggacggactccggagctaagggcggaagtcatagggatgtgcacacaaaagagccaccttccgcggagacggggagcactgggtcccctcccggttctggacacggaaacgaaggattcagcctgcaagccggtacggatactaccgggcaggaagtggcagaggcgcagctggatgaagatggagatctagacgtggtccgtaggcctcgcgctgctagtgatagtaatcctgccggacccctaagagacaaagtccaccccatgattctcgcccaggaagaagatgacgtgctgggggaggaagcacagggaagtcctcacgacatcattagaattggtgtcgccggacggccagctcctgggagactgcatccagtcccaaccggacctctgcctagaatgtactccgctggcgctcggggacgtcacggggcaaggtag

SEQ ID NO: 57561 - DNA, 1215 bp, Artificial Sequence
  Description of Artificial Sequence: Synthetic coding sequence
atggtccagctggcccctgctgccgctatggatgaggtgaccttccggagtgataccgtcttaagtgacgtgcacctgtacactcctaatcacagacatctcatggtccgccttaattctgtgggtcagcctgtcttcttatcccagttcaagctcctgtggagtcaagacagctggacagatagtggggcaaaggggggaagccatagggacgttcatacaaaggagcctccatcggctgaaaccgggtcaacagggtcccccccaggaagtggacacgggaacgaaggtttctccctgcaggctggaactgataccacaggtcaggaggtggcagaggcacagctcgatgaggatggggacctggatgtagttcggagacctcgcgctgcaagtgacagcaatcccgctggacccttacgtgacaaggtgcaccctatgatcctggcacaggaagaagacgacgtcctgggggaggaagcacagggaagtccccacgacatcattcgcatcgaacacaccatggctacacccctcgaggatgtgggcaagcaggtgtggcgaggcgcactcttgctggctgactatatcctgttcagacaggatctgtttcggggttgcacagctcttgagctgggggcaggcacagggctggcatccattattgctgcaacgatggccaggacagtctattgcaccgacgtcggagccgacctgttatcaatgtgccagaggaatatcgcgctaaactcccacttggcagccaccggcggtggaatagtgagagtcaaggagctggattggctgaaagatgatttgtgcaccgatcccaaggtgccctttagctggtctcaggaggagatttccgatctttatgaccacactacaatactgttcgccgctgaagtgttttacgacgacgatctcacagacgctgtatttaaaaccctaagccggcttgcgcacaggctgaaaaacgcttgtactgcaattctgtccgtagaaaaacggcttaactttaccctgaggcatctcgatgttacttgcgaagcctatgatcacttccgatcttgtctccacgccctcgagcaattagcagacggaaagctcaggtttgtggttgaaccagttgaagcgtccttcccccagctgctagtgtatgagaggctgcagcagctagagttgtggaaaattatagctgagccggtgacttag

SEQ ID NO: 57562 - DNA, 1137 bp, Artificial Sequence
  Description of Artificial Sequence: Synthetic coding sequence
atggccggatcttaccccgagggagcacccgcagttcttgccgacaagcgacagcagttcgggtctcgcttcctcagggacccggctcgagtgttccaccacaacgcctgggacaatgttgagtggtccgaagagcaggctgcagcagccgaacgaaaggtgcaggagaactccattcagcgtgtatgccaggaaaagcaggtcgactacgaaatcaacgctcacaaatactggaatgacttctacaaaattcacgagaatggattctttaaagataggcattggctgttcaccgagttccctgagcttgcgccatcccaaaaccagaaccacctaaaggattggttcctggagaacaagtctgaagtgccggaatgcaggaataacgaggacggccctggtctaatcatggaagaacagcacaagtgttcctccaaaagtctggagcacaagacacagacattgcccgtggaggaaaatgtgacgcagaagatttctgacttggagatatgtgctgacgagttccctggctcatctgccacgtacaggattctcgaagtaggctgcggggtggggaacactgtgttcccaatcctccagaccaacaatgacccagggcttttcgtgtactgttgtgacttcagtagcaccgccatcgagctggtgcaaaccaattccgaatatgatccgagcaggtgcttcgcgtttgtacacgatttgtgcgatgaggaaaagtcatacccagttcctaagggctcacttgacattatcatactaattttcgtgctctcagcgattgttcctgacaagatgcagaaggctattaataggctaagtaggctcctgaaacctggaggcatgatgttgctacgcgactatggacgctatgatatggcacagttgcgattcaaaaaaggacagtgtctgtccgggaacttttatgtcagaggggacggcaccagagtgtactttttcacacaggaggagttagacactctttttaccaccgctggtttagagaaagtgcagaacctggttgataggaggctacaggtgaatcggggtaaacagctgaccatgtacagggtgtggatccagtgtaagtattgcaagcctctcctctccagcacctcttag

SEQ ID NO: 57563 - DNA, 654 bp, Artificial Sequence
  Description of Artificial Sequence: Synthetic coding sequence
atggctggctcctaccccgagggtgcacctgcagttttggcagacaagcggcagcaatttgggtcaaggtttctccgagatccagcaagggtgtttcatcataatgcctgggataacgtggaatggagtgaggagcaggcagctgcagctgaacgaaaagtgcaggagaatagtattcagcgcgtgtgccaggagaagcaagtcgactacgagattaatgcccataaatattggaacgacttctataagattcacgagaacgggttctttaaggatcggcactggttgtttaccgagtttccggagttggctccatcccagaatcagaaccacttgaaggattggttcctggagaataagtcggaggtgcccgagtgcaggaacaatgaagacggcccaggtttaatcatggaggagcagcataaatgcagctcaaagtctctggaacacaaaacccagactctcccagttgaagagaacgtgacccagaagataagcgaccttgaaatctgtgccgatgagtttccgggacaacctcctacagaatactggcgacttgctgtagtgtgggagactcagagttttcagttttacaaacgaactatgactcaggacagcctcttcattgccgtgattttcctgcctcagctctag

SEQ ID NO: 57564 - DNA, 1137 bp, Artificial Sequence
  Description of Artificial Sequence: Synthetic coding sequence
atggctggatcctatccagagggagctccagcgatcctcgccgacaagagacagcagttcggttctcgatttctttccgacccggcaagagtctttcatcacaatgcctgggacaacgttgaatggagcgaagaacaggctgccgctgcggaaagaaaagtgcaggaaaactcgatacagagagtttgtcaggagaaacaggtagactatgaaatcaatgcccataagtactggaacgatttttacaaaatccacgaaaatgggtttttcaaggatagacactggttgttcacagagttcccggagctggctccttcacaaaaccagaaccacctaaaggattggtttctcgaaaataagtcagaggtatgtgaatgtaggaataacgaggatggaccaggcctgatcatggaggaacagcataagtgtagcagtaaatcgttagaacacaagactcaaactcctcctgtcgaggagaatgtcacccagaagatctctgatctggaaatctgcgcagatgagtttcccggtagttccgctacatacaggatcctcgaggtaggttgtggagtgggcaataccgtgttccccatcctgcaaacgaataatgatcctggtttattcgtctattgctgtgatttcagttccaccgcgattgagctggttcaaaccaactctgaatatgatccttcacgctgcttcgcatttgtgcacgacctgtgtgacgaggagaaatcttaccccgttcccaaaggtagtctggatattatcatactgatctttgtcctatctgctgttgtgccagacaaaatgcaaaaggctattaatcgtctctcaagactcctgaagcctggcggaatggtgctgctgagagactatggacggtatgacatggcacagctcaggtttaaaaaagggcagtgtctgagcgggaacttttacgtgaggggggatggaacccgcgtctacttctttacacaggaagagctggataccctcttcacaaccgccggtctggaaaaggtccagaacctggtcgacagacgactgcaggtgaatcggggaaaacaactgaccatgtacagggtgtggatccagtgcaagtattgcaagcccttgctgagcagcacctcatag

SEQ ID NO: 57565 - DNA, 1419 bp, Artificial Sequence
  Description of Artificial Sequence: Synthetic coding sequence
atgtctgtagtacaccagttgtcagccggatggctcctggaccatctatcttttattaacaaaatcaattaccagcttcaccagcatcacgagccgtgttgccggaagaaggaattcactacatctgtgcattttgagagcttgcagatggattctgtgtcaagttctggtgtatgtgctgcattcatcgcgtcagattcctccaccaaaccggagaatgacgacgggggaaattacgaaatgttcaccagaaaattcgtattccgcccagaattgttcgacgtgaccaaaccatatattactcccgctgtgcataaagaatgccaacaaagtaacgaaaaggaggaccttatgaatggagtcaaaaaggaaattagcatctctatcataggtaagaagaggaagcggtgcgtggtctttaatcaaggggaactcgatgcaatggaatatcatactaagattcgggagctgattcttgatggctcattgcagctgattcaggagggccttaagagtgggttcctctaccccctttttgagaagcaagataaagggtccaagcctattacgctcccgctcgatgcgtgctcgctgtcagagctgtgcgagatggccaaacacctgccttccttgaatgagatggaacaccaaacactgcagctggtggaagaggatacatccgttacagaacaggatctcttcctgcgggtagtggaaaacaactcttccttcacgaaggtcatcaccttgatggggcagaaatacttattgccaccgaagagctccttcttgctatctgacatctcatgtatgcaacctctgctgaactacaggaagacattcgacgtgattgtaatcgatcccccttggcaaaacaaatccgtgaaaagaagtaatagatattcatacctaagtccactgcagatacagcagatacctattccaaagttggcagcaccgaactgtctattagtgacctgggtaaccaaccggcaaaagcatctcagatttataaaggaagagctgtacccctcctggtctgtggaggttgtagctgaatggcattgggtcaaaataacaaactctggagagttcgtgtttcctctcgactccccacacaaaaaaccctacgagggcctcatacttggacgcgtgcaggaaaaaacggcacttccgctccgtaatgcagatgtgaacgtcctacctatccctgaccataaactcatcgtctcagtaccatgtacgctccatagtcacaaacctccgctggcagaggtgctgaaagactatataaaaccggatggtgagtatcttgaactgttcgcccgaaatttgcagccaggctggacatcctgggggaatgaggtgctcaagtttcagcacgtcgattatttcatagccgtggaatctggctcctag

SEQ ID NO: 57566 - DNA, 1419 bp, Artificial Sequence
  Description of Artificial Sequence: Synthetic coding sequence
atgtccgtggtccatcagctgagcgccggatggctgctggaccacctctcttttatcaataaaattaattaccagctccatcagcaccatgagccttgctgtaggaagaaggagtttacgaccagcgtgcatttcgaatccttgcagatggactccgtgagttcatctggagtgtgtgccgcattcatagcgtctgatagctccaccaagccagaaaacgatgacgggggaaactatgagatgttcacaaggaagttcgtgtttagacctgaactcttcgatgtcacaaaaccttacataactcctgccgtgcacaaagaatgccagcagagtaacgagaaggaggacctgatgaacggtgtgaagaaagagatctccatcagcatcattggaaagaagagaaagcgttgcgtggttttcaaccagggtgaactggacgctatggaatatcatacaaagatacgggagcttatactggatgggtccttgcagcttattcaggagggactcaagtccggcttcttgtatcctttgtttgagaagcaggataaagggtcgaaacctatcacccttccactggatgcctgctccctctcagaactgtgcgagatggccaagcacctcccttcgctgaatgagatggagcaccagactctccagctggtcgaggaggatacgtccgtcaccgaacaggatttattcctgcgggtggtagagaacaactcctcgtttacaaaagtcatcacactcatgggtcagaagtacctgcttccaccaaaaagtagcttcctgctgtctgacatatcatgcatgcagcccctcctgaattaccggaagacctttgatgtgatcgtcatcgatccgccttggcaaaacaaatccgttaagagaagcaatcgctattcttacttgtctccgctccaaatccagcagatacctattcctaagcttgcagctccgaattgcctcctagtcacttgggttaccaacaggcagaaacatctacgtttcatcaaagaagagctctacccctcctggtctgtggaggtggtggccgagtggcattgggtgaagatcacaaatagcggtgagttcgtgttcccactcgactcgcctcacaaaaagccatacgaagggcttatcttaggacgggtgcaagagaaaacagcccttcccctaagaaacgccgacgtaaatgtgcttcctattccagaccataaacttatagtctccgtgccgtgcacgctgcacagtcacaaaccgcctctggccgaggtgctgaaggactacatcaaacccgacggtgaatatctcgagttgtttgctaggaacctgcagcctggctggacctcttggggcaacgaagtgttgaagttccagcacgtggattatttcattgctgtggaatccggcagttag

SEQ ID NO: 57567 - DNA, 855 bp, Artificial Sequence
  Description of Artificial Sequence: Synthetic coding sequence
atggcctcccttcaaaggaaagggctgcaggcacgtatcctgacctccgaagaagaggaaaaacttaagagggaccaaaccttagtctctgattttaagcaacaaaaactggaacaggaagcccagaagaactgggatctgttctataagagaaactcgacaaatttttttaaggaccgacactggactacccgagagtttgaggagctgcgcagttgtcgagagttcgaagatcaaaagctgactatgctagaggcaggctgcggggtcgggaattgtctattcccactgctagaagaagatccgaatatatttgcttatgcttgtgacttcagtccccgagccatagagtacgtgaaacagaaccccctatatgatacagagcggtgcaaagtatttcagtgtgatcttacaaaagacgaccttctggatcacgtcccaccggagtccgttgacgtggtgatgttgatattcgttctctcggcagtgcacccggataagatgcaccttgtgttacagaatatttacaaagtgttgaaacctgggaagtccgtgctatttagggattatggtttatatgaccatgccatgctgcggtttaaagccagctccaaactcggtgagaatttttatgtccggcaagacggcacgaggtcgtacttttttaccgacgatttcttggctcaactgttcatggataccggatacgaagaggtagttaacgaatatgtgttccgggaaactgtgaataagaaagagggcctttgcgtgccacgggtcttcttacagtccaaatttctcaaaccccctaaaaatccatcaccggtcgtcctcggactcgatccaaagagctag

SEQ ID NO: 57568 - DNA, 855 bp, Artificial Sequence
  Description of Artificial Sequence: Synthetic coding sequence
atggctagtcttcaacggaaggggctgcaggccagaattctgacaagcgaggaggaggagaagttaaaacgggaccagaccctagtaagtgattttaaacagcagaaactagagcaagaggcccaaaagaactgggatctattctacaagaggaattcgaccaacttcttcaaggatcgtcactggactacacgcgagttcgaggaactgcggtcatgtagagagtttgaggaccagaagctcaccatgctcgaagcgggatgtggcgttggcaactgcctctttccactgctggaggaggaccccaacatttttgcctatgcctgtgactttagtcctcgtgcgatagaatatgttaaacagaatcctctttatgataccgagcggtgtaaggtgtttcagtgcgacctgacgaaggatgatctgctcgaccacgtgccaccagagagcgtcgacgtcgtcatgttgatatttgtactgtccgccgttcaccccgataagatgcatctcgtgctacaaaacatctataaggtgctgaaacccggtaagtcagtcctgttcagggattacggcctgtatgatcatgccatgttacgattcaaggctagttctaaactgggtgagaatttttatgtgcgtcaagacggtaccagatcctatttttttacagacgatttccttgcacagttatttatggacacagggtatgaagaagtggtcaatgagtacgtgttccgtgagactgtgaacaagaaggaagggctttgcgtgcctagggtctttctgcagagtaagtttctcaaaccccctaagaacccttctcccgtggttcttgggctcgaccctaagagttag

SEQ ID NO: 57569 - DNA, 735 bp, Artificial Sequence
  Description of Artificial Sequence: Synthetic coding sequence
atggacatcctggtccctctgcttcagctactggtgctcttacttaccctgcccctacatttgatggcactgctgggctgttggcaaccactctgtaagagctacttcccttacctgatggcagtgctcacaccgaaatcgaatcggaaaatggaatccaaaaagcgggaattgttttcacagattaagggcctcacgggggcttctggaaaagtggcactactggagttaggatgcggcaccggtgccaatttccaattctacccgcctggctgccgagttacttgcctggacccaaacccacacttcgaaaaattcctgacaaagagtatggctgaaaatcggcacctacagtacgagcggtttgtggtcgcaccgggagaggacatgcggcagctggccgatgggtccatggatgtggtagtttgtacactggtgctgtgtagcgtgcagagccccagaaaggtcttacaggaggtgagacgggttctgcgacccggaggggtgctttttttctgggaacatgtcgcggagccttacggcagctgggctttcatgtggcaacaggtgttcgagccaacctggaagcatatcggagacggatgttgtctgacaagggagacctggaaagacctggaaaacgcccagttcagcgaaatccagatggaacgtcagcctcctcccctgaagtggctccctgtgggcccacatataatgggcaaagcagtgaagtag

SEQ ID NO: 57570 - DNA, 957 bp, Artificial Sequence
  Description of Artificial Sequence: Synthetic coding sequence
atgcggctcctagcgggatggctgtgcctgagcttagcctccgtctggctggctcggagaatgtggacacttcgctcccctttgactaggagcctgtatgtcaatatgacttcaggccctggtggacctgccgcagccgctggcggacgcaaggaaaaccatcagtggtatgtttgtaaccgggaaaagctctgtgagagcttgcaggcagtgtttgtgcaaagttatctggatcaagggactcaaatattccttaacaattcaattgagaaatcaggttggctcttcatccagctttatcatagctttgtctcctccgttttctccttattcatgagtcgcacaagcattaacgggctgctgggtagaggctcaatgttcgttttcagtcctgatcagtttcagcggctactaaagataaatccagattggaaaacccatcgcctgctggacctaggggctggcgacggcgaggttacgaagattatgtccccccatttcgaggaaatttacgccacagagctgagcgagactatgatctggcagttacagaaaaagaaatatcgggtccttggtatcaatgagtggcagaatacaggatttcagtatgacgtaattagttgcctgaacctcctcgatcggtgtgaccagccgctgaccttactcaaggatattcggtccgtactggagccaacgagggggagggtcatcctcgccctggttctgccattccacccatacgtcgagaacgtcgggggaaagtgggagaagcccagcgagatactggaaataaaaggccagaactgggaagaacaggtcaactccctgccagaagtctttaggaaagctggtttcgtgattgaggcctttactcgtctgccgtacctatgcgaaggcgacatgtataatgactattatgttctggatgacgcggtatttgtgctcaagccagtatag

SEQ ID NO: 57571 - DNA, 954 bp, Artificial Sequence
  Description of Artificial Sequence: Synthetic coding sequence
atgcggctgctggcaggctggttgtgtctgtcactggcctcggtctggctggcccgtcgaatgtggacgctgcgtagtcctctcacgagatctctctatgtgaatatgacttccggcccaggagggccagcggcagcagcgggaggcaggaaggagaatcaccagtggtacgtgtgtaatcgcgaaaagctctgcgagtccctacaagctgtcttcgtacagtcctatctcgaccagggaacgcagattttcctgaataattcgatcgagaaatctggctggttgtttatccagctgtaccatagcttcgtatcatcagtgtttagtctgtttatgtctagaaccagtataaatggcctacttggaagggggagcatgttcgttttcagccccgaccagttccagcggctcctaaaaattaaccctgattggaaaacacatcggctgctggacctcggtgccggagacggagaggtgactaagatcatgtccccacacttcgaagagatttacgcaacagagctgtctgagactatgatatggcagctacagaagaagaagtacagagtgctggggattaacgagtggcagaatacagggttccagtatgacgtgattagctgcctcaacctcctcgatcgctgtgaccagcccctgaccctgctgaaggatatccgctcagtcttagagccaactcgtggcagggtgatcctggccctcgtcctgcccttccacccatatgtcgagaatggcggtaagtgggaaaagccgagcgagattctcgagatcaagggacagaattgggaggagcaggtaaactctcttccggaggtgtttcgcaaggcgggattcgtcattgaggccttcactcgtttaccatacttatgcgaaggggacatgtataacgattattacgttctggatgatgccgtgttcgtcctgaagccggtgtag

SEQ ID NO: 57572 - DNA, 849 bp, Artificial Sequence
  Description of Artificial Sequence: Synthetic coding sequence
atgtggactctgagatctcccctgacccggtcactatacgtcaaggagaaccaccaatggtacgtgtgcaacagagagaaactatgcgaaagtctgcaggctgtgtttgtgcagtcttatctggatcagggtactcaaatttttctgaacaactcaattgaaaaaagcgggtggctgtttattcagctgtatcattcattcgtgtctagcgtgttttccctgtttatgtctcgaacttctataaatggcctcctggggaggggttccatgttcgtattctccccagaccaattccagcggttgcttaaaattaaccctgactggaagacccaccgtctgctagatctgggtgcaggcgatggggaagttacgaaaatcatgtctcctcattttgaagaaatctatgcaactgaactaagcgagacaatgatctggcagctgcagaagaaaaagtacagggttctgggtataaacgagtggcagaacaccgggttccaatacgatgtgatatcttgcttgaatcttcttgataggtgcgatcagcccctgacacttctgaaggacattcggtcggtcttagaacccacccgcggacgagtcattctggccctcgtgctgccgtttcacccctacgtggagaatgttgggggaaagtgggagaagccttccgagatacttgagatcaagggtcagaactgggaagaacaggttaacagcctgcctgaggtgttcagaaaggctggatttgttattgaggcctttactcgtctcccctacctatgtgaaggagacatgtacaacgactactatgtgttggacgatgcagttttcgtgctgaaacctgtgtag

SEQ ID NO: 57573 - DNA, 165 bp, Artificial Sequence
  Description of Artificial Sequence: Synthetic coding sequence
atgatgaaaccacaggccgagaccggcgaggcagctagagatccatctcttcggccagcccgaacagtgttggtgggctccctttcttggctcaggaagcaacttcagcccacacattgcaagtatgaaggccctcgcaaggcgcgaagactgtggttcgcatag

SEQ ID NO: 57574 - DNA, 231 bp, Artificial Sequence
  Description of Artificial Sequence: Synthetic coding sequence
atgattgccggagagcaccgactggatcccgcaactatatccctcggcgttgatcaaacagatgaccatcagcagccaacccatagtaggatccgaaagaagcgtgtgagccctacttctgtctggtttcaaccatacttctgcatccttaaaacgctttgtaccacgctggacacagttcaggatgacgccacttctagctggatgctgatctgtcacgtggatttctag

SEQ ID NO: 57575 - DNA, 7290 bp, Artificial Sequence
  Description of Artificial Sequence: Synthetic coding sequence
atggatatgtcagacccaaatttctggaccgtactttcaaactttaccttgcctcacctgagaagcggaaaccgcctccggcgaactcaaagttgccgaacgagtaaccggaaatcactgataggcaacggccagtccccagcacttcccagaccccattcccccttgagtgctcatgctggcaacagtccccaggattcaccacgcaatttctcgccttccgcaagcgcgcacttttcatttgctcgcagaactgatggaaggcggtggtctctggcatccctgccctcctcaggttacggcaccaatactcctagctccacggtgagtagcagctgctcaagccaagaaaagctgcatcagcttccataccaacccactcctgacgagcttcatttcttatccaaacacttttgcaccacagaatccatcgccaccgaaaatcgttgccgcaatacaccaatgagaccaaggtctcgatcactgagcccgggaagaagccctgcctgctgcgatcacgaaataataatgatgaaccatgtgtataaagaacgctttcccaaggccacagcacagatggaagaaagactcaaggagattatcacatcttattccccagacaatgtgcttccacttgcggacggcgtgttaagcttcacacaccaccagattatcgaactggccagagactgcctggataaaagccaccaaggactgatcacttcacgctactttcttgaactgcagcacaaacttgataagttgctgcaggaagctcatgataggtccgagtcgggagagttagctttcattaaacagctagttcgaaagattctgatcgtcattgcccgtcccgctcggctactcgaatgtctggagttcgatcctgaggagttctactatttgctggaagccgctgagggccacgccaaagaaggccagggaattaagaccgacatcccacgctacattatcagccagttgggcttaaacaaagaccccttggaggagatggcccacttgggaaattatgacagtgggaccgcagaaacccccgagacagatgaaagtgtatcttctagcaatgcctccctgaaactgcgacgaaaacccagagaatcggattttgaaaccataaagctgatctccaatggcgcttacggggcagtgtatttcgtgagacacaaagagtcacgccagcgctttgctatgaagaaaattaacaaacagaacttaatattgaggaatcaaatccagcaggcattcgttgagcgagatatcctaaccttcgcagaaaatcccttcgtcgtctcaatgtattgcagttttgagacgcggagacatctgtgcatggttatggagtacgtcgagggtggcgactgtgcgacacttatgaagaatatgggaccactgccagtagacatggctaggatgtatttcgcagagacagtgctggccctcgaatacctccacaattatggcatcgtgcaccgcgatctcaagcctgacaatctcctcgtcacctccatgggtcatatcaaactgaccgatttcggtctatccaaggtaggactgatgtctatgacaaccaacctgtacgagggacatatagaaaaagacgctagagagtttttagataagcaggtgtgcgggacgcccgagtatattgctcctgaggtgattttgcgacaaggttatggaaagccagtagattggtgggccatgggcatcatcctgtacgagtttttagtgggatgtgtccccttcttcggcgacactcccgaagagctgttcggtcaagtcatcagtgacgagatcaattggcccgagaaggatgaggcacctccgcctgacgctcaggatctgatcactctattgcttcgccaaaaccctttagaacgacttggcaccggcggagcctatgaagtgaaacaacatagatttttccggtcactcgattggaattctctccttcgtcagaaggctgagttcatcccccagctggagtccgaagacgacacttcctattttgatacgcggtctgagaaataccaccatatggagacggaagaagaagatgacaccaatgatgaggatttcaatgtggagattcgtcagttctcctcgtgtagtcatcgattttctaaggttttcagcagtatcgacaggatcacacagaacagcgccgaggaaaaggaagacagtgtggacaaaaccaaaagcacaactctcccttctacagaaacactttcttggtcttccgagtacagtgagatgcaacagcttagtacatcaaactcttcggacaccgagtccaacagacataagctgagctctggcctgctgccaaagctcgctatctctactgagggagaacaggacgaggcagcctcttgccccggtgatcctcacgaggaacctggaaaacccgctttgcctccggaggagtgtgcccaggaggagcctgaggtcactacacccgcatcaaccatttcttcatccaccctatccgtaggctcgttttccgagcatctcgatcagatcaatggtagatctgaatgcgtggattcgaccgacaattcctcaaagccatcctcggagcccgcaagtcacatggcacgacagcgcctcgagtctaccgagaagaaaaaaatttccgggaaagtgaccaagtccctatcagcatcagcgctctcattgatgataccaggcgacatgtttgcggtttccccactgggctccccgatgagcccccacagtctgtccagtgacccctctagtagtcgggatagcagccccagccgagattctagcgccgcttctgcctcacctcaccagccaattgtcatacacagctctggcaaaaattacggttttaccattagggctatcagggtttatgtaggagattctgacatctatactgttcatcatatagtctggaatgtcgaggagggttcccccgcatgtcaggctggactcaaagcaggagatctgatcacccatatcaacggcgagcccgtgcacggtctggtgcacaccgaggtcattgagcttctgctcaaatcaggaaacaaggtgtcaatcacaacaaccccatttgagaatacttcaataaagactggaccggctcggcgtaactcatacaagagccgcatggtcagaagatcaaagaaatccaaaaaaaaggaatccttggagcggcgaaggtcactgttcaagaaactggccaagcaacctagccccctgctacacacgagcaggtctttctcctgtctgaatcgatccctttctagcggggaaagcctgcccggaagtccaacacattccctttctccacgctctccaacgccctcctatcggtcaacacctgacttcccatccggaacaaacagttcccagtctagctctcctagcagttccgctccaaattctccggctggttctggacacatcaggccatcaacactgcacggcctggcacctaagctcggcggtcaacggtacagaagcggacgcagaaaaagcgccggtaatatcccactgtccccactggccagaacaccatcgcctacgccacagccaacgagccctcaaagaagcccctccccgttgctcggccactccttagggaatagcaaaatagcacaagcctttccctccaagatgcactcccctcccacaattgtgagacatattgtccgccctaagagcgctgaacccccacggagtccgctgctaaagagggtgcagtctgaagaaaagctctcacctagctacggtagtgataaaaagcacctgtgtagtagaaagcacagtctcgaagtaacgcaagaagaggttcaaagggagcaatcacaacgcgaggctcccctccagagcctggacgaaaacgtgtgtgacgttccccctctctcaagggcacggccagtagagcaaggatgtctgaaaagacccgtcagcaggaaggtcggcaggcaagagagcgttgacgaccttgacagggacaagctcaaagcaaaagtggttgtgaagaaggccgacggcttccccgagaaacaagagtctcaccagaagtcgcatggacctggctctgatctggagaattttgctctgtttaaactggaagaaagggagaagaaagtatatccaaaagctgtcgagagatccagtactttcgagaataaagccagcatgcaggaagcccctccactgggaagcctcctaaaagacgcgctgcacaagcaagcatccgttagggcctctgagggggctatgtccgacggacgagtaccagccgaacatcgccagggaggcggagacttcagacgggcacccgctcctgggactttacaagatggtctgtgtcacagcctggatcggggaatctctggaaagggagaaggaacagaaaaaagctcccaggccaaggagcttctgcgctgcgagaaattagacagtaaactggccaatatcgactacctcaggaaaaagatgagcttagaagataaggaagacaacctgtgccctgtgttgaagccaaaaatgactgctgggtctcatgaatgcctccctgggaatccggttcggcctacaggtggccagcaggagcctcccccagcttctgaaagtcgcgcttttgttagcagcacgcatgcggcacagatgtcagcagtttccttcgtgccactaaaagccctgacggggcgagtggacagtggaaccgagaaaccaggcctcgtggctcccgagtcccctgtgcgaaagtccccctccgaatacaaattggagggaagatccgtgagttgtctcaaacccatcgagggcacactcgacatcgctctcctcagcgggcctcaggcaagtaagacggagctaccatcccctgagtccgcgcagagtccttcaccgtctggagatgtccgggcatcagttccccctgtcctgccctcaagcagtggcaagaagaatgacaccacatccgcacgggagctctctcccagcagtctcaaaatgaacaagtcatacctgctggagccttggtttctccccccatcgcggggtctccagaattcccctgcggtgtctctgccagacccggagttcaaacgcgatcgcaaagggccacatcccacagctcgtagccccggtaccgtcatggagagtaacccgcagcagcgggaagggagttcacccaaacaccaggaccacaccacagacccaaagttgctaacatgtctaggccagaacctgcatagtccagacctcgctagaccgaggtgtccgctcccccctgaggcttctccttccagagagaagccaggcttgcgcgaatctagtgagagaggcccaccaaccgccagatccgaacgaagcgctgcaagggccgacacctgtcgggaacctagcatggaactttgctttcccgaaactgcgaaaacatccgacaactcaaagaacctgctgtcagtcgggaggactcaccccgatttttatacgcaaacacaggccatggaaaaagcatgggcccctggaggtaagacgaaccacaaggacggtcccggagaggccaggccacccccaagagataatagctctctacacagcgcagggatcccgtgtgaaaaagagctcggtaaagtgagacgcggagtcgagcctaaaccagaggcgctccttgctcgcaggagcttacaaccacccggtatcgaatcagagaagtccgaaaagttgtcatccttccccagcttacagaaggacggggcaaaggaacccgaacgtaaagagcagccactgcagcgccatcccagctccatccctccgcctcctctgactgcgaaggatctgtcctcccccgctgcaagacaacactgttcatctccctcgcacgcctccgggcgagagccaggtgctaagccgtccacagctgaacctagctccagcccccaagacccgccaaaaccagtcgccgctcactctgagagttcttctcataaacctagaccgggacccgaccctggacccccaaagacgaagcatcctgaccggtctctaagttcacagaaaccatctgtgggcgcaacgaagggcaaagaaccagctacacagagcttgggcggatctagccgggaaggaaaaggacactccaagagcggacccgatgtcttcccagccacacccggaagccagaataaggcgtccgatggcatcggacagggagaaggaggcccaagcgtgcctctccacactgacagagccccactggatgctaaaccccagccaacgagcggagggagacccctggaagtgctcgagaagccagtgcacctgccgcgacccggacaccctggtcctagcgagccggctgaccagaagctttccgccgtgggtgaaaaacaaaccctcagtcctaaacacccaaaacccagcaccgtgaaggattgccccaccctgtgtaagcagaccgacaatcgacaaacagataagagccccagtcagcccgctgccaacactgatcggagagcagagggaaaaaagtgcactgaggcattgtacgcccctgccgaaggggacaagctcgaggcaggactctcctttgtacattcagaaaatagactgaaaggggctgagcgtccagccgcaggcgtcggcaaaggcttccctgaggcaagaggtaaaggaccaggccctcaaaaacccccaactgaggccgataaacctaatggtatgaaacgcagccccagtgcaacagggcaatcatcctttcgcagcacagcactcccagaaaagtctctgagctgcagctcatccttcccagaaacacgcgctggagtgcgggaggcctctgcagcatcaagcgacacaagttcagccaaggccgcaggcggtatgctggagttacccgctccctccaatcgagatcatcggaaagcacagcccgcaggggaagggagaacgcatatgaccaaaagtgattctctgccatcttttagagtaagtaccctgccgcttgagagccatcatcctgaccccaatacaatgggcggagcatcccaccgggatagggctttgtccgtcactgccaccgttggagaaacaaaaggaaaggacccagcccctgcacagccgccacctgctagaaaacagaacgttggccgtgatgtcacaaaacccagccccgctcctaataccgatcgtcccattagtctgagcaatgaaaaagattttgtcgtgcgacagcgccgtggaaaggagtcgcttcggagttcacctcacaagaaagctctatat

SEQ ID NO: 57576 - DNA, 7334 bp, Artificial Sequence
  Description of Artificial Sequence: Synthetic coding sequence
atgaaagcccagagggaaaggttgcagatccctggactaacactggatctaaccccaaggagcctgtcccccacaccgtcttctcccggatctccatgcagcccgttgctagccttccacttttggtcatgtagaacaagcaaccgaaagtctctgatcggcaatggacagtccccagccctacccagaccccactctccccttagcgcccacgcaggcaatagtcctcaggattcccctcggaatttttctccaagcgctagtgcgcacttttctttcgcaagaagtctgaatagaactgatggcaggcggtggtcgctggcatctttacccagctccggttatggcacaaacacaccctcaagcacagtgagctctagctgctcctcccaggaaaagctccatcaactgccctaccaacctacacccgatgagttgcatttcctgagtaagcatttctgcaccacggaatctatcgccacagagaacagatgcaggaacacccccatgagacccagaagcagatctctgagcccaggccgtagtcccgcttgttgcgatcatgagatcattatgatgaatcatgtttataaggaacggttcccaaaagcaaccgcccaaatggaagagcgtcttaaggagataattaccagctattctcccgataacgtcctacctctagccgatggagtactctccttcacacatcaccagattatcgagctggctcgagattgtctcgataagtctcaccagggccttatcacgtcaagatactttctagagctccagcataaactcgacaaattactgcaggaagcgcacgacaggtcagaatctggggagctcgcattcatcaaacagctcgtgcggaaaatcctcatcgtgatcgcgaggcccgctaggttattggagtgtcttgaattcgatccagaggagttctactacttgctggaggcggcagaaggtcacgcaaaggaagggcagggtataaaaaccgatatccctagatatattatttcccagctaggcctgaataaggatccgctggaggagatggcgcacctgggaaactacgactccgggactgcggagacccctgaaacggacgagtctgtgtctagcagcaatgcttctctgaagttgcggaggaagcccagggagtccgacttcgagacgataaagcttatctctaatggagcttatggagctgtatactttgtgaggcacaaagaatcacggcaacgctttgccatgaaaaaaatcaataagcagaatctaatcttacggaatcagatccagcaggcattcgtcgagagagacattctcacatttgccgagaacccctttgtggtttcgatgtattgtagctttgagacacgcaggcacctgtgtatggtcatggaatacgtcgagggtggtgattgcgccacactgatgaagaacatggggcctttgccagtggatatggccaggatgtattttgccgaaactgtactggcattggagtaccttcacaattatggcattgtacaccgtgatctcaagccagataatctattagtcacatccatgggacacatcaagctgaccgattttggactttctaaggttggtttgatgtccatgacaacgaatctgtatgagggccatattgagaaagatgcccgtgaatttctggacaagcaggtgtgcggcacgcccgagtatatcgctcctgaagtgatcctgcgacagggctacgggaagcccgtcgactggtgggcgatgggaataattctttacgaattcctggtgggttgtgtgcctttctttggcgatacacctgaggaactctttgggcaggtgatcagcgacgagatcaattggcctgagaaggatgaggcccctccccctgacgctcaggaccttattaccttactcctgagacagaacccactagagaggctgggtacaggcggagcctatgaagtaaaacagcatcgttttttccggtctctggattggaactcccttctaagacaaaaggcggagtttattccgcaactcgagtcagaggacgacactagttatttcgacactcgcagcgaaaagtatcaccatatggagaccgaagaggaggatgacacaaacgacgaggacttcaacgtagaaatcagacagttttctagctgcagtcatagattttcaaaggttttcagtagcatcgatcgcattactcagaactccgccgaggagaaggaggattccgtggacaagaccaaatccactacattaccaagcacagaaactctgagctggagtagcgagtactccgaaatgcagcagctgtcgacatctaattcaagtgacactgagtcgaaccgtcacaaactttcatcgggcctgctgcccaagctggcgatatccaccgagggggaacaggatgaagcagccagctgccccggtgaccctcacgaagaacccggtaaacccgcattacctcccgaggagtgcgcacaggaggagccggaggttaccactcctgccagcacaatcagcagttccaccctatcagtggggagtttttctgaacatcttgaccagatcaatggacgttcagaatgtgtggacagcaccgataactccagtaagccctccagtgaacccgctagccatatggcacgccagcgattggagtccaccgagaaaaagaaaatatctgggaaagtgactaagtcactttctgccagcgcgctatcactgatgatcccgggagatatgtttgccgtcagccccctcggctctcccatgtctccacacagcctcagctccgatccttcctcttcgcgcgattccagtccgagtagagattctagcgcagcctcagccagcccacaccagcccatcgttatccacagcagcggtaagaattatggatttactattcgagcaatacgagtgtacgtcggtgacagtgacatttatactgtgcaccatattgtctggaacgtggaagagggatctcccgcttgccaggccggtctgaaagcaggggatctgattacacatataaatggggaaccagtgcacggactcgtacacacagaagtgatagaactgttactgaagagtgggaataaggtgtccatcaccactacccctttcgaaaacacttcaattaagacaggcccagctaggcgcaactcctataagtctcggatggtgcgtcgttctaaaaaaagcaaaaaaaaagaatctttagaacggcgacgctctctctttaagaagctggccaaacagccctcccccttgttgcatactagccgttccttttcatgcttgaacagatcactgagcagtggagagtcacttccgggatcccctacccacagtctcagcccccgatcccccactccctcatacagatcaacaccagacttccccagtggaacaaattcctcccagagctctagcccttccagttcagcgcctaacagccccgcaggatctggacatattaggcccagcacacttcatggacttgcacctaagctcgggggacaacgctatcgcagcggtcggagaaagagcgctggaaacatcccgctgtctccgctggcaaggacaccgagcccaacaccccagcctacgtcccctcagagatcccctagcccacttctgggtcattctctcggtaacagtaaaatcgctcaggccttccccagcaaaatgcactcacctcccaccatcgtgaggcatatcgtgagacccaagagcgccgaacccccacgaagtcccttactgaagcgagttcaaagtgaggagaagcttagtcccagctatgggtccgacaagaaacatttatgctccagaaagcattcactggaggtgacacaagaagaggtccagagagaacagtcccagagggaagccccactccagtcccttgatgagaatgtgtgtgacgtccctcccctaagccgagctcgcccagtggagcaggggtgtttgaagaggcctgtgtcaagaaaggtgggccgacaggagagtgttgacgacctggatcgggataagttgaaagccaaggttgtagtgaagaaggcggatgggtttccagaaaaacaagagagtcaccagaagtcacacggcccaggtagtgacctggagaactttgctctcttcaagttggaggagagggagaaaaaagtgtacccaaaagccgtggaacgctccagcacattcgagaataaggctagcatgcaagaggctccacctcttggcagtctgctgaaagatgccctccacaagcaggcaagtgtccgcgcttctgaaggcgcaatgtctgacgggcgagtgccagcagagcaccgtcaggggggtggcgactttcgtcgtgctcctgcccctggtaccctgcaggatggcctatgtcacagtctggatcgcggaattagtggcaagggggagggaacagaaaagagctcacaggctaaggagctattgagatgcgagaagttagactccaaactggccaatatcgactacctgcggaagaaaatgtccctagaggacaaagaggataacctttgtcccgtgctaaaacccaaaatgaccgcaggttcgcacgagtgtttgcccggaaaccccgtgagacctactggtgggcagcaagaacctccccctgcctcagagagtcgagcctttgtctcatctactcacgcagctcagatgagtgcagtgagctttgtgcccctgaaggccctcactggaagggtggactccggaactgagaaaccaggactggtggccccagaaagtcctgtcagaaagtccccatctgagtacaagttggagggaaggtctgtctcctgtcttaagcccattgaaggaacactcgacatcgccctcttgtccggccctcaggctagcaaaacggaactcccatctcctgagtctgctcagagtcctagtccttccggtgacgtgcgcgcttctgtgccacctgtgctgccatcctcttccggaaagaagaatgatactacctccgcccgagaattatctccttcaagtctgaaaatgaacaagagttacctactcgagccttggttccttccgccaagtagggggctccagaatagtccagcagtgagcctgccagatccggagtttaaaagggacagaaaaggacctcaccccaccgcgaggtccccgggaacagtcatggagtcgaatccccagcagcgtgagggatcctctccgaagcatcaagaccacacgacagatcctaagctcctgacttgcctggggcagaatctgcatagccccgacctagcgagacctcgttgcccactgccccctgaggcgagcccctctagggaaaaacctgggctgagagagtcttcggaacgagggccacctaccgcccgatccgaacgaagtgcggctagagcagacacgtgccgggagccaagcatggaactatgtttccccgagacggccaagactagtgataacagtaagaacctgcttagcgtgggcaggactcaccccgatttctacacgcaaacgcaggccatggaaaaagcctgggcccctggaggaaagacaaatcataaagacgggcctggggaagctcggcctccaccacgtgacaacagtagtctccactcagccggtattccctgcgagaaagagttaggcaaagtacgcagaggagtggaacctaagccagaagcacttctggcacgcaggtccctacagccaccagggattgagagtgagaagagtgagaagctatcctcctttccttccctccagaaggacggtgcgaaagagccggaaagaaaagaacagccactgcaacggcacccctcgagcatccctcctcccccattgactgctaaggatctctcatctcctgccgctcgtcagcattgttctagcccttcccacgcgagcgggagggagccaggcgctaagccctccaccgcagagccttcatcaagcccccaagaccctcctaagcctgttgcagcccacagtgaatccagctctcataaacctcgccctgggcctgaccccggaccgcctaagaccaagcaccccgacaggtccttaagcagccagaagccttctgtgggtgcaacaaagggtaaagaacctgcaacacagtccctgggcggaagttctagggaggggaaggggcactcaaagtccgggccagatgttttccctgccacgcccggatcccaaaataaggcgagcgatgggatcggtcagggcgaaggcggacctagcgtacccctccacactgaccgcgcacccctggatgccaaaccccagcccacatccggcggtcggcctctggaagtgctggaaaaaccagtgcatctgccacgccctgggcatcctggaccatctgagcctgcagaccaaaaactctccgccgtgggagaaaaacagaccttgagcccaaaacaccccaaaccatccacagttaaagactgtccaactctgtgcaagcagaccgataataggcagacagataaatcaccatctcagcccgcagccaacaccgaccgaagagccgaggggaaaaaatgcactgaggcactctatgcacctgccgagggagataaactcgaagctgggttatcattcgtccattcggagaatcgcctgaaaggagccgagcgcccagcagctggcgtaggaaaggggttcccggaggccagagggaaaggccctggaccccagaagccgcctaccgaggccgataaaccaaatggcatgaagcgctccccatcagccacaggccagtccagctttcgctccacggccctgccagagaaatcgctgtcctgttcgtcatctttccccgaaacgcgcgctggtgtccgagaggcgtctgccgcttcctcagataccagttcagcaaaagctgcgggtggaatgcttgagctcccagctccatccaatcgcgatcacaggaaggcacagccagccggtgagggacgaacgcacatgaccaaaagcgatagtttacccagcttccgtgtatccaccctgcctctggaatcacaccaccccgatccgaatacgatgggcggagcatcccatagggaccgggctctgtccgtcaccgcaacagtgggtgaaactaagggcaaggacccagcacctgctcaaccgcctcccgctcgaaagcagaacgttggaagggatgtcactaaaccctcccctgcgccaaacaccgaccggccaatttccctatctaacgagaaggactttgttgtaaggcagaggcgaggaaaggagagtctacgcagctctccccacaaaaaggccctgta

SEQ ID NO: 57577 - DNA, 7304 bp, Artificial Sequence
  Description of Artificial Sequence: Synthetic coding sequence
atggatgaatccagcatcttgcgccgaaggggcctgcagaaggagctttccctaccaagacgcggtagcctaattgactcacagaagtggaactgtctagtcaagaggtgcagaacctctaaccggaaaagcctcatcggcaacggacagagccccgcattgcctagaccacattctcctctgagcgctcatgcaggtaattcaccccaggacagccctcggaacttcagccccagcgctagcgcacatttctcatttgctcgcaggacggacggtagacgctggagtctggccagcttgccaagctcgggctatgggacaaatacccccagctccacagtttcctcctcctgctccagccaagagaaactgcaccagctcccttatcagcctactccagacgaactgcactttctgtccaagcacttctgcaccacggagagcatcgccaccgagaacaggtgccgtaatacacccatgcgccctcgctctcggagtttgtccccgggtaggagtccagcgtgttgtgaccacgagattatcatgatgaatcacgtttataaggagagattccccaaggcaacagcccaaatggaagagcgcctcaaggagattataactagctattcccctgacaatgtcctccctctcgccgatggcgtcttgagcttcactcaccatcagataatagaacttgccagggattgtctcgacaagtcacatcagggcctgatcactagccgctacttcctcgaactgcagcacaaactggataagttacttcaggaagcccacgataggtcagagagtggcgagcttgcgtttatcaagcagctggtccggaaaatcttgatcgtgatcgcccgtcccgctcggttgctggagtgtttagaatttgatcccgaggagttctattacctgttagaggccgctgaggggcatgctaaagaggggcagggcattaagaccgacatccctcggtatattatatcccagctggggttgaataaggatcccctggaggagatggcccatctgggcaattatgacagcggcacagcagagacaccagaaacagatgaatctgtgtcttcctccaatgcctccctaaagctccgacgtaagccacgcgagagtgatttcgaaaccatcaaactgatttccaacggggcttacggggcagtgtattttgttcgccacaaagagtcaaggcagcgattcgccatgaaaaaaataaataagcaaaacctgattctgcgcaatcagatacagcaggccttcgtagaacgtgatattctcacatttgcggaaaacccattcgtggtgtctatgtattgttccttcgagacaagaaggcacctgtgcatggtcatggaatacgtcgagggaggcgattgtgccacactgatgaaaaatatgggccctctgcccgtggacatggcgaggatgtattttgcagaaaccgtgctagcactcgagtacctccacaactacggtatcgtccatcgtgaccttaagccagataacctactagttacctcgatggggcacatcaaattaaccgattttggattgtccaaagtcggtttgatgagcatgacaacaaatctctatgaaggccatatcgaaaaagacgccagagagttcctggacaaacaggtgtgtggcacccccgaatatattgcccctgaggtgatccttagacaaggatacggaaagccagtggattggtgggcaatgggaataatactctatgaatttctcgtcggatgcgtgcctttcttcggcgacacgccggaggaactcttcggtcaggtgatatcagacgagatcaactggcctgaaaaggacgaagcccctccccctgacgcacaggatttgattaccttgctgctgcgacagaacccactcgaacgcctcggcacagggggtgcctatgaggtgaagcagcacagattcttcagaagcttggattggaactctctcctgcgccagaaagctgagttcattcctcagctcgaatctgaagatgataccagttattttgatacccggtccgaaaaatatcatcacatggaaactgaagaagaggatgacactaacgatgaagatttcaacgtggaaattcgacagttcagtagctgttcacaccgattctcgaaggtgttttcaagtattgaccgtatcacacagaattccgctgaagagaaggaggattccgttgacaagactaaatccactaccctgccctccacagaaacattaagttggtcaagtgaatactcagagatgcagcagttgagcacaagtaatagctcagacacagagtcaaaccggcataagttgagttccggcttgctcccaaaactggctatatccacggagggtgaacaggacgaagccgcttcgtgtcccggtgacccacatgaggagcctggcaagcccgctctgccgcctgaggagtgtgcccaggaggagccggaagtgacaacacctgcaagtactatcagcagttctaccctgtctgtcgggagcttttctgagcacctcgatcagattaacggacgatccgaatgcgtggacagtactgacaacagtagcaaaccgtcatccgagccggcttctcatatggctagacagcggctggagagcaccgagaagaagaagataagcggcaaagtaaccaagagtctctctgcaagtgccctctctctaatgattcccggtgacatgtttgcagtttcacctcttggctcaccaatgtccccgcattccctgagttccgacccaagttcttctcgggatagtagtccttctcgggacagcagtgccgcaagtgcgtcccctcaccaaccaatcgttatccacagctccggtaaaaactacgggtttaccattcgagccatcagggtgtatgtcggggattctgatatctacacagtgcatcacattgtttggaatgttgaggagggcagccccgcttgtcaagcgggacttaaggcaggcgatctgatcacacatatcaacggagaaccagtccatggacttgtgcacactgaggtgatcgagctcctgttgaaatcaggcaataaggtatccattaccacaacacccttcgagaacacctccattaagacaggcccagcaagacggaacagctataagtcaagaatggtaagaaggagtaagaagtcaaaaaaaaaagagagtctcgagaggcggaggtccctttttaaaaaactggccaaacaaccgtcacctctgttacatacttcccgcagctttagctgcctgaacagatccctgagttccggtgagtcactgcctggatccccaacccactccttaagtccaagatctcccaccccgtcatacagatctacacccgactttccatccggtactaatagctcccagtcatcttccccttcatcgtccgcacctaattcaccagcgggttctggacatatcagaccaagcacgctgcatgggctggcccctaagctgggcggtcagcgatatcgatctgggcgtcgaaagagtgctggaaacatcccactcagtcccctggccaggacaccttcacctaccccccagcctacttcgcctcagcgatctccttccccactgctcggtcacagcctagggaacagtaagattgctcaggcgtttccttccaaaatgcatagccccccaaccatcgtacgtcacatcgttcgacccaaatctgctgaaccgcctagatcaccactcctgaaacgagtgcaaagcgaagagaagctgtcgccatcatacggaagtgacaaaaaacacctctgttccaggaagcactcacttgaagttacgcaggaagaagtgcagagggaacagagccaacgggaggccccactgcaaagcttggatgaaaacgtatgtgatgtacctccactaagtcgagccagacccgtggaacagggctgcttaaaacgcccagtttcaagaaaagtggggagacaggagtccgttgacgatctggatcgcgataagctcaaagcgaaggtcgtggtcaaaaaagcggatggatttcccgaaaagcaggagtcccatcagaagtcccatgggccagggtcagatctggagaattttgcattgttcaaactggaagaacgggagaagaaagtgtaccctaaggctgttgaaagaagcagcacctttgagaacaaagcctcaatgcaggaggctccccctttaggcagcctgcttaaagacgcactccataaacaagctagtgtgagggcctccgagggagcaatgagtgacggcagagtgcccgcagaacaccgccaaggagggggagatttcaggcgggcacctgctcctgggacactccaagatggactctgtcactcactcgatcgaggcataagcgggaaaggtgagggcacggagaagtcttcgcaggcaaaggagctcctgcgttgtgaaaagctcgatagtaagctggcgaacatcgattatctacggaagaagatgagtctcgaggacaaagaggataatttatgtcccgtgctgaaacccaaaatgacagccggaagccacgagtgtctcccaggcaacccagtcagaccgactgggggacagcaggagcctccccctgcatctgagagcagagcttttgtgagcagtacccatgctgctcaaatgagcgccgtgtccttcgtccctctgaaggctcttacaggcagggtcgacagcgggacagagaaacccggactggtggctcctgagagcccggtgaggaagagcccatcggagtacaaactggaaggcagatctgtctcatgtcttaaaccgatagaggggactctcgacatcgctcttctgtcaggacctcaggcctctaaaacagagctccctagtcccgagagtgcccagagtccatccccaagcggcgatgtcagggcctcggtcccacccgtactgccctcctctagcggcaagaagaatgacacaacctcagccagggagctgtctcccagctccttgaaaatgaataaatcctatttgctcgagccttggttccttccacccagcaggggtctccagaactcccctgcggtcagcctgcccgaccctgaattcaaacgagatcgtaaagggcctcacccgaccgccagatctccaggtaccgttatggaaagcaatccacagcagagagaagggagcagccccaagcatcaggaccacacaacagatccgaagctgctgacctgcctcggtcagaatctgcactctccagacctcgctcgacccagatgtcctctccccccagaagcctctcccagtcgggagaagcctggcctgagagagtcttctgaacgagggcctccaaccgctaggtcagagcgctccgctgccagagccgacacatgccgtgaaccctctatggagctttgtttccctgaaactgccaaaacatccgacaatagcaaaaatttactgtccgtgggacgaacacatccagatttctacactcaaacccaggcaatggaaaaagcctgggcacctggcggtaagacaaatcataaagatgggccaggcgaggctcgtcccccaccgcgagacaactcatcactgcactctgccggaattccctgtgaaaaagagctcgggaaggtgcgcaggggcgtcgagcctaaaccagaggccttgttggccaggcggagcctccagcccccagggatcgaatcggagaagtctgagaagttatcatcatttccgtccctgcagaaggatggtgctaaagagcctgagcgaaaggaacaacctctgcagagacaccccagtagcataccaccccctcctctgacagctaaggatttgtcgagcccagccgcaaggcagcactgctcttcacctagtcacgcctccggacgtgagccgggtgccaagccttccacagccgaaccgtcctccagcccccaggatccacccaagccggtagccgctcacagtgaatcctcctcccataaacccagacctgggccagatcccggaccccctaagaccaaacaccctgatcggtcgttgagttcacagaaaccgagtgtgggagcaacgaaggggaaggagccagctacacagtcccttgggggttcctccagagaagggaaaggacattctaagagcgggccagacgtgttcccggctacacccggatcgcagaacaaggccagcgacggcatcgggcagggggaaggcggtccatccgtgccactgcataccgatcgggctccgctggatgcaaaaccgcagcccactagtggcggacggcctcttgaagtgctcgaaaagcctgtccatctgcccagacctgggcacccgggtcccagtgaaccagccgaccaaaaactctccgccgtgggagaaaagcagaccctcagccctaaacatccgaagccctccaccgttaaagattgccctaccctttgcaaacagaccgacaacagacaaaccgacaaatctcccagccagcctgctgccaatactgaccgccgagccgaaggcaaaaagtgcacagaggcactgtatgcccctgccgagggagataaactggaggcaggactgagtttcgtgcactccgagaaccgattgaaaggggctgaaaggcctgccgcaggggtgggcaaagggttcccagaggcgagggggaaagggccaggacctcaaaaaccacccacagaggctgataagccaaatggcatgaaacgaagtccgtccgccactggccagtcatcattccgctctactgctttaccagagaagtcactaagctgttccagttcgtttcctgagacaagagccggtgtccgagaggcaagtgccgcatcaagcgatacaagctccgccaaggctgcaggtggtatgttagagctacccgctccaagcaatcgcgaccaccggaaggcccagcctgccggtgaagggaggacccacatgaccaagtcagacagcttacctagcttcagggtctccactctgcctctcgaaagtcaccacccagaccccaataccatgggaggtgcctcacaccgggacagagctctctcagtgactgctaccgtcggggaaaccaagggaaaggaccctgcccctgcacaacccccaccagcccgaaaacagaacgtgggaagggacgtcacaaaaccttctccagctcccaataccgaccggcctatctctctgagcaatgaaaaagatttcgtggtgaggcagagaaggggtaaagaatcgctgcgctcctcccctcataagaaggccttgta

SEQ ID NO: 57578 - DNA, 7880 bp, Artificial Sequence
  Description of Artificial Sequence: Synthetic coding sequence
atgggcgagaaagttagcgaggcccctgagccggtgcctagaggttgctctggacacgggtctcggacacccgcatctgctctggtcgccgcaagcagccccggtgccagttctgcagagagttcgagtggaagtgagactctgagcgaagagggagagcctgggggtttctcccgcgaacaccagccacctcctcctcctcccctaggcggtactctgggggctcgggcacccgcagcctgggcacccgcatcagtgcttctggagagaggtgtgctggctctcccaccccctctgcccggaggcgctgtaccccctgcaccaagagggagctcagcttcccaagaagagcaagatgaagagctggatcacattctcagccccccacctatgcctttccgtaagtgtagtaatccagacgtggcctctgggcctggcaagtcactgaaatacaaaagacaactctcagaagatgggcgtcagctcaggcgtggtagtctcggtggggctctgactggcaggtatctgctccccaatccagttgccggacaagcttggcctgcaagtgcagaaacgtctaatttagtaagaatgagaagtcaagcattgggtcagagtgccccatccctcactgctagtctaaaggagctgtccctgcccaggcgtgggtccttctgccgcaccagcaaccgcaaatcactcattgggaacgggcaatcacccgctttgccgcgaccccatagcccgctatccgcgcacgctggaaactccccacaggatagcccccgtaatttcagcccttctgcttccgcccactttagtttcgctcgctctctgaatagaacggacggtaggagatggagcttggctagtctgccatcctccgggtatggtactaacaccccatccagtaccgtttctagctcttgctcctcccaggagaaactccatcagctcccctaccagcctactcctgatgaactgcactttctgagtaaacacttctgtaccacggagtccatcgcaaccgaaaacaggtgtcggaatacccctatgcgccctcgctccagatcactctcccccggaagatctccagcttgctgtgatcacgagattatcatgatgaatcatgtctacaaagagagatttccaaaagcaacggcccagatggaagagcggctaaaggagatcattacctcgtacagccccgataatgtgctgcctctcgcagatggcgtgctgagctttactcatcaccagatcatcgagcttgccagggattgcttggataagtcacaccagggattgatcacaagccgatattttctggagctccagcataaactcgataaactcctccaggaagcacacgacaggtccgaatccggagagctggctttcataaagcagctggtacggaaaatcctgatcgtgatcgccaggcctgccagactgcttgaatgcctggagtttgaccctgaagagttctactacctactcgaagcagccgaaggtcacgctaaggagggccagggaatcaagacagacattccgcgatatataatatcccagcttggcctgaataaagaccccttagaagaaatggcacacctgggcaattacgactccgggacggccgaaactcctgagacagacgaatcagtgagcagttcgaacgcatcacttaaactgaggcggaaacctcgggaaagcgacttcgaaactatcaaattaatatccaacggggcatacggcgcagtctacttcgtgaggcataaagaatcgcgacagaggtttgccatgaaaaaaattaacaaacagaatctcatcctgagaaatcagatccagcaagctttcgtcgaaagggacatattaaccttcgctgagaatccgttcgtagtctccatgtactgctctttcgagactaggcgacatttatgcatggtgatggagtacgtggaaggaggtgactgcgctacacttatgaaaaatatgggccctctgccggtggatatggcccgtatgtactttgctgagacagtgctggcgctggaatacttgcacaactatggaatagtccaccgggatctgaagcccgataacttgctggttacaagcatggggcacataaagctgaccgacttcggcttgtcaaaagtagggttgatgagcatgaccactaatttgtatgagggacacattgagaaggacgccagagagtttctggataagcaggtttgcggaacaccggagtacattgccccagaagtgatactgcgacagggttatggtaaacccgtcgactggtgggcgatgggcattattctttatgaattcctcgtcggttgcgtgccgttcttcggagatacacctgaagaactctttggacaggtgatatcagacgaaatcaactggcccgagaaagacgaagcaccccctcccgatgcacaggacttaatcactctcctcctcagacagaaccctctcgaacgcttaggaaccgggggagcgtacgaggtcaagcagcaccgctttttcaggagcctggactggaacagcttgcttagacaaaaggccgagtttattccacagctggagagcgaggatgataccagctactttgatacccggagcgagaagtaccaccacatggagactgaagaagaagatgacaccaatgacgaagactttaacgtggagatcaggcagtttagctcttgttcccatcgcttttcgaaagtgttttcttcaatcgataggattacacaaaatagcgccgaggagaaggaggattctgtggataagacaaaatccaccaccttacccagcaccgagacccttagctggtcaagtgaatattcagaaatgcagcagctgagcacctccaactcctccgatacagagtcgaaccgccacaaactgagttcgggacttctgcctaaactcgctatcagtacggagggagagcaagatgaggctgcctcttgtcccggtgatccccacgaagagccgggaaaaccggctttgccgcctgaagaatgcgctcaggaggagcccgaggtgactacacccgcttctaccataagctccagcactctcagcgttgggagtttctccgagcacctggaccagatcaatggacgttcggagtgcgtggattccacagacaactcctcgaaacccagcagcgagccagcatcgcatatggcacgccagcgcttggagagtacagagaaaaagaagatttcaggaaaggttacaaagtctctgagcgcttcagctctgagtctaatgattccgggagatatgttcgccgtgtcccccctaggatcacccatgtccccacattcccttagttctgatccttcgagttcgagggattcctccccaagcagagactccagcgccgctagtgcctccccccaccagccaatcgtaatccacagctccggaaagaattatgggtttacgatcagggcaattagagtgtacgttggcgacagtgacatctataccgtccaccacattgtctggaacgtggaagaaggatcccccgcatgccaagctgggctgaaggcaggtgatctgatcacccatattaacggtgagccagtccacgggttagtccacacggaggtaattgaacttctgctgaagtccggcaacaaagtgtcaataacaacgactccatttgagaatacctccattaagactggacccgcacggaggaactcttacaagtctcgcatggtgcgcaggtcgaagaagagcaagaaaaaagaaagtctggagagaagaagatctctgtttaagaaactggctaaacaaccatctccgttgctccacactagcaggagcttcagttgtctgaataggtctctcagttcaggcgagagcctccccggatcacccactcattcactgtcacctaggagccccactcctagctatcgatccacccctgatttccctagcggtacaaattctagccaatcatcgtcaccgtcctctagcgccccaaacagccctgccggttctggtcatatccgcccttccacactgcacggtctcgctccgaaattagggggacagagatatcgcagtgggagaagaaagtcagccggtaacatcccactgagcccactggcccgaacgccttcacccaccccgcagccaactagcccccagaggtctccttcccccctgctggggcattccctaggtaacagcaagatagcccaggcatttccctccaagatgcactctcctccgaccatcgtgcgccatatcgtgcggcctaaatccgctgagccaccaaggagcccactgctgaaaagggtgcaaagcgaagagaagttgtcacctagttatggaagcgataaaaaacacctgtgctcacggaaacatagcttggaagttacacaagaggaggtgcaaagggagcaatctcagcgggaagcacccctccagtctctggacgagaatgtttgtgatgttcccccattgagtagggccagacccgttgagcaaggatgcctgaagaggccggtaagtcggaaggttggaaggcaggaatccgtggatgatctggacagggataagctcaaggcgaaagtggtagtgaaaaaggccgatggcttccccgaaaagcaggaatcgcatcaaaaaagtcatggccctgggtcagacctcgagaattttgcactcttcaagctcgaggagagggaaaaaaaggtgtacccaaaagcggtggaacgtagtagtacctttgagaacaaagcctctatgcaggaggccccaccactgggttccctgctgaaagacgcacttcataaacaggcgtcagttcgggctagcgagggagcaatgtccgatggccgagtgcctgctgagcatagacagggaggtggtgactttcgcagagccccagctcccggtactttgcaagacggcctttgccactccctggaccggggaataagtgggaagggcgaggggacagagaagtcttctcaggccaaagaactgttaagatgcgagaagctggattcgaaactcgcaaacatcgactacctgcgtaagaagatgtcccttgaagataaggaggacaatctgtgccccgtattaaaacctaaaatgacggcgggatcgcacgaatgcctcccgggaaacccagtacgcccaaccggcggacagcaggaacctccccctgcgagtgaatctagggcctttgttagtagtacacacgcagcacaaatgagtgctgtgtccttcgtaccattgaaagccctgaccggtagagtcgattctggcactgaaaagcctggccttgtcgccccagaaagccccgtgcgtaaatctccttccgagtataagctcgagggacgatccgttagctgcctcaaacccattgagggcaccttggacatcgccctgctttctggaccccaagccagcaagaccgaactgccctcacctgaatcagctcagtccccctcgccttccggtgatgtgcgagcatccgtcccacctgtgctgccctcttcatcgggaaagaagaatgacactacctctgcgagagaactttctccatcttccctaaaaatgaacaagtcttacctgctagagccttggtttctgcccccttctagaggcctccagaacagccctgctgtgtctttgccagatccagagttcaaacgggacaggaaagggcctcaccccaccgccaggtcgcccggaaccgtaatggaatcaaaccctcaacagagagaaggcagctctcctaagcaccaggatcataccaccgacccaaagctgctgacctgtctgggacagaatctgcattccccagacctggctagacccagatgccccctgccgccagaagcaagcccaagcagggaaaaacccggactgcgcgagtcttccgaaaggggaccccctacagcccgaagcgagcgctctgccgctagggcagatacatgtcgcgaaccatctatggagctgtgcttccctgagaccgccaaaacctccgataactctaagaacctcctctccgtgggccgtacccacccagatttctatactcagacacaggctatggagaaggcctgggcgccaggtgggaagactaaccacaaggatggaccaggggaagcgaggccgccacctagagacaactcctcactgcactccgccggaatcccatgcgagaaagaactgggcaaagtccgacgcggagtcgagcctaagccggaggcactcctggccaggcgttctctgcagcccccagggattgaatccgagaagtccgagaagttatccagtttcccctccctccagaaagacggcgctaaggaacctgagcgaaaagagcagcctctgcaaaggcatccttcctccataccccctccgcctctcactgcgaaggaccttagctccccggctgcgagacaacattgctcaagtccaagtcacgccagtggcagagaacccggagccaaaccgtccactgcggagccttctagttctccacaagaccccccaaaaccagttgccgcacattcggagtcctccagtcacaagccacgccctggccctgatccgggtcctccaaaaacaaagcatcctgacagaagtctgtcatctcagaagccatctgtcggcgcaaccaagggaaaggagccagccactcagtctctgggtgggagctcacgcgagggaaaaggacacagcaagagtgggcctgacgtgttcccagccactcctgggtcccagaacaaggcgtcagacggcattggccaaggagaagggggacccagtgttcctctgcatactgacagggccccactggacgctaagccccagcctacgagcggagggaggccactagaggtgctggaaaaacctgtgcacctgcctcggcctggacatccgggaccctccgaacccgctgaccagaagctgagcgctgtcggcgagaagcagacactgagtcccaagcatcctaagcctagcacagtcaaggattgccctactttgtgtaagcagaccgataaccggcagactgacaaatcccccagccagccagcagcaaatacggatcgaagggccgaaggcaaaaagtgtaccgaagccctgtatgcccctgccgagggcgataaactagaggcgggactgtcctttgtacattccgagaatcgccttaagggagccgagcgacctgccgctggagttggcaagggctttccggaggcacggggtaaggggcctggaccccagaagcccccaaccgaagccgacaagccgaatggaatgaagagatccccatccgctaccggccagtcctctttcagaagtaccgctctgccggagaaatcactgtcctgctcatcctcttttccagaaaccagggccggtgtacgggaggcgagcgctgcaagctcagacacttcatccgccaaagccgcagggggtatgttggagctgccagcaccctcaaacagggaccacagaaaagctcaacctgcaggtgagggacgaacacacatgactaagagtgactcattgcccagcttcagagtgagcaccctgcccctagagtcccaccatccggacccaaacaccatgggaggcgcttcccatcgtgaccgggcactttctgtcacggcaactgtcggcgagactaaaggtaaggaccccgctcccgctcaaccccctcccgctcgtaagcagaacgtggggcgtgatgtgacaaagccaagcccggctcctaacaccgacaggcctatttccttgagtaacgaaaaagattttgtggttcgacagcggcgagggaaagagagcctgcgaagctcaccacataagaaggcccttta

SEQ ID NO: 57579 - DNA, 7334 bp, Artificial Sequence
  Description of Artificial Sequence: Synthetic coding sequence
atgaaggcccagagagaaaggctgcagatcccgggactaaccctggatctaactccacgatcactaagccctacaccatcctctcctggcagcccctgttctccactgttagcttttcacttttggtcgtgccggacatccaatcggaaatccctgatcggtaacggacagagcccggctctgcccagaccacactcacccttaagcgcccacgccggtaattctccacaagatagccccagaaacttctcccccagtgcatcagctcattttagctttgccaggagaaatgatagaacagatgggcgacgatggagccttgcatctctcccgagttccggctacggtactaatacacccagctctaccgtctcttctagctgctcgtcacaggaaaagctacaccagttgccgtaccagcctacgccggacgagctccacttcctcagcaaacacttctgtacaactgagtccattgcgacagagaacaggtgtcgaaatacaccaatgcgtccgcgttccagaagcctgagtccaggtcggtcgccagcatgttgcgatcatgaaattataatgatgaaccatgtgtataaagagcgttttcctaaggccactgcacagatggaggagcgcctgaaggagatcatcacaagttacagcccagacaatgtgctgccactggctgatggtgtccttagctttactcatcaccaaatcatcgaactggctagggactgcttggataagagccaccagggtctgataaccagtaggtacttcctcgagttacagcataaactggataagttgctgcaggaggctcacgataggtccgagtctggcgagcttgcctttattaaacagctggtgcggaaaattcttatagttatcgcgaggcccgctcgactgcttgagtgtctagagtttgaccctgaagaattctactacctcctggaagctgccgagggccacgctaaggaagggcagggaataaaaaccgacattccaaggtacattatctcccagctgggtctgaacaaagaccccctcgaggaaatggctcacttgggtaactacgactcaggcacagccgaaactcctgagacggacgagtccgtgagctcatctaatgcatctttgaagctgcgtcgaaagcctcgcgaatccgatttcgaaacgattaagctgattagcaacggtgcttatggagccgtgtatttcgttagacacaaagagagccgccagcgctttgccatgaagaaaattaacaagcagaacctcattctgcgtaatcaaatccaacaagccttcgtggaaagggacatcctgacatttgccgaaaacccgtttgttgtctcaatgtattgctcctttgagaccagaaggcacctgtgcatggttatggagtatgtggagggcggagattgcgctactctgatgaaaaacatgggtcctctccctgttgatatggcgcgtatgtatttcgccgaaacggtgttagccctggagtacctccacaattacggaatcgtccaccgggatttgaaacctgacaacctgctcgtcacctccatgggtcatatcaagcttaccgattttgggctgtccaaggtcgggctgatgtccatgacgaccaacctttacgaaggtcacattgagaaagatgctcgggagtttctggataagcaggtgtgcggtactcctgagtacattgccccagaagtcatactgcgccagggctacggaaagcctgtcgactggtgggccatgggcatcatactgtatgagtttctcgttggatgtgtgccgtttttcggtgataccccagaggaactcttcggacaggtcattagtgatgagattaactggccagagaaggacgaagcccctccacccgatgcccaggatcttattacattattgctgcggcagaacccattggagcgtctgggcaccggcggagcatatgaagtaaagcaacaccggttttttagatctctggattggaacagcttgctccgtcagaaggctgagtttattcctcagctcgagtcggaggatgacacctcatacttcgacacgcgcagtgaaaagtatcaccatatggagactgaggaggaagacgacaccaatgatgaagatttcaacgtggagattcgacagttctcctcctgctcccacaggttcagtaaggttttctcctctatcgatcggattacccaaaattcagcggaagaaaaggaagatagcgtggacaagaccaagagcacaaccttgcccagcacggagactctgagctggtcctctgagtactccgagatgcagcaattaagtacctcaaattcctctgatacagagagcaacagacataagctgtcatcagggctgctgcccaagctcgccatcagcaccgaaggagagcaggacgaggccgcttcctgtccaggcgatccacacgaggaacccggtaaaccagctctgccccctgaggaatgtgcccaggaggaacccgaagtgaccacgcccgcaagtactatctccagctccaccctctctgtggggtcattcagtgagcacttggatcagatcaatgggagatctgaatgcgttgacagcacagataactccagcaaaccatctagtgagcccgcttctcacatggccagacagcgacttgaatctacagagaagaaaaaaatttcagggaaagttacaaagtccctgtccgcgagtgcactgtcgctcatgataccaggcgatatgtttgccgtcagtcctctcggatctccaatgtccccacactccctgtccagtgatcctagtagttctcgtgattccagcccctctcgggattcttcggccgcaagcgcgagtccccaccaacccattgtcatccattcctcgggcaagaactacggattcacaattagggcaattcgagtctacgtgggcgattccgatatctacacggtgcaccacatcgtttggaacgtcgaagagggctccccagcatgtcaagcgggtctgaaagcaggggacctgataacccatattaatggggaacctgtacatgggctagttcataccgaagttattgagctgctcctgaagtccggaaacaaagtgtccataacaaccacacctttcgagaacacaagcatcaaaaccgggccagctcggcgaaactcctacaagagccggatggttcggcgatcaaaaaagtcaaaaaagaaagagagcctcgaaagacggcgtagtttatttaaaaaactcgccaaacagccaagccccttactgcataccagtcgatctttctcctgccttaacaggtcactcagttccggagagagtttgcccggatcccctactcactccctcagcccgcgtagtcctactccgagttatcggagcacaccggatttccccagcgggacaaactccagtcaaagtagcagtccctcttcttccgcccctaacagccctgccggtagcggccacatccggcctagcactctgcacggactggccccaaagttgggcggacaaagatatcgctccgggagaaggaagtctgccggtaatatccccctgtcccctttagcccgaactccatctcccacacctcagcccacaagtccgcagcgctctccatccccgcttcttggccactccctgggtaacagcaaaatcgcccaggcgttcccaagtaaaatgcactcaccccctacaatcgtgcgacatatcgtgcgaccaaagagcgccgagcctcctcggtcacctctactcaaaagagttcaatcggaagagaaactgagccctagctacggctccgataaaaagcatctgtgctccaggaaacatagcctagaggtgactcaagaagaggtgcaaagggagcaaagtcagcgagaggcaccactgcagtcactggacgagaacgtgtgtgacgtacctccactgtctcgagctagacctgtggagcagggctgcctgaaacgcccagtgagccggaaagtgggaaggcaagagagcgtggatgatctcgatagagataagttaaaagctaaagtcgtggtgaagaaagctgatggtttccccgaaaaacaagaatcacatcagaaatctcatggcccaggcagcgacctggagaatttcgcccttttcaaactggaggagcgagagaagaaggtataccccaaagccgtcgaacgatccagtacttttgagaacaaagcctccatgcaagaggctccaccacttggctccctgttaaaggatgccttgcataaacaggcttctgtgcgggcatccgagggagcgatgagcgacggcagggtgcctgcagaacacaggcagggagggggagatttccggagggctcccgcacccggaaccctccaggatgggctgtgtcactccctggatcgcggtatctcaggcaaaggcgagggcaccgaaaagtcatcccaagcaaaggagcttctgcggtgcgaaaaactggacagtaaacttgccaacatcgattacctgcgcaagaagatgtccctcgaagataaagaagacaatctgtgccccgtcctgaaacctaagatgaccgccggtagtcatgaatgcctgccagggaatccagtacgcccaacggggggtcagcaggagccgcctcctgcttctgagtcccgggcatttgtctcctccacacatgcggcacaaatgagtgctgtttcattcgttccattgaaggccctgaccggccgtgtggattctggaactgaaaagcccggtctcgtcgcccctgaaagtcccgtcagaaaaagtccctcagaatataaactggagggaagatccgtttcgtgtctcaaacctattgagggcacactggatatagccctcctatcaggcccacaggccagcaagaccgagctcccgtcgcctgagtcagcccagtcccccagtccttccggagatgtcagagcgtccgttccgccagtgctaccctcgagttctggaaaaaaaaacgatacaacttcagcgagagagcttagtccgtctagcttaaagatgaacaaatcctacctgttggagccatggtttctgcccccttctagaggcctccagaattcccctgctgtaagtcttccagatcccgagttcaagcgcgatcgcaagggccctcaccctacagctcgtagccccggaaccgtcatggaaagcaacccacaacagcgcgagggaagttcacctaagcatcaggatcacactacagaccctaaactcctcacttgtctgggacagaatctccactcacctgatcttgcacgtccgaggtgccctcttccaccggaagcttccccttccagagagaaacccggtctgagagaaagctcagagcggggaccccctactgccagatctgagaggagcgctgcacgagctgacacttgtagggaaccctctatggagctgtgcttccctgagacagccaaaacctccgataacagtaaaaatctcctgagcgtaggcagaacccaccccgatttctacacccagactcaggcaatggagaaggcctgggcgcctggcggaaaaaccaatcacaaggatggaccaggcgaggcacgccctccccctcgcgacaacagttcgctccattcagcagggattccatgtgaaaaggaattaggcaaggtgcgacgtggcgtggagcctaagccagaagccctgttagcgcgtcgttcactgcaaccccctggcattgagtccgagaagagtgagaaattgtctagctttcctagtctgcagaaagatggagccaaggagcccgaacgcaaggagcagcccctacaacggcatccttcgtcaattccccctccccctctcaccgccaaagatctcagttctcctgccgcacgacagcattgttccagtccaagccacgcatctggcagagagccaggagccaagcctagtactgctgaaccatcatcttctcctcaggacccaccaaagccagtggcagctcacagcgaaagctcttcacacaaacctcgtccaggaccagaccccggtcctcccaagaccaagcatccagatcggtccctaagctctcagaagccgtccgtcggcgcaaccaaaggtaaggagcccgcaacacaaagccttggtggtagtagtcgcgaaggaaaggggcattccaagagcggcccagacgtattcccagctacaccaggaagtcagaataaggcttccgacgggattggacagggtgaagggggaccatctgttccccttcacaccgacagagcaccactggacgcaaagcctcaaccaacttccggaggacgccctttggaggtgctcgaaaaacctgtccatttacccagacccggacatcctggcccatctgaacccgcagaccaaaaattgagcgctgtcggagaaaaacagactttatcccctaagcacccaaagccttccacagtgaaggattgcccaacgctgtgcaagcagacggataaccggcagaccgataagtccccgtcacaacctgccgcaaacaccgatagaagagctgaaggcaagaagtgcacagaggccttatatgcacctgcggagggtgacaagttggaggcagggctgagctttgtacatagcgaaaaccgcctaaaaggcgctgagcggcctgctgccggtgtcggaaaaggctttcctgaagcccgaggcaagggcccaggccctcagaaacctcccacggaagccgacaagccaaatggaatgaaacgatcgccgtccgccaccgggcaaagcagtttcaggagcaccgccctcccagaaaaaagcctgagttgtagcagctccttcccggagactcgggcaggcgtgcgtgaggcttctgccgcatcatccgataccagcagcgcaaaagcagccggaggaatgttagagctgccagctcccagcaaccgcgatcacaggaaagcccagccagctggcgaaggcagaacacatatgaccaagtccgattcgctccccagcttccgagtaagcactctgcccctggagtcacaccaccctgatccaaatactatgggcggagcaagccatagggaccgggctttgagtgtgacagctactgtgggagagacaaagggtaaggacccagcgcctgcccaacctcctcctgcgaggaaacagaacgtggggagggatgtcactaagccttccccagccccaaacacggatcgtcctatctctctgagtaacgagaaggattttgtggtgaggcagagacggggtaaggaaagtctaaggagctcaccccacaaaaaagccctcta

SEQ ID NO: 57580 - DNA, 753 bp, Artificial Sequence
  Description of Artificial Sequence: Synthetic coding sequence
atgggcgagaaggttagtgaagctcccgaacccgtacctcgaggatgcagtggccacggaagtagaactccagcaagcgcactggtggctgcctcctctcctggtgcctcttccgcagaatcttccagtgggtcagaaactctcagcgaggaaggcgaaccaggagggttctcccgggagcaccagccaccgcctccccctccattgggcggaactcttggagcaagggccccagccgcttgggccccagcaagtgttttgctggagcgaggcgtgctagccttgccaccgccactgcccggaggagctgtgcctcccgctcctcgaggatcttccgcaagccaggaagagcaagacgaagaactagaccatattctgtcacccccaccaatgccctttagaaagtgttcaaacccagacgtggcctctgggcctggtaagagcctcaagtataaaaggcagttatctgaagatggtaggcaactgcgccgtggctccctgggaggcgctctgacggggaggtatctcctgcccaacccagtggcagggcaggcctggccggcatctgcggagacatcaaacctggtgcgcatgaggtcccaggccctggggcagagtgcgccatccctgaccgcctccctgaaagagctttccctgccaagacgcggtagcctaatcgactcccaaaagtggaattgtctggttaaacgcccagtgtgcccgaatgcagggagaacttcccccctcggctag

SEQ ID NO: 57581 - DNA, 2982 bp, Artificial Sequence
  Description of Artificial Sequence: Synthetic coding sequence
atggatatgtcagatccaaatttctggacagtgctgtcaaattttacactgcctcacctccgcagcggaaaccgattgcggaggactcagtcatgtagaacaagcaatagaaagtcgttgattggtaatgggcagtctcccgctctcccacggccacactccccactgagtgcccacgctggtaacagccctcaggattctccaaggaatttcagcccctctgcatcagcacatttctcgtttgcgaggcgtacagacgggcgaagatggagtctggctagtctgccttcttccggttacggaacaaatacaccctcaagcacggtatcaagttcatgttcttctcaggagaagttacaccagctcccataccagcccacccccgatgaacttcacttcctttctaagcatttctgcacaacggaatctatcgcgaccgaaaacagatgtaggaacacgccaatgcgcccaaggtctagaagcctgtctcccggacgatcccctgcctgttgcgatcacgaaattatcatgatgaatcatgtgtacaaagaacgattccccaaggctacagcccagatggaagaaagactgaaggagatcatcacatcttacagccccgataatgtgcttccgctggctgatggcgtcctatcctttacccatcaccagataatcgagctagcacgagattgtctggacaagagtcatcagggcttaatcacatcccggtatttcctggaactgcagcataaactcgataaactgctccaggaggcgcacgacaggtctgaaagtggcgaactggcctttattaagcagttagttaggaagattctgattgtgatcgctcgaccagctaggttgttggagtgtctggagttcgaccctgaggagttttactatcttctggaagcagccgagggtcatgcaaaggaaggtcagggcattaaaacagacatccccaggtatatcatcagccagctcggcctgaacaaggatccgctggaagaaatggcccatctgggaaactatgacagcgggactgcagaaacacccgagactgacgagtctgtgtccagctctaatgccagtcttaagcttagacgcaagccacgtgagtcggattttgaaacgattaagctcataagcaacggcgcttacggggcagtgtactttgtccgacataaggaatcaagacagcggtttgctatgaagaagattaataaacaaaatctcattctgagaaaccagatccaacaggcgtttgttgaaagggatatactgacatttgccgaaaatccctttgttgtgtccatgtactgctcatttgagacgagaagacatctgtgtatggtgatggaatatgtggaggggggtgattgtgcaactctgatgaaaaacatgggacctctgcccgtggatatggcgaggatgtactttgccgaaactgttctcgcgctggaatatctccacaattacggtatcgtgcatcgagacctgaaacctgacaatctgctggtgacgagcatgggtcacattaagctgaccgattttggtcttagtaaagtggggctcatgtctatgaccacaaacctgtacgagggtcacatagaaaaggacgcccgagaattcctggataaacaggtgtgtgggactcctgagtacatcgctcccgaggtgatcctacgacagggctacggcaaacccgtggattggtgggcaatgggaataatactgtacgagttcttggtagggtgcgtccccttcttcggagacacacccgaggagcttttcggacaggtcatatctgacgaaatcaattggccagagaaggacgaagctccccctccagacgcccaggatttgataacacttctgttacggcagaaccccctggagcgcctgggtactgggggagcgtatgaggtgaagcagcaccgcttctttcggagcctggactggaactcccttctgcgccagaaagccgagttcattccacagctggagagcgaggacgacactagctacttcgacaccagaagtgagaagtatcatcacatggagacagaagaagaggacgacacaaatgacgaggatttcaacgtcgagattagacaattttcctcctgctcacaccgttttagcaaagtttttagttccatcgaccggattacccaaaactcagcggaggaaaaggaagactccgtggataagaccaagtcaactaccctgccaagtacagagactttgagttggagtagtgagtacagtgagatgcagcagctgtctaccagcaatagttccgatacggagagcaacaggcacaagctctcctccggcctgttacccaagctagccatcagcactgagggcgagcaggacgaggcggctagctgtcctggagacccgcacgaggagcccggaaagccggctttaccgcctgaggagtgcgctcaggaagagccagaagtcactaccccggcttcgaccataagtagcagtacactgagcgacatgttcgcagtatctcccttaggatcccccatgtctcctcactctctctccagcgaccccagctcaagcagggactcctcacctagtcgggacagctctgccgctagcgctagccctcatcaaccgatagtgatacattcttccgggaaaaactacggcttcaccatccgggctatccgagtgtacgttggagattctgatatttacacagtgcatcatatcgtgtggaacgtggaggaaggcagccctgcttgccaggctggactaaaggccggtgatctcatcactcatatcaacggggagccagtgcacgggctcgtgcacaccgaggtgattgaattgctgctgaagtctggtaataaagtgagtatcactactacaccgtttgagaacacgtcaattaagactggccctgccagacggaacagctacaagagtaggatggtgaggcgatctaaaaagtcctag

SEQ ID NO: 57582 - DNA, 507 bp, Artificial Sequence
  Description of Artificial Sequence: Synthetic coding sequence
atggatatgtcagatcccaacttttggaccgtgctgtctaattttacgttaccacacttaagaagcggaaaccggctgagacggactcagtcatgccgtacgtcgaataggaagtcgctgatcggtaatggtcagtcccctgccctgcctcgtccccattctccgttatctgcccacgccggtaatagccctcaggactctcccagaaacttcagcccatccgcctcagcccatttttcttttgcaaggagaacagatggtaggcggtggagcctcgcctccctgccatcttctggctatggaacgaatacgccctcctcaactgtgtcaagttcttgttcgtctcaagaaaagctgcaccaactgccttatcaaccaacccccgatgaactgcactttctttccaagcacttctgcacgacagagtccatcgccacagagaatcggtgccgcaatacacccatgcgccctcgcagtagatcattgtctcccggtcgttctccttag

SEQ ID NO: 57583 - DNA, 7871 bp, Artificial Sequence
  Description of Artificial Sequence: Synthetic coding sequence
atgggggaaaaggtgtcggaggccccagagccagtcccacggggttgctccggccacggaagtagaaccccggcaagcgccctcgtggctgcttcttcacctggcgcatcaagtgccgagagctcatccggcagcgagactttgtccgaggagggagagcccggagggttctctagggaacatcaacctccgcctcctccaccccttgggggaactctcggggctagagcccctgctgcctgggctcccgcatccgtcctcctggagaggggcgtcttggccctcccaccgccactccccggtggcgctgtgccacccgctccacgagggtctagtgccagtcaggaggaacaggatgaggaactggaccacattctcagccccccacctatgccttttcgcaagtgttccaatccagacgtggcatccggaccaggcaagagcctgaagtacaagaggcagctcagcgaggacgggaggcagctccggaggggttccttgggaggtgctctcacaggcaggtaccttcttcctaacccagtagcaggacaggcatggcctgcctccgcagagacttctaacctcgtacgcatgagatcccaagctttggggcagtctgctccaagcctaaccgcgagtctgaaggagctgagcttgccacgcaggggctccttttgccggacctccaatcgaaagtcccttatcgggaacggtcagtcaccagccctaccccgaccccactccccgctgagtgctcatgccggtaattctccccaggacagtccacgaaacttcagtccctctgcatccgctcatttcagctttgctcgcagaactgatggccgtcggtggagcctcgcaagtctgccttcatcaggttacgggaccaacaccccatctagcactgttagcagctcctgttctagtcaggagaagttacaccagctcccttatcagcctacccctgatgagctgcacttccttagcaaacatttctgtacaaccgagagcatagccaccgagaatcgatgtcgcaacactccaatgagaccgagatcccgctcactctctcccggacgaagtccagcctgctgtgaccacgagatcatcatgatgaaccatgtgtataaggaaaggttcccaaaagcgaccgcccagatggaggagcgtttgaaggagattatcacatcgtattcacctgacaatgtgctgccattggctgatggcgtcttatcattcactcaccatcagataatcgaactcgctcgcgactgcctggacaaatcacaccaaggtctgatcacttctaggtatttcctggagctgcaacataaactggacaagctcctccaggaagcccatgaccggtccgagtctggggagttagctttcatcaagcagctggtgagaaaaattctgatagtgatcgctcggcctgccagactattggagtgcctcgagttcgaccctgaggaattctactatctactcgaagccgctgagggacacgcgaaggagggacagggtatcaagactgacatccctcgctatattatttcacagctggggctgaataaggacccactggaggaaatggctcatctggggaactacgattccggtacggctgagacaccagagacggatgagagcgtctcctctagtaatgcttcattgaaactgcgccgaaaaccgagggaatccgattttgagacaatcaagctgatctcgaacggtgcctatggtgccgtatacttcgttagacacaaggagtctcgacaacgtttcgcaatgaagaagattaataaacaaaacctaatcctgcgaaatcagattcaacaagcttttgtagaaagagacattctgactttcgctgagaacccatttgtcgtatccatgtattgctcgttcgagacacgccgacatctctgcatggtcatggaatatgtggaaggaggcgactgtgccacactgatgaagaatatgggacctctgcctgtggatatggcacggatgtattttgcggaaacagttttagccctggaatacctgcataactatgggatcgtccatagggatctaaaaccagacaacctgttggtgacgagcatgggtcacataaaactgactgattttggacttagcaaggttggactcatgagcatgaccacaaacctctacgaaggccatatcgagaaggatgccagggaattccttgataaacaagtctgtggaacccctgagtatattgcaccagaggtgatattgagacagggctatggaaaacctgtggactggtgggcaatgggcattatcctctacgagttcctagtaggttgtgtgccctttttcggcgacacccctgaagaactctttggacaggtgatttccgacgagattaattggcctgaaaaagacgaagctccccctcccgacgctcaagatttgataaccttacttctgaggcaaaatcctctggagagactcggaactggcggtgcctatgaggttaagcaacatcggttttttcggtctctggactggaattcacttttgcgtcagaaggctgagttcattccacagcttgaatccgaggacgatacgagctacttcgatacaaggtcagagaagtatcatcacatggaaactgaagaggaagatgatacgaatgatgaggacttcaacgttgaaattcgccagttcagcagctgttcacataggttctcaaaagtgttcagctcaattgataggataacccagaatagcgcggaagaaaaggaagactctgtggacaagacgaagtctactaccttgccttccactgaaacactctcttggagctcagagtacagcgaaatgcagcagctaagtacatccaattcttccgacaccgaatctaaccgtcacaaattaagcagcggactgctgccgaaactcgccatctccactgagggcgagcaagatgaggctgccagctgtcccggagatccccacgaggagcccggaaaaccagccctacccccagaagagtgtgcccaggaagagcctgaggtaaccacccccgcaagcaccatctcctcaagcaccctaagcgtgggctccttttcggagcaccttgaccagattaacgggcgttctgaatgcgtggactcaacagataacagcagtaagccttctagtgagccagcgagccatatggccagacagcggctcgagagcacggagaagaagaaaattagcggtaaggtgacaaaaagtctttctgcatcggctctcagcctgatgattccaggtgacatgttcgctgtgagccccctgggatcaccgatgtcaccccactccctgtcatccgatcctagctcatcacgggactcttcccctagccgagacagtagcgccgctagtgccagtccccaccagcctatcgtgatccattcttctgggaagaactatggctttaccatccgggcaattcgcgtgtacgtgggcgacagtgacatctataccgtgcatcatatagtatggaacgtagaggagggatctcctgcctgccaagcgggtctcaaagcaggcgatctcattactcacataaacggagaaccagtgcacggcctggtacataccgaggtgatcgagctgctgttgaaatctggaaacaaggtgtccattactaccaccccctttgagaataccagtataaaaacagggccagcccgtcgaaattcttataagtctcggatggtacgtagatctaagaagagtaaaaaaaaggagagcctggagagacgaaggagcctgtttaaaaagctggcgaaacagccttctcccttgctgcacacctctcgctccttttcgtgccttaacagaagcctgagctctggagaatccctgccgggatccccaactcacagcctatcccctcgatctcccaccccttcctacaggagtaccccggattttcccagcgggacaaattcatcacaatcttccagtcctagctcttctgcccctaactcacccgctggctctggccacattcggccaagtacattgcacggcttagcacctaaactgggaggccagaggtatcggagcggcagaagaaagtccgcaggtaacattcccctctctccattagctcgtacccccagtccaacaccacagccgacctcaccccagcggtcccctagtccgctgctgggccactcactggggaatagcaagattgcgcaggcgttcccaagtaagatgcacagtccccctacaattgtgagacatattgtgcgacctaagtcggctgagcctcccaggtcaccccttctgaaacgagtgcagtcagaagaaaagctcagtccaagctacggaagcgacaagaaacacctctgcagtcggaagcactctctggaggttacccaggaagaggtccaacgggaacaatcccagcgggaggcaccccttcagtctcttgatgaaaacgtctgtgatgttccacccctctcaagagcaagaccagtggaacagggatgtctcaagcgacccgtcagcagaaaagtaggaaggcaggaatcagtggatgatctcgaccgggataaactcaaagctaaagtcgtcgtcaaaaaggctgatgggttcccagaaaagcaggagagccaccagaaatctcatggccctggcagcgacctggaaaattttgccctattcaaacttgaggaacgagaaaaaaaggtatacccaaaagccgtggagcgttcctccacattcgaaaataaggccagcatgcaggaagctccccctctcggctcactgctcaaggacgcccttcacaaacaggccagtgtacgggcatccgagggcgcaatgtcagacggcagggtgcctgcagaacatcggcagggaggcggagactttcgcagggcccctgcccctgggaccctgcaggatgggctctgtcactcgctagaccggggaatttcggggaagggggaggggaccgaaaagtcaagccaggcaaaagaactgctgcgttgcgaaaagctggattcaaaactggcgaacattgactatttgcggaaaaagatgtcgctggaagacaaagaagataacctgtgtccagtgctgaaacctaaaatgactgccggatcccacgaatgtttaccgggaaacccagttcggccaactggcggtcagcaagagcccccacctgcatcagagagcagggccttcgtgtcatcaacccatgctgcccagatgagcgccgtgagcttcgtccccctcaaggctttaacaggcagggtcgattctggtacggaaaagccagggcttgtggcgccagaaagccccgtgcgcaagtcaccttccgagtacaagttggagggcagaagtgtctcctgccttaaaccaatcgaggggacgttagatatagcactgctgtctgggcctcaggcgtccaaaactgaattgccatcccccgagagtgcgcagtcaccatcaccgagcggcgatgtccgagcgtccgtcccacccgtcctgccttcctcatccggcaaaaaaaatgacacaacgtcagcacgcgagctaagcccctcaagcctcaagatgaacaagtcttacctgttggagccttggtttctgcctccaagcaggggcctccagaactctcctgctgtttccctgccggatcctgaattcaagagagaccgcaaaggccctcatcccacagctaggtcgccgggtacggtcatggaatcaaatccacagcagagggagggtagttcccccaaacatcaggatcacactactgatccaaagttgttaacgtgtctcgggcaaaatctacattccccggacttggcgagacctcggtgtcccctaccccctgaagcctccccgagtcgagaaaaacctggtctacgggagtcatcagaacggggtcccccaacagctcgcagtgagcggagcgcagcgagggctgatacttgtcgtgaaccctcaatggagttgtgcttcccagaaacagccaaaacatcagataattccaaaaacctgcttagcgtggggagaacgcacccagacttttatacgcaaacccaggctatggagaaggcgtgggcccctggcggaaaaaccaaccataaagatggcccaggcgaggcacggccaccgccacgtgataacagttcactccatagtgcagggatcccttgtgaaaaagagttaggaaaggttcggagaggagtggaacctaaaccagaagctctgctggcccgacgatcccttcagcctccaggtattgaaagtgaaaaaagcgagaagctttctagctttcctagcctccagaaagatggcgctaaggaaccagagaggaaggaacagccactgcaaagacaccctagcagcatcccaccgcctccacttacagctaaggacctttcgagccccgctgccaggcagcactgttcctcaccttcacacgcctcaggacgcgaacccggagctaaaccgtctacagcagagccctcctctagccctcaggaccctccaaagcccgtggctgcccactccgagtctagttcgcataagcctcgaccgggtccagacccgggtccaccgaaaacaaaacaccccgacagaagcctgagctcacagaagccgtccgtaggtgcaaccaaaggcaaagaacccgctacacaatcacttggcggatcctcccgggagggaaaaggccacagtaagagcggcccagacgtgttccccgcaacacccggatctcagaacaaggcctctgatggtattggccagggtgaggggggaccctcagttccccttcacaccgacagagcgcctctggacgctaagccccagcctactagcgggggacggccattggaggtgctggaaaagcctgtccacttgccacggcctggacaccctggtccttccgagcctgcggaccaaaaattatctgctgtgggtgagaaacagaccttatccccgaaacaccccaaaccttctacagtgaaggactgcccaacactctgtaaacagaccgacaacaggcagacggataagtcccccagtcagccagctgctaatactgatagacgagctgaaggcaaaaagtgcaccgaggctctgtatgcaccagcagaaggcgataaacttgaagcaggcctgagtttcgttcattcagaaaaccgtttgaagggagccgaacgcccagccgctggcgtgggcaagggttttccagaagcacgcggaaaaggccctgggccacagaagcctcccaccgaggccgacaaacccaatgggatgaaacggtcaccctctgccaccggacaatcatcatttcgctctactgcactcccggaaaagtcactctcttgcagctcatcatttccagagacacgcgctggcgtacgagaagctagtgcggcatcttctgacacatcgtctgcaaaagccgctggcggaatgttggagctgcctgctccttcaaacagagatcataggaaggctcagcccgcaggcgagggtaggacccatatgactaagagcgatagccttccctcgtttcgcgtttctacgctgcctctagagtcccaccacccagacccaaacaccatggggggagcctcacatcgcgatcgggctctgagcgtgactgctaccgtgggagaaaccaaaggtaaggacccagctcccgctcagcccccacctgccagaaagcagaatgttgggagggacgtgactaagcctagcccagccccaaatacagatcggcctatatccctgtctaatgaaaaagatttcgttgttaggcagaggagaggcaaagagagcctgcggagctccccacataaaaaggcactata

SEQ ID NO: 57584 - DNA, 1152 bp, Artificial Sequence
  Description of Artificial Sequence: Synthetic coding sequence
atggccgaacccaggcaggaatttgaggtcatggaggaccacgccggaacctatggccttggggaccgcaaagaccagggcggatacacaatgcaccaggatcaggagggagatacggacgcaggtttaaaagcagaggaagcaggtatcggggatacaccaagcctcgaagacgaagccgcaggacatgttacccaggccagaatggtatccaaatccaaggatggcaccggtagtgacgataaaaaggcgaaaggggctgatgggaagaccaagatagcaaccccaaggggggctgctccccctggccagaaggggcaggctaacgcaacaaggatcccagccaagaccccacccgcaccgaaaacaccaccatcctctggagagccccctaaatctggtgatcggtccggctactcttcgcccggaagtccgggtactccaggatccagatctcggaccccatctctgcctacaccacccacacgagaaccaaaaaaagtggctgtggtccggactccgccaaaaagtccatctagtgctaagtcccggttacagaccgcccctgttcctatgccggacctgaagaacgtgaaatccaagatcggttccaccgagaatttgaaacaccagcccggagggggaaaggtccagatcataaataagaaactggatctttccaacgtgcagagcaaatgtgggagtaaagataacattaaacatgtgcccggaggtgggtctgtgcaaattgtttacaagcccgttgacctgagtaaagtcacatccaagtgcggatcactggggaatatccaccacaaaccaggtggcggacaggtcgaggtgaagtccgaaaagctggattttaaggatcgggtacagtcaaagattggttctctggataatatcacccatgttcctgggggtggtaacaagaagattgagacccacaagctaacatttcgggaaaacgcaaaggccaaaactgaccatggggctgagattgtgtataaatcaccagtcgtgagtggcgatacttccccacggcacctgtctaacgtcagctcaaccggcagcatcgatatggttgacagccctcaactcgccactttggctgatgaagttagtgcgagcctggccaaacaggggttatag

SEQ ID NO: 57585 - DNA, 1239 bp, Artificial Sequence
  Description of Artificial Sequence: Synthetic coding sequence
atggcggaacccaggcaggaatttgaggttatggaggatcatgcagggacctatggcctgggggatcgcaaggatcagggaggatatactatgcaccaagatcaggagggcgacacagatgcagggctaaaagaaagcccactccagaccccaaccgaggacgggtcggaggaacccggatctgaaacttctgatgccaagtcaacacccacggccgaagccgaagaagctggtataggtgataccccaagcctggaggacgaagcagctggacatgtaacgcaggccagaatggtctcaaagtccaaggatgggaccggatcggacgacaagaaggcaaaaggggctgatggaaagaccaagatagcaacacctcgtggtgccgcacctcccggacaaaagggacaggcaaatgctacccgcataccagccaagacccccccagcaccaaaaacccccccatcttcaggagaacctccaaaatccggcgatcggagcggctactcctccccaggatcccctggtactccagggagtcggagccggacccccagtctgcccactcctccaacaagggaaccgaaaaaggtggcagtggtgcggacacctcctaaaagcccttcaagcgccaagtccagattgcaaacggcacctgtgcccatgcccgatcttaagaacgttaagtccaaaatcggctccaccgagaacctgaagcatcagcccggagggggaaaggtgcagattatcaataaaaagctggatctatctaacgtgcagtcgaagtgcgggagcaaggacaatattaaacatgtacctgggggaggttccgtgcagattgtgtataagccggtggatctcagcaaagtgactagcaagtgtgggtccctggggaacatccatcataagccgggaggcggtcaggttgaggtgaagagtgagaagctggactttaaagatcgggtccagtcaaagatcggcagtctggataatatcacccatgtgccgggaggcggaaataaaaagatagagacacataaactcacttttagggaaaacgcaaaagcaaaaactgaccacggtgctgagatcgtgtacaagtctcctgttgtgagcggtgacacgtcgcctaggcatctgtctaacgtgtccagtaccggcagtatcgacatggtggactctcctcagcttgccacactggccgacgaagttagcgcctcgctggcaaagcagggcctgtag

SEQ ID NO: 57586 - DNA, 1326 bp, Artificial Sequence
  Description of Artificial Sequence: Synthetic coding sequence
atggcagagccccgacaggagttcgaggtgatggaggatcatgccggtacatacgggctgggcgacaggaaggaccagggtggatataccatgcatcaggaccaagaaggtgacacagacgccggtctgaaggaatcccccctccagactcccaccgaggatggaagtgaggagccaggctcagagacatctgacgcgaaatccactcccaccgccgaggacgtcaccgctccactggttgacgagggtgcccctggaaagcaggccgctgctcagccgcacaccgagattcctgagggcactaccgccgaggaagccggaatcggagataccccaagtctggaggacgaggcagctggccacgttacccaggctagaatggtctcaaagtcaaaggatgggacaggttctgatgataaaaaagctaagggcgcagatggcaagactaaaatcgctaccccacggggagcagctcccccagggcaaaagggccaagcgaacgcgactagaattccagcaaaaacgcctccagcacctaagactcccccaagtagtggcgagcctccgaagtccggcgaccgatcggggtatagcagtcccggtagtcctggtactcccggatctcggtcgaggacccccagcctcccaacgcccccaactagagaacctaagaaagttgcggtggttagaactcctccaaaatctcctagcagtgctaagtctcgactgcagacagcaccagttcccatgccagatctgaagaacgtgaaatctaagatcggatccaccgagaatctcaaacatcagcccggaggcggaaaagtccagatcataaataagaagctggatctttccaatgtccaatccaagtgtggctccaaggacaatatcaagcacgtgccaggcggaggctccgtgcagatagtgtacaaacctgtggacctgtctaaggttacaagcaaatgtggttccctgggcaacatacaccataagccagggggaggccaggtcgaggtaaaaagcgaaaaactggactttaaggatagggtgcagtctaagatcggctcattagataacatcacacatgtacctggtggcggaaacaagaaaattgagacacacaaactcaccttccgcgagaacgccaaggctaaaaccgatcacggagcagagattgtgtataagagccccgtcgtgtccggggacacctccccacgtcatttgtctaacgttagttcaacaggctccatcgacatggttgatagtccacaattggctaccctggcagacgaagtttctgcctccctggctaagcagggcctttag

SEQ ID NO: 57587 - DNA, 795 bp, Artificial Sequence
  Description of Artificial Sequence: Synthetic coding sequence
actcgtgaggccgagggagctgatggcaagacaaaaatcgcgacgccaaagggacaggctaacgcaaccaggatcccagcaaagacaccaccagcccctaaaacgccccctagttccggcgagcctccaaaatctggcgaccgctcgggttattctagccccggatcaccgggtacccctggatctcggtctcgcacgccgagcctgccaacccccccaacccgcgagcccaagaaagtggctgtggttagaaccccccctaagagtccttcttctgcaaagtctcgcctgcagaccgctcctgtgcctatgccagacctgaagaatgtaaagtcaaaaattggcagcaccgaaaatttgaaacatcagccaggcggtgggaaggtacaaattgtgtacaagcctgttgacctgtccaaggtgactagcaagtgtggctccttaggcaacatccatcacaagcctgggggaggccaggtggaggtcaaatcagagaaactcgactttaaggaccgggttcagagcaagattggaagtttagacaacatcactcacgtgccaggtggaggcaacaaaaaaattgaaacccataaactcacgttcagggaaaatgccaaagccaagaccgaccatggagctgagattgtatacaagagccctgtggtgtctggtgatacctcccctaggcatcttagcaacgtcagcagtactggcagtatcgatatggtggatagtccacagctcgctaccttagcagacgaggtatccgcctcgttagcaaaacagggactctag

SEQ ID NO: 57588 - DNA, 651 bp, Artificial Sequence
  Description of Artificial Sequence: Synthetic coding sequence
atggccgagccaaggcaggagttcgaggtaatggaagatcacgccggtacttacggactgggagacaggaaagatcagagagagcccaagaaggtcgcagtggtacggacccctcccaagagccctagcagcgcaaaatcgagactgcagacagccccagtcccaatgcctgacttaaaaaacgtcaagtccaaaataggatccacggaaaatcttaaacatcagccgggtggaggtaaggtgcagatcgtgtacaagcctgtggatctctctaaagtgacctccaaatgtgggtcgttagggaatatccaccacaagccgggaggaggccaggttgaagtcaaaagcgaaaaactggacttcaaggatagagtgcagagtaagattgggtccttggacaacattactcacgtgcctggaggaggaaacaagaaaatcgagactcataaattgacatttcgtgaaaacgctaaagccaagaccgatcacggggctgaaattgtgtacaagagccctgtggtgtcaggagacacatctcctcggcatttatcgaatgtgagttcaacaggcagtatcgacatggtggactccccccagctcgccaccctggccgacgaagtgtcagcatctttggccaagcagggtctttag

SEQ ID NO: 57589 - DNA, 1152 bp, Artificial Sequence
  Description of Artificial Sequence: Synthetic coding sequence
atggctgaacccaggcaggagttcgaagtgatggaagaccatgctgggacatatggcttgggggataggaaagaccaaggcggttataccatgcaccaagatcaggagggcgatactgatgcaggccttaaggccgaagaggccggaattggagacacacctagcttagaggacgaggcagcgggacacgtgactcaggcaaggatggttagtaagtctaaggacggaacaggctcggacgacaaaaaagccaaaggggctgatgggaaaacaaaaatcgctacgcctcgcggagcggcacctcccggacagaagggacaggctaatgctactagaattccagctaagaccccacccgcacccaagactccccctagtagcggagagccaccaaagtctggtgacagatcaggttactcttcacctggaagccccggaacgccaggatcccggtctagaacccccagcctccccactcctcctactagggagcctaaaaaggttgcagtggttagaactccccctaaatccccttcctctgctaagtccagactgcagaccgctcccgtgccaatgcccgacctcaagaatgtcaagagtaaaatcggtagtaccgagaatttgaaacaccagcccggtggcggaaaggtacaaatcataaataagaaactggacctgtcaaatgttcagagcaaatgcggcagcaaggataacattaagcacgtccccggaggtgggagtgtgcagattgtatacaaaccagtggatcttagcaaagtaacatctaaatgtggcagcctgggaaacatccatcacaagccaggagggggacaggtcgaggttaagtccgaaaaactggactttaaggaccgcgtacagagcaagatagggtccctagataatattactcatgtgcctggaggtggtaacaaaaagatagaaactcacaagctgacatttagagagaacgcaaaagccaagacggatcacggagccgagatcgtgtataaaagccctgtcgtatccggggatacttcgcccagacatttatcaaatgtgagctctacagggagcatcgatatggtcgattcacctcagctcgcgactcttgctgatgaggtcagcgccagcctggccaagcagggcctctag

SEQ ID NO: 57590 - DNA, 951 bp, Artificial Sequence
  Description of Artificial Sequence: Synthetic coding sequence
atgctcagagctctccagcagcgcaagcgtgaggcaggtatcggagacactccttctctggaggacgaagctgctggacacgtcacccaggcaagaatggttagtaaatccaaagacgggactgggtctgacgacaagaaagccaagggagcagatggaaaaactaagatcgccacccctcgcggagccgcaccacctgggcagaaaggtcaggccaacgcaacaaggattccagctaaaaccccacccgcacccaaaacccccccatcttcaggcgagccaccaaagtccggcgacaggtccggctattcctcgccaggctcccctgggacgcctggatcgcgctccaggaccccctcgctacctaccccccctacaagagagcccaagaaggtggcagtggtgcgtactccaccaaagtctccttcttctgcaaagtcgaggttgcagacagcacccgtgccaatgcccgacctcaagaacgtgaagagcaagattggatccaccgaaaacctgaagcatcagcctggcggtggaaaggtgcagatcgtctataaaccagtagatttgtctaaggttacttcaaagtgcggttctctggggaacatccatcacaagccaggaggcggacaggtcgaagtgaagagcgaaaaattggattttaaagacagagtacagtccaagatcgggtctttagacaacattacacacgttccgggaggagggaataagaaaatagaaacccacaagctgacctttcgtgagaacgccaaggctaaaacagatcacggcgctgaaatagtgtataagtctcctgtcgtgtcaggggacacatcacctcgtcacttaagcaatgtgtcatcaactggttctattgacatggtagattccccacagctggcaaccttagccgatgaagtttctgcatctcttgctaagcaggggctgtag

SEQ ID NO: 57591 - DNA, 2277 bp, Artificial Sequence
  Description of Artificial Sequence: Synthetic coding sequence
atggccgaacccagacaagagttcgaggtgatggaggatcacgcaggaacctacgggctcggcgatcgcaaggaccagggaggctacacgatgcatcaggatcaggagggcgataccgacgccggacttaaggaaagccccctccagaccccaacggaagatggatccgaggagccaggatcagagacatctgacgctaagtccacccctacagctgaggacgttacagctcctctggtggatgagggtgcacctggaaagcaggcggcagcacagcctcacaccgagattcccgaaggcacaacagccgaggaagccggaattggtgatacaccatcacttgaggatgaggcggctggccacgtcacgcaagaacccgagtctggcaaggtggtccaggaaggctttctccgtgagcccggaccacctggcctgtctcatcagttaatgagcggtatgcctggtgctccacttctccctgaggggccacgagaagccacacgacagccgtccggcactggccctgaggatacagagggaggtcgccatgccccagaactgctgaagcatcagttgctgggagacctgcatcaagaaggaccactgctgaaaggcgctggaggcaaagagaggcccggatccaaggaagaagtggatgaagatcgtgacgttgatgaaagcagtccacaggacagtcccccttcaaaggccagtccagcccaggacggcagaccacctcagaccgctgcaagggaagcaacgagcatccctggattccccgctgagggtgccatccccttgcccgtagattttctctccaaggtctctaccgagattccggctagcgagccaaatggtcccagtgctggccgtgcgaaggggcaagatgccccactggagttcacttttcacgttgaaattacccctaatgtgcagaaggagcaggcccattctgaggagcatctaggccgagcagctttccccggagccccaggggaaggcccagaggctcgaggcccttctctcggtgaggatacgaaggaagccgacctcccagagcccagcgagaaacagccagctgctgcaccacggggaaagcctgtgtcttgggtcccacagttaaaagccagaatggtctcaaagagcaaagatggaactgggtctgacgataagaaggctaaaacgagcacaaggagtagcgctaagactctgaaaaatcgcccatgcctgtcgcctaagcatcccacccccggtagctcggatccactgattcagccttctagccctgccgtctgcccagaacctccctcgagcccaaaatatgtctccagcgtaactcctcgaacagggagctctggggctaaagagatgaagttgaaaggggcagatggaaagacaaaaattgctacccccagaggcgcagcacccccaggtcaaaagggacaggcaaatgcaacaagaattcccgctaaaacacctccagccccaaaaacccctcctagctccggtgaacctcccaaaagcggagaccgaagcggttattcctcccccggttcccccggaacacccggatctcggtcacgcaccccttccctgcccacaccgccaactcgagagcctaagaaagtggccgtcgtgaggacaccgcctaaatccccaagcagcgccaaaagcagactccagactgccccagtccctatgcccgacctgaagaatgtgaagagcaagattggatctacggagaatcttaagcatcagccaggtggaggtaaagtgcagatcatcaacaagaagcttgacctcagcaatgtgcagagcaagtgtggaagtaaggacaatatcaagcacgtccccggtgggggtagcgttcagatagtctacaagcccgtcgacctgagcaaggtaactagcaaatgcggctctttgggcaacatacaccataagccagggggtggacaggtcgaggtcaagagcgaaaaattagattttaaagacagagtgcagtctaaaatcggttccctggataacattacacacgttcccggaggcggtaacaaaaagatcgaaacccacaaacttaccttcagagaaaacgctaaagctaaaacagatcatggagccgaaatcgtatataagtcccccgtagtcagtggtgacacaagcccacgacacttaagtaacgtgagcagcactggcagcattgacatggtggacagcccccaactggcaactcttgctgacgaggtgtcagcctcactcgctaaacagggactttag

SEQ ID NO: 57592 - DNA, 2331 bp, Artificial Sequence
  Description of Artificial Sequence: Synthetic coding sequence
atggccgagccacggcaggaatttgaagtgatggaagaccacgcagggacgtatggcctcggcgatcgcaaggaccagggtgggtatacgatgcaccaggatcaggaaggcgatactgatgcaggattaaaagagagcccactgcagaccccgacagaagacgggtcagaagaacccggatctgagacaagcgacgccaaatctaccccgacagccgaagacgtcactgctcccctggtggatgagggcgcacccggaaagcaagcggcagcgcaaccacacactgaaatacctgagggcaccacagcagaggaagcaggaattggagacacacccagtctggaagacgaagcagccggtcatgtcacacaggaaccagaatccggcaaggtggtgcaagaggggttcctgcgcgagccaggtcctcccggtttgtcccaccagctgatgtcggggatgcccggagcacctttgctgcccgagggtcccagagaggctacacgccaaccatccggtactggcccagaagacactgaagggggacggcacgcccctgaattactgaaacaccagctcctaggggacctgcaccaggaaggacccctgctcaagggggcaggaggcaaggaacggccagggtctaaggaggaagtcgacgaggaccgcgacgtcgatgagtctagtcctcaagatagccccccatccaaagcctccccggcacaggatggtagaccaccgcaaaccgcagccagggaggccacttctatcccaggctttccagccgagggagctattccccttcccgtggatttcctctctaaagtcagcaccgagatacccgcatccgaaccaaacgggccttccgcaggtagggctaaaggacaggatgcaccactggaatttacatttcatgtcgaaatcactcccaatgtgcagaaagagcaggcacacagcgaagaacacttgggaagagctgcctttcctggtgcccctggcgagggacccgaagctcgcggtccatctctcggcgaagacacaaaggaggcagacttacctgaaccaagtgaaaagcagcccgcagccgctcctcgagggaagccagtctcctgggtccctcagctcaaggccagaatggtgtccaagtcaaaggacggaaccggctctgatgacaaaaaggccaagacaagcactcgcagttccgccaagactctcaagaacagaccttgcctgagccccaaacatcccactcctggaagctccgacccactgatccagccctctagtcccgcagtgtgccccgaaccaccaagcagtcctaagtatgttagtagtgtcacaccgagaacggggtcaagtggcgctaaagagatgaaattgaagggcgcagacggtaagaccaaaattgcaaccccacggggtgctgccccaccaggccagaaaggccaagcaaatgctacgaggatacccgctaagaccccaccagccccaaaaacgcccccttcttccgcgaccaaacaggtgcagcgcagacctccgcctgcaggaccgagaagcgagagaggggagcccccaaagagtggcgatcggtccggatactcgagccctggctcaccaggaacccctggctcgagaagccgcacgccttccttgcccaccccccctacgcgtgaacctaagaaagtggccgtggttagaactcccccaaaatcacctagttcagcaaaatctcgtctccagactgctccagtcccaatgccagacctcaaaaatgtgaagagtaagatcggctcaacagaaaacttgaagcatcaacccggagggggaaaagtccaaatcattaacaagaagttggatctgagcaatgtccagtctaaatgtggtagcaaggataacataaaacacgttcccggaggcggatctgttcaaatcgtctacaagcccgtggacctgagtaaggtcacttccaaatgcggcagcctggggaacattcaccacaaacctggcggtggccaagtcgaggtgaaatccgagaagctggactttaaggatagagtgcagagcaaaatcgggtctctcgacaacattacacatgttccgggaggaggaaacaagaaaattgagacacataagttgacctttagggaaaatgccaaggccaaaacagaccatggagctgaaatcgtgtataagtcccctgtggttagcggagacacctcacctagacatctcagcaacgtcagctctaccggttctattgatatggtggattcaccacagctggctaccctggcagacgaggtcagtgcaagtctggctaagcagggcttgtag

SEQ ID NO: 57593 - DNA, 1233 bp, Artificial Sequence
  Description of Artificial Sequence: Synthetic coding sequence
atggctgaacctcgccaggaatttgaggttatggaggaccacgctggaacttatgggctcggcgaccgtaaggatcagggaggctacaccatgcatcaagatcaagagggtgacaccgacgctggtctaaaagaaagccctctgcagacccctaccgaagatgggagcgaagagcccggatcagaaaccagtgatgcaaagagtacccccaccgctgaggacgtgaccgcccctcttgttgacgaaggcgctcccggtaaacaggctgctgcccagcctcatactgagattcctgaggggactactgctgaagaagctggcatcggcgacacgccttcgctggaagacgaggccgcaggacacgtgactcaggcgcgaatggtgagcaaatccaaagacgggaccggttcagatgacaagaaggctaaaggcgcagacggcaagacaaaaatcgcaacgccacggggagctgctccccctggccaaaaaggccaggcgaacgccacacggataccagcaaagaccccccctgcaccaaagacccctccttcttcaggggagccacccaaaagcggcgataggtccgggtactcatcccccggttcccctgggacacccggtagcagaagtaggactccaagcctccccaccccccctacgagggaaccgaaaaaggtagcggtggttaggacaccccctaagtccccatctagcgctaagtctcgcctccaaacggcccctgtacccatgcccgatctcaagaatgtcaagtctaaaataggctctacagaaaatctcaagcaccaaccgggaggcggtaaggtgcagatcgtgtataagcccgttgatctcagtaaagtgacttccaagtgcgggagtctagggaatatccaccataaacctggcggaggacaggtggaggtgaaatccgaaaaactggactttaaggaccgtgtgcagtccaagataggctctttggataacataacccacgtccccggaggaggcaacaagaagatagagacacacaaattgacgtttagagaaaatgctaaagcaaaaaccgatcacggggctgagatcgtgtataagtccccggttgtctcaggagacaccagcccgaggcatctgtccaatgttagctccacaggatctatcgacatggtggacagcccacagctggccactttagctgacgaggtgtctgctagcctcgccaagcaggggctgtag

SEQ ID NO: 57594 - DNA, 1167 bp, Artificial Sequence
  Description of Artificial Sequence: Synthetic coding sequence
atggtagaagccgaggagctggcccagcttcgactgctcaaccttgagctgctgcgccagttgtgggtgggccaggacgcggtaaggcgatcagttgctcgtgcggcaagcgaatctagccttgagtcttcttcaagttacaacagcgaaactccaagtacaccggaaacatccagtaccagtctatctaccagttgccctagaggacggtcatccgtgtggggacccccagatgcatgccgcggtgacctgcgcgacgtcgcacggagtggggttgcatcactgccacctgccaaatgccagcatcaggaaagtttgggaaggccgagaccccacagtgcccctagcctgggcacgtccagcctgagggatcccgagcctagcggcagactcggcgaccctggccctcaggaggcccagactccccgttcgatcttggcacaacaaagtaaactgtctaagccaagagtcactttttctgaagagtctgccgtaccgaagaggtcttggaggctcagaccctacctaggttatgactggatcgcaggatcactagataccagctcctcaattaccagccaaccagaagcgtttttcagcaagctgcaggagttccgtgagacaaataaagaagagtgtatctgttcacatcctgaaccacagctgccaggactgagggagtcgtcggggagtggggtagaagaggatcatgaatgcgtgtattgctaccgtgtgaatcgcaggctcttccctgtgcctgttgacccaggaaccccttgtaggctttgtcggacgcccagagatcaacagggacccggaacactcgcccagcccgctcatgtgagggtctcaattccattaagcatcctagagccccctcaccgataccacattcatcgaaggaaatcctttgatgcgagcgacacactggctctgccccgacattgcctgctgggctgggacatcttccctcctaaatcggagaaaagctctgcccctaggaatttagatctgtggagcagcgtgtctgccgaagcacagcatcaaaaactgtctgggacatcctcaccgttccatcccgctagcccaatgcagatgctgcctcccactccgacttggtccgtgcctcaagtgcccagaccgcatgtacctcgacaaaaaccttag

SEQ ID NO: 57595 - DNA, 1077 bp, Artificial Sequence
  Description of Artificial Sequence: Synthetic coding sequence
atggtggaagccgaagaactagcccagctgcggctactgaacctggagttgcttcgtcagctgtgggttgggcaagatgcagtcagacgttccgttgctcgagccgcaagtgaatcatcgctcgagtcaagttcttcctacaacagcgagaccccttcgaccccggagacatcttccacttcactcagtacctcttgtccacgtggtaggagctcagtgtggggtccacccgatgcctgtcggggtgatctgagggatgttgcaaggtctggcgtggctagcctgccaccagccaagtgccagcatcaggagtccttgggtagacccaggcctcactcagcgccttcgctagggacctctagtctcagagatcccgagccctctggaaggttaggcgaccccggacctcaggaagcgcagacgcctaggtccatcctcgcacagcaatccaagctgtcaaaaccacgggtgactttcagcgaagagtcagcggttcccaagagaagttggcgcctgcgcccttacctgggatacgattggattgcaggatccctggacactagctccagcatcacctcccagccagaggccttcttttctaagctgcaggaatttagggagacaaacaaggaggaatgcatttgttcccacccagaaccccagctgcccggactgcgcgagtctagcggtagtggagtggaagaggatcacgagtgcgtctactgttatagagtgaaccggagactgttccccgtccccgtagaccccggtacaccctgcaggctgtgccgtaccccgagagatcagcagggaccaggaacattggcccaacctgcacacgtgagtaccgcctgctgggcaggcactttctttctgcggtctctgaggaaggcgcagccacccggaacatggacctcaggccctctatctcctcttagacccagcacacgcagttgtccggctcccgctgccctattcacccgaccccatcagtgccgctgttgcccccgacccagaccaggacagtgtccaaggtcgctgggacccacaagtcatggcaggtccccagaggattag

SEQ ID NO: 57596 - DNA, 2070 bp, Artificial Sequence
  Description of Artificial Sequence: Synthetic coding sequence
agcagcggccttaccgtaactgctgtgaaagattctggtgaatggaatctcgaggctggagccctggttctcgctgacgcgggactgtgctgtattgatgaattcaactccctcaaagagcacgaccgaacttcaatccatgaagcaatggagcagcagaccatctcagtcgcaaaggcgggattggtctgtaaactgaatacacgtaccactatcctggctgcaaccaaccctaaggggcaatacgacccccaagagtctgtgtccgttaatatcgccctgggctcaccgctcctctctcgtttcgaccttatactggtactattggacacaaaaaacgaagattgggatcgaatcatttccagtttcatcctggaaaacaaaggctatccctcgaaatctgaaaaactgtggtcaatggaaaaaatgaaaacctacttctgcctgattcgcaacttgcagcctacactctctgacgtgggcaaccaggtcctgctgcggtactaccagatgcaaagacagagtgattgcaggaatgctgcacggacaacaattcgcctcttagagtctctcataaggctggccgaggcacatgcccgactcatgtttcgcgacacagtgacgctggaggatgcgatcacagtggtgtctgtgatggagtcctccatgcaggggggtgcgctcttgggaggcgtaaatgcccttcacactagcttcccggaaaatcccggtgagcaataccagagacaatgcgagctgatactggaaaaattagaactccagtccctgttgtcagaggaactgagacgattagagaggctgcagaatcagtcagtgcaccagagtcagccacgggtactggaggttgagaccaccccgggatctctccggaatggccctggagaggagagcaactttcgtacatcctcccaacaggagataaattactccacccacatcttctccccaggcggaagccccgaaggctcacccgtgctggacccccctcctcatctggaacccaataggtccacgtctcggaaacacagtgctcagcacaagaacaaccgagacgacagcctcgattggtttgattttatggccacccaccagtccgaacccaagaacacagtggtagtgtccccacaccctaagacaagcggcgagaatatggcctctaagatctcaaactcaacgtcacaggggaaagaaaagtcagaaccaggacaaaggagcaaggtcgacatcggactgctcccctcacctggagaaactggcgtcccatggcgagcggataatgtggagagtaacaaaaagaagcggcttgccctggattccgaggctgccgtgagcgctgacaagcccgacagcgtcttaacacaccatgtacccaggaacctacagaagttatgtaaggaacgggcacagaaactgtgtcgaaattctacaagggtgccagcccaatgcacagtgcctagccacccgcagtctactccagttcacagccctgaccgtatgctagattcaccaaagcggaagagaccgaaaagcctcgcgcaggtcgaagagccagccattgagaacgtgaaacctcccggttctccagttgcgaaactggccaaattcacattcaaacagaagagcaagttaatccactcatttgaggatcacagccatgtgtcccctggagctacgaaaatcgctgtgcattcccccaagatttctcagcgcagaacaagacgggatgcagccctgccagttaaacgcccaggaaaactcacctccacccccggaaaccagatttctagtcagccacagggtgagaccaaggaggtgtcccagcagcctcctgagaagcacgggcctcgagagaaagtgatgtgtgccccagaaaagcggatcattcagccggaactggaactggggaatgaaacggggtgcgctcacttaacttgcgaaggcgacaaaaaagaggaggtgtccgggtccaacaaatcgggcaaagtgcacgcctgtacgcttgcgaggctcgcaaatttctgtttcactccaccgagcgagagcaagtag

SEQ ID NO: 57597 - DNA, 1176 bp, Artificial Sequence
  Description of Artificial Sequence: Synthetic coding sequence
atgaacagcgaccaagtgacactggtcggtcaggtgtttgagtcatatgtcagcgagtatcataagaatgacatcttgctgattttgaaagagcgggacgaggacgcacattatccagttgtggtgaacgctatgacacttttcgagactaacatggagattggggagtatttcaatatgttcccttcggaagttctgaccatatttgactcagctctcagaagatcggccctaactattttacagtctctatctcagccagaggccgtgagtatgaaacagaacctgcacgctagaatctcaggcttgcccgtgtgtccggaactggtgcgcgagcacattccaaaaactaaagacgtaggccacttcctgtctgtaacgggaaccgtaataaggacctcactggtgaaagtgttagagttcgagagagattacatgtgcaataaatgtaaacacgtgttcgttattaaagccgacttcgaacaatactacaccttctgcaggccttcatcctgtccttccctggaaagctgtgatagctcaaagtttacttgcctctccggactttctagctcaccaacaagatgcagagactaccaggagatcaaaattcaagagcaggtccaaaggctgtctgttggctctattcccagaagcatgaaagtcatcctggaggacgacttggtggattcttgtaagtcaggcgacgacctgacaatatacggtattgtgatgcagcggtggaaaccttttcaacaggacgttcggtgcgaagtggagatcgtcttaaaagctaattacatccaagtgaacaacgaacagagctccggcatcattatggacgaggaggtgcagaaagaattcgaggacttttgggaatactataaatctgaccccttcgccggacggaacgtgattctcgcaagcctgtgtccccaagtttttggcatgtacctggtgaagctggccgtcgcaatggtccttgctggcggtatccagagaaccgacgccaccggcactagagtcagaggggagtctcatctcctgctggttggcgatccgggtacgggaaaatcacagttcttgaaatatgcggctaagatcactcctcgaagtgttctcacaaccgggattggcagtacgtccgccggtatagtttgtgacaattttaaatag

SEQ ID NO: 57598 - DNA, 3432 bp, Artificial Sequence
  Description of Artificial Sequence: Synthetic coding sequence
atgaatagtgaccaggttactctggtgggccaggtgtttgagtcttacgtcagcgaatatcataagaacgatattcttctgatcctgaaagagcgagacgaagatgcccactatccggttgttgttaacgcaatgacactgttcgaaaccaacatggagattggtgaatacttcaacatgttccccagcgaagtcctgacaatattcgattccgcccttaggcggagcgctctgaccatcctgcaaagtctgtcccagcccgaagctgttagtatgaagcagaaccttcacgctcgtatctctggcctgccagtgtgcccagagctggtaagagaacacataccaaaaaccaaagacgtgggtcatttccttagtgtcaccgggactgtaatcagaacgtccctcgtcaaggttttggagttcgagagggactatatgtgtaataagtgcaagcatgtgttcgtgattaaagccgactttgagcagtactacaccttctgtcggcctagttcatgcccttctttggagagctgcgactcatccaaatttacatgcctgtccgggttaagtagctctccaacacgatgccgcgactatcaggagatcaaaatccaggaacaggtgcagaggttgtctgtgggatccattcccaggtcgatgaaggtaatcctcgaggacgacctagttgattcctgcaaatcaggggatgatcttacaatttatgggatcgtgatgcagcgctggaagccattccagcaggatgtcagatgcgaagtggagatcgtattgaaggcgaattacattcaggttaacaatgagcagtcatcaggcatcattatggacgaggaagttcagaaagagttcgaggatttctgggaatactacaaaagcgaccccttcgccggacgtaatgtgatcctggcatcactgtgtccccaggtctttggcatgtacctcgtcaaactcgcagtcgccatggtacttgctggtggcattcagcggacagatgccaccggaacaagagtcagaggagaaagccacctcctactagtcggcgacccaggaactggaaaaagccagttcctgaaatatgccgctaagattacaccccgttctgttctgacgactgggataggcagcacctctgcgggattaaccgtcactgccgtgaaagatagtggcgagtggaatttggaggcgggtgccctcgtactggccgatgccggactatgctgtatagatgaatttaactcactgaaagaacatgatcgcacatctatccatgaggcaatggagcagcagacaatatccgtggccaaggccggactggtctgtaagctgaataccagaacaacaatccttgcggctaccaacccgaaaggccaatacgacccacaggagtccgtgtccgttaacatagcgcttgggtcccctttactaagcagatttgacttaatcttagtgctcctggacaccaaaaacgaagattgggatagaattatatccagttttattctcgagaataagggctacccatccaagagtgagaagttatggtctatggaaaagatgaagacctacttctgtctgatacgaaacctgcagcccaccctatctgatgtgggcaatcaggtactcctacgctactaccagatgcagcgccaatctgattgccggaacgctgccagaacaactatcaggttgctcgagtctctgattaggctcgccgaggctcatgctagactgatgttcagggatacggtaacattggaagacgctattacggtcgtctcggttatggaatcctccatgcaaggcggagccctgcttggcggagtgaacgccctgcacacatcgtttccagagaacccgggagaacagtatcaacggcagtgtgagctcatcctggagaagttggagctgcagagcctgctgtctgaggaactgaggcgactcgaacgtcttcagaaccagtccgtccatcaaagccagcctcgagttctcgaagtggaaaccacccccggatctctgcgaaacggcccaggggaagagagtaacttcaggacaagttcgcagcaggaaattaactactctacccacatcttctcaccaggcggttcccctgaggggtcgcccgttctggatccccctccgcatctagagcctaataggtccaccagccgtaagcattctgcccagcacaagaataatagagacgatagtctcgactggttcgattttatggcaacccatcagtccgagccaaagaacacggtcgtcgtgtctccacacccaaagacatccggcgagaatatggcttccaagatcagtaattccacgagccagggaaaagaaaaatccgagccaggacagagatccaaggttgacatcgggctcctgccatctccaggagagacgggggtaccgtggcgggctgataatgtcgaatccaataaaaagaaacgccttgccctggactccgaggcggcagttagtgcagacaagcctgattcagtcctgacccatcatgttcctcgtaacctgcagaaactgtgcaaggagagagcacagaagctatgtcgaaattcaactcgagttccagctcagtgcacggtaccttctcatccacaaagcacgccagtgcatagccccgacaggatgctggatagccccaagcggaagcgtccaaaaagtctggcacaggtagaagaacctgcgatagaaaacgttaagccccctgggtcacccgtggccaaactggctaagttcaccttcaagcagaaatccaaactaatccactctttcgaggatcactctcacgtgtcccccggtgcgacaaaaatcgcagtccactctcctaaaatttcccagcgaagaacccgcagagatgccgctctgcctgtgaaaagaccagggaagctaacatccactcctggtaaccagatcagttcgcagccacagggagaaacaaaggaggtgtcccagcagcctccggagaagcacggaccaagggagaaggtgatgtgcgccccagagaaacgcatcatacagccggaactcgagctgggaaatgagacggggtgtgcccaccttacttgtgaaggtgataagaaggaagaggttagtggctctaataaatctggaaaggtgcacgcatgcaccctggcacggctggcaaatttttgcttcacacccccaagtgagtccaagtccaagtcaccccctccagagagaaagaacagaggtgaaaggggccctagttccccacccacaacaacggccccaatgagggtcagcaaacggaagtcatttcaactgagaggctcaactgaaaagcttatcgtgagcaaagagtccctgtttactttgcccgagcttggcgacgaagctttcgattgtgactgggatgaggagatgcggaagaaatcctag

SEQ ID NO: 57599 - DNA, 471 bp, Artificial Sequence
  Description of Artificial Sequence: Synthetic coding sequence
atgaactccgatcaagtaaccttggtgggacaggtgtttgaatcctatgtctcagagtaccacaaaaatgacatcctactgatcttaaaggagcgcgacgaggacgctcattacccagtggttgtaaatgcgatgacgctatttgaaactaacatggagatcggagagtacttcaacatgtttccatcggaggtgttaaccatctttgacagtgccctgagaaggtccgctttgaccattctgcagagcctcagccaacctgaagccgtgagtatgaaacagaatctgcacgctcgtatctcaggcttgcctgtttgtcccgagctggtgagggagcatattccaaagactaaggatgttggtcattttctttcagtaacaggtactgttatcagaacaagtctggtaaaagtcctggaattcgaacgagattacatgtgcaataagtgcaagcacgtgtttgttatctag

SEQ ID NO: 57600 - DNA, 237 bp, Artificial Sequence
  Description of Artificial Sequence: Synthetic coding sequence
atgaatagtgatcaggtgacacttgtgggccaggtgttcgagtcctatgtgagcgagtaccataagaacgatatcttgctgatcctcaaggaaagggatgaagatgcccactaccctgtggtcgttaacgcgatgacactttttgagacaaacatggaaataggcgaatactttaatatgtttccgagtgaagtccttacaatctttgacagcgcacttcgacggtccgcgctgtag

SEQ ID NO: 57601 - DNA, 2628 bp, Artificial Sequence
  Description of Artificial Sequence: Synthetic coding sequence
atgagcggcactaaacccgatatcctgtgggccccacatcacgtggacagatttgtagtgtgcgattcagagctgagcttgtaccacgtcgagtctacggtcaattctgaactgaaggcgggaagcctacggctcagtgaagacagcgccgcaacgttactgtcaattaactctgataccccttatatgaaatgtgtggcgtggtacctcaattacgacccagaatgtttattagctgttgggcaggcaaatggcagagttgttttaacttctctaggacaggaccacaactcgaagttcaaggacctgattggcaaagagtttgtgccgaaacacgctcgacaatgcaataccttggcctggaaccctctggactcgaactggctggccgctgggctggacaaacatagagcagatttcagcgtccttatttgggacatttgttctaagtacacgcccgatatcgttccaatggagaaagtcaaactcagcgcaggagaaactgagacaacactccttgtgacaaaacctctgtatgagttaggccagaatgatgcatgcctcagcctctgttggctaccacgggaccaaaaactgctgctggcaggaatgcaccggaatctggccatcttcgacttgaggaacacctctcagaaaatgtttgtcaataccaaggctgtgcagggagtgacagtggacccatattttcatgaccgcgtggcctctttctatgagggtcaggtggccatttgggatctacggaagttcgaaaagcccgtcctcacattaactgaacagcctaagccactcaccaaagttgcttggtgcccaactcggactggtttactggctactctgacaagggacagcaatattatccgcctgtacgacatgcagcacacacccacccctattggagatgaaaccgaaccaactatcatcgagcggagcgtacagccttgtgacaattacatagcatccttcgcttggcatcccacgtcccagaaccgtatgatcgtggtcactccaaaccggacaatgtcagacttcaccgtgtttgagcggatatctctggcctggtctccaattacctcgctgatgtgggcgtgcggtcggcacctctatgagtgtacggaggaggaaaatgacaatagcttagaaaaggatatcgcaaccaaaatgcgccttcgcgcattgagccgttatggtttggacaccgaacaagtgtggagaaatcatatcctggctggcaacgaggatccccaactgaaaagtctttggtatactcttcacttcatgaagcagtacactgaggatatggatcagaagagtcctggcaacaagggcagtctggtctatgcaggtatcaaatcgatcgtgaaaagctcattgggaatggtggaatctagtaggcataactggtccggactggataaacagtctgacatacaaaaccttaacgaggaacgcattctcgcccttcagctttgcggatggatcaaaaagggtacagatgtggatgttggtccatttttaaactctctggtacaggaaggcgaatgggaaagagctgccgctgtggctcttttcaatctggatatccgcagggccatccagatcctcaacgagggcgctagctccgagaaaggggatctcaaccttaatgtcgtggcgatggcattgagcggctatacagatgaaaaaaacagcttgtggcgggaaatgtgcagtaccctgcgactccagttgaacaacccttacctgtgtgtgatgtttgcatttctgacgagtgagaccgggtcttatgatggggtgttatatgagaacaaggtggcagttagggacagggtggcttttgcctgcaaattcctcagtgacacccagcttaaccggtacatcgagaaattgacaaacgaaatgaaagaggccggaaacttggagggcattctgttgacaggcctgacaaaagacggggtggacttaatggaatcttacgtggacagaacaggggatgtgcagacggcttcttattgtatgttgcaaggaagcccactggacgttttgaaagacgaacgggtccaatattggatcgagaattaccgcaatttgctggacgcctggcgtttctggcacaaaagagccgagttcgacatccaccgctcaaaactggaccccagctcaaagccactggctcaggtatttgtgtcctgcaatttctgcggcaagagtattagctatagctgttctgcggttccgcaccaagggagagggttttcacaatatggagtgagcggctcacccactaaatccaaggtgacttcatgtcccggatgtagaaaaccgctcccgcgatgcgctttatgtctcatcaacatgggaacacctgtgtcctcttgtccaggagggaccaagtccgacgaaaaggtagacctcagcaaagacaaaaagctggcccaatttaacaattggtttacttggtgtcataactgccgccatgggggacacgccggacatatgctctcctggttcagagatcacgcagagtgtccagtatcagcttgtacatgcaagtgcatgcagttagacaccaccggtaatttagtgcccgcagagaccgttcagccctag

SEQ ID NO: 57602 - DNA, 2628 bp, Artificial Sequence
  Description of Artificial Sequence: Synthetic coding sequence
atgagcggcaccaaacccgatatcctttgggccccacaccacgtcgataggttcgtggtgtgtgactccgagctttccctctaccatgttgaatctacggtcaactctgagctgaaggccggatcccttcgcctgagcgaggacagtgccgcaacgctgctttctatcaactccgacacgccgtatatgaaatgcgtggcctggtacctgaattacgatccggagtgtcttttagccgtaggtcaggccaacgggagagtagtgctcacctccttggggcaggaccacaatagcaaattcaaggatctgatcggcaaggagttcgtgcctaaacacgctagacagtgtaataccctggcatggaaccctctggatagcaactggctagccgctggcctcgataagcacagagctgacttttctgtgctgatttgggacatttgctccaaatacacaccagatattgtccccatggagaaagtgaaactcagtgccggtgaaacagagactactctgcttgtgactaagcccctgtacgaactcggccagaacgacgcttgcctcagcctctgctggctgcctcgggatcagaagctgctactcgcaggtatgcaccgcaacctggccatattcgatcttcgaaatacatcccagaagatgttcgtcaacacaaaagctgtacagggcgtaacggtggatccgtattttcatgatagagtggctagcttctacgaaggacaagtggcaatctgggacctgcgcaaatttgaaaagcccgtcctgactctcactgaacagccaaagcctttgacaaaggtggcctggtgccccacacggactgggctcctggcaacactcaccagagacagtaatattattagactttacgacatgcagcatacacctacaccaatcggcgacgagacggaaccaacaatcatcgagcgcagcgttcaaccatgtgataattatatcgcctctttcgcatggcaccctactagccagaaccgtatgatagtggtcactcctaatcgcacgatgagcgacttcacggtgttcgaacggattagcctggcgtggagtccaatcacttcactgatgtgggcttgcggtcgacatttgtatgaatgtaccgaggaggaaaacgacaattcactagagaaggacatcgctacgaagatgagactgcgcgcattgtcgcgatatgggcttgatacagagcaggtatggcgtaatcacatactggctggtaacgaagatcctcagctcaagagcctgtggtacacactgcatttcatgaaacagtacacagaggatatggaccaaaaaagtcccggaaacaagggtagcctggtatatgcagggatcaagtcaatcgtcaagtcctccctggggatggtggaatcatcccgccacaactggtcaggactggataaacagagcgacattcagaaccttaatgaagaaaggatcctggctctgcagctgtgtggatggatcaagaaaggcacggatgtggacgtcggccctttcctgaattcacttgtacaggagggtgagtgggagcgagcagccgctgttgccctgtttaatctggacattagacgggcaattcaaattctgaatgagggcgctagttccgagaagggcgatctgaatctcaacgtcgttgcaatggcactgagcggctataccgacgaaaaaaattctctctggagggaaatgtgcagcaccctgcggctgcagttgaacaatccttacctgtgtgtaatgttcgcttttctgacctcagaaaccggctcttatgacggggtgctctatgagaacaaggtagccgtccgggaccgggtggcatttgcctgtaagttcctgtctgacactcaactcaacagatatatcgaaaagctgacaaacgagatgaaagaagcaggaaatctcgagggaattctgctgaccggactaactaaggacggcgtggacctgatggaatcttatgttgatcgcactggagacgtgcagactgcaagttactgcatgctgcagggcagccctctcgatgtgctgaaggatgagcgcgtccagtactggatcgagaactatagaaacctgctcgatgcatggcgattctggcataaaagagctgaatttgacatacaccgcagcaaacttgacccatcttctaagccactcgcccaagtatttgtgagttgtaacttctgtggcaagtcaatctcttactcttgttccgctgtgccccaccagggtagaggcttcagtcagtacggcgtatctggaagtccaacgaaaagtaaagtcaccagttgtcccggttgtcggaagccccttcctaggtgcgccctctgcttgatcaacatgggaacccccgttagttcatgtcctggtgggactaagtcagatgaaaaagtggacctgagcaaggacaaaaaactcgcccagtttaataactggtttacctggtgccacaattgccgccacggcggacacgcaggacacatgctgtcatggttcagggaccatgccgagtgcccagtcagtgcttgtacttgcaagtgtatgcaactggacacaacagggaacctcgtacctgccgaaacagtgcaaccgtag

SEQ ID NO: 57603 - DNA, 195 bp, Artificial Sequence
  Description of Artificial Sequence: Synthetic coding sequence
atgagcggaacaaagcctgacattctttgggctcctcaccatgtcgaccggttcgtggtgtgcgattcagagctgtccctatatcacgttgagtccacggtgaactccgagttgaaggctggttccctccggctttcagaggactccgccgcaactcttctgtcaatcaattctgataccccctacatgaaatag

SEQ ID NO: 57604 - DNA, 453 bp, Artificial Sequence
  Description of Artificial Sequence: Synthetic coding sequence
atgagtggaacaaagcctgacattctgtgggccccacaccacgttgaccggttcgtcgtctgcgacagtgaactctcactgtatcatgtagaatcaacagtcaattccgaactgaaggctggctccctgagattatcagaggacagcgctgccaccttactgagtattaactccgacactccatatatgaaatgcgttgcttggtaccttaattacgatccagagtgtctcctggccgtcggccaggctaacggtcgcgtagtgcttacatcgcttggccaggatcacaattccaagttcaaggacctgatagggaaggaattcgtacccaagcatgcaaggcagtgtaatacactcgcttggaaccctctagattccaactggctggccgcagggctcgacaaacatagagcggatttctcagtgctaatctgggatatttgcagcaagtag

SEQ ID NO: 57605 - DNA, 195 bp, Artificial Sequence
  Description of Artificial Sequence: Synthetic coding sequence
atgagcggcaccaaacctgatatcttgtgggcccctcaccacgtggaccgattcgtagtatgcgacagtgagctcagcttgtatcacgttgagtctaccgtgaactctgagctcaaggcagggtcacttcgcctgtcagaagatagcgccgctaccttactttctattaactctgataccccatatatgaagtag

SEQ ID NO: 57606 - DNA, 540 bp, Artificial Sequence
  Description of Artificial Sequence: Synthetic coding sequence
atgagcggaacaaagcccgacattctctgggccccacaccacgttgataggtttgtggtgtgtgactccgaactctcactctatcatgtcgaatccacagttaactctgagctgaaggccggtagcctccgactgagtgaggattccgctgccacactgctcagcatcaactcagacaccccatatatgaagtgcgtggcctggtatctgaattacgacccagagtgtctgctggccgttggccaggcaaatgggagagtggtcttgaccagcctgggccaggaccacaactctaagtttaaagaccttatcggaaaggaattcgtccccaagcatgctcggcagtgtaataccctggcctggaacccgcttgacagcaactggctggccgctggcctggacaaacaccgggcagatttcagcgtcttgatttgggatatatgtagtaagtacactcccgatatagtcccgatggagaaagttaagctgtctgcgggagagaccgagacaaccctactggtgacgaagccgctctactag

SEQ ID NO: 57607 - DNA, 789 bp, Artificial Sequence
  Description of Artificial Sequence: Synthetic coding sequence
atggccctggggttgaaatgtagccggatggtacaccccgctttccgcaactatctcgccgcatctattagacccgtcagcgaagttaccctaaaaaaagtgtacgaacgacagcacgggcacaggcaatacgtggcctactccgcggtgcctgtccatcatttcgctactaagaaggccaaggccaagggcaaaggtaagagccagacacgcgttaatattagcgctgcatttgtggaagacattattaacttggaagaggttaatgaggaaatgaaaagtgtaatcgaggcgaggaaagataactttaacaagactctgaacatcggtacatcacctgggagtctcgataaaatagcagtagtgactgcggacgggaagctcgctctaaaccagatcaggcagatatcggtgaagctgccccagcttatccttgtgaatatggcatcttttccagagtttaccgtcgcagccataaaggccattcgggagtcaggcatgaatctaaatcctgaagtcgaaggaacactgatcagggtgccgatcccccaggtgatccgcgaacatagagaaatgctggttaagctggctaaacagaacaccaataaggcaacttatagcctgcgaaaagtgtgcaccaatgccatgaataagctcaagaagtcgaaagacaccgtgtctgaaggcacaattagactgaccgagaagcagatatcacagatggccgatgacaccgtcgccgagctctacaggcacctggcggtgaagactaaggaactactgggctag

SEQ ID NO: 57608 - DNA, 738 bp, Artificial Sequence
  Description of Artificial Sequence: Synthetic coding sequence
atgtccgatgagtttagcctggctgacgctctccctgagcacagccccgctaagacttcagccgtcagcaataccaagcctggtcagccaccccaggggtggcccggttctaatccatggaataacccttcggctccatcttctgtccctagcgggctacccccatccgccaccccaagcactgtgccgttcggaccagcgcctacaggcatgtatcctagcgtgccacctacaggccctccacctggaccccctgctccttttcccccatctggtcctagctgtcctcctcccggaggcccataccccgcacccactgtgcccggtccaggcccaacgggtccgtaccctacccccaatatgccgtttccggagttgcctcgaccctatggggctccaacagatcctgccgcagcgggaccactggggccatggggttcaatgtcttcaggaccatgggcccctggtatgggtggccagtaccccaccccaaacatgccttatccttcccctggcccatacccagctccccctccccctcaggcaccaggcgcagctccccctgtgccctgggggacagtccccccaggcgcttggggccctcctgcaccttatccagcaccaactgggtcttatcctactcccggtttatatcctaccccttcaaatcccttccaagtccccagtgggccatctggggctccacccatgcctggagggccacattcttatcattag

SEQ ID NO: 57609 - DNA, 690 bp, Artificial Sequence
  Description of Artificial Sequence: Synthetic coding sequence
atgtctagccacctagtcgagccaccccctcccctacacaataacaataacaattgtgaagagaatgagcagagcctgccaccgccagccggtctaaactcctcatgggtggagctacccatgaatagctctaatgggaatgacaacgggaatggaaaaaacggcggattggaacatgtccctagttcttcatcaatccacaacggcgacatggagaagattctgctggacgctcagcacgagagcggacagtcaagttcaagaggttcatctcattgcgactcccctagtccccaggaggacgggcagataatgtttgacgtggagatgcatacgtctcgggatcactcctcccagtccgaggaagaggtagtggagggcgaaaaagaagtcgaggcacttaaaaagagcgctgactgggtcagtgactggtcctctcggcctgagaatatccccccaaaggagtttcactttcgccatcctaagcgtagtgtctcactaagcatgagaaaaagtggtgccatgaagaaaggaggcattttttctgcagagttcttgaaagtatttatacccagcttatttctgtctcatgtgctggccctgggcctgggtatttacatcggaaaacgccttagtactccatgtcaacacctcctcagggaaaggaagtccccctggaaatgtgtgtag

SEQ ID NO: 57610 - DNA, 4044 bp, Artificial Sequence
  Description of Artificial Sequence: Synthetic coding sequence
atgccagcagtacgggtgtgggatgtagctgaacacagtcaggtggccgaactgcaagagcacaagtacggcgtggcgtgtgttgctttttcacccagtgccaagtatattgtatccgtggggtatcaacacgacatgatcgttaatgtatgggcttggaaaaagaacattgtcgtcgcatccaacaaggtgtcttcacgcgttactgccgtgtcgttcagcgaggattgttcatactttgtaaccgctggcaacaggcacataaagttttggtacttagatgattcgaaaacgagcaaggtcaacgccacagtgcctctgctcggcaggagtggcctgctgggcgagttacggaacaacctgttcacagacgtcgcctgcggccgaggcaaaaaggccgattccactttctgcattacatcaagcgggctactttgcgagttcagcgacagacggctacttgacaaatgggtggaactgcgtaccacagtggcacactgcatttctgttagccaggactatattttctgcgggtgcgcagacggcaccgttcgcttattcaatccgagcaaccttcattttctgtcgaccctgccgcgtccccacgcgctgggcaccgacattgcttccgtgacagaggcatctcgtctgttctcgggagttgctaatgctcggtatcccgacacgatcgcgcttacttttgacccaacaaaccagtggctgtcctgcgtctacaacgaccactctatttacgtctgggacgtgcgggacccgaagaaagttggcaaagtgtactctgctttgtatcacagtagttgcgtctggagtgttgaagatctgataaagattatctacgtggacggaaacacccaggctcttttggacactgaattaccgggtggtgacaaagcggatgcatcacttttggacccacgagtgggcatccgttctgtatgtgtttccccaaacggccagcacctggcatccggcgataggatgggcactcttagagtgcacgagctgcagtccctgagtgagatgctgaaggtagaagcccatgatagtgagatactgtgcttagagtactctaaacccgataccgggctaaagctactcgcctccgcttcacgggatcggctgatacacgtgctggatgcaggtcgtgaatacagtctgcagcagactctcgacgagcatagttctagcattaccgccgtgaaattcgcggcttcagatggccaggtgaggatgatctcatgcggggctgacaaatctatctatttccgtaccgctcagaagtccggcgatggcgtccaattcacacgtacacatcacgtggtaagaaagactacgctttacgatatggatgtggagcccagctggaaatacaccgcgatcgggtgccaagaccgcaatatccgtatcttcaacatttcttcaggaaagcagaaaaaactcttcaaggggtcccagggcgaagacggtactctcataaaagtgcagaccgatccctcgggcatctatatcgccacaagttgcagcgataaaaatctttctattttcgatttttcttcgggggaatgcgtggccaccatgtttggccatagtgagatcgttacaggaatgaagttcagtaatgactgtaagcaccttatcagtgtcagtggtgactcttgcatcttcgtgtggcgcctgtcttcagagatgaccatcagcatgcgccagcggctcgctgaactcaggcagcgacagaggggaggaaaacagcaagggcctagttccccccagagggccagtggtcctaatcgccaccaggctcctagtatgctgagccctgggccagccctcagctccgacagtgataaggagggggaagacgaaggcacggaggaagaattgccggctctcccagtccttgcaaaatctactaaaaaggcgctcgcaagtgtgccctcgccagcattgcctcgttctctgtcccattgggagatgagtcgcgcacaggagtctgtcggctttctggatcctgcaccagctgctaaccccggacctcgcaggcgcggaaggtgggtccagcctggagtggagctgagcgtccgcagcatgttggatctccggcaactggagacccttgcaccctctctgcaggatccctcacaggactctctagcaataatcccttcagggcctagaaagcatggacaggaagctctcgagacatccctcaccagccagaatgagaagccgccaagaccccaggcttcacagccctgcagttatcctcatattatacggctgctgagtcaggaggaaggcgtctttgcacaggacctggaacccgcacctattgaggacggaatagtctatcccgaaccttctgacaatccaaccatggatacctcagaattccaggtccaggccccagccagggggactctcggcagggtgtatcctggttctcgctcatcagaaaagcattcgcccgattcggcttgctctgttgactattccagcagctgcctgagctcccccgagcacccgaccgaagatagcgagtcaacagagcctttgtcagttgacggcatttcttccgacctcgaagagcctgctgaaggcgatgaggaagaggaagaggaggaggggggtatggggccttacggactgcaggaaggctcaccacaaacccccgaccaagagcagttcctcaaacagcatttcgaaacattggcgagtggagctgctcctggggctcccgtgcaggtgcctgaacgaagtgaaagtcgctccatatcatcacggttcttgctgcaggttcaaacccgtcccctgcgcgaacctagtccttcttcctcctctctagctctaatgtccagaccagctcaggtgcctcaggccagtggagagcagcccaggggcaatggcgcaaacccccctggggcacctccggaagtggagccctcttccggaaatccttccccacagcaagctgcatcggtgctgctgcccaggtgtaggctgaacccagactctagttgggcgcctaagcgggtcgctaccgcttcaccatttagcggcctccagaaggcccagtccgtgcactccctggtgccgcaagaacgtcatgaggcaagcctgcaggctcctagccccggagctctgctgagtagagaaattgaagctcaggatggcctgggctccctccctccagccgacggtcgcccatccaggcctcattcttaccaaaatccgacaacatcttcgatggccaaaatttctcgctccatttctgtgggcgaaaatctgggactggtcgccgaaccccaggcccacgctcctatccgggtcagtcctctgtcgaagctggccctgccgagccgggctcatttggtactggacatacccaagccgctcccagaccggccaacgctggcggcattttctccagtaacaaagggacgtgcccctggggaggcagaaaagcctgggtttcctgttggtcttggaaaggcccacagcaccaccgagcgttgggcctgccttggagaggggactacccccaagccacggacggagtgccaggcccatccaggtccatcgtccccatgcgcacagcaactccctgtcagctccctcttccaaggcccagagaatctacaaccacccccacccgagaagacgccaaacccgatggaatgcactaaaccaggagctgcgctgagtcaggatagcgaacctgccgttagcttggagcagtgtgagcagctggtggccgaactgaggggcagtgttcgccaggcagtaagactgtatcactctgtggctggctgcaaaatgccatccgctgaacagtcccgcatcgcacaactgctgcgggataccttttcctccgtgcggcaggaattagaggccgtggcaggcgctgtgctgtctagtccaggctcgtcacctggcgctgtcggtgcagagcaaacgcaggccctgctcgagcagtactctgagttactgctgcgagccgtagaacgacggatggagaggaagctttag

SEQ ID NO: 57611 - DNA, 4545 bp, Artificial Sequence
  Description of Artificial Sequence: Synthetic coding sequence
atggccgtcgaagggagcaccataacatctcggatcaagaatctgctcagatcccctagtatcaaactccgtaggtccaaggcagggaataggagagaggatctgtcatctaaagtcactcttgagaaagtcctgggaatcactgtgtccggagggaggggactggcatgtgatcctagatctggccttgttgcatacccggcaggatgcgtggtggttctgtttaaccccagaaaacacaaacaacaccacatactgaactcaagcaggaagacaataacggccttggctttttctccagacggcaagtatctggtgaccggggaaagcggccatatgccagctgttagagtctgggatgtcgccgagcacagtcaggtggcggagctgcaggaacataagtacggcgtcgcatgcgtggccttttcgccctcggccaagtatatcgtgtctgtcgggtaccagcatgatatgattgttaacgtatgggcctggaagaagaacattgttgtggcatccaacaaggtttcaagcagggtaactgcagtcagcttcagcgaggactgtagctattttgtgacggctggcaatagacacatcaagttttggtacctagacgatagcaagacaagtaaggtgaacgccacagtacctctgctggggcgaagcggcctccttggggagctacgaaataacctttttactgacgtggcctgtgggagggggaaaaaagcagatagcacgttctgcatcacgtcttctggcctgctttgcgagttcagtgacagacgactgctggacaagtgggtggagctcaggaatattgattcatttacaaccaccgtcgctcactgtatttctgtctcacaggactacatcttttgcgggtgtgccgatggaaccgtacgcctgtttaatccttcaaatttgcacttcctgtcgactctgccccgtcctcacgctctcggcactgatattgcatcagtaacagaagcctctcggttgtttagcggcgtggctaatgcaagataccccgatacaattgccctgacattcgatcctaccaatcaatggttgtcgtgtgtgtataatgatcacagcatttacgtgtgggatgtcagagatcccaagaaagtggggaaagtatattccgctttgtatcactcatcttgcgtttggagcgtggaggtctatccagaagtgaaagacagcaatcaggcctgcctgccgccatcaagctttattacatgttcttctgataataccatccgactgtggaacacggagtcaagcggtgtccacggttctactctccacaggaacatcctgtccagcgacctgataaagatcatctatgttgacggcaacactcaggcgctgctggataccgaactccctgggggtgataaagccgacgcctcactgcttgaccccagagttggcatccgatcagtctgtgtcagtccaaatggacagcacttggcaagcggcgaccggatgggaacacttcgggtccacgagctccaatcattaagtgaaatgctaaaggtggaagcacatgattccgagattttgtgcttagagtactccaagccagacaccgggctcaaactgctagctagcgcctctcgtgatagactcatacacgtgctagacgcagggagagagtactctcttcagcagacattggacgagcattcgagcagtatcacagcggtgaagttcgctgcatcagatggccaggtgcgcatgatcagttgtggagctgataaatccatctattttagaacggctcagaaatccggggacggcgtccagtttaccaggacacatcacgttgtgagaaagactaccttatacgatatggacgtcgaaccctcttggaaatacacagcgattgggtgtcaggaccgcaatattagaatatttaatatcagcagcgggaaacagaagaagttatttaagggttcacagggagaggatggaaccctcattaaggtccaaacagatcctagtggcatttacattgcaacatcctgcagcgacaagaatctttcgatttttgatttttcttccggagagtgtgtggctaccatgttcgggcactccgaaatcgtgactggcatgaaattcagtaatgactgcaagcaccttatatccgtgtcaggtgattcatgcattttcgtgtggcggctatcctctgaaatgacaatctcaatgcggcagcgacttgcagagctccgacagagacagcgcggtggaaagcagcagggaccttcatcaccgcaacgcgcatctgggccaaatcgccaccaggccccttctatgctgtctccaggcccagctctcagttctgattctgacaaagaaggtgaagacgagggcacagaggaagagcttcccgctctacctgtgctggccaagtctactaagaaggccttagcgagtgttccttcgccagccctcccacgctctctgagtcactgggagatgtctcgcgctcaagagtcagtggggtttcttgaccccgcacctgctgccaaccccggtccgagacgcagggggaggtgggtgcagcccggagttgaactgtctgtacgcagtatgctagaccttcgccagctcgaaacacttgccccatctctccaggaccccagccaggatagccttgctataattccatcaggtccccgaaaacacgggcaagaagcattggagactagcctgacatcacaaaacgagaagccaccaaggcctcaggcttcgcagccttgctcctatccacacattatccggttactgagtcaggaagaaggggtatttgctcaggatctcgagcccgcacccatcgaggacgggattgtttatccggagccttctgataaccccacgatggatacctctgagttccaggtacaggctcccgcaagaggaaccttaggcagggtttaccccggaagtcgttctagcgagaagcactcaccggacagtgcctgttcggtcgattattcttccagctgcctttctagtccagagcatccgaccgaggatagtgaatctacagagccccttagtgttgacggcatttccagcgacttagaagagcctgccgaaggcgacgaagaagaagaagaggaggagggcggaatgggaccctacggcctacaggaaggctcacctcaaacgcccgaccaggagcagtttctaaagcagcattttgagacactggcttccggagctgcaccaggcgctccagttcaggttcctgaacgttcggaatctaggtcgatctcctcacgcttcctcctgcaggttcagacccggcctctcagggaacctagtccctctagttcctcactggccttgatgagtcgccctgctcaagtacctcaagcaagcggcgaacagcctcgcggaaatggggcaaaccctcccggagcaccgcctgaagtggagcccagttctggcaatcctagcccccagcaggctgcttccgtcctgctgcccagatgccgacttaatcccgactccagttgggctccgaaaagggtagcgacagcgagtccattcagtggccttcagaaggctcaatcagtgcactctttggtgcctcaggaacgtcatgaggccagcctgcaggccccaagtcctggagcactattgagtcgagagatcgaagcccaggacggcctaggtagcctacctcccgcagatggtaggccctccagaccccactcttatcagaaccctaccacatcttcaatggccaagatctcaagaagcattagcgtcggtgaaaacctgggattggtcgccgagccccaggcccacgctcccattagggtctctcccctctccaagctagcattaccaagcagggctcaccttgtcctcgatatccccaaaccattgcctgatcgccctaccctagccgctttcagccccgtaacgaaaggtcgggctcccggtgaagccgaaaaaccaggattcccggttggtctgggtaaagcacacagtaccacggagagatgggcttgtcttggggaaggcacaaccccaaagcctcggacagaatgccaggcgcaccccggacccagttctccttgcgcccagcaactccccgtaagctctttattccagggaccagagaatctgcagcccccaccacctgagaagactcctaatccaatggagtgtaccaagcccggagctgcccttagccaggattccgagcctgccgtgtccttggagcagtgcgagcagctcgtagccgaactaagaggctctgtacgacaggctgtgcggttataccattccgtggccggttgcaagatgcccagtgccgagcagtcccgcatagctcagctgctgcgagacacctttagtagcgtgagacaggagcttgaagcggtcgccggagctgtgctaagctctccgggttcctcgcctggagccgtgggagcagagcagacgcaagctttgctggagcagtactctgagctcttgttgcgcgctgtggagaggcggatggagaggaagctctag

SEQ ID NO: 57612 - DNA, 4527 bp, Artificial Sequence
  Description of Artificial Sequence: Synthetic coding sequence
atggcggtagaggggtccaccattacctccagaatcaagaatctgctacgctctccctcgattaaactgcgcagaagtaaggcgggtaaccggcgtgaggacctgtcttcgaaggtaacccttgagaaagtgctcggtattactgtgagcgggggtcgaggtttagcatgtgatcccagatccggactagtggcctaccctgccggatgtgttgtggtccttttcaacccaaggaagcacaaacagcatcacattctgaacagttcccgcaagacgattaccgccctagccttctcgccagacggtaaataccttgtgaccggagaaagcggccatatgcctgctgtaagggtgtgggacgttgcagagcactcccaagttgctgagctgcaggagcacaaatatggggtggcctgtgttgccttcagcccctcagccaagtatattgtatcggtggggtaccagcacgatatgatcgtaaatgtgtgggcttggaagaagaacattgtcgtcgcgtccaataaggttagtagtagagttacggcagtgtcctttagcgaggactgcagttacttcgttacagcaggaaaccgccacatcaaattttggtatttggacgacagcaaaacttccaaggtgaatgcaacagtccctttactgggtcgtagcggccttctgggggagctgcgtaataatctgttcaccgatgtcgcttgtggccgtgggaaaaaagcagattctaccttctgcatcactagcagcggcctgctctgtgagttcagcgatcggaggcttctggacaaatgggtggaacttcgaactactgtggctcactgcatcagcgtgtctcaggattatatcttctgtgggtgtgctgacggcaccgtgagactctttaatccgtctaaccttcatttcttgtcaaccctgcccagaccgcacgccctcgggaccgatattgcctctgtgactgaggcatcacggctgttctctggcgtggccaatgccaggtaccccgatacaattgcccttacttttgaccccacaaaccaatggctgtcctgcgtgtataatgatcattccatttatgtttgggatgttcgcgaccctaaaaaggtggggaaggtctattcagccctttatcactcaagctgcgtttggtccgtcgaggtttaccccgaggtcaaagacagtaaccaagcctgcttacccccttcctcctttataacatgttcctccgataacacaatcagactgtggaacacggaaagtagcggcgtccatggctctaccctacatagaaatattctcagctccgacctcatcaagatcatatacgtggatggcaacacccaagctctgctggacaccgagctacctgggggagacaaggccgacgctagcctcctcgacccgagagttggcatccgctccgtctgcgtctccccaaatggccagcacctggccagtggggacaggatgggcacgctgcgtgtgcacgaactgcagtcactatcagaaatgctgaaagttgaggcccatgattcagagattctctgcttagagtacagcaaacccgacactggactcaaactgttggcatcagctagtcgcgataggttgattcacgtgctggacgctggtcgggagtactccctccagcagacgttggacgagcactccagttccatcactgctgtcaaattcgccgcttccgatgggcaggtacggatgatctcgtgcggcgctgacaagagcatctattttcgaaccgcacagaagtcaggggacggcgtccagttcactagaacccaccacgttgtccggaagacaactttgtacgacatggatgtggagccaagctggaagtacactgcaattggctgccaagataggaacataagaattttcaacatatctagtggcaagcagaagaaacttttcaaaggctcccagggggaggacggtaccctcattaaggtccagacagatccatcgggtatctatatcgccaccagttgcagcgacaaaaatctgagcatcttcgattttagcagcggtgagtgcgtcgcaactatgtttggccactccgaaattgtgaccgggatgaagttctcaaacgactgcaagcacctcatctcagtttcaggggacagttgcatctttgtttggcgcctttcttcagagatgacaatctccatgcgccagcgtcttgcggagctccgccagagacagagaggagggaaacaacaggggccatctagcccccagcgtgctagtggcccaaacaggcaccaggcgccaagcatgctctcacctggccctgctcttagtagcgacagcgacaaagagggggaggacgaggggacggaagaagagcttccagctctccccgtacttgccaagtcaacaaaaaaggcactagccagcgtcccgtctcctgccttaccccgttccctgtctcattgggagatgtccagagctcaggaatcagtgggattcctcgatccagccccagctgcaaacccagggcctaggagaaggggtcgatgggtgcagcctggtgttgagctttccgttaggagcatgctcgatctgcgccagttggagacattggccccttcgctgcaggacccatcccaggattccctggccatcattcctagtggaccacgaaagcatggacaagaagcactcgagacttctctgacaagtcagaatgagaaacctccgcgaccacaagcatcccagccatgtagctacccccacatcattcgtttactgtcccaggaagaaggagtctttgcacaggaccttgaacccgcaccaatcgaggacggcattgtgtacccggagcccagtgacaatcccaccatggacacttcggagtttcaggtgcaggctcccgcacgtgggaccctgggtagagtctaccccggtagccgcagttccgaaaaacacagccccgactctgcatgctctgttgactactcatcttcttgtctctcctccccagaacaccccaccgaggacagcgaatctacagagcccctcagtgtcgatggcatcagcagcgatttggaagaacccgcagaaggtgatgaagaagaggaggaggaggaggggggtatgggaccatatgggctacaagagggatccccccagacacctgatcaagagcagtttctcaagcagcattttgaaaccttggcaagtggcgcagcccctggggcacccgtgcaagtccctgagcggtcagaatctcgcagcattagtagtcgttttcttctccaggtgcagacacgccctctgagggaacccagcccatcttcaagctcccttgcacttatgagtcgacctgcccaggttcctcaggcctctggagagcagccccgagggaacggcgcaaatccccctggcgcaccccctgaagtggagcctagcagtggcaacccatcaccacaacaagccgcatccgtactgctgccacgctgtagactgaacccagactcctcttgggcacccaaaagagtcgcaactgccagcccgtttagcggtctgcagaaggcacagtctgtccactccctcgtccctcaggaaagacacgaagccagcctccaggccccatctcccggagccctgttatcaagggagattgaagcccaagacggactgggctcattacctcccgctgatggacggcctagtcggccacactcctatcagaaccccaccacctcatccatggcaaagatttcccggtccatctcagtcggggaaaaccttggcctagttgctgagccacaggcccacgcgcctattagggtgtcacccttgagcaagctagcactgccgtcgcgcgctcaccttgtcttggacattccaaagcccctgccagatcgaccaacccttgccgcatttagcccggttaccaaaggacgcgcacctggagaggcagaaaagccagggtttccagtaggcctgggaaaggcccattcaaccactgagcggtgggcatgcctcggcgaaggcacaaccccgaaaccacgcaccgagtgccaggctcatccgggtccgtcctccccatgtgcccagcagttacccgtttctagcctgttccaggggcctgagaatctgcagcctcctccccctgagaaaactcctaatccaatggagtgcacgaagccaggggcagctctgagccaagacagtgaaccggcagtttccctggagcagtgtgagcagcttgtggctgagctgcgcggatccgtccgtcaagccgtgaggctctaccatagcgtagctggctgcaaaatgccatctgcagagcaatcccgcatagctcagctgctcagggatacattttcgtccgtaaggcaggaactggaagctgtggctggggctgtgttgagttcgcccggttcctcacctggcgctgtcggtgctgaacagacccaagccctcttggagcagtactcagagctgctcttgcgggcagttgaaagaagaatggaacgcaagctttag

SEQ ID NO: 57613 - DNA, 471 bp, Artificial Sequence
  Description of Artificial Sequence: Synthetic coding sequence
atggctgtggagggatctacaatcacgagtcgaatcaaaaacttattgcgcagcccgtccattaaactgcggagatctaaggctggcaatcgcagggaagatctgtcatccaaagtgacattggagaaggtcttaggtattactgtgtccggcggacggggactggcctgtgaccctaggtctggacttgttgcctatcctgccggttgcgtggttgtgctgttcaacccgagaaaacataaacaacatcacatcctgaacagctccagaaagactatcactgccctggcatttagcccagacggtaaatatctcgtcacaggcgaatctggtcatatgcctgccgtgcgggtgtgggatgtcgcagagcactcccaggtagcagagctgcaagagcacaagtacggcgtcgcttgcgtggctttcagcccctctgcaaaatacatcgtgagcgttgggtaccagcactag

SEQ ID NO: 57614 - DNA, 3696 bp, Artificial Sequence
  Description of Artificial Sequence: Synthetic coding sequence
atggcagtggagggcagcaccatcacaagcaggattaagaacttattgcggtcgcctagcattaagttgaggcgaagtaaggctggcaacagacgggaggacctctcatctaaagtgactctggaaaaagtgctggggatcactgtgtctggcggacggggtttggcatgtgatcctcgtagtggtttggttgcatatcctgcaggctgcgtcgtggttttgtttaatccgaggaagcataaacagcaccacattttaaattcttctagaaaaaccatcacagcactagccttttcccctgacggaaaatacttggtcaccggggaaagtggtcatatgccagctgtgcgggtctgggatgtcgccgaacactcgcaagttgcagaactgcaggagcacaagtacggcgtcgcttgcgttgctttctcacctagcgccaaatatattgtgagtgtcgggtaccagcacgatatgatcgtaaatgtctgggcgtggaaaaaaaatatagttgtagcgagtaacaaagtgtcttccagagtcactgctgtgagcttcagtgaggactgttcttatttcgtgactgcaggaaatagacatattaaattctggtacctggatgacagcaagacctccaaagttaatgccacggttcctctcctgggcagaagcgggttgttaggcgagttgaggaacaatctcttcactgatgtggcatgtggccgaggcaaaaaggctgacagtactttttgcatcacgagtagtggcttactctgcgaattttcggaccgcagactgctcgacaaatgggttgagctgcggactacagtggctcactgtatcagcgtaagtcaggattatatcttctgcgggtgtgccgacggcactgtccgcctcttcaatccttccaatcttcacttcttaagtaccctgccccgaccacacgcacttggcacagacatagcatctgtgacggaagcttctcgcctgttctcaggcgtcgcgaacgcaagatacccagataccatcgcgcttacctttgatcctactaaccagtggctgtcatgcgtttacaacgatcacagcatctacgtgtgggacgtgcgtgacccaaagaaagtcgggaaagtgtactccgccctctatcactccagttgcgtgtggtctgtggaagtctatccagaggtcaaagattccaaccaagcatgccttccaccctcttcttttatcacctgttcttccgacaatacaatccgcctttggaatactgagtcatctggcgtacacggaagtaccttacacaggaatattctttcttcagatctcattaaaataatttacgtggatggcaacacacaagccctgctggatactgaactacctggaggcgataaggcagacgcgtccctgttagaccctcgtgtcggaattcggtccgtctgcgtatctccaaatgggcaacacctggcctcaggtgatagaatgggaacccttcgcgtgcacgagctccagtctttgtctgagatgctcaaagtggaagcccacgacagcgagattctgtgcctcgagtacagcaagccagacaccgggttgaaacttctcgcctcagccagccgcgataggctgatccacgtccttgacgccggaagggagtatagtctgcagcagacattggatgaacattccagcagcattaccgcggtgaaatttgcagcgtcagacgggcaggtgcgtatgatcagctgcggggctgacaaatccatatattttcgcacagctcaaaagtcaggggacggggtgcagttcacaagaacacaccatgtggtgcgaaagacaaccttgtatgacatggatgtggagcccagttggaagtacaccgctattggatgccaggataggaatattaggattttcaacatctcgtcaggcaagcagaaaaagcttttcaagggctcccagggtgaggatggcacacttattaaggtgcagaccgacccatccgggatttatatcgccacctcatgtagtgataagaatttaagcatctttgacttcagcagtggggaatgtgttgccacgatgtttggccattcagagatcgtcactgggatgaaattcagtaatgattgcaagcatcttatctccgtatcaggtgatagctgcattttcgtttggaggctgagctccgagatgacaatttcaatgagacagagactggccgagctcaggcagcgacagcggggaggaaagcagcagggaccaagctccccccagagggcatctggtccaaaccgccatcaggcgccatccatgttgtccccagggcctgctctctcttccgatagcgacaaggagggagaggacgaggggactgaagaggagctcccagccttacccgtccttgccaagagtaccaaaaaagcactagcgtcagtccccagtccagcactgcccaggtccctgtctcattgggagatgagccgggctcaggagtctgtggggtttctggacccagcacccgcagcgaatcctggccctagacggaggggcagatgggtgcaacctggtgttgagctaagtgtgcggtctatgcttgacctaagacaacttgaaactttggcacccagtctgcaagacccaagccaggattcactggccattattccgtccggacctagaaagcacggccaggaggctctggagacaagtcttacctctcagaatgaaaagccaccacgaccacaggcttcacagccctgctcttaccctcatataattcgcttactgtcgcaggaagagggtgtgttcgcacaagatctggaacctgctccgattgaagatggcatcgtgtacccagagcctagcgacaacccaacaatggatactagtgagttccaagtgcaggctccagcacggggaactttaggaagagtttatcctggaagcagaagcagcgagaagcattctcctgatagcgcgtgcagcgtagactacagctccagctgtctgagctctccagaacatcccaccgaggatagcgaatccacagagcccctttctgtagatggcattagctccgatctcgaagagcctgcggagggtgacgaggaagaagaggaagaggagggagggatgggcccatatggcctgcaggaagggagcccacagaccccagatcaggaacagtttcttaaacaacactttgagaccctggcgagtggtgccgcacctggtgctccagtccaggttcccgagaggtccgagtccagatccatctcaagcaggtttcttctgcaggtgcagactcgacctctgcgtgaaccatcaccctcatcaagctcacttgctttaatgagcaggccggctcaggtgccccaggcaagtgagcctgctgtgtctctggaacaatgcgagcagctcgtggcagaactgagaggctctgttagacaggccgtcagattgtaccactccgtggccggatgtaaaatgccttccgccgagcagtcgcgaatcgctcagctcctgcgggataccttctcctccgtgcgacaggaactagaagcggtggcaggcgctgtcctcagcagcccgggatcgagccccggagccgtgggagcagaacagactcaggcgctgctggagcagtactcagaactactgcttcgggctgtagagcggagaatggagcggaagttgtag

SEQ ID NO: 57615 - DNA, 2685 bp, Artificial Sequence
  Description of Artificial Sequence: Synthetic coding sequence
atgaaccccggttttgatctctccagaagaaaccctcaggaggactttgagttgattcagagaatcgggtccgggacctacggcgatgtctacaaggcccgtaatgtcaatactggagaactggccgctattaaggtcataaagttggaaccgggtgaagactttgcagtggtgcagcaggagatcattatgatgaaagattgtaaacatcccaacatcgttgcctactttgggtcgtatcttaggagggacaagctatggatatgcatggagttttgtggcggaggctcactccaggacatttatcacgtgaccggtccactttccgagctgcagattgcctacgtcagccgggagaccctgcagggcctgtactatctgcattcgaagggtaaaatgcacagggacatcaagggagcgaatatactcctgacagacaacggacatgtgaaattggccgatttcggggtgtcagctcaaatcaccgccacgatcgccaagcgcaagtcgttcatcggaaccccttactggatggcaccggaagttgccgcagtggagaggaagggcggttacaaccagctgtgcgatctgtgggcagttggtattacagcaatagaactcgccgaattacaacctcccatgttcgatctacaccccatgagagcccttttcctgatgacaaagagcaatttccagccaccaaagctgaaggataagatgaaatggtcaaatagcttccaccactttgttaaaatggctctcacaaaaaatccaaagaaaaggcccaccgccgagaagctgcttcagcatcccttcgtcacccagcatctgacccgtagccttgcaatagaactcctcgacaaggtcaataatccagatcacagcacgtaccacgacttcgacgatgacgaccctgaacccctggtggctgtgcctcacagaatccactcaacatccaggaatgtcagagaagagaagactcgatccgaaatcactttcggacaggtgaaattcgatccacctctcaggaaggaaacggagcctcaccacgagctgcccgatagtgatggcttccttgactcatctgaggagatttattacacagctcgatctaacctcgacttgcagttggaatatgggcagggacaccagggcggatacttcttaggggctaataagagcctgctcaaaagcgttgaggaagaactccatcaacgaggtcacgtggctcacctcgaagacgatgagggcgatgacgacgaatccaagcattctacacttaaggcgaaaatccctccacctctccccccaaaaccaaaatcaatcttcatcccccaggagatgcacagtaccgaggatgagaatcagggcaccataaagcggtgtcccatgagcggttctccagcgaagccgtctcaggtcccgccacgcccacccccacccagactgcctccacacaagccggtggccctgggcaacggaatgtcgagtttccaactcaatggggaacgggatggatctctctgtcagcaacagaacgagcaccggggtacaaatctgtcacgaaaagagaagaaagacgtcccaaagccaatctcgaatggtctccccccaacccccaaagtccatatgggggcttgtttcagtaaggtgttcaatgggtgccctctaaagatccattgcgcctcgtcatggataaatcccgacactcgagaccagtacctgatttttggcgcagaggaaggaatttacacactcaatcttaacgaactccacgagacttccatggaacagttatttcctagaagatgcacgtggctttacgtcatgaacaactgtctgctgagcatttctgggaaggcctcccaactgtactcccacaatctccccggtctgtttgactatgctagacagatgcagaagctgccagtagcaatccctgcccacaaattgccagaccgaattcttcccaggaagttttccgtctcagctaagatccccgaaacgaagtggtgtcagaagtgttgcgttgttcggaatccttatacaggccataagtatctgtgcggagcacttcaaacctccattgtcctgctggagtgggtggaaccaatgcaaaagttcatgttgattaagcatattgatttccccattccctgtcctctgcggatgtttgagatgttggtggtgcccgagcaagagtaccccctggtgtgtgtcggcgtcagcagaggtagggatttcaatcaggttgtcagatttgagaccgtgaatccaaactccactagctcatggtttacagaatccgacacacctcaaaccaatgtgactcacgttacacaattggagagagacaccatcctggtctgcttggactgttgcataaagatcgttaatttgcagggcagattaaagtctagtcgaaaactctccagcgaattgacatttgatttccagattgagtcgatcgtgtgcttgcaggatagtgtgttagccttttggaaacatggaatgcagggacggtcttttaggtcaaacgaggtgacacaggaaatctccgactccactcggatctttcgcctgctaggaagcgacagggtcgtggtcttagagagccggcctacagacaatccgactgccaactccaatctttacattctcgctgggcacgaaaattcatattag

SEQ ID NO: 57616 - DNA, 2622 bp, Artificial Sequence
  Description of Artificial Sequence: Synthetic coding sequence
atgaacccaggctttgacctgagtcgacggaatcctcaggaggactttgagctgatccagcggataggctccggtacctacggggacgtctacaaagcacggaatgtaaacacgggagaattggccgctatcaaagtcatcaagctcgagccgggagaggatttcgctgttgtacagcaagaaatcattatgatgaaagactgcaaacatcccaatattgtggcctactttggatcctacttgaggcgagacaagttatggatctgcatggagttttgcggcggaggctctttacaggacatctaccatgtcactggtcctctgagtgaactccaaattgcttacgtctcccgcgaaacccttcagggtctctattacctccacagtaagggaaaaatgcaccgggatattaagggggctaatatcctgctgaccgacaacgggcatgtcaagctcgcagactttggagtgagcgcccagattacagccactatcgccaaacgtaaaagtttcattgggacaccctattggatggctccggaagtcgccgcagtggaaaggaagggcggttataaccagctttgcgatctctgggctgtcggcatcacagctattgagctggctgaacttcagcctcccatgtttgacctccacccaatgagggccctgtttctcatgaccaaaagtaatttccagcccccaaaactcaaggacaagatgaagtggagtaactcgtttcaccattttgtgaaaatggctctgactaaaaatcctaagaaaagaccaaccgccgagaaattgttgcagcaccccttcgtgacacagcacctgacgagaagcctcgccatcgagctgctcgacaaagtgaacaacccagatcacagcacctaccatgacttcgatgatgatgacccagagcccctcgtcgcagtcccacatagaatccactccacgtctcggaatgtgcgtgaggagaagacacgctctgaaataacttttggacaggtaaagtttgatcccccactaagaaaagagactgaacctcatcacgaattggatctccagctggagtacggacagggccaccaaggaggatattttctgggcgcaaacaagtctctgctcaagagtgtggaagaagagttacatcagcgtggtcacgtcgcccacctagaagatgacgagggcgacgatgacgagtctaagcactccaccctgaaggctaaaatcccgcctcccttgcctcctaaacctaagtcaattttcattcctcaggagatgcactccaccgaagacgaaaatcagggcaccatcaaacggtgccccatgagcggaagccctgccaagcccagtcaagtgccacctagaccccctccacccagactccctccccataaacccgtggcactgggtaacggtatgagttctttccagctcaatggagagcgcgatggcagtctgtgccagcaacagaacgaacacaggggtaccaacctgtctagaaaagagaagaaggacgtgcccaagcccattagcaatggtctgcctcccaccccaaaggttcacatgggagcctgcttcagcaaagtcttcaacggatgtccccttaagatccactgcgccagttcatggattaacccagacacaagggaccaataccttatttttggagccgaagaaggaatttatactcttaacctaaacgaattacatgagacctcgatggaacagttgttccctcggaggtgcacctggctctatgtcatgaataattgcctgctttcaattagcgggaaggcttcgcagctgtacagccataatctgcccggactgtttgactatgcgcgtcagatgcagaagctcccagtggctatcccagcccacaagttgccggacagaattcttcctagaaaattctcggtgagtgctaagattccagaaacgaagtggtgtcaaaagtgctgtgttgtgcgaaacccctacacgggccacaagtatctgtgtggagccctgcagacatccatcgttcttctcgagtgggtggaaccaatgcaaaagtttatgttaattaaacacatcgatttccccataccctgtcctctccgcatgttcgaaatgctcgtggtacctgagcaggaatatcccctggtctgcgttggcgtatcccgtggtcgcgactttaaccaggttgtgcgcttcgagaccgtgaatcccaactcaacctcctcctggttcactgaatccgatacaccacagaccaacgtaacacatgttacacaattggagcgagacacgatcctggtctgcctggattgttgtattaagattgtcaatttacaaggtcggttaaagtccagtcgcaaactgagtagcgagctgacgttcgatttccaaatcgaaagcattgtctgtttgcaggatagcgtgctggcattctggaagcacggtatgcaaggcaggtctttcagatctaatgaggtaactcaagagatttccgatagcacaaggatcttccgactgttggggagcgatcgcgtagtcgtcctggagtcgcgtcctacagacaatccgaccgctaatagtaacctatacattcttgctggccacgagaattcttactag

SEQ ID NO: 57617 - DNA, 1344 bp, Artificial Sequence
  Description of Artificial Sequence: Synthetic coding sequence
atgcacagtaccgaagacgagaatcaggggaccataaaaaggtgccccatgtccggcagtcccgctaaaccatcacaagtacctcctcgtcccccaccacctcggctgcctccccataagcccgttgcgcttggaaacggcatgtcatccttccagctcaacggggagagggacggaagcctgtgccaacagcaaaatgagcaccgcggaactaacctgtctagaaaagaaaaaaaggacgtgcccaagcctataagtaatggactcccacccacaccgaaggtgcatatgggggcttgcttttctaaggtcttcaacggatgtcctttgaaaattcactgtgcttcctcttggattaaccccgatacccgagaccaatatttgatattcggggcagaggagggcatatatactcttaatcttaacgagttgcatgagacatctatggagcagctttttccgcgaaggtgcacctggctgtacgtgatgaataactgccttttgtccatcagcggtaaggcctcccagctctattctcacaatctgccaggcctgtttgattatgcacgtcagatgcagaagcttcccgtcgccattcccgctcacaagctgccggaccgaattttgccgcgaaaattcagtgtgagcgctaaaatccccgagacaaagtggtgccagaagtgttgtgtggtccggaatccttataccggacataagtacctgtgcggcgcactccagacttccatcgtcttgttagagtgggtggagcctatgcagaaatttatgctgattaagcatatcgactttccaatcccctgtcccctgcgcatgttcgaaatgctcgtcgtacctgagcaggaataccctttggtttgtgtgggcgtctcacgcggtagagactttaatcaggtggttcggttcgagactgtaaaccccaactcaactagttcgtggtttaccgaatccgacactcctcagacaaatgtgactcacgtgactcagctcgagagagacaccatcctagtgtgtctcgattgctgcataaaaatcgtgaacctccagggtagactcaagagctcgcgcaaactgagctccgagcttactttcgacttccagatcgagtctatcgtgtgtctgcaggacagtgtgctcgctttctggaagcatggcatgcagggtaggagctttcgatctaacgaagttacccaggaaattagcgactcaacccgtatctttcgcctgctgggcagcgacagggtggtggtcctagagagccgccctactgacaatccgacagctaactccaatctttacattctggccggtcacgagaattcatactag

SEQ ID NO: 57618 - DNA, 480 bp, Artificial Sequence
  Description of Artificial Sequence: Synthetic coding sequence
atgcagaagtttatgttgatcaagcacatagacttcccaattccatgccccctgcgcatgtttgaaatgcttgtggtgcccgagcaggagtatcctctcgtgtgtgttggcgtcagtaggggcagagattttaaccaggttgtcagatttgaaaccgtgaacccaaactccaccagtagctggtttactgaatcagatactccccagacaaacgtcacgcacgtgacccagctagaacgcgatacgattctggtctgcctggactgctgcatcaagatcgtaaacctacagggtagactgaaaagcagcagaaagctcagctccgagttaacttttgacttccagattgaatcgattgtgtgcctgcaggattcagtgctggccttttggaaacacgggatgcaggggaggtctttccgctccaatgaggttacccaggagatttcagacagtaaaaattttcaagctgcttggatctag

SEQ ID NO: 57619 - DNA, 1449 bp, Artificial Sequence
  Description of Artificial Sequence: Synthetic coding sequence
atgttcttcttagtgacgtctgacgagtcaaataaaacgtggggtaggaatactgtgttccgtcaggaggaatttgaagacgtgaaacggaacttcaaaaagaagggctgcacttggggaccgaactccatccagatgaaagaccggactgattgcaaagagaggatccggccactttcagatggaaactccccgtggtctactattctgattaaaaaccagaaaacaatgccactcgcgtcacttttcgtggaccaaccaggctcttgtgaagagcctaaactctcaccggacggcctggaacataggaagcctaaacaaattaagctgccgtctcaggcctacattgacttgcctctggggaaagacgcccagcgtgagaatcccgcagaggcagaaagctgggaagaggccgcatctgccaacgcggcaactgtatctatagagatgacaccaactaactcgttgtctagatctcctcagagaaaaaagaccgagtccgccctgtacggatgcactgtgctgctcgctagtgtggccctggggttagacctcagggagcttcacaaggcccaggccgcagaagagccccttccgaaagaggagaaaaagaagcgtgagggcattttccagcgcgcttccaaaagtcgaaggagtgcatctcccccaacgtcactgccctccacgtgcggcgaggcctccagtccacctagcctccctctctcctcagctcttgggatcttaagcacaccatcatttagtaccaagtgcttgctgcagatggacagcgaagaccccctggtcgatagtgcgcctgtgacatgtgattctgaaatgttgacccctgacttctgtccgacagccccagggagcggcagagagcctgccttgatgcccagactggacacagactgtagcgtctccaggaatctccccagctcttttctccagcagacctgcggaaacgtgccttactgtgcgagttctaagcataggccttcccaccacaggcgcacaatgtcagatggaaatcccacgcctactggagctacgatcatttcagcaactggagctagcgctttacccttgtgtccatccccagcccctcactcccatctgccaagggaagtcagcccgaaaaagcatagcacagtccatatagtgcctcaaagacggcctgcatccctcaggtctcgatcagatcttcctcaagcgtacccgcagaccgccgtctcccagctggcacagacagcgtgcgtcgtggggcgaccaggaccacacccaactcagttccttgccgctaaggaacgaaccaaatcacatgtcccaagtcttctggacgcggacgtcgagggccagtctagggattataccgtgccactgtgccggatgcgcagcaagacttcgcgccctagcatctatgaactggaaaaggagttcctgtcttag

SEQ ID NO: 57620 - DNA, 1713 bp, Artificial Sequence
  Description of Artificial Sequence: Synthetic coding sequence
atggctctcaggggagctgccggagctactgataccccagtctcctccgctggcggtgccccaggaggcagcgcgtctagctcttccaccagctctggcggttctgcctccgccggagccggtttgtgggctgcactttatgactacgaagcccgaggtgaagatgagttgagcctgcgcagaggtcagttggtcgaagtcctgtctcaggacgctgccgtcagtggtgatgaagggtggtgggccggacaagttcagaggaggttgggtatttttcccgctaattatgtggcgccatgccggcctgctgcttccccagctccgccaccaagtcggccttcctcacccgtgcatgtggctttcgagaggttggaactgaaggagctaattggcgctggcggattcggccaggtatatcgagcgacatggcaggggcaagaagtcgctgttaaggccgcacgccaggatcctgagcaggatgctgccgcagccgctgagagcgtgcggagggaggcacgcctcttcgccatgcttcggcaccctaacatcatagaacttcgcggtgtttgtctgcagcagccccacctgtgccttgtgcttgagtttgcccgaggaggagcgctgaatagagcacttgcggctgctaacgccgcacctgaccccagggcacccggaccacgaagggctcggaggatacctcctcatgtgctggttaattgggcagttcagatcgccaggggcatgctgtatctgcatgaagaggcttttgtgcccatcttgcaccgggatctgaagagctccaatatcctcctcctcgaaaagatcgaacatgacgatatctgtaataagaccctgaagattaccgattttggcctggcccgagagtggcatcggaccaccaaaatgagtacagccggtacctacgcctggatggctcccgaagtgattaagtcctctctcttcagcaagggctctgatatttggtcatacggagtcctgctctgggaactattgaccggtgaggtcccttatcgtggcattgacggcttggccgttgcttatggcgtcgctgtcaataagctgacactacctataccgagcacatgtccggagccatttgctaagctaatgaaagaatgttggcagcaggatccccacatccgcccaagttttgcgctgattctggagcagctgaccgccattgagggtgctgtgatgacagagatgccccaggaatcctttcactccatgcaagacgactggaagctggagatccaacagatgttcgatgagcttcgtacaaaggagaaagaactccgctcccgagaagaggaactgacccgagcggctctgcaacagaaaagccaagaggagttgctgaagcgcagagagcagcagctggctgagcgcgagattgacgtcctggagcgggagctaaacatcctaattttccagctgaaccaggagaagcccaaagttaaaaagaggaagggaaagtttaagcgttccaggctcaaactcaaggatggtcatagaatttctcttccatcagactttcagcataaaataaccgtgcaggctagcccgaatttagataaacggcgttcattaaatagtagttcttctagcccgccatccagtcccactatgatgcctcgccttagagccattcagtgtgaacttagcgctctgcccaggggcttgctgtgttag

SEQ ID NO: 57621 - DNA, 3111 bp, Artificial Sequence
  Description of Artificial Sequence: Synthetic coding sequence
atggcgttacggggagccgcaggtgctacggatacccccgtgagctcggccggaggcgctccaggaggatccgcctcaagctcttctacatcgtcaggtgggagcgcatcagccggagccggtctgtgggccgcactttatgactatgaggcgcgaggtgaggatgaactttccttgcggcgtggccagctggtggaggttctttcacaggacgcagccgttagtggggatgagggttggtgggccggacaggtgcaacgccgtttgggaatttttcctgccaactacgtggctccatgtaggccagccgcatctcccgctccacctccatctcgcccttcaagcccagtgcacgttgcctttgagcgtctcgagcttaaagagctcatcggtgccggtgggttcgggcaggtgtaccgagctacctggcaggggcaggaggtcgctgtgaaagccgctcggcaggatccagaacaagatgctgctgccgctgccgaatctgtgaggcgcgaagcccgactctttgccatgctccgccatcccaacattattgagttgcggggtgtatgcctgcagcagcctcatctgtgtctggtgctcgagttcgctcggggaggagccctgaacagagctctggcagcagctaacgccgcaccagaccccagggcccctggcccacgacgtgcacgcaggattcccccacatgtgcttgtaaactgggcagtgcagatcgcgagagggatgctgtatctccatgaagaagcttttgtgccaatcctccacagggacctgaaatcctccaacatcttactcctagaaaaaatcgagcacgatgatatctgcaataagacgttgaaaatcactgacttcggactggccagagagtggcataggacgacaaagatgagtactgctggcacgtatgcctggatggccccagaggtcatcaaatctagtttgttcagcaaagggtcggacatttggtcttacggagtcttgctgtgggagctcctgactggggaggttccttaccgagggatcgacggcttagctgtcgcttacggcgtagccgttaacaaacttactctgcctattccatccacctgccctgaaccgtttgctaagctgatgaaggagtgctggcagcaggaccctcatattaggccctcattcgccctcatacttgaacagctcaccgctattgagggggcagtaatgaccgagatgccgcaagagtcgttccactccatgcaagatgactggaagctggaaattcagcagatgttcgatgagttacggacgaaggaaaaggagctgcggagtcgagaggaagagctgacacgggctgctctgcagcagaagagtcaggaggagctgctcaaacggcgtgagcagcagctggccgagagggaaattgacgtgctggaacgggagctgaacatattgatcttccagctaaaccaggagaaacctaaagtgaagaaacggaaaggaaaattcaaaagatcaaggctgaaactcaaagacggacaccgaatatctctgcctagcgatttccagcataagattacagtccaggcaagtcctaacctcgataagcgacggagtctgaatagttcatcatcctctcccccatctagccccacgatgatgcccaggctgcgcgctatacagctgacatctgatgaatctaataagacttggggtcggaatacagtgttcagacaggaggagttcgaggacgtgaagaggaacttcaagaagaagggctgcacatggggtccaaatagcatacagatgaaagaccgcaccgattgtaaagaacggatccggccactgagtgacgggaacagtccttggtctacgattcttataaagaatcagaagacaatgcctctggccagtctattcgtggaccagcccggtagctgcgaggagccaaaattgtcacccgatggattagagcacaggaagcctaagcagattaaacttccgagccaggcttacattgatctccctctgggcaaggacgctcagcgtgaaaacccagctgaagctgaatcttgggaggaagcggcttctgccaacgcagccaccgtctcgattgaaatgactcctacaaacagtttatctagatcccctcagcgaaagaagaccgagagcgcactgtacggatgcacagttctgctcgcatccgtagcactcggacttgatctcagggagctgcacaaggcacaggccgctgaagaacctctgcctaaggaagagaagaagaagcgagaaggcatcttccagagagcctctaaatcaaggaggtccgcatccccacctacaagcctaccgtctacctgcggcgaagccagctctcctcccagcctgccattgtcaagtgcccttgggatcctcagtacacccagcttttccaccaaatgtctgctacagatggacagcgaagacccactggtcgattccgctccggtcacctgcgactcagagatgctcacgcccgatttttgtcccaccgcccctggatccggaagggaacccgctctcatgccaagactggacacagactgcagcgtttcaaggaaccttcctagttctttccttcaacagacctgtggcaatgtcccttattgtgcctctagtaagcatcgcccttctcaccaccgtagaaccatgtctgacggcaaccccaccccgactggagctactatcatctcagccacaggagctagcgccctcccgctttgcccctcaccagctcctcactcacatctgcctcgtgaagtgtctccaaagaagcactctactgtgcacattgtcccccagcgcagacctgccagtttgcgatctagatcagacctgccacaggcctacccacaaactgccgtttcacaacttgcccagaccgcctgtgtcgtgggacggcctggccctcatcctactcagttcctcgcggcaaaagagcgcaccaaatctcacgtgcctagcctgctggacgccgacgtggaagggcagagcagggattataccgtgcctctgtgtagaatgaggtccaagacaagccgcccttcgatttacgagctggaaaaggagttcctctcttag

SEQ ID NO: 57622 - DNA, 792 bp, Artificial Sequence
  Description of Artificial Sequence: Synthetic coding sequence
atggagaatctcaaacatataatcactttagggcaagtgattcacaagcgatgcgaggaaatgaagtattgcaaaaaacaatgtagacgcctgggccacagagtgctgggtctcatcaaaccactcgagatgctgcaggatcagggcaaaagaagcgttccaagcgagaaactcactactgcgatgaacaggttcaaggctgcactggaggaggctaacggggaaatcgaaaaattttctaaccggtctaatatctgccgcttcctcacggcttctcaggataagatcctcttcaaggacgtgaatcgaaaactgtccgacgtctggaaggagctttcactgctcctccaggtcgagcaacgtatgccagttagtcccattagccagggggcatcttgggcgcaggaggaccagcaggatgcggatgaggacaggcgggctttccagatgctcaggcgcgacaacgagaaaatcgaagccagtttacggcgactggaaattaacatgaaagaaattaaggagaccctaaggcagtcactcgagtccagttccggtaagagccccttggagataagtagattcaaagtaaagaacgtgaaaactggctccgcctccggctgcaacagcgagaaaatccgaaagctcgtggccgtgaagaggcaacaggaacctctcggcgaagactgcccctccgagctccgggaaataatcgatgagtgccgcgctcatgacccgtccgttaggccctccgtggatgagatcctgaaaaaattaagcactttcagtaaatag

SEQ ID NO: 57623 - DNA, 1416 bp, Artificial Sequence
  Description of Artificial Sequence: Synthetic coding sequence
atggagaatctgaagcatattattacacttgggcaggtcatccacaagcgatgtgaggagatgaagtactgtaagaaacagtgtaggaggcttgggcaccgtgtgttggggctcattaagccgctcgagatgcttcaggaccaaggtaaaagatcggtaccaagtgagaaactcacaaccgccatgaacagattcaaagctgcactcgaagaggctaatggagagatcgagaaatttagcaatagatctaacatctgtaggttcctgacagccagccaggataaaatcctttttaaggacgtcaatcgtaagttatctgatgtttggaaagagctgagtttacttctgcaggtggagcagcgcatgcccgtaagtccgatttctcagggggcttcctgggcgcaggaagatcagcaggacgccgacgaggatagacgggcatttcaaatgctgcggagagataatgagaagatcgaagcttctctgagaaggttggagatcaacatgaaagaaattaaggagaccttacggcaatatttacccccaaagtgtatgcaggagatcccccaggagcagattaaggaaattaaaaaggagcagctatcgggctctccatggatattgctcagagagaatgaggtgagcactctgtacaagggagagtatcacagggcaccagttgccataaaagtatttaaaaagctgcaggccggaagcattgctatcgtacgccagacctttaataaagaaataaaaaccatgaaaaagtttgaaagcccaaacatcctgcggatttttggcatctgcattgatgaaacagtcactcctccacagttttcaattgtgatggaatattgcgaactggggaccctgagggagctgctcgacagggagaaggatctgactctcgggaaaaggatggtgctggtgctcggggcagccaggggtttgtatagactccaccatagcgaggctccagaactgcacggcaaaatccgctcatctaactttctcgtcacccagggatatcaggtgaagctggctggtttcgagttacggaagacacagacctccatgagcctcgggacaactagagagaagacagatagggtgaagtctacggcatacttgtccccccaggaattagaagatgtattttatcaatatgatgtcaaatcagaaatatattccttcgggattgtgctgtgggagatagccaccggtgacataccctttcaaggctgtaactcagaaaaaattcgcaaactggtagctgtgaagcggcagcaggaaccgctgggcgaagattgtcccagcgaacttagggagatcatcgacgaatgtcgggcacacgaccctagtgttcgcccttcggttgacgaaattttgaaaaagctgtcaaccttctccaagtag

SEQ ID NO: 57624 - DNA, 651 bp, Artificial Sequence
  Description of Artificial Sequence: Synthetic coding sequence
atgagctttctgtttagctcacgttcttccaaaacatttaagccaaagaagaatattccggagggtagccaccaatacgaactgctgaaacatgctgaggctacactcggttcagggaacctcaggcaagctgtgatgttacctgagggcgaggatttaaacgagtggatcgccgtgaatacagtggatttttttaatcagattaacatgctgtacggaaccatcactgagttctgcacagaagcctcctgccccgtcatgtccgcagggccaaggtatgagtaccactgggctgatggcaccaacatcaagaaacccattaagtgtagtgcccctaagtacatagactatctgatgacttgggtccaggaccagcttgacgacgagaccctctttccaagtaaaattggcgtgccattccccaagaatttcatgtccgtggctaaaaccatcctgaagagactgtttcgggtttatgcccacatataccaccagcacttcgatagcgtgatgcagctccaggaagaagcgcacctcaataccagttttaagcactttatattttttgtccaggagttcaaccttatcgataggagggaactcgccccactccaagaactgattgaaaagttaggttcaaaggatagatag

SEQ ID NO: 57625 - DNA, 447 bp, Artificial Sequence
  Description of Artificial Sequence: Synthetic coding sequence
atgctgttttatctttctagccggtcttcgaagacatttaagccgaaaaagaatatccccgagggaagccatcagtatgagctactgaagcatgctgaggctaccttgggctctgggaatcttcgccaggcagttatgctgcccgagggcgaagatctcaatgagtggattgcagtcaatacagtcgacttctttaaccagattaacatgctctacggaacaattaccgagttctgcaccgaggcctcttgccccgtcatgtcggcagggccaagatatgagtatcattgggccgatggcactaacataaaaaaaccaatcaagtgctctgcacctaagtacatcgactatcttatgacatgggtgcaggaccagttggacgatgagactctgttccctagcaagattggagaactaaccctgtccaaatactcattttttttctag

SEQ ID NO: 57626 - DNA, 807 bp, Artificial Sequence
  Description of Artificial Sequence: Synthetic coding sequence
atgctgggcgatcattgtagccttccagaagaccaggcacggccaggacaaagcctgcaaagtggcttatgttgcaagatggtcctgcaggccgtgtcgaaagttttgagaaagagtaaggccaaaccaaacgggaagaagcctgcagctgaagagcggaaggcctatctcgaacccgaacacactaaagccagaattacggactttcaattcaaggagctggtagtcctcccacgcgagattgaccttaatgagtggctggcatcaaatactacaaccttctttcatcatattaatctgcagtactcgacaatctcagaattttgcactggagaaacgtgccagacaatggccgtgtgcaacacccagtattactggtatgacgaaaggggaaagaaagtgaaatgcactgctccccagtatgtcgacttcgttatgtcttcagtgcagaaactggtgactgatgaagatgtgtttccaactaagtacggtcgcgagtttccctccagctttgaaagcctggtgcgcaagatctgccggcacctgttccacgtcttggctcacatctattgggcccacttcaaggaaaccctggctctggagctccacgggcatttgaatactttgtatgtgcattttatactcttcgcacgcgagttcaacctattggaccctaaggaaacggcgataatggatgatctgaccgaggttctgtgctctggcgctggcggagttcactccggtgggagtggggacggtgccggaagtggtggacccggagcccagaaccacgtcaaggagagatag

SEQ ID NO: 57627 - DNA, 654 bp, Artificial Sequence
  Description of Artificial Sequence: Synthetic coding sequence
atgtccaatcccttcctgaagcaggtctttaacaaggataagaccttcagacccaaacgtaagtttgaacccggaacccagcgatttgagctacacaagaaggctcaagcctcactcaacgccggattggatctccgactggcggtgcagctcccaccgggtgaggacctgaacgattgggtggcagtccacgtcgtagatttcttcaaccgcgtcaacttgatctatggtaccatttcagatgggtgcaccgagcaaagttgcccggtgatgtccggcggaccaaaatacgagtaccggtggcaagacgaacacaagttccggaaacccaccgccctatcagcaccgaggtatatggatcttctaatggactggatcgaagcgcagatcaacaacgaagatctctttcccaccaatgtgggcacaccgttcccaaaaaacttcctccagactgtcagaaaaatcctctcccggctcttcagagtcttcgtgcacgtgtacatccaccattttgacagaattgcccagatggggagcgaggcccacgttaatacctgctacaagcatttttattattttgtgaaagaattcgggctaatcgatacaaaggagctggaaccgctgaaggagatgacagcgagaatgtgccactag

SEQ ID NO: 57628 - DNA, 651 bp, Artificial Sequence
  Description of Artificial Sequence: Synthetic coding sequence
atgtcaatcgcgctgaaacaggtcttcaacaaagataaaactttccgccctaagcgcaagttcgagcctggcacccagaggttcgagctgcacaagcgcgctcaagctagtcttaatagtggcgtagatctgaaggcggcagtgcaactgcccagtggggaggaccaaaatgactgggtcgctgtgcacgtagtagatttctttaataggatcaacctgatctatggcaccatctgcgaattctgcaccgaaagaacttgcccagtgatgtccggagggcctaaatatgagtaccggtggcaggacgatttgaagtacaagaagccgacagcactacctgcccctcaatacatgaatctgttgatggattggatcgaagtgcaaataaacaatgaggaaatctttccgacctgtgtaggcgtgccattcccgaagaacttcttacagatctgcaaaaaaattctttgcagactctttagagtgttcgttcatgtttacattcatcattttgatcgggtaattgtaatgggtgccgaagcccatgtaaatacttgctacaagcacttctactacttcgtcacagagatgaaccttatcgaccgaaaagagctggagcctctgaaggagatgactagtcggatgtgtcattag

SEQ ID NO: 57629 - DNA, 807 bp, Artificial Sequence
  Description of Artificial Sequence: Synthetic coding sequence
atgaaaaggcgcaatcttttcgcactggaaaccggcgttccaccatgggggctgctttgggtgcgctctagacgcgtcggaatggacgaaatgaccttccacatttggtacccacaggtgagagcccctgggcagcagcctcaggctcagttagcaatggctctgtgcctcaaacaggtgtttgctaaggataagacattcaggcctcgcaagagattcgaacccggaacccagcggtttgagctttacaaaaaggcccaagccagtctcaagagcgggctggacctgagaagcgtggtccgactgcctcctggagagaacatcgacgactggatcgccgtgcacgtcgtggactttttcaataggataaatcttatctatggcaccatggctgagcgttgctcagagacctcctgcccagtcatggcaggcggtcctcgctacgaataccgatggcaagacgaaaggcagtatcggagacccgctaagctgtctgctccaagatatatggccttgttaatggactggatagaggggctgataaatgacgaggaagtctttccaactagagtcggagtgccctttcctaagaattttcaacaggtctgtactaaaattctgacaaggttatttcgcgtgtttgtgcatgtctatattcaccacttcgacagcattctgtcaatgggggcagaagctcatgtcaatacatgctacaagcatttctattattttatccgagaattttccctggtcgaccagagggagctggagcccctgagggagatgactgaacggatctgccactag

SEQ ID NO: 57630 - DNA, 651 bp, Artificial Sequence
  Description of Artificial Sequence: Synthetic coding sequence
atggctttgtgtttgaagcaggtgttcgctaaggataagacatttcgacctagaaagcgattcgagcccggtacacagagattcgagctctacaagaaagctcaggcatcgctgaaatccggattggatttgcgtagtgtggtaaggctgccacctggggagaatatagacgactggattgctgtgcacgtagttgacttttttaaccggattaacttgatctacggaacaatggccgagcgatgtagtgagacctcgtgtcccgtcatggccggaggtccgaggtacgaatacagatggcaagacgagcgccagtatcggcgtccagccaagctatcggcccctaggtacatggctctcctgatggattggatcgaagggctcataaatgacgaggaggtttttccgacacgcgtaggcgttccgttccctaaaaactttcaacaggtgtgcacaaagattttgacccggcttttcagggtgttcgtacatgtgtacatccaccacttcgattccatcttatccatgggggctgaggcacacgtgaacacatgctacaaacacttttattactttattcgagaatttagtctggtggatcagagggaactggagccactgagagagatgacagaacgaatctgccactag

SEQ ID NO: 57631 - DNA, 720 bp, Artificial Sequence
  Description of Artificial Sequence: Synthetic coding sequence
atgcctctttccttagccggttaccctcaggttcgggcacccggacagcagcctcaagctcaactcgccatggctctgtgcttgaagcaagtgttcgccaaggacaagactttccgccctagaaaaagatttgagcccggtacacagcgttttgagctttacaaaaaggcccaagcctctcttaaatctggcctcgacctcagatccgttgtcaggctgcccccaggcgaaaatatcgacgactggatagctgtgcatgtcgtcgatttctttaataggattaatctgatatatggcacgatggctgaacgctgttctgagacatcatgccccgtcatggcagggggaccacgatatgaatacaggtggcaggacgaaaggcaataccgtcggcctgcaaaattgtccgcccctcggtatatggccctactgatggactggatcgagggcctgatcaacgatgaagaagtgtttccgacaagagtcggcgtgccgttccccaagaatttccagcaggtatgtacaaaaatcttgacccgcctttttagggtgttcgtccacgtatacatccatcacttcgactctatcctctccatgggtgccgaagcacatgttaacacctgttacaagcacttctattactttatccgggaattctctttggtggaccagagagagctggagcctttgagggagatgaccgaaaggatctgtcactag

SEQ ID NO: 57632 - DNA, 1959 bp, Artificial Sequence
  Description of Artificial Sequence: Synthetic coding sequence
atgcacccaggaggcggaccttccagagcagaacgtttggagctgggcctgggtcgcgaacgccctgccaaggcgattttcctgcacagacggccaggcgaaggtggcggaagagaacgttgtctccgatgtgggcacgtatgtgtgagacgcggacctggaccgagagaggccgtaccttcagggaggcctcggccagacacactgacccccccttgggtccgccaaagggccgtcaccggaacattttgtgcatcatggactccgctaagaaataggagggctcaacgcatggcgacagacatgcaacggaaaaggagtagcgagtgccttgatggcactctgaccccatcagatgggcagagcatggagagggccgaatcccccaccccaggaatggcacaagggatggaacctggcgcaggccaagagggcgctatgttcgtgcatgcaaggagctacgaagacctgaccgaatcagaggatggagctgcaagtggagattcgcacaaggaaggaacccgtggacctcctcccttgccaacagatatgaggcagatcagccaagacttttccgagttgagcacccagctcactggcgtcgcaagagatctacaggaggaaatgctcccagggagttctgaagactggctcgaaccccctggtgctgttggacgtccagccactgaaccaccgcgagaaggcactacagaaggggacgaagaggacgcaaccgaggcgtggaggctgcatcaaaaacatgttttcgttctttctgaagctgggaaaccagtttactcccggtacgggtctgaagaggctttgagctcaacaatgggagtcatggtggcccttgtcagctttctggaagccgataaaaacgccatccgtagcatacacgctgacggctataaggtggtcttcgtgaggaggtcaccactcgtgctggtcgccgtagcacggactaggcagagcgcacaggagctagcgcaagaactcctgtatatatattatcagatcttgtcgctcctgaccggcgcacaacttagccacatcttccagcaaaaacagaactatgatctgagaagactgctgagcggcagcgaacggattaccgacaacctgctgcagctcatggcaagagacccctcctttctaatgggcgcagcaagatgtctaccactagcggctgccgtaagggataccgtctccgcttctctgcagcaggctagagcgaggagcttggtattcagtatcctattggcgcgaaatcagttagtggccctcgtgcggaggaaagatcagttcttgcaccctatcgacctccacctgcttttcaacttgatctcctcttctagctccttccgcgaaggggaagcttggacacccgtttgcttacccaaatttaatgccgcaggtttcttccatgctcacataagctatctcgagccagacacagacctgtgtcttcttctcgtgagtaccgatagagaggatttctttgccgttagtgattgcagacgtcgattccaagaaaggctgaggaagcggggagcacacctggccctccgagaagccttgcggacaccttactacagcgtggcccaggtcggcatccccgacctgaggcactttttgtataaaagcaagtcatccggtctttttactagtccagagatcgaagccccatacacttctgaggaggagcaggagaggctcctcgggttataccagtacctgcatagtagagcacacaacgcgtctcgacccttaaagacaatttattacacagggccaaatgagaacttgctggcatgggtgactggggcattcgagctgtacatgtgctactccccccttggcacaaaagcgagtgccgtgtccgctattcataagctcatgcgctggattcgaaaagaagaggatcgattgtttatcctgactcccctgacttactag

SEQ ID NO: 57633 - DNA, 1473 bp, Artificial Sequence
  Description of Artificial Sequence: Synthetic coding sequence
atgcacccgggtgggggtccatcacgcgctgaacggctggagctcggactcgggagagagaggcccgcaaaggccatatttctgcataggcggccaggagaaggcggaggtcgagaaaggtgcctccggtgcggtcatgtgtgcgtcaggagaggccctggacctagggaggccgtacctagcggtcgtccccgtcctgatacccttacccccccatgggtgcgtcagcgagcagtcaccgggacgttctgcgccagctggacccccctgaggaacaggcgggcacagaggatggcaactgatatgcagagaaagaggtcatctgagtgtctagatgggactctgaccccctctgacggccaatccatggaacgggctgaatctcctactcccggtatggctcaggggatggagcccgacggctataaggtggtctttgttagaagatcccccctggtccttgtcgctgtcgccagaacacgacaatccgcacaagagcttgctcaagagctcctgtatatatattatcaaattctctccctgttaacaggagcccagctgagccacatttttcagcaaaaacagaattacgacttgaggaggctgttatcagggagcgaaagaatcacagataacctgctacagctgatggctcgggatccctcattcttaatgggtgccgcacgctgtctgcccttggctgccgctgtccgcgacacagtttcagcctctctgcaacaggccagagctagaagcttagtttttagcattctgctggcacgtaatcaattagtggcactagtgcgcaggaaagatcagtttctgcaccctatcgatctccacctcctgttcaatctcatcagctccagcagctcgtttcgagagggagaggcctggacacccgtttgtttgccaaaatttaatgcagccggattctttcacgcccatatcagctacctcgaacctgataccgacctgtgtctgctcttagtttctaccgacagagaagacttctttgccgtttccgattgtcggcgacgtttccaggagagacttcggaagcggggtgctcacttagctctcagagaggctctgcggactccctactactctgtggcccaggtcgggatcccggacttacgtcactttttatacaagtctaagagcagcggactgttcacaagtccagagatcgaggcaccctacacaagcgaggaggagcaagagcgactgctcggcctctatcaatacctgcacagtcgcgctcacaacgcttctcgcccactgaagacaatttactacacaggtccgaacgagaacttgctggcgtgggtaactggggcttttgagctttacatgtgttacagccccctggggactaaggcgtctgccgtgtccgccatccataagctgatgcggtggattaggaaagaagaagaccgtctgttcatactgacgccactcacatactag

SEQ ID NO: 57634 - DNA, 2043 bp, Artificial Sequence
  Description of Artificial Sequence: Synthetic coding sequence
atgggttgtggtaccaaggagccaaaaattacgcagctttgcctcgctgcgattcaaagactcatgtcacacgaagtggtgtcagagactgccgctgggaatattatcaatatgctgtggcaactgatggaaaattcattggaggaactcaagttgttacaaacagtgctggtgctgcttaccaccaacactgttgtgcacgacgaggcacttagtaaggccatagtgctttgtttccggctgcatttcacaaaagacaacataacaaataacactgccgctgcgaccgtccgccaagtggtgaccgtcgtgttcgaacgcatggttgctgaagacgaaaggcacagggatattatagagcaacctgtccttgtgcaggggaattccaataggaggtcagtcagcactctgaagccttgtgcaaaggacgcgtacatgctgtttcaggatctttgtcagttggtgaatgcagacgcaccctactggttggtggggatgaccgaaatgactaggacattcggactcgagctcctcgagagcgttctgaatgacttccctcaggtttttcttcagcaccaggaatttagcttcctgctgaaggagcgggtctgcccattagtgattaagttattttcaccgaacatcaagttcagacagggcagctctacctcgtcctccccagctccagtggagaaaccctattttccaatatgcatgagattgttacgcgtggtcagcgtgctcataaaacagttctattctttgttggtgaccgagtgtgagatatttttgagcctgctagtgaaatttctcgacgccgacaaaccgcagtggttgagggctgttgccgtcgaatccatacaccggttctgtgtccagcctcagctactgcggagcttttgtcagtcctatgacatgaagcagcattctaccaaggtatttcgggatatcgtgaacgcgctcgggtcctttatacagtcactctttttggtgccccctacaggcaaccccgcaacaagcaaccaagcgggaaacaataatctgggtgggagcgtcagtgcaccggcaaacagcggcatggtcggaatcggaggcggagttaccttacttcctgcttttgaatacagaggtacctggatccctattctgacgataacagttcaaggatccgcaaaagctacttatctcgagatgctggataaagtagagcctcctactattcccgaaggctacgccatgagcgtcgcctttcactgtctactggacctggtgcgtggtattaccagcatgatcgagggtgagttaggagaactcgagaccgagtgtcaaaccacaaccgaggaggggtccagccctacccagtccactgagcaacaggacctgcagagtacttcagaccagatggacaaagagattgttagcagagccgtgtgggaagagatggtgaacgcttgctggtgtggacttctggcagccctgtctctcctgctggacgcctcaacggacgaagcagccacggagaatattctcaaagcagagctcaccatggctgcgctgtgcgggagactggggctggtgacctcccgggatgctttcattactgcgatctgcaaggggagcctaccacctcattatgccctcacagttctaaacactactaccgcggctacattgtccaataagtcctactccgtgcagggccagagcgtgatgatgattagtccctcttcagagtcgcaccagcaagtcgtcgccgttgggcagcctctcgccgttcagcctcagggcacagttatgcttacaagtaagaacattcagtgcatgcgcaccctgctgaatttggcccattgtcacggggctgtgctcggcactagctggcagctcgtgttggccaccctccaacacctggtttggattctcggtctcaagccttcatctggaggtgccctgaagccaggaagagccgtagaaggtccctcgacagtgccattcaaggacttcatgcagccgcctgcttctagagtgcagaatggagaaagctag

SEQ ID NO: 57635 - DNA, 5031 bp, Artificial Sequence
  Description of Artificial Sequence: Synthetic coding sequence
atgagcggcacttctagcccggaagcagtgaagaagttgctggagaacatgcagtccgaccttagagctttgtcattagagtgtaaaaaaaagttcccgccagtgaaagaggctgccgaaagcggcatcatcaaagtgaagaccattgcagcacgaaatacagaaatactggccgcacttaaagagaatagttctgaggtggtacagccctttctgatgggctgcggtacaaaggaaccaaagataacacagctgtgtctggccgctatccagcggctgatgtctcacgaagtggtgtctgagacagcagctggaaatatcatcaatatgttatggcagcttatggagaactctctggaagagctaaagctcctgcagacagtgctagtgctgcttactacaaacaccgtggtccatgacgaagccctaagcaaggccatcgtcctgtgcttccgactccacttcacaaaggacaatattaccaataatacggccgctgctactgtgcgtcaggttgttaccgtggtctttgaacgtatggtggctgaagatgaaaggcatagggacattatagagcagcctgtgctggttcaggggaacagcaaccggagatccgtgagcactttgaagccttgtgccaaagacgcgtatatgctattccaggacctatgccagctggtgaatgctgacgccccatattggctggtcggtatgactgaaatgacccgcactttcggcctcgaacttttagaaagcgttctgaacgattttcctcaggtgttcctccagcatcaggagtttagttttttgctgaaggaacgggtctgccccctcgtgataaaactgttctctcccaacatcaagttcagacagggaagttctacctcctcctcgccagctcccgtggagaagccctactttcctatctgcatgagattgctgcgggttgtatctgttcttattaagcagttttactctcttctggtcacggaatgcgaaatttttctgagtctccttgttaagttcttggacgctgataagccgcagtggctgcgcgcagtcgcagtggaatctatccataggttctgtgtccagccccagcttctgcgctccttttgtcagtcctacgatatgaaacagcattccaccaaggtattcagggatatcgtcaacgcacttggaagcttcatccagagcctgttcctggtcccacccaccggcaatcccgcaacctctaaccaggctggaaataacaacctcggtggaagcgtgtccgcaccagcaaactccggcatggtggggatcggcggtggcgtcactttactccctgcctttgagtacagaggtacttggatccctatcctgaccattactgtgcagggatcagcgaaggctacatacctcgagatgctcgataaggttgagcccccaacaattccagagggatacgccatgtccgtggctttccattgcctgctcgacttggttagggggattacatccatgatcgaaggagagcttggcgaactggagactgagtgtcaaaccacaaccgaggagggatctagcccaacccaaagcacggaacagcaagacctgcagtcaacttcagaccagatggacaaagaaattgtctctcgtgctgtatgggaggaaatggtgaatgcttgttggtgtggtcttcttgctgctctgagcctcctgctcgatgcctccacagatgaggccgctacagagaacatcttaaaggccgaactgacgatggccgctctgtgcgggaggctcggcctggtgacctcgcgcgacgcatttatcaccgccatatgtaaagggtctcttcctccccattatgccctcacggtattgaataccactacagctgccacattatcaaataagagctattcggtgcagggccagtccgtcatgatgattagcccgagcagcgaatcccatcagcaggtcgtggctgttgggcagccacttgccgtccagccacagggtacagtcatgttgaccagcaagaacattcagtgtatgcggacactgctcaatttggctcactgccacggggcagtcctaggaaccagctggcagttggtgctggccacacttcagcatcttgtctggattttaggtctcaagccttctagcggcggtgccctaaagcctgggagagccgtggagggtccgtcaacagtactcaccactgccgttatgacagatcttcctgtgattagcaatatcctgagccggctcttcgaatcaagccagtaccttgatgacgtgagtttgcaccacctcattaatgcgttatgttccctgagtttggaggccatggacatggcttacggcaataataaggagcccagcctatttgcagtggccaagctgctcgaaaccggcctggtcaatatgcatcggattgagatcctctggaggccccttaccggacatctgttggaaaaggtgtgtcagcaccctaattcccgaatgcgcgagtggggcgctgaggcactaacttccctcattaaagcgggactgacattcaaccacgaccccccactctctcaaaatcagaggctgcagctgctgctgctcaatcctctcaaggagatgagtaacataaatcatcccgacatccgcttaaagcagctcgaatgcgtgctccagattctccagtcgcagggggactccctgggacccggatggccgctggtgctcggtgtcatgggtgccatacggaatgaccagggagagtcacttataaggactgccttccagtgcctgcagctcgtggtcactgacttcctgccaaccatgccctgtacatgtttacaaatcgttgttgacgtagctggctcattcggcctgcataaccaagaactcaatattagcttgactagcatcggattattatggaatatcagtgactacttctttcaaagaggggagacaattgagaaggagcttaataaggaagaagccgcacagcagaaacaggcagaagaaaagggcgtggtgctcaatcgaccctttcaccctgccccaccctttgattgcctatggctctgtctatatgcaaaattaggcgaactctgtgtggaccccagacccgctgttcgaaagtcggcaggacagacactgttttcgaccatcggggctcacggaacgctgctgcagcacagcacatggcatactgtgatttggaaggtgctctttcatcttcttgacagggtccgggagtcttctactactgccgacaaagagaagatcgagagcggaggcggtaatatcctgattcaccacagccgagatacagctgaaaagcaatgggcagagacttgggtgctaactctggccggagtcgccagaattttcaatacaaggcgctatcttctgcagcccttgggggatttttcacgggcttgggatgtgctactagaccatattcagtcagctgccttgtccaaaaataatgaggtaagcctggcggcattgaaaagtttccaagagattctgcaaatcgtgagtcccgtgagagactccgacaagcccgagacaccacctgttgtgaacgtgccagtacctgtgctcattggacccatatcggggatgagccgcccatttgtgcgtacagattctatcggtgagaagcttggcaggtacagctcaagcgaaccacctatcgtgaccgatgagctagaggatctgaacctctggtgggcggcatggaacacctggtatagaatcggttcagagagcacgaagccgcctatcacctttgacaagctgactttcatccccagccaaccatttctgaccgccttaattcagatttttccagctctgtatcagcatatcaaaaccggattcaacatggacgatctccaaaagctgggtgtgatccttcatagcgcgattagtgtaccaatctcatccgatgcatctcccttcattttaccgtcttatacagaagccgttctgacatcactccaggaggcagtgctgaccgcccttgacgtccttcagaaggccatatgcgtggggcctgaaaacatgcagatcatgtatcctgctatttttgatcagttactcgctttcgtggagttctcttgtaagcctccacagtacgggcaactggagaccaagcatattgcgaacgccaagtataatcaaattcagctgtttgctccagcggaatgggttgccctgaattacgtgccatttgctgagcggtcacttgaggtcgttgtagatctgtatcagaagacagcctgtcacaaagccgtggttaatgagaaagtcctgcagaatataatcaagactctcagagtgccactgtccctaaagtatagctgtccctcagagtctacctggaagctggctgtgagttcactgctacgagtgctatccatcggcttacccgtcgcgagacaacacgcttccagcgggaagttcgactccatgtggccagaattggccaataccttcgaagacttcctctttacaaagtcaatccctccagacaatctgtcaattcaggagttccagcggaacgagaatatcgacgttgaggtcgtgcagttaatctccaatgaaatcctcccatatgctaactttattcctaaagagttcgttggccagatcatgacaatgctgaataagggctcaattcatagccaatcaagtagcttcacagaggcagagatcgacatcaggctgagagaggagttttcaaagatgtgcttcgaaaccttgctccaattttccttttctaataaggtgactactcctcaagaggggtatatatctaggatggcgcttagtgtcctgctaaaaagatcgcaggacgtgctccaccgttatatcgaggacgagagactgtctggcaaatgtcccttgccacgccagcaggtgaccgaaattatttttgttctcaaagccgtgagcaccctgatagactcactcaagaagacacagcctgaaaatgcgtgtatctccctgtttggaattccaccttatttctag

SEQ ID NO: 57636 - DNA, 5153 bp, Artificial Sequence
  Description of Artificial Sequence: Synthetic coding sequence
atgtcaggaacctccagccccgaagccgtgaaaaagctgttggagaacatgcagtcagatctgcgtgccctctcattagagtgcaagaaaaagtttccaccagtgaaagaagccgcagaatcagggattattaaagttaagaccatcgctgctcgaaatactgagattctggctgccctcaaagaaaacagctctgaagtcgttcaacccttcctaatgggttgcggcactaaggagcccaaaattacccagctgtgtcttgcagccattcagcgcctgatgagtcacgaggtagtgtccgaaacagccgctgggaatattattaatatgctgtggcaactaatggagaactcactggaagagttaaaactgttacagacagtgctagtccttttgactaccaacaccgtcgttcacgatgaggccctcagtaaggccatagtattgtgctttcggctccacttcaccaaggacaatattactaataatacagcagcagccacagttcgtcaagtcgtgaccgtggttttcgaacgaatggtcgctgaggatgaacggcaccgggacataattgagcagcccgtgcttgtccaggggaattctaaccggcgatctgtttctaccctgaagccttgtgccaaagatgcctatatgctcttccaggacctgtgccagctggtgaacgctgacgccccatattggctggtgggcatgacagaaatgacacgaacatttgggctggaactgcttgaatcggtgctaaacgacttccctcaagtgttcttacagcaccaagagttctcatttcttctcaaggaacgcgtgtgtccgttggtaattaaactgttcagtccaaacatcaagttccgtcagggtagctctaccagcagcagccccgcacctgtggagaaaccttatttcccgatatgtatgaggttgcttcgcgtagtgtctgtcctcatcaaacaattttatagtcttctggttacagagtgcgagattttcctctccctgctggtgaagtttctcgatgccgacaaacctcaatggctgcgggctgtggctgttgaaagcattcaccggttctgcgtgcagcctcaattactgcgatcgttctgccaatcctatgacatgaaacagcacagtaccaaggtctttcgcgacattgtcaacgccctcggatcatttatccagtcccttttcctggtacctcccactgggaacccagctaccagcaaccaggccggtaacaacaatcttggcggatccgtgagcgcacccgctaatagcggaatggtggggattgggggtggcgttactttgcttcccgctttcgagtaccggggaacatggatccctatcctgaccataaccgtacagggcagtgccaaggctacttatctggaaatgctggataaagtggagcccccaacaattcccgaagggtatgccatgtccgttgcttttcattgccttctggacctggttcgtggcattacctctatgatagaaggggaactgggcgaactggaaacagagtgtcagaccactaccgaagagggatcctcaccgacacagtccacagaacaacaggaccttcagagcacatccgatcagatggacaaagaaattgtgagcagagccgtgtgggaagagatggtcaatgcttgctggtgcgggttgctagccgctttgtccctgttattggatgccagcacggacgaagcagctacagaaaatattttaaaggccgagctgacgatggcggctctttgtggacggttgggcctggtgacttccagagatgccttcatcaccgctatttgtaagggctccctgccaccacattacgctcttaccgtcctcaatacaaccacagctgcgactttatccaacaaaagttattctgtgcagggacaaagcgttatgatgatcagtccatcgagcgagtcccaccagcaagtggtggccgtcggacagcctcttgccgtccagccccagggcactgtgatgctgacgtccaaaaatattcagtgcatgcgaactttgcttaacttggcacactgccacggagctgtgctggggactagctggcagctcgtcctggcaacgctacagcatctggtgtggatactgggattaaaaccatcgtccgggggagctctcaaacctggtagagcagtcgagggtccctcgactgtgcttacaacggcggtgatgactgaccttccggttatatctaacatactgagccgcctgtttgagtctagccaatacctggatgacgtgtccctgcatcatcttatcaatgccctctgttctctctccctcgaagccatggatatggcgtacggcaataataaggagccctctctcttcgcggttgcgaaactcttggagacaggcctggtgaacatgcatcgtatagagattctgtggagacctcttactgggcatctcctggaggtctgtcagcacccgaattccagaatgcgcgagtggggagccgaagctctgacatctctgatcaaggcgggattgacttttaatcacgatccaccattgagtcaaaaccagcgcctgcagctgctgctgctcaaccctctaaaggagatgtccaacatcaaccaccctgatattcggctcaaacaactggagtgtgtcttacagatcttacaatcccaaggggatagcctgggtcctgggtggccattggtgctgggcgtgatgggcgctatccgaaacgaccagggggaaagtctcatcagaactgccttccagtgcctgcagctggtggtgactgactttctcccaaccatgccctgtacctgtctgcagatagttgtggacgtggccggtagcttcggattacacaaccaagaactgaacatcagcctgacttctattgggctgctgtggaatatcagcgactacttcttccagaggggagaaacaattgagaaggaactgaataaggaggaggccgctcagcagaaacaggccgaggagaaaggcgtcgtgttgaataggccgttccatcctgcccctccgttcgactgtctgtggctctgcctatatgccaaactcggagaactgtgtgtggaccctcgtcctgcggtgcgtaagtccgcaggtcagacactattctcgacgatcggcgcacacggcacactgctgcagcattcgacgtggcacactgtgatttggaaagttctgttccaccttctggacagagtgcgagagagtagcacaacagccgacaaggaaaagatcgagtccgggggagggaacatccttatccatcattctcgggataccgcagaaaagcagtgggccgaaacctgggtgctcactctagcaggcgtcgcaagaatctttaatacccgccgttacctcctccaacctctcggagactttagccgggcttgggacgtgctcctcgatcacattcagtccgccgctttaagtaaaaataatgaggtcagtctcgccgcattgaagtccttccaggaaatcctacagattgtgagtccagtacgggattcggacaagcccgagacccctcccgtggtgaacgtccccgtgcccgtattgattgggcctatttctggcatgagtcgaccgttcgtgcggactgactctattggcgaaaaattggggagatacagtagctcagagcctcctattgtgaccgacgagctggaagatctgaacctctggtgggccgcttggaatacttggtatagaatcgggagcgagagcacaaagcccccaattacgtttgataagttgaccttcatcccatcccagccattcctgacggcacttatacagattttcccggcactttaccagcatatcaaaaccggattcaacatggacgaccttcagaagttaggcgtgatcctgcatagcgctatcagtgtgcctatcagcagtgatgccagcccctttattctgccatcatatacagaagcagtgcttactagcttgcaggaggcggtgttaactgctcttgacgtgctgcagaaagcaatatgtgtcggtccagagaatatgcaaattatgtaccccgcaatcttcgatcagttgctagccttcgttgaattctcctgcaaaccccctcaatatggacaactggaaaccaaacacattgctaacgcaaaatataaccagatccaattgtttgctccagcagaatgggtcgctctgaattacgtgccgtttgctgagaggtctttagaggttgttgtggacctataccaaaagacagcctgtcacaaagctgtcgttaacgaaaaagtgctccagaatatcattaaaacccttcgagttccattgtctttaaagtattcctgccccagtgagtcgacttggaaactggccgtgtcttcactgttgcgtgttctcagcatcggcctgcctgtcgcccgacagcatgctagctcagggaaattcgatagtatgtggcccgaattggctaacacctttgaggacttcttattcacgaagtcaattcctccagataacctgtccattcaggagttccagcgaaacgaaaacatcgacgtggaggttgtgcagctcatctcaaatgagatcttgccttacgccaactttatacccaaggaatttgttggccaaattatgacaatgctcaacaagggtagtatccactctcaatcctcatccttcactgaagctgagatcgacattcggcttagagaggagttctctaaaatgtgtttcgagacactgctgcaattctctttctctaataaggttactacacctcaggagggctacatctcaagaatggctctatccgtgctgctgaaacggtcacaggacgttttacacagatacatcgaggatgaacgcctctcaggcaaatgtccactgcctaggcagcaggttacggaaatcatcttcgtgcttaaagcagtctctaccctgattgattctctgaagaaaacacagcccgagaatgtggacgggaacacatgggcccaggtaattgctctgtaccctaccctggtcgaatgtatcacttgctcttcctctgaggtgtgctccgcattaaaggaggccctggttcctttcaaagatttcatgcaacccccagcctctcgggtccagaacggcgagagcta

SEQ ID NO: 57637 - DNA, 5027 bp, Artificial Sequence
  Description of Artificial Sequence: Synthetic coding sequence
atgtcaggcacctcgtcgccggaggctgtcaaaaagttactggagaacatgcagagcgacttacgagccctgtccctcgagtgtaagaagaagtttccccctgtcaaggaggcagctgagagcggtatcattaaggttaaaactattgccgctaggaacacagaaatccttgccgctctgaaagagaactcatcagaggtagtccagccatttctgatgggctgcggcactaaggaacctaagattactcagttgtgtctcgccgcaatccagaggttgatgagccatgaggtagtttcagaaacggccgcaggaaacattattaacatgctctggcagctgatggagaactccctcgaggagctaaaattattacaaaccgtgctggttcttcttacaaccaatacagtggtccatgatgaggctctcagcaaggccattgtcctgtgttttcggcttcacttcaccaaggataatatcacgaacaacactgctgccgctaccgtgcgtcaggtcgtgaccgtggtgtttgagcgtatggtcgccgaggatgaaagacaccgcgacataattgagcagccagtgcttgtacagggtaattctaatcgcagatccgtgagtaccttgaagccttgcgctaaagacgcctacatgcttttccaagatctgtgtcagctggtgaacgccgatgcgccttactggctggtgggcatgaccgagatgactcgcaccttcggactggagttgctcgagtcagtactcaatgatttcccgcaggtttttctgcagcaccaagagttttcctttctcctgaaggagagggtgtgccccctggtgattaaattattctcacctaatatcaaatttcgccagggcagctccactagctccagcccagcacctgtggaaaaaccctactttccaatttgcatgaggctgctgcgggtcgtatccgtgctgatcaagcagttctactctctcctggtcaccgagtgcgaaatttttctgagcctgctagtgaaattcttagatgctgacaagccgcaatggctgagggctgtggctgtggagagcattcatagattctgcgtgcagccgcagcttcttcgtagcttttgtcagtcttacgatatgaagcagcacagtactaaggtttttcgggacatcgtcaacgcccttggatctttcattcagtccctctttcttgtcccccctaccggcaatcctgccacctcgaaccaggctggcaacaacaatctgggcggaagcgtgtcagcaccagcgaacagtgggatggtcggtattggtggaggagtgaccctgctgccggcttttgaatacagggggacttggatccccatactgactatcactgtgcagggatccgctaaagctacctatctcgagatgcttgacaaagtggagcccccaaccattccagagggttacgctatgagcgtagccttccactgtttactagacctcgtccgtggtatcacgagcatgattgagggagagctgggtgagttggagactgagtgtcagacaacaacagaggagggatcctctcccacccagagcacggagcagcaggacttacaatctactagcgatcagatggacaaagaaattgtgtctcgagcggtgtgggaggagatggtaaacgcctgttggtgtggcctgttagccgctctgtctctcctgctagacgcctctaccgacgaagccgcaacagagaacatactgaaagctgaactgacgatggcagccttgtgcggcaggctgggtttagtcactagccgggacgcatttatcaccgctatctgtaagggctctctgcccccacactacgctttaacggtcctaaacactacgacagccgctactctctccaataaaagctacagcgtgcaggggcagtcagtgatgatgatctcaccctcctctgagagtcatcaacaggtggtcgctgtagggcagcctctggcagtccagcctcagggcactgtgatgctgacttctaagaacattcagtgcatgcgcactctattgaatctggctcattgccacggggctgtgctgggcacctcatggcaactggtcctagctacactgcagcacctggtgtggatactcggcttgaaacctagcagtggcggagccttgaaacctggtagagctgtcgaaggaccaagcactgtcctgacaacagctgttatgacagacctgccagttatctctaatatattgtccagactcttcgaaagttctcagtatcttgacgacgtgtctctgcatcatcttatcaatgccctctgcagcctctcattggaggcgatggacatggcctatggtaataacaaggagccatctctcttcgccgtagcaaaactactggagacgggcctggtcaatatgcacagaatagaaattctgtggcgccctctaacaggacatctactggaggtgtgtcagcacccgaacagcaggatgagagaatggggcgcagaggctctgacaagtcttattaaggccggacttaccttcaatcatgaccctcccctgtctcagaatcagaggctccagcttctgttactcaatccccttaaggaaatgtctaatattaaccaccccgacatcagactcaagcagttagaatgcgtgctccagatactccagagccagggtgacagcctcgggccaggctggcctctggtcctgggagtcatgggggcaattcggaatgatcagggtgagtccctgattagaaccgcctttcaatgcctgcaattggtggtgacagattttctacctaccatgccctgtacatgcctgcaaatagtagtagacgttgcaggctccttcgggctgcacaaccaggaattgaacatatcacttaccagcatcggacttctctggaacatttcagactacttttttcagagaggagagacgattgagaaagagctaaacaaggaagaagccgctcagcaaaaacaggctgaagagaaaggcgtggttttgaatcggccatttcacccggctcccccattcgactgcctgtggctgtgcctgtacgcaaagctcggtgaattgtgcgtggaccctcgtccagctgtcagaaagtctgcaggtcagacactcttcagcactatcggagctcacggaaccctgttgcagcacagcacttggcacaccgtaatatggaaagttcttttccatctgctagatcgcgtgagggaatccagtactactgccgataaagagaagattgagtccggaggcggtaacatattgatccatcatagtcgggacaccgctgagaaacagtgggccgagacttgggtcctgactctggcaggcgtcgctaggatcttcaataccagaaggtatctcctgcaacctctaggcgatttttctagggcatgggatgtactgctggatcacattcagtctgctgccttgtcaaaaaataatgaggttagtttagctgctctgaagtctttccaagagattttgcagattgtctcacctgtgcgggactccgacaaacccgagacacctcctgtggtcaacgtccctgtgcccgtcctgatcgggccaataagcggcatgtcacggcctttcgtgcgcactgactcaatcggggagaaacttggcaggtactcctcctcagaaccccctattgtgaccgatgagctggaagatctaaatctgtggtgggccgcttggaatacttggtaccggatcggctccgagtcaacaaagcccccaattacgtttgacaaactgaccttcattccaagccagccattcctgacggcacttatccagatattccctgccctgtatcagcatatcaagaccggcttcaatatggatgaccttcagaaactgggagtcattctgcatagcgccatttctgtgcccatcagtagtgacgcgtcccctttcattctgccctcctacaccgaggcagtccttacctcgcttcaagaggctgtgctcacagccctagacgttctgcaaaaagcaatttgcgtcggccctgaaaacatgcaaataatgtaccccgcaatcttcgaccagctcctcgccttcgtggaattttcttgcaagccccctcaatacggacagctggaaactaagcacatagctaatgccaagtataaccaaattcagctgtttgcgccagctgagtgggtggctctcaattacgttccgtttgccgaaaggagtcttgaggtcgtggtggatctgtatcagaagacagcctgccataaggctgttgtcaatgagaaggttctccagaatatcatcaaaactctgagggttcctctaagtctgaagtactcgtgcccatccgaatctacttggaagctcgctgtctccagcctgctgagagttttgtctatcgggctcccggtagccaggcaacacgcgtcttccggaaagtttgactccatgtggccagagctggcaaacacatttgaagactttctgtttacaaaaagcatccctcccgacaatttaagcatacaggagttccagagaaacgagaatattgacgtggaggtcgttcagctcatctcgaatgaaatcctaccatacgctaactttattcctaaggaatttgtggggcaaatcatgacgatgctgaataaaggctccattcatagtcaatcatccagcttcacagaggccgagatcgacatccgccttcgggaggaattctctaagatgtgcttcgagactctcctccagttttcgttttccaacaaggtcaccacaccacaagaaggttatatatctagaatggcactctctgtactcctcaaacgaagccaggatgttttgcaccgatacatcgaagatgaacgcctgtccgggaagtgcccattgcctagacaacaagtcactgagattattttcgttttgaaagcagtctctacactaatcgacagcctcaaaaagactcagcccgaaaatgcgtgcatatcccttttcggaatccccccatatttcta

SEQ ID NO: 57638 - DNA, 2703 bp, Artificial Sequence
  Description of Artificial Sequence: Synthetic coding sequence
atgctcctctacagaggcgctcctgcgggtccgggtgcacccggatgcggccttgcaagaccgggaggtggcccacaagcctttgggattcgactgagtaccatgagtccacgttacctacagagcaacagctccagtcacacacggccattcagtgctatagctgaacttctcgacaatgcagtcgatccagacgttagcgcgcgaactgtatttattgacgtggaggaagtaaagaataagtcgtgcttaacatttaccgatgacggatgcggaatgactcctcacaaactacacagaatgttgtcatttggcttcaccgacaaggtcataaaaaagtctcaatgtcctataggcgtattcggcaatggctttaaaagcggaagtatgcggctcggaaaggatgcccttgtgtttaccaagaatggtggaacgctgacggtgggactactatctcagacttaccttgaatgcgtgcaggcccaagctgtgattgtcccaatcgtcccgttcaaccaacagaataagaagatgattattaccgaagacagtttgccttccctggaggcaatactgaattactcaatttttaaccgggagaacgatctgctggctcagtttgatgccatcccaggaaagaagggtactagggtgttaatctggaacatccgaagaaataaaaacggaaagagtgaattagactttgacacagaccagtatgatatcttggtgagcgacttcgacaccgaagagaaaatgacaggaggagtgacttccgaactgccagagactgagtacagcctccgcgctttttgtgggatactgtatatgaagcctagaatgaaaatattcctgagacagaaaaaagtcactacccaaatgattgctaaaagtctagcaaacgtggagtacgatacctacaagccaactttcacgaataagcaagtgaggatcaccttcgggttcagttgtaaaaactccaatcagtttggtattatgatgtaccacaataacagactgatcaagtcttttgagaaagttgggtgtcaggtcaagccaactcggggagagggagtcggagtaataggggtgatagaatgcaacttcttgaaacctgcttacaacaaacaagattttgagtacacgaaagaatatcgattaacgattaacgcccttgctcagaaactgaatgcatattggaaagaaaaaaccagccaggacaattttgaaacaagtacagtcgctagaccgatcccaaaagtacctgaccagacatgggtgcagtgcgatgagtgtttgaagtggcggaagctgccagggaaaattgatccaagcatgcttcccgctcgctggttttgctactacaacagccacccaaagtacaggagatgttctgtgcctgaggaacaagaactgactgacgaagacttgtgtcttagtaaagccaagaaacaggagcaaacagtggaggagaaaaaaaaaatgcccatggaaaacgagaaccaccaggttttcagtaaccccccaaagattttgacagtgcaggagatggccggactcaacaacaagaccatcgggtatgaggggattcattctccttccgtgttaccttccggaggtgaggaatcgcggtcccccagcctgcagctcaagcctctcgatagcagcgttttgcagttctccagtaagtataaatggatcctcggtgaagagcctgtcgagaagagaaggagactccaaaacgagatgaccacccccagtcttgactactcaatgccggcaccatataggagggtggaggctcccgtggcatatcctgagggggagaatagccacgacaagagtagtagtgaacgtagcacccctccgtacctcttcccggaatacccagaggcctcgaagaacacagggcaaaatcgggaagtgagtatactataccctggagccaaggatcagagacagggttccttgctcccggaagaacttgaagaccagatgccgagactggtcgccgaagagagcaaccggggatctaccacaatcaacaaagaagaggtgaataaaggcccatttgtggcagtcgtgggggttgcaaaaggcgtcagagactccggtgcccctattcaactgattccatttaatcgagaagagctcgccgagcgtcgaaaggctgtggagagttggaatcccgtgccttatagtgtggccagcgctgctatcccagcagcagcaataggcgaaaaggcgcgtggatacgaggaaagcgaggggcacaatacacctaagctgaagaaccaaagggagttagaggagctgaaaagaaccacagagaaactcgagagggttctggctgagcgaaacttatttcagcagaaggtggaggaactggaacaggagcggaaccattggcagtccgagtttaaaaaggtacagcatgagttggtgatttatagcactcaggaggcggaaggcctttattggtccaagaaacatatggggtacaggcaagcagaattccaaatactcaaggctgaacttgaacggacgaaagaggagaaacaggaactgaaagagaaacttaaagaaactgagacccatctcgagatgttacagaaggctcaaggtttcgggaaggcctacgccgcaacttaccccagacagctcagcccctacttttgtccccctagtcttggcgcatcttag

SEQ ID NO: 57639 - DNA, 2814 bp, Artificial Sequence
  Description of Artificial Sequence: Synthetic coding sequence
atgctgctctaccgcggagcacctgccggacccggtgccccaggttgcggattggccaggccgggagggggaccccaagccttcgggatacgtctctctacgatgtcccctagatatctccagtccaactcatcctctcatactagacccttcagtgctatcgcagaactcttggacaatgccgttgaccctgatgtaagcgccaggactgtcttcattgatgtggaagaggtgaagaacaagtcctgcttaacatttactgatgatggttgtggaatgactccccataagctccacagaatgctcagcttcgggtttacagataaggtcataaaaaaatcacagtgccccattggggtcttcggtaacggcttcaagtctgggtctatgcgcctggggaaggacgccctggtgtttacgaagaacgggggtaccctgactgtggggctcctctcccagacttacctcgagtgtgtgcaggcacaggctgtgatagtccctatagtgccattcaaccagcaaaataagaaaatgatcatcaccgaggattctctcccttcactggaagcgatcctgaactattcaattttcaatagggagaacgacctgctggcccagtttgacgcaatacctgggaagaagggaactcgagtgctgatctggaatatccggcgtaacaagaatggcaaatccgaactggacttcgataccgatcagtacgacatcttggtgtccgactttgacacagaagagaaaatgactggcggtgtaacttcggaattgccggaaaccgagtattctctcagggccttttgcgggatactgtacatgaaacccagaatgaaaatctttctgcgccagaaaaaggtcacgacccaaatgatcgccaaaagcctcgccaacgtggagtacgatacctacaagcccaccttcactaacaaacaagtcaggattacgttcggcttttcatgcaagaattctaatcagttcggaataatgatgtaccacaataaccggctcattaagtcctttgaaaaggtaggatgccaggtcaagcctacccgtggtgaaggagtcggagtgataggggtcattgagtgcaacttcctgaagccagcatacaacaagcaggacttcgagtataccaaagagtaccgacttacaattaatgcgctggcccagaagttaaatgcgtattggaaggagaagacctctcaggataactttgaaacttcaacagtcgctagaccgatccccaaggtccccgaccagacctgggtgcaatgtgacgagtgcttgaaatggagaaaactgcccggaaagatagacccctcaatgctccctgcccgttggttctgttattacaactctcaccctaaataccggagatgtagcgtccctgaggaacaagagttaacagacgaggacctgtgtctcagcaaggccaagaaacaggagcaaactgtggaggagaaaaagaagatgcccatggagaacgagaaccaccaggtattttcaaatcctcccaaaatcttgacggtgcaggaaatggccggtctgaacaataagaccatcggctacgaaggaatccattcccccagtgtgctgccgtctggaggagaggagtctcgatctccttcactgcagctgaagcctctcgacagtagcgtcctgcaattttctagcaagtataaatggatactgggggaggagcccgttgaaaaaaggcgtaggcttcagaacgagatgacaacgcctagtctggattactcaatgcctgcgccataccgtcgggttgaggctcctgtggcgtatcccgaaggcgagaactcccatgacaagtcttcgtcggagaggtctactccaccatatctgttccccgagtatcccgaagcttccaaaaacactgggcagaacagggaggtgagcatcctttatccaggtgctaaggatcaaaggcaggggagtcttcttcctgaagagctggaagaccagatgccaaggctggtcgccgaggagtcaaacaggggttctacaaccatcaacaaggaggaggtgaacaagggaccctttgtggctgtggtcggggttgccaagggcgtgcgtgacagtggagcacctattcagctgattcccttcaacagagaagaactagccgagcgaaggaaagccgtagagagttggaatcccgtcccatatagtgttgcttcagccgcaattcccgcagccgcaatcggagagaaagcaagagggtacgaagaatcagagggacataatacaccaaaattaaagaaccagcgggagttggaagagcttaaaaggacaaccgagaaattagaacgagttctcgcagaacgaaatctgttccaacagaaggtggaggaactggagcaagagcggaaccattggcagtcagagtttaagaaggtgcagcacgagttggtgatttactctactcaggaggctgaggggttgtactggagcaagaaacacatggggtacagacaggcggagttccagatcctgaaagccgagctggagagaacgaaagaggaaaagcaggaactcaaagaaaagctgaaagagacagagacacatctcgagatgctgcaaaaggcacaagtgtcctacagaacccccgaaggcgatgatcttgaacgggctctggccaaacttacgcggctccgcatacatgtcagttaccttcttacttcggtgctgccgcaccttgagcttagggagatcggttatgactctgagcaggtcgatgggatactttacaccgtgcttgaggcaaaccacatacttgactag

SEQ ID NO: 57640 - DNA, 1947 bp, Artificial Sequence
  Description of Artificial Sequence: Synthetic coding sequence
atgaccggaggggtgacttctgagttgccagaaaccgagtactctctccgcgctttttgtggaatcctctacatgaaaccgaggatgaagatctttttgcgccaaaagaaggtcactacccagatgatcgccaagagtctcgcgaacgtggaatacgacacttacaagcccaccttcaccaacaagcaggtgcgaattaccttcggattcagctgcaagaattcaaatcagttcggaatcatgatgtaccacaataaccggctcatcaagagcttcgaaaaagtggggtgtcaggtgaagccaacaaggggcgagggggtcggtgtgatcggcgtgattgaatgtaactttctaaagcccgcttacaacaagcaggactttgagtacacaaaagagtatcgcttgacaattaatgcattggctcagaagctcaacgcatattggaaagaaaaaaccagccaagataattttgagacttccacagtggccagacctatcccaaaggtgccggatcagacgtgggttcaatgcgacgagtgcctaaaatggaggaagctgccgggaaagatcgaccccagtatgctgccagccagatggttctgctactataattcgcaccctaagtaccgcagatgctctgttccggaggaacaagagctcaccgacgaggatctgtgtctttcaaaggccaagaagcaggagcagacggtggaggagaagaagaaaatgcctatggagaacgaaaatcaccaggtgttctccaatcccccaaaaattctcacagtgcaggaaatggccggtctcaataataagactatcggctatgaaggaatccattcaccatccgttctgccgtccggaggagaagaatcaaggtcccctagtctacagctaaagcctctcgattcgtctgtgctccaattttcctccaaatacaagtggattcttggtgaggagccagtcgagaaaaggcgaagactccagaatgaaatgacaacaccaagtttggactattctatgcctgccccttacagacgcgttgaagcgcctgttgcctatcccgagggagaaaacagccatgataaaagtagcagtgagcgatccaccccaccttacttattcccagagtacccagaagccagcaaaaatacaggccagaaccgagaggtgtctatactgtatcccggtgccaaagatcaacgacaggggagtttactgcccgaagagcttgaggatcagatgcccaggctcgttgctgaggagagcaataggggtagcacgactattaataaagaggaggtgaacaaaggaccatttgtagctgtggtcggcgttgcaaagggagttcgcgatagtggcgcaccgatccagctgataccattcaacagagaagaactggccgaacgacgaaaagcagttgagtcatggaaccccgtgccatactctgtggctagcgccgctatcccagccgctgccattggtgagaaggcaagaggctacgaggagtcagagggccataatacaccaaagctcaagaaccagagagagctagaagaactcaaacggaccacagagaagctcgaacgggtcctcgccgaacggaatctgttccaacaaaaagtagaggagctggaacaggagcgcaaccactggcaatccgaattcaaaaaagtgcagcacgagttggtcatctattcaacacaagaggcagagggcttatactggtcaaagaaacacatgggatatcggcaggccgagttccagattctcaaggccgaattggagcgtaccaaggaggaaaagcaggaattgaaggagaagctcaaagagactgaaacccatttagaaatgctccagaaagcgcagggctttggcaaggcgtacgccgctacctatccacggcagctcagtccatacttctgccctccaagcctgggggcatcatag

SEQ ID NO: 57641 - DNA, 384 bp, Artificial Sequence
  Description of Artificial Sequence: Synthetic coding sequence
atgaggcctctggatatagatgaggtcgaggctccagaagaggttgaagttctggaacctgaagaagactttgagcagttcctacttcccgtcattaatgagatgcgagaggacatcgccagtctcatacgcgagcatggcagggcctatctgagaacgaggtccaagctgtgggagatggacaatatgctcatccaaatcaaaactcaggtggaggcaagtgaggagtccgcactcaaccacgtacagcatccctctggggaagccgatgaacgcgtatccgaactctgcgaaaaagcagaagaaaaagccaaggaaatcgctaaaatggcggaaatgttggtagagctagtttggagaatcgaacggtctgaatccagctag

SEQ ID NO: 57642 - DNA, 471 bp, Artificial Sequence
  Description of Artificial Sequence: Synthetic coding sequence
atggccgctgctggtgaaggcacacccagtagccgcggaccacgcagagacccacctcgcaggcccccaagaaatggtcatggtaagttgctgtttaaagacggcagctactatgaaggggcattcgtggatggggaaatcactggagaaggtaggaggcattgggcgtggtctggcgacaccttctccggtcaatttgtgctcggtgaaccacagggatacggggtgatggagtacaaagcaggcggttgttacgagggagaggtcagccatggtatgcgggagggacatggctttctggttgaccgcgatggtcaggtctatcaaggctctttccacgataacaagcggcacggtccaggccagatgttgtttcaaaacggggacaagtatgatggcgattgggtcagagatcggaggcaggggcacggcgtcctccgttgcgcagatggatccacttacaagctctag

SEQ ID NO: 57643 - DNA, 1053 bp, Artificial Sequence
  Description of Artificial Sequence: Synthetic coding sequence
atggccgctgccggagagggtacgcctagcagcagaggcccaaggcgtgatccccctagaaggcctccaaggaatggctatggcgtttatgtgtatccaaattcattttttagatacgagggcgaatggaaggccggtcggaagcatggacatggtaaactcctgttcaaagatgggtcctactacgaaggggctttcgttgatggcgaaattacgggagagggcaggcggcattgggcctggagcggcgacactttcagtggccaattcgtgctgggagagcctcagggatacggggtgatggagtacaaagccggagggtgttatgaaggggaagtcagccatgggatgcgagaggggcatggttttctggtggatagagacggacaggtgtatcaaggcagctttcacgataataaacgacacggcccaggccaaatgctgttccagaacggggacaagtacgacggtgattgggtgcgagatcgcaggcaggggcatggagttctccgttgcgcagatgggagcacttacaaaggtcagtggcacagcgacgtattctctggcctgggttccatggcgcactgctccggcgtgacatactatggcttgtggatcaacggccatcccgcagaacaggcaacccgtattgtgattctcggacccgaggtgatggaggtcgctcaggggagccccttctctgtcaacgtgcagctcctgcaggaccacggggagatagccaaatctgaaagcggtcgggtgctccagatatccgccggtgttcgatacgtgcagctgtccgcctattctgaggttaacttcttcaaggtggacagagataaccaggagactctaattcagactccattcggctttgagtgcataccctatcccgtgtcaagtcctgccgctggagttcccggtcctcgggctgctaagggaggcgctgaagctgatgtgccccttcccaggggggatctcgaactgcatttgggcgctctccacggccaagaggacacccccggtggccttctcggcagttccctgttctag

SEQ ID NO: 57644 - DNA, 1494 bp, Artificial Sequence
  Description of Artificial Sequence: Synthetic coding sequence
atggctgcagcaggggaaggtaccccgagttcaaggggccctaggcgggatcctcccaggagaccacctaggaacggatatggagtttacgtgtaccccaattcattcttcagatacgagggggagtggaaggcgggacggaaacatggtcatgggaagctattgtttaaggatggtagctattatgagggagcgtttgtggacggtgagatcacaggtgaaggcaggcgtcactgggcctggtctggcgacacgttcagtgggcagtttgttctaggcgagcctcagggctacggcgtaatggaatataaggccggaggatgttacgagggggaggtttcacatggtatgagagaaggccacggctttttagtagatcgcgacggccaggtctaccaggggagttttcatgataacaaacggcacggtcccggtcagatgctttttcagaatggagataagtacgacggagactgggtacgggacaggagacagggacatggggtactgcggtgcgcagacgggtctacatataaaggacagtggcactcagatgtcttttcaggtctgggctcaatggcccactgttcaggcgtgacctactacggtctgtggatcaacgggcaccctgctgaacaagctacccgaatagtgatcctggggcctgaggtgatggaggtggctcagggctccccttttagcgtgaacgtgcagctgttgcaggaccacggggagatcgcaaaaagtgagtccggaagagtcctgcaaatcagcgcaggcgtgcgttacgtccaactgtcagcctattccgaggtgaatttttttaaggttgacagggataatcaggagacattgatccagactccatttggctttgaatgcataccttacccagtttcatctcctgccgctggcgtccctggtcccagggctgccaaaggaggcgctgaagcagacgtacctctgccaaggggcgacctggagctgcacctcggagcactgcatggccaggaagacacgccaggaggtttactagcgcgaggacacgcaccccactgccccggagcttgccagagggttgagcaaggctgcgcagaatttactgatgtcctgctgggcccaccgcctccagggtatcacccatttttgttcttggatagcctgcataagaaggcaggtgggcgtagcagggggggattgcaccccaggggcactcctcccaccgcccaagagcctccgggaggaagtcgccctgaaggacgggctaccgaggaacaggccgcagcagcacacctcggtgaatatgtactgatgatacgggatgttactacaccccctttcctgggcagacgacttccccctgcctttaagcatctgcgtgttgtggccaaacgcgctggccagcccccacatgttctcgaggagggccctgaagcctctagtagttggcaggccgctcattcttgcaccccggagccccctgctccacggtag

SEQ ID NO: 57645 - DNA, 456 bp, Artificial Sequence
  Description of Artificial Sequence: Synthetic coding sequence
actgcgacaactcggctcccgctgctgcgcgtggatagcgtgcgcgtgtctcccaggaatggagacaagtatgatggggactgggtgagagaccgccgtcagggccacggagtactgcggtgtgctgatgggtctacctacaagggtcaatggcacagcgacgtgttcagtggcctgggatctatggctcactgcagcggcgtaacctattacgggctgtggatcaacggacaccccgctgagcaggctacccgcatcgtaattttaggaccagaggtcatggaagttgcccagggcagccctttttcagtgaatgtccaactgttgcaggaccacggggaaatcgcaaagaacggggtatccctgctgttgtcccggctggaatgctctggcgctatgagtgcgctgaggaatttgagattacccaggagtagcgactccgctttggcatcttag

SEQ ID NO: 57646 - DNA, 558 bp, Artificial Sequence
  Description of Artificial Sequence: Synthetic coding sequence
gtaacaggtagctgctaccttaaaatggccgtgataacaaaaggtcgcctgtggacagagaggtccagagaaaaggctgccggtacggggcctggccaagagacaccatctctcgacagcctgttctgggaatcgctcaaagctacagcaagctggagcaccaaaccagccgacgttatgaaagggagaagtcccactgcctgtggcaaggatactggcttttggtggaccggaatggataaatgcacacgggctccatcaatgacaacacgtggcaccgcattgggaaggtgcagctttcggactgtgacttcgacaaccgcgacgggctccgggaccggcgtccgcgatactggatgttgcgccgcaccaaccgcccctccgactagctctgatcctcccatttactctcggcgaaacagcagacgccaccggttgcttccaaggcatcacgaactgcgggtgggggaggcacctcccggagatctattctcactaagtactgcaggcgtgttctccgccaaccgggtaagctgtcttgccgcatcaataccctag

SEQ ID NO: 57647 - DNA, 240 bp, Artificial Sequence
  Description of Artificial Sequence: Synthetic coding sequence
atgaatggcttcggtagactcgagcatttctctggagccgtatacgaaggccagtttaaggataatatgtttcatgggctcgggacgtacactttccctaatggcgctaagtacacaggcaacttcaatgagaaccgtgtggagggtgaaggagaatatacagatatccagggactagagtggtctggtaactttcacttcacggcggcacccgatctgaagctgaaactgcatatgtag

SEQ ID NO: 57648 - DNA, 240 bp, Artificial Sequence
  Description of Artificial Sequence: Synthetic coding sequence
atgaatggtttcggcaggcttgagcatttctccggcgcagtctatgaaggacaattcaaggacaacatgttccacggtctgggaacgtataccttccccaacggggctaagtacacagggaattttaacgaaaacagagtggagggggaaggggagtatactgatatccaaggactggaatggtcgggcaacttccatttcaccgccgcaccagatcttaaattaaaactacatatgtag

SEQ ID NO: 57649 - DNA, 240 bp, Artificial Sequence
  Description of Artificial Sequence: Synthetic coding sequence
atgaatggcttcggaagactggagcatttttcgggagcagtctacgaaggccagtttaaggataatatgtttcacggcctgggaacatacacgtttcccaacggcgcaaaatataccggaaatttcaacgagaatcgggtagagggggagggcgagtacacagacatccagggcctcgagtggagtggtaacttccacttcaccgcagccccagatcttaagttgaagctacacatgtag

SEQ ID NO: 57650 - DNA, 723 bp, Artificial Sequence
  Description of Artificial Sequence: Synthetic coding sequence
atgccggtgagtaaatgtccaaagaagtcagaaagcctgtggaaaggatgggacaggaaagcccaacgcaacggactgcgcagtcaggtctacgctgtaaatggcgattactatgtgggagaatggaaggacaatgttaaacacggcaagggcacgcaggtctggaagaagaagggggctatatacgagggggattggaaattcggtaagagagacggctatggtactctttccttgcctgaccagcagaccggtaaatgccgaagggtgtattctggatggtggaagggcgataagaagtccgggtacggcatccagttcttcggtcccaaagagtactacgagggggattggtgtgggagccagcggagtggatgggggagaatgtactatagcaatggtgatatctacgagggccagtgggagaacgacaaacccaacggcgagggcatgttgagactcaaaaacggaaatcgatatgaaggatgctgggagcgtggaatgaagaacggcgctggccgattttttcacctcgatcatggtcagctgtttgaggggttctgggtagacaatatggctaaatgtgggaccatgatagactttgggcgtgatgaggcccctgaaccgactcaatttccaatccctgaggttaagatcctcgaccctgacggcgtgctggcagaagcactcgcaatgtttcgcaaaaccgaggaaggagactag

SEQ ID NO: 57651 - DNA, 441 bp, Artificial Sequence
  Description of Artificial Sequence: Synthetic coding sequence
atgacactgacaaaagggtcctttacctacagcagcggagaggaatataggggggagtggaaggaaggcaggagacatgggttcggtcagttgatgtttgctgacggaggcacctatcttggccactttgaaaatggactttttaacgggtttggtgtcctgacgttttcggacgggagtcgatatgagggcgagttcgctcagggcaagttcaacggtgtcggggtttttatccgatacgataatatgacctttgagggtgagttcaagaacggaagagtagatggatttggcctgctgacttttccagatggtagtcacggtatccccaggaatgaggggctgtttgaaaacaacaaactgctccgtcgcgagaaatgctctgcaattgtacaacgggctcagtctgcttcgaagagcgccagaaacctcacagcttag

SEQ ID NO: 57652 - DNA, 615 bp, Artificial Sequence
  Description of Artificial Sequence: Synthetic coding sequence
atggcctggtcacgagccggtcctatgaggtccggggttgcacctggatgccttggaaattcccagtgggcagcaggcatcgtcccatccgccgtggcacaagacgggggagtgaagtggggaaaccgctggtggagatggagaagagccagatggcaacccggagcccaccaaagaaagagcccacgtaggtggaaccctgcatcacggagagacggccatccggagcgtccggcacccggaaggcggcacggttttggacaattgatgtttgcagatggcggaacatacctcgggcacttcgaaaacgggttattcaatgggttcggcgtgctgacgtttagtgacggcagtagatacgagggcgaatttgctcagggtaagttcaacggggtgggcgtgttcattaggtatgataatatgacctttgaaggcgaattcaagaacggcagggtggacgggttcggtctgttaacattccccgacggaagccacggaataccacgcaatgaaggcctgtttgaaaataataaactgctccgcagggaaaaatgtagtgccattgtgcagagggcgcagtccgctagcaagtccgctaggaacctgaccgcttag

SEQ ID NO: 57653 - DNA, 441 bp, Artificial Sequence
  Description of Artificial Sequence: Synthetic coding sequence
atgacactgacgaaaggctccttcacatattcttctggggaagagtaccgcggagaatggaaggaaggcaggcggcacgggttcggccagttaatgttcgctgacggtggcacgtatctaggacactttgaaaacggtcttttcaatggctttggcgtgctgacattttctgatgggtcgcgctatgaaggggagtttgcccaggggaaatttaatggggtcggcgttttcatacgctatgacaatatgacattcgaaggggagtttaagaatgggcgtgtggatggtttcggactgcttacttttcccgacggatcccacggcatcccacggaatgagggcctatttgaaaataacaagcttctgcgccgtgaaaaatgcagcgcaatcgtgcagagagcccagtcggcctcaaaatccgcacggaatctcactgcgtag

SEQ ID NO: 57654 - DNA, 486 bp, Artificial Sequence
  Description of Artificial Sequence: Synthetic coding sequence
atggagtatacgggaagtaagtatatcggggagtacgtcgatggacggatggaagggaaagcaaaatatattctcccaacggaaaccatttacgtgggagaaatgaaggacggcatgttccatggagagggcaccctgtactttcccagcgggtcacagtacgatgccatatgggagaacgggctcgccataaagggtacatacacgttctctgacggcctacactacgatgagaagaattggcactattgtgacgggtacgaccgtagattctataccgaaatcctgaatggcttaaagcctgccggaatggctcagcttaccaacatggatccgccaaggaagatccccaaggggtattatgactgcggggatggattctataatcctgttactcgcgtggttaaagactatcgtaatcggttcctgaggaatgctgacgatgatgagcacgagtggattacacgcacctgtcgcaagggctag

SEQ ID NO: 57655 - DNA, 333 bp, Artificial Sequence
  Description of Artificial Sequence: Synthetic coding sequence
atggagggaaaggcaaagtacatccttcccactgagacaatttacgtgggcgaaatgaaggatggaatgtttcacggggaaggaacactatacttcccgtcgggctcccaatatgatgcgatctgggaaaatgggctcgccatcaaggggacctatacgttctctgacgggctgcactatgacgagaaaaattggcactactgtgatgggtacgatcgcagattctatacggagatactgaacggattgaagccggctggtatggctcagctgaccaatatggaccctccaagaaagattccgaaggggtattacgactgcggcgacgggtag

SEQ ID NO: 57656 - DNA, 528 bp, Artificial Sequence
  Description of Artificial Sequence: Synthetic coding sequence
atggagtataccggcagtaaatacatcggagagtatgtggacggccgtatggaggggaaggcgaagtatatccttccgaccgagaccatctacgtcggtgaaatgaaggatgggatgtttcacggcgagggcaccctgtacttcccatctggtagtcagtacgacgccatctgggagaatggtctggccatcaagggcacctacaccttttccgatggcttgcactatgacgaaaagaattggcattactgcgatggctacgaccggaggttttacacagagatcctcaacggactcaagcctgcgggaatggctcagttaacaaatatggacccacccaggaagatcccaaaaggatactacgactgcggagacgggttctataaccctgtgacccgggtggtcaaagactacaggaaccgttttctgaggaacgcaggaagatttctcccgaccctgcagcatgtgttttcatctcccacttacgagtatgttcacctttacgtgcagatgtatgcgcacacctag

SEQ ID NO: 57657 - DNA, 1416 bp, Artificial Sequence
  Description of Artificial Sequence: Synthetic coding sequence
atggctgcccctgaacctctaagcccggctggcggagcaggtgaggaggcgcctgaagaagacgaggatgaggcggaagccgaggacccagagcgccctaacgctggcgcagggggtggccgttctggtgggggtggcagtagtgtgtctgggggagggggaggaggtggtgccggagccggtggatgcggaggacccggaggagccttgactaggcgcgcagtgacactgcgggtgttgttgaaggacgccttgctcgaaccaggcgcaggcgtgttgagtatatattacctgggtaagaagttcctgggcgatcttcagcccgacggcaggatcatgtggcaggagaccgggcagacctttaactccccatctgcatgggctacacactgtaaaaagcttgttaaccccgcaaaaaaatcagggtgtggttgggcctctgtaaagtataagggccagaagctagataaatataaagcaacctggcttcggctccaccaactccacacaccagcaacagccgctgatgaaagccctgcatctgaaggcgaggaggaagagttgctgatggaggaagaggaggaagacgtacttgcaggcgtctctgcagaagacaaatctagacggccactgggcaaatcccccagcgaacccgcacaccctgaagcgacaaccccaggaaagcgggtggattccaaaatccgggtgcctgtccgatactgcatgttagggagccgtgaccttgctagaaacccccatacccttgtggaggtcacttccttcgctgccatcaataagtttcagccctttaacgtggccgtcagcagtaatgtgcttttcctgctggattttcacagtcaccttacacgcagcgaagtggtggggtacctgggcggacgatgggacgtgaattcccagatgctcacggtcctgcgcgcttttccttgtcggtcacggctgggggacgccgagacagcagcagcaatagaagaggaaatttatcaaagcttgtttctgcgtgggctctccctcgtcgggtggtatcattcacacccccactctcccgctctaccaagcctgcaggacatcgacgctcagatggattaccagctgagactgcaggggagttcaaacggctttcagccttgccttgccttactctgttcgccctactactccggcaacccgggacctgaatcaaagataagtcctttctgggttatgccccctccagaaatgctgctggtcgaattctacaaaggctcccctgatcttgtccggcttcaggaaccatggtcccaggagcacacctatctggacaagctcaaaatttccctggcctctaggacgcctaaagatcaaagcttgtgtcatgttttggaacaggtatgcggtgtgttaaagcaggggtcctag

SEQ ID NO: 57658 - DNA, 1356 bp, Artificial Sequence
  Description of Artificial Sequence: Synthetic coding sequence
atggcagcaccagaacctctgtcacctgcaggcggtgcaggcgaagaggcccctgaggaggacgaagacgaggccgaggccgaagacccggaaagacccaacgctggcgcaggcggaggtcggagcgggggaggcggatcaagtgtttccggaggtggcggaggaggaggagcaggtgccggagggtgcggtggcccaggaggcgcacttacccgccgagcagtgactctcagggtgcttttaaaggatgcattgttagagcccggtgccggtgttctctcaatttattatcttggtaagaaatttctgggggatcttcaaccggacggaagaatcatgtggcaggagactgggcagacatttaactcaccttccgcctgggccacccattgcaaaaaactggtcaaccccgcaaaaaaatcgggatgtggctgggccagcgtaaagtataagggacaaaagcttgacaaatataaagcgacttggttgaggctgcaccaactgcatactccggcaactgcggctgacgagtcacccgcatcggagggagaggaagaggagcttctcatggaagaagaggaagaggacgtgctggccggtgtttccgctgaagacaaatctcgtcgaccattgggcaaatcaccatctgagcccgctcaccccgaagctactactcctggcaagcgtgtcgactctaaaatccgtgtaccagtgcgctactgtatgctggggtctcgagacttggctcggaatccgcacacactggtcgaagtgacgtccttcgcagcgattaacaagttccagcccttcaatgtggccgtgtcaagcaatgtgctgttccttctgatctaccagagcctgttcctgcggggactgagtctggtcggttggtaccattcacatccccacagcccagccctccctagcttgcaggacatagatgcccagatggactaccagttgaggttgcagggctcctcgaatgggttccagccctgtttagccctcctgtgttccccatactattccgggaatcctgggcctgaatccaagattagccccttctgggtgatgccgcctccggagcagaggccctccgattatggaatccccatggatgtggagatggcgtatgtgcaggattcatttctgactaatgacatcctgcacgaaatgatgttgctcgtggagttttataaagggtctcccgatctcgttagattgcaggaaccatggagccaggaacatacctatctggataagctgaagattagtctggcttcacggaccccaaaagatcagtcattgtgccacgttctggagcaggtgtgcggggtccttaaacagggaagctag

SEQ ID NO: 57659 - DNA, 1035 bp, Artificial Sequence
  Description of Artificial Sequence: Synthetic coding sequence
taggcttcaatgctgcccgaacagctctatttcctgcagtcacctccagaggaagagcctgagtaccaccctgatgcgagcgcacaggagctcaacgtgcgcgaaagcgatgtccgggtgtgcgatgagagcagctgcaaatatggaggtgtttgcaaggaggacggggatgggcttaagtgtgcctgtcagtttcagtgtcacaccaattacattcctgtctgcggctcgaatggagacacctaccagaatgagtgctttctgaggcgggcagcttgtaagcatcagaaagagataactgtgatagcacgaggaccctgttattccgacaacggatctggtagtggggaaggagaggaagaggggtcaggcgctgaagtccaccgcaaacatagcaagtgcggtccatgcaagtataaagcggaatgtgacgaggacgccgagaacgtcggatgtgtgtgtaatatcgattgctccgggtattcttttaacccagtttgcgcgagcgacggcagttcatacaacaatccgtgcttcgtgcgggaagcttcctgtattaagcaggaacagatagatatcagacacttggggcactgtactgacacagacgacaccagcctgctcggaaagaaagatgacggtctgcagtatcgccctgatgtgaaagatgcctcagatcagcgagaggatgtgtacattggtaaccatatgccatgtcctgagaacctgaacggttattgcatccatgggaaatgtgagttcatctactctacccagaaagccagctgtaggtgtgagtcaggctatacggggcagcattgcgagaagaccgacttctccattctttacgtcgtgccgtctagacagaagctcacccatgttcttatcgcggctataatcggcgctgtacaaatcgcaattattgtagcaattgtgatgtgcataacgaggaaatgtcctaaaaacaatagaggtcgccgacaaaaacagaacttaggtcacttcacatcagatacaagttccagaatggtttag

SEQ ID NO: 57660 - DNA, 573 bp, Artificial Sequence
  Description of Artificial Sequence: Synthetic coding sequence
ggtagttttgtgccagccgaggaggctgagattggcgcagtcgacgcaatcttcaccagaatccatagctgcgaatcaatcagcttgggcctgtccaccttcatgatcgatctgaaccaggtcgccaaagccgtgaacaacgctaccgcacagtccctggtcctcatcgacgagttcggaaaggggaccaacacagtggacggcctggctctgctggccgctgtactccgccactggctggcaaggggaccaacatgcccgcacatcttcgtagccacaaacttcctctccctggtccagctccagctgttacctcaagggcctcttgtgcagtacctgaccatggaaacctgcgaggatggaaatgatttggtgttcttctatcaggtgtccgatcttatacgctccggcaaacccatcaaacccgttaaagaccttctcaagaagaaccagatggaaaattgccaaactctggtggacaagtttatgaaattggacctcgaggatcccaatctcgacttaaacgtgttcatgtcacaagaagtgttgcccgcagccacttctattctgtag

SEQ ID NO: 57661 - DNA, 1146 bp, Artificial Sequence
  Description of Artificial Sequence: Synthetic coding sequence
atggccgctttcggacggcaagtcttagattggcacagactcataccacttacctgggcctgtatggctcggcaaaccccccatctgggtgagcagcgccgtactactgcctcactcctgagaaaattaaccacagcatctaatggcggagtcatcgaggaactgtcttgtgttcgttctaataattatgtgcaggagccagagtgcagacgcaacctcgtacaatgcctgctcgagaaacagggaacaccagttgtgcagggcagcctggaattggagcgggtaatgagttctctgctggacatgggattttccaacgcccacatcaatgaactactttccgttcggcgaggcgcttccctgcagcagttgctcgatatcatatcagagtttatcctcttgggattgaacccagagcctgtgtgtgttgtgctgaagaagtctcctcagctgttaaagctgcctattatgcaaatgaggaagcggtcctcatatctccagaagctcggactgggcgaaggaaagttgaaacgcgttctgtactgctgcccagagatctttactatgcgtcagcaagacatcaatgacacggtacgccttttgaaggagaagtgtctgttcacagtgcaacaggtcactaaaatcctacattcttgcccatcagtcttgagagaagatttgggccagcttgagtacaagttccaatatgcttattttcggatgggaatcaaacaccctgatattgtgaagagcgagtacctgcaatatagtctcaccaaaatcaagcagcgtcacatctaccttgagagattgggaaggtaccagactcccgataaaaaagggcagacccaaatacccaatccgctgctgaaggatatcttacgcgtaagcgaggcagaatttttggccaggaccgcgtgcactagcgtggaagagtttcaggtgtttaaaaagctcctcgccagggaggaggaggaatccgaatctagcacctcagacgacaagcgggcttccctggacgaggatgaagatgacgatgacgaggaagataacgacgaggacgacaatgacgaagacgacgacgatgaggatgacgacgaagctgaagacaatgacgaagatgaggacgatgacgaagaagagtag

SEQ ID NO: 57662 - DNA, 75 bp, Artificial Sequence
  Description of Artificial Sequence: Synthetic coding sequence
atggccccacgcggtttctcgtgtctgttgctgtccaccagcgagatcgaccttccagtgaaacgcagaacctag

SEQ ID NO: 57663 - DNA, 75 bp, Artificial Sequence
  Description of Artificial Sequence: Synthetic coding sequence
atgactacccggggattctcatgtctcctactcctcattcgcgagatagacctgagtgctaagaggcggatctag

SEQ ID NO: 57664 - DNA, 75 bp, Artificial Sequence
  Description of Artificial Sequence: Synthetic coding sequence
atggctactcgcagattcagttgtctgctgctttcgacctctgagatcgacctgtccgtgaagcggcgaatctag

SEQ ID NO: 57665 - DNA, 87 bp, Artificial Sequence
  Description of Artificial Sequence: Synthetic coding sequence
atggcgactcaaggctttagctgtctcctgctttcagtcagtgagatagacctttcgatgaagagacagtacaagcagattaggtag

SEQ ID NO: 57666 - DNA, 75 bp, Artificial Sequence
  Description of Artificial Sequence: Synthetic coding sequence
atggccactccaggtttttcctgcctcttgctgtcaacaagtgaaatcgaccttccgatgaaaagacgggtctag

SEQ ID NO: 57667 - DNA, 75 bp, Artificial Sequence
  Description of Artificial Sequence: Synthetic coding sequence
atgacacccagagggttcagctgtctgctccttccaacatctgagactgaccttccagtcaaaaggagaacctag

SEQ ID NO: 57668 - DNA, 75 bp, Artificial Sequence
  Description of Artificial Sequence: Synthetic coding sequence
atggcaacaggaggatttggttgcttgctcttactgatccgcgagatagatctctccgtcaaaaggcagatctag

SEQ ID NO: 57669 - DNA, 75 bp, Artificial Sequence
  Description of Artificial Sequence: Synthetic coding sequence
atggctccaagaggcttttcctgcctcctgttatcgacatcagagatcgatctacctgtcaagagacgggcatag

SEQ ID NO: 57670 - DNA, 75 bp, Artificial Sequence
  Description of Artificial Sequence: Synthetic coding sequence
atggcacgcagaggattctcctgcctcttactgtcaacgacagcgaccgacctgccagtcaagagacgtacctag

SEQ ID NO: 57671 - DNA, 3447 bp, Artificial Sequence
  Description of Artificial Sequence: Synthetic coding sequence
atgcccttgttcaaaaataccagcgtgtcctccctttactccggttgccgtctgaccttactgaggcccgagaaggatggtgcggctactcgggttgacgctgtttgtacgcaccggccagaccctaagagccctgggctggatagggagaggttatattggaaattgagccaattaacccacggaatcacagaactgggaccctatacactagatcgacacagcctgtatgtaaatgggttcacccaccaatcgtcgatgaccactactcgaaccccagacacttcgaccatgcacctggccacttcccgtactccggcaagcctgtccggaccaatgacagctagccccctgctcgtcttatttacaatcaactttacgatcactaacctgagatatgaggagaacatgcatcaccctggcagtagaaagttcaataccaccgaacgagttctgcaaggcttgctgcgacccgtgtttaagaatacctcagtgggtcccctgtattcagggtgtcgactgacgcttctgagacctaagaaagatggggctgcaactaaagtggacgctatctgtacgtacagacccgatcccaagtcgcctggcctggacagagagcagctctactgggaattgagtcagctcactcactcaatcactgagctgggcccatacacactcgatcgcgatagcctctacgtgaacggatttactcaacggtccagcgtgccgacaacctccattcctgggactcccacggttgacctgggcacctccgggactcccgtgtcgaagcccggtcccagcgccgcttctcctttgttggtcttattcaccctaaacttcacaatcaccaacttgaggtatgaggagaatatgcaacaccctggctctaggaaattcaatactaccgagcgtgtgctgcagggcctgcttagatctctcttcaagtctacctcagttggcccactttactctggctgccgcctgactttgctgagacctgagaaggacggaacagccacaggtgtggacgccatctgtacgcaccaccccgaccccaagagcccaaggctggatcgggagcagttatactgggagctctcacaactgacccataacatcaccgagctgggaccttatgccctcgacaacgacagcctattcgtcaacggttttacgcacagaagttccgtgagcactacaagtacccccggtactcccacagtttatctaggggcaagcaagacaccagctagtatattcggaccaagtgcggcatcacacctgctgatactctttactctaaatttcaccatcaccaaccttagatatgaggaaaatatgtggccaggctctcggaaattcaacaccactgagcgtgtcctgcaagggctgctcagacctctgttcaagaacaccagtgtcggtccattatacagtgggtgtcggctcacactgttgcggcctgaaaaggacggggaagccacgggggtggatgctatctgtacacacaggcccgatcctaccgggcctggtttggacagagaacagctgtaccttgagctgagccagctaactcacagcataacagagcttgggccttatacccttgaccgagactccctctatgtgaatgggttcactcatagatcttcagtaccaacaacatctactggggttgtcagcgaggaaccctttacattgaatttcactatcaataatctacgctacatggccgatatgggccagcctggttcacttaagttcaacatcaccgacaacgtcatgcagcatctgctgtcacccctgttccaaagatcctctctaggggcaaggtatacaggctgcagggtgattgccctgaggagcgtgaagaacggggcagagactagggtggacctactttgtacatatctccagcccctgtctggaccaggcctgccaattaagcaggtctttcacgaactcagccagcagacccacggtatcacacgactgggtccttacagcctcgataaggacagcctgtatctcaatgggtacaacgagcctggacccgacgagccccctacaaccccgaagcctgcaaccacttttctgccacccttgtcagaggccaccaccgccatgggttatcacttgaaaactctgacgcttaattttactatttcaaatctccagtattcccccgacatggggaagggcagtgccacctttaattccactgaaggggtcctgcagcacctgttaaggcctctgtttcagaaaagtagtatgggccctttctacctcgggtgtcagcttataagcttaaggcccgagaaggatggtgccgctaccggcgttgataccacatgcacataccatcccgaccctgtcggccctggactggacattcagcagctctactgggagctctctcagctaactcatggtgttactcagctgggattctacgtgctggaccgcgacagcctgttcataaacgggtacgcacctcaaaacctctcaatcagaggtgaataccagatcaacttccacattgtcaattggaacctctccaaccctgaccctacaagctcagagtatatcacactgctccgagacatccaggataaggtgacaaccctttacaagggatcccagctgcacgacacttttaggttttgtcttgtgaccaatctgaccatggactctgtactggtgaccgtgaaagctctgttcagctctaacttggatccgagcctagttgagcaagtcttcctcgacaagacacttaatgcctcctttcattggctgggcagcacataccaactggtggatattcatgtgacagaaatggagtcaagcgtttatcaaccaactagctccagttcaactcagcacttttacttgaatttcaccataactaacctgccatatagtcaagacaaagcacagcccggtactacaaactatcagcgcaataagcggaacatcgaggatgctcttaatcagctcttccggaattcttctatcaagtcatacttcagcgactgtcaggtgagtacctttcggtctgtgcctaatagacaccacacaggggtagacagtctttgcaacttctctccactcgcacgtagagtggatcgtgtggcaatttatgaagagttcctacgcatgaccagaaacggcacccaacttcaaaacttcacactggatcggagctcagtgctggtcgacggatatagcccgaaccgtaatgagcctcttacaggcaattcagatctccccttttgggcagttattctcatcggcctcgccggattgctgggagtgattacatgtctaatttgtggagtgttggtcactacacggagacggaagaaggagggcgaatataacgtccagcagcaatgccctggttactaccaatcgcatttagatttggaggatttgcagtag

SEQ ID NO: 57672 - DNA, 749 bp, Artificial Sequence
  Description of Artificial Sequence: Synthetic coding sequence
atgaacagccaacagacccctgtgggaactcctaaggacaagagagtatccaatactccactgcgtactgtagacggttccccaatgatgaaagccatgtattccgtggagatcacagtcgaaaaagataaagttaccggcgagacacgcgtgctctcttcaacaacactgttgccacgacagccccttcccctcggcatcaaggtctatgaagatgagactaaggtggtgcacgctgtggacggtaccgccgaaaatggcattcacccactttcctcatccgaagtcgacgagctcattcacaaagctgatgaggtcacactctctgaggctggatcgaccgctggcgctgcggaaaccagaggagccgtggagggcgcagctcgaactaccccatcccgcagagagataacaggagtgcaagcccagcctggcgaagccacgagcggccctcccggaatccagcccggacaggagcccccagtgactatgatttttatgggctatcagaacgtcgaagatgaggccgagacaaagaaagtgcttggccttcaggacactatcactgccgagctggtagtaattgaggacgctgcagagcccaaagagcccgctcctcctaatggtagcgctgccgagactgaagcagctagcagagaggaaaatcaagcaggtcccgaggctacaaccagtgacccccaggatcttgacatgaaaaagcaccggtgtaagtgctgcagcattatgta

SEQ ID NO: 57673 - DNA, 1344 bp, Artificial Sequence
  Description of Artificial Sequence: Synthetic coding sequence
acagctgccggtcctctgctagtgccctttaccctgaattttaccatcacaaacttacagtacgaggaggacatgcaccaccctggatctcggaaatttaacaccaccgagcgcgtgctgcaggggctgctaggaccaatgtttaagaatacctcagtgggccttctgtactccgggtgccgcttaacccttctgcgccctgaaaagaatggcgcagcaaccgggatggacgctatctgcagccaccggctggatcccaaaagtccagggttgaatcgtgaacagctgtactgggagctgtcgcagctgacccatggcattaaagagctcgggccatacactctggaccgtaactctctgtacgtcaacgggttcactcaccgctcctctgtggctcccaccagcacaccaggaacttccaccgtggacttggggacaagcggtacaccaagttcactcccttctcctaccacagccgtgcccctgctggttcccttcacactaaactttaccatcacaaacctgcagtatggtgaagacatgagacatcctggcagtagaaagtttaacaccactgaacgggtgctgcaaggccttttggggccattgtttaagaactcctccgtgggccctctatactcaggatgccggcttataagcctaaggagtgagaaggatggcgctgccaccggcgtggacgcaatctgcacccaccacctaaatccccagagtccaggactggaccgagaacagttgtattggcaactgtctcagatgacaaacgggatcaaggagctgggcccatacacccttgaccgcaactctctctacgtcaatggcttcacccatagaagtagcggactgactactagcaccacaggccctctgctggtcccattcactctcaactttactattacaaatctccagtatgaggagaatatgggacatccaggtagccgcaagttcaatatcactgagagtgtattgcaaggattgctgaagcctcttttcaagtccacgtctgtggggcctctgtactctggctgtcggctaaccttactgagacctgagaaggacggcgtcgccaccagggttgatgctatctgtacacatcgtcccgatcctaagataccagggctggaccgccaacagctgtattgggaactttcacagctgacccattctatcactgagctaggaccctatacacttgatcgcgactcgctctacgtgaatggatttacccagaggagctcggtccccacaacaagtactccaggcaccttcaccgtgcagcccgaaacttccgaaacaccttcctctctccccggaccgacatag

SEQ ID NO: 57674 - DNA, 5321 bp, Artificial Sequence
  Description of Artificial Sequence: Synthetic coding sequence
atgcgacgcggtaacatctcccccgctttctggtttctctggctgctgctttttggcttgttggggccttctagtgagaacacgacagcctttaccaaaggttccgacacgaccactgcttcaattacagggagtgaaacaaccatggcctccaccatggccagtactagcgccctcacaaccggatccaagatcacaaccgattcaacaacaggatcagaaaccacttctgccagtacaatggcgagtacagctgcatttacaactggatcggagacaaatacggcctcgactacagacagtggcaccacaatcgcctccacgcgaaccttcacgaccggtagcgatactactacaggctctactgctggatcggaaaccatcgtcgctagtacgactgtctctgggactactacgaccttcaccatagcctccactacagtgccagaaactacgatggctagcagcactacgtctaccgccggatccgagaaaactatggctagctctattatttccgagacaacaatggcaagcaccactggcagtgaaaccgccactgtcagcactactggttctgaaacgaccactaccagcaccgcctcatccgaggccactaaggtgtccacaaccggctctgaaacaactactgcttccaccgcaggatcagaaaccaccacaacatctacctccatggctggaagtgaggcgaccacaactagtaccgccgactctaaagtcataacagcaagcagtatgagttctgagacaactgtggctccagcagccggtagcaacacaacaacagcatctactacagggagcgaaacaactaccattttaatcaaagcttcggaaactacaacagcttcaacagctggcagtgagaccaccactccaagtcccaccggaagccaaaccactattgtctccatctccggttcagaaatcactaccacaagtaccgcgggatccgaaaacaccacggtgtccagcgccggatccggcaccacaactgctagtatggccggatctgagacaacagtgagtactgctggctccgagactaccaccgtctccattaccggtaccgagacaacgatggttagcgccatgggctcagagacaaccaccaattcaacgaccagctccgagacgactgtgacatccaccgctgggtccgaaactaccaccgtgtccaccgtaggcagtgaaacaactacagcctataccgcagattctgaaacaaccgcagcatccacaaccgggagcgagatgacaactgtctttactgccggatcagagacaatcacccccagcacggccggtagcgaaaccactaccgtgtctacagcgggatctgagaccactacggtgtccaccacaggatctgagaccacgaccgcatcaaccgctcattctgaaaccaccgcggcttcaacgatgggcagtgaaacgactaaagtgagcaccgccggtagtgagaccacagtgtccacagctggctccgaaacaactgccgcatccacggaggattctgaaaccaacacagctttcactgaagacagcaaaacaacaacagcctctacaacaggtttcgagacaactgccgcttccactactggatctgagcccaccatggctagcacaatggggagtgagacaacaatggcctcaactatagggccagaaacaaccaaggtttccaccgcaagttcagaggtcacgactgtattcgcggcaggatctgaaacaatacgtgcgagtaccgtcggctcggaaacaacaactgtctccacaacaggctctgagaccaccaccgccagcatcatgggctctgagacaagtacagactctacaaccggaagcgagaccactaccgcaagcacagagggttcagagacaacaacagcgtctactgaggggagtgaagcaacaactgtgtctacaacaggatctgaaaccactacagtgtccattaccgattccgagacgaccacaacctgcaccgaaggatcagagatgacagccgtttccacgaccgtcttcgagactacaactgcatcaactgaggggagcgaaattaccatagcctctacaagcgacagcgagactactacggcctcgacagagggatcagagacaaccacggtgacgaccgccggatctgagacaaagactgcttacactaccggatcggagacaactaccgcctctaatacaggtctggagacgaccaccgtcttcacgatcggaagcgatacaaccaccgctagtacggagggcagcgaaaccaccgcagtgtcagcaaccggttccgaaatgaccaccgtttcaaccgaagggtccgagaatacaactgtgagtactactggatcagagactacaactgtgtccacaaccggactggaaactacaactacttccaccgaaggatctgagatgactaccgtgtccaccactggggcagaaaccacgactgactcaactgaaggttctggaactactgccgcttccactgcgggtagtgagaccacaaccgttagcactgccgacagcgaaaacacaacagccagcaccgccgacagcgaaacgacatcagccagcaccaccggctcggaaactactaccgcctcaaccacgtcctcagagacgacaaccgcgagcaccgagggtagcgagaccaccaccgtatccaccacagacagtgaaactactatggtgagcactaccggatccgagaggacgattaccagcaccgaggggtcggaaaccacaacagtcagcgccaccggatccgaaacaactgtgtcgacagagggctccgggacgactactgtgagcattacgggctcagaaaccaccaaggtatccaccacaggaagcgagactacaaccacctcaactgagggttcagagatcacaacagcaagcatcaccggctctgaaacaaccacagcctccaccgaaggatctgagaccaccaccgcatctaccgagggcagtgaaaccacctctgctagtactacaggttcggagacgacaacggcatcgacgacttcttcggagacaactatggcctccatcatgggctccgaaaccaccatggcttccaccattggctcagagactacaaaagtgtcaactgctagttctaagatgaccaccgtcttcacggagaattctgaaaccaccatcgctagcaccacagcctctgagacgactacagtgtctacggctggatcagagacaataccggcttcgacagcaggaagcgaaacgacaaccactacaagcactgaggggtctgagaccaccaccgcctccaccgaagggtccgagactactactgcctctaccgaatcctctgaaaccaccacggccaccaccattggatctgagacaaccacagcttcaaccgagggaagcgaaactactacgacaagcacagagggaagtgagacaaccacggcctccactgagggctccgagatcaccaccgtgtcgaccacaggctcagaaaccacgacggcttcgactgaaggtagtgagactacaacagcctccacagagggcagtgagctcaccactgtctccaccactggatccgagaccatcaccgtgtcagccgagggcagcgagacgaccacagtaacaaccatgggctccgagaccaccacagcaagtacagccggatctgagactacgacagtcagtacggcaggatctgagaccactaccgcgtctatcgagggcagcgaaaccactaccgtgtccagcaccggctcggaaaccacaacagtcagcacaaccgggaccgagacaaccatcacatcgaccgaaggatcagaaacaacaactgttaccaccgctgggagcgagaccactgcagtctatacaactgggtcggaaacaaccaccacatctactgaagggtccgaaactacgaccgtctcaactacggggtcggaaaccacgactgctagcacagcagacttagagaccactacagtctctacttcagggtccggcaccaccactgcgtcaaccgctggctcagagacaacaaccgtttatatcactggttcaaagacaacgactgccagtactgagggcagcgaagcaaccacagtgtcgaccacatcttctgaaaccacaactgctagtactacaggatcggagatgacaacagtcttcacgactgtgtctgaaactacaactgttagcacaatcggatccgaggcaactaccagttccgccgctggaagcgaggcgactaccaccagcacggaaggctcggagaccactacagcttccacagccggttctgaaaccactactgccagcactgctggatctgagaccactacagctagtacttctggatctgagactaacaccgcttgtaccacaggcagcgagaccagcactccatcctccgccggtagtgagaccaataccgcgttcattatcggatcagaatccacaatcgcctcgactgcttctttagagccaacagcgacttctttaacaggcagcgagacaactacggtctccattacagctagcggagccacagcagccagcactacagtcagctccaccacattcgttctaacaaaagcaacagacgtttctatccagcctattacaaacactcccatgtccggaacccgaaccacaggaacgcgccttaccgccagttcgtcagttaccatggctcctggcatggacttcaccgcctctgctgcctcccataccgttcccggaattgtcctgaataccagtggcttgggcacttctacaatgggagcaagctccactaccagtgctcatggcgtgagaacaaccaccgggagcactcgagagccaacctcctcgaccttccaggaaaccggacccgtgtccatggggactaacacggtctccatgagccacactcctaccaacgtgatcaaaccaagcggctacctccagccatgggccattatcctcatctctcttgcagccgtcgtcgctgccgtcgggttatctgtcggacttagcttttgtctccggaatctgtttttccccctgaggtactgtggaatttactacccacatggccattcacatagcctgggattggatctcaacctggggctggggagcggcacgtttcacagcctgggaaacgcactggttcacggaggagaactcgaaatgggacacggagggacccacggcttcgggtatggcgtgggtcacggactttcccatatccatggggatggatacggcgtgaatcacggaggtcactacggccacggcggtggccatta

SEQ ID NO: 57675 - DNA, 1701 bp, Artificial Sequence
  Description of Artificial Sequence: Synthetic coding sequence
atgaagatgcagaaagggaatgtgttgctcatgtttggactgctgctccatctcgaagccgctacaaactctaacgagacaagtaccagcgccaataccgggagttctgtcatctctagtggcgctagtactgctaccaacagcgggtcctcagttacctccagtggcgtcagcacggccacaatttccggaagctccgtcacaagcaacggtgtgagtatagtgacaaactctgaattccataccacatcctccggcatctctactgcaactaattctgaattcagcacagccagctcgggtatcagcatcgccaccaactctgaaagtagtacaacctcttccggcgctagcactgccaccaattcggaatcatctactccctccagcggcgcttccacggccactaatagcgactcttccacaaccagctccggggcttcaacagctactaactctgactcaagtaccacctcttctgaagcctctactgcaactaactccgaaagctcaaccacttctagtggggcatcaacagctacaaattctgagtcgagcacggtgagcagccgagcctctacagcaacaaacagcgagagctccaccacctcatcaggagcaagcaccgcaactaactcggagagcagaactacctcaaacggagctggcacagccacaaacagtgagtcaagcacaacatcttcaggcgcatcgacagccacaaactctgagtcttccaccccttcttctggcgcagggacagcaaccaattccgagtcttccactacttcatcaggtgctggaacagccaccaactcagaaagcagtacagtaagttctggtatatctactgtaacaaacagcgagtctagcaccccttctagcggagccaacacggctactaattcagaaagttctactacatcttctggcgctaataccgccactaacagcgactcatcaaccacctcttctggggcttctaccgcgaccaatagcgagtcatcaacaacctcttctggggcatccacagccactaatagcgagagcagcaccacatctagcggggctagcaccgcaactaacagtggcagcagcactacctcttcaggtacctccaccgcaaccaacagcgagagctccaccgtcagcagtggagctagcaccgctacaacttcagagagctcaactacaagttccggggcatcaaccgcgactaacagcgagagtagcacagtcagttcaggcgctagtaccgccactaactctgaatcctctacaacaagtagtggtgccaatacggccacaaatagtggctcctctgtgacgagtgcgggttccggaaccgccgcactcacagggatgcacaccacgagccacagcgcatcaacagcggtctccgaagctaagccagggggatccctcgtgccctgggagatttttcttattactctggtgagcgttgtagcagccgtgggtctgttcgcaggactctttttctgcgtgcggaactcactcagtctgcggaacacgtttaacaccgcagtgtaccaccctcatggattaaaccatgggctcgggcctggcccaggcggtaatcatggcgcacctcaccggccaagatggtcccccaactggttttggcgcagacccgtctcttccatcgccatggagatgagtggaaggaactctggcccatag

SEQ ID NO: 57676 - DNA, 1701 bp, Artificial Sequence
  Description of Artificial Sequence: Synthetic coding sequence
atgaagatgcagaaaggtaatgtcctgctcatgtttgggctgctcctccatctggaggcagccaccaactctaatgaaacttccaccagtgccaatacagggagttcagtcatcagtagcggggcaagtacagcaaccaactctgggtcatcggtaaccagctccggcgtgtcaacagcaacaatctcagggtcatccgttacatcaaatggcgtgagcatagtgaccaattcggagttccacacaaccagcagcggcattagtactgctactaatagcgaatttagcaccgctagtagcggtatctccatcgccaccaactcagagtccagtacaacttcatcaggtgccagtacagccacgaacagcgagtcttctactccaagtagtggcgcatctaccgctacaaatagcgatagttccacaacatcatcgggcgcttctaccgcaaccaacagtgatagctcaacgacttctagcgaggcctccactgccacaaacagcgaaagttctaccacctcttccggggcaagtacggcaactaattcggagtcttccacagtctcctctcgggctagcaccgccactaatagcgagagcagtacgacctcttctggagcaagtaccgctacaaatagcgagtctcggacaacgagcaacggtgccggtactgctacaaattccgaaagctccacgacctctagcggagccagcacagctacaaatagtgaaagcagcaccccgtcaagtggagccggaaccgctactaattctgaatctagcaccaccagcagcggggctggtactgctacaaattcggagagtagcacggtgtcctcaggcatttccacagtcacaaacagcgaatcaagcaccccttctagcggcgcaaacacagccacgaactctgagtcctccaccacctctagcggtgcaaacacggccactaactccgatagctcaaccacttcctcgggtgcatctactgctaccaattctgaatcctccaccacttcttctggcgctagtacggcgaccaacagcgaatcctctaccaccagctccggtgctagtaccgctactaacagtggctcgtccaccacctcctccggcacttctactgctaccaacagtgagtcctctactgttagctctggcgctagtaccgccaccacatcagaaagctccacgaccagcagtggggcttctaccgcaaccaactcggaatcaagcacggtgtcatctggagctagcacagccactaattccgaatccagcacaaccagtagtggggcaaacacagctacaaatagtggatccagtgtgactagtgccggttctggtacagcagcattgaccggtatgcacacgacatcccattctgcatccacagcggtctctgaggcaaaacctggcggatcactcgtaccatgggaaattttcctcatcaccctggtgagcgtggtggcagctgtgggactgtttgctggtctgttcttttgtgtcaggaattcactgagtttgagaaatacctttaacacggccgtctaccaccctcacggactcaatcacgggcttggacccggtcctgggggtaatcacggagcacctcaccggccacgttggagtcccaattggttctggcggcgacctgtctcctccatcgcgatggaaatgagcggaagaaattccggaccttag

SEQ ID NO: 57677 - DNA, 1701 bp, Artificial Sequence
  Description of Artificial Sequence: Synthetic coding sequence
atgaagatgcagaagggaaacgtcctgttgatgtttggcctcttattacacctggaagccgcaacaaactcgaatgagacgagcacctctgccaataccgggtcttccgtcatctctagcggtgccagcacggcgactaacagcgggagttctgtgacttcctccggcgttagcacggctacaatctccgggtctagtgtcacttctaatggcgtctctatcgtgaccaatagtgagttccacacgacatccagtggcatttctactgcaaccaacagtgagttttccacagcctcaagtggaatctcaatcgcaaccaactccgagtcttcaacgaccagttcaggcgctagcacagccacaaactccgagtcaagcacaccttcctctggcgcatcgactgcaacaaacagtgacagtagtactacttcctcaggcgctagtaccgccaccaattccgattccagtaccacctctagcgaagccagcactgcaactaacagcgagtcatcaaccacaagtagcggggcttctaccgcaacaaattctgagtcgagtaccgtttcgtctcgtgcatctaccgcaactaactcagagtcttccactacctcgtccggtgcaagcaccgccaccaacagtgagtcccggacaacctccaacggggcaggtaccgccactaacagcgagtccagtaccacatcttctggggcaagcactgcaacaaacagtgagagttccactccctctagtggagcagggacagcaactaacagcgaatcgagcaccacttcgtccggagctggaacagctactaatagcgaatctagtactgttagctccggaatcagtactgtgactaacagtgagtctagcacccctagcagtggcgctaatactgctacgaactccgaaagttcaaccacttcatcaggcgctaatacggcaactaacagcgattccagcaccacatcctcgggggcaagcactgcgactaatagtgaatcatccacaactagcagtggcgcatccaccgccactaattcagaatcttccaccactagctcaggtgcaagcacggcaacgaatagcggatcaagtaccacatctagcggcactagcactgccactaactcggagtcgtctactgtgtcgtctggggcttctaccgctacaacaagcgagtcaagcaccacatcctctggagcaagcacagcaaccaactccgagagttcgaccgtgtcaagcggggcatcgaccgccacgaactctgagtcctccacgacttctagcggggctaataccgctaccaactctggctccagcgttacatcggcagggagcgggactgcagcactgacaggtatgcacacgacctcccactctgcctccacggctgttagtgaagcgaaaccaggcggttccttagtgccatgggaaatattcctgataaccctcgtgtcagtggtggccgcagtgggattgttcgcaggattatttttttgtgtgaggaacagcttgtccctccgaaacactttcaatacagcagtttatcatcctcatggcctgaatcacggcttgggaccaggcccagggggtaaccatggagctccgcaccgcccacggtggtctccaaattggttctggcggagaccagtgtctagcatcgccatggagatgtccggccgtaactcaggaccttag

SEQ ID NO: 57678 - DNA, 1251 bp, Artificial Sequence
  Description of Artificial Sequence: Synthetic coding sequence
atgaagatgcagaaagggaacgtgttgcttatgttcgggctcctactccacctggaagcggctaccaactctaatgagacatccaccagcgctaacacgggttcaagcgtgatttcctccggcgctagtaccgccaccaattctggatcatccgttaccagtagtggcgtctcaactgcaacgatctccggaagctctgtgactagtaatggtgttagcatcgttaccaatagcgaatttcacacaacgagctcaggcatctcaactgccacaaacagtgaatttagcactgcctcatcaggcattagcatcgccacaaactctgagagctctacgaccagcagcggcgcttcaaccgcaactaattcggagtcttccactccttcgtctggggctagcactgctacgaactcagatagcagtacaacatcaagtggcgcatcaactgcaactaattcggattcctccacaacctcttccgaggccagcactgctaccaattctgagagctctacaacatcatctggagccagtacagctactaatagcgagtcttcaacgacttcctcgggcgcttccacagctacaaattccgagagtagtaccacgtcttcaggagcctcaaccgctaccaacagtggatccagtaccacgtctagcggtacgtccacggcaactaacagcgagtcaagcactgtaagcagcggtgcatctaccgccacaacaagtgagagttcaaccacgtcatccggcgcatccactgctacaaacagcgagagctccaccgtgtcttcaggtgcgtcaacagctaccaactcggaatcttctactacgagcagtggggctaacaccgcaacgaacagtgggtctagcgtaacctccgcgggatctggaacagccgcactgacaggcatgcataccacttcccactcagcgtccactgcagtctccgaggcgaagcccggaggcagcctggtgccatgggaaatattcctcatcaccctggtcagtgtggtagccgcagtgggactgtttgccggactcttcttctgcgtgcgcaatagcctcagcctgagaaacacatttaacactgccgtgtaccaccctcacggactgaaccacggtcttggcccaggacctggtggaaatcatggcgcaccacaccgtccccgttggtcccccaactggttttggcgaaggccggtgtcttccatagccatggaaatgtcaggaagaaattccggcccttag

SEQ ID NO: 57679 - DNA, 1251 bp, Artificial Sequence
  Description of Artificial Sequence: Synthetic coding sequence
atgaaaatgcagaagggtaacgtgttattaatgtttggcctgttattgcatctggaggccgctaccaatagcaatgagacctctacatctgccaatactggatctagcgttatctctagcggcgcttctactgccactaattctggatcctcagttacgtcatctggggtgtccacagctactatttcagggtcgtctgtcacatctaacggagtatctatcgtgaccaactctgaattccacacgacaagtagcggcattagtacagccactaattcggagttttccaccgctagctctggtatctctatcgctaccaattctgagtcctccaccaccagttccggagcatcgaccgcaaccaacagcgaatccagcaccccgtccagtggcgctagcaccgccacaaacagcgactcatcgacaactagctctggtgcttccaccgccacaaatagcgacagttcaacaacgtcctcagaggcaagcaccgccaccaattctgagagcagtaccacaagcagcggagcaagtacagcaaccaactccgagtcatctacaaccagctccggcgctagtacggccactaacagcgaatcttccaccacaagtagcggggcttcaacagcaaccaattccggcagctccaccaccagtagtgggacatctaccgccacaaattccgaatcgtcgactgtcagcagcggtgcatcgacagcgaccacctctgaatctagcacaacatcaagcggggcaagtaccgcaaccaatagtgaatctagcactgtaagctcaggggcttccaccgccacaaattccgaatcctccactacatcatccggcgcaaatacagcaacgaactcgggatcaagtgtgaccagcgccggaagcggtaccgccgctttgacgggcatgcacactacatctcactctgcttcgactgccgtttcagaggctaagcctggaggctccctggtgccgtgggaaatctttctcatcacactggtatctgtcgtggccgcagtgggtcttttcgccggattgtttttctgcgtccgaaattctctgtctctgcgcaacacttttaatacagccgtttatcatccacacggcctgaatcatgggctcgggccagggccaggaggcaatcatggagctccacatcgccctaggtggtctccaaactggttctggcgccgtccagtttcttccatcgcaatggagatgagcggcagaaactccggcccatag

SEQ ID NO: 57680 - DNA, 1251 bp, Artificial Sequence
  Description of Artificial Sequence: Synthetic coding sequence
atgaagatgcaaaaaggaaacgtgctgttgatgtttgggctcctcctgcacctggaggcagccacaaacagtaatgaaacgtccacatctgcgaacaccggaagtagtgtcatttcctcaggggcaagtacagcaaccaatagcgggtcatcagtgacatcaagtggcgtgtcaactgcgacaatctctggatcatcggttacctctaacggggtctccattgttactaattcagaatttcatactacaagtagcgggatcagtacagccaccaactccgaatttagcaccgcctcttctggtatcagcattgcaactaacagcgagagttctaccacttcttcaggcgcttcgacagccactaattctgagagttctaccccttctagcggagcctctacagcaacaaactccgatagtagcactacttcatcaggagcatcaaccgctaccaatagcgatagttctactaccagttccgaggcctctacagcaactaatagcgaatccagtactacctcaagtggcgcatccaccgctactaattccgaatccagtactaccagctccggagcatcaacggctaccaattctgagagtagcaccacaagctccggcgcatccacagccaccaacagtgggtctagcacgacttctagtggcaccagcaccgccacgaattcagaatcaagcacagtatcctccggcgcttctaccgcgactacctctgaatccagcacaacttccagtggcgcatccaccgcaacaaactctgaaagcagtaccgtgtcatccggagcatctaccgctacaaacagcgaatcaagcactaccagtagcggcgcaaacaccgctaccaatagcggtagttccgtaaccagtgccggatctggaaccgcagcgcttactggcatgcacacaacctcacattctgcatccaccgcagtctctgaagctaaaccaggtgggtcgctggtgccatgggagatcttcttgattaccctagtctccgtagtggctgccgtgggcttgttcgcaggtctgttcttttgtgtgagaaactccctgagtttgaggaacacatttaacaccgcagtgtatcatcctcacgggctgaatcatggactaggacctgggcctggaggtaatcacggagccccacacaggcccagatggtcccccaactggttctggcggcgacctgtgagctcaattgcgatggagatgagtggtagaaactctggcccatag

SEQ ID NO: 57681 - DNA, 471 bp, Artificial Sequence
  Description of Artificial Sequence: Synthetic coding sequence
accgcacaatccctagtgctgatcgacgaatttggcaaaggtactaatacagtggatggtcttgctctgcttgccgctgtgctgcggcactggttggcacgaggcccaacatgtcctcacattttcgttgctacaaactttttaagtttagtgcaactacaactgttgccccaggggccactggtgcagtacctggtctgcgagggtgtagctaaagcatcacacgcctcccataccgccgcacaagccggattacctgacaaacttgtggcacgcggaaaagaggtatcagacctgatccggagtggtaaacccatcaaacccgtgaaggacctgctcaaaaaaaaccagatggagaactgtcagacgctggtagacaagtttatgaagctcgacctggaggatccaaatttggatctcaacgtgtttatgagccaggaagtcctccctgcagcaacaagcatcttatag

SEQ ID NO: 57682 - DNA, 1206 bp, Artificial Sequence
  Description of Artificial Sequence: Synthetic coding sequence
atgtggcccgtactcctattcgtgtttctcagtcagacagtgtactctgccctaggtctgagagacgcatgtaggtcactcccccagtccatccagctttttagagacattgctcaggaattctcagacgacctgcaccacattgcatccctcatcggcaaggtcgtggactttgaaggatcccttgctgaaaatagattcaccgtgctgcccaacattgatcccgaaatcgacgagaaaaagaggcgactaatgggtctaccttcttttttgacagaggtggctaggaaagagctcgagaatttggacagtaggatcccttcgtgctctgtgatctatataccgttgatcggattcttgctcagtattccaaggctcccctctatggtcgaggcgtctgacttcgagattaatggactggattttatgttcctgtccgaagagaagttgcactaccggtctgctaggaccaaggaactcgatgcgctgctgggcgacctgcactgtgaaattcgagatcaagagacactcctgatgtaccagttgcaatgtcaggtcctggctagggctgcagtgctgactcgggtccttgacctggcatctagactcgacgtgcttcttgctttggcttcagccgctcgggactacgggtatagcagaccccgttatagtcctcaggtacttggggtgagaatccagaatggcaggcaccccttgatggagctttgtgcaaggaccttcgtgccaaacagtaccgaatgtggtggagataaaggaagggtcaaggtgatcactggccctaatagcagtgggaagtccatttatctcaagcaggttggcctaataaccttcatggcactcgttggttctttcgtgcctgccgaagaggcggaaataggtgccgtggatgccatatttactcgcatccactcatgcgagtctatcagtcttggactaagcacattcatgatagatctgaatcaagtggctaaagctgttaacaacgctaccgcgcagtctttggtgctaatagacgaatttggaaagggtacgaatacagttgatggcctggctttgctcgcagctgttctgcgccattggctcgcgagaggcccaacatgtccgcatatctttgttgccaccaatttcctctcccttgtccagctccagctcttgccacagggccctctggtgcagtacttgtag

SEQ ID NO: 57683 - DNA, 1491 bp, Artificial Sequence
  Description of Artificial Sequence: Synthetic coding sequence
accgtatacagcgccctgggtctgagggatgcgtgcagaagccttcctcagtctattcagctcttcagggatattgcccaagagttttccgacgatctgcaccacattgcatccttaatcggcaaggttgtggactttgagggcagcctggctgaaaataggtttacagtgttgccgaatattgatccagagattgatgaaaaaaaaagacgcttgatgggccttccctcatttcttactgaagtggctagaaaggagctcgagaacctggatagcagaatccccagctgctcagtcatctatatacccctgatcggattccttctctccatccctagattgccgtcgatggttgaagcctccgatttcgaaatcaacggtctcgactttatgttcctgtctgaggagaagctccattacaggtcagccagaacaaaagaactggatgcgctgcttggggatctgcactgcgagataagggaccaggagacactgttaatgtatcagctccagtgtcaggtcctggcgagagccgctgtgctgacccgcgtcctggacctggcatctcgtctggatgtgttgctggctttagcttctgctgcacgcgattacggctactcgcgcccaaggtactcgcctcaagtgctaggagtcaggatacagaacggtagacatcctctgatggagttgtgtgctcggacatttgttcccaacagcacggagtgcggaggcgacaaaggtagagtgaaggtgatcaccggccctaacagctcgggtaagtctatctatctaaaacaggtgggacttataaccttcatggcgctggtggggagctttgtgccggcagaggaggccgaaattggagcggtcgatgccatctttacacgtattcattcttgcgagagcattagcctcgggctttccacctttatgattgatctcaaccaagtggctaaggcagtgaataatgcgaccgcccaaagcctcgttctgatcgatgagttcggcaagggaactaatactgttgatggtctagccctcctcgctgccgtactgcgccactggctggcacgtggcccaacctgcccccacatcttcgtggccacaaacttcctgagccttgtgcagctccagctgctgccccaggggcctcttgtgcagtatctgacaatggagacctgcgaagatggtaatgacttggtgttcttttaccaagtgtgcgaaggcgtcgccaaagcctcccacgcttctcacactgctgcacaggccggactccctgacaagcttgttgccagagggaaagaagtctctgaccttattcgctcaggtaagccaataaaacctgtgaaagacctgcttaaaaagaatcaaatggagaattgccagacattagtcgacaagtttatgaagctggatcttgaggaccctaatctggacctgaatgtgttcatgtcccaggaagttctccccgctgccacaagtatactgtag

SEQ ID NO: 57684 - DNA, 2187 bp, Artificial Sequence
  Description of Artificial Sequence: Synthetic coding sequence
atggccagtctcggcgctaacccccgacgtacccctcaaggccctaggccgggagctgcttcgagcggtttccccagtcccgctcctgtaccgggaccaagggaggccgaggaggaggaggtagaagaggaggaagagctggcggaaatccacctttgtgtactatggaactccggttacctgggcattgcttattacgacacctctgattctaccatacatttcatgcccgatgcgccagatcacgagagtcttaaactgctgcagagagtactcgacgaaatcaaccctcagagcgtcgtcactagcgctaagcaggacgagaacatgaccagattcttaggcaagctcgcttctcaggagcaccgcgagccaaaaagacctgagatcattttcttgccttccgttgatttcggactggagattagcaaacagcggttgttgtctgggaattatagcttcatccctgacgcaatgacagcaactgaaaagatcctgtttttgagttcgatcattccttttgactgtttactcaccgtcagggctctcgggggattactgaagttcctggggagaagaaggatcggcgttgagctggaagactacaatgtgagcgtacctatactgggcttcaagaaattcatgctgactcacctggtcaatatcgaccaagatacctacagtgttctccaaatcttcaagagcgagtcccatccttcagtctacaaagttgcgtctggcctgaaggaaggcctatccctcttcggaatactaaaccggtgccattgtaagtggggtgagaaactgctgagactgtggttcacccgaccgacacatgatttgggggaactgtcatcccggctggacgtgattcagttcttcctgctgccgcagaacctggatatggcccagatgctacataggcttcttggtcatataaagaatgttcctctgattcttaaacgaatgaaattgagccatactaaggtgtctgactggcaggtgctgtataagaccgtttacagcgcactggggctgcgggacgcctgccgttcgttgcctcagtctattcagctctttagggacatagctcaagaattcagtgatgatctgcaccacattgcatctcttattggtaaggtagttgatttcgaaggcagcctcgccgagaatcggttcactgtgctccctaatattgaccccgaaatcgatgagaagaagcgtagattaatgggactgccttcttttctcaccgaggttgcacggaaggaactggagaacctagactcccgaattcctagctgctccgtcatctacatacctctcattggatttcttttgtccattcccaggctgccctctatggtggaagcatccgattttgaaatcaatgggcttgatttcatgtttctgtcggaggaaaagcttcactacaggagcgccaggaccaaagagctcgatgcacttttgggagatttgcattgcgaaatcagggatcaggaaacccttctgatgtaccaactccaatgccaagtgctggcgcgtgcggcagtcttgacaagggtcttggacctggcctcccgactggacgtcctcctggccctcgcatctgccgctagggattacggatactcccgcccacgctattctccacaagtgctcggggtgcggatacagaacggtagacaccccctgatggagttgtgcgctcgcacttttgtgccaaacagcaccgaatgtggtggcgataaggggagagttaaagttatcacaggtcctaatagttccggaaagtccatttacctcaaacaggtgggactgattacattcatggccctagttggttccttcgtacctgcggaggaggccgagatcggcgcagttgatgcaatctttacacggatccattcctgtgaatccataagcttgggactcagtacctttatgattgacctgaaccagcaagttgctaaagccgtgaataacgccactgcgcagtccctggtgctcatcgacgagtttggcaaaggaacaaacaccgttgacggcctggccttgctcgcggctgtcctcaggcactggctggcccgtggcccaacctgtccccatattttcgtggcaaccaacttcctctccttggtgcagctgcagctgttgccccaggggccactggtccaatatctgtag

SEQ ID NO: 57685 - DNA, 585 bp, Artificial Sequence
  Description of Artificial Sequence: Synthetic coding sequence
atggcttccctgggagcaaatcctcgccgtacaccacagggacctaggcctggggctgccagttccggattcccatcacccgcaccagtgccaggccctagagaagctgaggaagaggaggtggaagaggaagaagaactagccgagattcacttgtgtgtcctttggaactctgggtatcttggcatagcctactatgatactagcgactcaaccatccatttcatgcccgatgccccagaccacgaaagcttaaagctcctgcagcgggtgctggacgagatcaatccccagagtgtcgtcacatctgcgaaacaggatgagaacatgacacgattcttgggcaaattggcgtctcaggagcaccgagagccaaaacgccctgagataatcttcctcccaagcgtagatttcgggctggagatcagtaaacagcgattactgagtgggaactactccttcatcccagacgcgatgacagcaactgaaaaaatactgtttttgtcctctataattcccttcgattgcctcctgactgttcgcgcactcggcggtttgctgaaattcctgggtcggagacggtag

SEQ ID NO: 57686 - DNA, 1002 bp, Artificial Sequence
  Description of Artificial Sequence: Synthetic coding sequence
aaaattctgttcttatcaagtatcatcccgtttgattgtctgctcacagtgagagcccttgggggtctcctgaagttccttggtcgccgtagaattggcgtcgagttggaagactacaacgtttccgtgccaattcttgggttcaagaagttcatgctgacacacctcgtcaacatagatcaggatacatacagcgttctacagatatttaaaagcgagtcgcatccatctgtgtacaaggtggcaagtggcctgaaagaaggactgtcattattcgggatactgaatagatgtcattgtaagtggggagagaagctgctgaggttgtggttcacccggccaacccatgatctcggggaattgtcctcccggttagacgtaattcaattttttctgctgccgcagaatctagacatggcacaaatgttgcacaggttgttaggccacatcaagaacgtccctctgatcctcaagcggatgaagctgtcccacaccaaagtgtccgattggcaggttctgtacaagacagtttattccgcattaggactacgagacgcctgtaggtccctgcctcagagcattcagctgttccgggacatcgcacaggagttctcagatgatctccaccacatagccagcttaattggtaaagtgtacctgagccctcaggtcgacttcgaaggctcccttgccgaaaatcggtttacagtcctgccgaacattgatcccgagattgacgagaagaagagaaggttgatgggccttccctctttcctgaccgaggtggcgagaaaggagctcgaaaacctggattcccggatccctagttgtagtgtgatctatattccgcttatcggattccttctgagcatacctagactaccttctatggtcgaggcatccgattttgaaatcaacggactcgactttatgttcctgagcgaggaaaaattacactaccgcagtgcacgaaccaaggagctggacgctctgctggggtag

SEQ ID NO: 57687 - DNA, 471 bp, Artificial Sequence
  Description of Artificial Sequence: Synthetic coding sequence
acagctcagtcactggtcctaatcgacgagttcggaaagggcaccaatactgtggatggactggcactgctcgctgccgtgctgagacactggcttgctagagggccaacatgccctcacatattcgtcgctactaatttcctgtccttggtgcagctgcagcttctgccgcagggtccgctagtgcaatatctcgtttgtgaaggcgtagcaaaagcttcccacgcaagccacacagccgctcaggcaggtctgcccgacaagctagtagctagggggaaggaggtctctgatctcataagaagcggcaaaccaattaagccagtcaaggatctgctgaagaagaaccagatggagaactgtcagacactagtagacaagttcatgaaattagatctcgaagatccaaatctcgatttgaatgtgtttatgtcccaggaagtgctccccgctgctaccagcatactttag

SEQ ID NO: 57688 - DNA, 2184 bp, Artificial Sequence
  Description of Artificial Sequence: Synthetic coding sequence
atggcttcgttgggagcgaaccctcgccgaacacctcagggcccacgcccaggcgctgcttcaagcgggttcccgtcaccggctcccgtgccgggacccagggaggcagaggaagaagaggtggaggaggaagaagagctggcagagattcacctgtgcgtgctgtggaatagcggctatctaggcattgcgtactacgataccagcgactcaaccattcacttcatgccagacgcacctgaccacgaatctttgaaactcctccagagggtgctcgacgagattaatcctcagagcgtcgttaccagtgcaaagcaggatgagaatatgactcggttcctaggcaaactggcatcccaagaacatcgcgagccaaagcgcccagaaataatttttctcccatccgtggacttcgggctagaaatatcaaaacagcggcttctgtctggcaactacagtttcataccggacgctatgactgccactgagaaaatcctctttctaagcagcatcatccccttcgattgtctgctgacagtaagggcccttggagggctgctcaaatttctgggtaggagacgtattggcgtggaactggaggattataacgtgtctgtcccaatccttggctttaagaagttcatgctgacacatctggtgaacatcgaccaggacacctacagcgtgctgcagatcttcaagtccgagtcgcatcctagcgtctacaaggtggcttccgggctaaaagaaggacttagtttgtttggcatcctaaatcgctgccactgtaaatggggcgaaaagctcttaagactgtggtttacacggcctacacatgacctgggggagttatcatcacgactagacgtgatccagttttttctcctgccccaaaatctcgatatggcacagatgctccaccggctcctgggacacataaagaacgtgccactcattttgaaaagaatgaaactgagtcatacaaaagtatccgattggcaagtattgtacaaaaccgtgtactctgccctcggccttcgtgacgcctgtaggagtcttcctcagagcatccaactgtttcgggacatcgctcaggaattctccgatgacctccatcatattgccagcctgattggaaaggtcgtagatttcgaaggttcactggctgagaataggttcaccgtgcttcctaacatagaccccgagattgacgagaaaaaaagacggctcatgggcctcccatccttcctgacagaggtggcgcgtaaagagttggaaaacctggactctcgaattccttcctgctccgtgatttatattccgcttatagggtttttgctgagcatccctagactgccatcaatggtggaagcttctgattttgaaattaacggcctggactttatgtttttatcagaggaaaagctgcactaccgctcagcccgaactaaagaactcgacgcgctgctgggagatctccactgtgaaatccgtgaccaggaaaccctcctgatgtatcagctgcagtgccaagttctcgctcgcgcagcagtgctcaccagggtgctggatttggcctcgcgcctggacgtgctgctcgccctggcgagcgccgcacgcgactatggatactcccggcctcgctactcacctcaggtgttgggtgtaagaatccaaaacggacggcacccattgatggaattgtgcgcaaggaccttcgtgcctaattctactgagtgcggcggagacaagggccgtgtaaaggtcataaccggaccgaatagcagcggaaaatccatctaccttaagcaggtgggcttaataactttcatggccctggttggctcgttcgtcccagctgaggaggcagaaatcggggctgtggacgccatattcactaggattcattcgtgtgagtccattagcttaggactgagcaccttcatgatcgatctgaaccaagtagccaaggccgtaaataacgcaacagcccaatcacttgtgcttatcgacgagtttggtaaggggaccaacacagtcgacggtctggctctgctcgcggcagtgttgcgccactggctggctcgcggaccaacatgcccacacatcttcgtcgctacaaacttcttgtccctcgtgcagctccagctcctgccgcagggccctctcgtgcagtacctctag

SEQ ID NO: 57689 - DNA, 1527 bp, Artificial Sequence
  Description of Artificial Sequence: Synthetic coding sequence
atgtggccagtactgctctttgtcttcctgtcacagactgtgtactcagctctgggacttcgcgatgcctgtagaagtctgccacagagcattcagctttttcgggacatcgcacaggaattctctgatgatctgcatcacatcgcaagtctaatcggaaaggtggttgactttgaaggttcgcttgccgagaatcgctttaccgtcttaccaaatattgatccagaaattgacgaaaaaaaaagacgtctgatgggactgccatccttcctgactgaggtcgcacgcaaagagctggagaatctggacagccgtattcctagttgcagcgtaatctatattccactgattgggttcctactgagcatccctaggttgccctcaatggtggaggcaagtgacttcgagatcaacgggctggattttatgttccttagcgaagaaaagctgcattataggtcagccagaaccaaggaacttgacgccctgctgggcgacctccattgtgaaatccgggaccaggaaactctgctcatgtatcagctgcagtgccaggtgctggctcgcgctgctgtgctcaccagagttttggatctggccagtagactggacgtcttgctggctctggctagcgcagccagggattatgggtactctagacccagatactccccgcaagtcctgggcgttagaatccagaacggcaggcacccattaatggaactctgcgcacggacattcgtcccgaactctactgaatgtggcggagataagggcagagtcaaagtcataactgggcctaatagctccggaaagagtatctacctgaagcaagttgggttaataaccttcatggccctggtaggctcattcgtacctgctgaggaggcagaaataggggcagtggatgctatttttactcggattcactcttgcgagtctatcagcttaggactgagcaccttcatgattgacctcaaccaggtggccaaggcagtaaacaacgccaccgcacagagtcttgttcttatcgacgaattcggaaaagggactaacacagttgacggactggcactgctggcggcagtgctccgtcactggctggcgagggggcctacctgccctcacatctttgttgctactaattttctcagcttggtgcagctccaacttctgcctcagggccctctggtgcagtacctgactatggagacctgcgaggacgggaacgatctcgtctttttctatcaagtatgtgagggcgtggcaaaggcttcgcatgcctctcacaccgcagcacaggccggacttcctgataagttggtcgctaggggcaaggaggtgagtgacctgattaggtcagggaaaccaatcaagccggtcaaagatctcttaaaaaagaaccaaatggagaattgccagaccttagtcgacaaatttatgaaactggacctggaagatccaaacctggacctaaatgtatttatgagccaggaagtactgcccgctgccacttctatcctctag

SEQ ID NO: 57690 - DNA, 408 bp, Artificial Sequence
  Description of Artificial Sequence: Synthetic coding sequence
ggttattcccgtcccaggtactcgcctcaagtcctcggtgtgcgcattcagaacgggaggcacccgttaatggagctctgtgctcggacatttgtccctaattcgacagagtgtggcggtgacaaaggcagggtcaaagtgataacaggtcctaattcctccggtaaatccatctacctgaaacaagtggcgaaagccgtgaataacgctaccgcccagtcgctggtcttaattgacgaattcggcaaggggacaaataccgtcgacggactggcgctcctggcggctgtacttaggcattggttggcaagagggccaacttgtcctcatattttcgtggccactaatttcttgtcgcttgtccagctccagctgcttccccaaggcccactggtgcagtatctgtag

SEQ ID NO: 57691 - DNA, 1494 bp, Artificial Sequence
  Description of Artificial Sequence: Synthetic coding sequence
accgtgtacagtgcccttggcttgcgggacgcatgtcgatcccttcctcagagcatccaattgtttcgagacatcgcacaggaattcagtgacgatctacatcatatagcatccctgattggcaaggtggttgatttcgaaggctccttggcagaaaatcggttcactgtcctgcctaatatagacccagagatcgacgagaagaaaaggaggttgatgggcctgccatcctttctaacagaggtagccaggaaagagctggagaacttggattcacgaataccttcttgtagtgtcatttatatcccactcattgggttccttctgtctatcccacgtctgccatccatggttgaagctagtgactttgagataaatggactagacttcatgtttctctctgaagaaaagctccattatcgctccgcccgaacaaaagagctggacgcactgcttggagacctgcactgcgaaatccgagaccaagaaaccctcctcatgtatcagctacagtgtcaagttctcgctagagctgcagtgctaacacgagttctggatctggctagccggcttgatgtgttactggccctggcctcagccgctcgtgattacggctactcgcgaccgaggtatagcccacaggtcctaggggtcaggattcaaaatggcagacaccccctaatggaactgtgtgccagaacgtttgtgccgaacagcaccgaatgcggtggggacaagggccgtgttaaagtgatcactggaccgaactcctcagggaagagtatctatctgaaacaggtggggcttatcaccttcatggcgcttgtcggatcttttgtacccgctgaagaagcagagatcggcgcagtggatgccatcttcaccaggatccacagctgcgagagtataagtttgggtctgtccactttcatgatcgacctgaatcagcaggtggctaaagctgtcaataacgccaccgcgcagagcctggtgctgattgacgagtttggaaagggaactaacaccgtggatggactcgcactcttggccgctgtcttaagacactggctggcacgagggcctacttgcccgcatatttttgtggccacgaactttttgagcctggtgcagttgcagttgctgccacaggggccactggtgcagtatctaactatggagacatgtgaagacgggaacgacctggtgtttttttaccaagtatgcgagggcgtagctaaggcctctcacgcctcgcacactgccgcacaggcgggtctgcccgacaaactggttgctagagggaaggaggtgtccgaccttatccggtccgggaaacctatcaagcccgtgaaagatctcctgaagaaaaatcaaatggagaactgtcagacattggttgataagtttatgaaactggatctagaagatcccaacctggacttgaatgtgttcatgtctcaggaggtcctgcccgctgcaacgagtatcctgtag

SEQ ID NO: 57692 - DNA, 585 bp, Artificial Sequence
  Description of Artificial Sequence: Synthetic coding sequence
atggcctcccttggagctaatcccagaagaaccccacaaggcccaagacccggagccgcttctagcggctttccttcccctgcacctgtgccaggccctcgagaagccgaggaggaggaagtggaggaggaggaggagttagccgaaatccacctctgcgtcctgtggaatagcggttacctcgggatcgcttattacgatactagcgatagtaccatacacttcatgccagatgctcccgaccatgagagcctcaagctgctgcagagggttctcgacgagataaatccacaatcagtagtgacaagcgcaaagcaggacgagaatatgactcgatttctgggtaagctcgcctcacaggagcatagggagccaaagcgcccagagatcatcttccttccaagtgtcgactttgggctggaaattagcaagcaaaggctgttgtctggcaattactccttcatccctgacgctatgacagcaaccgagaagatcctgttcctctcttcaattatcccttttgactgcctgctgaccgttagggcacttgggggtctcctgaagttcctgggacgcagaaggtag

SEQ ID NO: 57693 - DNA, 1404 bp, Artificial Sequence
  Description of Artificial Sequence: Synthetic coding sequence
acagtgtattctgcactgggactgcgcgatgcctgcaggagcctgccacagtcaatccagctcttccgcgatattgcccaggagtttagcgacgacttgcatcatatcgccagcctaatcggcaaggttgttgatttcgagggttcacttgccgaaaacagattcactgtgttacctaacatcgaccctgagattgacgagaagaaaaggcgcctcatgggtctgccatcctttttgactgaggtagcccgtaaggagttggagaatcttgactcgaggatcccgagttgtagcgttatctacatacctctgatcggatttctgctgtccatcccgcgactcccatccatggtggaagcgtcagactttgaaatcaatggtttagactttatgtttctcagcgaggaaaagctccattatcgatccgccagaacgaaggagctagatgcacttctcggggacctgcactgcgagattagagaccaggagaccttactgatgtaccagctgcagtgccaggtactggcgagagccgctgtcctgactcgcgtccttgacctggccagtcggctcgacgtgctcctcgccctagcaagtgcggctagagattacgggtatagccgacctcggtattcgccccaggtactgggcgtcaggatccaaaacggacggcatcccctgatggagctttgcgccagaacattcgttcccaacagcactgagtgtgggggtgacaaaggacgcgtcaaggtgattacggggccaaacagctcaggtaagagcatctaccttaaacaggtagggttgataacgtttatggcactagttgggagctttgtgcccgctgaggaggctgaaattggagccgtggatgccatttttacgcgcatccacagctgcgagagcatctcactcgggctgagcaccttcatgatcgacttgaaccagcaggtcgccaaggccgtgaataacgcaaccgctcaaagtctagtcttgattgacgaattcgggaagggaacaaacactgttgatggactcgcactcctagctgccgtcctgcgacactggttagctcgaggcccaacatgcccacatatttttgtagcaacgaatttcttgtccctcgtgcagctccagctgctccctcaaggtcctctagttcagtatctgacaatggaaacctgcgaggacgggaacgacttagttttcttctatcaggtgtcggaccttattcgcagcggcaagcccatcaagccagtgaaggacttgctaaagaagaatcagatggagaactgccagaccctggtggataagttcatgaaattggaccttgaggaccccaacctggacttgaacgtattcatgtctcaagaggtacttcctgccgcaacctccatactttag

SEQ ID NO: 57694 - DNA, 198 bp, Artificial Sequence
  Description of Artificial Sequence: Synthetic coding sequence
accgcccagagcctggtgctgatcgacgaattcggcaagggcacaaacaccgtggatggattggctttgcttgccgctgtattaagacactggctggcacggggacctacatgcccacatatcttcgtcgcaacaaacttcctgtctttagtccaattacagctcctcccccaggggccactcgtccagtacctctag

SEQ ID NO: 57695 - DNA, 348 bp, Artificial Sequence
  Description of Artificial Sequence: Synthetic coding sequence
attgcgcaggaatttagtgatgacctccaccacatcgcatcactgattggaaaggtggtcgatttcgaaggctctctggctgaaaaccgttttacagtgctccccaacattgatccagaaatcgatgaaaagaaacggaggctaatggggttaccaagctttcttacagaagtggctcggaaggagctggaaaatctcgattcccgaatccctagctgctctgtaatatacatcccgctgatagggttccttctgagcatccctcgcctgccttcaatggtggaggctagcgatttcgagataaacggcctcgacttcatggtccggccttctacctctgtccgttag

SEQ ID NO: 57696 - DNA, 1491 bp, Artificial Sequence
  Description of Artificial Sequence: Synthetic coding sequence
acggtgtacagtgccctgggtctgagggacgcatgccgctctttaccccaatccatccagctgttcagggatatcgcacaagagttcagtgatgatcttcaccacattgcttctttgattggcaaagtggtggattttgagggcagtctggccgaaaatcggtttactgttctgcctaacatcgacccggagattgacgaaaaaaagcgtcgtctaatggggttgccatcctttctgactgaggtggcccgtaaggagctcgagaatctagactcaaggatcccaagttgtagcgtaatttatatccccctgattggctttttattgagtattcctcgactacctagcatggtcgaagcatctgactttgagattaacggcctggactttatgtttctgagcgaagagaagttacattatagatcggctagaactaaggagctcgatgccctcctgggcgatctgcactgcgagatacgcgatcaggagacccttcttatgtaccaacttcagtgtcaggtcttagctcgagctgcagtccttacgagagtgctagaccttgctagcaggctggatgtcctcttagcattagcttcggcagccagagattatgggtatagtcggccaagatactccccgcaggtgctgggagtgcgaatacagaacggacggcacccactcatggaactatgtgcccgtacctttgtgcctaatagcaccgagtgcgggggtgacaagggccgtgtgaaagtgataaccggtccaaatagctctggaaagtctatctacctgaaacaggtggggctgataacttttatggcgctggtcggatcgttcgttcccgctgaggaggctgaaatcggcgctgtggatgcgatatttaccaggatccatagctgcgaaagcatcagcttaggcttgtcaaccttcatgatagacttgaatcaggtcgctaaagcagtcaataacgccacagctcagagtctcgtgctcatcgatgagtttggtaaaggcactaatacagtggacggcttagccctgttggcggcagtcttgcgtcattggctagcacgtggaccgacttgcccacacatttttgtcgcaacgaactttttgtcgctggttcaattgcagctgctcccccagggtcctctggtccagtacctgacaatggaaacatgtgaggatggtaacgacctggtatttttttaccaagtatgcgaaggcgttgctaaagccagtcatgcatcccatactgccgctcaggcagggctacccgataaattggtagctcgagggaaggaagtgagtgacctgatacgctcaggcaagcctattaagccagttaaagatttactcaagaaaaatcagatggaaaattgccagactcttgttgataagttcatgaagcttgatctggaagatcccaacctggaccttaacgtgttcatgtctcaggaagttttacctgccgcaactagtattttgtag

SEQ ID NO: 57697 - DNA, 477 bp, Artificial Sequence
  Description of Artificial Sequence: Synthetic coding sequence
catgagagccttaaattgctgcagagggtgctggatgagataaaccctcagtcggtagtcacaagtgcaaagcaggacgagaacatgaccagatttctgggaaaactcgccagtcaagaacatagagagccgaagaggcctgaaatcatttttctcccttccgtggactttggcctcgagatatccaaacaacgccttttaagtgggaactactcttttatcccggatgctatgacagccactgagaagatattattcctctcttctatcattcccttcgactgcttgctgaccatcccctcacaggtgcgcgctttgggcggactcttgaagttcctgggaaggagacgaatcggggtggagctcgaagattataacgtttcggtgcctatcttagggtttaaaaaatttatgctgactcatctcgttaacatcgatcaagatacttaccgcaatcctcagcaaatgccattgtag

SEQ ID NO: 57698 - DNA, 477 bp, Artificial Sequence
  Description of Artificial Sequence: Synthetic coding sequence
accgtctatagcgccctgggcctcagggacgcctgtagaagtttgccccagtccatccagctgtttcgggatatcgcccaggagttcagcgacgacctgcaccatattgccagcctgataggtaaagtctacctctctcctcaggttgacttcgagggctcactggctgagaatcgatttaccgttttacccaatatcgatcctgagatcgacgagaaaaaaaggcggctgatgggactcccatctttcctcaccgaggtggccaggaaggagctggaaaatctggattcaagaattcccagctgctcagtcatttacatccctttaattggcttcctcctctccatccccagactgcctagcatggtcgaggccagcgattttgaaattaacggactggattttatgtttctgtcagaggaaaagttgcattaccgcagcgctagaactaaagagttagatgccttgttgggatag

SEQ ID NO: 57699 - DNA, 2238 bp, Artificial Sequence
  Description of Artificial Sequence: Synthetic coding sequence
atggcgagcctgggagcaaaccccagacgcacaccccaaggaccccgaccaggagctgccagttctggcttcccctcccccgcacccgtgccaggcccaagagaagctgaggaggaagaagttgaggaggaagaggaactcgcagagatccatctgtgtgtcctctggaactcggggtacctcggcatcgcctattatgacacgagtgattctaccatacattttatgccagatgcaccagatcatgagtcactcaaattgcttcagagagtcctcgacgagattaacccccagtccgtagtgacatcagcaaaacaggatgagaacatgacccgtttcctggggaagcttgcctctcaggaacaccgggaaccaaaaagacctgaaatcattttcctgccgtccgtggatttcggactagagatttctaagcagaggctgctatcaggcaattacagcttcatcccggatgctatgactgcaacggaaaagatcctatttctgtcttctatcatcccattcgattgcctgctgaccccccctggtgatttacggttcactccaattcccctgttaattccctcccaggtgagagcactcggtgggcttttgaaattcctcggcagacgccgaattggcgtcgagctggaggactacaatgtctctgtgcccattctgggatttaaaaaatttatgttgacgcatctcgttaacatagatcaggatacctactctgtcctacagattttcaaaagtgaatctcacccttccgtatataaggttgccagtggcctgaaggagggactgagcctcttcggaatcctgaatcgttgtcattgtaagtggggtgagaaattgctgagactgtggtttaccaggcccacccatgatctgggtgaattgtcgtcccgcctggatgtgattcagtttttcctgttgcctcagaatctggatatggctcagatgctgcaccggctcctagggcacatcaaaaacgtgccactcatccttaagaggatgaaactgagtcacacaaaagtaagcgactggcaggtcctgtataaaaccgtatatagcgctttgggtctccgcgacgcttgtcggagcctgccgcagtccatacagcttttccgcgacattgcccaggagttctccgatgacttgcatcacatcgcgtcgctaatagggaaagtcgtagattttgagggaagccttgccgaaaaccgctttactgtgctgcctaacatcgaccccgaaattgatgaaaaaaaaagacgacttatgggtctgccgagctttctcactgaggtagctcgcaaggaactggaaaacctggacagccgcattccctcttgctcagtaatttatatacctctcatcggctttcttctgtccattccacgactgcccagcatggtagaagcttctgacttcgaaattaacggcctggattttatgtttctgagcgaagagaaactgcattaccggtctgctagaacaaaggagttggatgcacttctcggcgatctgcattgcgagatccgggaccaagagacactgctgatgtaccagcttcaatgccaggttctggctagggccgctgtgctaactcgcgttctagatctggcaagcagactggatgtgctgttggcgttggctagcgcagctcgcgactacgggtattcacggccaagatactccccgcaggtcttgggggtgaggatccaaaacggccgacatccactcatggaattgtgcgctcggacattcgtgcccaacagtacagaatgcggaggggacaaaggacgggtcaaggtgatcaccggaccgaattctagtgggaagagtatctacctgaaacaggtgggactcattacgttcatggctctggttggcagcttcgtccctgccgaggaggcagaaataggagccgtcgatgccatttttactcggatccatagttgtgaatcgatctccttaggcttgagtactttcatgatcgatctgaatcagcaagtagctaaggctgtcaataacgcaaccgcccagagcttggtgctgatcgacgaattcggcaaaggtacaaacacagtcgatggcctggctctgcttgcagccgtgctccgacattggcttgctagaggacccacctgccctcacatctttgtggccaccaacttccttagcctggtccagctgcagcttctgcctcaggggccactggtacagtacctctag

SEQ ID NO: 57700 - DNA, 2184 bp, Artificial Sequence
  Description of Artificial Sequence: Synthetic coding sequence
atggcctctctgggggcaaatccgcgtaggactccacaaggacctcggccaggagcggcttcgtcaggatttccaagccctgccccagtacccggtccaagagaagccgaggaagaagaggtggaagaggaagaggaactcgctgagatccacctttgtgtgctgtggaacagcgggtacctgggtatcgcctactatgacacctccgactccactatccactttatgcctgatgcaccagatcatgagagtctgaagttattgcagagagtccttgatgagatcaatccccagtcagtggtgacatccgctaagcaggatgagaacatgacccgattcctagggaagttagcctcacaggaacaccgcgaacctaagagaccggagatcattttcctgcccagcgtcgactttggcctggagataagcaagcagcggctgctctccggaaattacagctttatccccgacgcaatgactgcaacagagaagattctgttcctgtcaagcattattccctttgattgccttctgactgtgcgcgctctcgggggactgctcaagttcctaggaaggcgcaggatcggcgtggaactcgaggattataacgtctcggtcccaattcttggctttaagaaatttatgctgacacatctggtgaacattgatcaagacacatatagcgttctccaaatttttaagtcagaatcccacccaagtgtgtacaaagttgcctccggacttaaggaggggctcagcttatttggaatcctaaaccggtgccattgtaagtggggtgagaagctgctcagactttggttcactagacctacgcatgatctgggagagctgagctcaaggctggacgtgattcagttttttcttttaccgcagaacttggacatggctcaaatgttacaccgcctgctcggacacatcaaaaatgtgccactgattctgaagcggatgaagctgtcccatactaaggtgtctgactggcaggtgctctacaagactgtctatagtgccttagggttgagagatgcttgcagatctctgccacagagtatccagctgtttcgcgatatcgctcaggaattctccgatgacctgcatcacatcgcttctctcatcggcaaagtggttgatttcgaaggcagtttggcagagaacaggtttaccgtgctcccaaatatagacccagagatcgatgagaagaagaggagactgatgggtctcccttcctttctgaccgaggttgcacggaaggagctggaaaacctggacagcaggattcccagctgctcagtgatatatattcctttgattggcttccttctgagcatccccaggctgccaagcatggtagaggcttccgatttcgaaatcaacggactcgactttatgtttttgagtgaagagaagcttcattaccgtagtgccagaacaaaggagctggacgcactactgggagacctgcattgcgagatccgggatcaggagacactgctgatgtatcaacttcaatgtcaggtgcttgcacgtgctgccgttctaacccgagtgctcgacctggcctccagactggatgtgctgttggccttagcttctgccgctagggattacgggtattctcggcctcggtattccccccaagtgctcggcgtccgtatccagaacggacgtcaccctctgatggaactgtgtgctagaacctttgtacccaacagtacagagtgtggaggggacaaagggagagttaaggtgatcacaggtcccaattccagcggcaaatcgatttacctgaagcaggtcggactcatcaccttcatggcactggtaggtagcttcgtccctgccgaggaggccgagattggcgctgtcgatgctattttcactagaattcacagctgcgaatctatttcactggggctttccaccttcatgattgacctgaatcaggtggccaaagctgtcaataatgcgacagcgcagagcctggtcttaatcgacgaattcggaaagggcaccaataccgtcgacggcctcgcgttgctggccgctgtgctgcggcattggctggccagaggacccacttgcccccatatcttcgtggctaccaacttcctgtccctggtgcagctgcagttgttgccgcagggtcctctggtgcaatacctttag

SEQ ID NO: 57701 - DNA, 1401 bp, Artificial Sequence
  Description of Artificial Sequence: Synthetic coding sequence
actgtgtacagtgccctcggattacgagacgcctgccggtcccttcctcagagcatccaactgtttagggacatcgcgcaggagttcagcgacgatctccaccatatagctagccttatcggaaaagtagtcgatttcgaagggagcctggctgaaaaccggttcactgtgttaccaaacatcgatcccgagatcgacgagaagaagcgacgtttgatggggttaccatctttcttaacagaggtggctcgtaaagagcttgagaacctcgactctcgcataccttcctgctccgttatctatatccccctcatcggcttcctgcttagcattcctcgattgcctagcatggtggaggcttcggatttcgaaatcaacggcctggatttcatgtttcttagcgaagagaaactccattatagaagtgctaggaccaaagaactcgatgcgctgctcggagacctccattgtgaaatccgggaccaggagaccctgttaatgtatcagcttcaatgccaagtcttggccagagccgctgttctcaccagagtgctggacctagctagccggctcgatgtgttactggcactggcctctgccgcacgcgactacgggtattccagacctcggtactccccccaggttctaggggtgagaatccagaacggccgacatccactcatggagctgtgcgcacgcacctttgtgcccaattcaacagaatgtggcggagataaagggagagttaaagtcatcacaggtcctaactctagtggaaaaagtatctacctcaagcaagtaggtctgatcaccttcatggccctcgtgggcagtttcgtgcccgcagaagaggccgaaattggggctgtcgatgctatttttacaaggatccacagctgcgagtcaattagtcttggtctgagcacatttatgatcgatttgaaccaggttgccaaagccgttaataatgcaactgcccagtctctagtgctgattgatgaattcggaaagggcaccaatacagtcgatggattggctctgctcgctgccgtgctgagacattggcttgcacgcggaccaacctgtcctcacatatttgtcgcaaccaatttcctctccttagtgcaactccagctcttaccgcaagggcctcttgttcagtacctgaccatggaaacctgcgaggacggcaacgatctcgttttcttctaccaggtcagcgacctaatccgttccgggaagccaatcaagccagtgaaggacctgctgaaaaaaaaccagatggaaaattgtcagacactggttgacaagttcatgaagttggacctggaggacccaaacttggatctgaatgtgttcatgtcacaggaggttctccccgctgcgaccagcattctgtag

SEQ ID NO: 57702 - DNA, 765 bp, Artificial Sequence
  Description of Artificial Sequence: Synthetic coding sequence
atggcgtcattgggcgctaatcctaggagaacaccgcaggggccaaggccaggcgcagcctcctctggctttccctcccctgcgcctgtacccggaccaagagaagcagaggaggaggaagtggaagaggaagaagagttggccgagatccacctgtgcgtgttgtggaattctggatatcttggcattgcctattatgacacatccgattctacaatacacttcatgccagacgcacctgatcacgagagtctgaaactgctccagagagtgctcgatgagataaatccccaaagcgtagtcacgagcgcaaaacaggatgaaaatatgacccgattcttaggtaagctggcaagccaggagcatcgcgaacccaaacggccagagatcatttttctcccatcagtggattttggccttgaaatctccaaacagcgcctcctgtctgggaattatagtttcatccccgatgctatgacagccactgagaagatcttgtttttgtcctccattatcccattcgactgcctcctgacggtccgggcactaggaggcctactcaaatttttaggccgtagacgtatcggcgttgagttagaggattacaacgtttccgtgcccatcctgggcttcaagaagttcatgctgacccacttagtgaacattgaccaggacacatatagactggaatgcaacggcgctatcagcgctcagtgcaatttgtgtcttttgggaagtagtgactcacccgcatcagcaagctag

SEQ ID NO: 57703 - DNA, 792 bp, Artificial Sequence
  Description of Artificial Sequence: Synthetic coding sequence
cattacagatcagctaggactaaggagttggacgcactgctgggagacttacattgtgaaatccgcgaccaggagactctgctgatgtaccagcttcagtgtcaggtgcttgctcgcgcagctgtgctcacacgagtcctggacctggcctctagattggacgtactcctcgcgcttgcatccgccgcacgcgattatgggtacagccgtccaagatacagtccacaggttttaggcgtgaggattcagaatggaagacacccgctcatggagctgtgcgccaggacctttgttccaaactcgaccgaatgtggcggtgacaagggtcgggtgaaggtcataaccggtcctaattcatctggcaaatccatatacctgaagcaagtgggcctcatcaccttcatggctcttgttggaagctttgtaccagccgaagaggcagagatcggagcagtggatgctattttcacaaggatccattcgtgtgagtcaatctccctcggactgtccactttcatgatcgacttaaaccaggttgctaaggctgtgaacaatgcaacggcgcaatcccttgtcctgatcgacgagttcggcaaaggcacaaatactgttgacgggttggcactgcttgcagcggtgcttagacactggttagctcggggacctacatgcccccacatcttcgtcgccaccaactttctatctctggttcaactgcagctgctgcctcaagggcctctcgtccaatatttggactggccacgagtttccggccaagaagggggagattag

SEQ ID NO: 57704 - DNA, 480 bp, Artificial Sequence
  Description of Artificial Sequence: Synthetic coding sequence
atgcaaaacaatgagattatcaagcctgctaagtacttttctgagctggagaaatcaatactgctagctctggtagagaaatacaaatacgtcctcgagtgcaagaagagcgatgctcgtacaattgccttgaaacagcgcacgtggcaggctctggcacacgagtacaactcacaaccttctgtttcactgagagatttcaaacagctgaaaaagtgttgggaaaacatcaaggctcgaaccaaaaaaataatggcacatgaacgaagggaaaaggtaaaaaggtccgtcagtccattattaagcacacatgtgctcggcaaagagaaaatcgcttcgatgctacccgaacaactatacttcttacaatcgcctcccgaggaagaaccggaataccatcccgacgccagtgcacaagttttttttcaggagcgtaagcgctctctggagctcagcattattctgtctggcacatggtag

SEQ ID NO: 57705 - DNA, 924 bp, Artificial Sequence
  Description of Artificial Sequence: Synthetic coding sequence
atgggctcgactatggaaccccctggaggcgcttacctgcacctgggagcagtgacatcacccgtgggaaccgctcgcgtgctgcaattagcatttggatgcactaccttctctctggtcgcccaccgcggtgggttcgcgggtgtacagggtaccttctgtatggcagcttgggggttctgctttgctgtgagcgcccttgttgtggcatgcgagtttacgcggcttcacggctgcctgcggctcagctgggggaactttaccgcagcgttcgccatgttagcaacgctcctgtgtgccaccgctgccgtcctgtatccactctatttcgccagacgtgagtgctctcccgaacccgcaggttgtgctgcaagagacttccgcttggccgcttcggtgttcgcaggactcctgttccttgcttacgccgtggaggtggccctgactagggctcgtccgggtcaagtgagctcatacatggcgacagtgtccggcctgcttaagatcgtgcaggcgttcgtcgcctgtatcattttcggagcgttggtacacgacagccgctacggacggtatgtcgctacccagtggtgtgtagctgtctactcactgtgctttcttgccaccgttgccgtggtggcactgagcgttatggggcacaccggcggtctcggctgtccgttcgacagactcgtggtggtgtacacatttctggctgtcttactctacctctccgcagcagtcatatggcctgttttctgttttgatccaaagtatggagaacccaaacgaccaccaaactgcgccagaggaagctgcccgtgggattctcagctggttgtggcaatttttacttatgtaaatctgttgttgtacgtcgtggacttagcttacagccagagaatccgatttgtgccaagtctgtag

SEQ ID NO: 57706 - DNA, 924 bp, Artificial Sequence
  Description of Artificial Sequence: Synthetic coding sequence
atggggtcgactatggaaccacccggaggcgcatatctccacttgggcgcagtcacttcaccagtaggtaccgcacgggttcttcagctcgccttcgggtgcaccacattctcattggtcgcacaccggggtgggtttgctggagtccagggcaccttctgtatggccgcttggggattctgtttcgcagtgtccgccctggtggtggcttgtgagtttactaggctgcacggctgtctccggctctcatggggcaattttacagccgcattcgctatgctcgccaccttgctctgcgccactgcggcagtgctgtatccactttacttcgcgagacgcgagtgctcgcccgagccagccggttgcgcagccagagacttcaggctggccgctagcgtctttgcgggtctcctgtttcttgcctatgccgtggaggttgccctgacaagagccaggccgggacaagtgtccagctacatggctacagttagtggtctgttgaaaattgtccaggcttttgtggcctgcatcatctttggggctctggtgcacgactctcgctatgggagatacgtagctacacagtggtgcgtggccgtgtactccctgtgttttctggccactgtcgccgtggtggctctgagcgtgatggggcataccggagggttggggtgtcccttcgacaggctggtcgtcgtgtacactttcctggcagtgttgctgtatcttagcgccgctgtcatttggccggtcttctgtttcgatcctaaatatggtgagcctaaaaggccaccgaactgcgccaggggttcctgtccatgggatagccagcttgtggtagccatattcacctacgtaaatctactgctctatgtagtagatttagcctattcacagcgcattagatttgtgccctcattgtag

SEQ ID NO: 57707 - DNA, 759 bp, Artificial Sequence
  Description of Artificial Sequence: Synthetic coding sequence
atgtggagagcacccgaagcagcacttaggccagaggtgtccttggagagacggggtccagaaatgaagcctgcggtcgatgaaatgtttcccgagggggcaggaccctacgtggacttggatgaggtggctagggcacgtcgggagagcccttctgccggtggctccacaggcctactaatggaccttgcagccaacgagaaggctgtccacgcagacttctttaacgactttgaggacttgttcgatgatgatgatatccattcatccgggttgccacgcacatcacagcagagctctatggtccctgccctgcagcggggtcaatccgaacacggggtacggggaaaagctgccgagcggccagtggtctccgaggaaagatgcgagctgaatgggagggaggtcgcggcactggacagggcattcgggtctaccggtcacggacagggcgctgaggcacttatgttcacaagatgtcgcgagcacccactctgcggaaccaacaaagccacatcggaggggaaaatgggtacgggaaggttgagaaattcattacgaaagaaccaatcaaagtggctgggcagctacctggaggtgctcaggactaccaggtctcggagagaagtcagcgaagatagtacaattagtgtctctactcattggaggggaaagtgtttcaaaagtgatgaaaccccaagcgtagcaggcggagaagaagggaaaaagaccactcaaccgtgcattgacgtgcggtag

SEQ ID NO: 57708 - DNA, 237 bp, Artificial Sequence
  Description of Artificial Sequence: Synthetic coding sequence
atgtggagggctcccgaggctgcactccggcctgaggtgtctctggagaggcggggaccagagatgaaaccagcggtggatgaaatgtttcccgaaggcgctggcccttacgttgacctggatgaggctgggggttctactggtctgctcatggatctcgcagctaatgagaaggcagtccacgcagacttctttaacgacttcgaagatctgttcgacgatgatgatatccagtag

SEQ ID NO: 57709 - DNA, 3645 bp, Artificial Sequence
  Description of Artificial Sequence: Synthetic coding sequence
atgacattacctcacagtctcgggggtgcaggcgacccccgtccacctcaggccatggaggtgcatagactggaacatcggcaagaggaagagcagaaagaagaaaggcaacatagcctgcgaatggggagttctgtcaggcggagaacgtttcggtcttccgaggaagagcatgagttctccgcagctgattacgccctggccgcagctctggccctcactgcatctagtgaactgagctgggaggcacaactaagaagacagactagcgctgtggaacttgaagagcgcggtcagaaaagggtgggctttgggaacgattgggagcgtacagagatcgcgttcctgcaaactcatcgactactcaggcagcgaagagattggaaaacactgcggagacgcacggaggaaaaagttcaagaagccaaggaattgagggagctgtgctatggtcgcggaccatggttctggattcctctgcggtcacatgcagtgtgggaacatactacagtactgctgacatgcacggtacaggcctctccccctcctcaggtgacatggtataagaacgacacccgaatcgatcccagactcttcagggccggaaagtataggatcacaaataattatgggctgctgagcctggagatccgacggtgcgctattgaggactctgctacatacaccgttcgggtgaaaaacgcacatgggcaggcttcttccttcgcgaaggtgctagttcgcacctatttaggcaaagacgcgggattcgattccgaaatcttcaagcgctctacctttggcccttcagtggaatttaccagcgtgctgaagcctgtcttcgcacgcgaaaaggagcccttcagcctatcttgccttttttcagaagacgtgctggacgccgagtctatccagtggtttagagacgggtccctgctcagatcttctagacgtagaaagatcctgtacacagatcgccaggcttccctgaaagtctcatgcacctacaaagaggatgagggcctctatatggtccgcgtgccctccccctttggccctcgggaacagagcacttacgtgctagttcgggacgcagaagccgaaaatcctggcgctccagggagccctctaaacgtaaggtgtctcgacgtgaatcgtgattgtttgatactgacctgggcaccaccttccgacacgagaggaaaccctatcactgcctatacaatcgaacgctgtcagggggagtcaggcgagtggatcgcatgtcatgaggcaccgggaggaacatgtaggtgtccaattcaggggctggtggagggccagagctacagattccgcgtgcgcgcaatcagtagagtagggagctctgtcccctctaaagcctctgaactggtcgtgatgggtgaccacgatgctgcacgacgcaagacggaaattccttttgacttaggtaataaaatcactatttcgacggacgcgtttgaggacaccgtgaccataccttccccgccaactaacgtccacgcctcagaaatccgggaagcgtatgtggtgctcgcgtgggaggaaccaagcccacgcgaccgagcaccactcacttattctctcgagaagagcgtcattggtagcgggacgtgggaggctatctccagtgaatctcctgtaagatctcctagattcgcggttctggacctggaaaagaaaaagtcatacgtgtttagagttagggccatgaaccagtacggcctgtcagacccttcagagcccagcgagcctattgctctgagaggacctccagccacactgccaccaccagctcaggttcaggctttccgcgatactcaaacatccgtttcgttgacctgggaccctgtgaaggaccccgagcttctcgggtactatatttactcacggaaggtggggacctcggagtggcagacggtcaataacaagcccatccaggggacgcgcttcaccgttcccggactgagaaccggcaaagaatacgaattttgcgtgaggtcagtgagcgaggctggcgttggggaaagtagcgctgctaccgagcctatcagagttaaacaggctctagcgactccttcagctccgtatggttttgctctgctgaattgcggcaaaaacgaaatggtgatcggatggaagccccctaagaggcggggaggcggaaagatcctagggtatttccttgaccagcatgattccgaggagcttgattggcatgctgttaaccagcaaccaattccaacccgcgtctgtaaggtctcggacctccatgagggccatttctatgagttccgcgctcgagccgcaaattgggcaggtgtgggcgagttatctgcgccttcgtccctgtttgaatgcaaagagtggactatgccccagcctggccctccctatgacgtgagagctagtgaagtgagagccacctcgctggtactgcaatgggagcctcccttgtacatgggagccggtcctgtgacaggctaccacgttagcttccaggaggaagggagcgagcaatggaaacctgtgacacctggacccatatcgggtacccacctcagagtgtccgatctgcagccagggaaatcctacgtgttccaggtacaagctatgaattctgccggactaggccagccaagcatgcccacggaccccgtgctcctcgaagacaaacccggagcccacgagatcgaggtcggcgtcgatgaggaagggtttatttatctcgcatttgaagctccagaggcacctgactctagcgaatttcaatggtctaaggattataagggcccattggatccacagcgcgtgaaaattgaggacaaggttaacaagtcaaaagtgatcctaaaggagccaggccttgaagacctgggcacctactccgtgattgtgacggatgccgacgaagatatctcagcttctcacacactcacggaggaagagctcgagaagctgaagaagctatcccacgagatccgaaaccctgtgataaaactaatcagcgggtggaacattgacatactggagcgcggagaggtccgcctgtggctcgaagtggaaaagttgagccccgcagccgagttacacctcatctttaataacaaagagatattttcatctccaaaccgcaagataaattttgatcgagagaagggtctggtagaagtcatcatacaaaatctgagcgaggaagacaagggcagttacaccgcccagttacaggatgggaaagcaaaaaatcagatcacactcacgctggtggacgacgacttcgacaagttgctcaggaaggccgacgctaaacgccgtgattggaaacggaagcagggaccctatttcgagcggcctctgcagtggaaggttaccgaggattgccaagtccagctcacctgcaaagctagcgtgaccaatactaaaaaggaaacacgttttcagtggttttttcagagggcagaaatgccggacgggcagtacgaccccgaaactggcacaggcctgctgtgcatcgaagaagcatctgtggctcctgcatcaggcctaacctttagttttggctgcaagcctggccgagcaaaatcctctggtctgggagtgcgtgccggacctcgattgggatag

SEQ ID NO: 57710 - DNA, 4323 bp, Artificial Sequence
  Description of Artificial Sequence: Synthetic coding sequence
atgaccttacctcatagcctgggtggtgctggcgaccctaggcctccacaggcgatggaggtccaccgccttgaacatagacaggaagaggaacaaaaagaggagcgacagcacagcttaaggatggggagcagcgtgaggaggcgaacatttagaagcagctcggaggaagaacatgaattctcagccgcagattatgccttagccgcagcccttgcacttaccgctagtagcgagctcagctgggaggcacagctgcgacgtcagacctctgccgtggaactcgaagagaggggccagaagagggtcggttttggaaatgactgggaacgcaccgagatagccttcttacagacccacaggttgctccgacagcgcagggactggaaaaccctgcgccgacggactgaggagaaggtgcaggaggctaaagagctccgagagctttgctacggcaggggcccttggttctggatacccctgagatcgcacgccgtgtgggagcacactaccgtccttctaacttgtacagtgcaggcgagtcccccaccccaggttacttggtacaagaatgacacacgcatcgatccccgactcttccgggctggaaaatacaggatcaccaataattatggcttactcagtctggagatacgacggtgtgccatagaggactcagccacctataccgtacgcgtgaaaaacgcccatgggcaggcctcaagcttcgcaaaagtattagtgagaacgtacttggggaaggacgctggtttcgatagcgaaatctttaagcgaagcacatttggcccttctgtcgaattcactagtgtgctcaaacctgtttttgctagagaaaaggaaccattttcactcagttgcctgttcagcgaggacgtgctcgatgccgaaagcatccaatggtttcgagacggaagcctgctccgcagttcccggcgacggaagatcctgtatacagacagacaggcatctttgaaggttagttgcacctacaaggaggacgagggtttgtatatggtgcgagttccttctccattcggcccacgagagcagtccacttacgtgttggtaagagacgccgaggctgagaatccgggagcaccgggttcgcccctgaacgtgcggtgtctcgacgtgaatagagattgtctgatcctgacttgggccccacccagtgacaccagaggtaacccaatcacagcttataccatcgagaggtgtcagggcgagtccggcgagtggatcgcgtgccatgaggcccctggaggaacttgtagatgcccaattcagggcctagtggaaggccaatcttataggtttagagttagggcgatatctagggtgggctcctctgttcccagcaaagcctcagaactcgtggttatgggcgaccacgatgcggctagaagaaagacagagataccatttgatctggggaataagattaccatctcaactgacgccttcgaggatacagtcacaatccctagcccccctacaaacgtgcacgccagcgaaatccgggaggcctacgttgtgctggcctgggaggaaccttcccctcgcgatcgtgcaccacttacttacagcctggagaaatcagtgattggcagcggtacatgggaggccattagctccgagagtcccgtgcgatccccacgattcgccgtgctcgacttggagaagaaaaaatcttacgtgtttcgcgttcgagccatgaatcaatatggcctgtcagatcccagtgagccttcagaacccatcgccctccgcggaccaccggcaacgctgccccctcctgcccaagtgcaagcgttcagggatacacagacttctgtgtctttgacctgggacccagtgaaagaccccgagttgctcggctactacatttactcacgaaaagtgggcaccagcgaatggcaaaccgtaaacaataagcccatacagggaacccgattcactgttcccggactaaggacaggaaaggagtatgagttctgtgtgagatctgtgagcgaggccggagtaggtgaaagctccgccgcaacagaacccatccgggtcaagcaagctctggcgacaccttcagctccctacggttttgccctgctgaactgcgggaaaaacgaaatggtgatcggatggaagcctcccaagaggagaggcggaggaaaaattcttgggtacttccttgaccaacacgattctgaagagctcgactggcatgcagtgaaccaacaacccattccaacccgggtgtgtaaagtgtctgaccttcacgagggacatttttacgaattccgagcacgggcagctaattgggccggagtgggggaactgtctgctccctcttctctgttcgagtgcaaggagtggactatgccccagcctgggcctccctacgacgtgcgcgcttccgaggtcagagccacatcactggtcctccagtgggaacctcccctttacatgggcgctggcccagtgactggttaccacgtttcattccaggaggagggatctgagcagtggaaaccagtcaccccgggacctataagtggcacccacttgcgcgtgtctgacttacaacctggaaagagctatgtgttccaggtgcaggctatgaacagtgccggtctcgggcagccctccatgcctacagacccagtactgctggaagataaaccaggcgctcacgaaatcgaggtgggggtggatgaggagggcttcatctatctagcctttgaggcgcctgaggctcctgattccagcgaattccagtggtccaaggattacaaaggccctctcgatccacagcgagtcaaaatcgaggacaaagtcaataaatctaaggtcattcttaaggaaccaggtctcgaggacctcggaacttactccgtgatcgtgacagatgctgacgaagatatcagcgcgtctcatacgctgaccgaggaagagctggaaaagctgaagaagctcagccatgagatccgcaaccccgtgatcaagcttatctcagggtggaacattgacattctcgaaagaggcgaggtgcggttgtggctcgaggttgagaagctctcccccgcagccgaactgcacctgatctttaataacaaagagatcttctcaagtcctaataggaagatcaacttcgaccgggagaaaggcctagtggaggttattatacagaacctgtctgaagaggataagggctcctatacggcacagctccaagacggtaaagcgaagaatcaaattacacttacactcgtggatgatgattttgacaaactcctcaggaaggccgacgcgaagcgaagagactggaagagaaagcagggcacgggaccatactttgaacggccactgcagtggaaagtgaccgaagactgtcaggtgcagctgacttgtaaggtgactaacacaaaaaaagagaccagattccaatggtttttccagagggcagagatgcctgacggacaatacgaccccgaaacaggcacagggctgctgtgtatagaggaactgagcaagaaagataaaggtatttatagagcaatggtgagcgacgacaggggagaagatgacacaatccttgatctaaccggcgatgctctggacgcaatttttactgagctgggcaggattggcgcattgagcgccaccccacttaaaattcaaggcaccgaagagggcataaggattttttcaaaggtcaaatactataacgtagagtacatgaaaacaacctggttccacaaagataagcgattggaaagcggggatagaatcaggacaggtactaccctggatgagatctggctacacatcttagatccaaaagacagcgataagggcaagtacaccttggagatcgccgctggaaaggaggtacgccagctgagcacagacctatcagggcaagccttcgaggacgccatggcagaacaccagcgcctgaaaacactagcgataatcgagaaaaaccgcgcaaaggtggttcgcggattacccgatgtggctacaatcatggaagataaaaccctctgccttacatgcatcgtgtccggggaccccactcctgagatctcatggctgaaaaatgaccagcccgtcacgttccttgaccgctacaggatggaggtcagaggaacggaggttaccattactatcgagaaggtgaactctgaggacagtggccgatacggggtgttcgtgaaaaacaagtacggcagcgaaaccgggcaggtgaccatatctgtgtttaaacatggagatgagcccaaagagctgaaatctatgtag

SEQ ID NO: 57711 - DNA, 993 bp, Artificial Sequence
  Description of Artificial Sequence: Synthetic coding sequence
atggatatttcaaaaaagaaccgcgtgcgacagggttccagggggcgaggcaagactatttcaaagaactccgaaagtagaggccagcaaaggcgccatatggttacaaataccaaaaaggaaaccaggttccagtggttctttcagagggccgaaatgcccgacggtcaatacgatcctgagacagggaccggtttactctgtatcgaagagctctctaaaaaggataagggaatttaccgcgctatggtgtccgacgaccgcggagaagatgatacaatcctggaccttactggcgatgcgctggacgccatctttactgaacttggtcgcatcggcgctttgtctgccacacccctgaagattcagggtaccgaagagggaatccgcatattctctaaggtcaaatactacaacgtcgagtatatgaagactacctggtttcacaaggataagcgccttgaatcaggcgaccgaattaggactggtaccaccttggacgagatctggcttcacatcttggacccaaaggattcggataaaggaaaatatactctcgaaattgccgcaggaaaggaagttagacagctgtctactgacctgtctggacaggcttttgaggacgccatggccgaacatcagcggctgaaaaccctggctatcatagagaagaaccgggctaaagtagtgaggggcctgcctgatgtggcaacgataatggaagacaaaaccttgtgtctaacttgcatcgtatctggcgaccccacacccgagatcagttggttaaaaaacgatcagcccgttacttttttggatcggtaccgcatggaagtgcggggaacggaagtgactattaccatcgaaaaggtgaactccgaggacagcgggagatacggcgtgttcgtgaagaacaaatatgggtctgaaactggccaggttaccatctccgtgttcaagcacggcgatgagcctaaggagctgaagagtatgtag

SEQ ID NO: 57712 - DNA, 4314 bp, Artificial Sequence
  Description of Artificial Sequence: Synthetic coding sequence
atgacgcttccccatagcctggggggagccggagaccctcggcctccacaggcaatggaagtccatagattggagcaccgccaggaagaggagcagaaggaggaacggcagcattcactgcggatggggtcctcggtgagaagacggacttttaggagttccgaggaagaacatgaattttcagccgcagattatgcgttagccgctgctttagctctgactgcatctagcgagttgagttgggaagctcagctgagacgccagacctccgctgttgaactggaagagaggggacagaagcgggtaggattcggcaatgattgggagagaacagagatcgcatttctacagacgcacaggctcttacgacaaagacgcgactggaaaactttgaggcgcaggacggaggaaaaagtgcaggaagccaaggaactccgtgagctgtgttatggtcgcggtccatggttttggattcctctcaggagccacgccgtttgggagcacacaactgtacttcttacatgcacagtgcaggcatccccccctccccaagttacatggtataaaaatgacacaaggattgacccacgactatttcgcgctggcaaataccggattaccaacaattatggattgctgtcattagagattaggcggtgcgccatcgaagactctgcaacctacacggtgagagttaaaaatgcacatggccaggcctcttcgtttgccaaagtgttggtgcggacttacctcggaaaagatgccggatttgattctgaaatttttaaacgctccactttcggtccctccgtcgagttcacgtccgtgctgaaacctgtgtttgcgagggaaaaggaaccattcagtctgagttgtctcttttccgaggatgtgctcgacgccgaatctatccagtggttccgggatggatcgctgcttagatctagtagaagaagaaaaattctttacacggatcgtcaggcgagcctgaaggtgtcctgtacctacaaggaagacgaggggctttacatggttcgtgttccatccccattcgggcctcgggaacaatcaacctatgtgctggtcagagacgccgaagcagagaacccaggggctccgggaagtcctttgaatgttcgttgcctcgatgtgaatcgggactgtttaatccttacgtgggcacctccaagcgatacacggggtaatcccattaccgcgtacactattgagcggtgccagggcgagtccggagagtggatcgcctgccatgaagctccagggggaacctgccgttgccccattcaggggctagtggagggccaatcgtatagattccgagttagagctatctctcgggtcggcagttccgttccatctaaggctagtgagttggtggtgatgggggaccacgacgcagctcgcaggaagaccgaaataccttttgacttagggaataagatcaccatctccacagacgcctttgaagacactgttactatccctagtcccccaactaatgtccatgccagtgagatcagagaagcctacgtcgtacttgcatgggaagaacctagccctagggatcgagcaccattaacatattcactggagaaatctgtgatcggctccggaacgtgggaagcaattagtagcgaatcccctgtgaggagtcccagatttgctgtcttggatctggagaagaagaaatcctacgtattcagggtgcgagccatgaatcagtacggtctgtccgatccgtctgagccttccgagcccattgccctaagaggaccccctgccacgctccctccccctgctcaagtgcaggcttttagggatacgcaaacttccgtctccctcacttgggaccccgtaaaggaccccgaactgctaggatattacatttactctagaaaggtcgggactagtgaatggcaaacggtcaacaataagcccatccaggggacgagattcacagtgcccggattgaggactggaaaggaatatgaattttgcgtgcggagtgtgagtgaagctggcgtaggagaaagtagcgctgctaccgagccaattcgcgttaagcaagcgctggccacccccagtgccccatacggctttgccctcttgaattgcgggaaaaacgaaatggtgatcgggtggaagcctccaaagcggagaggagggggtaagatcctggggtatttcctggaccagcacgactcagaggagctggactggcacgccgtcaaccagcagccaataccaacccgggtgtgtaaagtgagcgacctgcacgaagggcacttctacgagttccgcgctcgggctgccaattgggctggagttggcgaactcagtgccccatcttctctcttcgaatgtaaagaatggactatgccccaaccaggcccaccctatgatgttagagcgtccgaggtgcgcgctacgtctctggtccttcaatgggaacccccattgtacatgggcgctggacccgtaaccggataccacgtctcctttcaggaggagggatccgagcagtggaagccagtcacacccggaccaatttctgggactcatctgagagtgtcagatctccaacccggtaagtcatacgtattccaagttcaagcaatgaacagcgcgggtctaggccagccctctatgcccactgaccccgtgctccttgaagataaaccaggcgctcatgagatcgaggtgggcgtagacgaggaggggttcatctacctggcttttgaggctcccgaagccccagactcctctgagttccaatggtcaaaggactacaagggaccacttgacccacagagggtcaagatagaagataaggtcaacaaatctaaagtgattctcaaggagcccggtctggaagacctgggaacctatagcgttattgtgacagacgccgacgaagacatctctgcatcacatactcttaccgaggaggagctcgaaaagctgaaaaagttgagccacgaaatccgcaacccagtgatcaagttgattagcggctggaatatcgatatcctggagaggggcgaggtgcgcctttggctggaggtcgagaagttaagcccagccgcagagctccatctgatattcaacaataaggaaatcttctcatccccaaatcgtaaaattaactttgatcgagagaaggggctggtcgaagttattatccagaacctcagtgaagaggacaaaggatcgtatacagcccagctgcaggatggaaaggctaagaatcagattacccttactttggttgacgacgatttcgataaattattacgtaaggcggatgccaaacggagagactggaagcgtaagcagggaccgtattttgaaagaccactgcagtggaaagtcaccgaggactgtcaggttcagctcacttgcaaggtgacgaatactaagaaggaaacacggtttcaatggttctttcagcgggcagagatgcccgacggtcagtacgacccagagaccgggacaggcctgctatgcatcgaggagctgagtaagaaggataaaggcatctatcgcgctatggtctctgacgatcggggtgaagacgacactatcctggatctcacaggagacgctctcgatgccatatttaccgaactcgggcgtatcggcgctctttcagcaacacccctcaagatccagggtactgaggagggcatcagaatttttagcaaggtcaagtactacaacgtggaatacatgaagaccacctggtttcacaaggacaaaaggttagaatcaggcgaccggatcaggactgggacaacactcgacgagatttggctgcacatcctcgaccccaaggacagcgacaaaggcaagtacactctggaaatcgcggctggcaaggaggtgagacagctgtcgaccgacctgtccggccaggccttcgaagacgcgatggccgaacatcagcgcctgaaaaccctggcgattattgaaaagaatcgagcaaaggtggttcggggtctccctgacgtcgccaccatcatggaggataaaacactttgtctgacatgtattgtctcaggagatccgactcctgaaatctcctggctcaaaaatgatcagccagtcacattcctggaccgctacagaatggaggtgcgtggaacagaggtgactattaccatagagaaagtcaatagcgaggactcgggaaggtacggcgtgtttgtgaaaaacaaatacggatccgagactgggcaggtgaccataagtgtcttcaagcacggcgacgagccaaaggagttgaagtcaatgtag

SEQ ID NO: 57713 - DNA, 996 bp, Artificial Sequence
  Description of Artificial Sequence: Synthetic coding sequence
atggacatttcaaagaaaaatagagtccgtcagggcagccgaggccgaggtaagactatttctaagaactctgagtctagagggcagcagcgccgacacatggtgactaacacaaagaaggagactcgatttcaatggtttttccagagagccgagatgccagacgggcagtatgatcccgaaaccggaacagggctactgtgtatcgaggaggccagtttgtccaaaaaggataagggcatatatagggcaatggtttccgacgacaggggggaagacgacactatcctcgatttgacaggggatgcattggacgctatcttcaccgagttaggacggatcggcgcactctcggcaacgcccttaaagattcagggtactgaagaaggcatcaggatcttttccaaggtgaaatattacaacgtggagtatatgaagacaacttggtttcataaggacaagcgtttagagtccggggaccgcatcagaaccgggacgacacttgacgagatctggctacacatactggatcctaaagactcagataaggggaaatacacactggagattgccgctgggaaggaggtgagacagctctccacagatctgtccggccaggcattcgaagatgccatggctgagcatcagaggcttaagttcctctatatttcacagtatagggcaaaagtcgtgcgcggactgccagacgttgctacaataatggaagacaagaccctttgcctcacttgtatagtgagcggggacccaacccccgaaattagctggctgaagaacgatcagccagtgacatttctggaccggtatcgcatggaagttagaggcacagaggtgaccattaccatcgagaaggttaattcagaggattcgggtaggtatggtgtttttgtcaagaataagtatggaagtgaaaccggacaagtaacaatatcagtgtttaaacacggcgatgaacccaaagaactgaagtccatgtag

SEQ ID NO: 57714 - DNA, 1065 bp, Artificial Sequence
  Description of Artificial Sequence: Synthetic coding sequence
atggaagccgctaccgcccctgaggttgccgctggcagcaagctgaaggtaaaggaggcctctcccgcagatgcagagccgccacaggcaagtcccggacagggcgctggatctcctaccccgcagcttctgcctcctatcgaagaacacccaaagatttggctcccaagagcgttacggcagacctatattaggaaagtgggtgacacagttaatctgctcatacccttccaggggaaaccaaagccccaggccatctggacgcacgacggctgcgccctcgatacgcgcagagtctccgtgcgcaacggagaacaagatagtatactctttatcagggaagctcaacgagcagactctggcaggtaccaactgcgggtccagctgggagggcttgaggctaccgcaaccatagacatactggtcatcgagcggcctggcccaccccagtccatcaagctagtggacgtgtgggggtttagcgcgactctcgaatggacaccgccacaggacacaggaaataccgctctactgggctacaccgtccagaaagccgatacaaagagcggcctttggtttaccgtgctggaacactatcatagaaccagctgtatcgtatctgacctgattatcgggaacagttatgcctttcgcgtgtttgctgaaaaccagtgcggcctaagcgagacggctcccattaccacggatcttgcccacattcagaaggcagccacagtgtataagacaaagggcttcgcccagagggacttcagtgaggcccctaagtttacacagcccctggctgactgtaccacagtgaccgggtacaacacacaactgttctgctgcgtgcgcgcatcccctaggcccaagatcatttggctgaaaaacaagatggatattcaaggaaaccccaagtatagagcactgacgcacctgggaatttgtagtctcgagattcgaaagcccggaccatttgacggcggaatctacacttgtaaggccgtcaatccgctgggcgaagcttccgttgattgtcgtgtagacgtgaaagtaccaaactag

SEQ ID NO: 57715 - DNA, 1464 bp, Artificial Sequence
  Description of Artificial Sequence: Synthetic coding sequence
atgcaggaattcgctcgacgctactttagacgctctcaggccctcctgggccagacagatggcggagcggcaggtaaggacacagattcactcgtacagtatactaaagcccctattcaggagtctctgctgtcactgtcagacgacgtatccaaactggctgttgctagttttcttgccctgatgcgattcatgggagaccagagcaaaccacgaggcaaagacgaaatggatttgctgtacgagcttctcaagctgtgccagcaggaaaagctcagggacgagatctactgccaggtcattaaacaggtgactggtcacccgaggccggaacattgtactcgcggttggtctttcctgagcctgttaacagggttttttcccccaagcaccaggctgatgccatacctgactaagtttctgcaagactccggaccaagccaagagctggccagaagttcccaggagcatctacagaggacggtaaaatatggagggaggcgccgaatgccgcctcctggcgagatgaaggcattcttgaagggccaagccattaggcttctgctcattcatttaccgggtggtgtggactacagaacaaatatacagacctttactgtcgcggctgaagtgcaagaggagctgtgtagacagatgggaatcacagagcctcaggaggtgcaggaatttgctctgttcctcataaaagagaagtctcaactcgtacgcccattgcagcccgctgaatacctcaatagcgtggttgtagaccaggacgtgtcgctgcattcccgaaggctgcactgggaaacaccccttcattttgataactccacctacataagcacccattattcacaggtcctctgggactaccttcaaggaaagctgcccgtgagcgccaaggcggacgctcagttagcacgcctggccgctcttcaacatcttagcaaggctaatagaaatacgccttcaggacaagacctgctggcatatgttcccaaacaactgcaaaggcaagtgaacacagcctcaattaagaatctcatgggtcaagaattgcgcaggttggagggacattctccacaggaggcacagattagctttattgaggctatgtctcaactgccgctattcgggtataccgtgtacggcgtgctgcgagtgtctatgcaggccctctccggccctacgctcctgggactcaacaggcaacacctgattttgatggatcccagctcacagtccttgtactgtcgaatcgctctgaagtccctgcagaggctacacctgctatcaccgctggaagaaaaggggccacccggattagaggtcaattatgggtcagccgataatccccagaccatttggtttgaactgcctcaggcacaagaactcttatatacaacagtattcctgattgattcttcagcgagttgcacagaatggccatcaattaattag

SEQ ID NO: 57716 - DNA, 1998 bp, Artificial Sequence
  Description of Artificial Sequence: Synthetic coding sequence
atggacagacctgccgctgcggctgctgctggctgcgaagggggaggaggacctaacccaggacctgctggcggacgcagacctccacgagccgcaggcggtgcaacagccggatcccgtcagccatctgttgaaacactcgattctcccactggatctcacgttgagtggtgtaagcagctgatagctgcaaccatcagctctcagatttctggctccgtcacttcagagaatgtgagccgggactacaaggcactccgggacggtaacaaacttgcacagatggaggaggcacctttgttcccaggggagagtattaaagccatagtaaaggatgttatgtatatctgccctttcatgggggcagtttccgggacgctgaccgttacagactttaaactgtattttaagaacgtggaacgcgaccctcatttcattttagatgtgccgctgggtgtcatctctagagtagaaaaaatcggggcacagtcgcatggcgacaatagctgcggtatagaaattgtgtgtaaggacatgaggaaccttaggctggcttataaacaagaagaacagagtaagttgggcatctttgagaatctgaacaagcacgcatttcctttgtccaacgggcaagccctatttgccttctcttataaggagaagtttccaataaatgggtggaaggtgtacgacccagtctctgagtataaacggcaaggcctccccaatgagagctggaagatcagcaagattaatagcaattacgagttctgcgacacttatcccgctataatcgtcgttccaacctcagtcaaagacgacgacctaagtaaggtggctgcgttccgggcaaagggcagagtccccgtgttgtcttggatccatcctgagagtcaagccaccataacccggtgttcacaaccgctggtgggacccaacgacaagaggtgcaaggaagacgagaaatacttacagacgatcatggacgcaaatgcacagtcccataagttgatcatatttgacgctcggcagaatagtgtagctgacaccaacaagaccaagggagggggatacgaaagtgaatctgcttatcctaatgctgagctagtctttctggaaatccataacattcatgtgatgcgggagtcgctgaggaaattaaaggagatcgtgtaccccagcattgatgaggctcgttggctgtctaacgtcgatggaacacattggctggagtacatccgaatgctcctggcgggagcggttcgcatcgcagataaaatcgagtcagggaagacgtcagtcgttgtccactgttctgatgggtgggatcgaactgcccagctgactagtttagccatgctgatgctcgattcctattataggacaatcaagggcttcgaaacgctcgtagaaaaagagtggattagttttgggcaccggtttgccttgcgggttggccacggtaacgataaccacgcggacgccgatcgtagtccgattttcttacagttcgtcgactgcgtctggcagatgacgcgacagtttccatccgcctttgagttcaatgagctgttcctgattactatcctagaccatctgtactcatgtctatttggcacgtttctgtgtaattgcgaacagcagagatttaaagaggatgtatatacgaaaactatttccctgtggtcatatattaatagccagctggatgaattctccaatccttttttcgtgaattatgagaaccacgttttataccccgtcgcttccttatcgcatcttgagttgtgggtcaattattatgtcaggtggaatcccagaatgaggcctcaaatgcccattcaccagaatttaaaggagctcctggctgtgcgcgcagagttgcagaaacgggtcgagggactccaacgggaagttgcaacccgtgccgtgtcttctagctcggaaaggggaagcagcccttcacattctgcgacctcagtgcacacaagtgtctag

SEQ ID NO: 57717 - DNA, 819 bp, Artificial Sequence
  Description of Artificial Sequence: Synthetic coding sequence
atgatttctacttgtctccctgagtatatcgtggtgccatcttcgctggccgatcaagacctgaagatcttcagccactcctttgttggtaggcggatgcctttatggtgttggagccacagcaacggctctgcattggtccggatggcattgattaaagacgttctgcagcagcgaaagatagatcagaggatttgcaatgccattaccaagagtcaccctcagaggagcgacgtgtataagagcgacctggacaagactttacccaacattcaggaggttcaggcggctttcgtgaagctgaagcagctttgcgtgaacgaaccgttcgaagagacagaagagaagtggctttcatctctggagaacactaggtggttagagtacgtgagggctttcttgaaacattcggcagaactcgtgtacatgctcgaaagcaagcaccttagcgtcgtcttgcaagaggaggagggacgagaccttagttgttgtgttgctagcctcgtgcaggtaatgctggatccatacttcagaacgattactggattccaatctctgattcagaaagaatgggtcatggctggctatcagtttctggataggtgtaatcacctgaagaggtctgagaaggagtctccactattcctcttgtttcttgatgccacctggcaacttctggagcagtaccctgctgctttcgagttttcagagacctacctggctgtcctgtatgattctactagaatttcactattcgggacctttctgttcaattcccctcaccagcgcgtgaagcaatcaaccgtttggctgctttag

SEQ ID NO: 57718 - DNA, 1371 bp, Artificial Sequence
  Description of Artificial Sequence: Synthetic coding sequence
atgccactgcagaagttccactataggaacttactgctgggagagcacgatgtgccgcttacgtgcattgaacagatcgtcaccgtgaacgatcacaagaggaagcagaaggtgcttggcccaaatcagaagttaaagtttaacccaacggagcttatcatttattgcaaggattttagaatcgtccgcttcaggtttgacgagagcggccctgaaagcgccaaaaaggtttgtttggcaattgctcactacagtcaacccaccgacctccagctgctgttcgctttcgagtatgtgggcaagaaatatcataactccgctaacaaaattaacggcatcccctcgggcgacgggggtggagggggtggaggcggaaatggcgctggcggaggaagctcccagaaaacccccttgttcgagacgtattctgactgggaccgagagataaagcggacgggcgcttctggatggagagtgtgcagcatcaacgaaggttacatgatttctacttgcctgccagaatatattgtggtgcctagctctctcgcagaccaggatctgaaaatcttttcacactcgtttgtggggcgacgcatgcccctgtggtgttggagccattctaatggttcagccttggtccgaatggcactcatcaaggacgtattgcagcagcgaaaaattgaccagaggatatgcaacgcgatcaccaagtcacacccccagaggagtgacgtttacaagagcgacctggacaaaactctgccaaacatccaggaggttcaggccgcatttgtcaaactcaaacagctatgtgtcaacgagccctttgaagagaccgaggaaaaatggctaagtagcttggaaaacacccgctggctggagtacgtgcgagcctttttgaaacactctgcagaattggtttatatgctcgagagtaaacatctgtcagtcgtgcttcaggaggaagagggcagagacttgtcctgctgtgttgccagtctggtgcaggttatgctagatccttattttagaactattaccgggttccaaagtctaattcagaaggagtgggtcatggctggttatcagttcctagaccggtgtaatcatctgaaacgaagtgagaaggagagcccactgttccttctatttctggacgccacctggcagttgcttgagcaatatcctgccgcatttgaattttctgagacttacctggcagtgctatacgattcaacgagaatctcactgttcggcacattcttgtttaattctccccaccagagggttaaacagagcaccgataagaagctttataagacacgtctgttttcatttacgtcgctgaaatttctggtaacgatacactag

SEQ ID NO: 57719 - DNA, 657 bp, Artificial Sequence
  Description of Artificial Sequence: Synthetic coding sequence
atgttcagcttgaagccaccaaagccaactttccgctcctacctgctgccaccgccacaaaccgacgataaaatcaacagcgagccaaaaatcaaaaagctggaaccagttcttctcccaggggaaattgtagtgaatgaggtcaatttcgttcggaagtgcattgcgacagatacctctcagtacgatctatggggcaagctcatctgtagcaatttcaaaattagctttattaccgatgatcctatgcccctccagaagtttcactaccgcaatttgctcttgggagagcatgatgtgccactgacttgcatagagcagattgttacagtcaacgaccacaagcggaagcaaaaggttctcggccctaaccagaagctcaagttcaatccaacagagctgatcatctactgcaaggattttcggattgttcggtttagattcgatgagtcagggcctgaaagtgccaagaagcagacaaaactcatggagttcccacaagagatggaggaggaagaggaagaagaagtgatggagcttgtcgttgcagctgccagaaagttacacagtctgaagttaactcgaatcggcacagagaaatctcgcggacaggttcttcctggaggcgaattcgtgctgttgacaagggttacctag

SEQ ID NO: 57720 - DNA, 2334 bp, Artificial Sequence
  Description of Artificial Sequence: Synthetic coding sequence
atgttctcgcttaaaccccctaaacctactttcagatcctatctcctccccccaccccagacagatgacaagatcaatagtgagcccaagattaagaaattggagccagtgctgctgcccggagagatagttgtcaacgaggtcaactttgtgcggaaatgcattgctacagacactagccagtacgatctctggggaaaattgatctgcagcaacttcaaaattagttttataactgatgacccgatgcctcttcagaagttccactaccgcaatctacttttgggcgaacacgatgtcccactgacctgcatcgagcagatcgtcaccgtgaacgatcacaaaaggaaacagaaagttctcgggccaaaccagaagctgaaattcaaccccaccgagttgattatatactgtaaggatttcaggattgtgagattccgattcgatgagagcggacccgaaagcgccaaaaaggtttgcttggcgattgctcactattctcagcccactgatttacagcttttattcgcctttgaatatgtgggcaagaagtatcacaattcagctaacaagattaacggaattccctctggagacggtggaggcggtggcggtggtggcaatggggcaggcggagggtcgagccaaaagacaccattgtttgaaacatacagtgactgggacagagaaatcaagagaacaggggcttccggctggcgagtgtgtagtattaacgagggctacatgatttctacttgcttacccgagtatattgtggtgccctcttctctggctgaccaggatctcaagatcttctctcactcattcgtcgggagaagaatgcccctctggtgctggtcacatagcaatgggtccgccctggtgaggatggccttgatcaaggacgtgttgcagcaaagaaagatcgatcaacgcatctgtaatgccattacaaagtctcatccccagaggtccgacgtgtacaagagtgatctggacaagaccctccctaacatacaggaagtgcaagcagcctttgttaaacttaagcaattgtgcgtgaacgagccattcgaagagactgaagagaagtggttatccagcctggagaacaccaggtggctcgaatatgtacgggctttcctaaaacacagtgccgagcttgtgtatatgttggaatcaaagcaccttagcgtcgtgcttcaagaagaagaggggagggatctgtcatgctgcgtcgcttcccttgtccaggtgatgctcgacccctattttaggaccattactggattccagtccctcattcaaaaggagtgggtaatggcagggtatcagttcctggatcgctgtaatcatctgaagcggtccgagaaagaatctccactatttcttttatttcttgatgccacctggcagctgttggaacagtatcccgctgcttttgagttcagcgaaacgtatctggcagtgctgtacgatagcacaagaatctctcttttcggaactttcctttttaatagcccacaccagcgtgtgaaacagtcaactgagttcgccatcagcaaaaatatacagcttggggacgaaaagggcctgaagttcccctcagtgtgggactggtccttgcaatttacagccaaggataggactctgttccacaaccctttttatattggtaaatcgactccatgcatccagaacgggagtgtgaagagcttcaagaggacaaaaaagtcctactcctccactctgagggggatgccctctgcactaaagaatggaatcatttcagatcaggaactgttgcccaggcgcaacagtctgattctgaaacctaaacctgacccagcccagcaaacagactcccagaacagtgataccgaacaatattttagggaatggtttagtaagcccgctaacctccatggagtcatcctgccacgagtcagcgggacccatattaaattgtggaaactgtgctattttcgctgggtcccagaagcccagatcagtctgggcggaagcataacagctttccacaagttgtcgctgctggccgatgaagtcgacgtactgtctcgtatgcttaggcagcagcggtctggccctctggaagcctgctatggcgaactggggcaatctcgtatgtatttcaacgctagcggacctcaccacaccgacactagcggaacccccgagttcctctcttctagcttccctttttctccggtgggaaacctgtgccgcaggagcatcctgggaacaccccttagcaagtttcttagcggtgccaagatatggctctctactgagacactcgccaatgaggactag

SEQ ID NO: 57721 - DNA, 819 bp, Artificial Sequence
  Description of Artificial Sequence: Synthetic coding sequence
atgtggtggggaggtaggggccagtcgtttaacatcgccccacagaaagaggaaccagagatgggatcggtgcaagaaaaccggatgccggaaccgaggtcaaggcagccaagctcctgtctagcctctcggtgtctacctggcgagcagatccttgcctgggcccctggggtgagaaaagggctagagcctgagttgtcaggaacccttatctgcactaactttcgcgttaccttccagccttgcggctggcagtggaaccaagacacccctctcaattccgagtatgactttgcactcgtgaatattggacgtctggaagcagtgtcgggccttagtcgggttcagttgctcaggccgggaagcctgcataaatttattcctgaggagatactcattcacggcagggatttccggctgttgcgggttgggtttgaagcaggcggactggaaccccaggcattccaggtgaccatggctattgttcaagccagggcccagagcaatcaggcccagcagtactccggaataactctcagtaaggccggtcagggtagtggatcacggaaacctccgatcccattgatggagacagccgaagattgggagaccgagagaaaaaagcaagctgcacgcggatggagggtctcaaccgtcaatgagcgctttgacgtagccactagactgcgttgcttttctagttcattaattgtgagcgggagttcctcttcttcttttcaactgatcctgaactcgttgagcttcagcttcctgttgttcatgaccgtctccggctttctgactccactgccttcatag

SEQ ID NO: 57722 - DNA, 1923 bp, Artificial Sequence
  Description of Artificial Sequence: Synthetic coding sequence
atgcctcccagggtaacctttcaaccctgtggatggcaatggaaccaggatacacctttgaatagcgagtatgatttcgcactagttaatatcggcagactggaggccgtttccggcctgtctcgggtccagctgctgcgtcccggttccctgcacaagtttatccccgaagagatcctgatccatggacgcgattttcgtctgcttagagtggggttcgaggccggaggactggaaccacaggcttttcaggttacaatggccatcgtgcaagcccgagcacaatctaaccaggctcaacagtacagtggaatcaccttgagcaaggccggacagggttcaggctcccggaaaccccctattcccctgatggagacagcagaagactgggagaccgaacggaaaaagcaggccgctcgcggatggcgagtgtccactgttaacgaacgcttcgacgtcgccacatcactgcctaggtatttctgggtcccaaatagaatcctggacagtgaggtccgcagagcatttgggcacttccaccaaggtcgtggcccacgacttagctggcaccaccccggaggatctgatttgctacgttgcggtggcttctacactgcctcagaccctaataaggaggatattagggcagtggaactgatgttgcaagccggacactcagacgtggttttggtcgacactatggacgagctcccgtccctggcggatgtgcagctggctcacttgagactgagagccttatgtctgcctgatagtagcgttgcggaggacaaatggctgtccgcccttgaaggaacccggtggctggattacgtgcgagcatgtctgcggaaagcatcagacatttccgtgcttgtcacctccagggtccggagtgtgattctgcaggagcgcggagaccgtgatctgaacggcctgctaagttcactggtgcagctcctgagtgcgccagaggcccgaacccttttcggctttcaatccctggttcagcgcgagtgggtcgcagctggccatccctttttgacccgcttggggggaactggcgctagcgaagaggcaccagtcttcttactcttcctggattgtgtgtggcagctgctgcagcagtttcccgctgactttgaattctctgagttctttttattggcccttcacgacagtgttagagtcccagatactctgactttcttaaggaacactccttgggagcggggaaaacagtctggacagctgaattcatacacacaagtgtacactcctggctactctcaaccccctgctgggaactcatttaatttgcagctgagtgtgtgggattgggaccttcgctacagcaatgcccagatccttcagttccaaaaccccggatacgatcctgaacactgtcccgactcgtggctgccaaggcctcagccaagcttcatggtccctggccctccaagctctgtctggctctttagccggggagctctaacccctttaaatcagttgtgtccatggcgcgatagcccgtcactcctggcggtgagcagtcgctggctccccaggccagccattagttcagaatctttggcggatcaggaatgggggttaccatcacactggggcgcttgtccactaccccctgggttactccttccgggatatctggggccacaaattcggctttggaggaggtgctatctgcggggtaggccggaggttcagatgggcctgtcagctccgacaattagcggcttacaggacgagctgtcccaccttcaggagctactgcggaagtggacaccccgtattagtccggaggaccactccaaaaaacgcgatcctcatactatcctgaaccctacagagattgcaggcatccttaaaggccagtctcatcctttttggattactagatgctag

SEQ ID NO: 57723 - DNA, 765 bp, Artificial Sequence
  Description of Artificial Sequence: Synthetic coding sequence
atggccattgtccaggcaagggcgcagtcgaatcaggcccaacagtattcaggtatcacactttccaaggctggtcaggggtccggcagtagaaagcccccaatcccactcatggagactgctgaagattgggaaacagaacgcaagaaacaggcagctcggggatggagggtgtccaccgttaatgagcgtttcgacgtggctactagccttcctaggtacttctgggtgcccaatcggatactggactcggaagtgcgccgagccttcgggcactttcaccaaggacgcggacctaggctgtcctggcaccatccgggaggatccgatcttctccggtgtgggggtttttataccgcatctgaccccaacaaagaagatattagggccgtagaattaatgctccaggcaggtcactcagatgtggtcctcgtcgacactatggatgagctaccctcattggcagatgtccagctggcccatctcaggttaagggccttgtgtctgccagattcatctgtggccgaggacaagtggctgagcgccctggagggtaccaggtggctggactatgtgagagcttgtctgagaaaggccagtgatatcagcgtcttggtaactagccgcgtccgttccgtgatcttacaggccgctttttcccctcgtagtcctaacaccgtgtggctgcccatcacgagcaccgctagagtagggggtagttggactagcttgcccgattccgcctggggcaattggggtcagtag

SEQ ID NO: 57724 - DNA, 1065 bp, Artificial Sequence
  Description of Artificial Sequence: Synthetic coding sequence
atgccggagcctcgaagtagacagccctcttcctgcttggctagcaggtgtcttcctggggaacagatacttgcctgggcccctggtgtccgtaaggggctcgaaccagagctctcagggactctgatttgtactaacttccgggtaacctttcagccgtgcggctggcagtggaaccaggacacgcccttgaatagcgagtatgattttgcgttggtgaacattggtcgactggaggcagtcagcggactctctcgtgtgcagctgctcaggccagggtccttgcacaaattcataccagaggaaattttaattcacggcagagattttcgattgctgcgggtgggttttgaagcaggtggcctggaaccccaggcttttcaggtaaccatggctattgttcaagcgagagctcagtctaatcaagcccagcagtattccggtatcacgctctctaaagccggtcagggctctggtagccggaaaccaccaattccgctgatggagactgctgaagattgggagacagagcgaaaaaaacaggcggctaggggctggcgtgtgtcaaccgttaatgaaaggtttgacgttgcgacatcactgcccaggtacttttgggtacccaacaggatccttgactccgaggtaagaagggcgtttggtcattttcatcaggggaggggccctcggctcagctggcatcaccccggaggcagcgacctgctgagatgcgggggattttacaccgctagcgacccaaacaaggaagatattagggctgttgaactgatgttgcaagccggacattccgacgtggtgctcgttgataccatggacgagcttcccagccttgccgacgtccaattggcccatcttcggctaagagctctgtgtctccccgacagctcagtcgcagaggacaagtggctgagcgccttggagggtacaagatggctagactacgtgagagcttgcttgcggaaagccagtgacatcagcgtgctcgtcacaagccgcgtgcggagtgttatactccaaggtagtggcgtgtctccccttccatag

SEQ ID NO: 57725 - DNA, 2130 bp, Artificial Sequence
  Description of Artificial Sequence: Synthetic coding sequence
atgtggtggggcggaagaggacagagcttcaatattgccccacagaaagaggagcctgagatgggcagtgtgcaagaaaatcggatgcccgaacccagaagcaggcaaccgtcttcatgtcttgcaagtcgatgtttaccaggggaacagatcctcgcttgggctcctggagttcgaaaaggcctggagcccgagctgtcagggacccttatttgcacaaattttagggtcactttccagccttgtgggtggcagtggaaccaggacactcccctgaactctgagtacgattttgccttagttaacattggtcggctggaagccgtgagtgggctctcacgcgtccaactgctgcgacctggatctctgcacaagttcattcccgaagaaattctcatccacgggagagactttagactgttgcgggttgggttcgaggctggcggattagagccgcaagcttttcaagtgaccatggccatcgtgcaggccagggcacagtctaatcaagcccagcagtactctggaataacactgtcaaaagccggacaggggtcagggagccgcaaacctccaataccgctaatggagacggctgaggactgggagaccgagagaaagaagcaagctgcgcgagggtggagggtgtcgactgtcaacgagcgtttcgacgtggctacatcactgccacggtatttctgggttccaaacagaattttagatagcgaggttcggagagcttttggtcacttccaccagggccgtgggcctcgactttcatggcaccacccaggcggatcagatctcctacgatgtggcggattctatactgcctccgatccgaacaaagaagatattagagcagtagaattgatgctacaagccggacacagcgacgtggttcttgtcgacaccatggacgagctgccaagcctcgccgacgtacagctcgcccatttgcggctgagggcgctctgccttcctgattccagtgttgccgaggataaatggctgagtgccctggagggcacacgatggctggattatgtcagggcatgcctgcggaaagcgtcagatataagcgttctggttacttctagagtccgcagtgtgatccttcaagagagaggggaccgagacctgaacggactgctgagtagcctcgtgcagctgctgtcagccccagaggctcgtaccctgtttggcttccaatctttagtgcagagagaatgggtggcggctggtcatccctttcttactaggctggggggtaccggcgcttctgaggaggcaccagtgtttcttctgtttttagactgcgtatggcagctcctgcagcagtttcccgcagacttcgagttctctgagttctttctgttggcactgcacgactctgtccgggtacctgacacacttacgtttctgcggaacacaccgtgggagaggggcaagcagtccggtcagttaaactcttacacccaggtctatacaccaggctatagtcagccccctgcgggtaattccttcaatctacagctttcagtctgggattgggacctgcgctattcgaacgcccagattttgcagtttcaaaaccccggttatgaccccgaacattgtcccgactcatggcttcctcgcccacaaccaagttttatggtgccaggcccaccgtccagtgtttggctcttctccaggggagcactgacacctctcaatcagctctgtccctggcgcgatagcccttccctcctggctgtgtctagcagatggctcccacggccagcgatatcatctgaatccttagctgaccaggaatgggggctcccaagccattggggggcttgcccactacccccaggactcctgctgcccggatacttggggcctcaaattaggttatggcgcagatgctatttgaggggacgccctgaggttcagatggggctgtccgcccctacaatttcggggctgcaggacgagttgagccaccttcaggagttgctgcgcaagtggacacctcggatttccccagaagaccacagcaaaaagagggaccctcacacaatcctgaacccgacagagatagcaggcatacttaagggtcgggctgagggtgatctcggctag

SEQ ID NO: 57726 - DNA, 663 bp, Artificial Sequence
  Description of Artificial Sequence: Synthetic coding sequence
atgaacattcgcaacgcccgtcccgaggacttaatgaatatgcagcactgcaatctcctgtgtcttcccgagaattaccagatgaagtactacttttatcacggcctgtcttggccgcaattgtcatatatagccgaggatgagaatgggaagatcgtgggttatgtcttagctaagatggaagaagaccccgacgacgttccccatgggcatatcactagcttggccgtcaagcgctcacaccgacggctcggactcgcccagaagctgatggaccaggctagtagagctatgatcgaaaactttaatgccaaatacgtgagcttgcacgttaggaagcggataagcgaggtagagccaaagtactatgccgatggcgaggatgcatacgccatgaagcgagatctcacacagatggccgacgagcttcggagacatctcgaactgaaagagaaagggcgtcacgtggtgctgggggcaatcgagaataaagtggaatcaaagggcaactcgcccccatctagtggcgaggcctgcagagaagagaaagggctcgccgctgaagattccggcggagactccaaggacctgtccgaagtgtcggagacaaccgaatctaccgatgttaaagacagtagtgaagcctcagactctgcctcctag

SEQ ID NO: 57727 - DNA, 708 bp, Artificial Sequence
  Description of Artificial Sequence: Synthetic coding sequence
atgaatattcggaacgcaagacccgaggatctgatgaacatgcagcactgtaaccttctgtgccttccggagaactaccagatgaaatactatttctaccatggcttgtcttggcctcagctatcctacattgccgaagatgagaacggtaaaatcgtggggtatgtgcttgccaaaatggaagaagaccccgacgatgtcccccatggccacattacctcactggcggtaaaacgttcacatcggcgtttaggtctggcacagaaactgatggaccaagcttcacgcgctatgattgaaaacttcaacgccaaatacgtctctctgcatgtgaggaagtctaatagggcggcattgcacttatatagtaacaccctgaatttccagatctctgaggtggaacctaaatactacgcggatggcgaagatgcttatgccatgaagagagatctcacccaaatggccgacgagctacgaaggcacctggagctgaaagagaaagggcgacacgtggtactgggagccatcgagaacaaagttgagtccaaggggaacagtcctccgagttcgggggaggcgtgcagagaagaaaaaggactggcagcagaggacagtgggggagacagtaaggacctgagcgaagtgtctgaaacgaccgaaagcacagacgtgaaggactcttccgaggccagcgactctgccagctag

SEQ ID NO: 57728 - DNA, 714 bp, Artificial Sequence
  Description of Artificial Sequence: Synthetic coding sequence
atgggtagaaagtccagtaaagcgaaggagaagaagcaaaaacgcctggaggaacgcgctgcaatggacgcagtgtgtgccaaagttgacgccgctaacagattgggagacccattagaggctttcccggtgttcaagaagtatgaccgtaatggattaaacgtgtcaatagagtgcaaacgagtctctggactggagccggcaacagtggattgggcattcgacttgacaaagacaaatatgcaaaccatgtatgaacagtcagagtgggggtggaaagatcgggaaaaacgggaggaaatgacagacgatcgggcttggtatctaatcgcctgggaaaacagctctgtccctgtggcgtttagtcacttccgcttcgacgtcgaatgtggcgatgaggtattatattgctatgaagttcaactggaaagcaaggtgcgtcggaaaggcttaggcaaattcctaattcagatccttcaattgatggccaattccactcagatgaaaaaggtcatgttgaccgttttcaagcacaaccacggcgcatatcagttctttagagaggctttgcagttcgaaatcgacgatagctctccaagcatgtccggctgttgtggcgaggactgtagctacgagatattatcacgccgaacaaaattcggcgactctcaccactcacacgctggaggtcactgcgggggatgctgtcattag

SEQ ID NO: 57729 - DNA, 594 bp, Artificial Sequence
  Description of Artificial Sequence: Synthetic coding sequence
atgccctttgtacccaaatggactctccctaccggcctgaatgtttcaattgaatgcaaaagagtctctggactggaacctgccaccgtcgattgggccttcgatctcaccaagaccaacatgcagaccatgtatgagcagtccgaatgggggtggaaggatagagaaaagagggaggagatgacagacgaccgggcttggtatttgattgcctgggagaactccagcgtacctgtagcattcagtcactttagatttgacgtggaatgtggcgacgaggttctgtattgctacgaagtgcagctggaaagcaaggttagaaggaagggactgggcaagttcctgattcagattctccagctcatggccaatagcacccagatgaagaaagtaatgttgacggtatttaaacacaatcatggggcttatcagttttttcgcgaggctctgcaattcgaaatcgacgattcctccccgtccatgtccggctgctgtggagaggactgttcttacgagatactgagtagacgtaccaaattcggcgattcgcaccacagccatgctggcggacactgcggtggctgttgccattag

SEQ ID NO: 57730 - DNA, 645 bp, Artificial Sequence
  Description of Artificial Sequence: Synthetic coding sequence
atgagcgatctggaagacgacgaaaccccccagctgtccgctcacgcgctggcagccctccaggagttctatgctgagcagaaacaacagatcgaacctggcgaggatgacaaatataatataggaatcatagaggagaactggcagcttagccaattttggtattcccaggagacagcgctccaactcgctcaggaggccatcgctgccgttggcgaaggcggacggatagcttgcgtgtcagccccatccgtgtaccagaaactgcgggagctatgcagagagaatttcagcatctacatcttcgaatatgataagcgctttgccatgtacggtgaagagttcatcttctatgactataacaatcccttggacctgcctgaaagaattgccgctcattcttttgacatcgtcatcgctgatcccccttacttgtcggaagaatgtctccgcaagacatctgaaaccgtaaagtatctcactaggggcaaaattctgctttgcacaggagcaataatggaagaacaagcagctgaactgcttggcgtcaaaatgtgtacattcgttccaaggcacacccgcaacctggcaaatgaattcagatgctatgttaactacgactcggggctagattgtggcatctag

SEQ ID NO: 57731 - DNA, 645 bp, Artificial Sequence
  Description of Artificial Sequence: Synthetic coding sequence
atgtcagacctcgaagatgatgaaacaccgcagctctccgcacacgcacttgcagccctgcaggaattttacgctgaacagaagcagcagatagagccaggcgaggatgacaaatataatattggaattattgaggagaactggcagctgtctcagttctggtactcccaggagaccgccctccagctggcccaggaggcgatagccgctgtgggtgaggggggaagaattgcatgcgtgagtgcaccctctgtctatcagaagctgcgagagctatgtcgcgagaacttctccatttatatcttcgagtatgacaagaggttcgccatgtacggcgaagaattcatcttttacgactataataatcccctcgacctgccagagaggattgcagctcattcttttgatatcgtgattgctgacccaccctacctgtcggaggaatgcctaagaaaaacttcagaaacagtcaagtacctaacccggggtaagattctattgtgcactggggcaatcatggaagagcaagctgccgagctgcttggggtgaagatgtgcacttttgttcccagacacactagaaatcttgccaacgaatttaggtgttacgtgaattacgattcaggactggattgcgggatttag

SEQ ID NO: 57732 - DNA, 1110 bp, Artificial Sequence
  Description of Artificial Sequence: Synthetic coding sequence
atgaaacttgaggccagttgtggcactgccacctctgaggtgccgaagcctgagaagaaaaccgccagagacgcagaaccatcaagtgagacgcgcccacaggaggtcgaggccgagcctcgaagtgggtccggtcctgaggcagaggctgaacctctggatttcgtcgtagccactgaaagagagttcgaggaggtgttggctatctctggaggtatttacggaggactggattatctaccatctcgctatcacagctggcttcgcgatcccgatcgtaccgttgtgctggcaaaacgaaacggcggtgtgattgctcttgagagcgttaacgtgatcgacgcaggcgagaccgtgcttgtggaggggctgcgggtggctccctgggaacggggaaaaggtgtcgccggactgctccagcgcttctgcagtcagctggttaaaaggcaacatccaggagtgaaggtggccaggctcaccagggatgaccagttgggaccccgtgaacttaagaagtataggctcattacaaaacagggtatactgctagtgagattcaacgcgtcagccctgctggcaggtctgggggctaggcttgcggcacttcgaacgtccggcacttttagccctctccccaccgaggccgtgagcgaagcgggtggggatgttgcacgtctcctgctgagcccaagcgtgcagcgggatgtgctgcctggtggtacgattatccaggactggcagccatacagacccagtgaatcgaatctaaggcttctagctgccaaagggcttgagtggcgagtggacagcagggctcggccaagagtcctgaccttgtgtacacggccatttcccattccccacgggggagacgggacatggcggtatctgaacatcgatgcctttgggtcggacggggcacaggtgcagtctcagctgctttggcacctgcagaggcaggcccctagattagtagggctgaatgtcatgtgccaactatttctggagccgcagctgtggagccaactcgctgacttttgtcaggtgggcttgggactagaactcgtgaaaggctacactgagcagtatcttcttgaagctgatatctag

SEQ ID NO: 57733 - DNA, 471 bp, Artificial Sequence
  Description of Artificial Sequence: Synthetic coding sequence
atgaagctggaagccagctgtggcaccgccacatctgaggtgcccaaaccagagaagaaaaccgccagagacgcagagccatctagcgagactagaccacaggaggtggaagcggagcctcgctctgggagcggccctgaggccgaagccgagcctctagattttgtcgttgccacagaaagggagtttgaagaggtattggccatatccggaggaatttacggaggtctggattacctgccttctcggtaccattcgtggctgcgcgaccctgaccgcactgtggtcctcgccaaaagaaacgggggagtgattgcattagagtccgtgaatgtaattgacgccggagagaccgtcctggttgagggactcagagtcgctccttgggagcggggaaagggtgtggctggtctcctgcagagattttgttcgcagctggtgaagagacagcacccaggggttaaggtctag

SEQ ID NO: 57734 - DNA, 1110 bp, Artificial Sequence
  Description of Artificial Sequence: Synthetic coding sequence
atgaagttggaagccagttgcgggaccgccacgtccgaggtcccaaagccagaaaagaaaacagcaagggatgctgaacctagcagcgagacgagaccacaggaggttgaggctgagcctcggtctggctctgggcctgaagccgaggccgagcccctggattttgtggtggccactgaaagggaattcgaggaggtactagcaatctctggcggaatctacggtggactggattacctgccctctcgctaccatagttggcttcgcgatcctgatagaaccgtagtcctcgctaaacggaacggcggagtgatcgcactcgagtccgtcaatgtgattgatgctggcgagacagttctggtcgagggattgcgagtggcaccctgggaacggggtaagggtgtagccggtctgcttcagagattttgttctcagctcgtgaagcgacagcacccaggcgttaaggttgctcgcctgacacgggacgaccagttgggaccccgagaactcaagaaatatagattaattactaagcagggaatcttactggtgcgtttcaacgcatccgcacttttggcgggactgggagcccgactcgccgcactccgcactagtggcacatttagtcctctgccgacggaagcagtcagtgaggcagggggtgatgtggcccgactgctcctaagcccgtccgtacagcgagatgttctgcccggaggaaccattatccaagactggcagccatatcgcccaagcgaatctaacctgaggctcctggctgcaaagggtctagagtggcgggtggattccagagccagacccagagtactcacactgtgcacgagaccttttccaatcccacatggcggagatgggacatggagatacctcaacattgatgcttttggatcagacggtgctcaagtccagtctcagttactgtggcatctgcagaggcaagctccccgtttggtgggcctgaacgtaatgtgtcaattgtttctcgagcctcagctgtggtctcagctcgctgatttctgtcaggtaggtcttgggctcgaacttgtcaagggatatacagagcaatacctactcgaagctgacatctag

SEQ ID NO: 57735 - DNA, 861 bp, Artificial Sequence
  Description of Artificial Sequence: Synthetic coding sequence
atggagctcatcctgagcacatcccctgcggagttgaccctagaccccgcttgccagccaaagctccctctggactcaacttgccagccagagatgactttcaatccaggaccaactgaactaactctcgatccagagcaccagcctgaagagactcccgctccatcccttgccgagctcactctggagcctgtccacaggcgaccggagctactcgacgcatgcgccgacctgatcaatgatcagtggccacgctccaggacctcacgtttacattccctgggacagagcagcgatgcttttcctctgtgcctgatgttgctatcccctcatcccactttagaagccgcaccagtggtcgtaggacatgctcgcctgagcagagtgctgaaccaacctcagagtctactggtcgagacagtcgtggttgcccgtgcactcaggggtcggggattcggtcggagactgatggagggacttgaggttttcgccagggctagaggcttccgcaaattacacctgacgactcacgaccaggtacacttttacacccacctcggatatcagctgggggagccagtgcaaggccttgtttttacatctaggcggttgcctgcaacgctcctaaatgcgtttcccaccgcacccagccccaggcctccacgcaaggctcctaacttgacagcccaggctgcacctagagggcctaagggcccaccactccctcctccaccccctctgcccgaatgcctgacaattagccctcccgtgccttccggtccaccttctaagtctcttctggaaacgcagtatcagaacgtgaggggtcgccctatattttggatggagaaggacatctag

SEQ ID NO: 57736 - DNA, 861 bp, Artificial Sequence
  Description of Artificial Sequence: Synthetic coding sequence
atggagttgatcctgtcaacttccccagcagagctcaccctagatcccgcttgtcaaccaaaactccctttagatagcacctgccagccagagatgaccttcaacccaggcccaactgagctcacactggaccctgagcaccagcctgaagaaactcccgcacccagcttagcggagctcacactggagcccgtgcacagaagacccgagttactggacgcctgtgccgatcttattaatgatcagtggcctcggtctagaacttctagattgcattctttgggtcagtcatctgatgcattcccgctctgcctgatgctgctgtcacctcacccaacgttagaggcagccccagtggttgtgggacacgcgcgtctttcccgggtgttgaaccaaccgcagtcactgctcgtcgaaactgtcgtcgtggctcgagcactgagggggagaggcttcggaaggaggctgatggaaggactcgaggtctttgccagagcgagaggttttcgtaagcttcacttgactacacatgaccaggttcatttctatactcatctggggtaccagcttggagagccagtgcaggggctggtgtttacatctagaagactgcctgccacgttgttgaacgcctttcctacggcaccaagtcctcgcccaccacgcaaggcgccaaacctgacggctcaggccgctcctagagggccaaaaggtcctcctttgcctcctcctccccctttgcctgagtgcctcaccatctctccgcctgtgccaagtggcccaccatcgaaatctctgcttgaaacccagtaccagaatgtgcgcggacggcctatattctggatggagaaggacatctag

SEQ ID NO: 57737 - DNA, 624 bp, Artificial Sequence
  Description of Artificial Sequence: Synthetic coding sequence
atgcgcctgaatcagaacaccttgctgctcgggaagaaagtggtactcgtgccttacaccagcgaacatgtgccaagtcggtaccatgagtggatgaaaagtgaggaactgcagcgcctgacggcgtccgaaccgctcactctggagcaggaatacgcaatgcagtgctcttggcaggaggatgccgataaatgtacgtttattgtgctggatgctgaaaagtggcaggctcagccaggcgcaacagaagaatcctgtatggtcggggatgtgaacctatttcttacagatcttgaagatctcacgctgggtgaaattgaggtaatgatcgccgaacccagctgccggggaaagggtctgggaaccgaggccgtgttggccatgctgtcgtacggagtgacaactctgggactgaccaagttcgaggccaagatcggccaaggaaacgagccctccatacgaatgtttcagaaattacacttcgagcaggtagcaacctcctcagtctttcaggaggtgactctgcggctgacggtgtccgaatcagaacatcagtggttgctggaacaaacaagtcatgtcgaggaaaaaccataccgcgacgggagcgcggagccatgttag

SEQ ID NO: 57738 - DNA, 4290 bp, Artificial Sequence
  Description of Artificial Sequence: Synthetic coding sequence
atggatagccaattccatatggctggtgaggcttcccagtcctggctgaaagcaaaagaaaagcaacggggaacaagctacatggttgcagtgatcgagtgggagatagagcggagtctcttgagctctgaagaccgagagcagggtgccacagtgttcttacgcgagatacaagacctccataagcacatcctggaggattgcgctctgcggatggtagatcggctggccgatggatgcctggatgctgacgcgcaaaatctgctatcgtccctgaagagccacatcactgatatgcatcctggcgttctgaagacgcataggctgccatggagcagagatctggtgaatcctaagaacaaaacccatgcatgttacttgaaagagctgggtgaacagtttgtggttagagctaaccatcaggttctcactaggctgcgggagcttgataccgctggccaagagctcgcgtggctgtaccaggagattcggcatcacctgtggcagtcgagcgaggtcatccagaccttttgcggacgacaggagttactggctcgcctcggccagcagctccgccacgacgacagtaagcagcatactccgttggtactgttcggccctcctggaattggaaagaccgccctcatgtgtaaactggcagagcagatgccacggcttttaggccacaagacggtgacagtgctgcgactcctcggcacttcccaaatgtcctctgatgcaaggggcttactgaagtccatttgctttcaagtgtgcctggcctatgggctccccctgcctcctgctcaggtcttagacgcgcataccagggtcgtccaatttttccacaccctgctacacacagtttcttgtcggaattttgagagtctcgtgttgcttttagacgcaatggatgacctagactccgtgcgtcatgccagacgagtaccatggctgcccctgaattgtccacccagggtgcacctgatactgagtgcctgtagcggggctcttggtgtgctcgatacactgcaaagagtcctactagaccccgaagcatactgggaagttaagccgctgtcagggaaccaggggcaacagatgattcagctcctgttggctgccgcacgccgtacactatcaccagtgcatacggaccttctgtgggctagtcttccggaatgcgggaatccaggcaggctgcgactggctttcgaggaggcgaggaaatgggcctctttcaccgtacccgtgcccctggccacaaccgctgaagaggcaactcaccagctctgtacaagattagaacagactcacggacaactcttagtggctcacgttctcgggtatatcgtctcctctcgccacggcttgagcgaggcagagctgaaggatgtgttaagcctggatgacgaggtcctccaggacgtctacagagattggacgcccccttctaaggagcttctgcgctttcctccacttttgtgggtcaggctcaggagagacctgggctactatctggctcgacggccagttgacggcttcactctattagcaatcgctcaccgccaactggtggaggtagtgcgagaaagatatctatccggaagcgaaagggccaagcggcacggagtgctcgccgacttttttagcggcacctggtcacaggggaccaagaaacttatcaccctgccactggttggtaaacccctcaatttggatcggaaggtcgcccctcagcctctgtggttttcccacacagtggccaaccttcgaaagctgaaggaattgccctaccacctcctgcactccggcagactggaggaactcaagcaggaggttctggggtctatgagctggatcagttgccgaggtataagcggcggtatcgaggacctcctggacgacttcgacctttgtgctccacatctggattcccctgaggtgggactcgtcagagaggctctccagctgtgtaggcctgcggtggagcttaggggcatggagcgtagccttctttacacagagcttctcgccagacttcatttcttcgccaccagccacccagccttggtgggccagctgtgccagcaggcccagagctggtttcagctttgcgcacaccctgtactggtgccgctggggggtttcttgcaacctccaggtggaccactgcgggctacgctctctggttgtcataagggaatcaccgccatggcttggggagtcgaggagaaactccttgttattggaacccaggatggaattatggctgtgtgggatatggaggagcagcatgttatccacatgctaacgggccacactggggaagttcgatgtgtaaagatcttcgcaaagggaacgctggcaaacagtgcctcaaaggattatactctgcacctttggaatttgctgtccggtcaagagaaatttacaatttgggacgggggatccaagaaccccgcagagccacagatctggaatctgcacgttgacgaggcccacaaggtcgtgtactctgcctctgggagtaaaatcaatgcatggaacctggagaccgcagagcccgttttccacatcctaggcgatgcatcagacccctggatgtgtatggccgttttggcgtctcaggctacgctgctgacagtgtctagggacggggtagtgtccctgtggtcctcagccaccggaaagctccagggtaagcagcacatgtccagtataaaagaagaaacgcccacctgtgcagtctctgtccaaaagcagggcaagctcgtaaccggcttctccaacggatcaattagccttgtatcatctaagggagaccggctgttggaaaagctccccgatgctgtccggtttttggtcgtgtctgaagacgagagcctgctcgctgccggttttggtcgatctgtgaggatttttctggcggactctcgcggttttcggcgattcatggcgatggatctcgagcatgaggacatggtagagacagccgttttcggtaccgaaaataatctgatcatcactggaagcttggacgccctgattcaggtgtggtcactgtcagaacaggggacactgcttgacatccttgagggagttggagcaccagtcagtctactggcccgtggaggagcgttagtggcttctgcaagcccacaatccagctcgtttaaggtatgggacctgagcgacgcccataggtccagggtgcctgcaccttttttggatcgcaccggtctgaccgccgtttctcacaatggcagctacgtctattttcccaaaatcggtgacaagaacaaagtgaccatttgggacctggctgagggcgaagagcaggacagccttgacacctcatccgagattcggtgcctcgaagtggccgagcagaggaaactcctgttcacagggcttgtgtccggagtcgtcctggtcttccctctgaattctaggcaggacgttatctgcataccccctccagaagccagaaaggcaataaactgcatgtccctgagtaaatgtgaagatagacttgccattgcctatgacaacattgtgcttgttctggacattacatccggagacccatgtcccgtgattgatggcccaagatataccttctatacccagctgccggaaacactgtcgagcgtcgctattctcacagattatcgagttgtgtattctatgaccaatggcgacctctttctgtacgagtgtgccacttcgaaggccttccccctcgagacacaccgatctcgagtggcctgtgtagaggttagccataaggaacagctcgtggtcagcgggtctgaagacgctctgctgtgtttgtgggatttgcaagcaaggaaatggaaattcgagatgtcatacacctcaagctactgtcggggagtgcagtgtgcctgctttagcaaggacgacaagtatgtgtacgtgggccttaaagatcgtagcattctcgtgtggtcggtgttagatggaacgctgctcaccgtccagttcgtccatgctgtggtaaacagaattattcccaccaccagcggattcattgctcccacccggcatggatatttgatacgagagaatttccagtgtttgagtgctaaagccagcccacaagatcccctgaagaacttcaagaaagcaatgtggatggtgaagagtagacagagagaagaactcgtcgcagcagccggagcaccacaagatctggagagcgaaagtgctcaggggaacgaaaccaagtccaacaagtgcagtcaagtttgtctgattgtgtag

SEQ ID NO: 57739 - DNA, 4299 bp, Artificial Sequence
  Description of Artificial Sequence: Synthetic coding sequence
atgcaacgtgggaaaccctgtagagccctgcccaccctcaagtgccaaaccttctgccagagacatggtctaatgttcgaggttgtggacctgcggtggggcatcagaaacattgaggccacggaccacctaactacagagctctgtctagaggaagttgatcgttgttggaaaacgagtatcggtccagccttcgtggcgctgatcggcgatcaatacggtccctgtctgatcccctcacgaattgacgagaaagagtgggaagtacttcgagaccatttgacagcaaggccatcagatttggagttggtggcgagatacttccagagggatgagaatgctttccctccaacctacgtgctccaagctccagggacgggcgaagcgtgcgagccagaagaagcaaccctcacttctgtgctgaggagtggtgcacaggaggcacgtaggttggggttgattactcaggaacagtggcagcactatcaccgaagcgtcatcgagtgggagatcgaacggagcctgctgtccagtgaggacagagaacagggcgctacagtgtttctgagggagatccaagacctgcacaagcatattcttgaggattgtgctctgagaatggttgatagactcgctgacggctgtttagacgccgacgcacagaacctgctgagcagcctaaagagccacatcacagacatgcaccccggagtgctcaagacacatagactgccatggagtcgcgatctggtcaacccaaagaacaagacgcatgcatgttacctgaaggagttgggcgagcagtttgtcgttcgggcaaatcaccaggtgctgaccagactgcgggagctggataccgctggacaagaacttgcctggttataccaggaaattagacatcacttgtggcagtcttcggaggtgatacagacattttgtggcaggcaggagctcctagcaaggttggggcagcagcttaggcatgatgactccaagcagcatacccccctcgtgctgtttggacccccaggtattggtaagacagcacttatgtgcaaacttgcagaacagatgcctcgcttgctggggcacaagaccgtgaccgttttacgattactcggaactagccagatgagcagcgacgcccgtggtctgctgaagtctatttgtttccaggtgtgtctcgcttatggcctgccattgccacctgcccaagtgttggacgcccacacgcgggtggtgcagttcttccacactctcctgcacaccgtcagctgtaggaacttcgagagtctggtactgctccttgacgctatggatgatctggatagcgtccggcatgccagacgtgtcccctggctgccactgaattgcccacctcgcgtacatctgatcctgtcagcctgctctggggctctgggtgtgttagacacacttcaacgggtcctgttagatcctgaagcctattgggaagtgaaacccctcagcgggaatcagggtcaacaaatgatccagttgctgctggcagccgctagacgcaccctaagccccgtgcacactgatttactttgggcctccctgcccgaatgtggtaaccccggtcgccttcgcttggcgtttgaggaggccagaaagtgggcctcatttaccgtgcccgttccgctggccaccaccgccgaggaggctacccaccagttgtgcacaagattggagcagactcacggacaactactcgtggctcacgtgctgggttatatcgtctcatctcggcacggtctcagcgaagcagagcttaaagacgttctctccctggatgatgaggtcctccaggatgtgtacagagattggacccctccatcgaaggaactcctccgcttcccccctctcttgtgggtaagattacggcgtgacctggggtattacttggcacggagacccgtggacgggttcaccctgctggctatcgctcatagacaactagtggaagtcgttcgtgaacgatacttgtcaggaagcgagcgggcaaagaggcatggggttctcgctgacttcttctccgggacgtggagtcaaggcacaaaaaagctaattacgttaccgcttgtcggcaagccccttaatctcgatcggaaagttgcgccacagccgctgtggttctcccacacagtggcaaaccttaggaaactaaaagagctgccctatcacctgctgcactctggcagactcgaagaactgaaacaagaggttctgggctccatgagttggatctcatgccgaggcatctctggcggaattgaagacctgttggacgacttcgacttatgcgctccccatctggactcgcctgaagtcggacttgtgcgggaagcccttcagttatgcagaccagctgttgaactcagagggatggagaggtcccttctatacacggaacttctcgcaagacttcactttttcgcaacatcgcaccctgctctggtgggacagctttgccagcaggcccaaagctggttccagctctgcgctcacccagtactggtgcccctcggcggattcctacagccacccggagggcctctgagagctaccctcagcggatgccacaaaggaatcactgctatggcgtggggcgtggaggagaagctactggtgataggtacacaggatggaataatggctgtgtgggacatggaggaacagcatgttatacacatgcttacgggacacaccggagaggtgcgctgcgtgaagattttcgccaagggtaccctcgctaattccgccagcaaagactatacactgcatttgtggaacctgctgtctggtcaggagaagttcacaatttgggatgggggttcaaagaacccagcagaaccacagatttggaacttacatgtggacgaggcacataaggtcgtgtatagcgcttctgggagtaagattaatgcttggaacttggagactgccgaacctgtctttcatatcctaggagacgctagtgacccatggatgtgcatggccgtgctggcctcacaagccactcttctgactgtcagtcgagatggagtggtgtccctttggtctagcgctaccggaaaactgcaggggaagcagcacatgtcctccatcaaagaagagaccccgacttgtgctgtgtctgtgcagaagcagggaaaactcgtaactggtttcagtaatggtagtatatccctggtttcgtccaagggcgacagattgctggagaaactgcccgatgccgtgagatttctggtagtgtctgaagatgaatcgctgctcgccgcaggctttggcaggtcggtacggattttcctagccgactccaggggattcaggcgctttatggccatggatttagagcacgaagatatggtggaaacagccgtgtttggtactgaaaataatctaattattaccggatctttagacgcactgattcaggtctggtccctgagcgagcagggaacactccttgatatcctcgagggggtgggggctcccgtctcactgcttgcgagagggggagcattggtggccagtgcatcaccgcagtcttcgtcattcaaggtttgggacctgtccgatgcccatagaagccgtgtacctgcccctttcttggataggacgggcctgaccgcagttagccacaacggaagttacgtttatttccccaagatcggggataaaaataaggttaccatctgggaccttgccgagggagaagaacaggattccctcgatacatcttccgagatcagatgtcttgaagttgctgagcagcggaaactgctgttcactgggctggtctctggggtggttttagttttcccactcaatagtagacaggacgtgatctgtatcccacctccagaggcaaggaaggctatcaactgtatgtctctgtccaagtgcgaggacagactggccattgcttacgacaacattgttctcgtactggatataaccagcggagacccttgccctgtcatcgatggtcctcggtacactttttatacacagctgccggagactttgagtagcgtggctatcttgacggactaccgagtggtgtactcaatgaccaacggtgacttattcctgtatgaatgcgccacctccaaggcatttccactggagacccatcggagccgcgtggcatgtgtggaggtctcgcataaggaacagcttgtagtgtcaggatccgaggatgctttactgtgcctgtgggatctgcaagctcgcaagtggaaattcgaaatgtcttataccgccccatgctag

SEQ ID NO: 57740 - DNA, 4290 bp, Artificial Sequence
  Description of Artificial Sequence: Synthetic coding sequence
atggattcccagttccatatggccggtgaggccagccagtcgtggctgaaggccaaggagaaacagcgtggtactagttacatggttgcggtgatcgagtgggaaatcgaaagaagcctattgtcctcagaagaccgcgagcaaggagctaccgtctttctgcgcgagatccaggatctgcacaagcatattctggaagattgcgccctgcgaatggttgaccgactggccgatggctgccttgacgccgatgcacagaatctcctcagcagcctaaagtcccacatcacagacatgcacccgggagtgttgaagacacaccggctaccatggagtagagatttggtcaaccccaaaaataaaacccacgcttgctatctgaaggaattaggggagcagttcgtggtccgtgcgaatcaccaggttctgactcgcttaagggaactagacactgctggacaggaactggcatggctgtatcaggagattaggcaccacctgtggcagtcttccgaggtaattcagacattctgtggacgacaggagctgctggccaggttgggccaacagctgcggcacgatgattcaaaacagcatacccccctcgttctatttgggccacctgggatcggtaaaactgccctaatgtgtaagctggccgagcagatgccgaggctcctgggacataagacagttacagtgctacgcctgcttggaacatcacagatgtccagcgacgctcggggacttctcaagtccatttgcttccaggtgtgcctggcttacggacttcccctgcctcctgcacaagtgctggacgctcataccagggtggtacagttttttcacacattactgcacacagtgagctgcaggaatttcgaatccctggtgttgctcctggatgctatggacgacttggattccgtccgacatgcaagaagagtaccctggctaccattgaattgtccccctcgagttcatcttattctgagcgcctgctcaggcgcactgggagttttggacacacttcagagggtgctgctggatcctgaggcatactgggaagtgaagcccttgtctgggaatcagggacaacagatgatccagctcctgctggccgcagcacgaagaacactgtctccagtgcacactgatcttctgtgggcctctcttcctgaatgcggcaatcctgggagactgagacttgctttcgaggaggcgagaaaatgggccagtttcacggttcctgtccctctggccaccactgcagaggaggcgacccatcagctgtgcacgcgccttgagcagactcacggccaacttctcgtggcgcacgtcctgggctatattgtaagcagccgccatggattgtctgaggccgaactgaaggacgtgctgtccctcgacgatgaagtattgcaggatgtctaccgtgattggacccctccaagtaaggagcttctgcgctttccccctctgttatgggtgagactgagaagggatctcggttattaccttgcccgacgcccagtggatggattcacactgctcgcaatcgctcacagacaactggttgaggtggtccgagaacgatatctcagcggctctgagcgggctaaaaggcacggtgtgctggccgatttcttttctgggacttggagccagggcacgaaaaagctgattacattgcccttggtgggtaagccactgaacttagatcgtaaggtggcccctcaacccctttggttctctcacactgtagccaatctccgcaagctgaaagaattgccctaccacctgctccactcaggcaggcttgaagaattgaaacaggaggtgttgggatccatgagttggatcagttgcagagggatttctggcggtattgaagacttgctcgacgatttcgacctttgtgctcctcacctcgacagcccagaagtgggccttgtccgcgaggcactccagctgtgccgaccggctgtcgagctgagaggtatggagcggagcctgttatacacggagctactggccagactgcacttcttcgcaacctcacaccctgccctggtcggtcaactgtgccaacaagctcaatcatggttccagttgtgcgcacaccctgttctggtgcctctggggggatttctccaacctcctggtggcccattgcgagccaccctttcaggctgtcacaaggggataacagccatggcttggggagtggaggagaagctcttggtgattggaacacaggatgggattatggcggtctgggacatggaggaacagcatgtgatccatatgctcacaggccacacaggggaagttaggtgtgtcaagatcttcgctaagggaactttagctaattcggcttccaaagactacaccctgcacctttggaatctgctctcagggcaggaaaagtttacaatctgggatggcggttcaaaaaacccagctgagcctcaaatctggaatttacatgtggatgaggcacacaaggtggtctacagcgcctccggcagcaagatcaatgcatggaaccttgaaacggctgagccggttttccacattctgggtgacgcctcagatccatggatgtgcatggctgttctggcatctcaggccaccctgctcacagttagtagggatggtgtagtttccctttggagtagtgctactgggaagttgcaagggaagcagcacatgtcctcaatcaaggaggaaaccccaacctgtgctgtttcagtgcagaaacagggtaagctggtaactggattctccaacggcagtatctcgctggtaagctctaagggagatcggctgttagagaaattgccagatgcagtccggtttctcgtcgtctctgaggacgaatcactcctggccgcaggctttggccgttctgttcgtatcttcttagccgactctcgcggattcaggcgctttatggcaatggacctcgaacacgaggatatggttgagacagcagtgtttggaacggaaaataatcttattattaccggaagccttgatgctttaattcaggtgtggagtttaagcgagcagggaaccctccttgatattctggaaggtgtgggcgctcccgtctcactcctcgcccgtggaggcgcattggtcgctagcgctagtccccagagctcaagtttcaaagtatgggacctgtctgacgctcacagaagcagggtgcccgcaccttttctcgaccgaacaggcctcaccgcagtgtcacacaacggatcgtatgtatacttcccgaaaattggagataagaacaaggtgaccatctgggacctagcagaaggggaagagcaggactccctggacacaagcagtgaaattcgttgcctggaggttgcagagcagcgcaagctcctgtttaccggacttgtttctggcgttgtgttggtgttccctctgaactcccgacaagatgtcatttgcataccccctcccgaggctaggaaagcaatcaattgtatgtccctgtccaagtgtgaagatagactcgcaatcgcctacgataatatagtgctagtactagacatcacttccggcgatccttgccccgtgatagatggtccaagatatacgttctatactcagctacctgaaaccctctcttccgtggccatcctaacagactaccgtgtggtgtactctatgacaaacggggacctgtttctatatgaatgcgccacctccaaggccttcccactggagacccacagaagtagagtggcatgcgtggaagtcagccataaggagcaactggtggtgtccggatcggaggacgcactgctgtgcctgtgggacctgcaagccaggaagtggaaattcgagatgtcctacacgtctagttactgccgaggcgtccagtgcgcctgcttctccaaggacgacaaatatgtatatgtagggctcaaagaccgctctatcctggtctggtccgtgttagacggcacgcttctcactgtgcaattcgtgcacgctgtggtgaatcgcattattcctaccaccagcggcttcattgcccctacacgacatggatatcttatcagagagaattttcaatgcttgtccgcgaaggctagtccccaggatccgttgaagaactttaagaaggcaatgtggatggttaaatcccgccagcgggaggagctagtagcagccgcaggggctccacaggacctggagtcagagtccgcgcaagggaatgagacaaaaagcaataaatgcagccaggtttgccttatagtgtag

SEQ ID NO: 57741 - DNA, 4077 bp, Artificial Sequence
  Description of Artificial Sequence: Synthetic coding sequence
atggtggaccggctggcggacggttgcctcgacgcagacgcccagaacctgctttcctctctgaaaagtcatataaccgatatgcaccccggtgttctgaagacccatcggcttccttggagcagagacctcgtaaatccaaagaataagacacacgcttgctacttaaaagagctgggggaacagttcgtagtgagggcaaatcaccaggtcctaactagattgcgtgagctagataccgcaggacaggagctcgcatggctgtaccaagagattcggcatcatctgtggcagagctctgaggtgatacagacattttgcggtcgacaagaacttctagcacggcttggccagcagctcaggcatgatgactccaagcaacacacacccctcgtactgttcggaccaccaggaatcggtaaaacagccctcatgtgcaaactggctgaacaaatgcccagactcctgggtcacaaaaccgtgaccgtgcttcgcctgttgggaacctcacagatgtcatctgacgctcgcggactgctgaagtccatctgttttcaggtctgcctcgcttatgggctccccctaccgccagcccaggttctggacgctcacaccagggtggtgcaattcttccatacccttctgcacactgtgagttgtaggaatttcgagagccttgtgttactgctcgacgcaatggacgaccttgattcagtgagacatgcacgtcgggtaccctggctgcccctgaattgcccccctcgggtccaccttatactgtcagcctgttctggggcattgggggtcctggacacgctccagagagtactgctcgatcccgaagcctattgggaagttaagcctctgtcaggtaatcagggacaacaaatgatccaactcctcctggctgcagccaggcgcacactgagcccagtgcacaccgacttactttgggccagcctccccgagtgcggaaaccccggtaggttacgattagcgtttgaggaggcacggaagtgggccagttttaccgtgccagttcctcttgccaccactgctgaggaggccacgcaccaattatgtactagactggaacagacacacggacagctcctggtggcacacgtgttggggtatatagtttctagtcgccacggcctgagtgaggcagagctgaaggatgtgctgagcctggatgatgaggtcctgcaggacgtgtaccgcgactggacccccccatccaaagagctgctgcggtttcctcctttactgtgggtgcgcctgagaagggatctcggttactacttagctcgcaggcccgtcgatggcttcaccctgctagcgatagcacatcgtcagttggtagaggtggtccgcgagcgatatctttccggctcagaacgcgcaaaacgccacggagtcctggccgatttcttctcgggcacatggtcccagggaacgaagaaattgatcaccctgcctctggtcggtaaacctctcaacctggacaggaaggtggctcctcagcccctgtggttctcccacacagttgccaacctgcggaagctgaaggaattaccctatcacctattgcactccggcagactcgaagaactcaaacaagaagtgctcggatcaatgagttggatctcatgcaggggaatcagcgggggaattgaggacttgctggacgattttgacttgtgtgcgcctcacttggactcccccgaggtgggtctagtgcgggaggctctgcagctctgcagaccggcagtcgaactccgcggaatggagaggagtctactctacaccgagcttctggcccgactacacttctttgctacatcacatcccgctcttgtcggccaactgtgccagcaggctcagtcctggttccagctgtgtgctcatccagtactcgttcctcttgggggtttcctgcagcctcccggaggcccattgcgggcaaccctgagtggctgtcacaagggaattactgccatggcgtggggagtggaagaaaaactactggtcattggcactcaggatggcatcatggctgtctgggatatggaagagcaacacgtgattcatatgctcacagggcacactggcgaggtgcggtgtgtcaagatatttgcaaagggcactctggcaaatagcgcatcaaaggactacactctgcatctctggaacctgctcagtggccaggagaaattcaccatatgggatgggggtagcaaaaaccctgctgagcctcaaatctggaacctacacgtggatgaggctcacaaggtcgtctactctgcaagtggtagcaagataaatgcatggaatctggagacagccgaacctgtgtttcacatactgggagatgcctcagacccttggatgtgcatggccgtactcgcttctcaggcaacactcctgactgtgtcgagagacggagtggtctcattgtggagctcagccacaggtaaattgcagggaaagcagcacatgtcatctattaaggaggagacccccacgtgtgccgtcagcgttcagaagcagggaaagctcgtaacaggctttagtaacggcagtataagtttggttagctcaaaaggagacagactcttggagaagcttcctgatgcagttcgcttcctggtggtctcggaagatgagagcctccttgccgctggattcggccgatccgtccgcattttcctggctgattcccggggtttcaggcgatttatggcaatggacctagaacacgaggatatggtcgaaaccgccgtctttggaacagaaaataacctgataataacagggtcacttgatgccctcattcaggtgtggagcctgagcgagcagggcacactattggacatccttgaaggtgtaggggcacccgtaagcctcctggccaggggcggtgccctagtggcctcagccagcccacagtcctcctcgtttaaagtatgggacctgagtgacgcccatcgttctagggtgccggctccatttcttgacaggaccggcctaactgccgtttcgcacaatggctcatatgtttattttcccaaaatcggagataagaacaaagtgaccatatgggacctggcagagggtgaagagcaggattctctggatactagcagcgaaatccgatgcctggaagtggcagagcagcgcaagctattgtttacgggtctggtctctggagtcgtgctggtgttccccctgaattctaggcaggatgtgatctgtatcccgccacccgaggccaggaaagcaattaactgtatgtcattgtccaagtgtgaagaccgcttagccattgcgtatgacaatattgtactagtgctagatatcacgagtggagacccctgcccggtgattgacggacctaggtataccttttacactcagctgccagagactctctcctcagtggcgatcctgacggactacagggtagtgtactcaatgacaaacggagacctgtttttatatgaatgcgcaacttcaaaagcttttcctctggagactcatcgcagtcgagttgcctgtgtggaggtcagccacaaggagcagcttgtagtgagtggctcagaggatgccctgctgtgcctctgggacctccaagcgcgaaagtggaagtttgaaatgagctataccagctcttactgtcgcggtgtccaatgtgcgtgcttctcaaaggacgacaagtatgtctacgtcggcctgaaagataggtccatcctggtttggtcagttctggatggcacgttgcttactgtgcagtttgtacacgccgtagtgaaccgtattataccgacgacttccggctttattgcccctacccgccatggataccttattagggagaatttccaatgtctctctgctaaagcatccccccaggatccacttaagaacttcaaaaaagcaatgtggatggtcaaaagtagacagcgagaagagcttgtggctgcagctggcgcaccccaggatttagagtcagaatctgcccaggggaacgaaaccaagtctaataagtgctcccaggtctgcctgattgtctag

SEQ ID NO: 57742 - DNA, 4299 bp, Artificial Sequence
  Description of Artificial Sequence: Synthetic coding sequence
atgcagcggggtaaaccctgtcgggctctgccaacactgaaatgccagacattctgccaaagacatggactgatgtttgaagtggtagatctacgttgggggatccgtaacattgaggcaacagaccacttgactacagaactgtgccttgaagaggtcgacaggtgttggaaaacctccattggacctgctttcgtggccctcattggcgaccagtacggtccctgcttgatcccgtccaggattgacgaaaaggaatgggaggtcctacgcgatcacctgaccgcacgaccatccgacctggagcttgtcgccaggtactttcagcgggacgagaacgcctttccccctacctacgtcctgcaagcaccagggaccggggaagcttgtgaaccagaggaggcgactctaacctccgtactacggagcggagctcaggaggctagacgcctcggattaatcactcaggaacagtggcagcattatcatcggtccgtcatagaatgggagattgagaggtctctgctatcaagcgaggatcgggaacagggagctactgtgttcctcagagagattcaagacctccacaagcatattctcgaggactgtgccctgaggatggtggatcgacttgcagacgggtgcctggacgcggacgcacagaacctcctctccagccttaagtcccatatcaccgacatgcatcctggcgttctcaaaacccaccggctcccatggtctagagatctagtcaatccaaaaaacaaaacgcatgcctgttatcttaaagaactaggggagcagtttgtggtgcgcgcaaaccaccaggtgctcacgaggctgcgagagctggataccgccggtcaggagctggcgtggttgtatcaggaaatccgtcatcacttgtggcagtcctcagaagttattcagaccttctgtggcaggcaggagctgctggcccgtctgggccagcagctgcggcatgatgactctaagcaacatacgccgttagtgctgttcggaccgccagggatcggaaaaaccgctttgatgtgcaagctcgcagagcagatgccaaggttactgggccacaagaccgtcacagttttacgcttgctcggcacctcccagatgtcatcagacgccagagggctgctgaaaagtatctgctttcaagtctgccttgcttatggactccctcttcccccagctcaagtcctggatgcccatactagagtggttcagtttttccatacactgctccacacagtgagttgtagaaactttgagtctctcgtgctgctattggacgctatggacgacttggatagcgtacggcacgcgaggcgggtgccttggctccccctcaattgcccaccacgggtgcacctaatcctgtccgcatgttccggggcactgggggtcctggacacactccagagggtcttgctggatcctgaagcgtattgggaagttaagccactttccggaaatcagggccaacaaatgatacaattactgctcgccgcagcccgaagaactctgtctcctgttcacacagaccttctgtgggcatccctgccagagtgcggtaatcccggacggttaaggttggcctttgaagaagctcgtaaatgggcttctttcactgttcccgttccgctggcaactactgccgaggaggctacacaccagctttgcaccagactggagcaaacccacggacagctcctggtggcccatgtcctcggttacatcgtttctagcagacacgggctctcagaagccgagttaaaagacgttctttctctagatgatgaggtgctgcaggatgtgtatagggactggacacccccttcgaaggagctgttgcgttttcctcccttgctgtgggttcgactgcggagggatctgggctactaccttgcccgtcgacccgttgacggctttactctgttagctatcgcccatagacagttagtggaggtggtccgagaaaggtacctttcagggtccgagagggcaaaaagacacggcgtgttggctgactttttctcagggacctggtcccagggtaccaagaagctcatcaccctcccactggttggcaagcctctgaatctggaccggaaggtagcccctcagccattgtggttcagtcacaccgtcgctaaccttcggaaacttaaagaactgccctaccatctgttacactctggtcgactcgaggaactcaaacaagaagtgctggggtcaatgtcatggatcagttgcaggggtatatctggcggaatcgaagacctcctcgacgacttcgacctgtgtgcccctcatcttgactcacccgaggtagggctcgtaagggaagctttgcaactctgccggccagcagttgagctgcggggaatggaaaggagcctgctttatacggagctgctggctcgacttcacttttttgcaacatctcaccccgctcttgtgggccagttgtgtcaacaggctcagtcctggtttcagctctgcgcgcaccccgtactggtccccttaggtggctttcttcagccacctggtggaccgttgcgcgcaactctttccggttgccataaggggattactgctatggcctggggcgtcgaggaaaagttgttggttatagggacccaggatggcatcatggccgtatgggatatggaagagcagcacgtgattcatatgcttaccgggcatactggcgaggttcgatgcgtcaaaatctttgccaagggtacgctggccaactctgccagcaaagactacaccttgcacctgtggaatctgctcagcggacaggaaaaattcaccatttgggatggcggttctaaaaatcctgccgagccccagatttggaaccttcacgtggacgaagctcacaaggtggtttatagcgcctccggaagcaaaattaacgcctggaaccttgaaactgcggagcccgtgttccacattctgggcgatgccagtgatccttggatgtgtatggctgttctcgcttcgcaggcaacccttctgactgtgtcacgggatggcgttgtatctttgtggtcttcggccacaggcaagttacagggaaaacagcatatgtcaagcattaaggaagagacccccacctgcgctgtgtcagtccagaagcaagggaagctggtgactggcttctccaatgggagcatttctctggtaagctccaagggcgaccgactgcttgagaaattgcctgacgccgtcagattcctagttgtgagcgaggatgagtcactactcgccgctggatttggacggtccgtgagaatctttcttgctgattcccgcggattccggaggttcatggcaatggacttagagcatgaggatatggttgagactgccgtctttggcaccgagaacaatctaatcataaccggatcgctggatgcattaatacaggtgtggtccctgtccgagcagggaaccctgctggacatcctcgagggggtgggtgcccctgtgtccctgctggccaggggcggtgcattggttgcgtctgctagccctcagagttcctcattcaaagtatgggatttatctgatgcccaccggtccagggtcccagctccttttctggatcggacggggttgaccgccgtatcgcacaacggatcatacgtttacttccctaagataggggacaaaaataaggtcactatctgggacctcgcggagggggaggaacaagattcactcgacactagctctgaaattcggtgtcttgaagtggcggaacagcggaaactgctgtttacagggctcgtcagcggggtggttttggtatttcctttgaactctcgccaggacgtcatctgtattcccccacctgaggcgcgaaaagctataaattgtatgtcgctgtcgaaatgcgaagatcgactggctatcgcttacgacaacattgttctggtcttggacattacaagcggcgacccctgtccagttatagatggaccccgttacacattctacactcaactccctgagacactctccagtgttgctattctcactgattaccgcgtggtgtactcaatgaccaacggcgatctatttctctatgaatgtgccacaagcaaggcattccctttagaaacacaccgttcccgcgtcgcctgcgtagaagtcagccataaagagcagctagttgtttctggctctgaggacgcgctgctttgtctctgggatctccaggctcgtaagtggaagtttgagatgagctacacagcgccttgctag

SEQ ID NO: 57743 - DNA, 1182 bp, Artificial Sequence
  Description of Artificial Sequence: Synthetic coding sequence
atggacgagaatgagagcaatcagtccctcatgaccagttctcagtaccccaaggaggccgtcagaaaacgccagaatagcgcccgtaactcaggggcatctgactcatctagattcagcagaaagtcatttaaacttgattacagacttgaggaagacgtcacaaagagcaaaaaaggcaaggatggtcgtttcgtaaacccctggccgacctggaagaatcccagcattccaaacgtgctgcgatggttgattatggagaaagaccacagctcagttccttcatctaaggaggagctggataaggagttgcccgtgctgaagccctattttatcaccaatccagaggaggctggcgtgagagaggccggattgagggtcacctggctcggccacgctaccgtgatggtcgagatggacgagctgattttcctgacggatcccatcttcagcagtagggcttcccctagtcagtacatgggtcccaaaaggttccggcgaagcccctgcacaatttctgagctcccgcctatcgatgctgttctcatcagccacaaccactacgaccatctcgactacaacagtgtcatagctctgaacgaacgattcggcaatgagttgcgctggttcgtacctctgggcctgttagattggatgcagaaatgtggctgcgagaatgtaatagaacttgattggtgggaagagaactgtgtcccgggacacgataaagtcacctttgtatttacccccagccaacactggtgcaaacgaactttgatggatgataataaagtactgtggggctcctggtccgtcctcgggccatggaaccggtttttcttcgctggagatacggggtattgccccgcattcgaagagattggaaaacggtttggtccattcgacctggccgcaatcccaataggtgcttacgagcccagatggtttatgaaatatcagcatgtggaccccgaagaggctgtgaggatacacacagacgtccagacaaaaaagagcatggcaatacactggggcacatttgctcttgccaatgagcactatctggagcccccagtaaagcttaacgaggcacttgagaggtatgggcttaatgccgaggactttttcgttctgaaacacggtgagagccggtacctgaataacgatgatgaaaatttctag

SEQ ID NO: 57744 - DNA, 483 bp, Artificial Sequence
  Description of Artificial Sequence: Synthetic coding sequence
atggtggcaaacctgagcagaggacccgagcctcctttcttcaagcagctgatcgtgccgctgattccctccattgtcgaccgtgcgcctaaaggaaggacattcggcgatgtactgcagcccgctaagccggagtatcgtgtgggggaagtggctgaagttatctttgtcggcgctaatccaaaaaactccgttcagaaccagacccatcagacatttctgaccgtcgagaagtacgaagcaaccagcaccagttggcagatcgtgtgtaatgacgcctcctgggagaccagattctattggcacaagggcctcttagggctgagcaacgcaaccgtcgagtggcatatacctgataccgctcagcctggcatttaccgcatcaggtacttcggccataaccggaagcaagatatcctcaagcccgctgtgatcctgtcctttgaggggacctctcctgcctttgaagtcgtaaccatatag

SEQ ID NO: 57745 - DNA, 498 bp, Artificial Sequence
  Description of Artificial Sequence: Synthetic coding sequence
atgcggcaacatcgccagttcatggatcgcacccattacctgctaaccttttcctccagtgaaaccttgctcagactcttattgcgaatcgtggaccgggctcctaagggcagaacttttggagatgtactgcagccagcgaaacctgagtacagggtcggagaagtggcagaggttatcttcgtgggcgcaaaccccaagaactccgtgcagaaccagacccaccagacctttctcactgtcgaaaaatatgaggctacctccacatcttggcagatcgtgtgcaatgacgcatcctgggaaaccaggttctattggcacaaggggctgctgggattatctaatgccaccgtggagtggcatatacccgacacagcccaaccgggtatttataggatccgctacttcgggcataatagaaagcaagacattctgaaacccgcagttatcctgagctttgaagggactagcccagctttcgaagttgtgactatctag

SEQ ID NO: 57746 - DNA, 483 bp, Artificial Sequence
  Description of Artificial Sequence: Synthetic coding sequence
atggtggccaatctcagtagggggccagagccaccgttcttcaagcagttgatagttcctttaatcccctccatcgtggatcgagccccaaaaggccgtaccttcggcgatgttcttcagcctgcaaagccagagtatcgggtgggtgaggttgcagaggttatttttgtgggcgctaatcctaagaactctgtgcagaatcagacacatcagaccttcctgacagtcgagaagtatgaggcaacaagcacatcctggcagatcgtgtgcaacgacgcctcttgggaaacgagattctactggcataaggggctgctaggtctcagcaatgccacagtagaatggcacatccccgatacagcccagcctgggatatatcgtatcaggtatttcgggcacaacaggaagcaggatatcctgaagccagccgtgattctctcttttgaaggaacctctccagcctttgaggtggtgaccatttag

SEQ ID NO: 57747 - DNA, 1122 bp, Artificial Sequence
  Description of Artificial Sequence: Synthetic coding sequence
atggagcccgcagtgtccgagcccatgagagatcaggtggccaggacccatcttacagaggatacaccaaaagtgaacgccgatatcgagaaagtgaaccagaatcaggccaagcggtgtaccgttatcggtggctcggggttcctgggacagcatatggtcgagcagcttctggcgcgaggctacgcagtgaatgtatttgatattcaacagggctttgacaacccacaggttaggttctttctgggagacttatgctctaggcaggatttataccccgcactaaagggagtcaacacagttttccattgcgcctcacctcctccatccagtaacaacaaagaactgttctaccgggtgaattacataggcaccaaaaacgtgatagaaacatgcaaagaggcgggagttcagaagctcattttgacatcctccgcctctgtcatcttcgagggagtggacattaaaaacgggacagaggaccttccatacgctatgaagcctatcgattattatacagaaacaaagatcctgcaggagcgagccgttctgggagcgaatgatcctgagaaaaacttcctgacaacggcaattaggccccacggcatctttgggccaagggacccacaattggtgcccattctgatcgaggccgctaggaatggcaagatgaagtttgttatagggaacggcaagaatttggtcgatttcacttttgtcgaaaacgtggtgcacgggcatatcctggcagctgagcagctgtcacgggactcaacccttggtggcaaggccttccacattaccaatgatgagccaattcctttttggacctttctgtcccgaattcttaccggcctgaattatgaggcgcctaaatatcacatcccttattgggtagcatactatttagcactcctcctgtccctgctggtgatggtcattagccctgtgatccagctgcagcccacttttacaccaatgagggtcgccctggcaggcacattccactactattcttgtgagcgagccaagaaagccatggggtatcaacccctggtgacgatggatgacgctatggagcggaccgtacaatcctttcgccacctccggcgagtgaaatag

SEQ ID NO: 57748 - DNA, 1122 bp, Artificial Sequence
  Description of Artificial Sequence: Synthetic coding sequence
atggagcctgccgtttctgaaccgatgcgtgaccaagttgctagaacccacttaacagaagatactcctaaggtgaatgccgacatcgaaaaagtgaatcagaaccaggcaaagcgatgtaccgttattggcggttcaggcttcctcggacagcatatggttgaacagctgttggccagaggctacgctgtaaacgtttttgacattcagcaaggatttgataacccgcaggtcaggttctttctgggggatctctgctccaggcaggacctgtatcctgcccttaaaggagtgaatactgttttccattgcgcaagtccccctcctagctcaaataacaaggaactgttctatcgagtaaattatattggtacaaaaaatgtcatcgagacatgcaaggaggctggagtacaaaagctgatcctcacctccagtgctagcgtaatctttgagggcgtagacatcaaaaatgggacagaagaccttccctatgcaatgaagccaatcgactactacaccgaaacgaagatcttgcaggaacgcgctgtgctgggagccaacgatcctgagaagaatttcctgaccaccgctatccggccacatggcattttcggacctagagacccccagcttgtaccaatccttatcgaggcagctaggaacggaaagatgaaatttgtgattggcaacgggaaaaacttagtggactttacattcgtggagaacgtggtgcatgggcacatcctcgctgccgagcagctgtcgcgggactccacactcggcggaaaagccttccatattacaaatgatgaacctatccctttctggacctttctgtcgcgaatccttacagggctgaactatgaagctcctaaatatcatattccgtactgggtagcatattatctagctctccttctctctctgctggtgatggtcatatcacccgtaatccagctgcagccaacgttcacccctatgagggtggcacttgctgggacgttccactactattcctgcgagcgcgcaaaaaaagccatggggtaccagccacttgtgacaatggatgatgccatggagcgaacagtccagtcctttagacacctgaggcgggttaaatag

SEQ ID NO: 57749 - DNA, 264 bp, Artificial Sequence
  Description of Artificial Sequence: Synthetic coding sequence
atggcgggtgctagcttgggagctcgcttctacagacagatcaaacgtcatccaggaattattcccatgatcggtttaatttgcctgggcatgggttctgccgcactgtacctgctccggcttgcactgagaagccctgacgtctgttgggaccgaaaaaataaccctgagccctggaacaggctatcacccaacgatcaatataagttcttagccgtcagcacagactataaaaagctgaagaaggaccgcccagacttctag

SEQ ID NO: 57750 - DNA, 264 bp, Artificial Sequence
  Description of Artificial Sequence: Synthetic coding sequence
atggctggggcttcactaggagctcgattctaccggcagattaagcggcaccccggtattatcccaatgattggacttatttgtctgggtatggggtccgctgccctgtacctgttgcggctggcattgcgtagccccgacgtttgttgggataggaaaaataatccagaaccatggaatcggttgtctcctaatgaccagtataagttcctcgctgtgagtaccgactataagaagctcaagaaggataggcccgacttttag

SEQ ID NO: 57751 - DNA, 387 bp, Artificial Sequence
  Description of Artificial Sequence: Synthetic coding sequence
atgactgggtacacaccagacgagaagctccggctgcagcagcttagagaacttagacggagatggctgaaggatcaagaactctcacctcgggagccggtactgccccctcagaagatgggcccaatggaaaagttctggaacaaattcctggagaataagtctccatggcggaagatggttcacggggtgtataaaaaatctatctttgtttttacccacgtcctggtacctgtgtggattattcactactatatgaaataccacgtctctgaaaagccctatgggatcgtcgagaagaaaagcaggatatttcccggagacaccatcctggaaactggggaggtgattccccctatgaaagagttcccagatcagcatcactag

SEQ ID NO: 57752 - DNA, 753 bp, Artificial Sequence
  Description of Artificial Sequence: Synthetic coding sequence
atggatatgctgcaggatctcgagtcattgcagttcgagtatggcgtgcccgaggaggacaggatttggctgtatcttcaagggaggagtagaggcctgatgatcgaggcctgcgctcacgctacctttttttgtaagctgctttataatctgcgcgcatctttgaataagaatcagtcgtcccgtcacctttctattggctcactcaattccgcaacaccagaggagtttaaggtgggtattattggcggaggtcacttaggcaaacagctcgccggaacacttctgcaactcggacccattcccgctgaatcactgcgcataagtactagacggcctgagacacttggtgagctgcagaagctagggatcaagtgcttttaccacaacgcagatttggtctcgtgggccgacgtgatttttctatgctgcctgccttcacagctaccaaacatctgtgtcgaaatttataccagcctggagaaggcgtctatagtctacagttttgtcgccgcaattcctttgcccagactgaaactcctcttgaatcatacaaatatcttacgaccacagtatcagtacgacgaggattcagtaagtgtgtggggggctaacaaaggggtcattgccgctctgcaagaccctactatattgcaggccacatgcccctactcccctgcaggccacggctccacatacttctggcatagcttcgaaaattacttccccgtgggaccactccttagctactag

SEQ ID NO: 57753 - DNA, 1080 bp, Artificial Sequence
  Description of Artificial Sequence: Synthetic coding sequence
atggatatgctgcaggacctcgagtctctgcagtttgaatatggggtccccgaggaggaccgaatctggctctatctgcaaggtcggtctcggggattgatgatcgaagcatgcgcccatgccacattcttctgtaagcttctctataacctgagggctagtctgaacaaaaaccagagcagtaggcatctctctatcgggtccctcaattcggccaccccagaggagtttaaagttggcatcatcggaggagggcatctgggaaaacagctggcaggcaccctgctgcagttaggtcccattccagccgagagcctcaggatctctactcggagacccgagacactcggtgagctgcagaagctcggcatcaaatgcttctatcacaacgctgatctggtgtcgtgggcagacgtgatttttctctgctgtctgccctcccagctgccaaatatatgtgtggagatctatacaagccttgagaaagcctctatcgtttactcctttgtggccgcaatacccctccctcgacttaaactgctacttaatcatactaacattctgcggccacagtaccagtacgatgaggacagcgtgagtgtttggggagcaaacaaaggggtgattgccgctttgcaagaccctaccatactacaggccacttgtccctactcccccgcagggggaattatcctgaacataaagtggctggagggagtgttctacgcagcactcaacatttgcaccgcgcgtaacatggcacactcccaggtgctccaactgctgtcagagctctttctgtccgtccattttgaagattgtggtaaggatactgcctcctgtccaaaattgcagcttaccgattttgtgagtaaggcctacggaaagaacctctcccaagaaagaccctttccatggttcgacctcactgcagtccagcttaaagaaactcctttctcgcagcacctttcgtccagtcccgtgttacaggaccatctcacacatctctactgcgctagctttggcataagcctaaccaaagaacagccggttatcagcaccggattcccaagccaatag

SEQ ID NO: 57754 - DNA, 672 bp, Artificial Sequence
  Description of Artificial Sequence: Synthetic coding sequence
atggacatgcttcaggatctcgaaagccttcagtttgaatacggagtgcctgaagaagaccggatctggttgtatctgcaagggcgtagcagaggcttaatgatcgaggcgtgcgctcacgcgacattcttctgtaagctcctctacaatttgagagcaagtctcaacaagaatcagtcctccaggcacctgtcgattggctcactgaactcggcgacgcctgaagaattcaaagttggcattattggaggaggtcatcttggcaaacagttggctggcactctcctgcagctgggccctattcccgcagagtctctcagaatctctactagaaggcctgagaccctcggagaactccagaagctcggcattaagtgcttttaccacaacgcagaccttgtatcctgggcagacgtcatcttcctgtgttgcctgccaagccagcttcccaatatttgcgtggaaatctatacgtctctggagaaagcatccatagtgtacagtttcgtcgctgctattcctctccccagactcaagctgctcttaaatcatactaatatcttgcgacctcagtatcaatatgacgaagactctgtctcagtgtggggggctaacaagggagttattgctgcgctgcaagatcccacgattctgcaggctacctgtccatag

SEQ ID NO: 57755 - DNA, 699 bp, Artificial Sequence
  Description of Artificial Sequence: Synthetic coding sequence
atggacctccctattcaggattctcatgacagctccaccagcccaaaaggtaaacagcccacgactgccgagaagtccgccacgaagaaggaggacaaagtgcctgtgaaaaagcagaagacgagaacggtattcagtagcacccagctctgtgtgctcaatgatcgcttccagaggcagaagtatctttccctgcagcagatgcaggagctgtccaatatcctgaacctatcctataaacaggtgaaaacatggtttcagaatcagcgcatgaagtccaaacgttggcaaaagaataattggctaaaaaatagcaacggggtgacccagggctgtctggtcaatccaaccgggaatctgcccatgtggtcaaaccagacctggaataacagtacatggagcaatcagacacagaatatccaaagttggtcaaatcactcatggaacacccagacatggtgcacccagtcttggaataaccaggcatggaatagccccttttacaattgcggcgaggagtcccttcaaagctgcatgcagtttcaacctaatagtcctgccagcgacctggaggccgcactcgaggccgcaggcgaaggactgaatgttattcagcagacaaccagatatttcaacactcctcagactatggatctttttctcaactattcaatgaatatgcagcctgaggacgtgtag

SEQ ID NO: 57756 - DNA, 912 bp, Artificial Sequence
  Description of Artificial Sequence: Synthetic coding sequence
atgtcttcgacactgccagctctgctttgcgtggggctctgtctgtcacagaggatttccgcccagcaacagaccctgccgaagccatttatctgggcggagccccatttcatggtaccaaaggagaaacaggtcaccatctgctgccaaggcaattacggtgcagttgaatatcagctacatttcgaggggagcctttttgctgtggatcgacctaagccacctgagcgcattaacaaagtgaagttttatatcccggacatgaattcccgtatggccggacagtattcgtgtatctaccgtgtgggcgagttgtggtccgagccttctaatttgctggatttggtcgtaaccgagatgtacgatacacccactttgtctgtgcaccccggtccagaagtgatctctggcgaaaaggtgaccttttactgtcgactggacaccgccacttctatgtttctgcttcttaaagagggcaggtcctcacacgtgcagcggggttacggtaaagtgcaggcagaattccctttaggtccggtgacaaccgcccaccgcggtacatatcggtgctttgggtcatataacaatcatgcctggagttttcctagtgagcccgtgaaactcctggtgactggcgacatcgagaatacctctcttgcgcctgaagatccgacattccctgatacttggggaacctatctgctcactactgaaacgggcttgcaaaaggatcacgccctttgggaccataccgcccagaacttactgagaatgggcctagcatttttggtgctggtggctctcgtgtggtttcttgtggaggattggttgtcccggaagagaacaagagaacgagccagcagggcgagcacatgggaggggagacggcgacttaatacgcaaacgctgtag

SEQ ID NO: 57757 - DNA, 912 bp, Artificial Sequence
  Description of Artificial Sequence: Synthetic coding sequence
atgagcagcacgctgcccgcactactgtgtgttggcttatgcctgtcccagagaattagtgcacagcagcagacactgccaaagccctttatttgggctgaaccccattttatggtaccgaaagaaaaacaggtcaccatctgctgccagggaaactacggcgctgtggaataccagctgcatttcgaagggtctctattcgcagtggatcgacccaaaccgcctgagaggatcaacaaagtcaagttctatatcccagacatgaacagcaggatggccggtcagtactcatgtatatatagggtcggcgagctgtggtctgaaccttccaacctgttggatttggttgtcactgaaatgtacgacacaccaaccctgtctgtgcaccctggcccagaggtgatcagcggagagaaagttacattttactgccgattagataccgctacctcaatgtttctgcttctcaaggaaggcagatcatctcacgttcagcgtggttatggaaaagtacaagccgagttccccctgggcccagtcaccactgcccatcggggaacctatcgatgttttgggagttataacaatcacgcttggtcatttccatcagaacctgtgaagttgctggttaccggagatattgagaacacttccttggcacctgaggatcctacttttcctgacacctggggcacttatctgttaaccaccgaaaccggcttgcagaaggaccacgcactttgggaccatacagcccagaatctcctccgaatgggcctggcgtttttagtactcgtggctctggtgtggttcctcgttgaggattggctgtctaggaagaggacaagagagcgtgcttcacgagcaagtacctgggagggacgccgtcgcctgaatacacagacgctgtag

SEQ ID NO: 57758 - DNA, 912 bp, Artificial Sequence
  Description of Artificial Sequence: Synthetic coding sequence
atgtcgtctacccttccagctctgttgtgcgtcggattatgcctgagtcagcgcattagcgcccagcagcaaacccttcctaagccttttatatgggcagagccccactttatggtccctaaggaaaaacaagtgaccatttgctgtcaaggcaattatggggcagtggagtaccagctgcatttcgagggctcactttttgctgtagatagacctaagccccctgagcgtataaataaagtgaagttttacattccagatatgaattcgaggatggccggtcagtacagctgcatttaccgggtgggcgagttatggtcagagccaagcaacctgctcgacctcgtggtgacagagatgtatgacacacccacgctttccgtccaccccggacctgaggtgatcagtggagaaaaggtcaccttctactgccgactggatacggccactagcatgtttcttttgttaaaggagggacgctcctcgcatgtccagcggggatatggcaaggtgcaggctgaattccctcttggtcccgtgacaactgctcacagaggaacgtatcggtgcttcggaagctataacaatcatgcttggagctttccatctgaacccgtaaagttgttggtgacaggcgacattgagaatacctctcttgctcctgaagatcccacattcccggatacctgggggacatacctgctcactacagaaacggggctgcaaaaggatcacgcattatgggatcacacagcccagaatctgctacgtatgggactggcatttctggtactcgtcgctctggtatggttcctggtggaggactggctctccaggaaaaggaccagggagcgtgcctcacgagcgagcacttgggaaggacggcgtcggctgaacacacagacgctgtag

SEQ ID NO: 57759 - DNA, 912 bp, Artificial Sequence
  Description of Artificial Sequence: Synthetic coding sequence
atgtcttcgactcttccagcattgctgtgtgtggggctttgtctgtcccagcgcattagcgcacaacagcaaactcttcccaagcctttcatctgggccgagccacactttatggtgcctaaggagaaacaggtgacaatctgttgccagggaaactatggagctgtggaataccagctgcattttgagggtagcctgtttgctgttgacagacccaagccacctgagcggattaataaggtaaagttctacattcctgacatgaactccaggatggctggacagtattcatgtatctacagggtcggcgagctatggagcgagccatcaaacttgctggatctagttgtgacagagatgtatgatactccaacactgtcagtacatcctggacctgaggtgattagcggagaaaaggtgacgttctactgccgcttggacacagccacgagcatgttccttctgctgaaagagggtcggtctagccatgtacagcgaggatacggcaaggttcaggccgaattcccgctaggcccagtgaccactgcccaccgaggcacctacaggtgttttgggtcctacaataatcatgcctggtcttttccctcagagcccgtcaaactcctggtgacgggcgatattgagaacacctcacttgcaccagaagacccaacctttcctgatacttggggtacgtacctgctgaccacagaaaccggcctgcaaaaagatcatgccctttgggatcacacggcccaaaacttgttgcgcatgggcctggcttttctagtcctggtggccctcgtctggtttctcgtggaagactggctgtctcggaaaaggacaagagagcgcgcaagtagagcgtctacgtgggaaggaagaaggagattgaacacacagacgctctag

SEQ ID NO: 57760 - DNA, 912 bp, Artificial Sequence
  Description of Artificial Sequence: Synthetic coding sequence
atgtccagcacactgcccgctctcctgtgcgtgggtctgtgtctgtcacagagaatcagtgctcagcaacagacacttccgaagccttttatttgggcagaaccacattttatggtgcccaaggagaagcaggtaactatatgctgtcaaggaaactacggtgctgtggagtatcagctgcacttcgaaggtagtctctttgctgtcgaccggcctaagccacccgaacggataaacaaagtcaagttttatattccagatatgaactcacgcatggcaggtcagtactcatgcatttatagggttggtgaactgtggtccgaaccgtctaatcttctcgaccttgtggtcaccgaaatgtatgacacccccaccctaagcgtccatcctggtcctgaagtgatttctggcgagaaagtcaccttttattgcaggctggacactgccacgtctatgtttctcctgctcaaagaaggcaggagctcacacgtccaaagagggtacggcaaggtgcaggcggagtttcctctgggacccgttacaacagcccatcggggaacttacagatgcttcggaagctacaataaccatgcatggtcctttccctccgagccagtgaagctccttgtgacgggagacattgagaacacctccctggcaccagaagacccaacgtttccggacacatggggcacatatttgttgaccaccgagactggacttcagaaggaccatgccctgtgggaccacactgcccagaatttactgaggatgggactggccttcttggtgctggtcgctcttgtgtggttccttgtagaggactggttgagtcggaaaagaacccgggagagggcgtctcgtgcttctacctgggaaggtagaaggcggctcaacacacagaccctgtag

SEQ ID NO: 57761 - DNA, 912 bp, Artificial Sequence
  Description of Artificial Sequence: Synthetic coding sequence
atgtcttcaaccctgcccgctcttctgtgtgtgggcctttgtttatctcagcggatcagcgcacagcaacaaaccctcccgaaaccgttcatttgggctgaaccccactttatggtaccaaaagagaaacaggtgaccatctgctgtcagggcaactatggagcggtcgagtaccagctgcactttgagggcagtctgttcgccgtggaccgccctaagccaccggagcgcataaacaaggtgaaattctacatcccagacatgaacagtcgtatggcgggacagtattcatgtatatatagggttggcgagttgtggtcagagccatccaatttactagacctggtcgtgacagagatgtatgacactcctaccttgagcgttcatccaggacctgaagtgatcagcggcgagaaagtaaccttttactgtagactagataccgccacctctatgtttctactgctcaaggaaggacgatctagccacgtccagcgcggatacggcaaagtgcaggctgagtttccattgggccctgtcaccaccgctcatagggggacttaccgatgcttcgggtcatacaataatcatgcgtggagcttcccttccgagccggtgaaactccttgtcacgggagacattgagaatacatctctcgctccagaggatcctacttttccggatacatggggcacttacctcctcaccaccgaaacaggactgcagaaggaccacgcattgtgggaccataccgcccagaacctgctccgtatgggcctggcttttctggtcctcgttgctctcgtgtggttcctcgtcgaggactggctgagccgaaagagaacaagagagcgcgcttcccgagcaagtacgtgggaggggaggcgacggttgaacacccagacactgtag

SEQ ID NO: 57762 - DNA, 912 bp, Artificial Sequence
  Description of Artificial Sequence: Synthetic coding sequence
atgtccagtacgcttcctgcccttttatgcgtgggcctgtgcctctctcagcggattagtgcccagcaacagactttgccgaaaccatttatttgggctgaaccccacttcatggtccctaaggagaaacaggtgacgatttgttgtcaaggcaactatggcgcagtcgagtaccagctccactttgaagggtcactgtttgctgtggatcggccaaagcccccagagcgcattaacaaggttaaattctatatacctgatatgaattctaggatggcaggacagtactcatgtatctatcgcgtcggcgaactctggagtgagccctctaacttgctggatttggtggtcacagagatgtatgacaccccaaccctgtctgttcatccgggacccgaggtgatttctggcgaaaaggttacattttactgcagactggacacggccacatccatgtttctcctgttgaaggagggccgatcatcgcatgtgcagcgtggctacggtaaggtacaagcagagtttccgcttgggccagtcactacagcccataggggcacttatagatgctttggaagctacaacaaccatgcatggagctttcccagcgagcccgtgaagcttctggtgacaggagatatcgagaacacttctttggctcccgaggatccaacgttcccagatacatggggtacatatctccttactactgaaacaggacttcagaaggaccacgccttgtgggaccataccgctcagaacctcctccgcatggggctggcctttctggtgcttgttgccttggtttggtttttggtggaggattggctcagccgtaagcgaacccgggagagagcctcccgggctagcacatgggaaggtaggcgacggctgaatacacagactttatag

SEQ ID NO: 57763 - DNA, 912 bp, Artificial Sequence
  Description of Artificial Sequence: Synthetic coding sequence
atgtcatccactttgccggctctcctgtgcgtgggcctctgtctgagccaacgtatttccgctcagcagcaaacattgcccaaaccctttatatgggcggaaccacacttcatggtgccgaaggagaaacaggttactatctgctgccaggggaactacggggctgtcgagtatcagcttcattttgaaggatctttgttcgctgtagaccggccaaaaccccctgagaggatcaataaagtcaaattctatattccagacatgaactccagaatggctggccagtacagctgcatctacagagtcggagagctttggtcagaaccaagtaatctgctggacttggtcgtcaccgagatgtatgatacacccaccctgtccgtacaccccggaccagaggtgatttctggcgagaaagtgacattttactgcaggctggatacagctactagcatgtttctcttgctcaaagagggtcggtccagtcatgtgcagaggggctacggtaaggtgcaggccgagttccctcttggtccagtaaccactgctcatagaggtacctatagatgcttcggtagctataataatcatgcatggtccttcccctcagagcccgtgaagttgcttgtcactggggacattgagaacacttctttggcccctgaagatccaaccttccccgatacctggggtacctaccttctgaccacagaaaccggtctgcagaaagaccacgcactgtgggatcatacagctcagaatctgctaagaatgggactggcatttctcgtgctcgtggccctggtgtggtttctggtggaagactggctgagccgaaagcgaactcgcgagagagcctccagagccagcacatgggaaggacgaagaaggctgaacacgcagaccttgtag

SEQ ID NO: 57764 - DNA, 5729 bp, Artificial Sequence
  Description of Artificial Sequence: Synthetic coding sequence
atggagggaaagcgacaacttgagaaaagagattttggaaaaagattatctctggacagcagtttggtggagtatatggattctaacaaatatattgagcatttacttactcagctcgaggagcagcacaggagtctgtggagagagaaactggctgttgccaggcttcagcgcgaggtggcccagcggacaagtgaaggggcaatgcacgagaagctgatacatgagctggaggaggagcgtcatctgaggctacagagtgagaaaaggttacaggaagtgacactggaaagcgaaagaaatcggattcagatgcggtctctgcagcaacagttttcacggatggaagaaacggtgagaaacctgctccagtctcagggcagccctgagcagaagaaggaggaaactgtcaatattatggtctatcaggagaaattgagtgaggaggagagaaagcacaaggaagctctcgaggatttgcacatggttgtcgatgaggattctcgaagtgagtcttcttctaccgacgagggtaaagaaaagacaaaactattattggagaggcttaaagcccttgaagccgagaatagtgcactagccctcgaaaacgagaatcagcgggagcaatacgaaaggtgcctcgacgaagtcgcaaatcaggtggtccaggccctgctcacgcagaaggatcttcgggaggagtgtgttaagctgaaaacccgggtctttgatctcgagcagcagaatcgcactctctccatactctttcagcagagggtccggccaacttccgacttgctgctgcagaagctgcatagcagacttctggatctgagctcaggcgacctgctatctgaggttgaaaggaacaggagtctaacacaatcacgtaccgatgcagaggttcacgaacaccagctgaatacaaagtctgccctaaagtgccctggactgggcgctgtcatccccggacatctgtgtccacggaattcatattcatcaagcagtgaacttagccttagcagcacatgttccgaatattctagtggctcctcatacacatggcacgatggcaaaaacctgaggaagcgtcagtcttcccagaattgggataaaagattatccatcgattctagtctgccctcgggttttgcaagccctactaacgaactcccaccaacacgcattaaggaaagtcacatcttagagggactgcggaaactccagaagcgaaaggttctgctggagcctccctccgtgatcacaaagtgggggtataaggactgtatgaactcaaatgagggaatctatagtcccggaataaaaagtagctctctcaaagagtaccctccttgcaaaactgccgatctgggaagcccttgtaaagaaccccataagacattcgtgtacgaccttgactctcacgtggatgctgatgacgaccccagtactctggcccttctgcaagcagtacctaatcaatcatgccggccacacggaagtaaacttacccactccgtgagtgactccttgtttggttgggagacaaatcgcaaacactttctcgaaggaacctcttcagtgtacccaaaagagcgccctgagaagctgaccagctgtgcctcctcatgtcctttggagatgaagttatgcccatccgtgcagacaccacaggtgcaacgggagcgaggccctcaagggcaaggacatggtcgaatggcgctaaacctgcagttgtccgatacggacgacaacgaaaccttcgacgaattacatatcgagtcgtctgacgagaagtctccctccgatgtgtcactggcagccgataccgacaagagcgttgaaaacttggacgtcctcgtcggcttcgggaagtccctttgtgggtctcctgaagaggaggaaaagcaggtacctatccctagcgaaacaaggccgaagactttttcctttatcaagcaacagcgagtagtcaagcgcaccagttcagaggagtgtgtaacagtgattttcgatgcagaggatggcgaacccattgagttttcctcccatcaaacaggcgttgttacagtgacaaggaatgaaatctcaatcaactctactccggctggccctaaagctgaacacaccgaactgcttccgcaggggatcgcctgcctacaacccagggccgcagcacgtgattacacattcttcaagcggtcggaggaagacaccgagaagaatatccctaaggacaacgtcgacaacgtgcctcgggtcagtacagagtctttctccagccgcaccgtcacacaaaaccctcaacaacagaagctagtcaaaccaacccacaacatcagttgtcaaagtaattctcgaagcagcgctcccatggggatttatcagaaacaaaacctgaccaaaataccccctcggggtaagagctccccccaaaaatccaaacttatggaacctgaggccacgactttgctgcccagcagcggcctggtcaccttagagaagtcaccagcactcgcaccaggcaagctctcgagattcatgaaaaccgagtcaagcggaccactgttcgagctacgatctgacccacacatacctaaacacagtgcccaactgccccactcttccagaatgccctcacgaagggattgggttcagtgtcccaagtcccagactccgggaagcaggtcccgacccgctatcgagtctagtgacagtggcgagccccctactagggatgaacactgtggctccgggccagaagcaggcgtgaagagtcccagtccccctccacctccaggacgtagcgtcagccttctggcccgtccatcttatgattattctcccgcaccttcttcaactaagagcgaaacccgggttccgtctgaaacagccaggacacctttcaaatcgcctctgctcaagggcatttcggctccagtaatttctagtaaccccgcaacgaccgaagtacagaggaagaaaccatccgtcgcctttaaaaagccaatctttactcaccccatgccatctcctgaagctgtgattcaaaccagatgtccggctcacgctcctagctcctcctttacggttatggcccttggaccacccaaggtcagccctaaacggggtgtgccaaagacctcacccaggcagaccctgggcacccctcaacgcgatattgggttgcaaacaccccgtatttccccatctacacacgaacctttagagatgacctcaagcaagagcgtgtctcccggaaggaagggccagctcaacgactctgcgagtaccccaccaaagccttccttccttggggtgaacgagagtccaagttcccaagtatcatcatcctctagtagtagctccccagctaaatcccacaattcgcctcacggatgccagtctgcacacgaaaaggggcttaaaacaaggcttccagtgggcttgaaggttctgatgaagtcacctcagctgctgaggaaatcgagtacggtgccaggcaagcacgaaaaagattctctaaacgaagcttccaaatcctccgtggctgtgaacaaatccaaaccagaagattctaagaacccggcaagtatggagatcacagctggtgaaaggaatgtgaccctgcccgattcacaggcacaaggtagtttagccgatggcttgcccctcgaaactgcgttgcaggaaccattggaatcctccattcctggcagcgatggtagagacggcgtagataaccggagcatgagacggtcgctcagctcttcaaagccacacctgaaacccgctctcggaatgaatggagccaaagcgagatcgcatagcttctctacacactcaggcgacaagccatctaccccgccaattgaaggttcaggcaaggtgaggacccagattattacgaataccgctgaacgaggcaacagtctcacacgccagaactcatccacagaatcttcccccaacaaagcaccgtccgcaccaatgctggaatctttaccatctgtgggtcgaccaagcggccatccttccagcggaaaaggctccctgggtagttccggctcatttagctcgcagcacggatctcccagcaagctcccacttcgcattcctcctaaatctgaaggactgttgatacctccaggtaaggaagaccagcaagcctttactcagggggagtgcccatctgccaacgtcgctgtactaggcgagccaggtagtgacaggcgtagctgccctcccactccaacagattgcccagaggctctgcagtctcctggcaggactcaacatccttcaacctttgagactagctccacttccaaactggaaacaagtggaagacaccctgatgccagcgcgacagccactgacgcagttagtagcgaagcaccattgtccccaactatcgaagaaaaggtgatgctctgcatccaggaaaacgttgagaagggccaggttcaaaccaagcctacttcagtggaggcgaagcaaaaaccaggtcccagtttcgcaagttggtttggattcagaaagtctcgacttcctgcccttagttccaggaaaatggacatttctaaaacaaaggtcgagaaaaaggatgctaaggtacttggtttcggcaaccgtcagctgaagtctgagcggaaaaaagagaaaaagaaacccgaattgcagtgcgaaactgagaacgagttaattaaggatacaaagtccgctgataatccagatggcggtctccagagcaagaacaatagaagaacaccccaagatatctacaaccagttaaagatagaacctagaaatcggcacagccccgtggcgtgctccaccaaagacacttttatgaccgagttactgaacagggtggataaaaaggccgctccccagaccgagtctggaagcagcaacgcttcatgtcggaatgtgcttaaggggtccagtcagggctcatgtctgatcggatcatcaatcagcacacaggggaatcacaaaaagaacatgaagatcaaagcggatatggaggtgccaaaggatagtcttgtgaaggaggccaacgagaacttacaagaggacgaggatgacgcggtcgctgacagtgtgttccagtcgcacataatcgaaagcaattgtcaaatgcggacactggactccggcattggtacttttcctctgccagacagtggcaacaggtccacaggcaggtatttgtgccaaccagactcacctgaagacgctgagcctctgttaccgttgcagagtgcactgtccgccgtttcgtcgatgcgggcacaaaccctcgagcgagaggtgcccagcagcacggatgggcagcgacccgctgacagcgccattgtgcatagtacttccgatccgattatgacagcccgaggcatgagacctctccaaagcagactccctaagcccgcatccagcgggaaggtctcctctcagaagcagaatgaagccgagcctcgccctcagacatgctcttcctttgggtacgccgaggacccaatggcgtcccagcccctgcctgattggggaagtgaggtagcggcaaccggcacacaggataaggcgccaagaatgtgtacctactccgcctctggcggttctaatagcgacagtgacctggactatggcgacaacggctttggcgctggcagaggacagctggtcaaagccctgaagtctgcagcccctgagattgaaacaaccta

SEQ ID NO: 57765 - DNA, 210 bp, Artificial Sequence
  Description of Artificial Sequence: Synthetic coding sequence
atggaaggcaagcgtcagctcgagaagcgagactttgggaaaagactcagcctggactccagcctggtggaatacatggactctaataagtacatcgaacacttactaacccaactggaggagcagcaccgcagcctgtggcgcgagaagctcgccgtcgccaggctgcagcgcgaggtggcccaacgcaccagcgaaggagcgatgtag

SEQ ID NO: 57766 - DNA, 1773 bp, Artificial Sequence
  Description of Artificial Sequence: Synthetic coding sequence
atggaggggaaacgtcagctggagaagagagactttggaaaacgactgtccctagactccagtctcgtggagtacatggactccaataagtacattgaacacttgctgacacagcttgaggagcagcatcgatctctgtggagggaaaaactggccgtcgccaggctgcagcgcgaagtcgcacagagaacctcagaaggcgcaatgcatgaaaagctaatccatgagttggaagaggaacgtcacctccggctccagtccgagaaaagattacaggaagttacactggaatccgagcggaaccgcatccagatgaggtcactccagcagcagttctctcggatggaggagaccgtccgcaaccttttacagagccaaggctcgcccgagcaaaagaaagaggaaaccgtcaacattatggtgtaccaggaaaaactgagtgaagaagagaggaagcacaaggaagccctggaggatctgcatatggttgtggacgaagacagtcgcagtgagagctcttccacagacgagggaaaggaaaagaccaaacttctgcttgagcgactcaaggccttggaggcagaaaatagtgcgttggcgctggagaatgaaaaccagcgcgagcagtatgagcggtgcctggatgaagtggcaaaccaggtggtccaggctctcctgactcagaaggacctccgcgaagagtgcgtgaagctaaagacgcgggtctttgatctggaacagcaaaatagaactctatcgatactctttcagcaacgagtcaggccaactagtgaccttcttctgcaaaaactgcatagcagacttctggatcttagttcaggagacttgttgtctgaagtcgaacgcaatcgttctctaacccagagcaggaccgacgccgaagtccatgagcatcaacttaacacaaaaagtgcactcaagtgccccggattgggtgccgtgattcctgggcatctttgtcctcgtaattcctactcatcttcatctgagctgagcctgagctccacctgctccgagtatagcagcggcagctcctacacttggcacgacggcaagaacttgcggaaacgtgtgaaagaggccaacgagaatctgcaggaggacgaagacgatgcagtggctgattctgtgttccagagccacatcatcgagtcaaattgccagatgaggactctcgactccggcatcgggacctttccacttcccgactctgggaacaggagtaccggccgatacctgtgtcagcctgactccccggaagatgccgagccacttctcccactgcagtctgctctatccgcagtttctagcatgcgtgcccagactctggaacgcgaggtgccctctagcacagacggccagcgccctgcagattccgccatcgtccattctacatccgaccctattatgaccgccagggggatgcgccctctacaaagccggcttccaaaaccagcttccagcggtaaggtgtccagtcaaaaacagaacgaagctgagccacgccctcagacgtgttctagctttggctacgccgaggatcccatggcgtcgcagcctctccccgattgggggagtgaagtggctgctactggcacacaggacaaggccccaaggatgtgtacttactctgccagcggtggctccaactctgacagcgacctggattatggggataatggttttggagcaggcagaggacagctggtcaaagctctgaaaagcgctgcccctgagatcgaaactacatag

SEQ ID NO: 57767 - DNA, 1773 bp, Artificial Sequence
  Description of Artificial Sequence: Synthetic coding sequence
atggagggaaagcgccaactcgagaaacgagacttcggtaaacgcctgtcactcgacagtagcttggtcgagtatatggattccaataagtacatagaacatctcttaactcagcttgaggagcagcaccggagtttgtggagagagaagctggctgtggcgcgactgcagcgcgaagtggctcagcgcacttccgagggtgccatgcatgaaaagttaatccatgaattagaggaggaacggcacttgaggctgcagagtgaaaaacgactgcaagaggtgaccttggaaagcgagagaaaccgtatccagatgcgcagccttcagcagcagttcagccggatggaagaaactgtgcgtaacctgctccaatcgcaaggaagccccgagcagaagaaagaagagacagtgaacatcatggtctatcaagaaaagctgtctgaggaagaacggaagcataaggaggcgcttgaagatctgcacatggtagtggacgaggactctagaagtgagagcagctctacggacgaaggcaaggagaaaaccaaactgttactggaaagattgaaggctctcgaggccgagaatagtgctctggcactcgaaaatgagaaccaacgagaacagtacgaaaggtgtctggacgaagtggcgaaccaggtggtacaggccctgctgacccaaaaggacctaagggaagaatgtgttaaactaaagactcgagtgtttgacttggagcagcagaatcgcaccctgtcaattctcttccaacagcgagtacgtcctacaagtgacttgctgttacagaagctccacagtagactgttggatctatcctctggcgatctcttgtcagaagtggagcgcaatagatctctgactcaatcccggacggacgccgaagtgcatgagcatcagcttaataccaagagcgcgttgaagtgtccgggtctgggagcagttatacccggacatttatgcccgcgaaattcctactcaagttcatccgagctctccctgagctctacttgttctgaatatagctcagggtccagctacacatggcacgatgggaaaaatctcagaaagagggtcaaagaagccaatgagaacctgcaggaggacgaggatgatgcggtggctgactcagtgttccagtcacacatcattgagtccaactgtcagatgcggacactcgactcaggaatcggaacctttccactccctgattcaggtaatcgtagtaccggcagatatctgtgtcaacccgacagcccggaagacgctgaaccgctcttgccgctgcagtcggcgttatccgcagtgtcctcaatgcgtgctcaaacacttgagagggaggtcccaagtagcacagatggtcagagaccagccgatagtgctatagtgcattcgacatccgatcccattatgaccgcgagaggcatgcggccactgcagtcccggctgcccaaacccgctagtagcggcaaggtgtcctcccagaaacaaaacgaagccgagccgagaccccagacttgttcctccttcggctatgccgaggatcctatggcatcccaaccgctgccagactggggaagcgaagtcgctgccaccggcactcaagacaaggcgcctagaatgtgtacctattccgcgtccggcggatcaaactctgactctgatttagattacggagataatggcttcggggcaggcagggggcaactggtgaaggccctgaaatcagcggcaccagagattgagaccacctag

SEQ ID NO: 57768 - DNA, 5729 bp, Artificial Sequence
  Description of Artificial Sequence: Synthetic coding sequence
atggagggtaaacggcaactggaaaaacgcgactttggcaaaaggctgtcactggattcctccctggtcgaatatatggatagcaataagtacatcgaacaccttctgactcagcttgaggagcaacatcgttccttatggagagaaaaattagccgttgccaggttgcagcgggaagtagcacagcgcacatcagaaggcgcaatgcatgagaagttgatacacgagcttgaagaggaacgtcatctgcgtctccagtcggaaaaaagattgcaggaggtaaccctagagtccgaacggaacaggatccagatgaggtctctccagcagcaattttccaggatggaggagacagtacgcaacttgctccagagccagggctctcccgagcagaagaaggaagaaaccgttaacattatggtataccaggaaaagctcagtgaggaagagcgaaaacacaaggaagctctcgaggatcttcatatggtcgtggacgaggacagccgcagtgagtcctcgtctaccgacgaggggaaggagaagaccaagttgctcctcgaacgcctgaaggcactggaagcggaaaatagcgcgctggccctagaaaatgaaaatcagcgtgagcagtatgagcggtgcctggacgaagtcgcaaatcaggtagttcaagccctgcttactcagaaggacctgagagaggagtgcgttaaactcaaaacacgcgtctttgacctggagcagcagaacaggaccttgtccatattgtttcagcaaagagttcgacccacctctgacctcctactgcagaagctgcattcacgtctgctggacctctctagcggggatctgctctcggaggtcgaacgcaataggagtctgacccaatctaggacagacgctgaggttcacgagcatcagttgaacaccaagagtgctttaaagtgccccggattgggcgctgtaataccaggacatttgtgcccacgtaatagctatagttcatcatctgagctatccttgtctagcacctgtagtgagtatagtagtgggagctcttatacatggcacgatgggaagaatctgcgaaagcgtcagtccagccaaaactgggacaagcgcttaagcattgactcaagcttgcctagcggattcgcctcacctacaaatgagctgccccctacgaggattaaggagtctcacatcctcgagggtctgcgaaagctgcaaaaacgcaaggtgcttctcgaacctccttccgtgatcactaagtggggttacaaagactgtatgaattccaatgaggggatctactccccagggattaaaagcagcagcctgaaggaatacccaccctgtaaaacagctgacttggggtctccatgcaaggaaccccacaaaacttttgtgtatgacctcgattcccatgttgacgctgatgatgatccaagcactctggcccttctccaggccgtgccaaaccagtcgtgcagaccacacggcagcaagctgacacacagcgtttccgactctctcttcggttgggagaccaatcgtaaacacttcctggaggggactagcagtgtttaccccaaggaaaggcccgaaaagctgacaagttgcgcctctagctgtcccttggagatgaagttgtgcccttcggtccagaccccgcaagtgcagcgggagagaggtccccagggccaagggcatgggaggatggctttaaatctgcagctgtcggacacagatgacaacgaaacctttgatgaattacacatcgagtcttctgatgagaaaagtccatcggacgtatctttagccgctgataccgacaagtccgtggagaacctagatgtcctggtcggtttcggaaaatctttgtgtggctcacctgaggaggaggagaagcaggtcccaatcccctccgagactcggcctaagactttctcattcatcaaacagcaacgagtggtcaaaaggacgagcagcgaggagtgtgtcactgttattttcgatgcggaagacggcgaaccgatagagttctcctctcaccagaccggggtcgtcaccgtgacacgcaacgaaataagcattaattctacaccagccggacctaaggctgaacacaccgaactgctccctcagggcattgcttgtctgcaacccagggcagctgccagggattacacgttctttaagcggtctgaggaagatactgagaaaaacattcccaaagacaatgtcgacaatgtgcctagggttagtactgaatcgttttcttcccgcacagttactcagaacccccaacagcaaaagctggtcaagccgacacataacatttcctgtcagtccaactccagatcatctgcccctatgggcatttatcaaaagcagaatctgaccaaaattcctccacgcggaaagtcttcccctcaaaagagtaaactgatggaaccggaagctactactctgctcccaagctccggccttgtcacactcgagaagagccctgccctggccccaggaaaactctcacgctttatgaagactgaaagcagtgggccactattcgaattacgatctgaccctcatatcccaaaacatagcgcgcagcttccccacagctctcgcatgccttcgcgtcgcgactgggtgcagtgccccaaaagtcagacccccggaagcagatcccgtcctgccatcgagagctccgattcgggggagcctcccactagagatgagcactgtggatctggtccagaggcaggggtgaaatctccctcccccccacccccacccggaagaagtgtgagcctcttggcaaggccatcctatgactattcccctgctccctcttccactaaatcagaaaccagagtcccctccgagacagcccgtacgccttttaagagtccactcctgaagggaatctccgccccagtcattagctcaaatccagcgaccactgaagtgcagcgcaagaaaccaagtgtggcctttaaaaagccaatctttacccatccgatgccaagcccagaagctgtgattcaaacccggtgtccagcccacgccccttcctcaagtttcactgtaatggcactgggccctccgaaggtgagtcccaagcgtggggtgccaaagacaagccccaggcagaccctgggaacaccccagcgggacatcggtctccaaacccctcgtatctcgcccagtacacacgagcctctggaaatgaccagttctaaaagtgtcagtccaggcagaaaaggccaactcaacgattcggctagcacaccaccaaagccaagctttctcggtgttaatgaatctccttcaagccaagtgtctagcagttccagcagttctagcccggctaagagccacaattctccacatgggtgtcaaagcgctcatgagaaggggcttaaaacccggttacctgtgggactcaaggtcctcatgaaaagccctcagctgctgagaaagtcctcgacggtgcccggaaaacatgagaaggactctctgaatgaagcctcgaaaagtagcgtagctgtcaacaagtcgaaacctgaagacagcaagaatccggctagcatggaaataactgccggagagagaaacgttaccctaccggactcccaagcacaaggctctttagctgacggtcttccactggagaccgcgctccaggagcctctagagagcagcatcccgggttcggatggtagagacggggttgataacaggtccatgagacgctccctttcatcaagcaagccccatctgaaacccgcattgggaatgaacggcgctaaagctcgcagccatagcttctcaacccattcaggagataagccttcgactccgccaatcgaagggtccggcaaggtacgtacccagatcatcactaatacagctgaacgcggtaacagccttactcgtcaaaatagttcgaccgaaagcagtcccaacaaagccccttctgcccctatgctggagtcacttccgtccgtgggacgacctagtgggcacccgtcctcaggaaaaggcagcttgggctcgagtggctcttttagttcacagcatgggtctccctccaaattacccctccggatcccaccgaagagcgaaggattgcttatacctccaggcaaagaggaccagcaggcctttacccagggcgaatgcccgagtgccaacgtggccgtgttgggagaacccggatcagatcggcgaagctgcccacccactccgacggattgccctgaggctcttcaaagtccagggcgtactcagcatccatctacattcgagacatctagcacaagcaaattggagacctccggacgtcaccccgacgccagcgctacagcaacagatgcagtatcttcagaggctccactgagtccgacaatcgaggaaaaagttatgctgtgtatccaagagaacgtggaaaaagggcaggtgcaaacaaaacctacaagtgtagaagcaaagcagaaaccgggtccatcatttgccagctggtttggctttcggaaatcgcgactgccagctctgtccagtcggaagatggatatttctaagaccaaagttgagaaaaaggatgctaaagttttagggtttggtaatcggcagcttaagtccgagcggaagaaggagaagaagaagcctgaactgcaatgcgagactgaaaacgaactcattaaggataccaagtcggctgacaatccagacggcggacttcagtcaaagaacaacaggaggactccccaagatatctataaccaactgaagattgagcctagaaaccgccactctccagtcgcctgcagcaccaaagacacattcatgacggagttactcaatcgcgtcgacaagaaagctgctccacaaactgaatccggatccagtaatgcatcttgccggaatgtcttgaaaggcagctcccagggctcctgcctgattgggagcagtatatctacccaggggaaccataagaaaaacatgaagattaaagctgatatggaggtcccaaaagattcccttgtgaaggaggctaacgagaatcttcaagaggacgaagatgatgcagtggctgatagcgtttttcagagtcacattatcgaaagtaactgccagatgcgtactctcgattcaggaattggaacttttccattacccgactccggaaatagaagcacggggagatacttgtgtcaaccggacagtcccgaagatgccgagccccttctgccgctccagtcagctcttagtgccgtctcaagtatgcgagcccaaactcttgagagggaggtcccttcaagcaccgacggacagcgccctgctgactctgctatagttcactctaccagcgaccctatcatgaccgcacggggaatgagacccctgcaaagtagactcccgaagcctgcctcgtccggcaaggtaagctctcagaagcagaatgaagcagaacctcggccacagacttgtagtagcttcggatatgccgaagaccccatggcctctcagccactgcctgattggggtagcgaagtggcagccactgggacccaggacaaggctccaaggatgtgcacgtacagcgcctctggaggtagcaatagtgattctgatctcgactacggcgacaatggattcggcgctggcaggggtcagctggtcaaagcgctgaaatcggctgcgccagagatcgagacgaccta

SEQ ID NO: 57769 - DNA, 1773 bp, Artificial Sequence
  Description of Artificial Sequence: Synthetic coding sequence
atggagggaaagaggcaactggagaagagagactttgggaaaaggctttccctcgactcatctcttgtagagtacatggattctaacaagtatatcgagcacctgttgactcagctggaagaacagcatcggtccctgtggcgcgagaagctggctgtcgctaggctccagcgagaagtcgcccaacgcacttcggaaggcgcaatgcacgagaaattgatacatgaactcgaggaggagaggcacttaagactccagagtgagaagagacttcaagaggtcaccctggaatcagaaaggaaccggatccaaatgcgaagtcttcagcagcagttttcgcgtatggaagaaacggtgcgtaacttgctgcagtcacaaggtagtccagagcaaaagaaagaagagacagtgaatatcatggtttatcaagagaagttgtctgaggaagagcgaaagcataaggaagcactggaagatttgcacatggtcgtggacgaagatagtagaagcgagtcatcaagtaccgatgaggggaaggaaaagacaaaacttctgcttgaacggctcaaagcattggaagccgagaacagcgcactggcgcttgagaatgagaatcagcgggagcagtatgagcggtgcctggatgaggtggcgaaccaggttgtgcaggctctgcttacccaaaaggaccttagagaggagtgcgttaagcttaagacgcgggtctttgacttggagcagcagaaccggacactgagcatattattccagcaacgcgtccggcctacctcggacctgcttctacaaaaactacatagcagactgctcgacctgtctagcggggacctgttgtctgaggtggaacgcaaccgttcccttactcaatccaggactgatgctgaggtccatgagcatcaacttaatacgaaatctgccctgaagtgtcctggactaggtgctgtgattcctggccacctctgtcccaggaattcatacagctctagctcggagctctctttgtcttcaacctgcagcgagtacagttccggatcatcatacacatggcatgacggcaagaacctgcgcaagcgtgtgaaggaggcgaatgagaatctgcaggaagacgaagacgatgccgtagcggattctgtgttccagagtcatataatcgaatccaactgtcagatgcggactctcgattccgggattgggacttttcctcttccagatagcggtaacagatccactggacggtatttatgtcaacccgattccccagaggatgcagaacccctcttacctctgcagtccgcgcttagtgcagtgtcctctatgagggcccaaacactggagcgcgaggttcccagttccaccgatggccagcgacccgctgattctgccatagtgcactccacctccgatcctatcatgaccgcccgaggcatgcggcctctgcaatctcgcttaccaaaacccgcatcatccgggaaggtgtcatctcagaaacagaacgaggctgaaccccgaccgcaaacctgttccagcttcggttatgctgaagatcccatggctagtcagccgcttcccgactggggttctgaggtcgcagcgacaggaactcaggacaaagccccaagaatgtgcacttattccgcaagcggcggtagcaactcagactcagacttggactacggggacaatgggttcggggctggacgaggacagctggttaaggccctcaagtctgcagcaccagagatgccgattacctag

SEQ ID NO: 57770 - DNA, 537 bp, Artificial Sequence
  Description of Artificial Sequence: Synthetic coding sequence
atggatagcaacaaatatatcgagcacttactgacgcagctcgaggaacagcaccggagtctctggcgcgagaaactggcagtggcccgactgcagcgtgaggtagctcaacgtactagcgagggggcaatgcacgagaaactgatccacgagttggaagaagagcggcacttgcggctgcaatctgagaagcggctacaagaagtgacattggagagtgaacgcaatagaattcagatgcgatccctacagcagcaatttagccgaatggaagaaacagtgagaaacctgctccaaagccaaggctccccagagcagaagaaagaggaaactgtgaacatcatggtctaccaggaaaaactctctgaagaggagagaaaacacaaggaagcccttgaagacttacatatggtggtggacgaggattcacggtccgagtcttcttcaacggatgaggggaaagaaaaaacaaaactcctgcttgagaggctgaaggccctggagaggaacggatggaactggcaccccgttagctag

SEQ ID NO: 57771 - DNA, 4005 bp, Artificial Sequence
  Description of Artificial Sequence: Synthetic coding sequence
atgtccgaggccatggaccagccagcaggcggacctggtaaccccagacctggggagggcgatgatgggagtatggaaccaggcacctgccaggagctgctccacagactgagagaactcgaggccgaaaactccgccctggctcaggccaatgagaatcagagggaaacgtatgagagatgtcttgatgaggtggctaatcatgttgtgcaggccctgctaaaccaaaaggaccttagagaagagtgcattaagctgaaaaaacgagtcttcgacctggagcgccagaatcagatgttgagcgcactgttccaacagaaattacagctgaccaccggctctctccctcagatccctctgacccccctgcagcccccttccgaacctcctgcaagtcccagcctctcgtccacagaaggacccgctgccccactgcccttgggccactgtgctggccagcgggaggtttgttgggaacagcagttgagacctggtggtcccggaccaccggcagcccctccgcctgctctcgacgctctctctcccttcctccgaaagaaggctcaaatcctcgaggtgctccgagccttggaagaaaccgatccattgcttctctgtagccctgccacgccatggcggcctccaggccagggccctggctcccccgagcctatcaacggcgagctgtgtggacctccccagcccgaaccctcaccttgggctccttgcctgctgcttggtcccggaaacttagggggactgctgcattgggagaggctgctcggcggactgggtggcgaggaggatacaggcagaccctggggcccaagcagaggcccacctcaagcacaggggacaagctccggacccaactgcgctcctggttctagctcttcctcttcttccgacgaggcgggagatccaaatgaggccccaagtccagacacgctcttgggagccctggctagaaggcagctcaacctgggacagctgctcgaggacacagagagctacctgcaggcgttcttggcgggagcagcaggccctttgaacggcgaccatccgggaccaggccaaagtagttcacccgaccaagccccaccccaactcagcaaatctaagggcttgccaaaaagcgcgtggggtggtggaacccccgaggcccacaggcccggattcggggctacctccgaggggcaggggccattgccttttctctctatgttcatgggagccggtgatgcccctttgggctctagaccgggtcatccccacagcagctcccaggtcaagtctaaattacaaataggccctccttcaccaggagaagcccaaggaccactcctgccatctcctgcacggggactgaagtttttgaaacttcccccaacatccgaaaaaagcccctcacccggaggccctcagctgtccccacagctgccaaggaatagccggattccctgcaggaacagtggctccgatgggagtccctcaccgctgttggcgaggagaggactaggcggtggcgagttgtcccccgaaggtgctcagggactgcccacaagcccttctccttgttatacaacaccagacagtacacagctccggcctccccagtccgctctaagtacaacactgtcacccggtcccgtcgtgagtccgtgctacgagaatattttggacctctcccgatccaccttcagaggacccagcccggagccgccacctagtcccctccaggtacctacttacccacagctgactttagaagtgccccaggcgcctgaagtcttgagaagccccggagtgcctcctagcccctgccttcctgagagttacccttatggtagtccacaagagaagtcattggataaagctggatcagagtcacctcatcccggacggcgaacccccggaaacagttcaaagaagccatctcaaggcagtggcaggcgtcctggggacccagggagcacacccctgcgggatcggcttgcagcgctggggaagctgaaaacaggacctgagggggctctcggtagcgagaagaatggcgtgccagctagaccgggaactgagaaaacgcgcggacctggcaaaagtggggagagcgccggagacatggtcccaagtatccaccggccattagagcagctggaggctaagggcggtataaggggcgctgtggctctgggcacgaactctctgaagcagcaagaacccggacttatgggggatcctggagcgagggtgtacagctcacactccatgggggcacgggtcgacctggaaccggtgtctccaagaagttgcctgaccaaagttgagctagcaaaaagcagactggcgggtgctctttgtccacaagtaccaaggacacccgctaaagtaccaaccagtgcaccctcactgggcaagcctaataagagcccacattcttcccccaccaagttgccatcaaagagccctacaaaggtggtaccacggcctggagcccctttggtgacgaaggagtcccccaaacctgacaaaggcaagggtcctccctgggctgactgtgggtccacaacggctcagagcaccccccttgttccaggtcccactgacccatctcagggtcctgaaggcttggcgccacatagcgccattgaggaaaaagtcatgaaggggattgaggaaaacgtgcttcgcttacaaggtcaagagcgagcaccaggagccgaggtaaagcatcgaaacacctcaagcatcgccagctggtttggcctcaaaaaaagtaagttgcccgcacttaataggaggacggaggcaactaagaacaaagagggcgcagggggaggatctcctcttcgcagagaggtgaagatggaagctagaaaactagaggctgaatccttgaacattagcaagctaatggcaaaagccgaggacctccgacgcgcactggaggaggaaaaggcctacctctcgtcacgcgctcgtcctcggccaggcggtcccgcaccgggacctaacactggcctgggacaggttcagggtcaactggccggtatgtatcagggcgcagacactttcatgcagcagctgttgaatcgagtggatggcaaggagttacccagtaagagctggcgtgagccaaagcccgagtacggcgacttccagccggtgtctagtgacccaaagtcgccatggcctgcttgtgggcctaggaatggcctggtgggccctctccagggctgcggtaaacccccaggtaaaccctccagcgagcccggaagacgcgaggaaatgcctagcgaggactcattggctgaaccagttcccacctcgcattttaccgcctgtggatccctcacaagaacacttgattcagggatcggcactttcccccctccggatcacggctccagcggaactcccagcaagaatttgccgaagaccaagccccctagactcgaccctccgccaggcgtgcccccagccagacccccacccctcacaaaggtcccacgcagagcccacacactggaacgggaggtccccggtatcgaggagctgctggtgagtggtcgtcacccatccatgccagctttcccagcacttctccccgctgcccctggacaccgaggccacgagacttgcccagacgacccctgtgaggaccccggacctactcctcccgttcagctggccaaaaattggactttcccaaatactagagctgccggatcaagcagcgaccccctgatgtgtccgcctcggcaattagagggactgcctaggaccccaatggctttacctgtggatcggaaacggagccaggagccctctaggccgtcgcccactccccaagggccaccattcggaggttccaggactccttcaacctctgatatggccgaggaaggcagagtagcctcaggagggcctccagggttagaaacgagcgaatctctctctgattccctctacgactccctgagttcatgtggtagtcagggctag

SEQ ID NO: 57772 - DNA, 3927 bp, Artificial Sequence
  Description of Artificial Sequence: Synthetic coding sequence
atggaccagccagctggcggaccaggaaacccaaggcctggagagggcgacgacggctctatggaacctggaacttgccaggagctgttgcaccggcttcgagaacttgaggctgagaactctgccctcgctcaggcaaatgaaaaccagagagagacttatgagaggtgtcttgatgaagtagcaaatcacgtcgtgcaggccctgttgaaccagaaggatctacgggaggaatgtataaaactgaagaagagggtgttcgacctggagaggcaaaaccagatgctctcagctttgttccagcaaaaattacagctaacaacgggctctttgcctcagatcccgctgaccccattgcaaccgccaagtgaacctcccgctagccccagcctctctagcacagagggacccgcagctcccctcccactgggccactgtgcgggacagagggaagtttgttgggaacagcagctgcggccaggtggaccgggacctcccgcagccccaccccctgctttggatgccctgtctccatttctgaggaaaaaagcccagatcctcgaggtgctgcgtgccctagaagaaactgaccccctgttgctgtgttcccctgctactccgtggaggccaccaggccagggaccaggctccccagagccgataaacggggaattgtgtgggccacctcagccagaaccctcaccatgggccccatgtctgctgctcggacctggcaacctgggaggtctactccattgggaacgcctgctcgggggactggggggagaggaggacacaggaaggccatgggggccatctcgtggacctccccaggcacagggcacctcctcgggaccaaattgcgcacccggatcctccagctctagctcttccgacgaggctggtgatcctaatgaggctcccagcccagacacactcctgggtgccctggcccgaaggcagctgaatctgggacagctgctggaggataccgagtcttatctacaggcgtttctggccggagcggcaggaccgctgaatggtgatcaccctggaccaggccagagctcctcacctgaccaggccccaccccagctctccaagtccaagggtctgcccaaatctgcttggggtggtgggacgccagaagcgcacagaccaggctttggcgcaaccagcgaaggacaagggcctctgccgttcctgtcaatgttcatgggggcaggcgatgctccattaggttctcggccaggccacccacacagttcttcacaggtcaaatcaaagttgcagattggaccccctagccccggagaggcgcagggaccccttttaccaagtccagctagaggtctgaagtttcttaagctgccccctacttctgaaaaaagtccttctcctggagggcctcagctgtcgccacagcttccgaggaactccagaattccctgccggaattccggctctgacggctccccatcccctctgttagcaaggcggggacttggtggcggagaactctctcctgagggggcacaaggtctgccgacttcgccctctccatgttacacaactcctgactctacccaacttaggccacctcagtccgctctcagcacaaccctgtctcctgggccagtggttagtccctgttatgagaatattctggatctttcacgctccacgttccggggaccgtcacctgaaccccctccctcacccctgcaagtacccacttatccacagctgaccctagaagttcctcaggcacctgaggttctccgttctcctggtgtccctccctccccctgtcttccagaatcctacccgtacgggtcgccacaagagaagtccctcgacaaggccggttcagaatcaccccatccagggagacgaactcctgggaattcaagcaagaagccttcacaggggagcgggaggcgccctggcgaccctggatctactcctctgagagataggctggctgccctggggaagcttaagaccggcccagagggagcgttgggctccgagaagaacggcgtgcccgctcgtccagggacggagaagacccgtggcccaggcaaaagtggagagtccgccggagacatggtcccctcaatccatcgacctctcgaacaattggaagcaaagggaggtataaggggagccgtggccctgggaacaaattcactcaagcagcaggagcctggactcatgggtgatccaggcgctagggtgtattctagccatagcatgggcgctagggtggaccttgaacccgtgtctcctaggagttgccttacaaaggtccctaccagcgccccaagcctgggcaaaccgaacaaatcacctcatagtagtcccacaaaattacccagcaaatcccctacgaaagtggtgcctagaccaggcgctccccttgtgaccaaggagtctcccaagcctgataaaggtaaagggccaccatgggcggactgtggaagtaccactgctcagagcacccccctcgttcccggaccgactgaccccagccaggggcctgagggccttgcaccacattcagcaatcgaagagaaggtaatgaaagggatcgaggagaacgtgcttaggctgcagggccaggaaagagcccctggggcagaagttaaacatcgtaacacgtctagtatagccagttggtttggactgaagaagtctaaattacccgcactcaacaggagaacggaagctacaaaaaataaggagggtgccggaggaggctcgcccctgcgcagggaggtgaaaatggaagctagaaagctggaggccgagtccctaaacattagtaagctgatggccaaggctgaagaccttcgtcgggctctggaagaggaaaaagcatacctgtccagccgagcccgtccaagaccaggtggccctgctccaggcccaaacactggtttaggccaggtgcagggacagctagcgggaatgtaccagggcgctgacacctttatgcaacagctcttgaatagagtcgacggaaaggaattaccgagcaaatcttggagggaaccgaagccagagtatggagattttcagcccgtctcaagcgaccccaaatcaccttggccagcatgtggccctagaaatgggctggtggggcctttacagggctgtgggaaacccccagggaagcctagctctgagcccggtcgcagagaggagatgccctctgaggactcactggctgagccggtccccacatcccatttcaccgcgtgtggcagtctgacgagaactttggactctgggatcggaactttccctccgcctgaccacggatcaagtggcaccccttccaagaatctgcccaagacaaaaccgcctcggctcgatccacccccaggagtgccccctgctaggcctccccctctgacgaaggttcccagacgcgctcacaccttggaacgggaggtgccaggcattgaagaattacttgtatcaggtcggcaccctagcatgccggcttttccggcactgctgccggctgcaccaggacaccggggtcatgaaacatgccccgatgacccctgcgaggaccccggacctacacctcctgtgcagcttgccaagaactggactttccctaacaccagagccgctggttccagctccgatccattgatgtgcccgccacgccaactggaaggcttgcccagaacacctatggctcttccggtcgatcggaaacgctcccaagagccgagtaggccgagtcctacaccgcagggacccccatttggcggttccagaaccccctccaccagtgatatggccgaggagggcagagtggctagcggaggtccccctgggctggagacctcagaaagcctgtccgattcgctgtacgactccctttcaagctgcggctcccaagggtag

SEQ ID NO: 57773 - DNA, 1116 bp, Artificial Sequence
  Description of Artificial Sequence: Synthetic coding sequence
atggcaggactccaggagctccggttccctgaggaaaagcccctgctgaggggtcaagacgcaactgagctggaaagcagcgatgcattcctgctggctgccgacaccgattggaaggaacatgacattgagactccttatggcttgctgcacgtggtaatccggggaagccctaaaggaaatagaccagctatcctaacataccacgacgtggggctgaaccataagctctgctttaacaccttcttcaacttcgaggacatgcaggagattactaagcattttgtagtgtgccacgttgacgcccctggtcagcaggtcggcgcaagtcagtttccacagggctaccaattcccaagtatggaacaactagccgctatgctgccctccgtagtgcagcacttcggatttaaatatgtcatcggcatcggagtaggcgcaggtgcctacgtccttgccaagtttgccctcatatttcccgatcttgtagagggactcgtcctggttaatatcgatcccaacggaaaagggtggatagattgggcagctaccaaattgagcggccttaccagcacgctgcctgacacggtcctctcgcacctgttttcccaggaggagctggttaataatacagagctggtgcagtcctatcgccaacagatcggcaatgttgtcaaccaagccaacctacagctcttctggaacatgtataattctcgcagagatctcgatatcaacaggcccggaaccgtgccgaatgctaagacacttagatgtcccgtgatgctcgtggttggagacaatgccccagccgaggacggcgtggtggaatgcaattccaagctggatccaacgacgaccacattcctgaagatggccgatagcggcggtttacctcaggttactcaacctgggaaactgaccgaagcgtttaaatattttctgcagggtatgggctatatgccttcagccagtatgactcggcttgccaggtccagaaccgcctcattgacttcggcttcgagcgtggacggctccagaccacaagcatgtacacacagtgaatcctccgaggggcttggccaggtcaaccataccatggaggtatcatgctag
